United States Patent 11,332,783 (SAMPLE ANALYSIS, PRESENCE DETERMINATION OF A TARGET SEQUENCE) - sequence listing, part 13

SEQ ID NO: 253971 - DNA, 75 bp, Artificial Sequence
  Synthetic
tcactcaccaaaattcagaatgcgacaatcagactggctgttggaatgtttggtaccatgctactaatgttagta

SEQ ID NO: 253972 - DNA, 75 bp, Artificial Sequence
  Synthetic
ggaaggaagtttgctgagagtgattggttgcaaaaaactaaagtgacaattgctggggcaacacgcctgatggaa

SEQ ID NO: 253973 - DNA, 75 bp, Artificial Sequence
  Synthetic
ttgccatattttccacttgtggtcagctattttatgagaggacaaccatcaaagagagccaccgactacatgtca

SEQ ID NO: 253974 - DNA, 75 bp, Artificial Sequence
  Synthetic
attcttggggttgtcatggctctaggagcagcagtctgtagaaatggcatcaatacagatccttggataattgga

SEQ ID NO: 253975 - DNA, 75 bp, Artificial Sequence
  Synthetic
gttatggcattggtccttcttttctttctttttcaggttagttctggagagatggtagcagagtgggctgggtac

SEQ ID NO: 253976 - DNA, 75 bp, Artificial Sequence
  Synthetic
cacgagtggaaaaaggactgtcctaagtctgttggttctataagtcttgaagtgaagagaatggctgatggcaga

SEQ ID NO: 253977 - DNA, 75 bp, Artificial Sequence
  Synthetic
ttaataaacatgtcaaaagaaaaagactcactttgggaaatgggaatcgttggctgtgggatggtggtgaccgct

SEQ ID NO: 253978 - DNA, 75 bp, Artificial Sequence
  Synthetic
atgcactggattggaattccgttaaccattgtggctctagcgataaagtctggattagatggaaaaagaagaagt

SEQ ID NO: 253979 - DNA, 75 bp, Artificial Sequence
  Synthetic
ctatacttgttgggacttggggaaggagaacccgagtctaaccaaagaattacagatggggtgtatagaatcaag

SEQ ID NO: 253980 - DNA, 75 bp, Artificial Sequence
  Synthetic
gttagttcactctttggaaagaagcaggttggagtgggagtttggtcagaaggctcattccacactatgtggcat

SEQ ID NO: 253981 - DNA, 75 bp, Artificial Sequence
  Synthetic
gtcacaaggggtgccactttaaggattggtgacagaaaactctcgccagaatgggcaaacataactgaagatctc

SEQ ID NO: 253982 - DNA, 75 bp, Artificial Sequence
  Synthetic
atttcttacaatggaggctggaagctagaaaagaaatggaagggagaagaagtacagttacatgcctttactcct

SEQ ID NO: 253983 - DNA, 75 bp, Artificial Sequence
  Synthetic
tccaatgaaactgttgtcacacaactgttgccaggcagcatgaaaactgaaaaaggagaagaacttggcttgatc

SEQ ID NO: 253984 - DNA, 75 bp, Artificial Sequence
  Synthetic
ccattggatttcccacctggcacttcgggctcaccaataataacatcatcaggacatgtggttggcctctatggg

SEQ ID NO: 253985 - DNA, 75 bp, Artificial Sequence
  Synthetic
aatgggataatccatggagacgtgtactgcagttcaatagcccaggctaaggaagtggtcaaagaagagacagtg

SEQ ID NO: 253986 - DNA, 75 bp, Artificial Sequence
  Synthetic
aaggctgtggaaggagatgagtggttggcaaaggggaaaataactgtgattgacgcgcatccaggaagtggaaaa

SEQ ID NO: 253987 - DNA, 75 bp, Artificial Sequence
  Synthetic
actcacaagattcttccatctctggtaaggagagcctctgagcgtcgaatgcggacgttagtgctggctcctact

SEQ ID NO: 253988 - DNA, 75 bp, Artificial Sequence
  Synthetic
agggtagtcattaaagaaatggaaaatgctctacggggaatggatgtgagttttcattcatcagctgtgtcaagt

SEQ ID NO: 253989 - DNA, 75 bp, Artificial Sequence
  Synthetic
aaaacacctggaagtctgattgatgtgatgtgtcatgccacatttgttaaccgcaaattaatccatatgcctcaa

SEQ ID NO: 253990 - DNA, 75 bp, Artificial Sequence
  Synthetic
aagaactatgaacttatcatcatggatgaagcacattggacggacccatccagcatagcggctaggggatttatt

SEQ ID NO: 253991 - DNA, 75 bp, Artificial Sequence
  Synthetic
acaaccatgagtgaaaacaaaaaatgtgctgttgttttaatgactgcaactccaccgggggtccaagatccctgg

SEQ ID NO: 253992 - DNA, 75 bp, Artificial Sequence
  Synthetic
gctaactcaaatgaaaaaattgaagatgttgtcaaagtgatacctgagggaccatggaagcaaggccatgaatgg

SEQ ID NO: 253993 - DNA, 75 bp, Artificial Sequence
  Synthetic
ataactgaatttgaaggaaggaccgcctggtttgttccctcccagaatgctgcgcaagggattgcgaaaacctta

SEQ ID NO: 253994 - DNA, 75 bp, Artificial Sequence
  Synthetic
agggagcatgggaagaaagttgctatcttgacaagtaaaacctttcatgatgtgtatccaaaattgaaaactgaa

SEQ ID NO: 253995 - DNA, 75 bp, Artificial Sequence
  Synthetic
aagcctgattttattttgacaacagacatttctgaaatgggtgccaattttgatgttgaaagagtgattgatccc

SEQ ID NO: 253996 - DNA, 75 bp, Artificial Sequence
  Synthetic
cgaactactttgaagccaattgaaaaagggaatacagtggaaattagtggagaaatccaaatcacaccagcatca

SEQ ID NO: 253997 - DNA, 75 bp, Artificial Sequence
  Synthetic
gccgctcagcgaagaggaagagtggggagaactccgggaaagatggcacaatacatttatcagggagaggtcgaa

SEQ ID NO: 253998 - DNA, 75 bp, Artificial Sequence
  Synthetic
cctgatgactctgaacttgtgtgttggaaggaaggacaaatgctccttgataatatgagtgtgaagcagtccatg

SEQ ID NO: 253999 - DNA, 75 bp, Artificial Sequence
  Synthetic
atttgcactttctatggaccagaacaagaaaaaatgcctgaaactcctgggttctttcgcctgagtgaggagaaa

SEQ ID NO: 254000 - DNA, 75 bp, Artificial Sequence
  Synthetic
aggaaggtttttagacatctaataacccagtgtgactttactccatggctagcttggaatgttgcttctggcacg

SEQ ID NO: 254001 - DNA, 75 bp, Artificial Sequence
  Synthetic
aaggggattgaagatagagattgggtcaatttgggacctaaggaaaacttggtaactgatgaaaatgatgatcca

SEQ ID NO: 254002 - DNA, 75 bp, Artificial Sequence
  Synthetic
attgtgtacaaatcccctggtggaaaagagcataagttggctcccgtgtggctggacaccagactaaccagagaa

SEQ ID NO: 254003 - DNA, 75 bp, Artificial Sequence
  Synthetic
aggaaagatttggctgggttcatagaatatgctgagaagaggagaagtagtgttttaacagccatcccaggactg

SEQ ID NO: 254004 - DNA, 75 bp, Artificial Sequence
  Synthetic
ctttatagtaggttcttgtcagcctttgacaccatttacatctactccacttctgatccatctagtagagcattt

SEQ ID NO: 254005 - DNA, 75 bp, Artificial Sequence
  Synthetic
aagatggccgagagggaactacctgaagccatactgtgtgtattgcagggatttctaatgtgtgtgggcatgttg

SEQ ID NO: 254006 - DNA, 75 bp, Artificial Sequence
  Synthetic
gctctgattgtttggctggtgactagaacaaaggtggatagaatgtgcattgggttttgtgtcatagtgatgtca

SEQ ID NO: 254007 - DNA, 75 bp, Artificial Sequence
  Synthetic
ggaatcatggcttggattggaggagctcctttgagtctggttgcagcactggttttgatatcatttattttgctt

SEQ ID NO: 254008 - DNA, 75 bp, Artificial Sequence
  Synthetic
gtgtgcttaataccagagcagggaatgcagaggacccaaatagacaccacattggctacactggttttggctatt

SEQ ID NO: 254009 - DNA, 75 bp, Artificial Sequence
  Synthetic
gtgacatttggcttacttgtgtttgccaatgagatgagatggcttgaaaacacaaagaaagatttgtttggccag

SEQ ID NO: 254010 - DNA, 75 bp, Artificial Sequence
  Synthetic
cctcaaactagtcctagtgtgaatactggaggaatcatccaggatctccttcagcttgatattagaccaatgaat

SEQ ID NO: 254011 - DNA, 75 bp, Artificial Sequence
  Synthetic
gtgtggggaacctatgttgcactggtgacggttgctcggccacaagcgctccataatctaaaaatgttcactaag

SEQ ID NO: 254012 - DNA, 75 bp, Artificial Sequence
  Synthetic
aagatagtgtcgggagtggtcgcaggaaaggagagtgcaatggaaagactcccgaccggtggagcttggatgaat

SEQ ID NO: 254013 - DNA, 75 bp, Artificial Sequence
  Synthetic
ctcaggatgggtgacctcactcttctggcaacaaccttgaagggaatgacctgtttcaatctattgggaggttta

SEQ ID NO: 254014 - DNA, 75 bp, Artificial Sequence
  Synthetic
acctttgctttcatacactggttttggttctttcctttgcacgaagctgctgagagtgccaaggctcataaaata

SEQ ID NO: 254015 - DNA, 75 bp, Artificial Sequence
  Synthetic
gtaacccaatctttgtcaaagaacaacatggttgatggtgaggtaatttatcaacttgatgaagtcagagcagaa

SEQ ID NO: 254016 - DNA, 75 bp, Artificial Sequence
  Synthetic
acagaaaccaacgaaagaaatttttccttaggtgtcgccggttgtttggccctcctaaacattgtgatgtgcagg

SEQ ID NO: 254017 - DNA, 75 bp, Artificial Sequence
  Synthetic
aaaccatggacggttcttgaagccctgatgataatctcagttgtggcaaaaaattatttggatccaaaagcagaa

SEQ ID NO: 254018 - DNA, 75 bp, Artificial Sequence
  Synthetic
acattctggacactaccagtggctagtgggctgagtgcattgttgagaaatgaatttcttggtctggtcccaatt

SEQ ID NO: 254019 - DNA, 75 bp, Artificial Sequence
  Synthetic
ggttatagagtgtggaaacatttatcaccagggagaaggggcttgtcactaagccatctaaccttgggtgaggat

SEQ ID NO: 254020 - DNA, 75 bp, Artificial Sequence
  Synthetic
tggaaacttaagctaaacaaaatgacaaaatcagattttttggaatacagaacaagattaattactgaggtagat

SEQ ID NO: 254021 - DNA, 75 bp, Artificial Sequence
  Synthetic
aggggggaagccgtgtaccagctagggagaggaaaaacaaataccggacacgctgtgtccagagggacttctaaa

SEQ ID NO: 254022 - DNA, 75 bp, Artificial Sequence
  Synthetic
ttagcctggatgcatgaaagatctctagttcgtcttgaaggatgtgtggtggatcttgggtgtggtcgaggaggt

SEQ ID NO: 254023 - DNA, 75 bp, Artificial Sequence
  Synthetic
tggagttattactctgctgcccagaatcctgtgaggaaggtggatgcttacactctaggttatggtggacatgag

SEQ ID NO: 254024 - DNA, 75 bp, Artificial Sequence
  Synthetic
aaaccacgactagtggagaccctgggatggaatttgattacgttcaaggccaagacagatgttttttccttgaac

SEQ ID NO: 254025 - DNA, 75 bp, Artificial Sequence
  Synthetic
ccctactcatgtgacaccatactttgtgacataggggagtcaaacccaagctatgcagtggaagcgcagagaacc

SEQ ID NO: 254026 - DNA, 75 bp, Artificial Sequence
  Synthetic
atcagggtcatagatcttatggaaaggtggttgaaggtcaatcctcaggccaatttttgcttcaaagttttgacc

SEQ ID NO: 254027 - DNA, 75 bp, Artificial Sequence
  Synthetic
ccctacactgggaatgtgttggagcgcctacacagctttcagactaggtttggtggaggtcttgtcagggttcca

SEQ ID NO: 254028 - DNA, 75 bp, Artificial Sequence
  Synthetic
ttatctagaaattccactcatgaaatgtattttgtttctggaatcaccaacaatgttgtgggaacagtaaatgct

SEQ ID NO: 254029 - DNA, 75 bp, Artificial Sequence
  Synthetic
gtcagtcgtaagcttctacagcgaatgagtgcaaagggaggtagcagagtgattgaagacatcagatttccattg

SEQ ID NO: 254030 - DNA, 75 bp, Artificial Sequence
  Synthetic
ggcacgcgctccaatcttactaatctagtgaaggctgacagaaaaatcatccagagaagaattgacaaaatcaaa

SEQ ID NO: 254031 - DNA, 75 bp, Artificial Sequence
  Synthetic
agtgaaaacaagaacttctggatggaggatacaaatcacccatataggacatgggagtatcatggtagctaccac

SEQ ID NO: 254032 - DNA, 75 bp, Artificial Sequence
  Synthetic
attagagatgttggaactaaatgttcagctccaaatctagttgtgaaattgctgtcatggccttggcaagctcta

SEQ ID NO: 254033 - DNA, 75 bp, Artificial Sequence
  Synthetic
gagagtgtggtgtcaatgagcatgacggataccacggcctttggacaacagagagtcttcaaggaaaaggtcgac

SEQ ID NO: 254034 - DNA, 75 bp, Artificial Sequence
  Synthetic
actaaggctcctgaaccaagagtggaagtgaaaaaagtcatgcgtgtggtctttaactggctagttcatgtcatc

SEQ ID NO: 254035 - DNA, 75 bp, Artificial Sequence
  Synthetic
ctaaaaaatggagggaaggttagaaaatgcactagggaagaattcatcaaaaaagttgaaagccatgctgccatt

SEQ ID NO: 254036 - DNA, 75 bp, Artificial Sequence
  Synthetic
ggggcttggagcaaggacatacctgagtggggaagtgctgttgaggctgttcatgatgaaagattctggaatatg

SEQ ID NO: 254037 - DNA, 75 bp, Artificial Sequence
  Synthetic
gtagacaaagaaagacagttacatctcactggtgactgtgaaatgtgtgtctacaacctcatgggcaagagagaa

SEQ ID NO: 254038 - DNA, 75 bp, Artificial Sequence
  Synthetic
aagaaaccaggagactttggagtagcaaaaggaagtaggactatctggtacatgtggttgggaagtcgctttcta

SEQ ID NO: 254039 - DNA, 75 bp, Artificial Sequence
  Synthetic
gaatttgaaagctttggctttttgaacgaagaacactgggcctccagagaactttgtgggggtggagtggaagga

SEQ ID NO: 254040 - DNA, 75 bp, Artificial Sequence
  Synthetic
attccccttttctacttgggttaccatcttgaaaaaatggccgaaaaagcaggcatactctatgctgatgataca

SEQ ID NO: 254041 - DNA, 75 bp, Artificial Sequence
  Synthetic
gcaggttgggatactagaatcacaatggctgatctagaagatgaatacacactaactgaattgatggagggagaa

SEQ ID NO: 254042 - DNA, 75 bp, Artificial Sequence
  Synthetic
cataaaaaacttgctgaaacactgttcaattttgcttacaaaaacaaggtagcactatgtccaaggccaggaaaa

SEQ ID NO: 254043 - DNA, 75 bp, Artificial Sequence
  Synthetic
aatggagggacagttctggatgtgatctctagaacagatcaacgtggctctggacaagttgtgacttatgcttta

SEQ ID NO: 254044 - DNA, 75 bp, Artificial Sequence
  Synthetic
aataccttaacaaacatcaaagttcaactcatcagaatggctgaaagtgaaggagttcttgatgaagaatttcat

SEQ ID NO: 254045 - DNA, 75 bp, Artificial Sequence
  Synthetic
gataatggcatgctcaaatggcttgagaaacatggtagggaccgtctccaacggctgatggtcagtggtgatgac

SEQ ID NO: 254046 - DNA, 75 bp, Artificial Sequence
  Synthetic
tgtgttgtgaacgcaattgatgagaggtttggtaagagtttggtttggttgaatgagatgcaaaaaattaggaag

SEQ ID NO: 254047 - DNA, 75 bp, Artificial Sequence
  Synthetic
gacattgacctgtggaaaccttcagcaggtcattgcaactgggaggaagtagagttctgttccaaccactttcac

SEQ ID NO: 254048 - DNA, 75 bp, Artificial Sequence
  Synthetic
aagcttgttatgagagatgggagaaccttggttgttccttgcagacatgaagttgagcttgtggggcgtgccagc

SEQ ID NO: 254049 - DNA, 75 bp, Artificial Sequence
  Synthetic
gtcaaccagggtggttcaacagggatttctgggactgcttgtttagctaaggcatatgcacaaatgtggctgctt

SEQ ID NO: 254050 - DNA, 75 bp, Artificial Sequence
  Synthetic
ctttacttccacaggagagatctcagaattttgggaatggcaatttgttcagcagttccagccaactgggttcca

SEQ ID NO: 254051 - DNA, 75 bp, Artificial Sequence
  Synthetic
acaggacgaacgacctggtctcttcatgccactaaagattggatgacagttgatgacatgttgtcagtttggaat

SEQ ID NO: 254052 - DNA, 75 bp, Artificial Sequence
  Synthetic
aggatctggattgaagagaatccatggatgaaaaataaacaaccagttagagaatggaatgcaatcccatatctg

SEQ ID NO: 254053 - DNA, 75 bp, Artificial Sequence
  Synthetic
ccacggagagaagacataaactgtggtagtctgattggaacatcaaaacgatcaacatgggcaacactagtgcct

SEQ ID NO: 254054 - DNA, 75 bp, Artificial Sequence
  Synthetic
ggggctgttatgaaagtgaggaatttgtttgggcctgagaaattttctaactacatggattgtattggaagatat

SEQ ID NO: 254055 - DNA, 75 bp, Artificial Sequence
  Synthetic
catgttggccaccaggacttctgcctgtactagatccagcaacacctaaaatgtacatagaaaacaactaatgga

SEQ ID NO: 254056 - DNA, 75 bp, Artificial Sequence
  Synthetic
aaaaatgcgagtgagggcaactctgggattagctcaatgggtgtgacgaccctacccttccgcatttgtaaataa

SEQ ID NO: 254057 - DNA, 75 bp, Artificial Sequence
  Synthetic
ttgagccagtcatttccgtagggaagagagttattcgctcctctcgagattgagcggcctgctccttggagcatg

SEQ ID NO: 254058 - DNA, 75 bp, Artificial Sequence
  Synthetic
agatgggaggcccgaagcaaagctgaaaggactagcggttagaggagaccccttccatctctggtatcaaatttc

SEQ ID NO: 254059 - DNA, 75 bp, Artificial Sequence
  Synthetic
atggagtttactccatggtggctagaacccatagcgggggtgaaccacattggctaaggttcaccagcttttgct

SEQ ID NO: 254060 - DNA, 75 bp, Artificial Sequence
  Synthetic
cccgcgtttttcaaattgcctcatcttgaatggggggcggcgtggatatatactccagccagaaaagactcagat

SEQ ID NO: 254061 - DNA, 75 bp, Artificial Sequence
  Synthetic
cgtggatatatactccagccagaaaagactcagattgtctcatgactttctgactggcgtacatagccatccgct

SEQ ID NO: 254062 - DNA, 75 bp, Artificial Sequence
  Synthetic
gtttgagcatttctagagcatctcggagatggggcagatagtcaccttctttcaagaggtgccacacatccttga

SEQ ID NO: 254063 - DNA, 75 bp, Artificial Sequence
  Synthetic
gagatggggcagatagtcaccttctttcaagaggtgccacacatccttgaagaagtgatgaacattgtgctgatg

SEQ ID NO: 254064 - DNA, 75 bp, Artificial Sequence
  Synthetic
accctctcaatcttggccatcctaaagggcatctacaatgtgatgacctgtggaatcatcggtttgataacattt

SEQ ID NO: 254065 - DNA, 75 bp, Artificial Sequence
  Synthetic
agggcatctacaatgtgatgacctgtggaatcatcggtttgataacatttttgttcttgtgtgggagatcatgct

SEQ ID NO: 254066 - DNA, 75 bp, Artificial Sequence
  Synthetic
caagcatctataaggacaactatgagttcttctctttcgacctcgacatgtcttcactgaatgcaacgatgcctc

SEQ ID NO: 254067 - DNA, 75 bp, Artificial Sequence
  Synthetic
tctcctgctcaaagaacaactcccatcactacatccaagttgggaatgagacaggcctagagctgacattgacaa

SEQ ID NO: 254068 - DNA, 75 bp, Artificial Sequence
  Synthetic
acactagcataattgatcataagttttgcaacctgtctgatgctcacaggaggaatctttatgacaaagcactta

SEQ ID NO: 254069 - DNA, 75 bp, Artificial Sequence
  Synthetic
tgtcaatcttgacaacattccacctaagcattccagattttaaccaacatgaggcaatgtcatgtgattttaacg

SEQ ID NO: 254070 - DNA, 75 bp, Artificial Sequence
  Synthetic
gagggaagatctcagttcaatacaacctgtcccactcaaattatgtggatgccggcaaccactgtggcactattg

SEQ ID NO: 254071 - DNA, 75 bp, Artificial Sequence
  Synthetic
caaatggcattatggatgtttttagaagaatgtattggagcacctccctttcggttgcctctgacataagtggga

SEQ ID NO: 254072 - DNA, 75 bp, Artificial Sequence
  Synthetic
ctcaatgcatacagaccgattataagtatttgattattcagaacacatcatgggaggatcattgcatgttctcaa

SEQ ID NO: 254073 - DNA, 75 bp, Artificial Sequence
  Synthetic
gaccctcacccatgggatttttaagccttctgtcacagagaaccaggaatttctacatctcaagaagacttttgg

SEQ ID NO: 254074 - DNA, 75 bp, Artificial Sequence
  Synthetic
ttggagcagtaccctgagagttctctcctcaggctctgtgtccacaagaaggacttcacctcctttgaattggac

SEQ ID NO: 254075 - DNA, 75 bp, Artificial Sequence
  Synthetic
gtctttttacatggactttgagtgactcggaagggaacgacatgccaggtggttactgtctcacaaggtctatgc

SEQ ID NO: 254076 - DNA, 75 bp, Artificial Sequence
  Synthetic
ttggacattgttggaggcttttcggtgcagagctgattccaaaggcgcaatcaattagcctaggatccactgtgc

SEQ ID NO: 254077 - DNA, 75 bp, Artificial Sequence
  Synthetic
cgcaccgaggatcctaggcaattgagtttgtttctttagtgcacccaaacacccgtccgacacaccactcgacaa

SEQ ID NO: 254078 - DNA, 75 bp, Artificial Sequence
  Synthetic
taatagggcttgatctgaaatgctttgggaacactgccattgcgaagtgtaatcaggcacatgatgaagaattct

SEQ ID NO: 254079 - DNA, 75 bp, Artificial Sequence
  Synthetic
agaccatgggaaaatcccaatccaaaagctccccccacaacaagcccccagaacccgaggcaccaaggcatccag

SEQ ID NO: 254080 - DNA, 75 bp, Artificial Sequence
  Synthetic
gtgacatgctccgcctttttgattttaataaacaagcaattagcaaactgaggtctgaagttcagcagagcataa

SEQ ID NO: 254081 - DNA, 75 bp, Artificial Sequence
  Synthetic
tgattccagatgccagaggcacaggtcctgagttttgcaaaagttgctggtttgaaaggagaggattagtcaaat

SEQ ID NO: 254082 - DNA, 75 bp, Artificial Sequence
  Synthetic
atttgataaataaagctgtcaacgccctcatcaatgatcaactggtcatgaggaaccatttgagagatctaatgg

SEQ ID NO: 254083 - DNA, 75 bp, Artificial Sequence
  Synthetic
tggacattgttggaggcttttcggtgcagagctgattccaaaggcgcaatcaattagcctaggatccactgtgcg

SEQ ID NO: 254084 - DNA, 75 bp, Artificial Sequence
  Synthetic
gctatgatcactatttatgtctgaactgtctcaccctgcttcacacagtgtccgacagatgcccaatctgcaagc

SEQ ID NO: 254085 - DNA, 75 bp, Artificial Sequence
  Synthetic
gtattccttattgcaactactctaagttttggtacttgaatgatactaggacagggagaacatccctcccaaagt

SEQ ID NO: 254086 - DNA, 75 bp, Artificial Sequence
  Synthetic
acactctgccactaaagctggaactccagactcagccaacagcaccacccgaacacccacccaaccaacagcccc

SEQ ID NO: 254087 - DNA, 75 bp, Artificial Sequence
  Synthetic
gttggcttgtgaccaatgggtcatacctaaatgaaacccagttctcaacagaaattgagcaagaagccaataaca

SEQ ID NO: 254088 - DNA, 75 bp, Artificial Sequence
  Synthetic
caccctacacaccctagacaccaatccaccaaaacccatccccaatgcccaccctcccccccggggggacccccc

SEQ ID NO: 254089 - DNA, 75 bp, Artificial Sequence
  Synthetic
tgttcactgacatgttgaggaaggagtatgagaaaaggcagagcacaacacctctggggttagtagatctttttg

SEQ ID NO: 254090 - DNA, 75 bp, Artificial Sequence
  Synthetic
gccggggctccccccgggggaggcggacggcggtgtgcacagactgcctagtcgatgtcaaggggaggcctcctc

SEQ ID NO: 254091 - DNA, 75 bp, Artificial Sequence
  Synthetic
ttttctccactagcttttatttgatctccgtgttcctccacctaatcaaaattccaacacatagacacataaaag

SEQ ID NO: 254092 - DNA, 75 bp, Artificial Sequence
  Synthetic
tcttcaaagagaggtttgcacaactttcctttcagtctaagatttccttctgtagattgaatcattatgcatgat

SEQ ID NO: 254093 - DNA, 75 bp, Artificial Sequence
  Synthetic
gcaagccttgcccgaaaccacacagactcaatcacatggcaatctgttcctgtggcttctataagcaaccaggtc

SEQ ID NO: 254094 - DNA, 75 bp, Artificial Sequence
  Synthetic
ggtctgggggttggaatttgtggactccctatgactgctgcttcaaacatgagacaatccagcaatgcacagtgt

SEQ ID NO: 254095 - DNA, 75 bp, Artificial Sequence
  Synthetic
agtgatttactgtaacaaagactgtatcctttaaaatctatccatgcatcaatcctggatagtaccttgaacaag

SEQ ID NO: 254096 - DNA, 75 bp, Artificial Sequence
  Synthetic
ggtgtcacttcttctttgccacctctcttcttcttttgcgttacaatccccgtatgcattctacaaaggtgtttg

SEQ ID NO: 254097 - DNA, 75 bp, Artificial Sequence
  Synthetic
aaattttcatgatcttcgggaaagcattgttccgttactctgaccaaatcaagttccaaccactgcaacttttga

SEQ ID NO: 254098 - DNA, 75 bp, Artificial Sequence
  Synthetic
tattcatcccagatcttatcctcaaattttcttgcatcgtctttctgcatggacacatcaatcagttttatgtcc

SEQ ID NO: 254099 - DNA, 75 bp, Artificial Sequence
  Synthetic
tccagtctagactttagcatccttcctaaagattcctccaagagttcacgatgggtttccgacagctcacctatg

SEQ ID NO: 254100 - DNA, 75 bp, Artificial Sequence
  Synthetic
ctcctgttctgggagtcaagaagctttctgatgtcatcagcaccttgacacgacaagaccatgttctttggcagg

SEQ ID NO: 254101 - DNA, 75 bp, Artificial Sequence
  Synthetic
aaaacactcatatcctggtccaagattcgagggttaaacgggatgagtctgtttttaccttccatcaagaaccca

SEQ ID NO: 254102 - DNA, 75 bp, Artificial Sequence
  Synthetic
ctctcaattacagcacttgtcaaccccggctgaactgagaataggtcttggatgtcaatgccatgagagtgtttg

SEQ ID NO: 254103 - DNA, 75 bp, Artificial Sequence
  Synthetic
gaatcaacgacaagtggaatttgtgtatcttcaggtccaacatgtatgaagtcaaactcctccaaatccaaaatc

SEQ ID NO: 254104 - DNA, 75 bp, Artificial Sequence
  Synthetic
gagtcttgtttgaattgtttaatgtctgttggttccctgtaaaaatgaatatactgaccattattaggttgatag

SEQ ID NO: 254105 - DNA, 75 bp, Artificial Sequence
  Synthetic
tcctcatgcagccacacaggtaatgaagtgacactaggtatagaagaaccacttcgtagataatcataaatgttc

SEQ ID NO: 254106 - DNA, 75 bp, Artificial Sequence
  Synthetic
atagctatctccacggggtcttcaggtctcccttctatgtcaatccatgtcttagcatttggatccaattgcaac

SEQ ID NO: 254107 - DNA, 75 bp, Artificial Sequence
  Synthetic
tcagtggacaagaaccagctagatttacagcctgtcttaaaccaggcagatgttctcgcaactctccaacagtcc

SEQ ID NO: 254108 - DNA, 75 bp, Artificial Sequence
  Synthetic
atgctgtctttgagttccattgtctgagagtaggtcaaaccagcaggcatgccttgggcctgagcgagtctgttg

SEQ ID NO: 254109 - DNA, 75 bp, Artificial Sequence
  Synthetic
ctaattgcagacctgtggatatttccactgtaagttgcatccaaagaatggggcttgaacagaccaccctccaac

SEQ ID NO: 254110 - DNA, 75 bp, Artificial Sequence
  Synthetic
gagttacctttgtcaggctttgcattctgttgcacatcaccactcagatcaacagttgtgttatcccaagccctg

SEQ ID NO: 254111 - DNA, 75 bp, Artificial Sequence
  Synthetic
atcacccctttgaaaaggagatgaataaaaaacttttcctttagtgactcaccttgactcttgacctggaagttc

SEQ ID NO: 254112 - DNA, 75 bp, Artificial Sequence
  Synthetic
ccgacgatcgatgttcttgatgctatgtaaggccaaccctctccagaaagacatagtttgtagaggagattttca

SEQ ID NO: 254113 - DNA, 75 bp, Artificial Sequence
  Synthetic
actgtgatggacatttgaacactcccggtgtcaaggccagctagactctctaacatctctcccattgttgtgaat

SEQ ID NO: 254114 - DNA, 75 bp, Artificial Sequence
  Synthetic
taagggttcctttcccctggcgtgtcagagacaaacattcccaaagaacgcttgactttcaaggcagccttcaaa

SEQ ID NO: 254115 - DNA, 75 bp, Artificial Sequence
  Synthetic
attctctgctcagtcatacctgaagctattaactgtcctaaattcaagaccgctgggctgcagtcaaaatccagc

SEQ ID NO: 254116 - DNA, 75 bp, Artificial Sequence
  Synthetic
attccttccaaattggattttgttactttgatggtctccagcatgtttccgccgtctattagacaagcaccagct

SEQ ID NO: 254117 - DNA, 75 bp, Artificial Sequence
  Synthetic
catgcataaccggagtggagatcatgcttatacatgggcctttcaatacccctataaatgaccttttcaacaaaa

SEQ ID NO: 254118 - DNA, 75 bp, Artificial Sequence
  Synthetic
ttcaccgcagctgacaggctaaaattgtaccctgatatgtttatggcacttttcttgggctcaatgatccccaag

SEQ ID NO: 254119 - DNA, 75 bp, Artificial Sequence
  Synthetic
gaagaaaagggtcccaaaccttcaaggccctcagattcagggatggaggtcctgtgagggaaccaggtaaaagac

SEQ ID NO: 254120 - DNA, 75 bp, Artificial Sequence
  Synthetic
attgggtgggtctgagagagtttgtctaagtcagacatgtttggatactttgcagtgtacacaagccccaagtct

SEQ ID NO: 254121 - DNA, 75 bp, Artificial Sequence
  Synthetic
cccagagtccttgttgttgcaacaaaaggtctaacgaatgactcaaagtaaacctgccttaggaaattttgaaca

SEQ ID NO: 254122 - DNA, 75 bp, Artificial Sequence
  Synthetic
gacaacgattggatcacatcattcagatctgcctgcccttgtttgcacatgcaagcaatcgtcaggcttggcatt

SEQ ID NO: 254123 - DNA, 75 bp, Artificial Sequence
  Synthetic
acatcataagtagtaacaactctttcatcagtaattgggagatgtgacctctcatgggctactgttaactcagat

SEQ ID NO: 254124 - DNA, 75 bp, Artificial Sequence
  Synthetic
gtcccaaactgattgtttaaaagctctgggtttcgaacatcccacactctaacaatgccatctccgagagtgttt

SEQ ID NO: 254125 - DNA, 75 bp, Artificial Sequence
  Synthetic
gagaggacaacgtaatgttcctctcttttccacttcacaacatgggaaatcaatgacatcgcctcacagttgaca

SEQ ID NO: 254126 - DNA, 75 bp, Artificial Sequence
  Synthetic
cctgcccggaacccgccacccattccgaccatctgtaacaaaaccctcctctgttctagctgctgagctgttagg

SEQ ID NO: 254127 - DNA, 75 bp, Artificial Sequence
  Synthetic
tccaaaacaacacaaaggtcaaggaacttaacctttggtgtccacttcatctttgttgatgccagatcactcatg

SEQ ID NO: 254128 - DNA, 75 bp, Artificial Sequence
  Synthetic
ttgcccatatagactccagcagcaagaggcctctcacctctgatgacttttgctttgagtctgtccaggtcggca

SEQ ID NO: 254129 - DNA, 75 bp, Artificial Sequence
  Synthetic
aaaggcaataagtgcttttcaaaaagagacgggtaaagtcttctaaatgagtgaatgatatgattgaagcccact

SEQ ID NO: 254130 - DNA, 75 bp, Artificial Sequence
  Synthetic
gcaaggacgaggaggtcatcagaggttagtgtccccactctcaaaacattcttctgttggactgactttaactca

SEQ ID NO: 254131 - DNA, 75 bp, Artificial Sequence
  Synthetic
ttgtcttctaaaagccttgtggcagatggcttcattgggaagtaatcacatggcttgaatttaattgagcatatt

SEQ ID NO: 254132 - DNA, 75 bp, Artificial Sequence
  Synthetic
actagattgttcactgcctggtttaggtccctcaatcttttcaggtcagagtcatccctcttctcctttctcatc

SEQ ID NO: 254133 - DNA, 75 bp, Artificial Sequence
  Synthetic
ttattcttttctttcactttgggttctcccaagacccagggtccaagttcaagagatgttgatagagcaatgcaa

SEQ ID NO: 254134 - DNA, 75 bp, Artificial Sequence
  Synthetic
aacctttgaacattggcaacttcagagaagtccagcccatgaagaagtgcttgagcatccttgatgacttggatc

SEQ ID NO: 254135 - DNA, 75 bp, Artificial Sequence
  Synthetic
aaataatcccaaagaacaggtcttaaaaaactgattatcccctcttttgactccctacttttcaatccccataaa

SEQ ID NO: 254136 - DNA, 75 bp, Artificial Sequence
  Synthetic
gtgcttgagcatccttgatgacttggatctttatgttggagcagtaccctgagagttctctcctcaggctctgtg

SEQ ID NO: 254137 - DNA, 75 bp, Artificial Sequence
  Synthetic
tcaatcccctttatcttcaagtgagtcacagagtccgatgtagacaatcttgacaccaaagactttatatatgta

SEQ ID NO: 254138 - DNA, 75 bp, Artificial Sequence
  Synthetic
acatggcaatctgttcctgtggcttctataagcaaccaggtctccccacacaatggaaaaggtgaagaacagggg

SEQ ID NO: 254139 - DNA, 75 bp, Artificial Sequence; identical to SEQ ID NO: 219093
  Synthetic

SEQ ID NO: 254140 - DNA, 75 bp, Artificial Sequence
  Synthetic
gtgctcttgtctgagaatcgaacacacttactacctagtgttttgcagagcccaatgaaaccagaagcaatacca

SEQ ID NO: 254141 - DNA, 75 bp, Artificial Sequence
  Synthetic
cgcaccggggatcctaggcaattttgtggatctttgctgatacttcattctgcactcaaagccgcatccggcaag

SEQ ID NO: 254142 - DNA, 75 bp, Artificial Sequence
  Synthetic
ggacagcccagcacaaatctcctcaaggagacagaaccaaggcatccagtaataccagatgccaggggaactggc

SEQ ID NO: 254143 - DNA, 75 bp, Artificial Sequence
  Synthetic
ctttggaaagcacttttatttacagcttcacagaggagcttctgagcaccccttgtgaaacttgatgagagcttg

SEQ ID NO: 254144 - DNA, 75 bp, Artificial Sequence
  Synthetic
cctgaattctgcaagagctgctggttcgaaaggagggggttagtcaggtgcaacgatcactacctatgtttgaac

SEQ ID NO: 254145 - DNA, 75 bp, Artificial Sequence
  Synthetic
ttttgtaatgtcttaactaaagttggcagcttctcatctgcaagctcaagggcacctgcatacacaactttttgt

SEQ ID NO: 254146 - DNA, 75 bp, Artificial Sequence
  Synthetic
tgtcttacacttttacacacagtgtcagataggtgccccatctgcaaacacaaactacccttcagactagagctc

SEQ ID NO: 254147 - DNA, 75 bp, Artificial Sequence
  Synthetic
ctcatgaccatctttaatgggtgatgagttgtcaaattgagccaacaaactgacaagtcctcatcagagagagat

SEQ ID NO: 254148 - DNA, 75 bp, Artificial Sequence
  Synthetic
cagacccagccgacagcaccaccagaaatcccaccatcccaaaatcccccaccctacagcccctgaggcagaact

SEQ ID NO: 254149 - DNA, 75 bp, Artificial Sequence
  Synthetic
tcatcatcaatcagagcagtgagctttttaaaagaatcaactggatctccagacaggtagatggctgtgaactct

SEQ ID NO: 254150 - DNA, 75 bp, Artificial Sequence
  Synthetic
ccgccccgaagcccctcccaaacacccctcccctcccccccggggggaccccccgccggggctccccccgggggg

SEQ ID NO: 254151 - DNA, 75 bp, Artificial Sequence
  Synthetic
tcgtgaagctcacccaactttaatttgttaaacacaatccgaagaactttcctgactttgagggtactttctgga

SEQ ID NO: 254152 - DNA, 75 bp, Artificial Sequence
  Synthetic
agatgcgcgagctgttctcggagcacctactcaatgtcgaggggaggccccacctcttcaaagaggggcctgcac

SEQ ID NO: 254153 - DNA, 75 bp, Artificial Sequence
  Synthetic
agaattgcttcaatgtttctcataattctgtaacctctatttccatcaacccagtccttgacatcagaatccaaa

SEQ ID NO: 254154 - DNA, 75 bp, Artificial Sequence
  Synthetic
agcctccctcttaatctaaacttcccctctgaagactggatcatcagtgaagcctgcgatctactgtagcagaga

SEQ ID NO: 254155 - DNA, 75 bp, Artificial Sequence
  Synthetic
aatagaagaaaaggatctatgggatactgggcatacctgaggaggttcaacgtcctttcttggatgacattgcag

SEQ ID NO: 254156 - DNA, 75 bp, Artificial Sequence
  Synthetic
ctatagcctttaaaatctgcccagaagtcaattccggagaacactctagtaaggaagttttcgtagccttcaggc

SEQ ID NO: 254157 - DNA, 75 bp, Artificial Sequence
  Synthetic
agtgacacaggcacaccattggccactgactgatcaatgatagtgtcaatagtttcagccaactgatggggttct

SEQ ID NO: 254158 - DNA, 75 bp, Artificial Sequence
  Synthetic
atgcatcgtcccacaacccctataatatcaagttgtagccagtgtagtccttggtccattctggatctcagcatc

SEQ ID NO: 254159 - DNA, 75 bp, Artificial Sequence
  Synthetic
ttgcatttaacattgtgaagggcagcagcaacaaattttgttagtaaagggacctcatcaccccaaacaaaaaat

SEQ ID NO: 254160 - DNA, 75 bp, Artificial Sequence
  Synthetic
ttgctcaaagatctctccaagatttcggaatgatcctccattagctcaccaataaaaacattaagatcctggtca

SEQ ID NO: 254161 - DNA, 75 bp, Artificial Sequence
  Synthetic
ctagatttgaactcagcaacaaaggtacgggccacacttttggggctgatgaatttattcaaccggtcactaagg

SEQ ID NO: 254162 - DNA, 75 bp, Artificial Sequence
  Synthetic
tggatgttggggttgaagggcaggagtttcctggtcccttcaataaggtatcctgagtcaacaactaaggggatt

SEQ ID NO: 254163 - DNA, 75 bp, Artificial Sequence
  Synthetic
aaataatgaaattctaatatattctggaattcttcgggatcttctgatagcaaatttgaaatgcttctgccaaat

SEQ ID NO: 254164 - DNA, 75 bp, Artificial Sequence
  Synthetic
tcaacatgctcaggccctatatgcgtgaaatcatgttcctccaggtccaggatctcctcattcaataagacggac

SEQ ID NO: 254165 - DNA, 75 bp, Artificial Sequence
  Synthetic
aatgagatttgatcatcactagaagtgtatgagtccacctcatcctcaaatagacattcaatacaatagtttatg

SEQ ID NO: 254166 - DNA, 75 bp, Artificial Sequence
  Synthetic
aagggtatcacatcaggaatgggggaactatccctcaagtagtcacaaatattttcagtggacagcaaccaaatt

SEQ ID NO: 254167 - DNA, 75 bp, Artificial Sequence
  Synthetic
aacctttcactcacgagaccataaaaatctgaagtattgtgtaaaattccttgtcccatgtcaattattgaactt

SEQ ID NO: 254168 - DNA, 75 bp, Artificial Sequence
  Synthetic
gatgtggtttcccttttaaaccatgtagatgtctgtgcaactctccagcaatctttaattgcggatctttgaaca

SEQ ID NO: 254169 - DNA, 75 bp, Artificial Sequence
  Synthetic
aaatgtgaaggtattgtgttttgcttaaagtgttcaaagaagaatgtctctgctgttgtctggtggagtgatttc

SEQ ID NO: 254170 - DNA, 75 bp, Artificial Sequence
  Synthetic
ctaccactgtaagttacatcaagggaatgaggcttgaataatccaccttccaacaccacccctttgaaaaggagg

SEQ ID NO: 254171 - DNA, 75 bp, Artificial Sequence
  Synthetic
tttaaacctaatctggattttaaataagatttcatcattgcattgaccacattgaaggggacctcaatcagctta

SEQ ID NO: 254172 - DNA, 75 bp, Artificial Sequence
  Synthetic
tggagactaaatttctctttcaatgattcaccctgacttctcacctgaaaatttactgtgacagaaatttgaacg

SEQ ID NO: 254173 - DNA, 75 bp, Artificial Sequence
  Synthetic
tggacatgccaagacaataatgtagagatataatctttgctcttaatgtcctcaatgtcatctcctgaatcccat

SEQ ID NO: 254174 - DNA, 75 bp, Artificial Sequence
  Synthetic
ctcccaacactgaggtcggcaaaagcttcaagcagctcacttaccgactcaaagacgtgctgctcggttaatcct

SEQ ID NO: 254175 - DNA, 75 bp, Artificial Sequence
  Synthetic
ctaaggttttgaaggaataccaaaaaaagataaggagacatcattggtccccacttgctgtggtccaagctataa

SEQ ID NO: 254176 - DNA, 75 bp, Artificial Sequence
  Synthetic
gatgctatgagctgtcctaagtttagaattgctggtgcacattcaaaatccagccaagcataacctgagtaaaga

SEQ ID NO: 254177 - DNA, 75 bp, Artificial Sequence
  Synthetic
gaaacttggcctaaagacacattcaatttcattgctaggatggcattgtggaattctttctcatcattcagacaa

SEQ ID NO: 254178 - DNA, 75 bp, Artificial Sequence
  Synthetic
tcatgcctgtacatgggtctttcaacacccttataaataaccttttctataaaagaagaaaaggggccgaggttg

SEQ ID NO: 254179 - DNA, 75 bp, Artificial Sequence
  Synthetic
cttcctctatattgcctggtcaatgcttcaaagtaatcttctaccaaccgggtgaacatttttgttcttaagtca

SEQ ID NO: 254180 - DNA, 75 bp, Artificial Sequence
  Synthetic
tcaagcccttccgactcaggaattgaagatctatgtggaaaccaagtaaaagaacctaaagtcctgcttgttgca

SEQ ID NO: 254181 - DNA, 75 bp, Artificial Sequence
  Synthetic
ccaatgtaaagttccctatttccccccacttgttctttgtaggatagagaaaatttgagtctacctgtgtctgga

SEQ ID NO: 254182 - DNA, 75 bp, Artificial Sequence
  Synthetic
acgaatggtctgatgaaggactcaaagtagatttgtctcaggaaattttgtaccacatcataagtggtcaccacc

SEQ ID NO: 254183 - DNA, 75 bp, Artificial Sequence
  Synthetic
cctagagatgtgtatgattgtggagattcctgactgtaaaaacacaagttcttaagaactgcagtggtgcagttg

SEQ ID NO: 254184 - DNA, 75 bp, Artificial Sequence
  Synthetic
ctttcatccgtgattgggagatgagacctctcatgtgctattgctaaatctgaagacagaaccacataatgctct

SEQ ID NO: 254185 - DNA, 75 bp, Artificial Sequence
  Synthetic
gtgagcgataatgctttccctagtgcctctgaattgctctctctttcactaatcctaacatcatccatcaacttt

SEQ ID NO: 254186 - DNA, 75 bp, Artificial Sequence
  Synthetic
tctctcttccacttgacaacatgagaaattaatgacattgcctcacaattcacatctagaaccacacaaagatca

SEQ ID NO: 254187 - DNA, 75 bp, Artificial Sequence
  Synthetic
tccctatcaattttaaagttcagatgcctatttttgtaatgactgtacttcccgaccagtttccctgcgttcatt

SEQ ID NO: 254188 - DNA, 75 bp, Artificial Sequence
  Synthetic
agaaacttaatccttggtgtccacctcattttcgttgatgctaggtcactcatgaagggcaagaggtgtctctca

SEQ ID NO: 254189 - DNA, 75 bp, Artificial Sequence
  Synthetic
tgaagcaaaagtgatttaaagcactgaaaaaactgttgatcatggtatgttctggtggagacagcttgggttata

SEQ ID NO: 254190 - DNA, 75 bp, Artificial Sequence
  Synthetic
aatagagatgggtaaagtcttctgaatgagtgaataatatggttaaaccccaccttgtcttccaagagttttgtg

SEQ ID NO: 254191 - DNA, 75 bp, Artificial Sequence
  Synthetic
catgttataggacaagactctaaagattctaagtaaaaatatttttgcctcaattctgcgtcctcaaagaaacct

SEQ ID NO: 254192 - DNA, 75 bp, Artificial Sequence
  Synthetic
gtagtgggcttcattgggaaatagtcacatggcttgaagggaattgaggatgttttctccttcactttgggttca

SEQ ID NO: 254193 - DNA, 75 bp, Artificial Sequence
  Synthetic
ttacaaatctcctcatagacactctcaggcagcatagattcatcgaaatcttctatcatatgatgtgtaatttct

SEQ ID NO: 254194 - DNA, 75 bp, Artificial Sequence
  Synthetic
cccaacacccaggaacccagctcaagtgatgtagataaggctatgcagaagtaatcccaaaggacaggtctcaag

SEQ ID NO: 254195 - DNA, 75 bp, Artificial Sequence
  Synthetic
acttgaatcaatctataataagttccaccatgctgacaaccagacaaaacttttcttaaatcaacaagtgacttc

SEQ ID NO: 254196 - DNA, 75 bp, Artificial Sequence
  Synthetic
aaacctaacgcttcctcagctgcctttgtgtgctccttacccaagatccaaagatcgacgcccttaactttcaag

SEQ ID NO: 254197 - DNA, 75 bp, Artificial Sequence
  Synthetic
tgtccttgtccactttctttggatgacccataagcatacttgtaattggaaagcactgcatcaacagactccttg

SEQ ID NO: 254198 - DNA, 75 bp, Artificial Sequence
  Synthetic
ctggaaacagaatccaatgctgacagtcttgaaactaatgattttatataggcggtggacctatctgagaatcga

SEQ ID NO: 254199 - DNA, 75 bp, Artificial Sequence
  Synthetic
acttcctctaagcactcaagtacattgtgatctaatagtgtctcatccaagtcatcaaaattttctcgtggatgt

SEQ ID NO: 254200 - DNA, 75 bp, Artificial Sequence
  Synthetic
acacatttgctacctagtgtcttgcaaagacctatgaaacctgatgctatcccactctgaaaggcacttttgttg

SEQ ID NO: 254201 - DNA, 75 bp, Artificial Sequence
  Synthetic
gtgccctcggacttattttccttcccaataacaagatcactgattgttctctgcactttataatcataatcctcc

SEQ ID NO: 254202 - DNA, 75 bp, Artificial Sequence
  Synthetic
acggcttcacagagcaacttttgtgcccctcttgtgaaattagaggataacttgctttgcaatgttttcaccaag

SEQ ID NO: 254203 - DNA, 75 bp, Artificial Sequence
  Synthetic
ttgctcaataaatactttgtcttcctctggaaagtttctgacagttgacacacagaagctgccacaagtttgtca

SEQ ID NO: 254204 - DNA, 75 bp, Artificial Sequence
  Synthetic
gtaggcagtttttcttccccgagttcaacagcacctgtgtaaatgaccttctgtctcatgaccatctttaaaggg

SEQ ID NO: 254205 - DNA, 75 bp, Artificial Sequence
  Synthetic
tgatcataattaagcactctctcaccatcagtgtatttatttacaaccacacttttattactagctaagtcgagc

SEQ ID NO: 254206 - DNA, 75 bp, Artificial Sequence
  Synthetic
tgatgagttgtcaaattaagccaacacaccgataaatcctcttctgagagggtgtcatcaccaacaaggctggta

SEQ ID NO: 254207 - DNA, 75 bp, Artificial Sequence
  Synthetic
gcggttgcacacccagcagtgactaaagggtctttaaaaccacccaggcaatcacctcttttaaaaagagaccca

SEQ ID NO: 254208 - DNA, 75 bp, Artificial Sequence
  Synthetic
agtttcttgaaggaatctgcggggtctcctgacaagtagatggctgtgaattcttcatgaagctctcctaatttc

SEQ ID NO: 254209 - DNA, 75 bp, Artificial Sequence
  Synthetic
ttgttaaaggaggaggtcatcattgaaaagaactttcttgacacaccaggaaccttataggatattttactattc

SEQ ID NO: 254210 - DNA, 75 bp, Artificial Sequence
  Synthetic
agcttattaaaaactgtccttaggaccttcctaactttctgagtgctttctggtaggattgcctcaatgttcctc

SEQ ID NO: 254211 - DNA, 75 bp, Artificial Sequence
  Synthetic
accaaactggtctcctttgacagaaatttatttgctgattctaatagcagctctttttcttcttcttccccttct

SEQ ID NO: 254212 - DNA, 75 bp, Artificial Sequence
  Synthetic
ataatcctatagcccctattgccatcaacccaatctttaacatcagaatccaaaaacaacaagaaaggatcaatg

SEQ ID NO: 254213 - DNA, 75 bp, Artificial Sequence
  Synthetic
tcagaagggttcacatttatactgttgaaatccaacttgggctcaaggtacttttcaaaacacttaatctggtct

SEQ ID NO: 254214 - DNA, 75 bp, Artificial Sequence
  Synthetic
ggatattgtgcatatctaagtagattcagtgttctctcctgaatagcgttacatagtgtgacaggcacaccattg

SEQ ID NO: 254215 - DNA, 75 bp, Artificial Sequence
  Synthetic
gtgagtctgtcaggggtttctttagttataaaatgacacatgtatgacaagttgagtataaatttgaatctgttg

SEQ ID NO: 254216 - DNA, 75 bp, Artificial Sequence
  Synthetic
gccactgactgatcaatgatagtgtcaatagtttcagctaattgatgtggctccttacacttaacgttgtggagg

SEQ ID NO: 254217 - DNA, 75 bp, Artificial Sequence
  Synthetic
gttaacatagtacttacattcttactcagaactgtagtgagtatgttcctcactacactatacaagaggtactca

SEQ ID NO: 254218 - DNA, 75 bp, Artificial Sequence
  Synthetic
gcggcagccacgaatttcgttaacaatggaacttcatcaccccagacataaaaccttgatttgaactcagcaaca

SEQ ID NO: 254219 - DNA, 75 bp, Artificial Sequence
  Synthetic
gactctgttatcaagtcctctcttaatttttccattaattgtttatggtgaaaatccgaaacaaaagccattatg

SEQ ID NO: 254220 - DNA, 75 bp, Artificial Sequence
  Synthetic
aatgaaccaataacactctttggactgatgaatttattcaattgatcacttaggaaatagtgaaattctagaatg

SEQ ID NO: 254221 - DNA, 75 bp, Artificial Sequence
  Synthetic
aaatacctcaatccctgcaaaaacttttgtgccctcttgcttggatttgagagtatgagtatcataacaattttg

SEQ ID NO: 254222 - DNA, 75 bp, Artificial Sequence
  Synthetic
gcttggaattcctcaggctcatttgagagtaaatctgaaagatccttgccaaatagtgatatttgatcatcacta

SEQ ID NO: 254223 - DNA, 75 bp, Artificial Sequence
  Synthetic
agcaataacttcagatctcttaagtgatggctcaactcaacacattcagttatccaactcatcatggtctcaata

SEQ ID NO: 254224 - DNA, 75 bp, Artificial Sequence
  Synthetic
gaggtatatgaatcaacttcatcttcaaatagacacttaatgcaataatttatgaatctctcactcactagaccg

SEQ ID NO: 254225 - DNA, 75 bp, Artificial Sequence
  Synthetic
gtcctgagaataacatcatgcgaaaatatggcagggaagaatctctttgggtccgcataaaatgaacacacttca

SEQ ID NO: 254226 - DNA, 75 bp, Artificial Sequence
  Synthetic
tagaagtcagaagcattgtgcaagatcccttgccccatgtcaattattgagctgagatgtgatggtatcctgttt

SEQ ID NO: 254227 - DNA, 75 bp, Artificial Sequence
  Synthetic
cccctttcagaattgttgatggcataacacttagagcactctccagttttttgatagatcaaattgaacacatca

SEQ ID NO: 254228 - DNA, 75 bp, Artificial Sequence
  Synthetic
tgtttaaagtattcaaagaagaaagcttctgttgacgtttggtggagtgattttttcaaacctaacctagactta

SEQ ID NO: 254229 - DNA, 75 bp, Artificial Sequence
  Synthetic
ttgtccataacaaaactctggttaaaagcctccttgcagcggactcttttgtatcttgcagcaccatgctcattc

SEQ ID NO: 254230 - DNA, 75 bp, Artificial Sequence
  Synthetic
agataagatctcatcattgcattcacaacattgaaaggtacctcaattaacttgtgaatgtgccacgacagcaaa

SEQ ID NO: 254231 - DNA, 75 bp, Artificial Sequence
  Synthetic
tgtctaatttttgcaactgatgacgtcttcattgagtttaccaatgccaaggaaatgcttgagagcctttctaga

SEQ ID NO: 254232 - DNA, 75 bp, Artificial Sequence
  Synthetic
gtggacacgtaatccttactttttatgtcctctatatcatctcctgtctcccatcgcaaattttgaagaaacacc

SEQ ID NO: 254233 - DNA, 75 bp, Artificial Sequence
  Synthetic
tcctcagatgaatcagggttcggatccttgagaggataaggaaactccctaccctccattttttcataactcatt

SEQ ID NO: 254234 - DNA, 75 bp, Artificial Sequence
  Synthetic
aggaaaagaaaaggggacatcataggcccccacttgctgtgatcgaggctataagagacctgacctagtgaaaca

SEQ ID NO: 254235 - DNA, 75 bp, Artificial Sequence
  Synthetic
gtgggttggaccccctccctctccattgacaatagttccttgaaactaacttgcttaagtatgtcctcttttatc

SEQ ID NO: 254236 - DNA, 75 bp, Artificial Sequence
  Synthetic
ttcaatttcatggctagaatggcattgtggaattccttttcattattaagacagctccctctatattgcttagtt

SEQ ID NO: 254237 - DNA, 75 bp, Artificial Sequence
  Synthetic
acataatctttgaagcaaaggttgacagaggatagcacttctttcgcctttgtgaacagatggcttatcacttca

SEQ ID NO: 254238 - DNA, 75 bp, Artificial Sequence
  Synthetic
agtgcctcaaaataatcctcaattaggcgtgtgaacatttttgtcctcaggtcacctatataaagttccctgttc

SEQ ID NO: 254239 - DNA, 75 bp, Artificial Sequence
  Synthetic
aaaaacatgaaattgggatccagatgtgaactctgtttgttcctcccaagtgcgttagctaatcttctatcaatc

SEQ ID NO: 254240 - DNA, 75 bp, Artificial Sequence
  Synthetic
cctccaacttgttctttgtaagataaggaaaacttgagccttccagtatcaggacccaaggatgtgtatgactgt

SEQ ID NO: 254241 - DNA, 75 bp, Artificial Sequence
  Synthetic
cactttttaagctccttttgcgtctcttgcagagataccaatctatcattcacacttaagaatgaagagcctagc

SEQ ID NO: 254242 - DNA, 75 bp, Artificial Sequence
  Synthetic
ggggattcttgactgtaaaaacataggttctttagaactgcagttgtacaatttgtcaatgacagtgctttacct

SEQ ID NO: 254243 - DNA, 75 bp, Artificial Sequence
  Synthetic
cattctgattctagtaaactcccatagcagtgcaggtcttctagatgacccagaagaatcactgcatcaaaggtt

SEQ ID NO: 254244 - DNA, 75 bp, Artificial Sequence
  Synthetic
aatgcctcagaattgctctctctttcactgatcctaacatcattcatcagcctttctctatcaatcttgaagttt

SEQ ID NO: 254245 - DNA, 75 bp, Artificial Sequence
  Synthetic
agcatcaactttctccttgtgttcaacagctttaatgatttaattttatttaagagtgacttccatccaggcacg

SEQ ID NO: 254246 - DNA, 75 bp, Artificial Sequence
  Synthetic
aagcatttgtttttgtaatggctgtattttccagccaatttccctgcattcatctgaagaagtagtgacttgaag

SEQ ID NO: 254247 - DNA, 75 bp, Artificial Sequence
  Synthetic
caactatggaaatgttccttagccactctttgtctataactactgtaatccccgtataagcttgtaactattggt

SEQ ID NO: 254248 - DNA, 75 bp, Artificial Sequence
  Synthetic
cactgaaaaaactgctggtcattgaatgttctggtggagacagcttgggtgatgcatgttattgggcaagagtcc

SEQ ID NO: 254249 - DNA, 75 bp, Artificial Sequence
  Synthetic
gatgaagaaacaaaccttctcttcaatgtgtccagttctataggctcatcaccttctctgtcaaaataaagactg

SEQ ID NO: 254250 - DNA, 75 bp, Artificial Sequence
  Synthetic
aaggaatccaaatagaaatactttgaccttaactccaaatccttaaaaaagcctttgcagatcatctcataagca

SEQ ID NO: 254251 - DNA, 75 bp, Artificial Sequence
  Synthetic
gaaaaatccttcagaagctgctctctatctgtcttgacaaattgcttctcaacctccccctctctgagcttgttt

SEQ ID NO: 254252 - DNA, 75 bp, Artificial Sequence
  Synthetic
tctccaggtagtagtgactcatcaaaatcttccaccatgtggtgtgctatctctgcctggatcagtctgtagtaa

SEQ ID NO: 254253 - DNA, 75 bp, Artificial Sequence
  Synthetic
ctgaatgcctggaattctgtgatgacctccttcttcacatcaagaattgacatcttgttattaattcccctatag

SEQ ID NO: 254254 - DNA, 75 bp, Artificial Sequence
  Synthetic
acacagcccacatcttcagtacctaaaaccttcctcaagtctgtcaaggacttctcctctgacccatttcccaca

SEQ ID NO: 254255 - DNA, 75 bp, Artificial Sequence
  Synthetic
caagattctagcaatttctcatagtggtctgacctagaatccgtcagaatgttgagattctcaacacctaatgtt

SEQ ID NO: 254256 - DNA, 75 bp, Artificial Sequence
  Synthetic
gggaacttcctgtcatatctatacttctcaaggacgacatcaacagatttcttcacatcctctagacagtcaagt

SEQ ID NO: 254257 - DNA, 75 bp, Artificial Sequence
  Synthetic
ctcactcctgcctttgtcaaagactcgcagagtcttgagtactcagactcttcaaacatcttggatgattgttga

SEQ ID NO: 254258 - DNA, 75 bp, Artificial Sequence
  Synthetic
gcacaactatccaagaataactcatctaattcgtcaggagccccttgtgaattgggatttgaggaacctgacttc

SEQ ID NO: 254259 - DNA, 75 bp, Artificial Sequence
  Synthetic
gagtactcaagcaaggaaaatagtatattcctaaacctctcgttagcccactcagggaaaaggtcagtataaaaa

SEQ ID NO: 254260 - DNA, 75 bp, Artificial Sequence
  Synthetic
ttccccacaacaaggtcactaatggccttttgcaccttataatcataatcctccttactcaagaggtatttagtt

SEQ ID NO: 254261 - DNA, 75 bp, Artificial Sequence
  Synthetic
ttagtcctcccatccacaaggggcagtagaataacatcaatggacaaaagatctgatttaagggactctaactta

SEQ ID NO: 254262 - DNA, 75 bp, Artificial Sequence
  Synthetic
ttcctctggaatacctctgatagctggcaaacagaagcagccactagtttatcatgatcgtaattaagtatcctc

SEQ ID NO: 254263 - DNA, 75 bp, Artificial Sequence
  Synthetic
atcatatcttccttgtacttttgttcaaaattgacaggcgaagtcctaacgaaacactctagcaatattaaagtg

SEQ ID NO: 254264 - DNA, 75 bp, Artificial Sequence
  Synthetic
tctccgtcagtatacttattcacaaccacacttttgttgcttgcaaggtcaagagctgttgcacacccagcagta

SEQ ID NO: 254265 - DNA, 75 bp, Artificial Sequence
  Synthetic
ttcccattaaatttgaatccatcaggaaccacaaaaggcaagccagggcacaacactccttgcctttgtaacagg

SEQ ID NO: 254266 - DNA, 75 bp, Artificial Sequence
  Synthetic
actaatggatctttaaacccacttaggtcatctcctttcttgaaaagagagccattgttaaaagaagacgtcatc

SEQ ID NO: 254267 - DNA, 75 bp, Artificial Sequence
  Synthetic
atctcaacagagagatcttctgtgttgtgatcacagccatttgccttacaactgtctatttcaatacaaagagac

SEQ ID NO: 254268 - DNA, 75 bp, Artificial Sequence
  Synthetic
attgagaagaattttcttgacacaccaggaactttataagatattctgttgttactcatactggtttctttggat

SEQ ID NO: 254269 - DNA, 75 bp, Artificial Sequence
  Synthetic
agcagcttcagaccttccatcaagagcatccttggttctgtctgaattaggaatgccaacttctgtttggagagc

SEQ ID NO: 254270 - DNA, 75 bp, Artificial Sequence
  Synthetic
aaaaatttgtttgctgattcaagcagcagcatcctttcatcttcatccccctcttcagatgggttgatgttaata

SEQ ID NO: 254271 - DNA, 75 bp, Artificial Sequence
  Synthetic
ctcttatcttccaaaagatacttgctgataaggtctttgctctcagacagtaactcctccatcaattagaaatgt

SEQ ID NO: 254272 - DNA, 75 bp, Artificial Sequence
  Synthetic
ctgtcaaactccaacttgggctccaaatacttctcaaagcacttaatctgatctgtcaacctatctggagtttcc

SEQ ID NO: 254273 - DNA, 75 bp, Artificial Sequence
  Synthetic
cgcaccggggatcctaggcttttttgattgcgcaaatttcgagcacctcaaaaatgggacagatagtcaccttct

SEQ ID NO: 254274 - DNA, 75 bp, Artificial Sequence
  Synthetic
tcagacagtaactcctccatcaattagaaatgttctagtctttagacaaccaaaatgcctaggatcctcggtgcg

SEQ ID NO: 254275 - DNA, 75 bp, Artificial Sequence
  Synthetic
ttagttataaaatgacacatgtatgataggtttaacacaaacttaaatctattagtcaacatagtgctcacccct

SEQ ID NO: 254276 - DNA, 75 bp, Artificial Sequence
  Synthetic
tccaagaggtgccccatatcattgaggaggtgatgaacattgttttgatcaccctctcaatcctagccattctga

SEQ ID NO: 254277 - DNA, 75 bp, Artificial Sequence
  Synthetic
tcacccaggatgatgttgagaatgctcctcaccacactatacaagaggtgctccggctctgttatgagatcctcc

SEQ ID NO: 254278 - DNA, 75 bp, Artificial Sequence
  Synthetic
aaggcatttataatgtgatgacatgtggaataattgggttggttacattcttgctcttgtgtggaaaatcctgtt

SEQ ID NO: 254279 - DNA, 75 bp, Artificial Sequence
  Synthetic
ctcaacttttccattaactgcttatggtggaagtctgaaacaaaggccattatgaagtatcgcagaccttgcaag

SEQ ID NO: 254280 - DNA, 75 bp, Artificial Sequence
  Synthetic
caagtatctacaaggataactaccagttcctttctctagaccttgacatgtcatcgctgaacgccacaatgcctc

SEQ ID NO: 254281 - DNA, 75 bp, Artificial Sequence
  Synthetic
aacttctgtgctcttttgctagggttcacaagtatgaggatcatggtgattttgagcaataattttaaagttttt

SEQ ID NO: 254282 - DNA, 75 bp, Artificial Sequence
  Synthetic
tctcatgttcaaaaaacaactctcaccactacattcaagtgggcaatgaaactggtctagagttgaccttgacaa

SEQ ID NO: 254283 - DNA, 75 bp, Artificial Sequence
  Synthetic
tgttgatctctgagttctatacattcagacaaccaactcatcatggtgttgatagtctcatagataacacagtgt

SEQ ID NO: 254284 - DNA, 75 bp, Artificial Sequence
  Synthetic
acacctctataattgaccacaaattctgcaacttgagtgatgctcataggaagaacctctatgataaagcattga

SEQ ID NO: 254285 - DNA, 75 bp, Artificial Sequence
  Synthetic
gagaaaattgcaggaaaaaacctttttggatctgcatagaatgaacaaatctcccccttctcaggattgttaatg

SEQ ID NO: 254286 - DNA, 75 bp, Artificial Sequence
  Synthetic
tgtccattctcacaacattccacttgagcatccctgacttcaatcaatacgaaaagatgtcctgtgatttcaatg

SEQ ID NO: 254287 - DNA, 75 bp, Artificial Sequence
  Synthetic
gcataacattttgagcactctcctgttttctgataaattaagttgaaattcccgcttcccatgataaagctttga

SEQ ID NO: 254288 - DNA, 75 bp, Artificial Sequence
  Synthetic
gcggcaaaatatcagttcaatacaatctttcacacagcgactatcttgacgcgagcaatcattgcggcaccattg

SEQ ID NO: 254289 - DNA, 75 bp, Artificial Sequence
  Synthetic
ttaaaagcttccttacaacgtacacgtttgtaccttgcagcaccatactcattttgcctcactttggctactgat

SEQ ID NO: 254290 - DNA, 75 bp, Artificial Sequence
  Synthetic
ctaatggcattatggatgtgtttagaagaatgtattggagcacttctctatcagtcgcctctgatataagtggga

SEQ ID NO: 254291 - DNA, 75 bp, Artificial Sequence
  Synthetic
gatgtcttcattgaattcaccaatgccaaagagatgctagatagtcttctcaggtcttctatggaatcagcttcc

SEQ ID NO: 254292 - DNA, 75 bp, Artificial Sequence
  Synthetic
ctaactgcattcagaccaactatcagtacttgatcatacagaacaccacatgggaggaccactgtgtgttctcga

SEQ ID NO: 254293 - DNA, 75 bp, Artificial Sequence
  Synthetic
aactcaataagagggtaggggaattgattcccctcttctttctcatagctcattgttggctgaatccctcttttc

SEQ ID NO: 254294 - DNA, 75 bp, Artificial Sequence
  Synthetic
ggccatcacccatgggctttttgagccttttgtcacagagaactaggagctcttacatctcaagaagactattgg

SEQ ID NO: 254295 - DNA, 75 bp, Artificial Sequence
  Synthetic
tccattaacataagcctctcgtaactgtcctcctccagtatatcttcctctttaacataatctctaaagcacaaa

SEQ ID NO: 254296 - DNA, 75 bp, Artificial Sequence
  Synthetic
gccttttcacatggaccttaagtgattctgaagggaatgacatgccaggtggttattgcctcacaaggtccatgt

SEQ ID NO: 254297 - DNA, 75 bp, Artificial Sequence
  Synthetic
ctggcagaggataatgcctctttggcctttgtgaggagtttgtttatgatgtcaaagaatataagctcagatctc

SEQ ID NO: 254298 - DNA, 75 bp, Artificial Sequence
  Synthetic
tgattgggatggacttgaaatgttttggaaacactgctattgcaaagtgtaatcaaaaacatgatgaagaatttt

SEQ ID NO: 254299 - DNA, 75 bp, Artificial Sequence
  Synthetic
tgacacagagttcctacacctcccttcttcttcattgcactcaccattctcctttcaatccactttttaaggtcc

SEQ ID NO: 254300 - DNA, 75 bp, Artificial Sequence
  Synthetic
gtgacatgctcagactctttgacttcaacaaacaagcaataagcaggttacgctctgaagtccagcaaagtgtca

SEQ ID NO: 254301 - DNA, 75 bp, Artificial Sequence
  Synthetic
ttttgtgtttcttgtagtgacaccaatctgtcgttcacacttaagaatgaggagccaagccattctgatcctaac

SEQ ID NO: 254302 - DNA, 75 bp, Artificial Sequence
  Synthetic
acttgatcaataaagcaatgaactcacttattaatgatcagctggtgatgagaaaccacctaagggatttgatgg

SEQ ID NO: 254303 - DNA, 75 bp, Artificial Sequence
  Synthetic
agctcgccgtgacatttaagatcctttaagtgggccaaaaggatgattgcgtcaaaagtcagcattagttttctt

SEQ ID NO: 254304 - DNA, 75 bp, Artificial Sequence
  Synthetic
gtattccttactgtaactattctaagttctggtatttaaatgacaccagaacaggcttgacatccctcccgaaat

SEQ ID NO: 254305 - DNA, 75 bp, Artificial Sequence
  Synthetic
ctggtgttcaataactttagtgattttattttattcaacagtgacttccatccaggcacagagctttggaagtga

SEQ ID NO: 254306 - DNA, 75 bp, Artificial Sequence
  Synthetic
gctggcttgtcaccaatggatcatatttgaatgagactcagttttccacagacattgagcaggaggccaacaaca

SEQ ID NO: 254307 - DNA, 75 bp, Artificial Sequence
  Synthetic
ttctgcaagcagctgtctcgatcaactccctcttgcctataacggtcgtagtcaccatagagcgctgttaccata

SEQ ID NO: 254308 - DNA, 75 bp, Artificial Sequence
  Synthetic
tgctaaccgacatgctgcgaaaggaatatgcagagaggcagggcaagacacctctgggcttagtggacttgtttg

SEQ ID NO: 254309 - DNA, 75 bp, Artificial Sequence
  Synthetic
ggcgaggattttacaaacctctcttttagaggatcaatctctgagggtgtgtccccctctctgtcaatataaagg

SEQ ID NO: 254310 - DNA, 75 bp, Artificial Sequence
  Synthetic
ttttttcaaccagcttctatttgatatcagtgttcctacatttggtcagaattccaacacatagacacataaaag

SEQ ID NO: 254311 - DNA, 75 bp, Artificial Sequence
  Synthetic
ttgttgaaatctctcaagagctgtcgcctatctgtcctgacaaattgtctttctatctcaccctctttaagctta

SEQ ID NO: 254312 - DNA, 75 bp, Artificial Sequence
  Synthetic
gtaaaccttgccctaaaccccacaggattaaccacatggctgtgtgctcctgtggatattacaagcagccaggat

SEQ ID NO: 254313 - DNA, 75 bp, Artificial Sequence
  Synthetic
ttcctaaaagcatgaaattctgatacaatctcttttttcacatcaagaatggacattttgttattgatgcctctg

SEQ ID NO: 254314 - DNA, 75 bp, Artificial Sequence
  Synthetic
tgccaacacagtggaagagataggagggggtgccctccagaccctccaccagagggcccccgtgacccaccgcca

SEQ ID NO: 254315 - DNA, 75 bp, Artificial Sequence
  Synthetic
tggcagagctccaacaccctctcataatgatcagatcgagaatctgtcaaaacattgaggctctcaatgcccgat

SEQ ID NO: 254316 - DNA, 75 bp, Artificial Sequence
  Synthetic
ttggcggtgggtcacgggggcgtcccctctacaggacgagcttgggtgagcttgttctgaagaccaagtctttgc

SEQ ID NO: 254317 - DNA, 75 bp, Artificial Sequence
  Synthetic
gttctcactcctgcttttgttaaagattcacaaagccttgagtactcagattcttcaaacatttttgatgactgc

SEQ ID NO: 254318 - DNA, 75 bp, Artificial Sequence
  Synthetic
ttagcactggtctggggaccggcaattgtgggctccctatgactgctgcttcgaacatgagacagtctagtaagg

SEQ ID NO: 254319 - DNA, 75 bp, Artificial Sequence
  Synthetic
tgcgagaattcaagtaagctaaataggatatgcctaaacctctcattggcccattctggaaacaaatcagtgtag

SEQ ID NO: 254320 - DNA, 75 bp, Artificial Sequence
  Synthetic
cacaatgtggtgtcacttcctctttcccacctctctttttcttttgtgtcaccactccggtgtgcatcttgcaga

SEQ ID NO: 254321 - DNA, 75 bp, Artificial Sequence
  Synthetic
aaattggttctgccgtctatcaagggcaacagaatgatgtcaacagatgataagtcaggctttaaagactctagc

SEQ ID NO: 254322 - DNA, 75 bp, Artificial Sequence
  Synthetic
ggtgtttgtattcgtcccagatgttgtcttcaaatttccttgcatcttccttttgcattgagacgtcaatcaact

SEQ ID NO: 254323 - DNA, 75 bp, Artificial Sequence
  Synthetic
ttaatggtatcttctttatacttttgctcaaagtttattggtgaagtcctgacaaagcattccagtaatattaat

SEQ ID NO: 254324 - DNA, 75 bp, Artificial Sequence
  Synthetic
tgatgtctcttctgccctgggaatcaaggagcttcttgatgtcatctgcaccctggcatgtcaagaccatgttct

SEQ ID NO: 254325 - DNA, 75 bp, Artificial Sequence
  Synthetic
gtgttcccactgaatttgaatccatctggcaccacaaatggtagaccagggcacagaacaccttgtctctgcaga

SEQ ID NO: 254326 - DNA, 75 bp, Artificial Sequence
  Synthetic
ttggcaggctttcaattacagcgctcgtcagtcccggttgcacagagaacaggtcttggatgtcaatcccatgag

SEQ ID NO: 254327 - DNA, 75 bp, Artificial Sequence
  Synthetic
aggatttcaacagaaaggtcttctgagttgtgctcacaaccattggctttgcaactgtctatctcaatacagagt

SEQ ID NO: 254328 - DNA, 75 bp, Artificial Sequence
  Synthetic
aatgcttagcatcttgtttgaactgtttgatgtctgttggttctctataaaaatggatatattgtccattattgg

SEQ ID NO: 254329 - DNA, 75 bp, Artificial Sequence
  Synthetic
gacaacaacttaaggccctcaattaatagcattctcggctctgtctgaactaggaaggctagcttctgttttgaa

SEQ ID NO: 254330 - DNA, 75 bp, Artificial Sequence
  Synthetic
gctggtagatcgcaacttccacagggtcatcagctcttccctctatgtcaatccacgtctttgcgtttggatcca

SEQ ID NO: 254331 - DNA, 75 bp, Artificial Sequence
  Synthetic
agcctctcatcctctaagaggtacctgctcacaagatctttgctctcggacagcaactcctccatcaccacacac

SEQ ID NO: 254332 - DNA, 75 bp, Artificial Sequence
  Synthetic
actgtaacatacaatcttttagttccattgtttgagagtaagttagaccggccggcataccctgagcttgagcaa

SEQ ID NO: 254333 - DNA, 75 bp, Artificial Sequence
  Synthetic
tgctcacaagatctttgctctcggacagcaactcctccatcaccacacacttgttcctcagaagagagagtcaca

SEQ ID NO: 254334 - DNA, 75 bp, Artificial Sequence
  Synthetic
gtggatcctaggctttttggttgcgcatttctagagcatctcggagatggggcagatagtcaccttctttcaaga

SEQ ID NO: 254335 - DNA, 75 bp, Artificial Sequence
  Synthetic
gtctattggaatttcccttatcaggcttagtcacctgtggtgtctcaccacttaagtcgacagttgtgttgtccc

SEQ ID NO: 254336 - DNA, 75 bp, Artificial Sequence
  Synthetic
cggacagcaactcctccatcaccacacacttgttcctcagaagagagagtcacaatgcctaggatcctcggtgcg

SEQ ID NO: 254337 - DNA, 75 bp, Artificial Sequence
  Synthetic
atgctctgcctactattgaagttcttgatgcgatataaggccaaccttcaccagagaggcataacttgtaaagca

SEQ ID NO: 254338 - DNA, 75 bp, Artificial Sequence
  Synthetic
agttctcgtatgggtttctctcacctggagtgtcggatacaaacattcctaaggatcgctttacttttaaggcag

SEQ ID NO: 254339 - DNA, 75 bp, Artificial Sequence
  Synthetic
ccttaagaatcccttccatgttctttgtggtgaccctgatggtctccagcatatttcccccgtctatgaggcaag

SEQ ID NO: 254340 - DNA, 75 bp, Artificial Sequence
  Synthetic
ccccagccttcactgcagcagacaagctgaaattgtagcctgatatgtttatggcactcttcttgggctcaatca

SEQ ID NO: 254341 - DNA, 75 bp, Artificial Sequence
  Synthetic
cccccaagattgggtgagtctgagagagtttgtccaaatctgacatattggggaactttgctgtgtagacgagtc

SEQ ID NO: 254342 - DNA, 75 bp, Artificial Sequence
  Synthetic
ccaagtcagtcagtgactgaatgacgtcattcagatctgcctgaccctgtttgcacatacaagcaatcgttaggc

SEQ ID NO: 254343 - DNA, 75 bp, Artificial Sequence
  Synthetic
tcggcatggtaccaaattggttgtttaagagctcagggttccgaacatcccagacccttatgatgccatcctttg

SEQ ID NO: 254344 - DNA, 75 bp, Artificial Sequence
  Synthetic
tggtgtttcccatccggagtccaccacccatgcccaccatctggagcaatactcttctttgttccagttgctgac

SEQ ID NO: 254345 - DNA, 75 bp, Artificial Sequence
  Synthetic
tagttaggttgcccatatagactcctgaagcaagtggtctctcacttctaataacctttgctttgagtctgtcca

SEQ ID NO: 254346 - DNA, 75 bp, Artificial Sequence
  Synthetic
ggtcggcagcaagaactaaaagatcatctgaagttaacatccccaccctcaagacattcctttgctgagttgact

SEQ ID NO: 254347 - DNA, 75 bp, Artificial Sequence
  Synthetic
tcaattcgaccagattgttgactgcctggttcaagtctctcaggcgctttaggtcggagtcatccctcttttcct

SEQ ID NO: 254348 - DNA, 75 bp, Artificial Sequence
  Synthetic
tccgcattagtctctgaacattggcgacctcagaaaagtctaatccatgaagaagtgcctgagcatccttgatga

SEQ ID NO: 254349 - DNA, 75 bp, Artificial Sequence
  Synthetic
cttggaccttaacattagagcagaagccggatagctctctccttaggtgttgtgtccatagaaaggatttcactt

SEQ ID NO: 254350 - DNA, 75 bp, Artificial Sequence
  Synthetic
cctttgaattggacattgttggaaagtctcttgcacagaaaatttcctattagcgcaatcgattagcctaggatc

SEQ ID NO: 254351 - DNA, 75 bp, Artificial Sequence
  Synthetic
tggacattgttggaaagtctcttgcacagaaaatttcctattagcgcaatcgattagcctaggatccccggtgcg

SEQ ID NO: 254352 - DNA, 75 bp, Artificial Sequence
  Synthetic
cgcacagtggatcctaggcaattttgtggatctttgctgatacttcattctgcactcaaagccgcatccggcaag

SEQ ID NO: 254353 - DNA, 75 bp, Artificial Sequence
  Synthetic
acaatggaaaaggtgaagaacaggggcacccccgagacccaccgccttcggcggtgggtctcgggggcctggagt

SEQ ID NO: 254354 - DNA, 75 bp, Artificial Sequence
  Synthetic
gactgttccttgatggcctccacgacccaccgccagaggcggtgggtcgtggaggtgtcccttcttacaggacaa

SEQ ID NO: 254355 - DNA, 75 bp, Artificial Sequence
  Synthetic
cggacagcaactcctccatcaccacacacttgttcctcagaagagagagtcacaatgcctaggatccactgtgcg

SEQ ID NO: 254356 - DNA, 75 bp, Artificial Sequence
  Synthetic
ggaggtgtcccttcttacaggacaactctgggaggacctgttctaaacaccaggtctctactcaagactggtctg

SEQ ID NO: 254357 - DNA, 75 bp, Artificial Sequence
  Synthetic
cgcccttgtggatcctaggctttttggttgcgcatttctagagcatctcggagatggggcagatagtcaccttct

SEQ ID NO: 254358 - DNA, 75 bp, Artificial Sequence
  Synthetic
tggtctgggggttggaatttgtggactccctatgactgctgcttcaaacatgagacaatccagcaatgcacagtg

SEQ ID NO: 254359 - DNA, 75 bp, Artificial Sequence; identical to SEQ ID NO: 254141
  Synthetic

SEQ ID NO: 254360 - DNA, 75 bp, Artificial Sequence; identical to SEQ ID NO: 219093
  Synthetic

SEQ ID NO: 254361 - DNA, 75 bp, Artificial Sequence; identical to SEQ ID NO: 254142
  Synthetic

SEQ ID NO: 254362 - DNA, 75 bp, Artificial Sequence; identical to SEQ ID NO: 254144
  Synthetic

SEQ ID NO: 254363 - DNA, 75 bp, Artificial Sequence; identical to SEQ ID NO: 254146
  Synthetic

SEQ ID NO: 254364 - DNA, 75 bp, Artificial Sequence; identical to SEQ ID NO: 254148
  Synthetic

SEQ ID NO: 254365 - DNA, 75 bp, Artificial Sequence
  Synthetic
gatgcgcgagctgttctcggagcacctactcaatgtcgaggggaggccccacctcttcaaagaggggcctgcaca

SEQ ID NO: 254366 - DNA, 75 bp, Artificial Sequence
  Synthetic
ctactcaatgtcgaggggaggccccacctcttcaaagaggggcctgcacagcctccctcttaatctaaacttccc

SEQ ID NO: 254367 - DNA, 75 bp, Artificial Sequence
  Synthetic
ctctgaagactggatcatcagtgaagcctgcgatctactgtagcagagactatagcctttaaaatctgcccagaa

SEQ ID NO: 254368 - DNA, 75 bp, Artificial Sequence
  Synthetic
aagcctctcatcctctaagaggtacctgctcacaagatctttgctctcggacagcaactcctccatcaaacacac

SEQ ID NO: 254369 - DNA, 75 bp, Artificial Sequence
  Synthetic
cacacaacaaagaactgagactatctgccaaaatgacaaaagcaaagcgcaatccaatagcctaggatccactgt

SEQ ID NO: 254370 - DNA, 75 bp, Artificial Sequence
  Synthetic
gtcaattccggagaacactctagtaaggaagttttcgtagccttcaggcatgcatcgtcccacaacccctataat

SEQ ID NO: 254371 - DNA, 75 bp, Artificial Sequence
  Synthetic
accaccagaaatcccaccatcccaaaatcccccaccctacagcccctgaggcagaactccgccccgaagccccat

SEQ ID NO: 254372 - DNA, 75 bp, Artificial Sequence; identical to SEQ ID NO: 221094
  Synthetic

SEQ ID NO: 254373 - DNA, 75 bp, Artificial Sequence; identical to SEQ ID NO: 219120
  Synthetic

SEQ ID NO: 254374 - DNA, 75 bp, Artificial Sequence
  Synthetic
gaccggggatcctaggcatttttggttgcgcaattcaagtgtcctatttaaaatgggacaaatagtgacattctt

SEQ ID NO: 254375 - DNA, 75 bp, Artificial Sequence
  Synthetic
ggggggagatgcgcgagctgttctcggagcacctactcaatgtcgaggggaggccccacctcttcaaagaggggc

SEQ ID NO: 254376 - DNA, 75 bp, Artificial Sequence
  Synthetic
ggaatgattctccattagctcaccaataaaaacattaagatcctggtcatggatgttggggttgaagggcaggag

SEQ ID NO: 254377 - DNA, 75 bp, Artificial Sequence
  Synthetic
gaggtacctgctcacaagatctttgctctcggacagcaactcctccatcaccacacaccttgttcctcagaagag

SEQ ID NO: 254378 - DNA, 75 bp, Artificial Sequence; identical to SEQ ID NO: 219126
  Synthetic

SEQ ID NO: 254379 - DNA, 75 bp, Artificial Sequence
  Synthetic
gaaatcatgttcctccaggtccaggatctcctcattcaataagacggacaagggtatcacatcaggaatggggga

SEQ ID NO: 254380 - DNA, 75 bp, Artificial Sequence; identical to SEQ ID NO: 219132
  Synthetic

SEQ ID NO: 254381 - DNA, 75 bp, Artificial Sequence
  Synthetic
agatgtctgtgcaactctccagcaatctttaattgcggatctttgaacactaccactgtaagttacatcaaggga

SEQ ID NO: 254382 - DNA, 75 bp, Artificial Sequence; identical to SEQ ID NO: 219138
  Synthetic

SEQ ID NO: 254383 - DNA, 75 bp, Artificial Sequence
  Synthetic
ttcaccctgacttctcacctgaaaatttactgtgacagaaatttgaacgctcccaacactgaggtcggcaaaagc

SEQ ID NO: 254384 - DNA, 75 bp, Artificial Sequence
  Synthetic
ttgttcctgtggactctacaaacagcctggtgtgcctgtgaaatggaagagatgagacccttgtcagggcccccg

SEQ ID NO: 254385 - DNA, 75 bp, Artificial Sequence; identical to SEQ ID NO: 219144
  Synthetic

SEQ ID NO: 254386 - DNA, 75 bp, Artificial Sequence
  Synthetic
aattgctggtgcacattcaaaatccagccaagcataacctgagtaaagatcatgcctgtacatgggtctttcaac

SEQ ID NO: 254387 - DNA, 75 bp, Artificial Sequence; identical to SEQ ID NO: 219151
  Synthetic

SEQ ID NO: 254388 - DNA, 75 bp, Artificial Sequence
  Synthetic
agatctatgtggaaaccaagtaaaagaacctaaagtcctgcttgttgcaacgaatggtctgatgaaggactcaaa

SEQ ID NO: 254389 - DNA, 75 bp, Artificial Sequence; identical to SEQ ID NO: 219156
  Synthetic

SEQ ID NO: 254390 - DNA, 75 bp, Artificial Sequence
  Synthetic
cctctcatgtgctattgctaaatctgaagacagaaccacataatgctcttctctcttccacttgacaacatgaga

SEQ ID NO: 254391 - DNA, 75 bp, Artificial Sequence; identical to SEQ ID NO: 219162
  Synthetic

SEQ ID NO: 254392 - DNA, 75 bp, Artificial Sequence
  Synthetic
cattttcgttgatgctaggtcactcatgaagggcaagaggtgtctctcaaatagagatgggtaaagtcttctgaa

SEQ ID NO: 254393 - DNA, 75 bp, Artificial Sequence; identical to SEQ ID NO: 219168
  Synthetic

SEQ ID NO: 254394 - DNA, 75 bp, Artificial Sequence
  Synthetic
acatggcttgaagggaattgaggatgttttctccttcactttgggttcacccaacacccaggaacccagctcaag

SEQ ID NO: 254395 - DNA, 75 bp, Artificial Sequence; identical to SEQ ID NO: 219174
  Synthetic

SEQ ID NO: 254396 - DNA, 75 bp, Artificial Sequence
  Synthetic
tgtgtgctccttacccaagatccaaagatcgacgcccttaactttcaagctggaaacagaatccaatgctgacag

SEQ ID NO: 254397 - DNA, 75 bp, Artificial Sequence; identical to SEQ ID NO: 219180
  Synthetic

SEQ ID NO: 254398 - DNA, 75 bp, Artificial Sequence
  Synthetic
aagacctatgaaacctgatgctatcccactctgaaaggcacttttgttgacggcttcacagagcaacttttgtgc

SEQ ID NO: 254399 - DNA, 75 bp, Artificial Sequence; identical to SEQ ID NO: 219186
  Synthetic

SEQ ID NO: 254400 - DNA, 75 bp, Artificial Sequence
  Synthetic
aacagcacctgtgtaaatgaccttctgtctcatgaccatctttaaagggtgatgagttgtcaaattaagccaaca

SEQ ID NO: 254401 - DNA, 75 bp, Artificial Sequence
  Synthetic
acacaacaaagaactgagactatctgccaaaatgacaaaagcaaagcgcaatcaaacactaggatccactgtgcg

SEQ ID NO: 254402 - DNA, 75 bp, Artificial Sequence
  Synthetic
acctgctcacaagatctttgctctcggacagcaactcctccatcaaacacaaattgttcctcagaagagagagtc

SEQ ID NO: 254403 - DNA, 75 bp, Artificial Sequence; identical to SEQ ID NO: 219192
  Synthetic

SEQ ID NO: 254404 - DNA, 75 bp, Artificial Sequence
  Synthetic
ggcgagctgttctcggagcacctactcaatgtcgaggggaggccccacctcttcaaagaggggcctgcacagcct

SEQ ID NO: 254405 - DNA, 75 bp, Artificial Sequence
  Synthetic
gtgttgtatgcacacaacaaagaactgagactatctgccaaaatgacaaaagcaaagcgcaatccaatagccgga

SEQ ID NO: 254406 - DNA, 75 bp, Artificial Sequence
  Synthetic
tcctgacaagtagatggctgtgaattcttcatgaagctctcctaatttcagcttattaaaaactgtccttaggac

SEQ ID NO: 254407 - DNA, 75 bp, Artificial Sequence; identical to SEQ ID NO: 218307
  Synthetic

SEQ ID NO: 254408 - DNA, 75 bp, Artificial Sequence
  Synthetic
tctcggacagcaactcctccatcaccacacacttgttcctcagaagagagagtcacaatgcctaggatcctcggt

SEQ ID NO: 254409 - DNA, 75 bp, Artificial Sequence; identical to SEQ ID NO: 219199
  Synthetic

SEQ ID NO: 254410 - DNA, 75 bp, Artificial Sequence
  Synthetic
ccaccagaaatcccaccatcccaaaatcccccaccctacagcccctgaggcagaactccgccccgaagccctccc

SEQ ID NO: 254411 - DNA, 75 bp, Artificial Sequence
  Synthetic
gcgatcggggatcctaggcatttttggttgcgcaattcaagtgtcctatttaaaatgggacaaatagtgacattc

SEQ ID NO: 254412 - DNA, 75 bp, Artificial Sequence
  Synthetic
aacccaatctttaacatcagaatccaaaaacaacaagaaaggatcaatgggatattgtgcatatctaagtagatt

SEQ ID NO: 254413 - DNA, 75 bp, Artificial Sequence
  Synthetic
gggggggaacgggggcgtccatttacagaacgactctaggtgtcgatgttctgaacaccatatctctgggcagca

SEQ ID NO: 254414 - DNA, 75 bp, Artificial Sequence
  Synthetic
ggggatcctaggcattttggttgcgcaattcaagtgtcctatttaaaatgggacaaatagtgacattcttccagg

SEQ ID NO: 254415 - DNA, 75 bp, Artificial Sequence; identical to SEQ ID NO: 219204
  Synthetic

SEQ ID NO: 254416 - DNA, 75 bp, Artificial Sequence
  Synthetic
actctacaaacagcctggtgtgcctgtgaaatggaagagatgagacccttgtcagggccccgtgacccaccgcct

SEQ ID NO: 254417 - DNA, 75 bp, Artificial Sequence
  Synthetic
aatagtttcagctaattgatgtggctccttacacttaacgttgtggagggcggcagccacgaatttcgttaacaa

SEQ ID NO: 254418 - DNA, 75 bp, Artificial Sequence
  Synthetic
tttgctctcggacagcaactcctccatcaccaacacacttgttcctcagaagagagagtcaaatgcctaggatcc

SEQ ID NO: 254419 - DNA, 75 bp, Artificial Sequence; identical to SEQ ID NO: 219210
  Synthetic

SEQ ID NO: 254420 - DNA, 75 bp, Artificial Sequence
  Synthetic
atcccaccatcccaaaatcccccaccctacagcccctgaggcagaactccgccccgaagcccctcccaaacaccc

SEQ ID NO: 254421 - DNA, 75 bp, Artificial Sequence
  Synthetic
gcaccggggatcctaggcatttttggttgcgcaattcaagtgtcctatttaaaatgggacaaatagtgacattct

SEQ ID NO: 254422 - DNA, 75 bp, Artificial Sequence
  Synthetic
gatgaatttattcaattgatcacttaggaaatagtgaaattctagaatggcttggaattcctcaggctcatttga

SEQ ID NO: 254423 - DNA, 75 bp, Artificial Sequence; identical to SEQ ID NO: 219216
  Synthetic

SEQ ID NO: 254424 - DNA, 75 bp, Artificial Sequence
  Synthetic
tgttgtgttgtatgcacacaacaaagaactgagactatctgccaaaatgacaaaagcaaagcgcaatccaaacac

SEQ ID NO: 254425 - DNA, 75 bp, Artificial Sequence
  Synthetic
aaatagacacttaatgcaataatttatgaatctctcactcactagaccgtagaagtcagaagcattgtgcaagat

SEQ ID NO: 254426 - DNA, 75 bp, Artificial Sequence; identical to SEQ ID NO: 219225
  Synthetic

SEQ ID NO: 254427 - DNA, 75 bp, Artificial Sequence
  Synthetic
ttctgttgacgtttggtggagtgattttttcaaacctaacctagacttaagataagatctcatcattgcattcac

SEQ ID NO: 254428 - DNA, 75 bp, Artificial Sequence
  Synthetic
gaaatcccaccatcccaaaatcccccaccctacagcccctgaggcagaactccgccccgaagcccactcaaacac

SEQ ID NO: 254429 - DNA, 75 bp, Artificial Sequence; identical to SEQ ID NO: 219228
  Synthetic

SEQ ID NO: 254430 - DNA, 75 bp, Artificial Sequence; identical to SEQ ID NO: 220486
  Synthetic

SEQ ID NO: 254431 - DNA, 75 bp, Artificial Sequence
  Synthetic
gtcctctatatcatctcctgtctcccatcgcaaattttgaagaaacaccaggaaaagaaaaggggacatcatagg

SEQ ID NO: 254432 - DNA, 75 bp, Artificial Sequence; identical to SEQ ID NO: 219234
  Synthetic

SEQ ID NO: 254433 - DNA, 75 bp, Artificial Sequence
  Synthetic
gtggaattccttctcattattaagacagctccctctatattgcttagttagtgcctcaaaataatcctcaattag

SEQ ID NO: 254434 - DNA, 75 bp, Artificial Sequence; identical to SEQ ID NO: 219456
  Synthetic

SEQ ID NO: 254435 - DNA, 75 bp, Artificial Sequence
  Synthetic
aaaatcccccaccctacagcccctgaggcagaactccgccccgaagccccttccaaacactccccaccactaccc

SEQ ID NO: 254436 - DNA, 75 bp, Artificial Sequence; identical to SEQ ID NO: 219240
  Synthetic

SEQ ID NO: 254437 - DNA, 75 bp, Artificial Sequence
  Synthetic
gggggagagatgcgcgagctgttctcggagcacctactcaatgtcgaggggaggccccacctcttcaaagagggg

SEQ ID NO: 254438 - DNA, 75 bp, Artificial Sequence
  Synthetic
ggaaaacttgagccttccagtatcaggacccaaggatgtgtatgactgtggggattcttgactgtaaaaacatag

SEQ ID NO: 254439 - DNA, 75 bp, Artificial Sequence; identical to SEQ ID NO: 219246
  Synthetic

SEQ ID NO: 254440 - DNA, 75 bp, Artificial Sequence
  Synthetic
actgatcctaacatcattcatcagcctttctctatcaatcttgaagtttaagcatttgtttttgtaatggctgta

SEQ ID NO: 254441 - DNA, 75 bp, Artificial Sequence
  Synthetic
tgcacacaacaaagaactgagactatctgccaaaatgacaaaagcaaagcgcaatcaaacactaggatccactgt

SEQ ID NO: 254442 - DNA, 75 bp, Artificial Sequence; identical to SEQ ID NO: 219252
  Synthetic

SEQ ID NO: 254443 - DNA, 75 bp, Artificial Sequence
  Synthetic
gtatgcacacaacaaagaactgagactatctgccaaaatgacaaaagcaaagcgcaatccaatagcctaggatcc

SEQ ID NO: 254444 - DNA, 75 bp, Artificial Sequence
  Synthetic
tgttctggtggagacagcttgggtgatgcatgttattgggcaagagtccaaggaatccaaatagaaatactttga

SEQ ID NO: 254445 - DNA, 75 bp, Artificial Sequence
  Synthetic
ttgtatgcacacaacaaagaactgagactatctgccaaaatgacaaaagcaaagcgcaatcaatagcccatgatc

SEQ ID NO: 254446 - DNA, 75 bp, Artificial Sequence
  Synthetic
aatcccaccatcccaaaatcccccaccctacagcccctgaggcagaactccgccccgaagccccacatcaaacac

SEQ ID NO: 254447 - DNA, 75 bp, Artificial Sequence; identical to SEQ ID NO: 219258
  Synthetic

SEQ ID NO: 254448 - DNA, 75 bp, Artificial Sequence
  Synthetic
atcttccaccatgtggtgtgctatctctgcctggatcagtctgtagtaaacacagcccacatcttcagtacctaa

SEQ ID NO: 254449 - DNA, 75 bp, Artificial Sequence; identical to SEQ ID NO: 219264
  Synthetic

SEQ ID NO: 254450 - DNA, 75 bp, Artificial Sequence
  Synthetic
ctcaaggacgacatcaacagatttcttcacatcctctagacagtcaagtgcacaactatccaagaataactcatc

SEQ ID NO: 254451 - DNA, 75 bp, Artificial Sequence
  Synthetic
gatctttgctctcggacagcaactcctccatcaaacacacttgttcctcagaagagagagtcacaatgcctagga

SEQ ID NO: 254452 - DNA, 75 bp, Artificial Sequence
  Synthetic
ccccgccggggctcccccggggggagatgcgcgagctgttctcggagcacctactcaatgtcgaggggaggcccc

SEQ ID NO: 254453 - DNA, 75 bp, Artificial Sequence; identical to SEQ ID NO: 219270
  Synthetic

SEQ ID NO: 254454 - DNA, 75 bp, Artificial Sequence
  Synthetic
gttgtgtagcgaagaggtctgtgacatcaatcccatgtgagtacttagcatcctgcttgaactgcttttgcttta

SEQ ID NO: 254455 - DNA, 75 bp, Artificial Sequence
  Synthetic
atcaatcccatgtgagtacttagcatcctgcttgaactgcttttgctttaaatcagtaggttcacggaagaagtg

SEQ ID NO: 254456 - DNA, 75 bp, Artificial Sequence
  Synthetic
cttttgcaccttataatcataatcctccttactcaagaggtatttagttttcctctggaatacctctgatagctg

SEQ ID NO: 254457 - DNA, 75 bp, Artificial Sequence; identical to SEQ ID NO: 219277
  Synthetic

SEQ ID NO: 254458 - DNA, 75 bp, Artificial Sequence; identical to SEQ ID NO: 254331
  Synthetic

SEQ ID NO: 254459 - DNA, 75 bp, Artificial Sequence
  Synthetic
cggacagcaactcctccatcaccacacacttgttcctcagaagagagagtcacaatgcctaggatccccggtgcg

SEQ ID NO: 254460 - DNA, 75 bp, Artificial Sequence
  Synthetic
cacacttttgttgcttgcaaggtcaagagctgttgcacacccagcagtaactaatggatctttaaacccacttag

SEQ ID NO: 254461 - DNA, 75 bp, Artificial Sequence
  Synthetic
attctcgagaccatctcccatcggttatctcgggctcctctcacaaaggactagagatatttatattagtagaag

SEQ ID NO: 254462 - DNA, 75 bp, Artificial Sequence; identical to SEQ ID NO: 219282
  Synthetic

SEQ ID NO: 254463 - DNA, 75 bp, Artificial Sequence
  Synthetic
aggaactttataagatattctgttgttactcatactggtttctttggataaaaatttgtttgctgattcaagcag

SEQ ID NO: 254464 - DNA, 75 bp, Artificial Sequence; identical to SEQ ID NO: 219288
  Synthetic

SEQ ID NO: 254465 - DNA, 75 bp, Artificial Sequence
  Synthetic
atacttctcaaagcacttaatctgatctgtcaacctatctggagtttccttagttataaaatgacacatgtatga

SEQ ID NO: 254466 - DNA, 75 bp, Artificial Sequence; identical to SEQ ID NO: 219294
  Synthetic

SEQ ID NO: 254467 - DNA, 75 bp, Artificial Sequence
  Synthetic
cctcaccacactatacaagaggtgctccggctctgttatgagatcctccctcaacttttccattaactgcttatg

SEQ ID NO: 254468 - DNA, 75 bp, Artificial Sequence
  Synthetic
atcccaaaatcccccaccctacagcccctgaggcagaactccgccccgaagcccctctcaagcacccctcccctc

SEQ ID NO: 254469 - DNA, 75 bp, Artificial Sequence
  Synthetic
tctttgctctcggacagcaactcctccatcaccacacacttgttcctcagaagagagagtcacaatgcctggacc

SEQ ID NO: 254470 - DNA, 75 bp, Artificial Sequence; identical to SEQ ID NO: 219300
  Synthetic

SEQ ID NO: 254471 - DNA, 75 bp, Artificial Sequence
  Synthetic
ggggagatgcgcgagctgttctcggagcacctactcaatgtcgaggggaggccccacctcttcaaagaggggcct

SEQ ID NO: 254472 - DNA, 75 bp, Artificial Sequence
  Synthetic
cacaagtatgaggatcatggtgattttgagcaataattttaaagttttttgttgatctctgagttctatacattc

SEQ ID NO: 254473 - DNA, 75 bp, Artificial Sequence
  Synthetic
ccagattgttgtgttgtatgcacacaacaaagaactgagactatctgccaaaatgacaaaagcaaagcgcaatcc

SEQ ID NO: 254474 - DNA, 75 bp, Artificial Sequence
  Synthetic
ccggggatcctaggcatttttggttgcgcaattcaagtgtcctatttaaaatgggacaaatagtgacattcttcc

SEQ ID NO: 254475 - DNA, 75 bp, Artificial Sequence; identical to SEQ ID NO: 219306
  Synthetic

SEQ ID NO: 254476 - DNA, 75 bp, Artificial Sequence
  Synthetic
tggatctgcatagaatgaacaaatctcccccttctcaggattgttaatggcataacattttgagcactctcctgt

SEQ ID NO: 254477 - DNA, 75 bp, Artificial Sequence; identical to SEQ ID NO: 219313
  Synthetic

SEQ ID NO: 254478 - DNA, 75 bp, Artificial Sequence
  Synthetic
tttgtaccttgcagcaccatactcattttgcctcactttggctactgatgatgtcttcattgaattcaccaatgc

SEQ ID NO: 254479 - DNA, 75 bp, Artificial Sequence; identical to SEQ ID NO: 219318
  Synthetic

SEQ ID NO: 254480 - DNA, 75 bp, Artificial Sequence
  Synthetic
attcccctcttctttctcatagctcattgttggctgaatccctcttttctccattaacataagcctctcgtaact

SEQ ID NO: 254481 - DNA, 75 bp, Artificial Sequence; identical to SEQ ID NO: 221501
  Synthetic

SEQ ID NO: 254482 - DNA, 75 bp, Artificial Sequence; identical to SEQ ID NO: 219324
  Synthetic

SEQ ID NO: 254483 - DNA, 75 bp, Artificial Sequence
  Synthetic
cacaacaaagaactgagactatctgccaaaatgacaaaagcaaagcgcaatccaatagcctaggatccactgtgc

SEQ ID NO: 254484 - DNA, 75 bp, Artificial Sequence
  Synthetic
ctttgtgaggagtttgtttatgatgtcaaagaatataagctcagatctctgacacagagttcctacacctccctt

SEQ ID NO: 254485 - DNA, 75 bp, Artificial Sequence; identical to SEQ ID NO: 219330
  Synthetic

SEQ ID NO: 254486 - DNA, 75 bp, Artificial Sequence
  Synthetic
tgtgttgtatgcacacaacaaagaactgagactatctgccaaaatgacaaaagcaaagcgcaatccaatagccta

SEQ ID NO: 254487 - DNA, 75 bp, Artificial Sequence
  Synthetic
tctgtcgttcacacttaagaatgaggagccaagccattctgatcctaacagctcgccgtgacatttaagatcctt

SEQ ID NO: 254488 - DNA, 75 bp, Artificial Sequence
  Synthetic
ggtgggtcacgggggcgtccatttacagaacgactctaggtgtcgatgttctgaacaccatatctctgggcagca

SEQ ID NO: 254489 - DNA, 75 bp, Artificial Sequence; identical to SEQ ID NO: 219336
  Synthetic

SEQ ID NO: 254490 - DNA, 75 bp, Artificial Sequence
  Synthetic
tattttattcaacagtgacttccatccaggcacagagctttggaagtgattctgcaagcagctgtctcgatcaac

SEQ ID NO: 254491 - DNA, 75 bp, Artificial Sequence; identical to SEQ ID NO: 219341
  Synthetic

SEQ ID NO: 254492 - DNA, 75 bp, Artificial Sequence
  Synthetic
tctttgctctcggacagcaactcctccatcaaacacacttgttcctcagaagagagagtcaaatcgcctgggatc

SEQ ID NO: 254493 - DNA, 75 bp, Artificial Sequence
  Synthetic
aatcccaccatcccaaaatcccccaccctacagcccctgaggcagaactccgccccgaagcccctctcaaacaca

SEQ ID NO: 254494 - DNA, 75 bp, Artificial Sequence
  Synthetic
aatcccaccatcccaaaatcccccaccctacagcccctgaggcagaactccgccccgaagcccctctcaaacact

SEQ ID NO: 254495 - DNA, 75 bp, Artificial Sequence
  Synthetic
aatcccaccatcccaaaatcccccaccctacagcccctgaggcagaactccgccccgaagcccctctcaaacacc

SEQ ID NO: 254496 - DNA, 75 bp, Artificial Sequence
  Synthetic
aatcccaccatcccaaaatcccccaccctacagcccctgaggcagaactccgccccgaagcccctctcaaacacg

SEQ ID NO: 254497 - DNA, 75 bp, Artificial Sequence
  Synthetic
tagaggatcaatctctgagggtgtgtccccctctctgtcaatataaaggttgttgaaatctctcaagagctgtcg

SEQ ID NO: 254498 - DNA, 75 bp, Artificial Sequence
  Synthetic
gaccggggatcctaggcaattttgtggatctttgctgatacttcattctgcactcaaagccgcatccggcaagag

SEQ ID NO: 254499 - DNA, 75 bp, Artificial Sequence
  Synthetic
tcacaagatctttgctctcggacagcaactcctccatcaccaaacacgttcctcagaagagagagtcactgccta

SEQ ID NO: 254500 - DNA, 75 bp, Artificial Sequence; identical to SEQ ID NO: 219346
  Synthetic

SEQ ID NO: 254501 - DNA, 75 bp, Artificial Sequence
  Synthetic
aatctcttttttcacatcaagaatggacattttgttattgatgcctctgtggcagagctccaacaccctctcata

SEQ ID NO: 254502 - DNA, 75 bp, Artificial Sequence; identical to SEQ ID NO: 219351
  Synthetic

SEQ ID NO: 254503 - DNA, 75 bp, Artificial Sequence
  Synthetic
ttcacaaagccttgagtactcagattcttcaaacatttttgatgactgctgcgagaattcaagtaagctaaatag

SEQ ID NO: 254504 - DNA, 75 bp, Artificial Sequence
  Synthetic
gggttcacgggggcgtccatttacagaacgactctaggtgtcgatgttctgaacaccatatctctgggcagcact

SEQ ID NO: 254505 - DNA, 75 bp, Artificial Sequence; identical to SEQ ID NO: 219356
  Synthetic

SEQ ID NO: 254506 - DNA, 75 bp, Artificial Sequence
  Synthetic
caacagaatgatgtcaacagatgataagtcaggctttaaagactctagcttaatggtatcttctttatacttttg

SEQ ID NO: 254507 - DNA, 75 bp, Artificial Sequence; identical to SEQ ID NO: 219361
  Synthetic

SEQ ID NO: 254508 - DNA, 75 bp, Artificial Sequence
  Synthetic
tggcaccacaaatggtagaccagggcacagaacaccttgtctctgcagaaggatttcaacagaaaggtcttctga

SEQ ID NO: 254509 - DNA, 75 bp, Artificial Sequence
  Synthetic
gttgtgttcacaaccattggctttgcaactgtctatctcaatacagagtgacaacaacttaaggccctcaattaa

SEQ ID NO: 254510 - DNA, 75 bp, Artificial Sequence
  Synthetic
tagcattctcggctctgtctgaactaggaaggctagcttctgttttgaaagcctctcatcctctaagaggtacct

SEQ ID NO: 254511 - DNA, 75 bp, Artificial Sequence
  Synthetic
ttgctctcggacagcaactcctccatcacacacacttgctcctcagaagagagagtcacaatgcctaggaccctc

SEQ ID NO: 254512 - DNA, 75 bp, Artificial Sequence
  Synthetic
accagaaatcccaccatcccaaaatcccccaccctacagcccctgaggcagaactccgccccgaagcccctccca

SEQ ID NO: 254513 - DNA, 75 bp, Artificial Sequence
  Synthetic
gcgcaccggggatcctaggcatttttggttgcgcaattcaagtgtcctatttaaaatgggacaaatagtgacatt

SEQ ID NO: 254514 - DNA, 75 bp, Artificial Sequence
  Synthetic
tggttgcgcaattcaagtgtcctatttaaaatgggacaaatagtgacattcttccaggaagtgcctcatgtaata

SEQ ID NO: 254515 - DNA, 75 bp, Artificial Sequence
  Synthetic
gaagaggtgatgaacattgttctcattgcactgtctgtactagcagtgctgaaaggtctgtacaattttgcaacg

SEQ ID NO: 254516 - DNA, 75 bp, Artificial Sequence; identical to SEQ ID NO: 218980
  Synthetic

SEQ ID NO: 254517 - DNA, 75 bp, Artificial Sequence; identical to SEQ ID NO: 218983
  Synthetic

SEQ ID NO: 254518 - DNA, 75 bp, Artificial Sequence
  Synthetic
agtcatcattatataatggtgggcaatgagacaggactagaactgaccttgaccaacacgagcattattaatcac

SEQ ID NO: 254519 - DNA, 75 bp, Artificial Sequence
  Synthetic
aaattttgcaatctgtctgatgcccacaaaaagaacctctatgaccacgctcttatgagcataatctcaactttc

SEQ ID NO: 254520 - DNA, 75 bp, Artificial Sequence
  Synthetic
cacttgtccatccccaacttcaatcagtatgaggcaatgagctgcgattttaatgggggaaagattagtgtgcag

SEQ ID NO: 254521 - DNA, 75 bp, Artificial Sequence
  Synthetic
tacaacctgagtcacagctatgctggggatgcagccaaccattgtggtactgttgcaaatggtgtgttacagact

SEQ ID NO: 254522 - DNA, 75 bp, Artificial Sequence
  Synthetic
tttatgaggatggcttggggtgggagctacattgctcttgactcaggccgtggcaactgggactgtattatgact

SEQ ID NO: 254523 - DNA, 75 bp, Artificial Sequence
  Synthetic
agttatcaatatctgataatccaaaatacaacctgggaagatcactgccaattctcgagaccatctcccatcggt

SEQ ID NO: 254524 - DNA, 75 bp, Artificial Sequence
  Synthetic
attgctaggcacattcacatggacactgtcagattctgaaggtgaagacacaccagggggatattgtctgaccag

SEQ ID NO: 254525 - DNA, 75 bp, Artificial Sequence
  Synthetic
gtggatgctaattgaggctgaactaaaatgcttcgggaacacagctgtggcaaaatgtaatgagaagcatgatga

SEQ ID NO: 254526 - DNA, 75 bp, Artificial Sequence
  Synthetic
ggaattttgtgacatgctgaggctgtttgacttcaacaaacaagccattcaaaggttgaaagctgaagcacaaat

SEQ ID NO: 254527 - DNA, 75 bp, Artificial Sequence
  Synthetic
gagcattcagttgatcaacaaagcagtaaatgctttgataaatgaccaacttataatgaagaaccatctacggga

SEQ ID NO: 254528 - DNA, 75 bp, Artificial Sequence
  Synthetic
catcatgggaattccatactgtaattacagcaagtattggtacctcaaccacacaactactgggagaacatcact

SEQ ID NO: 254529 - DNA, 75 bp, Artificial Sequence
  Synthetic
gcccaaatgttggcttgtatcaaatggttcatacttgaacgagacccacttttctgatgatattgaacaacaagc

SEQ ID NO: 254530 - DNA, 75 bp, Artificial Sequence
  Synthetic
tgacaatatgatcactgagatgttacagaaggagtatatggagaggcaggggaagacaccattgggtctagttga

SEQ ID NO: 254531 - DNA, 75 bp, Artificial Sequence
  Synthetic
cctctttgtgttcagcacaagtttctatcttattagcatcttccttcacctagtcaaaataccaactcataggca

SEQ ID NO: 254532 - DNA, 75 bp, Artificial Sequence
  Synthetic
cgaccggggatcctaggcaattttgtggatctttgctgatacttcattctgcactcaaagccgcatccggcaaga

SEQ ID NO: 254533 - DNA, 75 bp, Artificial Sequence
  Synthetic
tattgtaggcaagtcgtgtcccaaacctcacagattgaatcatatgggcatttgttcctgtggactctacaaaca

SEQ ID NO: 254534 - DNA, 75 bp, Artificial Sequence
  Synthetic
tttgttcctgtggactctacaaacagcctggtgtgcctgtgaaatggaagagatgagacccttgtcagggccccc

SEQ ID NO: 254535 - DNA, 75 bp, Artificial Sequence
  Synthetic
gcctggtgtgcctgtgaaatggaagagatgagacccttgtcagggcccccgtgacccaccgcctattggcggtgg

SEQ ID NO: 254536 - DNA, 75 bp, Artificial Sequence
  Synthetic
gtcacgggggcgtccatttacagaacgactctaggtgtcgatgttctgaacaccatatctctgggcagcactgct

SEQ ID NO: 254537 - DNA, 75 bp, Artificial Sequence; identical to SEQ ID NO: 219031
  Synthetic

SEQ ID NO: 254538 - DNA, 75 bp, Artificial Sequence
  Synthetic
ctgacactgctgcatcaaacatgatgcagtccattagtgcacagtgaggggttatttcctctttaccgcctcttt

SEQ ID NO: 254539 - DNA, 75 bp, Artificial Sequence
  Synthetic
tcttcttttcaacaacgacacctgtgtgcatgtggcataagtctttatactggtcccagactgcattttcatact

SEQ ID NO: 254540 - DNA, 75 bp, Artificial Sequence
  Synthetic
tcctggaatcagttttactgaggtcaatatcaattagtttaatgtcttttcttccttgtgattcaaggagtttcc

SEQ ID NO: 254541 - DNA, 75 bp, Artificial Sequence
  Synthetic
ttatgtcatcggacccctgacaggtaatgaccatattccgggggagtgcatcaatgacagcactggtcaagcccg

SEQ ID NO: 254542 - DNA, 75 bp, Artificial Sequence
  Synthetic
gttgtgtagcgaagaggtctgtgacatcaatcccatgtgagtacttagcatcctgcttgaactgctttaaatcag

SEQ ID NO: 254543 - DNA, 75 bp, Artificial Sequence
  Synthetic
taggttcacggaagaagtgtatgtagcagcctgaacttggttgatagagggcaatttccactggatcttcaggtc

SEQ ID NO: 254544 - DNA, 75 bp, Artificial Sequence
  Synthetic
ttccttcaatgtccatccaggtcttagcatttgggtcaagttgcagcattgcatccttgagggtcatcagctgag

SEQ ID NO: 254545 - DNA, 75 bp, Artificial Sequence
  Synthetic
aataggtaagcccagcggtaaaccctgccgactgcagggatttactggaattgttgctgtcagctttctgtggct

SEQ ID NO: 254546 - DNA, 75 bp, Artificial Sequence
  Synthetic
tcccatctgattccagatcaacgacagtgttttcccaggcccttcctgttattgaggttcttgatgcaatatatg

SEQ ID NO: 254547 - DNA, 75 bp, Artificial Sequence
  Synthetic
gccatccatctcctgacaaacaaatcttgtagagtatgttttcataaggattcctttcaccaggggtgtctgaaa

SEQ ID NO: 254548 - DNA, 75 bp, Artificial Sequence
  Synthetic
tgaacattccaagagccttcttgacctttaaaatggatttgaggataccatccattgtctgaggtgacaccttga

SEQ ID NO: 254549 - DNA, 75 bp, Artificial Sequence
  Synthetic
ttgtctccaacatattgccaccatccagcatgcaagctcctgccttcacagctgcacccaagctaaaattataac

SEQ ID NO: 254550 - DNA, 75 bp, Artificial Sequence
  Synthetic
ctgagatattcaaagagcttttcttggtgtcaatcatatttaggatgggatgactttgagccagcctgtctaagt

SEQ ID NO: 254551 - DNA, 75 bp, Artificial Sequence
  Synthetic
ctgaagtgttgggatactttgctgtgtagatcaaacccaaatctgtcaatgcttgtactgcatcattcaagtcaa

SEQ ID NO: 254552 - DNA, 75 bp, Artificial Sequence
  Synthetic
cctgcccctgttttgtcagacatgccagtgtcagacttggcatggtcccgaactgattactgagcaactctgcat

SEQ ID NO: 254553 - DNA, 75 bp, Artificial Sequence; identical to SEQ ID NO: 218736
  Synthetic

SEQ ID NO: 254554 - DNA, 75 bp, Artificial Sequence
  Synthetic
tattcaggagagctcttctttggtcaagttgctgtgagcttaggttgcccatatagacacctgcacttaatggcc

SEQ ID NO: 254555 - DNA, 75 bp, Artificial Sequence
  Synthetic
tttctgttctgatcacctttgactttaacttctctagatcagcggctaagattaataagtcatctgaggttagag

SEQ ID NO: 254556 - DNA, 75 bp, Artificial Sequence
  Synthetic
tcccaactctcagtatactcttttgttgagttgattttaattcaacaagattgttgaccgcttgatttaggtccc

SEQ ID NO: 254557 - DNA, 75 bp, Artificial Sequence
  Synthetic
tcaaccgtttcaaatcattgtcatctcttctctccttgcgcatcaaccgttgaacattactgacttcggagaagt

SEQ ID NO: 254558 - DNA, 75 bp, Artificial Sequence
  Synthetic
caagtccatgtaaaagagcctgggcatctttcaccacctgtagtttgatgttggagcagtaaccagataattccc

SEQ ID NO: 254559 - DNA, 75 bp, Artificial Sequence
  Synthetic
tcctcaaagattgtgtccacaaaaaggattttatttcctttgaggcactcatcgccagattgttgtgttgtatgc

SEQ ID NO: 254560 - DNA, 75 bp, Artificial Sequence
  Synthetic
acaacaaagaactgagactatctgccaaaatgacaaaagcaaagcgcaatccaatagcctaggatccactgtgcg

SEQ ID NO: 254561 - DNA, 75 bp, Artificial Sequence
  Synthetic
aaatcccaccatcccaaaatcccccaccctacagcccctgaggcagaactccgccccgaagcccctcccaaacac

SEQ ID NO: 254562 - DNA, 75 bp, Artificial Sequence; identical to SEQ ID NO: 254150
  Synthetic

SEQ ID NO: 254563 - DNA, 75 bp, Artificial Sequence; identical to SEQ ID NO: 254152
  Synthetic

SEQ ID NO: 254564 - DNA, 75 bp, Artificial Sequence
  Synthetic
aaggctagcttctgttttgaaagcctctcatcctctaagaggtacctgctcacaagatctttgctctcggacagc

SEQ ID NO: 254565 - DNA, 75 bp, Artificial Sequence
  Synthetic
tctcggacagcaactcctccatcaccacacacttgttcctcagaagagagagtcacaatgcctaggatcctcgtc

SEQ ID NO: 254566 - DNA, 75 bp, Artificial Sequence
  Synthetic
cccaccatcccaaaatcccccaccctacagcccctgaggcagaactccgccccgaagcccctcaaactacccctc

SEQ ID NO: 254567 - DNA, 75 bp, Artificial Sequence
  Synthetic
ggagggcgcgagctgttctcggagcacctactcaatgtcgaggggaggccccacctcttcaaagaggggcctgca

SEQ ID NO: 254568 - DNA, 75 bp, Artificial Sequence
  Synthetic
tgttgtgttgtatgcacacaacaaagaactgagactatctgccaaaatgacaaaagcaaagcgcaatcaaagcct

SEQ ID NO: 254569 - DNA, 75 bp, Artificial Sequence
  Synthetic
aatcccaccatcccaaaatcccccaccctacagcccctgaggcagaactccgccccgaagcccctcaaacacccc

SEQ ID NO: 254570 - DNA, 75 bp, Artificial Sequence
  Synthetic
ctttgctctcggacagcaactcctccatcaaacacacttgttcctcagaagagagagtcacaatgcctaggatcc

SEQ ID NO: 254571 - DNA, 75 bp, Artificial Sequence
  Synthetic
accatcccaaaatcccccaccctacagcccctgaggcagaactccgccccgaagcccctcaaacacccccaccct

SEQ ID NO: 254572 - DNA, 75 bp, Artificial Sequence
  Synthetic
gagatgcgcgagctgttctcggagcacctactcaatgtcgaggggaggccccacctcttcaaagaggggcctgca

SEQ ID NO: 254573 - DNA, 75 bp, Artificial Sequence
  Synthetic
gctctcggacagcaactcctccatcaaacacacttgttcctcagaagagagagtcacaatgcctaggacctcggt

SEQ ID NO: 254574 - DNA, 75 bp, Artificial Sequence; identical to SEQ ID NO: 220826
  Synthetic

SEQ ID NO: 254575 - DNA, 75 bp, Artificial Sequence; identical to SEQ ID NO: 220822
  Synthetic

SEQ ID NO: 254576 - DNA, 75 bp, Artificial Sequence
  Synthetic
aagatctttgctctcggacagcaactcctccatcacacacagttacctaaactatagagagtcaaaatgcctagg

SEQ ID NO: 254577 - DNA, 75 bp, Artificial Sequence
  Synthetic
catcccaaaatcccccaccctacagcccctgaggcagaactccgccccgaagcccctcccaaacacccctcccgc

SEQ ID NO: 254578 - DNA, 75 bp, Artificial Sequence
  Synthetic
tcgccagattgttgtgttgtatgcacacaacaaagaactgagactatctgccaaatgacaaaagcaaagcgcaat

SEQ ID NO: 254579 - DNA, 75 bp, Artificial Sequence
  Synthetic
ggggatgcctaggatccccggttgcgcaattcaagtgtcctatttaaaatgggacaaatagtgacattcttccag

SEQ ID NO: 254580 - DNA, 75 bp, Artificial Sequence
  Synthetic
tcatcctctaagaggtacctgctcacaagatctttgctctcggacagcaactcctccatcaccacacacttcctc

SEQ ID NO: 254581 - DNA, 75 bp, Artificial Sequence; identical to SEQ ID NO: 221319
  Synthetic

SEQ ID NO: 254582 - DNA, 75 bp, Artificial Sequence
  Synthetic
ttctcggagcacctactcaatgtcgaggggaggccccacctcttcaaagaggggcctgcacagcctccctcttaa

SEQ ID NO: 254583 - DNA, 75 bp, Artificial Sequence
  Synthetic
cgcaccggggatcctaggcatttttggttgcgcaattcaagtgtcctatttaaaatgggacaaatagtgacattc

SEQ ID NO: 254584 - DNA, 75 bp, Artificial Sequence
  Synthetic
atttttggttgcgctttgctttgttcacaaattagtgatcaagaaatgggtcagattgtgaccttctttcaggaa

SEQ ID NO: 254585 - DNA, 75 bp, Artificial Sequence
  Synthetic
gtgccacatataatagaggaagtgatgaatatagtcctcataactctatcactcttggccattctaaaaggaatc

SEQ ID NO: 254586 - DNA, 75 bp, Artificial Sequence
  Synthetic
tacaacatcatgacctgcggcatcattggcctcctgacattcctctttttgtgtgggagatcctgctcaagcatc

SEQ ID NO: 254587 - DNA, 75 bp, Artificial Sequence
  Synthetic
tataaagacaattatcagtttctctcactggatctggatatgtcaggactcaatgcaacaatgcctctctcttgc

SEQ ID NO: 254588 - DNA, 75 bp, Artificial Sequence
  Synthetic
tcaaagaacaattcacaccactacatacaagtgaggaacgatacagggctagagttaactctcacaaacaccagc

SEQ ID NO: 254589 - DNA, 75 bp, Artificial Sequence
  Synthetic
ctcttggatcacaagttttgtaacctttcagatgctcacaagaggaacctctatgacaaggctttaatgtcaatc

SEQ ID NO: 254590 - DNA, 75 bp, Artificial Sequence
  Synthetic
gtaacaacattccacctcaatatccctaatttcaatcagtatgaggtcatgtcttgtgacttcaatggtgggaaa

SEQ ID NO: 254591 - DNA, 75 bp, Artificial Sequence
  Synthetic
atcactgtccagtacaacctatcgcactcatcctatgttgatgctgcaaaccactgtggaaccatcgccaatggt

SEQ ID NO: 254592 - DNA, 75 bp, Artificial Sequence
  Synthetic
atcatggatacctttaggaggatgtactggtccaatgcactgtcaccttctgaatacatctctggaacaacatgc

SEQ ID NO: 254593 - DNA, 75 bp, Artificial Sequence
  Synthetic
atccagacagcatatcagtacttgatcattcagaacacaacgtgggaggatcactgtgttttctccaggccatcc

SEQ ID NO: 254594 - DNA, 75 bp, Artificial Sequence
  Synthetic
cccatgggattccttagcctattatctcaacggacaaagaacttttacatatcaaggaggctgttgggcttgttc

SEQ ID NO: 254595 - DNA, 75 bp, Artificial Sequence
  Synthetic
acttggactctaagtgattctgaaggaaatgatatgcctggtggctactgtctgacaagatctatgctaataggg

SEQ ID NO: 254596 - DNA, 75 bp, Artificial Sequence
  Synthetic
atggacctgaagtgctttggcaacactgctgttgcgaagtgcaatcaacaacatgatgaagaattctgtgatatg

SEQ ID NO: 254597 - DNA, 75 bp, Artificial Sequence
  Synthetic
ctcagattatttgatttcaacaagcaagccatctcaaggcttaagtcagaagcacagcagagcctaaacctaata

SEQ ID NO: 254598 - DNA, 75 bp, Artificial Sequence
  Synthetic
acaaaggcagtgaactcattgatcaatgatcagctgataatgaaaaatcatcttagggatttgatggggattcct

SEQ ID NO: 254599 - DNA, 75 bp, Artificial Sequence
  Synthetic
tattgcaattatacaaaattttggtacttgaacgacacgaggtcaggcgccacttcgctgccaagatgttggttg

SEQ ID NO: 254600 - DNA, 75 bp, Artificial Sequence
  Synthetic
atttctaatgggtcttacttaaatgaaactcaatttagtagggacatagagcaggaggccaacaacatgctgaca

SEQ ID NO: 254601 - DNA, 75 bp, Artificial Sequence
  Synthetic
gatatgttaaggaaagaatatgagaaaaggcaaagcacaacaccacttggtttagtggacctctttgtcttctct

SEQ ID NO: 254602 - DNA, 75 bp, Artificial Sequence
  Synthetic
acaagcttctatcttataagtgtatttttgcacctcattaaaatcccaacacatcgacatataagaggcaagccc

SEQ ID NO: 254603 - DNA, 75 bp, Artificial Sequence
  Synthetic
tgccccaaaccacacaggattaatcacatggcaatctgctcatgtggcttttacaaacaacctggcatcccaact

SEQ ID NO: 254604 - DNA, 75 bp, Artificial Sequence
  Synthetic
caatggaagagatagtccgatggaccctccgagacgcaccgcccgaggcggtgcgtctcgggggcccgccggccc

SEQ ID NO: 254605 - DNA, 75 bp, Artificial Sequence
  Synthetic
ccgcagcccaccaccttgcggtggtgggctgcgggggtgtccatttacaggacaacctttggtgtgctcatccta

SEQ ID NO: 254606 - DNA, 75 bp, Artificial Sequence
  Synthetic
aagaccagatccttgctcagcactggccttggtgttgtcagcttcgaactccccacagtagcggcctcaaacatt

SEQ ID NO: 254607 - DNA, 75 bp, Artificial Sequence
  Synthetic
agacagtccatcaaggcacaatggggagtcacttcctccttgccacccctctttttcttctgagtgactatgcct

SEQ ID NO: 254608 - DNA, 75 bp, Artificial Sequence
  Synthetic
gtgtgcatagtgcagaggtgcttgtactcatcccagatgctgtcttcatatttccttgcctcttctttctgcata

SEQ ID NO: 254609 - DNA, 75 bp, Artificial Sequence
  Synthetic
gacacatcgatcaatttgatgtctcttctcccttgtgagtccaacagcttccttatgtcatcaacaccttggcag

SEQ ID NO: 254610 - DNA, 75 bp, Artificial Sequence
  Synthetic
gtgagcaccatgtttctaggtagcccctctataacagcacttgtcagccctggctgaacagagaacaagtcttgg

SEQ ID NO: 254611 - DNA, 75 bp, Artificial Sequence
  Synthetic
atgtcaatcccatgagaatgttttgcgtcctgcttgaattgcttgatgtcagtgggttctctataaaagtgaatg

SEQ ID NO: 254612 - DNA, 75 bp, Artificial Sequence
  Synthetic
tactgcccgttggatggctgatatatggccacttcaacagggtcctcagctctaccctctatatcgacccaggtt

SEQ ID NO: 254613 - DNA, 75 bp, Artificial Sequence
  Synthetic
ttggcatttgggtccaattgcagcatgcagtccttcagctccattgtctgagaataggttaatccagctgacatg

SEQ ID NO: 254614 - DNA, 75 bp, Artificial Sequence
  Synthetic
ccctgtgcctgtgcaaccctggtagaattgcctccagcaggcttgggtgcctgtgtcccgtccccacttaggtca

SEQ ID NO: 254615 - DNA, 75 bp, Artificial Sequence
  Synthetic
actgttgtgttgtcccatgccctcccgaggatggatgttcttgatgcaatgtagggccaaccctccccagagaga

SEQ ID NO: 254616 - DNA, 75 bp, Artificial Sequence
  Synthetic
cacaacttgtaaaggagattctcatagggattcctatcccctggcgtgtctgagacgaacatgcccaaagacctc

SEQ ID NO: 254617 - DNA, 75 bp, Artificial Sequence
  Synthetic
tttacctttagggtagctttgaggattccatcaaggtttctggctgaaaccctgatggtttcaagcatgtttcca

SEQ ID NO: 254618 - DNA, 75 bp, Artificial Sequence
  Synthetic
ccatcaatcaaacatgcaccagccttcacagctgcagacaggctgaagttgtatccagatatgtttatggcactt

SEQ ID NO: 254619 - DNA, 75 bp, Artificial Sequence
  Synthetic
tttttgggttctataactcccaggattgggtgtgcttgggtcagtttctccagatcagacatattcggatatttt

SEQ ID NO: 254620 - DNA, 75 bp, Artificial Sequence
  Synthetic
gctgtgtacacaagaccaaggtctgttaacgactggatgacatcatttaagtcagtctgaccttgtttgcacatg

SEQ ID NO: 254621 - DNA, 75 bp, Artificial Sequence
  Synthetic
catgctattgttagacttggcatcgtgccaaactgattgttaagcaattctgggtttctaacatcccagattctt

SEQ ID NO: 254622 - DNA, 75 bp, Artificial Sequence
  Synthetic
acaatgccatctctaggtggctccctacccagtggaccacctcccattccaaccatttgcaacagaacctttctt

SEQ ID NO: 254623 - DNA, 75 bp, Artificial Sequence
  Synthetic
tgttctaattgttgtgctgtcagatttcccatgtagacacctgctgccagcggcctttcacttctgatgaccttg

SEQ ID NO: 254624 - DNA, 75 bp, Artificial Sequence
  Synthetic
gctttgagtctgtccaagtcggctgcaagaacaagcaagtcatcaggagttaatgttccaacccttaagacattc

SEQ ID NO: 254625 - DNA, 75 bp, Artificial Sequence
  Synthetic
ttttgctgagtggatttcaactcaacaagattgttaacagcctgatttagatctcttaatctttttagatctgag

SEQ ID NO: 254626 - DNA, 75 bp, Artificial Sequence
  Synthetic
tcatccctcttttctttcctcatcaacctctgcacattgctgacctctgagaaatccagcccgtgaagaagggct

SEQ ID NO: 254627 - DNA, 75 bp, Artificial Sequence
  Synthetic
tgagcatccttgatgacttgcactttcacattcgtgcagaagcctgagagctctctccttagactctgagtccaa

SEQ ID NO: 254628 - DNA, 75 bp, Artificial Sequence
  Synthetic
aggaaagatttcacctcctttgagttagacatcttcacaccttgttcctcagcaacttgatctgcaattggcgca

SEQ ID NO: 254629 - DNA, 75 bp, Artificial Sequence
  Synthetic
tttcacctcctttgagttagacatcttcacaccttgttcctcagcaacttgatctgcaattggcgcagtcaataa

SEQ ID NO: 254630 - DNA, 75 bp, Artificial Sequence
  Synthetic
aattctgacacccataacattgtgttttcaacaagcacaagccgaggacagccaacatggggaagtcccaatcca

SEQ ID NO: 254631 - DNA, 75 bp, Artificial Sequence
  Synthetic
aggccaccctcagagagagggagtcaagtccaagagagaataggcagcctataataccagatgcaagagggactg

SEQ ID NO: 254632 - DNA, 75 bp, Artificial Sequence
  Synthetic
ggccagaattttgcaaaagctgctggtttgagaggagaggccttgtgagatgtcatgaccattacctctgtctaa

SEQ ID NO: 254633 - DNA, 75 bp, Artificial Sequence
  Synthetic
attgtctcacactgctactcacagtatccaacagatgccctctttgcaaacacagcctgccccaaaggctggagc

SEQ ID NO: 254634 - DNA, 75 bp, Artificial Sequence
  Synthetic
ttcacccacagcccacagcaccccccgaggcaatgcccagccagcaaccccccccataccagccctgaacacccc

SEQ ID NO: 254635 - DNA, 75 bp, Artificial Sequence
  Synthetic
gaaagcaccccagacagccccacccctccccccccggggggaacccccgccggggctccccccgggggagcgaag

SEQ ID NO: 254636 - DNA, 75 bp, Artificial Sequence
  Synthetic
agcgcgcgggcatcagtcaatgtcctccggaggaggtgggttgtcatgcagggatctgcacaatctgcccttcag

SEQ ID NO: 254637 - DNA, 75 bp, Artificial Sequence
  Synthetic
cctgagtgttccctctgagctttggaccatcaccttccccaacgatttactaaaacacaaactgtaccctttgaa

SEQ ID NO: 254638 - DNA, 75 bp, Artificial Sequence
  Synthetic
atcaacccaaccgtctgtccttgacatcacctcattgaggaaatctgcatgactcccaggcattgtttcctccac

SEQ ID NO: 254639 - DNA, 75 bp, Artificial Sequence
  Synthetic
aaccccgactatgtccacctgcagccagtgaagagactgctccacccttgatttaatcattcttgacagagagtc

SEQ ID NO: 254640 - DNA, 75 bp, Artificial Sequence
  Synthetic
aatcaacacatcccggtgatcctctgagagctctcctatgaaaactctcaaatcctggtcaaaaatcttggggtt

SEQ ID NO: 254641 - DNA, 75 bp, Artificial Sequence
  Synthetic
gaaggggatcaactttcttgtcccctcaaggagataacctgaatcaaccacgagaggtatgtcatcatagtctgg

SEQ ID NO: 254642 - DNA, 75 bp, Artificial Sequence
  Synthetic
cccaacatgattgaaatcatacacatccaaacacattatctccccctccaggaatactggcaatgggatagcatc

SEQ ID NO: 254643 - DNA, 75 bp, Artificial Sequence
  Synthetic
aggaatcgagtggctgtcagctaaatattcacacaggttttctgtggatagttgccacatacttctgcagtctct

SEQ ID NO: 254644 - DNA, 75 bp, Artificial Sequence
  Synthetic
cttgaaccaagatgaggtctgagctagcctccaacaatctaccagggctgatctgtgaactttgccactatacat

SEQ ID NO: 254645 - DNA, 75 bp, Artificial Sequence
  Synthetic
gccttccagtgagtagggcttaaaaacacccccctccaggatttcgcctttccacaagaggtgaatggagaattt

SEQ ID NO: 254646 - DNA, 75 bp, Artificial Sequence
  Synthetic
ctcagacagtgactccccttggctcttaacctgaaagttaatcgttaatgtaatctgcacaccaccagtgctcac

SEQ ID NO: 254647 - DNA, 75 bp, Artificial Sequence
  Synthetic
ctcagagaggagatcgaatagctcttcaggctcacgacaaattttttgctgtgttaaaccacatgctatgagttg

SEQ ID NO: 254648 - DNA, 75 bp, Artificial Sequence
  Synthetic
acttagattgaccacagcaggagaacattcaaagtccaaccatgcatagccagaatgaagatcatttttatacat

SEQ ID NO: 254649 - DNA, 75 bp, Artificial Sequence
  Synthetic
tggtcgttcaattcctttgtaaatgactttttctacaaaagatgagaagggtcccaacagccctaaaccttcgga

SEQ ID NO: 254650 - DNA, 75 bp, Artificial Sequence
  Synthetic
ctcaggcaatgaggacttgtgtgggaaccaagtgaatgaacccaatgtcctacttgttgccacaaatggccttac

SEQ ID NO: 254651 - DNA, 75 bp, Artificial Sequence
  Synthetic
gaaagactcaaaatacacttgcctcatgaaattttgaacaacatcataagtcgtcactactctctcatctgtgag

SEQ ID NO: 254652 - DNA, 75 bp, Artificial Sequence
  Synthetic
gggcaaatgcgttctatcatgagccacagccaaatcagaagataaaacaatatagtgttcttctctcttccattt

SEQ ID NO: 254653 - DNA, 75 bp, Artificial Sequence
  Synthetic
aactacatgtgatattaatgacatagcttcgcaatttacatcaagcaccacacatagatctaggaattttatcct

SEQ ID NO: 254654 - DNA, 75 bp, Artificial Sequence
  Synthetic
tggagtccatttcatctttgtggatgctaaatcactcataaatgggagtagatgtttttcataaattgatgggta

SEQ ID NO: 254655 - DNA, 75 bp, Artificial Sequence
  Synthetic
aagtcttctgaaggagtggattatatggttgaatcccaccttgtcttcaagaagccttgtgtgggttggcttcat

SEQ ID NO: 254656 - DNA, 75 bp, Artificial Sequence
  Synthetic
gggaaaataatcacatggattgaaatttatattaggctttttactttttatcttaggctcccccaaaacccatgg

SEQ ID NO: 254657 - DNA, 75 bp, Artificial Sequence
  Synthetic
gcccaattcaagagaagtggatagtgagatacaaaaatagtcccataatactggccttaagtaacctgctaaatc

SEQ ID NO: 254658 - DNA, 75 bp, Artificial Sequence
  Synthetic
ctcggggatactgtctgtaagctcccttgtgtcccacaagtccacccctcctagcttgagctttttgaccccctg

SEQ ID NO: 254659 - DNA, 75 bp, Artificial Sequence
  Synthetic
gatctcagacaatctagaaatcaatgaccttatgtatgtggtggttttatctagatacctgacacacttactccc

SEQ ID NO: 254660 - DNA, 75 bp, Artificial Sequence
  Synthetic
tagagtcttgcacaggcccacaaaaccagatgcaatagagctttgaaatgcacttttgttgacagcctcgcataa

SEQ ID NO: 254661 - DNA, 75 bp, Artificial Sequence
  Synthetic
cagcttttgtgctcctcttgtgaagcctgatgaaagtttactctgtaatgtcttcactaaagttggtagtttttc

SEQ ID NO: 254662 - DNA, 75 bp, Artificial Sequence
  Synthetic
gtcttcaacactgatggctcctgtgtatagcactttttgtctcatgaccatccgtaatggatggtgtgcagtcaa

SEQ ID NO: 254663 - DNA, 75 bp, Artificial Sequence
  Synthetic
gtttaaccagcaaacggataaatcatccttttgaagttcagattcacctatgagttcgcttagtttagtgaatga

SEQ ID NO: 254664 - DNA, 75 bp, Artificial Sequence
  Synthetic
ttccactgggtcaccagacaagtaaatagctgtgaattcttcgtgtaattcacctgtctttagcttattaaatac

SEQ ID NO: 254665 - DNA, 75 bp, Artificial Sequence
  Synthetic
cactctgagaatcttccttaccttctcagtacctcttggtagtatgccctcaatgttcctcataattctgtaccc

SEQ ID NO: 254666 - DNA, 75 bp, Artificial Sequence
  Synthetic
tctgtagccatcaacccagtctttaacatctgagttcagaaacattaaaaagggatctatgggatactgagcata

SEQ ID NO: 254667 - DNA, 75 bp, Artificial Sequence
  Synthetic
tctgttgccatcaacccagtctttaacatctgagttcagaaacattaaaaagggatctatgggatactgagcata

SEQ ID NO: 254668 - DNA, 75 bp, Artificial Sequence
  Synthetic
tctgtcgccatcaacccagtctttaacatctgagttcagaaacattaaaaagggatctatgggatactgagcata

SEQ ID NO: 254669 - DNA, 75 bp, Artificial Sequence
  Synthetic
tctgtggccatcaacccagtctttaacatctgagttcagaaacattaaaaagggatctatgggatactgagcata

SEQ ID NO: 254670 - DNA, 75 bp, Artificial Sequence
  Synthetic
ttttaaaacatctattgttcgcacctgtagagcattacatatagaaacaggcacaccatttgctattgactgatc

SEQ ID NO: 254671 - DNA, 75 bp, Artificial Sequence
  Synthetic
cagaattgtatcaatcgtctcagcgagctgatgggggtctttgcattttacgttgtgaagagcagcagcaacgaa

SEQ ID NO: 254672 - DNA, 75 bp, Artificial Sequence
  Synthetic
tttggttaaaaggggtacttcatcaccccaaacataaaatctagatttgaactcagcaacaaaggtccctaccac

SEQ ID NO: 254673 - DNA, 75 bp, Artificial Sequence
  Synthetic
actcttaggacttatgaatttgttaagcctgtcacttaaatagtagtgaaactctaagatgttttgaaattcctc

SEQ ID NO: 254674 - DNA, 75 bp, Artificial Sequence
  Synthetic
ggaatcacttcccattagttccgtcagccccttgccaaagagggttatttgatcatcacttgatgtgaaggattc

SEQ ID NO: 254675 - DNA, 75 bp, Artificial Sequence
  Synthetic
aacaccctcttcaaacaagcactttatgcagtaatttatgaatctctcactaatcaacccataaaaatctgaggt

SEQ ID NO: 254676 - DNA, 75 bp, Artificial Sequence
  Synthetic
attgtgcaatatgccctgacccatgtcaataatggaactcagatgtgatggtacctcatcaactctaaagctctc

SEQ ID NO: 254677 - DNA, 75 bp, Artificial Sequence
  Synthetic
gaagaagaaggactctgtgattgtctcatgaaaagttctcttcaaacctaacctagatttgaggtaggacttcat

SEQ ID NO: 254678 - DNA, 75 bp, Artificial Sequence
  Synthetic
cattgcattgacaacattgaaaggaacttcaatcaatttgtgaatgtgccaagataacaaagtactaatatggtc

SEQ ID NO: 254679 - DNA, 75 bp, Artificial Sequence
  Synthetic
tttgcttttaatgtctccaaggtcatcttgtgtttcccagtgcaggttctgtaaaaacaccaagaatagaaatgg

SEQ ID NO: 254680 - DNA, 75 bp, Artificial Sequence
  Synthetic
ggacatcattgggccccacttactatggtctaaactatatgaaacctgagccagtgagacattgagcttcattgc

SEQ ID NO: 254681 - DNA, 75 bp, Artificial Sequence
  Synthetic
cagaatggcattgctaaactcattctcatcatttaagcaactccccttgtattgcttagtcaatgcctcaaaata

SEQ ID NO: 254682 - DNA, 75 bp, Artificial Sequence
  Synthetic
atcttctatcagtctggtgaacatcttggtcctgaggtcccctatataaagctctctatttcccccaacttgctc

SEQ ID NO: 254683 - DNA, 75 bp, Artificial Sequence
  Synthetic
tttgtaggacaatgagaactttaacctcccagtatcaggtcccaacgatgtgtaagattgtggtgactcttggct

SEQ ID NO: 254684 - DNA, 75 bp, Artificial Sequence
  Synthetic
gtaaaagcataaattctttagcactgctgttgtgcaattagttagtgagagtgctttcccaagtgcttctgaatt

SEQ ID NO: 254685 - DNA, 75 bp, Artificial Sequence
  Synthetic
actctctctctcactaatcctaacatcactcatcaacctctctctgtcaattttgaaattcagacacttgttctt

SEQ ID NO: 254686 - DNA, 75 bp, Artificial Sequence
  Synthetic
ataatgagaatacttgccagttaatcttccagcattcatctgtagtaatagagatttaaaacattgaaagtactg

SEQ ID NO: 254687 - DNA, 75 bp, Artificial Sequence
  Synthetic
accttcattgagtgtcctagttgacacagcctgggtaatacatctgataggacaagattccagagaatcaagata

SEQ ID NO: 254688 - DNA, 75 bp, Artificial Sequence
  Synthetic
gaaatacctattcctcaaatctagattttcataaaacccttctgagatcagttggtaagacccattgggcaaaac

SEQ ID NO: 254689 - DNA, 75 bp, Artificial Sequence
  Synthetic
tgattcatcaaagtcctctatagtatgatgggttatctcagcctgaattaaattgtaatgggtgctgtgaaatcc

SEQ ID NO: 254690 - DNA, 75 bp, Artificial Sequence
  Synthetic
tttgacctccataactttcttcaaatcagttagtgatttatgttctccttctatatgttccttcttgtcatctaa

SEQ ID NO: 254691 - DNA, 75 bp, Artificial Sequence
  Synthetic
ggctcgatcaaatttgtacctgttcagtacagtgtcaattgattctttaacctcttcaaggcaccctaatgcatc

SEQ ID NO: 254692 - DNA, 75 bp, Artificial Sequence
  Synthetic
actactcagtaagacttcatctagctgctcaacttcaccactcttaccacctccctgcttatccttcttggttcc

SEQ ID NO: 254693 - DNA, 75 bp, Artificial Sequence
  Synthetic
aatcaccaaatcagtgagggttttctgaactttgtagtcataatcttctttattaagtaagtactttgttttcct

SEQ ID NO: 254694 - DNA, 75 bp, Artificial Sequence
  Synthetic
ctcaaacacttcagacagttggcaaacagaggtggctactaatttgtcatggtcgtaattcaataccctctcacc

SEQ ID NO: 254695 - DNA, 75 bp, Artificial Sequence
  Synthetic
atctgaatacttatttacaaccacactcttattgctggcaaggtctaatgctgttgcacacccagcggtgaccaa

SEQ ID NO: 254696 - DNA, 75 bp, Artificial Sequence
  Synthetic
ggggtctttgaacccacctttgagatctcctccttttgtcaatgatccattgttgaatgaggaggtcatcattga

SEQ ID NO: 254697 - DNA, 75 bp, Artificial Sequence
  Synthetic
gaataattttctagacacacccggttgtttataggagattgtatcacctgttagacaatccggtttagagaggaa

SEQ ID NO: 254698 - DNA, 75 bp, Artificial Sequence
  Synthetic
cttctcagcggagtttaacaacaagagtttttcttcttcatctcctgattccttaggattcacattcaagctgtc

SEQ ID NO: 254699 - DNA, 75 bp, Artificial Sequence
  Synthetic
aaactctaacttaggctctaaatacttctcaaaacacttgatttggtctgtcaatctatccggagtttctttggt

SEQ ID NO: 254700 - DNA, 75 bp, Artificial Sequence
  Synthetic
gatgaagtggcacatatatgaaaggtttaaaacatatttaaacctatttgttagcatagttgtcaccttgttgtc

SEQ ID NO: 254701 - DNA, 75 bp, Artificial Sequence
  Synthetic
gagaacaattgagaaaatagttctaactacactatagagaaggtattcagaatcagttatcagatcctccctcaa

SEQ ID NO: 254702 - DNA, 75 bp, Artificial Sequence
  Synthetic
cttctccattagctgcttgtggtgatagtctgacacaaaagccattatgaagtacctcaaaccttgcaaaaactt

SEQ ID NO: 254703 - DNA, 75 bp, Artificial Sequence
  Synthetic
ttgagcccttttgctagggttggctaaaatgaggattatgaccatttttaataacaatttcaagcttgcttcctg

SEQ ID NO: 254704 - DNA, 75 bp, Artificial Sequence
  Synthetic
ctcttttagttcaacacaatcagaaagccagcttgacatggcatccagtaccttggatatcacatcttgtgaaaa

SEQ ID NO: 254705 - DNA, 75 bp, Artificial Sequence
  Synthetic
aatggctgggaagaatcttttaggatctgcataaaatgaacaaacttctccacgctcagagttgttgatggcgta

SEQ ID NO: 254706 - DNA, 75 bp, Artificial Sequence
  Synthetic
acatttagaaccttcaccggtcttttgataaatgagattaaaacgcttttctcccataacaaaactttgattaaa

SEQ ID NO: 254707 - DNA, 75 bp, Artificial Sequence
  Synthetic
ggcctctttacatctgactttcttgtacctagctgcaccgtgctcattctgtctaacttttgcaacagaagatgt

SEQ ID NO: 254708 - DNA, 75 bp, Artificial Sequence
  Synthetic
tttcatcgagttcaccaatgccagagagatactcgaaagtctttttaagtcgttctgaccctgggagtcaatatc

SEQ ID NO: 254709 - DNA, 75 bp, Artificial Sequence
  Synthetic
aagtagtggatatgggaagtccctttcacaaagtctttcataactcatcgtgggctgaacccccctcctctctag

SEQ ID NO: 254710 - DNA, 75 bp, Artificial Sequence
  Synthetic
gtgaatcagtttttcaaagctctctctttccaagatgtcagtctcagttacataatcgcaaaaactcaaattcac

SEQ ID NO: 254711 - DNA, 75 bp, Artificial Sequence
  Synthetic
cacctttagcatttcctctgccctggttaagagtttcttaatgatgtcatagaagcacatactcaaattctgagg

SEQ ID NO: 254712 - DNA, 75 bp, Artificial Sequence
  Synthetic
ctgtggatggcctttctttactatgttatcccttctcctgctcaaccagttcttcaattccctctgagtagcctc

SEQ ID NO: 254713 - DNA, 75 bp, Artificial Sequence
  Synthetic
aagtgacaccaacctatcattaacacttagaaaagaagatcccaaccactcggagctaaccatgctcccgagttg

SEQ ID NO: 254714 - DNA, 75 bp, Artificial Sequence
  Synthetic
tttctcatcccttaagtgggctaagagtattatggtatcaaaggttagtagaagctttctcctagtgttcaatag

SEQ ID NO: 254715 - DNA, 75 bp, Artificial Sequence
  Synthetic
tttgagggatttaatcttattgaggagagatttccagccagcaacacaactggaagttggcaagtccccaccctc

SEQ ID NO: 254716 - DNA, 75 bp, Artificial Sequence
  Synthetic
acctaggtgaacagaaccataatcaccatacaatgctgttacaattggagaggaccagataaatctttcccttag

SEQ ID NO: 254717 - DNA, 75 bp, Artificial Sequence
  Synthetic
acctaggtgaacagatccataatcaccatacaatgctgttacaattggagaggaccagataaatctttcccttag

SEQ ID NO: 254718 - DNA, 75 bp, Artificial Sequence
  Synthetic
acctaggtgaacagacccataatcaccatacaatgctgttacaattggagaggaccagataaatctttcccttag

SEQ ID NO: 254719 - DNA, 75 bp, Artificial Sequence
  Synthetic
acctaggtgaacagagccataatcaccatacaatgctgttacaattggagaggaccagataaatctttcccttag

SEQ ID NO: 254720 - DNA, 75 bp, Artificial Sequence
  Synthetic
cacgtttaaattgtgaggaccatcaccttctctatctacataaagggtgttaaaatcatctagaagcttaattct

SEQ ID NO: 254721 - DNA, 75 bp, Artificial Sequence
  Synthetic
gtctgttttaacaaactgtctggggatgctttcctctctgagtttatttctgaatgcttggtattccagaatgat

SEQ ID NO: 254722 - DNA, 75 bp, Artificial Sequence
  Synthetic
ttcttttcgaacctcaagtggtgtcattctgttattcaaccccctgtgacacagttgcagcaacctttcatgatg

SEQ ID NO: 254723 - DNA, 75 bp, Artificial Sequence
  Synthetic
atctgctctagaatctgataaaatgttaaggctctcaatcccagatgttctgactcccgtctttgtcaaggactc

SEQ ID NO: 254724 - DNA, 75 bp, Artificial Sequence
  Synthetic
acacaaccttgagtactctgactcttcaaacatcctagatgattgttgagaatactcaagcagagagaataaatt

SEQ ID NO: 254725 - DNA, 75 bp, Artificial Sequence
  Synthetic
atttctaaacttttcattagcccactcgggaaataattctgtgtggaagctggttctaccatctatgaggggtag

SEQ ID NO: 254726 - DNA, 75 bp, Artificial Sequence
  Synthetic
tagcactatgtcgacagaattaaggtcagatttcaatgcctcaagcttcaccatgtcttctctatatttttgctc

SEQ ID NO: 254727 - DNA, 75 bp, Artificial Sequence
  Synthetic
aaaattggtgggagatgttcttacaaaacattcaagcaagattaatgtgttgcctgaaaacttgaatccatcagg

SEQ ID NO: 254728 - DNA, 75 bp, Artificial Sequence
  Synthetic
aaccacgaaagctaagccagggcataggacccctttcttctgtagtatgagctccactgacagggactctgtgtt

SEQ ID NO: 254729 - DNA, 75 bp, Artificial Sequence
  Synthetic
atgttcacatccgttggcttgacagctatctatctcaatgcagagggacaaaagcttcagtccctctatgagaag

SEQ ID NO: 254730 - DNA, 75 bp, Artificial Sequence
  Synthetic
catttttggctcagtttgcacaagaaatgctaacttttgttgagagagtctttcatcacctgccaagtatttgct

SEQ ID NO: 254731 - DNA, 75 bp, Artificial Sequence
  Synthetic
tatcaagtccttacattctcctaaaagctcttccattgctgatgttctcacacaccagtaacatatgtaatgaga

SEQ ID NO: 254732 - DNA, 75 bp, Artificial Sequence
  Synthetic
tccttacattctcctaaaagctcttccattgctgatgttctcacacaccagtaacatatgtaatgagagtcaaat

SEQ ID NO: 254733 - DNA, 75 bp, Artificial Sequence
  Synthetic
accgaacaaagggagtaatgattaattataaacaaaaggaatcggtaaaaaatttaggagtaaagctcctaaagc

SEQ ID NO: 254734 - DNA, 75 bp, Artificial Sequence
  Synthetic
gagacccagttactgcatctttggctgatgttaaaaggttgacaagtgctgggatattagcaaaatgtatgatcc

SEQ ID NO: 254735 - DNA, 75 bp, Artificial Sequence
  Synthetic
ctggttccagtaccggcaccaaacctacaataatgtctggggtgctaagtgcactacgtgagttcaaagatgcaa

SEQ ID NO: 254736 - DNA, 75 bp, Artificial Sequence
  Synthetic
aaaaaattatgaatcagcctccaggtgattctaccttccttgactgggcaaatgacccctattcagcaaatattc

SEQ ID NO: 254737 - DNA, 75 bp, Artificial Sequence
  Synthetic
gacttgcatcaaaaggagagggtcttacccgaggagcaattaccgggattaaacagaagattgctgttatcatcc

SEQ ID NO: 254738 - DNA, 75 bp, Artificial Sequence
  Synthetic
ccaatactcagagtatcacaaagatgataaaaaatatcacagcaaggaatatacttattcatagccctaatccta

SEQ ID NO: 254739 - DNA, 75 bp, Artificial Sequence
  Synthetic
cgggccaggagggctcaaaggtgaggtggcaactactaagactactactgggggtaatatggtcacaagaggcca

SEQ ID NO: 254740 - DNA, 75 bp, Artificial Sequence
  Synthetic
tgttaagaggactgttccatgatgggaccgctgaagaggatcataagcttgcagcttttcttatggatcggtcag

SEQ ID NO: 254741 - DNA, 75 bp, Artificial Sequence
  Synthetic
gtccaggagtaattacaggagcattcttatccctaatttccctgatctcagaatctccggggaacatggtaagaa

SEQ ID NO: 254742 - DNA, 75 bp, Artificial Sequence
  Synthetic
tgataattcctcgtgcggctcatgagatcattgacaactcgatatcaggggcaagggaacaaatagcagggatgt

SEQ ID NO: 254743 - DNA, 75 bp, Artificial Sequence
  Synthetic
gattgaataacgatcccgatcttgcaattactattattgaattcactattgggccagatagtgaatacaaatttg

SEQ ID NO: 254744 - DNA, 75 bp, Artificial Sequence
  Synthetic
tagacacaacaaaaggattgataaggagtggtctccgtatgggaggcctcaagactcgccttatcactcgaattg

SEQ ID NO: 254745 - DNA, 75 bp, Artificial Sequence
  Synthetic
catccagagggatgagctatgaagaacagatggcacactaccttcacctacgagacacaccgccgcagagtgcgc

SEQ ID NO: 254746 - DNA, 75 bp, Artificial Sequence
  Synthetic
caacttatgatgttgagcagtttaaaagatttaacaccttgatgaatgtacaagaaagcaaccctctaattgaaa

SEQ ID NO: 254747 - DNA, 75 bp, Artificial Sequence
  Synthetic
ctgatgacttcccttttgaagaatctgaagcttggagacaggatgacatgccaatggatgagttcctagttgcca

SEQ ID NO: 254748 - DNA, 75 bp, Artificial Sequence
  Synthetic
atgatgcatgttctgttgctctagctcgggcactacgtcaacatatgtggggttatctaacttatgggagaccaa

SEQ ID NO: 254749 - DNA, 75 bp, Artificial Sequence
  Synthetic
atatgactgtgcaggttcaactatggaccctacttatcaaagctgtaacggccccggacacagctcgtgatgggg

SEQ ID NO: 254750 - DNA, 75 bp, Artificial Sequence
  Synthetic
tctatgggttagaagttcctgatatcattgaggcaatgagaggaacattcataacaggtcatgaggattgcaatc

SEQ ID NO: 254751 - DNA, 75 bp, Artificial Sequence
  Synthetic
aacagagaaggtggttgaaatttgtgcagcaaagacgggtagagtctttctacaagctacacacagtctggatgg

SEQ ID NO: 254752 - DNA, 75 bp, Artificial Sequence
  Synthetic
aatgtgcttcaggatctcctaattatgcatggttctttgtcccatcagggtgtgatctagacgacgtgcacaatc

SEQ ID NO: 254753 - DNA, 75 bp, Artificial Sequence
  Synthetic
atcgtgcacgaatgcacattgcagcaagcctcagcattcgtcgctatatggttaagacactgattgaaatccaga

SEQ ID NO: 254754 - DNA, 75 bp, Artificial Sequence
  Synthetic
cgacaaatgcaattcgtgtaccttatgtgggatctagtacagatgagagaagtgatattaaagtcggacatgtaa

SEQ ID NO: 254755 - DNA, 75 bp, Artificial Sequence
  Synthetic
gaatggggcagggaaaaggaaggttgctggaggttattgctgatattggcaattacatagaagagtcaggattgg

SEQ ID NO: 254756 - DNA, 75 bp, Artificial Sequence
  Synthetic
ggaacccaagcaaagccctcaaagcagcaattagaatagcaatgatttatacgtgggcatttggggactcagatg

SEQ ID NO: 254757 - DNA, 75 bp, Artificial Sequence
  Synthetic
ctgggtttcagctgacaattaggtttgggattgagactaaatatgctgctcttgctctaaatgagttccaaggag

SEQ ID NO: 254758 - DNA, 75 bp, Artificial Sequence
  Synthetic
aatcatgggctgaagcttggaacatctctagtcaaagagctgcattgacacttgatgaccttaagttaattactc

SEQ ID NO: 254759 - DNA, 75 bp, Artificial Sequence
  Synthetic
acattgcaacaatagagagactcatgaaactctatctcgagttaggtccaacagcaccatttatggtacttcttg

SEQ ID NO: 254760 - DNA, 75 bp, Artificial Sequence
  Synthetic
cgatatcaacttcaaccaacttagctcatcggatgagagatcgtagcactcaaataaagtactctagttcatcac

SEQ ID NO: 254761 - DNA, 75 bp, Artificial Sequence
  Synthetic
aggattcaatacagaccaggtttgctccaggaaattaccctctactgtggagttatgctatgggagttggttcag

SEQ ID NO: 254762 - DNA, 75 bp, Artificial Sequence
  Synthetic
ttaaccgggcggctagatatacaactataagcaatgataatcttaatttcattattgatggtgtcaaaacagata

SEQ ID NO: 254763 - DNA, 75 bp, Artificial Sequence
  Synthetic
cgttggatagagcgatggccaacttaaatttcaatcggtcatatcttgattatgggtattttcgtctaggatata

SEQ ID NO: 254764 - DNA, 75 bp, Artificial Sequence
  Synthetic
ccaattacgtctaccaacaagggatgctattagggatctctgtaattgaggattttttcagatatgaaaatacta

SEQ ID NO: 254765 - DNA, 75 bp, Artificial Sequence
  Synthetic
ggatcgtcagacaatctgagggatcagttgacacaagaatggcccgcgagctaggtataacagatgaagagcagc

SEQ ID NO: 254766 - DNA, 75 bp, Artificial Sequence
  Synthetic
caggtcttcataatactgtactgcatctgcatacagttgacagctgctgtataatacggatgactgatcatccga

SEQ ID NO: 254767 - DNA, 75 bp, Artificial Sequence
  Synthetic
aaaggctgaggaggttagttgctgatcttggaaacagaggtgatagtgaagcagctgcttatcaagggggagctt

SEQ ID NO: 254768 - DNA, 75 bp, Artificial Sequence
  Synthetic
atgtggccagtacacagagctgtccgataatcagaccgcccaacaacaataagctcatatatgatgcatctccta

SEQ ID NO: 254769 - DNA, 75 bp, Artificial Sequence
  Synthetic
ttcaacttgcaaacatccaggactttgaaaatgatgatgcatttgcagccaaccctcaacaagccccacgcaaca

SEQ ID NO: 254770 - DNA, 75 bp, Artificial Sequence
  Synthetic
ttattgagaaagatcaaattaagttagatcagcaaaggtatagggtttcacttgttgacttcacaatctggagca

SEQ ID NO: 254771 - DNA, 75 bp, Artificial Sequence
  Synthetic
accgtaacaggaggaggagaggtcaacctgatcagggagatgatgatgattcagatgagggtgatgatcaaggtg

SEQ ID NO: 254772 - DNA, 75 bp, Artificial Sequence
  Synthetic
catctgatcttgagaaaggcctggctcaatctttatctctgacattaattgagttaatcactaaatctgaaaatg

SEQ ID NO: 254773 - DNA, 75 bp, Artificial Sequence
  Synthetic
ggagtgggtatgccgcagctgtccatgcagttcttcatagttcaggggatggtggtgatgatctgacaagtggtg

SEQ ID NO: 254774 - DNA, 75 bp, Artificial Sequence
  Synthetic
atcacctcaatgaactcaaaacggttgagagtgatgatgatattaagagcttgatcactgaatttttgttggtaa

SEQ ID NO: 254775 - DNA, 75 bp, Artificial Sequence
  Synthetic
cagacggcagtattgaccccccaacaagtggactcggtgcaaattatcgttactctcctgggctaaatgactcca

SEQ ID NO: 254776 - DNA, 75 bp, Artificial Sequence
  Synthetic
atcctaagctttttagtctttatctaggtcaagccattgcagtaaactggagttttgaaattcattatcggaggc

SEQ ID NO: 254777 - DNA, 75 bp, Artificial Sequence
  Synthetic
aaccaaagtttaatgatgcagatttacttggtctcggtgactagctttgtttacaattgatggcagactttttta

SEQ ID NO: 254778 - DNA, 75 bp, Artificial Sequence
  Synthetic
ctgctggaatatatcagatggttgaacttctccacaaattacttatgagaacctcacacggatcattaacagttt

SEQ ID NO: 254779 - DNA, 75 bp, Artificial Sequence
  Synthetic
cagggctatctacacgattaaatcgaatagagtgtcttaacctaactaaccagtattaacttatatgatgatttc

SEQ ID NO: 254780 - DNA, 75 bp, Artificial Sequence
  Synthetic
tatctaatgctctctcccacaaacaaatttatcgacgtctttgggatgctgacctgattgaaccgacaagtggcc

SEQ ID NO: 254781 - DNA, 75 bp, Artificial Sequence
  Synthetic
agtctagattatattattaccacagatcttatacatcttatattataaaaaacttaggacccaagtcccgaccac

SEQ ID NO: 254782 - DNA, 75 bp, Artificial Sequence
  Synthetic
atttacttgatcaacagaatctcgtagtgacagccattgagttactagttgaatgttatagtatatacttacatt

SEQ ID NO: 254783 - DNA, 75 bp, Artificial Sequence
  Synthetic
tctccaagacaatcaacagtccccatatggaaacgaattgtcaaaaagatattaagaatgccctccaaattctgg

SEQ ID NO: 254784 - DNA, 75 bp, Artificial Sequence
  Synthetic
actggttatcaactccaactagtggactacaatatattatttgtgaagcagacgaggatgtactcaatagccgct

SEQ ID NO: 254785 - DNA, 75 bp, Artificial Sequence
  Synthetic
cagtcgctaaagagactcagagtcccaagtcggaagaggagctcagagagcgactcgacatatcaggagttacaa

SEQ ID NO: 254786 - DNA, 75 bp, Artificial Sequence
  Synthetic
atgatgtagtacaggctaaacatttagcaatgctgaatgacctctataacacatcaggtaatattcctgcaatcc

SEQ ID NO: 254787 - DNA, 75 bp, Artificial Sequence
  Synthetic
ccacagcctccacagataccgttgaggccgagagtcaagataggagtgagaaggaacccggatctggtcggagtg

SEQ ID NO: 254788 - DNA, 75 bp, Artificial Sequence
  Synthetic
gaggtcttgcacccatacaaaaatgtaaggtgcttcgcgatgctcttatgaaatatgcagctgttacaaataatg

SEQ ID NO: 254789 - DNA, 75 bp, Artificial Sequence
  Synthetic
gagaggagcaacaaagctcagcatcaagttctagcgttggatttactcaatacgctgaaggagatggagatggag

SEQ ID NO: 254790 - DNA, 75 bp, Artificial Sequence
  Synthetic
cactagactggaatctctctgaccttgagatactcgcttatccagcatcattaacttatatacgtagaggaacaa

SEQ ID NO: 254791 - DNA, 75 bp, Artificial Sequence
  Synthetic
tatccgatggaggggccaatggctccatttcgactagagtattctactctacagtttgtgaaaacaatcctgatg

SEQ ID NO: 254792 - DNA, 75 bp, Artificial Sequence
  Synthetic
ttaaacaactacgaatgagatccccacaacctaacattttagcactggcggaaaccaaacaacacattcctatag

SEQ ID NO: 254793 - DNA, 75 bp, Artificial Sequence
  Synthetic
agagtctcggaaggtcatcttgttacgtcatgctgggcaaggcaggtggaattgaacctgtgccaaacacagcag

SEQ ID NO: 254794 - DNA, 75 bp, Artificial Sequence
  Synthetic
aggtcctgcaaatgtcaattactccccatcaaaacctcgaggaaatgccaccttcagtcaaagttaacgctcatg

SEQ ID NO: 254795 - DNA, 75 bp, Artificial Sequence
  Synthetic
gagatagagaatctacacgaagcaatcagctgggtgaagatgatgatgcaggacaatcaggattaacttctgcaa

SEQ ID NO: 254796 - DNA, 75 bp, Artificial Sequence
  Synthetic
atattataccgaaacttgggacactgaaatctgggccagtcttacctagtagtagatctgatttagcagattatg

SEQ ID NO: 254797 - DNA, 75 bp, Artificial Sequence
  Synthetic
gagcactcgaatccggaacacagtcagatgaaccggttgtcaaaccaaagcgaaagaataagaaatcacccatga

SEQ ID NO: 254798 - DNA, 75 bp, Artificial Sequence
  Synthetic
ggcatcatatttttagaagagtgggattaaattctacaagtgcatacaaagcagtagagattactgaatgtatca

SEQ ID NO: 254799 - DNA, 75 bp, Artificial Sequence
  Synthetic
atgaaagtgctgtagatgagaatatgagagaggaggacatcaaagaggcatttgggatgaacccccagcctagag

SEQ ID NO: 254800 - DNA, 75 bp, Artificial Sequence
  Synthetic
aaggcagatttgatcatgcaggaacaagattgttcttagcagaaggatccggagcaatgttgactacatactatt

SEQ ID NO: 254801 - DNA, 75 bp, Artificial Sequence
  Synthetic
caagaagactcaccggactagaggccgcagcatctacactcccatcaattgtggttcacaaagaacagactaaaa

SEQ ID NO: 254802 - DNA, 75 bp, Artificial Sequence
  Synthetic
acttattaggtgcagctaaatgttattacaacaccggtgttttcacagatgccgtcagagggcaaagagagtttg

SEQ ID NO: 254803 - DNA, 75 bp, Artificial Sequence
  Synthetic
ggggcatagacgagagtacaacttcgtctggacagactctggattcagagtcgaagcttggtgcaacccaatctg

SEQ ID NO: 254804 - DNA, 75 bp, Artificial Sequence
  Synthetic
caccgtaccctgctgaggttgctcttgtttcgaaagcaaatggtaacaatatgagcctaacggacaacattagca

SEQ ID NO: 254805 - DNA, 75 bp, Artificial Sequence
  Synthetic
ctcaaggatcaggaacctaccgaggcgggagaagtgcagatgcgggtggtgtccaaaagaatgcccggaatgtgc

SEQ ID NO: 254806 - DNA, 75 bp, Artificial Sequence
  Synthetic
tcctgtttaatgggaaacctgagagcacttggataggaaacctagagtgcttctcttatatcctaaaccaggtga

SEQ ID NO: 254807 - DNA, 75 bp, Artificial Sequence
  Synthetic
tcttggcaactaactctgctaagcaaacttatataactagcatctctgaaggcattaatcctagcaaacgctggt

SEQ ID NO: 254808 - DNA, 75 bp, Artificial Sequence
  Synthetic
agctaggtacatgctccttagtacattgtgatatggaaggagtaggagataagacaagccatcaagtgttagaag

SEQ ID NO: 254809 - DNA, 75 bp, Artificial Sequence
  Synthetic
accagagtaatgaaactagcatgataagttctatcgaaggctcatgccgagggagcattgcagatggtgattcaa

SEQ ID NO: 254810 - DNA, 75 bp, Artificial Sequence
  Synthetic
aaatgtgtcatgtaatcagtcttgctcttgccgtgggagaatatggctcttgctttgtattaaagatgatgcccc

SEQ ID NO: 254811 - DNA, 75 bp, Artificial Sequence
  Synthetic
ccgtggtctccgattctcctttagtcataatgtctgaaatccttgagaatcagaaatggataatggataagctca

SEQ ID NO: 254812 - DNA, 75 bp, Artificial Sequence
  Synthetic
tgggccaggactggtcagctgagataattagagtcatatcagagcactatgatgagaccctaatctatattccgt

SEQ ID NO: 254813 - DNA, 75 bp, Artificial Sequence
  Synthetic
agatcctagatgagatcaagcatgatgtagagagcatcaggaagacagttatgaagcatagtctgtctctcgcaa

SEQ ID NO: 254814 - DNA, 75 bp, Artificial Sequence
  Synthetic
ggttcagcaacccagactcaacagaggtatacgtcataggaataggcctcaaaaacaatcaggttatagatccta

SEQ ID NO: 254815 - DNA, 75 bp, Artificial Sequence
  Synthetic
ctctggaagggcagttgagctcggtaatgattgcagtcccttcaactgggtcccaaccacatcaagtagaggtga

SEQ ID NO: 254816 - DNA, 75 bp, Artificial Sequence
  Synthetic
cattaatctacagtagactatccacacgctttactcatgcaagtgtaattttccacaactgggtagtagacacta

SEQ ID NO: 254817 - DNA, 75 bp, Artificial Sequence
  Synthetic
atcaggaccttaggcccctgcttgggcgagacaagggaagagggatccctgaagttggaaaaatgaaagtccaaa

SEQ ID NO: 254818 - DNA, 75 bp, Artificial Sequence
  Synthetic
aacacttactagtaaatagttaccttgactctgttcaattcccattactatcagatcagagttttatcaatctcc

SEQ ID NO: 254819 - DNA, 75 bp, Artificial Sequence
  Synthetic
cagtttcgtttgatgagcccaatcaatcaaggagtagtcgtgctcaactgccgaagattagagttgagcttgata

SEQ ID NO: 254820 - DNA, 75 bp, Artificial Sequence
  Synthetic
atagttatcttagtaagctgaccaaagtagaacaggctctaatcacgattggatttcaactaaatggacctaaaa

SEQ ID NO: 254821 - DNA, 75 bp, Artificial Sequence
  Synthetic
agaagatactccctcctccaattgactcaagcaaaactaatgcaacaggatacaaacctgctcctactctaatct

SEQ ID NO: 254822 - DNA, 75 bp, Artificial Sequence
  Synthetic
tatttaaaaggctgattggccatgacccttctcacggaactcgaccaattgttgctggagttgtgatgagttata

SEQ ID NO: 254823 - DNA, 75 bp, Artificial Sequence
  Synthetic
caaaggaagtgatcatagcactgattgattctcggattaaggacaaggatatgaacactagaatgaggaggctac

SEQ ID NO: 254824 - DNA, 75 bp, Artificial Sequence
  Synthetic
aagaattgttatatacatacacgtctcataaatcagagcaccatttctttcagccatacccagtattagaagaat

SEQ ID NO: 254825 - DNA, 75 bp, Artificial Sequence
  Synthetic
ttaatacagccaagacacagagagaactagtggagatacataaggcaatcatcagtgctttaaagaatcaaggca

SEQ ID NO: 254826 - DNA, 75 bp, Artificial Sequence
  Synthetic
cgaggataagagagttggtaacagacattgttaagaagtttcacataatacagattctggaaaaaggtcagctag

SEQ ID NO: 254827 - DNA, 75 bp, Artificial Sequence
  Synthetic
gctaagcaacagtcagtttccattgggtatcaggtaaatttgatacgacattgcttgatacaaaactaaaaagtc

SEQ ID NO: 254828 - DNA, 75 bp, Artificial Sequence
  Synthetic
gggacaatgctcgatctaaactagctcaagcattaaggagacaacaatttatctttgacctctcaaatcatgaaa

SEQ ID NO: 254829 - DNA, 75 bp, Artificial Sequence
  Synthetic
aaatttagaatattcatcttagactacattagccctataaagtcagtagctcccttaatagattattggatacac

SEQ ID NO: 254830 - DNA, 75 bp, Artificial Sequence
  Synthetic
tgaatacattatgccctaaatacatctacaacaaactgattaaagcagagataaagaaacagtggataataccca

SEQ ID NO: 254831 - DNA, 75 bp, Artificial Sequence
  Synthetic
tccttagggtgatatcagttcaagataagcttcaaactaactcaggggtttatagaaaaatcggctggtattgac

SEQ ID NO: 254832 - DNA, 75 bp, Artificial Sequence
  Synthetic
ttactactcctgaagctaagatgtggtggaaggcaataggttattcagtattaatggacccggttccgtaaccgt

SEQ ID NO: 254833 - DNA, 75 bp, Artificial Sequence
  Synthetic
ttgaatatttaaagatttctcaacatgttttcggtaataaagtatagtcaaccagcaccacaagtatcgtacttt

SEQ ID NO: 254834 - DNA, 75 bp, Artificial Sequence
  Synthetic
tcacctaattactattaagaaaaactcaaaaataggaatctctataattaattatctatataccctttttccggt

SEQ ID NO: 254835 - DNA, 75 bp, Artificial Sequence
  Synthetic
tagaggggatgatctttacacttatcaaagaccagaatactaatattaatctagtattgcttagctaaattagac

SEQ ID NO: 254836 - DNA, 75 bp, Artificial Sequence
  Synthetic
cttaagatacatgcaacttactggccgctaatagcatattacaaaaaacttaggacgcaggtccatccctttact

SEQ ID NO: 254837 - DNA, 75 bp, Artificial Sequence
  Synthetic
ccagcaaccatggcaacgatgcatgaattcctacctggaacatgggttaacagggggctactagaggacatccga

SEQ ID NO: 254838 - DNA, 75 bp, Artificial Sequence
  Synthetic
ccagagtatgaccatgaaggcaagataaagccccgtgtacgggtgattgatccaggtgctggtacaaggaagtcc

SEQ ID NO: 254839 - DNA, 75 bp, Artificial Sequence
  Synthetic
agtggatttatgtatctgcatctccaaggtataatagaggattggattggggattttgagccagctacgcgacca

SEQ ID NO: 254840 - DNA, 75 bp, Artificial Sequence
  Synthetic
ccgggtagaactttagccgcatatccactcggtgtagggcagagtattgcaggtccctatgaactactaactgct

SEQ ID NO: 254841 - DNA, 75 bp, Artificial Sequence
  Synthetic
tgtctcgagttgaatgtagttgtgcgcagaactgtgggctctacagagaaggtggtattctataataacgccgct

SEQ ID NO: 254842 - DNA, 75 bp, Artificial Sequence
  Synthetic
cttgatgttctgtcaccatggaaaaatgtcttgatgaacggctgtatctttgatgctaataaagtctgcaagaga

SEQ ID NO: 254843 - DNA, 75 bp, Artificial Sequence
  Synthetic
gtggaggacatcccgcttgagaaggaacagcgctttaggccaatataccttaccataacactgctcactgattct

SEQ ID NO: 254844 - DNA, 75 bp, Artificial Sequence
  Synthetic
ggcctctataaaacacccagtatgatccaggacattagggcaaacaatgcagttgcatttaatttacttgtgtac

SEQ ID NO: 254845 - DNA, 75 bp, Artificial Sequence
  Synthetic
ttaacagcagggaacggaattatggaaaagctctaccctcatactggatcagaacctgaacagactgttgtctca

SEQ ID NO: 254846 - DNA, 75 bp, Artificial Sequence
  Synthetic
ttcatggtccatgttggtctattcatgcgggggcggaagaaagcctattcccatgactactgcagacttaaggtt

SEQ ID NO: 254847 - DNA, 75 bp, Artificial Sequence
  Synthetic
gaacgaatgaacctacagtttgggcttgggggagtcggtggcgtaagcttccatatgcgggtgcagggcaaactc

SEQ ID NO: 254848 - DNA, 75 bp, Artificial Sequence
  Synthetic
agcaagtctctgcatgcacagcttgggtttcaccggagtgtctgctattctttaatggacattaacccggcattg

SEQ ID NO: 254849 - DNA, 75 bp, Artificial Sequence
  Synthetic
aacaagctcctgtggcgaacacaatgctccattcagagggtagttgcagttttccagccctcagtgccctctgaa

SEQ ID NO: 254850 - DNA, 75 bp, Artificial Sequence
  Synthetic
ttcaggatctacaatgatgtcctgatagataatacaggaaagattatgacttactaagatcaagtcagccatcgg

SEQ ID NO: 254851 - DNA, 75 bp, Artificial Sequence
  Synthetic
tgggagtgttagagctcttccaatattcagttcatcactaggtaacctataagctcattagtaccagaatgtgat

SEQ ID NO: 254852 - DNA, 75 bp, Artificial Sequence
  Synthetic
atgtttccgatacggggtgtcacactatgatacacaacagcgatagtacagattagtagttatatgcaggtctct

SEQ ID NO: 254853 - DNA, 75 bp, Artificial Sequence
  Synthetic
aatacttaatggtacgacatctcaatcagacaaatcattaagcaccagccacgatcagtgtctcactctatagct

SEQ ID NO: 254854 - DNA, 75 bp, Artificial Sequence
  Synthetic
acaacaatgagtcttcctatacagaccttccaagcactgtatatcacacttataatgggtaagggctagtttcag

SEQ ID NO: 254855 - DNA, 75 bp, Artificial Sequence
  Synthetic
tcagatagtatatattgtttgggttaataatctaacaacaaaaaacttagggcaaaagaccctttaatcctggat

SEQ ID NO: 254856 - DNA, 75 bp, Artificial Sequence
  Synthetic
ctctgtacagtgccagacagaccaatccatagctccccactcacagtctcctcactagcaatcaccggaggattc

SEQ ID NO: 254857 - DNA, 75 bp, Artificial Sequence
  Synthetic
gttgtggtaagtcatatagagctatatttatactttcaccaaattctatattcactgtcagcatccgctggatct

SEQ ID NO: 254858 - DNA, 75 bp, Artificial Sequence
  Synthetic
tgtcttacaatctgttgcagggaactctatatctggattaaatcatgagtaactacttccctgctagggtcatta

SEQ ID NO: 254859 - DNA, 75 bp, Artificial Sequence
  Synthetic
taattgtctcattgattaccgcagtgagctgtcagatttccttccagaatttgagtaccatcggcgtattcaaat

SEQ ID NO: 254860 - DNA, 75 bp, Artificial Sequence
  Synthetic
tcaaagaatatgattatagagtctcaggtgattacaatgaacagtttctagcaattaaaatggtcccaaatgtga

SEQ ID NO: 254861 - DNA, 75 bp, Artificial Sequence
  Synthetic
caggagttgagaactgtacagcttcgttgatagatgagtatcggcatgtcatctacaacttactgcagcctatca

SEQ ID NO: 254862 - DNA, 75 bp, Artificial Sequence
  Synthetic
acacaacccttactgcatcaactagcaatgttgacccttatgctggtaacaaaaaattctttggagctgtcatag

SEQ ID NO: 254863 - DNA, 75 bp, Artificial Sequence
  Synthetic
ccggtgttgctctaggtgtcgctacagctgcccaagtcacagctggagtagcactgtatgaggcccgccagaacg

SEQ ID NO: 254864 - DNA, 75 bp, Artificial Sequence
  Synthetic
ctgctgctatagctgaaataaaagaaagcttacattacacgcataaagctatagagtcacttcaaatatcacaga

SEQ ID NO: 254865 - DNA, 75 bp, Artificial Sequence
  Synthetic
aacagacagtggtagcaatccagggtattcaagatcagattaacaccaacattatccctcaaataaatgctctaa

SEQ ID NO: 254866 - DNA, 75 bp, Artificial Sequence
  Synthetic
catgtgagatagcaaaccaaagactccgattaatgttgctgcagtattacactgagatgctcagttcctttggtc

SEQ ID NO: 254867 - DNA, 75 bp, Artificial Sequence
  Synthetic
ctattattcaggatccattgtctggtcatatcactgtacaagcattgtcccaagcagccggagggaacataactg

SEQ ID NO: 254868 - DNA, 75 bp, Artificial Sequence
  Synthetic
gattaatgcgagaactcggatactcatcaaaagatctaagatatatattatcagtaaatggaatcagtgctaata

SEQ ID NO: 254869 - DNA, 75 bp, Artificial Sequence
  Synthetic
ttattgatgctgatcctgaaataggatcaatcatacttaggatacggtatccaagtatgatcaaaatcccagatg

SEQ ID NO: 254870 - DNA, 75 bp, Artificial Sequence
  Synthetic
ttgctgttatggagctctcctaccttgcataccatgctgccggtggtgactggctcacagttggccctaggttta

SEQ ID NO: 254871 - DNA, 75 bp, Artificial Sequence
  Synthetic
tccttaaacgtggttactctttatcgaacctagatataacttcctgtacaattggagaagatttcctgttatgca

SEQ ID NO: 254872 - DNA, 75 bp, Artificial Sequence
  Synthetic
gtaaagatgtatcctctccgatgagtcttgctacacaatcttgcttaaggggggatactcaaatgtgttcaagaa

SEQ ID NO: 254873 - DNA, 75 bp, Artificial Sequence
  Synthetic
cagctgttcaagatagagaggccccacggttcttattacttcaaggcaacctaatagtaaattgcatgtctgtaa

SEQ ID NO: 254874 - DNA, 75 bp, Artificial Sequence
  Synthetic
actgcaagtgtgaagatccagaggagacaatcactcaggacccggcatatcctttgatggtcctaggtagtgata

SEQ ID NO: 254875 - DNA, 75 bp, Artificial Sequence
  Synthetic
cgtgcaaaatacattatattgatggaatcagaataaagttaggcaaggtgcagcttcccccaattacagttctga

SEQ ID NO: 254876 - DNA, 75 bp, Artificial Sequence
  Synthetic
atacactgtccttaggccctattgttgtcttaaatccaattgatgtcagcaatcagctcagtttagttgaaacta

SEQ ID NO: 254877 - DNA, 75 bp, Artificial Sequence
  Synthetic
cagttaaagaatctgaagaccacttaaagaatgctatcggtgccttgagatctcaatcaagagtaggaggggtag

SEQ ID NO: 254878 - DNA, 75 bp, Artificial Sequence
  Synthetic
ggattgttgcaattgtaggcttaatcatagcaacagtatcattggtagttctagttattagtggctgttgtcttg

SEQ ID NO: 254879 - DNA, 75 bp, Artificial Sequence
  Synthetic
tcaaatattttagtagaacagcaaccctagagtccagtctcaccacgatagaacatggtccgactctagcaccaa

SEQ ID NO: 254880 - DNA, 75 bp, Artificial Sequence
  Synthetic
aatcaggacctatcatccctacatatattaatccagtttatagacatgattgagacaaagggggcatgactgacc

SEQ ID NO: 254881 - DNA, 75 bp, Artificial Sequence
  Synthetic
agtgctagtatacttatcccctgttcacaaatatggagtcagcagaatattcttttaaagaacagatcatgcaaa

SEQ ID NO: 254882 - DNA, 75 bp, Artificial Sequence
  Synthetic
catcagccatctacttccatgataaatccagataatacagtgtgtatgtgtgtaaaagaccccccaaatcctatc

SEQ ID NO: 254883 - DNA, 75 bp, Artificial Sequence
  Synthetic
tgtacccttcacaagatgaatataatcctttcttcagccatatattctctatgcctaatagttgatctccatgaa

SEQ ID NO: 254884 - DNA, 75 bp, Artificial Sequence
  Synthetic
gtacaagatttagaccgtaatgtaatactgtcctttgtcatttttgttcccacagaatcccagtaagttactcta

SEQ ID NO: 254885 - DNA, 75 bp, Artificial Sequence
  Synthetic
gtgttagtggtgatgactaaagaaaaacgtaggatccaggatcctaaagccaacttttggggttcaaaatggttg

SEQ ID NO: 254886 - DNA, 75 bp, Artificial Sequence
  Synthetic
atccacctgcagtatcctattacacagggacaggccggaatgacagagttaaagtagttacaacacagtccacaa

SEQ ID NO: 254887 - DNA, 75 bp, Artificial Sequence
  Synthetic
acccttattgggctcataatcctaatcaaggtctaaggaggctcatagatatggtagtgaacgtgataatggtga

SEQ ID NO: 254888 - DNA, 75 bp, Artificial Sequence
  Synthetic
caggtgttatctttgccctaatcaacatcatcttaggtatcgtgataatttctcagagtgcaggttcaaggcaag

SEQ ID NO: 254889 - DNA, 75 bp, Artificial Sequence
  Synthetic
atacaagcaagagtctagatataatacagcatgtggactcaagtgtggcaattacaaaacaaatcgtcatggaaa

SEQ ID NO: 254890 - DNA, 75 bp, Artificial Sequence
  Synthetic
atctagaaccgaaaattcgtagtatccttgacagtgtttcttttcagattccaaagctattgtcatcactgcttg

SEQ ID NO: 254891 - DNA, 75 bp, Artificial Sequence
  Synthetic
ggcctggtaagactgacccacctatcgctctccctacgaaagcatctactccagtaattcctacagaatatccat

SEQ ID NO: 254892 - DNA, 75 bp, Artificial Sequence
  Synthetic
cccttaacacaacaacatgcttgaggatagaggagtctgttacacaaaatgctgctgctttattcaatatcagtt

SEQ ID NO: 254893 - DNA, 75 bp, Artificial Sequence
  Synthetic
ttgacctcaagacagtaatgtatgagttagtgactagaacaggggggtgcgtaaccttaccctcatattccgaac

SEQ ID NO: 254894 - DNA, 75 bp, Artificial Sequence
  Synthetic
tctacacacgtgtaaggacattctctactgcgatacggaaccctaaaacatgtcaaagggcagggcaagagactg

SEQ ID NO: 254895 - DNA, 75 bp, Artificial Sequence
  Synthetic
atttaaatcttattccggcattcataggaacggacacagggatcttgataaattcctgtgttaggcaacctgtga

SEQ ID NO: 254896 - DNA, 75 bp, Artificial Sequence
  Synthetic
ttgcaacaggtgatggtatctatgcactgacgtatctgacaatgagaggaacatgccaagatcaccgtcatgcag

SEQ ID NO: 254897 - DNA, 75 bp, Artificial Sequence
  Synthetic
tacgccactttgaaataggcttggtgcgtagagatgcctggtgggaccctgtcctaacaccgattcaccacttca

SEQ ID NO: 254898 - DNA, 75 bp, Artificial Sequence
  Synthetic
cagagcccggaactccggtttttgacgggtgctcattgactgttcaaaatcaaactgctctagccttgtgtacac

SEQ ID NO: 254899 - DNA, 75 bp, Artificial Sequence
  Synthetic
tgacaacagacggtccagagacagatatacataatggagcatcattgggtctagcattggttcacttcaatatca

SEQ ID NO: 254900 - DNA, 75 bp, Artificial Sequence
  Synthetic
gaggagaattttccaaacataaagttgacccgaggaatatagatacccaaaaccaaggactgcatctagttacca

SEQ ID NO: 254901 - DNA, 75 bp, Artificial Sequence
  Synthetic
cagcaggaaagtcagcagtcaaaaagggaatattatactcattcggatacatggttacaagatcacctgagccag

SEQ ID NO: 254902 - DNA, 75 bp, Artificial Sequence
  Synthetic
gtgattctaagtgtgtcactgaagagtgtaatcaaaataatcaggaaaaatgcaacgcttatagtaagacgaccc

SEQ ID NO: 254903 - DNA, 75 bp, Artificial Sequence
  Synthetic
tagatcctgacaaacctcgatctatgataatattccagattgacgttggggctgagtacttcacagtcgataaag

SEQ ID NO: 254904 - DNA, 75 bp, Artificial Sequence
  Synthetic
ttgtagtagtgcctagaacccaatattaccagcttacatctggtgatttgttttatacaggagaggaaaatgatc

SEQ ID NO: 254905 - DNA, 75 bp, Artificial Sequence
  Synthetic
tgctgtatcaactgcataataagggttggtacaacaaacctataaggggaagagttacatttgatggccaggtga

SEQ ID NO: 254906 - DNA, 75 bp, Artificial Sequence
  Synthetic
cattacatgaacatagcaggacatatgacagtttgtctaaccagagagcatgtaatcctaggttaggttgtcctt

SEQ ID NO: 254907 - DNA, 75 bp, Artificial Sequence
  Synthetic
ctacatgtgaattaacatcaatggcaagctattttccactcgacaaggattttaaagctgcagtaggtgttatag

SEQ ID NO: 254908 - DNA, 75 bp, Artificial Sequence
  Synthetic
cattaagaaacggaatgacacctatcattacatactctactgacgattggcgcaatcactggaagtacatcaaga

SEQ ID NO: 254909 - DNA, 75 bp, Artificial Sequence
  Synthetic
atgctgatttggaattttcggagtcatccctgtcatgttactcccctaaccctccgcttgatgattatgtccttt

SEQ ID NO: 254910 - DNA, 75 bp, Artificial Sequence
  Synthetic
gtacagcagtcatcacagcaaaagttatgagcaatactaatccacagctgttggcaacatcatggtatcagtatg

SEQ ID NO: 254911 - DNA, 75 bp, Artificial Sequence
  Synthetic
acaaatgtcacacttaagcagcagtaaattgtttctaatgaactcagtttataatccatgctatataagagtcca

SEQ ID NO: 254912 - DNA, 75 bp, Artificial Sequence
  Synthetic
taggttgaacccctgcagacttacaacacccttttggctctgtcttagagaattatctacaatcagtattgcagt

SEQ ID NO: 254913 - DNA, 75 bp, Artificial Sequence
  Synthetic
ggattccttaatacttgggcattatatttcctccaacacatatcatggtctgtataatgcttatcagattgtaag

SEQ ID NO: 254914 - DNA, 75 bp, Artificial Sequence
  Synthetic
acacctagggtatgagaactaaaaatggtactcagtaagagaatagattaaaactactagatattaagcctcatc

SEQ ID NO: 254915 - DNA, 75 bp, Artificial Sequence
  Synthetic
agtatagacttaatagtgttttaacaattatgttaatttgatatttcggtcagtagtattaactaacctcatttg

SEQ ID NO: 254916 - DNA, 75 bp, Artificial Sequence
  Synthetic
ttagaatattacaaaaaacttaggatccaagaggagctccgtaagctccaataatggatccatctccacatgata

SEQ ID NO: 254917 - DNA, 75 bp, Artificial Sequence
  Synthetic
ccattctttatccagaatcccatctgaatagccctattgtagctcaaaggcttgtagcttatctagagtactctc

SEQ ID NO: 254918 - DNA, 75 bp, Artificial Sequence
  Synthetic
tactgcctcacaaccaagttctgagcgatgaaacagttactgctaatattcggaatcgaatatcaacatttggaa

SEQ ID NO: 254919 - DNA, 75 bp, Artificial Sequence
  Synthetic
ttccacttcatctaagggttcttcagacatcaggacacattgtatctccttggatagcaccgcgaggacgttata

SEQ ID NO: 254920 - DNA, 75 bp, Artificial Sequence
  Synthetic
atcatgtaccctatccagagtgtaatagtcgattgtttaaatacagtgaccctaaaatttcaaaaaggctagaac

SEQ ID NO: 254921 - DNA, 75 bp, Artificial Sequence
  Synthetic
aagtccttgctcatgctaacaatacttacagttcagttagtgataagatcactaagtgcctcacagatgttcgcc

SEQ ID NO: 254922 - DNA, 75 bp, Artificial Sequence
  Synthetic
actcccttggcctacatcagttaccaagagatgatgaggaaaatattggtcttagtcgaatcatggatttaccgg

SEQ ID NO: 254923 - DNA, 75 bp, Artificial Sequence
  Synthetic
atatcatgatatcatcacagtggtatgactcatttctattttggtttacacttaaaacggaaatgagatcatgcc

SEQ ID NO: 254924 - DNA, 75 bp, Artificial Sequence
  Synthetic
ttaagatagcaactccaatcccctcaaattcaagcggcacaccagtcgttataagatcagatggaactgtaatcg

SEQ ID NO: 254925 - DNA, 75 bp, Artificial Sequence
  Synthetic
taattaataggtatttactgtacatgatctctcatgaattgagcgaggttttctacctgacatttgaaatggttc

SEQ ID NO: 254926 - DNA, 75 bp, Artificial Sequence
  Synthetic
ttatgatgtgtgatgttgtcgaaggccggttaatgtgtgaggttgcaatggcggcagatccaaaatatggctctc

SEQ ID NO: 254927 - DNA, 75 bp, Artificial Sequence
  Synthetic
taataccacatgttaaaacactttggatctttattgatggcttatttcctgatcttggcaataatacatataata

SEQ ID NO: 254928 - DNA, 75 bp, Artificial Sequence
  Synthetic
ttgtctctttactagagcctttaacattaggctttttacaattaaaagatgaagcacctatacttgctggtgcct

SEQ ID NO: 254929 - DNA, 75 bp, Artificial Sequence
  Synthetic
tccttgagcactgcttgtccgaagtaacaaacgaattaatttctaatgggtttactgatgaatatgatataagag

SEQ ID NO: 254930 - DNA, 75 bp, Artificial Sequence
  Synthetic
aggtactcagaattattaggacaatattcagtattgatgacatccacatgctagcagaaatgttctcttttttta

SEQ ID NO: 254931 - DNA, 75 bp, Artificial Sequence
  Synthetic
gaagcttcggacacccaatactggaggcagaagaagcagcagaaaaggtcagggagcatatgcataagccgaaac

SEQ ID NO: 254932 - DNA, 75 bp, Artificial Sequence
  Synthetic
ttatctcatttgaagtaatgatgaaaggacatgcactgttctgtgctacaatcataaatggttatcgggatcgtc

SEQ ID NO: 254933 - DNA, 75 bp, Artificial Sequence
  Synthetic
atggcggagcatggcctcccgttcaattccctgaccacataagcaaccctataaggtcagctcagttaaacaatg

SEQ ID NO: 254934 - DNA, 75 bp, Artificial Sequence
  Synthetic
aagctattactgatgcagttgcggttacaaactggaagtctttctgtggagtacaattcgggtgctttttaccat

SEQ ID NO: 254935 - DNA, 75 bp, Artificial Sequence
  Synthetic
tatcacttgatgaagacctcactatgtatatgaaagacaaagctttagcagctattgcgaaagagtgggactctc

SEQ ID NO: 254936 - DNA, 75 bp, Artificial Sequence
  Synthetic
cataccctattgaggtaatgaattacagacctcccaaacaaacaacctctcggcgtcttgtcgacgtattcatca

SEQ ID NO: 254937 - DNA, 75 bp, Artificial Sequence
  Synthetic
atgatcccaaatttgacccttatgacatgataacatatgttactagtggtgaataccttcatgatcctgacttca

SEQ ID NO: 254938 - DNA, 75 bp, Artificial Sequence
  Synthetic
atctctcatacagtctcaaggaaaaagaaactaaaaaagtgggaagactgtttgcaaaaatgtcatataaaatga

SEQ ID NO: 254939 - DNA, 75 bp, Artificial Sequence
  Synthetic
gggcatgtcaagttattgctgaatccctgattgccaatggtgtgggttcatatttcaaggataatggtatgtcca

SEQ ID NO: 254940 - DNA, 75 bp, Artificial Sequence
  Synthetic
aggatgaacatgagttggcaaaaacactacaccgcctttccatatcatcagttccaaggaataacaagtatcgcc

SEQ ID NO: 254941 - DNA, 75 bp, Artificial Sequence
  Synthetic
aacaagtagcagatctgatgaatagaaggaactttggaccccagagcagcaatagtaataatagaggatcagtca

SEQ ID NO: 254942 - DNA, 75 bp, Artificial Sequence
  Synthetic
atcatgactatgttcaacaaggaaatgtcaagggcctctcaggggttgttaatgataacaatgcagaacaatatg

SEQ ID NO: 254943 - DNA, 75 bp, Artificial Sequence
  Synthetic
aaaccatcagtacgttcttgactacggatctgcagaagttctgcttaaattggagagcagaaaccatcaatatat

SEQ ID NO: 254944 - DNA, 75 bp, Artificial Sequence
  Synthetic
tcgctgaacgacttaatgagatatatgggcttcctggatttttccaatggttgcataaacgactggaaatctcta

SEQ ID NO: 254945 - DNA, 75 bp, Artificial Sequence
  Synthetic
atctttatgtttgtgatccttattgcccgccaaaaaatgaccaccatattgatatcaatgacaatttaaatgaac

SEQ ID NO: 254946 - DNA, 75 bp, Artificial Sequence
  Synthetic
acatattcatcaaacaccctatgggtggtattgagggcttcaaccagaagttgtggacaatagccactatcccgt

SEQ ID NO: 254947 - DNA, 75 bp, Artificial Sequence
  Synthetic
tcctatacttgtctgcgtatgaaacaggcctaaggataagctctgtagtacaaggcgacaatgaagcaattgcaa

SEQ ID NO: 254948 - DNA, 75 bp, Artificial Sequence
  Synthetic
taactaagcgggtccctagctcttacccgtattggttgaagaaacaagagagtgctgaagcggcacgggtatact

SEQ ID NO: 254949 - DNA, 75 bp, Artificial Sequence
  Synthetic
ttcaccaacttcgtcacaattttgccatgatagggcataacctaaaggcaaatgagactctaatttcaagtcatt

SEQ ID NO: 254950 - DNA, 75 bp, Artificial Sequence
  Synthetic
tctttatttattcaaagcagatttactatgacggagttgttctatctcaagctctcaagtcaatcgctaggtgtg

SEQ ID NO: 254951 - DNA, 75 bp, Artificial Sequence
  Synthetic
ttttctggtcagagactattgttgatgagactcgatctgcatgtagtaatattgctacaaccatcacaaaatcaa

SEQ ID NO: 254952 - DNA, 75 bp, Artificial Sequence
  Synthetic
tagaaaagggctactcgcgcaatgtcggctatgcattgtgtatcctgaaaacaattcagcaattaatgatagcat

SEQ ID NO: 254953 - DNA, 75 bp, Artificial Sequence
  Synthetic
tggatttcaccatcaatcctcacatgactcctgatattaagaacccaatccttggcaatcggtcttggttgatac

SEQ ID NO: 254954 - DNA, 75 bp, Artificial Sequence
  Synthetic
atgcagctctaacacctgctccactaggagggttcaattatattaatatgagcaggatatatgttagaaatatag

SEQ ID NO: 254955 - DNA, 75 bp, Artificial Sequence
  Synthetic
taatgttatatgcccagacggacccagacccgggtccttcgaactataaatacccctcgctcgtccccaacctcc

SEQ ID NO: 254956 - DNA, 75 bp, Artificial Sequence
  Synthetic
tcgtttttttgtatgcgcgatttatcatgtctgccttgatccaccccgttgcctgcaatcggacttgccaagact

SEQ ID NO: 254957 - DNA, 75 bp, Artificial Sequence
  Synthetic
acgtcaaccacgctagacacgaatgttgtttagtgtgtaaccctccgccacccccttcatctcctactgtcgcac

SEQ ID NO: 254958 - DNA, 75 bp, Artificial Sequence
  Synthetic
attgttcagaatgtcggtcgcccgtcgatctggtcgaagaactcgcaaagctttccgccgcggtggtagagctac

SEQ ID NO: 254959 - DNA, 75 bp, Artificial Sequence
  Synthetic
aagatctcgtggccgaagtacacgccgctcttctaggcgaagagtcagacggcgaactatgactacccgacgtgt

SEQ ID NO: 254960 - DNA, 75 bp, Artificial Sequence
  Synthetic
cctcaacataaccactcgtaagaaggtggataacatgttgcctgttgttgttgccgaggataacacgactactgt

SEQ ID NO: 254961 - DNA, 75 bp, Artificial Sequence
  Synthetic
ggggccttacacgtccgtgtcacccctcctttcccttttcgttcccaatgcccgcacgacccgaacccctgttac

SEQ ID NO: 254962 - DNA, 75 bp, Artificial Sequence
  Synthetic
caatcctgccgtccgaaattcctcggatattttcgcggtcggatatagggagcgcgtccgcattgatcttatggg

SEQ ID NO: 254963 - DNA, 75 bp, Artificial Sequence
  Synthetic
tggtggaacttttatgtggcgccgcatcgtcttcatgttgaagggatccgatttgagagttgctatgaattccag

SEQ ID NO: 254964 - DNA, 75 bp, Artificial Sequence
  Synthetic
tgattcaggcaacattcctaatcagctgttcgatcagaccaccgaaggtggatgtcgacgcgtcatcggcccact

SEQ ID NO: 254965 - DNA, 75 bp, Artificial Sequence
  Synthetic
tctcggggtcactaatgcccgagatgagctgcaatcttacgtcttccggggtcaggaagattctgattgggcaga

SEQ ID NO: 254966 - DNA, 75 bp, Artificial Sequence
  Synthetic
tcagtttactgccccccttgatactcgtcgcattacggttaagtccgacaaactccgcgtcatccgccccggtaa

SEQ ID NO: 254967 - DNA, 75 bp, Artificial Sequence
  Synthetic
tgaaacaggtgcttcgcgcttgtttaagttttggtaccccattcgtcgtaccatctcttacgaagatgaccttga

SEQ ID NO: 254968 - DNA, 75 bp, Artificial Sequence
  Synthetic
gtccgacgttgtcggtgatcggcccttttctaccgcaggtttacgaggtgttggggatatgtacgtcatggatat

SEQ ID NO: 254969 - DNA, 75 bp, Artificial Sequence
  Synthetic
aatgggtattacgaatttggtgaatgatgcacctccaacgtcctacaggttcggtcctgagggcagcttttattg

SEQ ID NO: 254970 - DNA, 75 bp, Artificial Sequence
  Synthetic
gcatgagcggtaaattaggagactatggggctatctaggtacacgaaatcgcagttggcattaagccactcggtg

SEQ ID NO: 254971 - DNA, 75 bp, Artificial Sequence
  Synthetic
tcaacaccaagctcgtcacgtgggtcggagttagatagccaaattgagggccgagcccagtgtaccaactttttc

SEQ ID NO: 254972 - DNA, 75 bp, Artificial Sequence
  Synthetic
cccttgtacttatccgtgacgtagaactgcttttgatgacctaaccagaatttgtagctgggaaggaatttaatt

SEQ ID NO: 254973 - DNA, 75 bp, Artificial Sequence
  Synthetic
cctccgaagtcgtcaaagatggcgtactcaaccccatcaaggttttcgtccaagctaaagaggcctccgaagtaa

SEQ ID NO: 254974 - DNA, 75 bp, Artificial Sequence
  Synthetic
gcatggtttcccaggcttctagcccaaatggtttttcccattctggaaggcccgtataccacaagtgattttctt

SEQ ID NO: 254975 - DNA, 75 bp, Artificial Sequence
  Synthetic
cgttctgtatatcgaagtcagcatccagatttgttgatgcgcactcgagcgaggcgctgcgcgaggcccccgccg

SEQ ID NO: 254976 - DNA, 75 bp, Artificial Sequence
  Synthetic
agcatggaggcgcgcgtagccgccgactgcagccgctgcgacgtgcatgataacttacctccagtttcacctcgt

SEQ ID NO: 254977 - DNA, 75 bp, Artificial Sequence
  Synthetic
ccaagattttgttgtacccattgattgagttcagccacccaagacgtatcgatgttaactccctccggtgtctca

SEQ ID NO: 254978 - DNA, 75 bp, Artificial Sequence
  Synthetic
tacgggactctgattggtgggaatttccaggctgcgtatgccctgagctgggtgaaggaggtgaccaatgagcgt

SEQ ID NO: 254979 - DNA, 75 bp, Artificial Sequence
  Synthetic
ggagccaggcgtttgcataggtcccaaaactcttgctcactctcagcattgatgatttcagcccacaccccacta

SEQ ID NO: 254980 - DNA, 75 bp, Artificial Sequence
  Synthetic
gttgcatccactctgcctgcaacaggtcgctcgagtcccccagcaacaacatctccatctttgattgcataatca

SEQ ID NO: 254981 - DNA, 75 bp, Artificial Sequence
  Synthetic
aacccctcttctggtgttccgcgagaaggcgatacatttgggtggcatccttcaacatcgaatgcacgcgcgttc

SEQ ID NO: 254982 - DNA, 75 bp, Artificial Sequence
  Synthetic
cgggtcctatatttgactccgaagtcgacaaaagcgtgcagatgaagacccccatctgcgtgattctctcggccg

SEQ ID NO: 254983 - DNA, 75 bp, Artificial Sequence
  Synthetic
atgatgcattcagctccaagtcccgcaagatgattgaccactgcaaaagggtcgaggtctccacattgtggatag

SEQ ID NO: 254984 - DNA, 75 bp, Artificial Sequence
  Synthetic
gtgagcaaggcgtaccgtgcttgaaatcgaaaagaggacatagttcgttgttgcacattttccttgggtccaagt

SEQ ID NO: 254985 - DNA, 75 bp, Artificial Sequence
  Synthetic
gcgtaccgtgcttgaaatcgaaaagaggacatagttcgttgttgcacattttccttgggtccaagtctgggcagt

SEQ ID NO: 254986 - DNA, 75 bp, Artificial Sequence
  Synthetic
aggggccaggcccatcatagtctcatcttccgaaggaggcactggagggactcagattcctgagcctcttttcgc

SEQ ID NO: 254987 - DNA, 75 bp, Artificial Sequence
  Synthetic
ttgcaaaaactgatgacataatctattcaaagattaagatcgacaaggatgcagctaattacaagggagtttctt

SEQ ID NO: 254988 - DNA, 75 bp, Artificial Sequence
  Synthetic
acagtaagcccggaagtggtgttttgcgatttcgaggccgggctcgatcctcacctttcattgtcgataggggac

SEQ ID NO: 254989 - DNA, 75 bp, Artificial Sequence
  Synthetic
tgagttcatctctgaatcatcacaacaaaaggtaactcctgtagtgacggcgtgcatgctgtccttcggtgctgg

SEQ ID NO: 254990 - DNA, 75 bp, Artificial Sequence
  Synthetic
gtctgtgctcaaagcatttgagcgattcacgatagaacaggaacttcaagacaggggtgaggagggttcaattcc

SEQ ID NO: 254991 - DNA, 75 bp, Artificial Sequence
  Synthetic
actcttccctaattgcctcggcagccagtcaccacaatcccagaaccatagatgctctaccagctctgattatag

SEQ ID NO: 254992 - DNA, 75 bp, Artificial Sequence
  Synthetic
ttcaaagattaagatcgacaaggatgcagctaattacaagggagtttcttggaatccattccggaaatctgcttc

SEQ ID NO: 254993 - DNA, 75 bp, Artificial Sequence
  Synthetic
agatgacgacggtgatgaagatggaggtgcaggattccaaaatggagcacaagcaccagctgtaagacagggagg

SEQ ID NO: 254994 - DNA, 75 bp, Artificial Sequence
  Synthetic
aaagtcttcgttattaacacacccaatcccaccacacgctaccagatgctaaacttttgcctaaggataatctgc

SEQ ID NO: 254995 - DNA, 75 bp, Artificial Sequence
  Synthetic
cagtcaccacaatcccagaaccatagatgctctaccagctctgattatagaaaaaataagtccgaaaagatatat

SEQ ID NO: 254996 - DNA, 75 bp, Artificial Sequence
  Synthetic
catagtcctgatcaatcaatatgagaaaaactctagctattggtttgggttttatgatcttttcattatcagtat

SEQ ID NO: 254997 - DNA, 75 bp, Artificial Sequence
  Synthetic
aaaaactctagctattggtttgggttttatgatcttttcattatcagtatgtataaatatcaatactctacaaca

SEQ ID NO: 254998 - DNA, 75 bp, Artificial Sequence
  Synthetic
ctcacttccctcagcaggcatgcaaaatcatattagattagcagatagatcacctgaagctcagatagaacgctg

SEQ ID NO: 254999 - DNA, 75 bp, Artificial Sequence
  Synthetic
agacaattaagctactattcacagagttcaagtgcatatattgtggttaagcttctaccaaatatcaagccaagt

SEQ ID NO: 255000 - DNA, 75 bp, Artificial Sequence
  Synthetic
gttcaagtgcatatattgtggttaagcttctaccaaatatcaagccaagtaatgggaattgtgaatttaatagtg

SEQ ID NO: 255001 - DNA, 75 bp, Artificial Sequence
  Synthetic
gatgcaaggggcgaacacggaaataccttcccaaacaatcctaatcaaaacgcacagtcgcaagtgggcgactgg

SEQ ID NO: 255002 - DNA, 75 bp, Artificial Sequence
  Synthetic
ccaaggtccgagagtccatgtgcgctcctaaggtattagactttcaaacaataatgaagaccctggctttctttc

SEQ ID NO: 255003 - DNA, 75 bp, Artificial Sequence
  Synthetic
taacctacttcttccaatcgcagagaatattaacagcatagcaccgccctcatcaagtagtcggcgcaggaaaag

SEQ ID NO: 255004 - DNA, 75 bp, Artificial Sequence
  Synthetic
aaatacccccaattgcaataacccaaggacaatctagccaccgctaactgcctacatccactacatttcattcaa

SEQ ID NO: 255005 - DNA, 75 bp, Artificial Sequence
  Synthetic
aatattaacagcatagcaccgccctcatcaagtagtcggcgcaggaaaaggtttgcaggtattgctatcggaatt

SEQ ID NO: 255006 - DNA, 75 bp, Artificial Sequence
  Synthetic
atctagtctttaagaaaaatttaggcccggaaagaattagttctacgagcatcgacacaattatcctgatcgtgt

SEQ ID NO: 255007 - DNA, 75 bp, Artificial Sequence
  Synthetic
cacaagttacagctgcagtttcattggtgcaagcccaaacgaatgcacgtgcaattgcaacgcttaagaattcta

SEQ ID NO: 255008 - DNA, 75 bp, Artificial Sequence
  Synthetic
ggtgcaagcccaaacgaatgcacgtgcaattgcaacgcttaagaattctattcaggccactaacaaagcaatttt

SEQ ID NO: 255009 - DNA, 75 bp, Artificial Sequence
  Synthetic
ctagccattgcagtacaagcaattcaagatcacatcaatacaatcatgaatacacaattaaacaacatgtcttgt

SEQ ID NO: 255010 - DNA, 75 bp, Artificial Sequence
  Synthetic
ggagtccattcaggaagtctgcctcaatgagcaacctatgagaatttcctctattcccactgattcctccaggag

SEQ ID NO: 255011 - DNA, 75 bp, Artificial Sequence
  Synthetic
aagatcacatcaatacaatcatgaatacacaattaaacaacatgtcttgtcaaattctcgataatcagcttgcaa

SEQ ID NO: 255012 - DNA, 75 bp, Artificial Sequence
  Synthetic
caccagtactcattggcaatccagagcaaaagaccattcagtaccccactacatcaaatcagggatccaagtcaa

SEQ ID NO: 255013 - DNA, 75 bp, Artificial Sequence
  Synthetic
aatggtgggtgacattggaaagtacattgagaattcaggccttactgccttctttctcaccctcaaatatgcact

SEQ ID NO: 255014 - DNA, 75 bp, Artificial Sequence
  Synthetic
actaacaacagttttccaacctcaattagttaatccggcactatcacctatcagcattcaagctttaagatcttt

SEQ ID NO: 255015 - DNA, 75 bp, Artificial Sequence
  Synthetic
ttagttaatccggcactatcacctatcagcattcaagctttaagatctttgctaggcagtatgacacctgcagtg

SEQ ID NO: 255016 - DNA, 75 bp, Artificial Sequence
  Synthetic
gcaactttacttaatggacgtcccatcgagggattagaaacacctgatcccattgaattggtacatgggtgtttg

SEQ ID NO: 255017 - DNA, 75 bp, Artificial Sequence
  Synthetic
ggttgctatcaaacagatactatgcaatggtgggtgacattggaaagtacattgagaattcaggccttactgcct

SEQ ID NO: 255018 - DNA, 75 bp, Artificial Sequence
  Synthetic
tatctgctgcagagattttgagtgccggcctgatggaaggtcagatagttgcagtttttttagatcaaatgcaaa

SEQ ID NO: 255019 - DNA, 75 bp, Artificial Sequence
  Synthetic
cggcctgatggaaggtcagatagttgcagtttttttagatcaaatgcaaatgatagttaaagttaatgttccgac

SEQ ID NO: 255020 - DNA, 75 bp, Artificial Sequence
  Synthetic
cccaaataatggactttgcacccggaggctacccattgatattcagttatgctatgggagtcggtacagtcctag

SEQ ID NO: 255021 - DNA, 75 bp, Artificial Sequence
  Synthetic
gtaatagatttccactccatatcaagctttatcaataatcaggagtctttgatccagttacctagcagaatttta

SEQ ID NO: 255022 - DNA, 75 bp, Artificial Sequence
  Synthetic
gctttatcaataatcaggagtctttgatccagttacctagcagaattttagaaatcggaagtgagcaatggagtt

SEQ ID NO: 255023 - DNA, 75 bp, Artificial Sequence
  Synthetic
taagtcaatacaataagaccttgagtaatttgcttcttccaattgcagagaatataaacaatattgcatcgccct

SEQ ID NO: 255024 - DNA, 75 bp, Artificial Sequence
  Synthetic
aagaaatcatatattctgtcaatataatgaagcagagataatgagtctagagtcaaagcaatgcttagctggcaa

SEQ ID NO: 255025 - DNA, 75 bp, Artificial Sequence
  Synthetic
aatgaagcagagataatgagtctagagtcaaagcaatgcttagctggcaatattagtgcatgtgtgttcacacct

SEQ ID NO: 255026 - DNA, 75 bp, Artificial Sequence
  Synthetic
aaggggcagaggtgcggggataccaggtgggcccgtaaatccttttgttcctccagttcaacagcaacaacctgc

SEQ ID NO: 255027 - DNA, 75 bp, Artificial Sequence
  Synthetic
ggtgggcccgtaaatccttttgttcctccagttcaacagcaacaacctgctgccgcacatgaggacacccctgca

SEQ ID NO: 255028 - DNA, 75 bp, Artificial Sequence
  Synthetic
ttgttgcattggatggaactattgttgcaaattgccggagtctcacatgcctttgcaaagaaccatcttatccta

SEQ ID NO: 255029 - DNA, 75 bp, Artificial Sequence
  Synthetic
tgcaaattgccggagtctcacatgcctttgcaaagaaccatcttatcctatctatcagcccgaccatcatgcagt

SEQ ID NO: 255030 - DNA, 75 bp, Artificial Sequence
  Synthetic
tgaagtgaaagaaggcacccaacagttagccatagcggtacaagctatacaagaccacatcaacactattatgaa

SEQ ID NO: 255031 - DNA, 75 bp, Artificial Sequence
  Synthetic
aaaacattgtctctggatggattagacttcagtattgtctcattaagcaacgttacttatgctgagaatttaaca

SEQ ID NO: 255032 - DNA, 75 bp, Artificial Sequence
  Synthetic
tcaagcacaacttttcatgccattatatcctcaagtcagcaacatcccaaatcatcagaatcatcagatcaatcg

SEQ ID NO: 255033 - DNA, 75 bp, Artificial Sequence
  Synthetic
tgagcttagaagaagttttagtgatcatgtaacaattgttagtggaccaggagatgtgtcattcagctccggtga

SEQ ID NO: 255034 - DNA, 75 bp, Artificial Sequence
  Synthetic
acttcagtattgtctcattaagcaacgttacttatgctgagaatttaacaatttcattatctcaaacaatcaata

SEQ ID NO: 255035 - DNA, 75 bp, Artificial Sequence
  Synthetic
gcttagtagggtcaacgcatctctccaaaatgctgtcaattacataaaggagagcaataatcaattgcaatcagt

SEQ ID NO: 255036 - DNA, 75 bp, Artificial Sequence
  Synthetic
gcttgggagtatgactcctgcagtggttcaagcagcattatctactgcaatttctgctgctgaaatactaagcgc

SEQ ID NO: 255037 - DNA, 75 bp, Artificial Sequence
  Synthetic
caaaatgctgtcaattacataaaggagagcaataatcaattgcaatcagtcagtgttaattcaaagttaggagct

SEQ ID NO: 255038 - DNA, 75 bp, Artificial Sequence
  Synthetic
cctaatcaaaacgcacagtcgcaagtgggcgactgggatgagtaaatcactgacatgatcaaactacccccaatt

SEQ ID NO: 255039 - DNA, 75 bp, Artificial Sequence
  Synthetic
gcatattatcaattatcatttctctcttgttttgttgctgggcttatatagctactaaagagattagacgaatta

SEQ ID NO: 255040 - DNA, 75 bp, Artificial Sequence
  Synthetic
cttgttttgttgctgggcttatatagctactaaagagattagacgaattaatttcagaactaatcatattaacac

SEQ ID NO: 255041 - DNA, 75 bp, Artificial Sequence
  Synthetic
acagctaactgcccaaatccactacattccattcatatttagtctttaagaaaaaattaggcccggaaagaatta

SEQ ID NO: 255042 - DNA, 75 bp, Artificial Sequence
  Synthetic
attccattcatatttagtctttaagaaaaaattaggcccggaaagaattagttctacgagcatcgacacaattat

SEQ ID NO: 255043 - DNA, 75 bp, Artificial Sequence
  Synthetic
gtgagatactaaatcatcacaatcgcctattgggaaatcaaaattgaattaagaaaaaactaagaatgaaccccc

SEQ ID NO: 255044 - DNA, 75 bp, Artificial Sequence
  Synthetic
cctattgggaaatcaaaattgaattaagaaaaaactaagaatgaaccccctcgggtcgtaacgtctcgtgaccct

SEQ ID NO: 255045 - DNA, 75 bp, Artificial Sequence
  Synthetic
actcccctcttgtacagtctgcttaatgctcaccttcatggtcttgcttttgactttgtatgtttgtcttcttct

SEQ ID NO: 255046 - DNA, 75 bp, Artificial Sequence
  Synthetic
atgctcaccttcatggtcttgcttttgactttgtatgtttgtcttcttctaacgataattgataagaccatgatg

SEQ ID NO: 255047 - DNA, 75 bp, Artificial Sequence
  Synthetic
tcaatagaaacataggagacccattagtgtccgccattgctgatgtgaaacgattaattaaagctggctgtttag

SEQ ID NO: 255048 - DNA, 75 bp, Artificial Sequence
  Synthetic
tatcctatcgctggagatttgatgatccattttaggcagatcagcacatgcagccacgaagcaatcgattcaaca

SEQ ID NO: 255049 - DNA, 75 bp, Artificial Sequence
  Synthetic
tccattttaggcagatcagcacatgcagccacgaagcaatcgattcaacataacactactcatactaactaatta

SEQ ID NO: 255050 - DNA, 75 bp, Artificial Sequence
  Synthetic
tcagattcctgagccccttttcgcacaaacaggacaaggtggcattgtcaccaccgtttatcaggatccaactat

SEQ ID NO: 255051 - DNA, 75 bp, Artificial Sequence
  Synthetic
aattaagcccgaacaggtcaaagagagagcccacaaatcgcccaccacaaacaggtgtgccagtcccccaacatt

SEQ ID NO: 255052 - DNA, 75 bp, Artificial Sequence
  Synthetic
caaaatgccgttaagtacataaaggagagcaaccatcaactccaatctgtgagtgtaaattccaaaatcggagct

SEQ ID NO: 255053 - DNA, 75 bp, Artificial Sequence
  Synthetic
agagcccacaaatcgcccaccacaaacaggtgtgccagtcccccaacattccacaggatggagccatcaaaatta

SEQ ID NO: 255054 - DNA, 75 bp, Artificial Sequence
  Synthetic
gagtgtaaattccaaaatcggagctataattgtagcagctttagtcttgagcatcctgtcaattatcatttcact

SEQ ID NO: 255055 - DNA, 75 bp, Artificial Sequence
  Synthetic
acagaatttaagaggggggccgggagcggctgctcaaggccagacaatccaagaggagggcatagacgggaatgg

SEQ ID NO: 255056 - DNA, 75 bp, Artificial Sequence
  Synthetic
tcacacccgggtctgctcaaaactctgttggtaagaaaacttttcgtgtctgcttccgaatattggttttatcta

SEQ ID NO: 255057 - DNA, 75 bp, Artificial Sequence
  Synthetic
aagaggagggcatagacgggaatggagcctcagctgggtccaaggagaggtccgggtctttgagtggtgcaaccc

SEQ ID NO: 255058 - DNA, 75 bp, Artificial Sequence
  Synthetic
agcctcagctgggtccaaggagaggtccgggtctttgagtggtgcaaccccatatgctcacctatcactgccaca

SEQ ID NO: 255059 - DNA, 75 bp, Artificial Sequence
  Synthetic
tgttggtaagaaaacttttcgtgtctgcttccgaatattggttttatctatgcaacttgctactttgatacttat

SEQ ID NO: 255060 - DNA, 75 bp, Artificial Sequence
  Synthetic
aggatgatcaacgaccaaggtctaagtaatcaattgaattcagcaatagacaagatcaaagatgctgctgctttg

SEQ ID NO: 255061 - DNA, 75 bp, Artificial Sequence
  Synthetic
gtaatcaattgaattcagcaatagacaagatcaaagatgctgctgctttgatagcatcagctatgggggtgatga

SEQ ID NO: 255062 - DNA, 75 bp, Artificial Sequence
  Synthetic
ggaattgccccgcaaagtgcgatcagtgcgaacgagattatggacctccttagagggatggatgctcgcctgcaa

SEQ ID NO: 255063 - DNA, 75 bp, Artificial Sequence
  Synthetic
gtctctacctcttcaaatcgaaggaaaccagaatcaattattatctactatttctacaatttgctctaataataa

SEQ ID NO: 255064 - DNA, 75 bp, Artificial Sequence
  Synthetic
tttctattgctaattcttctatatctgatcataactttgtatgtctggattacattaaccattacttataagact

SEQ ID NO: 255065 - DNA, 75 bp, Artificial Sequence
  Synthetic
aaccagaatcaattattatctactatttctacaatttgctctaataataaacaattttccaattgctcggcagct

SEQ ID NO: 255066 - DNA, 75 bp, Artificial Sequence
  Synthetic
gcggtgcgacatgcaacactgtaccagagatccttctttcgctggagtttcgatcacccactctagaaagatctc

SEQ ID NO: 255067 - DNA, 75 bp, Artificial Sequence
  Synthetic
agagatccttctttcgctggagtttcgatcacccactctagaaagatctccagttaggacaagtctcaattcttc

SEQ ID NO: 255068 - DNA, 75 bp, Artificial Sequence
  Synthetic
ttatcaatggtatcaataagtttatcattgaggatcaaaatactcatggtttttctattggaagtccacttaaca

SEQ ID NO: 255069 - DNA, 75 bp, Artificial Sequence
  Synthetic
cattgaggatcaaaatactcatggtttttctattggaagtccacttaacatgccaagctttatcccaactgcaac

SEQ ID NO: 255070 - DNA, 75 bp, Artificial Sequence
  Synthetic
ccatccttttctttgggcaatacacactggtgttatactcacaatgtcatcaatgcaaattgcaaggatcatacc

SEQ ID NO: 255071 - DNA, 75 bp, Artificial Sequence
  Synthetic
actggtgttatactcacaatgtcatcaatgcaaattgcaaggatcatacctcttcaaatcaatatgtttctatgg

SEQ ID NO: 255072 - DNA, 75 bp, Artificial Sequence
  Synthetic
gtatccaatgttcaaaaccttaaaaatccagtatctgagtgatggattaaatcgtaagagttgctcgattgctac

SEQ ID NO: 255073 - DNA, 75 bp, Artificial Sequence
  Synthetic
atccagtatctgagtgatggattaaatcgtaagagttgctcgattgctactgtccctgatggttgtgcaatgtat

SEQ ID NO: 255074 - DNA, 75 bp, Artificial Sequence
  Synthetic
cgaggatgctctgaatgatatcaagcgagacatcataaggagcgccatatgaactcaccaggaacaccagactca

SEQ ID NO: 255075 - DNA, 75 bp, Artificial Sequence
  Synthetic
cggatgattatgcaggtactagtccacctactcaaaaaatcattatattattttacaatgatactatgatagaaa

SEQ ID NO: 255076 - DNA, 75 bp, Artificial Sequence
  Synthetic
cggatgattatgcaggttctagtccacctactcaaaaaatcattatattattttacaatgatactatgatagaaa

SEQ ID NO: 255077 - DNA, 75 bp, Artificial Sequence
  Synthetic
cggatgattatgcaggtcctagtccacctactcaaaaaatcattatattattttacaatgatactatgatagaaa

SEQ ID NO: 255078 - DNA, 75 bp, Artificial Sequence
  Synthetic
cggatgattatgcaggtgctagtccacctactcaaaaaatcattatattattttacaatgatactatgatagaaa

SEQ ID NO: 255079 - DNA, 75 bp, Artificial Sequence
  Synthetic
agtccgatttgaccggtggtaacttgattgaaattatagaaaaaataagcctagaaggatctcttacttctcgac

SEQ ID NO: 255080 - DNA, 75 bp, Artificial Sequence
  Synthetic
actatgattgcatctgctgtgggagtaatgaatcaagttattcacggggtaacggtatccttacccctacaaatt

SEQ ID NO: 255081 - DNA, 75 bp, Artificial Sequence
  Synthetic
acctactcaaaaaatcattatattattttacaatgatactatgatagaaagaacaataacacctaccaatttgga

SEQ ID NO: 255082 - DNA, 75 bp, Artificial Sequence
  Synthetic
ggggtggggagtggtgtgtattttgagaataaattgattttcccagcctatgggggggttctaccaaatagctca

SEQ ID NO: 255083 - DNA, 75 bp, Artificial Sequence
  Synthetic
agaataaattgattttcccagcctatgggggggttctaccaaatagctcactggggattaagttaactaatgaat

SEQ ID NO: 255084 - DNA, 75 bp, Artificial Sequence
  Synthetic
attacatttgtgaatacatatggattcatccgtgccactccagaaacatccgagttcatctctgaatcatcacaa

SEQ ID NO: 255085 - DNA, 75 bp, Artificial Sequence
  Synthetic
tccatgctctggatcagaccaagatttgaatcagcgtgcacttcaatcgtacttcccaaattatttttcaagccg

SEQ ID NO: 255086 - DNA, 75 bp, Artificial Sequence
  Synthetic
ttgaatcagcgtgcacttcaatcgtacttcccaaattatttttcaagccgaagaatacaaagtgcattcttactc

SEQ ID NO: 255087 - DNA, 75 bp, Artificial Sequence
  Synthetic
caaactgtgagttagtggtcccgtcagacaatcaggtaatgatgggtgcagaagggcgggtattattgattaata

SEQ ID NO: 255088 - DNA, 75 bp, Artificial Sequence
  Synthetic
catacttcgtctaaccaatatgtttccatggggattctcgttcagaccgcgtcagggtatcctatgttcaaaacc

SEQ ID NO: 255089 - DNA, 75 bp, Artificial Sequence
  Synthetic
acatcagggttcggaagacagcgagtgataaagagcagatcttattcgagatcaaccgcatccccaatctattca

SEQ ID NO: 255090 - DNA, 75 bp, Artificial Sequence
  Synthetic
agacaatcaggtaatgatgggtgcagaagggcgggtattattgattaataatagactaatctattatcagaggag

SEQ ID NO: 255091 - DNA, 75 bp, Artificial Sequence
  Synthetic
ctctacgaaatgtcatttacgcttgctgagtctggtcaaacacttgtgaacctgtcttggataccaatatactca

SEQ ID NO: 255092 - DNA, 75 bp, Artificial Sequence
  Synthetic
acattatccttcaggcgggagggactccaagcacaagaaaatggttggatctacctgactatccgtcgttcaatg

SEQ ID NO: 255093 - DNA, 75 bp, Artificial Sequence
  Synthetic
ctgagtctggtcaaacacttgtgaacctgtcttggataccaatatactcattcactcgtcctgggtcaggtgatt

SEQ ID NO: 255094 - DNA, 75 bp, Artificial Sequence
  Synthetic
ttgaaaccgacgactatgcggggtccagcccacctacccagaaacttaccctgttattctataatgacaccgtca

SEQ ID NO: 255095 - DNA, 75 bp, Artificial Sequence
  Synthetic
ttgcaggagtaaattacatctactgtgtcacatttttatctgtgacagtttgttctgcctcactcaagtttcgag

SEQ ID NO: 255096 - DNA, 75 bp, Artificial Sequence
  Synthetic
tgtctgcgtgtccggagtctacttggatgcttggcccctctctcaatacaccttgcagtcaggggtgaacagaaa

SEQ ID NO: 255097 - DNA, 75 bp, Artificial Sequence
  Synthetic
agttcatgtggatttggaaggtttacctggctcaatgaacagcatgttggagagagctcaagtacatgcgctgct

SEQ ID NO: 255098 - DNA, 75 bp, Artificial Sequence
  Synthetic
acagctaaccgcccaaatccactacattccattcatatttagtctttaagaaaaaattaggcccggaaagaatta

SEQ ID NO: 255099 - DNA, 75 bp, Artificial Sequence
  Synthetic
taaccagcttgcaacctccctaggattatacctaacagaattaacaacagtgtttcagccacaattaattaatcc

SEQ ID NO: 255100 - DNA, 75 bp, Artificial Sequence
  Synthetic
ctcataacaattcatctcaaagaggtaatagaaatcctaaagggccaatcatcagaccatgacaccctactattt

SEQ ID NO: 255101 - DNA, 75 bp, Artificial Sequence
  Synthetic
gagcatgttaaatgaccctgatggagaagggtgcattgcatccgtgtggttccacctgtgtaatctgtgcaaagg

SEQ ID NO: 255102 - DNA, 75 bp, Artificial Sequence
  Synthetic
caacattatatgtttctgcattaagtaatctcaagacctcatcttcatatggaactcagggattgattgctgctt

SEQ ID NO: 255103 - DNA, 75 bp, Artificial Sequence
  Synthetic
tccacctgtgtaatctgtgcaaaggcaggaataaacttagaagttacgatgaaaattattttgcatctaagtgcc

SEQ ID NO: 255104 - DNA, 75 bp, Artificial Sequence
  Synthetic
caggaataaacttagaagttacgatgaaaattattttgcatctaagtgccgtaagatgaatctgacagtcagcat

SEQ ID NO: 255105 - DNA, 75 bp, Artificial Sequence
  Synthetic
tgacgcctgcagtggttcaagcaacattatctacgtcaatttctgctgccgaaatactaagtgccggtctaatgg

SEQ ID NO: 255106 - DNA, 75 bp, Artificial Sequence
  Synthetic
gtaagatgaatctgacagtcagcataggagacatgtggggaccaaccattctagtccatgcaggcggtcacattc

SEQ ID NO: 255107 - DNA, 75 bp, Artificial Sequence
  Synthetic
ggaaatatctgaagtctgcattaaaccaatcaacattcaatcatctaatgggagaaacatctgacatattgttaa

SEQ ID NO: 255108 - DNA, 75 bp, Artificial Sequence
  Synthetic
ctagtccatgcaggcggtcacattccgacaactgcaaaaccttttttcaactcaagaggctgggtctgccacccc

SEQ ID NO: 255109 - DNA, 75 bp, Artificial Sequence
  Synthetic
gtatatatcatggaactggcgtcaaatattgtgggagaattccagattttacctgtactaacaagattgactatc

SEQ ID NO: 255110 - DNA, 75 bp, Artificial Sequence
  Synthetic
ctcaagaggctgggtctgccaccccatccaccaatcatcaccatcgttggcgaagaccctatggtcatctgggtg

SEQ ID NO: 255111 - DNA, 75 bp, Artificial Sequence
  Synthetic
ttacttaagaattaagaaaaaataggccagaatggcaggcctaaatgagatacttctacctgaagtacatctaaa

SEQ ID NO: 255112 - DNA, 75 bp, Artificial Sequence
  Synthetic
gagaattttttcggcctgttaatccatataacccatgtccaggaccacaacaagatctagatcagcgggctttga

SEQ ID NO: 255113 - DNA, 75 bp, Artificial Sequence
  Synthetic
aggagacatgtggggaccaaccattctagtccatgcaggcggtcacattccgacaactgcaaaaccttttttcaa

SEQ ID NO: 255114 - DNA, 75 bp, Artificial Sequence
  Synthetic
tgacaatgatatacctgattatgatatccacggggacataatttaaatcgactaaagactcctctggcacgatac

SEQ ID NO: 255115 - DNA, 75 bp, Artificial Sequence
  Synthetic
gaactcctctatgagatatcattcacatttacaaactctggtttatcatctgtgaatatgtcctggatacctata

SEQ ID NO: 255116 - DNA, 75 bp, Artificial Sequence
  Synthetic
taccaaatgatctggagccagatgatttaggtccattagccaatcaaaattggaaaactatcagatctgaagagt

SEQ ID NO: 255117 - DNA, 75 bp, Artificial Sequence
  Synthetic
ctccagggctcagactatgcatcacttgcaaaaactgatgacataatatattcaaagataaaagtcgataaagat

SEQ ID NO: 255118 - DNA, 75 bp, Artificial Sequence
  Synthetic
tggtgccgttcaatcatgagatataaagaaaaaagcaagccagaacaagcttagaatcacaatacaatacagaac

SEQ ID NO: 255119 - DNA, 75 bp, Artificial Sequence
  Synthetic
aatcaatcaacattcaatcatctaatgggagaaacatctgacatattgttaaaccgagcttatcagaagagaatt

SEQ ID NO: 255120 - DNA, 75 bp, Artificial Sequence
  Synthetic
gtcccagttgatgagcttagaagaagttttagtgatcatgtaacaattgttagtggaccaggagatgtgtcgttc

SEQ ID NO: 255121 - DNA, 75 bp, Artificial Sequence
  Synthetic
gatggaacaattgttgcaaactgtcgaagtctaacatgtctatgcaagagtccatcttatcctatataccaacct

SEQ ID NO: 255122 - DNA, 75 bp, Artificial Sequence
  Synthetic
ggtggtaacttgattgaaattatagaaaaaataagcctagaaggacatcttacttctcgactttccaactttgaa

SEQ ID NO: 255123 - DNA, 75 bp, Artificial Sequence
  Synthetic
tccatcttatcctatataccaacctgaccatcatgcagtcacgaccattgatctaaccgcatgtcaaacattgtc

SEQ ID NO: 255124 - DNA, 75 bp, Artificial Sequence
  Synthetic
aaatagtgtaagaaacagtaagcccggaagtggtgttttgcgatttcgaggccgggctcgatcctcaccttccat

SEQ ID NO: 255125 - DNA, 75 bp, Artificial Sequence
  Synthetic
gccacctttgcacctgggcctgttatcaatgcggctgacaagaagacattccgaacctgcttccgaatattggta

SEQ ID NO: 255126 - DNA, 75 bp, Artificial Sequence
  Synthetic
attcctagcttaagatggacccgctcccagagagaaattgctatcttgatttggccaaagattcttccgatgttg

SEQ ID NO: 255127 - DNA, 75 bp, Artificial Sequence
  Synthetic
attaactcagtctacagtgaatcttgtaagtgacggccttgaacgagtcatccaacaaattagcaaccaattaac

SEQ ID NO: 255128 - DNA, 75 bp, Artificial Sequence
  Synthetic
gtgtgaatatcaacatcttgcagcaaattggatatatcaagcaacaagtcaggcaactaagctattactcacaaa

SEQ ID NO: 255129 - DNA, 75 bp, Artificial Sequence
  Synthetic
tacttctcgactttccaactttgaaaatagaattgatcagtaatcatgaaggcttttttagttacttgcttaagc

SEQ ID NO: 255130 - DNA, 75 bp, Artificial Sequence
  Synthetic
tttgcagtcttttcatcttctgtatgtgtgaatatcaacatcttgcagcaaattggatatatcaagcaacaagtc

SEQ ID NO: 255131 - DNA, 75 bp, Artificial Sequence
  Synthetic
ggaactctattccttctacaaaggaattatcacaaatctggtttaacaatgagtggagtggtgctgttaagactt

SEQ ID NO: 255132 - DNA, 75 bp, Artificial Sequence
  Synthetic
gaagtggtgttttgcgatttcgaggccgggctcgatcctcacctttcattgtcgataggggacattttgacacta

SEQ ID NO: 255133 - DNA, 75 bp, Artificial Sequence
  Synthetic
gaattcaccaggactaccagactcacggggaaatccataaactgaaagccacaatgattctctgttaaataaaaa

SEQ ID NO: 255134 - DNA, 75 bp, Artificial Sequence
  Synthetic
taactcaatacaataagaccttgagtaatttgcttcttccaattgcagaaaacataaacaatattgcatcgccct

SEQ ID NO: 255135 - DNA, 75 bp, Artificial Sequence
  Synthetic
cagcaggcatgcaaaatcacattcgattagcagacagatctcccgaagcccagatagaacgctgtgagattgatg

SEQ ID NO: 255136 - DNA, 75 bp, Artificial Sequence
  Synthetic
ggagagttaacagatctgataactgtagtagacactaggtcaacattatgcattatcacacctgagttggttgcg

SEQ ID NO: 255137 - DNA, 75 bp, Artificial Sequence
  Synthetic
aacataaacaatattgcatcgccctcatctgggtcaagacggcataaaaggtttgctggtattgctattggcatt

SEQ ID NO: 255138 - DNA, 75 bp, Artificial Sequence
  Synthetic
ttattacgatacaacgagaatggtgattctcaacaagatgcaaggggcgaacacggaaataccttcccaaacaat

SEQ ID NO: 255139 - DNA, 75 bp, Artificial Sequence
  Synthetic
attatcacaaatctggtttaacaatgagtggagtggtgctgttaagacttggcttatgattaaatatagaatgag

SEQ ID NO: 255140 - DNA, 75 bp, Artificial Sequence
  Synthetic
tagtagacactaggtcaacattatgcattatcacacctgagttggttgcgttatattcagttgagcataaagcct

SEQ ID NO: 255141 - DNA, 75 bp, Artificial Sequence
  Synthetic
attgatgatcaccgatatgctagaaggtcgactcaatgtttcttcattgtgtacggcaagctactatttgtctcc

SEQ ID NO: 255142 - DNA, 75 bp, Artificial Sequence
  Synthetic
ggtcgactcaatgtttcttcattgtgtacggcaagctactatttgtctccattgaagaagagggttgaaactctg

SEQ ID NO: 255143 - DNA, 75 bp, Artificial Sequence
  Synthetic
ggatcgatgctacagtgtactaatccaggcttgggtgatggtctgtaaatgtatgacagcgtacgaccaacctgc

SEQ ID NO: 255144 - DNA, 75 bp, Artificial Sequence
  Synthetic
tgataacattattctcacttccctcggcaggtatgcaaaatcatattagactagcagataaatcacccgaagcca

SEQ ID NO: 255145 - DNA, 75 bp, Artificial Sequence
  Synthetic
ggagaaattgactcaatccacagttaatcttataagtgatggtctagaacgggttgtattacatatcagcaatca

SEQ ID NO: 255146 - DNA, 75 bp, Artificial Sequence
  Synthetic
tacttatgggagataaggtatacggcatagtctcatcattagaaagttttgtttatgctcaattacaatatggcg

SEQ ID NO: 255147 - DNA, 75 bp, Artificial Sequence
  Synthetic
aattcttctttatctgatcataactttgtatgtctggattatattaaccattacttataagactgcggtgcgaca

SEQ ID NO: 255148 - DNA, 75 bp, Artificial Sequence
  Synthetic
tacaagcaactaatcgagcagtcttcgaagtgaaggaaggcactcaacagttagctatagcggtacaagcaatac

SEQ ID NO: 255149 - DNA, 75 bp, Artificial Sequence
  Synthetic
ggcaggtatgcaaaatcatattagactagcagataaatcacccgaagccagaatagaacgctgtgagattgatgg

SEQ ID NO: 255150 - DNA, 75 bp, Artificial Sequence
  Synthetic
attaacaacagtgtttcagccacaattaattaatccggcattgtcaccgattagtatacaagccttgaggtcttt

SEQ ID NO: 255151 - DNA, 75 bp, Artificial Sequence
  Synthetic
atattgaatttactaactgaggatcatatttttacagatgaagaagcaaataaaattcttttagacttaacatct

SEQ ID NO: 255152 - DNA, 75 bp, Artificial Sequence
  Synthetic
tgaagcactgtaccaaagatccttctctcgctggagtttcgatcactcactctagaaagatttccagttaggaca

SEQ ID NO: 255153 - DNA, 75 bp, Artificial Sequence
  Synthetic
catagtctcatcattagaaagttttgtttatgctcaattacaatatggcgatcccgttattgatattaaagggac

SEQ ID NO: 255154 - DNA, 75 bp, Artificial Sequence
  Synthetic
atatttttacagatgaagaagcaaataaaattcttttagacttaacatctcagtttgacaaattatcaccagatt

SEQ ID NO: 255155 - DNA, 75 bp, Artificial Sequence
  Synthetic
atcatgagacataaagaaaaaagcaagccagaacaaacttaggatcacaatacaacacagaaccccagctgctat

SEQ ID NO: 255156 - DNA, 75 bp, Artificial Sequence
  Synthetic
gagattatggggtcatcctaccttaactgctagccaggcagcgtcaaaagtaagagaatctatgtgtgccccgaa

SEQ ID NO: 255157 - DNA, 75 bp, Artificial Sequence
  Synthetic
actgctagccaggcagcgtcaaaagtaagagaatctatgtgtgccccgaaagtgttagacttccaaactataatg

SEQ ID NO: 255158 - DNA, 75 bp, Artificial Sequence
  Synthetic
tattgattaatggttatcgaaggagtcataacggtatttggcccccaactaccttacatggtaatgcccctaaga

SEQ ID NO: 255159 - DNA, 75 bp, Artificial Sequence
  Synthetic
tcataacggtatttggcccccaactaccttacatggtaatgcccctaagagtctcattgagatgaggcatgacaa

SEQ ID NO: 255160 - DNA, 75 bp, Artificial Sequence
  Synthetic
atccagctaaaaattgtaagttgacaagacaccacatattctgccaatacaatgaggcagagaggctgagcctag

SEQ ID NO: 255161 - DNA, 75 bp, Artificial Sequence
  Synthetic
aatgaggcagagaggctgagcctagaatcaaaactatgccttgcaggcaatataagtgcctgtgtgttctcaccc

SEQ ID NO: 255162 - DNA, 75 bp, Artificial Sequence
  Synthetic
tgctaaggatacataaatgctttgatgcatcacctgatgaagatctaagtatatttatgaaggacaaggcgataa

SEQ ID NO: 255163 - DNA, 75 bp, Artificial Sequence
  Synthetic
ggtatttagaaagagcttgatcaaacagagataccgtgatgctcacagaccgctacctcaaacttttaatcggag

SEQ ID NO: 255164 - DNA, 75 bp, Artificial Sequence
  Synthetic
cagagataccgtgatgctcacagaccgctacctcaaacttttaatcggagattactattaaactttctggaggat

SEQ ID NO: 255165 - DNA, 75 bp, Artificial Sequence
  Synthetic
tataccaacctgaccatcatgcagtcacgaccattgatctaaccgcatgtcaaacattgtccctagacggattgg

SEQ ID NO: 255166 - DNA, 75 bp, Artificial Sequence
  Synthetic
acattaacagccagccaggcagcatccaaggtccgagagtccatgtgcgctcctaaggtgttggatttccaaaca

SEQ ID NO: 255167 - DNA, 75 bp, Artificial Sequence
  Synthetic
atttcagcattgtctctctaagcaacatcacttacgctgagaaccttaccatttcattgtctcagacaatcaata

SEQ ID NO: 255168 - DNA, 75 bp, Artificial Sequence
  Synthetic
catcacttacgctgagaaccttaccatttcattgtctcagacaatcaatactcaacccattgacatatcaactga

SEQ ID NO: 255169 - DNA, 75 bp, Artificial Sequence
  Synthetic
ttgaatacgtgaccagcggcgaatatttaagagaccctgaattttgtgcatcatattcgctaaaagagaaagaaa

SEQ ID NO: 255170 - DNA, 75 bp, Artificial Sequence
  Synthetic
ataatgaagactctggcttttttccacgcaatcctgattaacggttataggagaagccataatggtatctggcct

SEQ ID NO: 255171 - DNA, 75 bp, Artificial Sequence
  Synthetic
atttcattgtctcagacaatcaatactcaacccattgacatatcaactgaactgagtaaggttaatgcatccctc

SEQ ID NO: 255172 - DNA, 75 bp, Artificial Sequence
  Synthetic
tgtcaggtgattgcagagtcattattggctaatcatgcaggaaagttgatgagagagaatggagtggttctagat

SEQ ID NO: 255173 - DNA, 75 bp, Artificial Sequence
  Synthetic
agagcaaccatcagctccaatctgtgagtgtaaactccaaaatcggagctataattgtagcagccttagttttga

SEQ ID NO: 255174 - DNA, 75 bp, Artificial Sequence
  Synthetic
ccttcccaaacaatcccaatcaaaatgcacagtcgcaagtgggtgactgggacgagtaaatcactgacatgatca

SEQ ID NO: 255175 - DNA, 75 bp, Artificial Sequence
  Synthetic
aacataaacaatattgcaccgccctcaactgggtcaagacgtcataaaaggtttgctggcattgccattggtatt

SEQ ID NO: 255176 - DNA, 75 bp, Artificial Sequence
  Synthetic
tttaagagaccctgaattttgtgcatcatattcgctaaaagagaaagaaatcaaagccacaggtcgtatatttgc

SEQ ID NO: 255177 - DNA, 75 bp, Artificial Sequence
  Synthetic
atcagagcatagcaggaaatcaacagcagacaacatgacattagcacattcggggtcaaataagtatagagtcaa

SEQ ID NO: 255178 - DNA, 75 bp, Artificial Sequence
  Synthetic
tggctaatcatgcaggaaagttgatgagagagaatggagtggttctagatcaattgaaattaacaaagtcactat

SEQ ID NO: 255179 - DNA, 75 bp, Artificial Sequence
  Synthetic
gcagacaacatgacattagcacattcggggtcaaataagtatagagtcaataatagtcagttcaagaagaataaa

SEQ ID NO: 255180 - DNA, 75 bp, Artificial Sequence
  Synthetic
attgttttgctgctgggcttacattgcaactaaagaaatcagaagaatcaacttcaaaacaaatcatatcaatac

SEQ ID NO: 255181 - DNA, 75 bp, Artificial Sequence
  Synthetic
gcatcgaatatcgttggagaattccaaattctacctgtgctaaccagattgactatcacttgagtcatagtgaat

SEQ ID NO: 255182 - DNA, 75 bp, Artificial Sequence
  Synthetic
acggatttgagattgctgcttgtttccttacgacagacttgacgaaatactgtttaaactggagatatcaagtta

SEQ ID NO: 255183 - DNA, 75 bp, Artificial Sequence
  Synthetic
tagaaaaaaactaaattaagaatgaatctcctggggtcgtaacgtctcgtgaccctgccgttgcactatgccggc

SEQ ID NO: 255184 - DNA, 75 bp, Artificial Sequence
  Synthetic
gactatgctgggtccagcccacctactcagaaacttaccctgctattttataatgacactgtcacagagaggaca

SEQ ID NO: 255185 - DNA, 75 bp, Artificial Sequence
  Synthetic
ttgcaaatcatttcctatccgcccccattcagggagccaactcgttgagcaaggccacaatcattcctggtgttg

SEQ ID NO: 255186 - DNA, 75 bp, Artificial Sequence
  Synthetic
ccttacgacagacttgacgaaatactgtttaaactggagatatcaagttataataccttttgcacgcacattgaa

SEQ ID NO: 255187 - DNA, 75 bp, Artificial Sequence
  Synthetic
ttcgaatggatccaccttaggttaatgagaagtactctgtatgtcggtgatccttttaatccaccatcagacccc

SEQ ID NO: 255188 - DNA, 75 bp, Artificial Sequence
  Synthetic
tgagaagtactctgtatgtcggtgatccttttaatccaccatcagacccctctcaattggacttagatacagccc

SEQ ID NO: 255189 - DNA, 75 bp, Artificial Sequence
  Synthetic
gcaaaagaatattcagtaccccatcgcgtcacatcaaggatccaagtcaaagggcagaggctcaggagccagacc

SEQ ID NO: 255190 - DNA, 75 bp, Artificial Sequence
  Synthetic
tgatcactcactctagaaagatctccagctgggacaagtcccaatccatcatgcgagaacaagctgcatccaaat

SEQ ID NO: 255191 - DNA, 75 bp, Artificial Sequence
  Synthetic
tcagcgtgctttgagatcatacttcccaagttacttctctaatcgaagagtacagagtgcatttcttgtctgtgc

SEQ ID NO: 255192 - DNA, 75 bp, Artificial Sequence
  Synthetic
atccagctaaaaattgtaagttgacaagacaccatatattctgccagtacaatgaggcggagaggctgagcctag

SEQ ID NO: 255193 - DNA, 75 bp, Artificial Sequence
  Synthetic
tacagagtgcatttcttgtctgtgcctggaatcagatcctagttacaaattgcgagctagttgtcccctcaaaca

SEQ ID NO: 255194 - DNA, 75 bp, Artificial Sequence
  Synthetic
gatgccgttcaatcatgagacataaagaaaaaatcaagccagaacaagcttaggatcacaatacaacacagaacc

SEQ ID NO: 255195 - DNA, 75 bp, Artificial Sequence
  Synthetic
tccacgggggggaatagaggggttatgtcagaaattatggactatgatctccatatccaccatcatactatctgc

SEQ ID NO: 255196 - DNA, 75 bp, Artificial Sequence
  Synthetic
taagataggaaaagagagaatgattaatcgatttgttgaaaaacccagaacctcaacgccggtaacagaatttaa

SEQ ID NO: 255197 - DNA, 75 bp, Artificial Sequence
  Synthetic
caattgcaatcaccacaagagttgtacgctcactaagtcactctgagaaaaaggagcaggcatataaagctagta

SEQ ID NO: 255198 - DNA, 75 bp, Artificial Sequence
  Synthetic
ctattatattatcagagaagtaccagctggtggccgtatgaactcctctatgagatatcattcacatttacaaac

SEQ ID NO: 255199 - DNA, 75 bp, Artificial Sequence
  Synthetic
aaactcttcacaatgtcagacaatgccacctttgcacctggaccttttatcaatgcggcagacaagaagacgttc

SEQ ID NO: 255200 - DNA, 75 bp, Artificial Sequence
  Synthetic
ctgaaggagcaagagaccattcttagctcagatttctttatatatagtaaaagggtcttctataagggtaggatc

SEQ ID NO: 255201 - DNA, 75 bp, Artificial Sequence
  Synthetic
cgaacctgcttccgaatattggtactgtctgtacaagctgttacccttatattagttattgtcactttaggtgag

SEQ ID NO: 255202 - DNA, 75 bp, Artificial Sequence
  Synthetic
ccagctgccatcataactgttctctggccgctcgaaagatggagccctcaaaactcttcacaatgtcagacaatg

SEQ ID NO: 255203 - DNA, 75 bp, Artificial Sequence
  Synthetic
acgctcactaagtcactctgagaaaaaggagcaggcatataaagctagtaaattgttttttgaaaggcttagagc

SEQ ID NO: 255204 - DNA, 75 bp, Artificial Sequence
  Synthetic
aaaagaacattcagtaccccactgcaccacatcagggatccaagtcaaagggaagaagctcaggagccaggccca

SEQ ID NO: 255205 - DNA, 75 bp, Artificial Sequence
  Synthetic
ggtgaaaatgtgtgcccaactgcttgtgtgtcaggggtttatcttgatccctggccattaactccatatagccac

SEQ ID NO: 255206 - DNA, 75 bp, Artificial Sequence
  Synthetic
attaggtgattgctcacaagcatcgtgttctaacttggctaccactgtgatgcgcctcactgagaatggagttga

SEQ ID NO: 255207 - DNA, 75 bp, Artificial Sequence
  Synthetic
gcatcctgtcaattatcatttcgctattgttttgctgctgggcttacattgcaactaaagaaatcagaagaatca

SEQ ID NO: 255208 - DNA, 75 bp, Artificial Sequence
  Synthetic
taatgaatcaagttattcacggagtaacggtatccttacccctacaaattgagggaaaccaaaatcaattgttat

SEQ ID NO: 255209 - DNA, 75 bp, Artificial Sequence
  Synthetic
atttcgagaataaattgatctttcctgcatatgggggtgtcttgcccaatagtacgctcggagttaaatcagcaa

SEQ ID NO: 255210 - DNA, 75 bp, Artificial Sequence
  Synthetic
gttatgatttagtatttcctcaaactagatctctaagtcaagatatcacgaatgcatatctcaatcatcccttac

SEQ ID NO: 255211 - DNA, 75 bp, Artificial Sequence
  Synthetic
tgttctaacttggctaccactgtgatgcgcctcactgagaatggagttgaaaaagatttgtgttattatttaaat

SEQ ID NO: 255212 - DNA, 75 bp, Artificial Sequence
  Synthetic
tagatctctaagtcaagatatcacgaatgcatatctcaatcatcccttactagtggcaagattatgcctattacc

SEQ ID NO: 255213 - DNA, 75 bp, Artificial Sequence
  Synthetic
caaaaaacaagtctcaaactgctctacaaacatccccttagttaatgaccttaggtttataaatgggatcaataa

SEQ ID NO: 255214 - DNA, 75 bp, Artificial Sequence
  Synthetic
ttaggtttataaatgggatcaataaattcatcattgaagattatgcaactcatgatttctctatcggccatccac

SEQ ID NO: 255215 - DNA, 75 bp, Artificial Sequence
  Synthetic
ccaaactaaatctcttagtcaggacatcactaatgcctatcttaatcatccgatacttatctcaagattgtgtct

SEQ ID NO: 255216 - DNA, 75 bp, Artificial Sequence
  Synthetic
catgatttctctatcggccatccactcaacatgcctagctttatcccaactgcaacttcacccaatggttgcaca

SEQ ID NO: 255217 - DNA, 75 bp, Artificial Sequence
  Synthetic
tgtcccctctaaagaagaggatcgaaattctcctaacactagttgatgatcttgctctactcatgggggacaaag

SEQ ID NO: 255218 - DNA, 75 bp, Artificial Sequence
  Synthetic
tgcaacttcacccaatggttgcacaagaattccatccttttctctaggtaagacacactggtgctacacacataa

SEQ ID NO: 255219 - DNA, 75 bp, Artificial Sequence
  Synthetic
agaattccatccttttctctaggtaagacacactggtgctacacacataatgtaattaatgccaactgcaaggat

SEQ ID NO: 255220 - DNA, 75 bp, Artificial Sequence
  Synthetic
tatattaaccatcacttataagactgcagtgcgacatgcagcactgtaccagggatccttctttcgctggagttt

SEQ ID NO: 255221 - DNA, 75 bp, Artificial Sequence
  Synthetic
ctgtcatgtagccgcttatttaataggaacataggggacccattggtatcagctttagcagatgttaaacgactg

SEQ ID NO: 255222 - DNA, 75 bp, Artificial Sequence
  Synthetic
gagacctggaaaagggaaatggagcacattagcagccgacccttatactttgaatatagattatctagtaccatc

SEQ ID NO: 255223 - DNA, 75 bp, Artificial Sequence
  Synthetic
ccatcgttagatataagcttttctactatatattgcatggccagttaccaaatgatttggagccagatgacttgg

SEQ ID NO: 255224 - DNA, 75 bp, Artificial Sequence
  Synthetic
cgatcactcactctagaaagatctccagttaggacaagtctcaatccatcatgcgagaacaagctgcatttaaat

SEQ ID NO: 255225 - DNA, 75 bp, Artificial Sequence
  Synthetic
tcaatcctatgcttcgtggcatatttagtgaaaatgcagctgaggaagaagaagatcttgctcaatacttattgg

SEQ ID NO: 255226 - DNA, 75 bp, Artificial Sequence
  Synthetic
agaaaaaaacaagccagaacaaacttaggatcacaatacaacacagaaccccagctactatcacaattgtactct

SEQ ID NO: 255227 - DNA, 75 bp, Artificial Sequence
  Synthetic
gcaaaggccagcaccgaggatgctctgaatgatatcaagcgagacatcatacgaagcgccatatgagcctaccag

SEQ ID NO: 255228 - DNA, 75 bp, Artificial Sequence
  Synthetic
ccatggggatactcgttcagaccgcgtcagggtatcctatgttcaaaaccttaaaaatccaatatctcagtgatg

SEQ ID NO: 255229 - DNA, 75 bp, Artificial Sequence
  Synthetic
atgtactgttacgtctcaactcaacttgaaaccgacgactatgcggggtccagcccacctacccagaaacttacc

SEQ ID NO: 255230 - DNA, 75 bp, Artificial Sequence
  Synthetic
aaactcttcacaatatcggacaatgccacctttgcacctgggcctgttatcaatgcggctgacaagaagacattc

SEQ ID NO: 255231 - DNA, 75 bp, Artificial Sequence
  Synthetic
agagagattgccatactcatttggccaagaatacttccaatcctgcaagcatatgatcttcggcaaagtatgcaa

SEQ ID NO: 255232 - DNA, 75 bp, Artificial Sequence
  Synthetic
aataatgaagaccctggctttctttcacgcaatcctgattaacggttataggagaagccataatggaatctggcc

SEQ ID NO: 255233 - DNA, 75 bp, Artificial Sequence
  Synthetic
aggacgactcctcagacagatcagacttaggaaaatattatcaggggatccatctgatcagcaaattacatttgt

SEQ ID NO: 255234 - DNA, 75 bp, Artificial Sequence
  Synthetic
agttgtggtaggcgaaagcaaattcagggttatttggattcgaccagaaccataatcagatattcattagaggtt

SEQ ID NO: 255235 - DNA, 75 bp, Artificial Sequence
  Synthetic
gtatctttcttataatttggagatcattgagaagcctaacatagttcaaccttttttgaatgcaatcaatgtaga

SEQ ID NO: 255236 - DNA, 75 bp, Artificial Sequence
  Synthetic
agggttatttggattcgaccagaaccataatcagatattcattagaggttagaccactatcagcaaaaaagttaa

SEQ ID NO: 255237 - DNA, 75 bp, Artificial Sequence
  Synthetic
attgagaagcctaacatagttcaaccttttttgaatgcaatcaatgtagatacttgtagcattgatatagcacgg

SEQ ID NO: 255238 - DNA, 75 bp, Artificial Sequence
  Synthetic
gagaatttttccggcctgttaatccatataatccatgttcaggaccacaacaagatttagatcagcgtgctttga

SEQ ID NO: 255239 - DNA, 75 bp, Artificial Sequence
  Synthetic
agcaggacaagacgcaaaggattactcaattccatccactagagagctatctcaaatatggtttaacaatgagtg

SEQ ID NO: 255240 - DNA, 75 bp, Artificial Sequence
  Synthetic
cccttttaaatggccgccctattgagggattggagactcctgatcctattgagttagtacatggttctctcatca

SEQ ID NO: 255241 - DNA, 75 bp, Artificial Sequence
  Synthetic
gggattggagactcctgatcctattgagttagtacatggttctctcatcattgggtcagatgaatgtgagtattg

SEQ ID NO: 255242 - DNA, 75 bp, Artificial Sequence
  Synthetic
agctgaatacagtaatagaatataacttattatatctgtcctacaatttggagattattgaaaaaccaaatatag

SEQ ID NO: 255243 - DNA, 75 bp, Artificial Sequence
  Synthetic
tgataattgggtcagatgaatgtgagcattgtagtagtggtgatgacaaattcacctggtttttcctacccaagg

SEQ ID NO: 255244 - DNA, 75 bp, Artificial Sequence
  Synthetic
cccctcaaacaatcagacactgatgggtgcagaaggaagagttttattgatcaataatcgactattatattatca

SEQ ID NO: 255245 - DNA, 75 bp, Artificial Sequence
  Synthetic
tggtttttccttccaaagggtataaggctcgatgatgacccagcattcaacccacctattagagtgccctacatc

SEQ ID NO: 255246 - DNA, 75 bp, Artificial Sequence
  Synthetic
tcaataatcgactattatattatcagagaagtaccagctggtggccgtatgaactcctctatgagatatcattca

SEQ ID NO: 255247 - DNA, 75 bp, Artificial Sequence
  Synthetic
tagttacaaattgcgagctagttgtcccctcaaacaatcagacactgatgggtgcagaaggaagagttttattga

SEQ ID NO: 255248 - DNA, 75 bp, Artificial Sequence
  Synthetic
ggctcgatgatgacccagcattcaacccacctattagagtgccctacatcggatcaaagacagatgagcggagag

SEQ ID NO: 255249 - DNA, 75 bp, Artificial Sequence
  Synthetic
ggagggttgcgtcaatggcttacattaaaggtgcatctgtatcacttaaatcagcactcagattagcgggagtat

SEQ ID NO: 255250 - DNA, 75 bp, Artificial Sequence
  Synthetic
tgtgaatatgtcctggatacctatatattcattcactcgtcctggttcaggcaactgcagtggtgaaaatgtgtg

SEQ ID NO: 255251 - DNA, 75 bp, Artificial Sequence
  Synthetic
agcatccgtctctcttaagtcagcattaaggttagcaggtgtatacatctgggcatttggagacactgaagattc

SEQ ID NO: 255252 - DNA, 75 bp, Artificial Sequence
  Synthetic
catttacaaactctggtcaatcatctgtgaatatgtcctggatacctatatattcattcactcgtcctggttcag

SEQ ID NO: 255253 - DNA, 75 bp, Artificial Sequence
  Synthetic
ttaaggttagcaggtgtatacatctgggcatttggagacactgaagattcatggcaggatgcatatgaattggct

SEQ ID NO: 255254 - DNA, 75 bp, Artificial Sequence
  Synthetic
aattaatgagagagaatggagttgtcttagaccagttaaaattaacaaaatctttattaacgatgaaccaaattg

SEQ ID NO: 255255 - DNA, 75 bp, Artificial Sequence
  Synthetic
tctcttcacttgagagttttgtttacgcccaattacagtatggtgatcctgttatagacattaagggtacattct

SEQ ID NO: 255256 - DNA, 75 bp, Artificial Sequence
  Synthetic
aacaattacaatcactcacaccgctaccgacatctgctaatttagttcatagattggacgatggcactacccagt

SEQ ID NO: 255257 - DNA, 75 bp, Artificial Sequence
  Synthetic
accgacatctgctaatttagttcatagattggacgatggcactacccagttaaaattcacaccagcaagttcata

SEQ ID NO: 255258 - DNA, 75 bp, Artificial Sequence
  Synthetic
ctcctatgcattctctagctttgttcatatatctaacgactgtcaagttcttgagatcgatgatcaggtaacaga

SEQ ID NO: 255259 - DNA, 75 bp, Artificial Sequence
  Synthetic
tccaacgattgccaagtgcttgaaatagatgatcaagttacagattccaatttaatctaccagcaagttatgatt

SEQ ID NO: 255260 - DNA, 75 bp, Artificial Sequence
  Synthetic
tagatgatcaagttacagattccaatttaatctaccagcaagttatgattactggtcttgctttaattgagactt

SEQ ID NO: 255261 - DNA, 75 bp, Artificial Sequence
  Synthetic
tattgtgtttatattatggaactagcatcgaatatcgttggagaattccaaattctacctgtgctaaccagattg

SEQ ID NO: 255262 - DNA, 75 bp, Artificial Sequence
  Synthetic
tgtatatgaaactacattgcatttgcataccggctcatcatgttgtatcaggccggtagactcctgtgtagttaa

SEQ ID NO: 255263 - DNA, 75 bp, Artificial Sequence
  Synthetic
cataccggctcatcatgttgtatcaggccggtagactcctgtgtagttaatccgtcattacttccagtccctttc

SEQ ID NO: 255264 - DNA, 75 bp, Artificial Sequence
  Synthetic
tatgagaatttcctctatttccactgatgcctccaggagggtcaacaatcagtccaatttgaccagtggtaactt

SEQ ID NO: 255265 - DNA, 75 bp, Artificial Sequence
  Synthetic
ttgtatatgacccagaaccactcagtttgctcgagatggagaagattgaggatgttgcatatcaaactagaatag

SEQ ID NO: 255266 - DNA, 75 bp, Artificial Sequence
  Synthetic
tttgctcgagatggagaagattgaggatgttgcatatcaaactagaataggagggttagatcaaattcctttact

SEQ ID NO: 255267 - DNA, 75 bp, Artificial Sequence
  Synthetic
ctagaaggacattttacttcccgaccctccagctttgaaaatagaattgttcagtaatcatgaaggcttttttag

SEQ ID NO: 255268 - DNA, 75 bp, Artificial Sequence
  Synthetic
ctcactgctaaacaaatgataaatagtataactggccttgatgagtccacatcaattatgaatgatgcagtggta

SEQ ID NO: 255269 - DNA, 75 bp, Artificial Sequence
  Synthetic
gtataactggccttgatgagtccacatcaattatgaatgatgcagtggtacaggctgattatactagcaattgga

SEQ ID NO: 255270 - DNA, 75 bp, Artificial Sequence
  Synthetic
catcgaatatcgttggagaatttcaaattctacctgtgctgaccagattgaccatcatttgagtcatagtgaatg

SEQ ID NO: 255271 - DNA, 75 bp, Artificial Sequence
  Synthetic
tgactctgtatttgtctattctggctgggctttgctgctggaactctcataccaaatgtattacttgaggattca

SEQ ID NO: 255272 - DNA, 75 bp, Artificial Sequence
  Synthetic
tgggctttgctgctggaactctcataccaaatgtattacttgaggattcagggaatacaaggtatattagactat

SEQ ID NO: 255273 - DNA, 75 bp, Artificial Sequence
  Synthetic
caggaatggcaattaatggaatctcctccacaatcagtcaccctcgcattcttaggcggtgtattaacttagata

SEQ ID NO: 255274 - DNA, 75 bp, Artificial Sequence
  Synthetic
ctccacaatcagtcaccctcgcattcttaggcggtgtattaacttagatatcatagcccctataaattcaccgca

SEQ ID NO: 255275 - DNA, 75 bp, Artificial Sequence
  Synthetic
ttgagtatagatgctgtcatgtggggtactaaacaagtgttgactaacatttcacagggagtagattatgagata

SEQ ID NO: 255276 - DNA, 75 bp, Artificial Sequence
  Synthetic
aaaacagatcagagtagaactcattgcaaggattcctagtctccggtggacccgctctcagagagagattgccat

SEQ ID NO: 255277 - DNA, 75 bp, Artificial Sequence
  Synthetic
agacctggcttatgattaaatatagaatgaggcagctaatcacaaaccaaaagacaggtgagttaacagatttag

SEQ ID NO: 255278 - DNA, 75 bp, Artificial Sequence
  Synthetic
gtactaaacaagtgttgactaacatttcacagggagtagattatgagatagtagttccatctgaaagccagctca

SEQ ID NO: 255279 - DNA, 75 bp, Artificial Sequence
  Synthetic
ggttgcccggaaattgtcattattagctataatatgggccaactataattatccaccaaaagttaaaggtatgtc

SEQ ID NO: 255280 - DNA, 75 bp, Artificial Sequence
  Synthetic
gctataatatgggccaactataattatccaccaaaagttaaaggtatgtcacctgaagacaagtgtcaaacatta

SEQ ID NO: 255281 - DNA, 75 bp, Artificial Sequence
  Synthetic
gttgctttatactccaatgagcacaaagcattaacgtacctcacctttgaaatggtattaatggtcactgatatg

SEQ ID NO: 255282 - DNA, 75 bp, Artificial Sequence
  Synthetic
aatatgttgacaacattcaaattgaaaagactagaatcaatagaatgattattgagccaaaattgaccgcatacc

SEQ ID NO: 255283 - DNA, 75 bp, Artificial Sequence
  Synthetic
aaagactagaatcaatagaatgattattgagccaaaattgaccgcatacccaagtaatttattttatttatcaag

SEQ ID NO: 255284 - DNA, 75 bp, Artificial Sequence
  Synthetic
tgtatggtataccccacctgttcgaatggatacatttaaggctaatgcgaagcactctctatgttggtgatccct

SEQ ID NO: 255285 - DNA, 75 bp, Artificial Sequence
  Synthetic
tctgaagagggacagttcttgattgcatcatattatgagagctttggttatttggagccagcactaatggagtca

SEQ ID NO: 255286 - DNA, 75 bp, Artificial Sequence
  Synthetic
catcatattatgagagctttggttatttggagccagcactaatggagtcaaagatatttaacttaaattctaatg

SEQ ID NO: 255287 - DNA, 75 bp, Artificial Sequence
  Synthetic
gatgatatatttatagtttctcctcgtggaggaatcgagggtttatgtcaaaaattatggactatgatttccatc

SEQ ID NO: 255288 - DNA, 75 bp, Artificial Sequence
  Synthetic
tttcttactgaatttggaattatctgaaaacaaccttgaaaaatattcactaccaagtctactcatgacagctga

SEQ ID NO: 255289 - DNA, 75 bp, Artificial Sequence
  Synthetic
aaaattatggactatgatttccatctcaacaatcatattatccgcaactgaggcaaacactagagttatgagcat

SEQ ID NO: 255290 - DNA, 75 bp, Artificial Sequence
  Synthetic
acatcacagtttgacaatctatcccctgatttaactgctgagctcctctgcattatgagactttggggccatccc

SEQ ID NO: 255291 - DNA, 75 bp, Artificial Sequence
  Synthetic
aggcaaacactagagttatgagcatggttcagggtgacaatcaagcaattgcaatcaccactagagtagtacgct

SEQ ID NO: 255292 - DNA, 75 bp, Artificial Sequence
  Synthetic
ggcaaacaaggttcttctggacttgacatcacagtttgacaatctatcccctgatttaactgctgagctcctctg

SEQ ID NO: 255293 - DNA, 75 bp, Artificial Sequence
  Synthetic
ctcttggtttgtcttctacttcctggtataagacaataagtgtactgaatcatattagccacatgaaattgtcaa

SEQ ID NO: 255294 - DNA, 75 bp, Artificial Sequence
  Synthetic
cgctcagtcattccgagaagaaggagcaagcttataaagcaagtaaattattctttgaaaggcttagagctaaca

SEQ ID NO: 255295 - DNA, 75 bp, Artificial Sequence
  Synthetic
gaagtctaacgtgtctatgcaagagtccatcctatcctatataccaacctgatcatcatgcggtaacgaccattg

SEQ ID NO: 255296 - DNA, 75 bp, Artificial Sequence
  Synthetic
aggtaggagctgatacatgtgcattggttcatgtggatttggagggtgtccccggctcaatgaacagcatgttgg

SEQ ID NO: 255297 - DNA, 75 bp, Artificial Sequence
  Synthetic
gaaaacaaccttgaaaaatattcactaccaagtctactcatgacagctgaaaatatggataatcctttccctcag

SEQ ID NO: 255298 - DNA, 75 bp, Artificial Sequence
  Synthetic
atagagacatttttgcccggagaaactatctggtacaatagcttgtttaatagcggtgaaaaccctcctcaacgt

SEQ ID NO: 255299 - DNA, 75 bp, Artificial Sequence
  Synthetic
cctactactcttcatggcaatgcccccaaaagcctcattgagatgcggcatgataattcagagcttaagtatgag

SEQ ID NO: 255300 - DNA, 75 bp, Artificial Sequence
  Synthetic
ccaaaagcctcattgagatgcggcatgataattcagagcttaagtatgagtatgtcctcaagaattggaaaagta

SEQ ID NO: 255301 - DNA, 75 bp, Artificial Sequence
  Synthetic
gaggagccataatggaatctggcctcctactactcttcatggcaatgcccccaaaagcctcattgagatgcggca

SEQ ID NO: 255302 - DNA, 75 bp, Artificial Sequence
  Synthetic
gtataagacaataagtgtactgaatcatattagccacatgaaattgtcaaatggttcacacctgtatttggcaga

SEQ ID NO: 255303 - DNA, 75 bp, Artificial Sequence
  Synthetic
aattcaagctggtatagcagcagggaatggtatagttcagaaattttgcccattatggaatggaaacagcgatat

SEQ ID NO: 255304 - DNA, 75 bp, Artificial Sequence
  Synthetic
aggtcgcctggaagcaagatacatgctgcagccggaagctcaaaggttgattcaaactgccattaggaaaagtct

SEQ ID NO: 255305 - DNA, 75 bp, Artificial Sequence
  Synthetic
ctatctggtacaatagcttgtttaatagcggtgaaaaccctcctcaacgtaattttgcacccttgcctactcaat

SEQ ID NO: 255306 - DNA, 75 bp, Artificial Sequence
  Synthetic
atttgtgttattttctaaatgcattcatgacaatcagacaattatgttatgatctagtatttccccaaactaaat

SEQ ID NO: 255307 - DNA, 75 bp, Artificial Sequence
  Synthetic
tcactcatcccacctgaattggttagtgagtactggaggaggcgggttgaacaagggcagattatacaggatcgt

SEQ ID NO: 255308 - DNA, 75 bp, Artificial Sequence
  Synthetic
gtgctgatacatgtgcattggttcatgtagatttagaaggtgtgccaggatcgatgaatagtatgctagaacgag

SEQ ID NO: 255309 - DNA, 75 bp, Artificial Sequence
  Synthetic
aatcagaagaatcaacttcaaaacgaatcatattaacacaatatcaggtagtgtcgatgatctcatcagatacta

SEQ ID NO: 255310 - DNA, 75 bp, Artificial Sequence
  Synthetic
gtgagtactggaggaggcgggttgaacaagggcagattatacaggatcgtatagataaggtcacatcagaatgtg

SEQ ID NO: 255311 - DNA, 75 bp, Artificial Sequence
  Synthetic
aatggtatagttcagaaattttgcccattatggaatggaaacagcgatattacagatttaagcacaaaggcttgt

SEQ ID NO: 255312 - DNA, 75 bp, Artificial Sequence
  Synthetic
tgtagatttagaaggtgtgccaggatcgatgaatagtatgctagaacgagctcaagtacatgcattattaatcac

SEQ ID NO: 255313 - DNA, 75 bp, Artificial Sequence
  Synthetic
gtgtagtcgcctgttcaatagaaacataggagacccattagtatctgcaattgctgatgtgaaacgattaattaa

SEQ ID NO: 255314 - DNA, 75 bp, Artificial Sequence
  Synthetic
actccaagcacaagaaaatggttggatctacctgactatcagtcgttcaatgaattacaatcggagatggccaga

SEQ ID NO: 255315 - DNA, 75 bp, Artificial Sequence
  Synthetic
ctgttaatccttaaagcatcatgggagccatttaataagttttcattcttactcacactgctttggcaattcttt

SEQ ID NO: 255316 - DNA, 75 bp, Artificial Sequence
  Synthetic
agaatatcttagggaccctgaattttgtgcatcttactctctcaaggagaaggagataaaggctacaggtcgcat

SEQ ID NO: 255317 - DNA, 75 bp, Artificial Sequence
  Synthetic
ttacttataagactgcggagcgacatgcaacactataccagagatccttctttcgctggagtttcgatcactcac

SEQ ID NO: 255318 - DNA, 75 bp, Artificial Sequence
  Synthetic
cattgttggccaatcatgcaggtaaattaatgagagagaatggagttgtcttagaccagttaaaattgacaaaat

SEQ ID NO: 255319 - DNA, 75 bp, Artificial Sequence
  Synthetic
agtccacagattggatgatggtactactcaattaaaatttaccccggcaagctcctatgcattctccagctttgt

SEQ ID NO: 255320 - DNA, 75 bp, Artificial Sequence
  Synthetic
agtgtacataattgcaacattagctgtagatcctacaacatcatcctttactactgctctaaaccgggctcgtac

SEQ ID NO: 255321 - DNA, 75 bp, Artificial Sequence
  Synthetic
tttcgctggagtttcgatcactcactctagaaagatctccagtttgaacacgtcccagtccatcatgcgagatca

SEQ ID NO: 255322 - DNA, 75 bp, Artificial Sequence
  Synthetic
agccatttaataagttttcattcttactcacactgctttggcaattcttttctacgatcagaattttacgatcat

SEQ ID NO: 255323 - DNA, 75 bp, Artificial Sequence
  Synthetic
actggaaaaagcgtgtagaacagggacaaattatccaggaatgtatagatagagttatatctgagtgtgtaagag

SEQ ID NO: 255324 - DNA, 75 bp, Artificial Sequence
  Synthetic
agtctaacgtgtctatgcaagagtccatcttatcctatataccaacctgaccatcatgcagtcacgaccattgat

SEQ ID NO: 255325 - DNA, 75 bp, Artificial Sequence
  Synthetic
tacaacacagaatcctagctgctatcacaactgtgttccgaccgcctgaaagatggagccctcgaaactcttcac

SEQ ID NO: 255326 - DNA, 75 bp, Artificial Sequence
  Synthetic
gtagatcctacaacatcatcctttactactgctctaaaccgggctcgtacattgaatgaacagggcttttctttg

SEQ ID NO: 255327 - DNA, 75 bp, Artificial Sequence
  Synthetic
ctgatgatgggtttgagatagcagcctgctttctaacaactgacctcacaaaatactgcttaaattggaggtacc

SEQ ID NO: 255328 - DNA, 75 bp, Artificial Sequence
  Synthetic
acacttgcacacaggctcatcttgctgtataagacctgtcgagtcttgtgtagtaaatcctcctttgcttcctgt

SEQ ID NO: 255329 - DNA, 75 bp, Artificial Sequence
  Synthetic
agtacaagaaaatggttagaccttcccgactattcttcatttggtgagctacagtcagaattggctagattgatt

SEQ ID NO: 255330 - DNA, 75 bp, Artificial Sequence
  Synthetic
tccggtattcactggaggtgagaccattgtcagcgaaaaaactgaataccgtaatagaatataacttattgtatc

SEQ ID NO: 255331 - DNA, 75 bp, Artificial Sequence
  Synthetic
aaccaatcaacattcaatcacctaatgggagaaacatctgacatattgttgaatcgagcctatcaaaagagaatt

SEQ ID NO: 255332 - DNA, 75 bp, Artificial Sequence
  Synthetic
acaaattatccaggaatgtatagatagagttatatctgagtgtgtaagagatcagtatttgactgataacaatat

SEQ ID NO: 255333 - DNA, 75 bp, Artificial Sequence
  Synthetic
tcatgataccttattatttacatcatacaatgttgggccacttggaaagattaacactataatcagattaattgt

SEQ ID NO: 255334 - DNA, 75 bp, Artificial Sequence
  Synthetic
attgacaatgatatacctgattatgatatccacggggacataatttaaattgactaaggactcctctggtatgat

SEQ ID NO: 255335 - DNA, 75 bp, Artificial Sequence
  Synthetic
gatcctacccaacttgaccttgatacagctctcaatgatgatatatttatagtttctcctcgtggaggaatcgag

SEQ ID NO: 255336 - DNA, 75 bp, Artificial Sequence
  Synthetic
ccgactattcttcatttggtgagctacagtcagaattggctagattgattacaatccaccttaaagaagtaatag

SEQ ID NO: 255337 - DNA, 75 bp, Artificial Sequence
  Synthetic
tacaatgttgggccacttggaaagattaacactataatcagattaattgtcgaaagaatcctcatgtacacagtt

SEQ ID NO: 255338 - DNA, 75 bp, Artificial Sequence
  Synthetic
cgataagacttacattacgacaatctattgagcttggggagtttagactaagagatgtaataacgcccacagaga

SEQ ID NO: 255339 - DNA, 75 bp, Artificial Sequence
  Synthetic
tattgagcttggggagtttagactaagagatgtaataacgcccacagagattttgaagttatctccaaatcggaa

SEQ ID NO: 255340 - DNA, 75 bp, Artificial Sequence
  Synthetic
tcagatgaatgtgagcattgcagtagtggtgatgacaaattcacctggtttttcctacccaaggggataaggcta

SEQ ID NO: 255341 - DNA, 75 bp, Artificial Sequence
  Synthetic
tcaacattcaaccatttgatgggtgagacctctgatatgttattaaatcgagcttatcagaaaagaatttggaag

SEQ ID NO: 255342 - DNA, 75 bp, Artificial Sequence
  Synthetic
agacctctgatatgttattaaatcgagcttatcagaaaagaatttggaaggctattgggtgtgttatctattgtt

SEQ ID NO: 255343 - DNA, 75 bp, Artificial Sequence
  Synthetic
agactatgtgtatatgaccttgaggaggataccaggaatggctataacaggcatctcatccacaattagtcaccc

SEQ ID NO: 255344 - DNA, 75 bp, Artificial Sequence
  Synthetic
agtagtacgctcgctcagtcattccgagaagaaggagcaagcttataaagcaagtaaattattctttgaaaggct

SEQ ID NO: 255345 - DNA, 75 bp, Artificial Sequence
  Synthetic
cactatgccggcgatccaacccccattatacctcacatttctactgctaactcttctttatctgatcataacttt

SEQ ID NO: 255346 - DNA, 75 bp, Artificial Sequence
  Synthetic
agacatcaatcttttgcaagtcaatgatgatgaccttgattatgatatccatggagaagtgatgtgattgggtca

SEQ ID NO: 255347 - DNA, 75 bp, Artificial Sequence
  Synthetic
tccttagttctgatttcttcatatacagtaagagggtgttttacaaaggtcgaattttgactcaagcgttaaaga

SEQ ID NO: 255348 - DNA, 75 bp, Artificial Sequence
  Synthetic
gatgatgaccttgattatgatatccatggagaagtgatgtgattgggtcatggatgagcacaatttgcgttatta

SEQ ID NO: 255349 - DNA, 75 bp, Artificial Sequence
  Synthetic
gcatcatgctccaatttagctactactgtaatgcgcctgactgagaatggggtcgagaaagatttgtgttatttt

SEQ ID NO: 255350 - DNA, 75 bp, Artificial Sequence
  Synthetic
aaatatgcaaaaccgacctcgacctcgggaaaatattaccgtatcagtatttaagaaaaaaggttttttaaagaa

SEQ ID NO: 255351 - DNA, 75 bp, Artificial Sequence
  Synthetic
cgggaaaatattaccgtatcagtatttaagaaaaaaggttttttaaagaaaaaaatgcttcttctttctcccctt

SEQ ID NO: 255352 - DNA, 75 bp, Artificial Sequence
  Synthetic
catgagacataaagaaaaaaccaagccagaacaaactcagggtcacaatacaacaccaaaccctagctgctatct

SEQ ID NO: 255353 - DNA, 75 bp, Artificial Sequence
  Synthetic
ccaaactaaatctcttagtcaggacatcactaatgcttatcttaatcatccaatacttatctcaagattgtgtct

SEQ ID NO: 255354 - DNA, 75 bp, Artificial Sequence
  Synthetic
atggagccctcaaaattcttcacactatcggacaatgccacctttgcacctgggcctgttagcaacgcggctgac

SEQ ID NO: 255355 - DNA, 75 bp, Artificial Sequence
  Synthetic
gatgattattgaaccaaaattaactgcctaccctagtaatttgttttatctatctcgaaagctgcttaatgctat

SEQ ID NO: 255356 - DNA, 75 bp, Artificial Sequence
  Synthetic
agtgtctgcaattgctgatgtgaaacgattaattaaagctggctgtctagatatctgggtcctgtataacatcct

SEQ ID NO: 255357 - DNA, 75 bp, Artificial Sequence
  Synthetic
tgggaggaggcctggaaaaggtaagtggagcactctggcagctgatccttatactttaaacatagattatttagt

SEQ ID NO: 255358 - DNA, 75 bp, Artificial Sequence
  Synthetic
actttaggtgagcttgtaaggatgatcaatgatcaaggcttgagcaatcagttgtcttcaattacagacaagata

SEQ ID NO: 255359 - DNA, 75 bp, Artificial Sequence
  Synthetic
ggagtgttaatcccatgctccgtggagtattcagcgaaaatgcagctgaggaagaagaggaactcgcacagtatc

SEQ ID NO: 255360 - DNA, 75 bp, Artificial Sequence
  Synthetic
tatcctcaagtctgcaacctatcaaatcatcttaatcatcagatcaatggcataggggggatggaacgtcaagat

SEQ ID NO: 255361 - DNA, 75 bp, Artificial Sequence
  Synthetic
agtattcagcgaaaatgcagctgaggaagaagaggaactcgcacagtatctattagatcgtgaggtagtcatgcc

SEQ ID NO: 255362 - DNA, 75 bp, Artificial Sequence
  Synthetic
tagaactattatcaggtattcactggaggtgagaccattgtcagcaaagaagctgaatacagtaatagaatataa

SEQ ID NO: 255363 - DNA, 75 bp, Artificial Sequence
  Synthetic
cttattgtatctttcctacaatttggagattattgaaaaacccaatatagtccaaccttttttgaatgcaatcaa

SEQ ID NO: 255364 - DNA, 75 bp, Artificial Sequence
  Synthetic
ggtagtaacttgattgaaattatagaaaaaataagcctagaatgacatcttacttctcgactttccaactttgga

SEQ ID NO: 255365 - DNA, 75 bp, Artificial Sequence
  Synthetic
catcgagggattagaaacacctgatcccattgaattggtacatgggtgtttgatcattgggtcagatgaatgtga

SEQ ID NO: 255366 - DNA, 75 bp, Artificial Sequence
  Synthetic
aaggtatcgattatgagatagttgttccttctgaaagccaactcacactcagtgatagagttctaaatctagttg

SEQ ID NO: 255367 - DNA, 75 bp, Artificial Sequence
  Synthetic
aactagtgtcgaatacattattcacaaggtaggagctgatacatgtgcattggttcatgtggatttggagggtgt

SEQ ID NO: 255368 - DNA, 75 bp, Artificial Sequence
  Synthetic
atatgatcttcggcaaagtatgcaattgcccacagtatgggagaaattgactcaatccacggttaatcttataag

SEQ ID NO: 255369 - DNA, 75 bp, Artificial Sequence
  Synthetic
atatttgggctttcggagatacagaggaatcatggcaggatgcctatgagttagcttccactcgtgttaatctca

SEQ ID NO: 255370 - DNA, 75 bp, Artificial Sequence
  Synthetic
tgatggtctagaacgggttgtattacacatcagcaatcaactgacaggcaagcctaacttgtttaccagatctcg

SEQ ID NO: 255371 - DNA, 75 bp, Artificial Sequence
  Synthetic
gttgatcttccctgcatatgggggtgtcttgcccaatagtacactcggggttaaatcagcaagagaatttttccg

SEQ ID NO: 255372 - DNA, 75 bp, Artificial Sequence
  Synthetic
ggaatcatggcaggatgcctatgagttagcttccactcgtgttaatctcacactagagcaattgcaatctctcac

SEQ ID NO: 255373 - DNA, 75 bp, Artificial Sequence
  Synthetic
tcagaccgctaggtttatcatccacatcatggtataaaacaatcagcgttttgaattatattagccatatgaaga

SEQ ID NO: 255374 - DNA, 75 bp, Artificial Sequence
  Synthetic
ctcaattaaaatttacccctgcaagctcctatgcattctctagcttcgttcatatatctaatgactgtcaagttc

SEQ ID NO: 255375 - DNA, 75 bp, Artificial Sequence
  Synthetic
aaataccccctattgcaataaccccaggacaatctagcgaccgctaactacccaaatccactacatttcattcat

SEQ ID NO: 255376 - DNA, 75 bp, Artificial Sequence
  Synthetic
ctcctatgcattctctagcttcgttcatatatctaatgactgtcaagttcttgagatcgatgatcaggtaacaga

SEQ ID NO: 255377 - DNA, 75 bp, Artificial Sequence
  Synthetic
attcaatctaagttcatctgaatcagcatctcttacagaatttgatttcatcctcaacttggaattgtctgaagc

SEQ ID NO: 255378 - DNA, 75 bp, Artificial Sequence
  Synthetic
agtttgcttatgacggctgagaatatggataacccatttcctcaacccccccttcatcatgttctcagaccacta

SEQ ID NO: 255379 - DNA, 75 bp, Artificial Sequence
  Synthetic
atgattactggccttgctttaattgagacatggaacaatcctccaatcaacttctccgtttatgaaactacacta

SEQ ID NO: 255380 - DNA, 75 bp, Artificial Sequence
  Synthetic
atttataaaacaagatgagactggtgatttaattgagacaggaatgaatgttgcaaatcatttcctatccgcccc

SEQ ID NO: 255381 - DNA, 75 bp, Artificial Sequence
  Synthetic
cccttcattaatgtccctcaaatgaataaatttgtatatgaccctgaaccgctcagtttgctagagatggaaaaa

SEQ ID NO: 255382 - DNA, 75 bp, Artificial Sequence
  Synthetic
tacttcatacaatgtaggtcctctcgggaaaataaatacaatactcagattgattgttgagagaattcttatgta

SEQ ID NO: 255383 - DNA, 75 bp, Artificial Sequence
  Synthetic
cccggctcaatgaacagtatgttggagagagcccaagtacatgcgctactgatcacggtaactgtactaaagcca

SEQ ID NO: 255384 - DNA, 75 bp, Artificial Sequence
  Synthetic
gatcacggtaactgtactaaagccaggcggcttactaatcttgaaagcttcatgggaacctttcaatcgattttc

SEQ ID NO: 255385 - DNA, 75 bp, Artificial Sequence
  Synthetic
catcatggtctcatcctccgaaggaggcactggagggactcagattcctgagcccctttttgcacaaacaggaca

SEQ ID NO: 255386 - DNA, 75 bp, Artificial Sequence
  Synthetic
gaaagtgtcccttacagattgatccaagcaggtatagcagcaggaagtggtgtagtgcaaagtttctatccactc

SEQ ID NO: 255387 - DNA, 75 bp, Artificial Sequence
  Synthetic
tgtagtgcaaagtttctatccactctggaacggtaacagcgatatcactgacttaagcacgaaaactagtgtcga

SEQ ID NO: 255388 - DNA, 75 bp, Artificial Sequence
  Synthetic
ttacattgattctgtgtttgtttactctggctgggcattattattggaactttcgtaccaaatgtactacttaag

SEQ ID NO: 255389 - DNA, 75 bp, Artificial Sequence
  Synthetic
catgtaacaattgttagtggaccaggagatgtgtcattcagctccggtgaagaacccacactgtatttggatgaa

SEQ ID NO: 255390 - DNA, 75 bp, Artificial Sequence
  Synthetic
agtatgatacaccaccaaaaggtgctacaccagcatccaaattcttctagaccgcatacgacctcgaacaatcat

SEQ ID NO: 255391 - DNA, 75 bp, Artificial Sequence
  Synthetic
ctagcaaggcctgtccccaagcctcgtcctgcaaagcagccaaaaccccaaccagtaaaggatttagcaggacgg

SEQ ID NO: 255392 - DNA, 75 bp, Artificial Sequence
  Synthetic
acaaaattgagcatagacgcagtaatgtggggaactaagcaggttttgaccaacatttcgcaaggtatcgattat

SEQ ID NO: 255393 - DNA, 75 bp, Artificial Sequence
  Synthetic
tccgatccaaataatcacgaggtatacataatagctacattagcggttgatcccaccacatcatcctttacaact

SEQ ID NO: 255394 - DNA, 75 bp, Artificial Sequence
  Synthetic
tcccaccacatcatcctttacaactgctcttaatagggcgcgcaccctgaatgaacagggtttttcactcatccc

SEQ ID NO: 255395 - DNA, 75 bp, Artificial Sequence
  Synthetic
tggaaagccattgggtgtgtaatctattgctttggcttgcttactccggatgttgaagattccgagcgcattgat

SEQ ID NO: 255396 - DNA, 75 bp, Artificial Sequence
  Synthetic
gcaaaggccagcactgaggatgctctgaatgatatcaagcgagacatcatacgaagcgccatatgaattcaccag

SEQ ID NO: 255397 - DNA, 75 bp, Artificial Sequence
  Synthetic
tatgtcacctgaggacaaatgtcaggctttaactacccatctactccaaactgtcgaatatgttgagcacattca

SEQ ID NO: 255398 - DNA, 75 bp, Artificial Sequence
  Synthetic
tatttggcagacaacaacattatccttcaggcgggagggactccaagcacaagaaaatggttggatctacctgac

SEQ ID NO: 255399 - DNA, 75 bp, Artificial Sequence
  Synthetic
gactctcaaagactaaatgcattccctgtaatcatggctcaagaaggcaaaggacgactcctcagacagatcaga

SEQ ID NO: 255400 - DNA, 75 bp, Artificial Sequence
  Synthetic
gattgaaaagacgaacatcaggaggatgattattgaaccaaaattaactgcctaccctagtaatttgttttatct

SEQ ID NO: 255401 - DNA, 75 bp, Artificial Sequence
  Synthetic
caatccacagttaatcttataagtgatggtctagaacgagttgtattacacatcagcaatcaactgacaggcaag

SEQ ID NO: 255402 - DNA, 75 bp, Artificial Sequence
  Synthetic
gaatacatatggattcatccgtgccactccagaaacatccgagttcatctctgaatcatcacaacaaaaggtaac

SEQ ID NO: 255403 - DNA, 75 bp, Artificial Sequence
  Synthetic
actccagaaacatccgagttcatctctgaatcatcacaacaaaaggtaactcctgtagtgacggcgtgcatgctg

SEQ ID NO: 255404 - DNA, 75 bp, Artificial Sequence
  Synthetic
ttgtctgaagccagccttgagaaatactctctcccaagtttgcttatgacggctgagaatatggataacccattt

SEQ ID NO: 255405 - DNA, 75 bp, Artificial Sequence
  Synthetic
agaacaagaaacaatccttagttctgatttcttcatatacagtaagagggtgttttacaaaggtcgaattttgac

SEQ ID NO: 255406 - DNA, 75 bp, Artificial Sequence
  Synthetic
cccaattacagtatggtgatcctgttgtagacattaagggtacattctatggatttatatgtaatgagattctcg

SEQ ID NO: 255407 - DNA, 75 bp, Artificial Sequence
  Synthetic
cccaatcaaaacgcacagttgcaagtgggagactgggatgagcaaatcactgacatgatcaaactaaccccaatc

SEQ ID NO: 255408 - DNA, 75 bp, Artificial Sequence
  Synthetic
ttctagaccgcacacgacctcgaacaatcataaccacatcagtattaaatccataatatcattttaagaaaaaat

SEQ ID NO: 255409 - DNA, 75 bp, Artificial Sequence
  Synthetic
aagcaagatacatgctgcagccggaggcccaaaggttgattcaaactgccatcaggaaaagtcttgttgttagac

SEQ ID NO: 255410 - DNA, 75 bp, Artificial Sequence
  Synthetic
gaccgcacacgacctcgaacaatcataaccacatcagtattaaatccataatatcattttaagaaaaaattgatt

SEQ ID NO: 255411 - DNA, 75 bp, Artificial Sequence
  Synthetic
aggtaggggctgatacatgtgcattggttcatgtggatctggagggtgtacccggctcaatgaacagtatgttgg

SEQ ID NO: 255412 - DNA, 75 bp, Artificial Sequence
  Synthetic
gtaatagaatataacttattatatctttcctacaatttggagattattgaaaaacctaatattgtccaacctttc

SEQ ID NO: 255413 - DNA, 75 bp, Artificial Sequence
  Synthetic
gatcacggtaactgtactaaagccaggtggcttactaatcttgaaagcttcatgggaaccttttaatcgattttc

SEQ ID NO: 255414 - DNA, 75 bp, Artificial Sequence
  Synthetic
cctttacaaccgctctgaatagggcgcgtactctgaatgaacagggcttttcactcatcccacctgaattagtga

SEQ ID NO: 255415 - DNA, 75 bp, Artificial Sequence
  Synthetic
caaggcactgttgacaacagagtagcagatgatctaggcctgactcctgagcaaagaactgaggttactcagctt

SEQ ID NO: 255416 - DNA, 75 bp, Artificial Sequence
  Synthetic
gccgctgtctcattagttcaagcacagacaaatgcacgtgcaatagcggcgatgaaaaattcaatacaggcaact

SEQ ID NO: 255417 - DNA, 75 bp, Artificial Sequence
  Synthetic
taatcataactctgtatgtctggactatattgaccattaaccataatacggcggttcggtatgcagcactgtacc

SEQ ID NO: 255418 - DNA, 75 bp, Artificial Sequence
  Synthetic
atagataaagtcatatcagagtgtgttagagaccaatatctggcagacaacaatattatccttcaggcggggggg

SEQ ID NO: 255419 - DNA, 75 bp, Artificial Sequence
  Synthetic
ctcataacaattcatcttaaagaggtaatagaaatcctaaagggccaatcatcagatcatgacaccctattattt

SEQ ID NO: 255420 - DNA, 75 bp, Artificial Sequence
  Synthetic
cacgacggcaacaaggcactgttgacaacagagtagcagatgatctaggcctgactcctgaacaaagaactgagg

SEQ ID NO: 255421 - DNA, 75 bp, Artificial Sequence
  Synthetic
tcttcatgccattatatcctcaagtcagcaacatcccaaatcatcagaatcaccagatcaatcgcatcgggggga

SEQ ID NO: 255422 - DNA, 75 bp, Artificial Sequence
  Synthetic
tgttcctcaaatgaataaatttgtatatgaccctgaaccactcagtttgttagaaatggaaaaaattgaggatat

SEQ ID NO: 255423 - DNA, 75 bp, Artificial Sequence
  Synthetic
cacagccgaagatccactgctgacaacatgactttggcacactccggttcaaataagcacagaattaataatagt

SEQ ID NO: 255424 - DNA, 75 bp, Artificial Sequence
  Synthetic
tgttgaagattctgagcgcattgatattgacaatgatatacctgattatgatatccacggggacataatttaaat

SEQ ID NO: 255425 - DNA, 75 bp, Artificial Sequence
  Synthetic
attgacaatgatatacctgattatgatatccacggggacataatttaaatcgactaaagactcctctggcatgat

SEQ ID NO: 255426 - DNA, 75 bp, Artificial Sequence
  Synthetic
ttctttccgggcaaaccatggatcagtttataaaacaggatgagactggtgatttaattgagacaggaatgaatg

SEQ ID NO: 255427 - DNA, 75 bp, Artificial Sequence
  Synthetic
gacatatcaactgaactgagtaaagttaatgcatccctccaaaatgccgttaagtacataaaggagagcaaccat

SEQ ID NO: 255428 - DNA, 75 bp, Artificial Sequence
  Synthetic
cccaatcaaaacgcacagtcacaagtgggtgactgggatgagtagaccaccgacatgactaaactacccccaact

SEQ ID NO: 255429 - DNA, 75 bp, Artificial Sequence
  Synthetic
cgactaaagactcctctggcatgatacgtcaccaaaaggttccacaccagcatccaaattcttctagaccgtaca

SEQ ID NO: 255430 - DNA, 75 bp, Artificial Sequence
  Synthetic
attttgacactacctggaaaatgtcgtctgtgctcaaagcatttgagcggttcacgatagaacaggaacttcaag

SEQ ID NO: 255431 - DNA, 75 bp, Artificial Sequence
  Synthetic
tttcgctggagtttcgatcactcactctagaaagatctccaattaggacaagtcccagtccctcatgcgtgaaca

SEQ ID NO: 255432 - DNA, 75 bp, Artificial Sequence
  Synthetic
ccttcatcatgttctcagaccactaggtttatcatccacctcatggtataaaacaatcagtgttttgaattatat

SEQ ID NO: 255433 - DNA, 75 bp, Artificial Sequence
  Synthetic
ctcctgcaaatgtgggaattgccccgcaaagtgcgatcagtgcgaacgagattatggacctccttagagggatgg

SEQ ID NO: 255434 - DNA, 75 bp, Artificial Sequence
  Synthetic
acaatgattccctgttaaataaaaaataagcacgaacacaagtccaatccaaccatagcagcaatggccggatca

SEQ ID NO: 255435 - DNA, 75 bp, Artificial Sequence
  Synthetic
tggggttgagaccgcacgacggcaacaaggcactgttgacaacagagtagcagatgatctaggcctgactcctga

SEQ ID NO: 255436 - DNA, 75 bp, Artificial Sequence
  Synthetic
tctcaaactgctctacaaacatccccttagttaatgaccttaggtttataaatgggatcaataaattcatcattg

SEQ ID NO: 255437 - DNA, 75 bp, Artificial Sequence
  Synthetic
tctttctcactctcaaatatgcactagggaccaaatggagtcctctatcattggctgcattcaccggtgaactca

SEQ ID NO: 255438 - DNA, 75 bp, Artificial Sequence
  Synthetic
caatggccggatcacagatcaaaattcctcttccaaagccccccgactcagactctcaaagactaaatgcattcc

SEQ ID NO: 255439 - DNA, 75 bp, Artificial Sequence
  Synthetic
tgtcagcaaagaagctgaatacagtaatagaatataacttattgtatctatcctacaatttggagattattgaaa

SEQ ID NO: 255440 - DNA, 75 bp, Artificial Sequence
  Synthetic
tcctacaatttggagattattgaaaaacccaatatagtccaaccttttttgaatgcaatcaatgttgatacttgt

SEQ ID NO: 255441 - DNA, 75 bp, Artificial Sequence
  Synthetic
atgtccaaatgcgaaattacacttatgcacgacctttcctaaacggttattatttccagattggggttgagaccg

SEQ ID NO: 255442 - DNA, 75 bp, Artificial Sequence
  Synthetic
atgaacagggcttttcacttatcccacctgaattagtgagtgagtactggaggaggcgtgttgaacaagggcaga

SEQ ID NO: 255443 - DNA, 75 bp, Artificial Sequence
  Synthetic
tgtcacatttttatccgtgacagtttgttctgcctcactcaagtttcgagttgcgcgcccattgcttgctgcacg

SEQ ID NO: 255444 - DNA, 75 bp, Artificial Sequence
  Synthetic
cacatcagagtgtgtcagagaccagtatctggcagataacaatattatccttcaagcgggagggactccaagtac

SEQ ID NO: 255445 - DNA, 75 bp, Artificial Sequence
  Synthetic
ggtgggcctgtgaatccttttgttcctccagttcaacagcaacaacctgctgccgtatatgaggacattcctgca

SEQ ID NO: 255446 - DNA, 75 bp, Artificial Sequence
  Synthetic
tcttgatcagacagacatcagggttcggaagacagcaagtgataaagagcagatcttattcgagatcaaccgcat

SEQ ID NO: 255447 - DNA, 75 bp, Artificial Sequence
  Synthetic
aatgagcaacctatgagaatttcctctattcccactgattcctccaggaggatcaataatcagtccgattcgcct

SEQ ID NO: 255448 - DNA, 75 bp, Artificial Sequence
  Synthetic
atgaagatggaggcgcaggattccaaaatggagtacaagtaccagctgtaagacagggaggtcaaactgacttta

SEQ ID NO: 255449 - DNA, 75 bp, Artificial Sequence
  Synthetic
aaaaaataagcctagaaggacatcttacttctcgactttccagatttgaaaatagggttgattagtaatcatgaa

SEQ ID NO: 255450 - DNA, 75 bp, Artificial Sequence
  Synthetic
aatggcttacatcaaaggagcatctgtatcacttaaatcagcactcaggttagcgggagtatatatttgggcttt

SEQ ID NO: 255451 - DNA, 75 bp, Artificial Sequence
  Synthetic
tatctgtgacagtttgttctgcctcactcaagtttcgagttgcgcgcccattgcttgctgcacgatctagattag

SEQ ID NO: 255452 - DNA, 75 bp, Artificial Sequence
  Synthetic
actcaagtttcgagttgcgcgcccattgcttgctgcacgatctagattagtaagagcagttcagatggaagtttt

SEQ ID NO: 255453 - DNA, 75 bp, Artificial Sequence
  Synthetic
ataatcagaatcatcagatcaatcgcatcggggggctggaaaaccaagatttattacgatacaacgagaatggtg

SEQ ID NO: 255454 - DNA, 75 bp, Artificial Sequence
  Synthetic
taagagcagttcagatggaagttttgcttcgggtaacttgcaaaaaagattcccaaatggcaaagagcatgttaa

SEQ ID NO: 255455 - DNA, 75 bp, Artificial Sequence
  Synthetic
acacggaaacactttcccaaacaatcccaatcaaaacgcacagttgcaagtgggcgactgggatgagtaaatcac

SEQ ID NO: 255456 - DNA, 75 bp, Artificial Sequence
  Synthetic
acatcaccaaaaggtgccacaccagcatccaaattcttctagaccgcacacgacctcgaacaatcataaccacat

SEQ ID NO: 255457 - DNA, 75 bp, Artificial Sequence
  Synthetic
tgcatctaagtgccgtaagatgaatctgacagtcagcataggagacatgtggggaccaaccattctagtccatgc

SEQ ID NO: 255458 - DNA, 75 bp, Artificial Sequence
  Synthetic
ctagaaggatatcttacttctcgactttccaactctgaaaatagaattgatcagtaatcatgaaggctttgtcaa

SEQ ID NO: 255459 - DNA, 75 bp, Artificial Sequence
  Synthetic
aggtgccacaccagcatccaaattcctctagaccgcacacgacctcgagcaatcacaaccacatcagtattaaat

SEQ ID NO: 255460 - DNA, 75 bp, Artificial Sequence
  Synthetic
atgagactggtgatttaattgagacaggaatgaatgttgcaaatcatttcctatccgcccccattcagggaacca

SEQ ID NO: 255461 - DNA, 75 bp, Artificial Sequence
  Synthetic
ctatccgcccccattcagggaaccaactcgctgagcaaggcctcaatcatccctggcgttgcacctgtactcatt

SEQ ID NO: 255462 - DNA, 75 bp, Artificial Sequence
  Synthetic
ggcaatccagagcaaaagaacattcagcaccctaccgcatcacatcagggatccaagtcaaagggcagaggctca

SEQ ID NO: 255463 - DNA, 75 bp, Artificial Sequence
  Synthetic
tagggcatctcacagggtaggtgcattgataacattattctcacttccctcagcaggcatgcaaaatcatattag

SEQ ID NO: 255464 - DNA, 75 bp, Artificial Sequence
  Synthetic
cctccgaagcaggcaatggagggactcagattcctgagcccctttttgcacaaacaggacagggtggtatagtca

SEQ ID NO: 255465 - DNA, 75 bp, Artificial Sequence
  Synthetic
aattcaattgccagacaggatcttggagatcgggaatgaacaatggagctatccagctaagaattgtaagttgac

SEQ ID NO: 255466 - DNA, 75 bp, Artificial Sequence
  Synthetic
ttacttgcttgggcttcgcagtcttttcatcttctatatgtgtgaacatcaacatcttgcagcaaattggatata

SEQ ID NO: 255467 - DNA, 75 bp, Artificial Sequence
  Synthetic
acttcaaaacaaatcatatcaacacaatatcaagtagtgtcgatgatctcatcaggtactaatcctgacatggtg

SEQ ID NO: 255468 - DNA, 75 bp, Artificial Sequence
  Synthetic
cccaatcaattctccacacatagcttcactggattacacaaaattgagcatagatgcagtaatgtggggaactaa

SEQ ID NO: 255469 - DNA, 75 bp, Artificial Sequence
  Synthetic
agagatccttctttcgctggagtttcgatcatcaactctagaaagatctccagttaggacaagtctcaatccttc

SEQ ID NO: 255470 - DNA, 75 bp, Artificial Sequence
  Synthetic
gacattgttcaatcatgagacataaagaaaaaagcaagcccgaacaagcttaggatcacaatacaacacagaacc

SEQ ID NO: 255471 - DNA, 75 bp, Artificial Sequence
  Synthetic
atttggatgagctggcgaggcccgtctccaagcctcgtccttcaaagcagacaaaaccccaaccagtaaaggatt

SEQ ID NO: 255472 - DNA, 75 bp, Artificial Sequence
  Synthetic
ggccgctcgagagatggaaccctcaaaactcttcacaatatcagacaatgccacctttgcacctgggcctgttat

SEQ ID NO: 255473 - DNA, 75 bp, Artificial Sequence
  Synthetic
caatgcggctgacaagaagacattccgaacctgcttccgaatattggtactgtctgtacaagctgttacccttat

SEQ ID NO: 255474 - DNA, 75 bp, Artificial Sequence
  Synthetic
caaaatgatcactgattgtgtggctaaccctcaaatgaagcaggcgttcgagcaacgattggcaaaggccagcac

SEQ ID NO: 255475 - DNA, 75 bp, Artificial Sequence
  Synthetic
gcggtgcgacatgcagcactgtaccagagatccttctttcactggagtttcgatcactcactctaagaagatccc

SEQ ID NO: 255476 - DNA, 75 bp, Artificial Sequence
  Synthetic
gtcaattcaagaagaataaagacaataaacatgagatgcctgatgatgggtttgagatagcagcctgctttctaa

SEQ ID NO: 255477 - DNA, 75 bp, Artificial Sequence
  Synthetic
gaattcaccagaagcaccagactcaaggaaaaatccatgaactgagagccacaatgattccctattaaataaaaa

SEQ ID NO: 255478 - DNA, 75 bp, Artificial Sequence
  Synthetic
aaccatagcagaaatggcaggatcacagatcaaaattcctcttccaaagccccccgattcagactctcaaagact

SEQ ID NO: 255479 - DNA, 75 bp, Artificial Sequence
  Synthetic
gcctgaatcggaaaagctgctcaattgcaacagtccccgatggatgcgcaatgtactgttacgtctcaactcaac

SEQ ID NO: 255480 - DNA, 75 bp, Artificial Sequence
  Synthetic
caagaaggcaaaggacaactccttagacaaatcaggcttaggaaaatattatcaggagatccgtctgatcagcaa

SEQ ID NO: 255481 - DNA, 75 bp, Artificial Sequence
  Synthetic
gaggctgagcctagaatcaaaactatgccttgcaggcaatataagtgcctgtgtgttctcacctatagcagggag

SEQ ID NO: 255482 - DNA, 75 bp, Artificial Sequence
  Synthetic
tgatgacgatggcgatgaagacggaggtgcaggattccagaatggagcacaagcaccagctgtaagacagggagg

SEQ ID NO: 255483 - DNA, 75 bp, Artificial Sequence
  Synthetic
accagtgctagaagatccacaacatatgctgaaggctcttgatcagacagacattagggttcggaaaacagcaag

SEQ ID NO: 255484 - DNA, 75 bp, Artificial Sequence
  Synthetic
caagatctagatcagcgggctttgagatcatacttccccagttacttctctaatcgaagagtgcagagtgcattt

SEQ ID NO: 255485 - DNA, 75 bp, Artificial Sequence
  Synthetic
tttcccactttgaaaatagaattgatcagtaatcatgaaggtttctttagttacttgcttgggctttgcagtctt

SEQ ID NO: 255486 - DNA, 75 bp, Artificial Sequence
  Synthetic
gaggcgtgttgaacaagggcagattatacaggatcgtatagataaagtcatatcagagtgtgtcagagaccaata

SEQ ID NO: 255487 - DNA, 75 bp, Artificial Sequence
  Synthetic
tcagtttttatcgattattaagaaaaaacaggccagaatggcgggcctaaatgagatactcttacctgaagtaca

SEQ ID NO: 255488 - DNA, 75 bp, Artificial Sequence
  Synthetic
tcgtaacgtctcgtgaccctgccgttgcactatgccggcaatccaacctcccttatacctaacatttctattgct

SEQ ID NO: 255489 - DNA, 75 bp, Artificial Sequence
  Synthetic
aatcaacaatcaagcaaatttgaccggtggtaattcgattgaaattatagaaaaaataagcctagaaggatatcc

SEQ ID NO: 255490 - DNA, 75 bp, Artificial Sequence
  Synthetic
aaaaaataagcctagaaggatatcctacttctcaactttccaactttgaaaatagaatagatcagtaatcatgaa

SEQ ID NO: 255491 - DNA, 75 bp, Artificial Sequence
  Synthetic
tgataacacccatggagatccttaaactatcccccaacaggaaatatctgaagtctgcattaaaccaatcaacat

SEQ ID NO: 255492 - DNA, 75 bp, Artificial Sequence
  Synthetic
aggatgcctatgagttagcttccactcgtgttaatctcacactagagcaattgcaatctctcactcctttaccaa

SEQ ID NO: 255493 - DNA, 75 bp, Artificial Sequence
  Synthetic
tttgcaatcttttcatcctctatatgtgtgaatatcaatatcttgcagcaaattggatacatcaagcaacaggtc

SEQ ID NO: 255494 - DNA, 75 bp, Artificial Sequence
  Synthetic
tgacatattgttaaatcgagcctatcagaagagaatttggaaagccattgggtgtgtaatctattgctttggttt

SEQ ID NO: 255495 - DNA, 75 bp, Artificial Sequence
  Synthetic
attatctacttcaatttctgctgctgaaatactaagtgccggtctaatggagggtcagattgtttctgttctgct

SEQ ID NO: 255496 - DNA, 75 bp, Artificial Sequence
  Synthetic
accagtaaaggatttagcaggacggaaagtgatgataaccaaaatgatcactgactgtgtggccaatcctcaaat

SEQ ID NO: 255497 - DNA, 75 bp, Artificial Sequence
  Synthetic
tcactttaggtgagcttgtgaggatgatcaatgatcaaggcttgagcaatcagttgtcttcaattacagacaaga

SEQ ID NO: 255498 - DNA, 75 bp, Artificial Sequence
  Synthetic
gtcctgtaaagcagccaaaacctcaaccagtaaaggatttagcaggacgaaaggtgatgattaccaaaatgatca

SEQ ID NO: 255499 - DNA, 75 bp, Artificial Sequence
  Synthetic
acatcacagtttgacaatctatcccctgatttaactgctgagctcctctgcattatgaggctttggggccatccc

SEQ ID NO: 255500 - DNA, 75 bp, Artificial Sequence
  Synthetic
ctctggcacgatacatcaccaaaaggtgccacaccagtatccaaactcctctagaccgcacacgacctcgaacaa

SEQ ID NO: 255501 - DNA, 75 bp, Artificial Sequence
  Synthetic
gaacaccagactcacagggaaatccatgaactgagagccacaatgattccctgcttaataaaaaataagcacgaa

SEQ ID NO: 255502 - DNA, 75 bp, Artificial Sequence
  Synthetic
acgatctgtacaagcaaaaaacaagcctcaaactgctctacaaacgtccccttagttaatgaccttaggtttata

SEQ ID NO: 255503 - DNA, 75 bp, Artificial Sequence
  Synthetic
gtctgtgctcaaagcatttgagcgattcacgatagaacaggaactccaagacaggggtgaggagggttcaattcc

SEQ ID NO: 255504 - DNA, 75 bp, Artificial Sequence
  Synthetic
acaggggtgaggagggttcaattccgccggagactttaaagtcagcagtcaaagtcttcgtcattaacacaccca

SEQ ID NO: 255505 - DNA, 75 bp, Artificial Sequence
  Synthetic
tatcggccatccactcaacatgcctagctttatcccaactgcaacttcacccaatggttgcacaagaattccatc

SEQ ID NO: 255506 - DNA, 75 bp, Artificial Sequence
  Synthetic
tgagattgatggttttgagcccggcacatataggctgattccgaatgcacgcgccaatcttactgccaatgaaat

SEQ ID NO: 255507 - DNA, 75 bp, Artificial Sequence
  Synthetic
tccttcggtgctggaccagtactagaagacccacaacatatgctgaaagctcttgatcagacagacatcagggtt

SEQ ID NO: 255508 - DNA, 75 bp, Artificial Sequence
  Synthetic
agatcttattcgagatcaaccgcatccccaatctattcaggcatcatcaaatatctgcggaccatctgattcagg

SEQ ID NO: 255509 - DNA, 75 bp, Artificial Sequence
  Synthetic
tgcttaatgctattcgagattctgaagaaggacaatttctgattgcatcctattataacagttttggatatctgg

SEQ ID NO: 255510 - DNA, 75 bp, Artificial Sequence
  Synthetic
tattataacagttttggatatctggaaccaatactaatggaatctaaaatattcaatctaagttcatctgaatca

SEQ ID NO: 255511 - DNA, 75 bp, Artificial Sequence
  Synthetic
gtgtactaatccaggcttgggtgatggtctgtaaatgtatgacagcgtacgaccaacctgctgggtctgctgatc

SEQ ID NO: 255512 - DNA, 75 bp, Artificial Sequence
  Synthetic
cacgaccattgatctaacgtcatgtcaaacattgtccctggacggactggatttcagcattgtctcgctaagcaa

SEQ ID NO: 255513 - DNA, 75 bp, Artificial Sequence
  Synthetic
ctgccagtgctatcctccagggctcagactatgcatcacttgcaaaaactgatgacataatatattcaaagataa

SEQ ID NO: 255514 - DNA, 75 bp, Artificial Sequence
  Synthetic
tctttctcaccctcaaatacgcactaggtactaaatggagtcctttgtcattggccgcattcacaggtgaactca

SEQ ID NO: 255515 - DNA, 75 bp, Artificial Sequence
  Synthetic
tgcgagctagttgtcccctcaaacaatcagacactgatgggtgcagaaggacgagttttattgatcaataatcga

SEQ ID NO: 255516 - DNA, 75 bp, Artificial Sequence
  Synthetic
atttcattgtctcagacaatcactactcaacccattgatatatcaactgagctgagtaaggttaatgcatccctc

SEQ ID NO: 255517 - DNA, 75 bp, Artificial Sequence
  Synthetic
caaaggagtatcctggagtccattcaggaagtctgcctcaatgagcaacctatgagaatttcctctattccccct

SEQ ID NO: 255518 - DNA, 75 bp, Artificial Sequence
  Synthetic
gctgagtaaggttaatgcatccctccaaaatgccgttaaatacataaaagagagtaaccatcaactccaatccgt

SEQ ID NO: 255519 - DNA, 75 bp, Artificial Sequence
  Synthetic
gatgcctccaggaggatcaacaatcagtccgattttaccggtggtaacttgattgaaattatagaaaaaataagc

SEQ ID NO: 255520 - DNA, 75 bp, Artificial Sequence
  Synthetic
gtgtgtcaggggtttatcttgatccctggccattaactccatacagccaccaatcaggcattaacagaaatttct

SEQ ID NO: 255521 - DNA, 75 bp, Artificial Sequence
  Synthetic
ataattgtagcagccttagttttgagcatcctgtcgattatcatttcgctattgttttgctgctgggcttacatt

SEQ ID NO: 255522 - DNA, 75 bp, Artificial Sequence
  Synthetic
aagcacaaccagagtaaatcctaccctttatgtctctgcccttaataatcttaaagtactagccccatatggtac

SEQ ID NO: 255523 - DNA, 75 bp, Artificial Sequence
  Synthetic
gatgcctccaggaggatcaacaatcagtccgatttgaccggtggtaacttgattgaaattatagaaaaaataagc

SEQ ID NO: 255524 - DNA, 75 bp, Artificial Sequence
  Synthetic
ctgactcctgagcagagaactgaggttactcagcttgttgacaggcttgcaaggggcagaggtgcagggatacca

SEQ ID NO: 255525 - DNA, 75 bp, Artificial Sequence
  Synthetic
atatccaacccactgataacagctgtgaatttaagagtgtaactcaatacaataagaccttgagtaatttgcttc

SEQ ID NO: 255526 - DNA, 75 bp, Artificial Sequence
  Synthetic
tagaagaaaactaaaataagaatgaatctcctagggtcgtaacgtctcgtgaccctgccgttgcactatgccggc

SEQ ID NO: 255527 - DNA, 75 bp, Artificial Sequence
  Synthetic
atctcctagggtcgtaacgtctcgtgaccctgccgttgcactatgccggcaatccaacctcccttatacctaaca

SEQ ID NO: 255528 - DNA, 75 bp, Artificial Sequence
  Synthetic
gaccctgccgttgcactatgccggcaatccaacctcccttatacctaacatttctattgctaatccttctctatc

SEQ ID NO: 255529 - DNA, 75 bp, Artificial Sequence
  Synthetic
atgaggatggaggtgcaggattccaaaggggagcacaagcaccagctgtaagacagggaggtcaaaatgacttaa

SEQ ID NO: 255530 - DNA, 75 bp, Artificial Sequence
  Synthetic
ggtggacctgtgaatccatttgttcctccagttcaacagcaacaacctgctgctgtatatgaggacattcctgca

SEQ ID NO: 255531 - DNA, 75 bp, Artificial Sequence
  Synthetic
tatttggcagacaacaacattatccttcaagcgggagggactccaagcacaagaaaatggttggatcttcctgac

SEQ ID NO: 255532 - DNA, 75 bp, Artificial Sequence
  Synthetic
acaaccacctgctttcaagacaccggtgatgctagtgtgtattgtgtttatattatggaactagcatcgaatatc

SEQ ID NO: 255533 - DNA, 75 bp, Artificial Sequence
  Synthetic
gtgatgctagtgtgtattgtgtttatattatggaactagcatcgaatatcgttggagaattccaaattctacctg

SEQ ID NO: 255534 - DNA, 75 bp, Artificial Sequence
  Synthetic
tatcctcaagtcagcaacatcccaaatcatcagaatcatcagatcaatcgcatcggggggatggaacaccaagat

SEQ ID NO: 255535 - DNA, 75 bp, Artificial Sequence
  Synthetic
acaccctattatttacttcatacaatgtaggtcccctcgggaaaataaatacaatactcagattgattgttgaga

SEQ ID NO: 255536 - DNA, 75 bp, Artificial Sequence
  Synthetic
tgatcaatcactctagaaagatccccagttaggacaagtcccgatccgtcacgctagaacaagctgcatttaaat

SEQ ID NO: 255537 - DNA, 75 bp, Artificial Sequence
  Synthetic
cagttaggacaagtcccgatccgtcacgctagaacaagctgcatttaaatgaagctgtgctaccatgagacataa

SEQ ID NO: 255538 - DNA, 75 bp, Artificial Sequence
  Synthetic
attctcaacaagacgcgaggggcgaacaaggaaataccttcccaaacaatcctaatcaaaacacacagtcgcaag

SEQ ID NO: 255539 - DNA, 75 bp, Artificial Sequence
  Synthetic
aaggggagcacaagcaccagctgtaagacagggaggtcaaaatgacttaagagtacagccattacaggatccaat

SEQ ID NO: 255540 - DNA, 75 bp, Artificial Sequence
  Synthetic
taggatcacaacacaacacagaatattagctgctatcacaactgtgttccggccactaagaaaatggagccctcg

SEQ ID NO: 255541 - DNA, 75 bp, Artificial Sequence
  Synthetic
cctaatcaaaacacacagtcgcaagtgggcgactgggatgagtaaattactgacatgatcaaactacccccaaat

SEQ ID NO: 255542 - DNA, 75 bp, Artificial Sequence
  Synthetic
gccgccgtctcactagttcaagcacagacgaatgcacgtgcaatagcggcgatgaaaaattcaatacaggcaacc

SEQ ID NO: 255543 - DNA, 75 bp, Artificial Sequence
  Synthetic
cacatcagcaatcaactgacgggcaagcctaacttgtttactagatctcgagcaggacaagacgcaaaggattgc

SEQ ID NO: 255544 - DNA, 75 bp, Artificial Sequence
  Synthetic
ccacctttgcacctggacctgttgttaatgcggctggtaagaagacattccgaacctgtttccgaatattggtcc

SEQ ID NO: 255545 - DNA, 75 bp, Artificial Sequence
  Synthetic
ttgcttaccccggatgttgaagactccgagcgcattgatattgacaatgatatacctgattatgatatccacggg

SEQ ID NO: 255546 - DNA, 75 bp, Artificial Sequence
  Synthetic
agacgaatgcacgtgcaatagcggcgatgaaaaattcaatacaggcaaccaatcgagcagtattcgaagtaaagg

SEQ ID NO: 255547 - DNA, 75 bp, Artificial Sequence
  Synthetic
ggtacaagcaatacaagaccacatcaacactatcatgaacacccagttgaacaatatgtcttgtcaaatccttga

SEQ ID NO: 255548 - DNA, 75 bp, Artificial Sequence
  Synthetic
aatcaaatgcattggtgattgacttctactcaatttcgagctttattaataatcaggaatccataattcaattgc

SEQ ID NO: 255549 - DNA, 75 bp, Artificial Sequence
  Synthetic
aataccccaccgcatcacatcagggatccaagtcaaagggcagaagctcagggaccaggcccatcatagtctcat

SEQ ID NO: 255550 - DNA, 75 bp, Artificial Sequence
  Synthetic
cagaaaccaagtctcaaactgctctacaaacatccccttagttaatgaccttaggtttataaatggaatcaataa

SEQ ID NO: 255551 - DNA, 75 bp, Artificial Sequence
  Synthetic
ccaaccaacaggttcataccgaagtgtggaattggctaagataggaaaagagagaatgattaatcgatttgttga

SEQ ID NO: 255552 - DNA, 75 bp, Artificial Sequence
  Synthetic
ggcggcttactaatcttgaaagcttcatgggaaccttttaatcgattttcctttttactcacaatactctggcaa

SEQ ID NO: 255553 - DNA, 75 bp, Artificial Sequence
  Synthetic
tgcaacctcacccaatggttgcacaagaattccatccttttctttaggtaagacacactggtgttacacacataa

SEQ ID NO: 255554 - DNA, 75 bp, Artificial Sequence
  Synthetic
atggatttatatgtaatgagattctcgacctactgactgaagacaacatctttactgaagaggaggcaaataagg

SEQ ID NO: 255555 - DNA, 75 bp, Artificial Sequence
  Synthetic
aatcagaagaatcaatttcaaaacaaatcatatcaatacaatatcaagtagtgtcgatgatctcatcaggtacta

SEQ ID NO: 255556 - DNA, 75 bp, Artificial Sequence
  Synthetic
cagcccacctacccagaaacttaccctgttattctataatgacaccatcacagaaaggacaatatctccatctgg

SEQ ID NO: 255557 - DNA, 75 bp, Artificial Sequence
  Synthetic
cagaaaggacaatatctccatctggtcttgaagggaattgggctactttggtgccaggagtggggagtggaatat

SEQ ID NO: 255558 - DNA, 75 bp, Artificial Sequence
  Synthetic
tcttgaagggaattgggctactttggtgccaggagtggggagtggaatatatttcgaaaataagttgatctttcc

SEQ ID NO: 255559 - DNA, 75 bp, Artificial Sequence
  Synthetic
gtgccaggagtggggagtggaatatatttcgaaaataagttgatctttcctgcatatgggggtgtcttgcccaat

SEQ ID NO: 255560 - DNA, 75 bp, Artificial Sequence
  Synthetic
gagaatttttccggcccgttaatccatataatccatgttcaggaccaccacaagagttagatcagcgtgctttga

SEQ ID NO: 255561 - DNA, 75 bp, Artificial Sequence
  Synthetic
ccaaaaccccaaccagtaaaggatttagcaggacggaaagtgatgataaccaaaatgatcactgactgtgtggcc

SEQ ID NO: 255562 - DNA, 75 bp, Artificial Sequence
  Synthetic
tgcactatgccggcgatccaacctcccttgtacctcacatttctattgctaattcttccttatttgatcataact

SEQ ID NO: 255563 - DNA, 75 bp, Artificial Sequence
  Synthetic
attcgatcccattaaagagcttgagtatgtcaccagtggagaatatcttagggaccctgaattttgtgcatctta

SEQ ID NO: 255564 - DNA, 75 bp, Artificial Sequence
  Synthetic
cgaggatgccctgaatgacatcaagcgagacatcatacgaagcgccatatgaatcaaccagaaacacaagaccta

SEQ ID NO: 255565 - DNA, 75 bp, Artificial Sequence
  Synthetic
catccaaattcttctagaccgcatacgacctcgaacaatcataaccacatcagtattaaatccataatatcattt

SEQ ID NO: 255566 - DNA, 75 bp, Artificial Sequence
  Synthetic
tgcagcactgtaccaaagatccttctttcactggagtttcgatcactcactttagaaagagctccagttaggaca

SEQ ID NO: 255567 - DNA, 75 bp, Artificial Sequence
  Synthetic
catttacaaactctggtcaatcatctgtgaatatgtcctggatacctatatattcattcactcgtcctggttcgg

SEQ ID NO: 255568 - DNA, 75 bp, Artificial Sequence
  Synthetic
tgtgaatatgtcctggatacctatatattcattcactcgtcctggttcgggcaactgcagtggtaaaaatgtatg

SEQ ID NO: 255569 - DNA, 75 bp, Artificial Sequence
  Synthetic
atctgcgtttaaatgataccattcaatcatgagacataaagaaaaaagtaagccagaacgaacttagggtcacaa

SEQ ID NO: 255570 - DNA, 75 bp, Artificial Sequence
  Synthetic
tcaattccatccactagagagctatctcaaatatggtttaacaatgagtggagtggatctgtaaagacctggctt

SEQ ID NO: 255571 - DNA, 75 bp, Artificial Sequence
  Synthetic
atgaaccaaattggtattatatcagagcacagccgaagatccaccgctgacaacatgactttggcacactccggt

SEQ ID NO: 255572 - DNA, 75 bp, Artificial Sequence
  Synthetic
aaatgcattccctgtaattatggcccaagaaggcaaaggacgactcctcagacagatcagacttaggaaaatatt

SEQ ID NO: 255573 - DNA, 75 bp, Artificial Sequence
  Synthetic
agccagaacgaacttagggtcacaatataacaaagagccctagctgctatcataactgtgctccggccgctcgaa

SEQ ID NO: 255574 - DNA, 75 bp, Artificial Sequence
  Synthetic
cccaacagtctgtgtaacaggagtttatcttgatccctggccattaactccatacagccaccaatcaggcattaa

SEQ ID NO: 255575 - DNA, 75 bp, Artificial Sequence
  Synthetic
cgtcaaaactcctctagaccgcacacgacctcgaacaatcacaaccacatcagtattaaatccataatatcattt

SEQ ID NO: 255576 - DNA, 75 bp, Artificial Sequence
  Synthetic
ccttaataatcttaaagtactagccccatatggtactcaaggattgtttgcatcatacaccacaaccacctgctt

SEQ ID NO: 255577 - DNA, 75 bp, Artificial Sequence
  Synthetic
ctccagttcaacagcaacaacctgctgccgtatatgaagacattcctgcactggaggaatcagatgacgacggtg

SEQ ID NO: 255578 - DNA, 75 bp, Artificial Sequence
  Synthetic
catcgaatattgttggagaattccaaattctacctgtgctagccagattgaccatcacttgagttgtagtgaatg

SEQ ID NO: 255579 - DNA, 75 bp, Artificial Sequence
  Synthetic
aattggatatatcaagcaacaagtcaggcaactaagctattactcacaaagttcaagctcctacatagtggtcaa

SEQ ID NO: 255580 - DNA, 75 bp, Artificial Sequence
  Synthetic
ggcatcatcaaatatctgcggaccatctgattcaggccagctccgataaatatgtcaagtcaccagcaaagttga

SEQ ID NO: 255581 - DNA, 75 bp, Artificial Sequence
  Synthetic
tagcaggaagctttatgggcgtgtctcatttcttatcgattattaagaaaaaacaggccagaatggcgggcctaa

SEQ ID NO: 255582 - DNA, 75 bp, Artificial Sequence
  Synthetic
gactatgcggggtccagcccacctacccagaaacttaccctgttattctataatgacaccgtcacagaaaggaca

SEQ ID NO: 255583 - DNA, 75 bp, Artificial Sequence
  Synthetic
atagcgaactgcccaaattcactacattctattcatatttagtctttaagaaaaaattaggcccggaaagaatta

SEQ ID NO: 255584 - DNA, 75 bp, Artificial Sequence
  Synthetic
tgttttacaaaggtcgaattttgactcaagcgttaaagaacgtgagcaagatgtgcttaacagctgatatactag

SEQ ID NO: 255585 - DNA, 75 bp, Artificial Sequence
  Synthetic
tcaagcgttaaagaacgtgagcaagatgtgcttaacagctgatatactaggggactgttcacaagcatcatgctc

SEQ ID NO: 255586 - DNA, 75 bp, Artificial Sequence
  Synthetic
ctccagggctcagattatgcatcactcgcaaaaactgatgacataatatactcaaagataaaagtcgataaagat

SEQ ID NO: 255587 - DNA, 75 bp, Artificial Sequence
  Synthetic
cattggaaagtacattgagaattcaggccttactgccttctttctcaccctcaaatatgcactaggtaccaaatg

SEQ ID NO: 255588 - DNA, 75 bp, Artificial Sequence
  Synthetic
actaacaggcaagcctaacttgtttaccagatctcgagctggacaagacacaaaagattactcaattccatccac

SEQ ID NO: 255589 - DNA, 75 bp, Artificial Sequence
  Synthetic
gttcaggaccacaacaagatttagatcagcgtgctttgagatcatacttcccaagttacttctctaatcgaagag

SEQ ID NO: 255590 - DNA, 75 bp, Artificial Sequence
  Synthetic
accagatctcgagctggacaagacacaaaagattactcaattccatccactagagagctatctcaaatatggttc

SEQ ID NO: 255591 - DNA, 75 bp, Artificial Sequence
  Synthetic
aagacaggtgagttaacagatttagtaaccattgtggatactaggtccactctatgcattattaccccagaatta

SEQ ID NO: 255592 - DNA, 75 bp, Artificial Sequence
  Synthetic
tacttctcgactttccgactttgaaaagagaattaatcagtaatcatgaaggcctttttagttatttgcttgggc

SEQ ID NO: 255593 - DNA, 75 bp, Artificial Sequence
  Synthetic
aagcattaacgtacctcacctttgaaatggtattaatggtcactgatatgttagagggacgactgaatgtttctt

SEQ ID NO: 255594 - DNA, 75 bp, Artificial Sequence
  Synthetic
ctggaaaaggtaagtggagcactctggcagctgatccctatactttaaacatagattatttagttccttcaacaa

SEQ ID NO: 255595 - DNA, 75 bp, Artificial Sequence
  Synthetic
gtgtgaatatcaacatcttgcagcaagttggatatatcaagcaacaagtcaggcaactaagctattactcacaaa

SEQ ID NO: 255596 - DNA, 75 bp, Artificial Sequence
  Synthetic
aggcaactaagctattactcacaaagttcaagctcctacatagtggtcaagcttttaccgaatatccaacccact

SEQ ID NO: 255597 - DNA, 75 bp, Artificial Sequence
  Synthetic
ctctgtgcacagctagtcattatctgtcccctttaaagaagagaatcgaagttctcctgacattagttgatgacc

SEQ ID NO: 255598 - DNA, 75 bp, Artificial Sequence
  Synthetic
atggatacatttaaggctaatgcgaagcactctctatgtcggtgatcccttcaatcctccatcagatcctaccca

SEQ ID NO: 255599 - DNA, 75 bp, Artificial Sequence
  Synthetic
tcgggtcaatcatctgtaaacatgtcctggatacctatatattcattcactcgtcctggctcaggcaactgcagt

SEQ ID NO: 255600 - DNA, 75 bp, Artificial Sequence
  Synthetic
ggcaaacaaggttcttctggacttgacgtcacagtttgacaatctatcccctgatttaacagctgagctcctctg

SEQ ID NO: 255601 - DNA, 75 bp, Artificial Sequence
  Synthetic
cacaagtaactgccgctgtttcattagttcaagcacagacaaatgcacgtgcgatagcggcgatgaagaattcaa

SEQ ID NO: 255602 - DNA, 75 bp, Artificial Sequence
  Synthetic
ccaaggtccgagagtccatgtgcgctcctaaggtgttagatttccaaacaataatgaaaaccctggctttctttc

SEQ ID NO: 255603 - DNA, 75 bp, Artificial Sequence
  Synthetic
ctttgatgcatcacctgatgaagatctcagcatattcatgaaggataaggcaataagctgtccaaagcaagactg

SEQ ID NO: 255604 - DNA, 75 bp, Artificial Sequence
  Synthetic
gatgggagtatttaggaggagcctgattaaacagcgctatcgtgacgtgaatcggcctctaccacaaccatttaa

SEQ ID NO: 255605 - DNA, 75 bp, Artificial Sequence
  Synthetic
aggatgcctatgagttagcttccactcgtgtcaatcttacactagaacaattgcaatctctcactcctttaccaa

SEQ ID NO: 255606 - DNA, 75 bp, Artificial Sequence
  Synthetic
gatactaggtccactctatgcattattaccccagaattagttgctttatactccaatgagcacaaagcattaacg

SEQ ID NO: 255607 - DNA, 75 bp, Artificial Sequence
  Synthetic
tccaccgccgacaacatgaccttggcacactccggttcaaataagcacaggattaacaatagtcaattcaagaag

SEQ ID NO: 255608 - DNA, 75 bp, Artificial Sequence
  Synthetic
cccaatcaaaacgcgcagtcacaagtgggcgactgggatgagtaaatcactgaaatgatcaaactacccccaatt

SEQ ID NO: 255609 - DNA, 75 bp, Artificial Sequence
  Synthetic
ttagctatagcggtacaagcaatacaagaccacatcaatactattatgaacacccaattgaacaatatgtcttgt

SEQ ID NO: 255610 - DNA, 75 bp, Artificial Sequence
  Synthetic
caaaatgctgttaagtacataaaagagagcaaccaacaactccaatcggtgagtgtaaattccaaaatcggagct

SEQ ID NO: 255611 - DNA, 75 bp, Artificial Sequence
  Synthetic
ttagatcaaatcccgcttctggaaaaaatacccttgctggctcacctcaccgccaagcagatggtaaatagcatc

SEQ ID NO: 255612 - DNA, 75 bp, Artificial Sequence
  Synthetic
gagtccatgtgcgctcctaaggtgttagatttccaaacaataatgaagaccctggctttctttcacgcaatcctg

SEQ ID NO: 255613 - DNA, 75 bp, Artificial Sequence
  Synthetic
actgggcttgatgaagcaacatctatagtgaatgacgctgtagttcaagcagactatactagcaattggattagt

SEQ ID NO: 255614 - DNA, 75 bp, Artificial Sequence
  Synthetic
tagatttccaaacaataatgaagaccctggctttctttcacgcaatcctgattaacggttataggaggagccata

SEQ ID NO: 255615 - DNA, 75 bp, Artificial Sequence
  Synthetic
gcagcatggtgacccaaataaagaatgaattatcaacagtaaagacaacactagctacaattgaaggaatgatgg

SEQ ID NO: 255616 - DNA, 75 bp, Artificial Sequence
  Synthetic
ggtacatgggtgtttgataattgggtcagatgaatgtgagcattgcagtagtggtgatgataaattcacctggtt

SEQ ID NO: 255617 - DNA, 75 bp, Artificial Sequence
  Synthetic
gagaagaaagagcaagcttataaagcaagtaaattattctttgaaaggcttagagctaacaaccatggaattgga

SEQ ID NO: 255618 - DNA, 75 bp, Artificial Sequence
  Synthetic
tgatcataactttgtatgtctggattatgttaaccattactcacaagactgcggtgcaacatgcagcattgtacc

SEQ ID NO: 255619 - DNA, 75 bp, Artificial Sequence
  Synthetic
tatgttaaccattactcacaagactgcggtgcaacatgcagcattgtaccagagatccctctttcgttggagttt

SEQ ID NO: 255620 - DNA, 75 bp, Artificial Sequence
  Synthetic
atatcgtgatgcgaatcgacctctaccacaaccattcaaccgacggctactgttgaattttctagaggatgacag

SEQ ID NO: 255621 - DNA, 75 bp, Artificial Sequence
  Synthetic
caacccggacaagtcccaatccatcatgggagaacaagctgcattcaaatgatgctgctcaatcatgagacataa

SEQ ID NO: 255622 - DNA, 75 bp, Artificial Sequence
  Synthetic
ctgtaatgcgcctgactgagaatggggtcgagaaagatttgtgttatttcctaaatgcattcatgacaattagac

SEQ ID NO: 255623 - DNA, 75 bp, Artificial Sequence
  Synthetic
agaaaaaagcaggccagaacaaactcaggatcacaacacaatacagaactccagctgctatcacaactgtgctcc

SEQ ID NO: 255624 - DNA, 75 bp, Artificial Sequence
  Synthetic
aatccaacctcccttgcacctaacatttctattgctaattcttctatgtctgatcataactttgtatatctggat

SEQ ID NO: 255625 - DNA, 75 bp, Artificial Sequence
  Synthetic
agcactctctatgttggtgatcccttcaatcctccatcagatcctacccaacttgaccttgatacagctctcaat

SEQ ID NO: 255626 - DNA, 75 bp, Artificial Sequence
  Synthetic
gcggtgcgacatgcaacactgtaccagagatccttccttcactggagcttcgatcgcccactctagaaagatttc

SEQ ID NO: 255627 - DNA, 75 bp, Artificial Sequence
  Synthetic
agagatccttccttcactggagcttcgatcgcccactctagaaagatttccagtcaggacaagtctcaatcctta

SEQ ID NO: 255628 - DNA, 75 bp, Artificial Sequence
  Synthetic
gacaccgttcaatcatgaggcataaagaaaaaagcaagccagaacaagctcaagatcacgacacaacacagaacc

SEQ ID NO: 255629 - DNA, 75 bp, Artificial Sequence
  Synthetic
cccttcaacaacttttttaaagaaacatgcccaatatacattgatggaacggagtgttaatcccatgctccgtgg

SEQ ID NO: 255630 - DNA, 75 bp, Artificial Sequence
  Synthetic
caagatcacgacacaacacagaacccctgctgctatcacaactgtgctccggacgctcgaaagatggaaccctcg

SEQ ID NO: 255631 - DNA, 75 bp, Artificial Sequence
  Synthetic
gaggaagaggaactcgcacagtatctattagatcgcgaagtagtcatgcccagggttgcacatgttatacttgcc

SEQ ID NO: 255632 - DNA, 75 bp, Artificial Sequence
  Synthetic
cagtctagttgcggtagaagaaaacagatccaaggttacttggattctactagaactattatcaggtattcactg

SEQ ID NO: 255633 - DNA, 75 bp, Artificial Sequence
  Synthetic
agacacactggtgctatacccataatgtaattaatgccaactgcaaggatcatacttcgtctaaccaatatgtgt

SEQ ID NO: 255634 - DNA, 75 bp, Artificial Sequence
  Synthetic
cccaatctattcaggcatcatcaaatatctgcggaccatctgattcaggccagctccgataaatatgtcaagtca

SEQ ID NO: 255635 - DNA, 75 bp, Artificial Sequence
  Synthetic
tgatcaatcactctagaaagatcctcagttagggcaagtcccgatccgtcacgctagaacaagctgcatccaaat

SEQ ID NO: 255636 - DNA, 75 bp, Artificial Sequence
  Synthetic
cagttagggcaagtcccgatccgtcacgctagaacaagctgcatccaaatgaagctgcactaccatgagacataa

SEQ ID NO: 255637 - DNA, 75 bp, Artificial Sequence
  Synthetic
gggactgttcacaagcatcatgctccaatttagctactactgtaatgcgcctgactgagaatggggtcgagaaag

SEQ ID NO: 255638 - DNA, 75 bp, Artificial Sequence
  Synthetic
ttatcttaatcatccaatacttatctcaagattgtgtctattaccatctcaattggggggcctaaactttctctc

SEQ ID NO: 255639 - DNA, 75 bp, Artificial Sequence
  Synthetic
catcgagggattagaaacacctgatcctattgaattggtacatgggtgtttaataatcgggtcagatgagtgtga

SEQ ID NO: 255640 - DNA, 75 bp, Artificial Sequence
  Synthetic
gtgccaggagtggggagtggaatatatttcgagaataaattgatctttcctgcatatgggggtgtcttgcccaat

SEQ ID NO: 255641 - DNA, 75 bp, Artificial Sequence
  Synthetic
ttcacctggtttttcctccctaaggggataaggttagatgatgatccggcatctaacccacccatcagagtacct

SEQ ID NO: 255642 - DNA, 75 bp, Artificial Sequence
  Synthetic
tatatcggatctaaaacagatgaacgaagggttgcatcaatggcttatatcaaaggggcatcagtatcacttaaa

SEQ ID NO: 255643 - DNA, 75 bp, Artificial Sequence
  Synthetic
catctgggccaattataactatcctccaaaggttaaaggtatgtcacctgaggacaaatgtcaggctttaactac

SEQ ID NO: 255644 - DNA, 75 bp, Artificial Sequence
  Synthetic
agacacattggtgttacacacataatgtaattaatgccaactgcaaggatcatacttcatcgaaccaatatgttt

SEQ ID NO: 255645 - DNA, 75 bp, Artificial Sequence
  Synthetic
tatccgtcgttcaatgaattacaatcggagatggccagactcataacaattcatctcaaagaggtaatagaaatc

SEQ ID NO: 255646 - DNA, 75 bp, Artificial Sequence
  Synthetic
gtccacagattggatgatggcactactcaagtaaagttcacccctgcaagctcctatgcattctctagcttcgtt

SEQ ID NO: 255647 - DNA, 75 bp, Artificial Sequence
  Synthetic
tgttaacatgtcctggatacctatatactcattcactcgtcctggttcaggtaactgcagtggtgaaaatgtgtg

SEQ ID NO: 255648 - DNA, 75 bp, Artificial Sequence
  Synthetic
taaaacagatgagcggagggttgcgtcaatggcttacatcaaaggagcatctgtatcacttaaatcagcactcag

SEQ ID NO: 255649 - DNA, 75 bp, Artificial Sequence
  Synthetic
ttctaacctgatttaccagcaagttatgattactggccttgctttaattgagacatggaataatcctccaatcaa

SEQ ID NO: 255650 - DNA, 75 bp, Artificial Sequence
  Synthetic
acaatactcagattgattgttgagagaattcttatgtacaccgtaaggaactggtgcatcttgcccacccaaact

SEQ ID NO: 255651 - DNA, 75 bp, Artificial Sequence
  Synthetic
cttctccgtttatgaaactacattacacttgcacacaggctcatcttgctgtataagacctgtcgagtcttgtgt

SEQ ID NO: 255652 - DNA, 75 bp, Artificial Sequence
  Synthetic
ctggtgcatcttgcccacccaaactcgtctcaccttacgccagtctatcgagcttggagagtttagactaagaga

SEQ ID NO: 255653 - DNA, 75 bp, Artificial Sequence
  Synthetic
ttgcaatctctcactcctttaccaacatctgctaacctagtccacagattggatgatggcaccactcaattaaaa

SEQ ID NO: 255654 - DNA, 75 bp, Artificial Sequence
  Synthetic
cagaaatttctatttcacaggtgcactattaaattcaagcacaaccagagtaaatcctaccctttatgtctctgc

SEQ ID NO: 255655 - DNA, 75 bp, Artificial Sequence
  Synthetic
cagcggtaggccctatgggcgtgtcccaagttttatcgattattaagaaaaaacaggccagaatggcgggcctaa

SEQ ID NO: 255656 - DNA, 75 bp, Artificial Sequence
  Synthetic
ttacattgactctgtgtttgtttactctggctgggcattattgttggaactttcataccaaatgtattacctaag

SEQ ID NO: 255657 - DNA, 75 bp, Artificial Sequence
  Synthetic
tgcttatcagaccagaatcggtggcttagatcaaatcccactgctggaaaaaataccattactagctcacctcac

SEQ ID NO: 255658 - DNA, 75 bp, Artificial Sequence
  Synthetic
cgtatactcagaagatgcatcaatttggatgtcatagccccaatcaattctccacacatagcttcactggattac

SEQ ID NO: 255659 - DNA, 75 bp, Artificial Sequence
  Synthetic
gatcaggtaacagattctaacctgatttaccagcaagttatgattactggccttgctttaattgagacatggaac

SEQ ID NO: 255660 - DNA, 75 bp, Artificial Sequence
  Synthetic
aatcttataagtgatggcctagaacgggttgtattacatatcagcaatcaactgacaggcaagcctaacttattt

SEQ ID NO: 255661 - DNA, 75 bp, Artificial Sequence
  Synthetic
caacatttctcaaggtatcgattatgagatagttgttccttctgaaagccaacttacactcagtgatagagtcct

SEQ ID NO: 255662 - DNA, 75 bp, Artificial Sequence
  Synthetic
aatcttataagtgatggtctagaacgagttgtattacacatcagcaaccaactgacgggcaaacctaacttgttt

SEQ ID NO: 255663 - DNA, 75 bp, Artificial Sequence
  Synthetic
gattgaaaagacaaacatcaggaggatgattattgaaccaaaattaactgcctaccctagtaatttgttttatct

SEQ ID NO: 255664 - DNA, 75 bp, Artificial Sequence
  Synthetic
atcaaatgcattggtgattgacttctactcaatttcgagctttattaataatcaggaatccataattcaattacc

SEQ ID NO: 255665 - DNA, 75 bp, Artificial Sequence
  Synthetic
ctctcgaaagctgcttaatgctattcgagactctgaagaaggacaattcctgattgcatcctattataacagttt

SEQ ID NO: 255666 - DNA, 75 bp, Artificial Sequence
  Synthetic
gaatctaaaatattcaatctaagttcatccgaatcagcatctcttacagaatttgatttcatcctcaacttggaa

SEQ ID NO: 255667 - DNA, 75 bp, Artificial Sequence
  Synthetic
ttgaattatattagccatatgaagatatctgacggtgcccatctatacttggcagagggaagtggagcctctatg

SEQ ID NO: 255668 - DNA, 75 bp, Artificial Sequence
  Synthetic
tatctgacggtgcccatctatacttggcagagggaagtggagcctctatgtcacttatagagactttcttgcccg

SEQ ID NO: 255669 - DNA, 75 bp, Artificial Sequence
  Synthetic
ggcagagggaagtggagcctctatgtcacttatagagactttcttgcccggggaaaccatatggtacaacagcct

SEQ ID NO: 255670 - DNA, 75 bp, Artificial Sequence
  Synthetic
ccaaaggttaaaggtatgtcacctgaagacaaatgtcaggctttaactacacatctacttcaaactgtcgaatat

SEQ ID NO: 255671 - DNA, 75 bp, Artificial Sequence
  Synthetic
caacgtaatttcgcccctttacccacccagtttattgaaagtgtcccctatagattgattcaagcaggtatagca

SEQ ID NO: 255672 - DNA, 75 bp, Artificial Sequence
  Synthetic
cccagtttattgaaagtgtcccctatagattgattcaagcaggtatagcagcaggaaatggtatagtgcaaagtt

SEQ ID NO: 255673 - DNA, 75 bp, Artificial Sequence
  Synthetic
tatgtcctcaagaattggaaaagtatatctatgttaaggatacataaatgctttgatgcatcacctgatgaagat

SEQ ID NO: 255674 - DNA, 75 bp, Artificial Sequence
  Synthetic
cgatataactgacttaagcactaaaactagtgttgaatacattatccacaaggtaggagctgatacttgtgcatt

SEQ ID NO: 255675 - DNA, 75 bp, Artificial Sequence
  Synthetic
gatgggagtatttaggaggagcctgataaaacagcgatatcgtgatgcgaatcggcctctaccacaaccattcaa

SEQ ID NO: 255676 - DNA, 75 bp, Artificial Sequence
  Synthetic
aggtaggagctgatacttgtgcattagttcatgtggatttggaaggtgtccctggctcaatgaacagcatgttgg

SEQ ID NO: 255677 - DNA, 75 bp, Artificial Sequence
  Synthetic
agttcatgtggatttggaaggtgtccctggctcaatgaacagcatgttggagagagctcaagtacacgcgctact

SEQ ID NO: 255678 - DNA, 75 bp, Artificial Sequence
  Synthetic
gatcttcatactccgatccgaataatcacgaggtttacataatagccacattggcagttgatcccaccacatcct

SEQ ID NO: 255679 - DNA, 75 bp, Artificial Sequence
  Synthetic
tacttataagactgcggtgcgacatgcagcactgtaccagagatccttctttcactggagtttcgatcactcact

SEQ ID NO: 255680 - DNA, 75 bp, Artificial Sequence
  Synthetic
cctttacaactgctctgaatagggcacgcaccctgaatgaacagggcttttcactcatcccacctgaattagtga

SEQ ID NO: 255681 - DNA, 75 bp, Artificial Sequence
  Synthetic
aattaataatagtcaattcaagaagaataaagacaataaacatgagatgcctgatgatgggtttgagatagcagc

SEQ ID NO: 255682 - DNA, 75 bp, Artificial Sequence
  Synthetic
tcactcatcccacctgaattagtgagtgagtactggaggaagcgtgttgaacaaggacagattatacaggactgt

SEQ ID NO: 255683 - DNA, 75 bp, Artificial Sequence
  Synthetic
ctgatgatgggtttgagatagcagcctgctttctaacaactgaccatagaaaatattgcttaaattggaggtacc

SEQ ID NO: 255684 - DNA, 75 bp, Artificial Sequence
  Synthetic
tgaaatcaaggctgccagtgctatcctccagggttcagactatgcatcacttgcaaaaactgatgacataatata

SEQ ID NO: 255685 - DNA, 75 bp, Artificial Sequence
  Synthetic
cagagatccttctttcgctggagcttcgatcacccactctagaaagatatccagttaggacaagtctcaatccat

SEQ ID NO: 255686 - DNA, 75 bp, Artificial Sequence
  Synthetic
tcagagatcaatatctggcagacaacaacattatcctccaggcgggaggtactccaagcacaagaaaatggttgg

SEQ ID NO: 255687 - DNA, 75 bp, Artificial Sequence
  Synthetic
tgaactacaatctgaaatggccagactcataacaattcatcttaaagaggtaatagaaatcctaaagggccaggc

SEQ ID NO: 255688 - DNA, 75 bp, Artificial Sequence
  Synthetic
accaaggggaaaatgaagatgtgatattagtagaacaaatagtgtaagaaacagtaagccctgaagtggtgtttt

SEQ ID NO: 255689 - DNA, 75 bp, Artificial Sequence
  Synthetic
attagtagaacaaatagtgtaagaaacagtaagccctgaagtggtgttttgcgatttagaagccggcctcgatcc

SEQ ID NO: 255690 - DNA, 75 bp, Artificial Sequence
  Synthetic
acttcatacaatgtaggtcccctcggaaaaataaatacaatactcagattgattgttgagagaattcttatgtat

SEQ ID NO: 255691 - DNA, 75 bp, Artificial Sequence
  Synthetic
tcactttccggtgtcgaaagaggatattttgacactatctagaaaatgtcgtctgtgctcaaagcatttgaacga

SEQ ID NO: 255692 - DNA, 75 bp, Artificial Sequence
  Synthetic
agttgtcttcaattacagacaagataagagagtcagctactatgattgcatctgctgtgggagtaatgaatcaag

SEQ ID NO: 255693 - DNA, 75 bp, Artificial Sequence
  Synthetic
acaatctatcgagcttggagagtttagactaagagatgtgataacacccatggagattctaaaactatcccccaa

SEQ ID NO: 255694 - DNA, 75 bp, Artificial Sequence
  Synthetic
tgttgaagattctgagcgcattgatgttgataatgacatacccgattatgatattcacggggacataatttaaat

SEQ ID NO: 255695 - DNA, 75 bp, Artificial Sequence
  Synthetic
aagaaaatggttggatctacctgactatccgtcgttcaatgaattacaatcggagatggccagactcataacaat

SEQ ID NO: 255696 - DNA, 75 bp, Artificial Sequence
  Synthetic
atattcacggggacataatttaaatcgactaaagactcctctggcattacacatcaccaaaaagtgccaaactag

SEQ ID NO: 255697 - DNA, 75 bp, Artificial Sequence
  Synthetic
cgacctcgaacaatcataaccacatcagtattaaatccagaagatccttttaagaaaaaattgattttactttct

SEQ ID NO: 255698 - DNA, 75 bp, Artificial Sequence
  Synthetic
tatgttcaaaaccttaaaaatccaatatctcagtgatggcctgaatcggaaaagctgctcaattgcaacagtccc

SEQ ID NO: 255699 - DNA, 75 bp, Artificial Sequence
  Synthetic
tggagcactctggcagctgatccctatactttaaacatagattatttagttccttcaacaacttttttaaagaag

SEQ ID NO: 255700 - DNA, 75 bp, Artificial Sequence
  Synthetic
tatacctgattatgatatccacggggacataatttaaatcagctaaagactcctctggcataatacatcaccaaa

SEQ ID NO: 255701 - DNA, 75 bp, Artificial Sequence
  Synthetic
gatgcttggcccctctctcaatacaccttgcagtcaggggtgaacagaaatttctactttacaggagccctcctt

SEQ ID NO: 255702 - DNA, 75 bp, Artificial Sequence
  Synthetic
aaaccgagcttatcagaagagaatttggaaagccattgggtgtgtaatctattgctttggtttgctcaccccgga

SEQ ID NO: 255703 - DNA, 75 bp, Artificial Sequence
  Synthetic
aatgaagatgggatattggtagaacaaatagtgtaagaaacagtaagcccggaagtggtgttttgcgatttcgag

SEQ ID NO: 255704 - DNA, 75 bp, Artificial Sequence
  Synthetic
agagatccttctttcgctggagtttcgatcactcactctagaaagatctccagctgggacaagtcccaatccatc

SEQ ID NO: 255705 - DNA, 75 bp, Artificial Sequence
  Synthetic
attgacaatgacatacccgattatgatattcacggggacataatttaaatcgaataaagactcttctggcattac

SEQ ID NO: 255706 - DNA, 75 bp, Artificial Sequence
  Synthetic
tgctgcctatgctttgcttgcagatgacctccctccaaccataaataatggaactccttatgtacatgcagatgt

SEQ ID NO: 255707 - DNA, 75 bp, Artificial Sequence
  Synthetic
cgacctcgaacaatcataaccacatcagtattaaatccagaagatccttttaagaaaaaattgattctactttct

SEQ ID NO: 255708 - DNA, 75 bp, Artificial Sequence
  Synthetic
atccaacccacccatcagagtaccttatattggatctaaaacagatgagcggagggttgcgtcaatggcttacat

SEQ ID NO: 255709 - DNA, 75 bp, Artificial Sequence
  Synthetic
ttggccgcattcaccggtgaactcactaagctccgatccttgatgatgttatatcgagatctcggagaacaagcc

SEQ ID NO: 255710 - DNA, 75 bp, Artificial Sequence
  Synthetic
ctaagctccgatccttgatgatgttatatcgagatctcggagaacaagccagataccttgctttgttggaggctc

SEQ ID NO: 255711 - DNA, 75 bp, Artificial Sequence
  Synthetic
taatctcaagacctcatcttcatatggaactcagggattgattgctgcttataccaccaccacttgctttcaaga

SEQ ID NO: 255712 - DNA, 75 bp, Artificial Sequence
  Synthetic
gatcttcatactccgacccgaataatcacgaggtatacataatagctacattagcagttgatcccactacatcct

SEQ ID NO: 255713 - DNA, 75 bp, Artificial Sequence
  Synthetic
cttctccgtctatgaaactacactacacctgcacacaggctcatcttgctgtataagacctgttgagtcttgtgt

SEQ ID NO: 255714 - DNA, 75 bp, Artificial Sequence
  Synthetic
gattattaagaaaaaacaggccagaatggcgggcctaaatgagatactcctacctgaagtacatttaaactcacc

SEQ ID NO: 255715 - DNA, 75 bp, Artificial Sequence
  Synthetic
acttctggaaaaaatacccttactagctcacctcaccgccaagcagatggtaaatagcatcactgggcttgatga

SEQ ID NO: 255716 - DNA, 75 bp, Artificial Sequence
  Synthetic
gctgcactcggtgttgcaaccgcagcacaagtaactgccgctgtctcattagttcaagcacagacaaatgcacgc

SEQ ID NO: 255717 - DNA, 75 bp, Artificial Sequence
  Synthetic
atattgtgggagaattccagattttacctgtactaacaagattgactatcacatgaatgtaattgatattcagga

SEQ ID NO: 255718 - DNA, 75 bp, Artificial Sequence
  Synthetic
gtgcggggataccaggtgggcccgtgaatccttttgttcctccagttcaacagcaacaacctgctgccgtatatg

SEQ ID NO: 255719 - DNA, 75 bp, Artificial Sequence
  Synthetic
gaatccttttgttcctccagttcaacagcaacaacctgctgccgtatatgaggacattcctgcattggaggaatc

SEQ ID NO: 255720 - DNA, 75 bp, Artificial Sequence
  Synthetic
atttgctaaaatgacaaagaaaatgaggtcgtgccaagtaattgcagaatcgttgttggccaaccatgcaggtaa

SEQ ID NO: 255721 - DNA, 75 bp, Artificial Sequence
  Synthetic
cagcaacaacctgctgccgtatatgaggacattcctgcattggaggaatcagatgacgacggtgatgaagatgga

SEQ ID NO: 255722 - DNA, 75 bp, Artificial Sequence
  Synthetic
gccatggatcaatttataaaacaagatgaaactggtgatttaattgagacaggaatgaatgttgcaaatcacttc

SEQ ID NO: 255723 - DNA, 75 bp, Artificial Sequence
  Synthetic
aggaatgaatgttgcaaatcacttcctatctgcccccattcagggaaccaactcgttgagcaaggccacaatcat

SEQ ID NO: 255724 - DNA, 75 bp, Artificial Sequence
  Synthetic
tcagattcctgagccccttttcgcacaaaccggacaaggtggcactgtcaccaccgtttatcaggatccaactat

SEQ ID NO: 255725 - DNA, 75 bp, Artificial Sequence
  Synthetic
ccaccgtttatcaggatccaactatccaaccaacaggttcataccgaagtgtggaattggctaagataggaaaag

SEQ ID NO: 255726 - DNA, 75 bp, Artificial Sequence
  Synthetic
atttagtctttaagaaaaaattaggcccggaaagaattagttctacgagcatcgacacaattatcttgatcgtgt

SEQ ID NO: 255727 - DNA, 75 bp, Artificial Sequence
  Synthetic
gccagaatggcaggcctaaatgagatacttctacctgaagtacatctaaattcacctattgtaaggtacaaactt

SEQ ID NO: 255728 - DNA, 75 bp, Artificial Sequence
  Synthetic
aaggccacaatcatccctggcgttgcaccagtactcattggcaatccagagcaaaagaacattcagtaccccacc

SEQ ID NO: 255729 - DNA, 75 bp, Artificial Sequence
  Synthetic
caccagtactcattggcaatccagagcaaaagaacattcagtaccccaccgcatcacatcagggatccaagtcaa

SEQ ID NO: 255730 - DNA, 75 bp, Artificial Sequence
  Synthetic
gcattgcagtagtggtgacgacaagttcacctggtttttcctacccaaagggataaggctagataatgatccggc

SEQ ID NO: 255731 - DNA, 75 bp, Artificial Sequence
  Synthetic
attcaatagtggtgagaatcctccccaacgcaatttcgcccctttgcccacccagtttattgaaagtgtccctta

SEQ ID NO: 255732 - DNA, 75 bp, Artificial Sequence
  Synthetic
cgaggatgccctgaatgatatcaagcgagacatcatacgaagcgccatatgaacctaccaagaacaccagactca

SEQ ID NO: 255733 - DNA, 75 bp, Artificial Sequence
  Synthetic
gcaatgattccctattaaataaaaaataagcacgaacacaagtccaatccagccatagcagcaatggccggatca

SEQ ID NO: 255734 - DNA, 75 bp, Artificial Sequence
  Synthetic
tttaggtccattagccaatcaaaattggaaaactatcagatctgaagagtcacagctacatctgagattaaaaca

SEQ ID NO: 255735 - DNA, 75 bp, Artificial Sequence
  Synthetic
tcacgaggtatacataatagctacattagcagttgatcccactacatcctcctttacaactgctctgaatagggc

SEQ ID NO: 255736 - DNA, 75 bp, Artificial Sequence
  Synthetic
gacaaagagaatgagatcgtgccaagtaattgcggaatcattgttggccaatcatgcaggtaaattaatgagaga

SEQ ID NO: 255737 - DNA, 75 bp, Artificial Sequence
  Synthetic
aagatgcaaggggcgaacacggaaataccttcccaaacaatcccaatcagagcacacagtcgcaagtgggcgact

SEQ ID NO: 255738 - DNA, 75 bp, Artificial Sequence
  Synthetic
gtgagtactggaggaggcgcgttgaacaagggcagattatacaggatcgtatagataaagtcatatcagaatgtg

SEQ ID NO: 255739 - DNA, 75 bp, Artificial Sequence
  Synthetic
caagataccccccattgcagtagccccagaacaatccagccaccgccaactgcccgaatccactacatttcattc

SEQ ID NO: 255740 - DNA, 75 bp, Artificial Sequence
  Synthetic
gtttctttccgggcaagccatggatcaatttataaaacaagatgagactggtgatttaattgagacaggaatgaa

SEQ ID NO: 255741 - DNA, 75 bp, Artificial Sequence
  Synthetic
gcaaaggccagcaccgaagatgctctgaatgatatcaagcgagacatcataagaagtgccatatgaatttaccag

SEQ ID NO: 255742 - DNA, 75 bp, Artificial Sequence
  Synthetic
gattgttgagagaattcttatgtacactgtaaggaactggtgcatcttgcccacccaaactcgtctcaccttacg

SEQ ID NO: 255743 - DNA, 75 bp, Artificial Sequence
  Synthetic
cccattcaaggagccaacttgttgggcaaggccacaatcatccccggcgttgcaccagtactcattggcaatcca

SEQ ID NO: 255744 - DNA, 75 bp, Artificial Sequence
  Synthetic
cccagagagaaattgctatcttgatttggccaaagattcttccgatgttgcaatcatacgacctcagacaaagtc

SEQ ID NO: 255745 - DNA, 75 bp, Artificial Sequence
  Synthetic
cccatcatggtctcatcttccgagggaggcattggggggactcagattcctgagcccctctttgcacagacagga

SEQ ID NO: 255746 - DNA, 75 bp, Artificial Sequence
  Synthetic
caacagagtagcagatgatctaggcctgactcctgagcaaaggactgaggttactcagcttgttgacaggcttgc

SEQ ID NO: 255747 - DNA, 75 bp, Artificial Sequence
  Synthetic
gcagccaactacaagggagtatcctggagtccatttaggaagtctgcctcaatgagcaacctatgataatttcct

SEQ ID NO: 255748 - DNA, 75 bp, Artificial Sequence
  Synthetic
tggcgacagtaaagatcatggatcctggaaatccgacaggggtcccagttgatgagcttagaagaagttttagtg

SEQ ID NO: 255749 - DNA, 75 bp, Artificial Sequence
  Synthetic
gtaagtgacggccttgaacgagtcatccaacaaattagcaaccaattaactggcaaaccaaacttgtttactcgc

SEQ ID NO: 255750 - DNA, 75 bp, Artificial Sequence
  Synthetic
tccgaatgcacgcgccaatcttactgccaatgaaattgctgcctatgctttgcttgcagatgacctccctccaac

SEQ ID NO: 255751 - DNA, 75 bp, Artificial Sequence
  Synthetic
gtttgctggcattgccattggcattgctgcgctcggtgttgcgaccgcagcacaagtaactgccgctgtctcatt

SEQ ID NO: 255752 - DNA, 75 bp, Artificial Sequence
  Synthetic
ggtagaagaaaacagattcaaggttacttggattccactagaactattatcaggtattcactggaggtgagacca

SEQ ID NO: 255753 - DNA, 75 bp, Artificial Sequence
  Synthetic
aggaagtctgcctcaatgagtaacctatgagactttcctctattatcactgatacctccaagaggatcaacaatt

SEQ ID NO: 255754 - DNA, 75 bp, Artificial Sequence
  Synthetic
aggaataccggactcacggggaaatccatgaactgaaagccacaatgatcccctgtttaataaaaaataagcacg

SEQ ID NO: 255755 - DNA, 75 bp, Artificial Sequence
  Synthetic
gatacctccaagaggatcaacaattagtccgatttgatcagtagtaacttgattgagattatagaaaaaataagc

SEQ ID NO: 255756 - DNA, 75 bp, Artificial Sequence
  Synthetic
tacaggcaactaatcgggcagtcttcgaagtgaaagaaggcacccaacagttagctatagcggtacaagcaatac

SEQ ID NO: 255757 - DNA, 75 bp, Artificial Sequence
  Synthetic
cgaagtgaaagaaggcacccaacagttagctatagcggtacaagcaatacaagaccacatcaatactattatgaa

SEQ ID NO: 255758 - DNA, 75 bp, Artificial Sequence
  Synthetic
aagaccacatcaatactattatgaacacccaattgaacaatatgtcctgtcagattcttgataaccagcttgcaa

SEQ ID NO: 255759 - DNA, 75 bp, Artificial Sequence
  Synthetic
gttcaagcaacattatctacttcaatttctgctgctgaaatactaagtgccggtctaatggagggtcagattgtt

SEQ ID NO: 255760 - DNA, 75 bp, Artificial Sequence
  Synthetic
gagatcgggaatgaacaatggagctatccagcaaaaaattgtaagttgacaagacaccacatattctgccaatac

SEQ ID NO: 255761 - DNA, 75 bp, Artificial Sequence
  Synthetic
cgaggatgctctgaatgatatcaagcgagacatcataaggagcgccatatgaattcaccaggaacaccagactaa

SEQ ID NO: 255762 - DNA, 75 bp, Artificial Sequence
  Synthetic
gcaggattccaaaatggagcacaagcaccagctgtaagacagggaggtcaaaatgactttagagcacagccgtta

SEQ ID NO: 255763 - DNA, 75 bp, Artificial Sequence
  Synthetic
aatcaaaactatgccttgcaggcaatataagcgcctgtgtgttctcacccatagcagggagttatatgaggcgat

SEQ ID NO: 255764 - DNA, 75 bp, Artificial Sequence
  Synthetic
gcaaggggcgaacacggaaataccttcccaaacaatcccaatcaaaacgcacagtcacaagtgggtgactgggat

SEQ ID NO: 255765 - DNA, 75 bp, Artificial Sequence
  Synthetic
agagcaaccatcaactccaatctgtgagtataaattctaaaatcggagctataatcatagcagccttagttttga

SEQ ID NO: 255766 - DNA, 75 bp, Artificial Sequence
  Synthetic
acagtcacaagtgggtgactgggatgagtagatcactgacatgaccaaactacccccaactgcaacaaacccaga

SEQ ID NO: 255767 - DNA, 75 bp, Artificial Sequence
  Synthetic
aaatccactacattccattcatatttagtctttaagaaaaaattaggcccggaaagaattagttctacgagcatc

SEQ ID NO: 255768 - DNA, 75 bp, Artificial Sequence
  Synthetic
accaaggggaaaatggagatgggatgttggtagaacaaatagtgtaagaaacagtaagcccggaagtggtgtttt

SEQ ID NO: 255769 - DNA, 75 bp, Artificial Sequence
  Synthetic
ggcaaacaaggttctcctggacttgacatcacagtttgacaatctatcccctgatttaactgctgaactcctctg

SEQ ID NO: 255770 - DNA, 75 bp, Artificial Sequence
  Synthetic
gctgcgctcggtgttgcgaccgcagcacaagtaactgccgctgtctcattagttcaagcacagacaaatgcacgt

SEQ ID NO: 255771 - DNA, 75 bp, Artificial Sequence
  Synthetic
gcctagaaggatctcttacttctcgacttttctaccttgaaaatagaattaatcagtaatcatgaaggccttttc

SEQ ID NO: 255772 - DNA, 75 bp, Artificial Sequence
  Synthetic
tatgtatataaaggagagcaaccatcaactccaagctgtgagtgtaaattccaaaatcggagctataattgtagc

SEQ ID NO: 255773 - DNA, 75 bp, Artificial Sequence
  Synthetic
caactccaagctgtgagtgtaaattccaaaatcggagctataattgtagcagcgttaatcttgagcatcctgtca

SEQ ID NO: 255774 - DNA, 75 bp, Artificial Sequence
  Synthetic
cgaacctgcttccgaatactggtactatctgtacaagctgtcacccttatattagttattgtcactttaggtgag

SEQ ID NO: 255775 - DNA, 75 bp, Artificial Sequence
  Synthetic
tgcactatgccggctatccaacctcccttatacctaacatttctattactagttcttctttatctgattataacc

SEQ ID NO: 255776 - DNA, 75 bp, Artificial Sequence
  Synthetic
gcggtacaagcaatacaagaccacatcaatactattatgaacacccaattgaacaatatgtcttgtcagatcctt

SEQ ID NO: 255777 - DNA, 75 bp, Artificial Sequence
  Synthetic
ttacctacaagactgcggtacaacatgcagcgctgtaccagggatccttatttcgctggagtttcgatcactcat

SEQ ID NO: 255778 - DNA, 75 bp, Artificial Sequence
  Synthetic
tttcgctggagtttcgatcactcattctagatagatctccatttaggacaagtcccaatccatcatacgagaaca

SEQ ID NO: 255779 - DNA, 75 bp, Artificial Sequence
  Synthetic
ccaaaaacaagtctcaaactgctctacaaacatccccttagttaatgacctcaggtttataaatgggatcaataa

SEQ ID NO: 255780 - DNA, 75 bp, Artificial Sequence
  Synthetic
catctcttacagaatttgatttcatcctcaacttggaattgtctgaagccagtcttgagaaatactctctcccaa

SEQ ID NO: 255781 - DNA, 75 bp, Artificial Sequence
  Synthetic
atcatgagatataaagaaaaaagcaagccagaacaaacttaggatcacaatacaacacagaaccccagctgctat

SEQ ID NO: 255782 - DNA, 75 bp, Artificial Sequence
  Synthetic
tgttgttagacagtaccttaccttcgaactccagttggcaagacggcaggggttgctatcaaacagatactatgc

SEQ ID NO: 255783 - DNA, 75 bp, Artificial Sequence
  Synthetic
tcactttaggtgagcttgtgaggatgatcaatgaccaaggcttgagcaaccaattgttttcaactacagataaga

SEQ ID NO: 255784 - DNA, 75 bp, Artificial Sequence
  Synthetic
catggatcctggaaacccgacaggggtcccagtcgatgagcttagaagaagttttagtgatcatgtaacaattgt

SEQ ID NO: 255785 - DNA, 75 bp, Artificial Sequence
  Synthetic
tacccctacaaattgagggaaaccaaaatcaattgttatccacacttgccacaatctgtacaagcaaaaaacaag

SEQ ID NO: 255786 - DNA, 75 bp, Artificial Sequence
  Synthetic
ctgtgtgttctcacccatagcagggagttatatgaggcgatttgtagcactggatggaacaattgttgcaaactg

SEQ ID NO: 255787 - DNA, 75 bp, Artificial Sequence
  Synthetic
cttagttaatgaccttaggtttataaatggaatcaataaattcatcattgaagattatgcaactcatgatttctc

SEQ ID NO: 255788 - DNA, 75 bp, Artificial Sequence
  Synthetic
tgcatatgggggtgtcttgcccaatagtacactcggagttaaatcagcaagagaatttttccggcctgttaatcc

SEQ ID NO: 255789 - DNA, 75 bp, Artificial Sequence
  Synthetic
agtacactcggagttaaatcagcaagagaatttttccggcctgttaatccatataatccatgttcaggaccacaa

SEQ ID NO: 255790 - DNA, 75 bp, Artificial Sequence
  Synthetic
ggtcatacttcccaagttacttctctaatcgaagaatacagagtgcatttcttgtctgtgcctggaatcagatcc

SEQ ID NO: 255791 - DNA, 75 bp, Artificial Sequence
  Synthetic
atgaggatggaggtgcaggcctccaaaatggagcacatgcgccagctgtaagacagggaggtcaaaatgacctta

SEQ ID NO: 255792 - DNA, 75 bp, Artificial Sequence
  Synthetic
cttgtctgtgcctggaatcagatcctagttacaaattgtgagctagttgtcccctcaagcaatcagacaatgatg

SEQ ID NO: 255793 - DNA, 75 bp, Artificial Sequence
  Synthetic
tatcctcaagtcagcaacatcccaaaccatcagaatcatcagatcaatcgcatcggggggattgaacaccaagat

SEQ ID NO: 255794 - DNA, 75 bp, Artificial Sequence
  Synthetic
attctcaacaagatgcaaggggtgaacacggaaacaccttcccaaacaatcccaatcaaaacgcgcagtcgcaag

SEQ ID NO: 255795 - DNA, 75 bp, Artificial Sequence
  Synthetic
tgatcataactttatatgtctggattatatcaaccatcaattacaagactgcggtgcgacatgcagcactgcacc

SEQ ID NO: 255796 - DNA, 75 bp, Artificial Sequence
  Synthetic
ctgctgggcttacattgcaactaaagaaatcagaagaatcaacttcaaaacaaatcatatcaacacaatatcaag

SEQ ID NO: 255797 - DNA, 75 bp, Artificial Sequence
  Synthetic
tgggcgactgggacgagtaaatcactgacatgatcaaaccaccctcaattgcaataaccccagaacaatctagcc

SEQ ID NO: 255798 - DNA, 75 bp, Artificial Sequence
  Synthetic
gatgccgttcaatcatgagacataaagaaaaaatcaagccagaacaagcctaggaccataacacaacacataacc

SEQ ID NO: 255799 - DNA, 75 bp, Artificial Sequence
  Synthetic
gttctacgagcatcgacacaattatcttgatcgtgtttctttccgggcaagccatggatcaatttataaaacaag

SEQ ID NO: 255800 - DNA, 75 bp, Artificial Sequence
  Synthetic
ctattaaattcaagtacaactagagtaaatcctaccctttatgtctctgcccttaataatcttaaagtactagcc

SEQ ID NO: 255801 - DNA, 75 bp, Artificial Sequence
  Synthetic
ggctgctcgaaagatggagccctcaaaactcttcacaatgtcagacaatgccacctttgcacctggacctgttat

SEQ ID NO: 255802 - DNA, 75 bp, Artificial Sequence
  Synthetic
tcaagataccggtgatgctagtgtgtattgtgtttatattatggaactagcatcgaatattgttggagaattcca

SEQ ID NO: 255803 - DNA, 75 bp, Artificial Sequence
  Synthetic
actcgttgagcaaggccacaatcatccctggcgttgcaccggtactcattggcaatccagaacaaaagaacattc

SEQ ID NO: 255804 - DNA, 75 bp, Artificial Sequence
  Synthetic
catcgaatattgttggagaattccaaattctacctgtgctaactagattgactatcacttgaatcatagtgaatg

SEQ ID NO: 255805 - DNA, 75 bp, Artificial Sequence
  Synthetic
agtaccccaccgcatcaaatcagggatccaagtcaaagggcagaggctcaggggccaggcccatcatggtctcat

SEQ ID NO: 255806 - DNA, 75 bp, Artificial Sequence
  Synthetic
taatgaatcaagttattcacggagtaacggtatccttacccctacaaattgagggaaaccaaaatcaattattat

SEQ ID NO: 255807 - DNA, 75 bp, Artificial Sequence
  Synthetic
tctttcgctggagtttcgatcactcactctagaaagatctccagctaggacaagtcccaatacctcatgtgtgaa

SEQ ID NO: 255808 - DNA, 75 bp, Artificial Sequence
  Synthetic
cagtcataagacataaagaaaaaagcaggccagaacaaacttaggatcacaatacaacacagaaccccagctgct

SEQ ID NO: 255809 - DNA, 75 bp, Artificial Sequence
  Synthetic
tcatctgggtgtgaaatcaaggctgccagtgctatcctccagggctcagactatgcatcactcgcaaaaactgat

SEQ ID NO: 255810 - DNA, 75 bp, Artificial Sequence
  Synthetic
gaagatggagccctcgaaactcttcacaatattggacaatgccacctttgcacctgggccggttatcaatgcggc

SEQ ID NO: 255811 - DNA, 75 bp, Artificial Sequence
  Synthetic
cgtcaccaaaaggtgccacaccggcgtcaaaactcctctagaccgcacacgacctcgaacaatcacaaccacatc

SEQ ID NO: 255812 - DNA, 75 bp, Artificial Sequence
  Synthetic
agcctcaaactgctctacaaacatccccttagttaatgaccttaggtttataaatgggatcaataaattcatcat

SEQ ID NO: 255813 - DNA, 75 bp, Artificial Sequence
  Synthetic
caaaggattactcaattccatccactagagagctatctcaaatatggtttaacaatgagtggagtggatctgtaa

SEQ ID NO: 255814 - DNA, 75 bp, Artificial Sequence
  Synthetic
cgagacatcatacgaagcgccatatgaattcaccaggaataccggacccacgggaaaatccataaactgagagcc

SEQ ID NO: 255815 - DNA, 75 bp, Artificial Sequence
  Synthetic
ggtgctacacacataatgtgattaatgccaactgcaaggatcatacttcgtccaaccaatatgtttccatgggga

SEQ ID NO: 255816 - DNA, 75 bp, Artificial Sequence
  Synthetic
gttgctttatactctaatgagcacaaagcattaacgtacctcacctttgaaatggtattaatggtcactgatatg

SEQ ID NO: 255817 - DNA, 75 bp, Artificial Sequence
  Synthetic
cagcgggaggccctatgggggtgtctcaattttcatcaattattaagaaaaaacaggccagaatggcaggcctaa

SEQ ID NO: 255818 - DNA, 75 bp, Artificial Sequence
  Synthetic
tgagatgcagatgatagttaagataaatattccaaccattgtcacacaatcaaatgcattggtgattgacttcta

SEQ ID NO: 255819 - DNA, 75 bp, Artificial Sequence
  Synthetic
gggaccctgaattttgtgcatcttactctctcaaggagaaggagataaaggctacaggtcgtatatttgcaaaaa

SEQ ID NO: 255820 - DNA, 75 bp, Artificial Sequence
  Synthetic
ctctttatgtctctgcccttaataaccttaaagtgcttgccccgtatggtactcaaggactgtctgcctcgtata

SEQ ID NO: 255821 - DNA, 75 bp, Artificial Sequence
  Synthetic
catcggggggatggaacaccaagatttattacgatacaacgagaatggtgattctcaacaagatgcaaggggcga

SEQ ID NO: 255822 - DNA, 75 bp, Artificial Sequence
  Synthetic
ggtggtaacttgattaaaattatagaaaaaataagcctagaaggacaccttaattctcgaccttcccactttgaa

SEQ ID NO: 255823 - DNA, 75 bp, Artificial Sequence
  Synthetic
gtacataaaggagagcaaccatcaactccaatctgtgagtataaattctaaaatcggagctataatcatagcagc

SEQ ID NO: 255824 - DNA, 75 bp, Artificial Sequence
  Synthetic
aaaaaataagcctagaaggacaccttaattctcgaccttcccactttgaaaataggattgatcattaatcatgaa

SEQ ID NO: 255825 - DNA, 75 bp, Artificial Sequence
  Synthetic
cagaagaatcaacttcaaaacaaatcatatcaacacaatatcaagtagtgtcgatgatctcatcaggtactaatc

SEQ ID NO: 255826 - DNA, 75 bp, Artificial Sequence
  Synthetic
tagagccaacaaccatggaattggacaccacttgaaagaacaagaaacaatccttagttctgatttcttcatata

SEQ ID NO: 255827 - DNA, 75 bp, Artificial Sequence
  Synthetic
ggggccaagcccatcatagtctcatcctccgaaggaggcactggagggactcagattcctgagccccttttcgca

SEQ ID NO: 255828 - DNA, 75 bp, Artificial Sequence
  Synthetic
tgcatttgaataatgccgttcaatcatgagacataaagaaaaaaccaagccagaacaaacttagggtcataatac

SEQ ID NO: 255829 - DNA, 75 bp, Artificial Sequence
  Synthetic
ggtcgagaaagatttgtgttactttctgaatgcattcatgacaatcagacagttatgttatgatctagtatttcc

SEQ ID NO: 255830 - DNA, 75 bp, Artificial Sequence
  Synthetic
atactttaaacatagattatttagtcccttcaacaacttttttaaagaagcatgcccaatatacattgatggaac

SEQ ID NO: 255831 - DNA, 75 bp, Artificial Sequence
  Synthetic
cggagactttaaagtcagcagtcaaagtcttcgttattaacacacccaatcccaccacacgctaccagatgctaa

SEQ ID NO: 255832 - DNA, 75 bp, Artificial Sequence
  Synthetic
agcaacgattggcaaaggccagcaccgaggatgctctgaatgatatcaagcgagacatcatacgaagcgccatat

SEQ ID NO: 255833 - DNA, 75 bp, Artificial Sequence
  Synthetic
tgctgtgggagtaatgaatcaagttattcatggagtaacggtatccttacccctacaaattgagggaaaccaaaa

SEQ ID NO: 255834 - DNA, 75 bp, Artificial Sequence
  Synthetic
gaagaagaggaactcgcacagtatctattagatcgtgaggtagtcatgcccagggttgcacatgtaatacttgcc

SEQ ID NO: 255835 - DNA, 75 bp, Artificial Sequence
  Synthetic
ctatgggtttatatgtaatgagattctcgacctacttactgaggataacatctttaatgaagaggaggcaaacaa

SEQ ID NO: 255836 - DNA, 75 bp, Artificial Sequence
  Synthetic
caaaaggtaactcctgtagtgacggcgtgcatgctgtccttcggtgctggaccagtactagaagacccacaacat

SEQ ID NO: 255837 - DNA, 75 bp, Artificial Sequence
  Synthetic
accagtactagaagacccacaacatatgctgaaagctcttgatcagacagacatcagggttcggaagacagcgag

SEQ ID NO: 255838 - DNA, 75 bp, Artificial Sequence
  Synthetic
ccaacctgctggatctgctgatcggcgatttgcgaaataccagcagcaaggtcgcctggaagcaagatacatgct

SEQ ID NO: 255839 - DNA, 75 bp, Artificial Sequence
  Synthetic
gtagcatcgatatagctaggtcccttagaaaactatcctgggcaactttacttaatggacgtcccatcgagggat

SEQ ID NO: 255840 - DNA, 75 bp, Artificial Sequence
  Synthetic
tgtatcaaccatcacttataagactgcggtgcgacatgcagcatggtaccagagatccttatttcgctggagttt

SEQ ID NO: 255841 - DNA, 75 bp, Artificial Sequence
  Synthetic
ttgctatcaaacagatactatgcaatggtgggtgacattggaaagtacattgagaattcaggccttactgccttc

SEQ ID NO: 255842 - DNA, 75 bp, Artificial Sequence
  Synthetic
gtggtgatgataaattcacctggttcttcctacccaaggggatcaggctagacaatgatccggcatccaacccac

SEQ ID NO: 255843 - DNA, 75 bp, Artificial Sequence
  Synthetic
gcggtgcgacatgcagcatggtaccagagatccttatttcgctggagtttcgatcactcactctagaaagatctc

SEQ ID NO: 255844 - DNA, 75 bp, Artificial Sequence
  Synthetic
atgagagaacaagttgcatttaaatgatgccgttcaatcatgagacataaagaaaaaagcaagccagaacaaact

SEQ ID NO: 255845 - DNA, 75 bp, Artificial Sequence
  Synthetic
tgggatcacaatacgatacagaaccccagctgctatcacaactgtgatccgaccgctcgagagatggagccctcg

SEQ ID NO: 255846 - DNA, 75 bp, Artificial Sequence
  Synthetic
gtacacagattagatgatggcaccactcaattaaaatttaccccggcaagctcctatgcattctctagcttcgtt

SEQ ID NO: 255847 - DNA, 75 bp, Artificial Sequence
  Synthetic
acagagtagcagatgatctaggcctgactcctgaacaaagaactgaggtcactcagcttgttgacaggcttgcaa

SEQ ID NO: 255848 - DNA, 75 bp, Artificial Sequence
  Synthetic
aatagaattgatcagtaatcatgaaggctttttcagttacttgcttgggctttgcagtcttttcatcttctatat

SEQ ID NO: 255849 - DNA, 75 bp, Artificial Sequence
  Synthetic
tttgcagtcttttcatcttctatatgtgtgaatatcaacatcttgcagcaaattggatatatcaagcaacaagtc

SEQ ID NO: 255850 - DNA, 75 bp, Artificial Sequence
  Synthetic
tgcttatcaaaccagaattggtggtttagatcaaatcccacttctggaaaaaatacccttactagctcacctcac

SEQ ID NO: 255851 - DNA, 75 bp, Artificial Sequence
  Synthetic
taatttgcttcttccaattgcagaaaacataaacaatattgcatcgccctcacctgggtcaagacgtcataaaag

SEQ ID NO: 255852 - DNA, 75 bp, Artificial Sequence
  Synthetic
agacacactggtgctacacacataatgtaattaatgccaactgcaaggatcatacttcgtctaaccaatatgttt

SEQ ID NO: 255853 - DNA, 75 bp, Artificial Sequence
  Synthetic
aacataaacaatattgcatcgccctcacctgggtcaagacgtcataaaaggtttgctggcattgccattggcatc

SEQ ID NO: 255854 - DNA, 75 bp, Artificial Sequence
  Synthetic
gaccctgccgtagcactatgccggcgatccaacctcccttatacctaacatttctattgctaatacttctttata

SEQ ID NO: 255855 - DNA, 75 bp, Artificial Sequence
  Synthetic
gcaatagcggctatgaagaattcaatacaggcaactaatcgggcaatcttcgaagtgaaagaaggcacccaacag

SEQ ID NO: 255856 - DNA, 75 bp, Artificial Sequence
  Synthetic
gcctgaatcggaaaagctgctcaattgcaacagtccctgatggatgcgcaatgtactgttacgtctcaactcaac

SEQ ID NO: 255857 - DNA, 75 bp, Artificial Sequence
  Synthetic
agcaacatctatagtgaacgacgctgtagttcaagcagactacactagcaattggattagtgaatgctgctacac

SEQ ID NO: 255858 - DNA, 75 bp, Artificial Sequence
  Synthetic
aagaccacatcaatactattatgaacactcaattaaataatatgacttgtcagattctggataaccagcttgcaa

SEQ ID NO: 255859 - DNA, 75 bp, Artificial Sequence
  Synthetic
caaaaattatggactatgatttccatctcaacaatcatattgtccgcaacagaggcaaacactcgggttatgagc

SEQ ID NO: 255860 - DNA, 75 bp, Artificial Sequence
  Synthetic
accaaaattgactgcctaccctagcaatttgttttatctatctcgaaagctacttaatgctattcgagattctga

SEQ ID NO: 255861 - DNA, 75 bp, Artificial Sequence
  Synthetic
taaatcctaccctttatgtctctgcccttaataatcttaaagtactagccccatatggtactcaaggattgtttg

SEQ ID NO: 255862 - DNA, 75 bp, Artificial Sequence
  Synthetic
gcatcctgtcaattatcatttcgctattgttttgctgctgggcttacattgcaaccaaagaaatcagaagaatca

SEQ ID NO: 255863 - DNA, 75 bp, Artificial Sequence
  Synthetic
cgagattctgaagaaggacaatttctgattgcatcctattataacagttttggatatctggaaccaatactaatg

SEQ ID NO: 255864 - DNA, 75 bp, Artificial Sequence
  Synthetic
atttgatttcatcctcaacttggaattgtctgaagccagtcttgagaaatactctctcccaagtttgttgatgac

SEQ ID NO: 255865 - DNA, 75 bp, Artificial Sequence
  Synthetic
gaccctgccgttgcactatgccggcgatccaacctcccttatacctaacatttctattgctaattcttctttatc

SEQ ID NO: 255866 - DNA, 75 bp, Artificial Sequence
  Synthetic
cttgcacagggcagcatggtgacccaaataaagaatgaattatcaacagtaaagacaacactagctacaattgaa

SEQ ID NO: 255867 - DNA, 75 bp, Artificial Sequence
  Synthetic
ctcatggtataaaacaatcagtgttttgaattatattagccatatgaaaatatctgacggtgcccatctatactt

SEQ ID NO: 255868 - DNA, 75 bp, Artificial Sequence
  Synthetic
agttgatgaccttgctctactcatgggggacaaagtatacggtattgtctcttcacttgagagttttgtttacgc

SEQ ID NO: 255869 - DNA, 75 bp, Artificial Sequence
  Synthetic
agagatccttctttcgctggagtttcgatcactcactctagaaagatctccatctaggacaaatcccaatccatc

SEQ ID NO: 255870 - DNA, 75 bp, Artificial Sequence
  Synthetic
actcatttggccaagaatacttccaatcctacaatcatatgatcttcggcaaagtatgcaattgcccacagtatg

SEQ ID NO: 255871 - DNA, 75 bp, Artificial Sequence
  Synthetic
cccagtttattgaaagtgtcccttacagattgattcaagcaggtatagcagcaggaagtggtgtagtgcaaagtt

SEQ ID NO: 255872 - DNA, 75 bp, Artificial Sequence
  Synthetic
ggaaaaattgactcaatccacagttaatcttataagtgatgggctagaacgggttgtatcacacatcagcaatca

SEQ ID NO: 255873 - DNA, 75 bp, Artificial Sequence
  Synthetic
gaaaaacccaatatagtccaacctttcttgaatgcaatcaatgttgatacttgtagcatcgatatagctaggtcc

SEQ ID NO: 255874 - DNA, 75 bp, Artificial Sequence
  Synthetic
ccggctgctatcacaaccgtgctccggccgctcaaaagatggagccctcgaaactcttcacaatatcggacaatg

SEQ ID NO: 255875 - DNA, 75 bp, Artificial Sequence
  Synthetic
taggatcacaatacaacacagaaccccggctgctatcacaaccgtgctccggccgctcaaaagatggagccctcg

SEQ ID NO: 255876 - DNA, 75 bp, Artificial Sequence
  Synthetic
actagatctcgagcagggcaagacgcaaaggattgctcaattccatccacaagggagctatctcaaatatggttt

SEQ ID NO: 255877 - DNA, 75 bp, Artificial Sequence
  Synthetic
caacgattggcaaaggccagcaccgaggatgccctgaatgatatcaagcgagacatcatacgaagcgccatatga

SEQ ID NO: 255878 - DNA, 75 bp, Artificial Sequence
  Synthetic
cccggctcaatgaacagcatgttggagagagcccaagtacatgcgctactgatcacagtaactgtattaaagcca

SEQ ID NO: 255879 - DNA, 75 bp, Artificial Sequence
  Synthetic
agagagcccaagtacatgcgctactgatcacagtaactgtattaaagccaggtggcttactaatcttgaaagctt

SEQ ID NO: 255880 - DNA, 75 bp, Artificial Sequence
  Synthetic
atgaagatgggggtgcaggattccaaaatggagcacaagcaccagctgcaagacagggaggccaaaatgacttca

SEQ ID NO: 255881 - DNA, 75 bp, Artificial Sequence
  Synthetic
ttcttttccacaataaggatcctgcgatcttcatactccgacccgaataatcacgaggtatacataatagctaca

SEQ ID NO: 255882 - DNA, 75 bp, Artificial Sequence
  Synthetic
gttgctttatactcccatgagcacaaagcattaacgtacctcaccttcgaaatggtattaatggtcactgacatg

SEQ ID NO: 255883 - DNA, 75 bp, Artificial Sequence
  Synthetic
gatcttcatactccgacccgaataatcacgaggtatacataatagctacattagcagttgatcccaccacatcct

SEQ ID NO: 255884 - DNA, 75 bp, Artificial Sequence
  Synthetic
tgtcagaaattatggactatgatctccatatccaccatcatactatctgcaactgaggctaatactagggtaatg

SEQ ID NO: 255885 - DNA, 75 bp, Artificial Sequence
  Synthetic
aggagataaaggctacaggtcgtatatttgcaaaaatgacaaagagaatgagatcgtgccaagtaattgcggaat

SEQ ID NO: 255886 - DNA, 75 bp, Artificial Sequence
  Synthetic
attgacaaaatctttgttaacgatgaaccaaattggtattatatcagagcacagccgaagatccactgctgacaa

SEQ ID NO: 255887 - DNA, 75 bp, Artificial Sequence
  Synthetic
actgtaaggaactggtgtatcttgcccacccaaactcgtctcaccttacgacagtctatcgagcttggagagttt

SEQ ID NO: 255888 - DNA, 75 bp, Artificial Sequence
  Synthetic
aatgttcctcaaatgaataaatttgtatatgaccctgaaccactcagtttgctagagatggaaaaaattgaggat

SEQ ID NO: 255889 - DNA, 75 bp, Artificial Sequence
  Synthetic
tccaccgctgacaacatgactttggcacactctggttcaaacaaacacagaattaacaatagtcaattcaagaag

SEQ ID NO: 255890 - DNA, 75 bp, Artificial Sequence
  Synthetic
caggaaatatctgaagtctgcattaaaccaatcaacattcaatcatctaatgggagaaacatctgacatattgtt

SEQ ID NO: 255891 - DNA, 75 bp, Artificial Sequence
  Synthetic
ctgacctcacaaaatactgcttaaattggaggtaccaagtcatcatcccctttgcgcgtacattgaattcaatgt

SEQ ID NO: 255892 - DNA, 75 bp, Artificial Sequence
  Synthetic
cgacctcgaacaatcataaccacatcagtattaaatccataatatcattttaagaaaaaattgattttactttct

SEQ ID NO: 255893 - DNA, 75 bp, Artificial Sequence
  Synthetic
atcaccactagagtagtacgctcgctcagtcattccgagaagaaggagcaagcttataaagcaagtaaattattc

SEQ ID NO: 255894 - DNA, 75 bp, Artificial Sequence
  Synthetic
atcccaccacacgctatcagatgctaaacttttgcttaagaataatctgcagtcaaaatgctagggcatctcaca

SEQ ID NO: 255895 - DNA, 75 bp, Artificial Sequence
  Synthetic
cagcgggaggccctatgggcgtgtctcaatttttatcgattattaagaaaaaacaggccagaatggcgggcctaa

SEQ ID NO: 255896 - DNA, 75 bp, Artificial Sequence
  Synthetic
ctgtaatgcgcctaactgagaatggggtcgagaaagatttgtgttattttctaaatgcattcatgacaatcagac

SEQ ID NO: 255897 - DNA, 75 bp, Artificial Sequence
  Synthetic
ctgcagccggaggcccaaaggttgattcaaactgccatcaggaaaagtcttgttgttagacagtaccttaccttc

SEQ ID NO: 255898 - DNA, 75 bp, Artificial Sequence
  Synthetic
ggttgctatcaaacagatactatgcaatggtgggtgacatcgggaagtacattgagaattcaggccttactgcct

SEQ ID NO: 255899 - DNA, 75 bp, Artificial Sequence
  Synthetic
gacaaacatcaggaggatgattattgaaccaaaattgactgcctaccctagtaatttgttttatctatctcgaaa

SEQ ID NO: 255900 - DNA, 75 bp, Artificial Sequence
  Synthetic
atactttaaacatagattatttagttccttcaacaacgttcttaaagaagcacgcccaatatacattaatggaac

SEQ ID NO: 255901 - DNA, 75 bp, Artificial Sequence
  Synthetic
gctcagatttctttatatatagtaaaagggtcttctataagggtaggatcctaacacaagcactaaagaatgtaa

SEQ ID NO: 255902 - DNA, 75 bp, Artificial Sequence
  Synthetic
tgggtgactgggatgagtaaatcactgatatgatcaaactaacctcaattgcaataatcctaggacaatctagcc

SEQ ID NO: 255903 - DNA, 75 bp, Artificial Sequence
  Synthetic
gaggtgagaccattgtcagcaaagaagctgaatacagtaatagaatataacttattgtatctgtcctacaatttg

SEQ ID NO: 255904 - DNA, 75 bp, Artificial Sequence
  Synthetic
agctgaatacagtaatagaatataacttattgtatctgtcctacaatttggagattattgaaaaacccaatatag

SEQ ID NO: 255905 - DNA, 75 bp, Artificial Sequence
  Synthetic
aatggtattaatggtcactgatatgttagagggacgactgaatgtttcttctttgtgcacagctagtcattatct

SEQ ID NO: 255906 - DNA, 75 bp, Artificial Sequence
  Synthetic
ctttgtgcacagctagtcattatctgtcccctctaaagaagagaatcgaaattctcctaacattagttgatgacc

SEQ ID NO: 255907 - DNA, 75 bp, Artificial Sequence
  Synthetic
gtcccctctaaagaagagaatcgaaattctcctaacattagttgatgaccttgctctactcatgggggacaaagt

SEQ ID NO: 255908 - DNA, 75 bp, Artificial Sequence
  Synthetic
gtagtcatgcccagggttgcacatgtaatacttgcccagtctagttgcggtagaagaaaacagattcaaggttac

SEQ ID NO: 255909 - DNA, 75 bp, Artificial Sequence
  Synthetic
ttcacctggtttttcctacccaaggggataaggctagataatgatccggcatccaacccacccatcagagtacct

SEQ ID NO: 255910 - DNA, 75 bp, Artificial Sequence
  Synthetic
tttctattgctaattcttctctctctgatcataactttgtatgtctggattatatcaaccatcacttacaagact

SEQ ID NO: 255911 - DNA, 75 bp, Artificial Sequence
  Synthetic
ggatttagaaggtgtacccggctcaatgaacagcatgttggagagagctcaggtacatgcgctgctgatcacggt

SEQ ID NO: 255912 - DNA, 75 bp, Artificial Sequence
  Synthetic
aaccctcaaatgaagcaggcgttcgagcaacgattggcaaaggccagcaccgaggatgctctgaacgacatcaag

SEQ ID NO: 255913 - DNA, 75 bp, Artificial Sequence
  Synthetic
aggaatgaatgttgcgaatcatttcctatccaccccaattcagggaaccaattcgctgagcaaggcctcaatcct

SEQ ID NO: 255914 - DNA, 75 bp, Artificial Sequence
  Synthetic
cccttcattaatgttcctcaaatgaataaatttgtatatgaccctgaaccactcagtttgctagagatggaaaaa

SEQ ID NO: 255915 - DNA, 75 bp, Artificial Sequence
  Synthetic
tgcaacagtccctgatggatgcgcaatgtactgttatgtctcaactcaacttgaaaccgacgactatgcggggtc

SEQ ID NO: 255916 - DNA, 75 bp, Artificial Sequence
  Synthetic
tatcttgatccctggccattaactccatatagccaccaatcaggcattaacagaaatttctatttcacaggtgca

SEQ ID NO: 255917 - DNA, 75 bp, Artificial Sequence
  Synthetic
aaatactgcttaaattggaggtaccaagtcatcatcccctttgcgcgtacattgaattcaatgtatggtgtaccc

SEQ ID NO: 255918 - DNA, 75 bp, Artificial Sequence
  Synthetic
ctcgtctcaccttacgacagtctatcgagcttggagagtttagactaagagatgtgataacacccatggagatcc

SEQ ID NO: 255919 - DNA, 75 bp, Artificial Sequence
  Synthetic
aagaatcccaggttcatgcacgtttaaaacagatcagagtagaactcattgcaaggattcctagtctccggtgga

SEQ ID NO: 255920 - DNA, 75 bp, Artificial Sequence
  Synthetic
ataactatcctccgaaggttaaaggtatgtcacctgaggacaaatgtcaggctttaactacacatctactccaaa

SEQ ID NO: 255921 - DNA, 75 bp, Artificial Sequence
  Synthetic
gctctcctggtatgatgcatcaccaaaaggtgccataccagcattcaaattcctctagaccgcacacgacctcga

SEQ ID NO: 255922 - DNA, 75 bp, Artificial Sequence
  Synthetic
tactacttaagaattcaaggcatccaaggaattctagactatgtgtatatgaccttgaggaggataccaggaatg

SEQ ID NO: 255923 - DNA, 75 bp, Artificial Sequence
  Synthetic
ggaacataggggacccattggtatcagctttagcagatgttaaacgactgataaaagcgggctgtattgatatgt

SEQ ID NO: 255924 - DNA, 75 bp, Artificial Sequence
  Synthetic
ccgctcgaaagatggagccctcgaaattcttcacaatatcggacagtgccacctttgcacctgggcctgttagca

SEQ ID NO: 255925 - DNA, 75 bp, Artificial Sequence
  Synthetic
cacccaaactcttctaaaccgcccacgacctcgaacaatcacaaccacatcagtattaaatacagaagatccttt

SEQ ID NO: 255926 - DNA, 75 bp, Artificial Sequence
  Synthetic
accaaggggaaaatgaagatgggatattaataaaacaagtagtgtgagaaacagtaagcccggaagtggtgtttt

SEQ ID NO: 255927 - DNA, 75 bp, Artificial Sequence
  Synthetic
tctgtacaagctgtcacccttatattagttattgtcactttaggtgagcttgtaaggatgatcaatgatcaaggc

SEQ ID NO: 255928 - DNA, 75 bp, Artificial Sequence
  Synthetic
attaataaaacaagtagtgtgagaaacagtaagcccggaagtggtgttttgcgatttcgaggccgggctcgatcc

SEQ ID NO: 255929 - DNA, 75 bp, Artificial Sequence
  Synthetic
acagtaagcccggaagtggtgttttgcgatttcgaggccgggctcgatcctgttcctctattatttataaggagc

SEQ ID NO: 255930 - DNA, 75 bp, Artificial Sequence
  Synthetic
gtctgtgctcaaggcttttgagcgctttacgatagagcaggagctccaggatagaggggaggagggtgctattcc

SEQ ID NO: 255931 - DNA, 75 bp, Artificial Sequence
  Synthetic
tttacgatagagcaggagctccaggatagaggggaggagggtgctattccaccagagactttaaagtcagctgtc

SEQ ID NO: 255932 - DNA, 75 bp, Artificial Sequence
  Synthetic
tccttcaacaacttttttaaagaagcatgcccaatacacattgatggaacggagtgttaatcccatgctccgtgg

SEQ ID NO: 255933 - DNA, 75 bp, Artificial Sequence
  Synthetic
atccagccacacgctatcagatgctgaacttttgtcttcgaataatttgtagccagaatgcaagggcgtcccaca

SEQ ID NO: 255934 - DNA, 75 bp, Artificial Sequence
  Synthetic
cgatatcactgacttaagcacgaaaactagtgtcgaatacattattcacaaggtaggagctgatacatgtgcatt

SEQ ID NO: 255935 - DNA, 75 bp, Artificial Sequence
  Synthetic
gaacttttgtcttcgaataatttgtagccagaatgcaagggcgtcccacagggtgggtgcactaataactctatt

SEQ ID NO: 255936 - DNA, 75 bp, Artificial Sequence
  Synthetic
aatcacatcagattggccgataggtcacctgaggcccaaattgaacgttgtgaaattgatggttttgagccgggt

SEQ ID NO: 255937 - DNA, 75 bp, Artificial Sequence
  Synthetic
cacctgaggcccaaattgaacgttgtgaaattgatggttttgagccgggtacatatcggctaataccaaatgctc

SEQ ID NO: 255938 - DNA, 75 bp, Artificial Sequence
  Synthetic
acattagcagccgacccttatactttgaatatagattatctagtaccatcaacaactttcttgaagaaacatgcc

SEQ ID NO: 255939 - DNA, 75 bp, Artificial Sequence
  Synthetic
tgctgcatatgcattattagcagatgatctccctccaactataaacaatggaactccgtatgtgcatgcagatgt

SEQ ID NO: 255940 - DNA, 75 bp, Artificial Sequence
  Synthetic
agacagggaggtcaaaatgactttagagcacagcaattacaggatccaattcaagcacaacttttcatgccatta

SEQ ID NO: 255941 - DNA, 75 bp, Artificial Sequence
  Synthetic
gatctccctccaactataaacaatggaactccgtatgtgcatgcagatgttgaaggacaaccatgtgatgagata

SEQ ID NO: 255942 - DNA, 75 bp, Artificial Sequence
  Synthetic
acgcaccctgaatgaacagggcttttcactcatcccacctgaattagtgagtgagtactggaggaggcgtgttga

SEQ ID NO: 255943 - DNA, 75 bp, Artificial Sequence
  Synthetic
gtgtactgattcaggcatgggtgatggtttgcaaatgcatgactgcatatgatcagcctgcaggctctgctgacc

SEQ ID NO: 255944 - DNA, 75 bp, Artificial Sequence
  Synthetic
acaagggcagattgtacaggatcgtatagataaagtcacatcagagtgtgtcagagaccagtatctggcagacaa

SEQ ID NO: 255945 - DNA, 75 bp, Artificial Sequence
  Synthetic
tttcttgcccggtgaaacaatatggtacaacagcctattcaatagtggtgagaatcctccccaacgcaattttgc

SEQ ID NO: 255946 - DNA, 75 bp, Artificial Sequence
  Synthetic
ggtttgcaaatgcatgactgcatatgatcagcctgcaggctctgctgaccgacggttcgccaagtatcagcaaca

SEQ ID NO: 255947 - DNA, 75 bp, Artificial Sequence
  Synthetic
gttattctataatgacaccgtcacagaaaggacaatatctccatctggtcttgaagggaattgggctactttggt

SEQ ID NO: 255948 - DNA, 75 bp, Artificial Sequence
  Synthetic
ctgcaaccagaggcgcaacggttaattcaagctgccatacgaaagagcttggttgtaaggcagtatctaactttt

SEQ ID NO: 255949 - DNA, 75 bp, Artificial Sequence
  Synthetic
gtccacagattggatgatggcactactcaattaaaatttaccccggcaagctcctatgcattctctagctttgtt

SEQ ID NO: 255950 - DNA, 75 bp, Artificial Sequence
  Synthetic
gcaataaccccagaacaatctagcccctgctgaccgcccaaatccactacattccattcgcattcagtctttaag

SEQ ID NO: 255951 - DNA, 75 bp, Artificial Sequence
  Synthetic
ttcaagctgccatacgaaagagcttggttgtaaggcagtatctaacttttgagcttcagttagcacggaggcagg

SEQ ID NO: 255952 - DNA, 75 bp, Artificial Sequence
  Synthetic
aatggtgggtgatattggaaagtatattgagaactcaggtctgaccgctttcttcctgactttgaaatatgcatt

SEQ ID NO: 255953 - DNA, 75 bp, Artificial Sequence
  Synthetic
attgagaactcaggtctgaccgctttcttcctgactttgaaatatgcattagggacaaaatggagccctttatca

SEQ ID NO: 255954 - DNA, 75 bp, Artificial Sequence
  Synthetic
gcttggaagtatgacgcctgcagtggttcaagcaacattatctacttcaatttctgctgctgagatactaagtgc

SEQ ID NO: 255955 - DNA, 75 bp, Artificial Sequence
  Synthetic
ctaaactcagatctcttatgatgctgtaccgggatctaggagaacaagctagataccttgctttgttagaagcac

SEQ ID NO: 255956 - DNA, 75 bp, Artificial Sequence
  Synthetic
gtaccgggatctaggagaacaagctagataccttgctttgttagaagcacctcaaataatggacttcgcacccgg

SEQ ID NO: 255957 - DNA, 75 bp, Artificial Sequence
  Synthetic
tagtgaaaatgcagctgaggaagaagaagatcttgctcaatacttattggatcgagaggtagttatgcctcgggt

SEQ ID NO: 255958 - DNA, 75 bp, Artificial Sequence
  Synthetic
gctatgggagttggaactgtccttgacgttcaaatgagaaattacacctatgctcggccatttttaaatggttat

SEQ ID NO: 255959 - DNA, 75 bp, Artificial Sequence
  Synthetic
actgacaatgatatacctgattatgatatccacggggacataatttaaactgactaaagactcctctggcacgat

SEQ ID NO: 255960 - DNA, 75 bp, Artificial Sequence
  Synthetic
gtagttcaagcagactatactagcaattggattagtgaatgctgctacacttacattgattctgtgtttgtttac

SEQ ID NO: 255961 - DNA, 75 bp, Artificial Sequence
  Synthetic
atatccacggggacataatttaaactgactaaagactcctctggcacgatgcaccaccagaaggtgccacaccag

SEQ ID NO: 255962 - DNA, 75 bp, Artificial Sequence
  Synthetic
acgttcaaatgagaaattacacctatgctcggccatttttaaatggttattatttccagattggggtcgaaactg

SEQ ID NO: 255963 - DNA, 75 bp, Artificial Sequence
  Synthetic
caatagggttgcagatgatttaggcttgacacctgaacaaaggacagaggttacccagctggtcgatagacttgc

SEQ ID NO: 255964 - DNA, 75 bp, Artificial Sequence
  Synthetic
ttgacacctgaacaaaggacagaggttacccagctggtcgatagacttgcacggggtaggggtgcaggcattccc

SEQ ID NO: 255965 - DNA, 75 bp, Artificial Sequence
  Synthetic
aactcacactcagtgatagagttctaaatctagttgctcgaaaattatcactactggcaatcatctgggccaatt

SEQ ID NO: 255966 - DNA, 75 bp, Artificial Sequence
  Synthetic
caccagctcaacaacaacaaccagctgctgtatatgatgatatgcctgcactagaggagtcagaagatgatgatg

SEQ ID NO: 255967 - DNA, 75 bp, Artificial Sequence
  Synthetic
tgctgtatatgatgatatgcctgcactagaggagtcagaagatgatgatgatgatgacggtggtacaagatttca

SEQ ID NO: 255968 - DNA, 75 bp, Artificial Sequence
  Synthetic
ttaataatcttaaagtattagccccatatggtactcaaggactgtttgcctcgtacaccacaaccacctgctttc

SEQ ID NO: 255969 - DNA, 75 bp, Artificial Sequence
  Synthetic
aggatgggcggccaagctgatctccgagcacagcatgcacaagacccaatccaagcccaaatgtttgtgccatta

SEQ ID NO: 255970 - DNA, 75 bp, Artificial Sequence
  Synthetic
tatcacttacactgagaatcttactatttcattgtctcagacaatcaatacccaacccattgatatatcaactga

SEQ ID NO: 255971 - DNA, 75 bp, Artificial Sequence
  Synthetic
gagcacagcatgcacaagacccaatccaagcccaaatgtttgtgccattataccctcaagcaggcaacatgccaa

SEQ ID NO: 255972 - DNA, 75 bp, Artificial Sequence
  Synthetic
gctgagtaaggttaatgcatcccttcaaaatgccgttaaatacataaaagaaagcaaccatcaactccaatcctt

SEQ ID NO: 255973 - DNA, 75 bp, Artificial Sequence
  Synthetic
aattggaggggctgatcagcaggatttattaagatataatgatgataatgatcaaccacaaggtgcaaggggtga

SEQ ID NO: 255974 - DNA, 75 bp, Artificial Sequence
  Synthetic
ttattaagatataatgatgataatgatcaaccacaaggtgcaaggggtgaatatgggagtatattctctaacaac

SEQ ID NO: 255975 - DNA, 75 bp, Artificial Sequence
  Synthetic
taggtgattgggatgaataatctagagtcctatcaccactgtttttgattgtaactaccccgtcccaaagcagcc

SEQ ID NO: 255976 - DNA, 75 bp, Artificial Sequence
  Synthetic
agtcctatcaccactgtttttgattgtaactaccccgtcccaaagcagccatcaacaaccttcaaaatccaacat

SEQ ID NO: 255977 - DNA, 75 bp, Artificial Sequence
  Synthetic
gacctccctccaaccataaataatggaactccttatgtacatgcagatgttgaaggacagccatgtgatgagatt

SEQ ID NO: 255978 - DNA, 75 bp, Artificial Sequence
  Synthetic
cagttaccaaatgatttggagccagatgacttgggcccactagcaaatcagaattggaaggcaattcgagctgaa

SEQ ID NO: 255979 - DNA, 75 bp, Artificial Sequence
  Synthetic
aaaaaattaggcccggaaaagattgattccgtggctataggattaaatcctttagttggatctctttctgggtag

SEQ ID NO: 255980 - DNA, 75 bp, Artificial Sequence
  Synthetic
gtgtactaatccaggcttgggtgatggtttgtaaatgtatgacagcatacgaccaacctgctggatctgctgatc

SEQ ID NO: 255981 - DNA, 75 bp, Artificial Sequence
  Synthetic
gaccctgccgtcgcactatgccggcaatccaacctcctttatacctaacatttctagtgctaatccttctctatc

SEQ ID NO: 255982 - DNA, 75 bp, Artificial Sequence
  Synthetic
attccgtggctataggattaaatcctttagttggatctctttctgggtagatcatggaccaatttatcaaacagg

SEQ ID NO: 255983 - DNA, 75 bp, Artificial Sequence
  Synthetic
tatattgactattaactataagacggcggtgcgatatgcagcactgtaccagcgatccttctctcgctggggttt

SEQ ID NO: 255984 - DNA, 75 bp, Artificial Sequence
  Synthetic
aggaatgaatgttgcaaatcattttctatctgctcccatccaaggaaccagttcactaggtaagaccacaatacc

SEQ ID NO: 255985 - DNA, 75 bp, Artificial Sequence
  Synthetic
agaaattgactcaatccacagttaatcttataagtgatggtctagaacgagttgtattacacatcagcaatcaac

SEQ ID NO: 255986 - DNA, 75 bp, Artificial Sequence
  Synthetic
ctatctgctcccatccaaggaaccagttcactaggtaagaccacaatacctcctggagtagtgcctgtattagtc

SEQ ID NO: 255987 - DNA, 75 bp, Artificial Sequence
  Synthetic
caattaggacaagtcccgatccgtcacgctagaacaagctgcattcaaatgaagctgtgctaccatgagacataa

SEQ ID NO: 255988 - DNA, 75 bp, Artificial Sequence
  Synthetic
agcaccctaatgcattataccaaggggcaagaccaaagaataaacgtcctggattaaaaccaattgtggtttcac

SEQ ID NO: 255989 - DNA, 75 bp, Artificial Sequence
  Synthetic
ggcaagaccaaagaataaacgtcctggattaaaaccaattgtggtttcaccatcagactcaaacataggaggagc

SEQ ID NO: 255990 - DNA, 75 bp, Artificial Sequence
  Synthetic
cagtcaggacaaggtggcatcgtgtcaacagtatatcaggatcccaacattcaaccgacaggatcatatcgaagt

SEQ ID NO: 255991 - DNA, 75 bp, Artificial Sequence
  Synthetic
tcacgaggtatacataatagctacattagcagttgatcccaccacatcctcctttacaactgctctgaatagggc

SEQ ID NO: 255992 - DNA, 75 bp, Artificial Sequence
  Synthetic
caacagtatatcaggatcccaacattcaaccgacaggatcatatcgaagtgtggaactagccaaacttggaaagg

SEQ ID NO: 255993 - DNA, 75 bp, Artificial Sequence
  Synthetic
aaagcctaggacctcaacaccggtggcagaatttaagaggggggccaggaccggcagcccagaaacagacaatcc

SEQ ID NO: 255994 - DNA, 75 bp, Artificial Sequence
  Synthetic
gcagaatttaagaggggggccaggaccggcagcccagaaacagacaatccaagaggagggcatagaagggaatgg

SEQ ID NO: 255995 - DNA, 75 bp, Artificial Sequence
  Synthetic
aacggtatccttacctctacaaattgagggtaaccaaaatcaattattatccacacttgctacaatctgcacaaa

SEQ ID NO: 255996 - DNA, 75 bp, Artificial Sequence
  Synthetic
ggtgggcccgtgaatccttttgttcctccagttcaacaacaacaacctgctgccgtatatgaagacattcctgca

SEQ ID NO: 255997 - DNA, 75 bp, Artificial Sequence
  Synthetic
gcggccaactacaaaggagtatcctggagtccattcaggaagtctgcctcaatgagcaacctatgagaatttcct

SEQ ID NO: 255998 - DNA, 75 bp, Artificial Sequence
  Synthetic
tccgggtctttgagtggtgcaaccctatatgctcacctatcacagccacagctagattccattcctgcagatgtg

SEQ ID NO: 255999 - DNA, 75 bp, Artificial Sequence
  Synthetic
tatatgctcacctatcacagccacagctagattccattcctgcagatgtgggaattgcccagcaaaatgtgatca

SEQ ID NO: 256000 - DNA, 75 bp, Artificial Sequence
  Synthetic
tagagggatggatactcgtctgcaacatctggagcaaaaagtagataaggtgcttgcacagggcagcatggtgac

SEQ ID NO: 256001 - DNA, 75 bp, Artificial Sequence
  Synthetic
aaaaaataagcctagaaggatatcttacttctcgactttccaactttgaaaatagaattgatcagtaatcatgaa

SEQ ID NO: 256002 - DNA, 75 bp, Artificial Sequence
  Synthetic
catcgggggaatggaacaccaggatctattacgatacaacgagaatggcgactctcaacaagatgcaaggggcga

SEQ ID NO: 256003 - DNA, 75 bp, Artificial Sequence
  Synthetic
catctggagcaaaaagtagataaggtgcttgcacagggcagcatggtgactcaaatcaaaaacgagttatcaaca

SEQ ID NO: 256004 - DNA, 75 bp, Artificial Sequence
  Synthetic
ggcttttttagttacttgcttaggctttgcagtcttttcatcttctgtatgtgtgaatatcaacatcttgcagca

SEQ ID NO: 256005 - DNA, 75 bp, Artificial Sequence
  Synthetic
tggaaagccattgggtgtgtaatctattgctttggtttgcttaccccggatgttgaagattccgagcgcattgat

SEQ ID NO: 256006 - DNA, 75 bp, Artificial Sequence
  Synthetic
agggaatgatgtcgacagtcaaaatcatggatcctggtaatcccacaggggtcccagttgatgatctaagaagga

SEQ ID NO: 256007 - DNA, 75 bp, Artificial Sequence
  Synthetic
ttatgagactttggggccaccccacattaaccgccagccaagcagcatccaaggtccgagagtccatgtgcgctc

SEQ ID NO: 256008 - DNA, 75 bp, Artificial Sequence
  Synthetic
catggatcctggtaatcccacaggggtcccagttgatgatctaagaaggagttgcagtgatcatgttactattgt

SEQ ID NO: 256009 - DNA, 75 bp, Artificial Sequence
  Synthetic
agttctcatgatgactccactttatatttagatgaacttgcaagaccggtcccaaagcctcgcccaatcaagcag

SEQ ID NO: 256010 - DNA, 75 bp, Artificial Sequence
  Synthetic
atttagatgaacttgcaagaccggtcccaaagcctcgcccaatcaagcagacaaaaccccaacctgtgaaagact

SEQ ID NO: 256011 - DNA, 75 bp, Artificial Sequence
  Synthetic
caagatgataaatgattgtgttgcaaatccccagatcaagcagacatttgagcaaaggttggccaatgcaaatac

SEQ ID NO: 256012 - DNA, 75 bp, Artificial Sequence
  Synthetic
gccatggatcagtttataaaacaggatgagactggtgatttaattgagacaggaatgaatgttgcaaatcatttc

SEQ ID NO: 256013 - DNA, 75 bp, Artificial Sequence
  Synthetic
gccgggctcgatcctcaccttccattgtcgataggggacattttgacactacctggaaaatgtcgtctgtgctca

SEQ ID NO: 256014 - DNA, 75 bp, Artificial Sequence
  Synthetic
atgagactggtgatttaattgagacaggaatgaatgttgcaaatcatttcctgtccgcccccattcagggaacca

SEQ ID NO: 256015 - DNA, 75 bp, Artificial Sequence
  Synthetic
aatccccagatcaagcagacatttgagcaaaggttggccaatgcaaatacagaagaagcactgaacgatatcaag

SEQ ID NO: 256016 - DNA, 75 bp, Artificial Sequence
  Synthetic
gaagtgattcaaagggccagctttgcatatacacttagaagcttataatcatagtggttcatgatttaagaaaaa

SEQ ID NO: 256017 - DNA, 75 bp, Artificial Sequence
  Synthetic
catatacacttagaagcttataatcatagtggttcatgatttaagaaaaaataagcccgaacacaggtgaataca

SEQ ID NO: 256018 - DNA, 75 bp, Artificial Sequence
  Synthetic
tgctatgggagtcggtacagtcctagatgtccaaatgcgaaattacacttatgcacgacctttcctaaatggtta

SEQ ID NO: 256019 - DNA, 75 bp, Artificial Sequence
  Synthetic
cttccgaagaaggcactggagggactcagattcctgagccccttttcgcgcaaacaggacaaggtggtattgtca

SEQ ID NO: 256020 - DNA, 75 bp, Artificial Sequence
  Synthetic
caaatcaagattccccttccaaaacctccagactcagattcccaaaggttgaatgcattccctattgtcatggct

SEQ ID NO: 256021 - DNA, 75 bp, Artificial Sequence
  Synthetic
tcagattcctgagccccttttcgcgcaaacaggacaaggtggtattgtcactaccgtttatcaggatccaactat

SEQ ID NO: 256022 - DNA, 75 bp, Artificial Sequence
  Synthetic
ctccagactcagattcccaaaggttgaatgcattccctattgtcatggctcaggagggtaagggccgactcttgc

SEQ ID NO: 256023 - DNA, 75 bp, Artificial Sequence
  Synthetic
atctggagatccgtctgaccatcaaattacatttgttaacacatatggattcattcgtgctgccccagaaacatc

SEQ ID NO: 256024 - DNA, 75 bp, Artificial Sequence
  Synthetic
cgtatcaaccattacttataagactgcggtgcgacatgcagcactgcaccagagatccccatctcgctggagctt

SEQ ID NO: 256025 - DNA, 75 bp, Artificial Sequence
  Synthetic
gcggtgcgacatgcagcactgcaccagagatccccatctcgctggagcttcgatcactcactctagaaagatctc

SEQ ID NO: 256026 - DNA, 75 bp, Artificial Sequence
  Synthetic
attacatttgttaacacatatggattcattcgtgctgccccagaaacatcagaatttatatcagaatcctctcca

SEQ ID NO: 256027 - DNA, 75 bp, Artificial Sequence
  Synthetic
catgtatgttgtcatttggagcaggaccagttttggatgatcctcagcagatgctaaaagcacttgatcaggctg

SEQ ID NO: 256028 - DNA, 75 bp, Artificial Sequence
  Synthetic
accagttttggatgatcctcagcagatgctaaaagcacttgatcaggctgatataagagtcaggaaaacagcaag

SEQ ID NO: 256029 - DNA, 75 bp, Artificial Sequence
  Synthetic
ccatatggtactcaaggattgtttgcttcatacaccacaaccacctgctttcaagataccggtgacgctagtgtg

SEQ ID NO: 256030 - DNA, 75 bp, Artificial Sequence
  Synthetic
attaatcgtatcccaaatcttttcaagcatcatcagatatcttctgatcacctgattcaggctagctctgacaaa

SEQ ID NO: 256031 - DNA, 75 bp, Artificial Sequence
  Synthetic
agcatcatcagatatcttctgatcacctgattcaggctagctctgacaaatatgtcaaatctccggcaaaactaa

SEQ ID NO: 256032 - DNA, 75 bp, Artificial Sequence
  Synthetic
agctccggtgaagaacccacactgtatttggatgaactagcgaggcctgtccccaagcctcgtcctgcaaagcag

SEQ ID NO: 256033 - DNA, 75 bp, Artificial Sequence
  Synthetic
gcggtgcgacatgcagcactgtaccagagatccttctttcgctggagtttcgatcactcactctagaaagatctc

SEQ ID NO: 256034 - DNA, 75 bp, Artificial Sequence
  Synthetic
tgccacctttttgtctgtgacagtgtgctctgcatcacttaaattcagagttgcacgtccactgttggcagcacg

SEQ ID NO: 256035 - DNA, 75 bp, Artificial Sequence
  Synthetic
tcctaaccaaaacgcacagtcacaagtgggtgactgggatgagtaaatcactgacatgatcaaactacccaaaat

SEQ ID NO: 256036 - DNA, 75 bp, Artificial Sequence
  Synthetic
cgatcactcactctagaaagatctccagttgggacaagtcccaatccatcatgcgagaacaagctgcatttaaat

SEQ ID NO: 256037 - DNA, 75 bp, Artificial Sequence
  Synthetic
tgctctgcatcacttaaattcagagttgcacgtccactgttggcagcacgatcaagactagtcagagcagtccaa

SEQ ID NO: 256038 - DNA, 75 bp, Artificial Sequence
  Synthetic
gtaagaaggattcccctatggcaaaaagtatgctgactgatcccgatggtgagggttgtattgcatctgtttggt

SEQ ID NO: 256039 - DNA, 75 bp, Artificial Sequence
  Synthetic
cacagctgactgcccaaatccactacattccattcatatttagtctttaagaaaaaattaggcccggaaagaatt

SEQ ID NO: 256040 - DNA, 75 bp, Artificial Sequence
  Synthetic
aagtatgctgactgatcccgatggtgagggttgtattgcatctgtttggttccacctctgtaacttgtgcaaagg

SEQ ID NO: 256041 - DNA, 75 bp, Artificial Sequence
  Synthetic
cgagacatcatacgaagcgccatatgaattcaccaggaattccaaactcacgggagaatccatgaactgagggcc

SEQ ID NO: 256042 - DNA, 75 bp, Artificial Sequence
  Synthetic
atacctaacagaattaacaacagtgtttcagccacaattaattaatccggcattgtcaccgattagtatacaagc

SEQ ID NO: 256043 - DNA, 75 bp, Artificial Sequence
  Synthetic
gagaactactttgctgccaagtgcaaaaagatgaatctcactgttagtgttggagatatgtggggaccaactatt

SEQ ID NO: 256044 - DNA, 75 bp, Artificial Sequence
  Synthetic
tcggagaacaagccagataccttgctttgttggaggctccccaaataatggactttgcacccgggggctacccat

SEQ ID NO: 256045 - DNA, 75 bp, Artificial Sequence
  Synthetic
ataagcacgaacacaagtccaatccaaccatagcagcaatggctggatcacagatcaaaattcctcttccaaagc

SEQ ID NO: 256046 - DNA, 75 bp, Artificial Sequence
  Synthetic
cgaacctgcttccgaatattggtactatctgtacaagctgttacccttatattagttattgtcactttaggtgag

SEQ ID NO: 256047 - DNA, 75 bp, Artificial Sequence
  Synthetic
aaaagatgaatctcactgttagtgttggagatatgtggggaccaactattcttgttcatgcaagtggccacattc

SEQ ID NO: 256048 - DNA, 75 bp, Artificial Sequence
  Synthetic
ctcacgtggttgggtctgccaccctattcaccaatcatctccctcacttgcaaagactctctggtcctctgggtg

SEQ ID NO: 256049 - DNA, 75 bp, Artificial Sequence
  Synthetic
attcaccaatcatctccctcacttgcaaagactctctggtcctctgggtgcgagattaagggtgctagtgccata

SEQ ID NO: 256050 - DNA, 75 bp, Artificial Sequence
  Synthetic
caggaaggcaaaggacgactcctcagacagatcagacttaggaaaatactatcaggggacccgtctgatcagcaa

SEQ ID NO: 256051 - DNA, 75 bp, Artificial Sequence
  Synthetic
acgcgaaaaaatgcataacaaaactatcaacctgaaaaagttaggacaagtgaagattgctagtcccaaagacca

SEQ ID NO: 256052 - DNA, 75 bp, Artificial Sequence
  Synthetic
tgaagattgctagtcccaaagaccagaatcatgggctgtaatgtgatgatggagcttgattatggtggacgagct

SEQ ID NO: 256053 - DNA, 75 bp, Artificial Sequence
  Synthetic
gtttgtcacagaccacatgttcctggacttacaactcttcctctctagctttaaaacatttctcacagtttttaa

SEQ ID NO: 256054 - DNA, 75 bp, Artificial Sequence
  Synthetic
gcatggctggcattccacataaccaactttgataggtcagatttggaaactatcctaagaggtgctagggtgtgc

SEQ ID NO: 256055 - DNA, 75 bp, Artificial Sequence
  Synthetic
ctttgcatatcttaaggtaggatcaaacatagaggagataacaggtaatcaggcaaatttactagaactattaga

SEQ ID NO: 256056 - DNA, 75 bp, Artificial Sequence
  Synthetic
aatacatggcaagatcagagactctccgtgtaccttgtgggaagggattgcaatttgttaagaccatttgtgcaa

SEQ ID NO: 256057 - DNA, 75 bp, Artificial Sequence
  Synthetic
ccttggttactggaaaaacatgtataaagttttcagtgagacaaaagtgagattagctttattaaagcaagattt

SEQ ID NO: 256058 - DNA, 75 bp, Artificial Sequence
  Synthetic
gctgccaaatttatccataatactaggagaggccaaacattaacacattggttcacaaaaaatatcgtgtttagt

SEQ ID NO: 256059 - DNA, 75 bp, Artificial Sequence
  Synthetic
gagtttcaactcagtgaaaaattcctccagctttagacattggtttataaactcactacaggaagttcagtgtac

SEQ ID NO: 256060 - DNA, 75 bp, Artificial Sequence
  Synthetic
tctacagggcaagagacagagcctcccattgaccccacatgtgagctgttggtagagctgatcagtggttaagat

SEQ ID NO: 256061 - DNA, 75 bp, Artificial Sequence
  Synthetic
tagtgtcccttgggttgttaatgtaactagaaaccccacacaccttaaaggtgtgttgcaatatatgaaaatgat

SEQ ID NO: 256062 - DNA, 75 bp, Artificial Sequence
  Synthetic
gacagcacattatgtagttaattaaaacaaagggtaggacaagtcctaatgtccacagctatgaacaagttcact

SEQ ID NO: 256063 - DNA, 75 bp, Artificial Sequence
  Synthetic
agagtcaggcatgattcagggttactcagctaacatcagttcagtcctatcaatcccatacaactatcctgacat

SEQ ID NO: 256064 - DNA, 75 bp, Artificial Sequence
  Synthetic
cagaccatctctaaacctgccactatcttgaatatttcagacagtgaagagtcgggcgatgaggcaggggtgggc

SEQ ID NO: 256065 - DNA, 75 bp, Artificial Sequence
  Synthetic
ggcgcacatgatgacaaagattattagaaatagaggtcatatgtcttatgattatcccaagatgaagaagagttt

SEQ ID NO: 256066 - DNA, 75 bp, Artificial Sequence
  Synthetic
aaggtgtcccgtaccacacagagctcagagaggtggcttgatttgctcattgaaaagttccagccgagcctacaa

SEQ ID NO: 256067 - DNA, 75 bp, Artificial Sequence
  Synthetic
aacgttctcgatgacggacatgtcagattcttacatgctaaatctcttccctaaagttgagtgctcatatatgag

SEQ ID NO: 256068 - DNA, 75 bp, Artificial Sequence
  Synthetic
aacatcactagatacatcaactggaacttcatcaggatctgcaatgataggcttaaaaaagaaaaaatggggtac

SEQ ID NO: 256069 - DNA, 75 bp, Artificial Sequence
  Synthetic
tggttatttagataaattagatgatacattgctactgctcaaaaaaccacccgtgggtaggaaagtaccttctgt

SEQ ID NO: 256070 - DNA, 75 bp, Artificial Sequence
  Synthetic
attgaggccaagcaatatgtggaagacatggcttggatggtgatagcatctgaggcagacagcattgagtggaag

SEQ ID NO: 256071 - DNA, 75 bp, Artificial Sequence
  Synthetic
agcactaccctggcatcactgcaaccgatacaattttgtgttcagttccacaggttgtaaggtatctgtaataga

SEQ ID NO: 256072 - DNA, 75 bp, Artificial Sequence
  Synthetic
tgcataaggaggcaggagaaagtgactggggtgaaatacccaaagttcttctttgtacaacacaaagaggactgg

SEQ ID NO: 256073 - DNA, 75 bp, Artificial Sequence
  Synthetic
tatgttacctaagcatttccagagaagtaatttaaaggttatatgtttcataggtgaaggtgctggaaaccttat

SEQ ID NO: 256074 - DNA, 75 bp, Artificial Sequence
  Synthetic
attgagtgcacaggatgcattccgtacccaggccatgacttgatctatgatgaggatgatgatgactgagctgac

SEQ ID NO: 256075 - DNA, 75 bp, Artificial Sequence
  Synthetic
gttaagagcagtcttagaagtaggtgggaatattaaacttatttacaggagcctaaaagaccctgatgaccatca

SEQ ID NO: 256076 - DNA, 75 bp, Artificial Sequence
  Synthetic
tcagatcactccaaccagcagagagatccaccacctatagcaagtgatgtagtatttagtctatgattagttata

SEQ ID NO: 256077 - DNA, 75 bp, Artificial Sequence
  Synthetic
tgttcctgtggagtttcttagattaaaaccttgttatccttacatagatacaggtggatcactgagtctggcatc

SEQ ID NO: 256078 - DNA, 75 bp, Artificial Sequence
  Synthetic
gaaaaacattaggataaatacacatcctaggccgggccaaaatgtctctagacagattgaagctcaatgatgtct

SEQ ID NO: 256079 - DNA, 75 bp, Artificial Sequence
  Synthetic
aactgatgctactaataaagcacattgggattacctgcatttacattggacagatcctttaaatttaatagtatg

SEQ ID NO: 256080 - DNA, 75 bp, Artificial Sequence
  Synthetic
caaacaaggatagcctgctgtccaactgcaaatacagtgttaccagatccacaggcgatgtaaccagtgtgtctg

SEQ ID NO: 256081 - DNA, 75 bp, Artificial Sequence
  Synthetic
tgatgctgaaattagtggtgttaagcactggttgaaaatattgcatagatggtatgagcacatgaccagctgtaa

SEQ ID NO: 256082 - DNA, 75 bp, Artificial Sequence
  Synthetic
gtcatgctatgcagaaagcccttgcaaggacactcggcatgttcttacttactgccttcaaccgttgcgaagaag

SEQ ID NO: 256083 - DNA, 75 bp, Artificial Sequence
  Synthetic
gcactgccttaagtcagagcatgataaatatttgattatcaaatatcatgcacaggatgaccttatagacttacc

SEQ ID NO: 256084 - DNA, 75 bp, Artificial Sequence
  Synthetic
tggcagaaatagggctccaatatgccatgtccttgctaggcagagatgatagcatcaagatattaagagaagccg

SEQ ID NO: 256085 - DNA, 75 bp, Artificial Sequence
  Synthetic
tcatggtgtgcgcctattgaagtgcaatatctgtcttggtagtaaactgtcaggctcagagtcttacctgcttat

SEQ ID NO: 256086 - DNA, 75 bp, Artificial Sequence
  Synthetic
gctacaatgtaaaatgtgtggacacacagctcaaggactttacaatcaaattacaaggaaaggaatacaaaatac

SEQ ID NO: 256087 - DNA, 75 bp, Artificial Sequence
  Synthetic
aggattggggttatccaataaattacctgtgtacagcgaggtattgcactctaaactacttctagcagaatgtca

SEQ ID NO: 256088 - DNA, 75 bp, Artificial Sequence
  Synthetic
aagtcctagatatagtgggaatagatgcagccaatttagctgatctagagatacaagccagaggagtggtagcaa

SEQ ID NO: 256089 - DNA, 75 bp, Artificial Sequence
  Synthetic
ccaattccatcatcctaaatatctggatgtatcaggtattaacactaacattaagtctcttatacctatgctgga

SEQ ID NO: 256090 - DNA, 75 bp, Artificial Sequence
  Synthetic
aagaactcaaaacaggagccaggctacctgacaatcagaggcatgatgcaccagattgtggtgtgatagttctct

SEQ ID NO: 256091 - DNA, 75 bp, Artificial Sequence
  Synthetic
ttaccccatcacttataataagattacaacattattagaatctgttagagaattgtcttcaaataaaaataaaaa

SEQ ID NO: 256092 - DNA, 75 bp, Artificial Sequence
  Synthetic
gtattgcagcattagttgtttccaaattagctgcaggggacaggggaggacttgatgctgtggaaagaagggctt

SEQ ID NO: 256093 - DNA, 75 bp, Artificial Sequence
  Synthetic
tacaatgtggattggacgaaaccctgtttaccataacaaatggctaaagagaaagtattttaacatacttaaatg

SEQ ID NO: 256094 - DNA, 75 bp, Artificial Sequence
  Synthetic
taaatgtgctgaaagccgagaaagccaggtaccccaacatggaggtcaagcagatagctgaaagtttttatgatc

SEQ ID NO: 256095 - DNA, 75 bp, Artificial Sequence
  Synthetic
gttaaagtattgtattgaattaccagcttttagaatggattataattcatttgagaggatagaaatgctttaccc

SEQ ID NO: 256096 - DNA, 75 bp, Artificial Sequence
  Synthetic
tgtttgaaaggaagccttattacattgatgtcttcatcacttttggcctggcccagtctagtgtcaagggaggca

SEQ ID NO: 256097 - DNA, 75 bp, Artificial Sequence
  Synthetic
caacttaagggatttagtggattctgtgtcaacaagtgaactgaaaaaagttataaaagtcacagggattctttt

SEQ ID NO: 256098 - DNA, 75 bp, Artificial Sequence
  Synthetic
gcaaagttgaggggctgttttcaggtctcttcatgaatgcatacggggcaggacaagttatgctgaggtggggtt

SEQ ID NO: 256099 - DNA, 75 bp, Artificial Sequence
  Synthetic
ccgatctaacacaatgtaaattaatatgccaatgctaacatgccatccccactactttttttgttcaatcactct

SEQ ID NO: 256100 - DNA, 75 bp, Artificial Sequence
  Synthetic
tactggcaaaatctgtcaagaacatcatgctaggccatgctagtgtacaagctgagatggaacaggtggttgagg

SEQ ID NO: 256101 - DNA, 75 bp, Artificial Sequence
  Synthetic
cagtctagacatgtgagaagatcccaaacccaactgcacccctcccactcgaaatcagttgtagcctcagcagct

SEQ ID NO: 256102 - DNA, 75 bp, Artificial Sequence
  Synthetic
tttacgaatatgctcagaagcaaggaggggaggcaggattctatcacatcagaaataatccaaaagcttcacttc

SEQ ID NO: 256103 - DNA, 75 bp, Artificial Sequence
  Synthetic
ccatctgccatgatctctgaccagcagcaaatgtattattattttaatttgtctatagttaacaaaaaattgata

SEQ ID NO: 256104 - DNA, 75 bp, Artificial Sequence
  Synthetic
tctctttgaccaattgtcctaatttcaccagtgttgtgcttggcaatgctgcaggtttaggcatcatagggtcat

SEQ ID NO: 256105 - DNA, 75 bp, Artificial Sequence
  Synthetic
tctcacaggttgtaaacatagttcttttataattattgttagttaaactattgtgtttgacttcttttgggtatt

SEQ ID NO: 256106 - DNA, 75 bp, Artificial Sequence
  Synthetic
acgcgaaaaaatgcataacaaaactatcaacctgaaaaaagttaggacaagtgaagattgctagtcccaaagacc

SEQ ID NO: 256107 - DNA, 75 bp, Artificial Sequence
  Synthetic
ataagggtgctcctaggaatagagaactctttgatgctgccaaagattatgcagaaagattaaaggacaacaatg

SEQ ID NO: 256108 - DNA, 75 bp, Artificial Sequence
  Synthetic
tgtaaacatagttcttttataattattgttagttaaactattgtgtttgacttcttttgggtatttttttcccgt

SEQ ID NO: 256109 - DNA, 75 bp, Artificial Sequence
  Synthetic
taattaactacagtgcattaaacttgactgcagaagaaagagagctgatcagccagcagctgaacattgttgatg

SEQ ID NO: 256110 - DNA, 75 bp, Artificial Sequence
  Synthetic
acactcctgatgatgatatttaattaaaactggaaaatgtaggataaatatggagaaattcgcccccgaatttgt

SEQ ID NO: 256111 - DNA, 75 bp, Artificial Sequence
  Synthetic
tggcgaggatgctaacaagaaggcagaggagtttctcaaacatagatccttcccttcggaaaaaccactagctgg

SEQ ID NO: 256112 - DNA, 75 bp, Artificial Sequence
  Synthetic
tataccgaacactgccactcatgtcaccaaatataacatgccccctatattgcgtagctcattcaaactcccttc

SEQ ID NO: 256113 - DNA, 75 bp, Artificial Sequence
  Synthetic
tgcgtagctcattcaaactcccttccccgagagttgctgcaaatcttactaaaccctctactccccctaccactc

SEQ ID NO: 256114 - DNA, 75 bp, Artificial Sequence
  Synthetic
caccacccacacctccccagaacaaggaagagcagcccaaagagtctgatgttgacattgagactatacatgtct

SEQ ID NO: 256115 - DNA, 75 bp, Artificial Sequence
  Synthetic
ggaagagcagcccaaagagtctgatgttgacattgagactatacatgtctatggggttcctgacaatccggaaca

SEQ ID NO: 256116 - DNA, 75 bp, Artificial Sequence
  Synthetic
cagcaagaagccatgctgctcagatgataccgatactaagaaaactaggaagccgatggtcacctttgtggaacc

SEQ ID NO: 256117 - DNA, 75 bp, Artificial Sequence
  Synthetic
agccgatggtcacctttgtggaacccgaagagaaatttgtcggattgggagctagcttgtacaaggagaccatgc

SEQ ID NO: 256118 - DNA, 75 bp, Artificial Sequence
  Synthetic
aaacctttgctgctgatggttatgatgaagaaagcaacctatcgtttgaggagactaaccaagagccgggttctt

SEQ ID NO: 256119 - DNA, 75 bp, Artificial Sequence
  Synthetic
catctgtagaacaaagactagatagaatagaggagaaattgtcctacataataggccttttaaacaccataatgg

SEQ ID NO: 256120 - DNA, 75 bp, Artificial Sequence
  Synthetic
tagcgactgctggacctaccactgctagagatgagattagagatgcccttataggcactagagaagaacttattg

SEQ ID NO: 256121 - DNA, 75 bp, Artificial Sequence
  Synthetic
agatgatcaagtctgacatcttgactgtcaatgacagaatagtggccatggagaagctcagagatgaggaatgct

SEQ ID NO: 256122 - DNA, 75 bp, Artificial Sequence
  Synthetic
ccagagctgacactgatgatggatcagcctgttatttaacagacagagcaaggatactagataagatagtgtcca

SEQ ID NO: 256123 - DNA, 75 bp, Artificial Sequence
  Synthetic
gcaatgctgaagaggctaaggaagatttggatgttgatgacatcatgggcattaatttttagttaattaaaataa

SEQ ID NO: 256124 - DNA, 75 bp, Artificial Sequence
  Synthetic
caacaggacaaataatggaggcctacttggtagagatgtaccatggtgtcccatatacagctgcagtacagctaa

SEQ ID NO: 256125 - DNA, 75 bp, Artificial Sequence
  Synthetic
acttggttgaaaaacattcagccaacatatcactaactgtgtggataccgatgtttcaaacatctctaccaaaga

SEQ ID NO: 256126 - DNA, 75 bp, Artificial Sequence
  Synthetic
actccgttatggacctgctacatgatgttacagtcatttgtacacagatatcaacagtgcatggtcccatgatca

SEQ ID NO: 256127 - DNA, 75 bp, Artificial Sequence
  Synthetic
aggtagatctgagctcttccaatgcaggtttagctaccatgccaaggcaattcttgataaatgctatcatagctt

SEQ ID NO: 256128 - DNA, 75 bp, Artificial Sequence
  Synthetic
tggatgactggggcaacatggattacgaagtgcctgttgcttttgataaaaagagcttctgtgtgacaattctta

SEQ ID NO: 256129 - DNA, 75 bp, Artificial Sequence
  Synthetic
agcctaaaaacatgctttacactgtacccagcattactcccactaatcgacctactcatgagctgatagctgtct

SEQ ID NO: 256130 - DNA, 75 bp, Artificial Sequence
  Synthetic
gctctttccataacagggtaacattaaagtcattcaatatacctgtcttcatcagagcactgtctatcagacagc

SEQ ID NO: 256131 - DNA, 75 bp, Artificial Sequence
  Synthetic
aggaccttgatagtgtggagcaggctataagctccgatgtggaccatgctataacaacagctagggtggctccct

SEQ ID NO: 256132 - DNA, 75 bp, Artificial Sequence
  Synthetic
atgcagggcttacacttgtgatcaacatcacatccaccaaaggagcattcaaactgctaaaggcaggtagtcaga

SEQ ID NO: 256133 - DNA, 75 bp, Artificial Sequence
  Synthetic
ttcttgcagaactgggtccctatctgactcaggtgagcctacatgatgtgattatgaactggaaacatacaggca

SEQ ID NO: 256134 - DNA, 75 bp, Artificial Sequence
  Synthetic
cttcctacatactcaagagctcctcaacaagtggatgaaaaagagaaagtcaccattgatcagctcaatccacaa

SEQ ID NO: 256135 - DNA, 75 bp, Artificial Sequence
  Synthetic
ctacaaccccacgatttcacacagcacaacaaccaccgccaccaacatccacatgacaaccacacatacacaccc

SEQ ID NO: 256136 - DNA, 75 bp, Artificial Sequence
  Synthetic
acatacatatatacacatatcttagttaaataaaatcaggataaataatggatcctaacatgacctcataccaga

SEQ ID NO: 256137 - DNA, 75 bp, Artificial Sequence
  Synthetic
tcacttttgagatcaacatgaccagcagccgcattggcacatatattacactagccctaacagctcttctccttg

SEQ ID NO: 256138 - DNA, 75 bp, Artificial Sequence
  Synthetic
catgtgccgtcatcaacacagtgtgtgcgctgataatggcctgcagcagtagaagcattgctacatcaggcattg

SEQ ID NO: 256139 - DNA, 75 bp, Artificial Sequence
  Synthetic
tcagcagccaatgcacagttcatcccaatcaccctccaccaagttatggcgtcaatgtaactggtctgccgggta

SEQ ID NO: 256140 - DNA, 75 bp, Artificial Sequence
  Synthetic
acctacactcaaggaacaccacacaacaccataaacaacagaaattatccttcaataaaccccaggccagacagc

SEQ ID NO: 256141 - DNA, 75 bp, Artificial Sequence
  Synthetic
cagcatcctgacacatttaggactgttgtaaaaagtgaaccaaatgtgtaagcttattgcaggtgtgctcacaag

SEQ ID NO: 256142 - DNA, 75 bp, Artificial Sequence
  Synthetic
tttaccctgctagatgattcaatcagcctttgcagtatgtcgtctagttaacaaaaaattaggataagtactatc

SEQ ID NO: 256143 - DNA, 75 bp, Artificial Sequence
  Synthetic
ccccgagagttgctgcaaatcttactgaaccctctgctccccctaccactccaccacccacacctccccagaaca

SEQ ID NO: 256144 - DNA, 75 bp, Artificial Sequence
  Synthetic
ctattggaatcaaatgagacctgtagagcagctcatacaagagaactactagttgacttcacttagtatgggaag

SEQ ID NO: 256145 - DNA, 75 bp, Artificial Sequence
  Synthetic
tgttgacattgagactatgcatgtctgtaaggttcctgacaatccggaacacagcaagaagccatgctgctcaga

SEQ ID NO: 256146 - DNA, 75 bp, Artificial Sequence
  Synthetic
accaatttgaactttgagagaactcagcatcctgacacatttaggactggtgtaaaagtgaaccaaatgtgtaag

SEQ ID NO: 256147 - DNA, 75 bp, Artificial Sequence
  Synthetic
cttattgcaggtgtgctcacaagtgctgctgtggcagtttgtgtgggggtcataatgtattctgttttcacatca

SEQ ID NO: 256148 - DNA, 75 bp, Artificial Sequence
  Synthetic
ccgaggagaaatttgtcggattgggagctagcttgtacagggagaccatgcagacctttgctgctgatggttatg

SEQ ID NO: 256149 - DNA, 75 bp, Artificial Sequence
  Synthetic
aaccacaaggccaactccacgcagaatgccacgacccggaacagcacatccacccctccccaaccaaccgccggt

SEQ ID NO: 256150 - DNA, 75 bp, Artificial Sequence
  Synthetic
ctgcccaccacagagcaagggaccatccccagattcaccaaaccccccaccaaaaccgccacccaccatgagatc

SEQ ID NO: 256151 - DNA, 75 bp, Artificial Sequence
  Synthetic
acagagcccgtcaaaatggcaacaccttcagaggatccctaccaatgctccagcaatggttatttggaccgacct

SEQ ID NO: 256152 - DNA, 75 bp, Artificial Sequence
  Synthetic
gatttacctgaaaatttcaaactcgtattggatgttatatgcaagcctccaggtcctgaacatcacaacaccagc

SEQ ID NO: 256153 - DNA, 75 bp, Artificial Sequence
  Synthetic
tgttatgagaaacgtgaaatcaacccaggaagtgtttgccctgatcttgtaacaatgaaggcaaacatgggctta

SEQ ID NO: 256154 - DNA, 75 bp, Artificial Sequence
  Synthetic
aacaatggtggtggggaggatgctgcaccttatatagaggttaccaccctttctacgtactccaacaaaagggca

SEQ ID NO: 256155 - DNA, 75 bp, Artificial Sequence
  Synthetic
atgtgtgtccacaatgggtgtgatcaaggcttctgtttcttcctttctggtttaagcactgatcaggagagagct

SEQ ID NO: 256156 - DNA, 75 bp, Artificial Sequence
  Synthetic
gtgctagagcttggaggtcaacaggctatcatggagttgcattatgattcctactggaaacactattggagtaac

SEQ ID NO: 256157 - DNA, 75 bp, Artificial Sequence
  Synthetic
tctaattgtgttgttcccagaacaaactgcaacctgacagaccaaactgagattttgtttcctaggtttaacaac

SEQ ID NO: 256158 - DNA, 75 bp, Artificial Sequence
  Synthetic
aagaatcagtctcagtgtaccacctgtgcagattcagctggcctagataacaaattttatctcacatgtgatggg

SEQ ID NO: 256159 - DNA, 75 bp, Artificial Sequence
  Synthetic
cttttaagaaccctccctctagttggactacccagcctaagtcctcaggcttacaaagctgtacccacacaaact

SEQ ID NO: 256160 - DNA, 75 bp, Artificial Sequence
  Synthetic
acaggcaccaccacggcaccaacatcagagtcgaggcacccaacccctgcacccaggaggtccaaacctctcagt

SEQ ID NO: 256161 - DNA, 75 bp, Artificial Sequence
  Synthetic
cggaagaagagagctttatgtggtgtagactcaagcagagaacccaaaccaacaatgccttactggtgtcctatg

SEQ ID NO: 256162 - DNA, 75 bp, Artificial Sequence
  Synthetic
ctccaattatttccaaggaggtctaattcttaagtgacctattcctgaattaacttcagaataagtaccaacctt

SEQ ID NO: 256163 - DNA, 75 bp, Artificial Sequence
  Synthetic
atcagtagttaatgaaaactaagctttgatataataggacaaatatgattcctggcaggatctttctagtccttc

SEQ ID NO: 256164 - DNA, 75 bp, Artificial Sequence
  Synthetic
tggtgatcttcaacaccaagccaattcacccaaatacattaacagaaaaattctatgagtccacatgtagtgttg

SEQ ID NO: 256165 - DNA, 75 bp, Artificial Sequence
  Synthetic
agactgcaggttataagagtgcccttagaacaggttggcatatgacagttatgtcaattaagttgtctcaaataa

SEQ ID NO: 256166 - DNA, 75 bp, Artificial Sequence
  Synthetic
atattgagtcatgcaagagcagcaactcgttattggctcatgagcttgcaatctatagtagtgcagtggatgaat

SEQ ID NO: 256167 - DNA, 75 bp, Artificial Sequence
  Synthetic
tgagaacgttatcatccaatgccttgaagtccaaaaggaagaagaggttcctcggtttgattcttggtctcggag

SEQ ID NO: 256168 - DNA, 75 bp, Artificial Sequence
  Synthetic
ggatcctaacatgacctcacaccagatcaccctcgagatcaacatgaccagcagccgtattggcacatacactac

SEQ ID NO: 256169 - DNA, 75 bp, Artificial Sequence
  Synthetic
ctgcagtcactgccggggtggctttagccaagacagtgcaacttgaaagtgagattgcattgattagagatgcag

SEQ ID NO: 256170 - DNA, 75 bp, Artificial Sequence
  Synthetic
accagccccaacagctcttctccttgcatgtgccgtcatcaacacagtgtgtgcgctgataatggcctgcagcag

SEQ ID NO: 256171 - DNA, 75 bp, Artificial Sequence
  Synthetic
tgagaaatacaaatgaggctgttgttagcctaaccaacggcatgtcagtgttggctaaagtggtggatgatttga

SEQ ID NO: 256172 - DNA, 75 bp, Artificial Sequence
  Synthetic
gtgcgctgataatggcctgcagcagtagaagcactgccacatcaggcattgtcagcagccaatgcacagttcatc

SEQ ID NO: 256173 - DNA, 75 bp, Artificial Sequence
  Synthetic
aaaacttcatatctaaagaattactcccaaaaataaaccgagtctcttgtgatgtgcacgacatcactgccgtca

SEQ ID NO: 256174 - DNA, 75 bp, Artificial Sequence
  Synthetic
ccaatcaccctccaccaagttatggcgtcaatgtaactggtctgccgggtaacctatactcaaggaacactacat

SEQ ID NO: 256175 - DNA, 75 bp, Artificial Sequence
  Synthetic
ttagattccaacagctcaacaaaagacttttggaagtatctcgtgaattttcatctaatgcaggattaacacaca

SEQ ID NO: 256176 - DNA, 75 bp, Artificial Sequence
  Synthetic
aacattataaataacagaaattatccttcaataaaccccaggccagacagctttaccctgctagacgattcaatc

SEQ ID NO: 256177 - DNA, 75 bp, Artificial Sequence
  Synthetic
ctgtttcatcttttatgttaacagaccgggaactcacctccattgtaggcggcatggctgtttcagcaggccaaa

SEQ ID NO: 256178 - DNA, 75 bp, Artificial Sequence
  Synthetic
agcccttgcagtatgtcgtctagttaacaaaaaattaggataagtactatcctattggaaccaaacgagacctgt

SEQ ID NO: 256179 - DNA, 75 bp, Artificial Sequence
  Synthetic
aagagataatgctatctagcagagctataatgagaagaaatgggttagcaatattaagttcagtcaacgctgaca

SEQ ID NO: 256180 - DNA, 75 bp, Artificial Sequence
  Synthetic
cctattggaaccaaacgagacctgtagagcagctcacacaagagaaccacaagctgacttcacctagtatgggaa

SEQ ID NO: 256181 - DNA, 75 bp, Artificial Sequence
  Synthetic
cactggtttatgtaatacaactcccattatttggtgttatggacacagattgttgggtaataagaagttctatag

SEQ ID NO: 256182 - DNA, 75 bp, Artificial Sequence
  Synthetic
ggaacttagaagtgagtggcagcattaccaatttgaactttgagagaactcagcatcctgacacatttaggactg

SEQ ID NO: 256183 - DNA, 75 bp, Artificial Sequence
  Synthetic
actgtcataacatagcagacaagtatgcttgtttggctagagctgataatggctggtattgtcacaatgctggct

SEQ ID NO: 256184 - DNA, 75 bp, Artificial Sequence
  Synthetic
ggctggtattgtcacaatgctggctcattatcatacttcccgtcgccaactgattgtgagatccacaatgggtat

SEQ ID NO: 256185 - DNA, 75 bp, Artificial Sequence
  Synthetic
gttttctgtgacactctaaaaagtctaactgtacctgtaacatcacgagaatgcaactcaaacatgtataccact

SEQ ID NO: 256186 - DNA, 75 bp, Artificial Sequence
  Synthetic
aactacgattgtaagatttccacaagtaaaacttatgtgagtacagcggtactgactacaatgggttgcttggta

SEQ ID NO: 256187 - DNA, 75 bp, Artificial Sequence
  Synthetic
tcttgttatggtcataacagttgcacagtcatcaataatgacaaaggtataataaggactctgccagatggttgc

SEQ ID NO: 256188 - DNA, 75 bp, Artificial Sequence
  Synthetic
cactacatctccaacaaaggtgtggacagggttcaagtaggtaacactgtttactatcttagcaaagaagttggc

SEQ ID NO: 256189 - DNA, 75 bp, Artificial Sequence
  Synthetic
aagtcaattgttgtcagaggggaaccattggtcttgaaatatgaccctttgagtttccctgacgataaatttgat

SEQ ID NO: 256190 - DNA, 75 bp, Artificial Sequence
  Synthetic
gttgctataagagatgtggagcatagcatcaatcagacacgcacattcttgaaggcctctgatcagttattggac

SEQ ID NO: 256191 - DNA, 75 bp, Artificial Sequence
  Synthetic
ttaagtgaaaacagagagaataaaaatttaaacaagtcatatatactaacaactctgctcttcgttgtaatgctt

SEQ ID NO: 256192 - DNA, 75 bp, Artificial Sequence
  Synthetic
attataataatggctgtcatagggttcattctgtataaggtattgaaaatgatcagagacaacaagttgaaatcc

SEQ ID NO: 256193 - DNA, 75 bp, Artificial Sequence
  Synthetic
aaaagtacacctggcctcacagttttatcatgacaattgtaccaaaccataattgagttagttaattaaaaactt

SEQ ID NO: 256194 - DNA, 75 bp, Artificial Sequence
  Synthetic
aggataagtgacaatccagacccaacacctctttcaactctcaaggataaggtaggatgagtgtgagaccttgca

SEQ ID NO: 256195 - DNA, 75 bp, Artificial Sequence
  Synthetic
aatttgaggttcaagggttttgttccagagggaggaattgcaagtatagtcataaatattgggaatggcctttga

SEQ ID NO: 256196 - DNA, 75 bp, Artificial Sequence
  Synthetic
aaactcttatgctcaggcagaactacatgcttaataggatttataggttcctcgacaccaacacagatgcaatgt

SEQ ID NO: 256197 - DNA, 75 bp, Artificial Sequence
  Synthetic
cagatgtcagcggatttgatgcaccacaaaggactgctgagtatgccttgggaaccataggtgtgctgaaaagtt

SEQ ID NO: 256198 - DNA, 75 bp, Artificial Sequence
  Synthetic
acctggaaaaaactaacaacatcactaaatcaatagcttgtggcagtttgatcactgtattgcagaacttggatg

SEQ ID NO: 256199 - DNA, 75 bp, Artificial Sequence
  Synthetic
ttggtctagtaatacaagcaagagatagcaacactgaggacaccaattacttgagaagttgcaacactatactgt

SEQ ID NO: 256200 - DNA, 75 bp, Artificial Sequence
  Synthetic
cttatatagacaagatacacaagaagagacaaattattcacattctcaaaagactgccagtaggagtactatgca

SEQ ID NO: 256201 - DNA, 75 bp, Artificial Sequence
  Synthetic
atctgatccaatctgtcatctccatcgaggagaagataaattcttctatgaaaacagaatgataaggctgcctaa

SEQ ID NO: 256202 - DNA, 75 bp, Artificial Sequence
  Synthetic
atactatccagccatactgcataagatgtatattattagagtaaatagaaacctcacttacgatgggtctggacc

SEQ ID NO: 256203 - DNA, 75 bp, Artificial Sequence
  Synthetic
atccacaataatagatgcaggaaagtctgtggtgtggaatcgtgttgatgtgatagcttgtgtgaaagaggcctt

SEQ ID NO: 256204 - DNA, 75 bp, Artificial Sequence
  Synthetic
gtgctgcatagaattcagctggaataaccaagtgatcatagactttgattatagccaggccagatgatgtggact

SEQ ID NO: 256205 - DNA, 75 bp, Artificial Sequence
  Synthetic
gtattcctttttttgtcagtaatcagttattaacccaaaattgttaattatgtagactttaagttaactaacttc

SEQ ID NO: 256206 - DNA, 75 bp, Artificial Sequence
  Synthetic
atgttaattcaatagttatataaaaaaataattaattaggatcaatatggatcctattgatgaacaagaagttaa

SEQ ID NO: 256207 - DNA, 75 bp, Artificial Sequence
  Synthetic
tgtgtacttgccggatagctacttaaagggtgttatatcttttagtgaaactaatgctcttggcagctgtatcat

SEQ ID NO: 256208 - DNA, 75 bp, Artificial Sequence
  Synthetic
tggtagacctttcttgaaggatgactttactgccactacttcaatccgtaaccccctaattgaacataaaagaat

SEQ ID NO: 256209 - DNA, 75 bp, Artificial Sequence
  Synthetic
aagggacactaaattagtaaaaaatattgtttcaaaccctcaatataggttagtggagcctctccaaatgcagca

SEQ ID NO: 256210 - DNA, 75 bp, Artificial Sequence
  Synthetic
tgagctcttgagtgtactatcgcccaatttcatattgcacactgccaacttaagaaaaattatacaaagaagtgt

SEQ ID NO: 256211 - DNA, 75 bp, Artificial Sequence
  Synthetic
tgacataacagataaaaagttgaaccccattttgcacattttgaatcttaattctcctaaccaagagggtaaggt

SEQ ID NO: 256212 - DNA, 75 bp, Artificial Sequence
  Synthetic
gtcggaacggctaactaggctaattaagaaacatctctctcacatacctaattgggtaagcagctggtacaatat

SEQ ID NO: 256213 - DNA, 75 bp, Artificial Sequence
  Synthetic
atgggtcaatcttaacaacttactgcaggagtaccgttcaaaggaagttatagaccataactgtgttctgactag

SEQ ID NO: 256214 - DNA, 75 bp, Artificial Sequence
  Synthetic
gcaattgtctggaagtttcatacatgtggtcatgagtcaatatggagttgtgataattagcaaaaaaagtaaaag

SEQ ID NO: 256215 - DNA, 75 bp, Artificial Sequence
  Synthetic
atatacaatgtgtacttataaccaattcctaacctggaaggaccttgccttgagcagatttaatgccaattatgt

SEQ ID NO: 256216 - DNA, 75 bp, Artificial Sequence
  Synthetic
ggtctggctaagtaatgtgttaaacacactcaacgaggggttgggattaaggtgtagattaaaaggtcatctgct

SEQ ID NO: 256217 - DNA, 75 bp, Artificial Sequence
  Synthetic
cagtaagttgtacatttccactgacatctttttatcttcaacatctaatgaattttataatgtggtcaaggaatt

SEQ ID NO: 256218 - DNA, 75 bp, Artificial Sequence
  Synthetic
tgagggcttcatcatgtcactgatattgaaacaaactgaggaagccttatttagcacaaggttttataataacat

SEQ ID NO: 256219 - DNA, 75 bp, Artificial Sequence
  Synthetic
gttgaacaacttaattgatgccattgatagggctcgactagagtatctggcccgctgtgccaattcagctgccag

SEQ ID NO: 256220 - DNA, 75 bp, Artificial Sequence
  Synthetic
gattaatttacctagtacagatgttatgatagcatcattgggtgatatcttatctttgataaacgttttaggtga

SEQ ID NO: 256221 - DNA, 75 bp, Artificial Sequence
  Synthetic
atccaaccttaacaacttaagtgagttatattttatcttcaggatatttggtcaccctatggttgatgagaggaa

SEQ ID NO: 256222 - DNA, 75 bp, Artificial Sequence
  Synthetic
ggccatggatgcagtcagagataactgttgtgaaacaaagtttctgacggctaagaaccttgcatcgttaagagg

SEQ ID NO: 256223 - DNA, 75 bp, Artificial Sequence
  Synthetic
agcatatgtttatagaattatcaaaggattcgtagcaaattataacaggtggccttacataaaaactagagtttg

SEQ ID NO: 256224 - DNA, 75 bp, Artificial Sequence
  Synthetic
ccttacaccaacatggattaactatcttgacaccaattcatgtccctcattattagagatgacagaagatgattt

SEQ ID NO: 256225 - DNA, 75 bp, Artificial Sequence
  Synthetic
tattgtgttagctggagtgcactttataagagaattccacatcccaaagctaactgatctggagattatattaaa

SEQ ID NO: 256226 - DNA, 75 bp, Artificial Sequence
  Synthetic
tgacaaggccatatctcctccaaaatcactcatttggtcatgctttccaaaaaactacatacctcaggttataca

SEQ ID NO: 256227 - DNA, 75 bp, Artificial Sequence
  Synthetic
agatgagtatgcccggaggtattgtagagctaaagcacctttgaagacaagacgtgtcttggagttctacttaca

SEQ ID NO: 256228 - DNA, 75 bp, Artificial Sequence
  Synthetic
ggataaggatttcaagttggatcagctccatagagtagtagtgaaccaggactaccttaatgataaagaacatat

SEQ ID NO: 256229 - DNA, 75 bp, Artificial Sequence
  Synthetic
aatttctttaacaggaaaagaaagagagttgggtgttggtaggatgtttgccatgcaacctgggaagcagaggca

SEQ ID NO: 256230 - DNA, 75 bp, Artificial Sequence
  Synthetic
agtccaaattttagcagagaagctgttggctgataacatcctgcaattctttccggagacactgactagatacgg

SEQ ID NO: 256231 - DNA, 75 bp, Artificial Sequence
  Synthetic
tgatttggagctgcaaaagatactagagttaaaagctggactttcaaataaaaatgacagatctaaagactccta

SEQ ID NO: 256232 - DNA, 75 bp, Artificial Sequence
  Synthetic
caataattatataagtaggtgctcattaattactgatttaagtaaatttaaccaagcttttaggtacgagtcatc

SEQ ID NO: 256233 - DNA, 75 bp, Artificial Sequence
  Synthetic
ctgtgtgtgtagtgatcttttagatgagctacatgggactcaaagcttattctcttggctgcatttaacagtacc

SEQ ID NO: 256234 - DNA, 75 bp, Artificial Sequence
  Synthetic
actgactactataatgtgtacatataggcatgcgcctccagacactggcaataattataacgttgatgatatagc

SEQ ID NO: 256235 - DNA, 75 bp, Artificial Sequence
  Synthetic
agaacagagtggcctctataggtatcatatgggtggtatagaaggatggtgccagaagttgtggactacagaagc

SEQ ID NO: 256236 - DNA, 75 bp, Artificial Sequence
  Synthetic
catagcattattggacacagtagcagtcaagggcagatttcaactaacatcccttataaatggagataatcagtc

SEQ ID NO: 256237 - DNA, 75 bp, Artificial Sequence
  Synthetic
tatagatataagtaaacctacaagattgggaacaagaactcagtcagaggctgactatgatttagccataaactc

SEQ ID NO: 256238 - DNA, 75 bp, Artificial Sequence
  Synthetic
tttgaggcttatatcagctgcttacaaagggataggtcataagctgaaggaaggagaaacttacctatcacgtga

SEQ ID NO: 256239 - DNA, 75 bp, Artificial Sequence
  Synthetic
catgcagtttatgagtaaaaccattcaacatgagggggtatattatccagcttccatcaaaaagatcctgagagt

SEQ ID NO: 256240 - DNA, 75 bp, Artificial Sequence
  Synthetic
tggtccatggattaacaccatactagacgatatcaaaactagcacagagagtataggtagtttaacacaggaatt

SEQ ID NO: 256241 - DNA, 75 bp, Artificial Sequence
  Synthetic
agagtataagggggaaagtctaatgtccagtttgttattgaggaacttctggctatacaggttatactcagttga

SEQ ID NO: 256242 - DNA, 75 bp, Artificial Sequence
  Synthetic
cttgaaagaccattctttatgtgggaagcaattatataggtcattaattaaagtacttaagcatcttaagagatg

SEQ ID NO: 256243 - DNA, 75 bp, Artificial Sequence
  Synthetic
ttttaacctggaaaatttaggagaatgtttagaactgtttcttaatgtcccgatgcagtttggaggtgctgaccc

SEQ ID NO: 256244 - DNA, 75 bp, Artificial Sequence
  Synthetic
caatgtcatctataggtcattctatagaaggacaccagatttcttgactgagtccataactcatctaatactgat

SEQ ID NO: 256245 - DNA, 75 bp, Artificial Sequence
  Synthetic
attaaaacacttcagacgtgatctcgagtttaacaaagacaatgtctcaaaagcagtgttgtctttactagaatt

SEQ ID NO: 256246 - DNA, 75 bp, Artificial Sequence
  Synthetic
taccaagaatgattctgctgagtttgtaaccttaatgagagaccctcaagcaataggttcagagaggcaagctaa

SEQ ID NO: 256247 - DNA, 75 bp, Artificial Sequence
  Synthetic
aataactagtgacattaacagaactgctgtaaccagtgtgctctctaatgctcctaatgagatatttagaactag

SEQ ID NO: 256248 - DNA, 75 bp, Artificial Sequence
  Synthetic
tgccttacattattcctccactgagaatgaactgaacggcatagcaagtggtgttagccctgtatatcctcatgg

SEQ ID NO: 256249 - DNA, 75 bp, Artificial Sequence
  Synthetic
tttaagggtcttatatgaatcactaccattctataaagctgagaaaatagtcaatatggtgtctggaacaaaatc

SEQ ID NO: 256250 - DNA, 75 bp, Artificial Sequence
  Synthetic
aatcactaacatacttgagaaaacctcagctataagttatacagatattataagagctactaacatgatggtcga

SEQ ID NO: 256251 - DNA, 75 bp, Artificial Sequence
  Synthetic
gaatttaacattgctgacaagaataatgaaaccaggtgcagacacttctctagatccagacaccatagtgattac

SEQ ID NO: 256252 - DNA, 75 bp, Artificial Sequence
  Synthetic
catactaagtaagatcattagagataaatcttgggatgtaggagatattataggtgtaacctcaccttcacctgt

SEQ ID NO: 256253 - DNA, 75 bp, Artificial Sequence
  Synthetic
cagctgctttaaggtagtttacacctcaaccctccaaaataatagtgttgttattgagagatataccactgacac

SEQ ID NO: 256254 - DNA, 75 bp, Artificial Sequence
  Synthetic
atatacaagaggcaagagagggcctacaaaaccctgggtgggctctagcacccaagaaaagaaatcaatgcctgt

SEQ ID NO: 256255 - DNA, 75 bp, Artificial Sequence
  Synthetic
atacaacagacaggtgctcacaagaggccagagagaccaaatagagaacatagcaaaactagaatgggttttcag

SEQ ID NO: 256256 - DNA, 75 bp, Artificial Sequence
  Synthetic
ctctgttgcaaacatagactcattattgaatgagctaagcactatgaccttgggcttaagtctgagaaaatgtag

SEQ ID NO: 256257 - DNA, 75 bp, Artificial Sequence
  Synthetic
gcaattatttcccacttatttgagtttaaactttctccatagactatcagtgagcagcagacctcgggagtaccc

SEQ ID NO: 256258 - DNA, 75 bp, Artificial Sequence
  Synthetic
ctcatctttacctgcttacaggactactaacttccactttgacacaggtcctataaataaagttttaactgagag

SEQ ID NO: 256259 - DNA, 75 bp, Artificial Sequence
  Synthetic
gtttggagacgaggatattaaccttgtgtttcagaatgcaattagctatgggctaagcactatgagtttggtaga

SEQ ID NO: 256260 - DNA, 75 bp, Artificial Sequence
  Synthetic
acagtttactggagtgtgtcctaataaggttttgcttgtgccaaagcttcaggaaatacaactcatgaaagtccc

SEQ ID NO: 256261 - DNA, 75 bp, Artificial Sequence
  Synthetic
aatatttcaagggggatttaatctacagtctattatacctataattaggcagcaacacatgttccttcctaacca

SEQ ID NO: 256262 - DNA, 75 bp, Artificial Sequence
  Synthetic
tataacaccagctcaatatatagaattgtttctgagtagtaaacagttccactcacgaattaacttaaaacacaa

SEQ ID NO: 256263 - DNA, 75 bp, Artificial Sequence
  Synthetic
taataggtttaaattggttttgcaaaaagattactttaacggggaaaacatgattgagaccttaagcacatgtct

SEQ ID NO: 256264 - DNA, 75 bp, Artificial Sequence
  Synthetic
tgctggtcattggatcataattcttatgttgatgaaagaatcacaaggtatctttgacaaagaatggtacgatgg

SEQ ID NO: 256265 - DNA, 75 bp, Artificial Sequence
  Synthetic
agacgttcatctgcgtgagcttccgatctcagtattgtttggaaggatcattgattaacgcggtttgaacagttt

SEQ ID NO: 256266 - DNA, 75 bp, Artificial Sequence
  Synthetic
ttgattaacgcggtttgaacagttttttggagcttttgatttcaaatgtctaaaaaaccaggaggacccgggaag

SEQ ID NO: 256267 - DNA, 75 bp, Artificial Sequence
  Synthetic
gtcatgcgcccagcagctggaggaaagaccgtgatggatgtcatttcacgcgaagatcaaagaggaagtggacaa

SEQ ID NO: 256268 - DNA, 75 bp, Artificial Sequence
  Synthetic
agtgggagtgaagagggtagtaatgaacttgttagatggcagggggccaatacggtttgtgttggctcttttagc

SEQ ID NO: 256269 - DNA, 75 bp, Artificial Sequence
  Synthetic
cgaagatcaaagaggaagtggacaagtagtgacctatgctttgaacacattcaccaacattgctgtgcaattggt

SEQ ID NO: 256270 - DNA, 75 bp, Artificial Sequence
  Synthetic
tttcttcaggtttacagcacttgcccctaccaaggccttgataaggcgctggaagagcgtgaacaaaacaacggc

SEQ ID NO: 256271 - DNA, 75 bp, Artificial Sequence
  Synthetic
tatgaaacatctgaccagttttaagaaagaattaggaacactgattgatgtggtgaacaaaaggggcaaaaaaca

SEQ ID NO: 256272 - DNA, 75 bp, Artificial Sequence
  Synthetic
aaagaaaagaggtggcaatgagacatccgtgctcatggtcatttttatgctgattggatttgtcgctaccttgaa

SEQ ID NO: 256273 - DNA, 75 bp, Artificial Sequence
  Synthetic
tgattggatttgtcgctaccttgaagctttccacctttcagggcaagataatgatgactgtgaatgccacggata

SEQ ID NO: 256274 - DNA, 75 bp, Artificial Sequence
  Synthetic
agatgtggctgttgttgtacttccatcgacgggatctgcgcctgatggccaacgccatatgctcttcagttccag

SEQ ID NO: 256275 - DNA, 75 bp, Artificial Sequence
  Synthetic
ttgctgatgtgatcgtcattccaaccccgaagggacccaatcaatgctggattcgagccattgacattggattta

SEQ ID NO: 256276 - DNA, 75 bp, Artificial Sequence
  Synthetic
tcgacgggatctgcgcctgatggccaacgccatatgctcttcagttccagttgactgggttccaaccggtcggac

SEQ ID NO: 256277 - DNA, 75 bp, Artificial Sequence
  Synthetic
tgtgtgatgacaccatcacttatgaatgtccgaaattggaaagtggaaatgaccctgaagacattgactgctggt

SEQ ID NO: 256278 - DNA, 75 bp, Artificial Sequence
  Synthetic
taagcgtgtggaaccgtgtgtggattctggaaaatgaatggatggaagacaagaccatggtttccgactggacgg

SEQ ID NO: 256279 - DNA, 75 bp, Artificial Sequence
  Synthetic
ttacagtgcagactcacggtgaaagcactctggtcaacaaaaaggatgcctggctagattctacgaaggccacgc

SEQ ID NO: 256280 - DNA, 75 bp, Artificial Sequence
  Synthetic
gattataagaaatcctggttacgcgctggtggccgttgtccttggctggatgctgggcagcaacactggacaaaa

SEQ ID NO: 256281 - DNA, 75 bp, Artificial Sequence
  Synthetic
atagttaatgtaatatagtataggtagaattttttgaaattaagtaaaattaagtagtaagacttgatagtcagg

SEQ ID NO: 256282 - DNA, 75 bp, Artificial Sequence
  Synthetic
agttatttttacagtgcttttgctcctcgttgctcctgcctacagtttcaactgtttgggaatgagcagccgtga

SEQ ID NO: 256283 - DNA, 75 bp, Artificial Sequence
  Synthetic
ggagtgcaatctgtgaggccccaggaggactgggtaaacaaagccgtaaggcccccgcagcccgggccgggagga

SEQ ID NO: 256284 - DNA, 75 bp, Artificial Sequence
  Synthetic
ttttattgaaggtgcttcaggagctacgtgggtcgatttggtgctggagggcgatagttgcatcaccatcatggc

SEQ ID NO: 256285 - DNA, 75 bp, Artificial Sequence
  Synthetic
tgccgacaaacccacccttgacataagaatgatgaacattgaagccaccaatcttgcattggtcagaaattactg

SEQ ID NO: 256286 - DNA, 75 bp, Artificial Sequence
  Synthetic
ctacgcagctactgtgtcagatgtctctacggtgtcaaactgtcccactacaggggagtcacacaacacgaagcg

SEQ ID NO: 256287 - DNA, 75 bp, Artificial Sequence
  Synthetic
ggcagatcataattacttgtgtaaacgaggtgtgaccgacagaggctggggcaatggatgtggcttatttggcaa

SEQ ID NO: 256288 - DNA, 75 bp, Artificial Sequence
  Synthetic
ggcagatcataattacttgtgtaaacgaggtgtgaccgacagaggctggggcaatggatgtggcttttttggcaa

SEQ ID NO: 256289 - DNA, 75 bp, Artificial Sequence
  Synthetic
ggcagatcataattacttgtgtaaacgaggtgtgaccgacagaggctggggcaatggatgtggcttctttggcaa

SEQ ID NO: 256290 - DNA, 75 bp, Artificial Sequence
  Synthetic
ggcagatcataattacttgtgtaaacgaggtgtgaccgacagaggctggggcaatggatgtggcttgtttggcaa

SEQ ID NO: 256291 - DNA, 75 bp, Artificial Sequence
  Synthetic
agacgttcatctgcgtgagcttccgatctcagtattgtttggaaggatcatttgattaacgcggtttgaacagtt

SEQ ID NO: 256292 - DNA, 75 bp, Artificial Sequence
  Synthetic
ggggagcattgacacatgcgcaaagttcacctgctccaactcagctgcggggagactcatcctacctgagaatat

SEQ ID NO: 256293 - DNA, 75 bp, Artificial Sequence
  Synthetic
ttcacctgctccaactcagctgcggggagactcatcctacctgagaatattaagtatgaagttggggtttttgtc

SEQ ID NO: 256294 - DNA, 75 bp, Artificial Sequence
  Synthetic
ctaaaaaaccaggaggacccgggaagccccgggtcgtcaatatgctaaaacgcggcataccccgcgtattcccat

SEQ ID NO: 256295 - DNA, 75 bp, Artificial Sequence
  Synthetic
gccccgggtcgtcaatatgctaaaacgcggcataccccgcgtattcccattagtgggagtgaagagggtagtaat

SEQ ID NO: 256296 - DNA, 75 bp, Artificial Sequence
  Synthetic
cgcggcataccccgcgtattcccattagtgggagtgaagagggtagtaatgaacctgctggatggcagaggacca

SEQ ID NO: 256297 - DNA, 75 bp, Artificial Sequence
  Synthetic
atttcaccaaacgctccagccatcacagcaaagatgggcgactatggagaagtcaccgtggagtgcgaaccgagg

SEQ ID NO: 256298 - DNA, 75 bp, Artificial Sequence
  Synthetic
atacggtttgtattggctcttctggctttctttaggtttacagcactcgccccaactaaggccctgataagacgc

SEQ ID NO: 256299 - DNA, 75 bp, Artificial Sequence
  Synthetic
agtggactgaacacagaggcctactatgtcatgaccattggaacgaaacattttctagtacatcgtgagtggttc

SEQ ID NO: 256300 - DNA, 75 bp, Artificial Sequence
  Synthetic
tggaaaagcgtgaacaaaacaacggccatgaaacacctgaccagtttcaagaaggaactgggaacattgattgat

SEQ ID NO: 256301 - DNA, 75 bp, Artificial Sequence
  Synthetic
aatgatttgctcttgccatggacatcacctgcaagcacagaatggaggaatagagaggttctcgtggagtttgaa

SEQ ID NO: 256302 - DNA, 75 bp, Artificial Sequence
  Synthetic
gtggtgaacaaaaggggcaaaaaacaaaagaaaagaggtggtagtgaaacaccggtgcttctggtcatccttatg

SEQ ID NO: 256303 - DNA, 75 bp, Artificial Sequence
  Synthetic
gagccacatgccaccaaacaatcagtggtagccttgggttcacaggaaggagctttgcaccaagctctggctgga

SEQ ID NO: 256304 - DNA, 75 bp, Artificial Sequence
  Synthetic
ttgattggactctccgctgccttgaagctctccaccttccagggcaaaataatgatgaccgtgaatgctacggac

SEQ ID NO: 256305 - DNA, 75 bp, Artificial Sequence
  Synthetic
gccataccagtcgagttcccgagcagcacacttaaactcacttcaggacaccttaaatgtcgcgtaaaaatggag

SEQ ID NO: 256306 - DNA, 75 bp, Artificial Sequence
  Synthetic
attgctgatgtgattgccatcccaactccgaagggacccaatcaatgctggattcgagccattgacatcggattt

SEQ ID NO: 256307 - DNA, 75 bp, Artificial Sequence
  Synthetic
atgtgtgatgacactattacttatgaatgtccgaaattggaaagtggaaatgaccctgaagacattgactgctgg

SEQ ID NO: 256308 - DNA, 75 bp, Artificial Sequence
  Synthetic
ggtcatggcacggtagttctagaactgcagtacactgggagtgatggaccatgcaaaatcccaatatcctctgtg

SEQ ID NO: 256309 - DNA, 75 bp, Artificial Sequence
  Synthetic
tgaccctgaagacattgactgctggtgtgacaaacaagccgtgtatgtgaactatgggagatgcacacgagctcg

SEQ ID NO: 256310 - DNA, 75 bp, Artificial Sequence
  Synthetic
ccattcaaagcgtagtcgccgctccatcacagtgcagactcacggtgaaagcactttggtcaacaagaaggacgc

SEQ ID NO: 256311 - DNA, 75 bp, Artificial Sequence
  Synthetic
gcaagtctcaatgacatgacgcctgtcggaagaatggtgacggctaatccatatgtggcttcatcaactgccaat

SEQ ID NO: 256312 - DNA, 75 bp, Artificial Sequence
  Synthetic
gccaaagtcctagtggagattgaaccacccttcggagactcatacatcgtggtaggcaggggagacaagcagatc

SEQ ID NO: 256313 - DNA, 75 bp, Artificial Sequence
  Synthetic
ttggttagattcaacgaaggccacgcgttatcttaccaaaacagagaattggataataaggaaccctggctacgc

SEQ ID NO: 256314 - DNA, 75 bp, Artificial Sequence
  Synthetic
aatcaccattggcataaggagggtagctcaatcggcaaagcctttagcacaaccttgaagggagcacagagattg

SEQ ID NO: 256315 - DNA, 75 bp, Artificial Sequence
  Synthetic
actggtggcagttgttcttggctggatgctgggtagcaacacaggacaaaaagtcattttcacagtgcttttgct

SEQ ID NO: 256316 - DNA, 75 bp, Artificial Sequence
  Synthetic
aaccttgaagggagcacagagattggcagctcttggagacacggcgtgggactttggatcagtaggcggtgtttt

SEQ ID NO: 256317 - DNA, 75 bp, Artificial Sequence
  Synthetic
tcttgttgctcctgcttatagctttaactgtttaggaatgagcagccgtgattttattgaaggtgcttcaggagc

SEQ ID NO: 256318 - DNA, 75 bp, Artificial Sequence
  Synthetic
cacatgggtcgatttggtgctggaaggcgacagctgtatcaccatcatggccgctgacaaacccacccttgacat

SEQ ID NO: 256319 - DNA, 75 bp, Artificial Sequence
  Synthetic
cagtcaaggtctgctgggggcgttactgttatggatgggggtcaatgctagagacaaatcaattgctttggcttt

SEQ ID NO: 256320 - DNA, 75 bp, Artificial Sequence
  Synthetic
aagaatgatgaacattgaagccaccaatcttgcactagtcagaaattactgctacgcagccattgtgtcagacgt

SEQ ID NO: 256321 - DNA, 75 bp, Artificial Sequence
  Synthetic
tcttgcaacaggaggcgttctgttgttcctggctacaaatgtgcacgctgacactggttgtgcgattgacatcac

SEQ ID NO: 256322 - DNA, 75 bp, Artificial Sequence
  Synthetic
ttccacggtgtcgaactgtcctacaacaggggaatcacacaacacaaagcgagcagatcacaactacttgtgcaa

SEQ ID NO: 256323 - DNA, 75 bp, Artificial Sequence
  Synthetic
caggagggagctcaagtgcggcagcggaatatttatacacaatgacgttgaagcctggattgatcgctacaagta

SEQ ID NO: 256324 - DNA, 75 bp, Artificial Sequence
  Synthetic
acgaggtgtgactgacagaggctggggtaatggctgtggcttgtttggtaagggaagcattgacacatgtgcaaa

SEQ ID NO: 256325 - DNA, 75 bp, Artificial Sequence
  Synthetic
aagcctggattgatcgctacaagtacctgccagagacccccaagcaactggctaaagtggttgaaaatgctcaca

SEQ ID NO: 256326 - DNA, 75 bp, Artificial Sequence
  Synthetic
gtttacctgttccagttcggctgcggggagacttatcctacctgaaaacatcaagtatgaagttgggatttttgt

SEQ ID NO: 256327 - DNA, 75 bp, Artificial Sequence
  Synthetic
agagcggaatatgtgggattcggtcagtgaatagatttgaacatcaaatgtgggaatctgtgcgtgatgaactca

SEQ ID NO: 256328 - DNA, 75 bp, Artificial Sequence
  Synthetic
tcacggatcaacagactcaaccagccatggaaactattccacccaaatcggagccaaccaagcagctaggttcac

SEQ ID NO: 256329 - DNA, 75 bp, Artificial Sequence
  Synthetic
acgctttactcaaggaaaatgccattgatttgagtgttgtcgtggaaaaacagaagggcatgtatagagcagcac

SEQ ID NO: 256330 - DNA, 75 bp, Artificial Sequence
  Synthetic
tatttcaccaaacgccccagccatcacagcgaagatgggtgactatggagaagtcaccgtggagtgtgaaccgag

SEQ ID NO: 256331 - DNA, 75 bp, Artificial Sequence
  Synthetic
ccaataggctgagactcactgtggaagaacttgatataggctggaaggcctggggcaagagtttgttttttgcgg

SEQ ID NO: 256332 - DNA, 75 bp, Artificial Sequence
  Synthetic
agaacttgatataggctggaaggcctggggcaagagtttgttttttgcggcggaattggccaattcaacattcgt

SEQ ID NO: 256333 - DNA, 75 bp, Artificial Sequence
  Synthetic
aagtggactgaatacagaggcctactatgtcatgaccattggaacgaaacactttctggtgcaccgtgagtggtt

SEQ ID NO: 256334 - DNA, 75 bp, Artificial Sequence
  Synthetic
ggttgatggacctgaaacagccgaatgtcctaattcaaagagggcatggaacagctttgaaattgaagactttgg

SEQ ID NO: 256335 - DNA, 75 bp, Artificial Sequence
  Synthetic
taatgatctgctcctgccgtggacatcaccttcaagcacggaatggaggaatagagaaattctcatggagtttga

SEQ ID NO: 256336 - DNA, 75 bp, Artificial Sequence
  Synthetic
atttggcataacatccaccagggtctggctcaaactcagagaggaaaatacctcggagtgtgacagcaccattat

SEQ ID NO: 256337 - DNA, 75 bp, Artificial Sequence
  Synthetic
agagccacatgccaccaaacaatcagtagttgctttgggctcacaggaaggcgctttgcaccaggccctggctgg

SEQ ID NO: 256338 - DNA, 75 bp, Artificial Sequence
  Synthetic
cctcggagtgtgacagcaccattatcgggaccgcagttaagggcaaccatgcagtgcacagtgacctttcctact

SEQ ID NO: 256339 - DNA, 75 bp, Artificial Sequence
  Synthetic
agccataccagtcgagtttgcgagcagtacactcaaactcacctcaggccatctcaagtgccgcgtgaaaatgga

SEQ ID NO: 256340 - DNA, 75 bp, Artificial Sequence
  Synthetic
ggattgagagtggactcaatgggacatggaaacttgagagagccatttttggagaggtaaaatcctgcacctggc

SEQ ID NO: 256341 - DNA, 75 bp, Artificial Sequence
  Synthetic
gaaactgaaactgaaaggaactacttatgggatgtgcacagaaaaattcaccttctcgaagaatccagctgatac

SEQ ID NO: 256342 - DNA, 75 bp, Artificial Sequence
  Synthetic
tggccacggtacagtagtcttggagctgcagtacacaggaagtgatggaccatgcaaaatcccgatttcctcggt

SEQ ID NO: 256343 - DNA, 75 bp, Artificial Sequence
  Synthetic
atcccagtgactctcgccggcccacgtagcaagcacaacagaagagaaggatacagggttcaagttcagggtccg

SEQ ID NO: 256344 - DNA, 75 bp, Artificial Sequence
  Synthetic
tgggatgaagaagacataaaattggactttgactattgcccaggaacaaccgtcacagtgagtgaacattgtgga

SEQ ID NO: 256345 - DNA, 75 bp, Artificial Sequence
  Synthetic
agcgagtctcaatgacatgacgcctgttggaagaatggtgacggccaacccatatgttgcttcatcaactgccaa

SEQ ID NO: 256346 - DNA, 75 bp, Artificial Sequence
  Synthetic
aaacgaggtccctcagtgcgtaccacaactgatagcggaaaactcgtcacggactggtgttgtaggagctgcacg

SEQ ID NO: 256347 - DNA, 75 bp, Artificial Sequence
  Synthetic
tgccaaagttttggtggaaattgagccaccctttggagactcttatattgtggtaggtaggggagacaagcagat

SEQ ID NO: 256348 - DNA, 75 bp, Artificial Sequence
  Synthetic
cttcctcctttaagattcaccacggccagtggatgttggtatggaatggagataagacctatgaagcatgatgag

SEQ ID NO: 256349 - DNA, 75 bp, Artificial Sequence
  Synthetic
caatcaccactggcacaaggagggcagctcgattggcaaagctttcagtacaaccttgaagggagcgcagagact

SEQ ID NO: 256350 - DNA, 75 bp, Artificial Sequence
  Synthetic
gataagacctatgaagcatgatgagtccactctagttaaatcaaaggttcaagcatttaatggagacatgattga

SEQ ID NO: 256351 - DNA, 75 bp, Artificial Sequence
  Synthetic
ggcagctctcggagacacggcatgggattttggatcggtgggcggagtctttaactcaattgggaaagcggtaca

SEQ ID NO: 256352 - DNA, 75 bp, Artificial Sequence
  Synthetic
gattttggatcggtgggcggagtctttaactcaattgggaaagcggtacaccaagtttttggaggagcgtttaga

SEQ ID NO: 256353 - DNA, 75 bp, Artificial Sequence
  Synthetic
tccttttcagttgggccttctggtgatgtttctggccacccaggaggtcttgaggaagaggtggacggccagact

SEQ ID NO: 256354 - DNA, 75 bp, Artificial Sequence
  Synthetic
accctctttggaggaatgtcatggattagtcaaggtctactgggtgcgttgctattgtggatgggggtcaatgct

SEQ ID NO: 256355 - DNA, 75 bp, Artificial Sequence
  Synthetic
tgaggaagaggtggacggccagacttactctgccagcagcggttggggctctgctagtcctccttcttgggggca

SEQ ID NO: 256356 - DNA, 75 bp, Artificial Sequence
  Synthetic
tactctgccagcagcggttggggctctgctagtcctccttcttgggggcattacctacactgatttagtgcggta

SEQ ID NO: 256357 - DNA, 75 bp, Artificial Sequence
  Synthetic
agagataaatcaattgctctggcttttctagcaacaggaggcgtcttgctgttcctggccacaaacgtccatgcc

SEQ ID NO: 256358 - DNA, 75 bp, Artificial Sequence
  Synthetic
tctcatattggtgggttcagcatttgcagaatcaaacaacggaggtgatgtcattcatttggcactcattgctgt

SEQ ID NO: 256359 - DNA, 75 bp, Artificial Sequence
  Synthetic
gacactggttgcgcaattgacatcaccagaagggagctcaagtgcggcagcggaatattcattcacaatgatgtt

SEQ ID NO: 256360 - DNA, 75 bp, Artificial Sequence
  Synthetic
attcaaggtacagcccgcttttcttgttgccagcttgacacgcagtagatggaccaatcaagagaatctcgttct

SEQ ID NO: 256361 - DNA, 75 bp, Artificial Sequence
  Synthetic
gaggcttggattgatcgttacaagtacctgcctgagactcccaagcaattggcaaaagtggttgagaacgcccat

SEQ ID NO: 256362 - DNA, 75 bp, Artificial Sequence
  Synthetic
ggtcttgggagcggccttctttcagatggcagcttcagacctggagttgacaattccaggtttgttgaactcagc

SEQ ID NO: 256363 - DNA, 75 bp, Artificial Sequence
  Synthetic
aagagcggaatatgtgggatccggtcagtgaatagattcgagcatcaaatgtgggaatctgtgcgtgatgagctc

SEQ ID NO: 256364 - DNA, 75 bp, Artificial Sequence
  Synthetic
tgctactgcttggatggtgttgcgagcaatggcttttccgtcaacctcagcaatagccatgcccatgctagcaat

SEQ ID NO: 256365 - DNA, 75 bp, Artificial Sequence
  Synthetic
caatagccatgcccatgctagcaatgcttgctccgggaatgagaatgcttcaccttgacacatataggatagtgc

SEQ ID NO: 256366 - DNA, 75 bp, Artificial Sequence
  Synthetic
aacgctttactcaaggaaaacgctattgatttgagcgttgtagtggaaaagcagaaaggcatgtacagggcagca

SEQ ID NO: 256367 - DNA, 75 bp, Artificial Sequence
  Synthetic
tcttgctaattggcatttgtagcttgatgaatgagagaaggaagtctgcggagaaaaagaaaggggccgtcttga

SEQ ID NO: 256368 - DNA, 75 bp, Artificial Sequence
  Synthetic
cccaataggctgaagctcactgtggaagaacttgacataggctggaaggcctggggaaagagtctgctttttgca

SEQ ID NO: 256369 - DNA, 75 bp, Artificial Sequence
  Synthetic
ttggtctagccctgacttcgactggatatttttcaccaacaatcatggcagcaggcctcatggtatgcaacccta

SEQ ID NO: 256370 - DNA, 75 bp, Artificial Sequence
  Synthetic
gccgagttggccaactcaacgtttgtggttgatggacctgaaacagctgaatgtcccaattcaaagagggcatgg

SEQ ID NO: 256371 - DNA, 75 bp, Artificial Sequence
  Synthetic
aacagctttgaaattgaggactttggatttggaataacgtctaccagggtttggcttaaactcagggaggagaat

SEQ ID NO: 256372 - DNA, 75 bp, Artificial Sequence
  Synthetic
ctgagctagatattgattccatgtcaatcccttttaccatagctggcctcatgttggtgtcctatgtcgtctcgg

SEQ ID NO: 256373 - DNA, 75 bp, Artificial Sequence
  Synthetic
acctcggaatgtgacagtaccatcattgggaccgcagtcaaaggcaaccacgcagtgcacagcgacctctcctac

SEQ ID NO: 256374 - DNA, 75 bp, Artificial Sequence
  Synthetic
ttgggaccgcagtcaaaggcaaccacgcagtgcacagcgacctctcctactggattgagagtggactcaatggga

SEQ ID NO: 256375 - DNA, 75 bp, Artificial Sequence
  Synthetic
ggaaagccacagacatgtggcttgaaagagcagccgacgtatcatgggaaccaggggcagcaataacaggtacca

SEQ ID NO: 256376 - DNA, 75 bp, Artificial Sequence
  Synthetic
gcgaaagactggatgtccaactggatgatgatggagactttcatctgctcaatgaccctggagttccatggaaaa

SEQ ID NO: 256377 - DNA, 75 bp, Artificial Sequence
  Synthetic
cctgagacacacacactgtggggtgacgcggtggaagaaacagagctgattattccagtgactcttgccggccca

SEQ ID NO: 256378 - DNA, 75 bp, Artificial Sequence
  Synthetic
cgcagcaaacacaatagaagagaaggatacaaggttcaggtccaaggtccatgggatgaagaagacataaaattg

SEQ ID NO: 256379 - DNA, 75 bp, Artificial Sequence
  Synthetic
tctgggttttaagaatgacatgcctaagcatagctgctatcactccatgggccattgtgccatccgcgttcgggt

SEQ ID NO: 256380 - DNA, 75 bp, Artificial Sequence
  Synthetic
atgggatgaagaagacataaaattggattttgactactgtccaggaacaacggtcacagtgagtgaacactgtgg

SEQ ID NO: 256381 - DNA, 75 bp, Artificial Sequence
  Synthetic
attggttgactctgaagtacacaaaacgagggggtgttttttgggacacgccctccccaaaggtgtatcccaagg

SEQ ID NO: 256382 - DNA, 75 bp, Artificial Sequence
  Synthetic
aaaacggggcccttcagtgcgcaccacaactgacagcgggaaacttgtcacagattggtgttgcaggagctgcac

SEQ ID NO: 256383 - DNA, 75 bp, Artificial Sequence
  Synthetic
gggatacgacgccaggagtctaccgaataatggccagaggcatcctgggaaggtaccaagctggagtgggagtca

SEQ ID NO: 256384 - DNA, 75 bp, Artificial Sequence
  Synthetic
gcttcctcctctaagattcaccacggccagtggatgctggtatggaatggaaataagaccaatgaagcatgatga

SEQ ID NO: 256385 - DNA, 75 bp, Artificial Sequence
  Synthetic
tgcatgaaggtgtgttccacacgctgtggcacacaactagaggagccgccataatgagtggtgagggaagattga

SEQ ID NO: 256386 - DNA, 75 bp, Artificial Sequence
  Synthetic
gccagtggatgctggtatggaatggaaataagaccaatgaagcatgatgagtccactttggtaaaatcaagggtt

SEQ ID NO: 256387 - DNA, 75 bp, Artificial Sequence
  Synthetic
ataatgagtggtgagggaagattgacaccatactggggcaatgtgaaagaggatagagtgacctatggtggacca

SEQ ID NO: 256388 - DNA, 75 bp, Artificial Sequence
  Synthetic
caagcactcaatggagacatgattgacccttttcagttgggcctcctggtgatgtttctggccacccaggaggtc

SEQ ID NO: 256389 - DNA, 75 bp, Artificial Sequence
  Synthetic
tggaaattagatcaaaaatggaatggagtggatgacgtccagatgatagtggtggaaccaggaaagccagcgata

SEQ ID NO: 256390 - DNA, 75 bp, Artificial Sequence
  Synthetic
ttgaggaagaggtggacggccagactcactctgccggcagcggttggggccctgttagttcttcttcttgggggc

SEQ ID NO: 256391 - DNA, 75 bp, Artificial Sequence
  Synthetic
aacgtgcagaccaagcccgggatcttcaagacagcacacggagaaataggagccgtgagcttggactacccagta

SEQ ID NO: 256392 - DNA, 75 bp, Artificial Sequence
  Synthetic
aacgtgcagaccaagcccgggatcttcaagacagcacacggagaaataggagccgtgagcttggactaccctgta

SEQ ID NO: 256393 - DNA, 75 bp, Artificial Sequence
  Synthetic
aacgtgcagaccaagcccgggatcttcaagacagcacacggagaaataggagccgtgagcttggactaccccgta

SEQ ID NO: 256394 - DNA, 75 bp, Artificial Sequence
  Synthetic
aacgtgcagaccaagcccgggatcttcaagacagcacacggagaaataggagccgtgagcttggactacccggta

SEQ ID NO: 256395 - DNA, 75 bp, Artificial Sequence
  Synthetic
attacctacactgatttagtgcggtatctcattttggtgggctcagcatttgcagaatcaaacaatggaggtgat

SEQ ID NO: 256396 - DNA, 75 bp, Artificial Sequence
  Synthetic
ggaacttcaggatccccaatagtcaacagcagtggagaaattattggcctctatggaaatggagtgatactaggt

SEQ ID NO: 256397 - DNA, 75 bp, Artificial Sequence
  Synthetic
gtcattcacttggctctcatcgctgtgttcaaagtacagcccgcctttcttgttgccagcttgacacgtagcagg

SEQ ID NO: 256398 - DNA, 75 bp, Artificial Sequence
  Synthetic
acagcagtggagaaattattggcctctatggaaatggagtgatactaggtaacggggcctatgtcagcgctattg

SEQ ID NO: 256399 - DNA, 75 bp, Artificial Sequence
  Synthetic
tggactaatcaagagaatctcgtccttgttttgggtgccgccttctttcagatggcagcttcagacctggagttg

SEQ ID NO: 256400 - DNA, 75 bp, Artificial Sequence
  Synthetic
tgctggacctgcacccaggtgcggggaaaacacgacgcatacttccccaaataattaaagatgctatccaaaaaa

SEQ ID NO: 256401 - DNA, 75 bp, Artificial Sequence
  Synthetic
tcaatcccaggtctgttgaactcagctgcaacagcctggatggtgttgcgagcgatggccttcccgtcaacctca

SEQ ID NO: 256402 - DNA, 75 bp, Artificial Sequence
  Synthetic
gactgcgaacagctgttcttgcaccaacgagggtggttgcagcagaaatggcagaagctttgaggggccttccag

SEQ ID NO: 256403 - DNA, 75 bp, Artificial Sequence
  Synthetic
gcaatagccatgcccatgcttgcaatgctggctccggggatgagaatgctccatcttgacacatacaggatagtg

SEQ ID NO: 256404 - DNA, 75 bp, Artificial Sequence
  Synthetic
ttaggtatttgactccagctgtacaaagagaacacagtggaagcgagatagtggatgtgatgtgccatgcgacac

SEQ ID NO: 256405 - DNA, 75 bp, Artificial Sequence
  Synthetic
cttctgctgattggtatttgcagcttgctgaacgagagaaggaggtcagtagagaaaaagaaaggagccgtccta

SEQ ID NO: 256406 - DNA, 75 bp, Artificial Sequence
  Synthetic
taacacatcgactgatgtcgccgctaagagtcccgaactacaacctgtttgttatggatgaagcccatttcacag

SEQ ID NO: 256407 - DNA, 75 bp, Artificial Sequence
  Synthetic
attggtttagctctgacttcaaccggatacttttcaccaacaatcatggcggcaggcctcatggtatgcaatccc

SEQ ID NO: 256408 - DNA, 75 bp, Artificial Sequence
  Synthetic
aacaagaaaagaggctggcctgccactgaggttctaacagcagtgggcttgatgtttgccatcgttggaggactt

SEQ ID NO: 256409 - DNA, 75 bp, Artificial Sequence
  Synthetic
atatattgccacccgtgttgaagctggagaggccgcggccatctttatgacggccacccctccaggcacatccga

SEQ ID NO: 256410 - DNA, 75 bp, Artificial Sequence
  Synthetic
gctgagctagacattgattccatgtcagtccctttcactatagctggtctcatgctagtgtcctatgtgatctcg

SEQ ID NO: 256411 - DNA, 75 bp, Artificial Sequence
  Synthetic
cccattcccggatactaactcaccagtccacgatgtatctagtgaaatcccagatagagcatggagcagtggatt

SEQ ID NO: 256412 - DNA, 75 bp, Artificial Sequence
  Synthetic
gggaaagccacagacatgtggcttgagagagcagccgatgtatcatgggaaacaggagcagcaataacaggtacc

SEQ ID NO: 256413 - DNA, 75 bp, Artificial Sequence
  Synthetic
tgagtggataaccgactgtgctggaaagaccgtctggttcgtggctagcgtgaaaatgggcaatgagatcgcgca

SEQ ID NO: 256414 - DNA, 75 bp, Artificial Sequence
  Synthetic
agcgaaagactagacgtccagctggatgatgatggagactttcatctactcaatgatcctggagttccatggaag

SEQ ID NO: 256415 - DNA, 75 bp, Artificial Sequence
  Synthetic
gtgcttgcaacgagcagggaagcgagttatccaattgaacaggaagtcctatgatacggaatacccgaaatgcaa

SEQ ID NO: 256416 - DNA, 75 bp, Artificial Sequence
  Synthetic
gttatccaattgaacaggaagtcctatgatacggaatacccgaaatgcaaaaatggtgattgggactttgtgata

SEQ ID NO: 256417 - DNA, 75 bp, Artificial Sequence
  Synthetic
atctgggttctgagaatgacatgcttgagcgtggctgctatcactccatgggccattctgccatctgctttcggg

SEQ ID NO: 256418 - DNA, 75 bp, Artificial Sequence
  Synthetic
acaactgacatctcggaaatgggggcaaattttggagcaagcagagtgattgattgtcgtaagagtgttaagcca

SEQ ID NO: 256419 - DNA, 75 bp, Artificial Sequence
  Synthetic
tattggctgaccctgaagtacacaaagcgagggggtgttttttgggatacaccttctccaaaggtgtatcccaag

SEQ ID NO: 256420 - DNA, 75 bp, Artificial Sequence
  Synthetic
acgattttggacgaaggagagggaagagtcattctcagtgtgccatcagccatcactagtgccagtgctgcccaa

SEQ ID NO: 256421 - DNA, 75 bp, Artificial Sequence
  Synthetic
ggagacacaacgccgggagtttaccgaataatggctcgaggcatcctgggaaggtatcaagctggagtgggagtc

SEQ ID NO: 256422 - DNA, 75 bp, Artificial Sequence
  Synthetic
cggagagggagagtgggcaggaatcccagtcaaataggagatgagtaccactatggaggcggaaccagtgaggat

SEQ ID NO: 256423 - DNA, 75 bp, Artificial Sequence
  Synthetic
atgcacgagggtgtgttccacacgttgtggcacacaactagaggagctgccataatgagtggcgaaggaagatta

SEQ ID NO: 256424 - DNA, 75 bp, Artificial Sequence
  Synthetic
gacaccatgctggcacactggactgaagcaaagattcttttggacaatatccaccttccaaacggcctagtagct

SEQ ID NO: 256425 - DNA, 75 bp, Artificial Sequence
  Synthetic
acaccttactggggcaacgtaaaagaggacagagtgacttatggtggcccatggaaattagaccaaaagtggaat

SEQ ID NO: 256426 - DNA, 75 bp, Artificial Sequence
  Synthetic
cagctgtacggtcccgaaagagacaaaacctacaccatggatggagagtaccgacttagaggcgaagaacgcaaa

SEQ ID NO: 256427 - DNA, 75 bp, Artificial Sequence
  Synthetic
ggagtggatgacgttcagatgatagtggtggaaccaggaaagccggcagtaaacgtacagaccaagcctggaatc

SEQ ID NO: 256428 - DNA, 75 bp, Artificial Sequence
  Synthetic
acatttctcgagctcataaaaacagccgatttgccggtgtggcttgcttacaaggtagcgtcaaatggcatccag

SEQ ID NO: 256429 - DNA, 75 bp, Artificial Sequence
  Synthetic
ccgatttgccggtgtggcttgcttacaaggtagcgtcaaatggcatccagtacaatgacaggaaatggtgttttg

SEQ ID NO: 256430 - DNA, 75 bp, Artificial Sequence
  Synthetic
tttaagacaacgcacggagaaatcggagcagtgagcttagactacccgattggaacatcaggctctccaatagtc

SEQ ID NO: 256431 - DNA, 75 bp, Artificial Sequence
  Synthetic
atggaccccgatccaacattatcctcgaagacaacaacgaagtggaaatcataacaagaataggggaaagaaaag

SEQ ID NO: 256432 - DNA, 75 bp, Artificial Sequence
  Synthetic
aacagcaatggagaaattattggcctttatggaaatggagtaatactgggcaatggagcctatgtcagtgctatt

SEQ ID NO: 256433 - DNA, 75 bp, Artificial Sequence
  Synthetic
ataacaagaataggggaaagaaaagttctgaagccacgatggttagatgcacgtgtgtattcagaccatcagtca

SEQ ID NO: 256434 - DNA, 75 bp, Artificial Sequence
  Synthetic
gtccaaggagaaagagtagaggagccagtgccggaggcttacaatcctgagatgctaaagaaaagacaactaacc

SEQ ID NO: 256435 - DNA, 75 bp, Artificial Sequence
  Synthetic
gtgctggacctgcatccgggcgctggaaaaacacgacgcatcctcccccaaataatcaaagatgccatccaaaga

SEQ ID NO: 256436 - DNA, 75 bp, Artificial Sequence
  Synthetic
gagcattttgctgggaaaacacgtgaagctctggacaccatgtacttggtggcaacatcagaaaaggggggtaaa

SEQ ID NO: 256437 - DNA, 75 bp, Artificial Sequence
  Synthetic
agactacgaactgcagttcttgcaccaacgagggttgtcgcagcagaaatggcagaagctttgagaggcctccca

SEQ ID NO: 256438 - DNA, 75 bp, Artificial Sequence
  Synthetic
gcgcatagaatggctcttgaagaactacctgatgctctggaaaccataacactcattgcagcgttgggagtcatg

SEQ ID NO: 256439 - DNA, 75 bp, Artificial Sequence
  Synthetic
gtcaggtatttgaccccagctgtacaaagagaacacagtggaaacgaaatagtggatgttatgtgccatgcgaca

SEQ ID NO: 256440 - DNA, 75 bp, Artificial Sequence
  Synthetic
accgcagggttttttcttcttatgatgcagagaaaaggaattggtaagctgggacttggagcactcgtcttggtg

SEQ ID NO: 256441 - DNA, 75 bp, Artificial Sequence
  Synthetic
ttaacgcatcgcctgatgtcaccactaagagttccaaattacaacctgtttgtcatggatgaagcccatttcaca

SEQ ID NO: 256442 - DNA, 75 bp, Artificial Sequence
  Synthetic
gggacttggagcactcgtcttggtggtggccactttcttcctttggatgtcagacgtttctggtaccaaaatagc

SEQ ID NO: 256443 - DNA, 75 bp, Artificial Sequence
  Synthetic
gatccagccagcatcgcagctcgcggatacattgctacccgagttgaagcgggagaggctgcggccatctttatg

SEQ ID NO: 256444 - DNA, 75 bp, Artificial Sequence
  Synthetic
tggtgtgttgctgctcgcgctgcttatgatggttgtgttaatccctgaacctgagaaacagcgttcccagacgga

SEQ ID NO: 256445 - DNA, 75 bp, Artificial Sequence
  Synthetic
acggccacgcctccaggcacatccgacccatttccagacaccaactccccagttcatgacgtgtccagtgaaatt

SEQ ID NO: 256446 - DNA, 75 bp, Artificial Sequence
  Synthetic
caaccaactggcagtatttttgatatgtgtgctgcttgttgttgggttagtggcagcaaatgaatatgggatgtt

SEQ ID NO: 256447 - DNA, 75 bp, Artificial Sequence
  Synthetic
ccagatagagcatggagtagtggatttgagtggataactgactatgtgggaaagaccgtctggttcgtagcaagt

SEQ ID NO: 256448 - DNA, 75 bp, Artificial Sequence
  Synthetic
ggaaaggacaaaaactgacataagaaacctatttgggaagccactaattgaggaaaatgaggtccatattcctcc

SEQ ID NO: 256449 - DNA, 75 bp, Artificial Sequence
  Synthetic
aaagaccgtctggttcgtagcaagtgtgaaaatgggcaatgaaatcgcccagtgcttgcaacgagcaggaaagcg

SEQ ID NO: 256450 - DNA, 75 bp, Artificial Sequence
  Synthetic
cttagattttttcaccctggatttgaagcctgctactgcttgggctttgtacggaggaagcacagttgtgttgac

SEQ ID NO: 256451 - DNA, 75 bp, Artificial Sequence
  Synthetic
ggttatccaactaaacagaaagtcctatgacacagaatacccgaagtgcaaaaatggtgactgggactttgtgat

SEQ ID NO: 256452 - DNA, 75 bp, Artificial Sequence
  Synthetic
tccactggtaaaacatttggtgacatcacagtatattaccacctcattggcatcaataaacgcccaagcaggaag

SEQ ID NO: 256453 - DNA, 75 bp, Artificial Sequence
  Synthetic
aacaactgacatttcggaaatgggagcaaactttggagcaagcagagtgattgactgccgcaaaagtgtcaagcc

SEQ ID NO: 256454 - DNA, 75 bp, Artificial Sequence
  Synthetic
cttgttcacattgcccaaaggaattcctttcactgattttgacttgtctgtggcattagtgtttctcggttgctg

SEQ ID NO: 256455 - DNA, 75 bp, Artificial Sequence
  Synthetic
aacgatcctggaagaaggagagggaagagtcattctcagcgtgccgtcagccatcaccagtgccagtgctgccca

SEQ ID NO: 256456 - DNA, 75 bp, Artificial Sequence
  Synthetic
gggacaagtgacgctcaccaccttgataatggcaacaatactggtaacccttcactacggatatcttctacctgg

SEQ ID NO: 256457 - DNA, 75 bp, Artificial Sequence
  Synthetic
acgaagaggtagagtgggcaggaatcctagccaaataggagatgagtaccactatggaggcggaaccagtgagga

SEQ ID NO: 256458 - DNA, 75 bp, Artificial Sequence
  Synthetic
ttggcaagcagaagctttgagggctgcacagaagcgaacagccgctggtatcatgaaaaatgcagttgttgatgg

SEQ ID NO: 256459 - DNA, 75 bp, Artificial Sequence
  Synthetic
tgacaccatgctggcgcagtggactgaagcgaagatcctcttggacaacatccatcttccaaatggccttgtggc

SEQ ID NO: 256460 - DNA, 75 bp, Artificial Sequence
  Synthetic
catagtcgcgacagatgttccagagttggaaagaacgaccccacagatgcagaaaaggctaggtcaaatcctact

SEQ ID NO: 256461 - DNA, 75 bp, Artificial Sequence
  Synthetic
tcagctgtatggtcctgagagggacaaaacctacaccatggatggagagtaccgacttagaggcgaagaacgcaa

SEQ ID NO: 256462 - DNA, 75 bp, Artificial Sequence
  Synthetic
cgtcttggccagcgtggcagcagtatgcgtgaaccccagaataaccaccatccgtgaagccggaatactctgcac

SEQ ID NO: 256463 - DNA, 75 bp, Artificial Sequence
  Synthetic
aacgttcctcgagcttctaaagactgcagacctgccggtgtggctcgcctacaaggtagcatcaaatggcatcca

SEQ ID NO: 256464 - DNA, 75 bp, Artificial Sequence
  Synthetic
cgcagcagctctcaccctgtgggacaacaatgccagcgcggtttggaattctaccacggctattggattgtgcca

SEQ ID NO: 256465 - DNA, 75 bp, Artificial Sequence
  Synthetic
acaaggtagcatcaaatggcatccaatacaatgacaggaaatggtgttttgacggacctcgatccaatgttatcc

SEQ ID NO: 256466 - DNA, 75 bp, Artificial Sequence
  Synthetic
ttgaagacaacaatgaggtggaaatcataacaagaataggggaaaggaaagtcttgaagccgcgatggctagatg

SEQ ID NO: 256467 - DNA, 75 bp, Artificial Sequence
  Synthetic
cgttattcgcggaagctggatagcgggagcttcaatagcctggactcttataaaaaatgcagaaaagccagcgtt

SEQ ID NO: 256468 - DNA, 75 bp, Artificial Sequence
  Synthetic
ggagcttcaatagcctggactcttataaaaaatgcagaaaagccagcgtttaagagaggaagagcaggaggaaga

SEQ ID NO: 256469 - DNA, 75 bp, Artificial Sequence
  Synthetic
cacgcgtgtactcagaccaccagtccctaaaatggttcaaggattttgcagctgggaagcggtcagcaattggat

SEQ ID NO: 256470 - DNA, 75 bp, Artificial Sequence
  Synthetic
tttttgaagtgctgggccggatgccagagcattttgcagggaaaacacgcgaagccctggacaccatgtacctgg

SEQ ID NO: 256471 - DNA, 75 bp, Artificial Sequence
  Synthetic
atcttggaagtggatagaaccgaagccagaagggccagaagagagggaaacaaggtaggaggccacccagtgtca

SEQ ID NO: 256472 - DNA, 75 bp, Artificial Sequence
  Synthetic
tagcaacatcagaaaaaggaggcaaagcgcatagaatggctcttgaagaactgcctgatgctttagaaactataa

SEQ ID NO: 256473 - DNA, 75 bp, Artificial Sequence
  Synthetic
cgagggacagcgaagctcagatggttggtcgaaagacgctttgtccaacccataggaaaagtagtggatctgggg

SEQ ID NO: 256474 - DNA, 75 bp, Artificial Sequence
  Synthetic
cactcatcgcggcgttgggagtcatgactgcaggattttttcttctcatgatgcaaaggaaaggaattggcaagt

SEQ ID NO: 256475 - DNA, 75 bp, Artificial Sequence
  Synthetic
tgtggcagaggaggctggtcatactacgcagcaaccatgaagaatgtccaggacgtgagaggatatacgaaaggt

SEQ ID NO: 256476 - DNA, 75 bp, Artificial Sequence
  Synthetic
taggacttggagcactcgttttggtggtggccactttttttctatggatgtcagatgtctctggaaccaaaatag

SEQ ID NO: 256477 - DNA, 75 bp, Artificial Sequence
  Synthetic
gggccaggccatgaagaacccatgttgatgcaaagttatggatggaacatcgttaccatgaaaagtggtgttgat

SEQ ID NO: 256478 - DNA, 75 bp, Artificial Sequence
  Synthetic
ctggtgtgttgctacttgcgttgctcatgatggttgtattgatccctgagcctgaaaaacagcgttcccagacgg

SEQ ID NO: 256479 - DNA, 75 bp, Artificial Sequence
  Synthetic
gttttctacaaaccatctgagatcagtgacacccttttgtgtgacataggagagtcatcacctagtgctgaaata

SEQ ID NO: 256480 - DNA, 75 bp, Artificial Sequence
  Synthetic
acaaccaactggcagtgtttttgatatgtgtgttgcttattgttggtctagtggctgcaaacgaatatggaatgt

SEQ ID NO: 256481 - DNA, 75 bp, Artificial Sequence
  Synthetic
gaagaacaacggaccctgcggattctagagatggtgtctgactggctaagccgtggtccaaaggaattttgcata

SEQ ID NO: 256482 - DNA, 75 bp, Artificial Sequence
  Synthetic
tggaaagaacaaaaaccgacataagaaacttgtttggcaagccactgattgaagaaaatgagtcccacatccctc

SEQ ID NO: 256483 - DNA, 75 bp, Artificial Sequence
  Synthetic
aagatactctgcccgtacatgcccaaggtgattgaaaagctggaaagcctgcaacgcaggtttggaggtggattg

SEQ ID NO: 256484 - DNA, 75 bp, Artificial Sequence
  Synthetic
cctttgattttttcactctggacttgaggcctgctactgcctgggcattgtatggagggagcacagtggtattaa

SEQ ID NO: 256485 - DNA, 75 bp, Artificial Sequence
  Synthetic
gcaacgcaggtttggaggtggattggtacgcgttcccctttctcgtaactccaaccatgaaatgtactgggtcag

SEQ ID NO: 256486 - DNA, 75 bp, Artificial Sequence
  Synthetic
ctccgctgataaaacatctggtgacatcacagtacgttaccacctcattggcatcaataaatgcccaagcaggga

SEQ ID NO: 256487 - DNA, 75 bp, Artificial Sequence
  Synthetic
ttggaagggcccaaaatatgaagaagatgtcaacctgggcagcggtacgagagcagtaggaaaaggtgtgcagca

SEQ ID NO: 256488 - DNA, 75 bp, Artificial Sequence
  Synthetic
gcctgtttacactgccaaaaggaatcccttttactgattttgatctgtctgtagcgctggtgtttctcggttgtt

SEQ ID NO: 256489 - DNA, 75 bp, Artificial Sequence
  Synthetic
cacggattacaagaggattaaatctagaatagaaaaactgaaggaggagtacgcagccacgtggcatacggatga

SEQ ID NO: 256490 - DNA, 75 bp, Artificial Sequence
  Synthetic
ggggacaagtgacgctcaccaccctgatgttggcaacagtattgatcaccctccattacggatacctcctacctg

SEQ ID NO: 256491 - DNA, 75 bp, Artificial Sequence
  Synthetic
agaatagaaaaactgaaggaggagtacgcagccacgtggcatacggatgaaaaccacccgtatagaacttggact

SEQ ID NO: 256492 - DNA, 75 bp, Artificial Sequence
  Synthetic
gttggcaagctgaagcactgagagcagcacaaaagcgcacagccgctggcatcatgaaaaacgcagttgttgacg

SEQ ID NO: 256493 - DNA, 75 bp, Artificial Sequence
  Synthetic
tatcacgggagttatgaggtgaagccatcggggtcagccagcacgttggtaaatggagtggtgcggcttttgagc

SEQ ID NO: 256494 - DNA, 75 bp, Artificial Sequence
  Synthetic
agcacaaaagcgcacagccgctggcatcatgaaaaacgcagttgttgacggaatagttgcgacagatgtcccgga

SEQ ID NO: 256495 - DNA, 75 bp, Artificial Sequence
  Synthetic
gctggaaagaacaaccccacagatgcagaaaaggctaggccagattctactcgtcttggccagcgtggcagcagt

SEQ ID NO: 256496 - DNA, 75 bp, Artificial Sequence
  Synthetic
aaaccatgggacgctatcactggagtcaccaccatggccatgactgataccacaccatttggccagcagcgagtg

SEQ ID NO: 256497 - DNA, 75 bp, Artificial Sequence
  Synthetic
ttcaaagagaaggttgacacaaaagctcctgagcctccccagggagtgaagactgtgatggatgaaaccaccaac

SEQ ID NO: 256498 - DNA, 75 bp, Artificial Sequence
  Synthetic
gtgcgtcaaccccagaataaccaccattcgggaagctggcattctctgcaccgcagcagctctcaccttgtggga

SEQ ID NO: 256499 - DNA, 75 bp, Artificial Sequence
  Synthetic
tggctgtgggcttatttggctaggaacaaaaaagtcagactgtgcaccagagaggagttcgtaaaaaaagtgaat

SEQ ID NO: 256500 - DNA, 75 bp, Artificial Sequence
  Synthetic
caacaacgccagcgcggtctggaattccaccacagcaactgggctgtgccatgtcatgcgtggaagctggatagc

SEQ ID NO: 256501 - DNA, 75 bp, Artificial Sequence
  Synthetic
agccacgccgccttgggagccatgtttgaagaacaaaaccagtggaagaacgcacgagaagctgtggaagaccca

SEQ ID NO: 256502 - DNA, 75 bp, Artificial Sequence
  Synthetic
aggagcttcaatagcctggacgcttataaaaaatgcaggaaaaccagcgtgtaaaagaggaagagcaggaggaag

SEQ ID NO: 256503 - DNA, 75 bp, Artificial Sequence
  Synthetic
aactctcggggaacagtggaaagaaaaactgaatgccatgggcaaggaggaattcttcagctatcggaaagaagc

SEQ ID NO: 256504 - DNA, 75 bp, Artificial Sequence
  Synthetic
atgggcaaacgtgagaaaaaacccggagaatttggaaaggccaagggaagcagagccatctggttcatgtggctg

SEQ ID NO: 256505 - DNA, 75 bp, Artificial Sequence
  Synthetic
cattttagaagtggatagaactgaagctagaagagccagaagagagggaaacaaggtaggaggccacccagtgtc

SEQ ID NO: 256506 - DNA, 75 bp, Artificial Sequence
  Synthetic
ggggccagattcttggagtttgaagctctaggattccttaatgaggaccattggatgagtagagaaaattcagga

SEQ ID NO: 256507 - DNA, 75 bp, Artificial Sequence
  Synthetic
acgcggaacagcgaaactcagatggctggttgagagacgcttcatccaacccataggaaaggtagtggacctggg

SEQ ID NO: 256508 - DNA, 75 bp, Artificial Sequence
  Synthetic
ctggttgagagacgcttcatccaacccataggaaaggtagtggacctggggtgtggcagaggaggctggtcatac

SEQ ID NO: 256509 - DNA, 75 bp, Artificial Sequence
  Synthetic
ggaggagttgaaggagctggtattcagaagctgggatacatcctgagagatgtggcccgaaaacctggagggaaa

SEQ ID NO: 256510 - DNA, 75 bp, Artificial Sequence
  Synthetic
tacgcagcaaccatgaagaacgtccaagaagtgagggggtacacgaaaggtgggccaggccatgaagaaccgatg

SEQ ID NO: 256511 - DNA, 75 bp, Artificial Sequence
  Synthetic
atttatgccgatgatacagctggttgggacacccgcatcacacaagctgaccttgagaacgaagctaaagttctg

SEQ ID NO: 256512 - DNA, 75 bp, Artificial Sequence
  Synthetic
ctgatgcaaagttatgggtggaacattgtcaccatgaaaagtggtgttgatgttttctataaaccatctgaaacc

SEQ ID NO: 256513 - DNA, 75 bp, Artificial Sequence
  Synthetic
ccttgagaacgaagctaaagttctggagttgatggaaggtgagcagcggactttggcaagagcgatcatcgagct

SEQ ID NO: 256514 - DNA, 75 bp, Artificial Sequence
  Synthetic
agtgacactcttctgtgtgacataggagagtcatcacctagtgctgaaatagaggaacagcggaccctacgggtg

SEQ ID NO: 256515 - DNA, 75 bp, Artificial Sequence
  Synthetic
ttggaaatgacgtctgattggctaagtcgtggtccaaaggaattctgcataaagatactctgcccgtacatgccc

SEQ ID NO: 256516 - DNA, 75 bp, Artificial Sequence
  Synthetic
tcaccaacattgctgtgcaattggttagactcatggaagccgaggcggtcataggtccagacgacattgaaagca

SEQ ID NO: 256517 - DNA, 75 bp, Artificial Sequence
  Synthetic
aaggtgattgagaaattggagagcctgcagcgtagatttggaggtggactggtgcgcgtccccctctctcgcaac

SEQ ID NO: 256518 - DNA, 75 bp, Artificial Sequence
  Synthetic
ttgaaaggaaaaagaaatttgcagtccgtacatggctttttgagaatgcagaagaaagagtgcagcgcatggcta

SEQ ID NO: 256519 - DNA, 75 bp, Artificial Sequence
  Synthetic
tccaatcatgagatgtattgggtgagtggagcctcgggaaacatcgtgcatgcagtaaatatgactagtcaagtg

SEQ ID NO: 256520 - DNA, 75 bp, Artificial Sequence
  Synthetic
gtggagcctcgggaaacatcgtgcatgcagtaaatatgactagtcaagtgctcattgggaggatggacaagaaga

SEQ ID NO: 256521 - DNA, 75 bp, Artificial Sequence
  Synthetic
ttagtggtgatgactgtgttgttaaaccattggatgatagattttctactgctttgcactttttgaatgccatgt

SEQ ID NO: 256522 - DNA, 75 bp, Artificial Sequence
  Synthetic
tctggaaaggcccaaaatatgaggaagatgtcaatttgggtagtggcacaagagcagttggaaaaggtgtgcagc

SEQ ID NO: 256523 - DNA, 75 bp, Artificial Sequence
  Synthetic
caaaggtgagaaaagacatccaggaatggaaaccctcacaaggctggtatgactggcaacaagtccccttctgtt

SEQ ID NO: 256524 - DNA, 75 bp, Artificial Sequence
  Synthetic
acacggattacaagaggatcaagtccagaatagaaaaactgaaggaagagtatgcagccacgtggcacacagatg

SEQ ID NO: 256525 - DNA, 75 bp, Artificial Sequence
  Synthetic
cgaatcatttccaggaagttatcatgaaagatgggaggaccttggtggtgccctgcagaggacaggacgagttga

SEQ ID NO: 256526 - DNA, 75 bp, Artificial Sequence
  Synthetic
atgagcatccgtatagaacttggacttatcatgggagttatgaggtgaagccatcgggctcagccagcacgttgg

SEQ ID NO: 256527 - DNA, 75 bp, Artificial Sequence
  Synthetic
ttatcatgggagttatgaggtgaagccatcgggctcagccagcacgttggtaaatggagtcgtacggcttctgag

SEQ ID NO: 256528 - DNA, 75 bp, Artificial Sequence
  Synthetic
ttggaagagcacggatatcccctggctcaggatggaacgtcagggacacggcatgcttagcaaaagcatacgcac

SEQ ID NO: 256529 - DNA, 75 bp, Artificial Sequence
  Synthetic
caaaccatgggacgctatcactggagtcaccaccatggccatgactgacaccacaccatttggccagcagcgagt

SEQ ID NO: 256530 - DNA, 75 bp, Artificial Sequence
  Synthetic
agatgtggcttttgttgtacttccatcggcgggatttgcgcctgatggccaatgccatatgctcttcagtcccag

SEQ ID NO: 256531 - DNA, 75 bp, Artificial Sequence
  Synthetic
gtcaccaccatggccatgactgacaccacaccatttggccagcagcgagtgttcaaagagaaagtcgacacaaaa

SEQ ID NO: 256532 - DNA, 75 bp, Artificial Sequence
  Synthetic
ttgactgggttccaaccggcaggaccacttggtccattcatgggaaaggagaatggatgacaacagaggacatgt

SEQ ID NO: 256533 - DNA, 75 bp, Artificial Sequence
  Synthetic
gcccctgagcctcctcaaggagtgaagactgtgatggatgagaccaccaattggttgtgggcctatttagctagg

SEQ ID NO: 256534 - DNA, 75 bp, Artificial Sequence
  Synthetic
taagcgtgtggaaccgtgtgtggatcctggaaaacgaatggatggaggacaagaccatggtttccgactggacgg

SEQ ID NO: 256535 - DNA, 75 bp, Artificial Sequence
  Synthetic
aagaaaaaagccagactatgcacaagagaggagtttgtgaagaaagtgaacagccacgcagccctgggagccatg

SEQ ID NO: 256536 - DNA, 75 bp, Artificial Sequence
  Synthetic
aagtcccatatgtggggaagagagaagacatctggtgcggaagtctcatagggaccaggaccagggcaacatggg

SEQ ID NO: 256537 - DNA, 75 bp, Artificial Sequence
  Synthetic
tttgaagagcaaaatcaatggaagaacgcacgagaagctgtggaagacccaaagttctgggaaatggtggatgag

SEQ ID NO: 256538 - DNA, 75 bp, Artificial Sequence
  Synthetic
ctgaaaacatctacgccgccatcaaccaagtgaggtcagtcatagggaaagaaaaatatgcagactacatgcagt

SEQ ID NO: 256539 - DNA, 75 bp, Artificial Sequence
  Synthetic
gagagagaatgccatctccgaggagagtgccgaacctgcatatacaacatgatgggaaagcgtgagaaaaaaccc

SEQ ID NO: 256540 - DNA, 75 bp, Artificial Sequence
  Synthetic
cgctgaggaggtatgaagaaacccatgtgagtgaggatagggtcttgtaaataccattgatagaaaatgttgtaa

SEQ ID NO: 256541 - DNA, 75 bp, Artificial Sequence
  Synthetic
ggagaatttgggaaggccaagggaagcagagccatttggttcatgtggttgggagccagattcttggagtttgag

SEQ ID NO: 256542 - DNA, 75 bp, Artificial Sequence
  Synthetic
atattcaatgtaatatattgtaagtaaaatttttagagagcaagcaaaattaagtagtaagatttgatagtcagg

SEQ ID NO: 256543 - DNA, 75 bp, Artificial Sequence
  Synthetic
atattcaatgtaatatattgtaagtaaaattttttgagagcaagcaaaattaagtagtaagatttgatagtcagg

SEQ ID NO: 256544 - DNA, 75 bp, Artificial Sequence
  Synthetic
atattcaatgtaatatattgtaagtaaaatttttcgagagcaagcaaaattaagtagtaagatttgatagtcagg

SEQ ID NO: 256545 - DNA, 75 bp, Artificial Sequence
  Synthetic
atattcaatgtaatatattgtaagtaaaatttttggagagcaagcaaaattaagtagtaagatttgatagtcagg

SEQ ID NO: 256546 - DNA, 75 bp, Artificial Sequence
  Synthetic
gccctagggttcctcaatgaagaccactggatgagcagagaaaattccggaggaggggttgagggatctggcatc

SEQ ID NO: 256547 - DNA, 75 bp, Artificial Sequence
  Synthetic
ccagccggttaggctgccaccggaggttggtagacggtgctgcctgcgaccaaccccaggaggactgggttacca

SEQ ID NO: 256548 - DNA, 75 bp, Artificial Sequence
  Synthetic
gttggtagacggtgctgcctgcgaccaaccccaggaggactgggttaccaaagctgattttccacggttggaaag

SEQ ID NO: 256549 - DNA, 75 bp, Artificial Sequence
  Synthetic
caaaagctgggatacatcttgagagacgtggctcaaaaacctggaggaaaaatctacgctgatgacacagctggc

SEQ ID NO: 256550 - DNA, 75 bp, Artificial Sequence
  Synthetic
tgggacacccgaatcacgcaagctgacctcgagaatgaagccaaagttttggagttgatggaaggtgagcagcgg

SEQ ID NO: 256551 - DNA, 75 bp, Artificial Sequence
  Synthetic
ggagttgatggaaggtgagcagcggactctggcaagagcaatcattgagttgacatacaggcacaaagtggtcaa

SEQ ID NO: 256552 - DNA, 75 bp, Artificial Sequence
  Synthetic
gcgaggatcaaagaggaagtggacaagtagtgacctatgctttaaacacattcaccaacatcgctgttcaattga

SEQ ID NO: 256553 - DNA, 75 bp, Artificial Sequence
  Synthetic
ggcgaaggactagaggttagaggagaccctgcggaagaaatgagtggcccaagctcgccgaagctgtaaggcggg

SEQ ID NO: 256554 - DNA, 75 bp, Artificial Sequence
  Synthetic
ttagactcatggaagctgaagcggtcataggtccggatgacattgaaagcattgaaaggaaaaagaaattcgcag

SEQ ID NO: 256555 - DNA, 75 bp, Artificial Sequence
  Synthetic
aagctcgccgaagctgtaaggcgggtggacggactagaggttagaggagaccccactcttgaaagcatcaaataa

SEQ ID NO: 256556 - DNA, 75 bp, Artificial Sequence
  Synthetic
tccgcacatggctctttgagaacgcagaggaaagagtgcagcgcatggctgttagcggtgatgattgtgtagtca

SEQ ID NO: 256557 - DNA, 75 bp, Artificial Sequence
  Synthetic
gttagcggtgatgattgtgtagtcaaaccattggatgacagattctccaccgctttgcacttcctaaatgccatg

SEQ ID NO: 256558 - DNA, 75 bp, Artificial Sequence
  Synthetic
agatcttctgctctattccaccatcagtcacaaggcaccgagcgccgaatattgtgactgatgggggggaagacc

SEQ ID NO: 256559 - DNA, 75 bp, Artificial Sequence
  Synthetic
tcaaaggtgaggaaagacatccaggagtggaaaccttcacaaggctggtacgattggcaacaagtccccttctgt

SEQ ID NO: 256560 - DNA, 75 bp, Artificial Sequence
  Synthetic
agtgggagtgaagagggtagtaatgaacttgctagatggcagagggccaatacggtttgtgttggctctcttagc

SEQ ID NO: 256561 - DNA, 75 bp, Artificial Sequence
  Synthetic
tcgaatcatttccaggaagtcatcatgaaagatgggagaaccctagtggtaccctgcagaggacaggatgagctg

SEQ ID NO: 256562 - DNA, 75 bp, Artificial Sequence
  Synthetic
tttcttcaggtttacagcacttgccccgaccaaggccttgatgaggcgctggaagagcgtgaacaagacaacggc

SEQ ID NO: 256563 - DNA, 75 bp, Artificial Sequence
  Synthetic
ataggaagagcacgcatatcccctggctcaggatggaacgtcaaggatacggcatgtttggcaaaggcgtatgca

SEQ ID NO: 256564 - DNA, 75 bp, Artificial Sequence
  Synthetic
ggcatgtttggcaaaggcgtatgcacaaatgtggcttttgctgtacttccatcgaagggatctgcgtctgatggc

SEQ ID NO: 256565 - DNA, 75 bp, Artificial Sequence
  Synthetic
tggtgaacaaaaggggcaaaaaacaaaagaaaagaggtggcagtgaaacatccgtgcttatggtcattttcatgc

SEQ ID NO: 256566 - DNA, 75 bp, Artificial Sequence
  Synthetic
caacgccatatgctcttcagttccagtggactgggttccgaccggcaggaccacttggtccatccatggaaaagg

SEQ ID NO: 256567 - DNA, 75 bp, Artificial Sequence
  Synthetic
tgattggatttgccgctgccttaaagctttccaccttccagggcaagataatgatgactgtgaacgctacggaca

SEQ ID NO: 256568 - DNA, 75 bp, Artificial Sequence
  Synthetic
agagtggatgacaacagaggacatgcttagcgtatggaatcgtgtgtggattttggaaaatgaatggatggagga

SEQ ID NO: 256569 - DNA, 75 bp, Artificial Sequence
  Synthetic
caagaccttggtctctgactggacggaagtcccatacgtgggaaagagagaagacatctggtgcggaagtctcat

SEQ ID NO: 256570 - DNA, 75 bp, Artificial Sequence
  Synthetic
gtgacaaacaagctgtgtacgtaaactatggaaggtgcacacgtgctcgccattcaaagcgcagtcgtcgttcca

SEQ ID NO: 256571 - DNA, 75 bp, Artificial Sequence
  Synthetic
agggaccaggaccagagcaacatgggctgagaacatttatgcagctatcaatcaagtgaggtcagttatagggaa

SEQ ID NO: 256572 - DNA, 75 bp, Artificial Sequence
  Synthetic
tcacagtgcagactcatggtgaaagcactttggtcaacaaaaaggatgcctggctggattccacgaaggccacgc

SEQ ID NO: 256573 - DNA, 75 bp, Artificial Sequence
  Synthetic
agagaagtatgtagattacatgcagtcattgaggaggtatgaagaaatccatgtgagtgaagacagggttttgta

SEQ ID NO: 256574 - DNA, 75 bp, Artificial Sequence
  Synthetic
gttatctcaccaaaacagagaactggattataagaaatcctggttacgcgctggtggccgttgtccttggctgga

SEQ ID NO: 256575 - DNA, 75 bp, Artificial Sequence
  Synthetic
aataatatcaatggaaaatttttgtaaatatttaatgatatagtattgtttaggtttttagaattaagtagaatc

SEQ ID NO: 256576 - DNA, 75 bp, Artificial Sequence
  Synthetic
agttatttttacagtgcttttgctcctcgttgctcctgcctacagttttaactgtctgggaatgagcagccgtga

SEQ ID NO: 256577 - DNA, 75 bp, Artificial Sequence
  Synthetic
aaatatttaatgatatagtattgtttaggtttttagaattaagtagaatcaatttgtaagacttgatagtcaggc

SEQ ID NO: 256578 - DNA, 75 bp, Artificial Sequence
  Synthetic
actgtctgggaatgagcagccgtgatttcattgaaggtgcttcaggagctacatgggtcgatttggtgctggagg

SEQ ID NO: 256579 - DNA, 75 bp, Artificial Sequence
  Synthetic
aaccccaggaggactgggttaccaaagctgactctctacggttggaaagcctcccagaaccgtctcggaagagga

SEQ ID NO: 256580 - DNA, 75 bp, Artificial Sequence
  Synthetic
gcgacagttgcatcaccatcatggccgctgacaaacccacccttgacataagaatgatgaacattgaagccacca

SEQ ID NO: 256581 - DNA, 75 bp, Artificial Sequence
  Synthetic
atcttgcactggttagaaattactgctatgcagctactgtgtcagacgtttctacggtgtcaaactgtcccacta

SEQ ID NO: 256582 - DNA, 75 bp, Artificial Sequence
  Synthetic
ggccccaggaggactgggtaaacaaagccgtaaggcccccgcagcccgggccgggaggaggtgatgcgaaccccg

SEQ ID NO: 256583 - DNA, 75 bp, Artificial Sequence
  Synthetic
caggggagtcacacaacacgaagcgggcagatcacaattacttgtgcaaacgaggtgtgaccgacagaggctggg

SEQ ID NO: 256584 - DNA, 75 bp, Artificial Sequence
  Synthetic
ccgggaggaggtgatgcgaaccccggcgaaggactagaggttagaggagaccctgcggaaacactgagtggccca

SEQ ID NO: 256585 - DNA, 75 bp, Artificial Sequence
  Synthetic
gtaatggatgtggcttgtttggtaaggggagcattgacacatgcgcaaagttcacctgctctaactcagctgcgg

SEQ ID NO: 256586 - DNA, 75 bp, Artificial Sequence
  Synthetic
ttcacctgctctaactcagctgcggggagacttatcttacctgaggacatcaaatatgaagttggggtttttgtt

SEQ ID NO: 256587 - DNA, 75 bp, Artificial Sequence
  Synthetic
gctctattccaacatcagtcacaaggcaccgagcgccgaatattgtgactgatgggggagaagaccacaggatct

SEQ ID NO: 256588 - DNA, 75 bp, Artificial Sequence
  Synthetic
atttcaccaaacgctccagccatcacagcaaagatgggcgactatggagaagtcactgtggagtgtgaaccgagg

SEQ ID NO: 256589 - DNA, 75 bp, Artificial Sequence
  Synthetic
agtggactgaatacagaggcctactacgtcatgaccattggaacgaaacactttctagtgcatcgtgagtggttc

SEQ ID NO: 256590 - DNA, 75 bp, Artificial Sequence
  Synthetic
atacggtttgcattggctctcctagctttcttcaggtttacagcacttgccccaactaaggccttgataaaacgc

SEQ ID NO: 256591 - DNA, 75 bp, Artificial Sequence
  Synthetic
aatgatttgctcttgccatggacatcacctgcaagcacggaatggaggaatagagaaattctcgtggagtttgaa

SEQ ID NO: 256592 - DNA, 75 bp, Artificial Sequence
  Synthetic
cacctgcaagcacggaatggaggaatagagaaattctcgtggagtttgaagagccacatgccaccaaacaatcag

SEQ ID NO: 256593 - DNA, 75 bp, Artificial Sequence
  Synthetic
tggaaaagcgttaacaaaacaacggccatgaaacacctgaccagtttcaagaaggaactgggtacactgattgat

SEQ ID NO: 256594 - DNA, 75 bp, Artificial Sequence
  Synthetic
gtggtgaacaaaaggggcagaaaacaaaagaaaagaggtggtagtgaaatatcggtgtttctggtcatcttcacg

SEQ ID NO: 256595 - DNA, 75 bp, Artificial Sequence
  Synthetic
gccataccagtcgagttttcgagcagcacacttaaactcacttcaggacaccttaagtgtcgcgtgaaaatggag

SEQ ID NO: 256596 - DNA, 75 bp, Artificial Sequence
  Synthetic
ttgattggactcgccgctgccctaaagctttccaccttccagggcaaaataatgatgaccgtgaacgccacggac

SEQ ID NO: 256597 - DNA, 75 bp, Artificial Sequence
  Synthetic
aaattgaaactgaaaggaaccacttatgggatgtgcacagaaaaatttactttctcaaagaatccagccgacacc

SEQ ID NO: 256598 - DNA, 75 bp, Artificial Sequence
  Synthetic
attgctgatgtgattgctatcccaactccgaagggacccaatcaatgctggattcgagccattgacattggattc

SEQ ID NO: 256599 - DNA, 75 bp, Artificial Sequence
  Synthetic
ggtcatggcacggtagtactagaactgcagtacaccgggagtgatggaccatgcaaaattccaatatcctctgta

SEQ ID NO: 256600 - DNA, 75 bp, Artificial Sequence
  Synthetic
atgtgcgatgacactatcacttatgaatgtccgaaactggaaagtggaaatgaccctgaagacattgactgttgg

SEQ ID NO: 256601 - DNA, 75 bp, Artificial Sequence
  Synthetic
atgcaaaattccaatatcctctgtagcaagtctcaatgacatgacgcctgtcggaagaatggtgacagctaatcc

SEQ ID NO: 256602 - DNA, 75 bp, Artificial Sequence
  Synthetic
tgaccctgaagacattgactgttggtgtgacaagcaagccgtgtacgtgcactatgggagatgcacacgggctcg

SEQ ID NO: 256603 - DNA, 75 bp, Artificial Sequence
  Synthetic
atatgtagcttcatcaactgccaatgctaaagttctggtggagattgaaccacccttcggagactcatacattgt

SEQ ID NO: 256604 - DNA, 75 bp, Artificial Sequence
  Synthetic
gctaaagttctggtggagattgaaccacccttcggagactcatacattgtggtaggcaggggagacaagcagatc

SEQ ID NO: 256605 - DNA, 75 bp, Artificial Sequence
  Synthetic
aatcaccactggcataaggagggtagttcaattggcaaagccttcagcacaaccttgaagggagcacagagattg

SEQ ID NO: 256606 - DNA, 75 bp, Artificial Sequence
  Synthetic
ctggttagattcaacgaaggccacgcgttaccttaccaaaacagagaattggataataaggaatcctggctatgc

SEQ ID NO: 256607 - DNA, 75 bp, Artificial Sequence
  Synthetic
aaccttgaagggagcacagagattggcagctcttggagacacggcgtgggactttggatcagtaggcggagtctt

SEQ ID NO: 256608 - DNA, 75 bp, Artificial Sequence
  Synthetic
actggtggcagttgtccttggctggatgctgggcagcaacacagggcaaaaagttatttttacagtgcttttgct

SEQ ID NO: 256609 - DNA, 75 bp, Artificial Sequence
  Synthetic
caattcaatcggaaaggcagtacaccaagtctttggaggagcatttagaaccctctttggaggaatgtcatggat

SEQ ID NO: 256610 - DNA, 75 bp, Artificial Sequence
  Synthetic
caagtctttggaggagcatttagaaccctctttggaggaatgtcatggatcagccaaggtctgctgggggcgtta

SEQ ID NO: 256611 - DNA, 75 bp, Artificial Sequence
  Synthetic
tctcgtcgctcctgcttacagttttaactgtctaggaatgagcagccgtgactttattgaaggagcttcaggagc

SEQ ID NO: 256612 - DNA, 75 bp, Artificial Sequence
  Synthetic
ctgctatggatgggggtcaatgctagagataaatcaattgctttggctttcctagcaacaggaggcgttttgttg

SEQ ID NO: 256613 - DNA, 75 bp, Artificial Sequence
  Synthetic
cacatgggtcgatttggtgctagaaggcgacagctgtatcaccatcatggctgctgacaaacccacccttgacat

SEQ ID NO: 256614 - DNA, 75 bp, Artificial Sequence
  Synthetic
ttcctggccacaaatgtccatgctgacactggttgcgcgattgacatcaccaggagggagctcaagtgtggcagc

SEQ ID NO: 256615 - DNA, 75 bp, Artificial Sequence
  Synthetic
aagaatgatgaatattgaagctaccaatcttgcactagtcagaaattattgctacgcagctaccgtgtcagatgt

SEQ ID NO: 256616 - DNA, 75 bp, Artificial Sequence
  Synthetic
ggaatattcatacacaatgatgttgaagcctggattgaccgctacaagtacctgccagagacccccaagcaactg

SEQ ID NO: 256617 - DNA, 75 bp, Artificial Sequence
  Synthetic
aagcctggattgaccgctacaagtacctgccagagacccccaagcaactggctaaagtggttgaaaacgctcaca

SEQ ID NO: 256618 - DNA, 75 bp, Artificial Sequence
  Synthetic
ttccacggtgtcgaactgtcctacgacaggggaatcacacaacacgaagcgggcagatcacaactacttgtgcaa

SEQ ID NO: 256619 - DNA, 75 bp, Artificial Sequence
  Synthetic
gcgaggcgtgaccgacagaggctggggtaatggctgtggcttgtttggtaaaggaagcattgacacatgtgcaaa

SEQ ID NO: 256620 - DNA, 75 bp, Artificial Sequence
  Synthetic
gtttacctgctccagctcagctgcggggagacttatcctacctgagaacatcaagtatgaagttgggattttcgt

SEQ ID NO: 256621 - DNA, 75 bp, Artificial Sequence
  Synthetic
atgctttactcaaggaaaatgccattgatttgagtgttgtcgtggaaaaacagaaaggcatgtacagagcagcac

SEQ ID NO: 256622 - DNA, 75 bp, Artificial Sequence
  Synthetic
tcacggatcgacagactcaactagccatggaaactactccacccaaattggagctaaccaagcagccaggttcac

SEQ ID NO: 256623 - DNA, 75 bp, Artificial Sequence
  Synthetic
ccaataggctgagactcactgtggaagaacttgatataggctggaaggcctggggtaagagtttgctttttgcgg

SEQ ID NO: 256624 - DNA, 75 bp, Artificial Sequence
  Synthetic
tggggtaagagtttgctttttgcggcggaattggccaattcaacgtttgtggttgatggacctgaaacagctgaa

SEQ ID NO: 256625 - DNA, 75 bp, Artificial Sequence
  Synthetic
catttcaccaaacgctccagccatcacagcaaaaatgggtgactatggagaagtcgccgtggaatgtgagccgag

SEQ ID NO: 256626 - DNA, 75 bp, Artificial Sequence
  Synthetic
gagtgggttgaacacagaggcttactatgtcatgactatcggaacaaaacactttttggtgcaccgtgagtggtt

SEQ ID NO: 256627 - DNA, 75 bp, Artificial Sequence
  Synthetic
atttggcataacatccaccagggtttggcttaaactcagagaggaaaatacctcggagtgtgacagcaccattat

SEQ ID NO: 256628 - DNA, 75 bp, Artificial Sequence
  Synthetic
taatgatttgctcttgccgtggacatcaccttcaagtacggaatggaggaatagagaaatcctcatggagtttga

SEQ ID NO: 256629 - DNA, 75 bp, Artificial Sequence
  Synthetic
cctcggagtgtgacagcaccattattgggaccgcagttaagggcaaccatgcagtacacagtgacctttcctact

SEQ ID NO: 256630 - DNA, 75 bp, Artificial Sequence
  Synthetic
agagccacatgctactaaacaatcagtagttgccttgggctcacaggaaggagctttgcaccaggccttggctgg

SEQ ID NO: 256631 - DNA, 75 bp, Artificial Sequence
  Synthetic
ccgagacacacacactatggggtgatgcagtggaagaaacggagttgataatcccagtgactctcgccggcccac

SEQ ID NO: 256632 - DNA, 75 bp, Artificial Sequence
  Synthetic
agccgtaccagtcgagtttgccagcagcacactcaaactcacttcaggtcatctcaagtgtcgcgtaaaaatgga

SEQ ID NO: 256633 - DNA, 75 bp, Artificial Sequence
  Synthetic
atcccagtgactctcgccggcccacgcagcaagcacaacagaagagaaggatacaaggttcaagttcaaggtccg

SEQ ID NO: 256634 - DNA, 75 bp, Artificial Sequence
  Synthetic
gaagttgaaattgaaaggaaccacttatgggatgtgcacagaaaagtttactttctcgaagaatccagctgacac

SEQ ID NO: 256635 - DNA, 75 bp, Artificial Sequence
  Synthetic
atacaaggttcaagttcaaggtccgtgggatgaagaagacataaaattggactttgactactgcccaggaacaac

SEQ ID NO: 256636 - DNA, 75 bp, Artificial Sequence
  Synthetic
actttgactactgcccaggaacaaccgtcacagtgagtgaacattgtggaaaacgaggtccctcagtacgcacca

SEQ ID NO: 256637 - DNA, 75 bp, Artificial Sequence
  Synthetic
tggtcacggtacagtagttttggagctgcagtacacagggagtgatggaccatgcaaaattccaatatcctcagt

SEQ ID NO: 256638 - DNA, 75 bp, Artificial Sequence
  Synthetic
aaacgaggtccctcagtacgcaccacaactgacagcgggaaactcgtcacggactggtgttgtaggagctgcacg

SEQ ID NO: 256639 - DNA, 75 bp, Artificial Sequence
  Synthetic
agcgagtcttaatgacatgacgcctgtcggaagaatggtgacggccaatccatatgttgcttcatcaactgccaa

SEQ ID NO: 256640 - DNA, 75 bp, Artificial Sequence
  Synthetic
gataagacctatgaagcatgatgagtccactctagttaaatcaagggttcaagcatttaatggagatatgattga

SEQ ID NO: 256641 - DNA, 75 bp, Artificial Sequence
  Synthetic
tgccaaagtcttagtggaaattgaaccaccctttggagactcctacattgtagtaggtaggggagacaagcagat

SEQ ID NO: 256642 - DNA, 75 bp, Artificial Sequence
  Synthetic
caaccaccactggcacaaggagggcagctcgattggtaaggccttcagtacaactttgaagggagcgcagagact

SEQ ID NO: 256643 - DNA, 75 bp, Artificial Sequence
  Synthetic
tactctgccagcagcggttggggctctgctagtcctcctccttgggggcattacctacactgatctagtgcggta

SEQ ID NO: 256644 - DNA, 75 bp, Artificial Sequence
  Synthetic
ggcagctcttggagacacggcatgggattttggatcggtgggcggagtttttaactcaattgggaaagcgataca

SEQ ID NO: 256645 - DNA, 75 bp, Artificial Sequence
  Synthetic
gattttggatcggtgggcggagtttttaactcaattgggaaagcgatacatcaagtctttggaggagcgttcaga

SEQ ID NO: 256646 - DNA, 75 bp, Artificial Sequence
  Synthetic
attcaaggtacagcccgcttttcttgttgccagcttgacacgcagtagatggactaatcaagagaatctcgtcct

SEQ ID NO: 256647 - DNA, 75 bp, Artificial Sequence
  Synthetic
agagacaaatcaattgccctggcatttctagcaacaggaggcgtcttgttgtttctggccacaaatgtccatgct

SEQ ID NO: 256648 - DNA, 75 bp, Artificial Sequence
  Synthetic
tcttgctgattggcatttgcagcttgctgaatgagagaaggaggtctgtggagaaaaagaaaggagctgttttaa

SEQ ID NO: 256649 - DNA, 75 bp, Artificial Sequence
  Synthetic
gacactggttgcgccattgacatcaccaggagggagctcaagtgtggcagcggaatattcattcacaatgatgtt

SEQ ID NO: 256650 - DNA, 75 bp, Artificial Sequence
  Synthetic
ttggtctagccctgacttcgactggatatttttcaccaacaatcatggcagcaggccttatgatatgcaacccta

SEQ ID NO: 256651 - DNA, 75 bp, Artificial Sequence
  Synthetic
gaggcctggattgatcgctacaagtacctacccgagacccccaagcaattggcaaaagtggttgaaaacgcccat

SEQ ID NO: 256652 - DNA, 75 bp, Artificial Sequence
  Synthetic
acaagaagagaggatggcccgccacagaggtgttaacagcagtgggactgatgttcgccattgttggaggactcg

SEQ ID NO: 256653 - DNA, 75 bp, Artificial Sequence
  Synthetic
aagagcggaatatgtgggattcggtcagtgaacagattcgagcatcaaatgtgggagtctgtacgtgatgagctc

SEQ ID NO: 256654 - DNA, 75 bp, Artificial Sequence
  Synthetic
ctgagctagacattgattctatgtcagtcccttttaccatagctggcctcatgttagtgtcctatgttatctcgg

SEQ ID NO: 256655 - DNA, 75 bp, Artificial Sequence
  Synthetic
aacgccttatttaaggaaaacgccatcgatttgagtgttgtggtggaaagacagaaaggcatgtatagggcagca

SEQ ID NO: 256656 - DNA, 75 bp, Artificial Sequence
  Synthetic
gaaaagccacagacatgtggcttgaaagagcagcagatgtgtcatgggaagcgggggcagcaataacaggtacca

SEQ ID NO: 256657 - DNA, 75 bp, Artificial Sequence
  Synthetic
cctaataggctgaagctcactgtggaagaacttgacataggctggaaagcctggggaaagagcctgctctttgca

SEQ ID NO: 256658 - DNA, 75 bp, Artificial Sequence
  Synthetic
gcgggggcagcaataacaggtaccagcgaaagactggatgtccaattggacgatgatggagactttcatctgctc

SEQ ID NO: 256659 - DNA, 75 bp, Artificial Sequence
  Synthetic
gccgaactggccaactcaacgtttgtgatcgatggacctgaaacagccgaatgtcccaattcaaagagggcgtgg

SEQ ID NO: 256660 - DNA, 75 bp, Artificial Sequence
  Synthetic
aatgaccctggagttccatggaaaatctgggttttaagaatgacatgcttaagcgtagctgccatcactccatgg

SEQ ID NO: 256661 - DNA, 75 bp, Artificial Sequence
  Synthetic
aacagctttgaaattgaagattttggatttgggataacgtctaccagggtttggctcaagctcagggaggagaat

SEQ ID NO: 256662 - DNA, 75 bp, Artificial Sequence
  Synthetic
gccattttgccatccgcgtttgggtattggctgactctgaagtacacaaaacgagggggtgttttttgggatacg

SEQ ID NO: 256663 - DNA, 75 bp, Artificial Sequence
  Synthetic
acctcagagtgtgatagtaccatcattggaaccgccgtcaaaggcaatcatgcggtgcacagtgacctatcctac

SEQ ID NO: 256664 - DNA, 75 bp, Artificial Sequence
  Synthetic
ccttccccaaaagtgtatcccaagggggatacgacgccaggagtctaccgaataatggccagaggtatcctggga

SEQ ID NO: 256665 - DNA, 75 bp, Artificial Sequence
  Synthetic
tggattgagagtgaactcaatgggacgtggaagcttgagagagccatctttggagacgtgaaatcctgtacttgg

SEQ ID NO: 256666 - DNA, 75 bp, Artificial Sequence
  Synthetic
aggtaccaagctggggtaggagtcatgcatgagggtgtgttccacacgctgtggcacacaactagaggagctgcc

SEQ ID NO: 256667 - DNA, 75 bp, Artificial Sequence
  Synthetic
cccgagacacacacactgtggggtgatgcagtggaagaaacagagctgattattccagtgactcttgctggccca

SEQ ID NO: 256668 - DNA, 75 bp, Artificial Sequence
  Synthetic
ataatgagtggtgaaggaagattgacaccatactggggcaatgtgaaagaggacagagtgacctatggtggccca

SEQ ID NO: 256669 - DNA, 75 bp, Artificial Sequence
  Synthetic
ggtggaaccaggaaagccagcaataaacgtgcagaccaagcccgggatttttaagacagcacatggagaaattgg

SEQ ID NO: 256670 - DNA, 75 bp, Artificial Sequence
  Synthetic
aaaacgaggcccctcggtacgcaccaccactgatagtgggaaactcgtcacagactggtgttgcaggagttgtac

SEQ ID NO: 256671 - DNA, 75 bp, Artificial Sequence
  Synthetic
agccgtgagcttggattacccgattggaacttcaggatccccaatagtcaatagcaatggagaaatcattggcct

SEQ ID NO: 256672 - DNA, 75 bp, Artificial Sequence
  Synthetic
gctccctcctttaagattcaccacggctagtggatgctggtatggaatggaaataagacccgtgaaacacgatga

SEQ ID NO: 256673 - DNA, 75 bp, Artificial Sequence
  Synthetic
atagcaatggagaaatcattggcctttatggaaatggagtgatactaggtaatggggcctacgtcagtgctattg

SEQ ID NO: 256674 - DNA, 75 bp, Artificial Sequence
  Synthetic
gctagtggatgctggtatggaatggaaataagacccgtgaaacacgatgagtccactctggtaaagtcaagggtc

SEQ ID NO: 256675 - DNA, 75 bp, Artificial Sequence
  Synthetic
ttcaaggagaaagagtagaggaaccagtgccagaggcctacaatcctgagatgctaaagaaaaggcaactaaccg

SEQ ID NO: 256676 - DNA, 75 bp, Artificial Sequence
  Synthetic
tgctggacctgcacccaggtgctgggaaaacacgacgcatactcccccaaataattaaagatgccatccaaaaaa

SEQ ID NO: 256677 - DNA, 75 bp, Artificial Sequence
  Synthetic
attacctacactgatttggtgcggtacctcatattggtgggctcagcatttgcagaatcaaacaatggaggtgac

SEQ ID NO: 256678 - DNA, 75 bp, Artificial Sequence
  Synthetic
gtcattcacttggccctcattgctgtgtttaaagtacagcccgcattccttgttgccagcttaacacgcagtaga

SEQ ID NO: 256679 - DNA, 75 bp, Artificial Sequence
  Synthetic
tggactaatcaagagaatcttgttctggttctgggagcggccttctttcagatggcagcttcagacctggagttg

SEQ ID NO: 256680 - DNA, 75 bp, Artificial Sequence
  Synthetic
taacacatcgattgatgtcgccgctaagagtcccgaattacaacctgtttgtcatggatgaagcccatttcacag

SEQ ID NO: 256681 - DNA, 75 bp, Artificial Sequence
  Synthetic
tcgatcccaggtctgttgaattcagctgccacagcctggatggtgttgcgagcaatggccttcccgtcaacctca

SEQ ID NO: 256682 - DNA, 75 bp, Artificial Sequence
  Synthetic
atccagccagtatagcagctcgtggatatattgccacccgtgttgaagctggagaggccgcggccatctttatga

SEQ ID NO: 256683 - DNA, 75 bp, Artificial Sequence
  Synthetic
gcaatagccatgcctatgcttgcaatgttggctccggggatgagaatgctccatcttgacacataccggatagtg

SEQ ID NO: 256684 - DNA, 75 bp, Artificial Sequence
  Synthetic
cccattcccggacaccaattcaccagtccatgatgtatccagtgaaatcccagacagagcatggagcagtggatt

SEQ ID NO: 256685 - DNA, 75 bp, Artificial Sequence
  Synthetic
cttctgctgattggtatttgcagcttgctgaacgagagaaggagatcggtagagaaaaagaaaggagctgtcttg

SEQ ID NO: 256686 - DNA, 75 bp, Artificial Sequence
  Synthetic
tgagtggataaccgactatgctggaaagaccgtctggttcgtggcaagcgtaaaaatgagcaatgagatcgcgca

SEQ ID NO: 256687 - DNA, 75 bp, Artificial Sequence
  Synthetic
attggtttagctctgacttcgactggatatttttcaccaacaattatggcggcaggcctcatggtatgcaatcct

SEQ ID NO: 256688 - DNA, 75 bp, Artificial Sequence
  Synthetic
aacaagaaaagaggctggcctgctactgaggtcctaacagcagtgggcttgatgtttgctattgttggaggactg

SEQ ID NO: 256689 - DNA, 75 bp, Artificial Sequence
  Synthetic
acaactgacatctcggaaatgggagcaaattttggggcaagcagagtgattgattgtcgcaagagtgtcaagcca

SEQ ID NO: 256690 - DNA, 75 bp, Artificial Sequence
  Synthetic
gctgagctagacattgattccatgtcagtcccttttaccatagctggtctcatgttagtgtcctacgtgatttcg

SEQ ID NO: 256691 - DNA, 75 bp, Artificial Sequence
  Synthetic
acgatcttggacgaaggagagggaagagtcattctcagtgtgccgtcagccatcactagtgccagtgctgcccaa

SEQ ID NO: 256692 - DNA, 75 bp, Artificial Sequence
  Synthetic
gggaaagccacagacatgtggcttgagagagcagccgacgtatcatgggagacaggggcagcaataacaggtacc

SEQ ID NO: 256693 - DNA, 75 bp, Artificial Sequence
  Synthetic
cggagaggtagagtgggcaggaatccaagtcaaataggagatgagtaccactatggaggcggaaccagtgaggat

SEQ ID NO: 256694 - DNA, 75 bp, Artificial Sequence
  Synthetic
agcgaaagactagacgtccagttggatgatgatggagattttcatctactcaatgaccctggagttccatggaaa

SEQ ID NO: 256695 - DNA, 75 bp, Artificial Sequence
  Synthetic
gacaccatgctggcgcactggactgaagcaaaaattcttttggacaacatccacctcccaaatggcctagtagct

SEQ ID NO: 256696 - DNA, 75 bp, Artificial Sequence
  Synthetic
atttgggttttgagaatgacatgtttgagtgtggctgctatcactccatgggccattttgccatctgcgttcggg

SEQ ID NO: 256697 - DNA, 75 bp, Artificial Sequence
  Synthetic
cagctgtacggtcccgaaagagataaaacttacaccatggatggagagtaccgactcagaggcgaagaacgcaag

SEQ ID NO: 256698 - DNA, 75 bp, Artificial Sequence
  Synthetic
tactggctgacccttaagtacacgaagcgagggggtgtcttttgggacacaccttctccaaaagtgtaccccaag

SEQ ID NO: 256699 - DNA, 75 bp, Artificial Sequence
  Synthetic
ggagacacgacgccgggagtctatcgaataatggcccgaggcatcctgggaaggtaccaagctggagtaggagtc

SEQ ID NO: 256700 - DNA, 75 bp, Artificial Sequence
  Synthetic
ataacaagaataggagaaagaaaagttttgaagccacgatggttagatgcacgcgtgtattcagaccaccagtcc

SEQ ID NO: 256701 - DNA, 75 bp, Artificial Sequence
  Synthetic
atgcacgagggtgttttccacacgttgtggcacacaactagaggagctgccataatgagtggcgaaggaaggtta

SEQ ID NO: 256702 - DNA, 75 bp, Artificial Sequence
  Synthetic
ttaaaatggttcaaggactttgcagctgggaagcggtcggcgatcggattttttgaagtgctaggccggatgcca

SEQ ID NO: 256703 - DNA, 75 bp, Artificial Sequence
  Synthetic
acaccatactggggcaacgtgaaagaggacagagtgacttatggtggcccatggaaactggaccagaagtggaat

SEQ ID NO: 256704 - DNA, 75 bp, Artificial Sequence
  Synthetic
gagcattttgcagggaaaacacgtgaagctctggacaccatgtacctggtggcaacatcagaaaaaggaggcaaa

SEQ ID NO: 256705 - DNA, 75 bp, Artificial Sequence
  Synthetic
ggagtggatgacgttcaaatgatagtggtagaaccaggaaagccagcagtaaatgtacagaccaagcctggaatc

SEQ ID NO: 256706 - DNA, 75 bp, Artificial Sequence
  Synthetic
accgcagggttttttctcctcatgatgcaaagaaaaggaattggtaaactgggactcggagcactcgtcttggta

SEQ ID NO: 256707 - DNA, 75 bp, Artificial Sequence
  Synthetic
ttcaagacaacgcacggagaaatcggagcagtgagcttagactatccgattggaacatcaggctctccaatagtc

SEQ ID NO: 256708 - DNA, 75 bp, Artificial Sequence
  Synthetic
gtggccacttttttcctttggatgtcagacgtttctggcaccaaaatagctggtgtgttgctgcttgcgctgctt

SEQ ID NO: 256709 - DNA, 75 bp, Artificial Sequence
  Synthetic
aacagcaacggagagatcatcggcctttatggaaatggagtaattctaggaaatggagcctatgttagtgctatt

SEQ ID NO: 256710 - DNA, 75 bp, Artificial Sequence
  Synthetic
gtccaaggagaaagagtagaggaaccagttccggaggcttataaccctgagatgctaaagaaaaggcaactaact

SEQ ID NO: 256711 - DNA, 75 bp, Artificial Sequence
  Synthetic
caaccaactggcagtattcttgatatgtgtgctgcttgttgttgggttggtggctgcaaatgaatatgggatgtt

SEQ ID NO: 256712 - DNA, 75 bp, Artificial Sequence
  Synthetic
gtactggacttgcatccgggcgctggaaaaacacgacgcatccttccccaaataattaaagacgccatccagaga

SEQ ID NO: 256713 - DNA, 75 bp, Artificial Sequence
  Synthetic
ggaaaggacaaaaactgacataagaaacctatttgggaagtcactaattgaggaaaacgaggtccatatccctcc

SEQ ID NO: 256714 - DNA, 75 bp, Artificial Sequence
  Synthetic
agactacgcactgcggttcttgcacctacgagggtggtcgcagcagaaatggcagaagctttgagaggcctccca

SEQ ID NO: 256715 - DNA, 75 bp, Artificial Sequence
  Synthetic
gtcaggtatctgaccccagccgtgcaaagagaacatagcggaaacgagatagtggatgtgatgtgccatgcgaca

SEQ ID NO: 256716 - DNA, 75 bp, Artificial Sequence
  Synthetic
tccactgataaaacatctggtgacatcacagtatgttaccacctcattggcatcaataaatgcccaagcagggag

SEQ ID NO: 256717 - DNA, 75 bp, Artificial Sequence
  Synthetic
ttaacacatcgcttgatgtcaccactaagagttccaaattacaacttgtttgtcatggatgaagcccacttcaca

SEQ ID NO: 256718 - DNA, 75 bp, Artificial Sequence
  Synthetic
cttgtttacattgcctaaaggaattcctttcactgattttgacttgtctgtagcactggtgtttcttggttgctg

SEQ ID NO: 256719 - DNA, 75 bp, Artificial Sequence
  Synthetic
cctttcactgattttgacttgtctgtagcactggtgtttcttggttgctggggacaagtgacgctcaccaccttg

SEQ ID NO: 256720 - DNA, 75 bp, Artificial Sequence
  Synthetic
gatccagccagcatagcagctcgtggatacatagccacccgagttgaagcgggagaggccgcggccatctttatg

SEQ ID NO: 256721 - DNA, 75 bp, Artificial Sequence
  Synthetic
ataatggcaacaatactggtaaccctccactacggatatcttttacctggttggcaagcagaggctttgagggct

SEQ ID NO: 256722 - DNA, 75 bp, Artificial Sequence
  Synthetic
acggccacgcctccaggcacatccgacccatttcctgataccaactcaccagtccatgatgtgtctagcgaaatt

SEQ ID NO: 256723 - DNA, 75 bp, Artificial Sequence
  Synthetic
gcacagaagcgcacagccgctggtatcatgaaaaacgcagttgttgatggcatagtcgcgacagatgttccagag

SEQ ID NO: 256724 - DNA, 75 bp, Artificial Sequence
  Synthetic
ccagatagagcatggagtagtggatttgagtggataactgactatgtgggaaaaaccgtttggttcgtagccagc

SEQ ID NO: 256725 - DNA, 75 bp, Artificial Sequence
  Synthetic
aaaaaccgtttggttcgtagccagcgtaaaaatgggcaatgaaattgcccagtgcttgcagcgggcaggaaagcg

SEQ ID NO: 256726 - DNA, 75 bp, Artificial Sequence
  Synthetic
cgtcttggccagcgtggcagcagtatgcgtgaaccccagaataactaccatccgtgaagctggaatactctgtac

SEQ ID NO: 256727 - DNA, 75 bp, Artificial Sequence
  Synthetic
cgcagcagctctcaccctgtgggacaacaacgccagcgcggcttggaattccaccacggctactgggctgtgcca

SEQ ID NO: 256728 - DNA, 75 bp, Artificial Sequence
  Synthetic
aacaactgacatatcggaaatgggagcaaatttcggagcaagcagagtgattgactgccgcaagagcgtcaagcc

SEQ ID NO: 256729 - DNA, 75 bp, Artificial Sequence
  Synthetic
tgttatgcgtggaagctggatagcgggagcttcaatagcctggactctcataaaaaatgcagaaaaaccagcgtt

SEQ ID NO: 256730 - DNA, 75 bp, Artificial Sequence
  Synthetic
ggagcttcaatagcctggactctcataaaaaatgcagaaaaaccagcgttcaaaagaggaagagcaggaggaaga

SEQ ID NO: 256731 - DNA, 75 bp, Artificial Sequence
  Synthetic
aacgatcctggaagaaggagaaggaagagtcattctcagtgtgccgtcagccatcaccagcgccagtgctgcaca

SEQ ID NO: 256732 - DNA, 75 bp, Artificial Sequence
  Synthetic
actctcggagagcaatggaaagaaaagctaaatgccatgggtaaagaagaattcttcagctatcggaaagaagcc

SEQ ID NO: 256733 - DNA, 75 bp, Artificial Sequence
  Synthetic
tgacaccatgctggctcagtggactgaagctaagattcttttggacaacatccatcttccaaatggcctagtggc

SEQ ID NO: 256734 - DNA, 75 bp, Artificial Sequence
  Synthetic
tcagctgtatggtcctgagagagataaaacctacaccatggatggagagtacagactcagaggtgaagaacgcaa

SEQ ID NO: 256735 - DNA, 75 bp, Artificial Sequence
  Synthetic
cgagggacagcgaaactcagatggttggttgaaagacgctttgtccagcccataggaaaagtagtggatctgggg

SEQ ID NO: 256736 - DNA, 75 bp, Artificial Sequence
  Synthetic
aacgtttcttgagctcctaaagactgcagatctgcccgtgtggcttgcctacaaagtagcatcaaatggcatcca

SEQ ID NO: 256737 - DNA, 75 bp, Artificial Sequence
  Synthetic
tgtggcagagggggctggtcatactacgcagcaaccatgaagaacgtccaggaagtgagaggatacacgaaaggt

SEQ ID NO: 256738 - DNA, 75 bp, Artificial Sequence
  Synthetic
acaaagtagcatcaaatggcatccagtacaatgacagaaaatggtgttttgatggacctcgatccaatgttattc

SEQ ID NO: 256739 - DNA, 75 bp, Artificial Sequence
  Synthetic
gggccaggccatgaagaacccatgttgatgcagagctatgggtggaacatcgttactatgaaaagtggcgttgat

SEQ ID NO: 256740 - DNA, 75 bp, Artificial Sequence
  Synthetic
cacgtgtgtactcagaccaccagtccttaaaatggttcaaggattttgcagctgggaagcggtcagcaattggat

SEQ ID NO: 256741 - DNA, 75 bp, Artificial Sequence
  Synthetic
gaagaacaacggaccctgcggattttggaaatggtgtctgactggctaagccgtggtccaaaggaattttgcata

SEQ ID NO: 256742 - DNA, 75 bp, Artificial Sequence
  Synthetic
tttttgaagtgctaggccggatgccagagcactttgcagggaaaacacgtgaagccctggacaccatgtacttgg

SEQ ID NO: 256743 - DNA, 75 bp, Artificial Sequence
  Synthetic
aagatactctgcccgtacatgcccaaggtgattgaaaaactggagagcctgcaacgcaggtttggaggtggattg

SEQ ID NO: 256744 - DNA, 75 bp, Artificial Sequence
  Synthetic
tagcaacatcagaaaaaggaggtaaagcgcacagaatggctctcgaagaactgcctgatgccctagaaactataa

SEQ ID NO: 256745 - DNA, 75 bp, Artificial Sequence
  Synthetic
gcaacgcaggtttggaggtggattggtacgcgtccccctttctcgtaactccaaccatgagatgtactgggtcag

SEQ ID NO: 256746 - DNA, 75 bp, Artificial Sequence
  Synthetic
cactcatcgtggcgttgggagtcatgactgcagggttcttccttctcatgatgcaaaggaaaggaattggcaagt

SEQ ID NO: 256747 - DNA, 75 bp, Artificial Sequence
  Synthetic
tggagcctcggggaacatcgtgcacgcggtgaacatgaccagtcaggtgctcattggaagaatggacaagaagat

SEQ ID NO: 256748 - DNA, 75 bp, Artificial Sequence
  Synthetic
taggacttggagcactcgttttggtggtagccaccttcttcctatggatgtcagatgtctctggaaccaaaatag

SEQ ID NO: 256749 - DNA, 75 bp, Artificial Sequence
  Synthetic
ttggaaaggcccaaaatatgaggaagatgtcaacctgggcagcggcacgagagcagtaggaaaaggtgtgcagca

SEQ ID NO: 256750 - DNA, 75 bp, Artificial Sequence
  Synthetic
ctggtatgttgctgcttgcgttgctcatgatggtcgtgctaatccctgagcctgaaaaacagcgttcccagacgg

SEQ ID NO: 256751 - DNA, 75 bp, Artificial Sequence
  Synthetic
cacggattacaagaggatcaaatccagaatagaaaaactgaaggaggagtatgcagccacgtggcacacggatga

SEQ ID NO: 256752 - DNA, 75 bp, Artificial Sequence
  Synthetic
atgcagccacgtggcacacggatgataaccacccgtatagaacttggacttatcatgggagttatgaggtgaagc

SEQ ID NO: 256753 - DNA, 75 bp, Artificial Sequence
  Synthetic
acaaccaactggcagtgttcttgatatgtgtgttgcttgttgttggtttggtggctgcaaatgaatatggaatgt

SEQ ID NO: 256754 - DNA, 75 bp, Artificial Sequence
  Synthetic
tagaaagaacaaaaactgatataagaaacctgtttggcaagccactgatcgaagaaaatgaggcccacatccctc

SEQ ID NO: 256755 - DNA, 75 bp, Artificial Sequence
  Synthetic
ttcaaagagaaggttgacacaaaagctcctgagcctccccaaggagtgaagactgtgatggatgagaccaccaac

SEQ ID NO: 256756 - DNA, 75 bp, Artificial Sequence
  Synthetic
ctcttgacttcttcaccctggacttgagacctgctactgcctgggcattgtatggaggaagcacagtggtattaa

SEQ ID NO: 256757 - DNA, 75 bp, Artificial Sequence
  Synthetic
tggctgtgggcttatttggctaggaacaaaaaagccagactgtgcaccagagaggagtttgtgaaaaaagtgaac

SEQ ID NO: 256758 - DNA, 75 bp, Artificial Sequence
  Synthetic
ccccactgataaagcatttggtgacatcacagtacgttaccacctcactggcatcaataaacgcccaagctggga

SEQ ID NO: 256759 - DNA, 75 bp, Artificial Sequence
  Synthetic
aagttctgggaaatggtggatgaggaaagggaatgccacctccgaggggaatgccgaacctgcatatataacatg

SEQ ID NO: 256760 - DNA, 75 bp, Artificial Sequence
  Synthetic
gcttgttcacactgcccaaaggaatccctttcactgattttgatctgtctgtagcactagtgtttcttggctgtt

SEQ ID NO: 256761 - DNA, 75 bp, Artificial Sequence
  Synthetic
gggggcaagtgacgctcaccaccctaattttggcaacagtattggtcaccctccattacggatacctcctgcctg

SEQ ID NO: 256762 - DNA, 75 bp, Artificial Sequence
  Synthetic
ggagccagattcttggagtttgaagctctaggattcctcaatgaagaccattggatgagtagagagaattcagga

SEQ ID NO: 256763 - DNA, 75 bp, Artificial Sequence
  Synthetic
gttggcaagctgaagcgctgagggccgcccaaaagcgtacggccgctggcatcatgaaaaacgcagttgttgacg

SEQ ID NO: 256764 - DNA, 75 bp, Artificial Sequence
  Synthetic
ggaggagttgaaggagctggtattcagaagctgggatacatcttgagagatgtggctcaaaagcctggagggaaa

SEQ ID NO: 256765 - DNA, 75 bp, Artificial Sequence
  Synthetic
gaatagttgcaacagatgtcccggagctggaaaggacgaccccacagatgcagaaaaggctaggccaaattctac

SEQ ID NO: 256766 - DNA, 75 bp, Artificial Sequence
  Synthetic
tcgtcttggctagcgtggcagcagtatgcgtgaaccccagaataaccaccattcgggaggctggtattctatgca

SEQ ID NO: 256767 - DNA, 75 bp, Artificial Sequence
  Synthetic
gagttgatggaaggtgagcagcggactttggcaagagcaatcattgagctgacatacaggcacaaagtggtcaag

SEQ ID NO: 256768 - DNA, 75 bp, Artificial Sequence
  Synthetic
gacatacaggcacaaagtggtcaaggtcatgcgcccggcagctggaggaaagactgtgatggatgtcatttcacg

SEQ ID NO: 256769 - DNA, 75 bp, Artificial Sequence
  Synthetic
ccgcagcagctctcaccttgtgggataacaacgccagcgcggtctggaattccaccacagcaaccgggctatgcc

SEQ ID NO: 256770 - DNA, 75 bp, Artificial Sequence
  Synthetic
agactgtgatggatgtcatttcacgcgaagatcaaagaggaagtggacaagtagtgacctatgctttaaacacat

SEQ ID NO: 256771 - DNA, 75 bp, Artificial Sequence
  Synthetic
cgaagatcaaagaggaagtggacaagtagtgacctatgctttaaacacattcaccaacatcgctgtgcaattggt

SEQ ID NO: 256772 - DNA, 75 bp, Artificial Sequence
  Synthetic
atgtcatgcgtggaagctggatagcaggagcttcaatagcctggactcttataaaaaatgcagaaaaaccagcgt

SEQ ID NO: 256773 - DNA, 75 bp, Artificial Sequence
  Synthetic
tagactcatggaagccgaagcggtcataggtccagatgacattgaaagcattgaaaggaaaaagaaatttgcagt

SEQ ID NO: 256774 - DNA, 75 bp, Artificial Sequence
  Synthetic
tcaaaaggggaagagcaggaggaagaactctcggagagcagtggaaagaaaagcttaatgccatgggcaaggagg

SEQ ID NO: 256775 - DNA, 75 bp, Artificial Sequence
  Synthetic
ccgcacatggctttttgagaacgcagaagaaagagtgcagcgcatggctgttagtggtgatgactgtgttgtcaa

SEQ ID NO: 256776 - DNA, 75 bp, Artificial Sequence
  Synthetic
aattcttcagctaccggaaagaagccatcctggaggtggacagaactgaagccagaagagccagaagagaaggaa

SEQ ID NO: 256777 - DNA, 75 bp, Artificial Sequence
  Synthetic
ttagtggtgatgactgtgttgtcaaaccattggatgatagattttccactgctttgcatttcttgaacgccatgt

SEQ ID NO: 256778 - DNA, 75 bp, Artificial Sequence
  Synthetic
ataaggtaggaggccacccagtgtcacgcggaacagcgaaactcagatggctggttgagagacgcttcatccagc

SEQ ID NO: 256779 - DNA, 75 bp, Artificial Sequence
  Synthetic
ctggttgagagacgcttcatccagcccataggaaaagtagtggatctgggatgtggcagagggggctggtcatat

SEQ ID NO: 256780 - DNA, 75 bp, Artificial Sequence
  Synthetic
cgaatcatttccaggaagtcatcatgaaagatgggaggaccttggtggtgccctgcagaggacaggacgagctga

SEQ ID NO: 256781 - DNA, 75 bp, Artificial Sequence
  Synthetic
ttggaagagcacgaatatcccctggctcaggatggaacgtcagggacacggcatgcttagcaaaagcatatgcac

SEQ ID NO: 256782 - DNA, 75 bp, Artificial Sequence
  Synthetic
ttgatgcagagctatgggtggaacattgttaccatgaaaagtggtgttgatgttttttataaaccatctgagacc

SEQ ID NO: 256783 - DNA, 75 bp, Artificial Sequence
  Synthetic
agatgtggcttgtgttgtacttccatcgacgggatctgcgcctgatggccaacgccatatgctcttcagtcccag

SEQ ID NO: 256784 - DNA, 75 bp, Artificial Sequence
  Synthetic
tcgacgggatctgcgcctgatggccaacgccatatgctcttcagtcccagttgactgggttccaaccggcaggac

SEQ ID NO: 256785 - DNA, 75 bp, Artificial Sequence
  Synthetic
ctggaaatggtgtctgattggctaagccgtggtccaaaggaattctgcataaagatactctgcccgtatatgccc

SEQ ID NO: 256786 - DNA, 75 bp, Artificial Sequence
  Synthetic
tacttggtccatccatggaaaaggagaatggatgacaacagaagacatgctaagcgtgtggaaccgtgtgtggat

SEQ ID NO: 256787 - DNA, 75 bp, Artificial Sequence
  Synthetic
taagcgtgtggaaccgtgtgtggattttggaaaatgaatggatggaggacaagaccacggtttccgactggacgg

SEQ ID NO: 256788 - DNA, 75 bp, Artificial Sequence
  Synthetic
aaggttatcgaaaaattggagagcctgcagcgtaggtttggaggtggattggtgcgcgttcccctctctcgtaac

SEQ ID NO: 256789 - DNA, 75 bp, Artificial Sequence
  Synthetic
tccaaccatgagatgtattgggtgagtggagcttcgggaaacatcgtgcatgcagtaaacatgaccagccaagta

SEQ ID NO: 256790 - DNA, 75 bp, Artificial Sequence
  Synthetic
gtggagcttcgggaaacatcgtgcatgcagtaaacatgaccagccaagtactcattgggaggatggataagaaga

SEQ ID NO: 256791 - DNA, 75 bp, Artificial Sequence
  Synthetic
ctgagaacatctacgccgccatcaaccaagtgaggtcagtcatagggaaagaaaaatatgtagactacatgcagt

SEQ ID NO: 256792 - DNA, 75 bp, Artificial Sequence
  Synthetic
cgctgaggaggtatgaagaaactcatgtgagtgaagatagggtcttgtaaataacattgatagaaaattttgtaa

SEQ ID NO: 256793 - DNA, 75 bp, Artificial Sequence
  Synthetic
acacggattataagaagatcaaatccagaatagaaaaactgaaggaagagtatgcagccacttggcatacagatg

SEQ ID NO: 256794 - DNA, 75 bp, Artificial Sequence
  Synthetic
atatttaatgtaatatagtataggtaaaattttttgaaattaagtaaaattaagtagcaagacttgatagtcagg

SEQ ID NO: 256795 - DNA, 75 bp, Artificial Sequence
  Synthetic
acgaccatccgtatagaacttggacctatcatgggagttatgaggtgaagccatcgggctcagccagcacgctgg

SEQ ID NO: 256796 - DNA, 75 bp, Artificial Sequence
  Synthetic
tgaatggagtcgtgcggcttctgagcaaaccatgggacgctatcacaggagtcaccaccatggccatgactgaca

SEQ ID NO: 256797 - DNA, 75 bp, Artificial Sequence
  Synthetic
caaccccaggaggactgggttaccaaagctgattctccacggttggaaagcctcccagaaccgtctcggaagagg

SEQ ID NO: 256798 - DNA, 75 bp, Artificial Sequence
  Synthetic
agtccctgccaacaatggagatgaagcccgtgtcagatcgcgaaagcgccacttcgccgaggagtgcaatctgtg

SEQ ID NO: 256799 - DNA, 75 bp, Artificial Sequence
  Synthetic
ccacaccttttggtcagcagcgagtgttcaaagaaaaggttgacacaaaagcccctgagcctcctcaaggagtga

SEQ ID NO: 256800 - DNA, 75 bp, Artificial Sequence
  Synthetic
agaccgtgatggatgagaccaccaattggttatgggcttacttagctagaaagaaaaaagccagactatgcacca

SEQ ID NO: 256801 - DNA, 75 bp, Artificial Sequence
  Synthetic
aagctcgccgaagctgtaaggcgggtggacggactagaggttagaggagaccccactctcaaaagcatcaaacaa

SEQ ID NO: 256802 - DNA, 75 bp, Artificial Sequence
  Synthetic
gagaggaatttgtaaagaaagtaaacagccacgcagccttgggagccatgtttgaagagcaaaatcagtggaaga

SEQ ID NO: 256803 - DNA, 75 bp, Artificial Sequence
  Synthetic
cagcatattgacacctgggaaaagactaggagatcttctgctctattccaacatcagtcacaaggcaccgagcgc

SEQ ID NO: 256804 - DNA, 75 bp, Artificial Sequence
  Synthetic
acgcacgagaagctgtggaagacccaaaattttgggaaatggtggatgaggaaagagagtgccacctccgagggg

SEQ ID NO: 256805 - DNA, 75 bp, Artificial Sequence
  Synthetic
gctctattccaacatcagtcacaaggcaccgagcgccgaacactgtgactgatgggggagaagaccacaggatct

SEQ ID NO: 256806 - DNA, 75 bp, Artificial Sequence
  Synthetic
agacgttcatctgcgtgagctttcgatctcagtattgtttgaaaggatcattttgattaacgcggtttgaacagt

SEQ ID NO: 256807 - DNA, 75 bp, Artificial Sequence
  Synthetic
aatgccgaacttgcatatacaacatgatgggaaaacgtgagaaaaaacccggagaatttgggaaggccaagggaa

SEQ ID NO: 256808 - DNA, 75 bp, Artificial Sequence
  Synthetic
gcagagccatttggttcatgtggctgggggccaggttcttggagtttgaggccctagggttcctcaatgaagacc

SEQ ID NO: 256809 - DNA, 75 bp, Artificial Sequence
  Synthetic
agccccgggtcgtcaatatgctaagacgcggcataccccgcgtattcccattagtgggagtgaagagggtagtta

SEQ ID NO: 256810 - DNA, 75 bp, Artificial Sequence
  Synthetic
actggatgagtagagagaattccggaggaggggttgaaggagctggcatccaaaagttgggatacatcttgagag

SEQ ID NO: 256811 - DNA, 75 bp, Artificial Sequence
  Synthetic
tgaacttgttggatggcagagggccgatacgatttgtgttggctctcctggctttcttcaggtttacagcacttg

SEQ ID NO: 256812 - DNA, 75 bp, Artificial Sequence
  Synthetic
acgtggctcaaaagcctggaggaaaaatctacgctgatgacacagctggctgggacacccgaatcacacaagctg

SEQ ID NO: 256813 - DNA, 75 bp, Artificial Sequence
  Synthetic
cccctaccaaggccttgataagacgctggaagagcgttaacaagacaacggccatgaaacatctgaccagtttta

SEQ ID NO: 256814 - DNA, 75 bp, Artificial Sequence
  Synthetic
acctcgaaaatgaagccaaagttttggagttgatggaaggtgagcagcggactctggcaagagctatcattgagc

SEQ ID NO: 256815 - DNA, 75 bp, Artificial Sequence
  Synthetic
agaaggaactagggacactaattgatgtggtgaacaaaaggggcaaaaatcaaaagaaaagaggtggtagtgaag

SEQ ID NO: 256816 - DNA, 75 bp, Artificial Sequence
  Synthetic
tgacatacaggcacaaagtggtcaaggtcatgcgcccagcggctggagggaagactgtgatggatgtcatttcac

SEQ ID NO: 256817 - DNA, 75 bp, Artificial Sequence
  Synthetic
catcggcgcttctggctggctttatgctagttggattcgccgctgcgttgaagctttccacttttcagggtaaga

SEQ ID NO: 256818 - DNA, 75 bp, Artificial Sequence
  Synthetic
gtgaagatcagagaggaagtggacaagtagtgacttatgccttaaacacattcaccaacattgctgttcaattga

SEQ ID NO: 256819 - DNA, 75 bp, Artificial Sequence
  Synthetic
taatgatgaccgtgaacgccacggacattgctgatgtgattgccattccaaccccaaaaggacccaaccaatgct

SEQ ID NO: 256820 - DNA, 75 bp, Artificial Sequence
  Synthetic
ttagacttatggaagctgaagcagtcataggcccggatgacattgaaagtattgaaaggaaaaagaaatttgcag

SEQ ID NO: 256821 - DNA, 75 bp, Artificial Sequence
  Synthetic
ggattcgagctatcgacattggattcatgtgcgatgacaccatcacttacgaatgtccgaaattggaaagtggaa

SEQ ID NO: 256822 - DNA, 75 bp, Artificial Sequence
  Synthetic
tccgcacatggctttttgagaacgcggaggaaagagtgcagcgcatggctgttagcggtgatgattgcgttgtca

SEQ ID NO: 256823 - DNA, 75 bp, Artificial Sequence
  Synthetic
acgaccctgaagacatagactgttggtgtgacaagcaagctgtgtatgtgaactatggaagatgcacgagggctc

SEQ ID NO: 256824 - DNA, 75 bp, Artificial Sequence
  Synthetic
gttagcggtgatgattgcgttgtcaaaccattggatgacagattctccaccgctctgcatttcctaaatgccatg

SEQ ID NO: 256825 - DNA, 75 bp, Artificial Sequence
  Synthetic
gccattcaaagcgcagtcgacgttccatcacagtacagacccatggtgaaagtactttggtcaacaagaaagatg

SEQ ID NO: 256826 - DNA, 75 bp, Artificial Sequence
  Synthetic
cctggttggattcaacaaaagcaacacgttatctcaccaagacagagaattggataataaggaatcccggctacg

SEQ ID NO: 256827 - DNA, 75 bp, Artificial Sequence
  Synthetic
tcgaatcatttccaggaagtcatcatgaaagatggaagaacgctggtggtgccttgcagaggacaagatgagctg

SEQ ID NO: 256828 - DNA, 75 bp, Artificial Sequence
  Synthetic
cattggtggcagtagttcttggctggatgctgggtagcaacactgggcaaaaagtgatcttcacagtgcttttac

SEQ ID NO: 256829 - DNA, 75 bp, Artificial Sequence
  Synthetic
attggaagagcacgcatatcccctggctcaggatggaacgtcaaggatacggcatgtttggcaaaagcgtatgca

SEQ ID NO: 256830 - DNA, 75 bp, Artificial Sequence
  Synthetic
ggcatgtttggcaaaagcgtatgcacaaatgtggcttttgttgtacttccaccgaagggatttgcgtctgatggc

SEQ ID NO: 256831 - DNA, 75 bp, Artificial Sequence
  Synthetic
tccttgttgctcccgcctacagtttcaactgtttaggaatgagtagccgtgacttcattgaaggtgtttcagggg

SEQ ID NO: 256832 - DNA, 75 bp, Artificial Sequence
  Synthetic
ccacatggattgatttggtgctagaaggcgatagctgcatcaccatcatggccgctgataaacccacccttgata

SEQ ID NO: 256833 - DNA, 75 bp, Artificial Sequence
  Synthetic
agaatggatgacaacagaggacatgcttagtgtgtggaatcgcgtgtggattttggagaatgaatggatggagga

SEQ ID NO: 256834 - DNA, 75 bp, Artificial Sequence
  Synthetic
taagaatgatgaacattgaagccaccaatctagcagtggtcagaaattactgctacgcagccacagtgtcagacg

SEQ ID NO: 256835 - DNA, 75 bp, Artificial Sequence
  Synthetic
caagaccctggtctctgactggacagaagtcccatatgtagggaagagagaagacatctggtgtggaagtcttat

SEQ ID NO: 256836 - DNA, 75 bp, Artificial Sequence
  Synthetic
tctccacggtggcgaactgtcccacaacaggtgagtcacacaacacgaagagggctgatcacagctatttgtgta

SEQ ID NO: 256837 - DNA, 75 bp, Artificial Sequence
  Synthetic
agggactaggactagggcaacatgggctgagaacatttatgcagctatcaatcaagtgcggtcagtcatagggaa

SEQ ID NO: 256838 - DNA, 75 bp, Artificial Sequence
  Synthetic
aacgtggagtaaccgacagaggctggggtaatggatgtggcttgtttggtaagggaagtattgatacatgtgcaa

SEQ ID NO: 256839 - DNA, 75 bp, Artificial Sequence
  Synthetic
agagaagtatgtagattatatgcagtcactgaggaggtatgaagaaatcaatgtgagtgaagatagggttttgta

SEQ ID NO: 256840 - DNA, 75 bp, Artificial Sequence
  Synthetic
aattcacctgttctagttcagctacagggagacttatcctgcccgaaaacatcaaatatgaagtcggggtttttg

SEQ ID NO: 256841 - DNA, 75 bp, Artificial Sequence
  Synthetic
aataacattgatgaaaaattttgtaaatacttaatgtaacatagaattgattaatttttagaattaagtaaaatt

SEQ ID NO: 256842 - DNA, 75 bp, Artificial Sequence
  Synthetic
ttcatggatcgacagactcaactagtcatggaaattactctagccaaattggggccaaccaagctgctagattta

SEQ ID NO: 256843 - DNA, 75 bp, Artificial Sequence
  Synthetic
aatacttaatgtaacatagaattgattaatttttagaattaagtaaaattaatttgtaagacttggaagtcaggc

SEQ ID NO: 256844 - DNA, 75 bp, Artificial Sequence
  Synthetic
ccatttcaccaaacgcgccagctatcacagcgaagatgggtgactatggagaagttaccgtggagtgtgagccga

SEQ ID NO: 256845 - DNA, 75 bp, Artificial Sequence
  Synthetic
cttcgccgaggagtgcaatctgtgaggccccaggaggactgggtgaacaaagccgtaaggcccccgcagcccggg

SEQ ID NO: 256846 - DNA, 75 bp, Artificial Sequence
  Synthetic
ggagtggactaaacacagaagcttattatgttatgtccatcggaacgaaacactttttggtgcatcgcgaatggt

SEQ ID NO: 256847 - DNA, 75 bp, Artificial Sequence
  Synthetic
ccgggagtgtgatgcgaaccccggcgaaggactagaggttagaggagaccctgcggaaacactgagtggcccaag

SEQ ID NO: 256848 - DNA, 75 bp, Artificial Sequence
  Synthetic
ttaatgacttgctcttgccgtggacatcgccctcaaatacggactggaggaacagagaagtgctcatggagtttg

SEQ ID NO: 256849 - DNA, 75 bp, Artificial Sequence
  Synthetic
ctcgctgaagctgtaaggcgagtggacggactagaggttagaggagaccccactctcaaaagcatcaaacaaaca

SEQ ID NO: 256850 - DNA, 75 bp, Artificial Sequence
  Synthetic
aagagccacatgctaccaaacaatcagtagtcgccttgggctcacaggaaggagctctgcaccaagccttggctg

SEQ ID NO: 256851 - DNA, 75 bp, Artificial Sequence
  Synthetic
gagccataccagtcgagttcacgggcagcacgctaaagctcacctcaggacacctcaagtgtcgcgtgaaaatgg

SEQ ID NO: 256852 - DNA, 75 bp, Artificial Sequence
  Synthetic
agaagctaaaattgaaaggaaccacgtatggaatgtgcacagaaaaatttactctttcgaagaatccagctgata

SEQ ID NO: 256853 - DNA, 75 bp, Artificial Sequence
  Synthetic
ccgggcatggcacagtagtcttggagctgcagtacgccgggagtgatggaccatgcaaaatcccaatatcctcgg

SEQ ID NO: 256854 - DNA, 75 bp, Artificial Sequence
  Synthetic
tggcaagcctcaatgacatgacacctatcggaagaatggtgacagctaatccatatgttgcctcatcaactgcta

SEQ ID NO: 256855 - DNA, 75 bp, Artificial Sequence
  Synthetic
actccaaagtcttggtggagattgaaccaccttttggagactcttacatcgtagtaggtaggggagataagcaaa

SEQ ID NO: 256856 - DNA, 75 bp, Artificial Sequence
  Synthetic
ttaaccaccattggcacaaggagggcagctcgattggtaaggcttttagcacaaccctgaagggagcgcagagac

SEQ ID NO: 256857 - DNA, 75 bp, Artificial Sequence
  Synthetic
tggcagctctcggagacacagcatgggattttggttcggtgggaggagtcttcaattcaattgggaaggcagtgc

SEQ ID NO: 256858 - DNA, 75 bp, Artificial Sequence
  Synthetic
accaggtttttggaggagcgtttagaaccctctttggagggatgtcatggatcactcaaggtctgctgggagcgt

SEQ ID NO: 256859 - DNA, 75 bp, Artificial Sequence
  Synthetic
tgctattgtggatgggaatcaatgctagagacaaatcaatcgctctagcttttctagcgactggaggcgtcttgc

SEQ ID NO: 256860 - DNA, 75 bp, Artificial Sequence
  Synthetic
tattccttgccacaaacgtccatgctgacactggttgcgcgatcgacatcaccaggagggagcttaaatgcggca

SEQ ID NO: 256861 - DNA, 75 bp, Artificial Sequence
  Synthetic
gtggcatatttgtacacaatgatgttgaagcttgggttgatcgctacaggtacttgccagagacccccaagcaat

SEQ ID NO: 256862 - DNA, 75 bp, Artificial Sequence
  Synthetic
tagcaaaagtggttgagaatgcccataagagcggtatatgtgggattcggtcagtgaacagatttgagcatcaaa

SEQ ID NO: 256863 - DNA, 75 bp, Artificial Sequence
  Synthetic
tgtgggaatctgttcgcgatgagctcaacgctttgcttaaggaaaatgccattgatttgagtgtagttgtggaaa

SEQ ID NO: 256864 - DNA, 75 bp, Artificial Sequence
  Synthetic
aacagaagggcatgtatagagcggcgcccaacaggttgaaactcactgtggaagaacttgacataggttggaagg

SEQ ID NO: 256865 - DNA, 75 bp, Artificial Sequence
  Synthetic
cctggggaaagagtctgctctttgccgccgagttggctaattcaacgtttgtggtcgatggacccgaaacggcag

SEQ ID NO: 256866 - DNA, 75 bp, Artificial Sequence
  Synthetic
agtgtcctaactcaaaaagggcgtggaacagttttgaaattgaagactttggatttggaataacgtccactaggg

SEQ ID NO: 256867 - DNA, 75 bp, Artificial Sequence
  Synthetic
tctggcttaaactcagggaagaaaactcttcagagtgtgatagcactattattggaactgcagttaaaggtaact

SEQ ID NO: 256868 - DNA, 75 bp, Artificial Sequence
  Synthetic
acgcagtgcacagtgacctttcctattggattgagagcggacttaacggaacatggaagcttgagagagccatct

SEQ ID NO: 256869 - DNA, 75 bp, Artificial Sequence
  Synthetic
ttggagaggtgaaatcctgcacctggcctgagactcacacactatggggtgatgcagtggaagagacggatctga

SEQ ID NO: 256870 - DNA, 75 bp, Artificial Sequence
  Synthetic
tcattccagtgactctcgctggcccgcgcagcaaacacaacagaagagaagggtacaaggttcaggttcaaggtc

SEQ ID NO: 256871 - DNA, 75 bp, Artificial Sequence
  Synthetic
catgggatgaagacgacataaaactggactttgactattgccctggaacaacggtcacagtgagtgaacattgtg

SEQ ID NO: 256872 - DNA, 75 bp, Artificial Sequence
  Synthetic
gaaggcgaggcccctcggtacgtaccacaactgacagcgggaaactcgtcacagattggtgctgcaggagctgca

SEQ ID NO: 256873 - DNA, 75 bp, Artificial Sequence
  Synthetic
cgcttccccccttgagattcaccacggccagtggatgttggtacggaatggaaataagacccatgaagcatgatg

SEQ ID NO: 256874 - DNA, 75 bp, Artificial Sequence
  Synthetic
aatccactttagtgaaatcgagggtccaagcattcaacggagacatgattgacccttttcagctaggcctcctgg

SEQ ID NO: 256875 - DNA, 75 bp, Artificial Sequence
  Synthetic
tgatgtttctggccacccaggaggtcttgagaaagaggtggacggccagactaactctgccagcgacagttgggg

SEQ ID NO: 256876 - DNA, 75 bp, Artificial Sequence
  Synthetic
ctctgttagttctccttcttgggggcatcacttacactgatttggtacggtacctcatattggtgggttcagcgt

SEQ ID NO: 256877 - DNA, 75 bp, Artificial Sequence
  Synthetic
ttgcagaatcaaacaacgggggtgatgtcattcacttggctctcatcgctgtgttcaaagtgcagcccgcttttc

SEQ ID NO: 256878 - DNA, 75 bp, Artificial Sequence
  Synthetic
ttgttgccagcctgacacgtagcaagtggactaaccaagagaatctcgttctggttctgggagctgccttcttcc

SEQ ID NO: 256879 - DNA, 75 bp, Artificial Sequence
  Synthetic
aaatggcagcttcagatctggaactgtcaatcccaggtttgctgaattcagctgctacagcttggatggtgctgc

SEQ ID NO: 256880 - DNA, 75 bp, Artificial Sequence
  Synthetic
gagcgatggctttcccgtcaacctcagcaatggccatgcccatgctggcaatgctggctccaggaatgagaatgc

SEQ ID NO: 256881 - DNA, 75 bp, Artificial Sequence
  Synthetic
tccatcttgacacgtacagaatagtgctcctgctggtcggcatatgcagcttgctgaacgaaagaagaagatctg

SEQ ID NO: 256882 - DNA, 75 bp, Artificial Sequence
  Synthetic
tagagaaaaagaaaggagccatattgattggcctagctttgacttcgaccggatacttctcaccaacaatcatgg

SEQ ID NO: 256883 - DNA, 75 bp, Artificial Sequence
  Synthetic
cggcaggccttatggtatgcaatcccaataaaaaaagaggctggcctgccactgaggtattaacagcagtaggac

SEQ ID NO: 256884 - DNA, 75 bp, Artificial Sequence
  Synthetic
tgatgtttgccattgttggaggactcgctgagctagacattgattctatgtcagtccccttcacgatagctggcc

SEQ ID NO: 256885 - DNA, 75 bp, Artificial Sequence
  Synthetic
tcatgttggtgtcttacgtgatctcggggaaagctaccgacatgtggcttgaaagagcagccaatgtgtcatggg

SEQ ID NO: 256886 - DNA, 75 bp, Artificial Sequence
  Synthetic
aagcggaagcagcaataacaggcaccagcgaaagattggatgtccagttggatgatgacgggaatttccatctgc

SEQ ID NO: 256887 - DNA, 75 bp, Artificial Sequence
  Synthetic
tcaatgaccctggagttccatggaaaatctggattctgagaatgacatgcctgagtgtggccgctatcactcctt

SEQ ID NO: 256888 - DNA, 75 bp, Artificial Sequence
  Synthetic
gggctatcctgccatccgcatttgggtattggctgactttgaagtacacgaagcgcggaggtgttttctgggaca

SEQ ID NO: 256889 - DNA, 75 bp, Artificial Sequence
  Synthetic
cgccttctcctagagtgtaccccaagggggatacaacgccaggagtctacagaataatggctagaggcatcttgg

SEQ ID NO: 256890 - DNA, 75 bp, Artificial Sequence
  Synthetic
ggagctaccaagctggggtgggagtcatgcacgagggtgtgttccacacgttgtggcacacaaccagaggagcag

SEQ ID NO: 256891 - DNA, 75 bp, Artificial Sequence
  Synthetic
ccataatgagtggtgaaggaagattgacaccatattggggaagtgtgaaagaagacagagtgacttatggcggcc

SEQ ID NO: 256892 - DNA, 75 bp, Artificial Sequence
  Synthetic
catggaaattggaccagaaatggaacggggtggatgacgtccaaatgatagtagtggaaccaggaaaaccagtag

SEQ ID NO: 256893 - DNA, 75 bp, Artificial Sequence
  Synthetic
taaatgtacagactaagcctgggatcttcaagacaacacacggagaaatcggagcagtgagcctagactatccga

SEQ ID NO: 256894 - DNA, 75 bp, Artificial Sequence
  Synthetic
ctggaacctcgggctctccaatagtcaacagcaatggagagatagtcggtctttatggaaatggagtgatactgg

SEQ ID NO: 256895 - DNA, 75 bp, Artificial Sequence
  Synthetic
gtaatggagcctatgttagtgcaattgtccaaggggagagagtagaggaacctgtgccagaagcttacaatcctg

SEQ ID NO: 256896 - DNA, 75 bp, Artificial Sequence
  Synthetic
agatgctaaagaaaaggcagttgactgtgctggacttgcatccaggtgctggaaaaacacggcgcattcttcccc

SEQ ID NO: 256897 - DNA, 75 bp, Artificial Sequence
  Synthetic
aaataatcaaagatgccatccaaagaagactacggactgcggttctcgcaccaacgagagtggttgcagcagaaa

SEQ ID NO: 256898 - DNA, 75 bp, Artificial Sequence
  Synthetic
tggcagaggccttgagaggtcttccagtcaggtatttgactccagctgtgcagagagaacatagcggaaatgaaa

SEQ ID NO: 256899 - DNA, 75 bp, Artificial Sequence
  Synthetic
tagtggatgtaatgtgccacgcgacgttgacgcatcgattgatgtcgccgctacgagttccaaattacaacttgt

SEQ ID NO: 256900 - DNA, 75 bp, Artificial Sequence
  Synthetic
ttgtcatggatgaagcccattttacggatccagccagcatagcagcccgaggatacattgctacccgtgttgaag

SEQ ID NO: 256901 - DNA, 75 bp, Artificial Sequence
  Synthetic
caggggaagcagcggctatctttatgacagccactcctccaggtacatctgatccattccctgacaccaattcgc

SEQ ID NO: 256902 - DNA, 75 bp, Artificial Sequence
  Synthetic
cagtccacgatgtgtccagtgagattccagaccgagcgtggagcagcggatttgagtggataactgactatcccg

SEQ ID NO: 256903 - DNA, 75 bp, Artificial Sequence
  Synthetic
gaaagactgtttggttcgttgcgagcgtgaaaataggcaatgagatcgcgcagtgtttacaacgtgcaggaaaaa

SEQ ID NO: 256904 - DNA, 75 bp, Artificial Sequence
  Synthetic
gagtcattcaattgaacagaaaatcttatgacacggaatatccgaagtgtaaaaatggtgactgggactttgtca

SEQ ID NO: 256905 - DNA, 75 bp, Artificial Sequence
  Synthetic
tcacaactgacatctcggagatgggggcaaactttggagcaagcagagtgattgactgccgcaagagcgtcaagc

SEQ ID NO: 256906 - DNA, 75 bp, Artificial Sequence
  Synthetic
caacaatcctggacgaaggagaagggagagttattctcggtgtgccatcagctatcactagtgccagcgcggccc

SEQ ID NO: 256907 - DNA, 75 bp, Artificial Sequence
  Synthetic
agcgaagaggtagagtaggtaggaaccctagtcaaataggagacgaatatcattatggaggtggaaccagtgagg

SEQ ID NO: 256908 - DNA, 75 bp, Artificial Sequence
  Synthetic
atgacaccatgcttgcccactggactgaagccaagattcttttggacaacattcatcttccaaatggcctggtgg

SEQ ID NO: 256909 - DNA, 75 bp, Artificial Sequence
  Synthetic
cccagctgtatggtcctgaaagagaaaaaacctacaccatggatggagaatatcgacttagaggcgaagaacgga

SEQ ID NO: 256910 - DNA, 75 bp, Artificial Sequence
  Synthetic
aaacattccttgagcttctaaagaccgcagacctgccggtatggcttgcttataaggtagcatcaaatggtatcc

SEQ ID NO: 256911 - DNA, 75 bp, Artificial Sequence
  Synthetic
aatacaatgacaggagatggtgttttgatggaccccgatcaaatataattcttgaagacaacaatgaggtggaaa

SEQ ID NO: 256912 - DNA, 75 bp, Artificial Sequence
  Synthetic
ttacgacgagaataggggaaaggagagttttgaagccacgatggctggatgcacgcgtgtattcagatcaccaat

SEQ ID NO: 256913 - DNA, 75 bp, Artificial Sequence
  Synthetic
ccttaaagtggttcaaggactttgcagctggaaagcggtcagcaattggattctttgaagtgctgggtcggatgc

SEQ ID NO: 256914 - DNA, 75 bp, Artificial Sequence
  Synthetic
cagagcattttgtaggaaaaacacgtgaagctctggacaccatgtatttggtggcaacctcagagaaggggggca

SEQ ID NO: 256915 - DNA, 75 bp, Artificial Sequence
  Synthetic
aagcgcacagaatggctcttgaagaattacctgatgctttagagaccataacactcattgcggcattggggatca

SEQ ID NO: 256916 - DNA, 75 bp, Artificial Sequence
  Synthetic
tgactgcaggattctttcttctcttgatgcaaagaaaaggaattggtaagttagggcttggagcacttgttctag

SEQ ID NO: 256917 - DNA, 75 bp, Artificial Sequence
  Synthetic
cggtagtcactttttttctgtggatgtcagatgtttctggaactaaaatagctggtgttttactgcttgcgctac

SEQ ID NO: 256918 - DNA, 75 bp, Artificial Sequence
  Synthetic
tcatgatggtcgtgctaatccctgagcctgaaaaacagcgttctcagacggacaaccaattggcagttttcttga

SEQ ID NO: 256919 - DNA, 75 bp, Artificial Sequence
  Synthetic
tatgcgtgttgcttgttgttggcttggtggccgcaaacgagtatgggatgctagagagaacaaaagatgacataa

SEQ ID NO: 256920 - DNA, 75 bp, Artificial Sequence
  Synthetic
aaaacctgtttggcaagccattgattgaagaaactgaggctcacatttcccctcttgatttttttaccttggacc

SEQ ID NO: 256921 - DNA, 75 bp, Artificial Sequence
  Synthetic
tgaggcccgccactgcctgggccctgtatggaggaagtacagaggtgttgactccattgataaaacacttggtaa

SEQ ID NO: 256922 - DNA, 75 bp, Artificial Sequence
  Synthetic
tgaggcccgccactgcctgggccctgtatggaggaagtacagtggtgttgactccattgataaaacacttggtaa

SEQ ID NO: 256923 - DNA, 75 bp, Artificial Sequence
  Synthetic
tgaggcccgccactgcctgggccctgtatggaggaagtacagcggtgttgactccattgataaaacacttggtaa

SEQ ID NO: 256924 - DNA, 75 bp, Artificial Sequence
  Synthetic
tgaggcccgccactgcctgggccctgtatggaggaagtacaggggtgttgactccattgataaaacacttggtaa

SEQ ID NO: 256925 - DNA, 75 bp, Artificial Sequence
  Synthetic
catcacaatacgtcaccacctcgctggcgtcaataaacgcccaagcagggagcttgtttacgttgcccaaaggaa

SEQ ID NO: 256926 - DNA, 75 bp, Artificial Sequence
  Synthetic
ttcctttcactgactttgatttgtcagtagcgctagtgtttcttggctgctggggacaagtgacgctgaccactt

SEQ ID NO: 256927 - DNA, 75 bp, Artificial Sequence
  Synthetic
tggcgttggcagcaatactgatcaccctccactatgggtatctcctacccggttggcaagcagaagctttgagag

SEQ ID NO: 256928 - DNA, 75 bp, Artificial Sequence
  Synthetic
ctgcacaaaaacgtacagccgccggcatcatgaaaaacgcagttgttgacggaattgttgcaacggatgttccag

SEQ ID NO: 256929 - DNA, 75 bp, Artificial Sequence
  Synthetic
agctggaaagaacgactccacagatgcagaaaagactgggtcaaattttattagtcttggccagcgtagcatcat

SEQ ID NO: 256930 - DNA, 75 bp, Artificial Sequence
  Synthetic
tatgtgtgaatcccagagttactaccatccgggaagctggtatcctttgtaccgcagcagctctcactttgtggg

SEQ ID NO: 256931 - DNA, 75 bp, Artificial Sequence
  Synthetic
aaaacaatgccagtgcggtatggaattccaccacagcaactggactttgccacgtcatacgtggaagctggatag

SEQ ID NO: 256932 - DNA, 75 bp, Artificial Sequence
  Synthetic
caggagcttcaatagcttggaccctcataaaaaatgcagaaaaaccagcattcaaaagaggaagagcaggaggaa

SEQ ID NO: 256933 - DNA, 75 bp, Artificial Sequence
  Synthetic
ggactcttggggagcaatggaaagaaaaactaaatgccatgggcaaagaagaattttttaactaccgaaaagaag

SEQ ID NO: 256934 - DNA, 75 bp, Artificial Sequence
  Synthetic
ccatcctggaagtggatagaactgaagctagaagagccaggagggaagggaataaagtaggaggtcatccagtgt

SEQ ID NO: 256935 - DNA, 75 bp, Artificial Sequence
  Synthetic
cacgtggaacagctaagctcagatggttagttgaaagacgctttattcagcccataggaaaggtggtggacttgg

SEQ ID NO: 256936 - DNA, 75 bp, Artificial Sequence
  Synthetic
ggtgtggtagagggggctggtcatactacacagccaccatgaaaaatgtccaggaagtgagagggtacacgaaag

SEQ ID NO: 256937 - DNA, 75 bp, Artificial Sequence
  Synthetic
gtggtccaggtcatgaagaaccaatgcttacgcagagctatgggtggaacatcgtcaccatgaaaagtggtgttg

SEQ ID NO: 256938 - DNA, 75 bp, Artificial Sequence
  Synthetic
acgttttttacaaaccgtccgaaatcagtgacacccttctgtgtgacataggagagtcatcacccagtgctgaag

SEQ ID NO: 256939 - DNA, 75 bp, Artificial Sequence
  Synthetic
tagaggaacagcggaccttacgggtgttggaaatggtgtctgactggttgagccgaggtccaaaggaattctgca

SEQ ID NO: 256940 - DNA, 75 bp, Artificial Sequence
  Synthetic
taaaaatactttgtccgtacatgcccaaggtgattgaaagattagagagcctacaacgtagatttggaggtggac

SEQ ID NO: 256941 - DNA, 75 bp, Artificial Sequence
  Synthetic
tggtgcgtgttcctctctcccgtaattctaaccatgaaatgtactgggtcagtggagcctcgggaaatatcgtgc

SEQ ID NO: 256942 - DNA, 75 bp, Artificial Sequence
  Synthetic
atgctgtgaacatgactagtcaggtgctcatagggaggatggacaagaagatttggaaaggcccaaagtatgaag

SEQ ID NO: 256943 - DNA, 75 bp, Artificial Sequence
  Synthetic
aggatgttaatctgggcagtggcacgagagcagttggaaagggtgtccagcactcggattacaggaagatcaaat

SEQ ID NO: 256944 - DNA, 75 bp, Artificial Sequence
  Synthetic
ccagagtagagaaactgaaggaagaatatgcagccacgtggcacacggatgacaaccatccgtatagaacttgga

SEQ ID NO: 256945 - DNA, 75 bp, Artificial Sequence
  Synthetic
cttaccatgggagctatgaggtgaaaccatcgggttcagccagcacgctggtgaatggagtggtgcgacttctga

SEQ ID NO: 256946 - DNA, 75 bp, Artificial Sequence
  Synthetic
accatcgggttcagccagcacgctggtgaatggagtggtgcgacttctgagcaaaccatgggacgctatcactgg

SEQ ID NO: 256947 - DNA, 75 bp, Artificial Sequence
  Synthetic
agtcaccaccatggccatgactgacaccacaccattcggccagcagcgagtgtttaaagagaaggttgacacaaa

SEQ ID NO: 256948 - DNA, 75 bp, Artificial Sequence
  Synthetic
agcccccgagcctccgcaaggagtgaaaatcgttatggatgagaccaccaattggctgtgggcatatttggctag

SEQ ID NO: 256949 - DNA, 75 bp, Artificial Sequence
  Synthetic
aaacaaaaaagctagattatgcaccagagaggagtttgtgaaaaaagtgaacagccacgcagccttgggggccat

SEQ ID NO: 256950 - DNA, 75 bp, Artificial Sequence
  Synthetic
gtttgaagaacaaaaccaatggaagaatgcacgagaagccgtagaagacccaaagttttgggaaatggttgatga

SEQ ID NO: 256951 - DNA, 75 bp, Artificial Sequence
  Synthetic
ggaaagggaatgccacctacgaggggaatgccgaacctgcatatataatatgatgggaaaacgcgagaaaaaacc

SEQ ID NO: 256952 - DNA, 75 bp, Artificial Sequence
  Synthetic
cggagagtttgggaaggccaagggaagcagagctatatggttcatgtggctaggagccaggttcttggaatttga

SEQ ID NO: 256953 - DNA, 75 bp, Artificial Sequence
  Synthetic
agccctaggatttcttaacgaagaccactggatgagcagggaaaactcaggaggcggggttgaaggagctggcat

SEQ ID NO: 256954 - DNA, 75 bp, Artificial Sequence
  Synthetic
ccagaagttaggatatatcttgagagacgtggctaaaaaacccggaggaaaaatctatgctgatgacacagccgg

SEQ ID NO: 256955 - DNA, 75 bp, Artificial Sequence
  Synthetic
atgggatacccgcattacacaggccgaccttgagaatgaagctaaagttctggagttgatggaaggtgagcagcg

SEQ ID NO: 256956 - DNA, 75 bp, Artificial Sequence
  Synthetic
gacattggcgagggcaatcattgagctaacatacaggcacaaggtggtcaaggtcatgcgtccggcaaccggagg

SEQ ID NO: 256957 - DNA, 75 bp, Artificial Sequence
  Synthetic
aaagactgtgatggatgtcatctcacgtgaggaccagagaggaagtggacaagtggtaacttacgctttaaacac

SEQ ID NO: 256958 - DNA, 75 bp, Artificial Sequence
  Synthetic
attcaccaacattgccgtacaactgattcgactcatggaggctgaagctgtcataggaccagatgacatcgagag

SEQ ID NO: 256959 - DNA, 75 bp, Artificial Sequence
  Synthetic
cgttgaaaggaagaagaaatttgcagttcgcacatggctatttgaaaatgcagaagaaagagtgcagcggatggc

SEQ ID NO: 256960 - DNA, 75 bp, Artificial Sequence
  Synthetic
tgttagcggtgatgactgtgttgtcaaaccgctggacgacagattttctaccgctctgcattttttaaatgccat

SEQ ID NO: 256961 - DNA, 75 bp, Artificial Sequence
  Synthetic
gtcaaaagtgagaaaggacatccaggagtggaaaccttcacaaggctggtacgactggcaacaggtccccttctg

SEQ ID NO: 256962 - DNA, 75 bp, Artificial Sequence
  Synthetic
ttcgaatcacttccaggagcttatcatgaaagatgggagaaccttggtggtgccctgtagaggacaggatgagct

SEQ ID NO: 256963 - DNA, 75 bp, Artificial Sequence
  Synthetic
gattggacgagcacgcatatcccctgggtcaggatggaacgtccgagacacggcatgtttggcaaaagcgtacgc

SEQ ID NO: 256964 - DNA, 75 bp, Artificial Sequence
  Synthetic
acaaatgtggctcttgttgtatttccaccgaagagatctgcgtctgatggctaacgccatatgctcctcagttcc

SEQ ID NO: 256965 - DNA, 75 bp, Artificial Sequence
  Synthetic
agtagactgggtcccgaccggcaggaccacttggtccattcatgggaaaggagagtggatgacaacagaggacat

SEQ ID NO: 256966 - DNA, 75 bp, Artificial Sequence
  Synthetic
gctgagcgtatggaaccgggtgtggatcttggaaaatgaatggatggaggacaagaccatggtcgctgactggac

SEQ ID NO: 256967 - DNA, 75 bp, Artificial Sequence
  Synthetic
ggaagtcccatacgttgggaagagagaagacatctggtgtggaagcctcatagggaccaggaccagagcgacatg

SEQ ID NO: 256968 - DNA, 75 bp, Artificial Sequence
  Synthetic
ggctgagaacatctatgctgccatctaccaagtgagatcaatcatagggaaagagaagtatgtggactacatgct

SEQ ID NO: 256969 - DNA, 75 bp, Artificial Sequence
  Synthetic
gtcattaaggaggtatgaagaggcccatgtgagtgaagacagagtgttgtaaggtaagtagaattaaggtgtaaa

SEQ ID NO: 256970 - DNA, 75 bp, Artificial Sequence
  Synthetic
aaggtaagtagaattaaggtgtaaaacttgatagtcaggccagccgctcaggctgccaccggaggttggtagacg

SEQ ID NO: 256971 - DNA, 75 bp, Artificial Sequence
  Synthetic
gagtgcaatctgtgaggccccaggaggactgggtgaacaaagccgtgaggcccccgcagcccgggccgggggaag

SEQ ID NO: 256972 - DNA, 75 bp, Artificial Sequence
  Synthetic
tgatgcgaaccccggcgaaggactagaggttagaggagaccctgcggaagcattgagtggcccaagctcgctgaa

SEQ ID NO: 256973 - DNA, 75 bp, Artificial Sequence
  Synthetic
gctgtaaggcgggtggacggactagaggttagaggagaccccactctcacaagcatcaaacaaacagcatattga

SEQ ID NO: 256974 - DNA, 75 bp, Artificial Sequence
  Synthetic
agatgttcatctgtgtgaactttttgactcaggattgttggaagggattgaaagattaatacagtttgaacagtt

SEQ ID NO: 256975 - DNA, 75 bp, Artificial Sequence
  Synthetic
ttttagagcagttggaaactatgtctaaaaaaccaggaggacccggaagaaaccgggtcgtcagtatgctaagac

SEQ ID NO: 256976 - DNA, 75 bp, Artificial Sequence
  Synthetic
gcggagcatcccgcgtttccccgcttatggggataaagaggatgttgaacagtttgttggacgggagaggaccaa

SEQ ID NO: 256977 - DNA, 75 bp, Artificial Sequence
  Synthetic
tacgtttcgtactggcgcttctcacgttcttcaaatttacagcaattgctccaacaaaggctttgattaacagat

SEQ ID NO: 256978 - DNA, 75 bp, Artificial Sequence
  Synthetic
ggaggtcagttgagaaaggaacagcgatgaaacatctagctagtttcaaaaaagaacttggcaccctgattgacg

SEQ ID NO: 256979 - DNA, 75 bp, Artificial Sequence
  Synthetic
tggtcaacagaaggagcaagaaacaaaagagaagaggaaatggcaccaaccgatggcttatgctgatggtaactt

SEQ ID NO: 256980 - DNA, 75 bp, Artificial Sequence
  Synthetic
tggtggctatgggaggattagcagccttgaagctttcaaacttccaagggaaagtgatgatgacaatcaatgcta

SEQ ID NO: 256981 - DNA, 75 bp, Artificial Sequence
  Synthetic
ccgacatatctgatgtgataacggtgccaacacccgcaggaaagaaccaatgctgggttaaagcgatggatgttg

SEQ ID NO: 256982 - DNA, 75 bp, Artificial Sequence
  Synthetic
ggtacatgtgtgccgacacgattacctatgaatgcccaaagcttgacgctggaaatgatccagaagacatagatt

SEQ ID NO: 256983 - DNA, 75 bp, Artificial Sequence
  Synthetic
gctggtgtgataatcaagccatgtacgtgagttatggtagatgcacgagaaccagacattcaaaaagaagcaaga

SEQ ID NO: 256984 - DNA, 75 bp, Artificial Sequence
  Synthetic
gatcagtggcagtccaggctcacggagaaagcacgctagtgaataagaaagaagcctggttggattccaccaagg

SEQ ID NO: 256985 - DNA, 75 bp, Artificial Sequence
  Synthetic
ccactcgttacttaacgaagactgaaaactggatcattaggaatccgggctatgccttggtagctgtagctctag

SEQ ID NO: 256986 - DNA, 75 bp, Artificial Sequence
  Synthetic
gctggatgcttggtagcaacaaggctcagaaagtaatatttacagtattgctgctattggtcgcaccagcataca

SEQ ID NO: 256987 - DNA, 75 bp, Artificial Sequence
  Synthetic
gctttaactgtctggggatgagcagtagagactttctagaaggtgtatcaggggccacatgggtggaccttgttc

SEQ ID NO: 256988 - DNA, 75 bp, Artificial Sequence
  Synthetic
ttgaaggagacagctgtgtaacaatcatggctaaagacaaacctacactggacgtgcggatgatgagcatagagg

SEQ ID NO: 256989 - DNA, 75 bp, Artificial Sequence
  Synthetic
ctagcaacctagcagttgtgaggaactactgttactcagccactatcacggaggtatcaacagtgtccaattgtc

SEQ ID NO: 256990 - DNA, 75 bp, Artificial Sequence
  Synthetic
cgaccactggagaagcacacaacacaaagcgggccgaccctaaatacatctgcaagcaaggtgtgactgacagag

SEQ ID NO: 256991 - DNA, 75 bp, Artificial Sequence
  Synthetic
gatggggcaatggttgcggactctttggaaaaggaagcattgacacatgcgctaagtttgaatgcccccatcatg

SEQ ID NO: 256992 - DNA, 75 bp, Artificial Sequence
  Synthetic
cgtcagggagaatgattctccccgagaatatcaagtatgaggtaggggtgtttgtccatggatctactgactcaa

SEQ ID NO: 256993 - DNA, 75 bp, Artificial Sequence
  Synthetic
caaaccatggagattactccacccaagtaggtgcaaaccaagcagcaaagtttaccatatctccgaacgctccag

SEQ ID NO: 256994 - DNA, 75 bp, Artificial Sequence
  Synthetic
caatcacagtgaaattgggagagtatggagaagtgacagtggaatgcgaaccaagaagtggtttagacacgagtg

SEQ ID NO: 256995 - DNA, 75 bp, Artificial Sequence
  Synthetic
cgtactatgtgttcactattggtactaagcacttcatggtgcatcgggaatggttcaatgacctggctctcccat

SEQ ID NO: 256996 - DNA, 75 bp, Artificial Sequence
  Synthetic
ggacccccccctctggaaccagttggagaaatagagagatcttagtggagttcgaagaaccccatgccactaagc

SEQ ID NO: 256997 - DNA, 75 bp, Artificial Sequence
  Synthetic
aatccgtggtcgctttggggtcgcaggagggagcacttcatcaagcccttgcaggagccattccagtgcagatgg

SEQ ID NO: 256998 - DNA, 75 bp, Artificial Sequence
  Synthetic
atagcacattgaagctgtcatcaggacacctcaaatgcagaataaagatggaaaagctcaccctgaagggaacca

SEQ ID NO: 256999 - DNA, 75 bp, Artificial Sequence
  Synthetic
cttacgcagtttgcgctgaagggttcacttttaccaagaccccagctgacacaggccacggaacggtagtgttag

SEQ ID NO: 257000 - DNA, 75 bp, Artificial Sequence
  Synthetic
aactcaagtatttgggagctgacggaccatgcaagattcccatctcttctgttaccaatctaaatgacttgactc

SEQ ID NO: 257001 - DNA, 75 bp, Artificial Sequence
  Synthetic
cagtgggaaggttggtgacggcaaacccattcgtctcagccacaacagccaattctaaagtgcttgtcgaaatag

SEQ ID NO: 257002 - DNA, 75 bp, Artificial Sequence
  Synthetic
aacctccttttggagactcttacatcgtagtgggaagaggagacaaacaaatcaaccaccattggcacaaatctg

SEQ ID NO: 257003 - DNA, 75 bp, Artificial Sequence
  Synthetic
ggagctcaataggcaaggcgtttacaacgacactgaaaggagcacagcgattagccgcgctaggagacacagctt

SEQ ID NO: 257004 - DNA, 75 bp, Artificial Sequence
  Synthetic
gggacttcggttcaattggtggggtcttcaactccttgggtaaagccatgcaccaggtctttggaggagcgttca

SEQ ID NO: 257005 - DNA, 75 bp, Artificial Sequence
  Synthetic
gaacactctttggaggcatgtcctggataacccaggggctgatgggagcgctcctcctgtggatgggcgtcaatt

SEQ ID NO: 257006 - DNA, 75 bp, Artificial Sequence
  Synthetic
caagggacagatccatcgcgttggcgttcttggcgacaggaggagtcctattattcctagcagtcaacgtgcatg

SEQ ID NO: 257007 - DNA, 75 bp, Artificial Sequence
  Synthetic
cggacacaggatgtgctcttgacattgggagaagagaattgcggtgcggcagtggtgtgttcgtgcacaatgatg

SEQ ID NO: 257008 - DNA, 75 bp, Artificial Sequence
  Synthetic
tcgaagcttgggtggataggtataagttcttacctgagactccaaaaaagttagcgaagatcattgagaaggcgc

SEQ ID NO: 257009 - DNA, 75 bp, Artificial Sequence
  Synthetic
acaaggactcgttgtgcggagtacggtcagtaacccgcctggagcaccagatgtgggagagcatcagagatgaat

SEQ ID NO: 257010 - DNA, 75 bp, Artificial Sequence
  Synthetic
tgaatgcattgctacatgataatggagtggacttgagcgtggtggttgaaaagcagaaagggatttaccaccaag

SEQ ID NO: 257011 - DNA, 75 bp, Artificial Sequence
  Synthetic
ctccgaataggctcaagccaacggctgaacaatttgagataggatggaaggcgtggggaaagagtaagatattcg

SEQ ID NO: 257012 - DNA, 75 bp, Artificial Sequence
  Synthetic
ctccggaattggcaaattccactttcgtgatcgacggtcccgaaaccagcgaatgtccgaacagccgccgtgcct

SEQ ID NO: 257013 - DNA, 75 bp, Artificial Sequence
  Synthetic
ggaacagccttgagattgaagacttcggatttggaatcacatctactcgagtgtggctaaaagtgcgtgatgaga

SEQ ID NO: 257014 - DNA, 75 bp, Artificial Sequence
  Synthetic
agacttccgaatgtgatagtgcaatcattggaacagcaataaagggaagcctggctgtgcacagtgatttgtcat

SEQ ID NO: 257015 - DNA, 75 bp, Artificial Sequence
  Synthetic
attggattgaaagcagctttaatgagacttggaaactagagagggcagtgtttggtgagatcaagacttgcacct

SEQ ID NO: 257016 - DNA, 75 bp, Artificial Sequence
  Synthetic
ggcccgaaacacacacgctatggggggacggagtcgaggagacagaactcatcattcccaccaccttggctggac

SEQ ID NO: 257017 - DNA, 75 bp, Artificial Sequence
  Synthetic
cgcgtagcaaacataatagaagacaaggttacaaagtgcagctacagggtccttggaatgaggagcagatcacac

SEQ ID NO: 257018 - DNA, 75 bp, Artificial Sequence
  Synthetic
tggactttgattattgcccaggcactaccgtgacgattagcgagcattgtgggaagaggggaccctccgtgcgca

SEQ ID NO: 257019 - DNA, 75 bp, Artificial Sequence
  Synthetic
ccacgactgacagtgggaaactggtcactgactggtgctgcaggagttgcacattgcccccactgcgctacacca

SEQ ID NO: 257020 - DNA, 75 bp, Artificial Sequence
  Synthetic
cagcttctggatgttggtatggaatggaaatccggccaatgaagcatgacgagacaacattagttaagtctagcg

SEQ ID NO: 257021 - DNA, 75 bp, Artificial Sequence
  Synthetic
ttcacgcactgcgagctgacatggttgacccttttcagctgggcctcttggtagttttcctggccacccaggagg

SEQ ID NO: 257022 - DNA, 75 bp, Artificial Sequence
  Synthetic
tcttgaggaagaggtggacggccagaatgactattccagcagtagtagcggctttcctagtgatgatcttgggag

SEQ ID NO: 257023 - DNA, 75 bp, Artificial Sequence
  Synthetic
gtattacatacgttgatatcgcccgatacttgattttagtaggagctgctttcatggagcataacaatggtggag

SEQ ID NO: 257024 - DNA, 75 bp, Artificial Sequence
  Synthetic
acgtagtgcacttagcccttattgcagccttcaaaatacaacctgggtttttggtgatgagtatgatgaagagtc

SEQ ID NO: 257025 - DNA, 75 bp, Artificial Sequence
  Synthetic
attggactaatcaggaaaaccttgctttagtgctaggagctgcttttttccaaatggctgctaccgatctccagt

SEQ ID NO: 257026 - DNA, 75 bp, Artificial Sequence
  Synthetic
tcaacatgcctgacttactgaatgcagcggccatagcctggatgatcatacgagctctcgcaagaccatctgcct

SEQ ID NO: 257027 - DNA, 75 bp, Artificial Sequence
  Synthetic
ctgcgctagctatgccaatgctagcactgctggcacctggaatgcgcttactctatatggatacatacagaatcg

SEQ ID NO: 257028 - DNA, 75 bp, Artificial Sequence
  Synthetic
tgcttctgctaatcggagttagtagcttgttgaatgaaaagcggaaggccgcagagaagaagaaaggggccgttt

SEQ ID NO: 257029 - DNA, 75 bp, Artificial Sequence
  Synthetic
tgatgagcctagctttgactaccacgggctggtgctctccatccatattagctgcagggctcatggtgttcaacc

SEQ ID NO: 257030 - DNA, 75 bp, Artificial Sequence
  Synthetic
ccaataaaaggagggggtggccagccactgaagttctcacagcggtgggactgatgtttgctatagtgggagggc

SEQ ID NO: 257031 - DNA, 75 bp, Artificial Sequence
  Synthetic
tggccgagcttgatgttgaatccatggccattccgtttaccatagctggcttaatgttggtgacatacgtcatat

SEQ ID NO: 257032 - DNA, 75 bp, Artificial Sequence
  Synthetic
ctgggaagtcagtggatatgtggttggaacgcgccgcagacataacctgggagcaggacgcagccatcacgggaa

SEQ ID NO: 257033 - DNA, 75 bp, Artificial Sequence
  Synthetic
ctagtgaaagagttgacgtctgcctggacgatgacggtgattttcatctcatcaacgacccgggagtaccatgga

SEQ ID NO: 257034 - DNA, 75 bp, Artificial Sequence
  Synthetic
aggtatggctactgcggatgacgtgcataggattggcttctgtcacaccctgggccataatcccagcagcggtcg

SEQ ID NO: 257035 - DNA, 75 bp, Artificial Sequence
  Synthetic
ggtattggttaacactgaaatacgcgaagcgcggaggagtgttttgggacacgccttctccaaaaacgtatgcga

SEQ ID NO: 257036 - DNA, 75 bp, Artificial Sequence
  Synthetic
aaggagacaccacccctggcgtttataggataatggcaaaaggactcttagggagataccaagcaggagttggaa

SEQ ID NO: 257037 - DNA, 75 bp, Artificial Sequence
  Synthetic
tcatgtatgaaggtgttttccacactctctggcacacaactagaggagcagccataatgagtggggagggtcgac

SEQ ID NO: 257038 - DNA, 75 bp, Artificial Sequence
  Synthetic
tcacgccattctggggaaacgtgaaagaagacagaatcacatatggtggaccatggaagttcgatcggaagtgga

SEQ ID NO: 257039 - DNA, 75 bp, Artificial Sequence
  Synthetic
acggagtcgatgatgtccaaatgatcgtagtacagccaggaaagccggcgatgaacgtgcaaacaaagccaggag

SEQ ID NO: 257040 - DNA, 75 bp, Artificial Sequence
  Synthetic
tgtttaagacgccgcatggcgatattggggcagtcagcctcgactatcccgttggcacatcggggtctccgataa

SEQ ID NO: 257041 - DNA, 75 bp, Artificial Sequence
  Synthetic
tagatgccaacggggatgtggtgggcctatacggcaatggagtcgtcctcaacaacggtgcgtatgtgagcgcta

SEQ ID NO: 257042 - DNA, 75 bp, Artificial Sequence
  Synthetic
ttgtgcaaggcgatagaatggaggaacccattccagaagcttacaacgccgacatgttaaggaagaggcagctga

SEQ ID NO: 257043 - DNA, 75 bp, Artificial Sequence
  Synthetic
cagtccttgacctccaccccggagcgggaaaaaccaggagaatacttccgcaaatcatcaaggacgccatcgcga

SEQ ID NO: 257044 - DNA, 75 bp, Artificial Sequence
  Synthetic
agcgcttgcgaaccgcagtcctggctcctactagggtggtagcagcagaaatggcggaggccttgaaaggactcc

SEQ ID NO: 257045 - DNA, 75 bp, Artificial Sequence
  Synthetic
cggtgaggtatttgacaccagcagtgcaaagagaacacacgggaaatgagatcatcgacgtcatgtgtcatgcaa

SEQ ID NO: 257046 - DNA, 75 bp, Artificial Sequence
  Synthetic
ccctaacgcacaggctgttgtcgccaactcgggttcccaattacaatctgtttgtcatggatgaggctcacttca

SEQ ID NO: 257047 - DNA, 75 bp, Artificial Sequence
  Synthetic
ctgatcccgctagcatcgccgctcgtggatacatatcaacaaaagttgagttaggagaagcagcggcgatcttca

SEQ ID NO: 257048 - DNA, 75 bp, Artificial Sequence
  Synthetic
tgacggccaccccacctgggacgtcagacccgtttccagatacgaactcaccagtccaggacattccgaatgagg

SEQ ID NO: 257049 - DNA, 75 bp, Artificial Sequence
  Synthetic
tgcctgatagggcttggagcagcggttttgagtggataacagagtatgcaggcaagactgtatggttcgtagcga

SEQ ID NO: 257050 - DNA, 75 bp, Artificial Sequence
  Synthetic
gtgtaaaaatgggaaatgagattgcgcaatgcttgcagcgcgcaggaaagagagtgatccagctgaacaggagat

SEQ ID NO: 257051 - DNA, 75 bp, Artificial Sequence
  Synthetic
cgtatgacacagaatacccgaagtgcaagggtggagagtgggactttgtggtcaccactgacatatctgaaatgg

SEQ ID NO: 257052 - DNA, 75 bp, Artificial Sequence
  Synthetic
gagcgaactttggagctagcagggtgattgactgcaggaagagtgtgaagcctgccattctagaagaaggagaag

SEQ ID NO: 257053 - DNA, 75 bp, Artificial Sequence
  Synthetic
gcagggtcgtgcttggagtcccgtcagctatcactagcgcgagtgcagcacaacgcagaggaagagtcggaagga

SEQ ID NO: 257054 - DNA, 75 bp, Artificial Sequence
  Synthetic
acccaaaccagattggggatgagtaccactatggaggaggaacgagcgaagatgattccattctcgcccactgga

SEQ ID NO: 257055 - DNA, 75 bp, Artificial Sequence
  Synthetic
ctgaggcaaagattttgcttgacaacatacatctaccaaatgggttggtggcacaactgtattcacccgagcgtg

SEQ ID NO: 257056 - DNA, 75 bp, Artificial Sequence
  Synthetic
acaaaacatttaccatggatggggagttccgattacgaggagaagagaggaagacgttcttggaactgcttcgaa

SEQ ID NO: 257057 - DNA, 75 bp, Artificial Sequence
  Synthetic
cggctgacctcccagtttggctttcctataaagtggcttcagccggagtccaatacaatgatagaaaatggtgct

SEQ ID NO: 257058 - DNA, 75 bp, Artificial Sequence
  Synthetic
ttgacggacctagatctaacattattctcgaggacaacaacgaggttgaggtcatcactagagtcggagaaagga

SEQ ID NO: 257059 - DNA, 75 bp, Artificial Sequence
  Synthetic
aacagctcagaccaagatggttggatgcgcgagtgtattcagaccatcagtccttgaaatggtttaaagatttcg

SEQ ID NO: 257060 - DNA, 75 bp, Artificial Sequence
  Synthetic
ctgcaggaaagcggtcagccatggggtttgtggaggtcctaggaagaatgccagaacacttcgctgggaagacta

SEQ ID NO: 257061 - DNA, 75 bp, Artificial Sequence
  Synthetic
gagacgccctagacatcatgtatctagttgtcacgtcagagagaggaggaaaagcccacaaaatggcattagagg

SEQ ID NO: 257062 - DNA, 75 bp, Artificial Sequence
  Synthetic
aattgcctgacgccttggagacgctagctttgattgcagctcttggagtcatgacagcaggatttttcttggtga

SEQ ID NO: 257063 - DNA, 75 bp, Artificial Sequence
  Synthetic
tgatgcagagaaaaggaataggcaagcttggattgggaacactggtattgtgcctagcaacgttttttctatgga

SEQ ID NO: 257064 - DNA, 75 bp, Artificial Sequence
  Synthetic
tggccgatgtgtcatgtacgaagatcgctgggatgctactcttgtcgctgctgatgatggttgtgcttatacctg

SEQ ID NO: 257065 - DNA, 75 bp, Artificial Sequence
  Synthetic
aacctgagaagcagcggtcgcagacagacaaccaactggctgtttttctagtgtgcgtgatgtgcgttgttggaa

SEQ ID NO: 257066 - DNA, 75 bp, Artificial Sequence
  Synthetic
tggtggcagccaatgagtttggcatgttggagaaaacaaaggaagaccttagacatctttttgtaggatccaagc

SEQ ID NO: 257067 - DNA, 75 bp, Artificial Sequence
  Synthetic
cagctaatgaagcaataagcatgaccaccagcatgttcaccctggacctccggccagccaccgcctgggctcttt

SEQ ID NO: 257068 - DNA, 75 bp, Artificial Sequence
  Synthetic
atggagggagcactgttgttttcaccccaatgatcaaacacatagttacatctcagtacgtaacaacttcgctgg

SEQ ID NO: 257069 - DNA, 75 bp, Artificial Sequence
  Synthetic
cctcaatcagcgcacaagcagggactttgttcacgttgccaaagggaataccattttccaatattgacatgacag

SEQ ID NO: 257070 - DNA, 75 bp, Artificial Sequence
  Synthetic
tagctttagtgtttctaggttgttggggccaaataaccctgacaactctgcttacagctgtagtgttgggagtgg

SEQ ID NO: 257071 - DNA, 75 bp, Artificial Sequence
  Synthetic
tgcattatggttatctcctaccaggttggcaggcggaagccttgcgggcagcccagaagaggacagcagccggga

SEQ ID NO: 257072 - DNA, 75 bp, Artificial Sequence
  Synthetic
taatgaaaaatgctgttgttgacgggatagttgctaccgatgtgcctgagctggaacggactactcccatgatgc

SEQ ID NO: 257073 - DNA, 75 bp, Artificial Sequence
  Synthetic
agaagcgcttggggcagattctattgataggagtgagtgtcacagccctgctggtcaacccacgcgtgaccaccg

SEQ ID NO: 257074 - DNA, 75 bp, Artificial Sequence
  Synthetic
tcagagaagctggcgttctttgctcagccgccctcctgacattatgggacaatagtgccagtgcggtgtggaatt

SEQ ID NO: 257075 - DNA, 75 bp, Artificial Sequence
  Synthetic
cgaccacagccacaggcttgtgccatgttatgcgtggtagctggctcgccggtgcctcgattgcttggactctca

SEQ ID NO: 257076 - DNA, 75 bp, Artificial Sequence
  Synthetic
taaaaaatgcggagaagccaacatttaagcgaggctcggccggaggtcggacgctgggagaacagtggaaagaca

SEQ ID NO: 257077 - DNA, 75 bp, Artificial Sequence
  Synthetic
ggcttaatcagctgagcaaagaggaatttttccagtatcgaaaggaagctatcatagaggtagatagaacagacg

SEQ ID NO: 257078 - DNA, 75 bp, Artificial Sequence
  Synthetic
cgaggaaggccaggaaggctggcaatgttacaggagggcatccagtctcccgaggcactgcaaaattgcgatggc

SEQ ID NO: 257079 - DNA, 75 bp, Artificial Sequence
  Synthetic
tggtcgaacggcagttcctcaacccggtagggcgcgttgtcgatctgggctgtgggagaggaggctggagctact

SEQ ID NO: 257080 - DNA, 75 bp, Artificial Sequence
  Synthetic
acgcagccaccatgaagcgagtgcaggaagtgcgcggctacacgaaaggtggtgctggacacgaagaaccaatgc

SEQ ID NO: 257081 - DNA, 75 bp, Artificial Sequence
  Synthetic
tgatgcagagctacggatggaatatagtgtcactgaagagcggagtggatgtgttttaccggccttcagaggtta

SEQ ID NO: 257082 - DNA, 75 bp, Artificial Sequence
  Synthetic
gtgacacgctcctatgtgacataggtgaatcggcctccagcgctgaagttgaggaacacagaacgcttagaatcc

SEQ ID NO: 257083 - DNA, 75 bp, Artificial Sequence
  Synthetic
tggagatggtaagtgattggcttagcagaggccctagggaattctgcatcaaggttttatgcccttacatgccca

SEQ ID NO: 257084 - DNA, 75 bp, Artificial Sequence
  Synthetic
aggtcattgagaagatggaacagcttcagagaagatttggtggaggactagtgagagtcccgctctccaggaatt

SEQ ID NO: 257085 - DNA, 75 bp, Artificial Sequence
  Synthetic
cgagtcacgagatgtactgggtaagtggagcatcaggcaatatcattcactctgtcaacatgaccagccaagtgt

SEQ ID NO: 257086 - DNA, 75 bp, Artificial Sequence
  Synthetic
tgataggccgtatggaaaagaagtcttggaaagggccacgatatgaagaagatgtgaacttaggcagtggtacaa

SEQ ID NO: 257087 - DNA, 75 bp, Artificial Sequence
  Synthetic
gatccgtaggcaaggcagtgccccattctgacttaaagaagatttccgctagagttgagagactccgggacgaat

SEQ ID NO: 257088 - DNA, 75 bp, Artificial Sequence
  Synthetic
atagcgctacttggcaccaggacaaagatcatccttatcgcacgtggacgtaccatggaagctatgaggtgaagc

SEQ ID NO: 257089 - DNA, 75 bp, Artificial Sequence
  Synthetic
caactgggtcggcaagttctctagtcaatggagtagttcgaatgttgagcaagccctgggacgccatcacaagcg

SEQ ID NO: 257090 - DNA, 75 bp, Artificial Sequence
  Synthetic
tgaccacgatggccatgacggacacaactccattcggacagcagagagtgttcaaagaaaaggtggacaccaagg

SEQ ID NO: 257091 - DNA, 75 bp, Artificial Sequence
  Synthetic
ccccagaaccgccagcgggtgtgaaagaagtgatgaatgagacaacaaactggctatgggcttttttggctcgca

SEQ ID NO: 257092 - DNA, 75 bp, Artificial Sequence
  Synthetic
ggaagagagcaaggatgtgttctcgcgaagaatttaaacagaaagtcaacagccatgcagcactcggagcaatgt

SEQ ID NO: 257093 - DNA, 75 bp, Artificial Sequence
  Synthetic
ttgaagagcagaaccaatggaagaatgcacgagaagccgtggaggatccaatcttctggaatatggtagatgaag

SEQ ID NO: 257094 - DNA, 75 bp, Artificial Sequence
  Synthetic
agcgtgagtgccacctacgaggagaatgccggacctgcatatacaacatgatggggaagagagaaaagaagccag

SEQ ID NO: 257095 - DNA, 75 bp, Artificial Sequence
  Synthetic
gagagtttggaaaagcaaaaggcagtagagcgatctggttcatgtggttaggggctcgctttcttgaatttgaag

SEQ ID NO: 257096 - DNA, 75 bp, Artificial Sequence
  Synthetic
cccttgggttcttgaacgaggaccattggttgagcagagaaaactcaggaggtggggtggaaggcgcaggcattc

SEQ ID NO: 257097 - DNA, 75 bp, Artificial Sequence
  Synthetic
aaaaattaggctacatcctgagggaagtggggacgaaggctggaggaaagatctacgcggatgacactgcaggct

SEQ ID NO: 257098 - DNA, 75 bp, Artificial Sequence
  Synthetic
gggacacacgaataacgaaagctgaccttgaaaacgaagcgaaagtcctggaactgatgcaaggtgagcacagaa

SEQ ID NO: 257099 - DNA, 75 bp, Artificial Sequence
  Synthetic
ccttggcaagggcaattatagagctcacctataggcacaaagtagtgaaagtcatgaggcccgctgccggaggaa

SEQ ID NO: 257100 - DNA, 75 bp, Artificial Sequence
  Synthetic
aaacagtgatggatgtgatatcaagagaggaccagaggggtagtggtcaagtggtaacatatgcgctaaatacat

SEQ ID NO: 257101 - DNA, 75 bp, Artificial Sequence
  Synthetic
tcaccaatatagcggtacagcttattagattgatggaagctgaaggggtgattggacctgaagacctagaaaatt

SEQ ID NO: 257102 - DNA, 75 bp, Artificial Sequence
  Synthetic
tggaaagaaagaagaaataccttgtcagaacttggcttttcgagaatggagaagagagggtaagtagaatggcag

SEQ ID NO: 257103 - DNA, 75 bp, Artificial Sequence
  Synthetic
tcagtggagatgactgtgtggtgaagccactcgacgacaggttcgcaggagctttgcactttcttaatgccatgt

SEQ ID NO: 257104 - DNA, 75 bp, Artificial Sequence
  Synthetic
ccaaggttaggaaggatatccaggagtggaagccatctcaaggatggtacgactggcagcaggttcctttttgtt

SEQ ID NO: 257105 - DNA, 75 bp, Artificial Sequence
  Synthetic
caaatcactttctggagctggttatgaaggacgggagaagtttggtggtcccctgtcggggtcaagacgagttga

SEQ ID NO: 257106 - DNA, 75 bp, Artificial Sequence
  Synthetic
taggaagggctagaatatcccctggagccggatggaacgtgcgagacaccgcttgcttggcaaaggcctatgcac

SEQ ID NO: 257107 - DNA, 75 bp, Artificial Sequence
  Synthetic
agatgtggctcctgctctacttccaccggcgggacctgcgaatcatggccaacgcaatatgctcagccgtccctg

SEQ ID NO: 257108 - DNA, 75 bp, Artificial Sequence
  Synthetic
tgaactgggtccccacggggagaacaacatggtcagtgcatgccaagggagaatggatgacaacggctgatatgt

SEQ ID NO: 257109 - DNA, 75 bp, Artificial Sequence
  Synthetic
tggaagtttggaacagagtatggatacaggacaatgagtggatgcaggacaaaacccccattacaagctgggcgg

SEQ ID NO: 257110 - DNA, 75 bp, Artificial Sequence
  Synthetic
acgtgccctactcaggaaaaagagaagacatatggtgtgggagtctaattggaacgcgtccgcgctcaacatggg

SEQ ID NO: 257111 - DNA, 75 bp, Artificial Sequence
  Synthetic
ctgagaacatctatgcggcaatcaatcaggttaggtcaataattggaaaagaggaataccgtgattacatgcaat

SEQ ID NO: 257112 - DNA, 75 bp, Artificial Sequence
  Synthetic
cattgaggaggtatgaagaggcaacaatatgtgaagacagagtgctgtaaacagaacaagtggttaatttgagag

SEQ ID NO: 257113 - DNA, 75 bp, Artificial Sequence
  Synthetic
attaggagtgtgagtcaggccagtgaaaactgccaccggatgttggtagacggtgctgcctgcgaccaaccccag

SEQ ID NO: 257114 - DNA, 75 bp, Artificial Sequence
  Synthetic
gaggactgggttaacaaagctgaactccaatcgttggaaagcctcctgataccgtctcggaataggagtccctgc

SEQ ID NO: 257115 - DNA, 75 bp, Artificial Sequence
  Synthetic
caatagggaggagtgaagcccgtgtcaggtcacattgtgccaccttgccagaaggtgcaacctgcgaggccccag

SEQ ID NO: 257116 - DNA, 75 bp, Artificial Sequence
  Synthetic
gtggactgggtaatcaaagccgccaggcccccacggcccgggccatgagtgatgatgttaactcatggcgaagga

SEQ ID NO: 257117 - DNA, 75 bp, Artificial Sequence
  Synthetic
ctagaggttagaggagaccccgtggtaataacacacaacggcccaaacacgcggaagctgtaacgcgtgtggaag

SEQ ID NO: 257118 - DNA, 75 bp, Artificial Sequence
  Synthetic
gactagaggttagaggagaccccgttgtggaaaaagcatcaaaacttaacagcatactgacacctgggacagact

SEQ ID NO: 257119 - DNA, 75 bp, Artificial Sequence
  Synthetic
aggagatcttctgctctatttcaacaccagctacgaggcaccgaacgccgaaaagtgtagctggtggtggagaag

SEQ ID NO: 257120 - DNA, 75 bp, Artificial Sequence
  Synthetic
ctgctctatttcaacaccagctacgaggcaccgaacgccgaaaagtgtagctggtggtggagaagaacacaggat

SEQ ID NO: 257121 - DNA, 75 bp, Artificial Sequence
  Synthetic
tggtgaacaaaaggggcaaaaaacaaaagaaaagaggcggcagtgaaacatccaagcttatggtcattctcatgc

SEQ ID NO: 257122 - DNA, 75 bp, Artificial Sequence
  Synthetic
ttgctgatgtgatcgccattccaactccgaagggacccaatcaatgctggattcgagccattgacattggattca

SEQ ID NO: 257123 - DNA, 75 bp, Artificial Sequence
  Synthetic
tcacagtgcagacccatggtgaaagcactttggtcaacaaaaaggatgcctggctggattccacgaaggctacgc

SEQ ID NO: 257124 - DNA, 75 bp, Artificial Sequence
  Synthetic
agtcatttttacagtgcttttgctcctcgtcgctcctgcctacagttttaactgtctgggaatgagcagccgtga

SEQ ID NO: 257125 - DNA, 75 bp, Artificial Sequence
  Synthetic
actgtctgggaatgagcagccgtgattttattgaaggtgcttcaggagctacatgggtcgatttggtgctggaag

SEQ ID NO: 257126 - DNA, 75 bp, Artificial Sequence
  Synthetic
atcttgcactggttagaaattactgctatgcagccactgtgtcagacgtttctacggtgtcaaactgtcctacta

SEQ ID NO: 257127 - DNA, 75 bp, Artificial Sequence
  Synthetic
gtaacggatgtggcttgtttggtaaagggagcattgatacatgcgcaaagttcacctgctctaactcagctgcgg

SEQ ID NO: 257128 - DNA, 75 bp, Artificial Sequence
  Synthetic
ttcacctgctctaactcagctgcggggagacttattttaccagagaacatcaaatatgaagttggggtttttgtc

SEQ ID NO: 257129 - DNA, 75 bp, Artificial Sequence
  Synthetic
cacggatcaacggactcaaccagtcatggaaattactctacccaaattggagctaaccaagcagtcaggttcacc

SEQ ID NO: 257130 - DNA, 75 bp, Artificial Sequence
  Synthetic
atttcaccgaacgccccagccatcacagcaaagttgggcgactatggagaagtcactgtggagtgtgaaccgagg

SEQ ID NO: 257131 - DNA, 75 bp, Artificial Sequence
  Synthetic
agtggactgaacacggaggcttactacgtcatgaccattggaacgaaacactttctagtgcatcgtgagtggttc

SEQ ID NO: 257132 - DNA, 75 bp, Artificial Sequence
  Synthetic
acgtcatgaccattggaacgaaacactttctagtgcatcgtgagtggttcaacgacttgctcttgccatggacat

SEQ ID NO: 257133 - DNA, 75 bp, Artificial Sequence
  Synthetic
tggttgccctgggttcacaggaaggagctttgcatcaagctctggctggagccataccagtcgacttttcgagca

SEQ ID NO: 257134 - DNA, 75 bp, Artificial Sequence
  Synthetic
gccataccagtcgacttttcgagcagtacacttaagctcacttcagggcaccttaagtgtcgcgtgaaaatggag

SEQ ID NO: 257135 - DNA, 75 bp, Artificial Sequence
  Synthetic
ggccatggcacggtagttctagaactgcagtacaccgggagtgatggaccatgcaaaatcccaatatcctctgta

SEQ ID NO: 257136 - DNA, 75 bp, Artificial Sequence
  Synthetic
atgcaaaatcccaatatcctctgtagcgagtctcaatgacatgacgcccgtcggaagaatggtgacggctaaccc

SEQ ID NO: 257137 - DNA, 75 bp, Artificial Sequence
  Synthetic
caggtctttggaggagcatttagaaccctctttggaggaatgtcatggattagtcaaggtctgctgggggcgtta

SEQ ID NO: 257138 - DNA, 75 bp, Artificial Sequence
  Synthetic
cagaaaggcatgtacagagcagcgcccaataggcttaaactcactgtggaagaacttgaaatgggctggaaggcc

SEQ ID NO: 257139 - DNA, 75 bp, Artificial Sequence
  Synthetic
aaacgaggtccctcagtacgcaccacaactgacagcggaaaactcgtcacggactggtgctgcaggagctgcacg

SEQ ID NO: 257140 - DNA, 75 bp, Artificial Sequence
  Synthetic
tactctgccagcagcggttggggctctgctagtcctcctccttgggggcattacctacactgatctggtacggta

SEQ ID NO: 257141 - DNA, 75 bp, Artificial Sequence
  Synthetic
tgccacagcctggatggtgttgcgagcaatggcttttccgtcaacctcagcaatagctatgcccatgctagcaat

SEQ ID NO: 257142 - DNA, 75 bp, Artificial Sequence
  Synthetic
caatagctatgcccatgctagcaatgcttgctccaggaatgagaatgcttcaccttgacacatacaggatagtgc

SEQ ID NO: 257143 - DNA, 75 bp, Artificial Sequence
  Synthetic
ttggtctagccctgacttcgactggatatttttcaccaacaatcatggcagcaggccttatggtgtgcaacccta

SEQ ID NO: 257144 - DNA, 75 bp, Artificial Sequence
  Synthetic
ctgagctagacattgattctatgtcagtcccttttaccatagctggcctcatgctagtgtcttatgtcatctcgg

SEQ ID NO: 257145 - DNA, 75 bp, Artificial Sequence
  Synthetic
gaaaagccacggatatgtggcttgaaagagcagccgatgtgtcatgggaagcgggggcagcaataacaggcacca

SEQ ID NO: 257146 - DNA, 75 bp, Artificial Sequence
  Synthetic
gcgggggcagcaataacaggcaccagtgaaagactggatgtccaattggacgatgatggagattttcatctgctc

SEQ ID NO: 257147 - DNA, 75 bp, Artificial Sequence
  Synthetic
gccattttgccatccgcgtttgggtattggctgactctgaaatacacaaagcgagggggtgttttttgggacacg

SEQ ID NO: 257148 - DNA, 75 bp, Artificial Sequence
  Synthetic
tggaaattagaccagaaatggaatggagtggatgacgtccagatgatagtggtggaaccaggaaagccagcaata

SEQ ID NO: 257149 - DNA, 75 bp, Artificial Sequence
  Synthetic
ggtggaaccaggaaagccagcaataaatgtgcagaccaagcctgggattttcaagacagcacacggagaaattgg

SEQ ID NO: 257150 - DNA, 75 bp, Artificial Sequence
  Synthetic
atagcaatggagaaatcattggcctttatggaaatggagtgatactaggtaatggggcctatgtcagcgctattg

SEQ ID NO: 257151 - DNA, 75 bp, Artificial Sequence
  Synthetic
tgcttgacctgcacccaggtgctgggaaaacacgacgcatacttccccaaataattaaagatgccatccaaaaaa

SEQ ID NO: 257152 - DNA, 75 bp, Artificial Sequence
  Synthetic
gactacgaacagctgttctagcaccaacgagggtggttgcggcagaaatggcagaagctctgaggggccttccag

SEQ ID NO: 257153 - DNA, 75 bp, Artificial Sequence
  Synthetic
taacacaccgattgatgtcgccgctaagagtcccaaattacaacctgtttgtcatggatgaagcccatttcacag

SEQ ID NO: 257154 - DNA, 75 bp, Artificial Sequence
  Synthetic
atatattgccacccgtgttgaagcgggagaggccgcggccatctttatgacggccacccccccaggcacatctga

SEQ ID NO: 257155 - DNA, 75 bp, Artificial Sequence
  Synthetic
tgagtggataaccgactatgttggaaagaccgtctggttcgtagcaagcgtaaaaatgggcaatgagattgcgca

SEQ ID NO: 257156 - DNA, 75 bp, Artificial Sequence
  Synthetic
aagaccgtctggttcgtagcaagcgtaaaaatgggcaatgagattgcgcagtgcctgcaacgagcagggaagcga

SEQ ID NO: 257157 - DNA, 75 bp, Artificial Sequence
  Synthetic
gataccatgctggcgcactggactgaagcaaagattcttttggacaacatccacctcccaaatggcctagtagct

SEQ ID NO: 257158 - DNA, 75 bp, Artificial Sequence
  Synthetic
cagctgtacggtcctgaaagagataaaacatacaccatggatggagagtaccgactcagaggcgaagaacgtaaa

SEQ ID NO: 257159 - DNA, 75 bp, Artificial Sequence
  Synthetic
aaacatacaccatggatggagagtaccgactcagaggcgaagaacgtaaaacattcctcgagctcgtaaaaacag

SEQ ID NO: 257160 - DNA, 75 bp, Artificial Sequence
  Synthetic
atggaccccgttccaacattattctcgaagacaataacgaagtggaaattacaacaagaataggagaaaggaaaa

SEQ ID NO: 257161 - DNA, 75 bp, Artificial Sequence
  Synthetic
acaacaagaataggagaaaggaaaattttgaagccacgatggttagatgcacgcgtgtattcggaccaccagtct

SEQ ID NO: 257162 - DNA, 75 bp, Artificial Sequence
  Synthetic
gcgcatagaatggctcttgaagaactacctgatgctctggaaactataacactcatagcagcgttgggagtcatg

SEQ ID NO: 257163 - DNA, 75 bp, Artificial Sequence
  Synthetic
accgcagggttttttctcctcatgatgcaaagaaaagggattggtaaactgggactcggagcactcgttttggtg

SEQ ID NO: 257164 - DNA, 75 bp, Artificial Sequence
  Synthetic
ggaaagaacaaaaactgatataagaaacctatttgggaagccactaattgaggaaaatgaggtccatatccctcc

SEQ ID NO: 257165 - DNA, 75 bp, Artificial Sequence
  Synthetic
ctttgattttttcactctggatctgaagcctgctactgcttgggctttgtacggaggaagcacagtcgtgttgac

SEQ ID NO: 257166 - DNA, 75 bp, Artificial Sequence
  Synthetic
cttgtttacattgcctaaaggaattcctttcactgattttgacttgtctgtagcactagtgtttcttggctgctg

SEQ ID NO: 257167 - DNA, 75 bp, Artificial Sequence
  Synthetic
cctttcactgattttgacttgtctgtagcactagtgtttcttggctgctggggacaagtgacgcttaccaccttg

SEQ ID NO: 257168 - DNA, 75 bp, Artificial Sequence
  Synthetic
cgtcttggccagcgtggcagcagtatgcgtgaaccccagaataactaccattcgtgaagccggaatactctgtac

SEQ ID NO: 257169 - DNA, 75 bp, Artificial Sequence
  Synthetic
gggccaggccatgaagaacccatgttaatgcagagctatgggtggaacatcgtcaccatgaaaagtggcgttgat

SEQ ID NO: 257170 - DNA, 75 bp, Artificial Sequence
  Synthetic
gttttctacaaaccatctgaaatcagtgacacccttttgtgtgacgtaggagagtcatcaccaagtgctgaaata

SEQ ID NO: 257171 - DNA, 75 bp, Artificial Sequence
  Synthetic
ttggaaaggcccaaaatatgaggaagatgtcaacctgggtagcggtacgagagcagtaggaaaaggtgtgcagca

SEQ ID NO: 257172 - DNA, 75 bp, Artificial Sequence
  Synthetic
gagcagtaggaaaaggtgtgcagcacacggattacaagaagatcaaatccagaatagaaaaactaaaggaagagt

SEQ ID NO: 257173 - DNA, 75 bp, Artificial Sequence
  Synthetic
agccacgccgccttgggagccatgtttgaagagcaaaaccagtggaagaacgcacgagaagctgttgaagacccc

SEQ ID NO: 257174 - DNA, 75 bp, Artificial Sequence
  Synthetic
accacacaaaggtggctatgattactataaataaaaagcactccaatacaaacttaggagtaaagtctggtttgc

SEQ ID NO: 257175 - DNA, 75 bp, Artificial Sequence
  Synthetic
tagatcagcaacggttccgaatagccctggtagattttacaatctggtccactgaagacttatcgagaggcctgg

SEQ ID NO: 257176 - DNA, 75 bp, Artificial Sequence
  Synthetic
taggtgacagcaacagctactccaaaatggcaggtgttttaagtgctcttaaggattttaaggaggctaagttat

SEQ ID NO: 257177 - DNA, 75 bp, Artificial Sequence
  Synthetic
ctcaatctttagctgtaaccctgattgatataattacaaaggctgagaacgaccacctcaatgagatcaaagctg

SEQ ID NO: 257178 - DNA, 75 bp, Artificial Sequence
  Synthetic
gtatcaagacagataagattgccaaaggtgcgatcactgccatcaagcgcaaagttgcagtaattgttccaggcc

SEQ ID NO: 257179 - DNA, 75 bp, Artificial Sequence
  Synthetic
tagagagtgacgatgacatcagtagtcttatcgcagaattcctaattgcctcaccaaaattgttgtcccttcact

SEQ ID NO: 257180 - DNA, 75 bp, Artificial Sequence
  Synthetic
aagagggcagcaaaccaaggtggaagctcctcaagatgttactaggtgttatttggtcagatgaagcatccccct

SEQ ID NO: 257181 - DNA, 75 bp, Artificial Sequence
  Synthetic
taggtcaagtcatagcagttaattgggcatttgagatccactatagaagaccccgcggccggtaccagatggttg

SEQ ID NO: 257182 - DNA, 75 bp, Artificial Sequence
  Synthetic
cagtcataactggcgctcttctatctatgattgcactgatgtcagagaatccagcaagcatggtcaggcgcttgt

SEQ ID NO: 257183 - DNA, 75 bp, Artificial Sequence
  Synthetic
agctcctgcataccctattatcaagaatgtctaagggatctttaaatattctggtcaatgccttttctcatccta

SEQ ID NO: 257184 - DNA, 75 bp, Artificial Sequence
  Synthetic
gtacagaccctgatctatcaatcaccatagtggagttcactctcaatgctgaaggagaacctgtgttcgcctcca

SEQ ID NO: 257185 - DNA, 75 bp, Artificial Sequence
  Synthetic
gagtcttccgtagaatgtgggatgctgatctgatcgaaccaagagcagggcacttagtagatcaacagaacctgg

SEQ ID NO: 257186 - DNA, 75 bp, Artificial Sequence
  Synthetic
gaggtgtaaattaccaagaacagatggcccaatatatgaggatggcaaacaaccccccaggcagagcacagaatg

SEQ ID NO: 257187 - DNA, 75 bp, Artificial Sequence
  Synthetic
tggagcttattcgtgactatttagtagaatgttacagtatgtacctgtctgtatgggagtcagatgatgatgtcc

SEQ ID NO: 257188 - DNA, 75 bp, Artificial Sequence
  Synthetic
atgtcccctttgaagacgaagatgcatgggagcaggatgatatccctatggatgaatttatggtagccaatatga

SEQ ID NO: 257189 - DNA, 75 bp, Artificial Sequence
  Synthetic
atattccgtatatgatatgtgagcctgatgaggatgttctatcacagaggtatgatgtagtgcagtcgaaacacc

SEQ ID NO: 257190 - DNA, 75 bp, Artificial Sequence
  Synthetic
ctgtccagatccagctatggactctgcttattaaagcagtaacagctcctgatacagctagagatggtgagttga

SEQ ID NO: 257191 - DNA, 75 bp, Artificial Sequence
  Synthetic
tcgctatgatttcagatttatatgtcaatgaacactttagtgttataattcggggacttgatccaatcaataaat

SEQ ID NO: 257192 - DNA, 75 bp, Artificial Sequence
  Synthetic
ggaggtggataaagtatgcccaacaaaggagggttgtatctttctacaaattgaatacgatctggttaaacatca

SEQ ID NO: 257193 - DNA, 75 bp, Artificial Sequence
  Synthetic
gtagggtactcagagattcaatagacagggcagctcggttaacaacagcaagcatggactggaatattgaggacc

SEQ ID NO: 257194 - DNA, 75 bp, Artificial Sequence
  Synthetic
ctagaggccatcttgcagctgatctcagcgtacgaaggtttatggtgagaacattgattgagattcagagaatgg

SEQ ID NO: 257195 - DNA, 75 bp, Artificial Sequence
  Synthetic
taactatttttgcctatccggcatctgtgacttatatccgccggggtactattaaacagttgaggctgagaatgc

SEQ ID NO: 257196 - DNA, 75 bp, Artificial Sequence
  Synthetic
ggggaaataaaggcaggctacttgaggctattgcagatattggtaattatatagaggagtcgggtcttgcaggct

SEQ ID NO: 257197 - DNA, 75 bp, Artificial Sequence
  Synthetic
ctgatccagggctcatcctgcaagggttcattacagacaggatcccgcctgatgttgttagcactcctcacagta

SEQ ID NO: 257198 - DNA, 75 bp, Artificial Sequence
  Synthetic
tccatctcaccattcgatacgggattgagaccagatactctgctctagcactaaatgagttccaaggtgatttgg

SEQ ID NO: 257199 - DNA, 75 bp, Artificial Sequence
  Synthetic
tcgtttcaataccagatgaacttcctaagaacataactttgtccgctacagaggtcttgagcacaatcacaagtg

SEQ ID NO: 257200 - DNA, 75 bp, Artificial Sequence
  Synthetic
ccacgatcgagcgccttatgaagatgtaccttgaaatgggtcccagtgctccgtatatggtactacttgaggagt

SEQ ID NO: 257201 - DNA, 75 bp, Artificial Sequence
  Synthetic
ctttcgcatgccccgcaatccccaacctatcgcgacaggcggttgattatagccatcacctgtatcgcagacttg

SEQ ID NO: 257202 - DNA, 75 bp, Artificial Sequence
  Synthetic
ctgtccaaactaaattcgcaccaggaaattatcccttgttgtggagttatgcgatgggggtcggagcagctctgg

SEQ ID NO: 257203 - DNA, 75 bp, Artificial Sequence
  Synthetic
gaatcaactccaccagctgttacaaggcccttgagattgcaaatgtaatagcaggcagatttgaccaaacaggcc

SEQ ID NO: 257204 - DNA, 75 bp, Artificial Sequence
  Synthetic
atagagcaatggccaatctgaatttcaatcggccataccttgaccatggtctgttcaggcttggacaaagggttg

SEQ ID NO: 257205 - DNA, 75 bp, Artificial Sequence
  Synthetic
agagactatttttaggggaaggatcgggtgcaatgttggtcacatattactatatgctgggcaatacaaagtgtt

SEQ ID NO: 257206 - DNA, 75 bp, Artificial Sequence
  Synthetic
tgcgacaaatggaaggctctgtggatcagcatatggccagagagctagggatgacgtctgaagatcatggtaggc

SEQ ID NO: 257207 - DNA, 75 bp, Artificial Sequence
  Synthetic
attataatactggtgtgttcacagattctgtaaggggtcaaagagaatttaatccatatccctcagaggtagcac

SEQ ID NO: 257208 - DNA, 75 bp, Artificial Sequence
  Synthetic
tgcagaggatgatccagggtatggggacacgcggggcaggtgatatagatgagtaccaacaaggggaatttcagg

SEQ ID NO: 257209 - DNA, 75 bp, Artificial Sequence
  Synthetic
ttgtagggaagcaaaactcggtacaaaatctattaaatgaccagattgagatactattcaacgggaaacctgaaa

SEQ ID NO: 257210 - DNA, 75 bp, Artificial Sequence
  Synthetic
tagcatctctggacgatgatgaacctaaatcagggcaatcagctaagcaagttcaaagtcagcgacccacattgt

SEQ ID NO: 257211 - DNA, 75 bp, Artificial Sequence
  Synthetic
gcacctggataggaaatttagaatgctatgcttatattttaaaccaggtcaagataggaacatgtagtatggtgc

SEQ ID NO: 257212 - DNA, 75 bp, Artificial Sequence
  Synthetic
tgagaacgccaatccaacagcacagcaacacagctgcagaaaccggagaggatgaggatgatgctgatgacttcg

SEQ ID NO: 257213 - DNA, 75 bp, Artificial Sequence
  Synthetic
attgtgatatggaggggactagtgaaaaaacaaggctccaagtgttggaagaattatgtcatgttgttagtatag

SEQ ID NO: 257214 - DNA, 75 bp, Artificial Sequence
  Synthetic
ctgcagccattcaggcagcctttgattatgaccctccaactaacagacccatgaccccgcatgcttctcttcccg

SEQ ID NO: 257215 - DNA, 75 bp, Artificial Sequence
  Synthetic
cagtggcaactggagcacctggctctgttttggttctcaaactaatgcccttaggggatgattggatgtcagagc

SEQ ID NO: 257216 - DNA, 75 bp, Artificial Sequence
  Synthetic
aaagaccaacagggtaccgtggcccgacaagagtgcttagccatcccgacctcatgcggtacaatgaccaagagt

SEQ ID NO: 257217 - DNA, 75 bp, Artificial Sequence
  Synthetic
taataaagttcatttgtgaacaatatgaagaagtattcctccatatcccttggtatagtaaccctgattctactg

SEQ ID NO: 257218 - DNA, 75 bp, Artificial Sequence
  Synthetic
taatgagataatgggcccttaaaaccatcaatcaacccttcacaacaggaaacattacaaaaaacttaggaccaa

SEQ ID NO: 257219 - DNA, 75 bp, Artificial Sequence
  Synthetic
aaatgtatgttattgcgatcaatctcaaaatttcacaagtacttgatccggggatcataatggctaaactcagct

SEQ ID NO: 257220 - DNA, 75 bp, Artificial Sequence
  Synthetic
ggtccggcctaatccaagcagagtcaatggaaaccaacggtcaaaaggtcatcagagatgccctccaggttcttg

SEQ ID NO: 257221 - DNA, 75 bp, Artificial Sequence
  Synthetic
catcaagctgtaatacatcatcacagctccattcatggatcattcaatccaaaagtcatcttgttatgaatcatg

SEQ ID NO: 257222 - DNA, 75 bp, Artificial Sequence
  Synthetic
cagtcgttaaggaaactgactctccgacgacagagaaccaatgcggaagaagactctcagtccagggagtcacca

SEQ ID NO: 257223 - DNA, 75 bp, Artificial Sequence
  Synthetic
ggcctgtggacggcaatcagattttatcgcatcagggaatgaccactctggctcattctatgattaaattgaccc

SEQ ID NO: 257224 - DNA, 75 bp, Artificial Sequence
  Synthetic
cccagacctccaccacggaccccgagaccaagggtgagagtgggagtgaggaagaatccggatctggttggggtg

SEQ ID NO: 257225 - DNA, 75 bp, Artificial Sequence
  Synthetic
caatagagagaacactagctactatagggttccagcagaacggtacaaaggttgttaaacaactaatagcaaatg

SEQ ID NO: 257226 - DNA, 75 bp, Artificial Sequence
  Synthetic
gagaaggaaactcaagccaggaagcaagcggaagcaatcaacttgttgacaatgctgagagatatggagagggag

SEQ ID NO: 257227 - DNA, 75 bp, Artificial Sequence
  Synthetic
atcctagcaacgggattgatcccattattgcagggattgttatggcatataaagagttactctacacctacagtg

SEQ ID NO: 257228 - DNA, 75 bp, Artificial Sequence
  Synthetic
aatctaaggggcctcaggggcctggagggtttgacggagtacacgacagtccagttcgtcaagaccatcctgatg

SEQ ID NO: 257229 - DNA, 75 bp, Artificial Sequence
  Synthetic
ttcaccagagtgaccaccatttctttcagccatatcctgtccttgattcatcaaaggttagggaggtggtatatg

SEQ ID NO: 257230 - DNA, 75 bp, Artificial Sequence
  Synthetic
agggtatcagaagggagccctgttacgtcttgttgggtgcagcaagtggaggagcatatctgtcagagtcagagg

SEQ ID NO: 257231 - DNA, 75 bp, Artificial Sequence
  Synthetic
atattatcagaaagacatacatggtctccattcttgattcatctgttgacagaactcagacatggatagacctag

SEQ ID NO: 257232 - DNA, 75 bp, Artificial Sequence
  Synthetic
gagaaggaagccctacacgaggcagtccagtgggtgagagcggtgatgcaaaagtgattgctcccccaaataggg

SEQ ID NO: 257233 - DNA, 75 bp, Artificial Sequence
  Synthetic
gaatcaatcttaggaagcgtgtcctaccatttgatttccatgatgagaatcatacgagatattgcccgcactatg

SEQ ID NO: 257234 - DNA, 75 bp, Artificial Sequence
  Synthetic
gttcaaccattaatgataacccgagctgtgatgatgtcaaggagtctcttggctttataagtcagcctaagccaa

SEQ ID NO: 257235 - DNA, 75 bp, Artificial Sequence
  Synthetic
tcagagttaagctcctaaaatctgatatcaagagattctggctactacatatgacacccagagagattaaactct

SEQ ID NO: 257236 - DNA, 75 bp, Artificial Sequence
  Synthetic
gaaggctaactggaattgatacatcaacggacactgggactcctattccgcccccgagggattatactaaaaggg

SEQ ID NO: 257237 - DNA, 75 bp, Artificial Sequence
  Synthetic
ggtggaaggccatcagttactctttcctggtttagccgctaccgcgtcctatcagtaagtttaaaaaatgattaa

SEQ ID NO: 257238 - DNA, 75 bp, Artificial Sequence
  Synthetic
gcatagacgggagtacagtctcacatggacagactgcgggtttcttgttgaatcctggtgcaatcccgtgtgtgc

SEQ ID NO: 257239 - DNA, 75 bp, Artificial Sequence
  Synthetic
tcagtaagtttaaaaaatgattaaagaaaacttaaacctcaccttaaataagtatctatatccactttgtgtggt

SEQ ID NO: 257240 - DNA, 75 bp, Artificial Sequence
  Synthetic
ccgtgtcacaccacttcctagacgtgagtcgtgtaagtgcgggaagtgcccagtgttctgcccggaatgtgttgg

SEQ ID NO: 257241 - DNA, 75 bp, Artificial Sequence
  Synthetic
tcccggtgtctcgcaagaggacatctacaatgactagtgcatctgagctagccattccagagcgagcaactagtg

SEQ ID NO: 257242 - DNA, 75 bp, Artificial Sequence
  Synthetic
atagagttagtagtgatgagccttactgcacatccttatcagcaaatagcagtttcattgatccggataatctaa

SEQ ID NO: 257243 - DNA, 75 bp, Artificial Sequence
  Synthetic
gcacggcagaatcagcactgacccttttaaacgagatcctagacaatcaaagaacaatcttggtcaagcttaaag

SEQ ID NO: 257244 - DNA, 75 bp, Artificial Sequence
  Synthetic
ccttagaagaggtcaaaacggaggttgaggtcatcaagaagaccctaagtaaacacggtttggctctatcaacat

SEQ ID NO: 257245 - DNA, 75 bp, Artificial Sequence
  Synthetic
tagagggtcaaataagttgtgtgatgatagcaataccatcatccggcagatccgacgccgctgtggatccaaaac

SEQ ID NO: 257246 - DNA, 75 bp, Artificial Sequence
  Synthetic
cggacctcaagccccttcttggcagagacaaaggtcggggaataaatgatgctgcaagacccaagggtgtcaatg

SEQ ID NO: 257247 - DNA, 75 bp, Artificial Sequence
  Synthetic
tttcctttgagtcaggcagtgcaggcagttggaaagcctccagcacctctactgttaccatggaaccgaagccgg

SEQ ID NO: 257248 - DNA, 75 bp, Artificial Sequence
  Synthetic
gagtcttcccagagccaattgatcctgataaaacaaatgctgcaggtttcaaacccaccgggacaaatgtgtcac

SEQ ID NO: 257249 - DNA, 75 bp, Artificial Sequence
  Synthetic
gcgaagttgtcctagcgctcatcgaaactcgtatcaaagatccgagagtggcagaaaggatgatatcaatcctgt

SEQ ID NO: 257250 - DNA, 75 bp, Artificial Sequence
  Synthetic
ctcatgctaagacccccaagcagctccaagaggtacatgatgccatcttggctcaactgaggaaggcaaaacagt

SEQ ID NO: 257251 - DNA, 75 bp, Artificial Sequence
  Synthetic
aggcagtatgatcggtaatccttaactaatgtgattctcattaggtgtttacattaccctttaccaaattataaa

SEQ ID NO: 257252 - DNA, 75 bp, Artificial Sequence
  Synthetic
aaacttaggactaacgggtccatcggcgacaagatgtccagcacacacgaattcctacccggaacctgggcaaac

SEQ ID NO: 257253 - DNA, 75 bp, Artificial Sequence
  Synthetic
aaagggtgtattgacgatctgagaccagactatgatagagaggggaagataataccgagagttcgagtcgtatac

SEQ ID NO: 257254 - DNA, 75 bp, Artificial Sequence
  Synthetic
cccggtacaggcacccggagacctggtgggtatatgtacctgtttcttcaaggggtaattgaggatgacatcctc

SEQ ID NO: 257255 - DNA, 75 bp, Artificial Sequence
  Synthetic
gatagccaacctcagaccagaccaccaggtaggaccttcggagcctatccgctgggagtgggccaatccactgca

SEQ ID NO: 257256 - DNA, 75 bp, Artificial Sequence
  Synthetic
ggtccatacgaactgctagcagcttgccaggaattaaagattattgtgcgccgcactgtgggtaagggtgaaaag

SEQ ID NO: 257257 - DNA, 75 bp, Artificial Sequence
  Synthetic
ctcgtttattataatacaactccattgaatgtccttgcaccgtggaaagctgtcttgaccaggggtgcaatattt

SEQ ID NO: 257258 - DNA, 75 bp, Artificial Sequence
  Synthetic
gatgcaacaaaggtgtgtaatagggtggaggatattccccttgagacaccccagaagttcagaccagtattccta

SEQ ID NO: 257259 - DNA, 75 bp, Artificial Sequence
  Synthetic
actatcaccatgctgactgactcggggctgtacaaagtacctagctctgtccaggatattcgtgccccaaatgca

SEQ ID NO: 257260 - DNA, 75 bp, Artificial Sequence
  Synthetic
gtggcattcaatttacttgttgaaataaatgctgggtgctccattgatcaaaaactctatccgaaggtcaaccca

SEQ ID NO: 257261 - DNA, 75 bp, Artificial Sequence
  Synthetic
gcggatgagttcaaggttgtgtccttcatggtacatgtcgggttattccaaaggaagaaatctaaaccctactca

SEQ ID NO: 257262 - DNA, 75 bp, Artificial Sequence
  Synthetic
catgactattgtaggatcaaggtagagaggatgaatttggtcttctccctgggctgtgtagggggactgagtttc

SEQ ID NO: 257263 - DNA, 75 bp, Artificial Sequence
  Synthetic
cacttgagggtacaagggaaaatgagcaaggctttgcatgcccagctgggttttcataggtctatctgctactct

SEQ ID NO: 257264 - DNA, 75 bp, Artificial Sequence
  Synthetic
ctcatgggtattaatcccagtctcaacaagctcttatggaagacccaatgctctatccgcaaggtgactgcagtt

SEQ ID NO: 257265 - DNA, 75 bp, Artificial Sequence
  Synthetic
ttccaaccttcagttcctccggaattcaaaatctatgatgatatcctgattgacaatactgggaaaatcctgaca

SEQ ID NO: 257266 - DNA, 75 bp, Artificial Sequence
  Synthetic
aattaacctgcataccaaaagctctcagctaagacaatgtgccaactattcatgaagcttgccaaattctcttac

SEQ ID NO: 257267 - DNA, 75 bp, Artificial Sequence
  Synthetic
taatttctcagcaagataatcaataaaaaacttaggactaacgtccagacattccgatgccagaaatggccgagc

SEQ ID NO: 257268 - DNA, 75 bp, Artificial Sequence
  Synthetic
aagaaaagactcccctgcgttacaaaatactgttgattataatcgttattaatcattataacatcactaatgtct

SEQ ID NO: 257269 - DNA, 75 bp, Artificial Sequence
  Synthetic
ttgggcagatacacctagcaaatttgtcatctattggagtatttgttactaagactctagattacaggacaacca

SEQ ID NO: 257270 - DNA, 75 bp, Artificial Sequence
  Synthetic
gtgatccaacagagcaacttctcgtgataaatatgctcccaaatatctcaaacatccaggattgtgctcagggtg

SEQ ID NO: 257271 - DNA, 75 bp, Artificial Sequence
  Synthetic
tggttaatgagtataagcacttgattagttcccttctaactcctatcaatgacacgcttgaccttataacttcta

SEQ ID NO: 257272 - DNA, 75 bp, Artificial Sequence
  Synthetic
acatcaatccgtactcaggtaggaacaaattgtttggcgagataattgcaggggctgcactgaccgttgctacgt

SEQ ID NO: 257273 - DNA, 75 bp, Artificial Sequence
  Synthetic
ctgcacagattacagcaggtgttgccctttacgaggcaagacagaatgcaaaagatatagctgctatcaaggaat

SEQ ID NO: 257274 - DNA, 75 bp, Artificial Sequence
  Synthetic
ctcttggttatgcctataaagccattgataaattgacaactgcaacaagagagattacagtagtgattaatgagt

SEQ ID NO: 257275 - DNA, 75 bp, Artificial Sequence
  Synthetic
tgcaggaccaaattaataataggctcattcctaggatcaatgacttagcatgtgaagtctgggctacccgcctcc

SEQ ID NO: 257276 - DNA, 75 bp, Artificial Sequence
  Synthetic
aagcaatgttactgcagtactatgcagagattttctcagtgattggaccaaatctccaagatccgctttcaggga

SEQ ID NO: 257277 - DNA, 75 bp, Artificial Sequence
  Synthetic
agatctctatccaagctcttgctagagcggccggagggaatataaagcttatggtcgacgaactaaattactctg

SEQ ID NO: 257278 - DNA, 75 bp, Artificial Sequence
  Synthetic
ggcaagacctcagtaggctagttaaggttggagcaattaaggggcaaattattgatgccgacccgagcctcggag

SEQ ID NO: 257279 - DNA, 75 bp, Artificial Sequence
  Synthetic
tagtgattatcaagatgagatatcctaatattatcaagattccgaatgttgcaatttcagagctgtcctatgtct

SEQ ID NO: 257280 - DNA, 75 bp, Artificial Sequence
  Synthetic
catattccagtgatgggcaagattggattactaccgggcccaactatatagtgaccagaggttattccattgcca

SEQ ID NO: 257281 - DNA, 75 bp, Artificial Sequence
  Synthetic
atatacaaacatcatcctgctctgtcggggatgactttgtactgtgtgaccgtgacatgacctatccaatgagtc

SEQ ID NO: 257282 - DNA, 75 bp, Artificial Sequence
  Synthetic
aagttacacaagattgtctgcgagggaatattgctctttgctctcgtatggttgtcagagatagggaggctccaa

SEQ ID NO: 257283 - DNA, 75 bp, Artificial Sequence
  Synthetic
gatacttaatattgcaagggaatatggttgccaattgtatgtctattacctgtagatgtgaggagccagagtccg

SEQ ID NO: 257284 - DNA, 75 bp, Artificial Sequence
  Synthetic
aaatctaccaatccccggatcagccactaacactgttaactcgagatacctgtgatactcatgtagttgatggga

SEQ ID NO: 257285 - DNA, 75 bp, Artificial Sequence
  Synthetic
ttcggatcagattaggtgttcgtaaactgccaaccatatcagttataaacaatattacccttggccctattataa

SEQ ID NO: 257286 - DNA, 75 bp, Artificial Sequence
  Synthetic
caacagatcctattgatgttagtaaccagctgaatgctgtcgttagtacgattgaccaatctgctgaactgctcc

SEQ ID NO: 257287 - DNA, 75 bp, Artificial Sequence
  Synthetic
accaagctcaacgagttctctcggagcgtgctcggggtgcgcgtgatcatattttggcaaccgctgcgatagtca

SEQ ID NO: 257288 - DNA, 75 bp, Artificial Sequence
  Synthetic
tatgtgtggtgcttgctgtcttaatcttagtgttgttaattgggcttgtctacctgtataggactcaaaacgaaa

SEQ ID NO: 257289 - DNA, 75 bp, Artificial Sequence
  Synthetic
tcctggttaagacgactatgttagaacaggtcccaacttttgctcctaagtcattccccatggagtctcagatat

SEQ ID NO: 257290 - DNA, 75 bp, Artificial Sequence
  Synthetic
actctgggaaaaccaacaagggctatgatcccgcagagtaattaataaccactttccatgtaatcttatggaaat

SEQ ID NO: 257291 - DNA, 75 bp, Artificial Sequence
  Synthetic
ataacactattacaggaacactataaaaaacttaggaccaaggtccagctgtcaccaagcaacagagaattaaaa

SEQ ID NO: 257292 - DNA, 75 bp, Artificial Sequence
  Synthetic
tggcaccaatcaactatccagcctcttattacactaataatgccgagaggccagtagttataactacaaaatcca

SEQ ID NO: 257293 - DNA, 75 bp, Artificial Sequence
  Synthetic
cagaatctaagggtcaacgccccctacctctggggaatgctaggttttgggagtactttggtcatgtatgtggca

SEQ ID NO: 257294 - DNA, 75 bp, Artificial Sequence
  Synthetic
cacttacattttgcatgtcactgattgggattattgtaggaattatagcacttgcaaattactcgtctgacaagg

SEQ ID NO: 257295 - DNA, 75 bp, Artificial Sequence
  Synthetic
attggaaaggaaggattgggggagatatccaagtaacaaggatggcaacagaaaagactgtcaagttaattctcg

SEQ ID NO: 257296 - DNA, 75 bp, Artificial Sequence
  Synthetic
aggatactaccccaaagctcaggaacatattagacagtgtgttattccagctcccaaagatgcttgcatctatag

SEQ ID NO: 257297 - DNA, 75 bp, Artificial Sequence
  Synthetic
catctaagatcaatactcagacacctcctccaccgacaacctcgggccactccacggccttggctacacagtgta

SEQ ID NO: 257298 - DNA, 75 bp, Artificial Sequence
  Synthetic
gttccaattgtgagaatagacctgagatagggtatgattacctccggcaagttgagcaatcacttcaaaggataa

SEQ ID NO: 257299 - DNA, 75 bp, Artificial Sequence
  Synthetic
ctaatatatctatccaactgctcgaggcaagtgagatccactctatggcaggggcttatccgaatgccctctata

SEQ ID NO: 257300 - DNA, 75 bp, Artificial Sequence
  Synthetic
agattcgaacacaggattcctggtctgttactgctaaagagtgcccacttcaagcattccaaccaaacttgaatc

SEQ ID NO: 257301 - DNA, 75 bp, Artificial Sequence
  Synthetic
tgataccggcaatgattgggactgctactggggcattgattaggaactgcgtcaggcaacctgtaattgtggtag

SEQ ID NO: 257302 - DNA, 75 bp, Artificial Sequence
  Synthetic
atgacggagtatatatgctaacatacctagctatgcgaggttcctgccaggaccatcaaaaatcagtccgtcact

SEQ ID NO: 257303 - DNA, 75 bp, Artificial Sequence
  Synthetic
ttgaaatgggtgtcataacatcagacccattcggggacccagtaccaaccccgttgaggcattggaccaaaagag

SEQ ID NO: 257304 - DNA, 75 bp, Artificial Sequence
  Synthetic
cactcccagcttatgatggttgtgctctggcagtcaagggccatgccggatttgcactatgcacagaaacatcag

SEQ ID NO: 257305 - DNA, 75 bp, Artificial Sequence
  Synthetic
taggacctcttagagataggactgctaagcggaagcccaatatagttcttttcaaggcatcactagtaggagagc

SEQ ID NO: 257306 - DNA, 75 bp, Artificial Sequence
  Synthetic
taagtgagagggttattcctcctcaatcttggctctcagggttctctttcttttcagtatatacagtagcaggaa

SEQ ID NO: 257307 - DNA, 75 bp, Artificial Sequence
  Synthetic
aagggtatgcttaccatagcaaattccacgcattcggtaatgttgtccgggtaggacagtcagaataccaagcta

SEQ ID NO: 257308 - DNA, 75 bp, Artificial Sequence
  Synthetic
agtgtagaggcactggatgcccaacagctaaccaagatgactgcaatacagctcagagggttagtcaggaggata

SEQ ID NO: 257309 - DNA, 75 bp, Artificial Sequence
  Synthetic
acacatatctccatcaagctattttgtctgtagatatagatagcgtaattgatcctgaggatgtggtttatgtta

SEQ ID NO: 257310 - DNA, 75 bp, Artificial Sequence
  Synthetic
ttgagcgtgatcaatactatcaggcatcagctggggatctgtatagggtgccagagactggtgagatcctgtaca

SEQ ID NO: 257311 - DNA, 75 bp, Artificial Sequence
  Synthetic
accttcacaatggaggatggagcaatgaggtccaggtgggtagaatacaaccatccgacagattttatatgcggg

SEQ ID NO: 257312 - DNA, 75 bp, Artificial Sequence
  Synthetic
aaattcagcttacgagcaccagggtcccagcaccaaatggatgtaaccgggttaaaggttgtcccggagggtgtg

SEQ ID NO: 257313 - DNA, 75 bp, Artificial Sequence
  Synthetic
tagctgtaatctctcctgcatttaccccgatgcaccccgagtttaatgttggggttggcatcttcccgatgaatc

SEQ ID NO: 257314 - DNA, 75 bp, Artificial Sequence
  Synthetic
aaccacacaacccctctataatgcatgttcaacagcaaacagagcttttctggaagcctattgtggggggcaata

SEQ ID NO: 257315 - DNA, 75 bp, Artificial Sequence
  Synthetic
ttacactgcatgagagttctattgcatgctattctactgtgcccccgaatcccagttatgatctctgtataggtg

SEQ ID NO: 257316 - DNA, 75 bp, Artificial Sequence
  Synthetic
ttatgacattacttttgcatcagggtcagctcccccagttccaagcactttcttggtatcagcctacaatgtgta

SEQ ID NO: 257317 - DNA, 75 bp, Artificial Sequence
  Synthetic
acggtaatgctcctcagaatagaagggcgcttatcccggtgattgttgaggattctaaagctatgagtgtgtcat

SEQ ID NO: 257318 - DNA, 75 bp, Artificial Sequence
  Synthetic
ctgatgcgccaagaacgccatgaccttgatttcgttcagatgacagaatctatcagagaaattgataactttgaa

SEQ ID NO: 257319 - DNA, 75 bp, Artificial Sequence
  Synthetic
atagataagctgtgaagtgtgtgagtgcctgactggattgccagattatttatatccattgcctgtgtgattgaa

SEQ ID NO: 257320 - DNA, 75 bp, Artificial Sequence
  Synthetic
tattgggcgctgcctgtatcgactttgatgtagtaacctcttcctctccagacagagaattataaaaaacttagg

SEQ ID NO: 257321 - DNA, 75 bp, Artificial Sequence
  Synthetic
atccagggagatccagcacgagctaagctatggaagagactgatacaatattgtacccagaatctcacctcaaca

SEQ ID NO: 257322 - DNA, 75 bp, Artificial Sequence
  Synthetic
gcccaatagttggccaaaggctagtcacttacttaacctactcacatctcccgcacaatcaggtccttaaagatg

SEQ ID NO: 257323 - DNA, 75 bp, Artificial Sequence
  Synthetic
agacagcccttaggaatattagattacgcagccaaattagtggccaaccttatcacctacgaatcttagggatat

SEQ ID NO: 257324 - DNA, 75 bp, Artificial Sequence
  Synthetic
caggccagatggtcctcccttataccagaccgccttacagctgccatcatatcccatacccagaatgtaataaaa

SEQ ID NO: 257325 - DNA, 75 bp, Artificial Sequence
  Synthetic
tcttgttcaattatgtagatgatagaattgctaaaagattggatgatgttctagctcatgcaaattctgctttct

SEQ ID NO: 257326 - DNA, 75 bp, Artificial Sequence
  Synthetic
ctatggtcagtcaacacattgcaatttcactagcatcaatcagagctgatctcggcctatctgctgaacctgcta

SEQ ID NO: 257327 - DNA, 75 bp, Artificial Sequence
  Synthetic
ttgatccagaagctctttgccatgatagtattattaagctacctgaagtgatgacgagatcacaatggtatcacc

SEQ ID NO: 257328 - DNA, 75 bp, Artificial Sequence
  Synthetic
cctttttgttctggttcaccctcaagactgaaatgcgtgcatgtataaagaagtatagtattcattctaaaactg

SEQ ID NO: 257329 - DNA, 75 bp, Artificial Sequence
  Synthetic
cccgagagatccctgtaataataagaacacataacaacataattgtgatcaatagattcttaacttacataatca

SEQ ID NO: 257330 - DNA, 75 bp, Artificial Sequence
  Synthetic
accttaaaaggagagaaacatattatctcactttcgagattgtcctgatgctatgtgatgtggttgaaggacgaa

SEQ ID NO: 257331 - DNA, 75 bp, Artificial Sequence
  Synthetic
tgatgtgtgatgttgccatgtgtagtgacccgaaatacgggccaattgttccaaatgtatataaattatggtcct

SEQ ID NO: 257332 - DNA, 75 bp, Artificial Sequence
  Synthetic
ttattgacgggttattccaggaccttgggaaccgcacatacaatgttgtctctctacttgaaccattaacattag

SEQ ID NO: 257333 - DNA, 75 bp, Artificial Sequence
  Synthetic
gatttctccaattaagagatgaatcacctatccttgccggggcattcttggatcattcactgaatgagctcatag

SEQ ID NO: 257334 - DNA, 75 bp, Artificial Sequence
  Synthetic
ctgaactcaatgacgctggatatacccatgaggaagatcaaaagagtgtcctgcggatagttcgatcaatattta

SEQ ID NO: 257335 - DNA, 75 bp, Artificial Sequence
  Synthetic
acatcgatagcatccacctgctagcagagatgttctcgttctttcgtagttttggccacccaatattagaggcgg

SEQ ID NO: 257336 - DNA, 75 bp, Artificial Sequence
  Synthetic
aaaatgccgcaaataaggtacgagaccatatgcacaagcccaagttaatctcgttcgaagtaatgatgaagggcc

SEQ ID NO: 257337 - DNA, 75 bp, Artificial Sequence
  Synthetic
acgccatcttctgcggtactatcattaacgggttcagagataggcatggaggcgtttggccccccgtgaccctcc

SEQ ID NO: 257338 - DNA, 75 bp, Artificial Sequence
  Synthetic
ctgatcattgtgcattaattgtcaaatctgcccaactcaataatgaagctctaacagatccaatctgcattacca

SEQ ID NO: 257339 - DNA, 75 bp, Artificial Sequence
  Synthetic
actggaaatcattttgtggcatcagattcgggtgcttcatgcctctgtctcttgatgaagacttgactatgtata

SEQ ID NO: 257340 - DNA, 75 bp, Artificial Sequence
  Synthetic
tgaaggacaaggctcttgctgcactcaagaaggaatgggattcagcataccctatcgaagtcatgccctatagac

SEQ ID NO: 257341 - DNA, 75 bp, Artificial Sequence
  Synthetic
ctcccaaagctactacctcaaggagattaatagatgtattcgttagtgatcctaaatttgacccctatgagatga

SEQ ID NO: 257342 - DNA, 75 bp, Artificial Sequence
  Synthetic
tccaatatgtgctgagtggtgattacttggaggataaagatttcaatctatcatatagcctcaaggagaaagaga

SEQ ID NO: 257343 - DNA, 75 bp, Artificial Sequence
  Synthetic
ctaagcaagtaggcagactttttgcaaaaatgacctacaagatgagggcatgccaggtcatagctgagaacctca

SEQ ID NO: 257344 - DNA, 75 bp, Artificial Sequence
  Synthetic
ttgccaatggagtcgggaagtactttaaggataatgggatggctaaagatgaacatgaactggcaaagactctac

SEQ ID NO: 257345 - DNA, 75 bp, Artificial Sequence
  Synthetic
accgcctatcaatatctgcagtcccaaggaataatgctctaagggaggaagtcaatagactattaatcgggtctc

SEQ ID NO: 257346 - DNA, 75 bp, Artificial Sequence
  Synthetic
ccactatttatgctggagagggaactggaattggtcatagaaagcctgacgagcaacctaggcatagaggtgatc

SEQ ID NO: 257347 - DNA, 75 bp, Artificial Sequence
  Synthetic
atgaaggcacctatgtcaatccgataagccttgaatccggaggtcaatatgaaacaattagtacattcttgacga

SEQ ID NO: 257348 - DNA, 75 bp, Artificial Sequence
  Synthetic
cagatctgcaaaaattctgtcttaattggagagcagagacaatcaatgtatttgctcagaggttggacgaaattt

SEQ ID NO: 257349 - DNA, 75 bp, Artificial Sequence
  Synthetic
acgggctccagggtttcttccagtggctccatagacggttggagcgctctgttctatatgtctgtgatccatact

SEQ ID NO: 257350 - DNA, 75 bp, Artificial Sequence
  Synthetic
gccctccagggaacctcctccatatagacctcgatgcatgccccgatgagcacatcttcatcaagtaccccatgg

SEQ ID NO: 257351 - DNA, 75 bp, Artificial Sequence
  Synthetic
gtgggattgaagggttctgtcaaaaactttggactatagcaacaatcccatacctatatctgtcggcctatgagg

SEQ ID NO: 257352 - DNA, 75 bp, Artificial Sequence
  Synthetic
taggagtcaggatcagttcagtggtgcaaggtgataatgaggcaattgccattaccaagagggttccaagccgct

SEQ ID NO: 257353 - DNA, 75 bp, Artificial Sequence
  Synthetic
acccttactggttaaagaaggaggagagttcacgcgcagccagattgtacttccatagactccgagaaaatctcg

SEQ ID NO: 257354 - DNA, 75 bp, Artificial Sequence
  Synthetic
ccatggtcggccacaacctcaaggccaatgagacagtgatttctagtcacttctttatttactctaagcagatat

SEQ ID NO: 257355 - DNA, 75 bp, Artificial Sequence
  Synthetic
actatgatggtgtagccttatcacaatccctcaaagctatctcaaggtgtgtgttctggtccgaaaccatcgtcg

SEQ ID NO: 257356 - DNA, 75 bp, Artificial Sequence
  Synthetic
acgagacacgatctgcatgcagcaatatagcaacttcacttgcaaaagccatagaaaagggatattcacggaatg

SEQ ID NO: 257357 - DNA, 75 bp, Artificial Sequence
  Synthetic
tggggtacggactttgtctacttaagactgttcaacaacttatgatatcattggatttcactatcaaccctttca

SEQ ID NO: 257358 - DNA, 75 bp, Artificial Sequence
  Synthetic
tgacccatgatatcaagaaccctattattggcaataaacagtggcttctccatgctgctcttacacctgcaccat

SEQ ID NO: 257359 - DNA, 75 bp, Artificial Sequence
  Synthetic
tgggggggttcaattatatgaacatgagtagactatacgtcaggaatatcggtgacccactaactgcatccctag

SEQ ID NO: 257360 - DNA, 75 bp, Artificial Sequence
  Synthetic
cagatgtcaagagactaatgaaatctagtgtcctctcaaaaagtattctgcaaaaagtcatgaaccaagagcctg

SEQ ID NO: 257361 - DNA, 75 bp, Artificial Sequence
  Synthetic
gtgattcttctttcctggactgggctaatgatccctattcagccaatattcctaacactcagagcataactaaga

SEQ ID NO: 257362 - DNA, 75 bp, Artificial Sequence
  Synthetic
tgctaaaaaatataaccgcacgaaatattttagtccacagcccgaaccccatgctaaggggtcttttccataacg

SEQ ID NO: 257363 - DNA, 75 bp, Artificial Sequence
  Synthetic
gtactactgatgaggaccaagaacttgctaggttcctgatggacagacgtgttattatcccaagagctgctcacg

SEQ ID NO: 257364 - DNA, 75 bp, Artificial Sequence
  Synthetic
aaatcatagataattctatgacaggggccagagagcacattgcaggtatgcttgattccaccaaaggttttgtgc

SEQ ID NO: 257365 - DNA, 75 bp, Artificial Sequence
  Synthetic
gaagtgggctcagagtgggagggctcaaatcaggaatgataacaaagattgctacctatgacattgagcaattta

SEQ ID NO: 257366 - DNA, 75 bp, Artificial Sequence
  Synthetic
gaagattcaaccagctcatggcagttaggaacaccaatcctttgatagataatgacgcctgttctgtttctttag

SEQ ID NO: 257367 - DNA, 75 bp, Artificial Sequence
  Synthetic
cccaggctatgagacaacacatgtggcaaaacctatctatgggcagattgatttacgggctagaggtgccagata

SEQ ID NO: 257368 - DNA, 75 bp, Artificial Sequence
  Synthetic
ttcttgaactgtgtactggaactttcatcaggggtcatgaggattgttgtcaatgtatctcagggaaccaatatt

SEQ ID NO: 257369 - DNA, 75 bp, Artificial Sequence
  Synthetic
atggatggttcttcacacctagtggatgtgatctggatgctgtaggtcgagctacaaatgctattagagtgcctt

SEQ ID NO: 257370 - DNA, 75 bp, Artificial Sequence
  Synthetic
acattgggtctacaacagaagaaagaagtgatcttaaagttggacatataagaaacccaagtaaggctcttaaag

SEQ ID NO: 257371 - DNA, 75 bp, Artificial Sequence
  Synthetic
cagccatcaggatagcaacaatttatacatgggcttatggagatacagatgagtcttggcatgaagcatggacca

SEQ ID NO: 257372 - DNA, 75 bp, Artificial Sequence
  Synthetic
ttgctaaccagagagctaacctatcaatagatgatctcaaattgattacccctatctcaacttcaactaaccttg

SEQ ID NO: 257373 - DNA, 75 bp, Artificial Sequence
  Synthetic
cccaccgtatgcgtgacaagagtacgcaggttaaatattccagttcatcgttgaaccgtgtagcacgatacacca

SEQ ID NO: 257374 - DNA, 75 bp, Artificial Sequence
  Synthetic
cgattagcaatgacaatctcagtttcatgatcgatggcgttaaggttgatacaaattatgtatatcagcagggta

SEQ ID NO: 257375 - DNA, 75 bp, Artificial Sequence
  Synthetic
tgttgcttgggttatctgtcatggaggatcacttcaggttcgatagcactactggtttgacaaatacggtcctcc

SEQ ID NO: 257376 - DNA, 75 bp, Artificial Sequence
  Synthetic
atctacatgtaatggatagttgttgcctagtaaagatggaagatcatccgaatgtcggaagtaggtaccgtgtac

SEQ ID NO: 257377 - DNA, 75 bp, Artificial Sequence
  Synthetic
cggtaacaattcctccgatgaataacaaacttgtatatgataacagcccaattattgagagagatcagttgagac

SEQ ID NO: 257378 - DNA, 75 bp, Artificial Sequence
  Synthetic
atcctccaggtattatctttctttaagggaacaatcatcaatggatacagaaagaagaactcaggtgtgtggccg

SEQ ID NO: 257379 - DNA, 75 bp, Artificial Sequence
  Synthetic
gcaaatccacgcttcaacaccccaaacaacagccctctctcaccccccccaatcccccgaatgatcgcacaactg

SEQ ID NO: 257380 - DNA, 75 bp, Artificial Sequence
  Synthetic
gtgctgactgtaccgcctaatacagttacactcatgggggccgaaggcagagttctcacagtagggacatctcat

SEQ ID NO: 257381 - DNA, 75 bp, Artificial Sequence
  Synthetic
tcgatcgaagagatcaggaaggtcaagcgccttgcactgaatggttgacagccgtcacagctcacggcgggctcc

SEQ ID NO: 257382 - DNA, 75 bp, Artificial Sequence
  Synthetic
actcttcatagtccttatacatttaatgctttcacccggccaggtagtgtcccttgtcaggcatcagcaagatgc

SEQ ID NO: 257383 - DNA, 75 bp, Artificial Sequence
  Synthetic
cacactccccaacccacaaccccgcatgaccacaccaacaaaagcaccctcccaccctctcccccaatcccagcc

SEQ ID NO: 257384 - DNA, 75 bp, Artificial Sequence
  Synthetic
ctaagctcctgagcaagctagatgcagccaagtcaattgaggagatcaggaagatcaaacgccttgcgctgaatg

SEQ ID NO: 257385 - DNA, 75 bp, Artificial Sequence
  Synthetic
cagctgaaaacatctgttgcagtcatggaagccaatttgggaatgatgaagattctggatcccggttgtgccaac

SEQ ID NO: 257386 - DNA, 75 bp, Artificial Sequence
  Synthetic
cggtgttctgtctccggattgctgtcagcgaggatgccaacaagccactcaggcaaggtgctctcatatctctcc

SEQ ID NO: 257387 - DNA, 75 bp, Artificial Sequence
  Synthetic
cggaatcccctgggagcccccccttgcaaatccatgcttcaacaccccaaacaacagccctctctcacccccccc

SEQ ID NO: 257388 - DNA, 75 bp, Artificial Sequence
  Synthetic
tgcagtatttgataacatatctcgcagtcgcataacccgggtaagttcaagcagtactaaggcagcatacacgac

SEQ ID NO: 257389 - DNA, 75 bp, Artificial Sequence
  Synthetic
aggcaaggtgctctcatatctctcctatgctctcattctcgggtgatgagaaaccacgttgcccttgcagggaga

SEQ ID NO: 257390 - DNA, 75 bp, Artificial Sequence
  Synthetic
gacatttgacaagatagaggaaaagataaggagactcaatttatctgttgggctcagtgatgtgctcggaccctc

SEQ ID NO: 257391 - DNA, 75 bp, Artificial Sequence
  Synthetic
accaataaagcttattgtcttagcattgccgaaatatccaataccctatttggggaatttaggatcgtcccttta

SEQ ID NO: 257392 - DNA, 75 bp, Artificial Sequence
  Synthetic
aagcgccttgcactaaatggctaattactactgccacacgtagcgggtccccgtccactcggcatcacacggaat

SEQ ID NO: 257393 - DNA, 75 bp, Artificial Sequence
  Synthetic
gaagacgaccttatatcacctatcttctgcaatgccaaggatcgagctgaatacaaatgcatgctcgaatcctat

SEQ ID NO: 257394 - DNA, 75 bp, Artificial Sequence
  Synthetic
atacaaatgcatgctcgaatcctatgctgctggtcagccataatcggataattctgacgtgatcggtctgaatct

SEQ ID NO: 257395 - DNA, 75 bp, Artificial Sequence
  Synthetic
gggcagagccaagacaatactcctgtacctgtggatcgtgtccagctacctgccgactttgcgcaggcgatgatg

SEQ ID NO: 257396 - DNA, 75 bp, Artificial Sequence
  Synthetic
gcctgattttagcatgctacctgatgtataaacaaaaggcacaacaaaagactttactatggcttgggaataata

SEQ ID NO: 257397 - DNA, 75 bp, Artificial Sequence
  Synthetic
aagaagccactgtcggcatgatcaatgataatcccaagcgcgagttactttccgccgcgatgctctgcctaggaa

SEQ ID NO: 257398 - DNA, 75 bp, Artificial Sequence
  Synthetic
atgaaaattctggaccctggttgtgctaacgtttcatccttaagtgatctccgggcagtagcccgatcccaccca

SEQ ID NO: 257399 - DNA, 75 bp, Artificial Sequence
  Synthetic
atggtagtcacatgcaagaagagtgcaactaatactgagagaatggttttctcagtagtgcaggcaccccaagtg

SEQ ID NO: 257400 - DNA, 75 bp, Artificial Sequence
  Synthetic
tggaaggcttaagaaaaaactactggatataagaaaccaaaaaacaatacacgggtagaacggtcgagaaagcca

SEQ ID NO: 257401 - DNA, 75 bp, Artificial Sequence
  Synthetic
cagtggcagttgggaagatgcagcagtttgtcaatgaccagtttaataatacggcacgagaattggactgtataa

SEQ ID NO: 257402 - DNA, 75 bp, Artificial Sequence
  Synthetic
tatgacattgctaggtgacagtgatcagatgagctttgcaccagctgaatacgcacaactttattcttttgccat

SEQ ID NO: 257403 - DNA, 75 bp, Artificial Sequence
  Synthetic
aactggctagtattgaggtccctgattcaaccaacaaatttcggaagattgagaagaagatccagattcacaaca

SEQ ID NO: 257404 - DNA, 75 bp, Artificial Sequence
  Synthetic
caaccggtgcagcacccctctgaattgattaagtctgccactgcaagcgggcctgacatgggagtggagaaggac

SEQ ID NO: 257405 - DNA, 75 bp, Artificial Sequence
  Synthetic
atgaggaaagagaggcaaagaacacatggcgcttggttttccggatcgcagttttacttttaataatggtgacct

SEQ ID NO: 257406 - DNA, 75 bp, Artificial Sequence
  Synthetic
tagttatctctgtagctgccctggtgtacagcatgggggctagtacgccgcgtgacctcgtcggcatatcgactg

SEQ ID NO: 257407 - DNA, 75 bp, Artificial Sequence
  Synthetic
cccggcagcgaggagaggcctggcagctgctgcccagcgagtatctgaggaaactggcagcatggatattcccac

SEQ ID NO: 257408 - DNA, 75 bp, Artificial Sequence
  Synthetic
agggcaaccagatgccggggatggggagacccaattcttggacttgatgagagcggtggcgaacagcatgagaga

SEQ ID NO: 257409 - DNA, 75 bp, Artificial Sequence
  Synthetic
cttgattatttacagttagtttacctgtctatcaaattagaaaaaacacgggtagaagattctggatcccggttg

SEQ ID NO: 257410 - DNA, 75 bp, Artificial Sequence
  Synthetic
atgaatgcaataacatctctctctcatcaaataaacggagctacgaataatagcaggtgtggggcacctgtccat

SEQ ID NO: 257411 - DNA, 75 bp, Artificial Sequence
  Synthetic
gagacccaattcttggacttgatgagagcggtggcgaacagcatgagagaagcacaaaatcccgcacagggcacc

SEQ ID NO: 257412 - DNA, 75 bp, Artificial Sequence
  Synthetic
acatctcagaagcctatcagagaaaattgatgatattctgcggttagtagatgctctggcaaaagatttgggcaa

SEQ ID NO: 257413 - DNA, 75 bp, Artificial Sequence
  Synthetic
cccagcctgcactcacggggccatcccaagctccctgctcgaaccccctcaacactccccgacccacatccccgc

SEQ ID NO: 257414 - DNA, 75 bp, Artificial Sequence
  Synthetic
ccccgtatgcaggagtgcaattcaactcacaatcagacattctttggcagttcgcattttcttagttagcgagct

SEQ ID NO: 257415 - DNA, 75 bp, Artificial Sequence
  Synthetic
tcttgcggctgcaggaattgtggtaacaggagacaaagcagtcaacatatacacctcatcccagacaggatcaat

SEQ ID NO: 257416 - DNA, 75 bp, Artificial Sequence
  Synthetic
ccaagctccctgctcgaaccccctcaacactccccgacccacatccccgcacgacagagccagcaagagcaaccc

SEQ ID NO: 257417 - DNA, 75 bp, Artificial Sequence
  Synthetic
cttgcagctgcggggattgtggtaacaggagataaagcaatcaatatatacacctcatctcagacagggtcaatc

SEQ ID NO: 257418 - DNA, 75 bp, Artificial Sequence
  Synthetic
gacgagctctcttgatggcaggccacttgcagctgcggggattgtggtaacaggagataaagcaatcaatatata

SEQ ID NO: 257419 - DNA, 75 bp, Artificial Sequence
  Synthetic
aatccatccagagcacaagatattagaaaaaaatacgggtagaagagagacactcagagatcagagtgagtcatc

SEQ ID NO: 257420 - DNA, 75 bp, Artificial Sequence
  Synthetic
gaaaaaaatacgggtagaagagagacactcagagatcagagtgagtcatcaaggtccctgtcacctcttctaccc

SEQ ID NO: 257421 - DNA, 75 bp, Artificial Sequence
  Synthetic
aacacgggtagaagagtctggatcccgaccagcacattcaggacgcaatatgggctccaaaccttctaccaggat

SEQ ID NO: 257422 - DNA, 75 bp, Artificial Sequence
  Synthetic
agaatcaagcagctgagatgttgtgcctgctgcgtttgtggggtcacccactgcttgagtcccgtattgcagcaa

SEQ ID NO: 257423 - DNA, 75 bp, Artificial Sequence
  Synthetic
tgggctccaaaccttctaccaggatcccagcacctctgatgctgatcactcggattatgctgatattgagctgta

SEQ ID NO: 257424 - DNA, 75 bp, Artificial Sequence
  Synthetic
tagacagcataattacggctcagggcaaatcagcagagacagtcggaagaagtgcaatcccacagggcaagacca

SEQ ID NO: 257425 - DNA, 75 bp, Artificial Sequence
  Synthetic
tcaacaggccggggtcctcactggactcagcgacggaggcccccaagccccacagggcggatcgaacaagtcgca

SEQ ID NO: 257426 - DNA, 75 bp, Artificial Sequence
  Synthetic
gcatgggagcgcccaaccacactccagccaggacagccctgaccaacaagccagacctgataaacagccacccac

SEQ ID NO: 257427 - DNA, 75 bp, Artificial Sequence
  Synthetic
aatcttgcgctcaatgtcactattgatgtggacgtggatccgaagagcccgttagtcaaatccctttctaagtcc

SEQ ID NO: 257428 - DNA, 75 bp, Artificial Sequence
  Synthetic
aaaacctaattcgcctagcgacactgcacaagaggggaaatatgtgatatacaagcgctataataacacatgccc

SEQ ID NO: 257429 - DNA, 75 bp, Artificial Sequence
  Synthetic
gagcggtggcgaatagcatgcgagaagcacaaaactccgcaccgagcaccacccatccagagcctcccccaactc

SEQ ID NO: 257430 - DNA, 75 bp, Artificial Sequence
  Synthetic
ggcactttacaatctagctggtgggaatatggattacttgttgactaagttaggtgtagggaacaatcaactcag

SEQ ID NO: 257431 - DNA, 75 bp, Artificial Sequence
  Synthetic
ctaagtatgttcttaaaagacaaggcaatcgcacatccgagagataactggctcgcctcatttaggcgaaacctt

SEQ ID NO: 257432 - DNA, 75 bp, Artificial Sequence
  Synthetic
ccagccgagccatgggagcaaccaagaaagaccgcagcaccaagccgggatcgtctctggaagccggggcacaga

SEQ ID NO: 257433 - DNA, 75 bp, Artificial Sequence
  Synthetic
tcattaataggcagtggcttgatcacaggcaaccctatactgtatgactcacagactcaactcttgggcatccag

SEQ ID NO: 257434 - DNA, 75 bp, Artificial Sequence
  Synthetic
ttatattgtacaagaatagtaacattccctatgtcccctggtatttattcctgcttgagcggcaatacatcggcc

SEQ ID NO: 257435 - DNA, 75 bp, Artificial Sequence
  Synthetic
gcatctgtagatcatgtccagctacctgtcgactttgtgcaggcgatgatgtctacgatggaggcattatcacaa

SEQ ID NO: 257436 - DNA, 75 bp, Artificial Sequence
  Synthetic
tccgagcagtagcccgatctcacccagttttaatttcaggtcccggagacccatctccttacgtgacacaagggg

SEQ ID NO: 257437 - DNA, 75 bp, Artificial Sequence
  Synthetic
ggggaattcaggatcgttcctttactagttgagatccttaaggatgatagggtttaggaggctagatccagtcgg

SEQ ID NO: 257438 - DNA, 75 bp, Artificial Sequence
  Synthetic
ctgtccgaccagcgcccttgatggcaggcctcttgcagctgcagggattgtggtaacaggagacaaagcagtcaa

SEQ ID NO: 257439 - DNA, 75 bp, Artificial Sequence
  Synthetic
aggcctcttgcagctgcagggattgtggtaacaggagacaaagcagtcaacatatacacctcatctcagacaggg

SEQ ID NO: 257440 - DNA, 75 bp, Artificial Sequence
  Synthetic
tatccatgcaaacccgaatcccatactgccgggcagatacaacccgacaatgcttacgcaactaatctgaatcct

SEQ ID NO: 257441 - DNA, 75 bp, Artificial Sequence
  Synthetic
aacaggacattgactactttgctcaccccccttggtgattctatccgtaggatacaagagtctgtgaccacgtcc

SEQ ID NO: 257442 - DNA, 75 bp, Artificial Sequence
  Synthetic
tgcttacgcaactaatctgaatcctgtccgcggtcgctttattaagaaaaaatatagatgatagtgagatacaag

SEQ ID NO: 257443 - DNA, 75 bp, Artificial Sequence
  Synthetic
agtcctcagtcatggaccgcgcagttagccaagttgcgttagagaatgatgaaagagaggcaaaaaatacatggc

SEQ ID NO: 257444 - DNA, 75 bp, Artificial Sequence
  Synthetic
gaaagagaggcaaaaaatacatggcgcttgatattccggattgcaatcttactcttaacagtagtgaccttagct

SEQ ID NO: 257445 - DNA, 75 bp, Artificial Sequence
  Synthetic
gttgattgtcatcacaatttacaacaggctcccgcttctttggcatcacatagtatcttcccggggtccccccaa

SEQ ID NO: 257446 - DNA, 75 bp, Artificial Sequence
  Synthetic
aagatcgtgaaaccatcaggtcagacacattcttcatatacagcaaacgaatattcaaagatggagcaatactca

SEQ ID NO: 257447 - DNA, 75 bp, Artificial Sequence
  Synthetic
ataacagcagcctcggctctgatacaagccaatcaaaatgctgccaacatactccggctaaaagagagcattgct

SEQ ID NO: 257448 - DNA, 75 bp, Artificial Sequence
  Synthetic
tccagggcagaagaaaagattacatctgcacttggttccaatcaagatgtagtagataggatatataagcaagtg

SEQ ID NO: 257449 - DNA, 75 bp, Artificial Sequence
  Synthetic
ctgcacttggttccaatcaagatgtagtagataggatatataagcaagtggcccttgagtctccgttggcattgt

SEQ ID NO: 257450 - DNA, 75 bp, Artificial Sequence
  Synthetic
ccaacattgcatccactatagcacggctgtgcgagaacgggcttcctaaggatttctgttattatttaaactacc

SEQ ID NO: 257451 - DNA, 75 bp, Artificial Sequence
  Synthetic
tttgttaatgaccagtttaataaaacagctcaggaattggactgtataaaaattacacagcaggttggtgtagaa

SEQ ID NO: 257452 - DNA, 75 bp, Artificial Sequence
  Synthetic
attctgacaacctgttcaatggaagatttaagaaaaaactactggatataagcaaccgaaaagcaatacacgggt

SEQ ID NO: 257453 - DNA, 75 bp, Artificial Sequence
  Synthetic
agtggcagttgggaagatgcagcaatttgttaatgaccagtttaataaaacagctcaggaattggactgtataaa

SEQ ID NO: 257454 - DNA, 75 bp, Artificial Sequence
  Synthetic
acctacggattcatcttccaaattgggaatgaggaagccaccgtcggcatgatcaatgacaatcccagacacgag

SEQ ID NO: 257455 - DNA, 75 bp, Artificial Sequence
  Synthetic
cagtggggttgctgagtcctagcattatgactaacatcttaactaggccacctggcaatggagattgggccagtc

SEQ ID NO: 257456 - DNA, 75 bp, Artificial Sequence
  Synthetic
gtctacaggatcccaactgcagtattggaagtatctggctcaagcctgtataatcttgcgctcaatgtcactatt

SEQ ID NO: 257457 - DNA, 75 bp, Artificial Sequence
  Synthetic
gttgctaagatactctggagtcaaactgcgcacctgcgaagtgtaaaggtcatcattcaagcgggcacccaacgt

SEQ ID NO: 257458 - DNA, 75 bp, Artificial Sequence
  Synthetic
atcaagattgcactgactaggaggcccctcggtatcaagaggctgatgcggataatcaattactcgagcatgcat

SEQ ID NO: 257459 - DNA, 75 bp, Artificial Sequence
  Synthetic
gagtttaagaagctagacttggccgattgagccaatcataggatggttgggaagacgacatcgtgccaatcatct

SEQ ID NO: 257460 - DNA, 75 bp, Artificial Sequence
  Synthetic
gaaacacaccatcgccaaatacaaccccttcaaaaaataggttgcatctcgaagactgtgatccacccgttttct

SEQ ID NO: 257461 - DNA, 75 bp, Artificial Sequence
  Synthetic
gcgcaaaagccccattggaggcatacaatagaacactgaccactttactcacccctcttggtgactccatccgca

SEQ ID NO: 257462 - DNA, 75 bp, Artificial Sequence
  Synthetic
atgctgacatgattattctaagtctcgctcactgtcactttattaagaaaaaacacaagaagcattggcatataa

SEQ ID NO: 257463 - DNA, 75 bp, Artificial Sequence
  Synthetic
aacacgggtagaagagtctggatcccggctaacacatctagagcgcagtatgggctccaaaccttctaccaggat

SEQ ID NO: 257464 - DNA, 75 bp, Artificial Sequence; identical to SEQ ID NO: 96333
  Synthetic

SEQ ID NO: 257465 - DNA, 75 bp, Artificial Sequence
  Synthetic
cggctaacacatctagagcgcagtatgggctccaaaccttctaccaggatcttagtacccttgatactgatcact

SEQ ID NO: 257466 - DNA, 75 bp, Artificial Sequence
  Synthetic
ccctgcatctctttacagggtatcaccttacattcacatatctaatgattctcaaaggctatttaccgaagaagg

SEQ ID NO: 257467 - DNA, 75 bp, Artificial Sequence
  Synthetic
gagatcctcaaaaatgatggggttagagaagccaggtctggttagttgagtcaactatgaaagagctggaaagat

SEQ ID NO: 257468 - DNA, 75 bp, Artificial Sequence
  Synthetic
gtgcgagctcgaattccatgtcgccagttgaccacaatcagccagtgctcatgcgatcagatcaagtcttgtcaa

SEQ ID NO: 257469 - DNA, 75 bp, Artificial Sequence
  Synthetic
caacagaacactgacctccttactcaacccccttggcgattctatccgcaggatacaagggtctgcgtccacttc

SEQ ID NO: 257470 - DNA, 75 bp, Artificial Sequence
  Synthetic
tgacctcaaataagttcatgtatgatcctagccctgtatcagagagagactttgcgagacttgacttagctatct

SEQ ID NO: 257471 - DNA, 75 bp, Artificial Sequence
  Synthetic
tcctagccctgtatcagagagagactttgcgagacttgacttagctatcttcaagagttacgagcttaatttaga

SEQ ID NO: 257472 - DNA, 75 bp, Artificial Sequence; identical to SEQ ID NO: 96232
  Synthetic

SEQ ID NO: 257473 - DNA, 75 bp, Artificial Sequence
  Synthetic
gacattggtgctcgagtgaaagacccgtttacccgacaacccgcatcattcatacaagagctagatctgagtgcc

SEQ ID NO: 257474 - DNA, 75 bp, Artificial Sequence
  Synthetic
ccagcaaggtacgacgcatttacactgagtaaggtttgcttcgagcacacattaccgaacccaaaggaagattac

SEQ ID NO: 257475 - DNA, 75 bp, Artificial Sequence
  Synthetic
gtgcagatcccccaggtatcatatcgcaaaattacggggaagctgtgtccctaatagataaacattcatgcaatg

SEQ ID NO: 257476 - DNA, 75 bp, Artificial Sequence
  Synthetic
tatacaagaatatgccaggaattctactctctaatattgcggctacgatatctcaccccatcattcattcaaggt

SEQ ID NO: 257477 - DNA, 75 bp, Artificial Sequence
  Synthetic
ccgtacggatccggcattctggtttcactcaaaatggtccacagccaagtttgcatggctccatataaaacagat

SEQ ID NO: 257478 - DNA, 75 bp, Artificial Sequence
  Synthetic
ctaatagataaacattcatgcaatgtcttatccttagacgggataaccctgaggctcagtggggaatttgatgcg

SEQ ID NO: 257479 - DNA, 75 bp, Artificial Sequence
  Synthetic
actcagctcattaattagtagcggcctgattgttggctaccctatattgtatgactcacagactcaactcctggg

SEQ ID NO: 257480 - DNA, 75 bp, Artificial Sequence
  Synthetic
aataagtacgatctattgtttccgtctgtcttggatgataacctgagtgaaaagatgcttcagctgatttcccgg

SEQ ID NO: 257481 - DNA, 75 bp, Artificial Sequence
  Synthetic
gtcaacctaactagcacatctgctctcattacttatattgttttagctgtcatatctcttgttttcggcgtaatt

SEQ ID NO: 257482 - DNA, 75 bp, Artificial Sequence
  Synthetic
ctggatttatattgtacaagaacagtgacattccccatgtctccgggtatctattcttgtttaagtggcaatacg

SEQ ID NO: 257483 - DNA, 75 bp, Artificial Sequence
  Synthetic
atcatgtctcccaacataattacgttcccagccaatctatattacatgtctaggaagagccttaatttgatcagg

SEQ ID NO: 257484 - DNA, 75 bp, Artificial Sequence
  Synthetic
ttagttaactttaagcaaaaatgcgcaaagtcgtctctaattatagttatgtcattcaccaaatctctgtttggt

SEQ ID NO: 257485 - DNA, 75 bp, Artificial Sequence
  Synthetic
accaaacagagaatctgtgaggtacgataaaaagcgaaggagcaatcgaagtcgcacgggtagaaggtgtgaatc

SEQ ID NO: 257486 - DNA, 75 bp, Artificial Sequence
  Synthetic
caacagcaagctagataaaatcaatgtcagactaaccagcacatctgctctcattacttacatcgttctaactgc

SEQ ID NO: 257487 - DNA, 75 bp, Artificial Sequence
  Synthetic
cttgtattgatgtatgcagatatgatggagggcagggacatggtcaacataatatcatctacagcgacacatctc

SEQ ID NO: 257488 - DNA, 75 bp, Artificial Sequence
  Synthetic
ttcggaccgaccccaacacagtttctaaattcagttgtttataggaatctacaggcggaagtgccatgcaaagat

SEQ ID NO: 257489 - DNA, 75 bp, Artificial Sequence
  Synthetic
gactttactgtggcttgggaacaataccctcgatcaaatgagaaccactataagggcatgagcagagaagcgaga

SEQ ID NO: 257490 - DNA, 75 bp, Artificial Sequence
  Synthetic
accctcgatcaaatgagaaccactataagggcatgagcagagaagcgagatggacgtatacccagcatcgattta

SEQ ID NO: 257491 - DNA, 75 bp, Artificial Sequence
  Synthetic
tgacctgacctcagataaagcagtgggatacatcacatctgcagtgccctacagatctgtatcattactacactg

SEQ ID NO: 257492 - DNA, 75 bp, Artificial Sequence
  Synthetic
tagttgagatcctcaaggatgatagagtttaagaagctagacttggccgattgagccaatcataggatggttggg

SEQ ID NO: 257493 - DNA, 75 bp, Artificial Sequence
  Synthetic
cacgggtagaacggtcagagaagccacccttcagtcgaagactaggcttcgcaacatctgttctaccgcatcacc

SEQ ID NO: 257494 - DNA, 75 bp, Artificial Sequence
  Synthetic
tatgatgtcgtagcattgatggagggatttgcatatggtgctgttcagctgcttgagccgtcaggtacattcgca

SEQ ID NO: 257495 - DNA, 75 bp, Artificial Sequence
  Synthetic
acccttcagtcgaagactaggcttcgcaacatctgttctaccgcatcaccaacagcaagtgtcaatcatgggccg

SEQ ID NO: 257496 - DNA, 75 bp, Artificial Sequence
  Synthetic
ccacaatgcttagagtcaagctgaatattaacataagccaggatcccatgttgttgggcagccacaatcagacaa

SEQ ID NO: 257497 - DNA, 75 bp, Artificial Sequence
  Synthetic
tcagtaactcacgcaatcgcctccatattctctggcttagaacagaatcaagcagctgagatgttgtgcttgttg

SEQ ID NO: 257498 - DNA, 75 bp, Artificial Sequence
  Synthetic
cagctggggggactgagtaaccttcaatactcaaggctctacacaaggaatattggtgacccagggaccactgct

SEQ ID NO: 257499 - DNA, 75 bp, Artificial Sequence
  Synthetic
gcactctgtaagggagggcggggttgtaatcatcaaagtactgtatgcaatgggatattacttccatctactcat

SEQ ID NO: 257500 - DNA, 75 bp, Artificial Sequence
  Synthetic
agtcttacttctaatggtaatgactttagctatctctgcagttgccctggtatacaccatgggggccagcacgcc

SEQ ID NO: 257501 - DNA, 75 bp, Artificial Sequence
  Synthetic
tcgtgatctcgcaaacataccgactatgatctccaagacagaagataaggtcacgtctttactcagttctagtca

SEQ ID NO: 257502 - DNA, 75 bp, Artificial Sequence
  Synthetic
gtcgcacgggtagaaggtgtgaatctcgagtgcgagcccgaagcacaaactcgagaaagccttctgccaacatgt

SEQ ID NO: 257503 - DNA, 75 bp, Artificial Sequence
  Synthetic
tctaaatcagacgaaattacattgactaggttatttacctcacagcagcatcgtgtaacagacatcctgtccagc

SEQ ID NO: 257504 - DNA, 75 bp, Artificial Sequence
  Synthetic
gtgttcgggacaatgcttgataatgaacaagcaaggctcaaccccgtatctgcagtatttgattacacatctcgc

SEQ ID NO: 257505 - DNA, 75 bp, Artificial Sequence
  Synthetic
atgtgaaggcagcactaagggcatcatccgtgttaatctgggcttatggggacaacgaagtaaactggactgctg

SEQ ID NO: 257506 - DNA, 75 bp, Artificial Sequence
  Synthetic
tgttcttaaaagacaaggcaatcgcacatccgaaagataactggctcgcctcatttaggcggaaccttctctctg

SEQ ID NO: 257507 - DNA, 75 bp, Artificial Sequence
  Synthetic
ggcaaagaactcatagtagatgacactagtgatgtcacattattctatccttccgcatatcaagaacatttgaat

SEQ ID NO: 257508 - DNA, 75 bp, Artificial Sequence
  Synthetic
ctattgtcacccttgcccacagctgggaatctccaacatagattggatgatggcataacccagatgacatttacc

SEQ ID NO: 257509 - DNA, 75 bp, Artificial Sequence
  Synthetic
tgctgacacagtgttcttatttactccttacaatctctctacagacggtaaaaagagaacatcacttaaacagtg

SEQ ID NO: 257510 - DNA, 75 bp, Artificial Sequence
  Synthetic
ggcaacctcaactaaccgcctcttgatagagttcttagaatcaaatgattttgatccatataaggagatggaata

SEQ ID NO: 257511 - DNA, 75 bp, Artificial Sequence
  Synthetic
atagagttcttagaatcaaatgattttgatccatataaggagatggaatacttgacaacccttgagtacctaaga

SEQ ID NO: 257512 - DNA, 75 bp, Artificial Sequence
  Synthetic
gccgggtcaaccacgggagggatgggaagatgacgttgtatcacctatcttctgcaatgccaaggatcaagcgga

SEQ ID NO: 257513 - DNA, 75 bp, Artificial Sequence
  Synthetic
accaaacagagaatctgtaaggtacgatacaaggcgatggagcaattgaaatcgcacgggtagaaggtgtgaatc

SEQ ID NO: 257514 - DNA, 75 bp, Artificial Sequence
  Synthetic
tctaattgaatcactcttcccaatgacaacaaccaagacgtatgatgagatcacattacacctccacagtaaatt

SEQ ID NO: 257515 - DNA, 75 bp, Artificial Sequence
  Synthetic
taaatatttgaaggcagtcctaggtattactaaactcaaagaaatgttcacagacacctctttattatacttgac

SEQ ID NO: 257516 - DNA, 75 bp, Artificial Sequence
  Synthetic
taggttgtgatatactgtgctccaaagtcacagagactgagaaagaggattataagtcagtcacccccacatcaa

SEQ ID NO: 257517 - DNA, 75 bp, Artificial Sequence
  Synthetic
cacaagatgtgacagcggagatgaacagtttacttggttccatcttccaagcaatatagaattgaccgatgacac

SEQ ID NO: 257518 - DNA, 75 bp, Artificial Sequence
  Synthetic
tagctgctgtatcagggaagcacctgttgctgttcccttcgagttactcgggttggcaccagaattaaggacggt

SEQ ID NO: 257519 - DNA, 75 bp, Artificial Sequence
  Synthetic
gcaatatagaattgaccgatgacaccagcaagaatcctccgatgagagtaccatatctcgggtcaaagacacagg

SEQ ID NO: 257520 - DNA, 75 bp, Artificial Sequence
  Synthetic
agcttgtcattgtgacacatacagatgagaacaagttcacatgcctcacccaggaacttgtattgatgtatgcgg

SEQ ID NO: 257521 - DNA, 75 bp, Artificial Sequence
  Synthetic
tcgtgctcaacaaaaattctatatgaaaaccataggcaatgcagccaagggatattatagtaacaatgactctta

SEQ ID NO: 257522 - DNA, 75 bp, Artificial Sequence
  Synthetic
aaagtcaaattccgatcctttgaaactcgtattcggattcaaataattatcttaaaacaggagtgcgcatagtta

SEQ ID NO: 257523 - DNA, 75 bp, Artificial Sequence
  Synthetic
ctcgtattcggattcaaataattatcttaaaacaggagtgcgcatagttatccttgactatagtcctgttattca

SEQ ID NO: 257524 - DNA, 75 bp, Artificial Sequence
  Synthetic
atctctctacagggtgtcaccttacattcacatatccaatgattctcaaaggctattcactgaagaaggagtcaa

SEQ ID NO: 257525 - DNA, 75 bp, Artificial Sequence
  Synthetic
ccgatgagcaagattaccaaattcggatggccaagtcctcatataaacctgggcggtttggtggaaagcgcgtgc

SEQ ID NO: 257526 - DNA, 75 bp, Artificial Sequence
  Synthetic
atcatgctcttgggtttatctctaatcgaatcgatctttccaatgacgacaaccaggacatatgatgagatcaca

SEQ ID NO: 257527 - DNA, 75 bp, Artificial Sequence
  Synthetic
gtcatgttgagggagtacaagagtctatctgcacttgaattcgagccatgtatagaatatgaccctgtcaccaac

SEQ ID NO: 257528 - DNA, 75 bp, Artificial Sequence
  Synthetic
tgttgatctgggcttatggggataatgaagtaaattggactgctgctcttacgattgcaaaatctcggtgtaatg

SEQ ID NO: 257529 - DNA, 75 bp, Artificial Sequence
  Synthetic
gcactttaaaagttgaggtcccagtattcactcttaacagtgatgatccagaagatagatggaattttgcggtat

SEQ ID NO: 257530 - DNA, 75 bp, Artificial Sequence
  Synthetic
ttacactcatgggggccgaaggcagagttctcacgataggagcatctcatttcttgtatcaacgaggatcgtcat

SEQ ID NO: 257531 - DNA, 75 bp, Artificial Sequence
  Synthetic
atttctcgcccgccttattatatcccatgacagtagataacaaaacagccactcttcatagtccttatacattta

SEQ ID NO: 257532 - DNA, 75 bp, Artificial Sequence
  Synthetic
gatggactcatctaggacaatcgggttatacttcgattctgccctaccatcaagcagccttctggcctttccaat

SEQ ID NO: 257533 - DNA, 75 bp, Artificial Sequence
  Synthetic
actgttcttaccaactctattatctgagagtaagaggcctagacaatattgtcttatatatgggtgatttataca

SEQ ID NO: 257534 - DNA, 75 bp, Artificial Sequence
  Synthetic
acactgtaatgtcctgtgccaacattgcatccactgtagcacggctatgtgagaacgggcttcctaaggatttct

SEQ ID NO: 257535 - DNA, 75 bp, Artificial Sequence
  Synthetic
cacagttgcatcaagccagtgataatttcttcaaagagttgattcatgtcaatcatctgattggccataacctaa

SEQ ID NO: 257536 - DNA, 75 bp, Artificial Sequence
  Synthetic
ttgcagaaatatccaataccctattcggggaatttaggatcgttcctttactagttgagatcctcaaggatgata

SEQ ID NO: 257537 - DNA, 75 bp, Artificial Sequence
  Synthetic
cggggaatttaggatcgttcctttactagttgagatcctcaaggatgataaggtttaggaggctagatctggcca

SEQ ID NO: 257538 - DNA, 75 bp, Artificial Sequence
  Synthetic
atgtcaccgcagaccaggatcccatgctgccgggtagccacaatctggcaatgctgacgtgattaatctgagtcc

SEQ ID NO: 257539 - DNA, 75 bp, Artificial Sequence
  Synthetic
ctgaggtcagatgtgcaagacatgggaactccttgtacttggcggaaggaagtggagccatcatgagtcttcttg

SEQ ID NO: 257540 - DNA, 75 bp, Artificial Sequence
  Synthetic
gaagaaaatactagagtcggccactcctgacacagagagaatgataaaactcgggcgagcagtacatcagaccct

SEQ ID NO: 257541 - DNA, 75 bp, Artificial Sequence
  Synthetic
tgatgggcctacctcatttctttgagtggattcatcttaggctgatggacactacaatgtttgtaggggatcctt

SEQ ID NO: 257542 - DNA, 75 bp, Artificial Sequence
  Synthetic
attacatctgcagtgccctacagatctgtatcattgctgcattgtgacattgaaatccctccagggtccaatcaa

SEQ ID NO: 257543 - DNA, 75 bp, Artificial Sequence
  Synthetic
acaagcggaagtgccatgtaaagatggatatgtccaggagttctacccattatggagagagaatgcagaagaaag

SEQ ID NO: 257544 - DNA, 75 bp, Artificial Sequence
  Synthetic
aattactcgagcatgcatgcaatgttattcagagatgatgttttcttgcctaatagatccaaccacccattagtt

SEQ ID NO: 257545 - DNA, 75 bp, Artificial Sequence
  Synthetic
ttcaaccaacaagttcaggaagattgagaagaagatccagattcacaacacaaggtatggggaactgttcacgag

SEQ ID NO: 257546 - DNA, 75 bp, Artificial Sequence
  Synthetic
caaggtatggggaactgttcacgaggctgtgcacacatgttgaaaagaaattgctaggatcatcctggtctaata

SEQ ID NO: 257547 - DNA, 75 bp, Artificial Sequence
  Synthetic
agtttacttggtttcatcttccaagcaatatagagctgactgatgacaccagcaagaatcccccgatgagagtgc

SEQ ID NO: 257548 - DNA, 75 bp, Artificial Sequence
  Synthetic
ttagtacgatacttgttcagaggaatagggactgcgtcatcttcttggtataaggcatctcatcttctttccgta

SEQ ID NO: 257549 - DNA, 75 bp, Artificial Sequence
  Synthetic
acagatccaaaggcatctaattgtagcagcaagaacaaggtccgcagtcaacaagctagtaacgttaacccatag

SEQ ID NO: 257550 - DNA, 75 bp, Artificial Sequence
  Synthetic
ccccacccgcccagagcaacacgggcacaattcaattcaccaacaatccgtgtagaacccgaaatattagaaaaa

SEQ ID NO: 257551 - DNA, 75 bp, Artificial Sequence
  Synthetic
gagagaaaatatcgatgctgcactgattgaggccggaggacagcccgtccgtccattctgtgcagagagtttagt

SEQ ID NO: 257552 - DNA, 75 bp, Artificial Sequence
  Synthetic
aacccagatgacatttactcctgcatctctctacagagtatcaccttacattcacatatccaatgattcccaaag

SEQ ID NO: 257553 - DNA, 75 bp, Artificial Sequence
  Synthetic
tctaaatcagacgaaattacgttgactaggttatttacctcacagcagcatcgtgtaatggacatactatccagt

SEQ ID NO: 257554 - DNA, 75 bp, Artificial Sequence
  Synthetic
atcaataagtatatgcagcaaggtagagtccagaagaagtacatcctccaccccgtatgcaggagtgcaattcaa

SEQ ID NO: 257555 - DNA, 75 bp, Artificial Sequence
  Synthetic
aaactcaaagaaatgtttacagacacctctgtattgtacttgactcgtgctcaacaaaaattctacatgaaaact

SEQ ID NO: 257556 - DNA, 75 bp, Artificial Sequence
  Synthetic
gggtgtacactgacccgtatccaataatatttcacaagaatcacacactgcgaggagtgtttggtacaatgttgg

SEQ ID NO: 257557 - DNA, 75 bp, Artificial Sequence
  Synthetic
aaaagagaacatcacttaaacagtgcacaagacagatcttagaggtcacaatactgggtctcagagtcaaagatc

SEQ ID NO: 257558 - DNA, 75 bp, Artificial Sequence
  Synthetic
acagtaactgtgactcttaacgaaaatcacatattaataggctccttttctggccaattgtatccttggtgattt

SEQ ID NO: 257559 - DNA, 75 bp, Artificial Sequence
  Synthetic
accaaacagagaacctgtgagttacggtagaaggcgaagaagcaatcgaaatcgtacgggtagaaggtgtgaacc

SEQ ID NO: 257560 - DNA, 75 bp, Artificial Sequence
  Synthetic
cttagtactcagaggtacagtttctctggaagacctcattccactgaggacatatttgaagcgtagtacctgccc

SEQ ID NO: 257561 - DNA, 75 bp, Artificial Sequence
  Synthetic
actattcggggagtttagaatagtaccgctactagttgagatcctaagagatgaagggcgatcagaggcaagatc

SEQ ID NO: 257562 - DNA, 75 bp, Artificial Sequence
  Synthetic
aataaatgtctttaaaaaaggttgcgcacaattattcttgagtgtagtctcgtcattcaccaaatctttgtttgg

SEQ ID NO: 257563 - DNA, 75 bp, Artificial Sequence
  Synthetic
ggatgaaaggggaaaatgcaccgtacatgacattgttaggtgacagtgaccagatgagctttgcaccagctgaat

SEQ ID NO: 257564 - DNA, 75 bp, Artificial Sequence
  Synthetic
cgacctgatcataccgtattagaaaaaagttgaattccgattctttggaactcgtattcggattctaataattat

SEQ ID NO: 257565 - DNA, 75 bp, Artificial Sequence
  Synthetic
gaagatacttctataaagaatgatgctataatagtgtatgataacacacgaaattggattagtgaagcccagaat

SEQ ID NO: 257566 - DNA, 75 bp, Artificial Sequence
  Synthetic
gggaaccttaataatatgcgtgccacctacttggagactttatctgtaagcacaaccaaagggtttgcctcagca

SEQ ID NO: 257567 - DNA, 75 bp, Artificial Sequence
  Synthetic
accaaacagaagatccgtgaggtacgacaaaaggcgaagtggcaatcgaaatcgtacgggtagaaggtgtgaacc

SEQ ID NO: 257568 - DNA, 75 bp, Artificial Sequence
  Synthetic
tcgtactcggattcaagtaattatcttaagacaaaagtgaatgtagttgtccttaattatagtcctgtcattcac

SEQ ID NO: 257569 - DNA, 75 bp, Artificial Sequence
  Synthetic
cacatgcacaacccgatctgccagcaacacactcaggacccaagggattagaaaaaaatacgggtagaagagagg

SEQ ID NO: 257570 - DNA, 75 bp, Artificial Sequence
  Synthetic
gagacccaattcttggacttgatgagagcagttgcgaatagcatgcgagaagcgccaaattctgcacagagcacc

SEQ ID NO: 257571 - DNA, 75 bp, Artificial Sequence
  Synthetic
tgtgccccagttcaacaacaggagtggagtgtctgaggagagagcacagagattcatggtaatagcagggtctct

SEQ ID NO: 257572 - DNA, 75 bp, Artificial Sequence
  Synthetic
ggagtgtctgaggagagagcacagagattcatggtaatagcagggtctcttcctcgggcatgcagtaacggtact

SEQ ID NO: 257573 - DNA, 75 bp, Artificial Sequence
  Synthetic
aattctggaccctggttgtgctaacgtttcgtccttaagtgatctacgggcagtcgctcgatcccacccagtttt

SEQ ID NO: 257574 - DNA, 75 bp, Artificial Sequence
  Synthetic
gagcagttgcgaatagcatgcgagaagcgccaaattctgcacagagcaccacccgcccggagccccctccatctc

SEQ ID NO: 257575 - DNA, 75 bp, Artificial Sequence
  Synthetic
ccgtttgtcacggctggggttgaagatgatgcaccagaagatatcactgacactttggagagaatcctatctatc

SEQ ID NO: 257576 - DNA, 75 bp, Artificial Sequence
  Synthetic
gaaagaccgcagcaccaggccaaggccgtccctggaagccggggcacagacgcgaacacagcatatcatggacaa

SEQ ID NO: 257577 - DNA, 75 bp, Artificial Sequence
  Synthetic
tgcagtcagcaagattgcgttagagaatgaagaaagagaagcaaagaacacatggcgcttagtattccggatcgc

SEQ ID NO: 257578 - DNA, 75 bp, Artificial Sequence
  Synthetic
ctttacagatgctgagatagatgatatacttgagaccagtggaactgtcatcgacagcataatcacagcccaagg

SEQ ID NO: 257579 - DNA, 75 bp, Artificial Sequence
  Synthetic
ccgcgacctcgtaggcatatcgactgtggtctctaaggtggaggacaagattacgtctttactcagttcaaatca

SEQ ID NO: 257580 - DNA, 75 bp, Artificial Sequence
  Synthetic
gagcttcgtccagtacaagacattggtgctcgagtgagagatcctttcactcaacaacctgcatcattcatacaa

SEQ ID NO: 257581 - DNA, 75 bp, Artificial Sequence
  Synthetic
atagacttaataatcattgcatcattagaaaaaacttaaatctgtcaaacttaggcctcgagtccgcaaccgaat

SEQ ID NO: 257582 - DNA, 75 bp, Artificial Sequence
  Synthetic
tagaaaaaacttaaatctgtcaaacttaggcctcgagtccgcaaccgaatcatagtgtcgaaaacaatacaaaac

SEQ ID NO: 257583 - DNA, 75 bp, Artificial Sequence
  Synthetic
gcatgggaacatccagccatccgctggccaggacacctccgaccaacaggatagaccggacaagcagccatccac

SEQ ID NO: 257584 - DNA, 75 bp, Artificial Sequence
  Synthetic
ggccaggacacctccgaccaacaggatagaccggacaagcagccatccactcccgagcaggcgaccccacacaac

SEQ ID NO: 257585 - DNA, 75 bp, Artificial Sequence
  Synthetic
ttaggcctcgagtccgcaaccgaatcatagtgtcgaaaacaatacaaaacataacagtttgtcatattattctga

SEQ ID NO: 257586 - DNA, 75 bp, Artificial Sequence
  Synthetic
gaggcttggagtagagtatgctcaggctcagggaagtagcatcaatgaagacatggctgctgaactaaaactgac

SEQ ID NO: 257587 - DNA, 75 bp, Artificial Sequence
  Synthetic
cacagttgcatcaagctagtgataatttcttcaaggaattgattcacgtcaatcatctgattggccataacctga

SEQ ID NO: 257588 - DNA, 75 bp, Artificial Sequence
  Synthetic
ggagcaagcaactctcttctgtctatgcttgacaagctgagcaataaatcgtctaatgctaaaaagggcccacag

SEQ ID NO: 257589 - DNA, 75 bp, Artificial Sequence
  Synthetic
gccatcatgagtattcttgaactgcatataccacatgagaccatctattacaatacacttttctcgaatgagatg

SEQ ID NO: 257590 - DNA, 75 bp, Artificial Sequence
  Synthetic
tcaacaggtgggggtcctcaccgggctcagcaacgaagtccctcgagctccacagggtgggttgaacaagctgca

SEQ ID NO: 257591 - DNA, 75 bp, Artificial Sequence
  Synthetic
ctcagcaacgaagtccctcgagctccacagggtgggttgaacaagctgcaagggcaaccagacgtcggggatgga

SEQ ID NO: 257592 - DNA, 75 bp, Artificial Sequence
  Synthetic
acatggctgccgagctaaagctaaccccggcagcaaggaggggcctggcagctgctgcccaacgagtatctgagg

SEQ ID NO: 257593 - DNA, 75 bp, Artificial Sequence
  Synthetic
ccaacattgcatccaccgtagcacgactgtgtgagaatgggcttcctaaggatttctgttattatctgaactacc

SEQ ID NO: 257594 - DNA, 75 bp, Artificial Sequence
  Synthetic
acccctctagagcctcccccaactcctgggccatcccaagataatgacactgactgggggtactgaacggcaaca

SEQ ID NO: 257595 - DNA, 75 bp, Artificial Sequence
  Synthetic
ctgggccatcccaagataatgacactgactgggggtactgaacggcaacacccagcctgcccccataaggtcacc

SEQ ID NO: 257596 - DNA, 75 bp, Artificial Sequence
  Synthetic
cctgccatttctcctaccttcagccgtgtaaccccatccgcccgaggcaacacaggcgtaactcggttcgccaac

SEQ ID NO: 257597 - DNA, 75 bp, Artificial Sequence
  Synthetic
cacaggcgtaactcggttcgccaacaatccactcagagcccgaggtattagaaaaaaatacgggtagaagggaga

SEQ ID NO: 257598 - DNA, 75 bp, Artificial Sequence
  Synthetic
agggcaaccagaagccggggatggggagacccaattcctggatctgatgagagcggtagcaaacagcatgaggga

SEQ ID NO: 257599 - DNA, 75 bp, Artificial Sequence
  Synthetic
tgactggggttactgatcgacaacacccagccctcccccacagggacatcccaagccctccgcccaaaagtcgac

SEQ ID NO: 257600 - DNA, 75 bp, Artificial Sequence
  Synthetic
ttcactccgtgttccacaaaaggatatattctctctaatggctatgcctgtagaggggatatggagtgttacctg

SEQ ID NO: 257601 - DNA, 75 bp, Artificial Sequence
  Synthetic
agttctcacagtagggacatctcacttcttgtaccaacgagggtcttcatatttctcccctgccttattatatcc

SEQ ID NO: 257602 - DNA, 75 bp, Artificial Sequence
  Synthetic
gtggtctcaggtttatatgcagggaataagtacgatctgctgtttccatctgtcttagatgataacctgagtgag

SEQ ID NO: 257603 - DNA, 75 bp, Artificial Sequence
  Synthetic
attgtcctcaagaaacatacacaaaaagtcttatttgagacttgttcaaatcccttattatccggggtacataca

SEQ ID NO: 257604 - DNA, 75 bp, Artificial Sequence
  Synthetic
tcaaatccctttctaagtctgatagtggatactatgctaatctttttttgcatatcgggcttatgtccactgtag

SEQ ID NO: 257605 - DNA, 75 bp, Artificial Sequence
  Synthetic
cactggctgaattcttactcaatcaagaagtggttcacccgcgtgtcgcacatgctatcatggaggcaagctctg

SEQ ID NO: 257606 - DNA, 75 bp, Artificial Sequence
  Synthetic
aagatcaaacgccttgcgctgaatggttgatcgccatcacaacccacaacaagttcctgccccattggtatcaca

SEQ ID NO: 257607 - DNA, 75 bp, Artificial Sequence
  Synthetic
agactcaatctttctgtcgggctcagtgatgtgctcggaccttctgtgcttgtgaaggcgagaggtgcacggact

SEQ ID NO: 257608 - DNA, 75 bp, Artificial Sequence
  Synthetic
tcatgtctcccaacataatcacgttcccagccaatctatactacatgtctaggaagagccttaatttgatcagag

SEQ ID NO: 257609 - DNA, 75 bp, Artificial Sequence
  Synthetic
gcacgggagtgtccaatcaaatgccggccaggacgcccccgaccaacaagccagaccagacaaacagccgtccgc

SEQ ID NO: 257610 - DNA, 75 bp, Artificial Sequence
  Synthetic
actcccccgaatgatcgcacaactgcaattaatctaacagcattagagattaagaaaaaatacgggtagaatcaa

SEQ ID NO: 257611 - DNA, 75 bp, Artificial Sequence
  Synthetic
atatcaatgcaagcctgaatcccgtatcattaggcgggtacaacctgacaatgccgatgtgaccagtctgaattt

SEQ ID NO: 257612 - DNA, 75 bp, Artificial Sequence
  Synthetic
ggccggcgacatacagctcaagaccggagcaagcaactctcttctgtccatgcttgacaagctgagcaataaatc

SEQ ID NO: 257613 - DNA, 75 bp, Artificial Sequence
  Synthetic
gttagtctcctcggatatgtgttcgctgactttagcggactatgcacggaacaggagctggtcacccttgacagg

SEQ ID NO: 257614 - DNA, 75 bp, Artificial Sequence
  Synthetic
ctgactttagcggactatgcacggaacaggagctggtcacccttgacagggggtaggagaatactgggcgtatct

SEQ ID NO: 257615 - DNA, 75 bp, Artificial Sequence
  Synthetic
acgggtaggaaatggcgggctccggtcccgaaagggcagagcatcagatcatcctaccagagtcacatctatcct

SEQ ID NO: 257616 - DNA, 75 bp, Artificial Sequence
  Synthetic
ccccaagaggggaaccaccaacgtccgactcaacagcaggggagtcaacccagccgcggaaacagtcaggaaaga

SEQ ID NO: 257617 - DNA, 75 bp, Artificial Sequence
  Synthetic
ccagccgagccatggaagcaaccaggaaagaccgcagcaccaggccaaggctatccctggaaaccggggcacaga

SEQ ID NO: 257618 - DNA, 75 bp, Artificial Sequence
  Synthetic
gaaatgaagaggtcactgtcggcatgatcaacgacaatcccaggcacgagttactctcttctgcaatgctctgcc

SEQ ID NO: 257619 - DNA, 75 bp, Artificial Sequence
  Synthetic
gcggatcatgtccagccacctgtagactttgtgcaagcgatgatgtctatgatggaggcgatatcacagagggta

SEQ ID NO: 257620 - DNA, 75 bp, Artificial Sequence
  Synthetic
ctcactatggtggtaacctgcaagaagagtgcaactaatactgagagaatagtcttctcagtagtgcaggcacct

SEQ ID NO: 257621 - DNA, 75 bp, Artificial Sequence
  Synthetic
agacaacgaagtaaactggactgctgctcttaagattgcaaggtctcgatgcaacataagctcagagtaccttcg

SEQ ID NO: 257622 - DNA, 75 bp, Artificial Sequence
  Synthetic
ttctatccctatgatgcggtctgaaatccaacagcttaaaacatctgttgcgatcatggaagccaacttaggcat

SEQ ID NO: 257623 - DNA, 75 bp, Artificial Sequence
  Synthetic
acacctcatctcagacagggtcaatcatagtcaagttgctcccgaatatgcccaaggacaaagaggcatgtgcaa

SEQ ID NO: 257624 - DNA, 75 bp, Artificial Sequence
  Synthetic
gacctgacctcagataaggcagttggatatatcacatctgtggtaccctacaggtctgtatcattactacattgt

SEQ ID NO: 257625 - DNA, 75 bp, Artificial Sequence
  Synthetic
gtttacaggatcccaactgcagcattgaaaatatctggctcaagcctgtacaatctcgcgctcaatgtcactatt

SEQ ID NO: 257626 - DNA, 75 bp, Artificial Sequence
  Synthetic
ccttacattcacatatctaacgactctcaacggctatttacagaagaaggaattaaagaggggaacgtggtttat

SEQ ID NO: 257627 - DNA, 75 bp, Artificial Sequence
  Synthetic
agttttaatttcgggccctggagacccatctccttatgtgacacaagggggtgaaatgacactcaataaactctc

SEQ ID NO: 257628 - DNA, 75 bp, Artificial Sequence
  Synthetic
acaaacccacaacccaacaacccaagcaacgaccttctcttgcccctctcactccctcgaatgatcacacaacta

SEQ ID NO: 257629 - DNA, 75 bp, Artificial Sequence
  Synthetic
tttttgcatatcgggcttatgtctactgtagataagaagggaaagaaagtgacatttgacaagatagaggaaaag

SEQ ID NO: 257630 - DNA, 75 bp, Artificial Sequence
  Synthetic
agttttaatttcgggccccggagacccatccccttacgtgacacaagggggcgaaatggcgctcaataaactctc

SEQ ID NO: 257631 - DNA, 75 bp, Artificial Sequence
  Synthetic
gccccgcaatataggatccagcgccttgactcgtggactgatagtaaagaagactcagtattcatcaccacctat

SEQ ID NO: 257632 - DNA, 75 bp, Artificial Sequence
  Synthetic
ctgcgcacctgcggagtgtaaaagtcattattcaagcaggcacccaacgtgctgttgcagtgactgctgatcatg

SEQ ID NO: 257633 - DNA, 75 bp, Artificial Sequence
  Synthetic
cgagaattggactgtataaaaattgcacaacaagtcggtgtagaactcaacctatacctaactgaactgactaca

SEQ ID NO: 257634 - DNA, 75 bp, Artificial Sequence
  Synthetic
aggctcccacccttctaacatcacacagaatacctcctgggcccccctcaacgaactcatgctccaacaatccaa

SEQ ID NO: 257635 - DNA, 75 bp, Artificial Sequence
  Synthetic
attgaagccgggggacagcccgtccgtccattctgtgcagaaagtttggtgagcacactaacaaatatgacccag

SEQ ID NO: 257636 - DNA, 75 bp, Artificial Sequence
  Synthetic
tgagactgtgatccacccgctttcctgaattatcgcgacactagataatgatctatcttgattgcccatagctag

SEQ ID NO: 257637 - DNA, 75 bp, Artificial Sequence
  Synthetic
aagatcaaacgccttgcgctgaatggttgatcgccaccacaacccacgacaggttcatgcctctccagcgtcaca

SEQ ID NO: 257638 - DNA, 75 bp, Artificial Sequence
  Synthetic
aacacgggtagaagagtctggatcccggccggcacattcaaggtgcgatatgggctctaaaccttctaccagggt

SEQ ID NO: 257639 - DNA, 75 bp, Artificial Sequence
  Synthetic
taagaaaaaatacgggtagaatcgaagtgccccgactgcaccaaaatggactcatccaggacagtcgggctgtac

SEQ ID NO: 257640 - DNA, 75 bp, Artificial Sequence
  Synthetic
caaggaagactcggtattcatcaccacctacggatttatcttccaaactgggaatgaggaagccaccgtcggcat

SEQ ID NO: 257641 - DNA, 75 bp, Artificial Sequence
  Synthetic
acctacggatttatcttccaaactgggaatgaggaagccaccgtcggcatgatcaatgacagtcccaggcatgaa

SEQ ID NO: 257642 - DNA, 75 bp, Artificial Sequence
  Synthetic
tgacggatcacaccagcttgcagatatagatttcatcgaaatgtctgcgaaactattagtctcttgcacccgacg

SEQ ID NO: 257643 - DNA, 75 bp, Artificial Sequence
  Synthetic
cagatcaccccacaatataggattcagcgtcttgactcatggacagacagtaaggaagactcggtattcatcacc

SEQ ID NO: 257644 - DNA, 75 bp, Artificial Sequence
  Synthetic
ctcactatggtgataacctgcaagaagagtgcaactaacactgagagaatagtcttctcagttgtgcaggcacct

SEQ ID NO: 257645 - DNA, 75 bp, Artificial Sequence
  Synthetic
tccccacttggtgattccatccgcaggatacaagggtctgtgtctacatcaggaggaaggagacagaaacgcttt

SEQ ID NO: 257646 - DNA, 75 bp, Artificial Sequence
  Synthetic
tgcagtgaagcatgtgagagcaccagaaaagatccccgggagcgggaccctagagtataaggtgaattttgtctc

SEQ ID NO: 257647 - DNA, 75 bp, Artificial Sequence
  Synthetic
gataacagcagctgcagccttaatacaagccaaccaaaatgccgccaacatcctccggcttaaggagagcattgc

SEQ ID NO: 257648 - DNA, 75 bp, Artificial Sequence
  Synthetic
gacattggtgctcgagtgaaagacccatttacccgacagcctgcatcattcatacaagagctaggcttgtgtgct

SEQ ID NO: 257649 - DNA, 75 bp, Artificial Sequence
  Synthetic
cgaactaagttactggctccttttttctccagcagtgggacagcctgctatcccatagcaaatgcctctccacag

SEQ ID NO: 257650 - DNA, 75 bp, Artificial Sequence
  Synthetic
gctgtcgcagtgaccgctgatcatgaagtcacctctactaagatagagaagagacataccattgctaagtacaat

SEQ ID NO: 257651 - DNA, 75 bp, Artificial Sequence
  Synthetic
ttcacctgtctatctaattagaaaaaacacgggtagaagagtctggaacctaactagcacattctgaacgcaata

SEQ ID NO: 257652 - DNA, 75 bp, Artificial Sequence
  Synthetic
tcagcttgcatgtattcaaagactgaaggcgcactcaccacgccatatatggccctcaaaggctcagttattgcc

SEQ ID NO: 257653 - DNA, 75 bp, Artificial Sequence
  Synthetic
ggatatatcacatctgtggtgccctacaggtctgtatcattactacattgtgacattgagattcctccagggtcc

SEQ ID NO: 257654 - DNA, 75 bp, Artificial Sequence
  Synthetic
tctgtctgacaaactcccttgatggcaggccccttgcagctgcggggattgtaataacaggagataaggcagtca

SEQ ID NO: 257655 - DNA, 75 bp, Artificial Sequence
  Synthetic
tccatctgtctatctagttagaaaaaacacgggtagaagagtctggatcccgaatagcgcatccaaaacacaaca

SEQ ID NO: 257656 - DNA, 75 bp, Artificial Sequence
  Synthetic
ctaccaatatatctctggttgccatgcattctgtaagggaaggcggggtagtgatcatcaaagtattgtatgcaa

SEQ ID NO: 257657 - DNA, 75 bp, Artificial Sequence
  Synthetic
atgctttcacccggccaggtattgtcccttgtcaggcatcagcaagatgccccaactcatgtatcactggagtct

SEQ ID NO: 257658 - DNA, 75 bp, Artificial Sequence
  Synthetic
tggggtactacttccatctactcatgaatttatttactccatgctccacaaaaggatatatactctccaatggtt

SEQ ID NO: 257659 - DNA, 75 bp, Artificial Sequence
  Synthetic
caacagaacactgaccaccttactcactccccttggcgattccatccacaggatacaagggtctgtgtccacatc

SEQ ID NO: 257660 - DNA, 75 bp, Artificial Sequence
  Synthetic
aatacaacgacacggtacacttctgtctaaatcagatgaaattacattgactaagctatttactttacagcagca

SEQ ID NO: 257661 - DNA, 75 bp, Artificial Sequence
  Synthetic
cgtccattttgcgcggaaagtttagtaagcacaataacagatatgacccagactaaccggatcattgccagtcat

SEQ ID NO: 257662 - DNA, 75 bp, Artificial Sequence
  Synthetic
tgtgccaattctgacaacctattcaatagaagacttaagaaaaaactactggatataagcaacccaaaggcaatg

SEQ ID NO: 257663 - DNA, 75 bp, Artificial Sequence
  Synthetic
cttcccctgccttaacacagctgactatccaggcactgtacaatttagctggtagcaatatggactatttgttaa

SEQ ID NO: 257664 - DNA, 75 bp, Artificial Sequence
  Synthetic
atattgggtctcagagtcaaagatatcaacaaagtaggtgatgtaatcagcttaatactcagaggtatggtttct

SEQ ID NO: 257665 - DNA, 75 bp, Artificial Sequence
  Synthetic
actcaacctatacctaactgaactgactacagtattcgggccacagatcacttccccggccttgactcaactaac

SEQ ID NO: 257666 - DNA, 75 bp, Artificial Sequence
  Synthetic
agcgtcttgactcgtggacggacagcaaagaagattcggtatttatcaccacctacggattcatcttccaagtcg

SEQ ID NO: 257667 - DNA, 75 bp, Artificial Sequence
  Synthetic
atgacccacagacccagctcttgggtatacaagtaaatttaccctcagtcgggaacttaaataatatgcgtgcca

SEQ ID NO: 257668 - DNA, 75 bp, Artificial Sequence
  Synthetic
tatagaatatgaccctgtcaccaatctaagtatgttcttaaaggacaaggcaatcgcacatccaaaagataactg

SEQ ID NO: 257669 - DNA, 75 bp, Artificial Sequence
  Synthetic
gacaagaatatcaaatccggatggctaagtcttcgtacaagcctgggcgattcggtggaaagcgtgtacagcaag

SEQ ID NO: 257670 - DNA, 75 bp, Artificial Sequence
  Synthetic
aagcaacttcgactaaccgcctcttgatagagtttttagagtcaaatgattttgatccatataaagagatggaat

SEQ ID NO: 257671 - DNA, 75 bp, Artificial Sequence
  Synthetic
tatacagcatgggggccagtgtgccgcgcgatctcgcaggcatatcaactgtgatctctaagatggaagacaaga

SEQ ID NO: 257672 - DNA, 75 bp, Artificial Sequence
  Synthetic
cttgtcccgaaggtagtgacgcaagtcggttccgtgatagaggaactcgacacctcatactgcatagagtctgat

SEQ ID NO: 257673 - DNA, 75 bp, Artificial Sequence
  Synthetic
atgactcacagactcaactcttgggcatacaagtaaatttaccctcagtcgggaacctaaataatatgcgtgcca

SEQ ID NO: 257674 - DNA, 75 bp, Artificial Sequence
  Synthetic
ctggacttatattgtacaagaatagtgacattccctatgtctccaggcatttattcctgtctaagcggcaatacg

SEQ ID NO: 257675 - DNA, 75 bp, Artificial Sequence
  Synthetic
tgacattccctatgtctccaggcatttattcctgtctaagcggcaatacgtcagcatgtatgtattcaaaaactg

SEQ ID NO: 257676 - DNA, 75 bp, Artificial Sequence
  Synthetic
tcgtgctcaacaaaaattctacatgaaaaccataggtaatgcggcaaagggatattacagtaacaatgactcttg

SEQ ID NO: 257677 - DNA, 75 bp, Artificial Sequence
  Synthetic
aaagttgaattccgactctttgaaactcgtattcggattcagccaattaactttgagcagagatgcgcgtagttg

SEQ ID NO: 257678 - DNA, 75 bp, Artificial Sequence
  Synthetic
ctcgtattcggattcagccaattaactttgagcagagatgcgcgtagttgcccgtaattgtgatcctgtcgttcg

SEQ ID NO: 257679 - DNA, 75 bp, Artificial Sequence
  Synthetic
ttggatctatattgtacaagaatagtgacattccctatgtctccaggtatttattcctgtttaagcggcaatacg

SEQ ID NO: 257680 - DNA, 75 bp, Artificial Sequence
  Synthetic
atcgtacgggtagaaggtgtgaaccccgagcgcgaggccgaagctcgaacctgagggaaccttctaccgatatgt

SEQ ID NO: 257681 - DNA, 75 bp, Artificial Sequence
  Synthetic
ctgagggaaccttctaccgatatgtcgtctgttttcgacgaatacgagcagctcctcgctgctcagacccgccct

SEQ ID NO: 257682 - DNA, 75 bp, Artificial Sequence
  Synthetic
ggaaatgtcaacaattcaataagcaatgccttggataagttggcagaaagtaacagcaagctagacaaagtcaat

SEQ ID NO: 257683 - DNA, 75 bp, Artificial Sequence
  Synthetic
gatccagaggatagatggaattttgcggtattctgtcttcggattgctgttagcgaggatgccaacaaaccactc

SEQ ID NO: 257684 - DNA, 75 bp, Artificial Sequence
  Synthetic
taacagcaagctagacaaagtcaatgtcagactgaccagcacatctgctctcattacctatattgttctaactgt

SEQ ID NO: 257685 - DNA, 75 bp, Artificial Sequence
  Synthetic
tatgctcccattctcaggtgatgagaaaccatgttgcccttgcagggaaacagaatgaggccacactggctgttc

SEQ ID NO: 257686 - DNA, 75 bp, Artificial Sequence
  Synthetic
tgtataagcaaaaagcacaacaaaagaccttactatggctcgggaacaatacccttgatcagatgagggccaata

SEQ ID NO: 257687 - DNA, 75 bp, Artificial Sequence
  Synthetic
acccttgatcagatgagggccaatacaagagcatgaccgcaaatgagaattggatgcacatacagcagcagcctg

SEQ ID NO: 257688 - DNA, 75 bp, Artificial Sequence
  Synthetic
tacgggtagaacgatcagagaagccacctttcaattgaagacagggcttcacaacatccgttctaccacatcacc

SEQ ID NO: 257689 - DNA, 75 bp, Artificial Sequence
  Synthetic
acctttcaattgaagacagggcttcacaacatccgttctaccacatcaccgattacaagagtctgtcatggaccg

SEQ ID NO: 257690 - DNA, 75 bp, Artificial Sequence
  Synthetic
caaaggccatgactgcatatgagacagcagatgagtcagaaacaagaagaataaataagtatatgcagcaaggtc

SEQ ID NO: 257691 - DNA, 75 bp, Artificial Sequence
  Synthetic
ttgcactcatgggggccgagggcagggttctcacagtagggacatctcatttcttataccaacgagggtcttcat

SEQ ID NO: 257692 - DNA, 75 bp, Artificial Sequence
  Synthetic
accccacccgcccagagcaacacgggcacaactcggttcaccaacgatccgcgtagaacccaaaatattagaaaa

SEQ ID NO: 257693 - DNA, 75 bp, Artificial Sequence
  Synthetic
ctcacaatcagacattctctggcagtccgtattttcctagttagtgagctcaagaggggccgcaatacagcaggt

SEQ ID NO: 257694 - DNA, 75 bp, Artificial Sequence
  Synthetic
tccgtattttcctagttagtgagctcaagaggggccgcaatacagcaggtgggagctctacatattacaacttgg

SEQ ID NO: 257695 - DNA, 75 bp, Artificial Sequence
  Synthetic
tacgggtagaacggtcaaaggagccacctttcagtcgggaaataggcttcatgacatccgttctaccgcatcacc

SEQ ID NO: 257696 - DNA, 75 bp, Artificial Sequence
  Synthetic
agtcttacttctaatggtgatgaccttagttatctctgcagctgccctggtatatatcatgggggccagcacgcc

SEQ ID NO: 257697 - DNA, 75 bp, Artificial Sequence
  Synthetic
cgcagttaatagaattgtgttagaaaatgaggaaagagaagcaaagaacacatggcgcttggttttccgggtcac

SEQ ID NO: 257698 - DNA, 75 bp, Artificial Sequence
  Synthetic
gcgcgaccttgcaggcatatcagccgcgatctccaaggcggaggataaggtcacgactttgctcagttctagcca

SEQ ID NO: 257699 - DNA, 75 bp, Artificial Sequence
  Synthetic
agtcttaattctaatggtaatgattttagctttctctgcagctaccctggtatataccatgagggccagtacacc

SEQ ID NO: 257700 - DNA, 75 bp, Artificial Sequence
  Synthetic
aatcccgcaaggcaagacaaaggccctgagcatagcatgggagaagcatgggagcatccagccgcccgctggcca

SEQ ID NO: 257701 - DNA, 75 bp, Artificial Sequence
  Synthetic
gcgcgacctcacaggtatatcgaccatgctctccaaggcggagggtaagattacgtctctactcagttcaggtca

SEQ ID NO: 257702 - DNA, 75 bp, Artificial Sequence; identical to SEQ ID NO: 96162
  Synthetic

SEQ ID NO: 257703 - DNA, 75 bp, Artificial Sequence
  Synthetic
cacgatcagaggagttcagcagcatccgtacagatccagcattctggtttcactcaaaatggtccagagccaagt

SEQ ID NO: 257704 - DNA, 75 bp, Artificial Sequence
  Synthetic
atgcacaactttattcttttgccatgggcatggcatcagtcttagataagggaactggcaagtaccaattcgcca

SEQ ID NO: 257705 - DNA, 75 bp, Artificial Sequence
  Synthetic
tataagtcagttacccctacatcaatggtgcatggaaggttagggtttgacggtcaataccatgagaaggactta

SEQ ID NO: 257706 - DNA, 75 bp, Artificial Sequence
  Synthetic
caaccgggagcccccagaagaaggaccccgtccgtcccaagcccaggccgccgcacagccccaagaggatgtgga

SEQ ID NO: 257707 - DNA, 75 bp, Artificial Sequence
  Synthetic
ctcacaatgtcaagggtaaaaatgaatatcagtgcaagcccgaatcccatactgccgggcagctacaacctaaca

SEQ ID NO: 257708 - DNA, 75 bp, Artificial Sequence; identical to SEQ ID NO: 96168
  Synthetic

SEQ ID NO: 257709 - DNA, 75 bp, Artificial Sequence
  Synthetic
ttctgcgtatcaagaacacttgaattttatcccggcgcctactacagggtctggttgcactcggataccctcatt

SEQ ID NO: 257710 - DNA, 75 bp, Artificial Sequence
  Synthetic
cggtcaataccatgagaaggacttagacgtcacagtcttatttaaggattgggttgcaaattacccgggagtggg

SEQ ID NO: 257711 - DNA, 75 bp, Artificial Sequence
  Synthetic
cacagggcggatcaaacaagccgcaagggcaaccagatgccggggatggggagacccaattcttggattttatga

SEQ ID NO: 257712 - DNA, 75 bp, Artificial Sequence; identical to SEQ ID NO: 96172
  Synthetic

SEQ ID NO: 257713 - DNA, 75 bp, Artificial Sequence
  Synthetic
gggaaaacaacatacggaagatagcacgggtaggaaatggctggctccggtcccgaaagggcagagcatcagatc

SEQ ID NO: 257714 - DNA, 75 bp, Artificial Sequence
  Synthetic
tcaatacttggcactcggtgtacttcggacatctgcaacagggagggtattcttttctactctgcgttccatcaa

SEQ ID NO: 257715 - DNA, 75 bp, Artificial Sequence
  Synthetic
agcgccaaatcctgcacagagcaccacccatccagagcctcccccaacccctggggcatcccaagacaacgacac

SEQ ID NO: 257716 - DNA, 75 bp, Artificial Sequence
  Synthetic
taggttgcgatatgctgtgctctaaagtcacagagaccgaggaagcggattacaagtctgccactcccacatcaa

SEQ ID NO: 257717 - DNA, 75 bp, Artificial Sequence
  Synthetic
ctggggcatcccaagacaacgacactgactgggggtactgatcgacaacacccagcctgccttcacaggatcaca

SEQ ID NO: 257718 - DNA, 75 bp, Artificial Sequence
  Synthetic
cccagcctgccttcacaggatcacaccaaaccctccgcccaaaaccctcccacactccccgacccacaaccccgc

SEQ ID NO: 257719 - DNA, 75 bp, Artificial Sequence
  Synthetic
taggttgtgatatgctgtgctctaaagtcacagagaccgaggacgaggattacaagtcagtctcccccacatcaa

SEQ ID NO: 257720 - DNA, 75 bp, Artificial Sequence
  Synthetic
tgcacaagaagggaaatatgtaatatacaagcgctataataacacatgccccgatgaacaagattaccaaattcg

SEQ ID NO: 257721 - DNA, 75 bp, Artificial Sequence
  Synthetic
tacaagcgctataataacacatgccccgatgaacaagattaccaaattcggatggccaagtcctcgtataaacct

SEQ ID NO: 257722 - DNA, 75 bp, Artificial Sequence
  Synthetic
ggctgtgcaaatgtgtcctctctaagtgatctacgtgcagtggctaaatctcatcccgtgttaattgcaggtcca

SEQ ID NO: 257723 - DNA, 75 bp, Artificial Sequence
  Synthetic
acacgatcccacccacccgggacaacacaggcacagctcggttcgtcgacaatccgcccagagcccaaggtatta

SEQ ID NO: 257724 - DNA, 75 bp, Artificial Sequence
  Synthetic
aagttctctgttctcccttctacccagtgaattagggtgaagatggccacttttacagatgcggagatagatgac

SEQ ID NO: 257725 - DNA, 75 bp, Artificial Sequence
  Synthetic
ttacactcatgggggctgaaggcagaattctcacagtagggacatctcacttcttgtaccaacgagggtcttcat

SEQ ID NO: 257726 - DNA, 75 bp, Artificial Sequence
  Synthetic
agcgcgatcccgcagggcaagaccaaagctctaagcacagcatgggagaagcacgggagtgtccagccacacgcc

SEQ ID NO: 257727 - DNA, 75 bp, Artificial Sequence
  Synthetic
tgaatggataaggagcagggcatagccaagtaagttgagagcaagtcccatctcttatcagataggaagaatctc

SEQ ID NO: 257728 - DNA, 75 bp, Artificial Sequence
  Synthetic
gcacgggagtgtccagccacacgccagtcaggacgcccctgaccaacaagacagaacagaaaaacagccatccac

SEQ ID NO: 257729 - DNA, 75 bp, Artificial Sequence
  Synthetic
agtcaggacgcccctgaccaacaagacagaacagaaaaacagccatccacacctgagcaggcgactctacacaac

SEQ ID NO: 257730 - DNA, 75 bp, Artificial Sequence
  Synthetic
atactgatccgtatcccttagtcttcaatcggaatcataccctacgaggggtattcgggacaatgcttgatgatg

SEQ ID NO: 257731 - DNA, 75 bp, Artificial Sequence
  Synthetic
tcaacataatatcatctctggcgatccatctcagaagtctatcagagaaaatcgatgatattctgcggttggtag

SEQ ID NO: 257732 - DNA, 75 bp, Artificial Sequence
  Synthetic
aatggactcgtctaggacaatcgggctatacttcgattctgccctaccatcaagcagccttctggcctttccaat

SEQ ID NO: 257733 - DNA, 75 bp, Artificial Sequence
  Synthetic
agacagcaaggaggactcggtgttcatcaccacatacggattcatcttccaggtcgggagtgaggaaacttctgt

SEQ ID NO: 257734 - DNA, 75 bp, Artificial Sequence
  Synthetic
attgagtcagccataggacggctggaagaatgatgtggcactgaatatctttcgcgatgccaagagtcaaactga

SEQ ID NO: 257735 - DNA, 75 bp, Artificial Sequence
  Synthetic
accaataaagcttattgtcttagcattgcagaaatatccaataccctattcggggagttcagaatcgttcctttg

SEQ ID NO: 257736 - DNA, 75 bp, Artificial Sequence
  Synthetic
acagtcatccgatctgtgatatatatggaagctgagggtgatctcgctgacacagtatttctatttaccccttac

SEQ ID NO: 257737 - DNA, 75 bp, Artificial Sequence
  Synthetic
ttgcagaaatatccaataccctattcggggagttcagaatcgttcctttgctagttgagatcctcaaggaagtca

SEQ ID NO: 257738 - DNA, 75 bp, Artificial Sequence
  Synthetic
gctgccgggtagccacaatctaacaacactgacatgattagtctgagtcctgtttttggccactttattaagaaa

SEQ ID NO: 257739 - DNA, 75 bp, Artificial Sequence
  Synthetic
cttgtgatgccaagggtcaggctgaatatcaacacaaggccgaatcccacgctgccgggcaaccacaatccgcca

SEQ ID NO: 257740 - DNA, 75 bp, Artificial Sequence
  Synthetic
gggtggttgcaaacaagtactcctctgtgaatgcagtaaagcacgtgaaggctcctgagaaaataccgggcagcg

SEQ ID NO: 257741 - DNA, 75 bp, Artificial Sequence
  Synthetic
ttcaccttagactaatggatactacaatgtttgtaggagacccttttaatcctccaagtgacccgaccgactgtg

SEQ ID NO: 257742 - DNA, 75 bp, Artificial Sequence
  Synthetic
gggaaaacaacccaaggagaaggtcacgggtaggacatggcgggctccggtcccgaaagggcggagcaccagatc

SEQ ID NO: 257743 - DNA, 75 bp, Artificial Sequence
  Synthetic
ggcctgacatgggagtggagaaggacactgtccgcgcattaatcacctcgcgcccgatgcatccaagctcctcgg

SEQ ID NO: 257744 - DNA, 75 bp, Artificial Sequence; identical to SEQ ID NO: 96206
  Synthetic

SEQ ID NO: 257745 - DNA, 75 bp, Artificial Sequence
  Synthetic
aagatcaaacgccttgcgctgaatggttgatggccatcacaactcataacaggctcccgtcactttagcgtcaca

SEQ ID NO: 257746 - DNA, 75 bp, Artificial Sequence
  Synthetic
aacggagcccatgggggaggagagaagggcagtaccctcaaagtggaagtgccggtcttcacactcaacagcgac

SEQ ID NO: 257747 - DNA, 75 bp, Artificial Sequence
  Synthetic
agggcagtaccctcaaagtggaagtgccggtcttcacactcaacagcgacgatccagaagaccgatggaattttg

SEQ ID NO: 257748 - DNA, 75 bp, Artificial Sequence
  Synthetic
tggtttcactcaaaatggtccacagccaagtttgcatggctccatataaaacagatccagaggcatctgattgtg

SEQ ID NO: 257749 - DNA, 75 bp, Artificial Sequence
  Synthetic
caaccaatccagcggcattagaaattaagaaaaaatacgggtagaatcaaagtgccttgattgcaccaaaatgga

SEQ ID NO: 257750 - DNA, 75 bp, Artificial Sequence
  Synthetic
tgtgctctcattcacaggtgatgaggaaccatgtggcacttgctgggaagcagaacgaggcaacactggcaatac

SEQ ID NO: 257751 - DNA, 75 bp, Artificial Sequence
  Synthetic
tgaattttctattactcacagctcgcaaccagattccaaccagtcttggatcgaggacatctcttttgtacactc

SEQ ID NO: 257752 - DNA, 75 bp, Artificial Sequence
  Synthetic
gaaccatgtggcacttgctgggaagcagaacgaggcaacactggcaatacttgaaatcgatggattctcaaatgg

SEQ ID NO: 257753 - DNA, 75 bp, Artificial Sequence
  Synthetic
acaagacacaggagacgggaagaagcaaatcaccccacaatacaggatccagcgtcttgattcgtggacagacag

SEQ ID NO: 257754 - DNA, 75 bp, Artificial Sequence
  Synthetic
gggtctcgacctgcacttatggcaggcagaatggatcccaagccttctaccagctatttgcatgccttttcattg

SEQ ID NO: 257755 - DNA, 75 bp, Artificial Sequence; identical to SEQ ID NO: 96212
  Synthetic

SEQ ID NO: 257756 - DNA, 75 bp, Artificial Sequence
  Synthetic
gcctcgtgcatgcagcaacgggaccccatttgtcacggccggggtagaggacgatgcccctgaggatataactga

SEQ ID NO: 257757 - DNA, 75 bp, Artificial Sequence
  Synthetic
acctacgggttcatctttcaaattgggaatgaagaagccaccgtcggtgtgatcaatgacaatcccaggcacgag

SEQ ID NO: 257758 - DNA, 75 bp, Artificial Sequence; identical to SEQ ID NO: 96213
  Synthetic

SEQ ID NO: 257759 - DNA, 75 bp, Artificial Sequence
  Synthetic
agaatcaagcagctgagatgttgtgcctgttgcgtctgtggggtcacccactgcttgagtcccgtattgcagcaa

SEQ ID NO: 257760 - DNA, 75 bp, Artificial Sequence
  Synthetic
gtgctgttcagctgcttgagccgtcaggtacatttgcaggagatttctttgcattcaacctacaggagctcaaag

SEQ ID NO: 257761 - DNA, 75 bp, Artificial Sequence
  Synthetic
ccatttgtcacggccggggtagaggacgatgcccctgaggatataactgacactcttgaaagaattctctccatc

SEQ ID NO: 257762 - DNA, 75 bp, Artificial Sequence
  Synthetic
cacagttgcatcaagctagtgataatttcttcaaagaactgattcatgtcaatcatctgattggccataacctga

SEQ ID NO: 257763 - DNA, 75 bp, Artificial Sequence
  Synthetic
ataaacaagtatatgcaacagggcagggtccagaaacggtacattctccatccagtgtgtaggagtgcaatccag

SEQ ID NO: 257764 - DNA, 75 bp, Artificial Sequence
  Synthetic
atcctccaggtactatctttttttaagggaacaatcatcaatggatacagaaagaagaactcaggtgtatggcca

SEQ ID NO: 257765 - DNA, 75 bp, Artificial Sequence
  Synthetic
gggtccagaaacggtacattctccatccagtgtgtaggagtgcaatccagcttaccatcagacagtcgctagcag

SEQ ID NO: 257766 - DNA, 75 bp, Artificial Sequence
  Synthetic
taggggacgtagattcatatatcaggaacactggtctcaccgcattcttccttacactcaaatacggcatcaaca

SEQ ID NO: 257767 - DNA, 75 bp, Artificial Sequence
  Synthetic
tttttaaggggacgatcatcaatggatacagaaagaagaactcaggtgtatggccgcgtgtcaaggcagatacaa

SEQ ID NO: 257768 - DNA, 75 bp, Artificial Sequence
  Synthetic
gaacactggtctcaccgcattcttccttacactcaaatacggcatcaacaccaagacatccgcactcgcactaag

SEQ ID NO: 257769 - DNA, 75 bp, Artificial Sequence
  Synthetic
gatttctgttattatttaaactacctaatgagttgtgtgcagacatattttgattctgagttttctattacccac

SEQ ID NO: 257770 - DNA, 75 bp, Artificial Sequence
  Synthetic
tatacgggaaggtcattgggcagcttcatgccgattcagcggagatctcacacgatgtcatgttgagagagtaca

SEQ ID NO: 257771 - DNA, 75 bp, Artificial Sequence
  Synthetic
catgaccttgctgggtgacagcgaccaaatgagctttgcgccggcagagtatgctcagctgtactcattcgcaat

SEQ ID NO: 257772 - DNA, 75 bp, Artificial Sequence
  Synthetic
caaatgagctttgcgccggcagagtatgctcagctgtactcattcgcaatgggtatggcctccatattagacaag

SEQ ID NO: 257773 - DNA, 75 bp, Artificial Sequence
  Synthetic
ctggcgggtgggaacatggattacatgctgacaaagctgggagtgggtaacaatcagctcagttctctgattagt

SEQ ID NO: 257774 - DNA, 75 bp, Artificial Sequence
  Synthetic
gcacaggggagcagtatcaatgaagacatggctgctgagttgaagctgacaccagcagcaaggagggggctcgcg

SEQ ID NO: 257775 - DNA, 75 bp, Artificial Sequence
  Synthetic
gaatcaaatgattttgatccatacaaggagatggaatacttgacaacccttgagtacctaagagatgacagtgtg

SEQ ID NO: 257776 - DNA, 75 bp, Artificial Sequence
  Synthetic
cccagcctgccctcacagaaccatctcaaaccatccgctggaatcctccccaaactccacaactcaccggctcac

SEQ ID NO: 257777 - DNA, 75 bp, Artificial Sequence
  Synthetic
acatggctgctgagttgaagctgacaccagcagcaaggagggggctcgcggccgcagcccagagagtgtcagagg

SEQ ID NO: 257778 - DNA, 75 bp, Artificial Sequence
  Synthetic
gctgtcgcagtgaccgctgatcatgaggtaacctccactaagatagagaggaggcatgccattgctaaatacaat

SEQ ID NO: 257779 - DNA, 75 bp, Artificial Sequence
  Synthetic
aggtaacctccactaagatagagaggaggcatgccattgctaaatacaatcctttcaggaaataagttgcatccc

SEQ ID NO: 257780 - DNA, 75 bp, Artificial Sequence
  Synthetic
cacgggcacaacccaatccaccaacaatccgcacagaacccaaaatattagaaaaaaatacgggtagaagagaga

SEQ ID NO: 257781 - DNA, 75 bp, Artificial Sequence
  Synthetic
caccgagtgcttctaacagaccgcagaatcccaccgacggaggcgacggtgagactcagttccttgacctaatga

SEQ ID NO: 257782 - DNA, 75 bp, Artificial Sequence
  Synthetic
gggttgcaaccgctgcacagataacagcagcctcggctctgatacaagccaaccaaaatgctgccaacatcctcc

SEQ ID NO: 257783 - DNA, 75 bp, Artificial Sequence
  Synthetic
catgctatcatggaagcaagctctgtaggtaggagaaaacaaattcaaggacttgttgacacgacaaacactgtg

SEQ ID NO: 257784 - DNA, 75 bp, Artificial Sequence
  Synthetic
gaatcccaccgacggaggcgacggtgagactcagttccttgacctaatgagggcagttgccaacagcatgagaga

SEQ ID NO: 257785 - DNA, 75 bp, Artificial Sequence
  Synthetic
aggaactgccaggtaatggcagaagggattctagctgaccagattgcacctttcttccaaggaaatggggtcatt

SEQ ID NO: 257786 - DNA, 75 bp, Artificial Sequence
  Synthetic
cgactggggctattaaccagcaccccggctaacggggacccagatccctctcctttcttccccataccccaacac

SEQ ID NO: 257787 - DNA, 75 bp, Artificial Sequence
  Synthetic
cgaccggcacattcaggacgcaatatgggctccaaaccttctaccaggatcccagcacctctgatgctgatcacc

SEQ ID NO: 257788 - DNA, 75 bp, Artificial Sequence
  Synthetic
cggctaacggggacccagatccctctcctttcttccccataccccaacacaacctcacgcgcaccaagaaaagac

SEQ ID NO: 257789 - DNA, 75 bp, Artificial Sequence
  Synthetic
ggccaggacacccccaaccaacaagacaaaccagacaaacagccacccgcatccgagcaggtgactccacacaac

SEQ ID NO: 257790 - DNA, 75 bp, Artificial Sequence
  Synthetic
attagtctcttctaatatgtgttcgctgactctagcagattatgcccggaacagaagttggtcacctttgacagg

SEQ ID NO: 257791 - DNA, 75 bp, Artificial Sequence
  Synthetic
accagcacacgccaatcaccacagctgcactatttgattgattagaaaaaagtacgggtagaagagtagtgtccc

SEQ ID NO: 257792 - DNA, 75 bp, Artificial Sequence
  Synthetic
tgcactatttgattgattagaaaaaagtacgggtagaagagtagtgtcccgagggtgggcacccaaacccacgcc

SEQ ID NO: 257793 - DNA, 75 bp, Artificial Sequence
  Synthetic
aatatgcccagggataaggaggcgtgtgcgaaagccccattagaggcatataacagaacactgactgctttgctc

SEQ ID NO: 257794 - DNA, 75 bp, Artificial Sequence
  Synthetic
cccaaatgatgatatatatattgtcagtgctagggggggcattgagggattatgccagaagctatggacaatgat

SEQ ID NO: 257795 - DNA, 75 bp, Artificial Sequence
  Synthetic
gaaacgagtggaactgtcattgacagcatcatcacggcccaaggcaagcccgtagaaacggtggggcggagtgcc

SEQ ID NO: 257796 - DNA, 75 bp, Artificial Sequence
  Synthetic
gcatcatcacggcccaaggcaagcccgtagaaacggtggggcggagtgccattccacaagggaagacaaaggccc

SEQ ID NO: 257797 - DNA, 75 bp, Artificial Sequence
  Synthetic
ctcttggggttgcaacagcggcacagataacagcagctgcggccctaatacaagccaaccagaatgctgccaaca

SEQ ID NO: 257798 - DNA, 75 bp, Artificial Sequence
  Synthetic
cggggcaagaccaggccgacagcagtagccaggcacgccaaggagaaggcccccaagcgccccaagctcaacccg

SEQ ID NO: 257799 - DNA, 75 bp, Artificial Sequence
  Synthetic
cagtggcagttgggaagatgcagcagtttgtcaatgaccagtttaataatacggcgcgagaattggactgtataa

SEQ ID NO: 257800 - DNA, 75 bp, Artificial Sequence
  Synthetic
ctcacaatcagacagtctctggcggtccgtatcttcttagttagtgagcttaagagaggtcgcaatacggcaggt

SEQ ID NO: 257801 - DNA, 75 bp, Artificial Sequence
  Synthetic
tagccaggcacgccaaggagaaggcccccaagcgccccaagctcaacccgccgcacaactccaagaagacacggg

SEQ ID NO: 257802 - DNA, 75 bp, Artificial Sequence
  Synthetic
atctaaattagtgctaatatcaggtgaccttagtgaaaacactgtaatgtcctgtgccaacattgcatccactgt

SEQ ID NO: 257803 - DNA, 75 bp, Artificial Sequence
  Synthetic
tgctaaaaagggcccacagcagaatcccttgcaactgacccctcactctcaagagggtcccgcgatggaacaagc

SEQ ID NO: 257804 - DNA, 75 bp, Artificial Sequence
  Synthetic
cccttgcaactgacccctcactctcaagagggtcccgcgatggaacaagcccaacgtgggaccaaccaggggaag

SEQ ID NO: 257805 - DNA, 75 bp, Artificial Sequence
  Synthetic
ggtggcaatatggattacttattaactaagttaggtatagggaacaatcaactcagctcattaattggtagcggc

SEQ ID NO: 257806 - DNA, 75 bp, Artificial Sequence
  Synthetic
cagatgagctttgctccggctgagtatgctcaactttattcgtttgccatgggcatggcatcagtcttagataaa

SEQ ID NO: 257807 - DNA, 75 bp, Artificial Sequence
  Synthetic
ggacaatgggaggggtcaccacaatcagctggtgcaacccatcatgctctccgatcagggcagaaccaagacaat

SEQ ID NO: 257808 - DNA, 75 bp, Artificial Sequence
  Synthetic
atcttcaatactcaaggctctacacgaggaatataggtgacccggggactactgcttttgcagaagtcaagcgac

SEQ ID NO: 257809 - DNA, 75 bp, Artificial Sequence
  Synthetic
tacaaccaaaggatatgcctcagcacttgtcccgaaagtagtgacacaagtcggttctgtgatagaagagcttga

SEQ ID NO: 257810 - DNA, 75 bp, Artificial Sequence
  Synthetic
gatgatgtctatgatggaggcgatatcgcagcgggtaagcaagattgattatcaattggaccttgttctcaagca

SEQ ID NO: 257811 - DNA, 75 bp, Artificial Sequence
  Synthetic
acatggctgccgagctaaagctaactccggcagcaaggagaggcctggcagttgctgcccagcgagtatctgagg

SEQ ID NO: 257812 - DNA, 75 bp, Artificial Sequence
  Synthetic
ctttaactttgagactgttgcaagcccaaatattgtcctcaagaagcatacacaaaaggtcttatttgagacttg

SEQ ID NO: 257813 - DNA, 75 bp, Artificial Sequence; identical to SEQ ID NO: 96241
  Synthetic

SEQ ID NO: 257814 - DNA, 75 bp, Artificial Sequence
  Synthetic
aatgacgctataatagtgtatgacaacacacgaaattggatcagtgaagcccagaattcagatgtggtccgccta

SEQ ID NO: 257815 - DNA, 75 bp, Artificial Sequence
  Synthetic
tgacattccccatgtccccaggtatttattcctgtttgagcggcaacacatcagcttgcatgtattcaaagactg

SEQ ID NO: 257816 - DNA, 75 bp, Artificial Sequence; identical to SEQ ID NO: 96242
  Synthetic

SEQ ID NO: 257817 - DNA, 75 bp, Artificial Sequence
  Synthetic
ctatctgagagtgagaggtctcaacaacatcgtcctatacatgagtgacttatacaagaatatgccagggattct

SEQ ID NO: 257818 - DNA, 75 bp, Artificial Sequence
  Synthetic
caatcaagaagtgattcacccacgtgtcgcacatgctatcatggaagcaagttctgtaggtaggagaaagcaaat

SEQ ID NO: 257819 - DNA, 75 bp, Artificial Sequence
  Synthetic
cacggggcggatcaaacaagccgcaagggcaaccagatgccggggatggggagacccaattcctagacttgatga

SEQ ID NO: 257820 - DNA, 75 bp, Artificial Sequence
  Synthetic
actttctaatatcgcggctacgatatcccatcccatcattcactcaaggttgaatgcagtaggtctaattaacca

SEQ ID NO: 257821 - DNA, 75 bp, Artificial Sequence
  Synthetic
ggctgtgcaaacgtgtcctctctgagtgatctacgtgcagtggctaaatctcaccctgtattagttgcaggccca

SEQ ID NO: 257822 - DNA, 75 bp, Artificial Sequence
  Synthetic
cgtgccctgatgaccaggagtatcaggttaagatggccaagtcggcatacaagcctaatcgattcggggggaagc

SEQ ID NO: 257823 - DNA, 75 bp, Artificial Sequence
  Synthetic
tctgatctcataaagcatgcagcttctggtggccctgacatagggattgagagggacactgtccgtgcgcttatc

SEQ ID NO: 257824 - DNA, 75 bp, Artificial Sequence
  Synthetic
tgactgggggtactgattggctacgcccagcccacccccatagggccaacccaaaccctccgtccaaaactctcc

SEQ ID NO: 257825 - DNA, 75 bp, Artificial Sequence
  Synthetic
ctggtggccctgacatagggattgagagggacactgtccgtgcgcttatcttatcaagacctatgcaccccagct

SEQ ID NO: 257826 - DNA, 75 bp, Artificial Sequence
  Synthetic
agggcaaccagatgccggggatggggagacccaattcctagacttgatgagagcagtagccaacagcatgcgaga

SEQ ID NO: 257827 - DNA, 75 bp, Artificial Sequence
  Synthetic
atgccttggataggttggcagaaagcaacagcaagctagaaaaagtcaatgtcagactaaccagcacatctgctc

SEQ ID NO: 257828 - DNA, 75 bp, Artificial Sequence
  Synthetic
gtcgcacatgctatcatggaagcaagttctgtaggtaggagaaagcaaatccaagggctagttgacacgacaaac

SEQ ID NO: 257829 - DNA, 75 bp, Artificial Sequence
  Synthetic
catataccacacgagaccatctattacaatacgcttttctcgaatgagatgaaccccccacagcgacatttcgga

SEQ ID NO: 257830 - DNA, 75 bp, Artificial Sequence
  Synthetic
taaatgggtgagctacaggatccaaccaggatgattgagaataaggtctagtcgctgacaggcaggagggacctc

SEQ ID NO: 257831 - DNA, 75 bp, Artificial Sequence
  Synthetic
ccacgaccccatccacccgagaccacataggcgcagctcggtctaccaacaatcctttcagaacccaaggtatta

SEQ ID NO: 257832 - DNA, 75 bp, Artificial Sequence
  Synthetic
ccaggatgattgagaataaggtctagtcgctgacaggcaggagggacctctcataatcaagcttcgaatacaacg

SEQ ID NO: 257833 - DNA, 75 bp, Artificial Sequence
  Synthetic
tgtacaaacagaaggcacaacaaaagaccttgctatggcttgggaataataccctcgatcagatgagagccacta

SEQ ID NO: 257834 - DNA, 75 bp, Artificial Sequence
  Synthetic
cataggcgcagctcggtctaccaacaatcctttcagaacccaaggtattagaaaaaaatacgggtagaagagaga

SEQ ID NO: 257835 - DNA, 75 bp, Artificial Sequence; identical to SEQ ID NO: 96248
  Synthetic

SEQ ID NO: 257836 - DNA, 75 bp, Artificial Sequence
  Synthetic
agtaattaagaaaaaatacgggtagaatcggagcatcccgattgtgccaagatggactcatctaggacaatcggg

SEQ ID NO: 257837 - DNA, 75 bp, Artificial Sequence
  Synthetic
tgagactgcgagccacccacttttccgaatcatcacgacattagataatgatctatcttaattgcttatagttag

SEQ ID NO: 257838 - DNA, 75 bp, Artificial Sequence
  Synthetic
ttcatcttccaagcaacatagagctgactgatgacactagcaaaaatcccccgatgagagtgccatatcttgggt

SEQ ID NO: 257839 - DNA, 75 bp, Artificial Sequence
  Synthetic
tacaacatctacttgtttcaaggtggtgaagacagggagagtatactgtctaagtattgctgaaatctctaatac

SEQ ID NO: 257840 - DNA, 75 bp, Artificial Sequence
  Synthetic
cacgggtagaacggtcagaggagccacccttcaatcggaaattaggcttcacaacatccgttctaccacatcacc

SEQ ID NO: 257841 - DNA, 75 bp, Artificial Sequence
  Synthetic
gacatcggtgctcgagtgagagatcctttcactcgacaacctgcgtcattcatacacgagttacatctgagcgct

SEQ ID NO: 257842 - DNA, 75 bp, Artificial Sequence
  Synthetic
gggaacaagcaaccaaagagcaatacacgggtagaacggtcagaggagccacccttcaatcggaaattaggcttc

SEQ ID NO: 257843 - DNA, 75 bp, Artificial Sequence
  Synthetic
ggatacagcgcctggactcctggacagacagtaaagaggactcagtgttcatcaccacatacggattcatattcc

SEQ ID NO: 257844 - DNA, 75 bp, Artificial Sequence
  Synthetic
gcatgggagtgcccagccacatgccagccgggatgcccccgaccaacaagccagaccagacaaaccgccatccac

SEQ ID NO: 257845 - DNA, 75 bp, Artificial Sequence; identical to SEQ ID NO: 96252
  Synthetic

SEQ ID NO: 257846 - DNA, 75 bp, Artificial Sequence
  Synthetic
actgctgcccttaagattgcaaggtctcgatgtaacataaactcagagtatcttcggctactatcacccttgccc

SEQ ID NO: 257847 - DNA, 75 bp, Artificial Sequence
  Synthetic
gcgtgagctcgagtcttacgctgccagctggccataatcagccagcgccaatgtgattagattaaatcttatcga

SEQ ID NO: 257848 - DNA, 75 bp, Artificial Sequence
  Synthetic
aggagatcttgtagagttggcaagggcttgtctggccatggtgataacatgcaagaagagtgccacaaatacgga

SEQ ID NO: 257849 - DNA, 75 bp, Artificial Sequence
  Synthetic
gactgttccgcctaatacaattacactcatgggggccgaaggcagagttctcacagtagggacatctcacttctt

SEQ ID NO: 257850 - DNA, 75 bp, Artificial Sequence
  Synthetic
agaaggagtcaaagaggggaatgtggtttatcaacagattatgctcttgggtttatcgctgattgaatcattatt

SEQ ID NO: 257851 - DNA, 75 bp, Artificial Sequence
  Synthetic
aacaacaagagtcaatcatggaccgcgcggttaacagagtcgtgctggagaatgaggaaagagaagcaaagaaca

SEQ ID NO: 257852 - DNA, 75 bp, Artificial Sequence
  Synthetic
gcttgtctggccatggtgataacatgcaagaagagtgccacaaatacggaaaggatggtcttctcagtggtgcaa

SEQ ID NO: 257853 - DNA, 75 bp, Artificial Sequence
  Synthetic
cccaatgacaacaaccaaaacgtatgatgagatcacattacatctccacagcaaatttagctgctgtatccggga

SEQ ID NO: 257854 - DNA, 75 bp, Artificial Sequence
  Synthetic
gatgagatcacattacatctccacagcaaatttagctgctgtatccgggaagcgcctgttgcggttcctttcgag

SEQ ID NO: 257855 - DNA, 75 bp, Artificial Sequence
  Synthetic
gctcccgagaagataccgggtagcgggacacttgagtacaaggtaaacttcgtgtcattaactgtggtgcctaag

SEQ ID NO: 257856 - DNA, 75 bp, Artificial Sequence
  Synthetic
cccgtcgagccatggaagcaaccaggaaagaccgcagaaccagaccaaggccgccactggaaaccggggcacaga

SEQ ID NO: 257857 - DNA, 75 bp, Artificial Sequence
  Synthetic
gcaatggaagaagatccttgaatcgtcaaccccagacattgaaagaatgattaagttaggtcgctcggtgcatca

SEQ ID NO: 257858 - DNA, 75 bp, Artificial Sequence
  Synthetic
gaattgcatataccgcatgagaccatctattacaacacgctcttctcaaatgagatgaaccctccgcagcgacat

SEQ ID NO: 257859 - DNA, 75 bp, Artificial Sequence; identical to SEQ ID NO: 96256
  Synthetic

SEQ ID NO: 257860 - DNA, 75 bp, Artificial Sequence
  Synthetic
ggacacttgagtacaaggtaaacttcgtgtcattaactgtggtgcctaagaaagatgtctacaagatcccgactg

SEQ ID NO: 257861 - DNA, 75 bp, Artificial Sequence
  Synthetic
ttctgcatatcaagaacacttgaatttcatcccggcgcctactacaggatccggttgcactcggataccctcatt

SEQ ID NO: 257862 - DNA, 75 bp, Artificial Sequence
  Synthetic
agagcccgttggtgaaatcactatctaagtcagagaatggatactatgcgaacctcttcctgcatataggactta

SEQ ID NO: 257863 - DNA, 75 bp, Artificial Sequence
  Synthetic
ggtttcttatgatgaagatacctctataaagaatgatgctataatagtgtatgacaacacacgaaattggatcag

SEQ ID NO: 257864 - DNA, 75 bp, Artificial Sequence
  Synthetic
aaaggtgacgtttgacaagctagagaggaaacttcgaaggcttgacctgtctgtgggactcagtgatgtgctcgg

SEQ ID NO: 257865 - DNA, 75 bp, Artificial Sequence
  Synthetic
gttgcagagatcactcacactcacatcaatacttagcacttggtgtgcttcggacatctgcaacagggagggtat

SEQ ID NO: 257866 - DNA, 75 bp, Artificial Sequence; identical to SEQ ID NO: 96261
  Synthetic

SEQ ID NO: 257867 - DNA, 75 bp, Artificial Sequence
  Synthetic
gcaaccggtgcagcacccttctgatctagtcaaacctgcctccacaaacgggcctgacgtgggtgtagagaagga

SEQ ID NO: 257868 - DNA, 75 bp, Artificial Sequence
  Synthetic
cctcaggtggcaaagatactatggagtcagacagccagcctgcgcagtgtcaaagtgatcattcaagcaggcaca

SEQ ID NO: 257869 - DNA, 75 bp, Artificial Sequence
  Synthetic
acgatatcccaccctattattcactcaaggttgaatgcagtaggcctaattaaccatgacgggtcacaccagctg

SEQ ID NO: 257870 - DNA, 75 bp, Artificial Sequence
  Synthetic
ctaggctatttacctcacagcagcatcgtgtaatagacatcttatccagccctataccgagactaatgaagttct

SEQ ID NO: 257871 - DNA, 75 bp, Artificial Sequence
  Synthetic
tacaacccgttcaagaaatgagcgcctactaccactaatatgagccaaagatacctgaaaactgatcaacactaa

SEQ ID NO: 257872 - DNA, 75 bp, Artificial Sequence
  Synthetic
ctactaccactaatatgagccaaagatacctgaaaactgatcaacactaatcaaatctaatggtcgaataacgag

SEQ ID NO: 257873 - DNA, 75 bp, Artificial Sequence
  Synthetic
agggacctttgctggcgacttcttttcattcaatctacaagaattgagggatactttgattggtttattaccgca

SEQ ID NO: 257874 - DNA, 75 bp, Artificial Sequence
  Synthetic
catatctcttgttttcggtgcacttagcctggttttagcatgctacctgatgtacaaacaaaaggcacaacaaaa

SEQ ID NO: 257875 - DNA, 75 bp, Artificial Sequence
  Synthetic
aaattctgatcctttgaagttcgtactcggattcaggcaattatcttaaagcagaagtgaacgtagttatcctta

SEQ ID NO: 257876 - DNA, 75 bp, Artificial Sequence
  Synthetic
attaccgaacccagaagaagattacttagtgcggtacttattcagaggaatcgggactgcttcatcttcttggta

SEQ ID NO: 257877 - DNA, 75 bp, Artificial Sequence
  Synthetic
tgcacaagaagggaaatatgtaatatacaagcgccataacaacacatgccccgatgaacaagattaccaaattcg

SEQ ID NO: 257878 - DNA, 75 bp, Artificial Sequence
  Synthetic
ccctgacgaatgcgactttgatcatctcattatcagcaggcaatggaagaaaatacttgaatctgccactcctga

SEQ ID NO: 257879 - DNA, 75 bp, Artificial Sequence
  Synthetic
ccgagcgcgaggccgaagctcgaacataagagaaccgcctaccgatatgtcgtctgtcttcgacgagtacgagca

SEQ ID NO: 257880 - DNA, 75 bp, Artificial Sequence
  Synthetic
gcagaatggaccctaagccttctaccagctacccatgcatccttacactgacctttgcagtcgtcactctgacgc

SEQ ID NO: 257881 - DNA, 75 bp, Artificial Sequence
  Synthetic
gggctcctgcctccttagtgtcacatagaatccctctggagcccccctcaacaaactcacaacctaacactccaa

SEQ ID NO: 257882 - DNA, 75 bp, Artificial Sequence
  Synthetic
ctcatccaggacaatcgggttgtactttgattctgccctcccctccagcagcctgttagcatttccgattgtctt

SEQ ID NO: 257883 - DNA, 75 bp, Artificial Sequence
  Synthetic
cacaagacagatcctagaggtcacaatactgggtctcagagtcaaagatctcaataaagtaggtgatgtaatagg

SEQ ID NO: 257884 - DNA, 75 bp, Artificial Sequence
  Synthetic
tcacatttcccgccaatctatattacatgtccaggaagagtcttaatctgatcagggaaagagaggacagagaca

SEQ ID NO: 257885 - DNA, 75 bp, Artificial Sequence
  Synthetic
aactgggacgattatcataaaattactacccaatatgcccaaggacaaggaggcatgtgccaagagccctctcga

SEQ ID NO: 257886 - DNA, 75 bp, Artificial Sequence
  Synthetic
cagctacccatgcatccttacactgacctttgcagtcgtcactctgacgcttatgacagagtgggcatcagcact

SEQ ID NO: 257887 - DNA, 75 bp, Artificial Sequence
  Synthetic
catgacagtaaataacaaaacggctacactccatagtccttatacgtttaatgctttcactcggccaggtagtgt

SEQ ID NO: 257888 - DNA, 75 bp, Artificial Sequence
  Synthetic
caaagaggactcggtattcattaccacctacggattcatcttccaaattgggaacgaggaagtcactgccggcgt

SEQ ID NO: 257889 - DNA, 75 bp, Artificial Sequence
  Synthetic
catacctgaaacgcagtacctgcccgaagtatttgaaggcagtcctagggattactaaactcaaagaactgttca

SEQ ID NO: 257890 - DNA, 75 bp, Artificial Sequence
  Synthetic
cccttgccaggcatcagcaagatgccccaactcatgcatcactggggtctatactgatccatatcccttaatctt

SEQ ID NO: 257891 - DNA, 75 bp, Artificial Sequence
  Synthetic
ctacccaatatgcccaaggacaaggaggcatgtgccaagagccctctcgatgcatataacaggacgctaactacc

SEQ ID NO: 257892 - DNA, 75 bp, Artificial Sequence
  Synthetic
cgtctgataggggctataataggaggtgccgccttaggcgtggcaactgcagcgcagatcacagcggcttctgct

SEQ ID NO: 257893 - DNA, 75 bp, Artificial Sequence
  Synthetic
ttacgcttagcgagatttgccccgagcacacactaccaaacccaaaggaagattacttagtacgatacttgttca

SEQ ID NO: 257894 - DNA, 75 bp, Artificial Sequence
  Synthetic
gatattacagtaacaatggctcctgaaggcaatcacacattaatgaactatcttcctaatcaatttcttcctcac

SEQ ID NO: 257895 - DNA, 75 bp, Artificial Sequence
  Synthetic
aacttgctctcagaagatcagaagaaaaatgtgcaggatgccacatcaaccaatcggctcttaatagaatttcta

SEQ ID NO: 257896 - DNA, 75 bp, Artificial Sequence
  Synthetic
gtgccgccttaggcgtggcaactgcagcgcagatcacagcggcttctgctcttatacaagctaaccaaaatgctg

SEQ ID NO: 257897 - DNA, 75 bp, Artificial Sequence
  Synthetic
aaagggtatatactctccaatggctatgcctgtagaggggatatggaatgttacctggtctttgtcatgggctat

SEQ ID NO: 257898 - DNA, 75 bp, Artificial Sequence
  Synthetic
aactggctgtcgctgtaggtaagatgcagcagtttgtcaatgatcagttcaacaagacagcacaagagattgatt

SEQ ID NO: 257899 - DNA, 75 bp, Artificial Sequence
  Synthetic
caaaggccatgactgcatatgagacagcagatgagtcagaaacaagaagaatcaataagtatatgcagcaaggta

SEQ ID NO: 257900 - DNA, 75 bp, Artificial Sequence
  Synthetic
ttaattaccttaaggcagaagtgaatgtagttgtccttaattatagtcctgtcattcaccaaatctttgtttggt

SEQ ID NO: 257901 - DNA, 75 bp, Artificial Sequence
  Synthetic
gcagcagtttgtcaatgatcagttcaacaagacagcacaagagattgattgcattaagatcacacagcaagtcgg

SEQ ID NO: 257902 - DNA, 75 bp, Artificial Sequence
  Synthetic
tcccgtatgcaggagtgcaatccaactcacaatcaggtattctctggcagtccgtattttcttagtcagtgagct

SEQ ID NO: 257903 - DNA, 75 bp, Artificial Sequence
  Synthetic
attgagccaatcataggatggttgggaagacgacaccgcaccaatcatctcccacaatgcttagagtcaagctga

SEQ ID NO: 257904 - DNA, 75 bp, Artificial Sequence
  Synthetic
ctgtcaaaggatttgggcaatcaagtctatgatgtcgtagcattgatggagggatttgcatatggtgctgttcag

SEQ ID NO: 257905 - DNA, 75 bp, Artificial Sequence
  Synthetic
taacatcttaactaggccgcctggaaatggagattgggccagtctgtgcaacgacccatactctttcaattttga

SEQ ID NO: 257906 - DNA, 75 bp, Artificial Sequence
  Synthetic
tgagagaaaatattgatgctgcactaattgaagcagggggacagcccgtccgtccattttgcgcagaaagtttag

SEQ ID NO: 257907 - DNA, 75 bp, Artificial Sequence
  Synthetic
gttgactatccaggccctgtataacttggcgggcgggaacatggactatatgctgacaaagttgggggtaggcaa

SEQ ID NO: 257908 - DNA, 75 bp, Artificial Sequence
  Synthetic
ttggcgggcgggaacatggactatatgctgacaaagttgggggtaggcaataatcagctcagctctctaattagc

SEQ ID NO: 257909 - DNA, 75 bp, Artificial Sequence
  Synthetic
gcattgcgacattgagattcctccggggtctaaccaaagtctattagatcaactggctactaatttgtctctgat

SEQ ID NO: 257910 - DNA, 75 bp, Artificial Sequence
  Synthetic
tccgtaggcaatctaaataacatgcgtgccacgtatctagagaccttatctgtgagcacgagcaaaggatttgcg

SEQ ID NO: 257911 - DNA, 75 bp, Artificial Sequence
  Synthetic
catattctctggcttagaacaaaatcaagcagctgagatgttgtgcttgttgcgtttgtggggtcacccactact

SEQ ID NO: 257912 - DNA, 75 bp, Artificial Sequence
  Synthetic
gtgccacgtatctagagaccttatctgtgagcacgagcaaaggatttgcgtccgcattagtgcctaaggtggtaa

SEQ ID NO: 257913 - DNA, 75 bp, Artificial Sequence
  Synthetic
atcctaccagagtcacatctatcctctccattggtcaagcacaaattgctatactactggaaattgactgggcta

SEQ ID NO: 257914 - DNA, 75 bp, Artificial Sequence
  Synthetic
acctaaaagacagagagactatcaggtcagatactttcttcatctatagcaagaggatttttaaggacggtgcca

SEQ ID NO: 257915 - DNA, 75 bp, Artificial Sequence
  Synthetic
ttgagattgacggattctcaaatggtgtgccgcagtttaacaacaggagtggcgtatcggaagagagagcccaga

SEQ ID NO: 257916 - DNA, 75 bp, Artificial Sequence
  Synthetic
ggattgtgacgttccccatgtctccgggtatcttttcttgccttggcgggaatacttcagcatgtatgtactcta

SEQ ID NO: 257917 - DNA, 75 bp, Artificial Sequence
  Synthetic
gggtatcttttcttgccttggcgggaatacttcagcatgtatgtactctaaaactgaaggagccctcaccacgcc

SEQ ID NO: 257918 - DNA, 75 bp, Artificial Sequence
  Synthetic
cctgacacagagagaatgataaaactcgggcgggcagtgcaccagactctcaaccacaattccaagataaccgga

SEQ ID NO: 257919 - DNA, 75 bp, Artificial Sequence
  Synthetic
gctgtcgcagtaaccgcggaccatgaggtcacctctactaagatagagaagaggcacaccatcgctaaatacaat

SEQ ID NO: 257920 - DNA, 75 bp, Artificial Sequence
  Synthetic
cttctgtctaaatcagatgaaattacattgactaagctattcacctcacagcagcgtcgtgtcaaggacatccta

SEQ ID NO: 257921 - DNA, 75 bp, Artificial Sequence
  Synthetic
caggtccaagtctgggtcactgttgccaaagccatgacagcttatgagacagcagatgagtcagagaccagaaga

SEQ ID NO: 257922 - DNA, 75 bp, Artificial Sequence
  Synthetic
gtcacccttacctacagctgggaatctccaacatagactggatgacggcataactcagatgacattcacccctgc

SEQ ID NO: 257923 - DNA, 75 bp, Artificial Sequence
  Synthetic
agtttctcaaaattatggagaggctgtctccctgatagataagaaggtatgtaatgtgttgactctggacgggat

SEQ ID NO: 257924 - DNA, 75 bp, Artificial Sequence
  Synthetic
gtctccctgatagataagaaggtatgtaatgtgttgactctggacgggatcactttacgcctcagtggggagttc

SEQ ID NO: 257925 - DNA, 75 bp, Artificial Sequence; identical to SEQ ID NO: 96283
  Synthetic

SEQ ID NO: 257926 - DNA, 75 bp, Artificial Sequence
  Synthetic
aggacaaccagacgctggggatggagagacccagttcttggacttgatgagagcggtggcgaacagcatgcgaga

SEQ ID NO: 257927 - DNA, 75 bp, Artificial Sequence
  Synthetic
aaagttaaattctgactctttggagctcgtattcggactcagtcgattatctctaagcagaaatgcgcgtagctg

SEQ ID NO: 257928 - DNA, 75 bp, Artificial Sequence
  Synthetic
cccgtccgtcccttttgtgcagaaagtttggtgagcacactaacagatacgccccagatgactcagataattgcc

SEQ ID NO: 257929 - DNA, 75 bp, Artificial Sequence
  Synthetic
tggtttcactcaaaatggtccagagccaagttcgcgtggctccatataaaacaagtccaaaggcatctgattgta

SEQ ID NO: 257930 - DNA, 75 bp, Artificial Sequence
  Synthetic
gagttggggaacgtgaacaattcaatcagtaatgccctagacaagctagaggaaagtaacagcaagctagacaag

SEQ ID NO: 257931 - DNA, 75 bp, Artificial Sequence
  Synthetic
acaagtccaaaggcatctgattgtagcagcaaggacaaggtctgcagtcaacaagttagtaacattaagtcataa

SEQ ID NO: 257932 - DNA, 75 bp, Artificial Sequence
  Synthetic
ccagcttatgtaatgacccctattcgttcaattttgagacagtggccagcccgaatatcgtcctcaagaaacata

SEQ ID NO: 257933 - DNA, 75 bp, Artificial Sequence
  Synthetic
cccggcctacatccataaggccatcccgaaccccccaaaaaaaccccccccacacctctcgacccatagccccgc

SEQ ID NO: 257934 - DNA, 75 bp, Artificial Sequence
  Synthetic
ctcacaatcagacagtcattagctgtcagaatcttcctagtgagtgagcttaagagaggtcgtaatactgctggt

SEQ ID NO: 257935 - DNA, 75 bp, Artificial Sequence
  Synthetic
cccgatacccttgctgctgatcattcgggttatgctgattttaggctgcgtccgtcagacaagctccattgacgg

SEQ ID NO: 257936 - DNA, 75 bp, Artificial Sequence
  Synthetic
atataatgtacaagcaaaaggcccagcaaaagacattactatggctcgggaataacactttggaccagatgagag

SEQ ID NO: 257937 - DNA, 75 bp, Artificial Sequence; identical to SEQ ID NO: 96287
  Synthetic

SEQ ID NO: 257938 - DNA, 75 bp, Artificial Sequence
  Synthetic
actcctcttggcgattccatccgtaggatacaagggtctgcgtccacatccggagggaggagacagaaacgcttt

SEQ ID NO: 257939 - DNA, 75 bp, Artificial Sequence
  Synthetic
cagatgagcttcgcaccagcagaatatgcccagctatattcatttgcaatgggtatggcatctgtattagacaaa

SEQ ID NO: 257940 - DNA, 75 bp, Artificial Sequence
  Synthetic
cacaggcacaactcggcctgcaaacaacacgaccaaggtccgaggtattagaaaaaaatacgggtagaagagaga

SEQ ID NO: 257941 - DNA, 75 bp, Artificial Sequence
  Synthetic
acgggaaaaagagaacatcacttaaacagtgcacacgacagatcttggaggttacaatactgggtctcagagtca

SEQ ID NO: 257942 - DNA, 75 bp, Artificial Sequence
  Synthetic
gcaaaagacattactatggctcgggaataacactttggaccagatgagagcaacgacgaagatgtgaaatctggt

SEQ ID NO: 257943 - DNA, 75 bp, Artificial Sequence
  Synthetic
actgagtcccactcgggaagtggcggagatatacgggtagaacagtcggagaggtcgcccctatttagggagttc

SEQ ID NO: 257944 - DNA, 75 bp, Artificial Sequence
  Synthetic
tcaagtctatgacgttgtagcattaatggagggattcgcatacggtgctgttcagctgcttgagccatcaggtac

SEQ ID NO: 257945 - DNA, 75 bp, Artificial Sequence
  Synthetic
ttttacagatgcagaaatagatgacatatttgagaccagtgggactgtcattgacagcataatcatggcccaggg

SEQ ID NO: 257946 - DNA, 75 bp, Artificial Sequence
  Synthetic
cccgacaacctgcggcgtttttacaagagttagatttgagcgctccagcaaggtatgacgcatttacacttagtc

SEQ ID NO: 257947 - DNA, 75 bp, Artificial Sequence
  Synthetic
gagatatacgggtagaacagtcggagaggtcgcccctatttagggagttcgaccttgatctgtctgttctaccac

SEQ ID NO: 257948 - DNA, 75 bp, Artificial Sequence
  Synthetic
agcggaatcagtaactcacgctattgccactgtattctccggcttagaacagaatcaagcagctgagatgttgtg

SEQ ID NO: 257949 - DNA, 75 bp, Artificial Sequence
  Synthetic
caatgtttgtaggagaccctttcaatcctccaagtgacccgactgactgtgatctatcaagagtcccaaatgatg

SEQ ID NO: 257950 - DNA, 75 bp, Artificial Sequence
  Synthetic
gcacgagagcgcccggccacacgtcagccaggacaacctcgaccaacaagctagatcagacgaacattcacccat

SEQ ID NO: 257951 - DNA, 75 bp, Artificial Sequence
  Synthetic
agaacacatggaggctggtgttcagggtgactgttcttatcctcaccgtagtaactcttgctatttccgcggctg

SEQ ID NO: 257952 - DNA, 75 bp, Artificial Sequence
  Synthetic
acggcgcgggaattggattgtataaagattacacaacaggtcggcgtagagctcaacctatacttaactgaatta

SEQ ID NO: 257953 - DNA, 75 bp, Artificial Sequence
  Synthetic
atcgtacgggtagaaggtgtgaatcccgagtgcgaggccgaagctcgaacctgagggaaccttctaccgatatgt

SEQ ID NO: 257954 - DNA, 75 bp, Artificial Sequence
  Synthetic
ttgaaactcgtattcgggttcaattaattaacttcaagcagaagtgcgcgtgattgtccttaaccacagtcttgt

SEQ ID NO: 257955 - DNA, 75 bp, Artificial Sequence
  Synthetic
agccaggacaacctcgaccaacaagctagatcagacgaacattcacccatacctgagcaggtaaccccacacgac

SEQ ID NO: 257956 - DNA, 75 bp, Artificial Sequence
  Synthetic
cagccaagatgtcatagataggatatacaaacaggtagcattagagtctcccttagccctgcttaacactgagtc

SEQ ID NO: 257957 - DNA, 75 bp, Artificial Sequence
  Synthetic
ggagcaagcaactctcttctatccatgcttgacaagcttagcaataaatcatccaatgctaaaaagggcccgaat

SEQ ID NO: 257958 - DNA, 75 bp, Artificial Sequence
  Synthetic
ccggaggggatcaggacaacgacaccgactggggatactagtcaaagccttgctcagcaatgacccaaatcttcc

SEQ ID NO: 257959 - DNA, 75 bp, Artificial Sequence
  Synthetic
ggtgactgttcttatcctcaccgtagtaactcttgctatttccgcggctgcccttgcattcagcatggaggccag

SEQ ID NO: 257960 - DNA, 75 bp, Artificial Sequence
  Synthetic
tacaaacaggtagcattagagtctcccttagccctgcttaacactgagtctacaatcatgaatgccttgacatca

SEQ ID NO: 257961 - DNA, 75 bp, Artificial Sequence
  Synthetic
cgcattacacaagccaggaagagacatccactgtggccgtccctcatcgcctgaccgaccaccagtccgacctct

SEQ ID NO: 257962 - DNA, 75 bp, Artificial Sequence
  Synthetic
tatctgctcttgaatttgagccatgtatagattatgaccctgttaccaatctaagcatgttcctaaaagacaagg

SEQ ID NO: 257963 - DNA, 75 bp, Artificial Sequence
  Synthetic
gggataggtaaggagctgattgtagatgatacaagtgacgtgacgtcattctacccatctgcatttcaggagcat

SEQ ID NO: 257964 - DNA, 75 bp, Artificial Sequence
  Synthetic
atgatacaagtgacgtgacgtcattctacccatctgcatttcaggagcatcttaattttattcctgcccccacca

SEQ ID NO: 257965 - DNA, 75 bp, Artificial Sequence
  Synthetic
atcaccgtataccaatcatcacaaccccattgtcagattgattagaaaaaaatacgggtagaagagtagtgtccc

SEQ ID NO: 257966 - DNA, 75 bp, Artificial Sequence
  Synthetic
gctcgcctcatttaggcggaacctactctctgaggaccagaagaaacagataaaagaggcaacttcaactaaccg

SEQ ID NO: 257967 - DNA, 75 bp, Artificial Sequence
  Synthetic
tgacattccctatgtccccaggtatttattcctgtttaaacggcaatacgtcggcttgcatgtactcaaagactg

SEQ ID NO: 257968 - DNA, 75 bp, Artificial Sequence
  Synthetic
tcttctactccccccgcccaacaagccaaagcaagcatggccacgttcacagacgcagagatagatgagctgttc

SEQ ID NO: 257969 - DNA, 75 bp, Artificial Sequence
  Synthetic
tatcaggctgtagagaccactcacattctcatcaatacttagccttaggagttctaaggacttcagcgaccggta

SEQ ID NO: 257970 - DNA, 75 bp, Artificial Sequence
  Synthetic
ttctcatcaatacttagccttaggagttctaaggacttcagcgaccggtagggtgttcttctcaactcttcgctc

SEQ ID NO: 257971 - DNA, 75 bp, Artificial Sequence; identical to SEQ ID NO: 96298
  Synthetic

SEQ ID NO: 257972 - DNA, 75 bp, Artificial Sequence
  Synthetic
agccgggggacagcctgtccgtccattctgtgcagagagcttggtgagcacattggcggacataactcagatgac

SEQ ID NO: 257973 - DNA, 75 bp, Artificial Sequence
  Synthetic
caagctcaggtatggatcacagtagcaaaggccatgactgcatatgagacagcagatgagtcagaaacaagaaga

SEQ ID NO: 257974 - DNA, 75 bp, Artificial Sequence
  Synthetic
ttctaaagtcacggagactgaggaagaggattaccagtcaacagaccctacattgatggtacatgggcggctagg

SEQ ID NO: 257975 - DNA, 75 bp, Artificial Sequence
  Synthetic
gaggattaccagtcaacagaccctacattgatggtacatgggcggctagggtttgatggacagtaccatgagagg

SEQ ID NO: 257976 - DNA, 75 bp, Artificial Sequence
  Synthetic
ctcacaatcagacattctctggcagtccgcattttcttagtcagtgagcttaaaagaggccgcaatacagcaggt

SEQ ID NO: 257977 - DNA, 75 bp, Artificial Sequence
  Synthetic
accatatcccacccgatcatacattcacgtttacacaccgtagggttgatcagccatgatggctcacaccaactt

SEQ ID NO: 257978 - DNA, 75 bp, Artificial Sequence
  Synthetic
ctaatatcttaactaggccacctggcaatggagactgggccagcctgtgcaacgatccttactcctttaattttg

SEQ ID NO: 257979 - DNA, 75 bp, Artificial Sequence
  Synthetic
aatcgtgtctggttcccggtatatggtggcttgaagccgggctccccaacagacaagaagcaagaggggcagtac

SEQ ID NO: 257980 - DNA, 75 bp, Artificial Sequence
  Synthetic
gtgccttgaacaagttggcagaaagcaaaagcaagctagacaaagttaatgtcaaactaaccagcacatctgctc

SEQ ID NO: 257981 - DNA, 75 bp, Artificial Sequence
  Synthetic
tgctaaaaagggcccacctcagagtcctccacagcaggccctccactccaaagggagccccgcagtggaacaaac

SEQ ID NO: 257982 - DNA, 75 bp, Artificial Sequence; identical to SEQ ID NO: 96303
  Synthetic

SEQ ID NO: 257983 - DNA, 75 bp, Artificial Sequence
  Synthetic
gtactctgacccttcaggactcgtattcgaattcaaataaatgtcttagaaaaaagttgcacgtaattgttcttg

SEQ ID NO: 257984 - DNA, 75 bp, Artificial Sequence
  Synthetic
ctaaactcctgagcaagctggatgcagccatgtcgattgaagagattaggaagatcaaacgccttgcgcttaatg

SEQ ID NO: 257985 - DNA, 75 bp, Artificial Sequence
  Synthetic
agccatgtcgattgaagagattaggaagatcaaacgccttgcgcttaatggttgattgtcgtcacaattttcaac

SEQ ID NO: 257986 - DNA, 75 bp, Artificial Sequence
  Synthetic
gggtccaacaagcaatcttatccataggagtatccaccacccttgcagacgacccggtattaactgtgaccccca

SEQ ID NO: 257987 - DNA, 75 bp, Artificial Sequence
  Synthetic
caccggcgtgaacacagcatttcctggacaatggggggtgtcaccacaatcagttggtgcaacccagcctgctcc

SEQ ID NO: 257988 - DNA, 75 bp, Artificial Sequence
  Synthetic
tgaatgcatacccaacagcaacttgtgtgtcaactctgacaatctgtcaattagaagacttaagaaaaaactgct

SEQ ID NO: 257989 - DNA, 75 bp, Artificial Sequence
  Synthetic
actgtgatctatcaagagtcccaaatgatgacatatatattgtcagtgctagagggggcattgagggactctgcc

SEQ ID NO: 257990 - DNA, 75 bp, Artificial Sequence
  Synthetic
gtagcgaccctccctcaaccccctccctccctcgaacgatcgtgcaactgcaatcaatccaagagcattagagat

SEQ ID NO: 257991 - DNA, 75 bp, Artificial Sequence
  Synthetic
aggagtatccaccacccttgcagacgacccggtattaactgtgacccccaataccataacacttatgggggcaga

SEQ ID NO: 257992 - DNA, 75 bp, Artificial Sequence
  Synthetic
tgtgtcaactctgacaatctgtcaattagaagacttaagaaaaaactgctgggtataaacaactgaagagcaatg

SEQ ID NO: 257993 - DNA, 75 bp, Artificial Sequence
  Synthetic
ttacccattgaccatcgaaaataagactgtaactcttcaggatccttataaattcaatgcattcactaggccggg

SEQ ID NO: 257994 - DNA, 75 bp, Artificial Sequence
  Synthetic
actgtaactcttcaggatccttataaattcaatgcattcactaggccgggtagtgttccatgtcaggcatctgcc

SEQ ID NO: 257995 - DNA, 75 bp, Artificial Sequence
  Synthetic
tacaacaggtgtcagtcatggaccgtgcagtcaccagggtcgtgctagagaatgaggaaagagaagcaaagagta

SEQ ID NO: 257996 - DNA, 75 bp, Artificial Sequence
  Synthetic
ccctcggtatcaagaggctgacacggataatcaattactcgagcatgcatgcaatgttattcagagatgatgtct

SEQ ID NO: 257997 - DNA, 75 bp, Artificial Sequence
  Synthetic
tccggcagcaaggagaggcctggctgctgctgcccaacgagtatctgaggaaatcggcagcatggatattcctac

SEQ ID NO: 257998 - DNA, 75 bp, Artificial Sequence
  Synthetic
cggggagtgttcggcacgatgttggatgatgagcaagccaggctgaacccagtctccgcggtatttgactctatc

SEQ ID NO: 257999 - DNA, 75 bp, Artificial Sequence
  Synthetic
tatataccatgggggccagcacgccacgtgacctcgcaggtatatcgactgtggtctccaagacaggggataagg

SEQ ID NO: 258000 - DNA, 75 bp, Artificial Sequence
  Synthetic
acctacggatttatcttccaaatcgggaatgaggaagccactgtcggcatgatcaatgacaatcccaagcgcgag

SEQ ID NO: 258001 - DNA, 75 bp, Artificial Sequence
  Synthetic
atgatgagcaagccaggctgaacccagtctccgcggtatttgactctatcgcacgaagtcgagcaactagggtga

SEQ ID NO: 258002 - DNA, 75 bp, Artificial Sequence
  Synthetic
ccaacattgcatccactgtagcacgactatgtgagaatgggcttcctaaggatttctgttactatttgaactacc

SEQ ID NO: 258003 - DNA, 75 bp, Artificial Sequence
  Synthetic
tcagaccttataaagcatgcaacttctggcggcccggatatagggattgagagggacactgttcgtgcacttatt

SEQ ID NO: 258004 - DNA, 75 bp, Artificial Sequence
  Synthetic
ctgggccacctcaagataacgacactgactgggggtactgatcgacaacacccagcccgctctcacagggccatc

SEQ ID NO: 258005 - DNA, 75 bp, Artificial Sequence
  Synthetic
taagtattgctgaaatctcaaatacattattcggggagttcagaatagtaccactcttggttgagattctgaagg

SEQ ID NO: 258006 - DNA, 75 bp, Artificial Sequence
  Synthetic
attattcggggagttcagaatagtaccactcttggttgagattctgaaggatgaggggcgatcagacacaagatc

SEQ ID NO: 258007 - DNA, 75 bp, Artificial Sequence
  Synthetic
ccaaactctttgccccaaactctcccacaccccttaactcacaatcccacacaacaaaaccaagaaaagcccccc

SEQ ID NO: 258008 - DNA, 75 bp, Artificial Sequence
  Synthetic
aaccgactaccgacagaagctggagcaatacgcgcaaagttggccttgaataggaacaatatagatacatcatgg

SEQ ID NO: 258009 - DNA, 75 bp, Artificial Sequence
  Synthetic
caatacgcgcaaagttggccttgaataggaacaatatagatacatcatggcatgatgtcttacctgtagcatatt

SEQ ID NO: 258010 - DNA, 75 bp, Artificial Sequence
  Synthetic
tatactcacaatgtaatattatctggctgcagggatcactcacactcacatcaatatttagcattaggtgtactt

SEQ ID NO: 258011 - DNA, 75 bp, Artificial Sequence
  Synthetic
cacaggcacaactcggtccactaaaaatccattcagagcccaagacattagaaaaaaatacgggtagaagggagg

SEQ ID NO: 258012 - DNA, 75 bp, Artificial Sequence
  Synthetic
ctccgggcccgaaagggcggagcaccagattatcctacccgaatctcacttgtcttccccacttgtcaagcacaa

SEQ ID NO: 258013 - DNA, 75 bp, Artificial Sequence
  Synthetic
tcttgcagtgtgagtgcgactcctttaggttgtgatatgctgtgttctaaagtcacagagaccgaggaagaggat

SEQ ID NO: 258014 - DNA, 75 bp, Artificial Sequence
  Synthetic
ttatacttcgattctgccttaccatcaagtagccttcttgcctttccaatcgtccttcaggacacaggagatggg

SEQ ID NO: 258015 - DNA, 75 bp, Artificial Sequence
  Synthetic
ttgacagcataattacggctcagggtaagtcagcagagaccgtcggaagaagcgcaatcccacaaggcaagacca

SEQ ID NO: 258016 - DNA, 75 bp, Artificial Sequence
  Synthetic
cagattatcctacccgaatctcacttgtcttccccacttgtcaagcacaagttgctgtactattggaaactaact

SEQ ID NO: 258017 - DNA, 75 bp, Artificial Sequence
  Synthetic
ggcaccagaattaaggacggtaacctcaaataagttcatgtatgatcctagccctatatcagagagagattttgc

SEQ ID NO: 258018 - DNA, 75 bp, Artificial Sequence
  Synthetic
tcaactccagatgtcgaaagaatgataagattaggccgctcagtacatcagacactcaatcactcctcaaaactc

SEQ ID NO: 258019 - DNA, 75 bp, Artificial Sequence
  Synthetic
atcaccacatacggattcatcttccaggtcgggagtgaggaaacttctgtggggatgataaatgacaacccgaga

SEQ ID NO: 258020 - DNA, 75 bp, Artificial Sequence
  Synthetic
gacaccacagtcttatttaaagattgggtggcaaactacccgggagtgggaggtgggtccttcattgacgaccgt

SEQ ID NO: 258021 - DNA, 75 bp, Artificial Sequence
  Synthetic
taagattaggccgctcagtacatcagacactcaatcactcctcaaaactcactggaatattgcatcctaggtgcc

SEQ ID NO: 258022 - DNA, 75 bp, Artificial Sequence
  Synthetic
atccgagcaggtgaccccacacaacaccctgctggtcacacccaccgaaccgccccccactcaggccacaggtga

SEQ ID NO: 258023 - DNA, 75 bp, Artificial Sequence
  Synthetic
gggagatcttgtggagctggcaagggcttgtctggctatggtggtgacatgcaaaaagagtgccacgaatacaga

SEQ ID NO: 258024 - DNA, 75 bp, Artificial Sequence
  Synthetic
ataatacgagatacggggagctattcactaaactttgcgcttatgttgaaaggaaactgctaggttctgcctggt

SEQ ID NO: 258025 - DNA, 75 bp, Artificial Sequence
  Synthetic
ctgacgctagcagattatgcccggaacagaagctggtcacccctgacagggggcaggaaaatactgggtgtatcc

SEQ ID NO: 258026 - DNA, 75 bp, Artificial Sequence
  Synthetic
gaggcacaccattgctaaatacaatcctttcaagaaataagctgcatcccgaaaactgtgatcaacctgctctcc

SEQ ID NO: 258027 - DNA, 75 bp, Artificial Sequence
  Synthetic
gaaaactgtgatcaacctgctctcctgaattaccatgatactagataatgatctatcctgattgcttgtagctag

SEQ ID NO: 258028 - DNA, 75 bp, Artificial Sequence
  Synthetic
gtgctgactattccgcctaatacgattacactcatgggggctgaaggcagagttctcacggtggggacatctcac

SEQ ID NO: 258029 - DNA, 75 bp, Artificial Sequence
  Synthetic
caactgcgaaatttgcatggctccacgtgaagcagatccaaagacatttgattgttgctgcacggacaaggtctg

SEQ ID NO: 258030 - DNA, 75 bp, Artificial Sequence
  Synthetic
acagaagctggtcacccctgacagggggcaggaaaatactgggtgtatccaaccctgataccatagaacttgtgg

SEQ ID NO: 258031 - DNA, 75 bp, Artificial Sequence
  Synthetic
cctgtcgagccacggaagcaaccaggaaaggccgcagcaacaggccaaggccgtccctggaagccggggcacaga

SEQ ID NO: 258032 - DNA, 75 bp, Artificial Sequence
  Synthetic
ttccaagcaatatagagctgactgatgacaccagcaaaaatcccccgatgagagtgccatatctcgggtcgaaga

SEQ ID NO: 258033 - DNA, 75 bp, Artificial Sequence
  Synthetic
tgggctccaaaccttctaccaggatcctagtacctctgacgctgatcactaggattatgctgatactaagctgta

SEQ ID NO: 258034 - DNA, 75 bp, Artificial Sequence
  Synthetic
gcacctgtggatcatgtccagctacctgtcgactttgtgcaggcgatgatgtctatgatggaggcattatcacag

SEQ ID NO: 258035 - DNA, 75 bp, Artificial Sequence
  Synthetic
cagcgcttaaggtgtctggatcaagtctctataatcttgcactaaatgtcaccattgatgtggaggtagatcaca

SEQ ID NO: 258036 - DNA, 75 bp, Artificial Sequence
  Synthetic
cctcacgcaggaacttgtgttgatgtatgcagatatgatggaggggagagacatggtcaacataatctcgtcaac

SEQ ID NO: 258037 - DNA, 75 bp, Artificial Sequence
  Synthetic
cgtgaagcagatccaaagacatttgattgttgctgcacggacaaggtctgctgcaggtaagcttgtgacgttatc

SEQ ID NO: 258038 - DNA, 75 bp, Artificial Sequence
  Synthetic
ccataggaatcataccttacgaggggtcttcgggacaatgttagatgatgtacaagcaagactcaaccccgtatc

SEQ ID NO: 258039 - DNA, 75 bp, Artificial Sequence
  Synthetic
aaaggtgacatttgacaagttggaaagaaaactccggaggctcgatctgtctgtagggctcagtgatgtacttgg

SEQ ID NO: 258040 - DNA, 75 bp, Artificial Sequence
  Synthetic
gggtaatcaagtatacgacgttgtggcattgatggagggcttcgcatacggtgctgtgcagctcctagaaccgtc

SEQ ID NO: 258041 - DNA, 75 bp, Artificial Sequence
  Synthetic
tagcgaggatgccaacaaaccacttaggcaaggtgctctcatatctctcttatgttcccactctcaggtgatgag

SEQ ID NO: 258042 - DNA, 75 bp, Artificial Sequence
  Synthetic
gcattgatggagggcttcgcatacggtgctgtgcagctcctagaaccgtcaggtacttttgctggcgacttcttc

SEQ ID NO: 258043 - DNA, 75 bp, Artificial Sequence
  Synthetic
agttttaatttcaggccctggagacccatctccctacgtgacacaagggggcgaaatggcgctcaataaactatc

SEQ ID NO: 258044 - DNA, 75 bp, Artificial Sequence
  Synthetic
atgctacccaattgccaatgcatcccctcaggtggcaaagatactgtggagtcaaacagcgagcctgcgcagcgt

SEQ ID NO: 258045 - DNA, 75 bp, Artificial Sequence
  Synthetic
gtctcccaacataattacgttcccagccaatctatattacatgtctaggaagagccttaatttaatcagagaacg

SEQ ID NO: 258046 - DNA, 75 bp, Artificial Sequence
  Synthetic
accaacaaagtttattgtcttagcattgcggaaatatctaataccctgtttggggaatttaggatcgttccttta

SEQ ID NO: 258047 - DNA, 75 bp, Artificial Sequence
  Synthetic
gcgattgccgacatattctccggtcttgaacagaatcaggcagcagagatgttatgtctgctacggttatggggc

SEQ ID NO: 258048 - DNA, 75 bp, Artificial Sequence
  Synthetic
ttgaacagaatcaggcagcagagatgttatgtctgctacggttatggggccacccactgttggagtcgcgagctg

SEQ ID NO: 258049 - DNA, 75 bp, Artificial Sequence
  Synthetic
ggaaaaagggcacactattgccaaatacaacccgttcaaaaagtaagtactcgctgcaactgacactacaaagaa

SEQ ID NO: 258050 - DNA, 75 bp, Artificial Sequence
  Synthetic
agagatagtgttgcaccgactaactctcacgatgccaaaggtcaagctacatactagaacgagcccggatcccat

SEQ ID NO: 258051 - DNA, 75 bp, Artificial Sequence
  Synthetic
atactagaacgagcccggatcccatgctgccaggtagtcacaatccgacgttattgacgtgattagtctgggttt

SEQ ID NO: 258052 - DNA, 75 bp, Artificial Sequence
  Synthetic
tcaagtataataattaaacctttaaagataggttgattcgtaatagcattagaaaaaacacgggtagaaggtatg

SEQ ID NO: 258053 - DNA, 75 bp, Artificial Sequence
  Synthetic
gttgattgccatcacagcttacaacaagatcctgcctctccagcgtcacacagaatccttctaggggccccttta

SEQ ID NO: 258054 - DNA, 75 bp, Artificial Sequence
  Synthetic
tctttaaggggactatcatcaacgggtacagaaagaagaatgctggcgtctggcctagagtcaaagtgcatacca

SEQ ID NO: 258055 - DNA, 75 bp, Artificial Sequence
  Synthetic
gtacagaaagaagaatgctggcgtctggcctagagtcaaagtgcataccatctatgggaaggtaattgctcagct

SEQ ID NO: 258056 - DNA, 75 bp, Artificial Sequence
  Synthetic
ggtggcaatgtggactacttgttaactaagttaggtgtaggaaacaatcaactcagctcattaatcggtagtggc

SEQ ID NO: 258057 - DNA, 75 bp, Artificial Sequence
  Synthetic
caatcaatctaacagcattagagattaagaaaaaatacgggtagaatcgaagtgccccgactgcaccgaaatgga

SEQ ID NO: 258058 - DNA, 75 bp, Artificial Sequence
  Synthetic
atctccgtagctatcagttcagtattcatggctgggaaagcatcagcattggatgggcgaccgctcgctgccgca

SEQ ID NO: 258059 - DNA, 75 bp, Artificial Sequence
  Synthetic
atcttgcattgagtatgaccctgttactaatttgagcatgttcttgaaagataaggcaattgcacatccaagaga

SEQ ID NO: 258060 - DNA, 75 bp, Artificial Sequence
  Synthetic
acacacgaaattggattagtgaggcgcagaactcagatgtggtccgcctgtttgagtatgcagcactcgaagtgc

SEQ ID NO: 258061 - DNA, 75 bp, Artificial Sequence
  Synthetic
actaatttgagcatgttcttgaaagataaggcaattgcacatccaagagacaactggcttgcatccttcaggaga

SEQ ID NO: 258062 - DNA, 75 bp, Artificial Sequence
  Synthetic
gacagggacaattatcatcaaactattaccaaatatgcccaaagacaaagaacaatgtgctaagagccccttaga

SEQ ID NO: 258063 - DNA, 75 bp, Artificial Sequence
  Synthetic
tttgagtatgcagcactcgaagtgctccttgactgtgcttatcaactctactatctgagggtaaggggtctaaac

SEQ ID NO: 258064 - DNA, 75 bp, Artificial Sequence
  Synthetic
gagtcgaacgatttcgacccctataaggagatggagtacttaacaactctcgagtacctgagagatgacagcgtg

SEQ ID NO: 258065 - DNA, 75 bp, Artificial Sequence
  Synthetic
tatataagaacatgccagggatcctactctccaatattgcggccacgatatcccaccccatcattcactcaaggt

SEQ ID NO: 258066 - DNA, 75 bp, Artificial Sequence
  Synthetic
aggagatggagtacttaacaactctcgagtacctgagagatgacagcgtggcagtctcatactcattgaaagaga

SEQ ID NO: 258067 - DNA, 75 bp, Artificial Sequence
  Synthetic
gtgtcgcattaggtgtagccaccgcagcgcaaatcacagcggcttctgccctcatacaagccaaccagaacgctg

SEQ ID NO: 258068 - DNA, 75 bp, Artificial Sequence
  Synthetic
gaattcttgcagatcagattgcccctttcttccaagggaatggagtgatccaagatagtatctctctgactaaga

SEQ ID NO: 258069 - DNA, 75 bp, Artificial Sequence
  Synthetic
tttcttccaagggaatggagtgatccaagatagtatctctctgactaagagtatgttagctatgagccaactatc

SEQ ID NO: 258070 - DNA, 75 bp, Artificial Sequence
  Synthetic
agctagctgttgccgtaggtaagatgcagcagtttgtaaatgagcaattcaataagacagcacaagagatcgact

SEQ ID NO: 258071 - DNA, 75 bp, Artificial Sequence
  Synthetic
aataagacagcacaagagatcgactgtattaagatcacacaacagattggggtggagttgaatctatacttgacc

SEQ ID NO: 258072 - DNA, 75 bp, Artificial Sequence; identical to SEQ ID NO: 96145
  Synthetic

SEQ ID NO: 258073 - DNA, 75 bp, Artificial Sequence
  Synthetic
aaaacatcggcggagggtcgccacgttcatcaccaccgatctacagaagtactgtctgaactggcgatatcaaac

SEQ ID NO: 258074 - DNA, 75 bp, Artificial Sequence
  Synthetic
ttcatcaccaccgatctacagaagtactgtctgaactggcgatatcaaactgtaaaattatttgctcatgcaatc

SEQ ID NO: 258075 - DNA, 75 bp, Artificial Sequence
  Synthetic
aaatcacatctcctgcacttacgcagttaaccatccaggctttatataatctggcgggtgggaacatggattaca

SEQ ID NO: 258076 - DNA, 75 bp, Artificial Sequence
  Synthetic
caacagcaagctagacaaggtcaatgtcagactaatcagcacatctgctctcattacctatattgttctaacagt

SEQ ID NO: 258077 - DNA, 75 bp, Artificial Sequence
  Synthetic
tcaacataatatcttctacagcaacacacctcagagacctaacagagaaaatcgatgatattctgcggttagtgg

SEQ ID NO: 258078 - DNA, 75 bp, Artificial Sequence
  Synthetic
cgactgggggtactgaccaacagcacccagcctgcctatatgaaaccattccaacccttccgtctgcacctcacc

SEQ ID NO: 258079 - DNA, 75 bp, Artificial Sequence
  Synthetic
gacccctttaatcctccgagcgacccgactgattgtgacctcacaagagttccgaatgatgacatatacatcgtc

SEQ ID NO: 258080 - DNA, 75 bp, Artificial Sequence
  Synthetic
tgtcattgttgttccctcaggaaccactgcttgagcttcgcccagtacgagacattggtgctcgagtgaaagacc

SEQ ID NO: 258081 - DNA, 75 bp, Artificial Sequence
  Synthetic
gaacgagaggacagagatactatcttgtcattgttgttccctcaggaaccactgcttgagcttcgcccagtacga

SEQ ID NO: 258082 - DNA, 75 bp, Artificial Sequence
  Synthetic
gaccctactgtggcttgggaataataccctcgatcaaatgagaaccactacaagagtatgaacacagaaaggaga

SEQ ID NO: 258083 - DNA, 75 bp, Artificial Sequence
  Synthetic
accctcgatcaaatgagaaccactacaagagtatgaacacagaaaggagacgtatgcctacccaacagcagctcg

SEQ ID NO: 258084 - DNA, 75 bp, Artificial Sequence
  Synthetic
aagccgcggaaacagccaagagagaccgcagaaccaggtcaaggccatccctggaaaccaggtcacagacgcgaa

SEQ ID NO: 258085 - DNA, 75 bp, Artificial Sequence
  Synthetic
catgtatggtacaaggggacaatcaagtcatagctgtcacaagagaggttcgaccggatgattccccagaatctg

SEQ ID NO: 258086 - DNA, 75 bp, Artificial Sequence
  Synthetic
cgactgattgtgacctcacaagagttccgaatgatgacatatacatcgtcagtgcgagagggggaattgaggggc

SEQ ID NO: 258087 - DNA, 75 bp, Artificial Sequence
  Synthetic
agtacgggtagaagggagtcattcaggggtcagggcgagtcacccgggtctccgctctcccttctacctagtgga

SEQ ID NO: 258088 - DNA, 75 bp, Artificial Sequence
  Synthetic
agtcatagctgtcacaagagaggttcgaccggatgattccccagaatctgtcctaactcagcttcacgaggctag

SEQ ID NO: 258089 - DNA, 75 bp, Artificial Sequence
  Synthetic
cacgggtagaacggtcagagaagccgctcttcacttgaaaactaggcttcctaactctcgttctaccgtatcacc

SEQ ID NO: 258090 - DNA, 75 bp, Artificial Sequence
  Synthetic
ccgcgcacctgcggagtgtgaaagtcatcattcaagctggcacccagcgtgctgtcgcagtaaccgctgatcatg

SEQ ID NO: 258091 - DNA, 75 bp, Artificial Sequence
  Synthetic
atcagatactttcttcatctacagtaagaggatcttcaaagatggcgccatactaagccaagtactcaagaattc

SEQ ID NO: 258092 - DNA, 75 bp, Artificial Sequence
  Synthetic
gtataattactgcccaaggaaaaccagtagagactgtcggaaggagtgcaatcccacaaggcaaaaccaaggctt

SEQ ID NO: 258093 - DNA, 75 bp, Artificial Sequence
  Synthetic
aagaggatcttcaaagatggcgccatactaagccaagtactcaagaattcttcgaaattggtgctagtgtcagga

SEQ ID NO: 258094 - DNA, 75 bp, Artificial Sequence
  Synthetic
catggcgtttgattttccggatcgcggtcttacttctaatgataatgactttagctatctctacagctgccctgg

SEQ ID NO: 258095 - DNA, 75 bp, Artificial Sequence
  Synthetic
cctttcaggaaataagttgcgtccgtaagactgtgattcacctgctttcctgaatcattatgacgctggataatg

SEQ ID NO: 258096 - DNA, 75 bp, Artificial Sequence
  Synthetic
gagcatccagtctccagccagccaggacacctccgatcgacaggatagaccagacaaaccgctgtccacacccga

SEQ ID NO: 258097 - DNA, 75 bp, Artificial Sequence
  Synthetic
ggtcttacttctaatgataatgactttagctatctctacagctgccctggtacacaccatgggggctagcacacc

SEQ ID NO: 258098 - DNA, 75 bp, Artificial Sequence
  Synthetic
ccgaaagacttttgttattaccttaactatctaatgagctgcatccaaacatattttgactctgagttttcaatc

SEQ ID NO: 258099 - DNA, 75 bp, Artificial Sequence
  Synthetic
tatggagagagaatgcagaagaaagtgacctgacctcagataaggcagttggatatatcacatctgtggtaccct

SEQ ID NO: 258100 - DNA, 75 bp, Artificial Sequence
  Synthetic
cgactagcacatgcaagacgcaatatgggctccaaaccttctaccaggatcccagtacccctgatgctgatcact

SEQ ID NO: 258101 - DNA, 75 bp, Artificial Sequence
  Synthetic
ctaagcatgttcctaaaagacaaggcaatcgcacacccaaaagataactggcttgcctcatttagacggaacctt

SEQ ID NO: 258102 - DNA, 75 bp, Artificial Sequence
  Synthetic
actatctaatgagctgcatccaaacatattttgactctgagttttcaatcactaattctgcgcagtccagctcta

SEQ ID NO: 258103 - DNA, 75 bp, Artificial Sequence
  Synthetic
taaattctgatcctttgaagttcgtactcggactcaggcaattgtcttaaagcagaagtgaacgtaattatcctt

SEQ ID NO: 258104 - DNA, 75 bp, Artificial Sequence
  Synthetic
accttcagtattcaagactctacaccagaaacatcggggaccctgggacgacagcattcgctgaggtaaaaagac

SEQ ID NO: 258105 - DNA, 75 bp, Artificial Sequence
  Synthetic
cagaaacatcggggaccctgggacgacagcattcgctgaggtaaaaagactcgaagcagtaggtcttctgagtcc

SEQ ID NO: 258106 - DNA, 75 bp, Artificial Sequence
  Synthetic
gcaaaaaacactgctgtggcttgggaacaacaccttggaccagatgagagcaacgacaaagatgtaaaatcccat

SEQ ID NO: 258107 - DNA, 75 bp, Artificial Sequence
  Synthetic
cgacatgagcactactcactactgctatactcacaatgtgataatgtctggttgcagagatcactcacattcaca

SEQ ID NO: 258108 - DNA, 75 bp, Artificial Sequence
  Synthetic
attcaacttcgaaacagtagccagcccaaatattgtcctcaagaagcatacacagcgagtcttattcgagacatg

SEQ ID NO: 258109 - DNA, 75 bp, Artificial Sequence
  Synthetic
aagtggtaaggatggcaaaaactctaatacaacgacacggtacacttctatctaaatcagatgaaattacattga

SEQ ID NO: 258110 - DNA, 75 bp, Artificial Sequence
  Synthetic
aatacaacgacacggtacacttctatctaaatcagatgaaattacattgactaagctatttacctcacagcagcg

SEQ ID NO: 258111 - DNA, 75 bp, Artificial Sequence
  Synthetic
tatactcacaatgtgataatgtctggttgcagagatcactcacattcacatcaatacttagcacttggtgtgctc

SEQ ID NO: 258112 - DNA, 75 bp, Artificial Sequence
  Synthetic
ctaagctatttacctcacagcagcgtcgtgtaacagatatcctatccagccctttaccgaagctaatgaagctct

SEQ ID NO: 258113 - DNA, 75 bp, Artificial Sequence
  Synthetic
tggcggaggagagaaagggagcaccttaaaggtagaagttccggttttcactcttaacagtgatgacccagaaga

SEQ ID NO: 258114 - DNA, 75 bp, Artificial Sequence
  Synthetic
gtagcccatgcaattatggaggcaagctcagtggggaggaggaagcaaattcaggggttggtggatacaactaac

SEQ ID NO: 258115 - DNA, 75 bp, Artificial Sequence
  Synthetic
ccaaatattgtcctcaagaagcatacacagcgagtcttattcgagacatgttcaaatccactgctatccggggtc

SEQ ID NO: 258116 - DNA, 75 bp, Artificial Sequence
  Synthetic
gctcagtggggaggaggaagcaaattcaggggttggtggatacaactaacacagtcataaagattgccttatcta

SEQ ID NO: 258117 - DNA, 75 bp, Artificial Sequence
  Synthetic
ctcgagaatgatgaaagggaggcaaaaaacacatggaggttggtgttcagagtgactgttctttttctcattata

SEQ ID NO: 258118 - DNA, 75 bp, Artificial Sequence
  Synthetic
aggttcctgtctccccagcgtcacacaaaatccttctaggggcctccccaataaacccacactctaacactccga

SEQ ID NO: 258119 - DNA, 75 bp, Artificial Sequence
  Synthetic
aaaacacatggaggttggtgttcagagtgactgttctttttctcattatagtgactcttgctatctccgcagcca

SEQ ID NO: 258120 - DNA, 75 bp, Artificial Sequence
  Synthetic
gacaccacagtcttatttaaggattgggtggcaaattacccaggggtaggaggtgggtctttcattaacgaccgt

SEQ ID NO: 258121 - DNA, 75 bp, Artificial Sequence
  Synthetic
atgttttcttgtctaatagggccaatcatccgttagtctcatcggatatgtgttctctaacactggcagactatg

SEQ ID NO: 258122 - DNA, 75 bp, Artificial Sequence
  Synthetic
gtttgttaatgaccagtttaataatacagcacgagaattggactgtataaaaattacacaacaggttggcgtgga

SEQ ID NO: 258123 - DNA, 75 bp, Artificial Sequence
  Synthetic
tcatccgttagtctcatcggatatgtgttctctaacactggcagactatgcaaggaaccggagctggtcgccgtt

SEQ ID NO: 258124 - DNA, 75 bp, Artificial Sequence
  Synthetic
ataaaattacctctgcttttggagtgagccaggacgtaatagacaggatatataaacaagtggcattagagttgc

SEQ ID NO: 258125 - DNA, 75 bp, Artificial Sequence
  Synthetic
tatccaggcactttataatttagctggcggcaatgtggactatttgttaactaagttaggtgtggggaacaatca

SEQ ID NO: 258126 - DNA, 75 bp, Artificial Sequence
  Synthetic
cgccgacacagtgttcttatttactccttacaatctatccacagacggaaaaaagagaacatcacttaagcagtg

SEQ ID NO: 258127 - DNA, 75 bp, Artificial Sequence
  Synthetic
ccgatgaccaagattaccaaatccggatggccaagtcctcatataaaccggggcggtttggtgggaagcgcgtac

SEQ ID NO: 258128 - DNA, 75 bp, Artificial Sequence
  Synthetic
cagcggaggctgtacgagatgcgatagcggggatgagcagttcacatggttccaccttccaagcaacattgaatt

SEQ ID NO: 258129 - DNA, 75 bp, Artificial Sequence
  Synthetic
agcggggatgagcagttcacatggttccaccttccaagcaacattgaattgacagatgacacaagcaagaatcct

SEQ ID NO: 258130 - DNA, 75 bp, Artificial Sequence
  Synthetic
tttagtactcagaggtgcggtttccctagaggacctcatcccattaaggacatacctgaagcgcagtacctgccc

SEQ ID NO: 258131 - DNA, 75 bp, Artificial Sequence
  Synthetic
attactaaactcaaagaaatgttcacagatacctcgttactgtacttgactcgtgctcaacaaaaattctacatg

SEQ ID NO: 258132 - DNA, 75 bp, Artificial Sequence
  Synthetic
ctgccaacctaacaccacacggtatccgcaccaagctcctctctgcaagcccaaggtccaacacctcaagtgaca

SEQ ID NO: 258133 - DNA, 75 bp, Artificial Sequence
  Synthetic
ctactctgctctgtaacgttcagcgtgggagatgtcccgaaggacggagatcttgttgagctggcaagagcctgc

SEQ ID NO: 258134 - DNA, 75 bp, Artificial Sequence
  Synthetic
aaaaccataggtaatgctgccaagggatattacagtaataatgactcttaaaggcaatcgtacgccaatcagtta

SEQ ID NO: 258135 - DNA, 75 bp, Artificial Sequence
  Synthetic
caggatccggctgtactcgaatcccatcttttgacataggtgtcactcattattgctatacacacaatgtcatct

SEQ ID NO: 258136 - DNA, 75 bp, Artificial Sequence
  Synthetic
tcacctcatgtcaaagcagcactcagagcctcctcagtactaatctgggcatacggagacaatgacaccaactgg

SEQ ID NO: 258137 - DNA, 75 bp, Artificial Sequence
  Synthetic
gatgattctccggatacagtgttaacacagttgcatcaagccagtgagaatttcttcaaagaattgattcatgtc

SEQ ID NO: 258138 - DNA, 75 bp, Artificial Sequence
  Synthetic
gatattacagtaataatgactcttaaaggcaatcgtacgccaatcagttatcttcctaactgatgactccctcac

SEQ ID NO: 258139 - DNA, 75 bp, Artificial Sequence
  Synthetic
tgggagatgtcccgaaggacggagatcttgttgagctggcaagagcctgcctcactatggtggtaacctgcaaga

SEQ ID NO: 258140 - DNA, 75 bp, Artificial Sequence
  Synthetic
gttttaaggacttcagcaactggtagagtgttcttttcaacccttcgctcaattaatctagatgatactcagaac

SEQ ID NO: 258141 - DNA, 75 bp, Artificial Sequence
  Synthetic
gagtgttcttttcaacccttcgctcaattaatctagatgatactcagaacaggaagtcatgtagtgtaagtgcaa

SEQ ID NO: 258142 - DNA, 75 bp, Artificial Sequence
  Synthetic
tggctaataattactcattggtgcatacagtgaaatatgtgatatcaccagaaaagctccctgggagcggaacct

SEQ ID NO: 258143 - DNA, 75 bp, Artificial Sequence
  Synthetic
ctcgtattcggattcagttagttaactttaagcaagagtgcgcaaagtcgtccctaattatagttatgtcattca

SEQ ID NO: 258144 - DNA, 75 bp, Artificial Sequence
  Synthetic
ttgatgatggtatcactcaaatgacgttcactcctgcttcgttatacagggtctctccatatgtccacatatcaa

SEQ ID NO: 258145 - DNA, 75 bp, Artificial Sequence
  Synthetic
cctgactgtgacaccgtacatagatcactacaacataccaactgcagtattgaaagtatccggttcaagcccata

SEQ ID NO: 258146 - DNA, 75 bp, Artificial Sequence
  Synthetic
gatttctgttactatttgaattacctaatgagctgcatacagacatacttcgattctgagttttctattactcac

SEQ ID NO: 258147 - DNA, 75 bp, Artificial Sequence
  Synthetic
tctacccttccttctagcaacctgctagcattcccgatcgtcctacaagatacaggagatgggaagaagcaaatc

SEQ ID NO: 258148 - DNA, 75 bp, Artificial Sequence
  Synthetic
ccccatgaccgttacaaagacatacgatgagatcacccttcacctccatagcaagttcagctgctgtatccgaga

SEQ ID NO: 258149 - DNA, 75 bp, Artificial Sequence
  Synthetic
cctaattcatgtatcactggagtctatactgatccatatcctttagtcttccataagaatcataccctacgaggg

SEQ ID NO: 258150 - DNA, 75 bp, Artificial Sequence
  Synthetic
gttcactcctgcttcgttatacagggtctctccatatgtccacatatcaaatgactcccagagactgtttactga

SEQ ID NO: 258151 - DNA, 75 bp, Artificial Sequence
  Synthetic
gatgagatcacccttcacctccatagcaagttcagctgctgtatccgagaagcaccagtggccgtcccatttgag

SEQ ID NO: 258152 - DNA, 75 bp, Artificial Sequence
  Synthetic
ggagaggcctggcagctgctgcccaacgagtgtctgaggacactagtagcatagacatgcccactcaacaagtcg

SEQ ID NO: 258153 - DNA, 75 bp, Artificial Sequence
  Synthetic
ggggacttcgctagattagaccttgcaatatttaagagttacgaattaaatctggaatcatattccacaatggaa

SEQ ID NO: 258154 - DNA, 75 bp, Artificial Sequence
  Synthetic
ctcgcattgctggaggtcaagctgaatgtcaacataagcccggatcctatgaggacgggcagccacagtctgaca

SEQ ID NO: 258155 - DNA, 75 bp, Artificial Sequence
  Synthetic
atgtcaacataagcccggatcctatgaggacgggcagccacagtctgacaatgctggcacgattagtccgaattc

SEQ ID NO: 258156 - DNA, 75 bp, Artificial Sequence
  Synthetic
tgtataaacaaaaagcacaacaaaagaccttactatggcttggaaataatactcttagtcagatgagagccacca

SEQ ID NO: 258157 - DNA, 75 bp, Artificial Sequence
  Synthetic
caatatttaagagttacgaattaaatctggaatcatattccacaatggaactgatgaacattctttccatatcta

SEQ ID NO: 258158 - DNA, 75 bp, Artificial Sequence
  Synthetic
aggtgtatcaactacccttgcagatgatccagtattaactgtgacttccaataccatcactctcatgggcgcgga

SEQ ID NO: 258159 - DNA, 75 bp, Artificial Sequence
  Synthetic
acgacaacacccgcaattggataagtgaagctcagaactcagacgttgtccggctatttgagtatgcagccctag

SEQ ID NO: 258160 - DNA, 75 bp, Artificial Sequence
  Synthetic
acgggtaggacatggcaggctccagccctgaaagagcagagcaccagatcatcctaccagagtcacacttgtctt

SEQ ID NO: 258161 - DNA, 75 bp, Artificial Sequence
  Synthetic
tgaagctcagaactcagacgttgtccggctatttgagtatgcagccctagaggtcttgcttgattgttcttacca

SEQ ID NO: 258162 - DNA, 75 bp, Artificial Sequence
  Synthetic
attgattgtcaaatctcaactcgcttctataaaatcatctcaactctctcatctgcagctgaccccccgattcac

SEQ ID NO: 258163 - DNA, 75 bp, Artificial Sequence
  Synthetic
aatatgcctaaagataagggggcgtgtgcaaaaccccctttagagggatgcaacagcaccctgacacccttgctc

SEQ ID NO: 258164 - DNA, 75 bp, Artificial Sequence
  Synthetic
ctactactggaaattaactgggttaccgcttcctgatgaatgcgaatatgatcatctcattatcagtaggcaatg

SEQ ID NO: 258165 - DNA, 75 bp, Artificial Sequence
  Synthetic
catcctactatccaatattgccgctactatatctcacccaatcatacactcgcgtttacatgcagtgggactgat

SEQ ID NO: 258166 - DNA, 75 bp, Artificial Sequence
  Synthetic
agcagatgagtcggaaacaagaagaatcaataagtatatgcagcaaggcagagtccaaaagaaatacattctcca

SEQ ID NO: 258167 - DNA, 75 bp, Artificial Sequence
  Synthetic
caagacaacacaggcacaacatgacccaccaacaatccacacagagccaattaaattagaaaaaagtacgggtag

SEQ ID NO: 258168 - DNA, 75 bp, Artificial Sequence
  Synthetic
agtatttcacaagaatcacacactgcgaggagtgtttggtacaatgttggatgacgtacaagccaggttgaatcc

SEQ ID NO: 258169 - DNA, 75 bp, Artificial Sequence
  Synthetic
actatatctcacccaatcatacactcgcgtttacatgcagtgggactgataagccatgatgggtcgcaccaactt

SEQ ID NO: 258170 - DNA, 75 bp, Artificial Sequence
  Synthetic
ttagctatctctatagccgtcctggtatatatcatgggggccagcacgccgcgtgacctcgcaggtatatcggct

SEQ ID NO: 258171 - DNA, 75 bp, Artificial Sequence
  Synthetic
gcaggtaataaatatgatttgcttttcccttctgttctggacgacaatctgaatgagaagatgttacagctgata

SEQ ID NO: 258172 - DNA, 75 bp, Artificial Sequence
  Synthetic
taatctcgcgctcaatgtcactattgatgtggaggtagacccgaagagcccactagtcaaatccctttctaagtc

SEQ ID NO: 258173 - DNA, 75 bp, Artificial Sequence
  Synthetic
gtgaagacagggagagtatactgtctaagtattgctgaaatctctaatacactattcggggagtttagaatagta

SEQ ID NO: 258174 - DNA, 75 bp, Artificial Sequence
  Synthetic
gcagtgaccgccgaccacgaggttacttccaccaagctagagaaggggcacactattgccaaatacaatcccttc

SEQ ID NO: 258175 - DNA, 75 bp, Artificial Sequence
  Synthetic
taagtattgctgaaatctctaatacactattcggggagtttagaatagtaccgctactggttgagatcctaagag

SEQ ID NO: 258176 - DNA, 75 bp, Artificial Sequence
  Synthetic
aactgtcattgacagcataatcacagcccagggcaagccgatagagactgttggaaggagtgcaatcccgcaagg

SEQ ID NO: 258177 - DNA, 75 bp, Artificial Sequence
  Synthetic
tcccttctgttctggacgacaatctgaatgagaagatgttacagctgatatctcgactctgttgcttgtacacag

SEQ ID NO: 258178 - DNA, 75 bp, Artificial Sequence
  Synthetic
aatatcttttgtctgatgcagtgagaccactccttagcccagagcaggtggattcaatcacctctccaaacattg

SEQ ID NO: 258179 - DNA, 75 bp, Artificial Sequence
  Synthetic
accactccttagcccagagcaggtggattcaatcacctctccaaacattgtgacattcccagctaatctgtacta

SEQ ID NO: 258180 - DNA, 75 bp, Artificial Sequence
  Synthetic
caatcttctgcacagtgaccaaccaaactgaccataggcaaaagctagaggaatatgcacaaagctggccatgac

SEQ ID NO: 258181 - DNA, 75 bp, Artificial Sequence
  Synthetic
tcaacaggacagatccgataaacaaccgtccacacctgagcatgcgactctgcatgacagcccgccaaccacatc

SEQ ID NO: 258182 - DNA, 75 bp, Artificial Sequence
  Synthetic
acttatcaaaagaacatctcaatactagattctcaagtcatcgtgacaggcaatctcgatatatcaactgagctt

SEQ ID NO: 258183 - DNA, 75 bp, Artificial Sequence
  Synthetic
gcagatccagaggcatctaattgtagcagcaagaacaaggtccgcaatcaacaagctagtaacgttgactcatag

SEQ ID NO: 258184 - DNA, 75 bp, Artificial Sequence
  Synthetic
tgtagtattccactcatagcatattagaaaaaactatagccacagctgagataggcaaagatgagcaaaccagag

SEQ ID NO: 258185 - DNA, 75 bp, Artificial Sequence
  Synthetic
gagacttggggtggaatatgctcaggctcaggggagtagcatcaatgaggacatggctgctgagctaaaactaac

SEQ ID NO: 258186 - DNA, 75 bp, Artificial Sequence
  Synthetic
gctcaggggagtagcatcaatgaggacatggctgctgagctaaaactaaccccggcagcaaggagaggcctggca

SEQ ID NO: 258187 - DNA, 75 bp, Artificial Sequence
  Synthetic
ggaaccactgcttgaattcccaccaatccaggacatcggtgcacgtgtcaaggacccgttgacgagaaaacccgc

SEQ ID NO: 258188 - DNA, 75 bp, Artificial Sequence
  Synthetic
atccaggacatcggtgcacgtgtcaaggacccgttgacgagaaaacccgctgcgttcttgcatgagttagattta

SEQ ID NO: 258189 - DNA, 75 bp, Artificial Sequence
  Synthetic
tatcgtctccacttgtcaaacataagttactgtattattggaaactgaccggcctacccttaccagatgagtgtg

SEQ ID NO: 258190 - DNA, 75 bp, Artificial Sequence
  Synthetic
gatcatctagttcgatatctattcagaggggtagggacagcatcctcgtcttggtacaaggcgtctcacttgctc

SEQ ID NO: 258191 - DNA, 75 bp, Artificial Sequence
  Synthetic
gaggggtagggacagcatcctcgtcttggtacaaggcgtctcacttgctctccgtcccggagatcagatgtgctc

SEQ ID NO: 258192 - DNA, 75 bp, Artificial Sequence
  Synthetic
atcacattacacctccacagtaagtacagctgctgtatccgggaagcgcctgttgcggttcctttcgagctactt

SEQ ID NO: 258193 - DNA, 75 bp, Artificial Sequence
  Synthetic
cacgggtagaacggtcaggggagccacccttcaatcgaaaattaggcttcacaacatccgttctaccacatcacc

SEQ ID NO: 258194 - DNA, 75 bp, Artificial Sequence
  Synthetic
gctaccgtattctctggtctagaacagaatcaagcggctgagatgttgtgcttactacgtctgtggggtcaccca

SEQ ID NO: 258195 - DNA, 75 bp, Artificial Sequence
  Synthetic
tcccgattcaacaaacaagttcagaaggatagagaagaagattcagattcacaatacacggtatggggaactatt

SEQ ID NO: 258196 - DNA, 75 bp, Artificial Sequence
  Synthetic
agaccatatattataatacactcttttctaacgaaatgaaccccccgcagcgacactttggccccacaccaacac

SEQ ID NO: 258197 - DNA, 75 bp, Artificial Sequence
  Synthetic
tcaaatcttccgcccaaacccccccctcactccccgacccacattctcgcgcggccgagccaacaaaagtacccc

SEQ ID NO: 258198 - DNA, 75 bp, Artificial Sequence
  Synthetic
ggtctgaaatccagcagttaaaaacatctgttgcggtcatggaagccaatttgggtatgatgaagattctggacc

SEQ ID NO: 258199 - DNA, 75 bp, Artificial Sequence
  Synthetic
actcaacctatacctaactgaactgactacagtgttcgggccacaaatcacttcccctgccttaactcagctgac

SEQ ID NO: 258200 - DNA, 75 bp, Artificial Sequence
  Synthetic
agcagcctcggctttgatacaagccaatcaaaatgctgccaacatcctccggctcaaagagagcattgctgcaac

SEQ ID NO: 258201 - DNA, 75 bp, Artificial Sequence
  Synthetic
agagagcgacctgacatcagacaaagctgtagggtacatcacatccgtagtaccttatcggtcagtgtctctgct

SEQ ID NO: 258202 - DNA, 75 bp, Artificial Sequence
  Synthetic
ttctaacgaaatgaaccccccgcagcgacactttggccccacaccaacacagtttcttaattccgtggtatacag

SEQ ID NO: 258203 - DNA, 75 bp, Artificial Sequence
  Synthetic
gctgtagggtacatcacatccgtagtaccttatcggtcagtgtctctgcttcactgtgacattgaaatcccacca

SEQ ID NO: 258204 - DNA, 75 bp, Artificial Sequence
  Synthetic
agcaagccatcctatctatcaaagtatcaacatctttgggtgaggacccggtgctgactattccacctaatacaa

SEQ ID NO: 258205 - DNA, 75 bp, Artificial Sequence
  Synthetic
ggcgtggtgatcgtcaaaatattgtactctatgggctactacttccacttgcttgtgaacctttttaccccatgc

SEQ ID NO: 258206 - DNA, 75 bp, Artificial Sequence
  Synthetic
actctctaatattgcgactacaatatcccatcccatcattcactcaagattgaatgcagtaggcctgactaatca

SEQ ID NO: 258207 - DNA, 75 bp, Artificial Sequence
  Synthetic
actctatgggctactacttccacttgcttgtgaacctttttaccccatgctcagtcaaaggatacgttctatcca

SEQ ID NO: 258208 - DNA, 75 bp, Artificial Sequence
  Synthetic
gctcgcctcatttaggcggaaccttctctctgaggaccaaaagaaacaggtaaaggaggcgacttcaactaaccg

SEQ ID NO: 258209 - DNA, 75 bp, Artificial Sequence
  Synthetic
tatgcggatatgatggagggaagggacatggtgaatataatctcatcgactgcggtacatttgcgttgcttggcg

SEQ ID NO: 258210 - DNA, 75 bp, Artificial Sequence
  Synthetic
aaatcagaaaaatcaagcgccttgcacttaatggctaattaccaccacagcatatgataggtccccgcctactct

SEQ ID NO: 258211 - DNA, 75 bp, Artificial Sequence
  Synthetic
acatgggagcatccaaccatccgccagtcaggacaaccctgaccaacaggatggatcagacaaacagccatccac

SEQ ID NO: 258212 - DNA, 75 bp, Artificial Sequence
  Synthetic
ttaatgaagtagtacggatggcaaagaccctgatacagagacacgggacactgcttgccaagtcagatgaagcgg

SEQ ID NO: 258213 - DNA, 75 bp, Artificial Sequence
  Synthetic
gcatcacaaggaacctacaccaaacttctcgctgcaaacttaaggtccagcaatccaaatggcaatcatcccttg

SEQ ID NO: 258214 - DNA, 75 bp, Artificial Sequence
  Synthetic
gcactgatggagggcttcgcatatggtgccgtgcaacttttggaaccatcagggacctttgctggcgacttcttt

SEQ ID NO: 258215 - DNA, 75 bp, Artificial Sequence
  Synthetic
gaccctgatacagagacacgggacactgcttgccaagtcagatgaagcggctctgacaacattattcaactcgca

SEQ ID NO: 258216 - DNA, 75 bp, Artificial Sequence
  Synthetic
ttatgctgtctgttcacggtgctctttgctacaacaagagagatcccgaaaataagggggctatcggcggaagag

SEQ ID NO: 258217 - DNA, 75 bp, Artificial Sequence
  Synthetic
taagttaacaaagaagctgaggaactgccaggtgatggcagaagggattctagctgaccagattgcacctttctt

SEQ ID NO: 258218 - DNA, 75 bp, Artificial Sequence
  Synthetic
agtcaggacaaccctgaccaacaggatggatcagacaaacagccatccacatccaagcaggcgaccccacacaac

SEQ ID NO: 258219 - DNA, 75 bp, Artificial Sequence
  Synthetic
tgcattgattgaggccggagggcaacctgtgagaccgttctgcgccgaaagcttggtgaacacactttctgacat

SEQ ID NO: 258220 - DNA, 75 bp, Artificial Sequence
  Synthetic
ttacactcatgggggccgaaggcagaattctcacagtagggacatctcacttcttgtaccaacgagggtcttcat

SEQ ID NO: 258221 - DNA, 75 bp, Artificial Sequence
  Synthetic
cctgtgagaccgttctgcgccgaaagcttggtgaacacactttctgacatcacccagactacacaggtaattgct

SEQ ID NO: 258222 - DNA, 75 bp, Artificial Sequence
  Synthetic
ggagcaagcaactctctcctgtctatgctcgacaagctgagcaataaatcgtccaatgctaaaaagggcccacga

SEQ ID NO: 258223 - DNA, 75 bp, Artificial Sequence
  Synthetic
atcgtcttacaggacacaggagatggaaagaagcaaatcgccccgcaatataggatccagcgccttgactcgtgg

SEQ ID NO: 258224 - DNA, 75 bp, Artificial Sequence
  Synthetic
ggaaaattccagcaccaggccaaggccgcccctggaagccggggcacagacgtgaacacagcatatcatggacaa

SEQ ID NO: 258225 - DNA, 75 bp, Artificial Sequence
  Synthetic
ccgcccctggaagccggggcacagacgtgaacacagcatatcatggacaacagaaggagtcacaactatcagctg

SEQ ID NO: 258226 - DNA, 75 bp, Artificial Sequence
  Synthetic
tttacgccatacaatttatctactgacgggaagaagagaacgtcactaaagcaatgtacaaggcagatcctcgaa

SEQ ID NO: 258227 - DNA, 75 bp, Artificial Sequence
  Synthetic
aaggaacaataatcaatggatatagaaagaagaactcaggggtgtggccacttgtcaaagcagataccatatacg

SEQ ID NO: 258228 - DNA, 75 bp, Artificial Sequence
  Synthetic
gacatcggtgcgcgagtgaaagacccacttacccgacaacctgcaacattcatgcaggagctagatctgagtgct

SEQ ID NO: 258229 - DNA, 75 bp, Artificial Sequence
  Synthetic
gtgtgcacccaaaatggtagattttgatatgattctccaggtgctgtcattttttaaaggaaccatcattaacgg

SEQ ID NO: 258230 - DNA, 75 bp, Artificial Sequence
  Synthetic
tgatatctcaactgagcttgggaatgtcaacaactcgataagcaatgctttggataagttagaggaaagcaacag

SEQ ID NO: 258231 - DNA, 75 bp, Artificial Sequence
  Synthetic
gcatgccgactctgccgagatatctcatgacatcatgttgagagaatataagaatctgtctgcgattgaatttga

SEQ ID NO: 258232 - DNA, 75 bp, Artificial Sequence
  Synthetic
acgggaagaagagaacgtcactaaagcaatgtacaaggcagatcctcgaagtaactattcttggtctcggggcag

SEQ ID NO: 258233 - DNA, 75 bp, Artificial Sequence
  Synthetic
agaatctgtctgcgattgaatttgaggcttgtattgagtacgatcctgtcactaacttgagcatgtttctaaaag

SEQ ID NO: 258234 - DNA, 75 bp, Artificial Sequence
  Synthetic
tacgtacttacctcaaaaggagcacttgtcctaagtatctaaaatctgtgctgggtctgacaaaacttagagaga

SEQ ID NO: 258235 - DNA, 75 bp, Artificial Sequence
  Synthetic
acgggtaggacatggcgggctcgggtcctgaaagggcagagcaccagatcatcctaccagagtcacacctatcct

SEQ ID NO: 258236 - DNA, 75 bp, Artificial Sequence
  Synthetic
ttgtcctaagtatctaaaatctgtgctgggtctgacaaaacttagagagatgttctctgacggttccaagcttta

SEQ ID NO: 258237 - DNA, 75 bp, Artificial Sequence
  Synthetic
aaaatgtgcaggactccacatcaactaatcggctcctaatagaattcctagaatcaaatgattttgatccatata

SEQ ID NO: 258238 - DNA, 75 bp, Artificial Sequence
  Synthetic
aaattgaagaagttaggactactgatggtgatggtaattgtcactgattgacagacctaataatcattgtgtcat

SEQ ID NO: 258239 - DNA, 75 bp, Artificial Sequence
  Synthetic
ggttttaatttcaggccccggagatccgtctccttatgtgacacaaggaggtgaattgacactcaataaactctc

SEQ ID NO: 258240 - DNA, 75 bp, Artificial Sequence
  Synthetic
aagcggagccatcatgagtcttctcgaattgcatataccgcatgagaccatctattacaatacactcttttcaaa

SEQ ID NO: 258241 - DNA, 75 bp, Artificial Sequence
  Synthetic
aagtctgataacctattaattagaaggattaagaaaaaactaccggatatagataaccaaagggcgatatacggg

SEQ ID NO: 258242 - DNA, 75 bp, Artificial Sequence
  Synthetic
tttaatctcggatccgcattcgaatgataatatcaacaccagtaaaagagataaaatctcgttacattgttctga

SEQ ID NO: 258243 - DNA, 75 bp, Artificial Sequence
  Synthetic
ggatttgtccaggagttctgcccattatggagagagaatgcagaagaaagtgacctgacctcagataaagcagtg

SEQ ID NO: 258244 - DNA, 75 bp, Artificial Sequence
  Synthetic
ggattaagaaaaaactaccggatatagataaccaaagggcgatatacgggtagaacggtcgggggggccgtccct

SEQ ID NO: 258245 - DNA, 75 bp, Artificial Sequence
  Synthetic
ccgtctccttatgtgacacaaggaggtgaattgacactcaataaactctcgcaaccggtacaatgcccttccgag

SEQ ID NO: 258246 - DNA, 75 bp, Artificial Sequence
  Synthetic
aatcaaagcttattagatcaattggctacgaacatatccctgatcgccatgcattctgtgagagagggcggggta

SEQ ID NO: 258247 - DNA, 75 bp, Artificial Sequence
  Synthetic
aggttcccgcctcttaagtgtcccaagggatctgccctaggcccctctccacaaatctatgctccaacactccaa

SEQ ID NO: 258248 - DNA, 75 bp, Artificial Sequence
  Synthetic
aagtgataaggatggcaaagactctaatccaacggcacggtacacttctagctaaatcagatgaaattacactaa

SEQ ID NO: 258249 - DNA, 75 bp, Artificial Sequence
  Synthetic
ctcatccaggacaatcggactgtactttgattctgcccttccttccagcagcctgcttgctttcccgatcgtcct

SEQ ID NO: 258250 - DNA, 75 bp, Artificial Sequence
  Synthetic
cctggcaatggagattgggccagcctatgcaatgacccatattcgttcaatttcgagactgttgcaagcccaaat

SEQ ID NO: 258251 - DNA, 75 bp, Artificial Sequence
  Synthetic
atgatgcgccagaagatatcaccgacactctggaaagaatcctatctatccaggctcaagtatgggtcacagtag

SEQ ID NO: 258252 - DNA, 75 bp, Artificial Sequence
  Synthetic
atgccttggcaaaggatttgggtaacagagtctatgatgttgtagcattaatggagggattcgcatacggtgccg

SEQ ID NO: 258253 - DNA, 75 bp, Artificial Sequence
  Synthetic
atggagggattcgcatacggtgccgttcagctgcttgagccgtcaggtacatttgcaggagatttctttgcattc

SEQ ID NO: 258254 - DNA, 75 bp, Artificial Sequence
  Synthetic
agaatcaagcagctgagatgttgtgcttgctgcgtttgtggggtcacccactgcttgagtcccgtagtgcagcaa

SEQ ID NO: 258255 - DNA, 75 bp, Artificial Sequence
  Synthetic
gaggcatacaacaggacattgaccactttgctcaccccccttggtgattctattcgtaggatacaagagtctgtg

SEQ ID NO: 258256 - DNA, 75 bp, Artificial Sequence
  Synthetic
cttagtactcaggggtgcgatttctctggaggacctcatcccactaaggacatatctgaagcgcagcacatgccc

SEQ ID NO: 258257 - DNA, 75 bp, Artificial Sequence
  Synthetic
atttgtccattcatatgtcctgacaccggcacaactaggcgggttgagcaatctccaatactcaaggctctatac

SEQ ID NO: 258258 - DNA, 75 bp, Artificial Sequence
  Synthetic
gagactcggagtggagtatgctcaggctcagggaagtagcatcaatgaggatatggctgctgaactgaaactaac

SEQ ID NO: 258259 - DNA, 75 bp, Artificial Sequence
  Synthetic
aaagttgaattctgactctttggtgctcgtactcggattcattttattaattttaaacagaaatgcgtgtagctt

SEQ ID NO: 258260 - DNA, 75 bp, Artificial Sequence
  Synthetic
caatcgcgcatccgaaagataactggctcgcctcatttaggcggaaccttctctccgaggcccaaaagaaacaga

SEQ ID NO: 258261 - DNA, 75 bp, Artificial Sequence
  Synthetic
ctcgtactcggattcattttattaattttaaacagaaatgcgtgtagctttccttaattgtagttctgtcattca

SEQ ID NO: 258262 - DNA, 75 bp, Artificial Sequence
  Synthetic
tatcaacgagggtcatcgtacttctcccctgccctactataccccatgatagtcagtaacaaaacagccactctt

SEQ ID NO: 258263 - DNA, 75 bp, Artificial Sequence
  Synthetic
tcaacaggctggggtcctcactgggctcagcgacgaaggcccccgaggcctacagggtggatcgagcaagtcgca

SEQ ID NO: 258264 - DNA, 75 bp, Artificial Sequence
  Synthetic
ctgcgcacctgcgaagtgtaaaggtcatcattcaagcgggcacccaacgtgctgtcgcagtgaccgctgaccatg

SEQ ID NO: 258265 - DNA, 75 bp, Artificial Sequence
  Synthetic
agcaccaaattctacacagagcactactcacctggagcctcccccaactcctgagccaccccaggacaacgacat

SEQ ID NO: 258266 - DNA, 75 bp, Artificial Sequence
  Synthetic
cctcagtcgggaacctaaataatatgcgtgccacctacctagaaaccttgtccgtaagtacaaccaagggatttg

SEQ ID NO: 258267 - DNA, 75 bp, Artificial Sequence
  Synthetic
caagactcaacccggtatctgcagtatttgacggcatatctcgcagtcacataacccgggtgagttcaggcagca

SEQ ID NO: 258268 - DNA, 75 bp, Artificial Sequence
  Synthetic
ctcaaaggctattcaccgaagaaggaatcaaagaggggaatgtggtttaccaacaaattatgctcttgggtttat

SEQ ID NO: 258269 - DNA, 75 bp, Artificial Sequence
  Synthetic
tgaatcattgcaacactagataatgatctgctttgattgcttatagttagtttacatatctacccagttagaaaa

SEQ ID NO: 258270 - DNA, 75 bp, Artificial Sequence
  Synthetic
ccaaaccccccgcccaaacctcccccaatctccccaacccgctgccccgcacggccaaaccggcaggagcacccc

SEQ ID NO: 258271 - DNA, 75 bp, Artificial Sequence
  Synthetic
gaccggcgacacacagctcaagaccggggcaagcaactccctcctgtccatgcttgacaagctgagcaataaatc

SEQ ID NO: 258272 - DNA, 75 bp, Artificial Sequence
  Synthetic
ctctaattgaatcgctcttcccgatgacaacaaccaaaacatatgatgaaatcacactacacctccacagtaaat

SEQ ID NO: 258273 - DNA, 75 bp, Artificial Sequence
  Synthetic
cacaaggataataaattactctagcatgcatgccatgctcttccgagatgatgtcttcttgtctaatagagccaa

SEQ ID NO: 258274 - DNA, 75 bp, Artificial Sequence
  Synthetic
atgtagatgtgcagaccccccgggtatcatatcacaaaattatggagaagccgtgtctctaatagataagcagtc

SEQ ID NO: 258275 - DNA, 75 bp, Artificial Sequence
  Synthetic
acccctcttggtgactccatccgcaggatacaagggtctgtgaatacatctggaggaaggagacagaaacgcttt

SEQ ID NO: 258276 - DNA, 75 bp, Artificial Sequence
  Synthetic
acatgggaacatccagccacctgctggccaggacacccctgaacaacaagacaggccagacaaacagccatccac

SEQ ID NO: 258277 - DNA, 75 bp, Artificial Sequence
  Synthetic
actgagagaatgataaaacttggaagggcagtgcaccagactctcaaccacaattccaggataaccggagtactc

SEQ ID NO: 258278 - DNA, 75 bp, Artificial Sequence
  Synthetic
gtgtctccatatgtccatatatcaaatgactcacagaggctgttcactgaggagggtgttaaggaagggaacgtg

SEQ ID NO: 258279 - DNA, 75 bp, Artificial Sequence
  Synthetic
gggcagtgcaccagactctcaaccacaattccaggataaccggagtactccatcccaggtgtttagaagaactgg

SEQ ID NO: 258280 - DNA, 75 bp, Artificial Sequence
  Synthetic
gtttgttaatgaccagtttaataatacggcgcgagagttagactgcataaaaattacacaacaggttggtgtcga

SEQ ID NO: 258281 - DNA, 75 bp, Artificial Sequence
  Synthetic
gatttctgttactatttgaactacctaatgagttgcgtgcagacatactttgattctgagttttctattacccac

SEQ ID NO: 258282 - DNA, 75 bp, Artificial Sequence
  Synthetic
ggcaccagtggctgtcccatttgaactaacaggtgtagcaccagatctcagggttgtagcatctaacaagttcat

SEQ ID NO: 258283 - DNA, 75 bp, Artificial Sequence
  Synthetic
tggaaggagtcacaaccatcagctggtgcaacccctcatgcgctccagtcagggcaaagccaagacagtactcct

SEQ ID NO: 258284 - DNA, 75 bp, Artificial Sequence
  Synthetic
aataaggggcctatcagcagaagagaagtgttcagtactcactgagtacctattgtcagatgctgtgaaaccgtt

SEQ ID NO: 258285 - DNA, 75 bp, Artificial Sequence
  Synthetic
tttggagtcatattccacagtagaattgatgaatattctttccatctctagcggaaagctaattggtcaatcagt

SEQ ID NO: 258286 - DNA, 75 bp, Artificial Sequence
  Synthetic
gggaacctaaataatatgcgtgccacctacttggagaccttatccgtaagcacaaccaaagggtttgcctcagca

SEQ ID NO: 258287 - DNA, 75 bp, Artificial Sequence
  Synthetic
cctacttggagaccttatccgtaagcacaaccaaagggtttgcctcagcacttgtcccgaaagttgtgacgcaag

SEQ ID NO: 258288 - DNA, 75 bp, Artificial Sequence
  Synthetic
caggaagagccttaatttgatcagggaacgggaagacagagatactatcctggcattgttgttcccccaggagcc

SEQ ID NO: 258289 - DNA, 75 bp, Artificial Sequence
  Synthetic
attaaaaatgatgcaataatagtgtatgacaatacccgcaactggataagtgaggctcaaaattcagatgtcgtc

SEQ ID NO: 258290 - DNA, 75 bp, Artificial Sequence
  Synthetic
atgacaatacccgcaactggataagtgaggctcaaaattcagatgtcgtccggctattcgagtacgcagcccttg

SEQ ID NO: 258291 - DNA, 75 bp, Artificial Sequence
  Synthetic
catacaggtaaatttaccctcagtcgggaacctaaataatatgcgtgccacctacttggagaccttatccgtaag

SEQ ID NO: 258292 - DNA, 75 bp, Artificial Sequence
  Synthetic
gacatcggtgctcgagtgaaagacccatttacccggcagcctgcatcattcatacaagagctagatttgagtgct

SEQ ID NO: 258293 - DNA, 75 bp, Artificial Sequence
  Synthetic
ggccctcaaaggctcagttattgccaattgcaagatgactacatgtagatgtgcagatcccccaggtatcatatc

SEQ ID NO: 258294 - DNA, 75 bp, Artificial Sequence
  Synthetic
tagggactgcttcatcttcttggtataaggcatctcatctactctccgtacctgaagtcaggtgtgcaaaacatg

SEQ ID NO: 258295 - DNA, 75 bp, Artificial Sequence
  Synthetic
gctgatcaccatcacaactcacaacaggctcccgccccactagtgtcacaaggaatctgtctcgagccctccccc

SEQ ID NO: 258296 - DNA, 75 bp, Artificial Sequence
  Synthetic
caatctcgatatatccactgagcttgggaatgtcaacaactcgataagcagtgccctggacaaattagcggaaag

SEQ ID NO: 258297 - DNA, 75 bp, Artificial Sequence
  Synthetic
attagtctcctccaatatgtgttcgctgacgctagcagattatgcccggaacagaagctggtcacctttgacagg

SEQ ID NO: 258298 - DNA, 75 bp, Artificial Sequence
  Synthetic
gtgccctggacaaattagcggaaagcaacagcaagctaaataaagtcaatgtcaacctaaccagcacatctgctc

SEQ ID NO: 258299 - DNA, 75 bp, Artificial Sequence
  Synthetic
tgtggagagaaattgcagaagaaagtgatctgacttcagataaagcagtgagttatatcacatctgtggtgcctt

SEQ ID NO: 258300 - DNA, 75 bp, Artificial Sequence
  Synthetic
tatgtctaggaaaagcctgaatttaattagagaaagagaggacagggactcgattctagctttgatgttcccaca

SEQ ID NO: 258301 - DNA, 75 bp, Artificial Sequence
  Synthetic
tgacaccagcaaaaatcccccgatgagagtgccgtatcttgggtcgaagactcaagagaggagagctgcctcact

SEQ ID NO: 258302 - DNA, 75 bp, Artificial Sequence
  Synthetic
cttagtctgccttcacaggaccatcccaaaccccccgcccgaacccctcctaaaccccccaattcgtcgccccgc

SEQ ID NO: 258303 - DNA, 75 bp, Artificial Sequence
  Synthetic
caagaacatgaatacagatgagagacggatgtatccccagtagcaattcgtgtgttaattctgatagcctgtcaa

SEQ ID NO: 258304 - DNA, 75 bp, Artificial Sequence
  Synthetic
ccaaaccccccgcccgaacccctcctaaaccccccaattcgtcgccccgcatggccaaaccagcaagagcacccc

SEQ ID NO: 258305 - DNA, 75 bp, Artificial Sequence
  Synthetic
gatagaattcttagagtcaaatgatttcgatccatataaggagatggaatatctaacgaccctcgagtacctaag

SEQ ID NO: 258306 - DNA, 75 bp, Artificial Sequence
  Synthetic
agcgctccagcacggtacgatgcatacacgttggagcaagcccgatctgactgtgcacttgctgacatgggggag

SEQ ID NO: 258307 - DNA, 75 bp, Artificial Sequence
  Synthetic
aacaaagaaattaaggaactgtcaggtgatggcggaagggatcttagctgaccagattgcacctttctttcaggg

SEQ ID NO: 258308 - DNA, 75 bp, Artificial Sequence
  Synthetic
tctgtcccagaaatcaggtgtgccaggcacggcaactctctgtatcttgccgaaggaagcggggctatcatgagc

SEQ ID NO: 258309 - DNA, 75 bp, Artificial Sequence
  Synthetic
ggcacggcaactctctgtatcttgccgaaggaagcggggctatcatgagcttactagagctgcatataccgcacg

SEQ ID NO: 258310 - DNA, 75 bp, Artificial Sequence
  Synthetic
aacgaagaaagagaagcaaagaacacatggcgcttggttttccggatcgcagtcttatccctaatagtaatgact

SEQ ID NO: 258311 - DNA, 75 bp, Artificial Sequence
  Synthetic
tatcaaattaatggggctgcaaataatagtgggtgtggggcacctgttcatgacccagattatattgggggggta

SEQ ID NO: 258312 - DNA, 75 bp, Artificial Sequence
  Synthetic
ggagcaagcaactctcttttgtccatgcttgacaagctgagcaataagtcgtctaatgctaaaaagggcccacgg

SEQ ID NO: 258313 - DNA, 75 bp, Artificial Sequence
  Synthetic
cttaatactcagaggtatggtctctctagaggatctcatcccactaaggacgtacctgaagcgcagcacctgccc

SEQ ID NO: 258314 - DNA, 75 bp, Artificial Sequence
  Synthetic
gcgattgcagtgactgctgatcatgaagtcacctctactaggatagagaagaggcacaccattgctaaatacaat

SEQ ID NO: 258315 - DNA, 75 bp, Artificial Sequence
  Synthetic
ttcgagtatgcggcactcgaagtgctccttgactgttcttatcaactctactatctgagagtgagaggcctaaac

SEQ ID NO: 258316 - DNA, 75 bp, Artificial Sequence
  Synthetic
gagacccaattcttggattttatgagagcggtggcgagcagcatgcgggaagcgccaaattctacacagagcacc

SEQ ID NO: 258317 - DNA, 75 bp, Artificial Sequence
  Synthetic
atctatcttgattgcttatggttagttcacctgtctatctaattagaaaaaacacgggtagaagagtctggatca

SEQ ID NO: 258318 - DNA, 75 bp, Artificial Sequence
  Synthetic
actctctaatattgcaactacgatatcccaccccatcattcactcaaggttgaatgcggtaggcctgactaacca

SEQ ID NO: 258319 - DNA, 75 bp, Artificial Sequence
  Synthetic
gaaacaaagagttaacaacatcctatcaagccctctcccgaggctggcaaagctactaagacgcaatattgacac

SEQ ID NO: 258320 - DNA, 75 bp, Artificial Sequence
  Synthetic
aaagttgaattccgactccctgaaactcgtattcggattcagttagttaacttcgagcaaaagtgcacgtatttg

SEQ ID NO: 258321 - DNA, 75 bp, Artificial Sequence
  Synthetic
cgatcatggaagccaatttaggcatgatgaaaattctggaccctggttgtgctaacgtttcatccttaagtgatc

SEQ ID NO: 258322 - DNA, 75 bp, Artificial Sequence
  Synthetic
ctcgtattcggattcagttagttaacttcgagcaaaagtgcacgtatttgtctatagttgtaatcctgtcattca

SEQ ID NO: 258323 - DNA, 75 bp, Artificial Sequence
  Synthetic
tgacttcgaccacctcattctcagccgacaatggaagaaaatacttgaatcggcctctcctgacactgagagaat

SEQ ID NO: 258324 - DNA, 75 bp, Artificial Sequence
  Synthetic
gtgaaatgacactcaataaactctcgcaaccggtacagcacccttctgagttaattaaatctgccacagcaagcg

SEQ ID NO: 258325 - DNA, 75 bp, Artificial Sequence
  Synthetic
caaaccaggcgagaccgtcggaagaagcgcgatcccgcaaggcaagaccaaagctctgagcacagcatgggagaa

SEQ ID NO: 258326 - DNA, 75 bp, Artificial Sequence
  Synthetic
atatctctagaagaccttataccgctacgcacatatctcaagatgagtacatgccctaaatatctgaaatccgta

SEQ ID NO: 258327 - DNA, 75 bp, Artificial Sequence
  Synthetic
gaaagatcgagaaaaagatccaaattcacaacacaagatatggagaactattcgcaagcctgtgcacgcatgtag

SEQ ID NO: 258328 - DNA, 75 bp, Artificial Sequence
  Synthetic
aagtggagtgtctgaggagagagcgcagagattcatggtaatagcaggatctctccctcgggcatgtagtaatgg

SEQ ID NO: 258329 - DNA, 75 bp, Artificial Sequence
  Synthetic
gacattggtgctcgagtaaaggacccattcacccgacaacctgcatcgttcatacacgagctagatttgagtgct

SEQ ID NO: 258330 - DNA, 75 bp, Artificial Sequence
  Synthetic
atactgatccgtatcctgtagtcttccataggaatcacactttgcgaggggtgttcgggacaatgcttgataatg

SEQ ID NO: 258331 - DNA, 75 bp, Artificial Sequence
  Synthetic
ttagtacggtacttattcagaggaatagggactgcttcatcttcttggtacaaggcatctcatctactctccgta

SEQ ID NO: 258332 - DNA, 75 bp, Artificial Sequence
  Synthetic
aacaagcaaggctcaatcccgtatctgcaatatttgattacacatctcgcagtcgcataacccgggtaagttcaa

SEQ ID NO: 258333 - DNA, 75 bp, Artificial Sequence
  Synthetic
ccaagttaggtatagggaacaatcaactcagctcattaattggtagtggcttgatcacaggccaccctatactgt

SEQ ID NO: 258334 - DNA, 75 bp, Artificial Sequence
  Synthetic
agtcgcataacccgggtaagttcaagcagcaccaaggcagcatacacgacatcgacatgttttaaagttgtcaag

SEQ ID NO: 258335 - DNA, 75 bp, Artificial Sequence
  Synthetic
tagggactgcttcatcttcttggtacaaggcatctcatctactctccgtacctgaggtcaggtgtgcaagacatg

SEQ ID NO: 258336 - DNA, 75 bp, Artificial Sequence
  Synthetic
ttcaccctgtatgcaggagtgcgattcaactcacaatcagacattctctggcagtccgcatcttcttagtgagtg

SEQ ID NO: 258337 - DNA, 75 bp, Artificial Sequence
  Synthetic
tcaggaacactggacttactgcattcttcttaacactcaaatacggaatcaataccaagacatcagctcttgcac

SEQ ID NO: 258338 - DNA, 75 bp, Artificial Sequence
  Synthetic
gctggtcacctttgacagggggtagaaagatactgggtgtatctaatcccgatactatagaacttgtagagggtg

SEQ ID NO: 258339 - DNA, 75 bp, Artificial Sequence
  Synthetic
caattcacttggttccatctcccgagcaatatagaactgaccgatgacaccagcaagaatcctccgatgagagtg

SEQ ID NO: 258340 - DNA, 75 bp, Artificial Sequence
  Synthetic
agaggagagccgcctcgcttgcgaaaatagctcatatgtcaccacatgtgaaagctgctctaagggcatcatccg

SEQ ID NO: 258341 - DNA, 75 bp, Artificial Sequence
  Synthetic
tagggagtgtcccgaacgatggagatcttgttgagctggcgagagcctgcctcactatggtggtaacttgcaaga

SEQ ID NO: 258342 - DNA, 75 bp, Artificial Sequence
  Synthetic
gatatatgggaaggtcattgggcagctacatgctgattcagcagagatttcacatgacatcatgttgagagagta

SEQ ID NO: 258343 - DNA, 75 bp, Artificial Sequence
  Synthetic
ccactcaacaggttggggtcctcactgggctcagcaacgaagtccctcgagttccacagggcgggtcaaacaagc

SEQ ID NO: 258344 - DNA, 75 bp, Artificial Sequence
  Synthetic
tgggctcagcaacgaagtccctcgagttccacagggcgggtcaaacaagccgcaagggcaaccagactctgggga

SEQ ID NO: 258345 - DNA, 75 bp, Artificial Sequence
  Synthetic
ctaggcgggcctacgttcgtacacgaggtggtaaggatggcaaagactctaatacaacgacatggtacacttctg

SEQ ID NO: 258346 - DNA, 75 bp, Artificial Sequence
  Synthetic
agcagatgagtcagaaacaagaagaatcaataagtatatgcagcaaggtagaattcagaagaagtacatcctcca

SEQ ID NO: 258347 - DNA, 75 bp, Artificial Sequence
  Synthetic
catcacccatccggagccccccccaactcccgggccctcccaagacaacgacactgactgggggtactgaacggc

SEQ ID NO: 258348 - DNA, 75 bp, Artificial Sequence
  Synthetic
cctttaccgaggctaatgaagttcctgagagaaaatattgatgctgcactaattgaagctgggggacagcctgtt

SEQ ID NO: 258349 - DNA, 75 bp, Artificial Sequence
  Synthetic
accaaacagagaatcggtgagttacgataaaagagcgaaaagcaatcgaaatcgtacgggtagaaggtgtgaacc

SEQ ID NO: 258350 - DNA, 75 bp, Artificial Sequence
  Synthetic
gctgtgcacgcacgttgaaaagaaattgctaggatcatcctggtctagcaatgtctcacgatcagaggaattcaa

SEQ ID NO: 258351 - DNA, 75 bp, Artificial Sequence
  Synthetic
caccccaaaccctcctcccaaaacccctcaacactcctcaacccatgcccccgcacaacaaaaccgacaagagca

SEQ ID NO: 258352 - DNA, 75 bp, Artificial Sequence
  Synthetic
cgactgggggtactgaccaacaacacccagcttgcttttatgaaatcatcccaactcccccgcttgcaccccacc

SEQ ID NO: 258353 - DNA, 75 bp, Artificial Sequence
  Synthetic
caggcctcttgcagctgcggggattgtggtaacaggagataaagcagtcaatatatacacctcatctcagacggg

SEQ ID NO: 258354 - DNA, 75 bp, Artificial Sequence
  Synthetic
tgtgtcaattctgacaacccgttcaatggaagacttaagaaaaaattactggatatatgcaacccaaaagcaata

SEQ ID NO: 258355 - DNA, 75 bp, Artificial Sequence
  Synthetic
cagcatccgtatggatccagcattctggtttcactcaaaatggtccagagccaagtttgcctggctccatataaa

SEQ ID NO: 258356 - DNA, 75 bp, Artificial Sequence
  Synthetic
caacaatccatccagagcccaaggtattagaaaaaaatacgggtagaagggagacacccagagaccaggacgagt

SEQ ID NO: 258357 - DNA, 75 bp, Artificial Sequence
  Synthetic
atggaagacttaagaaaaaattactggatatatgcaacccaaaagcaatacacgggtagaacggttgaagaggcc

SEQ ID NO: 258358 - DNA, 75 bp, Artificial Sequence
  Synthetic
atattgggtctcagagtcaaagatatcaataaagtaggtgatgtaatcagcttagtactcagaggtacgattact

SEQ ID NO: 258359 - DNA, 75 bp, Artificial Sequence
  Synthetic
ccacctttacagatgcggagatagacgacatatttgaaaccagtgggaccgttattgacagcataattacggccc

SEQ ID NO: 258360 - DNA, 75 bp, Artificial Sequence
  Synthetic
agggcaaccagatgccggggatggggagacccaattcctggatttgatgagagcggtggcaaacagcatgcgaga

SEQ ID NO: 258361 - DNA, 75 bp, Artificial Sequence
  Synthetic
agaaacacgggagcgtccagccaaacaccagccaggacgcccccgacaaacaagccagatcggacaaacagccat

SEQ ID NO: 258362 - DNA, 75 bp, Artificial Sequence
  Synthetic
aaagttgaattctgactctttggaactcgtattcggattcagttgattaactttaagcagaaatgcatgtagttg

SEQ ID NO: 258363 - DNA, 75 bp, Artificial Sequence
  Synthetic
ctcgtattcggattcagttgattaactttaagcagaaatgcatgtagttgtctttaattgtagtcctgtcattca

SEQ ID NO: 258364 - DNA, 75 bp, Artificial Sequence
  Synthetic
agggaacaatcatcaatggatacagaaagaagaactcgggtgtgtggccacgtgtcaagatggatacaatatatg

SEQ ID NO: 258365 - DNA, 75 bp, Artificial Sequence
  Synthetic
ttattcctgtctgagcggcaatacatcagcttgcatgtattcaaagactgaaggcgcactcactacgccatatat

SEQ ID NO: 258366 - DNA, 75 bp, Artificial Sequence
  Synthetic
cgtgtcaagatggatacaatatatgggaaggtcattagacagctgcacgctgattcagcagagatttcacatgat

SEQ ID NO: 258367 - DNA, 75 bp, Artificial Sequence
  Synthetic
tgattcagcagagatttcacatgatgtcatgttgagggagtacaagagtctatctgcacttgaattcgagccatg

SEQ ID NO: 258368 - DNA, 75 bp, Artificial Sequence
  Synthetic
gtttcatctctaagtgatctacgggcagtcgctcgatcccacccagttttaatttctggccccggagacccatct

SEQ ID NO: 258369 - DNA, 75 bp, Artificial Sequence
  Synthetic
gcatgggatcgcccagccgcacgccagccaggacaaccccgaccagcaggtcagatcagataaacagtcgtccac

SEQ ID NO: 258370 - DNA, 75 bp, Artificial Sequence
  Synthetic
caaccttgatatatcaaccgagcttggaaatgtcaataattcgataagtaatgctctggacaggttagcggagag

SEQ ID NO: 258371 - DNA, 75 bp, Artificial Sequence
  Synthetic
gctcaggggagcagcatcaacgaggatatggctgctgagctaaaactaaccccggcagcaaggaagggcctggca

SEQ ID NO: 258372 - DNA, 75 bp, Artificial Sequence
  Synthetic
caaccttcaatactcaaggctctacactagaaacatcggtgacccgggaactactgcttttgcagagatcaagcg

SEQ ID NO: 258373 - DNA, 75 bp, Artificial Sequence
  Synthetic
atccagttttaatttcaggccctggagacccatctccttatgtgacgcaagggggcgaaatgacactcaataaac

SEQ ID NO: 258374 - DNA, 75 bp, Artificial Sequence
  Synthetic
ctgtatcattgctgcactgtgacattgagattcctccaggatccaatcaaagcttactagatcaactggctacca

SEQ ID NO: 258375 - DNA, 75 bp, Artificial Sequence
  Synthetic
agcttactagatcaactggctaccaatctgtctctgattgccatgcattctgtaagggagggcggggtcgtgatc

SEQ ID NO: 258376 - DNA, 75 bp, Artificial Sequence
  Synthetic
ctcagcgatgtaggcccccaggcctcacagggcgaatcgagcaagccaaaagggcaaccgaacgccggggacgga

SEQ ID NO: 258377 - DNA, 75 bp, Artificial Sequence
  Synthetic
aagcgccttgcactgaatggctaatcatcactgcaactcgcagccggtctccgttcgctcagaattacaaggtat

SEQ ID NO: 258378 - DNA, 75 bp, Artificial Sequence
  Synthetic
agcacaaaactctgcgccgggcactaaccccccagagccccccccaacacctgggccatccccagacaatgacac

SEQ ID NO: 258379 - DNA, 75 bp, Artificial Sequence
  Synthetic
cccagcccgcccccacagggccaccccaaatcccccgcccgaacccctcccccactccccaacccacagccccgc

SEQ ID NO: 258380 - DNA, 75 bp, Artificial Sequence
  Synthetic
aatagcagatttcagtcatggaccgtgcagttagcagagttgtgctagagaatgaagaaagagaggcaaagaaca

SEQ ID NO: 258381 - DNA, 75 bp, Artificial Sequence
  Synthetic
caacaggctcccgcccctccatcgtcacgcagaatacttccggggcccccctcaacaaactcatgctccaataac

SEQ ID NO: 258382 - DNA, 75 bp, Artificial Sequence
  Synthetic
cccactccccaacccacagccccgcatggctgagccaacgacagcactcccctattccctcctccccccccagcc

SEQ ID NO: 258383 - DNA, 75 bp, Artificial Sequence
  Synthetic
acgactgatttgcagaagtactgtcttaactggagatatcagacaatcaagctatttgcccacgctatcaaccag

SEQ ID NO: 258384 - DNA, 75 bp, Artificial Sequence
  Synthetic
tggaggctgaaggtgatctcgctgacacagtgttcttatttaccccttacaacctctctacagacggtaagaaga

SEQ ID NO: 258385 - DNA, 75 bp, Artificial Sequence
  Synthetic
tgctgcaatccaacttgctgcagcaagatcgcattgtagagttgcctgcatggtacaaggtgacaatcaagtaat

SEQ ID NO: 258386 - DNA, 75 bp, Artificial Sequence
  Synthetic
taaaccaacagagaccctcggaaagggcgcaatccagcaaggcgacacaaaagcaccgagcacagcacgggagaa

SEQ ID NO: 258387 - DNA, 75 bp, Artificial Sequence
  Synthetic
gctgagtcgaacataggatggctgggaaaatgatgctgtgccacctatctctcacaataccaaagatcaaactag

SEQ ID NO: 258388 - DNA, 75 bp, Artificial Sequence
  Synthetic
ctagtgatgtcacatcattctatccttctgcataccaagaacacctgaattttatcccggcacctaccacaggat

SEQ ID NO: 258389 - DNA, 75 bp, Artificial Sequence
  Synthetic
gaaaatgatgctgtgccacctatctctcacaataccaaagatcaaactagatatcaatgtaagcccaactctcat

SEQ ID NO: 258390 - DNA, 75 bp, Artificial Sequence
  Synthetic
gcttaaaggtatgatttctctggaggacctgatccctctaagaacatacttgaagcgtagtacctgccctaagta

SEQ ID NO: 258391 - DNA, 75 bp, Artificial Sequence
  Synthetic
ggcgcaatccagcaaggcgacacaaaagcaccgagcacagcacgggagaaacacggagacatgcaaccacccgcc

SEQ ID NO: 258392 - DNA, 75 bp, Artificial Sequence
  Synthetic
agcccttcagcaacacccgccgaatcgccccccacccaggccgcgggcgaggccggcgacacgcagctcaagacc

SEQ ID NO: 258393 - DNA, 75 bp, Artificial Sequence
  Synthetic
aaatatgaatggtagcaagatataagggggaacaacgtacaggagatagcacgggtaggaaatggcgagctccgg

SEQ ID NO: 258394 - DNA, 75 bp, Artificial Sequence
  Synthetic
ggagcaagcaactctcttttgtccatgctagacaagctgagcaacaaatcgtccaatactaaaaagggcccacgg

SEQ ID NO: 258395 - DNA, 75 bp, Artificial Sequence
  Synthetic
attagtgctaatatcaggtgaccttagtgaaaacactgtaatgtcttgtgcaaacattgcatccactatagcacg

SEQ ID NO: 258396 - DNA, 75 bp, Artificial Sequence
  Synthetic
accctagcgtataaggtgaattttgtctctttgaccgtggtgccgaggagggacgtctacaaggtctcaactaca

SEQ ID NO: 258397 - DNA, 75 bp, Artificial Sequence
  Synthetic
gataatattatattagaaaaaagttgcgctccgatcctttaggcctcgtattcgaattcaaataattgtcttaaa

SEQ ID NO: 258398 - DNA, 75 bp, Artificial Sequence
  Synthetic
gcgctccgatcctttaggcctcgtattcgaattcaaataattgtcttaaaaaaaaaatgcgcataattgttcttg

SEQ ID NO: 258399 - DNA, 75 bp, Artificial Sequence
  Synthetic
gtattgaaggtatctggctcaagcctgtacaatctcgcgctcaatgtcactattgatgtagaggtggacccgaag

SEQ ID NO: 258400 - DNA, 75 bp, Artificial Sequence
  Synthetic
aatactcaaggctctacacaaggaacatcggtgacccagggactactgcttttgcagaggtcaagagattagaag

SEQ ID NO: 258401 - DNA, 75 bp, Artificial Sequence
  Synthetic
cccttgtcaggcatcagcaagatgccctaactcatgtatcactggagtctacactgatccgtatcctttagtctt

SEQ ID NO: 258402 - DNA, 75 bp, Artificial Sequence
  Synthetic
ggtactctttgctacaacaagagaaatcccgaaaatcagaggcctatctgcagaagagaaatgttcaatacttac

SEQ ID NO: 258403 - DNA, 75 bp, Artificial Sequence
  Synthetic
aggcaaggtgctcttatatccctcttatgctcccattctcaagtgatgaggaaccatgttgcccttgcagggaaa

SEQ ID NO: 258404 - DNA, 75 bp, Artificial Sequence
  Synthetic
agttttagtttcaggccccggagatccgtccccttatgtgacacaaggtggcgaagtgacgctcaataaactctc

SEQ ID NO: 258405 - DNA, 75 bp, Artificial Sequence
  Synthetic
catgaggttacctctaccaagatagagaagagacacaccattgctagatacaatcccttcaggaagtaagttgca

SEQ ID NO: 258406 - DNA, 75 bp, Artificial Sequence
  Synthetic
ttgagattgatgggtttgccaacagcacaccccagttcaacaacaggagtggagtgtccgaggagagagcacaga

SEQ ID NO: 258407 - DNA, 75 bp, Artificial Sequence
  Synthetic
ttagttcacctgtttatctaattaaaaaaaacacgggtagaagagtctggaacccgaccagcacattcggaacgc

SEQ ID NO: 258408 - DNA, 75 bp, Artificial Sequence
  Synthetic
aggtccctgcctccttagtgtcacaagggatccgtcctaggccccttcctataaatctacgctctagcactccaa

SEQ ID NO: 258409 - DNA, 75 bp, Artificial Sequence
  Synthetic
acagaagctggtcaccattgacagggggcaggaaaatactgggcgtgtctaatcccgataccatagagcttgtag

SEQ ID NO: 258410 - DNA, 75 bp, Artificial Sequence
  Synthetic
catacaagtaactttaccttcagtcgggaacctgaataatatgcgtgccacctacttggagaccttatcggtaag

SEQ ID NO: 258411 - DNA, 75 bp, Artificial Sequence
  Synthetic
ttcgcattttcttagttagcgagcttaagagaggccgcaatacggcaggtgggagctccacatattacaacttag

SEQ ID NO: 258412 - DNA, 75 bp, Artificial Sequence
  Synthetic
catggcgcttggttttccggatcgcagttttacttttaacagtggtgaccttagctatctctgtagctgccttgg

SEQ ID NO: 258413 - DNA, 75 bp, Artificial Sequence
  Synthetic
ctcaagagaggagggctgcctcgcttgcaaaaatagctcatatgtcacctcatgtgaaggcagcactaagggcat

SEQ ID NO: 258414 - DNA, 75 bp, Artificial Sequence
  Synthetic
aaaggctagactcgtggactgacagcagagaagactcggtatttatcactacttatggattcatcttccaagtcg

SEQ ID NO: 258415 - DNA, 75 bp, Artificial Sequence
  Synthetic
acttatggattcatcttccaagtcgggaatgaagaagtcaccgtcggcacgatcaatgataatccaaggcaagag

SEQ ID NO: 258416 - DNA, 75 bp, Artificial Sequence
  Synthetic
aatacaagccaaccagaatgctgccaacatcctccggcttaaggagagcattgctgcaaccaatgaagctgtgca

SEQ ID NO: 258417 - DNA, 75 bp, Artificial Sequence
  Synthetic
ttgctgcaaccaatgaagctgtgcatgaggtcaccagcggattatcacaactagcagtagcagttgggaagatgc

SEQ ID NO: 258418 - DNA, 75 bp, Artificial Sequence
  Synthetic
gatatgatggagggcagagacatggtcaacataatatcatctatggcgacccatctcagaagtctatcagagaaa

SEQ ID NO: 258419 - DNA, 75 bp, Artificial Sequence
  Synthetic
attacctcccctgccttaacacagctaactatccaggcactttataatttagctggtagcaatatggactacttg

SEQ ID NO: 258420 - DNA, 75 bp, Artificial Sequence
  Synthetic
gagcggtggcaaatagcatgcgagaagcacaaaattccgcaccgagcaccacccacccagagccccccccaactc

SEQ ID NO: 258421 - DNA, 75 bp, Artificial Sequence
  Synthetic
gggttggcaccagaactaaggacagtaaccacaaataagttcatgtatgatcctagccctgtatcagagagagac

SEQ ID NO: 258422 - DNA, 75 bp, Artificial Sequence
  Synthetic
gatgtggaggtggctccgaatagcccattagtcaagtctctttccaagtccgatagtgggtattatgctaacctt

SEQ ID NO: 258423 - DNA, 75 bp, Artificial Sequence
  Synthetic
ctagaagacttaagaaaaaactgctgggtaaaagcaaccaaagagcaaaatacgggtagaacggtcagaggagcc

SEQ ID NO: 258424 - DNA, 75 bp, Artificial Sequence
  Synthetic
gtcataccccacaatggagctaatgaatgttctttcaatatctagtgggaagttgattggtcagtccgtagtctc

SEQ ID NO: 258425 - DNA, 75 bp, Artificial Sequence
  Synthetic
cccactccccgatccacagcctcgcatggccgagccaacaaaagtacccccccatcctctctcccacccccagcc

SEQ ID NO: 258426 - DNA, 75 bp, Artificial Sequence
  Synthetic
ctgcttgagtcccgtagtgcagcaaaagcagtcaggagccagatgtgcgcaccaaagatggtagacttcgatatg

SEQ ID NO: 258427 - DNA, 75 bp, Artificial Sequence
  Synthetic
aaggtctctgttctcccttctacctagtagaccagggcgaagatggccacctttacagatgcagagatagacgac

SEQ ID NO: 258428 - DNA, 75 bp, Artificial Sequence
  Synthetic
gaggcatactattgctaagtacaatcccttcaagaaatagattgcattcctgatgctatggtctgctcgccttcc

SEQ ID NO: 258429 - DNA, 75 bp, Artificial Sequence
  Synthetic
aacacgggtagaagaatctggatcccagccgacgtgtcctaggcgcgaaatgggctccaaaccttctacctggat

SEQ ID NO: 258430 - DNA, 75 bp, Artificial Sequence
  Synthetic
caggcaatctcgatatatcaactgagcttggaaatgtcaacaattcaataagcaatgccttagacaagttggcag

SEQ ID NO: 258431 - DNA, 75 bp, Artificial Sequence
  Synthetic
ctagtgatgtcacatcattctatccttctgcatatcaagaacacttgaattttatcccggctcctactacaggat

SEQ ID NO: 258432 - DNA, 75 bp, Artificial Sequence
  Synthetic
gaagatgctccaactgatttcccggttatgttgtctgtacacagtgctctttgccacaacaagggaaatcccaaa

SEQ ID NO: 258433 - DNA, 75 bp, Artificial Sequence
  Synthetic
agtcaagggatattacagtaactgtgactcttaacaacagtcgcatattaataggctctctttctatctaattgt

SEQ ID NO: 258434 - DNA, 75 bp, Artificial Sequence
  Synthetic
tgctcgacaagctgagcaataaatcgtctaatactaaaaagggcccatggtcaagtcctcaaggaggacatcacc

SEQ ID NO: 258435 - DNA, 75 bp, Artificial Sequence
  Synthetic
caatacccttgatcagatgagggccaatacaagagcatgaccacggatgagaggtagatgcacaccctacagcaa

SEQ ID NO: 258436 - DNA, 75 bp, Artificial Sequence
  Synthetic
caatagaacactgaccactttactcacccctcttggtgactctatccgcaggatacaagggtctgcgactacatc

SEQ ID NO: 258437 - DNA, 75 bp, Artificial Sequence
  Synthetic
ctgtcgactttgtgcaggcaatgatgtctacgatggaggcgttattgcagaaggtaaataaagttgactatcagc

SEQ ID NO: 258438 - DNA, 75 bp, Artificial Sequence
  Synthetic
gtaggtgccattatcggcagtgtagctcttggggttgcaacagctgcacagataacagcagccgcagctctgata

SEQ ID NO: 258439 - DNA, 75 bp, Artificial Sequence
  Synthetic
ccagcaaggtacgatgcatttacgcttgatgagtttcaccttgagcacacactgccgaacccagaggaagattac

SEQ ID NO: 258440 - DNA, 75 bp, Artificial Sequence
  Synthetic
atccaacagctgaaaacatctgttgcggtcatggaagccaatttaggcatgatgaaaattctggaccctggttgt

SEQ ID NO: 258441 - DNA, 75 bp, Artificial Sequence
  Synthetic
aacacatggcgcctggttttccggatcgcagtcttatttctaatgacaatgactttagttatctctgcagctgcc

SEQ ID NO: 258442 - DNA, 75 bp, Artificial Sequence
  Synthetic
cggtggcggtcgggaagatgcagcagtttgttaataaccagtttaataatacggcgcgagaattggactgcataa

SEQ ID NO: 258443 - DNA, 75 bp, Artificial Sequence
  Synthetic
cctgaggtcagatgtgcaaggcatggaaactccttatacttggcggaaggaagtggagccattatgagtcttctt

SEQ ID NO: 258444 - DNA, 75 bp, Artificial Sequence
  Synthetic
tcgcagtcttatttctaatgacaatgactttagttatctctgcagctgccctggtatatatcatgggggccagca

SEQ ID NO: 258445 - DNA, 75 bp, Artificial Sequence
  Synthetic
ctggcgctactaaacactgagtctataattatgaatgcaataacatccctttcttatcaaatcaacggggccgcg

SEQ ID NO: 258446 - DNA, 75 bp, Artificial Sequence
  Synthetic
ttcacaatacccatggtcgagttgaatatcagcacaagcccggatcctaagctgccgggcagccacaatccgaca

SEQ ID NO: 258447 - DNA, 75 bp, Artificial Sequence
  Synthetic
atatcagcacaagcccggatcctaagctgccgggcagccacaatccgacaatgctgacatgattagtctgagtcc

SEQ ID NO: 258448 - DNA, 75 bp, Artificial Sequence
  Synthetic
atgctgacatgattagtctgagtcccttctttagtcgctttattaagaaaaaatacaaaaaacactgagacatag

SEQ ID NO: 258449 - DNA, 75 bp, Artificial Sequence
  Synthetic
caacaagtttcggaagattgagaagaagatccaaattcacaacacaagatacggagaactgttcacaaggctgtg

SEQ ID NO: 258450 - DNA, 75 bp, Artificial Sequence
  Synthetic
ttcgcatcttcctagtcagcgagctcaagagaggccgcaatacgacaggtgggagctccacatattataacttag

SEQ ID NO: 258451 - DNA, 75 bp, Artificial Sequence
  Synthetic
tgcaaaaatagctcatatgtcgccacatgtgaaggcagcactaagggcatcatctgtgttaatctgggcttatgg

SEQ ID NO: 258452 - DNA, 75 bp, Artificial Sequence
  Synthetic
taagaaaaaatacgggtagaatcaaagtgccccgactgtgccaaaatggactcatccaggacaatcggactgtac

SEQ ID NO: 258453 - DNA, 75 bp, Artificial Sequence
  Synthetic
cctttaggttgcgatatactgtgttctaaagtcacagagaccgaggaagaggattacaagtctgccactcccacc

SEQ ID NO: 258454 - DNA, 75 bp, Artificial Sequence
  Synthetic
aatacagcggcatggtacgcttctgtctaaatcagacgaaattacattgactaggctatttacctcacagcagca

SEQ ID NO: 258455 - DNA, 75 bp, Artificial Sequence
  Synthetic
ttcaactaacaaattccgaaagattgaaaagaagatccaaattcacaacacaaggtatggagaattgttcacaaa

SEQ ID NO: 258456 - DNA, 75 bp, Artificial Sequence
  Synthetic
caacaaattatgctcctgggcctatctctaattgaatcactcttcccaatgacaacaaccaagacgtatgatgag

SEQ ID NO: 258457 - DNA, 75 bp, Artificial Sequence
  Synthetic
tagattctcaagtcatcgtgacaggaaatctcgatatatcaactgagcttgggaatgttaacaactcgataagca

SEQ ID NO: 258458 - DNA, 75 bp, Artificial Sequence
  Synthetic
aaatcagcagcgtggatattcccattcaacgggccggggtcctcactggactcagcgacggaggcccccaagccc

SEQ ID NO: 258459 - DNA, 75 bp, Artificial Sequence
  Synthetic
gtattctccggcttagaacaaaatcaagcagccgagatgttgtgtctgttgcgtctgtggggccacccactactc

SEQ ID NO: 258460 - DNA, 75 bp, Artificial Sequence
  Synthetic
gatatacaagcgctataataacacatgccctgatgaacaagattaccaaatccggatggccaagtcctcatataa

SEQ ID NO: 258461 - DNA, 75 bp, Artificial Sequence
  Synthetic
tcatcacttatattgtcttagctgtcgtgtctcttgctttcggcataattagcctggttctagcatgctacctga

SEQ ID NO: 258462 - DNA, 75 bp, Artificial Sequence
  Synthetic
tggcaaataggtactcatcagtgaatgcagtaaagcatgtaaaagcaccagagaagatccccgggagcggaactc

SEQ ID NO: 258463 - DNA, 75 bp, Artificial Sequence
  Synthetic
agctcaaaactccgcaccgagcaccacccatccagaacctcccccaactcctgggccgtccccagacaacgacac

SEQ ID NO: 258464 - DNA, 75 bp, Artificial Sequence
  Synthetic
gtcatactccacaatggagctaatgaacattctctcaatatctagtgggaagttgattggccagtccgtggtttc

SEQ ID NO: 258465 - DNA, 75 bp, Artificial Sequence
  Synthetic
ccttacaatctttctacagacggtaaaaagagaacatcacttaaacagtgcacaaggcagatattagaggtcaca

SEQ ID NO: 258466 - DNA, 75 bp, Artificial Sequence
  Synthetic
caagaacctgaatacagatgagagatgaatgtatccccagtagcaattcgtacgtcaattctgatagcctgtcaa

SEQ ID NO: 258467 - DNA, 75 bp, Artificial Sequence
  Synthetic
aatgatgctataatagtgtacgacaacacacgaaattggatcagtgaagcccagaattcagatgtggtccgcctg

SEQ ID NO: 258468 - DNA, 75 bp, Artificial Sequence
  Synthetic
tcctccccccggcccacagccccgcacagccgagccgacgaggacgcccccccatcccatcccccacccccagcc

SEQ ID NO: 258469 - DNA, 75 bp, Artificial Sequence
  Synthetic
acagccgagccgacgaggacgcccccccatcccatcccccacccccagccgcacaacctcacccgtccaaagcaa

SEQ ID NO: 258470 - DNA, 75 bp, Artificial Sequence
  Synthetic
ggatatgaatggccgaaaaacaatacacgggtagaacggtcggagaagccaccctttagtcaggaaccaggtttc

SEQ ID NO: 258471 - DNA, 75 bp, Artificial Sequence
  Synthetic
tgaatacagtaggtctaatcaaccatgatgggtcacaccagcttgcagacatagatttcatcgaattgtctgcga

SEQ ID NO: 258472 - DNA, 75 bp, Artificial Sequence
  Synthetic
cacccagagaccaggacaagtcaccaaggtccctgctctcccctccacccagtggatcagggcggagatggctac

SEQ ID NO: 258473 - DNA, 75 bp, Artificial Sequence
  Synthetic
aacgaagaaagagaagcaaagaatacatggcgcctggttttccgggtcgcagtcctatctctaatagtaatgaca

SEQ ID NO: 258474 - DNA, 75 bp, Artificial Sequence
  Synthetic
aaggtccctgctctcccctccacccagtggatcagggcggagatggctaccttcacagacgcggagatagacgac

SEQ ID NO: 258475 - DNA, 75 bp, Artificial Sequence
  Synthetic
gaaaggtcattgggcagctacatgctgattcagcagagatctcacatgatgtcatgttgagagagtacaagagtt

SEQ ID NO: 258476 - DNA, 75 bp, Artificial Sequence
  Synthetic
ctcgtattcggattctaataattatcttaaaacaggagtctacgtagttgttcttgactatagtcctgtcattca

SEQ ID NO: 258477 - DNA, 75 bp, Artificial Sequence
  Synthetic
agcgcagccccacaaggcaagaccaaagcaccgagcacaacatgggagaaacatggggacacccaaccatccgcc

SEQ ID NO: 258478 - DNA, 75 bp, Artificial Sequence
  Synthetic
gtgatctccagggcagaggatagggttacatctttactcaattcaaatcaagatgtggtggatagggtatataaa

SEQ ID NO: 258479 - DNA, 75 bp, Artificial Sequence
  Synthetic
ggagatatcagacagtcaaattgttcgctcatgccatcaatcagctgatgggcctacctcacttcttcgagtgga

SEQ ID NO: 258480 - DNA, 75 bp, Artificial Sequence
  Synthetic
aagcaccgagcacaacatgggagaaacatggggacacccaaccatccgccagtcgggacacccccgaccaacaag

SEQ ID NO: 258481 - DNA, 75 bp, Artificial Sequence
  Synthetic
atcacgtctcccaacataattacattcccggccaatctatactacatgtccaggaagagccttaatttaatcagg

SEQ ID NO: 258482 - DNA, 75 bp, Artificial Sequence
  Synthetic
ttacctggtatttgtcatgggctatttaggcgggcctacattcgtgaacgaagtagtgaggatggcaaaaactct

SEQ ID NO: 258483 - DNA, 75 bp, Artificial Sequence
  Synthetic
gccaattgagtccgccgtaggatggttggaagaatgatgtggcaccaaatacctttcacgatgccaagagtcaaa

SEQ ID NO: 258484 - DNA, 75 bp, Artificial Sequence
  Synthetic
cccccaagtgacccgactgactgtgatctctcaagagtcccgaatgatgacatatatattgttagtgctagaggg

SEQ ID NO: 258485 - DNA, 75 bp, Artificial Sequence
  Synthetic
cactcctctctcaggctgcgagcgaggctggtgacgcgcaactcaagaccggagcaagcaactctcttctgtcca

SEQ ID NO: 258486 - DNA, 75 bp, Artificial Sequence
  Synthetic
atgaatagcaacacaagcccagatcccgtgctgccgggcagctacaatctggcgccactgacatgattggcctga

SEQ ID NO: 258487 - DNA, 75 bp, Artificial Sequence
  Synthetic
tgcttgacaagctgagcaataagtcgcctaatactaaaaagggcccatggtcaagtcctcaagaaggacatcatc

SEQ ID NO: 258488 - DNA, 75 bp, Artificial Sequence
  Synthetic
tgagagataatattgatgctgcactgattgaagctgggggacagcccgttcgtccgttctgtgcagagagtttag

SEQ ID NO: 258489 - DNA, 75 bp, Artificial Sequence
  Synthetic
tgtgccccagttcaacaacaggagcggagtgtctgaagagagagcacagagattcatggtgatagcagagtctct

SEQ ID NO: 258490 - DNA, 75 bp, Artificial Sequence
  Synthetic
ttaggcgggcctaccttcgtgcacgaagtggtaaggatggcaaaaactctaatacaacgacacggtacacttcta

SEQ ID NO: 258491 - DNA, 75 bp, Artificial Sequence
  Synthetic
ctctcaaccacagctctaagataatcggagtactccatcccaggtgtttagaagaactggttagtattgaggtcc

SEQ ID NO: 258492 - DNA, 75 bp, Artificial Sequence
  Synthetic
ttgcatctactatagcacggctatgcgagaacgggcttcccaaggatttctgttattacttaaactacctaatga

SEQ ID NO: 258493 - DNA, 75 bp, Artificial Sequence
  Synthetic
cgagaacgggcttcccaaggatttctgttattacttaaactacctaatgagttgcgtgcagacgtacttcgactc

SEQ ID NO: 258494 - DNA, 75 bp, Artificial Sequence
  Synthetic
cagaaacttctttaatatgcttgactcgtgctcaacaaaaattctacatgaaaaccataggtaatgcagccaagg

SEQ ID NO: 258495 - DNA, 75 bp, Artificial Sequence
  Synthetic
tccgcatttttttagttagtgagcttaagagaggccgcaatacggcaggtgggagctccacgtattacaacttag

SEQ ID NO: 258496 - DNA, 75 bp, Artificial Sequence
  Synthetic
agggcaatcacatgttaatgaactatcttcttaatcaattgctccctcattgatgtgatagtaccgtattagaaa

SEQ ID NO: 258497 - DNA, 75 bp, Artificial Sequence
  Synthetic
tgacccgggaactactgcctttgcagaggtcaagcgactagaggcagtggggttactgagtcctagcattatgac

SEQ ID NO: 258498 - DNA, 75 bp, Artificial Sequence
  Synthetic
atcaacatctttgggcgaggacccggtgctgactgtaccgccaaatacagttacactcatgggggccgagggcag

SEQ ID NO: 258499 - DNA, 75 bp, Artificial Sequence
  Synthetic
cactgtccgtgcattgatcacttcacgcccgatgcatccaagctcctcagccaagctcctgagtaagctggatgc

SEQ ID NO: 258500 - DNA, 75 bp, Artificial Sequence
  Synthetic
acaattatctaaaagcagaagtgaacgtggttgttcttaattatagtcccatcattcaccaaatctttgtttggt

SEQ ID NO: 258501 - DNA, 75 bp, Artificial Sequence
  Synthetic
atgaaacagctcatgcgtttatatcggatgaaaggagaaaatgcaccgtacatgacattgctaggtgacagcgac

SEQ ID NO: 258502 - DNA, 75 bp, Artificial Sequence
  Synthetic
aatcaaagcttactagatcaactggctaccaatttatctctgattgccatgcattctgtaagggaaggcggggta

SEQ ID NO: 258503 - DNA, 75 bp, Artificial Sequence
  Synthetic
catgacattgctaggtgacagcgaccagatgagcttcgcaccagctgaatatgcacaactctattcttttgccat

SEQ ID NO: 258504 - DNA, 75 bp, Artificial Sequence
  Synthetic
aggttcccgcctcttcaatgcaacaagggatctgtcctgggcccccccccacaaatccacgctccagcactccaa

SEQ ID NO: 258505 - DNA, 75 bp, Artificial Sequence
  Synthetic
atgcacaactctattcttttgccatgggcatggcatcagtcttagataagggaactggtaaataccaattcgcca

SEQ ID NO: 258506 - DNA, 75 bp, Artificial Sequence
  Synthetic
cctggcaatggagactgggccagcctgtgcaacgacccgtattcctttaattttgagactgttgcaagcccaaat

SEQ ID NO: 258507 - DNA, 75 bp, Artificial Sequence
  Synthetic
tataacagtgcgcaacaaaacagccactcttcatagtccttatacatttaatgcgttcactcggccgggtagtgt

SEQ ID NO: 258508 - DNA, 75 bp, Artificial Sequence
  Synthetic
tgacattccccatgtctcctggtatttattcctgtctgagcggcaatacgtcagcttgtatgtattcaaagactg

SEQ ID NO: 258509 - DNA, 75 bp, Artificial Sequence
  Synthetic
aatacaacggcacggtacacttctgtctaaatcagatgagattacattaactaggctatttacctcacagcagca

SEQ ID NO: 258510 - DNA, 75 bp, Artificial Sequence
  Synthetic
gctgttcagctgcttgagccgtcaggtacatttgcaggagatttctttgcattcaacctacaggagctcaaagac

SEQ ID NO: 258511 - DNA, 75 bp, Artificial Sequence
  Synthetic
ttgcagaaatatccaatactctatttggggaattcaggatcgttcctttactggtcgagattctcaaagatgata

SEQ ID NO: 258512 - DNA, 75 bp, Artificial Sequence
  Synthetic
acctacggattcattttccaagtcggggacgaagaagccactgtcggcacgatcaatgataaccccaggcaagag

SEQ ID NO: 258513 - DNA, 75 bp, Artificial Sequence
  Synthetic
ctggtcgagattctcaaagatgatagggtttaaggagctaagatcagccagctgtgtccaccacgcgggatatgg

SEQ ID NO: 258514 - DNA, 75 bp, Artificial Sequence
  Synthetic
tcaccgataccctggagaggatcctctctatccaggctcaagtatgggtcacagtagcaaaagccatgactgcgt

SEQ ID NO: 258515 - DNA, 75 bp, Artificial Sequence
  Synthetic
ttcagcctgccttcacaggatcatcccagaccatccgccggaaccctccctaaactccatgatccaccggcccac

SEQ ID NO: 258516 - DNA, 75 bp, Artificial Sequence
  Synthetic
gctattgagcaaccgcaatcggacaacgttgacgcgatcggcctgaatcttgtcaatagtcactctgtttagaaa

SEQ ID NO: 258517 - DNA, 75 bp, Artificial Sequence
  Synthetic
aaagttaaattctgattctttgaaactcgtgctcggattcaattaattatcctgaagcagaattgagcgtagttg

SEQ ID NO: 258518 - DNA, 75 bp, Artificial Sequence
  Synthetic
aatcgaaatcgtacgggtagaaggtgtgaaccccgagcgcgaggccgaagctcgaatctgagggaaccttctacc

SEQ ID NO: 258519 - DNA, 75 bp, Artificial Sequence
  Synthetic
aaggcaatcgcacatccaaaagataactggcttgcctcatttaggcgaaatcttctctctgaggaccaaaagaaa

SEQ ID NO: 258520 - DNA, 75 bp, Artificial Sequence
  Synthetic
cagccacgattctaaaataaccggagtgctccatcctaggtgtttagaagaattggctagtattgaaattcccga

SEQ ID NO: 258521 - DNA, 75 bp, Artificial Sequence
  Synthetic
ttgctaagttaacaaagaaactaaggaactgccaggtaatggcagaagggattctagctgaccagattgcacctt

SEQ ID NO: 258522 - DNA, 75 bp, Artificial Sequence
  Synthetic
tgatgaggaaccatgttgcccttgcagggaaacagaatgaggccacactggctgttcttgagattgatggtttta

SEQ ID NO: 258523 - DNA, 75 bp, Artificial Sequence
  Synthetic
gatcctccaaccgcacctaaagaaccgctccccactcaggccgcaggtgatgctggcgacacacagctcaagacc

SEQ ID NO: 258524 - DNA, 75 bp, Artificial Sequence
  Synthetic
tgctggcgacacacagctcaagaccggagcaagcaactctcttttgtcaatgcttgacaagctgagcaacaaatc

SEQ ID NO: 258525 - DNA, 75 bp, Artificial Sequence
  Synthetic
cagcattcgtatggatccagccttttggtttcactcaaaatggtctagagccaagtttgcctggctccatataaa

SEQ ID NO: 258526 - DNA, 75 bp, Artificial Sequence
  Synthetic
cctggcagctgctgcccaacgggtctccgaggagaccagcagcatagacatgcctactcaacaagtcggagtcct

SEQ ID NO: 258527 - DNA, 75 bp, Artificial Sequence
  Synthetic
ctcaggcttatacgcagggaataagtatgatctgctgttcccatccgtcctagatgataacctgagtgagaagat

SEQ ID NO: 258528 - DNA, 75 bp, Artificial Sequence
  Synthetic
ttccagccaatctatattacatgtctagaaagagccttaatttgatcagggaacgagaggacagagatactatct

SEQ ID NO: 258529 - DNA, 75 bp, Artificial Sequence
  Synthetic
tgcttgacaagctgagcaacaaatcgtctaatgctaaaaaagggccaaggtcgatcccccaggagggccaccatc

SEQ ID NO: 258530 - DNA, 75 bp, Artificial Sequence
  Synthetic
tgacattaaggtctacccgcttccttgaatcattgcgacaccagataatgatccgccttgactacccacagttaa

SEQ ID NO: 258531 - DNA, 75 bp, Artificial Sequence
  Synthetic
ttcgagtggattcatcttagacttatggacactacgatgtttgtgggggatccttttaatcctccaagtgacccg

SEQ ID NO: 258532 - DNA, 75 bp, Artificial Sequence
  Synthetic
cgcgagcacagcatatcatggacaatggaaggagtcacaaccatcagctggtgcaacccctcatgtgctccagtc

SEQ ID NO: 258533 - DNA, 75 bp, Artificial Sequence
  Synthetic
ccgtccacccagcaccacacggcatctgcacgaggctcctctctgcaaacccaaggtccaacaccccgggcgaca

SEQ ID NO: 258534 - DNA, 75 bp, Artificial Sequence
  Synthetic
catgtgccacatgagactatctattacaatacgctcttctcaaatgagatgaaccctccacagcgacatttcgga

SEQ ID NO: 258535 - DNA, 75 bp, Artificial Sequence
  Synthetic
ctggcagtccgtattttcttagttagtgagcttaagagaggccgcaatacagcaggtgggagctccacatattac

SEQ ID NO: 258536 - DNA, 75 bp, Artificial Sequence
  Synthetic
aacacgggtagaagagtccggatcccggccggcacatccaaagcgcagcatgggccccaaaccccccaccggaac

SEQ ID NO: 258537 - DNA, 75 bp, Artificial Sequence
  Synthetic
ggaactccttatacttggcggaaggaagcggagccatcatgagtcttcttgaattgcatataccgcatgagacca

SEQ ID NO: 258538 - DNA, 75 bp, Artificial Sequence
  Synthetic
ccccgtatgcaggagtgcaattcaactcacgatcagacattctctggcagtccgcattttcttagttagcgagct

SEQ ID NO: 258539 - DNA, 75 bp, Artificial Sequence
  Synthetic
tgaatcattgcgacaccagataatgatccgccttgactacccacagttaacttacctatctatccaattaaaaaa

SEQ ID NO: 258540 - DNA, 75 bp, Artificial Sequence
  Synthetic
tgtacaactccgcacgccctagataccacaggcacaatgcggctcactaacaatcaaaacagagccgagggaatt

SEQ ID NO: 258541 - DNA, 75 bp, Artificial Sequence
  Synthetic
ccacaggcacaatgcggctcactaacaatcaaaacagagccgagggaattagaaaaaagtacgggtagaagaggg

SEQ ID NO: 258542 - DNA, 75 bp, Artificial Sequence
  Synthetic
acaagcggaagtgccttgtaaagatggatttgtccaggagttctgcccactatggagagagaatgcagaagaaag

SEQ ID NO: 258543 - DNA, 75 bp, Artificial Sequence
  Synthetic
actcctcttggtgactccatccggaggatacaagggtctgcaactacatctagaggaaggagacagaaacgtttt

SEQ ID NO: 258544 - DNA, 75 bp, Artificial Sequence
  Synthetic
ttaattaaatctgccatggtgagcgggcctgatatgggagtggagaaggacactgtccgtgcattaatcacatcg

SEQ ID NO: 258545 - DNA, 75 bp, Artificial Sequence
  Synthetic
caagccaaccagaacgctgccaacatcctccggcttaaggagagcattgctgcaaccaatgaagctgtgcacgag

SEQ ID NO: 258546 - DNA, 75 bp, Artificial Sequence
  Synthetic
aatgaggacatggctgctgagctaaaactaactccggcagcaaggagaggcctggcagccgccgcccaacgagta

SEQ ID NO: 258547 - DNA, 75 bp, Artificial Sequence
  Synthetic
tacctaatgagttgcgtgcagacatactttgactctgagttttctattactcacagctcgcaatcagattccgac

SEQ ID NO: 258548 - DNA, 75 bp, Artificial Sequence
  Synthetic
cgagccccacagggcggatcgaataagctgcaaggtcaaccagatgccggggacggggagacccaattcttggac

SEQ ID NO: 258549 - DNA, 75 bp, Artificial Sequence
  Synthetic
attgacacagtcattagatctgtgatttacatggaggctgagggtgaccttgctgacacagtgttcttatttact

SEQ ID NO: 258550 - DNA, 75 bp, Artificial Sequence
  Synthetic
agctgcaaggtcaaccagatgccggggacggggagacccaattcttggacctgatgagggcagtggcaaacagca

SEQ ID NO: 258551 - DNA, 75 bp, Artificial Sequence
  Synthetic
gaaacgaccctctctcgcctctctcacttccccgagtgatcgcgcaactgcaatcaatctaacagcattagagat

SEQ ID NO: 258552 - DNA, 75 bp, Artificial Sequence
  Synthetic
acttccccgagtgatcgcgcaactgcaatcaatctaacagcattagagattaagaaaaaatacgggtagaatcaa

SEQ ID NO: 258553 - DNA, 75 bp, Artificial Sequence
  Synthetic
ctctctgaggaccaaaagaaacatgtaaaggaagcgacctcaactaatcgcctcttgatagagttcctggagtca

SEQ ID NO: 258554 - DNA, 75 bp, Artificial Sequence
  Synthetic
acgacactgactgggggtactgattgacaacgcccagtctaccccaacagggtcgtcccaaactctcctctcaga

SEQ ID NO: 258555 - DNA, 75 bp, Artificial Sequence
  Synthetic
atgactcacagacccaactcttaggcatacagataaatgtaccctcagtcgggagcctaaataatatgcgtgcca

SEQ ID NO: 258556 - DNA, 75 bp, Artificial Sequence
  Synthetic
cccagctgcacgacctcatttgtccgagggaacacaggcacgactcggcccaccagcaatctattcagagcccag

SEQ ID NO: 258557 - DNA, 75 bp, Artificial Sequence
  Synthetic
caaggaagactcagtatttatcaccacctacggattcatcttccaaattgggaatgaagaggtcactgttggcac

SEQ ID NO: 258558 - DNA, 75 bp, Artificial Sequence
  Synthetic
gagggaacacaggcacgactcggcccaccagcaatctattcagagcccagggtattagaaaaaaatacgggtaga

SEQ ID NO: 258559 - DNA, 75 bp, Artificial Sequence
  Synthetic
tggccacttttacagatgcggagattgacgatatacttgagaccagtgggactgtcattgacagcataattacgg

SEQ ID NO: 258560 - DNA, 75 bp, Artificial Sequence
  Synthetic
gagccaagacaatactcctgcacttgtggatcatgtccagctacctgtcgactttgtgcaggcgatgatgtctat

SEQ ID NO: 258561 - DNA, 75 bp, Artificial Sequence
  Synthetic
tggcaaataagtactcatcagtgaatgcagtgaagcatgtgaaagcacccgagaagatccctgggagtggaaccc

SEQ ID NO: 258562 - DNA, 75 bp, Artificial Sequence
  Synthetic
gcacaccagccaggacaaccccgaccaacaggccggaccagacggacagccatccacacacgagcaggcgacccc

SEQ ID NO: 258563 - DNA, 75 bp, Artificial Sequence
  Synthetic
tagagtataaagtgaatttcgtctctttgactgtagtgccgaggaaggatgtctacaggatcccaactgcagcat

SEQ ID NO: 258564 - DNA, 75 bp, Artificial Sequence
  Synthetic
caggaccggagcaagcaactctctcctgtccatgctcgacaagctgagcaataagtcatccaatgctaaaaaggg

SEQ ID NO: 258565 - DNA, 75 bp, Artificial Sequence
  Synthetic
gacgtggaggtagacccgaagagcccgctagtcaaatctctttctaagtctgatagtggatactatgctaatctt

SEQ ID NO: 258566 - DNA, 75 bp, Artificial Sequence
  Synthetic
ctgtccatgctcgacaagctgagcaataagtcatccaatgctaaaaagggctcaaggtcaggtccccaagaaggg

SEQ ID NO: 258567 - DNA, 75 bp, Artificial Sequence
  Synthetic
gaatgaaaggagataatgcgccgtatatgacattgctcggtgacagtgaccagatgagctttgcacccgccgagt

SEQ ID NO: 258568 - DNA, 75 bp, Artificial Sequence
  Synthetic
tgtataaacaaaaagcacaacaaaagaccttactatggcttgggaacaataccctcgatcagatgagagccacca

SEQ ID NO: 258569 - DNA, 75 bp, Artificial Sequence
  Synthetic
tcgggcgggcagtgcaccagactctcaaccacaattctaagataaccggagtgctccatcctaggtgtttagaag

SEQ ID NO: 258570 - DNA, 75 bp, Artificial Sequence
  Synthetic
ttgagagaagtaagaaaaaactactggatataagtgaccaaagagcaatacacgggtagaacggtcggagaagtc

SEQ ID NO: 258571 - DNA, 75 bp, Artificial Sequence
  Synthetic
ctgaatgatcgcgcaactgcaattaatctagcagcattaaagattaagaaaaaatacgggtagaatcggagtgcc

SEQ ID NO: 258572 - DNA, 75 bp, Artificial Sequence
  Synthetic
accctctattcaggtaccaggcttcacaacatctgctccaccgcaccaccaataacagacttcggccatggatca

SEQ ID NO: 258573 - DNA, 75 bp, Artificial Sequence
  Synthetic
gctatgtgaaaacggacttcctaaggacttctgttattacttaaactacctaatgtgttgtgtacaaacatattt

SEQ ID NO: 258574 - DNA, 75 bp, Artificial Sequence
  Synthetic
caggacaatcgggctgtacttcgattccacccttccttccagcaacctgctagcattcccgatcgtcctacaaga

SEQ ID NO: 258575 - DNA, 75 bp, Artificial Sequence
  Synthetic
cacaaggtggatcaaacagatcacaagggcaaccggacaccggggatggggagacccaatttctggatttgatga

SEQ ID NO: 258576 - DNA, 75 bp, Artificial Sequence
  Synthetic
atctatcttgattgcttatagttagtttacctgtctatctaattagaaaaaacacgggtagaagagtctggatcc

SEQ ID NO: 258577 - DNA, 75 bp, Artificial Sequence
  Synthetic
aatgaagaaagggaagcaaaaaacacatggcgcttggtttttcggatcacagtcttatctctaatagtaatgact

SEQ ID NO: 258578 - DNA, 75 bp, Artificial Sequence
  Synthetic
atggtaacctcaaataagttcatgtatgatcctagccctatatcagagagagattttgcaagacttgacttagct

SEQ ID NO: 258579 - DNA, 75 bp, Artificial Sequence
  Synthetic
acattcgtatgtcttaacccctgctcagcttgggggactaagtaaccttcaatactcaaggctctacacaagaaa

SEQ ID NO: 258580 - DNA, 75 bp, Artificial Sequence
  Synthetic
gagtgatcttgcaggcatatcgacagtgatctctaaggcagaagatagggttacatctttactcagtctgaatca

SEQ ID NO: 258581 - DNA, 75 bp, Artificial Sequence
  Synthetic
aactctcgcaacctgtacagcacccctcagagctaattaagtctgccactgcaagcgggcctgacatgggagtcg

SEQ ID NO: 258582 - DNA, 75 bp, Artificial Sequence
  Synthetic
taggcatgatgaaaattctggaccctggttgcgctaacatttcatccttaagtgacctccgggcagtagcccgat

SEQ ID NO: 258583 - DNA, 75 bp, Artificial Sequence
  Synthetic
ctcagagctaattaagtctgccactgcaagcgggcctgacatgggagtcgagaaagacactgtccgtgcactaat

SEQ ID NO: 258584 - DNA, 75 bp, Artificial Sequence
  Synthetic
tctgcccgacgagctctcttgacggcaggccacttgcagctgcagggattgtggtaacaggagataaagcaatca

SEQ ID NO: 258585 - DNA, 75 bp, Artificial Sequence
  Synthetic
tatgaatgcaataacgtctctctcttatcaaattaatggggctgcaaataatagtgggtgtggggcacctgttca

SEQ ID NO: 258586 - DNA, 75 bp, Artificial Sequence
  Synthetic
ctttgagactgtcgcaagcccaaatattgtccttaagaaacatacacaaaaagtcttattcgaaacttgttcaaa

SEQ ID NO: 258587 - DNA, 75 bp, Artificial Sequence
  Synthetic
agagaagattcccgggagtggaaccctagaatacaaggtgaactttgtctccttgactgtggtaccgaagaagga

SEQ ID NO: 258588 - DNA, 75 bp, Artificial Sequence
  Synthetic
ctgcaaagctgtatggttgtggcgaacagatactcgtcagtgaatgcagttaagcacgtgaaagtaccagagaag

SEQ ID NO: 258589 - DNA, 75 bp, Artificial Sequence
  Synthetic
gagtcccgtattgcagcaaaagcagtaaggagccaaatgtgcgcaccaaaaatggtagacttcgatatgatcctc

SEQ ID NO: 258590 - DNA, 75 bp, Artificial Sequence
  Synthetic
gataaggaagatcaaacgccttgcgctgaatggctgactgccaccacaactcaccacaggctcctgcccctctag

SEQ ID NO: 258591 - DNA, 75 bp, Artificial Sequence
  Synthetic
cacagagcagatcaagcaagacgcaggggcaaccagatgttggggatggggaggcccaattcctggacttgatga

SEQ ID NO: 258592 - DNA, 75 bp, Artificial Sequence
  Synthetic
cccggcagcaaggaggggcctggcagctgctgcccaacgagtgtctgaggaaatcggtggcatggatatccccac

SEQ ID NO: 258593 - DNA, 75 bp, Artificial Sequence
  Synthetic
cgacatgagcgccacccattactgttatacccacaatgtgattctatctggttgtagggatcactcacattcaca

SEQ ID NO: 258594 - DNA, 75 bp, Artificial Sequence
  Synthetic
tccccccactcccctgaatgatcgcgcaactgcaatcaatataacagcattagagattaagaaaaaacacgggta

SEQ ID NO: 258595 - DNA, 75 bp, Artificial Sequence
  Synthetic
tttgctgcgtttgtgggggcacccactgcttgagtcccgtattgcagcaaaagcagtcaggggccagatgtgcgc

SEQ ID NO: 258596 - DNA, 75 bp, Artificial Sequence
  Synthetic
ggaatgtcattagacagctgcacgctgattcagcagagatttcacatgatgtcatgttgagggagtacaagagtc

SEQ ID NO: 258597 - DNA, 75 bp, Artificial Sequence
  Synthetic
cgacacacaactcaagaccggagcgagcaactccttgctgtccatgcttgataagctcagcaataagtcgtccaa

SEQ ID NO: 258598 - DNA, 75 bp, Artificial Sequence
  Synthetic
catccaagcgctttataatttagctggcggcaacatggattacttattgactaaattaggtatagggaacaatca

SEQ ID NO: 258599 - DNA, 75 bp, Artificial Sequence
  Synthetic
ttgattacaggtaaccccatactgtatgactcacagactcaactcttgggcatccaggtaaatttaccctcagtc

SEQ ID NO: 258600 - DNA, 75 bp, Artificial Sequence
  Synthetic
tcatactcactcaaagagaaggaggtgaaagttaatgggcggattttcgctaaattaaccaagaaattaaggaac

SEQ ID NO: 258601 - DNA, 75 bp, Artificial Sequence
  Synthetic
catagtcaagttactcccaaatatgcccaaggacaaagaggcgtgtgcaaaagccccattggaggcatacaacag

SEQ ID NO: 258602 - DNA, 75 bp, Artificial Sequence
  Synthetic
tgctcgataagctgagcagtaagtcatccaatgctaaaaagggcccagggacgggtccccaagaaagacaccacc

SEQ ID NO: 258603 - DNA, 75 bp, Artificial Sequence
  Synthetic
ttacttagtacggtacttattcagaggaatagggactgcttcatcctcatggtataaagcttctcatctactctc

SEQ ID NO: 258604 - DNA, 75 bp, Artificial Sequence
  Synthetic
tcagctgctgtatcagggaagcacccgtcgcagtacccttcgagctcctcgggttggcaccggaattgaggacag

SEQ ID NO: 258605 - DNA, 75 bp, Artificial Sequence
  Synthetic
tcttgaattgcatataccgcatgagaccatctactacaatacgcttttctcaaatgagatgaacccgccacagcg

SEQ ID NO: 258606 - DNA, 75 bp, Artificial Sequence
  Synthetic
tcctgagcaagctggatgcagctggatcgattgaagagatcaggaaaatcaagcgccttgcactgaatggctaat

SEQ ID NO: 258607 - DNA, 75 bp, Artificial Sequence
  Synthetic
gggttggcaccggaattgaggacagtaaccacaaataagttcatgtatgatcccagccctgtatcagagagagac

SEQ ID NO: 258608 - DNA, 75 bp, Artificial Sequence
  Synthetic
tcttatcattagatggggtaactctaaggctcagtggggagtttgatgcaacttatcaaaagaatatctcaatac

SEQ ID NO: 258609 - DNA, 75 bp, Artificial Sequence
  Synthetic
aaggctcagtggggagtttgatgcaacttatcaaaagaatatctcaatactagattctcaagtcatcgtgacagg

SEQ ID NO: 258610 - DNA, 75 bp, Artificial Sequence
  Synthetic
agtggggtatatcacatctgtagtgccctacaggtctgtggcattactgcattgtgatattgagattcctccggg

SEQ ID NO: 258611 - DNA, 75 bp, Artificial Sequence
  Synthetic
ggtcactgacggattatcgcaactagcagtggcagttgggaagatgcagcagtttgttaatgaccaatttaataa

SEQ ID NO: 258612 - DNA, 75 bp, Artificial Sequence
  Synthetic
ctggtcgagatcctcaaggaagacagggtttaagaggctaggttcaaccagccgggtcaaccacgagagggatga

SEQ ID NO: 258613 - DNA, 75 bp, Artificial Sequence
  Synthetic
tgaaagtcatcattcaagccggcacccagcgtgctgtcgcagtgactgctgatcatgaggtcacctctacgaaga

SEQ ID NO: 258614 - DNA, 75 bp, Artificial Sequence
  Synthetic
gctttcctgaatcattatgacactagatagtgatccattttgattgattatagttattgcacctgtctatctact

SEQ ID NO: 258615 - DNA, 75 bp, Artificial Sequence
  Synthetic
atatcaatacgagttcgaaccccatactatcgggcagccacagtcggacaacgctgacatgatcagtctaaatct

SEQ ID NO: 258616 - DNA, 75 bp, Artificial Sequence
  Synthetic
cacattcttcatatatagcaagcgaatattcaaagatggagcaatactcagtcaggtccttaagaactcatctaa

SEQ ID NO: 258617 - DNA, 75 bp, Artificial Sequence
  Synthetic
ccaggactccagtatccctgatgcctattgtccagattatgctggtactatgctgtgtctatatgacaagctccc

SEQ ID NO: 258618 - DNA, 75 bp, Artificial Sequence
  Synthetic
acaaggtgaattttgtctctttgaccgtggtgccgaggaaggatgtctacaaaataccaactgcagcactaaagg

SEQ ID NO: 258619 - DNA, 75 bp, Artificial Sequence
  Synthetic
cgtgacctcaggtctatacgcagggaataagtatgacctactgtttccatctgttttagatgataacttgagtga

SEQ ID NO: 258620 - DNA, 75 bp, Artificial Sequence
  Synthetic
aggttcctgcctccctagcgtcacacaaaattcttctaggggcccctttaataaacccacactccaaaacaccaa

SEQ ID NO: 258621 - DNA, 75 bp, Artificial Sequence
  Synthetic
tagcagagttgcgctagagaatgaagaaagagaagcaaagaatacatggcgctttgtattccggatcgcaatctt

SEQ ID NO: 258622 - DNA, 75 bp, Artificial Sequence
  Synthetic
gaacgagaggacagagatataatcttgacattactgttccctcaggaaccgctacttgagtttcgtccattacag

SEQ ID NO: 258623 - DNA, 75 bp, Artificial Sequence
  Synthetic
tgagttgactacggtattcgggccacagattacttcccctgccttaacacagctgactattcaggcgctttataa

SEQ ID NO: 258624 - DNA, 75 bp, Artificial Sequence
  Synthetic
caaggcatcacacctactttctgtacctgaggtcagatgtgcaaggcatggaaactccttgtacctggcggaagg

SEQ ID NO: 258625 - DNA, 75 bp, Artificial Sequence
  Synthetic
ccactgacttaattataccgtattagaaaaaagttaaattccgactctttgaaactcgtattcgaattcagttga

SEQ ID NO: 258626 - DNA, 75 bp, Artificial Sequence
  Synthetic
aagccccattggaggcgtacaacaggacattgactactctgctcaccccccttggtgattctatccgtaggatac

SEQ ID NO: 258627 - DNA, 75 bp, Artificial Sequence
  Synthetic
taggttgtgatatactgtgctctaaagtcacagaggctgaagaagaggattataagtcagttactcccacatcaa

SEQ ID NO: 258628 - DNA, 75 bp, Artificial Sequence
  Synthetic
atttgcaggggatttttttgcattcaacctgcaagagctcaaagatactttaatcgaactcctcccaaatgatat

SEQ ID NO: 258629 - DNA, 75 bp, Artificial Sequence
  Synthetic
aacctgcaagagctcaaagatactttaatcgaactcctcccaaatgatatagtagaatcagtgactcacacaatc

SEQ ID NO: 258630 - DNA, 75 bp, Artificial Sequence
  Synthetic
cgacattgaaattcctccaggatccaaccaaagcttactggatcaactagctactaacttatccctgattgccat

SEQ ID NO: 258631 - DNA, 75 bp, Artificial Sequence
  Synthetic
gcaatataaactcagagtatcttcgactattgtcacccctacctacagctgggaatctccaacatagattggatg

SEQ ID NO: 258632 - DNA, 75 bp, Artificial Sequence
  Synthetic
aatacagcagcacggtacgctcctgtctaaatcggacgaaattacgttgactgggttatttacctcacagaagca

SEQ ID NO: 258633 - DNA, 75 bp, Artificial Sequence
  Synthetic
ccctgcatctctctatagggtatcaccttacattcacatatccaatgattctcaaaggctatttaccgaagaagg

SEQ ID NO: 258634 - DNA, 75 bp, Artificial Sequence
  Synthetic
ttatgaacgcaataacatctctctcttatcagattaatggagctgcaaacaacagtgggtggggggcacctatcc

SEQ ID NO: 258635 - DNA, 75 bp, Artificial Sequence
  Synthetic
ataagcagtgccttggacaagttggcagaaagtaacagcaagctagacaaggtcaatgtcagactcaccagcaca

SEQ ID NO: 258636 - DNA, 75 bp, Artificial Sequence
  Synthetic
caaaggatttgcctcagcacttgtcccaaaggtggtgacacaggtcggttccgtgatagaagaacttgacacctc

SEQ ID NO: 258637 - DNA, 75 bp, Artificial Sequence
  Synthetic
atttaggatcgttcctttactagttgagattctcaagaatgatggggtttaagaagccaggtctggttagttgag

SEQ ID NO: 258638 - DNA, 75 bp, Artificial Sequence
  Synthetic
ccgtgatagaagaacttgacacctcatactgtatagagaccgatttagatctatattgtacaagaatagtgacat

SEQ ID NO: 258639 - DNA, 75 bp, Artificial Sequence
  Synthetic
tacctaatgtataaacaaaaagcacaacaaaagaccctactatggcttgggaataatacccttgatcagatgaga

SEQ ID NO: 258640 - DNA, 75 bp, Artificial Sequence
  Synthetic
ctatattgtacaagaatagtgacattccctatgtctcctggtatttactcctgtttgagcggcaatacatcggct

SEQ ID NO: 258641 - DNA, 75 bp, Artificial Sequence
  Synthetic
gggttggcaccagagttaaggacagtaactacaaataagttcatgtatgatcctagccctgtagcggagagagac

SEQ ID NO: 258642 - DNA, 75 bp, Artificial Sequence
  Synthetic
tgcagtattcgacaacatatctcgcagtcgtgtaacccgagtaagttcaagcagcaccaaggcagcatacacgac

SEQ ID NO: 258643 - DNA, 75 bp, Artificial Sequence
  Synthetic
atcagtatttagcacttggtgtgctccggacatctgcaacagggagggtattcttttctactctgcgttccatca

SEQ ID NO: 258644 - DNA, 75 bp, Artificial Sequence
  Synthetic
ctgtcgaatggaagacttaagaaaaaactgctgggtataagcaatcaaagagcagtacacgggtagaacgatcag

SEQ ID NO: 258645 - DNA, 75 bp, Artificial Sequence
  Synthetic
ggatacaagggtctgtgtctacatctggagggaggagacagaagcgctttataggtgccgttattggcagtgtag

SEQ ID NO: 258646 - DNA, 75 bp, Artificial Sequence
  Synthetic
ttgcagaaatatccaacaccctatttggggaattcagaatcgttcctttgttagttgagattctaaaggatgata

SEQ ID NO: 258647 - DNA, 75 bp, Artificial Sequence
  Synthetic
ccttggacgggataactttgaggctcagtggggaatttgatgcaacttatcaaaagaatatctcaatacaagatt

SEQ ID NO: 258648 - DNA, 75 bp, Artificial Sequence
  Synthetic
ggccaggacacctccgaccaacaggacagaccagacaaacagccatccacacctgagcaggcgaccccacacaac

SEQ ID NO: 258649 - DNA, 75 bp, Artificial Sequence
  Synthetic
gaacaccgggcttactgcattcttcctgacacttaagtatggaattaacaccaagacatcagcccttgcacttag

SEQ ID NO: 258650 - DNA, 75 bp, Artificial Sequence
  Synthetic
aactgctgggtataagcaatcaaagagcagtacacgggtagaacgatcagagaagccacccttcaattgaagacc

SEQ ID NO: 258651 - DNA, 75 bp, Artificial Sequence
  Synthetic
tcgccgaagagttgccacttttatcacgactgacctgcagaaatactgtcttaactggagatatcagacaatcaa

SEQ ID NO: 258652 - DNA, 75 bp, Artificial Sequence
  Synthetic
caacctggtcataccatattagaaaaaagttgaatcccgattctttggaactcgtattcggattctaataattat

SEQ ID NO: 258653 - DNA, 75 bp, Artificial Sequence
  Synthetic
atacaagcgatacaatgacacatgcccagatgagcaagactaccagattcgaatggccaagtcttcgtataagcc

SEQ ID NO: 258654 - DNA, 75 bp, Artificial Sequence
  Synthetic
atatggctgccgagctaaagctaaccccagcagcaaggagaggcctggcagctgctgcccaacgagtgtctgagg

SEQ ID NO: 258655 - DNA, 75 bp, Artificial Sequence
  Synthetic
gaccagatgagggccactacgaaaatgtgaacgtaaatgagaggtgggggcgtctccaatagcggtttgtgtgta

SEQ ID NO: 258656 - DNA, 75 bp, Artificial Sequence
  Synthetic
ctcgtattcggattctaataattatcttcgaacagaagtatacgtagttgtcttcgactatattcctgtcattca

SEQ ID NO: 258657 - DNA, 75 bp, Artificial Sequence
  Synthetic
ggtactgactgtaccgcccaacacagtcacactcatgggggccgaaggcagaattctcacagtagggacatctca

SEQ ID NO: 258658 - DNA, 75 bp, Artificial Sequence
  Synthetic
ctcatccagaacaatcgggctgtactttgactctgccctcccttccagcagcctgttagcattcccgatcgtctt

SEQ ID NO: 258659 - DNA, 75 bp, Artificial Sequence
  Synthetic
cacaaccaaagggtttgcctcagcacttgtcccgaaggtggtgacacaagtcggttccgtgatagaagagcttga

SEQ ID NO: 258660 - DNA, 75 bp, Artificial Sequence
  Synthetic
caatcacaattccaagataaccggagtactccatcccaggtgtttagaagaactgtcaagtattgaggtccctga

SEQ ID NO: 258661 - DNA, 75 bp, Artificial Sequence
  Synthetic
tgtgcttcgggtatctgcaacaggaaaggtattcttctctactttgcgttccatcaatttagatgacacccaaaa

SEQ ID NO: 258662 - DNA, 75 bp, Artificial Sequence
  Synthetic
tggcattattgttccctcaggaaccgctacttgagtttcgtccattacaagatattggtgcgcgagtgaaagatc

SEQ ID NO: 258663 - DNA, 75 bp, Artificial Sequence
  Synthetic
actcccttaggttgtgatatgctgtgttctaaagttacagagaccgaggaagaggactacaaatcggtcaccccc

SEQ ID NO: 258664 - DNA, 75 bp, Artificial Sequence
  Synthetic
ccagcaaggtacgatgcatttacacttgatgagtctcaccttgagcacacactgccaaacccagaggaagattac

SEQ ID NO: 258665 - DNA, 75 bp, Artificial Sequence
  Synthetic
catcaacttgttttaaagtggtcaagactaataagacctattgtctcagcattgctgaaatatctaatactctct

SEQ ID NO: 258666 - DNA, 75 bp, Artificial Sequence
  Synthetic
agatgcggagatcgacgagctatttgagaccagtggaactgtcattgacagcataattacggcccaggggaaacc

SEQ ID NO: 258667 - DNA, 75 bp, Artificial Sequence
  Synthetic
ggtagagactgttggaaggagtgcaatcccacaaggcaaaaccaaggcgctgagcgcagcatgggagaagcatgg

SEQ ID NO: 258668 - DNA, 75 bp, Artificial Sequence
  Synthetic
ggagggctcaaacccaactcacctagcgacactgcacaggaagggaaatatgtaatatacaagcgctacaataac

SEQ ID NO: 258669 - DNA, 75 bp, Artificial Sequence
  Synthetic
catcattcaagctggcacccaacgtgctgttgcagtgactgctgatcatgaggttacctctactaagatagagaa

SEQ ID NO: 258670 - DNA, 75 bp, Artificial Sequence
  Synthetic
ccctttattatccggagtacatacagaggacaatgaggcagaagagaaggcattggctgaattcttactcaatca

SEQ ID NO: 258671 - DNA, 75 bp, Artificial Sequence
  Synthetic
tcttgttgagctggcgagagcctgcctcactatggtggtaacctgcaagaagagtgcaactaacactgagagaat

SEQ ID NO: 258672 - DNA, 75 bp, Artificial Sequence
  Synthetic
tcttcatatttctcccctgccttattataccctatgacagtacgcaacaaaacagctactcttcatagtccttat

SEQ ID NO: 258673 - DNA, 75 bp, Artificial Sequence
  Synthetic
agaatcaagcagctgagatgttgtgcttgttgcgtttgtggggtcacccactacttgagtcccgtagtgcagcaa

SEQ ID NO: 258674 - DNA, 75 bp, Artificial Sequence
  Synthetic
tatcctaccagagtcacacctgtcttcaccattggtcaagcacaaactactctattactggaaattaactgggct

SEQ ID NO: 258675 - DNA, 75 bp, Artificial Sequence
  Synthetic
ggagtctatactgatccgtatcccttagtcttcaataagaatcataccctacgaggggtcttcgggacaatgctt

SEQ ID NO: 258676 - DNA, 75 bp, Artificial Sequence
  Synthetic
actgtaccgcccaacacagtcacactcatgggggctgaaggcagagttctcacagtagggacatctcatttcttg

SEQ ID NO: 258677 - DNA, 75 bp, Artificial Sequence
  Synthetic
tcttgtccaatagatccaaccaccctttagtctcctctaatatgtgttcgctaacactagcagattatgcgcgga

SEQ ID NO: 258678 - DNA, 75 bp, Artificial Sequence
  Synthetic
aagccaaaacaatactcctgcacctgtggatcatgtccagctacctgtcaactttgtgcaagcaataatttctat

SEQ ID NO: 258679 - DNA, 75 bp, Artificial Sequence
  Synthetic
gatgatgtgcaggcaagactcaatcctgtatctgcagtatttgataacatatcccgcagccgtgtaacccgggtg

SEQ ID NO: 258680 - DNA, 75 bp, Artificial Sequence
  Synthetic
gaaaaagaattcaggtgtgtggccacgagtcaagatagacacgatatatgggaaggtcattgggcagctacatgc

SEQ ID NO: 258681 - DNA, 75 bp, Artificial Sequence
  Synthetic
cagctgaaaacatccgttgcggtcatggaagccaatttgggcatgatgaagattctggaccctggttgtgccaac

SEQ ID NO: 258682 - DNA, 75 bp, Artificial Sequence
  Synthetic
gattgaagccggggggcagcctgtccgtccattctgtgcagagagtttagtgagcacactaacagatatgactca

SEQ ID NO: 258683 - DNA, 75 bp, Artificial Sequence
  Synthetic
aagccgaacaccaacacaggcccagatcccatgctcccgggcagccacaatccgacaatgctaacatagtcagtc

SEQ ID NO: 258684 - DNA, 75 bp, Artificial Sequence
  Synthetic
ccgttcactcagcatcacaaggtatctgcaccgagcccctccccgcaaacccaaggtccaacactccgagcgaca

SEQ ID NO: 258685 - DNA, 75 bp, Artificial Sequence
  Synthetic
atatgtcctgacccctgcccagctggggggactgagtaaccttcaatactcaaggctctacacaaggaacatcgg

SEQ ID NO: 258686 - DNA, 75 bp, Artificial Sequence
  Synthetic
agctggccgtaatcagccagcgccaatgtgattagattaaatcttgtcgatgatcacttgattaagaaaaaatgt

SEQ ID NO: 258687 - DNA, 75 bp, Artificial Sequence
  Synthetic
gacaacaaccaagacatatgatgaaatcacattacacctccacagtaaatttagttgctgtatcagggaagcacc

SEQ ID NO: 258688 - DNA, 75 bp, Artificial Sequence
  Synthetic
ttaaacccaattcgcctagtgacactgcacaggaagggaaatatgtgatatacaagcgctataacaacacatgcc

SEQ ID NO: 258689 - DNA, 75 bp, Artificial Sequence
  Synthetic
tgtacaagcagaaggcacaacaaaagaccctgctatggcttgggaacaataccctcgatcagatgagagccacta

SEQ ID NO: 258690 - DNA, 75 bp, Artificial Sequence
  Synthetic
tccctgattcaaccaacaaatttcggaagattgaaaagaagatccagattcacaatacaaggtatggagaactgt

SEQ ID NO: 258691 - DNA, 75 bp, Artificial Sequence
  Synthetic
tgatgatatatatattgtcagtgctagagggggcattgagggattatgccagaagctatggacaatgatctcaat

SEQ ID NO: 258692 - DNA, 75 bp, Artificial Sequence
  Synthetic
agatcgcattgtcgagttgcctgcatggtacaaggtgacaatcaagtaatagctgtaacaagagaagtaagatca

SEQ ID NO: 258693 - DNA, 75 bp, Artificial Sequence
  Synthetic
tggtacaaggtgacaatcaagtaatagctgtaacaagagaagtaagatcagatgactccccagatatggtgttga

SEQ ID NO: 258694 - DNA, 75 bp, Artificial Sequence
  Synthetic
aatccgtgcagaacccaaaatattagaaaaaaatacgggtagaagagagacactcagagatcaggacgagtcacc

SEQ ID NO: 258695 - DNA, 75 bp, Artificial Sequence
  Synthetic
tgggtaatcaagtctatgatgttgtagcattaatggagggattcgcatacggtgctgttcagctgcttgagccgt

SEQ ID NO: 258696 - DNA, 75 bp, Artificial Sequence
  Synthetic
gtgaaagttaatggacggatcttcgctaagctgacaaagaagttaaggaactgtcaggtgatggcggaagggatc

SEQ ID NO: 258697 - DNA, 75 bp, Artificial Sequence
  Synthetic
ggtgctgttcagctgcttgagccgtcaggcacatttgcaggagacttctttgccttcaacctacaggagctcaaa

SEQ ID NO: 258698 - DNA, 75 bp, Artificial Sequence
  Synthetic
gcagtgaccgctgaccatgaggttacctctactaagctggagaaggggcataccattgccaaatacaatcctttc

SEQ ID NO: 258699 - DNA, 75 bp, Artificial Sequence
  Synthetic
atatcaacacgagcccgaatcccatgccgccgggcaaccacaatccgccaatgctgacgtgtttagtatgagtcc

SEQ ID NO: 258700 - DNA, 75 bp, Artificial Sequence
  Synthetic
gggtttaagaagctagatccggttggttgagtcgaacacaggatggctgggaggatgatgctgtatcacctatct

SEQ ID NO: 258701 - DNA, 75 bp, Artificial Sequence
  Synthetic
ttagaacagaatcaagcagctgagatgttgtgcttgctgcgtttgtggggtcacccattgcttgagtcccgtagt

SEQ ID NO: 258702 - DNA, 75 bp, Artificial Sequence
  Synthetic
aatactcaaggctctacacaaggaatattggtgacccggggactactgcttttgcagaggtcaagcgattagaag

SEQ ID NO: 258703 - DNA, 75 bp, Artificial Sequence
  Synthetic
ttcagatgtggtccgcctattcgaatatgcagcacttgaagtgctcctcgactgttcttatcaactctactatct

SEQ ID NO: 258704 - DNA, 75 bp, Artificial Sequence
  Synthetic
tcttgcagctgcagggattgtggtgacaggagacaaagcagtcaccatttccacctcatctcagacagggtcaat

SEQ ID NO: 258705 - DNA, 75 bp, Artificial Sequence
  Synthetic
accggcagcaagaagagggcttgcggcagcagcccagagagtgtccgaagataccagcaacatggaccttccaac

SEQ ID NO: 258706 - DNA, 75 bp, Artificial Sequence
  Synthetic
aagagtctatccgcccttgaattcgaaccgtgtatagagtacgaccccgttaccaacctaagcatgttcttaaaa

SEQ ID NO: 258707 - DNA, 75 bp, Artificial Sequence
  Synthetic
gaggacaatgaagcagaagagaaggcactggctgaattcctactcaatcaagaagcggttcacccacgtgtcgca

SEQ ID NO: 258708 - DNA, 75 bp, Artificial Sequence
  Synthetic
gtgatggcagaagggatcttagctgaccagattgcacctttctttcaggggaatggggtcattcaggatagcata

SEQ ID NO: 258709 - DNA, 75 bp, Artificial Sequence
  Synthetic
cgatacttgttcagaggaatagggaccgcgtcctcctcttggtataaggcatctcatcttctttctgtacccgag

SEQ ID NO: 258710 - DNA, 75 bp, Artificial Sequence
  Synthetic
ggatttgtccaggagtttcgccccttatggagagagaatgcagaagaaagtgacctgacctcagataaagcagtg

SEQ ID NO: 258711 - DNA, 75 bp, Artificial Sequence
  Synthetic
aaccaaaatgctgccaacatcctccggcttaaagagagcattgctgcaaccaatgaggctgtgcacgaggtcact

SEQ ID NO: 258712 - DNA, 75 bp, Artificial Sequence
  Synthetic
gggtaggaaaatactgggtgtatctaaccccgataccatagaacttgtggagggagagatccttagtgtcagtgg

SEQ ID NO: 258713 - DNA, 75 bp, Artificial Sequence
  Synthetic
tgccgactgcaaagagagggtctcctcaaaccgcaatcatgacccaaagagcaagaatcgtcgaagagttgccac

SEQ ID NO: 258714 - DNA, 75 bp, Artificial Sequence
  Synthetic
ctcattaattggtagcggcctgatcaccggcaaccctattctgtacgactcacagactcagctcttgggtataca

SEQ ID NO: 258715 - DNA, 75 bp, Artificial Sequence
  Synthetic
catgtgaaggcagcactaagggcatcatccgtgttaatctgggcttatggggacaacgaagtaaattggactgct

SEQ ID NO: 258716 - DNA, 75 bp, Artificial Sequence
  Synthetic
catccgtgttaatctgggcttatggggacaacgaagtaaattggactgctgctcttaagattgcaaggtctcgat

SEQ ID NO: 258717 - DNA, 75 bp, Artificial Sequence
  Synthetic
cgcgaaaatagctcatatgtcgccacatgtgaaggcagcactaagggcatcatccgtgttaatctgggcttatgg

SEQ ID NO: 258718 - DNA, 75 bp, Artificial Sequence
  Synthetic
agagtcctatttgaaacttgttcaaatcccttattgtctggagtgcacacagaggataatgaggcagaagagaag

SEQ ID NO: 258719 - DNA, 75 bp, Artificial Sequence
  Synthetic
atatgtcctgacccctgcccagttagggggactgagtaaccttcaatactcaaggctctatacgagaaacatcgg

SEQ ID NO: 258720 - DNA, 75 bp, Artificial Sequence
  Synthetic
aacctgaaagatcgcgaaaccatcaggtcagacacattcttcatatacagcaaacgaatattcaaagatggagca

SEQ ID NO: 258721 - DNA, 75 bp, Artificial Sequence
  Synthetic
ggcttgttgacacaacaaacaccgtaattaagattgcgcttactaggaggccattaggcatcaagaggctgatgc

SEQ ID NO: 258722 - DNA, 75 bp, Artificial Sequence
  Synthetic
tcctagccctgtatcagagagagattttgcgagacttgacttggctatcttcaagagttacgagcttaatttaga

SEQ ID NO: 258723 - DNA, 75 bp, Artificial Sequence
  Synthetic
tcaagagttacgagcttaatttagagtcatattccacaatggagctaatgaacattctttcaatatctagtggga

SEQ ID NO: 258724 - DNA, 75 bp, Artificial Sequence
  Synthetic
aaatgctcagtactcactgagtacctattgtcagatgctgtgaaaccattgcttaggtccgaacaagtgagctct

SEQ ID NO: 258725 - DNA, 75 bp, Artificial Sequence
  Synthetic
tcttgtttgtggtatacttagcctggttctagcatgctacctgatgtacaagcaaaaggcgcaacagaagacctt

SEQ ID NO: 258726 - DNA, 75 bp, Artificial Sequence
  Synthetic
ccttagtctcttctaatatgtgttctctgacactggcagactatgcacggaatagaagctggtcacctttgacgg

SEQ ID NO: 258727 - DNA, 75 bp, Artificial Sequence
  Synthetic
ccgtgctcaacaaaaattctatatgaaaaccataggcaatgcggccaagggatattatagctgtaacgattccta

SEQ ID NO: 258728 - DNA, 75 bp, Artificial Sequence
  Synthetic
gatcagatgagagccactacgaaaatgtgaatgtagatgagaggcggaggcatctccaatagcagtttgtgtgta

SEQ ID NO: 258729 - DNA, 75 bp, Artificial Sequence
  Synthetic
attatctggagtgcatacagaagataatgaggcagaggagaaggcattggctgaatttttactcaatcaagaagt

SEQ ID NO: 258730 - DNA, 75 bp, Artificial Sequence
  Synthetic
ttcgagtatgcagcgctcgaagtgctcctcgactgttcttatcaactctactatctgagagtgagaggtctcaac

SEQ ID NO: 258731 - DNA, 75 bp, Artificial Sequence
  Synthetic
ctcgtattcggactctaataattatcttaaaacggaagtatgcgtaattgttcttgtatatagtcctgtcattca

SEQ ID NO: 258732 - DNA, 75 bp, Artificial Sequence
  Synthetic
aacctccagtactcaaggctctacacaaggaatattggtgacccgggaactactgcttttgcagaggtcaagcga

SEQ ID NO: 258733 - DNA, 75 bp, Artificial Sequence
  Synthetic
caaggaatattggtgacccgggaactactgcttttgcagaggtcaagcgactggaagcggtggggttgctgggtc

SEQ ID NO: 258734 - DNA, 75 bp, Artificial Sequence
  Synthetic
cctttaattttgagactgtcgcaagcccaaacattgtcctcaagaaacatacgcagaaagtcttgtttgagactt

SEQ ID NO: 258735 - DNA, 75 bp, Artificial Sequence
  Synthetic
ctgttttggatgataacctgagtgagaagatgtttcagctgatttcccggttatgctgtctgtatacagtactct

SEQ ID NO: 258736 - DNA, 75 bp, Artificial Sequence
  Synthetic
cacaagatgtgacagcggggatgagcagttcacttggttccatcttccgagcaatatagaactgaccgatgacac

SEQ ID NO: 258737 - DNA, 75 bp, Artificial Sequence
  Synthetic
ctgcactcggttccaaccaagatgtagtagataggatatataagcaggtggccctcgaatctccattggcattgc

SEQ ID NO: 258738 - DNA, 75 bp, Artificial Sequence
  Synthetic
cagatgagctttgcaccagctgagtatgcacagctttactcttttgccatgggcatggcgtcagtcttggataaa

SEQ ID NO: 258739 - DNA, 75 bp, Artificial Sequence
  Synthetic
ttcaagggcttgttgacacaacaaacactgtgattaagattgcactgactaggaggcccctcggtatcaaaaggc

SEQ ID NO: 258740 - DNA, 75 bp, Artificial Sequence
  Synthetic
aggaggcccctcggtatcaaaaggctgatgcggataatcaactactcaagcatgcatgcaatgttattcagagat

SEQ ID NO: 258741 - DNA, 75 bp, Artificial Sequence
  Synthetic
acatggctgctgagctaaaattaaccccggcagcaaggaggggcctggcagctgctgcccaacgagtgtctgagg

SEQ ID NO: 258742 - DNA, 75 bp, Artificial Sequence
  Synthetic
gtgacctcaaataagtttatgtatgatcctagccctgtatcggagggagactttgcgagacttgacttagctatc

SEQ ID NO: 258743 - DNA, 75 bp, Artificial Sequence
  Synthetic
gagtgctacccactactgctatactcacaatgtgatattatctggctgcagagatcactcgcactcacatcagta

SEQ ID NO: 258744 - DNA, 75 bp, Artificial Sequence
  Synthetic
gacattggtgctcgagtgagagatcctttcactcaacaacctgcatcattcatacaagagctagatctgaatgct

SEQ ID NO: 258745 - DNA, 75 bp, Artificial Sequence
  Synthetic
attactaaactcaaagaaatgttcacagaaacttctttactatacttgactcgtgctcaacaaaaattctacatg

SEQ ID NO: 258746 - DNA, 75 bp, Artificial Sequence
  Synthetic
agggcaaccagacgtcggagatggagagacccaattcttggacttgatgagagcagtgacgaatagcatgcgaga

SEQ ID NO: 258747 - DNA, 75 bp, Artificial Sequence
  Synthetic
aagttgattggccagtctgtggtttcttatgatgaagatacctccataaagaatgacgccataatagtgtatgac

SEQ ID NO: 258748 - DNA, 75 bp, Artificial Sequence
  Synthetic
gagacccaattcttggacttgatgagagcagtgacgaatagcatgcgagaagcaccaaactcctcacagagcacc

SEQ ID NO: 258749 - DNA, 75 bp, Artificial Sequence
  Synthetic
cccagtccacctccacagggctatcccaaatcctccgtctgaaccccccccccaccccctgacccacagccccgc

SEQ ID NO: 258750 - DNA, 75 bp, Artificial Sequence
  Synthetic
caaattacccaggagtagggggcgggtcttttattgacaaccgcgtatggttcccagtttacggagggctaaaac

SEQ ID NO: 258751 - DNA, 75 bp, Artificial Sequence
  Synthetic
tgtgcaacgacccgtactcttttaattttgagactgttgcaagccctaatattgtcctcaagaaacatacacaga

SEQ ID NO: 258752 - DNA, 75 bp, Artificial Sequence
  Synthetic
atctcatcccgtcattcattcaaggttacatgcagtgggcctggtcaaccatgacggatcacaccaacttgcaga

SEQ ID NO: 258753 - DNA, 75 bp, Artificial Sequence
  Synthetic
cacgggcacaactcaatccaccaataatccatacggagccaaagacattagaaaaaaatacgggtagaagagaga

SEQ ID NO: 258754 - DNA, 75 bp, Artificial Sequence
  Synthetic
aatcaaagcctgttagatcaactggctactaatttatctttgattgccatgcactctgtaagggagggtggagta

SEQ ID NO: 258755 - DNA, 75 bp, Artificial Sequence
  Synthetic
tcatgtgttaccggagtctatactgatccatatcccttagtcttttataggaaccacaccttgcgaggggtattc

SEQ ID NO: 258756 - DNA, 75 bp, Artificial Sequence
  Synthetic
agcgcaatcccacaaggcaagaccaaagcgctgagcacagcatgggagaagcacgggagcatccaaccatccgcc

SEQ ID NO: 258757 - DNA, 75 bp, Artificial Sequence
  Synthetic
aagcgctgagcacagcatgggagaagcacgggagcatccaaccatccgccagtcaggacaaccccgaccggcagg

SEQ ID NO: 258758 - DNA, 75 bp, Artificial Sequence
  Synthetic
tccgagcagtagcccgatcccacccagtcctagtttcaggccccggagacccatctccttacgtgacacaagggg

SEQ ID NO: 258759 - DNA, 75 bp, Artificial Sequence
  Synthetic
ttcccagctaatctgtactacatgtctcggaagagcctcaatttgatcagggaaagggaggacagggatactatc

SEQ ID NO: 258760 - DNA, 75 bp, Artificial Sequence
  Synthetic
gagagattttgcaagacttgacttagctatcttcaagagttatgagcttaatttggagtcatattccacactgga

SEQ ID NO: 258761 - DNA, 75 bp, Artificial Sequence
  Synthetic
cgctctctgcccaggccgcaggcgcagccggcgatacacagctcaaaactggagcaagcaactctcttttgtcca

SEQ ID NO: 258762 - DNA, 75 bp, Artificial Sequence
  Synthetic
ggagcaagcaactctcttttgtccatgctcgacaagctgagcaataagtcatccaatgctaaaaagggcccacgg

SEQ ID NO: 258763 - DNA, 75 bp, Artificial Sequence
  Synthetic
aaatatccaataccctcttcggggaattcagaattgtccctttactagttgagattctcaaggatgatggggtta

SEQ ID NO: 258764 - DNA, 75 bp, Artificial Sequence
  Synthetic
tacgatctctcaccccatcatccactcaaggttgaatgcagtaggcctaattaatcatgatggatcacaccagct

SEQ ID NO: 258765 - DNA, 75 bp, Artificial Sequence
  Synthetic
cgatacctgttcagaggaataggaactgcgtcctcctcttggtataaggcatcccaccttctttctgtacccgag

SEQ ID NO: 258766 - DNA, 75 bp, Artificial Sequence
  Synthetic
tctgcaaaactgttagtctcatgcactcgacgtgtgatctcaggcttatatgcaggaagtaaatacgatctgctg

SEQ ID NO: 258767 - DNA, 75 bp, Artificial Sequence
  Synthetic
agccatcatgagtcttctcgaactgcatgtgccgcatgaaactatctattacaatacgctcttctcaaatgagat

SEQ ID NO: 258768 - DNA, 75 bp, Artificial Sequence
  Synthetic
cttaatactcagaggtatggtttctctggaggacctcatcccgctaaggacatacctgaagcacagtacatgccc

SEQ ID NO: 258769 - DNA, 75 bp, Artificial Sequence
  Synthetic
ctccatccctatgatgcggtctgaaatccaacagcttaagacatctgtcgcagtaatggaagctaatttaggcat

SEQ ID NO: 258770 - DNA, 75 bp, Artificial Sequence
  Synthetic
aaccgtgtctggttcccagtgtacggcggtttgaaaccaggctccccaacagacaaaaggcaagaggggcagtat

SEQ ID NO: 258771 - DNA, 75 bp, Artificial Sequence
  Synthetic
agtcacagaggctgaagaagaggactataagtcaattacccccacatcaatggtgcacggaaggttaggttttga

SEQ ID NO: 258772 - DNA, 75 bp, Artificial Sequence
  Synthetic
agacaaaaggcaagaggggcagtatgctatttatgagaggtacaatgatacgtgccctgatgatcatgagtatca

SEQ ID NO: 258773 - DNA, 75 bp, Artificial Sequence
  Synthetic
gtcatattccacactggagctgatgaacatcctttcaatatctagcgggaagttgattggccagtctgtggtttc

SEQ ID NO: 258774 - DNA, 75 bp, Artificial Sequence
  Synthetic
acatgtccaggaagagccttaatttgatcagggaacgagaggatagagatactatcttggcgctgttgtttcctc

SEQ ID NO: 258775 - DNA, 75 bp, Artificial Sequence
  Synthetic
cgaggagtgtttggtacaatgttggatgacgagcaagccaggttgaacccagtttctgcagtatttgattccatt

SEQ ID NO: 258776 - DNA, 75 bp, Artificial Sequence
  Synthetic
gcaattatcttaaagcagaagtgaacgtggttgtccttaattatagtcctgtcattcaccaaatctttgtttggt

SEQ ID NO: 258777 - DNA, 75 bp, Artificial Sequence
  Synthetic
ctcgtattcgggttcgagcaattatcttaaagcagaagtgaacgtggttgtccttaattatagtcctgtcattca

SEQ ID NO: 258778 - DNA, 75 bp, Artificial Sequence
  Synthetic
taaacaggcgataggacgcatcgaagtcgtacgggtagaaggtgtgaatctcgagtgcgaggtcgaagctcaagc

SEQ ID NO: 258779 - DNA, 75 bp, Artificial Sequence
  Synthetic
aggttcctgccccctgagtgccaaaaagaatccaccccgagccccccttccccgacccgtgctccaacactctaa

SEQ ID NO: 258780 - DNA, 75 bp, Artificial Sequence
  Synthetic
gaggtggtgaggatggcaaaaactctggtgcagcggcacggtacgcttttgtctaaatcagatgagatcacactg

SEQ ID NO: 258781 - DNA, 75 bp, Artificial Sequence
  Synthetic
aatggagctcacggaggaggggagaaggggagcactttaaaagttgagatcccagtattcactcttaacagtgac

SEQ ID NO: 258782 - DNA, 75 bp, Artificial Sequence
  Synthetic
tcctttaccaagattaataaagtacttgaggaagaatattgacactgcgctgattgaagccgggggacagcccgt

SEQ ID NO: 258783 - DNA, 75 bp, Artificial Sequence
  Synthetic
gaaccatgttgcccttgcagggaaacagaatgaggccacactggctgttcttgagatcgatggttttaccaacag

SEQ ID NO: 258784 - DNA, 75 bp, Artificial Sequence
  Synthetic
taactctattgttccctcaggaaccattgcttgagcttcgccccgtacaagacatcggtgctcgagtgaaagacc

SEQ ID NO: 258785 - DNA, 75 bp, Artificial Sequence
  Synthetic
tgtgccccagttcaacaacaggagtggagtgtctgaagagagagcacagagattcatggtgatagcagggtctct

SEQ ID NO: 258786 - DNA, 75 bp, Artificial Sequence
  Synthetic
attgcttgagcttcgccccgtacaagacatcggtgctcgagtgaaagacccattcactcgacaacctgcatcatt

SEQ ID NO: 258787 - DNA, 75 bp, Artificial Sequence
  Synthetic
ctgtagataagaggggaaagaaagttacatttgacaagatagaagaaaagataaggagactcaatctatctgtcg

SEQ ID NO: 258788 - DNA, 75 bp, Artificial Sequence
  Synthetic
acttatggattcatcttccaagttgggaatgaagaagtcactgttggcatgatcaatggtaatcccaggcacgaa

SEQ ID NO: 258789 - DNA, 75 bp, Artificial Sequence
  Synthetic
tacactgcgacatcgagattcccccagggtccaatcaaagcttattagaccaactggctacgaatttgtctctgg

SEQ ID NO: 258790 - DNA, 75 bp, Artificial Sequence
  Synthetic
tgtttacagacacttctgtactgtacttgactcgtgctcaacaaaaattctacatgaaaactataggcaatgcag

SEQ ID NO: 258791 - DNA, 75 bp, Artificial Sequence
  Synthetic
tgaaagtatctggctcgagcctgtataatcttgcacttaacgtcactattgatgtggaggtggacccgaagagcc

SEQ ID NO: 258792 - DNA, 75 bp, Artificial Sequence
  Synthetic
gtgcatgaggtggtaaggatggccaaaactctaatacaacggcacggtacacttctgtctaaatcgaatgaaatc

SEQ ID NO: 258793 - DNA, 75 bp, Artificial Sequence
  Synthetic
ttgagcaaaaccaggcagcagagatgttatgtctattgaggttatggggtcatccgctattagagtcgcgagctg

SEQ ID NO: 258794 - DNA, 75 bp, Artificial Sequence
  Synthetic
tgagtcaactgtctttcaacagcaataagaaacgtatcactgactgcaaagaaagagtatcctcaaaccgcaatc

SEQ ID NO: 258795 - DNA, 75 bp, Artificial Sequence
  Synthetic
ctgcaaaagctgttagggcccaaatgtgtgcacccaaaatggtagattttgatatgattctccaggtgctgtcat

SEQ ID NO: 258796 - DNA, 75 bp, Artificial Sequence
  Synthetic
aagttcttgagagaaaatattgatgctgcactgattgaagccggaggacagcccgtccgtcccttttgtgcagaa

SEQ ID NO: 258797 - DNA, 75 bp, Artificial Sequence
  Synthetic
gagactttatgagcacatcattctggagacttggagtagagtatgctcaggctcagggaagtagcatcaatgagg

SEQ ID NO: 258798 - DNA, 75 bp, Artificial Sequence
  Synthetic
cgtcatccaagcaggcacccaacgtgctgtcgcagtgaccgccgatcatgaggttacttctaccaagatagagaa

SEQ ID NO: 258799 - DNA, 75 bp, Artificial Sequence
  Synthetic
tctaaatcagatgaaattacgttgactaagctatttacctcacagcggcaccgtgtaacggacatcttatccagc

SEQ ID NO: 258800 - DNA, 75 bp, Artificial Sequence
  Synthetic
agaccggcagcgtggatattcctactcaacaagccggggtcctcaccgggctcagtgacggaggtcctcgagccc

SEQ ID NO: 258801 - DNA, 75 bp, Artificial Sequence
  Synthetic
ggtttctctggaggatctcatcccactaaggacatacctgaagcgcagcacctgccctaaatatctgaagacagt

SEQ ID NO: 258802 - DNA, 75 bp, Artificial Sequence
  Synthetic
aacacgggtagaagagtccggatcctagttggcacatccaaggcacaatatgggttccaaatcttctaccaggtt

SEQ ID NO: 258803 - DNA, 75 bp, Artificial Sequence
  Synthetic
gatcggtggcaaatagcatgcgagaaacgtcaaactccgcacagagcactaaccaactggagcctccctcgaccc

SEQ ID NO: 258804 - DNA, 75 bp, Artificial Sequence
  Synthetic
ctacatgaaaaccataggtaatgcagcaaagggatactacagtaacaatgactcttaaaggcaaccacgcactaa

SEQ ID NO: 258805 - DNA, 75 bp, Artificial Sequence
  Synthetic
aacgtcaaactccgcacagagcactaaccaactggagcctccctcgacccctgggccgtcccaaggcaatgacac

SEQ ID NO: 258806 - DNA, 75 bp, Artificial Sequence
  Synthetic
catgtatggtccaaggggataaccaagtcatagctgtcactagagaggtccgaccggatgactctcccgagtccg

SEQ ID NO: 258807 - DNA, 75 bp, Artificial Sequence
  Synthetic
caccctgattttaaccagtcgtggattgaagacatctcttttgtgcactcatatgtcctgacccctgcccagcta

SEQ ID NO: 258808 - DNA, 75 bp, Artificial Sequence
  Synthetic
taaactgtcctcttaaccgattatttcctcactgacttaactataccatattagaaaaaaattaaattctgacac

SEQ ID NO: 258809 - DNA, 75 bp, Artificial Sequence
  Synthetic
ggttactgagtcctagcattatgactaacatcttaactaggccgcctgggaatggagattgggccagtctgtgca

SEQ ID NO: 258810 - DNA, 75 bp, Artificial Sequence
  Synthetic
ttcaaaattagtactggtatcgggagacttgagcgaaaatacagtgatgtcctgtgccaatatctcatcgactgt

SEQ ID NO: 258811 - DNA, 75 bp, Artificial Sequence
  Synthetic
ctggaggacctcatcccactaaggacatacctgaagcgcagtacctgcccgaagtatctgaaggcagtcctaggt

SEQ ID NO: 258812 - DNA, 75 bp, Artificial Sequence
  Synthetic
ctccgatccaccgccccgcatgaccaaacccacaaaagaaccttcccatcccccctctcccctctggccgcacga

SEQ ID NO: 258813 - DNA, 75 bp, Artificial Sequence
  Synthetic
cacaacctgacccaccaacagtctatacggagccaaagatattagaaaaaaatacgggtagaagagaagcattca

SEQ ID NO: 258814 - DNA, 75 bp, Artificial Sequence
  Synthetic
taacatcttaactaggccgcctgggaatggagattgggccagtctgtgcaatgacccatactctttcaattttga

SEQ ID NO: 258815 - DNA, 75 bp, Artificial Sequence
  Synthetic
ctgaatttttactcaatcaagaagtaattcatccacgtgtcgcacatgctatcatggaagcaagctctgtaggta

SEQ ID NO: 258816 - DNA, 75 bp, Artificial Sequence
  Synthetic
aaaattaaattctgactctttggaactcgtattcggactcagtagattaactctatgcagaaatgcacgtcactg

SEQ ID NO: 258817 - DNA, 75 bp, Artificial Sequence
  Synthetic
atgccctggcaaaggacttaggtaatcaagtctatgatgttgtagcattaatggagggattcgcatacggtgccg

SEQ ID NO: 258818 - DNA, 75 bp, Artificial Sequence
  Synthetic
ctcaaacccactactatctggagtccacacagaagacaatgaagcagaggagaaagcattggcagagtatttact

SEQ ID NO: 258819 - DNA, 75 bp, Artificial Sequence
  Synthetic
ccaacagatccaaccaccccttagtctcttctaatatgtgttctctgacgctggcagactatgcacggaatagaa

SEQ ID NO: 258820 - DNA, 75 bp, Artificial Sequence
  Synthetic
ctcttctaatatgtgttctctgacgctggcagactatgcacggaatagaagctggtcacctttgacggggggtag

SEQ ID NO: 258821 - DNA, 75 bp, Artificial Sequence
  Synthetic
taagcgcagcatgggagaagcatgggagcatccaaccaccggccagccaagatacccttgaccaacaggatagat

SEQ ID NO: 258822 - DNA, 75 bp, Artificial Sequence
  Synthetic
ctcgtattcggactcagtagattaactctatgcagaaatgcacgtcactgtcctcaattgcagccctgtcatcca

SEQ ID NO: 258823 - DNA, 75 bp, Artificial Sequence
  Synthetic
gagactttatgagcacatcattctggagacttggagtagagtacgctcaggctcaaggaagtagcatcaatgagg

SEQ ID NO: 258824 - DNA, 75 bp, Artificial Sequence
  Synthetic
gggtttaagaagctagatctggttagttgagtcaaatgcaggatggctgggagaatgatgctgcatcacctatct

SEQ ID NO: 258825 - DNA, 75 bp, Artificial Sequence
  Synthetic
cagcaagaatcctccgatgagagtgccgtatctcgggtcaaagactcaagagaggagagctgcctcgcttgcgaa

SEQ ID NO: 258826 - DNA, 75 bp, Artificial Sequence
  Synthetic
tcacccaggctgcaggcgagatcggcgacgcacagcttaaaaccggagcaagcaactcccttttgtcgatgcttg

SEQ ID NO: 258827 - DNA, 75 bp, Artificial Sequence
  Synthetic
cgacgcacagcttaaaaccggagcaagcaactcccttttgtcgatgcttgacaaacttagcaataagtcgtctaa

SEQ ID NO: 258828 - DNA, 75 bp, Artificial Sequence
  Synthetic
aaagctgctctaagggcatcatctgtgttgatctgggcttatggagacaacgaagtaaattggactgctgctctt

SEQ ID NO: 258829 - DNA, 75 bp, Artificial Sequence
  Synthetic
gttgatggccatcacaactcataacaggctcccgtcactttagcgtcacacggaatccctcgggggccctccctc

SEQ ID NO: 258830 - DNA, 75 bp, Artificial Sequence
  Synthetic
gagccgcgggaacaatcaggaaagaccgcagaacccggccaaggccgcccctggagaccggggcacagacgcgaa

SEQ ID NO: 258831 - DNA, 75 bp, Artificial Sequence
  Synthetic
gtatgacccaaacccagtagcggaaggggacttcgctaggttagatcttgcaatattcaagagttatgaattgaa

SEQ ID NO: 258832 - DNA, 75 bp, Artificial Sequence
  Synthetic
ctggagaccggggcacagacgcgaacacagcatatcctggacaatggaaggagtcacaactatcagctggtgtaa

SEQ ID NO: 258833 - DNA, 75 bp, Artificial Sequence
  Synthetic
cccagtttgcttctatgaggtcatcccaattcctccgcccacaccccacccctcaatccgcaatctcgcatggcc

SEQ ID NO: 258834 - DNA, 75 bp, Artificial Sequence
  Synthetic
ttgagtcactcttcccaatgacgacaaccaggacatacgatgagatcacattgcacctccacagtaaatttagct

SEQ ID NO: 258835 - DNA, 75 bp, Artificial Sequence
  Synthetic
aaccaggacatacgatgagatcacattgcacctccacagtaaatttagctgctgtatcagagaagcacctgttgc

SEQ ID NO: 258836 - DNA, 75 bp, Artificial Sequence
  Synthetic
ggccctcaaaggctcagtcatcgccaactgcaagatgacaacatgtagatgtgcagaccctccgggtatcatctc

SEQ ID NO: 258837 - DNA, 75 bp, Artificial Sequence
  Synthetic
tcaacaggccggggtccttactgggctcagcgacaagggtccccgagctccgcagggtggaccgagcaggtcgca

SEQ ID NO: 258838 - DNA, 75 bp, Artificial Sequence
  Synthetic
gatggaggcattatcacagagggtaagtaaggttgattatcagctagacctagttttaaagcagacatcttctat

SEQ ID NO: 258839 - DNA, 75 bp, Artificial Sequence
  Synthetic
atgccctggataagttatcagaaagtaacagcaaactagacaaagtcaaagtcaagctaactagcacatctgctc

SEQ ID NO: 258840 - DNA, 75 bp, Artificial Sequence
  Synthetic
taacattcccagctaacctctattatatgtctaggaaaagcctgaatttaatcagagaaagagaggacagggact

SEQ ID NO: 258841 - DNA, 75 bp, Artificial Sequence
  Synthetic
cccctctcccatcacaacccgccgctgcaccacataagccaagaagagacatcccccgcggctgtcccccaccgt

SEQ ID NO: 258842 - DNA, 75 bp, Artificial Sequence
  Synthetic
aattctggaccctggttgtgctaacgtttcatctctaagtgacttacgggcagtcgcccgatcacacccagtttt

SEQ ID NO: 258843 - DNA, 75 bp, Artificial Sequence
  Synthetic
aatccgcacagaacccaaaatattagaaaaaaatacgggtagaagagagacactcagagatcaggacgagtcacc

SEQ ID NO: 258844 - DNA, 75 bp, Artificial Sequence
  Synthetic
taggacaatcgggctatactttgattctgcccttccttctagcaacctgttagcattcccgattgtcctacaaga

SEQ ID NO: 258845 - DNA, 75 bp, Artificial Sequence
  Synthetic
gaccttattatggcttgggaataataccctcgatcagatgagagccaccacaagaacatgaatacggacgagagg

SEQ ID NO: 258846 - DNA, 75 bp, Artificial Sequence
  Synthetic
agtgcaacatccctctgagttaattaaacctgccacggctagcgggcctgatatgggagtggagaaggacactgt

SEQ ID NO: 258847 - DNA, 75 bp, Artificial Sequence
  Synthetic
gtgttgtatatgagtgatttatacaagaatatgccaggaattctactttccaacattgcagctacaatatctcat

SEQ ID NO: 258848 - DNA, 75 bp, Artificial Sequence
  Synthetic
gaaaaaaatacgggtagaagagagacactcagagatcaggacgagtcaccaaggtctccactctcccctccaccc

SEQ ID NO: 258849 - DNA, 75 bp, Artificial Sequence
  Synthetic
ggatataagtgccaaaagggcaatacacgggtagaacggtcggagaaaccccctttcaaccgggaaccaggcctc

SEQ ID NO: 258850 - DNA, 75 bp, Artificial Sequence
  Synthetic
cacgggtagaacggtcggagaaaccccctttcaaccgggaaccaggcctcacaacgtccgttctaccgcatcact

SEQ ID NO: 258851 - DNA, 75 bp, Artificial Sequence
  Synthetic
tcctgaggaagttggatgcagccgggtcgattgaagaaatcaggaaaatcaagcgccttgcgctgaacgcctgat

SEQ ID NO: 258852 - DNA, 75 bp, Artificial Sequence
  Synthetic
gtcacaccaacttgcagacacagatttcatcgaaatgtctgcaaaactgttagtctcttgcactcgacgcgtggt

SEQ ID NO: 258853 - DNA, 75 bp, Artificial Sequence
  Synthetic
tagtctcttgcactcgacgcgtggtctcaggtttatatgcagggaataagtatgatctgctgttcccatctgtct

SEQ ID NO: 258854 - DNA, 75 bp, Artificial Sequence
  Synthetic
attccacaagggaagacgaaggccctcagtctagcctgggagaagcacggcaacacgaacaccccagccgcccaa

SEQ ID NO: 258855 - DNA, 75 bp, Artificial Sequence
  Synthetic
ataagaaggggaagaaagtgacatttgacaagctggagaggaagataaggagacttgatctatctgtcgggctca

SEQ ID NO: 258856 - DNA, 75 bp, Artificial Sequence
  Synthetic
tagatgataacctgagtgagaagatgcttcagctgatatctcggttatgctgcctgtacacggtgctctttgcta

SEQ ID NO: 258857 - DNA, 75 bp, Artificial Sequence
  Synthetic
ctaagctccaacattttaaatgataactctctctcacctctcctaccccaccgaatgatcgcgcaaatgcaatta

SEQ ID NO: 258858 - DNA, 75 bp, Artificial Sequence
  Synthetic
cgtggcgcttagttttccggatcgcagttttattcttaatagtaacgactttagccatctctgcagctgccctga

SEQ ID NO: 258859 - DNA, 75 bp, Artificial Sequence
  Synthetic
cctctactaagctggagaaggggcataccattgccaaatacaatcctttcaagaaataggctgcatctctgagat

SEQ ID NO: 258860 - DNA, 75 bp, Artificial Sequence
  Synthetic
tctcctaacatagttacgttcccagctaatctatactacatgtctcggaagagccttaatttgatcagggaaaga

SEQ ID NO: 258861 - DNA, 75 bp, Artificial Sequence
  Synthetic
ctaatctatactacatgtctcggaagagccttaatttgatcagggaaagagaggacagggacactatcttggcac

SEQ ID NO: 258862 - DNA, 75 bp, Artificial Sequence
  Synthetic
tatgatctgctgttcccatctgtcttagatgataacctgagtgagaagatgcttcagctgatatctcggttatgc

SEQ ID NO: 258863 - DNA, 75 bp, Artificial Sequence
  Synthetic
caacaaattatgctcttgggtttatctctaattgaatcgctcttcccaatgacaacaaccagaacatatgatgag

SEQ ID NO: 258864 - DNA, 75 bp, Artificial Sequence
  Synthetic
tctacccttccttccagcaacctgttagcgttcccaatcgtctgcaaggatacaggagatgggaagaggcgaatc

SEQ ID NO: 258865 - DNA, 75 bp, Artificial Sequence
  Synthetic
gagcaaccttgcaggcatacctactgcaatctctaaggcagaggatcggattacgtccttactcagctcaaatca

SEQ ID NO: 258866 - DNA, 75 bp, Artificial Sequence
  Synthetic
tgggctccaaaccttctaccaggatcccagcacctctgatgctggtcacccggattatgctgatattgggctgta

SEQ ID NO: 258867 - DNA, 75 bp, Artificial Sequence
  Synthetic
cctgtgaggccgttctgcgcagaaagcttagtaaataccctctcagacattactcaaaccacgcaggtgattgcc

SEQ ID NO: 258868 - DNA, 75 bp, Artificial Sequence
  Synthetic
gaggacagggacactatcttggcactgttgttcccccaagagccactactcgagttccccttggtacaagatatt

SEQ ID NO: 258869 - DNA, 75 bp, Artificial Sequence
  Synthetic
agattctgtatttatcaccacctatggattcatcttccaggttgggagtgaggaggtcactgccggcatgatcaa

SEQ ID NO: 258870 - DNA, 75 bp, Artificial Sequence
  Synthetic
atctgcataccaggaacacctgaattttatcccagcacctactacaggatcaggttgcacacggataccctcatt

SEQ ID NO: 258871 - DNA, 75 bp, Artificial Sequence
  Synthetic
acaatacgctcttctcaaatgagatgaaccccccacagcgacatttcggaccgaccccaacacagtttctgaatt

SEQ ID NO: 258872 - DNA, 75 bp, Artificial Sequence
  Synthetic
tgagctggcgagggcctgccttactatggtggtaacatgcaagaagagtgcaactaatactgagagaatggtctt

SEQ ID NO: 258873 - DNA, 75 bp, Artificial Sequence
  Synthetic
tacatgaagactgtagggaatgccgtcaaaggatattacaacagtagcaaaaattgagaagactgtaactgttga

SEQ ID NO: 258874 - DNA, 75 bp, Artificial Sequence
  Synthetic
gtccaggagttccgtccattatggagagagaatacagaagaaagcgacctgacctcagataaagcagtggggtat

SEQ ID NO: 258875 - DNA, 75 bp, Artificial Sequence
  Synthetic
cgactcagcagggtcaattgaagagatcaggaagatcaagcgccttgcattgaatggataaggagcagggcatag

SEQ ID NO: 258876 - DNA, 75 bp, Artificial Sequence
  Synthetic
taggttgtgatatgttatgctttaaggtcacggagactgaggaagaggattataagtcagtcaccccaacgtcaa

SEQ ID NO: 258877 - DNA, 75 bp, Artificial Sequence
  Synthetic
aaggtcaagcgccttgcgctgaatggttgatagccatcacagctcacgacaggctcctgcctcaccagtgtcaca

SEQ ID NO: 258878 - DNA, 75 bp, Artificial Sequence
  Synthetic
aggatcccaactgcagcattgaaagtatctagctcgagcctgtacaatcttgcgctcaatgtcaccattgatgtg

SEQ ID NO: 258879 - DNA, 75 bp, Artificial Sequence
  Synthetic
gcccttgatcagatgagagccactgcaagagcatgaatgtagataagaggtggatatatacccaacagcagcctg

SEQ ID NO: 258880 - DNA, 75 bp, Artificial Sequence
  Synthetic
tgtaaaggcgagaggtgcacggactaagctgctggcacctttcttctctagcagtgggacagcctgctaccccat

SEQ ID NO: 258881 - DNA, 75 bp, Artificial Sequence
  Synthetic
tacaagcgctataataacacatgccccgatgaacaggattaccagattcgaatggctaaatcttcgtataagcct

SEQ ID NO: 258882 - DNA, 75 bp, Artificial Sequence
  Synthetic
agcaaatgcctctcctcaggtagctaagatactctggagtcaaactgcgcgcctgcggagtgtaaaagtcattat

SEQ ID NO: 258883 - DNA, 75 bp, Artificial Sequence
  Synthetic
taccatttccaaatacaatcctttcaaaaaatagggtgcatctttgaaactgcaatccgcccgctttccaggatc

SEQ ID NO: 258884 - DNA, 75 bp, Artificial Sequence
  Synthetic
gcagatcttagaggtcacaatactgggtcttagagttgaaaacctcaataaagtaggtgatgtaatcagcctagt

SEQ ID NO: 258885 - DNA, 75 bp, Artificial Sequence
  Synthetic
tgcaatccgcccgctttccaggatcaccatgacaccaagcaataatctgtcgtgattgcttatagttagcttacc

SEQ ID NO: 258886 - DNA, 75 bp, Artificial Sequence
  Synthetic
aagccccgttggaggcatacaacaggacattgactactctactcacccctcttggtgattctatccgtaggatac

SEQ ID NO: 258887 - DNA, 75 bp, Artificial Sequence
  Synthetic
cattcttctcaagcagcggaaccgcatgctatccaattgccaatgcatcccctcaggtggcaaagatactgtgga

SEQ ID NO: 258888 - DNA, 75 bp, Artificial Sequence
  Synthetic
ccagatcttctaccaggaccccagcacatctagtgctgatcatccgaactgcattgacactgagctggatccgtc

SEQ ID NO: 258889 - DNA, 75 bp, Artificial Sequence
  Synthetic
tcaacaaaaattctacatgaaaactataggcaatgcagtcaagggatactacagtaactgtgactcttagaggca

SEQ ID NO: 258890 - DNA, 75 bp, Artificial Sequence
  Synthetic
acttgtgttgatgtatgcagatatgatggagggcagagatatggtcaacataatatcatctacggcagcacatct

SEQ ID NO: 258891 - DNA, 75 bp, Artificial Sequence
  Synthetic
agtcgcatgactcgggtaagttcaagcagcactaaggcagcatacacgacgtcgacatgctttaaggtcgtcaag

SEQ ID NO: 258892 - DNA, 75 bp, Artificial Sequence
  Synthetic
ccggagggggccaggacaacgacaccgactggggatactagtcagaacctcgctcggtgatgacccagaccctcc

SEQ ID NO: 258893 - DNA, 75 bp, Artificial Sequence
  Synthetic
gacaccacggtcttatttaaggattgggtggcaaattacccaggagtgggaggagggtcttttattgacgaccgt

SEQ ID NO: 258894 - DNA, 75 bp, Artificial Sequence
  Synthetic
ttcgaattcaaataattgtcttagaaaaaagttgcgcgtaattgttcttgagtgtagtcctgtcattcaccaaat

SEQ ID NO: 258895 - DNA, 75 bp, Artificial Sequence
  Synthetic
ctggttgagattctcaaagatgatagggtttaggaaattagatctggctggctgagtcacccatgggaggtttga

SEQ ID NO: 258896 - DNA, 75 bp, Artificial Sequence
  Synthetic
tcaagtctgatgattgaacctttaaagatagtttgattcatagtagcattagaaaaaacacgggtagaaggtatg

SEQ ID NO: 258897 - DNA, 75 bp, Artificial Sequence
  Synthetic
gacgctgaccactttgctcactccccttggtgactctatccgcaggatacaagaatctgtgaccacatccggagg

SEQ ID NO: 258898 - DNA, 75 bp, Artificial Sequence
  Synthetic
cggtcaataccatgagaaggacttagacaccacggtcttatttaaggattgggtggcaaattacccaggagtggg

SEQ ID NO: 258899 - DNA, 75 bp, Artificial Sequence
  Synthetic
ataccgatgcatgctcgaatcctacgctgccggtcagctataaccggataatgctgacgtgatcagtctgaatct

SEQ ID NO: 258900 - DNA, 75 bp, Artificial Sequence
  Synthetic
actcttcataatccttatacattcaatgctttcactcggccaggtagtgtcccttgccaggcttcagcaagatgc

SEQ ID NO: 258901 - DNA, 75 bp, Artificial Sequence
  Synthetic
gggtcgcaacagctgcacagataacagcagcctcggctcttatacaagccaaccagaatgctgccaacatcctcc

SEQ ID NO: 258902 - DNA, 75 bp, Artificial Sequence
  Synthetic
gctgtcgcagtgactgctgaccatgaggttacctctactaagatagagaagaggcacaccatcgccaagtacaat

SEQ ID NO: 258903 - DNA, 75 bp, Artificial Sequence
  Synthetic
accatcttattatcagcagacaatggaagaaaatacttgagtcagccaccccggacactgagaggatgataaaac

SEQ ID NO: 258904 - DNA, 75 bp, Artificial Sequence
  Synthetic
cacaacaggtcggtgtagaactcaacttgtacctaactgaattgactacagtatttgggccacaaatcacatccc

SEQ ID NO: 258905 - DNA, 75 bp, Artificial Sequence
  Synthetic
gaagacgacaccacatcaatcatctcccacaatgcttagagtcaagctgaatattaacataagccaggatcccat

SEQ ID NO: 258906 - DNA, 75 bp, Artificial Sequence
  Synthetic
ctcattaattggtagcggcttggtcaccggcaaccctattctgtatgactcacagactcagctcttgggtataca

SEQ ID NO: 258907 - DNA, 75 bp, Artificial Sequence
  Synthetic
ccgtccctggaaaccggggcacagacgagaacacagcatatcatggacaacggaaggagtcacaactatcagctg

SEQ ID NO: 258908 - DNA, 75 bp, Artificial Sequence
  Synthetic
ttgtctgagcggtaatacatcagcctgtatgtattcaaagactgaaggcgcacttactacaccatatatggctct

SEQ ID NO: 258909 - DNA, 75 bp, Artificial Sequence
  Synthetic
aagatgacaacatgtagatgtgtagaccccccaggcatcatatcgcaaaattacggagaagctgtatctctaata

SEQ ID NO: 258910 - DNA, 75 bp, Artificial Sequence
  Synthetic
tcagatgagatcacactgactaagttatttacctcacagcggcagcgtgtaacagacatcctatccagtccttta

SEQ ID NO: 258911 - DNA, 75 bp, Artificial Sequence
  Synthetic
ccaggtcagctgggagtaaggcccatctcttagcagataggaagaatctccgataatgaagctttaagtataatt

SEQ ID NO: 258912 - DNA, 75 bp, Artificial Sequence
  Synthetic
actgagtctcactggagggatggtgaagatatacgggtagaacagttggaggggtcgtctccactcaggaagtgt

SEQ ID NO: 258913 - DNA, 75 bp, Artificial Sequence
  Synthetic
ccgaccgaccaccagtccaacccctcgaggccaccgcagccgcaacaccaatcaccacacaccaatcatcacaac

SEQ ID NO: 258914 - DNA, 75 bp, Artificial Sequence
  Synthetic
ctcaagtcatagtgacaggcaatctcgatatatcaactgagcttgggaatgtcaacaactcaataagtaatgctc

SEQ ID NO: 258915 - DNA, 75 bp, Artificial Sequence
  Synthetic
ctcacactcaagtatggtattaacaccaagacatccgcgcttgcactgagcagcctctctggcgacatccaaaag

SEQ ID NO: 258916 - DNA, 75 bp, Artificial Sequence
  Synthetic
cttacattattttgactgtaatatctcttgctcttggtgcactcagccttgcactagcatgccacctgatgtaca

SEQ ID NO: 258917 - DNA, 75 bp, Artificial Sequence
  Synthetic
tcttgctcttggtgcactcagccttgcactagcatgccacctgatgtacaaacaaagggcacaacaaaagacctt

SEQ ID NO: 258918 - DNA, 75 bp, Artificial Sequence
  Synthetic
tatccccaatagcaatttgtgtgtaaagtctggcaacctggtagttggaagaattaagaaaaagctactgaatag

SEQ ID NO: 258919 - DNA, 75 bp, Artificial Sequence
  Synthetic
ataaggagactcaatctatccgtcgggctcagtgatgtgctcggaccctctgtgcttgtgaaggcgagaggtgca

SEQ ID NO: 258920 - DNA, 75 bp, Artificial Sequence
  Synthetic
ctgtcttaccagatcaacggtgcagccaatgccagcggatgtggggcccctgtacatgatcctgattacatcggg

SEQ ID NO: 258921 - DNA, 75 bp, Artificial Sequence
  Synthetic
gcacagggcagtagtatcaacgaagacatggccgctgaattgaagctaacaccggcagcaagaagagggcttgcg

SEQ ID NO: 258922 - DNA, 75 bp, Artificial Sequence
  Synthetic
taaaagaggcaacttcaactaaccgcctcttgatagagttcttagaatcaaatgattttgatccatataaagaaa

SEQ ID NO: 258923 - DNA, 75 bp, Artificial Sequence
  Synthetic
gaattaagaaaaagctactgaatagaagtgactagaaagaagtacacgggtagaacggtcggagaggccacccct

SEQ ID NO: 258924 - DNA, 75 bp, Artificial Sequence
  Synthetic
atgccctggacaggttagcagaaagtaacagcaaactagacaaagtcaatgtcaaattaaccagcacatctgctc

SEQ ID NO: 258925 - DNA, 75 bp, Artificial Sequence
  Synthetic
caatcgcacatccgagggataactggctcgcctcatttaggcgaaaccttctctctgaggaacagaaaagacaca

SEQ ID NO: 258926 - DNA, 75 bp, Artificial Sequence
  Synthetic
ttcacctgtctagcaaattagaaaaaacacgggtagaagagtctggatcccgaccggcacattcaggacgcaata

SEQ ID NO: 258927 - DNA, 75 bp, Artificial Sequence
  Synthetic
tgtacaaacaaaaggcacaacaaaagaccttactgtggcttgggaacaacaccctcgatcagatgagagccacta

SEQ ID NO: 258928 - DNA, 75 bp, Artificial Sequence
  Synthetic
acttttaatagtaataaccttagccatctctgcagctgccctggcgtatagcaaggaggctagcacgcctgacga

SEQ ID NO: 258929 - DNA, 75 bp, Artificial Sequence
  Synthetic
ggtagataggatatataagcaggtggcccttgagtctccgttggcgttgttaaacactgaatctgtaattatgaa

SEQ ID NO: 258930 - DNA, 75 bp, Artificial Sequence
  Synthetic
gcccttgagtctccgttggcgttgttaaacactgaatctgtaattatgaatgcaataacgtctctctcctatcaa

SEQ ID NO: 258931 - DNA, 75 bp, Artificial Sequence
  Synthetic
cccctcccccaccacaacccgccgccgtaccacacaagccaggaagagacatcccccctggctgtcccccactgc

SEQ ID NO: 258932 - DNA, 75 bp, Artificial Sequence
  Synthetic
gacaaccctgatcatcaggacagatcagacaaacgactgtccacagccgagcaagtgagtccacatgacagccca

SEQ ID NO: 258933 - DNA, 75 bp, Artificial Sequence
  Synthetic
tagtcacttgattaagaaaaaatgtgggtggtgacgggatataaggcaaaacaactcaaggaggatagcacgggt

SEQ ID NO: 258934 - DNA, 75 bp, Artificial Sequence
  Synthetic
gaacttattacagatgacactagtgatgtcacatcgttctatccttctgctttccaagaacacctgaatttcatc

SEQ ID NO: 258935 - DNA, 75 bp, Artificial Sequence
  Synthetic
tttccaagaacacctgaatttcatcccggcgcctactacaggatcaggttgcactcggataccctcctttgatat

SEQ ID NO: 258936 - DNA, 75 bp, Artificial Sequence
  Synthetic
ttaactggagatatcagacagtcaagctatttgcccatgccatcaatcagctgatgggcctacctcacttcttcg

SEQ ID NO: 258937 - DNA, 75 bp, Artificial Sequence
  Synthetic
tatacagcatgggggctagtacgccccgcgacctcgtaggcatatcgactatggtttctaaggcggaggacagga

SEQ ID NO: 258938 - DNA, 75 bp, Artificial Sequence
  Synthetic
ttacgtctttactcagttcaaaccaagatgtagtagacagagtatacaagcaagtggcccttgaatctccgttgg

SEQ ID NO: 258939 - DNA, 75 bp, Artificial Sequence
  Synthetic
gaatcagttggagagcaggaccagcccgggaagaaccaagccagcaacagcaaccgggaacccccagaagaagga

SEQ ID NO: 258940 - DNA, 75 bp, Artificial Sequence
  Synthetic
gtgatatgctgtgctctaaagtcacagagactgaggaggaggattataattcggttatccccacatcaatggtgc

SEQ ID NO: 258941 - DNA, 75 bp, Artificial Sequence
  Synthetic
ccaagtctttgttactcctgagcttgtcattgtgacacatacagatgagaacaagttcacgtgccttacccagga

SEQ ID NO: 258942 - DNA, 75 bp, Artificial Sequence
  Synthetic
agcagctcactactctctatgctcgacaaacttagcaacaagtcatcgaatgctaaaaagggcccacctcagagc

SEQ ID NO: 258943 - DNA, 75 bp, Artificial Sequence
  Synthetic
caaattacccgggtgtggggggtgggtccgttattgacggccgcgtgtggttcccagtctacggaggtctaaaac

SEQ ID NO: 258944 - DNA, 75 bp, Artificial Sequence
  Synthetic
aacaagattaccagattcggatggctaaagtttcatataagcctggccggttcggtgggaaacgcgtacagcaag

SEQ ID NO: 258945 - DNA, 75 bp, Artificial Sequence
  Synthetic
aggatagaaaagaagattcagattcacaatacaaggtatggggaactattcaccagactctgctcttatgttgaa

SEQ ID NO: 258946 - DNA, 75 bp, Artificial Sequence
  Synthetic
cataatccttatacattcaatgctttcactcggccaggtagtgtcccttgccaggcatcagcaagatgtcccaac

SEQ ID NO: 258947 - DNA, 75 bp, Artificial Sequence
  Synthetic
ccctaattgaatcactcttcccaatgacagcaaccagaacatatgatgagatcacattacacctccacagtaaat

SEQ ID NO: 258948 - DNA, 75 bp, Artificial Sequence
  Synthetic
gggacaatgcttgacaatgaacaagcaaggtttaaccctgtatctgcagtatttgataatatatcccgcagtcgc

SEQ ID NO: 258949 - DNA, 75 bp, Artificial Sequence
  Synthetic
accatctcattatcagcaggcaatggaagagaatactggagtcggccactcctgacacagagagaatgataaaac

SEQ ID NO: 258950 - DNA, 75 bp, Artificial Sequence
  Synthetic
agttgattggccaatctgtggtttcttatgatgaagacacctctataaagaatgatgctataatagtgtatgaca

SEQ ID NO: 258951 - DNA, 75 bp, Artificial Sequence
  Synthetic
gtcattgtgtcacctatctcttgcgatgccaagggtcaaactgagtaccgacgcgagtccagactctacgctgcc

SEQ ID NO: 258952 - DNA, 75 bp, Artificial Sequence
  Synthetic
gtcttcggaacaatgcttgatgatgaacaagcaagactcaaccccgtatctgcggtattcgacaacatatctcgc

SEQ ID NO: 258953 - DNA, 75 bp, Artificial Sequence
  Synthetic
tctcttagcagataggaagaatctctgataattaggcttcaagtatgatttaacaagtaggtgcagcaatcatca

SEQ ID NO: 258954 - DNA, 75 bp, Artificial Sequence
  Synthetic
acagaagctggtcacctctgacaggaggcagaaaaatactgggtgtatctaatcccgataccatagaacttgtcg

SEQ ID NO: 258955 - DNA, 75 bp, Artificial Sequence
  Synthetic
atgccaagggtcaaactgagtaccgacgcgagtccagactctacgctgccagtcagccataattagctagtgcta

SEQ ID NO: 258956 - DNA, 75 bp, Artificial Sequence
  Synthetic
tcaataccattgattatgcatacacagtaattaagaaaaaatacgggtagaatcgaagtgtcccggccgtgccaa

SEQ ID NO: 258957 - DNA, 75 bp, Artificial Sequence
  Synthetic
acatctcacggaggatagcacgggtaggacatggcaagctccggtcccgaaagggcagagcatcagatcatccta

SEQ ID NO: 258958 - DNA, 75 bp, Artificial Sequence
  Synthetic
cctgacgaatgtgacttcgaccacctcattatcagccgacaatggaagaaaatacttgaatcggccactcctgac

SEQ ID NO: 258959 - DNA, 75 bp, Artificial Sequence
  Synthetic
atgctgatgtgatcagtctgaattttgtctgcagtcactttatttagaaaaaatatggatggcagtgaaatacag

SEQ ID NO: 258960 - DNA, 75 bp, Artificial Sequence
  Synthetic
tgtgtctgggcagtgttcccaatacgggagatcttgtggatctggcgagggcttgtctggctatggtggtaacat

SEQ ID NO: 258961 - DNA, 75 bp, Artificial Sequence
  Synthetic
aaatatggatggcagtgaaatacaggggaaaacaacatacaaaggacagcacgggtaggaaatggcgagttccgg

SEQ ID NO: 258962 - DNA, 75 bp, Artificial Sequence
  Synthetic
ctagtattgaggtccctgattcaaccaacaaatttcggaagatcgagaagaagatccaaattcacaacacaaggt

SEQ ID NO: 258963 - DNA, 75 bp, Artificial Sequence
  Synthetic
tatttgaaacttgttcaaatcccttattatctggcgtacatacagaggataatgaggcagaagagaaggcgttgg

SEQ ID NO: 258964 - DNA, 75 bp, Artificial Sequence
  Synthetic
tgtcaacagtagacaagaaaggaaggaaggtgacatttgacaaattggaaaggaagatccggaggcttgatctat

SEQ ID NO: 258965 - DNA, 75 bp, Artificial Sequence
  Synthetic
gtgatcatcaaagtactgtatgcaatggggtactacttccatttactcatgaatttattcactccatgttccaca

SEQ ID NO: 258966 - DNA, 75 bp, Artificial Sequence
  Synthetic
atggagggcagagatatggtcaacataatatcatccacggcagcacatctcaagagcttatcagagaaaattgat

SEQ ID NO: 258967 - DNA, 75 bp, Artificial Sequence
  Synthetic
ttgctaggatcatcccgatctagcaaagtaccacgatcagaggagttcagcagcatccgttcagatccagcattc

SEQ ID NO: 258968 - DNA, 75 bp, Artificial Sequence
  Synthetic
gctcagtcggaaggagaaagcagattcaagggttagtggatacaaccaatacagtcataaaaattgcgttatcca

SEQ ID NO: 258969 - DNA, 75 bp, Artificial Sequence
  Synthetic
acttgtgttgatgtatgcggatatgatggagggcagagatatggtcaacataatatcatccacggcagcacatct

SEQ ID NO: 258970 - DNA, 75 bp, Artificial Sequence
  Synthetic
atgagaacaagttcacatgcctcacccaagaacttgtattgatgtatgcagatatgatggagggcagggacatgg

SEQ ID NO: 258971 - DNA, 75 bp, Artificial Sequence
  Synthetic
accacgaggtaacatccaccaaattggagaaagggcatactattgccaaatacaacccattcaaaaagtaaacac

SEQ ID NO: 258972 - DNA, 75 bp, Artificial Sequence
  Synthetic
tgagcacactaacagatatgactcagacaactcagatcattgccagccacattgacacagtcattcggtctgtaa

SEQ ID NO: 258973 - DNA, 75 bp, Artificial Sequence
  Synthetic
aagatgacaacatgtagatgtgtaaaccccccgggtatcatatcgcaaaattatggagaagccgtgtctctaata

SEQ ID NO: 258974 - DNA, 75 bp, Artificial Sequence
  Synthetic
attcgcaggagatttctttgcattcaacctgcaggagctcaaagacactctaatcgaactcctcccaaatgatat

SEQ ID NO: 258975 - DNA, 75 bp, Artificial Sequence
  Synthetic
tcaccgcatgttaaagcagcactcagagcctcctcggtactaatctgggcatacggtgacaatgacatcaattgg

SEQ ID NO: 258976 - DNA, 75 bp, Artificial Sequence
  Synthetic
gggtctcgatctgcacctatggcaggcagaatggatcccaagcctcctaccagctatttgcacgcccttccattg

SEQ ID NO: 258977 - DNA, 75 bp, Artificial Sequence
  Synthetic
agcggaatcagtaactcacgcaattgcctccatattctctggcttagaacagaatcaagcagctgagatgttgtg

SEQ ID NO: 258978 - DNA, 75 bp, Artificial Sequence
  Synthetic
agcagagatttcacatgatgtcatgttgagagagtacaagagtttatctgcacttgaattcgagccatgtataga

SEQ ID NO: 258979 - DNA, 75 bp, Artificial Sequence
  Synthetic
ggaatagtagtcacaagagacagggcagttaatatatacacatcatcgcagacagggacaattatcatcaaattg

SEQ ID NO: 258980 - DNA, 75 bp, Artificial Sequence
  Synthetic
cacttgaattcgagccatgtatagaatatgaccccgtcaccaatctaagcatgtttctaaaagacaaggcaatcg

SEQ ID NO: 258981 - DNA, 75 bp, Artificial Sequence
  Synthetic
aggcaacctcgactaaccgcctcttgatagagttcttagagtcaaatgattttgatccatataaggagatggaat

SEQ ID NO: 258982 - DNA, 75 bp, Artificial Sequence
  Synthetic
gatattggtgctcgagtgaaagatccatttactcgacaacctgcagcgttcatacaagagttagatttgagtgct

SEQ ID NO: 258983 - DNA, 75 bp, Artificial Sequence
  Synthetic
tcgagtgcgagcccgaagctcaagctcgagagtaccttctgccaagatgtcctccgtattcgatgaatacgagca

SEQ ID NO: 258984 - DNA, 75 bp, Artificial Sequence
  Synthetic
gccagtcttcacactcaacagtgatgacccggaggacaggtggaactttgcagtcttctgccttcggattgcagt

SEQ ID NO: 258985 - DNA, 75 bp, Artificial Sequence
  Synthetic
gaaccatgtggcactggctggaaagcaaagtgaggcaacactggcaatacttgagattgacggattctcaaatgg

SEQ ID NO: 258986 - DNA, 75 bp, Artificial Sequence
  Synthetic
ggagatatcagacagtcaagctgtttgctcatgccatcaatcagctgatgggcctacctcacttctttgagtgga

SEQ ID NO: 258987 - DNA, 75 bp, Artificial Sequence
  Synthetic
ccgtttgtcacggccggagtggaggatgatgcccctgaagacataactgacactcttgagagaatcctctccatc

SEQ ID NO: 258988 - DNA, 75 bp, Artificial Sequence
  Synthetic
ctcaggtaggctccgtaatcgaagagctggatacgtcgtattgcatagagacggatctagacctgtactgcacca

SEQ ID NO: 258989 - DNA, 75 bp, Artificial Sequence
  Synthetic
ataaacaagtacatgcaacagggcagggtccagaagcggtacatcctccacccggtgtgtagaagtgcgatccag

SEQ ID NO: 258990 - DNA, 75 bp, Artificial Sequence
  Synthetic
ggcattgagggattgtgccagaagctatggacaatgatctcaattgctgcaatccaacttgctgcagcaagatca

SEQ ID NO: 258991 - DNA, 75 bp, Artificial Sequence
  Synthetic
aaggtgacaatcaagtaatagctgtaacgagagaggtaagatcagatgattccccggagatggtgttaacacaat

SEQ ID NO: 258992 - DNA, 75 bp, Artificial Sequence
  Synthetic
ggcacctcaacttattacaacctcgtgggagatgtggactcatacatcaggaacactggtcttaccgcattcttc

SEQ ID NO: 258993 - DNA, 75 bp, Artificial Sequence
  Synthetic
gcggcacggtacacttttgtctaaatcagatgagatcacactgactaggttatttacctcacagcggcagcgtgt

SEQ ID NO: 258994 - DNA, 75 bp, Artificial Sequence
  Synthetic
gtcaggtcctcaaaaactcatctaaattagtgctaatatcaggagaccttagtgaaaacactgtaatgtcctgtg

SEQ ID NO: 258995 - DNA, 75 bp, Artificial Sequence
  Synthetic
atgaaacagctaatgcgcttgtatcggatgaaaggggagaatgccccatacatgactctactgggtgacagcgac

SEQ ID NO: 258996 - DNA, 75 bp, Artificial Sequence
  Synthetic
ctactcgccaaatcagatgagatggcattgatggcgttatttacctcgcagaagcaaaaagttaacaacatccta

SEQ ID NO: 258997 - DNA, 75 bp, Artificial Sequence
  Synthetic
gatgcaacctatcggaagaatatctcaattcaggattctcaggtggtgattactgggaatctagatatatccacc

SEQ ID NO: 258998 - DNA, 75 bp, Artificial Sequence
  Synthetic
caaatgagcttcgcaccagcagaatatgcccagctgtattcatttgcaatgggtatggcatctgtattggacaaa

SEQ ID NO: 258999 - DNA, 75 bp, Artificial Sequence
  Synthetic
agaatatcgatactgcgctaattgaagccgggggacaacccgtccgtccgttctgtgcagagagcttggtgagga

SEQ ID NO: 259000 - DNA, 75 bp, Artificial Sequence
  Synthetic
cttggattgaggacatctcttttgtccactcgtatgtcttaacccctgcccagctaggaggactgagtaaccttc

SEQ ID NO: 259001 - DNA, 75 bp, Artificial Sequence
  Synthetic
gggcagtcgctaacagcatgagggatgcccccaactcggcacagggcagcccccagcctgctccccccccaaccc

SEQ ID NO: 259002 - DNA, 75 bp, Artificial Sequence
  Synthetic
ccccagcctgctccccccccaacccccggagggggtcaggacaacgacaccgactggggatactagtcagaacct

SEQ ID NO: 259003 - DNA, 75 bp, Artificial Sequence
  Synthetic
attatccggagtacatacagaggataatgaagcagaagagaaggcattggctgaattcttgctcaatcaagaagt

SEQ ID NO: 259004 - DNA, 75 bp, Artificial Sequence
  Synthetic
ccggagggggtcaggacaacgacaccgactggggatactagtcagaacctcgcccggtgaggacccagatcttcc

SEQ ID NO: 259005 - DNA, 75 bp, Artificial Sequence
  Synthetic
ccggagggggccaggacaacgacaccgactggggatactagtcagaacctcgcccggtgacaatccagaccctcc

SEQ ID NO: 259006 - DNA, 75 bp, Artificial Sequence
  Synthetic
aattcacccacgcgtcgcgcatgctatcatggaagcaagctctgtaggtaggagaaagcaaattcaggggcttgt

SEQ ID NO: 259007 - DNA, 75 bp, Artificial Sequence
  Synthetic
aaagttgaattccgaccctttgaaactcgtattcggattcgaataattatctcaaaacaggagtgcgtgtagtta

SEQ ID NO: 259008 - DNA, 75 bp, Artificial Sequence
  Synthetic
ctcgtattcggattcgaataattatctcaaaacaggagtgcgtgtagttatccttgattgcagccctgtcattca

SEQ ID NO: 259009 - DNA, 75 bp, Artificial Sequence
  Synthetic
attagtttcgtctgctatgtgctcgctgacactagcagactatgcccggaatagaagctggtcacccttaacagg

SEQ ID NO: 259010 - DNA, 75 bp, Artificial Sequence
  Synthetic
cccacaatctgattgattagaaaaaagtacgggtagaagagtagtgtcccgagggtgggcatccaagcctacgcc

SEQ ID NO: 259011 - DNA, 75 bp, Artificial Sequence
  Synthetic
aaaaatactgggtgtatctaatcctgataccatagaacttgtagagggtgagatcctcagtgtcagcggagggtg

SEQ ID NO: 259012 - DNA, 75 bp, Artificial Sequence
  Synthetic
caggatctggctgtacccgaatcccatcttttgatatgagtgtcactcattattgctatacacacaatgtcatct

SEQ ID NO: 259013 - DNA, 75 bp, Artificial Sequence
  Synthetic
gaatcagctggagagcaggaccagcccgggcagaaccaggccagcagcagcaaccgggcacccccggaagaagga

SEQ ID NO: 259014 - DNA, 75 bp, Artificial Sequence
  Synthetic
cagcaagaatcctccgatgagagtgccatatctcggatcaaagactcaagagaggagggccgcctcgcttgcgaa

SEQ ID NO: 259015 - DNA, 75 bp, Artificial Sequence
  Synthetic
gagtgttcttttcgacccttcgatcaatcaacctagatgatactcagaacaggaagtcgtgtagtgtgagcgcaa

SEQ ID NO: 259016 - DNA, 75 bp, Artificial Sequence
  Synthetic
gggaatctccaacatagattggatgatggcataacccagatgacatttacccctgcatctctctacagagtatca

SEQ ID NO: 259017 - DNA, 75 bp, Artificial Sequence
  Synthetic
ttaggcctcgagtccgcaaccgaatcatagtgtaaaaaacaatacaaaacgtaacagtttgtcacattattctga

SEQ ID NO: 259018 - DNA, 75 bp, Artificial Sequence
  Synthetic
gctcagtgggagacggggcaccaggtcgccccaggccctggactcccgggcaccggcgtgaacacagcatttcct

SEQ ID NO: 259019 - DNA, 75 bp, Artificial Sequence
  Synthetic
tcgccccaggccctggactcccgggcaccggcgtgaacacagcatttcctggacaatggggggggtcaccacaat

SEQ ID NO: 259020 - DNA, 75 bp, Artificial Sequence
  Synthetic
gagattgggtggctaactaccctggggttggtggcggatccttcataaataaccgcgtctggttctcagtgtatg

SEQ ID NO: 259021 - DNA, 75 bp, Artificial Sequence
  Synthetic
agctacctgtagactttgtgcaggcgatgatgtctatgatggaggcgatctcacagagggtaagcaagattgatt

SEQ ID NO: 259022 - DNA, 75 bp, Artificial Sequence
  Synthetic
ggttaagatggccaagtcggcatacaagcctaatcgattcggggggaaacgaatccaacaggctatcttatctat

SEQ ID NO: 259023 - DNA, 75 bp, Artificial Sequence
  Synthetic
agacttgatctagccatctttaagagttatgagctgaatttagagtcatatcccacaatagagctaatgaacatt

SEQ ID NO: 259024 - DNA, 75 bp, Artificial Sequence
  Synthetic
aggaatgatgaagattctagaccccggctgtgcaaacgtgtcctctctgagcgatctacgcgcagtggctaaatc

SEQ ID NO: 259025 - DNA, 75 bp, Artificial Sequence
  Synthetic
gcgatctacgcgcagtggctaaatctcaccccgtgttagttgcaggtccaggtgacccgtcaccctacgtgacgc

SEQ ID NO: 259026 - DNA, 75 bp, Artificial Sequence
  Synthetic
gctgtcgcagccagtaccccacccatcggaccttataaagcatgcaacttctggcggcccggacatagggattga

SEQ ID NO: 259027 - DNA, 75 bp, Artificial Sequence
  Synthetic
cctgaggtcagatgtgcaagacatgggaactccttatacctggcagaaggaagtggagccatcatgagtcttctt

SEQ ID NO: 259028 - DNA, 75 bp, Artificial Sequence
  Synthetic
ttcattgaaatgtctgcaaaactgctagtctcttgcactcgacgcgtggtctcaggtttatatgcagggaatagg

SEQ ID NO: 259029 - DNA, 75 bp, Artificial Sequence
  Synthetic
agctttgaccaccaagggacgaccaggctggaatgatgaagtcgttgatccaatattctgcacagtgaccaacca

SEQ ID NO: 259030 - DNA, 75 bp, Artificial Sequence
  Synthetic
cgctagtcaaatccctttctaagtctgatagcggatactatgctaatctttttttgcatatcgggcttatgtcta

SEQ ID NO: 259031 - DNA, 75 bp, Artificial Sequence
  Synthetic
gaagatgatgctgtatcacctatctctcgcaacaccaaggatcaaactggatatcaatgcaagcctgaatcccat

SEQ ID NO: 259032 - DNA, 75 bp, Artificial Sequence
  Synthetic
tgtgcctcagttcaacaataggagtggagtgtctgaggagagagcacagagattcatggtaatcgcaggatctct

SEQ ID NO: 259033 - DNA, 75 bp, Artificial Sequence
  Synthetic
cagatgctgtgaaaccattacttaggtccgagcaagtgagctctatcatgtctcccaacataattacattcccag

SEQ ID NO: 259034 - DNA, 75 bp, Artificial Sequence
  Synthetic
tctattacaatacacttttctcgaatgagatgaaccccccacagcgacatttcggaccgaccccaacacagtttc

SEQ ID NO: 259035 - DNA, 75 bp, Artificial Sequence
  Synthetic
gtccgagcaagtgagctctatcatgtctcccaacataattacattcccagccaatctatattacatgtctaggaa

SEQ ID NO: 259036 - DNA, 75 bp, Artificial Sequence
  Synthetic
tgtagtatctcacttatagcatattagaaaaaactatggccacagccgtgatagactaagataagcaaaccagag

SEQ ID NO: 259037 - DNA, 75 bp, Artificial Sequence
  Synthetic
tgcttgacaagctgagcaataaatcgtccaatgctaaaaagggcccatggtcaggtccccaagaagggcaccacc

SEQ ID NO: 259038 - DNA, 75 bp, Artificial Sequence
  Synthetic
tgtgtctgggcagtgtccccaatgcgggagatcttgtggagctggcgagggcctgtctggctatggtgataacat

SEQ ID NO: 259039 - DNA, 75 bp, Artificial Sequence
  Synthetic
ggtgctcgagtgaaagatccatttacccgacaacctgcggcgttcttacaagagttagatttgagtgccccagca

SEQ ID NO: 259040 - DNA, 75 bp, Artificial Sequence
  Synthetic
gcaaaaagagtgccacgaatacagagaggatggtcttctcggtggtgcaagcgccgcaggtgttgcagagttgca

SEQ ID NO: 259041 - DNA, 75 bp, Artificial Sequence
  Synthetic
ctgtcgactttgtgcaggcgatgatgtctatgatggaggcattatcacagaaggtaagtaaagttgatcatcagc

SEQ ID NO: 259042 - DNA, 75 bp, Artificial Sequence
  Synthetic
ggacacttgaatacaaggtaaatttcgtgtcgctgaccgtagtacccaaaaaggacgtttacaagattccaaccg

SEQ ID NO: 259043 - DNA, 75 bp, Artificial Sequence
  Synthetic
tcccgattcaacaaacaggttcagaaggatagaaaagaagattcagattcacaacacaaggtatggggaactatt

SEQ ID NO: 259044 - DNA, 75 bp, Artificial Sequence
  Synthetic
cagcgctcaaggtgtctggatcaagtctctacaatcttgcgctaaatgtcactattgatgtggaggtagatcaca

SEQ ID NO: 259045 - DNA, 75 bp, Artificial Sequence
  Synthetic
actattgatgtggaggtagatcacaaaagcccgctggtaaaatcactgtctaaatcagagaacgggtactacgca

SEQ ID NO: 259046 - DNA, 75 bp, Artificial Sequence
  Synthetic
gatgaaaattctggaccctggctgtgctaacgtttcatccttaagtgatctccgagcagtagcccgatcccaccc

SEQ ID NO: 259047 - DNA, 75 bp, Artificial Sequence
  Synthetic
tgtcaacggtagacaagaaaggaagaaaggtgacattcgacaagttggaaaggaagctccggaggctcgatctgt

SEQ ID NO: 259048 - DNA, 75 bp, Artificial Sequence
  Synthetic
gccatctatcttagtcaaagcaagaggtgcacgtactaagctcctggcaccatttttctcaagcagcggaaccgc

SEQ ID NO: 259049 - DNA, 75 bp, Artificial Sequence
  Synthetic
tctcacgcaggaacttgtattgatgtatgcggatatgatggagggaagagacatggtgaatataatctcatcgac

SEQ ID NO: 259050 - DNA, 75 bp, Artificial Sequence
  Synthetic
atgttatccgattgccaatgcatcccctcaggtggcaaagatactgtggagtcagacagcgagcctgcgcagcgt

SEQ ID NO: 259051 - DNA, 75 bp, Artificial Sequence
  Synthetic
accacgaggtaacatccaccaagctggagaaagggcatactattgccaaatacaacccgttcaaaaagtaagcac

SEQ ID NO: 259052 - DNA, 75 bp, Artificial Sequence
  Synthetic
agatagtttgattcataatagcattagaaaaaacacgggtagaaggtatggggtctcgacctgcacccatggcag

SEQ ID NO: 259053 - DNA, 75 bp, Artificial Sequence
  Synthetic
tatttacctcacagcagcatcgtgtaacagacatcctatccagccctttaccgagactaatgaagttcttgagag

SEQ ID NO: 259054 - DNA, 75 bp, Artificial Sequence
  Synthetic
ccgagactaatgaagttcttgagagagaatattgatgctgcgctgattgaagccgggggacagcctgtccgtcca

SEQ ID NO: 259055 - DNA, 75 bp, Artificial Sequence
  Synthetic
ggatgggcggccgctcgccgccgcaggaatagtagtcacaggagacaaggcagttaatatatacacatcgtcgca

SEQ ID NO: 259056 - DNA, 75 bp, Artificial Sequence
  Synthetic
cccaaggtgcactgaacagatcacaagggcaaccggacaccggggacggggagacccaatttctggatctgatga

SEQ ID NO: 259057 - DNA, 75 bp, Artificial Sequence
  Synthetic
agggcaaccggacaccggggacggggagacccaatttctggatctgatgagagcggtggcaaatagcatgagaga

SEQ ID NO: 259058 - DNA, 75 bp, Artificial Sequence
  Synthetic
ttctgtgcagagagtttagtgagcacactaaaagatatgactcagatgacccagatcatcgccagccacattgac

SEQ ID NO: 259059 - DNA, 75 bp, Artificial Sequence
  Synthetic
tgcatacaataggactcttacaaccctccttgccccgctcggcgattcgattaggagaatccaagagtcggtaac

SEQ ID NO: 259060 - DNA, 75 bp, Artificial Sequence
  Synthetic
acagatcctagaggtcacaatactgggtctcagggccaaagatctcaataaagtaggtgatgtaatcggcctagt

SEQ ID NO: 259061 - DNA, 75 bp, Artificial Sequence
  Synthetic
gtgtcgcattaggtgtagccaccgcagcgcagatcacagcggcttctgccctcatacaagccaaccagaatgctg

SEQ ID NO: 259062 - DNA, 75 bp, Artificial Sequence
  Synthetic
ctcatacaagccaaccagaatgctgcaaacatactgaaattaaaggagagtattgccgctaccaatgaagcagta

SEQ ID NO: 259063 - DNA, 75 bp, Artificial Sequence
  Synthetic
tttgaaggctgtcctaggtattactaaactcaaagaaatgttcacagacacctctttattatacttgactcgtgc

SEQ ID NO: 259064 - DNA, 75 bp, Artificial Sequence
  Synthetic
cctctttattatacttgactcgtgctcaacaaaaattctacatgaaaactataggcaatgcagtcaagggatatt

SEQ ID NO: 259065 - DNA, 75 bp, Artificial Sequence
  Synthetic
tcaacaaaaattctacatgaaaactataggcaatgcagtcaagggatattacagtaacggtaactcttaaaggca

SEQ ID NO: 259066 - DNA, 75 bp, Artificial Sequence
  Synthetic
gataaaaggcgaagaagcaatcgagatcgtacgggtagaaggtgtgaaccccgagcgcgaggccgaagctcgaac

SEQ ID NO: 259067 - DNA, 75 bp, Artificial Sequence
  Synthetic
ttctctatgactcgcaaactcagcttctgggtatacaggtgactctcccctctgtgggcaatctgaacaacatgc

SEQ ID NO: 259068 - DNA, 75 bp, Artificial Sequence
  Synthetic
tttatcactaccgatctacagaaatactgcttgaactggcggtatcagaccataaagctattcgctcatgccatc

SEQ ID NO: 259069 - DNA, 75 bp, Artificial Sequence
  Synthetic
tctgggtatacaggtgactctcccctctgtgggcaatctgaacaacatgcgcgccacatatctggaaaccctctc

SEQ ID NO: 259070 - DNA, 75 bp, Artificial Sequence
  Synthetic
tccgcattagtgcctaaggtggtaactcaggtaggctccgtaattgaagagctggatacgtcgtattgcatagag

SEQ ID NO: 259071 - DNA, 75 bp, Artificial Sequence
  Synthetic
gctggatacgtcgtattgcatagagacagacctggatctgtactgcactagaattgtaacattccccatgtctcc

SEQ ID NO: 259072 - DNA, 75 bp, Artificial Sequence
  Synthetic
acagacctggatctgtactgcactagaattgtaacattccccatgtctccaggtatcttctcctgtctcggtgga

SEQ ID NO: 259073 - DNA, 75 bp, Artificial Sequence
  Synthetic
ggagtgtctgaggagagagcacagagattcatggtaatagcaggatctctccctcgggcatgcagtaacggtact

SEQ ID NO: 259074 - DNA, 75 bp, Artificial Sequence
  Synthetic
ttcacctgtctagcgaattagaaaaaacacgggtagaagagtctggatcccaatcagcacacccgagacgcaaca

SEQ ID NO: 259075 - DNA, 75 bp, Artificial Sequence
  Synthetic
ctcaattgcagctattcagttggcagcagcacgatcgcattgtcgcgtagcatgtatggtccaaggggataacca

SEQ ID NO: 259076 - DNA, 75 bp, Artificial Sequence
  Synthetic
agactgaaggagcactcaccacaccatatatgacactcaaaggatcagtcatagcaaattgcaagatgacaacat

SEQ ID NO: 259077 - DNA, 75 bp, Artificial Sequence
  Synthetic
aaattgcttcggtaccttagaaaaaactgagtctcattggaggaatggtgaatatatacgggtagaacagtcgga

SEQ ID NO: 259078 - DNA, 75 bp, Artificial Sequence
  Synthetic
atagcaaattgcaagatgacaacatgtaggtgcgcagatcccccggggataatctcacagaattatggagaggct

SEQ ID NO: 259079 - DNA, 75 bp, Artificial Sequence
  Synthetic
gatgcaacctatcagaaaaatatctcaattcaggattcccaggtggtgattactgggaatctagatatatccact

SEQ ID NO: 259080 - DNA, 75 bp, Artificial Sequence
  Synthetic
gtgactcttgccatctccgcagccgccctcgcattcagcatgaatgctagcacacctcaggacttagaaggaata

SEQ ID NO: 259081 - DNA, 75 bp, Artificial Sequence
  Synthetic
atgtttctaaaagacaaggcgatcgcacacccgaaagacaactggctcgcctcgtttaggcgaaaccttctctct

SEQ ID NO: 259082 - DNA, 75 bp, Artificial Sequence
  Synthetic
agagagtaacagcaagctggacaaagttaatgtgaggcttaccagtacatctgccctaatcacatatattgtctt

SEQ ID NO: 259083 - DNA, 75 bp, Artificial Sequence
  Synthetic
gttgatagccgtcacagctcacaacaggctcctgcctcaccagtgtcacaaggaattcttcccgagccctccccc

SEQ ID NO: 259084 - DNA, 75 bp, Artificial Sequence
  Synthetic
gagacttggagtagagtatgcccaggctcagggaagtagcatcaatgaggacatggctgctgagctaaaactaac

SEQ ID NO: 259085 - DNA, 75 bp, Artificial Sequence
  Synthetic
aacaacaccttggaccagatgagagcaacgacaaagatgtaaaatctcattgttgcataagctgataaaacacat

SEQ ID NO: 259086 - DNA, 75 bp, Artificial Sequence
  Synthetic
acagcatttgctgaggtgaaaaggctcgaagcagtaggacttttaggaccaaacataatgacaaacattctgact

SEQ ID NO: 259087 - DNA, 75 bp, Artificial Sequence
  Synthetic
tggacctagtcttgaaacagacatcctccatccctatgatgcgatctgaaatccaacagctcaagacatctgttg

SEQ ID NO: 259088 - DNA, 75 bp, Artificial Sequence
  Synthetic
cacaacgtgttctgtttgagacatgctcaaacccgctactatctggagtccacacagaagacaatgaagcagaag

SEQ ID NO: 259089 - DNA, 75 bp, Artificial Sequence
  Synthetic
cttgagaatgatgaaagggaggcaaaaaacacatggaggttggtgttcagggtgactgttctttttctcactata

SEQ ID NO: 259090 - DNA, 75 bp, Artificial Sequence
  Synthetic
gaggactaccaatcgacagaccctacactaatggtgcatgggaggctaggatttgatggacagtatcatgagaga

SEQ ID NO: 259091 - DNA, 75 bp, Artificial Sequence
  Synthetic
cactaatggtgcatgggaggctaggatttgatggacagtatcatgagagagatttggacgttcgcactctttttg

SEQ ID NO: 259092 - DNA, 75 bp, Artificial Sequence
  Synthetic
tacaaacaagtggcattagagtcgcccctagccctgctcaacaccgaatccacgatcatgaacgccttgacatca

SEQ ID NO: 259093 - DNA, 75 bp, Artificial Sequence
  Synthetic
actcttgatcagatgagagccaccacaagagcatgagtgcagatgagaggcggatgtatacccagcagcagcctg

SEQ ID NO: 259094 - DNA, 75 bp, Artificial Sequence
  Synthetic
ccaatgccagcggatgtggggcccctgtacatgatcctgattacattggagggataggcaaggagctgattgtag

SEQ ID NO: 259095 - DNA, 75 bp, Artificial Sequence
  Synthetic
gaccgggggaagaaagattctaggggtctctaatcctgacacgattgagctggtggaaggagaaatactaagtat

SEQ ID NO: 259096 - DNA, 75 bp, Artificial Sequence
  Synthetic
agcgcaatcccacaaggcaagaccaaagctctgagcacagcatgggagaagcacgggagcgtccagccacacgcc

SEQ ID NO: 259097 - DNA, 75 bp, Artificial Sequence
  Synthetic
cttaatttcatccctgcacctaccacaggatccggctgtacccgaatcccatcttttgatatgagtgccactcat

SEQ ID NO: 259098 - DNA, 75 bp, Artificial Sequence
  Synthetic
cacgggtagaacggcctgaggagcctcccttcaatcggaagctaggcttcacaacgtccgctctaccacatcacc

SEQ ID NO: 259099 - DNA, 75 bp, Artificial Sequence
  Synthetic
ttggatttatattgtacaagaatagtgacattccctatgtcccctggtatttattcctgtctgagcggtaataca

SEQ ID NO: 259100 - DNA, 75 bp, Artificial Sequence
  Synthetic
caggatccggctgtacccgaatcccatcttttgatatgagtgccactcattattgctatacacataatgtcatct

SEQ ID NO: 259101 - DNA, 75 bp, Artificial Sequence
  Synthetic
catggcgcttggttttccggatcgcagtcttacttttaatggtaatgattctagccatctctgcagccgccctgg

SEQ ID NO: 259102 - DNA, 75 bp, Artificial Sequence
  Synthetic
caaatcagctgagaccgtcggaagaagcgcaatcccacaaggcaagaccaaagctctgagcacagcatgggagaa

SEQ ID NO: 259103 - DNA, 75 bp, Artificial Sequence
  Synthetic
tggtggaaggagaaatactaagtatcagtgggggttgtacaaagtgcgatagcggagatgaacaattcacatggt

SEQ ID NO: 259104 - DNA, 75 bp, Artificial Sequence
  Synthetic
ggaagaccgcagcaccaggccaaggccgtccctggaaaccggggcacagacgagaacacagcatatcatggacaa

SEQ ID NO: 259105 - DNA, 75 bp, Artificial Sequence
  Synthetic
atgactcacagagactgttcactgaggaaggtgttaaggaaggaaacgtggtatatcagcaaatcatgctcctag

SEQ ID NO: 259106 - DNA, 75 bp, Artificial Sequence
  Synthetic
cacactccctgacccacaaccctgcacgaccccacctacaaaagatcccccccaccctctcccccactcccagcc

SEQ ID NO: 259107 - DNA, 75 bp, Artificial Sequence
  Synthetic
aatccgcccagagtccaaggtattagaaaaaaatacgggtagaagagagacatccagagaccaggacgggtcacc

SEQ ID NO: 259108 - DNA, 75 bp, Artificial Sequence
  Synthetic
gcaagtttagttgttgtatccgtgaggcgccagtggctgtcccatttgagctaacaggtgtagcaccagatctca

SEQ ID NO: 259109 - DNA, 75 bp, Artificial Sequence
  Synthetic
ctttacagatgcggagatagatgacatatttgagaccagtgggactgtcattgacagcataattacggcccaggg

SEQ ID NO: 259110 - DNA, 75 bp, Artificial Sequence
  Synthetic
ataccatcactctcatgggtgctgagggcagggtgatgactgtcgggacctctcattacttgtaccagcgcgggt

SEQ ID NO: 259111 - DNA, 75 bp, Artificial Sequence
  Synthetic
ggcaaggtgctctcatatccctcttatgctcccattcccaagtgatgagaaaccatgttgcccttgcagggaagc

SEQ ID NO: 259112 - DNA, 75 bp, Artificial Sequence
  Synthetic
cgatattcaaaagttatgaattgaatttggagtcatattctacgatagagttgatgaatattctttctatctcta

SEQ ID NO: 259113 - DNA, 75 bp, Artificial Sequence
  Synthetic
atgctcccattcccaagtgatgagaaaccatgttgcccttgcagggaagcagaatgaggccacactggctgttct

SEQ ID NO: 259114 - DNA, 75 bp, Artificial Sequence
  Synthetic
cggaatccctcgggggcccccccttgcaaatccacgcttcaacacccaaaacaacagccctctctcaccctcctc

SEQ ID NO: 259115 - DNA, 75 bp, Artificial Sequence
  Synthetic
tctcattacttgtaccagcgcgggtcttcttattactcccctgccatactttatcccttgaccattgcaaataag

SEQ ID NO: 259116 - DNA, 75 bp, Artificial Sequence
  Synthetic
cagtgtcccgtgtcaagcgtccgccaggtgtccaaactcttgtgtaacgggggtgtacactgacccgtatccaat

SEQ ID NO: 259117 - DNA, 75 bp, Artificial Sequence
  Synthetic
aggtgtccaaactcttgtgtaacgggggtgtacactgacccgtatccaatagtatttcacaagaatcacacactg

SEQ ID NO: 259118 - DNA, 75 bp, Artificial Sequence
  Synthetic
atgacaagcaagccagactgaacccagtttctgcagtatttgattccattgcacggagtcgagtaactagggtaa

SEQ ID NO: 259119 - DNA, 75 bp, Artificial Sequence
  Synthetic
ttacactcatgggggccgaaggcagaattctcacggtagggacatctcacttcttgtatcaacgagggtcttcat

SEQ ID NO: 259120 - DNA, 75 bp, Artificial Sequence
  Synthetic
caatattctgcgcagtgaccaaccaaactgaccataggcaaaagctagaggagtatgcacaaagttggccatgac

SEQ ID NO: 259121 - DNA, 75 bp, Artificial Sequence
  Synthetic
tgctgtttgcgaccacgagagagatcccgaaaataagaggattgcccgcagaagataaatgtgctatgttaacag

SEQ ID NO: 259122 - DNA, 75 bp, Artificial Sequence
  Synthetic
tgtagtatctcacttatagcatattagaaaaaactgtggccacagccgcgataggcaaagataagcaaaccagag

SEQ ID NO: 259123 - DNA, 75 bp, Artificial Sequence
  Synthetic
ctccgggcccgaaagggtggagcatcaaatcatcctacccgaatctcacttatcgtctccacttgtcaaacataa

SEQ ID NO: 259124 - DNA, 75 bp, Artificial Sequence
  Synthetic
atgctttcactcggccaggtagtgtcccttgccaggcatcagcaagatgccccaactcatgcatcactggagtct

SEQ ID NO: 259125 - DNA, 75 bp, Artificial Sequence
  Synthetic
tgcattcctgcacgagctagacttaagcgctccagcacggtacgatgcatacacgttagagcaagcccgatctga

SEQ ID NO: 259126 - DNA, 75 bp, Artificial Sequence
  Synthetic
aaaatgtgcaggacgccacatcaaccaatcgactcctaatagaattcctagaatcaaatgattttgatccatata

SEQ ID NO: 259127 - DNA, 75 bp, Artificial Sequence
  Synthetic
ccgcgcacctgcggagtgtgaaagtcatcattcaagccggcactcagcgtgctgtcgcagtgaccgctgatcatg

SEQ ID NO: 259128 - DNA, 75 bp, Artificial Sequence
  Synthetic
ctgtgcacttgctgacatgggggaggatcaattagttcgatacctatttaggggagtaggaacagcatcttcatc

SEQ ID NO: 259129 - DNA, 75 bp, Artificial Sequence
  Synthetic
cccgcgatgcctcgagtcaggctaggtattaacataagccaggatcctatgctgccaagcaaccataatctgaca

SEQ ID NO: 259130 - DNA, 75 bp, Artificial Sequence
  Synthetic
gcattctggttccactcttcatggtccaccgccaaattcgcatggcttcatgtgaagcagatccagaggcacttg

SEQ ID NO: 259131 - DNA, 75 bp, Artificial Sequence
  Synthetic
agttccttaactctgtggtgtatagaaacttacaagccgaggtcccgtgcaaagatggatttgtccaggagttcc

SEQ ID NO: 259132 - DNA, 75 bp, Artificial Sequence
  Synthetic
tccgtctgacaagctctcttgacggcaggcctcttgcagctgcaggaattgtagtaacaggagataaggcagtca

SEQ ID NO: 259133 - DNA, 75 bp, Artificial Sequence
  Synthetic
gaagcaccgacggagggttgccacatttatcaccaccgacctacagaagtactgtttgaactggcggtatcagac

SEQ ID NO: 259134 - DNA, 75 bp, Artificial Sequence
  Synthetic
cctccagcaagcttgtgacactgtctcatcattcaggccaagtctttatcactcctgagctagtaatagtaacgc

SEQ ID NO: 259135 - DNA, 75 bp, Artificial Sequence
  Synthetic
tcatcattcaggccaagtctttatcactcctgagctagtaatagtaacgcatacgaatgaaaacaagtttacatg

SEQ ID NO: 259136 - DNA, 75 bp, Artificial Sequence
  Synthetic
catggataccacgatgttcgtgggcgaccctttcaaccctccgagtgatccgactgactgtgacctaaccaaggt

SEQ ID NO: 259137 - DNA, 75 bp, Artificial Sequence
  Synthetic
gtgcaaaagccccattagaggcatataacagaacactgactactctgctcactcctcttggcgactccatccgca

SEQ ID NO: 259138 - DNA, 75 bp, Artificial Sequence
  Synthetic
gaaaagaagatccaaattcacaatacaaggtacggagagctgttcacaaagctgtgcacgcatgttgaaaagaaa

SEQ ID NO: 259139 - DNA, 75 bp, Artificial Sequence
  Synthetic
ctcttggggttgcaacagcggcacagataacagcagccgcggccctaatacaagctaaccagaatgccgccaaca

SEQ ID NO: 259140 - DNA, 75 bp, Artificial Sequence
  Synthetic
tcagtcaaaggatacgttctgtccaacgggtatgcctgtagaggagatatggaatgctatgtagtattcgtaatg

SEQ ID NO: 259141 - DNA, 75 bp, Artificial Sequence
  Synthetic
gagcaggcgaccccacacaacgacccgccgaccgcgcccaaagaaccgcttcccactcaggcaacaggcaacacc

SEQ ID NO: 259142 - DNA, 75 bp, Artificial Sequence
  Synthetic
aaatcacacaacaggttggtgtagaactcaacctatacctaactgaattgactacagtattcgggccacagatca

SEQ ID NO: 259143 - DNA, 75 bp, Artificial Sequence
  Synthetic
gctatcgccaacatattctctggtcttgagcaaaaccaggcagcagagatgttatgtctattgaggttatggggt

SEQ ID NO: 259144 - DNA, 75 bp, Artificial Sequence
  Synthetic
gaccgcagcaccaggccaaagccgcccctggaagccggggcacagacgcgagcacagcatatcatggacaatgga

SEQ ID NO: 259145 - DNA, 75 bp, Artificial Sequence
  Synthetic
tcaagaacttgtattgatgtatgcagatatgatggagggcagggacatggtcaacataatatcttccacggcggt

SEQ ID NO: 259146 - DNA, 75 bp, Artificial Sequence
  Synthetic
ttttcaaagggactatcatcaatggatataggaagaagaacgccggtgtctggccgagggttaaagcacatacca

SEQ ID NO: 259147 - DNA, 75 bp, Artificial Sequence
  Synthetic
cacctcatactgtatagagtccgatctggatttatattgtacaagaatagtgacattccccatgtccccaggtat

SEQ ID NO: 259148 - DNA, 75 bp, Artificial Sequence
  Synthetic
tcggttctgtgatagaagagcttgacacctcatactgtatagagtccgatctggatttatattgtacaagaatag

SEQ ID NO: 259149 - DNA, 75 bp, Artificial Sequence
  Synthetic
tcaagtatatgatgttgtggcattaatggaggggtttgcatacggtgccgtgcaactgcttgagccgtcaggtac

SEQ ID NO: 259150 - DNA, 75 bp, Artificial Sequence
  Synthetic
ctgatagatagacattcatgcaatgtcttatcattagacgggataactctgaggctcagtggggaatttgatgca

SEQ ID NO: 259151 - DNA, 75 bp, Artificial Sequence
  Synthetic
gtcagactaaccagcacatctgctctcattacctatatcgttctaactgtcatttctctagttttcggtgcactt

SEQ ID NO: 259152 - DNA, 75 bp, Artificial Sequence
  Synthetic
aggaggtgaaagttaacggtcgcatattcgccaagttgaccaagaagctgaggaactgccaggtcatggcagaag

SEQ ID NO: 259153 - DNA, 75 bp, Artificial Sequence
  Synthetic
gctcctgagcaagctggatgcagccaagtcgatcgaagagatcagaaagatcaaacgccttgcgctgaatggttg

SEQ ID NO: 259154 - DNA, 75 bp, Artificial Sequence
  Synthetic
caagacagcatttctctgaccaagagcatgctagcaatgagccaactatcatataatagcaacaggaagcgtatc

SEQ ID NO: 259155 - DNA, 75 bp, Artificial Sequence
  Synthetic
ttaggcctcgaatccgcaaccgaatcatagtatcaagaataatataaaatataacagtttgtcatattattctga

SEQ ID NO: 259156 - DNA, 75 bp, Artificial Sequence
  Synthetic
tcctgcctcatcagtgtcacaaggaatccttctcgagccctccctcacaaacccacgcctcaacaacccaagcaa

SEQ ID NO: 259157 - DNA, 75 bp, Artificial Sequence
  Synthetic
cagacaaacaaccgtctgtacccgagcaaatggctccacacgacagcccgccaaccacatccaccgaccagctcc

SEQ ID NO: 259158 - DNA, 75 bp, Artificial Sequence
  Synthetic
gtcagatactttcttcatctatagcaagaggatttttaaggatggtgccatactcagtcaggtcctcaagaattc

SEQ ID NO: 259159 - DNA, 75 bp, Artificial Sequence
  Synthetic
tttatcccggcgcctactacaggatccggttgcactcggataccctcatttgacatgagcaccactcattactgt

SEQ ID NO: 259160 - DNA, 75 bp, Artificial Sequence
  Synthetic
gatctgagcgaaaatacagtgatgtcctgtgccaacatctcatcgactgtggcacggctatgcgagaatggcctc

SEQ ID NO: 259161 - DNA, 75 bp, Artificial Sequence
  Synthetic
gtataaagtgaattttgtctctttgactgtagtgccgaggaaggatgtctacaggatcccaactacagcattgaa

SEQ ID NO: 259162 - DNA, 75 bp, Artificial Sequence
  Synthetic
actagttctactcaatccggctcaaatcaatcgtggataaatgacataccatttgtccattcgtatgtcctgaca

SEQ ID NO: 259163 - DNA, 75 bp, Artificial Sequence
  Synthetic
aaagttaaattccgactctttggaactcgtattcggattcagttagttaactttaagcaaaagtgcgcaaagtcg

SEQ ID NO: 259164 - DNA, 75 bp, Artificial Sequence
  Synthetic
atctccaatactcgaggctctacaccaggaacatcggggacccagggacgacagcatttgccgaggtgaaaaggc

SEQ ID NO: 259165 - DNA, 75 bp, Artificial Sequence
  Synthetic
atccgtgagttacgataaaaggcgaaggagcaattgaagtcgcacgggtagaaggtgtgaatctcgagtgcgagc

SEQ ID NO: 259166 - DNA, 75 bp, Artificial Sequence
  Synthetic
aggagcaattgaagtcgcacgggtagaaggtgtgaatctcgagtgcgagcccgaagcacaaactcgagaaagcct

SEQ ID NO: 259167 - DNA, 75 bp, Artificial Sequence
  Synthetic
cacaacgcgtattatttgagacgtgctcaaacccactactatctggagtccacacggaagacaatgaggcagagg

SEQ ID NO: 259168 - DNA, 75 bp, Artificial Sequence
  Synthetic
gaatcaagaggtgatccacccgagagtggcccatgcaattatggaagcaagctcagtcggaaggagaaagcagat

SEQ ID NO: 259169 - DNA, 75 bp, Artificial Sequence
  Synthetic
caacaataggagtggagtgtctgaagagagagcacagagatttgcgatgatagcaggatctctccctcgggcatg

SEQ ID NO: 259170 - DNA, 75 bp, Artificial Sequence
  Synthetic
gtacctccgatgctgatcacccgaatcatgctgatattgagctgcatctgccagacgagttctcttgacggcagg

SEQ ID NO: 259171 - DNA, 75 bp, Artificial Sequence
  Synthetic
cgaggaaccgcagttggtcacccttgaccgggggaagaaagattctaggggtctccaatcctgacacgattgagc

SEQ ID NO: 259172 - DNA, 75 bp, Artificial Sequence
  Synthetic
ttgcagaaatatccaataccctattcggggaatttaggatcgttcccttactagttgagatcctcaaggatgata

SEQ ID NO: 259173 - DNA, 75 bp, Artificial Sequence
  Synthetic
gacggatgacacgagcaagaatcctcccatgagggtcccttatctaggctccaaaactcaggaaaggcgagctgc

SEQ ID NO: 259174 - DNA, 75 bp, Artificial Sequence
  Synthetic
gcggccaaaccggcaggagcatcccccaaatcccccccccacccccagccacacggtcccacccacccaaagcaa

SEQ ID NO: 259175 - DNA, 75 bp, Artificial Sequence
  Synthetic
aaatacaaaaagcattgagatataaggggaaacaaccaacaggagagaacacgggtaggacatggcgggctccgg

SEQ ID NO: 259176 - DNA, 75 bp, Artificial Sequence
  Synthetic
actgcagggaatctccaacaccgactcgatgatggcatcacccagatgacattcacccctgcctctctatatcga

SEQ ID NO: 259177 - DNA, 75 bp, Artificial Sequence
  Synthetic
actccatgggctactatttccacttgcttgtgaaccttttcaccccttgctcagttaaagggtacgttctatcca

SEQ ID NO: 259178 - DNA, 75 bp, Artificial Sequence
  Synthetic
acgactcacagaggctgttcactgaggagggtgttaaggaagggaacgtggtatatcagcagatcatgctcctgg

SEQ ID NO: 259179 - DNA, 75 bp, Artificial Sequence
  Synthetic
ccctttattatccggggtacatacagaggacaatgaggcagaagagaaagcattggctgaattcttactcaatca

SEQ ID NO: 259180 - DNA, 75 bp, Artificial Sequence
  Synthetic
caatattcaagagttatgaattgaatttagagtcatattccacgatagagttgatgaatattctttccatctcta

SEQ ID NO: 259181 - DNA, 75 bp, Artificial Sequence
  Synthetic
gcgatctttataagaatatgcctggcatcctactatctaacattgctgctaccatatcccacccgatcatacatt

SEQ ID NO: 259182 - DNA, 75 bp, Artificial Sequence
  Synthetic
accatatcccacccgatcatacattcacgtttacacaccgtagggctgatcagccatgatggctcacaccaactt

SEQ ID NO: 259183 - DNA, 75 bp, Artificial Sequence
  Synthetic
tggccacctttacagatgcagagatcgacgagctatttgagacaagtggaactgtcattgacaacataattacag

SEQ ID NO: 259184 - DNA, 75 bp, Artificial Sequence
  Synthetic
gacatttgacaagatagaagaaaagataaggagactcaatctttccgtcgggctcagtgatgtgctcggaccttc

SEQ ID NO: 259185 - DNA, 75 bp, Artificial Sequence
  Synthetic
cgtgtcaaagtagatacaatatacgggaatatcattgggcagctacatgctgattcagcagagatctcacatgat

SEQ ID NO: 259186 - DNA, 75 bp, Artificial Sequence
  Synthetic
tccgaaaataagaggattgcccgcagaagagaagtgtgctatgttaacagaataccttctatctgatgcagtgag

SEQ ID NO: 259187 - DNA, 75 bp, Artificial Sequence
  Synthetic
agtgtgagtgcaactcccttaggttgtgatatgctgtgctctaaagtcacagagactgaggaggaggattataat

SEQ ID NO: 259188 - DNA, 75 bp, Artificial Sequence
  Synthetic
aggaccaattgacaaggaagcctgctgcattcctgcacgagctagacttaagcgctccagcacgatacgatgcat

SEQ ID NO: 259189 - DNA, 75 bp, Artificial Sequence
  Synthetic
tagcgatgagtcaactgtcctttaacagcaataagaaacgtatcactgactgcaaagagagggtttcctcaaacc

SEQ ID NO: 259190 - DNA, 75 bp, Artificial Sequence
  Synthetic
ctcgtattcggattcaattagttaattctaagtaggagtgcgcgtagttatccctaattatagtcctgtcattcg

SEQ ID NO: 259191 - DNA, 75 bp, Artificial Sequence
  Synthetic
acgcgagtccagactctacgctgccagtcagccgcaaccagctagtgccaatgaggctagcctgaatcttgccga

SEQ ID NO: 259192 - DNA, 75 bp, Artificial Sequence
  Synthetic
tggactccaaaccccacaccaggattccagcacctctgatgctggtcacccgaatcactctggtactgagctgca

SEQ ID NO: 259193 - DNA, 75 bp, Artificial Sequence
  Synthetic
gatcatttagttcgatacctgtttaggggagtaggaacagcatcttcatcttggtacaaagcatctcatctgtta

SEQ ID NO: 259194 - DNA, 75 bp, Artificial Sequence
  Synthetic
ggcacggcaattctctgtatctcgctgaaggaagcggggctatcatgagcttattggagttgcatataccgcacg

SEQ ID NO: 259195 - DNA, 75 bp, Artificial Sequence
  Synthetic
tgaaggaagcggggctatcatgagcttattggagttgcatataccgcacgagacgatatattacaatacactctt

SEQ ID NO: 259196 - DNA, 75 bp, Artificial Sequence
  Synthetic
gacccttatggagagagaacacagaggagagtgatttgacatcagataaagctgtggggtacattacatccgtag

SEQ ID NO: 259197 - DNA, 75 bp, Artificial Sequence
  Synthetic
ggagagtgatttgacatcagataaagctgtggggtacattacatccgtagtaccttaccgatcagtgtctctgct

SEQ ID NO: 259198 - DNA, 75 bp, Artificial Sequence
  Synthetic
gtctaatgctaaaaagggcccatggtcgggtccccaagaagggcatcaccaacctccggcccaacaacacgggaa

SEQ ID NO: 259199 - DNA, 75 bp, Artificial Sequence
  Synthetic
cacattcttcatatacagcaaacgaatattcaaagatggagcaatactcagccaggtcctcaaaaattcatctaa

SEQ ID NO: 259200 - DNA, 75 bp, Artificial Sequence
  Synthetic
ggatctaatcagagcttattagatcaactggccaccaatttatcactaatagcgatgcactcagtgagagaggga

SEQ ID NO: 259201 - DNA, 75 bp, Artificial Sequence
  Synthetic
actatgtgagaacgggcttcctaaggatttctgttactatttgaactacctaatgagttgcgtgcagacatactt

SEQ ID NO: 259202 - DNA, 75 bp, Artificial Sequence
  Synthetic
ccgttcactcagaattacaaggtatctgcatcgggcccctctttgcaaacccaaggtccaataatccgagcgacg

SEQ ID NO: 259203 - DNA, 75 bp, Artificial Sequence
  Synthetic
tctgctgcaatgctctgcctaggaagtgtcccaaatgtcggagatcttgttgagctggcaagggcctgcctcact

SEQ ID NO: 259204 - DNA, 75 bp, Artificial Sequence
  Synthetic
cagtggggttgctgagtcctagcattatgactaacatcttaaccaggccacctggcaatggagactgggccagcc

SEQ ID NO: 259205 - DNA, 75 bp, Artificial Sequence
  Synthetic
aacaagttcacatgcctcacccaggaacttgtgttgatgtatgcagatatgatggagggcagagatatggtcaac

SEQ ID NO: 259206 - DNA, 75 bp, Artificial Sequence
  Synthetic
gaatggggtcattcaggatagcatatctttaaccaagagtatgctagcgatgagtcaactgtctttcaacagcaa

SEQ ID NO: 259207 - DNA, 75 bp, Artificial Sequence
  Synthetic
gtaaccatcctcggtcttggggcagaggatctcaatcgggtgggagacatcataagcttgatactcagagggaca

SEQ ID NO: 259208 - DNA, 75 bp, Artificial Sequence
  Synthetic
cataagcttgatactcagagggacaatatctctagaagaccttataccgctacgcacatatctcaagaggagtac

SEQ ID NO: 259209 - DNA, 75 bp, Artificial Sequence
  Synthetic
cctgtacctaactgaattgactacagtattcgggccacaaatcacttcccctgccttaacccagctgactatcca

SEQ ID NO: 259210 - DNA, 75 bp, Artificial Sequence
  Synthetic
tacatgaagactgtagggaatgctgtcaaaggatattacaacagtagcaaaaattgagaagactgtaactgttga

SEQ ID NO: 259211 - DNA, 75 bp, Artificial Sequence
  Synthetic
tgatcgacaatacccagcccgctccaacagggccatcccaaactccccgccccaaactcccccacactccccaac

SEQ ID NO: 259212 - DNA, 75 bp, Artificial Sequence
  Synthetic
cgcccgaagcagcacaggcacaactcggtccacaaagaatccattcagagcccaagacattagaaaaaaatacgg

SEQ ID NO: 259213 - DNA, 75 bp, Artificial Sequence
  Synthetic
ttaggcctcgaatccgcaaccgagtcatagtgtcaagaataatacaaaacgtaacagtttgtcacattattctga

SEQ ID NO: 259214 - DNA, 75 bp, Artificial Sequence
  Synthetic
gtcgcacgggtagaaggtgtgaatctcgagtgcgagatcgaagctcaaactcgagagagccttctgccgaaatgt

SEQ ID NO: 259215 - DNA, 75 bp, Artificial Sequence
  Synthetic
gaagatggccacttttacagatgcggagatagacgatatatttgagaccagtgggaccgttattgacagcataat

SEQ ID NO: 259216 - DNA, 75 bp, Artificial Sequence
  Synthetic
caacaccaggggtcaaactggatatcaatgcaaacccgaatcccatactgccaggcagatacaacccgacgatgt

SEQ ID NO: 259217 - DNA, 75 bp, Artificial Sequence; identical to SEQ ID NO: 96331
  Synthetic

SEQ ID NO: 259218 - DNA, 75 bp, Artificial Sequence
  Synthetic
caatgcaaacccgaatcccatactgccaggcagatacaacccgacgatgttgatgcaactagtctgaatcctgtc

SEQ ID NO: 259219 - DNA, 75 bp, Artificial Sequence
  Synthetic
atgagtcaactgtccttcaacagcaataagaaacgtatcaccgactgcaaagaaagagtatcctcaacccgcaat

SEQ ID NO: 259220 - DNA, 75 bp, Artificial Sequence
  Synthetic
agttgattggccagtccgtagtttcttatgatgaagatacttctataaagaatgatgctataatagtgtatgaca

SEQ ID NO: 259221 - DNA, 75 bp, Artificial Sequence
  Synthetic
ggagtgtctgaagagagagcacagagattcatgatgatagcagggtctctccctcgggcgtgcagcaatggtacc

SEQ ID NO: 259222 - DNA, 75 bp, Artificial Sequence
  Synthetic
cgatgtttgtaggagaccctttcaatcctccaagtgacccgaccgactgtgatctatcaagagtcccaaatgatg

SEQ ID NO: 259223 - DNA, 75 bp, Artificial Sequence
  Synthetic
tcctgtatcggagggtgactttgcgagacttgacttagctatctttaagagttatgagcttaatttagagtcata

SEQ ID NO: 259224 - DNA, 75 bp, Artificial Sequence
  Synthetic
ccagggcacagacgcgaacacagcatatcatggacaacggaaggagtcacaaccatcagctggtgcaacccctca

SEQ ID NO: 259225 - DNA, 75 bp, Artificial Sequence
  Synthetic
caaaggccatgactgcatacgagacggcagacgaatcagaaacaagaagaataaataagtatatgcagcagggta

SEQ ID NO: 259226 - DNA, 75 bp, Artificial Sequence
  Synthetic
tccgtattttcctagttagtgaactcaagaggggccgcaatacagcgggtgggagctccacatattacaacttag

SEQ ID NO: 259227 - DNA, 75 bp, Artificial Sequence
  Synthetic
tcaaagagttaattcatgtcaaccatttgattggccataacttgaaagaccgagaaaccatcaggtcagatacat

SEQ ID NO: 259228 - DNA, 75 bp, Artificial Sequence
  Synthetic
tcggggatgtagactcatacatcagaaacactgggcttactgcattcttcctaacactcaaatatggaatcaata

SEQ ID NO: 259229 - DNA, 75 bp, Artificial Sequence
  Synthetic
tgctagtatcaagtgacctcagtgaaaacactgtgatgtcttgtgccaacattgcatccaccatagcacggctgt

SEQ ID NO: 259230 - DNA, 75 bp, Artificial Sequence
  Synthetic
ggatgaaaggtgagaatgcaccatacatgacgttgttaggtgacagtgaccagatgagttttgcgccagctgagt

SEQ ID NO: 259231 - DNA, 75 bp, Artificial Sequence
  Synthetic
ctgttattattttaactacctaatgagttgtgtgcagacctactttgattctgagttttccaccactaacacctc

SEQ ID NO: 259232 - DNA, 75 bp, Artificial Sequence
  Synthetic
tagggactgcttcatcttcttggtataaggcatctcatcttctatccgtacctgaggtcaggtgtgcaagacatg

SEQ ID NO: 259233 - DNA, 75 bp, Artificial Sequence
  Synthetic
tcaacaagccggggtcctcaccgggctcagcgacaaaggcccccaagccccacaaggcggatcgaacaggccgca

SEQ ID NO: 259234 - DNA, 75 bp, Artificial Sequence
  Synthetic
gggcctacatttgtacatgaggtagtgaggatggcaaaaactttagtgcagcggcacggcacacttttgtctaaa

SEQ ID NO: 259235 - DNA, 75 bp, Artificial Sequence
  Synthetic
aggacaaccggacgccggggacggggagacccaatttttggaccttatgagagcggtagcaaacagtatgagaga

SEQ ID NO: 259236 - DNA, 75 bp, Artificial Sequence
  Synthetic
gagacccaatttttggaccttatgagagcggtagcaaacagtatgagagaagcgccaagctctgcgcagagcacc

SEQ ID NO: 259237 - DNA, 75 bp, Artificial Sequence
  Synthetic
tcttgggcatacaagtgaatttgccctcagtcgggaacttaaataatatgcgtgccacctatttggagaccttat

SEQ ID NO: 259238 - DNA, 75 bp, Artificial Sequence
  Synthetic
acaggtctgtatcattactacattgtgacattgagattcctccggggtccaatcaaagcttattagatcaactgg

SEQ ID NO: 259239 - DNA, 75 bp, Artificial Sequence
  Synthetic
tgacattgagattcctccggggtccaatcaaagcttattagatcaactggctactaatttatctctgattgccat

SEQ ID NO: 259240 - DNA, 75 bp, Artificial Sequence
  Synthetic
atactgtatgactcacagactcaactcttgggcatacaagtgaatttgccctcagtcgggaacttaaataatatg

SEQ ID NO: 259241 - DNA, 75 bp, Artificial Sequence
  Synthetic
ctcagcacttgtcccgaaagtagtgacacaagtcggttctgtgatagaagagcttgacacctcatactgtataga

SEQ ID NO: 259242 - DNA, 75 bp, Artificial Sequence
  Synthetic
ctcagcctgcctctataggaccatcccaacccccttgcacgcaccccccccccaccccccgatccacagccccac

SEQ ID NO: 259243 - DNA, 75 bp, Artificial Sequence
  Synthetic
cgactgggggtactgatcggcaacgcccagcccgcccccacagggccacacccgctcccccacccaaagcccccc

SEQ ID NO: 259244 - DNA, 75 bp, Artificial Sequence
  Synthetic
ccaacccccttgcacgcaccccccccccaccccccgatccacagccccacatggccaaacccacaaacgagcccc

SEQ ID NO: 259245 - DNA, 75 bp, Artificial Sequence
  Synthetic
agaatagtgacattccccatgtccccaggtatttattcctgtttgagcggcaacacatcagcttgcatgtattca

SEQ ID NO: 259246 - DNA, 75 bp, Artificial Sequence
  Synthetic
tgagagaaaatattgatgctgcactaattgaagccgggggacagcccgtccgtccattctgtgcagaaagtttag

SEQ ID NO: 259247 - DNA, 75 bp, Artificial Sequence
  Synthetic
aatccacacagaaccaaagacattagaaaaaaatacgggtagaagagagatactcagagatcaggaagagtcacc

SEQ ID NO: 259248 - DNA, 75 bp, Artificial Sequence
  Synthetic
cgtccattctgtgcagaaagtttagtgagcacgctaacagatatgacccagacaactcagatcattgccagccac

SEQ ID NO: 259249 - DNA, 75 bp, Artificial Sequence
  Synthetic
gcacgatcccacccacccggaacaacaccagcacaacccgatccgccaacaatccatccagagcccaagacatta

SEQ ID NO: 259250 - DNA, 75 bp, Artificial Sequence
  Synthetic
gaaaaaaatacgggtagaagagagatactcagagatcaggaagagtcaccagggtctctgttctaccttctaccc

SEQ ID NO: 259251 - DNA, 75 bp, Artificial Sequence
  Synthetic
caccagcacaacccgatccgccaacaatccatccagagcccaagacattagaaaaaaatacgggtagaagagaga

SEQ ID NO: 259252 - DNA, 75 bp, Artificial Sequence
  Synthetic
ttgacagcataattacggcccagggcaacccagcggggaccgttggaaggagcgcaatcccacaaggcaaaacca

SEQ ID NO: 259253 - DNA, 75 bp, Artificial Sequence
  Synthetic
ctcatcggtgaatgcagtgaagcatgtgaaagcaccagaaaagatccctgggagcggaaccctagagtataaggt

SEQ ID NO: 259254 - DNA, 75 bp, Artificial Sequence
  Synthetic
caacccagcggggaccgttggaaggagcgcaatcccacaaggcaaaaccaaagcattgagtgcagcatgggagaa

SEQ ID NO: 259255 - DNA, 75 bp, Artificial Sequence
  Synthetic
gcacgggggcgcccagccacacgacggccaggacactcccgaccaacaggacagaacggacaaacagccatccgc

SEQ ID NO: 259256 - DNA, 75 bp, Artificial Sequence
  Synthetic
acctagacaggcgactccacacaacaattcgccagccacatctactgaccagcctcctacccaggccgcagacga

SEQ ID NO: 259257 - DNA, 75 bp, Artificial Sequence
  Synthetic
gtccaatgctaaaaagggcccatggttgagtccccaggaagggcatcatcaacttccaacccaacagcaggggag

SEQ ID NO: 259258 - DNA, 75 bp, Artificial Sequence
  Synthetic
tgacttaattataccagattagaaaaaagttaaattccgactctttggaactcgtattcggattcagttagttaa

SEQ ID NO: 259259 - DNA, 75 bp, Artificial Sequence
  Synthetic
gccactacaagagcatgaatgcagataagaggtggatatatacccaacagcagcctgtgtgtcaattccgataac

SEQ ID NO: 259260 - DNA, 75 bp, Artificial Sequence
  Synthetic
ataacccagatgacgtttacccctgcatctctctacaggttatcaccttatatccacatatccaatgattcccaa

SEQ ID NO: 259261 - DNA, 75 bp, Artificial Sequence
  Synthetic
ccagccgagccatggaagcaaccaggaaagaccgcagcaccagcccaaggccgtccctggaagccagggcacaga

SEQ ID NO: 259262 - DNA, 75 bp, Artificial Sequence
  Synthetic
tcccgaaagggcagagcaccagatcatcctaccagagtcacatctatcctctccattggtcaaacacaaattgct

SEQ ID NO: 259263 - DNA, 75 bp, Artificial Sequence
  Synthetic
ggcaccagaattgagggcagttacttcaaataagtttatgtatgatcctagccctgtatcagagggggactttgc

SEQ ID NO: 259264 - DNA, 75 bp, Artificial Sequence
  Synthetic
gtacgccgcacgacctcgcaggcatatcgactgtgatctctaagacagaggataaggttacgtctttactcagtt

SEQ ID NO: 259265 - DNA, 75 bp, Artificial Sequence
  Synthetic
ttcaactaacaaatttcggaagattgaaaagaagatccagattcacaacacaaggtatggagacctgttcacaaa

SEQ ID NO: 259266 - DNA, 75 bp, Artificial Sequence
  Synthetic
agttttagtttcaggccccggagacccatccccttatgtgacacaagggggtgaaatggcactcaataaactttc

SEQ ID NO: 259267 - DNA, 75 bp, Artificial Sequence
  Synthetic
agtcttagtttcaggccccggagacccatctccttatgtgacgcaagggggcgaaatggcgctcaataaactctc

SEQ ID NO: 259268 - DNA, 75 bp, Artificial Sequence
  Synthetic
cgtgccccagttcaacaacaggagtggagtgtctgaagagagagcacagagatttatgatgatagcagggtctct

SEQ ID NO: 259269 - DNA, 75 bp, Artificial Sequence
  Synthetic
ctgttcatgacccagattatatcggggggataggcaaagaactcatagtggacgacatcagtgatgtcacatcat

SEQ ID NO: 259270 - DNA, 75 bp, Artificial Sequence
  Synthetic
aaaacactgtaatgtcctgtgccaacattgcatccactgtagcacggctatgtgagaatgggcttcctaaggatt

SEQ ID NO: 259271 - DNA, 75 bp, Artificial Sequence
  Synthetic
cactgtccgtgcattgatcacctcacgtccaatgcatccgagctcttcagctaaactcctgagtaagctggatgc

SEQ ID NO: 259272 - DNA, 75 bp, Artificial Sequence
  Synthetic
aagaatatgccgggaatcttgctttccaatattgcggctacaatatctcaccctgtcattcattcaaggttgaat

SEQ ID NO: 259273 - DNA, 75 bp, Artificial Sequence
  Synthetic
gggttcccgttcattcagtgccgcaagagacccgccccgagccctcctccataaactcaagctttaatactccaa

SEQ ID NO: 259274 - DNA, 75 bp, Artificial Sequence
  Synthetic
accagctcgcgcttcaacaacccaaacagcagcccccacccacccctcttactcccctgaatgatcgcacagttg

SEQ ID NO: 259275 - DNA, 75 bp, Artificial Sequence
  Synthetic
tcggaagtcctgcagtgtgagtgcaacccctttaggttgtgatatgctgtgctctaaggtcacagggactgaaga

SEQ ID NO: 259276 - DNA, 75 bp, Artificial Sequence
  Synthetic
taagaaaaaatacgggtagaatcggagtgcccagactgtgccaagatggactcatctaggacaatcgggctatac

SEQ ID NO: 259277 - DNA, 75 bp, Artificial Sequence
  Synthetic
agtgcccagactgtgccaagatggactcatctaggacaatcgggctatactttgattctgcccttccttctagca

SEQ ID NO: 259278 - DNA, 75 bp, Artificial Sequence
  Synthetic
gaacactgggctaactgcattcttcctgacacttaaatatggaattaacaccaagacatcagcccttgcacttag

SEQ ID NO: 259279 - DNA, 75 bp, Artificial Sequence
  Synthetic
ctcatccaggacaatcgggctgtattttgattctgccctcccttccagcagcctgctagcattcccgattgtttt

SEQ ID NO: 259280 - DNA, 75 bp, Artificial Sequence
  Synthetic
ccggccctcccccccgcccccagccgcacgatcccgcccgtccaaagcaacacatgcacagcccgatccgccagc

SEQ ID NO: 259281 - DNA, 75 bp, Artificial Sequence
  Synthetic
acaagacacaggagacgggaagaagcaaatcaccccacaatacaggatccagcgtcttgactcgtggacagacag

SEQ ID NO: 259282 - DNA, 75 bp, Artificial Sequence
  Synthetic
ggatgaaaggagataatgcgccgtacatgacattgctcggtgacagtgaccagatgagctttgcacctgccgagt

SEQ ID NO: 259283 - DNA, 75 bp, Artificial Sequence
  Synthetic
acctatggattcatcttccaggttagggatgaagaagtcgctgtcggcatgatcaatgataatcccaagcgcgag

SEQ ID NO: 259284 - DNA, 75 bp, Artificial Sequence
  Synthetic
tggggctcgggtgaaagatccatttaccagacagcctgctgcgttcctacaagagttagatttgagtgctcaggc

SEQ ID NO: 259285 - DNA, 75 bp, Artificial Sequence
  Synthetic
gagacttggagtagagtacgctcaggctcaaggaagtagcatcaatgaggatatggccgccgagctaaagctaac

SEQ ID NO: 259286 - DNA, 75 bp, Artificial Sequence
  Synthetic
ctcactatggtggtaacatgcaagaagagtgcaaccaatactgagagaatggtcttctcggtagtgcaggcaccc

SEQ ID NO: 259287 - DNA, 75 bp, Artificial Sequence
  Synthetic
acatgggagtgtccaatcacccgccagccaggagaaccccgatcgacaggacagatctgacagacaaccatccat

SEQ ID NO: 259288 - DNA, 75 bp, Artificial Sequence
  Synthetic
gagaagatccctggaagcggaaccctagagtacaaggtgaattttgtttctttgactgtggtgccgaagaaggac

SEQ ID NO: 259289 - DNA, 75 bp, Artificial Sequence
  Synthetic
tccttatacttggcagaaggaagtggagccattatgagccttcttgagttgcatgtgccacatgaaaccatctat

SEQ ID NO: 259290 - DNA, 75 bp, Artificial Sequence
  Synthetic
agggcaaccggacaccggggatggggagacccaatttctggatctgatgagagcggtggcaaatagcatgagaga

SEQ ID NO: 259291 - DNA, 75 bp, Artificial Sequence
  Synthetic
tgaaggtatctggctcgagcctgtacaatctcgcactcaatgtcactattgatgtggaggtagacccaaagagcc

SEQ ID NO: 259292 - DNA, 75 bp, Artificial Sequence
  Synthetic
gagcggtggcaaatagcatgagagaagcgccaaactctgcgcagggcacccctcaaccggggcctcccccaaccc

SEQ ID NO: 259293 - DNA, 75 bp, Artificial Sequence
  Synthetic
cgacagtggatactatgctaatctcttcttacatatcggacttatgtccactgtagataagaggggaaggaaagt

SEQ ID NO: 259294 - DNA, 75 bp, Artificial Sequence
  Synthetic
gacatttgacaagctggagaggaagataaggagactcgatctgtctgtcgggcttagtgatgtgcttggaccctc

SEQ ID NO: 259295 - DNA, 75 bp, Artificial Sequence
  Synthetic
ccccacctgcccagggcaacataggtacaatgcgacccactaataatcaatacagggccaaagaaattagaaaaa

SEQ ID NO: 259296 - DNA, 75 bp, Artificial Sequence
  Synthetic
tacagggccaaagaaattagaaaaaagtacgggtagaagggagacattcagagatcagggcgagtcacccgggtc

SEQ ID NO: 259297 - DNA, 75 bp, Artificial Sequence
  Synthetic
tcctatagcaaatgcctctcctcaggtagccaagatactctggagtcaaaccgcgtgcctgcggagtgtaaaagt

SEQ ID NO: 259298 - DNA, 75 bp, Artificial Sequence
  Synthetic
ctgtcgactttgtgcaagcgatgatgtctacgatggaggcattatcacagaaggtaggtaaagtagactatcagc

SEQ ID NO: 259299 - DNA, 75 bp, Artificial Sequence
  Synthetic
gctgttgcagtgaccgctgatcacgaggtaacctccactagaatagagaagaagcacgctattgcaaaatacaat

SEQ ID NO: 259300 - DNA, 75 bp, Artificial Sequence
  Synthetic
ttaggatggagatggccacctttacagatgcggagatcgacgagctatttgagaccagtggaactgtcattgaca

SEQ ID NO: 259301 - DNA, 75 bp, Artificial Sequence
  Synthetic
gctgtcgcagtgactgctgaccatgaggttacttctactaagatagagaaggggcataccatcactaaatacaat

SEQ ID NO: 259302 - DNA, 75 bp, Artificial Sequence
  Synthetic
agtacgggtagaagggagacattcagagatcagggcgagtcacccgggtctctgctctcccttctacctagtgga

SEQ ID NO: 259303 - DNA, 75 bp, Artificial Sequence
  Synthetic
tgatatttgtcatgggctgtctaggcgggcccacatttgtgcgcgaggtggtgaggatggcaaaaactctaatac

SEQ ID NO: 259304 - DNA, 75 bp, Artificial Sequence
  Synthetic
ctcacctgtctagcaaattagaaaaaacacgggtagaagagtctggatcccaactagtacattctaggcgcaaca

SEQ ID NO: 259305 - DNA, 75 bp, Artificial Sequence
  Synthetic
atctgtctcgattacttatagttagctcacctgtctatcgagttagaaaaaacacgggtagaagagtttggatcc

SEQ ID NO: 259306 - DNA, 75 bp, Artificial Sequence
  Synthetic
gagcatccagtcaccagccagccaagacacccctgatcgacaggacagatcagataaacaactgtccacacccga

SEQ ID NO: 259307 - DNA, 75 bp, Artificial Sequence
  Synthetic
aacacgggtagaagagtttggatcccggtcggcgcattcaaagtgcaagatgggccccaaatcttctaccaatgt

SEQ ID NO: 259308 - DNA, 75 bp, Artificial Sequence
  Synthetic
tcatttacctcgcagcagcatcgtgtaacagacatcctgtccagccctttaccaaggctaatgaagtttttgaga

SEQ ID NO: 259309 - DNA, 75 bp, Artificial Sequence
  Synthetic
cgatacacagctcaagaccggagcaagcaactctctgctgtcgatgcttgataaactcagcaataagtcatctaa

SEQ ID NO: 259310 - DNA, 75 bp, Artificial Sequence
  Synthetic
tcccagctaatctatattacatgtctaggaagagccttaatttgatcagagaacgagaggacagagatactatct

SEQ ID NO: 259311 - DNA, 75 bp, Artificial Sequence
  Synthetic
tgctaaaaagggcccagggtcgagccctcaagaaaggcatcatcaacgtctgactcaacaacaggggagtcaaca

SEQ ID NO: 259312 - DNA, 75 bp, Artificial Sequence
  Synthetic
aggttcttgtctctttagtgtcgcgcaaaattcttccggggccctccccaataaacccacactccaacacacaaa

SEQ ID NO: 259313 - DNA, 75 bp, Artificial Sequence
  Synthetic
ccgcagaaccaggccaaggccatccctggaaaccaggtcacagacgcgaacacagcatatcatggacaatgggag

SEQ ID NO: 259314 - DNA, 75 bp, Artificial Sequence
  Synthetic
atttgaaggctgtcttgggtattaccaaactcaaagaaatgttcacagacacctctttattatacttgactcgtg

SEQ ID NO: 259315 - DNA, 75 bp, Artificial Sequence
  Synthetic
acaagacacaggagacgggaagaagcagatcaccccacaatacaggattcagcgccttgactcatggacagacag

SEQ ID NO: 259316 - DNA, 75 bp, Artificial Sequence
  Synthetic
gttagtctcttgcactcgacgcgtggtctcaggcttatatgcagggaataagtacgatctgctgttcccatctgt

SEQ ID NO: 259317 - DNA, 75 bp, Artificial Sequence
  Synthetic
gcattctgtgagggaaggcggggtagtgatcatcaaagtactgtatgcaatggggtactacttccatttactcat

SEQ ID NO: 259318 - DNA, 75 bp, Artificial Sequence
  Synthetic
ccccatgatgcggtctgaaatccagcagctgaaaacgtctgttgcggtcatggaagccaatttgggcatgatgaa

SEQ ID NO: 259319 - DNA, 75 bp, Artificial Sequence
  Synthetic
gcttattagcatttccaattgtcctacaagacacaggagacgggaagaagcagatcaccccacaatacaggattc

SEQ ID NO: 259320 - DNA, 75 bp, Artificial Sequence
  Synthetic
tggatgctgatcctttaaggctcgtattcggattcaaatacttatcttaaaacagaaatgcgcatcgttgttctt

SEQ ID NO: 259321 - DNA, 75 bp, Artificial Sequence
  Synthetic
aatttctggccccggagacccatctccttatgtgacccaagggggcgaaatggcactcaataaactttcgcaacc

SEQ ID NO: 259322 - DNA, 75 bp, Artificial Sequence
  Synthetic
cttcccctgccttaactcagctgactatccaggcgctttacaatctagctggtggtaatatggattatttgttga

SEQ ID NO: 259323 - DNA, 75 bp, Artificial Sequence
  Synthetic
ccgtgcattgatcatgtcacgccctatgcatccgagctcttcagctaggctcttgagcaaactggacgcagccgg

SEQ ID NO: 259324 - DNA, 75 bp, Artificial Sequence
  Synthetic
ctgtccacccagcaccacacggtatctgcaccaagctcctctctgcaaacccaaggtccaacaccccgagcgaca

SEQ ID NO: 259325 - DNA, 75 bp, Artificial Sequence
  Synthetic
cacctcatactgtgtagagaccgatttggatttatattgtacaagaatagtgacattccctatgtctcctggtat

SEQ ID NO: 259326 - DNA, 75 bp, Artificial Sequence
  Synthetic
actcaacctatatctaactgaattgaccacagtattcgggccacagatcacttcccctgccttaacccaactgac

SEQ ID NO: 259327 - DNA, 75 bp, Artificial Sequence
  Synthetic
tgacattccctatgtctcctggtatttattcctgtctgagcggtaatacatcagcttgcatgtattcaaagactg

SEQ ID NO: 259328 - DNA, 75 bp, Artificial Sequence
  Synthetic
cactctggaaagaatcctatctatccaggctcaggtatgggtcacagtagcaaaggccatgactgcatatgagac

SEQ ID NO: 259329 - DNA, 75 bp, Artificial Sequence
  Synthetic
aaaatacgggtagaatcggagtgccccgattgtgccaagatggactcatctaggacaatcgggctgtactttgat

SEQ ID NO: 259330 - DNA, 75 bp, Artificial Sequence
  Synthetic
ccgattgtgccaagatggactcatctaggacaatcgggctgtactttgattctacccttccttctagcaacctgc

SEQ ID NO: 259331 - DNA, 75 bp, Artificial Sequence
  Synthetic
gcaaaattatggagaagctgtgtctctaatagataggcactcatgcaatgtcttatccttagacgggataacttt

SEQ ID NO: 259332 - DNA, 75 bp, Artificial Sequence
  Synthetic
cacaggggacgggaagaagcaaatcgccccgcaatacaggatccagcgtcttgactcgtggacagacagcaaaga

SEQ ID NO: 259333 - DNA, 75 bp, Artificial Sequence
  Synthetic
ttgactcgtggacagacagcaaagaagactcggtattcatcaccacctatggattcatctttcaggttgggaatg

SEQ ID NO: 259334 - DNA, 75 bp, Artificial Sequence
  Synthetic
agactcggtattcatcaccacctatggattcatctttcaggttgggaatgaagaagccactgtcggcatgatcaa

SEQ ID NO: 259335 - DNA, 75 bp, Artificial Sequence
  Synthetic
ggattcatctttcaggttgggaatgaagaagccactgtcggcatgatcaatgataatcccaagcgcgagttactt

SEQ ID NO: 259336 - DNA, 75 bp, Artificial Sequence
  Synthetic
gctgttgcagtaaccgctgatcacgaggttacctccactaagatagaaaagaggcacaccattgctaaatataat

SEQ ID NO: 259337 - DNA, 75 bp, Artificial Sequence
  Synthetic
caatctcgatatctcaactgaacttgggaatgtcaacaactcgataagtaatgctttggataagttagaggaaag

SEQ ID NO: 259338 - DNA, 75 bp, Artificial Sequence
  Synthetic
cctcgatttgcggccctatatgaccacaccctcaaacaaacatccccctctttcctccctccccctgctgtacaa

SEQ ID NO: 259339 - DNA, 75 bp, Artificial Sequence
  Synthetic
caactaacaccgagagaatggtcttctcagtagtgcaggcaccccaggtgctgcaaagctgtagggttgtggcaa

SEQ ID NO: 259340 - DNA, 75 bp, Artificial Sequence
  Synthetic
ctcagtagtgcaggcaccccaggtgctgcaaagctgtagggttgtggcaaacaaatactcgtcggtgaatgcagt

SEQ ID NO: 259341 - DNA, 75 bp, Artificial Sequence
  Synthetic
actctcgatcagatgagagccaccacaagagcgtgaatgtagataagaggtggatgtacacccagctgccgcccg

SEQ ID NO: 259342 - DNA, 75 bp, Artificial Sequence
  Synthetic
tctgtaagggagggtggagtagtgatcatcaaagtgctgtatgtgatgggatactactttcatctactcatgaat

SEQ ID NO: 259343 - DNA, 75 bp, Artificial Sequence
  Synthetic
tactactgccacacgtagcgggtccccgtccactcggcatcacacggaatctgcaccgagtccccccccgcagac

SEQ ID NO: 259344 - DNA, 75 bp, Artificial Sequence
  Synthetic
gaccttattatggcttgggaataataccctaaatcagatgagggccactacaagaatgtgaatgcagacaagagg

SEQ ID NO: 259345 - DNA, 75 bp, Artificial Sequence
  Synthetic
cacgggtagaacggtcagaggagccacccttcagtcggaagccaggcttcacaacatccgttctaccgcatcgcc

SEQ ID NO: 259346 - DNA, 75 bp, Artificial Sequence
  Synthetic
cgtggtgccaagaaaggacgtctacaagataccaactgcagcacttaaggtctctggctcaagtctgtacaatct

SEQ ID NO: 259347 - DNA, 75 bp, Artificial Sequence
  Synthetic
caataccctattcggggaatttaggatcgttcccttactggttgagatcctcaaggatgttagggcttaagagga

SEQ ID NO: 259348 - DNA, 75 bp, Artificial Sequence
  Synthetic
ggatttgggtgatcaaagggcaacatacgggtagaacggccagagaggccactccttagccaggaatcgggcctc

SEQ ID NO: 259349 - DNA, 75 bp, Artificial Sequence
  Synthetic
tgggtactatgctaatctcttcttacatattgggcttatgtccactgtagataagaaggggaagaaagtgacatt

SEQ ID NO: 259350 - DNA, 75 bp, Artificial Sequence
  Synthetic
catggcgcttggttttccggatcgcggtcctacttttaatgataatgattctagctatctccgcagctgccttgg

SEQ ID NO: 259351 - DNA, 75 bp, Artificial Sequence
  Synthetic
tagtcgagctgaatatcagcacaagcccggatcctaagctgctgggcagccgcagtccgacaaagctgacatgac

SEQ ID NO: 259352 - DNA, 75 bp, Artificial Sequence
  Synthetic
aacgatgaaagagaggcgaaaaatacatggcgcttggtatttcggaccgcagtcttacttttaatagtagtgacc

SEQ ID NO: 259353 - DNA, 75 bp, Artificial Sequence
  Synthetic
catattgggcttatgtccactgtagataagaaggggaagaaagtgacatttgacaagctggaaaggaagataagg

SEQ ID NO: 259354 - DNA, 75 bp, Artificial Sequence
  Synthetic
ccgaactctccgcccaaacctcccccaaactctccaactcaccgccccgcacggtcaaaccggcaggagcacccc

SEQ ID NO: 259355 - DNA, 75 bp, Artificial Sequence
  Synthetic
cccggatcctaagctgctgggcagccgcagtccgacaaagctgacatgactagtctgagttccttctttggtcgc

SEQ ID NO: 259356 - DNA, 75 bp, Artificial Sequence
  Synthetic
aagctgctggcacctttcttctctagcagtgggacagcctgctatcccatagcaaatgcctctcctcaggtggcc

SEQ ID NO: 259357 - DNA, 75 bp, Artificial Sequence
  Synthetic
gcagtgggacagcctgctatcccatagcaaatgcctctcctcaggtggccaagatactctggagccaaaccgcgt

SEQ ID NO: 259358 - DNA, 75 bp, Artificial Sequence
  Synthetic
tggtgaccttgtaggcatactgactgcgatctccagggcagaagaaaagattacatctgcactcggttccaatca

SEQ ID NO: 259359 - DNA, 75 bp, Artificial Sequence
  Synthetic
atagcgggtgtggggcgcctgttcatgacccagattatatcggggggataggcaaagaactcatagtagacgaca

SEQ ID NO: 259360 - DNA, 75 bp, Artificial Sequence
  Synthetic
tgcagctagatcgcattgtcgtgttgcctgtatggtacagggtgataatcaagtaatagcagtaacgagagaggt

SEQ ID NO: 259361 - DNA, 75 bp, Artificial Sequence
  Synthetic
aatcagcgcagaacccaaagtattagaaaaaaatacgggtagaagagagacacgtagagatcaggacaattcacc

SEQ ID NO: 259362 - DNA, 75 bp, Artificial Sequence
  Synthetic
tatgagtgcaataacgtccctctcttaccagatcaatggagctgcaaataacagtgggtgtggggcacctgttca

SEQ ID NO: 259363 - DNA, 75 bp, Artificial Sequence
  Synthetic
ggcaaagaactcatagtagacgacacgagtgatgtcacatcattttatccttctgcctatcaagaacacttgaat

SEQ ID NO: 259364 - DNA, 75 bp, Artificial Sequence
  Synthetic
cctctactaagctggagaaggggcataccattgccaaatacaatcccttcaagaaataggctgcatctctgagat

SEQ ID NO: 259365 - DNA, 75 bp, Artificial Sequence
  Synthetic
atactagagaccagtggaaccgtcattgacagcataattacggcccagggcaaatcagcagagaatgtcgggagg

SEQ ID NO: 259366 - DNA, 75 bp, Artificial Sequence
  Synthetic
taccagatcaatggagctgcaaataacagtgggtgtggggcacctgttcatgacccggattatatcggagggata

SEQ ID NO: 259367 - DNA, 75 bp, Artificial Sequence
  Synthetic
tgtctatcaaattagaaaaaacacgggtagaagattctggatcccggttggcgccttcaaggtgcaagatgggct

SEQ ID NO: 259368 - DNA, 75 bp, Artificial Sequence
  Synthetic
ggtagaagattctggatcccggttggcgccttcaaggtgcaagatgggctccagatcttctaccaggatcccagt

SEQ ID NO: 259369 - DNA, 75 bp, Artificial Sequence
  Synthetic
actcagctcattgatcagtagtggcttgatcgctggctatcctatactgtatgactcacagactcaaatcttggg

SEQ ID NO: 259370 - DNA, 75 bp, Artificial Sequence
  Synthetic
gcacgggaacacccagccaccagccggccaggacacctccgaacaacaagacagaccagacaaacagccatccac

SEQ ID NO: 259371 - DNA, 75 bp, Artificial Sequence
  Synthetic
ccagatcttctaccaggatcccagtacctcttatgctgaccgtccgagtcatgttggcactgagttgcgtctgtc

SEQ ID NO: 259372 - DNA, 75 bp, Artificial Sequence
  Synthetic
tcgataataccgtattagaaaaaaattaaattctgatcctttgaagctcgtactcggattcaagtaattatctta

SEQ ID NO: 259373 - DNA, 75 bp, Artificial Sequence
  Synthetic
ttaaattctgatcctttgaagctcgtactcggattcaagtaattatcttaaagcaaaaatgagcgtagttgtccc

SEQ ID NO: 259374 - DNA, 75 bp, Artificial Sequence
  Synthetic
tacaagtcagttacccccacatcaatggtgcacggaaggttagggtttgacggtcaataccatgagaaggactta

SEQ ID NO: 259375 - DNA, 75 bp, Artificial Sequence
  Synthetic
aagccccgttggaggcatacaacaggacattgactactttgctcaccccccttggtgattctatccgtaggatac

SEQ ID NO: 259376 - DNA, 75 bp, Artificial Sequence
  Synthetic
agtcacggaaactgaggaagaagattataattcagttatccccacaccaatggtacatgggaggctggggtttga

SEQ ID NO: 259377 - DNA, 75 bp, Artificial Sequence
  Synthetic
ccagccaagccgtggaaacaaccaggagagaccacagcaccaggccaaagccgcccctggaagccggggcacaga

SEQ ID NO: 259378 - DNA, 75 bp, Artificial Sequence
  Synthetic
gccagtctgtgcaacgacccatactctttcaattttgagactgttgcaagcccaaatattgttcttaagaaacat

SEQ ID NO: 259379 - DNA, 75 bp, Artificial Sequence
  Synthetic
gatggctaagtcttcatataagcctgggcggtttggtgggaaacgcgtacagcaggccatcctatccatcaaggt

SEQ ID NO: 259380 - DNA, 75 bp, Artificial Sequence
  Synthetic
ccatccccttatgtgacgcaagggggtgaaatgacactcaataaactctcgcaaccggtcaagaacccttctgag

SEQ ID NO: 259381 - DNA, 75 bp, Artificial Sequence
  Synthetic
actcttcatagtccttatgcattcaatgctttcactcggccaggtagtgtcccttgccaggcttcagccagatgc

SEQ ID NO: 259382 - DNA, 75 bp, Artificial Sequence
  Synthetic
accggcaaccctattctgtacgactcacagactcaactcttgggtatacaggtaaccctaccctcagtcgggaac

SEQ ID NO: 259383 - DNA, 75 bp, Artificial Sequence
  Synthetic
cacagactcaactcttgggtatacaggtaaccctaccctcagtcgggaacctaaataatatgcgtgccacctacc

SEQ ID NO: 259384 - DNA, 75 bp, Artificial Sequence
  Synthetic
ctaaataatatgcgtgccacctacctggaaaccttgtctgtaagtacaaccaaaggatttgcctcagcacttgtc

SEQ ID NO: 259385 - DNA, 75 bp, Artificial Sequence
  Synthetic
caattgcacatccgaaagataactggctcgcctcatttaggcggaaccttctctctgaggaccaaaagaaacagg

SEQ ID NO: 259386 - DNA, 75 bp, Artificial Sequence
  Synthetic
cggggaatttaggattgttcctttactagttgagatcctcaaggataatagggcttaagaagctaggcttggccg

SEQ ID NO: 259387 - DNA, 75 bp, Artificial Sequence
  Synthetic
agtcgcataacccgggtgagttcaagcagtaccaaggcagcatacacgacatcaacatgttttaaagttgtcaag

SEQ ID NO: 259388 - DNA, 75 bp, Artificial Sequence
  Synthetic
aacaagcaagactcaaccctgtatctgcagtatttgataacatatctcgcagtcgcataacccgggtgagttcaa

SEQ ID NO: 259389 - DNA, 75 bp, Artificial Sequence
  Synthetic
accaataaaacctattgcctcagcattgcagaaatatccaataccctcttcggggaattcaggattgtcccttta

SEQ ID NO: 259390 - DNA, 75 bp, Artificial Sequence
  Synthetic
ccctcgggcatgcagcaacggtaccccgttcgtcacagctggggttgaagatgatgcaccagaagacatcactga

SEQ ID NO: 259391 - DNA, 75 bp, Artificial Sequence
  Synthetic
gtattaacataagccaggatcccatgctgccaggcagccacaattcgacaacgctgacatgattaatttgagtcc

SEQ ID NO: 259392 - DNA, 75 bp, Artificial Sequence
  Synthetic
aagatgacaacatgtagatgtgcagaccccccgggtatcatatcgcaaaattatggagaagctgtgtctctaata

SEQ ID NO: 259393 - DNA, 75 bp, Artificial Sequence
  Synthetic
gaagatgacactgcgccacccatcctttgtagcaccaggaatcaaactgagaaccggcacaggctcaaatcatac

SEQ ID NO: 259394 - DNA, 75 bp, Artificial Sequence
  Synthetic
cacggctgggaatcttcaacatagactagatgatggtataactcagatgacattcacccctgcatctctctacag

SEQ ID NO: 259395 - DNA, 75 bp, Artificial Sequence
  Synthetic
aatatggattacttgttgactaagttaggtgtagggaacaatcaactcagctcattaatcggtagcggcttgatc

SEQ ID NO: 259396 - DNA, 75 bp, Artificial Sequence
  Synthetic
aaatatagatggtagtgagatacgagacaaagcaactcacggtggataacacgggtaggacatggcgagctccgg

SEQ ID NO: 259397 - DNA, 75 bp, Artificial Sequence
  Synthetic
ctcaagtaatagtgacaggcaatcttgatatctcgactgagcttgggaatgtcaacaactcgataagtaatgctt

SEQ ID NO: 259398 - DNA, 75 bp, Artificial Sequence
  Synthetic
acgggtaggacatggcgagctccggtcccgagagggcagagcaccagattatcctaccagagtcacatctgtctt

SEQ ID NO: 259399 - DNA, 75 bp, Artificial Sequence
  Synthetic
ggcaaagaactcataatagacgacactagtgatgtcacatcgttctacccttctgcgtatcaagaacacttgaat

SEQ ID NO: 259400 - DNA, 75 bp, Artificial Sequence
  Synthetic
tcggacgggcagtgcaccagaccctcaaccacaattccaagataaccggagtgctccatcccaggtgtttagaag

SEQ ID NO: 259401 - DNA, 75 bp, Artificial Sequence
  Synthetic
gttctagcatgctacctgatgtacaagcaaaaggcgcaacagaagaccttgttgtggcttgggaataatacccta

SEQ ID NO: 259402 - DNA, 75 bp, Artificial Sequence
  Synthetic
accaccttattatcagtcgacaatggaagaaagtacttgaatcggccactcctgacattgagagaatgataaaac

SEQ ID NO: 259403 - DNA, 75 bp, Artificial Sequence
  Synthetic
aactggctagtattgaaatccctgactcaaccaacaaatttcggaagattgaaaagaagatccaaattcataata

SEQ ID NO: 259404 - DNA, 75 bp, Artificial Sequence
  Synthetic
gccatcaatcagctgatgggcctacctcacttcttcgagtggattcatcttagactaatggacactacgatgttt

SEQ ID NO: 259405 - DNA, 75 bp, Artificial Sequence
  Synthetic
tcaatacttggcactcggtgtacttcggacatctgcaacagggagagtattcttttctactctgcgttccatcaa

SEQ ID NO: 259406 - DNA, 75 bp, Artificial Sequence
  Synthetic
agccaggacgcccccgatcaacaggacagaacagacaaacaaccatccacacctgagcaggcgaccccacataac

SEQ ID NO: 259407 - DNA, 75 bp, Artificial Sequence
  Synthetic
aagtctgacagcctgttaattagaagaattaagaaaaaactaccggatgtagatgaccaaagggcgatatacggg

SEQ ID NO: 259408 - DNA, 75 bp, Artificial Sequence
  Synthetic
gaattaagaaaaaactaccggatgtagatgaccaaagggcgatatacgggtagaacggtcggggaggccgtccct

SEQ ID NO: 259409 - DNA, 75 bp, Artificial Sequence
  Synthetic
ctgacgctagcagattatgcccggagcagaagctggtcacctttgacagggggtaggaagatactaggtgtatct

SEQ ID NO: 259410 - DNA, 75 bp, Artificial Sequence
  Synthetic
tagccaagttgcgctagagaatgatgaaagagaggcaaagaatacatggcgcttggtattccggatcgcaatcct

SEQ ID NO: 259411 - DNA, 75 bp, Artificial Sequence
  Synthetic
cgaatcatgctgatactgagctgcattcgtctgacaagctctcttgatggcaggcccctcgcagctgcgggaatt

SEQ ID NO: 259412 - DNA, 75 bp, Artificial Sequence
  Synthetic
gcatggaggccagcacacctagcgatcttgtaggcataccgactgcgatctctagagcagaggaaaagattacat

SEQ ID NO: 259413 - DNA, 75 bp, Artificial Sequence
  Synthetic
gtgcaacccctcatttgccccaatcagggcaaagccaaaacaatactcctgtacctgtggatcatttccacctac

SEQ ID NO: 259414 - DNA, 75 bp, Artificial Sequence
  Synthetic
aacctacaggagctcaaggacactctaatcgaacttctcccaaacaatatagcggaatcagtaactcacgcaatc

SEQ ID NO: 259415 - DNA, 75 bp, Artificial Sequence
  Synthetic
gatgtggagcacccattcatgatccagattatattggaggaataggtaaagaacttattgtagatgatgctagcg

SEQ ID NO: 259416 - DNA, 75 bp, Artificial Sequence
  Synthetic
atttgaactacctaatgagttgcgtgcagacatactttgattctgagttttttattactcacagctcgcaaccag

SEQ ID NO: 259417 - DNA, 75 bp, Artificial Sequence
  Synthetic
tcaggtctacgatgttgtagcactaatggagggattcgcatacggcgctgttcagctgcttgagccgtcaggtac

SEQ ID NO: 259418 - DNA, 75 bp, Artificial Sequence
  Synthetic
tacgggcagtcgcccgatcccacccagttttagtttcaggccccggagacccatctccttatgtgacacaaggag

SEQ ID NO: 259419 - DNA, 75 bp, Artificial Sequence
  Synthetic
gcactcggataccctcatttgacatgagcgctacccactactgttatactcacaatgtgatattatctggctgca

SEQ ID NO: 259420 - DNA, 75 bp, Artificial Sequence
  Synthetic
taatcggactcctccccaaggatatcacagaatctgtgactcatgcaatcgccaccgtattctctggcttagaac

SEQ ID NO: 259421 - DNA, 75 bp, Artificial Sequence
  Synthetic
actacggtgttcgggccacaaatcacttcccctgccctaactcagctgaccatccaggcactttataatttagct

SEQ ID NO: 259422 - DNA, 75 bp, Artificial Sequence
  Synthetic
gggttcccgcctctttagcgtcacacggaacctgcaccgagcccccccccacaaacccaaggtccaacactccaa

SEQ ID NO: 259423 - DNA, 75 bp, Artificial Sequence
  Synthetic
catggcgcctagttttccggatcgcagtcttacttttaatggtaatgactctagctatctccgcagctgccctgg

SEQ ID NO: 259424 - DNA, 75 bp, Artificial Sequence
  Synthetic
cctgcgatgccaagggccaggctgaatatcaacacaagcctgaatctcatgccgccgggcatccacaatccacca

SEQ ID NO: 259425 - DNA, 75 bp, Artificial Sequence
  Synthetic
cgatacaatgacacatgtccagatgagcaagattatcagattcaaatggctaagtcttcatataagcctgggcgg

SEQ ID NO: 259426 - DNA, 75 bp, Artificial Sequence
  Synthetic
ctactctcttctgcaatgctctgcttgggaagtgtcccgaacgacggagatcttgttgagctggcgagagcctgc

SEQ ID NO: 259427 - DNA, 75 bp, Artificial Sequence
  Synthetic
tcatgggggccgaaggcagagttctcacagtagggacatctcatttcctttatcagcgagggtcatcatacttct

SEQ ID NO: 259428 - DNA, 75 bp, Artificial Sequence
  Synthetic
gaaccacaccttgcgaggggtattcgggacgatgcttgatgataaacaagcaagactcaaccctgtatctgcagt

SEQ ID NO: 259429 - DNA, 75 bp, Artificial Sequence
  Synthetic
tactcatgaatttattcactccatgttccacgaaaggatacatactctccaatggctatgcctgtagaggggata

SEQ ID NO: 259430 - DNA, 75 bp, Artificial Sequence
  Synthetic
ccaaggcagcatacacaacatcaacatgttttaaagttgtaaagaccaataaaacctattgtctcagcattgccg

SEQ ID NO: 259431 - DNA, 75 bp, Artificial Sequence
  Synthetic
agcagttcgcagggttgcgctagagaatgaagaaagggaagcaaagaacacatggcgtttggttttccggattgc

SEQ ID NO: 259432 - DNA, 75 bp, Artificial Sequence
  Synthetic
aaaacctattgtctcagcattgccgaaatatccaataccctcttcggggaattcagaatcgtccctttactagtt

SEQ ID NO: 259433 - DNA, 75 bp, Artificial Sequence
  Synthetic
gacgactccccggaaatggtgttgacacagttacatcaagctagtgataatttcttcaaggaattgatccacgtc

SEQ ID NO: 259434 - DNA, 75 bp, Artificial Sequence
  Synthetic
agggggggcattgagggattgtgtcagaagctgtggacaatgatctcaattgctgcaatccaacttgctgcagca

SEQ ID NO: 259435 - DNA, 75 bp, Artificial Sequence
  Synthetic
tcaactgcgagagggttggaaagatgacattgtatcacctatcttttgcgacgccaagaatcaaactgaataccg

SEQ ID NO: 259436 - DNA, 75 bp, Artificial Sequence
  Synthetic
gacattgtatcacctatcttttgcgacgccaagaatcaaactgaataccggcgcgagctcgagtcctacgctgcc

SEQ ID NO: 259437 - DNA, 75 bp, Artificial Sequence
  Synthetic
acgccaagaatcaaactgaataccggcgcgagctcgagtcctacgctgccagttggccataatcagctagtgcta

SEQ ID NO: 259438 - DNA, 75 bp, Artificial Sequence
  Synthetic
agatgtagtagataggatatacaagcaggtggcccttgaatctccgctggcactgctaaatactgaatctataat

SEQ ID NO: 259439 - DNA, 75 bp, Artificial Sequence
  Synthetic
tagtcacttgattaagaaaaaatgtgggtggtagcgggatataaggcaaaacaactcaaggaggatagcacgggt

SEQ ID NO: 259440 - DNA, 75 bp, Artificial Sequence
  Synthetic
gggtggtagcgggatataaggcaaaacaactcaaggaggatagcacgggtaggacatggcgagctccggtcccga

SEQ ID NO: 259441 - DNA, 75 bp, Artificial Sequence
  Synthetic
gacggtaaaaagagaacatcacttaagcagtgcaccaaacagatcttggaagtcacaatactgggtctcagagcc

SEQ ID NO: 259442 - DNA, 75 bp, Artificial Sequence
  Synthetic
aggacatggcgagctccggtcccgagagggcggagcatcagattatcctaccagagtcacacctgtcttcaccat

SEQ ID NO: 259443 - DNA, 75 bp, Artificial Sequence
  Synthetic
agtcacaatactgggtctcagagccaaagatatcaataaagtaggtgatgtaatcagcttagtactcagaggtgc

SEQ ID NO: 259444 - DNA, 75 bp, Artificial Sequence
  Synthetic
ttcagctgcttgagccgtcaggtacatttgcaggagatttcttcgcattcaacctacaagagctcaaagacactc

SEQ ID NO: 259445 - DNA, 75 bp, Artificial Sequence
  Synthetic
ccagagtcacacctgtcttcaccattagtcaagcacaaactactctattactggaaattaactgggctaccactc

SEQ ID NO: 259446 - DNA, 75 bp, Artificial Sequence
  Synthetic
attagtgctgatatcaggcgaccttagtgaaaacaccgtaatgtcttgtgccaacattgcatctactatagcgcg

SEQ ID NO: 259447 - DNA, 75 bp, Artificial Sequence
  Synthetic
cctggatcgaggatatctctttcgtacactcatacgtgttaactcctgcccagctggggggattgagcaaccttc

SEQ ID NO: 259448 - DNA, 75 bp, Artificial Sequence
  Synthetic
cagatgagctttgcacctgctgagtatgcacaactttactcctttgccatgggtatggcatcagtcctagataaa

SEQ ID NO: 259449 - DNA, 75 bp, Artificial Sequence
  Synthetic
gtggtccgtctattcgagtatgcagcactcgaagtgctccttgactgttcttatcaactctactatctgagagtg

SEQ ID NO: 259450 - DNA, 75 bp, Artificial Sequence
  Synthetic
acttgactcgtgctcaacaaaaattctacatgaaaaccataggtaatgctgccaagggatattacagtaataatg

SEQ ID NO: 259451 - DNA, 75 bp, Artificial Sequence
  Synthetic
tgattctgagttttccatcactaacaacccgcaacccgattctaaccagtcgtggattgaggacatctcttttgt

SEQ ID NO: 259452 - DNA, 75 bp, Artificial Sequence
  Synthetic
tcttctcgactctgcgttccatcaatttggatgatacccaaaatcgaaagtcttgcagtgtgagtgcaactcctc

SEQ ID NO: 259453 - DNA, 75 bp, Artificial Sequence
  Synthetic
gaagaagaactcaggtgtatggccacgtgtcaaggtaaatacaatatacggaaaggtaattgggcagctacatgc

SEQ ID NO: 259454 - DNA, 75 bp, Artificial Sequence
  Synthetic
cctggcaacggagactgggccagcctgtgcaacgatccgtactctttcaattttgagactgttgcaagccccaac

SEQ ID NO: 259455 - DNA, 75 bp, Artificial Sequence
  Synthetic
cccagcagcaaggaggggcctggcagctgctgcccaacgagtctctgaggagatcagcagcatagacatgccaac

SEQ ID NO: 259456 - DNA, 75 bp, Artificial Sequence
  Synthetic
atggagaactgttcacaagactgtgcacgcatgtagagaagaaattgttgggatcatcttggtctaataatgtcc

SEQ ID NO: 259457 - DNA, 75 bp, Artificial Sequence
  Synthetic
ttgcatggctccatataaaacagattcaaaggcatctgattgtggcagcaagaacaaggtccgcagccaacaaat

SEQ ID NO: 259458 - DNA, 75 bp, Artificial Sequence
  Synthetic
agaacaaggtccgcagccaacaaattggtgacgctgacccataaggtaggccaagtctttgttactcctgagctt

SEQ ID NO: 259459 - DNA, 75 bp, Artificial Sequence
  Synthetic
cgactggggttattgattgacaaaacccagcttgcttccacaaaatcattccaatgccctcacccgtagtcgacc

SEQ ID NO: 259460 - DNA, 75 bp, Artificial Sequence
  Synthetic
cacctcatactgtatagagtctgatctggatttatattgtacaagaatagtgacattccccatgtccccaggtat

SEQ ID NO: 259461 - DNA, 75 bp, Artificial Sequence
  Synthetic
gtcattgtgacacatacagatgagaacaagttcacgtgtcttacccaggaacttgtgttgatgtatgcagatatg

SEQ ID NO: 259462 - DNA, 75 bp, Artificial Sequence
  Synthetic
atggagggcagagatatggtcaacataatatcatccacggcggcacatctcaggagcctatcagagaaaattgat

SEQ ID NO: 259463 - DNA, 75 bp, Artificial Sequence
  Synthetic
ccagggaaatggggtcattcaagatagcatatccctgactaagagtatgttagcgatgagtcaattgtcctttaa

SEQ ID NO: 259464 - DNA, 75 bp, Artificial Sequence
  Synthetic
gcttgttgacacaacaaacaccgtgattaagatcgcactgactcggaggcctctcggcatcaagaggctgatgcg

SEQ ID NO: 259465 - DNA, 75 bp, Artificial Sequence
  Synthetic
gggcaggaaaatactgggtgtatctaaccccgataccatagaacttgtggagggagagattctcagtgtcagtgg

SEQ ID NO: 259466 - DNA, 75 bp, Artificial Sequence
  Synthetic
ccccgcgcgccctaggcaccgcaggcacaatgcggctcaccaacaaccagaacagagccgaggaagttagaaaaa

SEQ ID NO: 259467 - DNA, 75 bp, Artificial Sequence
  Synthetic
gacattctgcggttagtagatgccctggcaaaagatctgggtaatcaagtctacgatgttgtagcactcatggag

SEQ ID NO: 259468 - DNA, 75 bp, Artificial Sequence
  Synthetic
tctcatccaacagatccaaccaccccttagtctcttctaatatgtgttctcttacgctggcagattatgcacgga

SEQ ID NO: 259469 - DNA, 75 bp, Artificial Sequence
  Synthetic
ctgatgggcctacctcacttcttcgaatggattcatcttagactaatggacactacgatgtttgtaggagatcct

SEQ ID NO: 259470 - DNA, 75 bp, Artificial Sequence
  Synthetic
caggagctcaaagacactttgatcggcctccttcctaaggatatagcagaatctgtgactcacgcaatagccact

SEQ ID NO: 259471 - DNA, 75 bp, Artificial Sequence
  Synthetic
gtattctctggcttagaacaaaatcaagcggctgagatgctgtgcctgttgcgtctatggggccacccattactt

SEQ ID NO: 259472 - DNA, 75 bp, Artificial Sequence
  Synthetic
ccctgcatctctctacagagtatcaccttatgttcacatatccaatgattctcaaaggctattcaccgaagaagg

SEQ ID NO: 259473 - DNA, 75 bp, Artificial Sequence
  Synthetic
gaccttactatggcttgggaataatactctcgatcagatgagagccaccacaagagcatgaatacagatgagagg

SEQ ID NO: 259474 - DNA, 75 bp, Artificial Sequence
  Synthetic
tcaagcgggcacccaacgcgctgtcgcagtgactgctgaccatgaggttacctctactaagatagagaagaggca

SEQ ID NO: 259475 - DNA, 75 bp, Artificial Sequence
  Synthetic
ctcaggtaggctccgtaattgaagagctggatacgtcgcattgcatagagacagatctggatctgtactgcacca

SEQ ID NO: 259476 - DNA, 75 bp, Artificial Sequence
  Synthetic
gcagtgactgctgaccatgaggttacctctactaagatagagaagaggcataccatcgctaaatacaatcccttc

SEQ ID NO: 259477 - DNA, 75 bp, Artificial Sequence
  Synthetic
gtagaagacttaagaaaaaactgctgggtacaagcaaccaaagagcaatacacgggtagaacggtgggagaggcc

SEQ ID NO: 259478 - DNA, 75 bp, Artificial Sequence
  Synthetic
ggacaacgaagtaaattggactgctgctcttaagattgcaaggtctcggtgcaacataagctcagagtatcttcg

SEQ ID NO: 259479 - DNA, 75 bp, Artificial Sequence
  Synthetic
agcggagatttcacacgatatcatgttgagagagtacaagagtttatctgcgcttgaattcgagccatgtataga

SEQ ID NO: 259480 - DNA, 75 bp, Artificial Sequence
  Synthetic
aatggtagactttgatatgatcctccaggtattgtctttctttaaaggaacaatcatcaacggatacagaaagaa

SEQ ID NO: 259481 - DNA, 75 bp, Artificial Sequence
  Synthetic
tgcggttaacagagtcgtgctagagaatgaggaaagagaagcaaagaacacatggcgcttggtattccggattat

SEQ ID NO: 259482 - DNA, 75 bp, Artificial Sequence
  Synthetic
tttgatccatataaggagatggaatatctgacgacccttgagtacctaagagatgacaatgtggcagtatcatac

SEQ ID NO: 259483 - DNA, 75 bp, Artificial Sequence
  Synthetic
tgacccagattatatcggggggataggcaaagaactcatagtagatgacactagtgatgtcacatcattttatcc

SEQ ID NO: 259484 - DNA, 75 bp, Artificial Sequence
  Synthetic
tgtgcaacgacccgtactcctttaattttgagactgttgcaagccctaatattgtcctcaagaaacatacacaga

SEQ ID NO: 259485 - DNA, 75 bp, Artificial Sequence
  Synthetic
gacctgcaaaagtactgtcttaattggagatatcagacaatcaaactgttcgctcatgccatcaatcagctgatg

SEQ ID NO: 259486 - DNA, 75 bp, Artificial Sequence
  Synthetic
cattggctgaatacttactcaatcaagaagtgattcacccacgagtcgcacacgctatcatggaagcaagctctg

SEQ ID NO: 259487 - DNA, 75 bp, Artificial Sequence
  Synthetic
ttcatctaagactaatggatactacgatgtttgtaggagaccctttcaatcccccaagtgacccaactgactgtg

SEQ ID NO: 259488 - DNA, 75 bp, Artificial Sequence
  Synthetic
gaagatgcttcagctgatttcccgattatgctgtctatacacagtgctctttgctacaacaagggaaatcccaaa

SEQ ID NO: 259489 - DNA, 75 bp, Artificial Sequence
  Synthetic
tttagatgacactcaaaatcggaagtcctgcagtgtgagtgcaactcctttaggttgtgatatgctgtgctctaa

SEQ ID NO: 259490 - DNA, 75 bp, Artificial Sequence
  Synthetic
gatgtttgtaggagaccctttcaatcccccaagtgacccaactgactgtgatctctcaagagtcccaaatgatga

SEQ ID NO: 259491 - DNA, 75 bp, Artificial Sequence
  Synthetic
tcctcgactgttcttaccaactctactatctaagagtaagaggcctaaacaatattgtcttatatatgagtgatt

SEQ ID NO: 259492 - DNA, 75 bp, Artificial Sequence
  Synthetic
ttggaggtcacaatattgggtctcagagtcaaagatgtcaataaagtaggtgatgtaatcagcttagtactcaga

SEQ ID NO: 259493 - DNA, 75 bp, Artificial Sequence
  Synthetic
aatccaacttgctgcagcaagatcacattgtcgcgtcgcctgtatggtacagggtgacaatcaagtaatagctgt

SEQ ID NO: 259494 - DNA, 75 bp, Artificial Sequence
  Synthetic
cattgtcgcgtcgcctgtatggtacagggtgacaatcaagtaatagctgtaacgagagaggtaaggtcagatgac

SEQ ID NO: 259495 - DNA, 75 bp, Artificial Sequence
  Synthetic
acagatttcattgaaatgtctgcaaaactgctagtatcttgcactcggcgcgtggcatcaggtttatatgcagga

SEQ ID NO: 259496 - DNA, 75 bp, Artificial Sequence
  Synthetic
taggaagagccttaatttgatcagggaacgagaggacagagatactatcttgtcgttgttgttccctcaggaacc

SEQ ID NO: 259497 - DNA, 75 bp, Artificial Sequence
  Synthetic
tgcatcaagccagtgataatttcttcaaggaattgattcatgttaatcatttgattggccataatttgaaggatc

SEQ ID NO: 259498 - DNA, 75 bp, Artificial Sequence
  Synthetic
gaaaagattgatgatatcttgaggctggtggatgcacttgctagggatctgggcaatcaggtttacgatgttgtg

SEQ ID NO: 259499 - DNA, 75 bp, Artificial Sequence
  Synthetic
ttatgctgtctgtacacggtgctctttgctacaacaagagaaatcccgaaaataagaggcttatccgcggaagaa

SEQ ID NO: 259500 - DNA, 75 bp, Artificial Sequence
  Synthetic
attgcactgactaggaggccactcggcatcaagaggctgatgcggatagtcaattattcgagcatgcatgcaatg

SEQ ID NO: 259501 - DNA, 75 bp, Artificial Sequence
  Synthetic
tatactcacaatgtgatactatccggttgcagagatcactcacactcacatcaatatttagcacttggtgtgctt

SEQ ID NO: 259502 - DNA, 75 bp, Artificial Sequence
  Synthetic
aacaccgtaatgtcctgtgccaacattgcatctactatagcacggctgtgcgagaacgggcttccaaaggatttc

SEQ ID NO: 259503 - DNA, 75 bp, Artificial Sequence
  Synthetic
tgttattacttaaactacctgatgagttgcgtgcagacatactttgattctgagttttccatcactaacagctcg

SEQ ID NO: 259504 - DNA, 75 bp, Artificial Sequence
  Synthetic
catttacccgacaacctgcggcgtttttactagagttggatttgagtgctccagcaaggtatgatgcatttacac

SEQ ID NO: 259505 - DNA, 75 bp, Artificial Sequence
  Synthetic
gggggactgagcaacctccaatactcaaggctctacacgaggaacatcggtgacccgggaactactgcttttgca

SEQ ID NO: 259506 - DNA, 75 bp, Artificial Sequence
  Synthetic
tgacccgggaactactgcttttgcagagatcaagcgattagaagcagtggggttactaagtcctagtattatgac

SEQ ID NO: 259507 - DNA, 75 bp, Artificial Sequence
  Synthetic
ataggaaggggaagaaagtgacatttgacaagctagaaaagaagataaggagccttgatctatctgtcgggctca

SEQ ID NO: 259508 - DNA, 75 bp, Artificial Sequence
  Synthetic
caacaaattatgcttttgggtttatctctaattgaatcgcttttccccatgacaacaaccaaaacgtatgatgag

SEQ ID NO: 259509 - DNA, 75 bp, Artificial Sequence
  Synthetic
gactgtcgcgagtccaaatattgtccttaagaaacatacacaaagagtcctatttgaaacttgttcaaatccctt

SEQ ID NO: 259510 - DNA, 75 bp, Artificial Sequence
  Synthetic
gggaaaacaacccatagaagagagcacgggtaggacatggcgggctccggtcccgaaagggcagagcaccagatt

SEQ ID NO: 259511 - DNA, 75 bp, Artificial Sequence
  Synthetic
acgggtaggacatggcgggctccggtcccgaaagggcagagcaccagattatcctaccagagtcacatctatcct

SEQ ID NO: 259512 - DNA, 75 bp, Artificial Sequence
  Synthetic
gcatcaagaggctgatgcggatagttaactactcgagcatgcatgcaatgctgtttagagacgatgttttctcat

SEQ ID NO: 259513 - DNA, 75 bp, Artificial Sequence
  Synthetic
cctggcaatggagactgggctagcttatgcaacgatccttactcttttaattttgagactgtcgcaagcccaaat

SEQ ID NO: 259514 - DNA, 75 bp, Artificial Sequence
  Synthetic
ctccattggtcaagcacaaattgctctattactggaaattgactgggctaccgcttcctgatgaatgcgactttg

SEQ ID NO: 259515 - DNA, 75 bp, Artificial Sequence
  Synthetic
tatacaagaacatgccagggattctactctctaacattgcgactacgatatcccaccccatcattcactcaaggt

SEQ ID NO: 259516 - DNA, 75 bp, Artificial Sequence
  Synthetic
gtgatcatcaaagtactgtatgcaatgggatactacttccatctactcatgaacttgttcgctccatgctctgcg

SEQ ID NO: 259517 - DNA, 75 bp, Artificial Sequence
  Synthetic
cttggcggacctacatttgtgcatgaggtggtgaggatggcaaaaactctagtacagcggcacggcacgcttttg

SEQ ID NO: 259518 - DNA, 75 bp, Artificial Sequence
  Synthetic
aggtggtgaggatggcaaaaactctagtacagcggcacggcacgcttttgtctaaatcggatgaggttatactga

SEQ ID NO: 259519 - DNA, 75 bp, Artificial Sequence
  Synthetic
tactgtcagatgctgtgaaaccattacttaggtccgaacaattgagttctatcatgtctcccaacatagtcacgt

SEQ ID NO: 259520 - DNA, 75 bp, Artificial Sequence
  Synthetic
cgaagtaaattggactgctgctcttaaaattgcaagatctcggtgcaatataaactcagagtatcttcgactatt

SEQ ID NO: 259521 - DNA, 75 bp, Artificial Sequence
  Synthetic
aaagttggactccgactctttgaaactcgtactcggattcagttagttaactttaagcaggagtgcgcgtagttg

SEQ ID NO: 259522 - DNA, 75 bp, Artificial Sequence
  Synthetic
ctcgtactcggattcagttagttaactttaagcaggagtgcgcgtagttgtccctagttatagtcctgtcgttca

SEQ ID NO: 259523 - DNA, 75 bp, Artificial Sequence
  Synthetic
cacagactcaactcttgggtatacaggtaactctaccctcagtcgggaacctaaataatatgcgtgccacctact

SEQ ID NO: 259524 - DNA, 75 bp, Artificial Sequence
  Synthetic
taagtatttaaagactgtcctaggtgttactaaactcaaagaaatgttcacagacacttctttattatacttgac

SEQ ID NO: 259525 - DNA, 75 bp, Artificial Sequence
  Synthetic
gttactaaactcaaagaaatgttcacagacacttctttattatacttgacgcgtgctcaacaaaaattgtacatg

SEQ ID NO: 259526 - DNA, 75 bp, Artificial Sequence
  Synthetic
caaataagtttatgtatgatcctagtcctgtatcggagggtgactttgcgagacttgacttagctatctttaaga

SEQ ID NO: 259527 - DNA, 75 bp, Artificial Sequence
  Synthetic
cagaccatccgccggaaccctccccaaactccacgacacaccggcccacatggccaaaccagcaggagcaacccc

SEQ ID NO: 259528 - DNA, 75 bp, Artificial Sequence
  Synthetic
atccgtgcagaacccaaaatattagaaaaaaatacgggtagaagagagatactcggagatcaggacaaatcacta

SEQ ID NO: 259529 - DNA, 75 bp, Artificial Sequence
  Synthetic
cttttttagccaattgtatccttgttgatttaattataccatattagaaaaaagttgaactccgaccctctagga

SEQ ID NO: 259530 - DNA, 75 bp, Artificial Sequence
  Synthetic
tcggccagtctgtggtttcttatgatgaagatacctccataaagaatgacgccataatagtgtatgacaacaccc

SEQ ID NO: 259531 - DNA, 75 bp, Artificial Sequence
  Synthetic
ctcgtactcggattcaaataattaccttagaaaaaaaatgcgcataattgctcttgagtgtagttctgtcattca

SEQ ID NO: 259532 - DNA, 75 bp, Artificial Sequence
  Synthetic
ccaaaccatctgctggaaccctccccaaactccacaactcaccggcccacgtggccaaaccggcaggagcatccc

SEQ ID NO: 259533 - DNA, 75 bp, Artificial Sequence
  Synthetic
gacattggtgctcgagtgagagatccttttactcgaaaacctgcatcattcatacaagagttagatctgagtgct

SEQ ID NO: 259534 - DNA, 75 bp, Artificial Sequence
  Synthetic
ctcaggtttatatgcagggaataagtatgatctgctgttcccgtctgtcttagatgataacctgagtgagaagat

SEQ ID NO: 259535 - DNA, 75 bp, Artificial Sequence
  Synthetic
gtacagaccctcctggtatcatatcacaaaattacggagaagctgtatccctgatagatagacattcatgcaatg

SEQ ID NO: 259536 - DNA, 75 bp, Artificial Sequence
  Synthetic
atatttgagaccagtggaaccgtcattgacagtataatcacggcccagggcaggtcagcagaggctgtcgggaag

SEQ ID NO: 259537 - DNA, 75 bp, Artificial Sequence
  Synthetic
aggcttatctgcagaagagaagtgttcagtacttactgagtacctactgtcagatgctgtgaaaccattacttag

SEQ ID NO: 259538 - DNA, 75 bp, Artificial Sequence
  Synthetic
tcagtacttactgagtacctactgtcagatgctgtgaaaccattacttagttctgagcaagtgagctctatcatg

SEQ ID NO: 259539 - DNA, 75 bp, Artificial Sequence
  Synthetic
gcacgggaatacccagccatccgccggccaggacaaccccaaccaacaagacaaatcagacaaacatccacccgc

SEQ ID NO: 259540 - DNA, 75 bp, Artificial Sequence
  Synthetic
tgagttccccttagtacaagatattggcgctcgagtgaaagatccattcacccgacaacctgcggcgtttttaca

SEQ ID NO: 259541 - DNA, 75 bp, Artificial Sequence
  Synthetic
tccaacagcttaaaacatctgttgcaatcatggaggccaatttaggcatgatgaaaattctggaccctggttgtg

SEQ ID NO: 259542 - DNA, 75 bp, Artificial Sequence
  Synthetic
tccaaggcagaagaaaagattacatctgtacttggttccaatcaggatgtagtggataggatatataagcaagtg

SEQ ID NO: 259543 - DNA, 75 bp, Artificial Sequence
  Synthetic
tcgtgctcaacaaaaattctacatgaaaaccataggtaatgcagcaaagggatattacagtaataatgactctta

SEQ ID NO: 259544 - DNA, 75 bp, Artificial Sequence
  Synthetic
atattcaaagatggagcaatactcagtcaggtcctcaaaaactcatctaaattggtgctaatatcaggcgacctt

SEQ ID NO: 259545 - DNA, 75 bp, Artificial Sequence
  Synthetic
aggttcattctgaacacacatcaccaaatccggaggacgactacttagtacgatacctgttcagaggaataggga

SEQ ID NO: 259546 - DNA, 75 bp, Artificial Sequence
  Synthetic
aaagttaaattctgactctttggaactcgtattcggactcagtagattaactctaagcagaaatgcgcgtagttg

SEQ ID NO: 259547 - DNA, 75 bp, Artificial Sequence
  Synthetic
gtcagatgtgcaaggcacgggaattccttatacttggcagaaggaagcggagccattatgagtcttctcgaactg

SEQ ID NO: 259548 - DNA, 75 bp, Artificial Sequence
  Synthetic
ccttatacttggcagaaggaagcggagccattatgagtcttctcgaactgcatgtgccgcatgagactatctatt

SEQ ID NO: 259549 - DNA, 75 bp, Artificial Sequence
  Synthetic
ctcgtattcggactcagtagattaactctaagcagaaatgcgcgtagttgtctttaattgcagccctgtcattca

SEQ ID NO: 259550 - DNA, 75 bp, Artificial Sequence
  Synthetic
taagctcctgagtaagttggatgcagccaagtcgatcgaagagatcagaaaggtcaagcgccttgcgctgaatgg

SEQ ID NO: 259551 - DNA, 75 bp, Artificial Sequence
  Synthetic
aggtcaagcgccttgcgctgaatggttgatagccatcacagctcacgataggcccctgcctcattagtgtcacaa

SEQ ID NO: 259552 - DNA, 75 bp, Artificial Sequence
  Synthetic
ccctcgggcatgcagcaacggtactccgtttgtcacagctggggttgaagatgatgcaccagaagatatcactga

SEQ ID NO: 259553 - DNA, 75 bp, Artificial Sequence
  Synthetic
tgtaagggagggcggggtcgtgatcatcaaagtgttgtatgcaatgggatattacttccatctactcatgaactt

SEQ ID NO: 259554 - DNA, 75 bp, Artificial Sequence
  Synthetic
ggagtgtctgaagagagagcacagagattcatggtgatagcagggtctctcccccgggcatgcagtaacggtact

SEQ ID NO: 259555 - DNA, 75 bp, Artificial Sequence
  Synthetic
gattcatggtgatagcagggtctctcccccgggcatgcagtaacggtactccgttcgttacagctggagttgaag

SEQ ID NO: 259556 - DNA, 75 bp, Artificial Sequence
  Synthetic
cccccgggcatgcagtaacggtactccgttcgttacagctggagttgaagatgatgcgccagaagatatcactga

SEQ ID NO: 259557 - DNA, 75 bp, Artificial Sequence
  Synthetic
cttacggattcatcttccaaattgggaatgaagaggccaccgttggcacgatcaacgacaatcccagacatgagt

SEQ ID NO: 259558 - DNA, 75 bp, Artificial Sequence
  Synthetic
ccgagactaataaagttcttgagaaagaatatcgatactgcgctaattgaagccgggggacaacccgtccgtcca

SEQ ID NO: 259559 - DNA, 75 bp, Artificial Sequence
  Synthetic
atatttgagaccagtgggactgtcattgacagcataattacggcccagggcaaatcagctgagaccgtcggaaga

SEQ ID NO: 259560 - DNA, 75 bp, Artificial Sequence
  Synthetic
gaacaccgggcttactgcattcttcctgacactcaagtatggaatcaataccaagacatcagcccttgcactcag

SEQ ID NO: 259561 - DNA, 75 bp, Artificial Sequence
  Synthetic
aatctctctacagacggtaaaaagagaacatcacttaaacagtgcacaaggcagatcttagaggtcacaatattg

SEQ ID NO: 259562 - DNA, 75 bp, Artificial Sequence
  Synthetic
ggagcaagcaactcccttctgtccatgctcgacaaactgagcaataaatcgtccaatgctaaaaagggcccatgg

SEQ ID NO: 259563 - DNA, 75 bp, Artificial Sequence
  Synthetic
tcaactatgaaagagttggaaagatggcattgtttcacctatcctctgcgacacccagaatcaaacttaatgccg

SEQ ID NO: 259564 - DNA, 75 bp, Artificial Sequence
  Synthetic
gctgctgcccaacgagtatctgaggaaattggcaatgtggatattcctactcaacaggccggggtcctcactggg

SEQ ID NO: 259565 - DNA, 75 bp, Artificial Sequence
  Synthetic
aaactcaaagaaatgtttacagacacctctttattatacttgactcgtgctcaacaaaaattctacatgaaaact

SEQ ID NO: 259566 - DNA, 75 bp, Artificial Sequence
  Synthetic
gtgcaagctcgaattccatgtagccagttgaccacaatcagccagtactcatgcaatcagattaagtcttgccaa

SEQ ID NO: 259567 - DNA, 75 bp, Artificial Sequence
  Synthetic
tcaacaggccggggtcctcactgggctcagcgacgaaggtccccgagccccgcagggtggatcgagcaagtcgca

SEQ ID NO: 259568 - DNA, 75 bp, Artificial Sequence
  Synthetic
cctctttattatacttgactcgtgctcaacaaaaattctacatgaaaactataggcaacgcagtcaagggatact

SEQ ID NO: 259569 - DNA, 75 bp, Artificial Sequence
  Synthetic
tagttaactgagcccttgttgatttaatgatactatattagaaaaaagttgcactccgatcctttaggactcgtg

SEQ ID NO: 259570 - DNA, 75 bp, Artificial Sequence
  Synthetic
gagacccaattcctggacctgatgagagcagtggcaaatagcatgcgagaagcgccagactctgcacagagcacc

SEQ ID NO: 259571 - DNA, 75 bp, Artificial Sequence
  Synthetic
gcactccgatcctttaggactcgtgttcgaattcaaataattgtcttagaaaaaagttgcgcgtaattgttcttg

SEQ ID NO: 259572 - DNA, 75 bp, Artificial Sequence
  Synthetic
ttcgaattcaaataattgtcttagaaaaaagttgcgcgtaattgttcttgaatgtagtcttgtcattcaccaaat

SEQ ID NO: 259573 - DNA, 75 bp, Artificial Sequence
  Synthetic
agcgccagactctgcacagagcaccattcatctggagcctccctcaactcatgagccatctcaggacaacgacac

SEQ ID NO: 259574 - DNA, 75 bp, Artificial Sequence
  Synthetic
ccaaacctttcgcccgaaccctccccaaactccccgactcactgccccacatggccaaaccgacaggagcacccc

SEQ ID NO: 259575 - DNA, 75 bp, Artificial Sequence
  Synthetic
acacgggtagaagagtctggatcccggccggcacattcaaagtgcaatatgggctccaaaccccacaccaggatc

SEQ ID NO: 259576 - DNA, 75 bp, Artificial Sequence
  Synthetic
ctcagactcgccctaatggagctcatggcggaggagagaaagggagcaccttaaaagtagaagtcccggttttca

SEQ ID NO: 259577 - DNA, 75 bp, Artificial Sequence
  Synthetic
aataagtacgatctgctgtttccatctgtcttagatgataacctgaatgagaagatgcttcagctgatttcccgg

SEQ ID NO: 259578 - DNA, 75 bp, Artificial Sequence
  Synthetic
cttaggattgctgttagcgaagatgccaacaaaccactcaggcaaggtgctctcatatctctcttatgctctcac

SEQ ID NO: 259579 - DNA, 75 bp, Artificial Sequence
  Synthetic
ccaacaaaccactcaggcaaggtgctctcatatctctcttatgctctcactcacaggtgatgaggaaccatgttg

SEQ ID NO: 259580 - DNA, 75 bp, Artificial Sequence
  Synthetic
ttgctacaacaagagaaatcccaaaaataaggggcctatcagcagaagagaaatgctcagtactcactgagtacc

SEQ ID NO: 259581 - DNA, 75 bp, Artificial Sequence
  Synthetic
gaagatgcttcagctgatttcccggttatgctgtctgtacacagtgctctttgctacaacaagagaaatcccaaa

SEQ ID NO: 259582 - DNA, 75 bp, Artificial Sequence
  Synthetic
gcaaggaggggcttggcagctgctgcccagcgagtgtccgaggaggccggtagcatggacattcctgcccaacaa

SEQ ID NO: 259583 - DNA, 75 bp, Artificial Sequence
  Synthetic
gtctcaagacaatgatactgactgggggtactaaccgacaaatcccagcctgtccctgcaggaccgccccaactc

SEQ ID NO: 259584 - DNA, 75 bp, Artificial Sequence
  Synthetic
ggagcaagcaactctcttttgtctatgcttgacaagctgagcaataaatcgtctaatgctaaaaaggggccaagg

SEQ ID NO: 259585 - DNA, 75 bp, Artificial Sequence
  Synthetic
atggaagatttaagaaaaaactactggatataagcaactgataggcaatacacgggtagaacggtcggagaggcc

SEQ ID NO: 259586 - DNA, 75 bp, Artificial Sequence
  Synthetic
cctgaggtcaggtgtgcaagacatgggaactccttatacttggcggaaggaagtggagccatcatgagtcttctt

SEQ ID NO: 259587 - DNA, 75 bp, Artificial Sequence
  Synthetic
aggtacatcctccaccctgtatgcaggagcgcaatccaacttacgatcagacagtctcttgcagtccgcatcttc

SEQ ID NO: 259588 - DNA, 75 bp, Artificial Sequence
  Synthetic
tcccccccccctcccgccacgcgaccccactagcccgagtccacacgggcgcggcctggcccaacaacgatctac

SEQ ID NO: 259589 - DNA, 75 bp, Artificial Sequence
  Synthetic
agttctggtagtctgtcaattcggagagtttagaaaaaactaccggttgttgatgacccaaggacgatatccggg

SEQ ID NO: 259590 - DNA, 75 bp, Artificial Sequence
  Synthetic
tctattacaatacgcttttctcaaatgagatgaaccctccacagcgacatttcggacctacaccaacacagtttc

SEQ ID NO: 259591 - DNA, 75 bp, Artificial Sequence
  Synthetic
gactcatacatcaggaacaccgggcttactgcattcttcctgacactcaagtacggaatcaacaccaagacatca

SEQ ID NO: 259592 - DNA, 75 bp, Artificial Sequence
  Synthetic
ttacgggtagaagagagacattcagagaccaagacgtatcatcaaggtctccgttctcccctctaccaagcagat

SEQ ID NO: 259593 - DNA, 75 bp, Artificial Sequence
  Synthetic
tcccgcaaggcaagaccaaagcattaagcacagcgtgggagaagcatgggggcacccaaccgccggccaaccagg

SEQ ID NO: 259594 - DNA, 75 bp, Artificial Sequence
  Synthetic
aagcacagcgtgggagaagcatgggggcacccaaccgccggccaaccaggacaccccggaccaacaggacagacc

SEQ ID NO: 259595 - DNA, 75 bp, Artificial Sequence
  Synthetic
tcattgggcagctacatgctgattcagcagagatttcacatgatgtcatgttgagagagtacaagagtttatctg

SEQ ID NO: 259596 - DNA, 75 bp, Artificial Sequence
  Synthetic
aaaattaaattctaatcctctgaagctcgtattcggattcaagcaattatctaaaagcagaagtgaacgtggttg

SEQ ID NO: 259597 - DNA, 75 bp, Artificial Sequence
  Synthetic
tggggtactactttcatctactcatgaatttattcactccatgttccacaaaaggatatatactctccaatggct

SEQ ID NO: 259598 - DNA, 75 bp, Artificial Sequence
  Synthetic
caccccggccgtgggagaagccggcgacacacagctcaagaccggggcaagcaactcgctgctgtcgatgctcga

SEQ ID NO: 259599 - DNA, 75 bp, Artificial Sequence
  Synthetic
gcaactcgctgctgtcgatgctcgacaaactcagcaataaatcatctaatgctaaaaagggcccacgatcgagtt

SEQ ID NO: 259600 - DNA, 75 bp, Artificial Sequence
  Synthetic
cgcggacccaggccggagctacacctggagaccgggtcacagacgcgaacacagcatatcctggacaatggaagg

SEQ ID NO: 259601 - DNA, 75 bp, Artificial Sequence
  Synthetic
gttgatagccatcacagctcacaacaggctcctgcctcattagtgtcacaaagaatccttcctgagctcctcccc

SEQ ID NO: 259602 - DNA, 75 bp, Artificial Sequence
  Synthetic
actgattgtcaaatcccagctcgcttccataaaatcatctcgactctctcatctgtagccgcgatccgcagcccc

SEQ ID NO: 259603 - DNA, 75 bp, Artificial Sequence
  Synthetic
tccataaaatcatctcgactctctcatctgtagccgcgatccgcagccccacctgaccggacccacaaacaaacc

SEQ ID NO: 259604 - DNA, 75 bp, Artificial Sequence
  Synthetic
taagaaacgtatcaccaactgcaaagagagggtttcctcaaaccgcaatcatgatccgaagagcaagaatcgtcg

SEQ ID NO: 259605 - DNA, 75 bp, Artificial Sequence
  Synthetic
gagagggtttcctcaaaccgcaatcatgatccgaagagcaagaatcgtcgaagagttgccacctttatcacgact

SEQ ID NO: 259606 - DNA, 75 bp, Artificial Sequence
  Synthetic
caatcaatctaacagcattagagattaagaaaaaatacgggtagaatcaaaataccccgattgtgccaaaatgga

SEQ ID NO: 259607 - DNA, 75 bp, Artificial Sequence
  Synthetic
ggtcgcccgatcccacccagttttaatttcaggtcctggagatccgtcaccttatgtgacccaagggggtgaaat

SEQ ID NO: 259608 - DNA, 75 bp, Artificial Sequence
  Synthetic
agcgtcttgactcgtggacagacagtaaggaagactcagtatttatcaccacctacggattcatcttccaaattg

SEQ ID NO: 259609 - DNA, 75 bp, Artificial Sequence
  Synthetic
tgcatccgagctcctcagctaagcttctgagtaagctagatgcagccgggtcaattgaggagatcaggaaaatca

SEQ ID NO: 259610 - DNA, 75 bp, Artificial Sequence
  Synthetic
aaagttggattctgactgtttgaaactcgtattcgggttcagttagttaactttaagcaggagcgcgcgtagttg

SEQ ID NO: 259611 - DNA, 75 bp, Artificial Sequence
  Synthetic
tcaacaagacagatccgataaacaaccgtccacacctgagcatgtgattccgcatgacggccagccaaccacatc

SEQ ID NO: 259612 - DNA, 75 bp, Artificial Sequence
  Synthetic
ctcgtattcgggttcagttagttaactttaagcaggagcgcgcgtagttgtccctaattatagtcctgtcattca

SEQ ID NO: 259613 - DNA, 75 bp, Artificial Sequence
  Synthetic
tgagcgcagcatgggagaagcatgggagcatccagccaccggccagtcaagacacccctgatcgacaggacagat

SEQ ID NO: 259614 - DNA, 75 bp, Artificial Sequence
  Synthetic
tgcagtgaagcatgtgaaagcacccgagaagatccctgggagcggaaccctagagtataaagtgaattttgtctc

SEQ ID NO: 259615 - DNA, 75 bp, Artificial Sequence
  Synthetic
cgctcccagcccccccccgcacacccaagcttcaacacctcaagtggtaaccccctcctacctctcccaccccac

SEQ ID NO: 259616 - DNA, 75 bp, Artificial Sequence
  Synthetic
tagagtataaagtgaattttgtctctttgactgtggtgccgaggaaggatgtctacaggatcccaactgcagcat

SEQ ID NO: 259617 - DNA, 75 bp, Artificial Sequence
  Synthetic
gctatcgatgctggacaagctcagcaataagtcatccaatgctaaaaagggcccatggtcaagcccccaagaagg

SEQ ID NO: 259618 - DNA, 75 bp, Artificial Sequence
  Synthetic
caaatcctccgccgaaaccccccccaaacaccccgacccgccggcccacacggccaaatcggcaggagcatcccc

SEQ ID NO: 259619 - DNA, 75 bp, Artificial Sequence
  Synthetic
cgaactaagctactggcaccttttttctctagcagcgggacagcctgctatcctatagcaaatgcctctcctcag

SEQ ID NO: 259620 - DNA, 75 bp, Artificial Sequence
  Synthetic
atcatggaagcaagctctgtaggtaggagaaagcaaattcaagggcttgttgacacaacaaacactgtgattaag

SEQ ID NO: 259621 - DNA, 75 bp, Artificial Sequence
  Synthetic
ggagaaagcaaattcaagggcttgttgacacaacaaacactgtgattaagattgcactgactaggaggcccctcg

SEQ ID NO: 259622 - DNA, 75 bp, Artificial Sequence
  Synthetic
acatcacaaggaacctgcaccaagcctctctctgcagacctaagatccaacattccaaatggcaatcctcccccg

SEQ ID NO: 259623 - DNA, 75 bp, Artificial Sequence
  Synthetic
attgcactgactaggaggcccctcggtatcaaaaggctgatgcggataatcaattattctagcatgcatgcaatg

SEQ ID NO: 259624 - DNA, 75 bp, Artificial Sequence
  Synthetic
aagcacgtgaaggcaccagagaagatccctgggagcggaaccctagaatacaaagtgaactttgtatctctgact

SEQ ID NO: 259625 - DNA, 75 bp, Artificial Sequence
  Synthetic
aagtgacttacgagcagttgcccgatctcacccagttttagtttcaggccccggagatccatctccttatgtcac

SEQ ID NO: 259626 - DNA, 75 bp, Artificial Sequence
  Synthetic
ccaggtcggaaatgaggaagccactgtcggtatgatcaatgataatcccaagcgcgagttactttccgctgcaat

SEQ ID NO: 259627 - DNA, 75 bp, Artificial Sequence
  Synthetic
ttcacctgtctatctaattagaaaaaacacgggtagaagagtctggatcccggctggcacattcaaggtgcaaca

SEQ ID NO: 259628 - DNA, 75 bp, Artificial Sequence
  Synthetic
aataggcgggcctgatataggagtagagaaggacactgtccgtgcactgatcatgtcacgcccgatgcacccgag

SEQ ID NO: 259629 - DNA, 75 bp, Artificial Sequence
  Synthetic
aacacgggtagaagagtctggatcccggctggcacattcaaggtgcaacatgggctccaaaccttctaccaggat

SEQ ID NO: 259630 - DNA, 75 bp, Artificial Sequence
  Synthetic
aggttacctctactaagatagagaagaagcacaccattgctaagtacaatcctttcaagaagtaggttgcatctc

SEQ ID NO: 259631 - DNA, 75 bp, Artificial Sequence
  Synthetic
ctcttcagccaaactcctgagtaagctagatgcagccgggtcaatcgaagaaatcagaaaaatcaagcgccttgc

SEQ ID NO: 259632 - DNA, 75 bp, Artificial Sequence
  Synthetic
aagtagacccgaaaagtccgttagtcagatccctcactgaatctgccaatggatactacgctaatctctttttgc

SEQ ID NO: 259633 - DNA, 75 bp, Artificial Sequence
  Synthetic
tccctgggagcggaaccctagaatacaaagtgaactttgtatctctgactgtggtgcctagaaaggacatctata

SEQ ID NO: 259634 - DNA, 75 bp, Artificial Sequence
  Synthetic
ggctcaatctatccatcgggctcagtgatgtgctcggaccttccgtgcttgtgaaggcaaggggtgcacgaacta

SEQ ID NO: 259635 - DNA, 75 bp, Artificial Sequence
  Synthetic
caacagaacactgaccactttactcaccccccttggtgattccatccgcaggatacaagggtctgtgtccacatc

SEQ ID NO: 259636 - DNA, 75 bp, Artificial Sequence
  Synthetic
agaatcggagtgccccgattgtgccaagatggattcatctaggacaatcgggctataccttgattctgcccttcc

SEQ ID NO: 259637 - DNA, 75 bp, Artificial Sequence
  Synthetic
taggatccagcgtcttgactcgtggaccgatagtaaagaagattcggtattcatcaccacctatggattcatctt

SEQ ID NO: 259638 - DNA, 75 bp, Artificial Sequence
  Synthetic
actattgctaaatataatcctttcaagaagtaggctacatctccgatgctgctctccgactgcttccctagatca

SEQ ID NO: 259639 - DNA, 75 bp, Artificial Sequence
  Synthetic
atctctctacagggtgtcaccttatattcacatatccaatgattctcaaaggctattcactgaagaaggagtcaa

SEQ ID NO: 259640 - DNA, 75 bp, Artificial Sequence
  Synthetic
gtttgttaatgaccaatttaataatacggcacgagaattggactgtataaaaattacacaacaagtcggtataga

SEQ ID NO: 259641 - DNA, 75 bp, Artificial Sequence
  Synthetic
gagagaatggttttctcagtggtacaggcaccccaagtgctacaaagctgcagggttgtggcaaacaaatactcg

SEQ ID NO: 259642 - DNA, 75 bp, Artificial Sequence
  Synthetic
gacaactcagatcattgccagccacattgacacagtcattcggtctgtgatttacatggaggctgagggtgacct

SEQ ID NO: 259643 - DNA, 75 bp, Artificial Sequence
  Synthetic
cgcagcattgaaggtttctggttcgagtctgtataatcttgcgctcaatgtcaccattgatgtggaggtggaccc

SEQ ID NO: 259644 - DNA, 75 bp, Artificial Sequence
  Synthetic
cttgtcccgaaggtagtgacacaagtcggctccgtgatagaagaactcgacacctcatactgtatagagtctgat

SEQ ID NO: 259645 - DNA, 75 bp, Artificial Sequence
  Synthetic
ttggcgattctatccgtaggatacaagagtctgcgactacctctggaggaaggaggcggagacgctttgtaggtg

SEQ ID NO: 259646 - DNA, 75 bp, Artificial Sequence
  Synthetic
agtctgtataatcttgcgctcaatgtcaccattgatgtggaggtggacccgaagagtccgctggttaaatcacta

SEQ ID NO: 259647 - DNA, 75 bp, Artificial Sequence
  Synthetic
cttagtactcagaggtgcggtttctctagaggacctcatcccattaaggacatacctgaagcgcagtacctgccc

SEQ ID NO: 259648 - DNA, 75 bp, Artificial Sequence
  Synthetic
aattgcaaaataacaacatgcaggtgtgcagaccccccaagtatcatatcgcaaaactatggagaagctgtatct

SEQ ID NO: 259649 - DNA, 75 bp, Artificial Sequence
  Synthetic
gcaaaactatggagaagctgtatctctgatagatagacattcatgcaatgtcttatcattagacgggataactct

SEQ ID NO: 259650 - DNA, 75 bp, Artificial Sequence
  Synthetic
acctttcttctctagcagtggaacagcctgctaccccatagcaaatgcctctcctcaggtagccaagatactctg

SEQ ID NO: 259651 - DNA, 75 bp, Artificial Sequence
  Synthetic
gaggctcagtggggaatttgatgcaacttatcaaaagaatatctcaatactagattctcaagtcatcgtgacagg

SEQ ID NO: 259652 - DNA, 75 bp, Artificial Sequence
  Synthetic
caaccttgatatatcaaccgagcttggaaatgtcaacaattcaataagcaatgccctggacaggttagcagaaag

SEQ ID NO: 259653 - DNA, 75 bp, Artificial Sequence
  Synthetic
tgaccatgaggttacctctaccaagctggaaaaggggcataccattgccaaatacaatcctttcagaaaataggc

SEQ ID NO: 259654 - DNA, 75 bp, Artificial Sequence
  Synthetic
aaaagaagatccaaattcacaacacgaggtatggagacctgttcgccaggctgtgcacgcacgttgaaaagaaat

SEQ ID NO: 259655 - DNA, 75 bp, Artificial Sequence
  Synthetic
tgtacaaacaaaaggcacaacaaaagactttactatggcttgggaataataccctcgatcagatgagagccacta

SEQ ID NO: 259656 - DNA, 75 bp, Artificial Sequence
  Synthetic
atagttagtttacctgtctatcagattagaaaaaacacgggtagaagattctggatcccagttggcgcctccagg

SEQ ID NO: 259657 - DNA, 75 bp, Artificial Sequence
  Synthetic
caagtttgcatggctccatataaaacagatccagaggcacctgattgtagcagcaagaacaaggtctgcagtcaa

SEQ ID NO: 259658 - DNA, 75 bp, Artificial Sequence
  Synthetic
gcggatcatttccacccacctgtagactttgtgcaagcgatgatgtctattatggaggggatttcccaaagagta

SEQ ID NO: 259659 - DNA, 75 bp, Artificial Sequence
  Synthetic
atggaagacttaagaaaaaactattagatataggcaaccgaaaagcaatacacgggtagaacggtcgaaaaagct

SEQ ID NO: 259660 - DNA, 75 bp, Artificial Sequence
  Synthetic
cttgatggcaggcctctagcagctgcaggaattgtggtaacaggagacaaggcagtcaacatatatacctcatct

SEQ ID NO: 259661 - DNA, 75 bp, Artificial Sequence
  Synthetic
tgcagttagcagagttgtgctagagaatgaagaaagagaagcaaagaacacatggcgcttggttttccggatcgc

SEQ ID NO: 259662 - DNA, 75 bp, Artificial Sequence
  Synthetic
agatgataacatgtagatgtgcggaccccccgggcatcataacgcaacattacggagaagctgtgtctttaatag

SEQ ID NO: 259663 - DNA, 75 bp, Artificial Sequence
  Synthetic
ttagctatctctgcagccgccctggtatacagcatgggggctagtacgccgcgcgacctcgtaggcatatcgact

SEQ ID NO: 259664 - DNA, 75 bp, Artificial Sequence
  Synthetic
gtccaagagttccgtccattatggagagaaaatacagaggaaagcgacctgacctcagataaagcagtggggtat

SEQ ID NO: 259665 - DNA, 75 bp, Artificial Sequence
  Synthetic
ttaacaactcaataagcaagaccttgaataagttagaggaaagcaacagcaaactagacagagttaatgtcaaac

SEQ ID NO: 259666 - DNA, 75 bp, Artificial Sequence
  Synthetic
tgcatgaggtcactgacggattatcgcagctcgcagtggccgttgggaagatgcagcaatttgttaatgaccaat

SEQ ID NO: 259667 - DNA, 75 bp, Artificial Sequence
  Synthetic
tcaatacttagcacttggtgtgcttcggacatctgcaacagggagggtattcttttctactctgcgttccatcaa

SEQ ID NO: 259668 - DNA, 75 bp, Artificial Sequence
  Synthetic
cggacatctgcaacagggagggtattcttttctactctgcgttccatcaatttagatgacacccaaaatcggaag

SEQ ID NO: 259669 - DNA, 75 bp, Artificial Sequence
  Synthetic
aacaatcagctcagttcattaattggtagcggcttgatcaccggcaaccctattctgtatgactcacaaactcaa

SEQ ID NO: 259670 - DNA, 75 bp, Artificial Sequence
  Synthetic
attccggtggcctgctgattataagaatttagaaaaaactactggacatgagttaaaatagggcaatgcacgggt

SEQ ID NO: 259671 - DNA, 75 bp, Artificial Sequence
  Synthetic
tcttgcagtgtgagtgcaactcctctaggttgtgatatactgtgctctaaagtcacagagactgaagaagaggat

SEQ ID NO: 259672 - DNA, 75 bp, Artificial Sequence
  Synthetic
ttcagcctgccttcacagggccatcccaaatcctccgccggaaccctccaaaaattccccgacccaccggcccac

SEQ ID NO: 259673 - DNA, 75 bp, Artificial Sequence
  Synthetic
aatttagaaaaaactactggacatgagttaaaatagggcaatgcacgggtagaacggtcgaaggagccacccctc

SEQ ID NO: 259674 - DNA, 75 bp, Artificial Sequence
  Synthetic
tggtgcacggaaggttaggttttgacggtcaataccatgagaaggacttagacatcacagtcttatttaaggatt

SEQ ID NO: 259675 - DNA, 75 bp, Artificial Sequence
  Synthetic
gactcaggtcggttctgtgatagaagaacttgacacctcatattgtatagaaaccgacttggacttatattgtac

SEQ ID NO: 259676 - DNA, 75 bp, Artificial Sequence
  Synthetic
cacgggcacaacccaatccaccaacaatccgtgcagaacccgaaatattagaaaaaaatacgggtagaagagaga

SEQ ID NO: 259677 - DNA, 75 bp, Artificial Sequence
  Synthetic
gcaatacatcggcctgcatgtactcaaagactgaaggcgcacttactacaccatatatgactctcaaaggctcag

SEQ ID NO: 259678 - DNA, 75 bp, Artificial Sequence
  Synthetic
taaaacctaattcgcctagcgacactgcacaagaagggaaatatgtaatatacaagcgctataataacacatgcc

SEQ ID NO: 259679 - DNA, 75 bp, Artificial Sequence
  Synthetic
gaaaaaaatacgggtagaagagagacactcagagatcaggacgagtcaccaaggtctccactctcccctctaccc

SEQ ID NO: 259680 - DNA, 75 bp, Artificial Sequence
  Synthetic
ggccggttcggtggaaagcgcgtacagcaagccatcttatctatcaaagtgtcaacatctttgggtgaggacccg

SEQ ID NO: 259681 - DNA, 75 bp, Artificial Sequence
  Synthetic
agcaagccatcttatctatcaaagtgtcaacatctttgggtgaggacccggtgttgactgttccgcctaatacaa

SEQ ID NO: 259682 - DNA, 75 bp, Artificial Sequence
  Synthetic
taagagaggccgcaatacggcaggtgggagctccacatattacaacttagtaggggatgtagactcgtacatcag

SEQ ID NO: 259683 - DNA, 75 bp, Artificial Sequence
  Synthetic
gtcaacatctttgggtgaggacccggtgttgactgttccgcctaatacaattacactcatgggggccgaaggcag

SEQ ID NO: 259684 - DNA, 75 bp, Artificial Sequence
  Synthetic
ttacactcatgggggccgaaggcagagttctcacagtagggacatctcatttcttgtaccaacgagggtcttcgt

SEQ ID NO: 259685 - DNA, 75 bp, Artificial Sequence
  Synthetic
ttgatgcaacttatcagaagaatatctcaatacaggactctcaagtaatagtaacaggcaatcttgatatctcaa

SEQ ID NO: 259686 - DNA, 75 bp, Artificial Sequence
  Synthetic
agacaaggagcacttatatctctattgtgctctcactcgcaagtgatgaggaaccatgtggcactggctggaagg

SEQ ID NO: 259687 - DNA, 75 bp, Artificial Sequence
  Synthetic
cagcttgcatgtactcaaagactgaaggcgcactcaatacgccatatatggccctcaaaggctcagtcattgcca

SEQ ID NO: 259688 - DNA, 75 bp, Artificial Sequence
  Synthetic
cgctccccactcaggccgcaggtgatgccggcgatacacagctcaagaccggagcaagcaactctcttttgtcaa

SEQ ID NO: 259689 - DNA, 75 bp, Artificial Sequence
  Synthetic
ctacttgatgtacaagcagaaggcacaacaaaagaccttgttatggcttgggaataataccctagatcagatgag

SEQ ID NO: 259690 - DNA, 75 bp, Artificial Sequence
  Synthetic
ccataggaatcataccttgcgaggggtcttcgggacaatgcttgatgatgaacaagcaagactcaaccccgtatc

SEQ ID NO: 259691 - DNA, 75 bp, Artificial Sequence
  Synthetic
gtcttcgggacaatgcttgatgatgaacaagcaagactcaaccccgtatctgcagtattcgacaacatatcccgc

SEQ ID NO: 259692 - DNA, 75 bp, Artificial Sequence
  Synthetic
aacctctggcccaacaacacgggaatcagtcgagccgtggaaacaaccaggaaggaccgcagcaccaggccaaag

SEQ ID NO: 259693 - DNA, 75 bp, Artificial Sequence
  Synthetic
tccgtcaattaggagaagttagaaaaaactgtcggatgtagatgaccaaagggcaacatacgggtagaacggtct

SEQ ID NO: 259694 - DNA, 75 bp, Artificial Sequence
  Synthetic
atcgacatgttttaaagttgtcaagaccaataaagcttattgtcttagcattgcagaaatatctaataccctatt

SEQ ID NO: 259695 - DNA, 75 bp, Artificial Sequence
  Synthetic
ccaaatcccccgcccgaacccctccctcactccccgacccacagcctcgcatggccgagccaacgacagcactcc

SEQ ID NO: 259696 - DNA, 75 bp, Artificial Sequence
  Synthetic
aaagaatacatggcgcttggtattcaggatcgcaattctacttttaacagtagtgactctagccatatctgcagc

SEQ ID NO: 259697 - DNA, 75 bp, Artificial Sequence
  Synthetic
gaaaaaaatacgggtagaagagagacgcccagagaccaagacaagtcaccaaggtctctgttctcccttctaccc

SEQ ID NO: 259698 - DNA, 75 bp, Artificial Sequence
  Synthetic
ggaaaagattacatctgcactaggttccaaccaagatgtagtagataggatatacaagcaggtggcccttgagtc

SEQ ID NO: 259699 - DNA, 75 bp, Artificial Sequence
  Synthetic
agttttagtttcgggccccggagatccatccctttacgtgacacaaaggggtgaaatgacactcaataaactctc

SEQ ID NO: 259700 - DNA, 75 bp, Artificial Sequence
  Synthetic
gtgaaatgacactcaataaactctcgcaaccggtacagcacccttctgagttaattaaatctgccatggtaagcg

SEQ ID NO: 259701 - DNA, 75 bp, Artificial Sequence
  Synthetic
tccgttggcattgctaaacaccgaatccacaatcatgaacgcaataacatctctctcgtatcagatcaatggagc

SEQ ID NO: 259702 - DNA, 75 bp, Artificial Sequence
  Synthetic
atcctaccagagtcacatctatcctctccattggtcaagcacaaactgctctactactggaaattaactgggcta

SEQ ID NO: 259703 - DNA, 75 bp, Artificial Sequence
  Synthetic
ggcccgacatgggagtggagaaggaaactgtccgtgcattaattacatcgcgcccgatgcatccaagctcctcgg

SEQ ID NO: 259704 - DNA, 75 bp, Artificial Sequence
  Synthetic
ggcgcaatccagcaaggcgatacaaaagcactgagcacagcacgggagaaacacggagacatccaatcacccgct

SEQ ID NO: 259705 - DNA, 75 bp, Artificial Sequence
  Synthetic
ccacacagccccaagaggatgcaaacgaatcccaactcaaaacaggggcaagcagctcattactctctatgctcg

SEQ ID NO: 259706 - DNA, 75 bp, Artificial Sequence
  Synthetic
gggggataggtaaagagctcattgtagatgatgccagtgacgtcacatcattctatccctctgcatttcaagaac

SEQ ID NO: 259707 - DNA, 75 bp, Artificial Sequence
  Synthetic
cggttgcagtgatggaagcaaacctaggaatgatgaagattctagaccccggttgtgcaaacgtgtcctctctaa

SEQ ID NO: 259708 - DNA, 75 bp, Artificial Sequence
  Synthetic
agtcttatttgagacttgctcaaaccctttattatcaggagtacacacagaggacaatgaagcagaagagaaggc

SEQ ID NO: 259709 - DNA, 75 bp, Artificial Sequence
  Synthetic
aggctcccgcctcaccagtgccgcaaagaatccctcccgaaccttccccaacagacccgtgccccaacaccccaa

SEQ ID NO: 259710 - DNA, 75 bp, Artificial Sequence
  Synthetic
gaaaagaagatccaaattcacaacacaaggtatggagacctgttcgccaagctgtgcacgcatgttgaaaagaaa

SEQ ID NO: 259711 - DNA, 75 bp, Artificial Sequence
  Synthetic
gagggtattcttttctactctgcgttccatcaatctggatgacacccaaaatcggaagtcttgcagtgtgagtgc

SEQ ID NO: 259712 - DNA, 75 bp, Artificial Sequence
  Synthetic
taagaaaaaatacgggtagaatcaaagtaccccaactgtgccaaaatggactcatccagaacaatcgggctgtac

SEQ ID NO: 259713 - DNA, 75 bp, Artificial Sequence
  Synthetic
ttcaggatcgtccctttactagtggagattctcaaggatggcaggacttgaaatgcaaggttcggccagttggat

SEQ ID NO: 259714 - DNA, 75 bp, Artificial Sequence
  Synthetic
aggacctagacgtcacaacattatttggggactgggtggcaaattatccaggagtagggggtgggtcctttattg

SEQ ID NO: 259715 - DNA, 75 bp, Artificial Sequence
  Synthetic
catgagtctggctcctacaccgctgatcacccaaaatcagctagtgtcaataagattaatctcaatcctattgat

SEQ ID NO: 259716 - DNA, 75 bp, Artificial Sequence
  Synthetic
taagattaatctcaatcctattgatagtcgcctagttaagaaaaaacataagtggtattgagacgcacagctgaa

SEQ ID NO: 259717 - DNA, 75 bp, Artificial Sequence
  Synthetic
tgtgaatgcagtaaagcatgtgaaggctcctgagaagataccgggcagcgggacacttgaatacaagataaattt

SEQ ID NO: 259718 - DNA, 75 bp, Artificial Sequence
  Synthetic
cacatgcccagatgaacaagactaccagattcgaatggccaaatcttcatataagcctgggcggtttggcgggaa

SEQ ID NO: 259719 - DNA, 75 bp, Artificial Sequence
  Synthetic
gaaggcagagttctcacagtaggaacatcgcatttcttgtatcagcgagggtcatcatacttctcccctgctcta

SEQ ID NO: 259720 - DNA, 75 bp, Artificial Sequence
  Synthetic
ggtagtgtcccttgccaggcttcagcaagatgccccaactcatgtgttaccggagtctatactgatccatatccc

SEQ ID NO: 259721 - DNA, 75 bp, Artificial Sequence
  Synthetic
atcctccaggtattatctttctttaagggaacaatcatcaatggatacaggaagaagaattcaggtgtgtggcca

SEQ ID NO: 259722 - DNA, 75 bp, Artificial Sequence
  Synthetic
agtgccctgactgtgccaaaatggactcatccaggacaatcggactgtactttgattctgcccttccctccagca

SEQ ID NO: 259723 - DNA, 75 bp, Artificial Sequence
  Synthetic
tgtgcttgtgaaggcgagaggtgcacggactaagctactggcaccttttttctctagcagcgggacagcctgcta

SEQ ID NO: 259724 - DNA, 75 bp, Artificial Sequence
  Synthetic
tgcgaggagtattcgggacaatgcttgatgatgaacaggcaagacttaaccccgtgtctgcagtatttgatagca

SEQ ID NO: 259725 - DNA, 75 bp, Artificial Sequence
  Synthetic
tagttgagattcttaaggatgatagggtttaagaagctagatctggctggttgagtcgaatagaggatggttggg

SEQ ID NO: 259726 - DNA, 75 bp, Artificial Sequence
  Synthetic
ttgtcaagactaataaaacctattgtctcagcattgctgagatatctaatactctcttcggggagttcagaatcg

SEQ ID NO: 259727 - DNA, 75 bp, Artificial Sequence
  Synthetic
tagatagcacgggtaggacatggcgagctccggtcccgaaagggcagagcatcagattatcctaccagagtcaca

SEQ ID NO: 259728 - DNA, 75 bp, Artificial Sequence
  Synthetic
agctccggtcccgaaagggcagagcatcagattatcctaccagagtcacacctgtcttcaccgctggtcaagcac

SEQ ID NO: 259729 - DNA, 75 bp, Artificial Sequence
  Synthetic
tcgtcgaagagttgccacttttatcacgactgacctgcaaaagtattgtcttaactggagatatcagacagttaa

SEQ ID NO: 259730 - DNA, 75 bp, Artificial Sequence
  Synthetic
attggtgctaatatcaggcgaccttagtgaaaacactgtaatgtcctgtgccaacattgcatccactgtagcacg

SEQ ID NO: 259731 - DNA, 75 bp, Artificial Sequence
  Synthetic
agaagaaattgctggggccatcttggtctaacaatgtcccccggtcagaggagttcaactgcatccgtgcagatc

SEQ ID NO: 259732 - DNA, 75 bp, Artificial Sequence
  Synthetic
ggagagaggggtcagccaggttgcactcgagaatgatgaaagggaggcaaaaaacacatggaggttggtgttcag

SEQ ID NO: 259733 - DNA, 75 bp, Artificial Sequence
  Synthetic
cctcccctgctttaactcagctgactatccaggcactttataatttagccggtggcaatatggattacctgttga

SEQ ID NO: 259734 - DNA, 75 bp, Artificial Sequence
  Synthetic
gaatacgagcagctcctcgctgctcagacccgccctaacggaactcacggaggaggagagaaagggagcacttta

SEQ ID NO: 259735 - DNA, 75 bp, Artificial Sequence
  Synthetic
gttagtggatgctctggcaaaagatttgggcaatcaagtctacgacgttgtagcattaatggagggatttgcata

SEQ ID NO: 259736 - DNA, 75 bp, Artificial Sequence
  Synthetic
aaagttgaggtcccagtatttactcttaacagtgatgatccagaggatagatggaattttgcggtattctgtctt

SEQ ID NO: 259737 - DNA, 75 bp, Artificial Sequence
  Synthetic
cattggctgaattcctactcaatcaagaagcggttcacccacgtgtcgcacatgctatcatggaagcaagctctg

SEQ ID NO: 259738 - DNA, 75 bp, Artificial Sequence
  Synthetic
atggaattttgcggtattctgtcttcggattgctgttagcgaggatgccaacaaaccactcaggcaaggtgctct

SEQ ID NO: 259739 - DNA, 75 bp, Artificial Sequence
  Synthetic
agaagcggttcacccacgtgtcgcacatgctatcatggaagcaagctctgtaggtaggagaaagcaaattcaagg

SEQ ID NO: 259740 - DNA, 75 bp, Artificial Sequence
  Synthetic
agacaccctaatcagtctcctccccaaggacatagcagaatccgtgactcatgcaatagccactgtgttctctgg

SEQ ID NO: 259741 - DNA, 75 bp, Artificial Sequence
  Synthetic
cggattgctgttagcgaggatgccaacaaaccactcaggcaaggtgctctcatatctctcctatgctcccattct

SEQ ID NO: 259742 - DNA, 75 bp, Artificial Sequence
  Synthetic
gataatcaattactcgagcatgcatgcaatgttattcagagatgatgttttcttgtctaatagatccaaccaccc

SEQ ID NO: 259743 - DNA, 75 bp, Artificial Sequence
  Synthetic
tgcggcaaaggcagttaggagccaaatgtgtgcaccgaaaatggtagactttgatatgatcctccaggtactgtc

SEQ ID NO: 259744 - DNA, 75 bp, Artificial Sequence
  Synthetic
atgtgtgcaccgaaaatggtagactttgatatgatcctccaggtactgtctttctttaaaggaacaatcatcaac

SEQ ID NO: 259745 - DNA, 75 bp, Artificial Sequence
  Synthetic
gtaacggtactccgttcgtcacagctggggttgaagatgatgcaccagaagatatcactgacactctggaaagaa

SEQ ID NO: 259746 - DNA, 75 bp, Artificial Sequence
  Synthetic
atgtttgtaggggacccctataatcctccgagcgatccaactgactgtgatctatcggaagtcccaaatgatgac

SEQ ID NO: 259747 - DNA, 75 bp, Artificial Sequence
  Synthetic
ggtcacagtagcaaaggccatgactgcatatgagacagcagatgagtcagaaacaagaagaatcaataagtatat

SEQ ID NO: 259748 - DNA, 75 bp, Artificial Sequence
  Synthetic
taagctatttacctcacagcagcatcgtgtagtagacatcctatccagccctttaccgagactaatgaagtattt

SEQ ID NO: 259749 - DNA, 75 bp, Artificial Sequence
  Synthetic
attgaagctgggggacagcccgtccgtccattctgtgcagagagtttagtgggcacattgacagatatgactcag

SEQ ID NO: 259750 - DNA, 75 bp, Artificial Sequence
  Synthetic
atacagcaggtgggagctccacatattacaacttagttggggatgtagactcatacatcagaaacaccgggctta

SEQ ID NO: 259751 - DNA, 75 bp, Artificial Sequence
  Synthetic
gataattggctcgcctcgtttaggcggaaccttctctctgaagaccagaagaaacatgttaaagaggcaacatca

SEQ ID NO: 259752 - DNA, 75 bp, Artificial Sequence
  Synthetic
acaacatccattccaccacattaccaatagcagatttcagttatggaccatgcagtcagcaaggttgcattagag

SEQ ID NO: 259753 - DNA, 75 bp, Artificial Sequence
  Synthetic
tttatcccggcgcccaccacaggttcaggctgcactcggataccctcattcgacatgagcgctacccactattgt

SEQ ID NO: 259754 - DNA, 75 bp, Artificial Sequence
  Synthetic
tcttggataagggaactggcaagtaccaattcgccagggactttatgagcacatcattctggagacttggggtag

SEQ ID NO: 259755 - DNA, 75 bp, Artificial Sequence
  Synthetic
gagtatgctggcgatgagtcaactatcttttaatagcaataagaagcgtatcactgactgcaaggaaagagtatc

SEQ ID NO: 259756 - DNA, 75 bp, Artificial Sequence
  Synthetic
tatgtccttacccctgcccagcttggggggctgagtaaccttcagtactcaaggctctacacaaggaatattggc

SEQ ID NO: 259757 - DNA, 75 bp, Artificial Sequence
  Synthetic
gacccggggactactgcctttgcagagatcaagagattggagactgtggggttattgagtcctagcattatgatt

SEQ ID NO: 259758 - DNA, 75 bp, Artificial Sequence
  Synthetic
agcaaaaatcgtcggagagttgccacctttataacaactgacctgcaaaagtactgtcttaattggagatatcag

SEQ ID NO: 259759 - DNA, 75 bp, Artificial Sequence
  Synthetic
ttgtcccaaaggtagtgacacaagtcggctctgtgatagaagaactcgacacctcatactgtatagagtctgatc

SEQ ID NO: 259760 - DNA, 75 bp, Artificial Sequence
  Synthetic
gagaccctttcaatcctccaagtgaccctactgactgtgatctttcaagagtcccaaatgatgacatatatattg

SEQ ID NO: 259761 - DNA, 75 bp, Artificial Sequence
  Synthetic
tctcaccccatcattcactcaaggttgaatgcagtaggtctaatcaaccatgacgggtcacaccagcttgcagac

SEQ ID NO: 259762 - DNA, 75 bp, Artificial Sequence
  Synthetic
tgcctgtatggtacagggtgacaatcaagtaatagctgtaacaagggaggttagatcagatgactccccagagat

SEQ ID NO: 259763 - DNA, 75 bp, Artificial Sequence
  Synthetic
tgacgggtcacaccagcttgcagacacagatttcattgaaatgtctgcgaaattgttagtctcttgcactcgacg

SEQ ID NO: 259764 - DNA, 75 bp, Artificial Sequence
  Synthetic
acagggtcatctcaaatcctctgcccaagactctcccacactccccgactcacaaccccgcatgacaaaaccaac

SEQ ID NO: 259765 - DNA, 75 bp, Artificial Sequence
  Synthetic
tccatgttaatcatttgattggccataatttgaaggatcgtgaaaccatcaggtcagacacattcttcatataca

SEQ ID NO: 259766 - DNA, 75 bp, Artificial Sequence
  Synthetic
ttatgctgtctgtatacagtactttttgctacaacaagagagatcccaaaaataaggggcctgtcagcggaagaa

SEQ ID NO: 259767 - DNA, 75 bp, Artificial Sequence
  Synthetic
gcttaggtccgaacaagtgagctctatcatgtctcccaacataattacgttcccagccaatctatattacatgtc

SEQ ID NO: 259768 - DNA, 75 bp, Artificial Sequence
  Synthetic
gtagcacgactatgtgagaacgggcttcctaaggacttctgttattatttaaactacctaatgagttgcgtgcag

SEQ ID NO: 259769 - DNA, 75 bp, Artificial Sequence
  Synthetic
tggccaagggttaaagcacacaccatatacgggaaggtaattgctcaattgcatgccgactctgccgagatatct

SEQ ID NO: 259770 - DNA, 75 bp, Artificial Sequence
  Synthetic
agccacacgccagccaggacacccccgaccaacaagccagatcagacaaacagtcatccacacctgagcaggcga

SEQ ID NO: 259771 - DNA, 75 bp, Artificial Sequence
  Synthetic
gttagtctgggcttatggggacaacgaagtaaattggactgctgctctcaagattgcaaggtctcgatgcaacat

SEQ ID NO: 259772 - DNA, 75 bp, Artificial Sequence
  Synthetic
ttagtacggtatttgttcagaggaatagggactgcttcatcttcttggtataaggtatctcatcttctttctgtc

SEQ ID NO: 259773 - DNA, 75 bp, Artificial Sequence
  Synthetic
agctcaagaccggagcaagcaactctcttctgtccatgcttgacaagctgagcaataaatcgtccaatgctaaaa

SEQ ID NO: 259774 - DNA, 75 bp, Artificial Sequence
  Synthetic
atactgatccgtaccctttggtcttctataggaatcataccttgcgaggggtcttcgggacaatgcttgatgatg

SEQ ID NO: 259775 - DNA, 75 bp, Artificial Sequence
  Synthetic
tggcataacccagatgacatttacccctgcatctctctacagagtatcaccttacattcacatatccaatgattc

SEQ ID NO: 259776 - DNA, 75 bp, Artificial Sequence
  Synthetic
tgagatgaaccccccacagcgacatttcggaccgaccccaacacagtttctaaattcggtcgtttataggaatct

SEQ ID NO: 259777 - DNA, 75 bp, Artificial Sequence
  Synthetic
ggagaaggcattggctgaattcttgctcaatcaagaagtgattcatccccgtgtcgcgcatgccatcatggaagc

SEQ ID NO: 259778 - DNA, 75 bp, Artificial Sequence
  Synthetic
ctgtatcagggaagcacctgttgcagttcctttcgagctgctcgggttggcgccagaactaagggcagttacttc

SEQ ID NO: 259779 - DNA, 75 bp, Artificial Sequence
  Synthetic
gagctcaagaagctagatctggctagttgagtcgaatggaggatggttgggaggatgatgctgcatcaaccatct

SEQ ID NO: 259780 - DNA, 75 bp, Artificial Sequence
  Synthetic
aaacagacatcctccatccccatgatgcgatctgaaatccaacagcttaaaacatctgttgcgatcatggaagcc

SEQ ID NO: 259781 - DNA, 75 bp, Artificial Sequence
  Synthetic
tgcgatctgaaatccaacagcttaaaacatctgttgcgatcatggaagccaacttaggcatgatgaaaattctgg

SEQ ID NO: 259782 - DNA, 75 bp, Artificial Sequence
  Synthetic
gtgatcatcaaagtactgtatgtaatgggatactactttcatctactcatgaatttattcactccatgttccaca

SEQ ID NO: 259783 - DNA, 75 bp, Artificial Sequence
  Synthetic
gaatttattcactccatgttccacaaaaggatatattctctctaatggctatgcctgtagaggggatatggagtg

SEQ ID NO: 259784 - DNA, 75 bp, Artificial Sequence
  Synthetic
cttaagtgatctccgggcagtagcccgatcccacccagttttaatttcaggccctggagacccatctccttacgt

SEQ ID NO: 259785 - DNA, 75 bp, Artificial Sequence
  Synthetic
tcagatgtggtccgcctgttcgagtatgcggcacttgaagtgctcctcgactgttcttatcaactttactatttg

SEQ ID NO: 259786 - DNA, 75 bp, Artificial Sequence
  Synthetic
gttccatctcccgagcaatatagaattgaccgatgacaccagtaagaatcctccgatgagagtaccatatctcgg

SEQ ID NO: 259787 - DNA, 75 bp, Artificial Sequence
  Synthetic
cctgacattgagaggatgataaaactcgggcgggcagtgcatcagactctcaaccacaattccaagataaccgga

SEQ ID NO: 259788 - DNA, 75 bp, Artificial Sequence
  Synthetic
gtggagaaggacactgtccgtgcattaatcacctcgcgcccgatgcatccaagctcctcagctaagctcctgagc

SEQ ID NO: 259789 - DNA, 75 bp, Artificial Sequence
  Synthetic
gagggcatcatctgtgttgatatgggcttacggggacaatgaagtaaattggactgctgctcttaagatcgcaag

SEQ ID NO: 259790 - DNA, 75 bp, Artificial Sequence
  Synthetic
aagagatcaggaagatcaaacgccttgcgctgaatggttgattgccattacaacttacaacaggctcccgcctct

SEQ ID NO: 259791 - DNA, 75 bp, Artificial Sequence
  Synthetic
gggtatcaccttacattcacatatccaatgattctcaaaggttattcactgaagaaggagtcaaagaggggaatg

SEQ ID NO: 259792 - DNA, 75 bp, Artificial Sequence
  Synthetic
ccaacattgcatctactatagcacggctatgtgaaaacgggcttcctaaggacttctgttattatttaaactacc

SEQ ID NO: 259793 - DNA, 75 bp, Artificial Sequence
  Synthetic
tcgggctgtactttgattctgccctcccttccagcagcctgttagcatttccgattgtcttacaagacacaggag

SEQ ID NO: 259794 - DNA, 75 bp, Artificial Sequence
  Synthetic
gctattccctcaagaaccattgcttgagttccctttggtacaagatattggtgctcgagtgaaggatccatttac

SEQ ID NO: 259795 - DNA, 75 bp, Artificial Sequence
  Synthetic
ccaggcacgagttactctcttctgcaatgctctgcttaggaagcgtcccgaacgacggagatcttgttgagctgg

SEQ ID NO: 259796 - DNA, 75 bp, Artificial Sequence
  Synthetic
gagttagacttgagtgccccagcaagatatgatgcgtttacacccagtcaggttcactctgaatacacattgctg

SEQ ID NO: 259797 - DNA, 75 bp, Artificial Sequence
  Synthetic
actgagagaatagtcttctcagtagtgcaggcacctcgggtgctgcaaagctgtatggttgtggcaaataggtac

SEQ ID NO: 259798 - DNA, 75 bp, Artificial Sequence
  Synthetic
atgccagcaacatggaccttccaacccagcaagcaggtgtcctgacagggctaagtgacagcacaccccctgctc

SEQ ID NO: 259799 - DNA, 75 bp, Artificial Sequence
  Synthetic
ctgtatggttgtggcaaataggtactcatcggtgaatgcagtgaagcatgtgaaagcaccagaaaagatccctgg

SEQ ID NO: 259800 - DNA, 75 bp, Artificial Sequence
  Synthetic
tctcatctcctttctgtacctgaggtcaggtgtgcaaggtatggaaactccttatacctggcggaaggaagtgga

SEQ ID NO: 259801 - DNA, 75 bp, Artificial Sequence
  Synthetic
cccggcctgtcttcacagagtcatatcaagccccccgcccaaaactctcccacactccccgacccacgaccccgc

SEQ ID NO: 259802 - DNA, 75 bp, Artificial Sequence
  Synthetic
cacaggcacaacttggtccgccaacaatccattcagagccccaggtattagaaaaaaatacgggtagaagagaga

SEQ ID NO: 259803 - DNA, 75 bp, Artificial Sequence
  Synthetic
gcttgtctggctatggtgataacatgcaaaaagagtgccacgaatacagagaggatggtcttctcggtggtgcaa

SEQ ID NO: 259804 - DNA, 75 bp, Artificial Sequence
  Synthetic
gcctagataatatcgtcttatacatgagtgatttgtataagaatatgccaggaatcctactttctaacattgcag

SEQ ID NO: 259805 - DNA, 75 bp, Artificial Sequence
  Synthetic
cgaccccaacacagttcctgaattcagttgtttacaggaatttacaagcggaagtaccatgcaaggatggatttg

SEQ ID NO: 259806 - DNA, 75 bp, Artificial Sequence
  Synthetic
cagagggctgtggctgtgactgcagaccacgaggtaacatccaccaagctggagaaagggcatactattgccaaa

SEQ ID NO: 259807 - DNA, 75 bp, Artificial Sequence
  Synthetic
ctccttgccccgctcggcgattcgattaggagaatccaagagtcggtaaccacatcaggaggagaacggcaggag

SEQ ID NO: 259808 - DNA, 75 bp, Artificial Sequence
  Synthetic
ttttacagacgcggagatagatgatatacttgagaccagtgggactgtcattgacagcataatcacggcccaggg

SEQ ID NO: 259809 - DNA, 75 bp, Artificial Sequence
  Synthetic
ttgcagatacggatttcattgaaatgtctgcaaaactgttagtctcttgcacccgacgtgtggtctcaggtttat

SEQ ID NO: 259810 - DNA, 75 bp, Artificial Sequence
  Synthetic
cacatcaggaggagaacggcaggagcgtttggtaggggcaataataggaggtgtcgcattaggtgtagccaccgc

SEQ ID NO: 259811 - DNA, 75 bp, Artificial Sequence
  Synthetic
actctctctcacctctcctaccccaccgaatgatcgcgcaaatgcaattaatccagcagcattagagattaagaa

SEQ ID NO: 259812 - DNA, 75 bp, Artificial Sequence
  Synthetic
gcacgggagcgtccagccacacgccagccaggacgctcctgagcaacaagacggaacagacaaacagccatccac

SEQ ID NO: 259813 - DNA, 75 bp, Artificial Sequence
  Synthetic
acagcctgctatcctatagcaaatgcctctccccaggttgctaagatactctggagccaaaccgcgcacctgcgg

SEQ ID NO: 259814 - DNA, 75 bp, Artificial Sequence
  Synthetic
cctctccccaggttgctaagatactctggagccaaaccgcgcacctgcggagtgtgaaagtcatcatccaagctg

SEQ ID NO: 259815 - DNA, 75 bp, Artificial Sequence
  Synthetic
atcccgaaaatacgaggcctgtctgcggaagagaaatgttcagtacttactgagtacctactgtctgatgctgtg

SEQ ID NO: 259816 - DNA, 75 bp, Artificial Sequence
  Synthetic
gaccggcgacacacagctcaagaccggagcaagcaactcccttctgtccatgcttgacaagctgagcaataaatc

SEQ ID NO: 259817 - DNA, 75 bp, Artificial Sequence
  Synthetic
cgtccgtatttgacgaatacgagcaactcctcgctgctcagactcgccctaatggagctcacggaggaggagaga

SEQ ID NO: 259818 - DNA, 75 bp, Artificial Sequence
  Synthetic
gctcctcgcggctcagactcgccctaatggagctcacggaggaggagagaaggggagcaccttaaaagttgaagt

SEQ ID NO: 259819 - DNA, 75 bp, Artificial Sequence
  Synthetic
agttgctcccgaatatgcccaaggataaagaggcgtgtgcaaaagccccattagaggcatacaacagaacactga

SEQ ID NO: 259820 - DNA, 75 bp, Artificial Sequence
  Synthetic
ttttcaaacgagatgaatcccccacagcgacatttcggaccgaccccaacacaatttttgaattcggttgtttat

SEQ ID NO: 259821 - DNA, 75 bp, Artificial Sequence
  Synthetic
cacgccccagttcaacaacaggagtggagtgtccgaggagagagcacagagattcatggtgatagccgggtctct

SEQ ID NO: 259822 - DNA, 75 bp, Artificial Sequence
  Synthetic
gtgtccacatctggaggaaggagacagaaacgctttataggtgccgttattggcagtgtagctcttggggttgca

SEQ ID NO: 259823 - DNA, 75 bp, Artificial Sequence
  Synthetic
gcaaccggtacagcatccttctgaactaattaagtctgccactgcaagcgggcctgacatgggagtagagaagga

SEQ ID NO: 259824 - DNA, 75 bp, Artificial Sequence
  Synthetic
ctgcattgtgacattgaaattcctccaggatccaatcaaagcttactagatcaactagctaccaatttgtctctg

SEQ ID NO: 259825 - DNA, 75 bp, Artificial Sequence
  Synthetic
gagagcattgctgcaaccaatgaagctgtgcatgaggtcaccgacggattatcacaactagcagtggcagttggg

SEQ ID NO: 259826 - DNA, 75 bp, Artificial Sequence
  Synthetic
ttgacagcataattacggcccagggcaaaccagctgagaccgctggaggaagcgcgatcccgcagggcaagacca

SEQ ID NO: 259827 - DNA, 75 bp, Artificial Sequence
  Synthetic
gagcagtggcgaacagcgtgcgggaagcgccaaatcctgtacagagcaccacccatccagaaccccccccgaccc

SEQ ID NO: 259828 - DNA, 75 bp, Artificial Sequence
  Synthetic
gttggtgtagaactcaacctatacctaactgaattgactacagtattcgggccacagatcacttcccctgcctta

SEQ ID NO: 259829 - DNA, 75 bp, Artificial Sequence
  Synthetic
acagaacagaaaaacagtcatccacacctgagcatacgactccacacaacaatccgccgatcacatccaccgaac

SEQ ID NO: 259830 - DNA, 75 bp, Artificial Sequence
  Synthetic
tgtacacgaggtggtgaggatggcaaaaactttagtacagcggcacggtacacttttgtctaaatcagatgagat

SEQ ID NO: 259831 - DNA, 75 bp, Artificial Sequence
  Synthetic
ccccgtatgtaggagcgcaattcaactcacgattagacaatctctggcagtccgcattttcttggttagcgagct

SEQ ID NO: 259832 - DNA, 75 bp, Artificial Sequence
  Synthetic
agggcaaccggatgccggggacggagagacccaattcttggatttgatgagagcggtggcaaatagcatgcgaga

SEQ ID NO: 259833 - DNA, 75 bp, Artificial Sequence
  Synthetic
taccctcagtcgggaacctaaataatatgcgtgccacctacttggagaccttatcggtaagcacaaccaaagggt

SEQ ID NO: 259834 - DNA, 75 bp, Artificial Sequence
  Synthetic
aaagtttttgagaaaaaatattgatactgcactgattgaagccgggggacaacccgtccgtccattctgtgcaga

SEQ ID NO: 259835 - DNA, 75 bp, Artificial Sequence
  Synthetic
ttgcctcagcacttgtcccgaaggtagtgacacaagtcggttccgtgatagaagaactcgacacctcatactgta

SEQ ID NO: 259836 - DNA, 75 bp, Artificial Sequence
  Synthetic
ccgaatcctccgcccgaacccctccctcactccccgacccacagcctcgcatggccgagccaacaaaagtacccc

SEQ ID NO: 259837 - DNA, 75 bp, Artificial Sequence
  Synthetic
tacaagaatagtgacattccccatgtctccaggtatttattcctgtttaagcggcaatacgtcagcttgcatgta

SEQ ID NO: 259838 - DNA, 75 bp, Artificial Sequence
  Synthetic
gaggcacaccattgccaagtacaatccctttaagaagtaagttgcatctctgagactgcgagccacccacttttc

SEQ ID NO: 259839 - DNA, 75 bp, Artificial Sequence
  Synthetic
cgggtgctgcaaagctgtatggttgtggcaaataggtactcatcagtgaatgcagtgaagcatgtgaaagcacca

SEQ ID NO: 259840 - DNA, 75 bp, Artificial Sequence
  Synthetic
cagttattgccaattgtaagataacaacatgtagatgtgcagaccctccaggtatcatatcgcaaaattatggag

SEQ ID NO: 259841 - DNA, 75 bp, Artificial Sequence
  Synthetic
aaacagtgcacgagacagatcttagaggtcacgatactaggtctcagagtcgaaaatctcaataaagtgggcgat

SEQ ID NO: 259842 - DNA, 75 bp, Artificial Sequence
  Synthetic
aacatgtagatgtgcagaccctccaggtatcatatcgcaaaattatggagaagctgtatctctgatagacagaca

SEQ ID NO: 259843 - DNA, 75 bp, Artificial Sequence
  Synthetic
tagagtataaagtgaattttgtctctttgactgtggtgccgagaagggacgtctacaggatcccaactgcagtat

SEQ ID NO: 259844 - DNA, 75 bp, Artificial Sequence
  Synthetic
agtccatgcagagccaaagatattagaaaaaaatacgggtagaagagagacgcccagagaccaggacaagtcacc

SEQ ID NO: 259845 - DNA, 75 bp, Artificial Sequence
  Synthetic
gagacttggagtagagtatgctcgggctcagggaagcagcatcaatgaggatatggctgccgagctaaagctgac

SEQ ID NO: 259846 - DNA, 75 bp, Artificial Sequence
  Synthetic
atacttgagaccagtggaaccgtcattgacagcataatcacggcccagggtaaatcaacagagaatttcggaagg

SEQ ID NO: 259847 - DNA, 75 bp, Artificial Sequence
  Synthetic
acttgccctaagtacttgaaggctgtcttaggtattactaaactcaaagaaatgtttacagacacctctttatta

SEQ ID NO: 259848 - DNA, 75 bp, Artificial Sequence
  Synthetic
tcaacaagctggggtcctcacagggctcagcgacggaggccctcaagccccacaaggtggactgaacaggtcgca

SEQ ID NO: 259849 - DNA, 75 bp, Artificial Sequence
  Synthetic
ctcagcgacggaggccctcaagccccacaaggtggactgaacaggtcgcaagggcaaccggacgccggagatggg

SEQ ID NO: 259850 - DNA, 75 bp, Artificial Sequence
  Synthetic
gtctacaggatcccaactgcagtattgaaagtatctggctcaagcctatacaatcttgcgctcaatgtcactatt

SEQ ID NO: 259851 - DNA, 75 bp, Artificial Sequence
  Synthetic
gactcttaatgacaatcgcatatcaataggctctccttctatctaattgcatccctgttgattcaattatactgt

SEQ ID NO: 259852 - DNA, 75 bp, Artificial Sequence
  Synthetic
agtcaggacacccctgaccaacaggatggatcagacaaacagccgtccacacccaagcaggcgacctcacacaac

SEQ ID NO: 259853 - DNA, 75 bp, Artificial Sequence
  Synthetic
ggccggcgacgcgcagctcaagaccggagcaagcaactctcttttgtccatgctcgacaagctgagcaataaatc

SEQ ID NO: 259854 - DNA, 75 bp, Artificial Sequence
  Synthetic
actcagcaggagcctccatctactcctgggccatctcaagacaacgacaccgactggggatactgaccgacaaca

SEQ ID NO: 259855 - DNA, 75 bp, Artificial Sequence
  Synthetic
ctgggccatctcaagacaacgacaccgactggggatactgaccgacaacactcagcctgcctccatcgaatcatc

SEQ ID NO: 259856 - DNA, 75 bp, Artificial Sequence
  Synthetic
gggttggcaccagaactaaggacggtaacctcaaataagttcatgtatgatcctagccctatatcagagagagat

SEQ ID NO: 259857 - DNA, 75 bp, Artificial Sequence
  Synthetic
tctcctcccccctccagccacacggctccaaccgcccaaaacaacacgggcacaactcgactcactcataatcta

SEQ ID NO: 259858 - DNA, 75 bp, Artificial Sequence
  Synthetic
ctccaaccgcccaaaacaacacgggcacaactcgactcactcataatctacacagagccgaagatcttagaaaaa

SEQ ID NO: 259859 - DNA, 75 bp, Artificial Sequence
  Synthetic
ggggcaaccagatgccggggatggggagacccaattcctggacttgatgagagcggtggcaaacagcatgcgaga

SEQ ID NO: 259860 - DNA, 75 bp, Artificial Sequence
  Synthetic
ctgggccatcccaagaaaacgacactgactgggggtactgatcgacaacacccagccccccttcacagggtcatc

SEQ ID NO: 259861 - DNA, 75 bp, Artificial Sequence
  Synthetic
ttcacctgtctagcaaattagaaaaaacacgggtagaagagtctggatcccaaccagcacattcaagacgcgaca

SEQ ID NO: 259862 - DNA, 75 bp, Artificial Sequence
  Synthetic
gtcatggaccgcgcagttaacagagttgtgctagagaatgaggaaagagaagcaaagaacacatggcgcttggtt

SEQ ID NO: 259863 - DNA, 75 bp, Artificial Sequence
  Synthetic
ccagagtgaagatggccaccttcacggatgcagagatcgacgatctatttgaaaccagtggaactgtcattgaca

SEQ ID NO: 259864 - DNA, 75 bp, Artificial Sequence
  Synthetic
tgaatgcagtaggtctggtcaaccatgacgggtcacaccagcttgcagacacagatttcattgaaatgtctgcga

SEQ ID NO: 259865 - DNA, 75 bp, Artificial Sequence
  Synthetic
ttgtgctagagaatgaggaaagagaagcaaagaacacatggcgcttggttttccggatcgcagtcttacttctaa

SEQ ID NO: 259866 - DNA, 75 bp, Artificial Sequence
  Synthetic
ctaagctcctgagtaagctggatgcagccgggtcgattgaggagatcaggaagatcaaacgccttgcgctgaatg

SEQ ID NO: 259867 - DNA, 75 bp, Artificial Sequence
  Synthetic
atcccacaaggcaaaactaaagcattgagtgcagcatgggagaaacatggaagcacccaaccgccggccggccaa

SEQ ID NO: 259868 - DNA, 75 bp, Artificial Sequence
  Synthetic
atatatacacctcgtctcagacagggtcaatcatagtcaagttgctcccgaatatgcccaaggataaagaggcgt

SEQ ID NO: 259869 - DNA, 75 bp, Artificial Sequence
  Synthetic
gccagcacgccgcgcgacctcgcaggtatatcgactgtgatctccaagacagaggataaggttacgtctttactc

SEQ ID NO: 259870 - DNA, 75 bp, Artificial Sequence
  Synthetic
agttcaagtcaagatgtgatagataggatatataagcaggtggctcttgaatccccgctggcgctactaaacact

SEQ ID NO: 259871 - DNA, 75 bp, Artificial Sequence
  Synthetic
agggatccgtcctaggcccctccccacaagtctacgctccagcactccaagtaacaaccctctctcacctcctct

SEQ ID NO: 259872 - DNA, 75 bp, Artificial Sequence
  Synthetic
gaatctataattatgaatgcaataacatccctctcttatcaaatcaacggggctgcgaataatagcgggtgtggg

SEQ ID NO: 259873 - DNA, 75 bp, Artificial Sequence
  Synthetic
ttttacagatgcggagatagacgatatatttgagactagtgggactgttattgacagcataattacagcccaggg

SEQ ID NO: 259874 - DNA, 75 bp, Artificial Sequence
  Synthetic
tgctaaaaagggcccacggtcgagtccccaggaagggcaccaccaacctccgacccagcagcaagggagtcaaca

SEQ ID NO: 259875 - DNA, 75 bp, Artificial Sequence
  Synthetic
agtagatgacactagtgatgtcacatcattctatccttctgcatatcaagaacacttgaattttatcccggcgcc

SEQ ID NO: 259876 - DNA, 75 bp, Artificial Sequence
  Synthetic
gtttgtcaatgaccagtttaataatacggcgcgagaattggactgtataaaaattacacaacaggttggtgtaga

SEQ ID NO: 259877 - DNA, 75 bp, Artificial Sequence
  Synthetic
tagggagtgtccctaatgacggagatctcgttgagctggcgagggcctgcctcactatggtggtaacgtgcaaga

SEQ ID NO: 259878 - DNA, 75 bp, Artificial Sequence
  Synthetic
gtggatcatgtccagctacctgtcgactttgtgcaggcgatgatgtctatgatggaggcgatatcacagaaggta

SEQ ID NO: 259879 - DNA, 75 bp, Artificial Sequence
  Synthetic
gggcatggcatcagtcttggataagggaactggtaaataccaattcgccagagacttcatgagtacatcattctg

SEQ ID NO: 259880 - DNA, 75 bp, Artificial Sequence
  Synthetic
actcagctcattaattggtagcggcttgatcactggctaccctatactgtatgactcacagactcaactcttggg

SEQ ID NO: 259881 - DNA, 75 bp, Artificial Sequence
  Synthetic
gtctacaggatcccaaccgcagcattgaaagtatctggctcgagcctgtacaatcttgcgctcaatgtcactatt

SEQ ID NO: 259882 - DNA, 75 bp, Artificial Sequence
  Synthetic
ggaactggtaaataccaattcgccagagacttcatgagtacatcattctggaggctcggggtggaatatgctcag

SEQ ID NO: 259883 - DNA, 75 bp, Artificial Sequence
  Synthetic
catacaagtaaatttgccctcagtcgggaacctaaataatatgcgtgccacctacttggagaccctatctgtaag

SEQ ID NO: 259884 - DNA, 75 bp, Artificial Sequence
  Synthetic
ttagggtttgacggtcaataccatgagaaggacttagacaccacagtcttatttaaggattgggtggcaaattac

SEQ ID NO: 259885 - DNA, 75 bp, Artificial Sequence
  Synthetic
cactgtccgtgcattaattacctcgcgcccgatgcatccaagctcctctgctaagctcctgagcaagctagatgc

SEQ ID NO: 259886 - DNA, 75 bp, Artificial Sequence
  Synthetic
gttgctgcccaacgagtatccgaggaaactggcaatgcggatattcctactcaacaggctggggtccttactggg

SEQ ID NO: 259887 - DNA, 75 bp, Artificial Sequence
  Synthetic
gcaattatctaaaagcagaagtgaacgtggttgtccttaattatagtcttgtcattcaccaaatctttgtttggt

SEQ ID NO: 259888 - DNA, 75 bp, Artificial Sequence
  Synthetic
ttcttacatatcgggcttatgtccactgtagataaaaagggaaagaaagtgacatttgacaagctggaaaggaag

SEQ ID NO: 259889 - DNA, 75 bp, Artificial Sequence
  Synthetic
agtttcaggccccggagacccatctccttatgtgacacaagggggtgaattgatactcaataaactctcgcaacc

SEQ ID NO: 259890 - DNA, 75 bp, Artificial Sequence
  Synthetic
atttaaggattgggtggcaaattacccgggagtaggaggtgggtcttttattgacgaccgtgtatggttcccagt

SEQ ID NO: 259891 - DNA, 75 bp, Artificial Sequence
  Synthetic
ggatacatcacatctgtggtgccctataggtctgtttcattactacattgtgatattgaaattcctccagggtcc

SEQ ID NO: 259892 - DNA, 75 bp, Artificial Sequence
  Synthetic
cccagccccccttcacagggccatcccaaaccccccgcccaaaacccccccacactctcagacccccagccccgc

SEQ ID NO: 259893 - DNA, 75 bp, Artificial Sequence
  Synthetic
acaggcggaagtgccatgcaaagatggatttgtccaggaattctgcccattatggagagagaatgcagaagaaag

SEQ ID NO: 259894 - DNA, 75 bp, Artificial Sequence
  Synthetic
atataggagtggagaaggacactgtccgtgcattgatcacctcacgcccaatgcatccgagctcttcagctaagc

SEQ ID NO: 259895 - DNA, 75 bp, Artificial Sequence
  Synthetic
aaagcgcgtacagcaagccatcctatctatcaaagtatcaacgtctttgggtgaggacccggtgctgactattcc

SEQ ID NO: 259896 - DNA, 75 bp, Artificial Sequence
  Synthetic
cgactgggggtactgatcgacagaattcagcccgccctcacaggatcatcccagaccatccgccggaaccctccc

SEQ ID NO: 259897 - DNA, 75 bp, Artificial Sequence
  Synthetic
ccagaccatccgccggaaccctccccaagctccacgacccaccgacccacacggccaaaccggcaggagcatccc

SEQ ID NO: 259898 - DNA, 75 bp, Artificial Sequence
  Synthetic
acctaatacaattacactcatgggggccgaaggcagagttctcacggtagggacatctcacttcttgtaccaacg

SEQ ID NO: 259899 - DNA, 75 bp, Artificial Sequence
  Synthetic
tgaatcattgcgacactagataatgatctgctttgattgcttatagttagtttacctgtctatccaattagaaaa

SEQ ID NO: 259900 - DNA, 75 bp, Artificial Sequence
  Synthetic
gcacgatcccgcccgcccagagcaacacgggcacaacccaatccaccaacgatccgtgcagaccccagaagatta

SEQ ID NO: 259901 - DNA, 75 bp, Artificial Sequence
  Synthetic
ccgtttatctattgtcacaaggaacccgccccgagccctcctctataaacccaagattcaaggctccaagcgata

SEQ ID NO: 259902 - DNA, 75 bp, Artificial Sequence
  Synthetic
ccaagattcaaggctccaagcgataaccttctcccgcctcttccatcccactgaatgatcgcgcagctgcaatta

SEQ ID NO: 259903 - DNA, 75 bp, Artificial Sequence
  Synthetic
ctcagtacctctgatgctgatcacccggattatgctgatactgagctgtatctgtctgacaagctctcttgacgg

SEQ ID NO: 259904 - DNA, 75 bp, Artificial Sequence
  Synthetic
agtgaactagggtgaacatggcaacttttactgatgctgagatagaggatatatttgagaccagtggaactgtca

SEQ ID NO: 259905 - DNA, 75 bp, Artificial Sequence
  Synthetic
tagacctcttgcagctgcagggattgtggtaacgggagataaagcagtcaatatatacacttcatctcaaacagg

SEQ ID NO: 259906 - DNA, 75 bp, Artificial Sequence
  Synthetic
atatttgagaccagtggaactgtcattgacagtataattacggcccagagcagaccagcagagactgtcgggaag

SEQ ID NO: 259907 - DNA, 75 bp, Artificial Sequence
  Synthetic
aggtcacctccactaagatagagaagaggcacaccattgctaaatataatcctttcaggaaataagttgcatccc

SEQ ID NO: 259908 - DNA, 75 bp, Artificial Sequence
  Synthetic
agactcggtattcatcactacctacggattcatcttccaggttgggaatgaagaagtcactgtcggcatgatcaa

SEQ ID NO: 259909 - DNA, 75 bp, Artificial Sequence
  Synthetic
tgctgatacagtgttcttgtttactccttacaatctctctacagacggtaagaagagaacatcactcaaacagtg

SEQ ID NO: 259910 - DNA, 75 bp, Artificial Sequence
  Synthetic
ttgtcttagcattgcagaaatatccaataccctattcggggaatttaggatcgttcctttactagttgagatcct

SEQ ID NO: 259911 - DNA, 75 bp, Artificial Sequence
  Synthetic
tgtgtcaattctgacaacctgtcaaatagaggacttaagaaaaaactgctgggtacaagcaaccaaagagcgata

SEQ ID NO: 259912 - DNA, 75 bp, Artificial Sequence
  Synthetic
atctatcttgattgtttgtagttagttcacctgtctatctagttagaaaaaacacgggtagaagagtctggatcc

SEQ ID NO: 259913 - DNA, 75 bp, Artificial Sequence
  Synthetic
aataccctattcggggaatttaggatcgttcctttactagttgagatcctcaaggatgatagggtttaagaggct

SEQ ID NO: 259914 - DNA, 75 bp, Artificial Sequence
  Synthetic
tgagctggcaagggcctgcctcactatggtggtaacatgcaagaagagtgcaactaatactgagagaatggtctt

SEQ ID NO: 259915 - DNA, 75 bp, Artificial Sequence
  Synthetic
cggtggcggttgggaagatgcagcagtttgttaatgaccagtttaataatacggcgcgagaattggactgcataa

SEQ ID NO: 259916 - DNA, 75 bp, Artificial Sequence
  Synthetic
aacacgggtagaagagtctggatcccgactagcacattcaaaacgcaatatgggctccaaaccttctaccagaat

SEQ ID NO: 259917 - DNA, 75 bp, Artificial Sequence
  Synthetic
ggtcaagccgaacatcaacacaagcccggatcccatgctgccgggcatccacaatcagacaatgctgacgtgatt

SEQ ID NO: 259918 - DNA, 75 bp, Artificial Sequence
  Synthetic
ctcagtagtgcaggcaccccgggtgctgcaaagctgtagggtcgtggcagacaaatactcgtcagtgaatgcagt

SEQ ID NO: 259919 - DNA, 75 bp, Artificial Sequence
  Synthetic
taattaaatctgccatggtaagcgggcccgacatgggagtggagaaagaaactgtccgtgcattaattacatcgc

SEQ ID NO: 259920 - DNA, 75 bp, Artificial Sequence
  Synthetic
aatgaagagagagaagcaaagaacacatggcgcttggttttccggatcgcagtcttacttttaatgatagcgact

SEQ ID NO: 259921 - DNA, 75 bp, Artificial Sequence
  Synthetic
cgcaaccaatgaagctgtgcatgaggtcaccgacggattatcacaactagcagtggcagtcgggaagatgcaaca

SEQ ID NO: 259922 - DNA, 75 bp, Artificial Sequence
  Synthetic
gtgatctccaagacagaagataaggttacgtctttactcagttcaagtcaagatgtgatagataggatatataag

SEQ ID NO: 259923 - DNA, 75 bp, Artificial Sequence
  Synthetic
tgtggtgccgaagaaggatgtctacaagatcccaaccgcagtattgaaggtatccggctcgagcctgtataatct

SEQ ID NO: 259924 - DNA, 75 bp, Artificial Sequence
  Synthetic
agcaccagatcatcctaccagagtcacacctatcctctccattggtcaagcacaaattgctctattactggaaat

SEQ ID NO: 259925 - DNA, 75 bp, Artificial Sequence
  Synthetic
ctcccccgagtgatcgcgcagctgcaatcaatctaccagcattagagattaagaaaaaatacgggtagaataaaa

SEQ ID NO: 259926 - DNA, 75 bp, Artificial Sequence
  Synthetic
cagaagagagcacgggtaggacatggcgggctccggtcccgaaagggcagagcaccagatcatcctaccagagtc

SEQ ID NO: 259927 - DNA, 75 bp, Artificial Sequence
  Synthetic
atgcgactttgatcatctcattatcagcaggcaatggaagaaaatactagagtcggccactcctgacacagagag

SEQ ID NO: 259928 - DNA, 75 bp, Artificial Sequence
  Synthetic
agcaggcaatggaagaaaatactagagtcggccactcctgacacagagagaatgataaaactcgggcgggcagta

SEQ ID NO: 259929 - DNA, 75 bp, Artificial Sequence
  Synthetic
ggtggcaatatggactatttgttaactaagttaggtgtagggaacaatcaactcagctcattaatcggtagtggc

SEQ ID NO: 259930 - DNA, 75 bp, Artificial Sequence
  Synthetic
caccagactctcaaccacaattccaagataaccggagtactccatcccaggtgtttagaagaactggctagtatt

SEQ ID NO: 259931 - DNA, 75 bp, Artificial Sequence
  Synthetic
gtgtttagaagaactggctagtattgaggtccctgattcaaccaacaaatttcggaagatcgaaaagaagatcca

SEQ ID NO: 259932 - DNA, 75 bp, Artificial Sequence
  Synthetic
tgtgaaggcgagaggtgcacggactaggctgctggcacctttcttctctaacagcgggacagcctgctaccctat

SEQ ID NO: 259933 - DNA, 75 bp, Artificial Sequence
  Synthetic
tgacatgagcaccactcactattgttatactcacaatgtgatattatctggttgcagagatcactcacactcaca

SEQ ID NO: 259934 - DNA, 75 bp, Artificial Sequence
  Synthetic
tcctgcagtgtgagtgcaactcctttaggttgtgatatgctgtgctctaaagtcacagagactgaggaagaggat

SEQ ID NO: 259935 - DNA, 75 bp, Artificial Sequence
  Synthetic
cccaccctctcccccactcccagccacacgatcccacccacccgggacaacacaggcacagctcggttagtcaac

SEQ ID NO: 259936 - DNA, 75 bp, Artificial Sequence
  Synthetic
ttgggagaattaagaaaaaactactggatataagtgaccaaagagcaatacacgggtagaacggtcggagaagcc

SEQ ID NO: 259937 - DNA, 75 bp, Artificial Sequence
  Synthetic
atccggcattctggtttcactcaaaatggtccagagccaagtttgcatggctccatataaaacaggtccaaaggc

SEQ ID NO: 259938 - DNA, 75 bp, Artificial Sequence
  Synthetic
accccttagtcaggaaccaggcttcacaacatccgttctaccgcattaccaatagcagacttcagtcatggatcg

SEQ ID NO: 259939 - DNA, 75 bp, Artificial Sequence
  Synthetic
aggaatccttcccgaaccctcccccacagacccgcgctccaacagcccaagcaacgaccctctctcgcctctctc

SEQ ID NO: 259940 - DNA, 75 bp, Artificial Sequence
  Synthetic
aacccgccgatcacatccactgaaccgccccccactcaggccgcaagcgagaccagcgacacacagctcaagacc

SEQ ID NO: 259941 - DNA, 75 bp, Artificial Sequence
  Synthetic
cgccccccactcaggccgcaagcgagaccagcgacacacagctcaagaccggagcaagcaactcccttctgtcca

SEQ ID NO: 259942 - DNA, 75 bp, Artificial Sequence
  Synthetic
cttgattacttacagctagtttccctgtctatcaaattagaaaaaacacgggtagaagagttcggatcccggccg

SEQ ID NO: 259943 - DNA, 75 bp, Artificial Sequence
  Synthetic
atgccttggacaagttggcagaaagcaacagcaagctagacaaagtcaatgtcagactaaccagcacatctgctc

SEQ ID NO: 259944 - DNA, 75 bp, Artificial Sequence
  Synthetic
acatgcctcacacaggaacttgtattgatgtatgcagatatgatggagggcagggacatggtcaacataatatct

SEQ ID NO: 259945 - DNA, 75 bp, Artificial Sequence
  Synthetic
gcgcaccaaaagcgcaagatgggccccagatcttctaccaggatcccagtacctctaatgctgaccatacggatc

SEQ ID NO: 259946 - DNA, 75 bp, Artificial Sequence
  Synthetic
ggagtgtctgaagagagagcgcaaagatttttggtgatagcaggatctctccctcgagcatgcagcaacggtacc

SEQ ID NO: 259947 - DNA, 75 bp, Artificial Sequence
  Synthetic
caataaatctaacggcattagagattaagaaaaaatacgggtagaatcgaagtaccctaactgttaaaaaatgga

SEQ ID NO: 259948 - DNA, 75 bp, Artificial Sequence
  Synthetic
gtgatctctaaggcagaggatagggttacatctttactcagttcaaatcaagatgtggtagatagggtatataaa

SEQ ID NO: 259949 - DNA, 75 bp, Artificial Sequence
  Synthetic
tatcagagaaaattgatgatattctgcggttagtagatgctttggcaaaggatttgggtaatcaagtctatgatg

SEQ ID NO: 259950 - DNA, 75 bp, Artificial Sequence
  Synthetic
ccgatgaacaagattaccaaattcggatggctaagtcttcatataagcctgggcgatttggtggaaagcgcgtac

SEQ ID NO: 259951 - DNA, 75 bp, Artificial Sequence
  Synthetic
ttgtagcattaatggagggattcgcatacggtgccgttcagctgcttgagccgtcaggtacatttgcaggagact

SEQ ID NO: 259952 - DNA, 75 bp, Artificial Sequence
  Synthetic
caagtgatgtcacatcattctatccttcagcataccaagaacacctgaattttatcccggcgcctactacaggat

SEQ ID NO: 259953 - DNA, 75 bp, Artificial Sequence
  Synthetic
ttaacagacttaagaaaaaactgctgagtataagcaaccgaagagcaatatacgggtagaacggtcaaaggagcc

SEQ ID NO: 259954 - DNA, 75 bp, Artificial Sequence
  Synthetic
aatgaggaaagagaagcaaagaacacatggcgcttggttttccggatcacagtcttaattctaatggtaatgatt

SEQ ID NO: 259955 - DNA, 75 bp, Artificial Sequence
  Synthetic
acttcgatatgatcctccaggtactatctttttttaaggggacaatcatcaatggatacagaaagaagaactcag

SEQ ID NO: 259956 - DNA, 75 bp, Artificial Sequence
  Synthetic
tgcacaagaagggagatatgtaatatacaagcgctataataacacatgccccgatgaacaagattaccaagttcg

SEQ ID NO: 259957 - DNA, 75 bp, Artificial Sequence
  Synthetic
gcgcgacctcgcaggtatatcgaccatgatctccaagacggaggataagattacgtctctactcagttcaggtca

SEQ ID NO: 259958 - DNA, 75 bp, Artificial Sequence
  Synthetic
ggatgaaaggagataatgcgccgtacatgacattgcttggtgacagtgaccagatgagctttgcacctgccgagt

SEQ ID NO: 259959 - DNA, 75 bp, Artificial Sequence
  Synthetic
cagttggaaagatgcagcaatttgttaatgaccagtttaataacacagctcaagagttggactgtataaaaattg

SEQ ID NO: 259960 - DNA, 75 bp, Artificial Sequence
  Synthetic
tatgaatgcaataacatctctttcttatcaaatcaacggggctgctaataatagcgggtgtggagcgcctgttca

SEQ ID NO: 259961 - DNA, 75 bp, Artificial Sequence
  Synthetic
gtacaagagtttatctgcccttgaattcgagccatgtatagagtatgaccctgttaccaatctaagcatgttctt

SEQ ID NO: 259962 - DNA, 75 bp, Artificial Sequence
  Synthetic
cccgcgatgcctagagtcaggctgagtattaacataagccagaatcccatgctgccgggcagccacaatccgaca

SEQ ID NO: 259963 - DNA, 75 bp, Artificial Sequence
  Synthetic
ttacactcatgggggccgaaggcagagtcctcacagtagggacatctcatttcttgtaccaacgagggtcttcat

SEQ ID NO: 259964 - DNA, 75 bp, Artificial Sequence
  Synthetic
ctgccttaactcagttgactgttcaggctctttacaatctggctggtggtaatgtagattacttgttgactaagt

SEQ ID NO: 259965 - DNA, 75 bp, Artificial Sequence
  Synthetic
catccaggcactttataatttagctggtggcaatatggattacttattaactaagttaggtataggaaacaatca

SEQ ID NO: 259966 - DNA, 75 bp, Artificial Sequence
  Synthetic
actcaacctatacctaactgaattgactacagtattcgggccacagatcacttcccctgcattaactcagctgac

SEQ ID NO: 259967 - DNA, 75 bp, Artificial Sequence
  Synthetic
actcttcatagtccttatacatttaatgctttcactcggccaggtagtgtcccttgccaggcatcagcaaggtgc

SEQ ID NO: 259968 - DNA, 75 bp, Artificial Sequence
  Synthetic
ccaacaagctggggtcctcaccgggctcagtgatgaaggctcccaagcctcaaaaggtggatcaaacagatcaca

SEQ ID NO: 259969 - DNA, 75 bp, Artificial Sequence
  Synthetic
ctcagtgatgaaggctcccaagcctcaaaaggtggatcaaacagatcacaagggcaaccggaggccagagatggg

SEQ ID NO: 259970 - DNA, 75 bp, Artificial Sequence
  Synthetic
gggtggcaaattacccaggagtgggaggtgggtcctttattgacgaccgtgtatggttcccagtttacggagggc

SEQ ID NO: 259971 - DNA, 75 bp, Artificial Sequence
  Synthetic
ctaaataatatgcgtgccacctacttggagaccttgtctgtaagcacaacaaagggatttgcctcagcacttgtc

SEQ ID NO: 259972 - DNA, 75 bp, Artificial Sequence
  Synthetic
cggattttcgctaagttaacaaagaaactaaggaactgccaggtaatggcagaaggaattctagctgaccagatt

SEQ ID NO: 259973 - DNA, 75 bp, Artificial Sequence
  Synthetic
gcgtggcagtatcgtactcacttaaagagaaggaggtgaaagtgaatgggcggattttcgctaagttaacaaaga

SEQ ID NO: 259974 - DNA, 75 bp, Artificial Sequence
  Synthetic
ccccaatcggggcctcccccaactcctgggccctctcaagacaatgacactgactggggttattgaccgacaata

SEQ ID NO: 259975 - DNA, 75 bp, Artificial Sequence
  Synthetic
gccgggtcaaccacgggagggatgggaagatgacgttgtattacctatcttctgcaatgccaaggatcaagcgga

SEQ ID NO: 259976 - DNA, 75 bp, Artificial Sequence
  Synthetic
aacaagccatcctatctatcaaagtatcaaagtctttgggtgaggacccggtgctgactgttccacctaatactg

SEQ ID NO: 259977 - DNA, 75 bp, Artificial Sequence
  Synthetic
ctgggccctctcaagacaatgacactgactggggttattgaccgacaatacccagcttgcttccatgaaatcatc

SEQ ID NO: 259978 - DNA, 75 bp, Artificial Sequence
  Synthetic
tgtcaatagtcactctgtttagaaaaaatatgaaaggtggtgggatataagaaaaaacaacttacagaagatagc

SEQ ID NO: 259979 - DNA, 75 bp, Artificial Sequence
  Synthetic
tccctcctctcccccagccccacaaccccacccgtccaaggcaatacaggcacaacgcgacccaccaacaatcaa

SEQ ID NO: 259980 - DNA, 75 bp, Artificial Sequence
  Synthetic
cacaacgcgacccaccaacaatcaatacaggaccgaagaaattagaaaaaagtacgggtagaaaggagacattca

SEQ ID NO: 259981 - DNA, 75 bp, Artificial Sequence
  Synthetic
gtagaagacttaagaaaaaattactgggaacaagcaaccaaagagcaatacacgggtagaacggtcagaggagcc

SEQ ID NO: 259982 - DNA, 75 bp, Artificial Sequence
  Synthetic
accatctcattatcagcaggcaatggaagaaaatccttgagtcagccactcctgacactgagagaatgataaaac

SEQ ID NO: 259983 - DNA, 75 bp, Artificial Sequence
  Synthetic
aatatgcccaaggacaaagaggcatgtgcgaaagccccactagaggcatacaacagaacactgaccactttactc

SEQ ID NO: 259984 - DNA, 75 bp, Artificial Sequence
  Synthetic
ttacgtctttactcagttcaagtcaagatgtgatagataggatatacaagcaggtagctcttgaatccccgctgg

SEQ ID NO: 259985 - DNA, 75 bp, Artificial Sequence
  Synthetic
ttgtcagtgctagggggggcattgagggattatgccagaagctatggacaatgatctcaattgctgcaatccaac

SEQ ID NO: 259986 - DNA, 75 bp, Artificial Sequence
  Synthetic
atgagaacaagttcacatgcctcacccaggaacttgtattgatgtatgcagatatgatggagggcagggatatgg

SEQ ID NO: 259987 - DNA, 75 bp, Artificial Sequence
  Synthetic
caggtagctcttgaatccccgctggcactactaaacaccgaatctataattatgaatgcaataacctctctttct

SEQ ID NO: 259988 - DNA, 75 bp, Artificial Sequence
  Synthetic
agttgcctgcatggtacaaggtgacaatcaagtaatagctgtaacgagagaggtaagatcagatgattctccgga

SEQ ID NO: 259989 - DNA, 75 bp, Artificial Sequence
  Synthetic
acatctcagaagcctatcagagaaaattgatgatgttctgcggttagtggatgctctagcaaaagatttgggcaa

SEQ ID NO: 259990 - DNA, 75 bp, Artificial Sequence
  Synthetic
gttctagcatgctatctgatgtacaagcaaaaagcgcaacgaaagaccttgttgtggcttggaaataatacccta

SEQ ID NO: 259991 - DNA, 75 bp, Artificial Sequence
  Synthetic
atgatctcaattgctgcaatccaacttgctgcagcaagatcgcattgtcgagttgcctgcatggtacaaggtgac

SEQ ID NO: 259992 - DNA, 75 bp, Artificial Sequence
  Synthetic
atttgcaggagatttctttgcattcaacctacaggagctcaaagacactctaatcgaacttctcccaaatgatat

SEQ ID NO: 259993 - DNA, 75 bp, Artificial Sequence
  Synthetic
tggataagttagaggaaagcaacagcaaactagacaaagtcaatgtcagactgaccagcacatctgctctcatta

SEQ ID NO: 259994 - DNA, 75 bp, Artificial Sequence
  Synthetic
gaccgtccagtctccggccagccaagacaaccctgatcatcaggacagatcagacaaacgactgtccacagccga

SEQ ID NO: 259995 - DNA, 75 bp, Artificial Sequence
  Synthetic
atttgcaggagatttttttgcattcaacctgcaggagctcaaagatactctaatcgaactcctcccaaatgatat

SEQ ID NO: 259996 - DNA, 75 bp, Artificial Sequence
  Synthetic
acagcgcgagaattggactgtataaaaatttcacaacaagtcggtatagaactcaacttatacctaactgaactg

SEQ ID NO: 259997 - DNA, 75 bp, Artificial Sequence
  Synthetic
gaattaagaaaaaactaccggatgtaggtgaacaaaaggcaatatacgggtagaacggcctgagaggccacccct

SEQ ID NO: 259998 - DNA, 75 bp, Artificial Sequence
  Synthetic
ctattactggaaattaactgggctaccgcttcctgatgaatgcgactttgatcatctcattatcagcaggcaatg

SEQ ID NO: 259999 - DNA, 75 bp, Artificial Sequence
  Synthetic
tgattcatgtcaatcatctgattggccataacctgaaagatcgtgaaaccatcaggtcagacacattcttcatat

SEQ ID NO: 260000 - DNA, 75 bp, Artificial Sequence
  Synthetic
aggtgaacaaaaggcaatatacgggtagaacggcctgagaggccacccctcaatcgggagccaggccccactacg

SEQ ID NO: 260001 - DNA, 75 bp, Artificial Sequence
  Synthetic
gttgttgggcaaccacaatccgacaatgctgacatgattattctgagtctcgcccactgtcactttattaagaaa

SEQ ID NO: 260002 - DNA, 75 bp, Artificial Sequence
  Synthetic
ctaaattaggtatagggaacaatcatctcagctcattaataggcagtggcttgatcacaggcaaccctatactgt

SEQ ID NO: 260003 - DNA, 75 bp, Artificial Sequence
  Synthetic
caatcgcacatccaaaagataactggctcgcctcattcaggcgaaaccttctctctgaggaccagaagaaacatg

SEQ ID NO: 260004 - DNA, 75 bp, Artificial Sequence
  Synthetic
ttccaaccagtcttggatcgaggatatctctttcgtacactcatacgtgttaacccctgcccagctggggggact

SEQ ID NO: 260005 - DNA, 75 bp, Artificial Sequence
  Synthetic
gtctctgcagtcgccctggcatatagtatggaggctagcacacctggcgaccttgtaagcataccgactgcgatc

SEQ ID NO: 260006 - DNA, 75 bp, Artificial Sequence
  Synthetic
ctgctagggtcatcttggtctaataatgtcccacgatcagaagaattcagcagcatccgtacggatccggcattc

SEQ ID NO: 260007 - DNA, 75 bp, Artificial Sequence
  Synthetic
aacctacaggagctcaaaaacacgttaatcgaacttctcccaaataatatagcggaagcagtaactcacgctatt

SEQ ID NO: 260008 - DNA, 75 bp, Artificial Sequence
  Synthetic
cagcatccgtacggatccggcattctggtttcactcaaaatggtccagagccaagtttgcatggctccatataaa

SEQ ID NO: 260009 - DNA, 75 bp, Artificial Sequence
  Synthetic
caatcgcacatccgaatgataactggctcgcctcatttaggcggaaccttctctctgaggaccagaagaaacaga

SEQ ID NO: 260010 - DNA, 75 bp, Artificial Sequence
  Synthetic
ccccatgatgcggtccgaaatccagcagctgaaaacatctgttgcggtcatggaagccaatttgggtatgatgaa

SEQ ID NO: 260011 - DNA, 75 bp, Artificial Sequence
  Synthetic
ccaggggaatggggtcattcaggatagcatatccttgactaagagtatgttagcaatgagccaactatcttttaa

SEQ ID NO: 260012 - DNA, 75 bp, Artificial Sequence
  Synthetic
taaataccgaatctataattatgaatgcaataacgtctctctcttatcaaatcaatggagccacaaataatagcg

SEQ ID NO: 260013 - DNA, 75 bp, Artificial Sequence
  Synthetic
gtatggaggctagcacacctggcgaccttgtaagcataccgactgcgatctatagggcagaggaaaggattacat

SEQ ID NO: 260014 - DNA, 75 bp, Artificial Sequence
  Synthetic
tgcaataacgtctctctcttatcaaatcaatggagccacaaataatagcgggtgtggggcacctgttcatgaccc

SEQ ID NO: 260015 - DNA, 75 bp, Artificial Sequence
  Synthetic
cacctcatactgtatagaatctgatctggatctatactgtacaaggatagtgacattccctatgtctccaggaat

SEQ ID NO: 260016 - DNA, 75 bp, Artificial Sequence
  Synthetic
tagctgaccagattgcacccttcttccagggaaatggggtcattcaagatagcatatccttgactaagagtatgt

SEQ ID NO: 260017 - DNA, 75 bp, Artificial Sequence
  Synthetic
acgggtagaacggtcggagaagccatcttccaatcaggaactaggcttcacaacatctgttccaccacatcacca

SEQ ID NO: 260018 - DNA, 75 bp, Artificial Sequence
  Synthetic
gagatcactcacactcacatcagtatttagcacttggtgtgcttcggacatctgcaacagggagggtattctttt

SEQ ID NO: 260019 - DNA, 75 bp, Artificial Sequence
  Synthetic
tatctgctcttgaattcgagccatgtatagagtacgaccctgttaccaatctaagcatgttcttaaaggacaagg

SEQ ID NO: 260020 - DNA, 75 bp, Artificial Sequence
  Synthetic
ccgcttaatcagcattacaaggtatctacaccaagctcctttccgcagatccgaggcccaatactctaagcaaca

SEQ ID NO: 260021 - DNA, 75 bp, Artificial Sequence
  Synthetic
tccaaccacccattagtctcttctaatatgtgttcgctgacgctagcagattatgcccggaacagaagctggtca

SEQ ID NO: 260022 - DNA, 75 bp, Artificial Sequence
  Synthetic
agtggattcatcttaggctaatggacactacgatgtttgtaggggatcctttcaatcctccaagtgacccgactg

SEQ ID NO: 260023 - DNA, 75 bp, Artificial Sequence
  Synthetic
cctggcaatggagactgggccagcctatgcaacgacccatactcctttaattttgagactgttgcaagcccaaat

SEQ ID NO: 260024 - DNA, 75 bp, Artificial Sequence
  Synthetic
agtgtgagtgcaactcctttaggttgtgatatgctgtgctctaaaatcacagagactgaggaagaggattataaa

SEQ ID NO: 260025 - DNA, 75 bp, Artificial Sequence
  Synthetic
acaacactatttagggactgggtggcaaattacccaggagtaggaggtgggtcttttattaacaaccgcgtatgg

SEQ ID NO: 260026 - DNA, 75 bp, Artificial Sequence
  Synthetic
gtgacagcggagatgagcagtttacttggtttcatcttccaagcaatatagagctgactgatgacaccagcaaaa

SEQ ID NO: 260027 - DNA, 75 bp, Artificial Sequence
  Synthetic
caaattacccaggagtaggaggtgggtcttttattaacaaccgcgtatggttcccggtctacggagggctaaaac

SEQ ID NO: 260028 - DNA, 75 bp, Artificial Sequence
  Synthetic
agctcgcagccagattccaaccagtcctggattgaggacatctctttcgtacattcgtacgtcttaacccctgcc

SEQ ID NO: 260029 - DNA, 75 bp, Artificial Sequence
  Synthetic
atggaagatttaagaaaaaactactggatataagcaaccgaaaagcaatacacgggtagaacggtcggagaggcc

SEQ ID NO: 260030 - DNA, 75 bp, Artificial Sequence
  Synthetic
cagctggggggactgagtaatcttcaatactcaaggctctacacaaggaacatcggtgacccggggactactgcc

SEQ ID NO: 260031 - DNA, 75 bp, Artificial Sequence
  Synthetic
aatcatctgattggccataacctgaaggatcgtgaaaccatcagatcagacacattcttcatatacagcaaacga

SEQ ID NO: 260032 - DNA, 75 bp, Artificial Sequence
  Synthetic
tatgactaacatcttaacaaggccacctggcaatggagattgggccagtctttgcaacgatccatactcctttaa

SEQ ID NO: 260033 - DNA, 75 bp, Artificial Sequence
  Synthetic
tcatgggggccgaaggcagagttctcacagtggggacatctcatttcttatatcagcgagggtcatcatacttct

SEQ ID NO: 260034 - DNA, 75 bp, Artificial Sequence
  Synthetic
caagtggcccttgaatctccgctggcactactaaatactgaatctataatcatgaatgcaataacgtctctctct

SEQ ID NO: 260035 - DNA, 75 bp, Artificial Sequence
  Synthetic
atctgcataccaagaacacctgaattttatcccggcgcccactacaggatcaggctgcactcggataccctcatt

SEQ ID NO: 260036 - DNA, 75 bp, Artificial Sequence
  Synthetic
atggtctctaaggtggaagacaagattacgtctttaatcagttcaaatcaagatgtagtagacagaatatacaaa

SEQ ID NO: 260037 - DNA, 75 bp, Artificial Sequence
  Synthetic
gataatcaattactcgagcatgcatgcgatgttattcagagatgatgtttttttgcccaacagatccaaccaccc

SEQ ID NO: 260038 - DNA, 75 bp, Artificial Sequence
  Synthetic
atccaatgattctcaaaggctatttaccgaagaaggaatcaaagaggggaacgtggtttatcaacaaattatgct

SEQ ID NO: 260039 - DNA, 75 bp, Artificial Sequence
  Synthetic
ttacgtctttaatcagttcaaatcaagatgtagtagacagaatatacaaacaagtagcccttgaatttccgctgg

SEQ ID NO: 260040 - DNA, 75 bp, Artificial Sequence
  Synthetic
ctcttcccaatgacaacaaccaaaacgtatgatgagatcacattacacctccacagtaaatttagctgctgtatc

SEQ ID NO: 260041 - DNA, 75 bp, Artificial Sequence
  Synthetic
agggggagattcttagtgtcagcggagggtgcacaaagtgtgacagcggagatgaacagtttacgtggttccatc

SEQ ID NO: 260042 - DNA, 75 bp, Artificial Sequence
  Synthetic
catccgtgttaatctgggcgtatggggacaacgaagtaaactggactgctgctcttaagattgcaagatctcggt

SEQ ID NO: 260043 - DNA, 75 bp, Artificial Sequence
  Synthetic
tccgtggtttcttatgatgaagatacttctataaagaatgatgctataatagtgtatgacaacacacgaaattgg

SEQ ID NO: 260044 - DNA, 75 bp, Artificial Sequence
  Synthetic
agtgtatgacaacacacgaaattggatcagtgaggcccagaattcagatgtggtccgcttattcgagtatgcggc

SEQ ID NO: 260045 - DNA, 75 bp, Artificial Sequence
  Synthetic
ctcaagagaggagagctgcctcgcttgcgaaaatagctcatatgtcaccacatgtgaaagcagcactaagggcat

SEQ ID NO: 260046 - DNA, 75 bp, Artificial Sequence
  Synthetic
tcactcaaggttgaatgcagtaggcctaattaaccatgacgggtcacaccagcttgcagatatagatttcatcga

SEQ ID NO: 260047 - DNA, 75 bp, Artificial Sequence
  Synthetic
gcagtccgcatctttttggttagcgagctcaagagaggccgcaacacggcaggtggtacctctacttattataac

SEQ ID NO: 260048 - DNA, 75 bp, Artificial Sequence
  Synthetic
cttgattacttatagttagtttgcctgtctatcaaattagaaaaaacacgggtagaagattctggatcccggttg

SEQ ID NO: 260049 - DNA, 75 bp, Artificial Sequence
  Synthetic
tgcactcgacgcgtggtctcaggcttatatgcagggaataagtacgatctgctgtttccatctgtcttagatgat

SEQ ID NO: 260050 - DNA, 75 bp, Artificial Sequence
  Synthetic
aatgtctgcgaaactgttagtctcttgcactcgacgcgtggtctcaggcttatatgcagggaataagtacgatct

SEQ ID NO: 260051 - DNA, 75 bp, Artificial Sequence
  Synthetic
gctgtttccatctgtcttagatgataacctgaatgagaagatgcttcagctgatttcccggttatgctgtctgta

SEQ ID NO: 260052 - DNA, 75 bp, Artificial Sequence
  Synthetic
ctgtcttagatgataacctgaatgagaagatgcttcagctgatttcccggttatgctgtctgtacacggtgctct

SEQ ID NO: 260053 - DNA, 75 bp, Artificial Sequence
  Synthetic
ttatgctgtctgtacacggtgctctttgctacaacaagagaaatcccaaagataaggggcctatcggcagaagag

SEQ ID NO: 260054 - DNA, 75 bp, Artificial Sequence
  Synthetic
cgaccggctctcttgatggcaggcctcttgcagctgcaggaattgtggtaacaggagacaaagcggtcaacatat

SEQ ID NO: 260055 - DNA, 75 bp, Artificial Sequence
  Synthetic
atcatgtctcccaacataatcacgtttccagccaatctatattacatgtctaggaagagtcttaatttgatcagg

SEQ ID NO: 260056 - DNA, 75 bp, Artificial Sequence
  Synthetic
aataagaggcctatcggcggaagaaaaatgctcagtactcactgagtacctactgtcagatgctgtgaaaccatt

SEQ ID NO: 260057 - DNA, 75 bp, Artificial Sequence
  Synthetic
gggtcatcttggtctaacaatgtcccacggtcagaggaattcaacagcatccgtacagatccggcattttggttt

SEQ ID NO: 260058 - DNA, 75 bp, Artificial Sequence
  Synthetic
ccgtacagatccggcattttggtttcactcaaaatggtccacagccaaatttgcatggctccatataaaacaggt

SEQ ID NO: 260059 - DNA, 75 bp, Artificial Sequence
  Synthetic
tgctgatgtgatcagtctgaattttgtccgcagtcgctttattaagaaaaaatatggatggtagtgagatacaag

SEQ ID NO: 260060 - DNA, 75 bp, Artificial Sequence
  Synthetic
tcccagccaacctatattacatgtctaggaagagccttaacttaatcagggaacgagaggacagagataccatct

SEQ ID NO: 260061 - DNA, 75 bp, Artificial Sequence
  Synthetic
ctcgcaacaccaaggatcgaattggatatcaatgcaagcttgaatcccataccatcaggcaggcacaacccgaca

SEQ ID NO: 260062 - DNA, 75 bp, Artificial Sequence
  Synthetic
tcagaattcagatgtggtccgcctattcgagtatgcggcactcgaagtgctccttgactgttcttatcaactcta

SEQ ID NO: 260063 - DNA, 75 bp, Artificial Sequence
  Synthetic
attaccaaacccagaagaagattacttagtacggtacttattcagaggaatagggactgcttcatcttcttggta

SEQ ID NO: 260064 - DNA, 75 bp, Artificial Sequence
  Synthetic
cctgcatcattcatacaagagctagatttgagtgctccggcaaggtatgacgcatttacacttagtgaggtttgc

SEQ ID NO: 260065 - DNA, 75 bp, Artificial Sequence
  Synthetic
caggaactagactgtataaaaattacacagcagattggcgtagaactcaacctgtacctaactgagttgactaca

SEQ ID NO: 260066 - DNA, 75 bp, Artificial Sequence
  Synthetic
tgagtcttcttgaattgcatataccgcatgagaccatctattataatacgcttttctcgaatgagatgaaccccc

SEQ ID NO: 260067 - DNA, 75 bp, Artificial Sequence
  Synthetic
ctacctggtctttgtcatgggctatttaggcgggcctacattcgtgcatgaggtggtaaggatggcaaagactct

SEQ ID NO: 260068 - DNA, 75 bp, Artificial Sequence
  Synthetic
gaagaaaatacttgaatctgccactcctgacattgagagaatgataaaactcggacgggcagtgcatcagactct

SEQ ID NO: 260069 - DNA, 75 bp, Artificial Sequence
  Synthetic
ggattcgcatacggcgctgttcagctgcttgaaccgtcaggtacatttgcgggggatttcttcgcattcaacctg

SEQ ID NO: 260070 - DNA, 75 bp, Artificial Sequence
  Synthetic
gttctgcccattatggagagagaatgcagaagaaagtgacctgacttcagataaagcagtgggatatatcacatc

SEQ ID NO: 260071 - DNA, 75 bp, Artificial Sequence
  Synthetic
gcttaggtccgaacaagtgagctctatcatgtctcccaacataatcacgttcccagccaatctatattacatgtc

SEQ ID NO: 260072 - DNA, 75 bp, Artificial Sequence
  Synthetic
caggtattatctttctttaaaggaacaatcatcaatggatatagaaagaagaatgcaggcgtgtggccacgtgtc

SEQ ID NO: 260073 - DNA, 75 bp, Artificial Sequence
  Synthetic
agggcggggtagtgatcatcaaagtactgtatgcaatggggtactactttcatctactcatgaatttattcactc

SEQ ID NO: 260074 - DNA, 75 bp, Artificial Sequence
  Synthetic
aatcaaagcttactagatcaactggctaccaacttatccctgattgccatgcactctgtaagagagggcggtgtc

SEQ ID NO: 260075 - DNA, 75 bp, Artificial Sequence
  Synthetic
ctctaatggctatgcctgtagaggggatatggagtgttacctgatatttgtcatgggctatttaggcgggcctac

SEQ ID NO: 260076 - DNA, 75 bp, Artificial Sequence
  Synthetic
gatatggagtgttacctgatatttgtcatgggctatttaggcgggcctacattcgtgcacgaggtggtaaggatg

SEQ ID NO: 260077 - DNA, 75 bp, Artificial Sequence
  Synthetic
cacttgaattcgagccatgtatagaatatgaccctgtcaccaatctgagcatgtttttaaaagacaaggcaatcg

SEQ ID NO: 260078 - DNA, 75 bp, Artificial Sequence
  Synthetic
ttagtaaggtttgcttcgagcacacattaccgaacccaaaggaagattacctagtacggtacttgttcagaggaa

SEQ ID NO: 260079 - DNA, 75 bp, Artificial Sequence
  Synthetic
tgagcacactaacagatatgactcagatgactcagatcatcgccagccacattgacacagtcattcgatctgtga

SEQ ID NO: 260080 - DNA, 75 bp, Artificial Sequence
  Synthetic
ttcggacctaccccaacacagtttctaaattcggtcgtttataggaatctacaagcggaagtgccatgtaaagat

SEQ ID NO: 260081 - DNA, 75 bp, Artificial Sequence
  Synthetic
gatatgacccagatgactcagatcattgccagccacattgacacagtcattagatctgtgatttacatggaggct

SEQ ID NO: 260082 - DNA, 75 bp, Artificial Sequence
  Synthetic
cagacacctctttattatacctgactcgtgctcaacaaaaattctatatgaaaaccataggcaatgcggccaagg

SEQ ID NO: 260083 - DNA, 75 bp, Artificial Sequence
  Synthetic
gtaatggcagaagggatcctagctgaccagattgcacctttcttccagggaaatggggtcattcaggatagcata

SEQ ID NO: 260084 - DNA, 75 bp, Artificial Sequence
  Synthetic
tcttatttactccttacaatctctctacagacgggaaaaagagaacatcacttaaacagtgcacaagacagatct

SEQ ID NO: 260085 - DNA, 75 bp, Artificial Sequence
  Synthetic
tacagacgggaaaaagagaacatcacttaaacagtgcacaagacagatcttggaggtcacaatactgggtctcag

SEQ ID NO: 260086 - DNA, 75 bp, Artificial Sequence
  Synthetic
gtcatgttgagagagtacaaaagtttatctgcccttgaatttgagccatgtatagactatgaccctgttaccaat

SEQ ID NO: 260087 - DNA, 75 bp, Artificial Sequence
  Synthetic
tggaggtcacaatactgggtctcagagtcaaagatatcaataaagtaggtgatgtaattagcttagtactcagag

SEQ ID NO: 260088 - DNA, 75 bp, Artificial Sequence
  Synthetic
aaagttgaattccgattctttggaactcgtattcggattctaataattatctttaaacggaagtatgcgtagttg

SEQ ID NO: 260089 - DNA, 75 bp, Artificial Sequence
  Synthetic
gatgtaattagcttagtactcagaggtacggtttctctggaggatctcatcccactaaggacatacctgaagcgc

SEQ ID NO: 260090 - DNA, 75 bp, Artificial Sequence
  Synthetic
aagtctgatagcaggtcatttaagaaaaaaaagaaaaaactatcaagcacagatgaccaaagggcaatgtacggg

SEQ ID NO: 260091 - DNA, 75 bp, Artificial Sequence
  Synthetic
aaaaaaagaaaaaactatcaagcacagatgaccaaagggcaatgtacgggtagaacggtcagagaggccgtccct

SEQ ID NO: 260092 - DNA, 75 bp, Artificial Sequence
  Synthetic
tagcgaggatgccaacaaaccactcaggcaaggtgctctcatatccctcctatgctcccattctcaagtgatgag

SEQ ID NO: 260093 - DNA, 75 bp, Artificial Sequence
  Synthetic
ctcgtattcggattctaataattatctttaaacggaagtatgcgtagttgttcttgactataggcctgtcgttca

SEQ ID NO: 260094 - DNA, 75 bp, Artificial Sequence
  Synthetic
acagatctgacagacaaccatccatacccgaacaagcgatcccgcatgacagcccgccggccacatccgccgacc

SEQ ID NO: 260095 - DNA, 75 bp, Artificial Sequence
  Synthetic
tatttcctcactgacttaattataccatattagaaaaaagttgaattccgactctttgaaactcgtattcggatt

SEQ ID NO: 260096 - DNA, 75 bp, Artificial Sequence
  Synthetic
agcatatccttgactaagagtatgttagcaatgagtcaactgtcttttaacagcaataggaaacgtatcactgac

SEQ ID NO: 260097 - DNA, 75 bp, Artificial Sequence
  Synthetic
actctttgaaactcgtattcggattcagttgattaattttaagcagaagtgcgcgtagttgtccttaattgtagt

SEQ ID NO: 260098 - DNA, 75 bp, Artificial Sequence
  Synthetic
tcttgtaggcatatcaactgcgatctctagagcagaagaaaagattacatctgcacttggttccaatcaagatgt

SEQ ID NO: 260099 - DNA, 75 bp, Artificial Sequence
  Synthetic
gctgctgcccaacgagtatccgaggaaattggcagtgtggacattcctactcaacaggccggggttctcactggg

SEQ ID NO: 260100 - DNA, 75 bp, Artificial Sequence
  Synthetic
agctgaccagattgcaccttttttccagggaaatggggtcattcaagatagcatatccttgactaagagtatgtt

SEQ ID NO: 260101 - DNA, 75 bp, Artificial Sequence
  Synthetic
agactatattgggggaataggtaaagaacttattgtagatgatgctagcaacgtcacttcattctatccctctgc

SEQ ID NO: 260102 - DNA, 75 bp, Artificial Sequence
  Synthetic
cccagcccgccctcacagggtcatcccaaaccctccgcccgaatctctcccaaactccccgattcacagctctgc

SEQ ID NO: 260103 - DNA, 75 bp, Artificial Sequence
  Synthetic
agaaaaaatacgggtagaattggagtgccccaattgtgccaagatggactcatctaggacaattgggctgtactt

SEQ ID NO: 260104 - DNA, 75 bp, Artificial Sequence
  Synthetic
catacctgaagcgcagtacctgccctaagtacctgaaggcggtcctaggtattactaaactcaaagaaatgttca

SEQ ID NO: 260105 - DNA, 75 bp, Artificial Sequence
  Synthetic
ccaaaccctccgcccgaatctctcccaaactccccgattcacagctctgcatggccaaaccaacaagagcacccc

SEQ ID NO: 260106 - DNA, 75 bp, Artificial Sequence
  Synthetic
gctaatatcaggcgaccttagtgaaaacactgtaatgtcttgtgccaacattgcatctactgtagcacggttatg

SEQ ID NO: 260107 - DNA, 75 bp, Artificial Sequence
  Synthetic
tgaattttccatcaccaacaactcgcaactcgattctaaccagtcgtggatagaggacatttcttttgtgcactc

SEQ ID NO: 260108 - DNA, 75 bp, Artificial Sequence
  Synthetic
aatccatgcagggcccaagatattagaaaaaaatacgggtagaagagagacacccagagatcaggacaagtcacc

SEQ ID NO: 260109 - DNA, 75 bp, Artificial Sequence
  Synthetic
ctttacagatgctgagatagacgatatacttgagaccagtggaactgtcattgacagcataattacggcccaggg

SEQ ID NO: 260110 - DNA, 75 bp, Artificial Sequence
  Synthetic
aaagtttaattctgactctttgaaactcgtattcggattcagttagttgattttgggcaggaatacgcttaattg

SEQ ID NO: 260111 - DNA, 75 bp, Artificial Sequence
  Synthetic
ctcgtattcggattcagttagttgattttgggcaggaatacgcttaattgtccctaattatagtcctgtcatcca

SEQ ID NO: 260112 - DNA, 75 bp, Artificial Sequence
  Synthetic
aatggagattgggccagtctgtgcaacgatccatactcctttaattttgagactgtcgcaagcccaaatattgtc

SEQ ID NO: 260113 - DNA, 75 bp, Artificial Sequence
  Synthetic
acttatcaaaagaatatctcaatattagattctcaggtcatcgtgacaggcaatcttgatatatcaactgaactt

SEQ ID NO: 260114 - DNA, 75 bp, Artificial Sequence
  Synthetic
actcctcgctgctcagacgcgccccaatggatctcatggggggggagagaagggtagtaccctcaaagtggaagt

SEQ ID NO: 260115 - DNA, 75 bp, Artificial Sequence
  Synthetic
gcctcgtgcatgcagcaatgggaccccgtttgtcacggccggagtagaggatgatgcccctgaagacataactga

SEQ ID NO: 260116 - DNA, 75 bp, Artificial Sequence
  Synthetic
aggccccgagcatagcacgggagaagcacgggagcatccagccatccgccggccaggacatctccaaccaacaag

SEQ ID NO: 260117 - DNA, 75 bp, Artificial Sequence
  Synthetic
agtcagcaatagaacagccactcttcatagtccttatacattcaatgccttcactcgaccgggcagcgtcccttg

SEQ ID NO: 260118 - DNA, 75 bp, Artificial Sequence
  Synthetic
ctggcagactatgcacggaacagaagctggtcacctttgacagggggtagaaaaatactgggtgtatctaatcct

SEQ ID NO: 260119 - DNA, 75 bp, Artificial Sequence
  Synthetic
gtctatgatggaggcgttatcacagaaagtaagtaaagttgactatcagctagacctagtctcaaagcagacatc

SEQ ID NO: 260120 - DNA, 75 bp, Artificial Sequence
  Synthetic
atgttttaaagttgtcaagaccaataaaacctattgtctcagcattgccgaaatatccaataccctcttcgggga

SEQ ID NO: 260121 - DNA, 75 bp, Artificial Sequence
  Synthetic
gagctctgccgatggaaatgatggtgagacccagtttcttgatctgatgcgggcagtcgccaacagcatgaggga

SEQ ID NO: 260122 - DNA, 75 bp, Artificial Sequence
  Synthetic
tcagctgagagaggattagaaagatgacattgtatcacctatcttttgcaacgccaagaaccaaattgaataccg

SEQ ID NO: 260123 - DNA, 75 bp, Artificial Sequence
  Synthetic
aagattgcaaggtctcggtgcaacataagctcagagtaccttcgactattgtcacccttgcctacagctgggaat

SEQ ID NO: 260124 - DNA, 75 bp, Artificial Sequence
  Synthetic
gacattgtatcacctatcttttgcaacgccaagaaccaaattgaataccggagcaagcttgattcctacgctgcc

SEQ ID NO: 260125 - DNA, 75 bp, Artificial Sequence
  Synthetic
taactcagatgacattcacccctgcatctctatacagggtgtcaccttacattcatatatctaatgattctcaaa

SEQ ID NO: 260126 - DNA, 75 bp, Artificial Sequence
  Synthetic
tcagtctagcctgggagaagcatggcaacacgaacaccccagttgcccaagaatcagccggagaacaggacagca

SEQ ID NO: 260127 - DNA, 75 bp, Artificial Sequence
  Synthetic
aagatcaaacgccttgcgctgaatggttgatcgccatcacaacttacaacaggctcctgcctcattagtgtcaca

SEQ ID NO: 260128 - DNA, 75 bp, Artificial Sequence
  Synthetic
tgctaaaaagggcccacctcagagtcctccacagcagcgccctctactccaaagggagctgcagtggaacaaacc

SEQ ID NO: 260129 - DNA, 75 bp, Artificial Sequence
  Synthetic
aagatccaaattcacaacacaaggtatggagaactattcacaagactgtgcacacacgtagataagaaattgtta

SEQ ID NO: 260130 - DNA, 75 bp, Artificial Sequence
  Synthetic
ttcagatgtggtccgcctattcgagtatgcggcactcgaagtgctcctcgactgttcttatcaactctactatct

SEQ ID NO: 260131 - DNA, 75 bp, Artificial Sequence
  Synthetic
aattgttagtctcctgcactcgacgcgtggtctcaggtttatatgcagggaataagtacgatctgctgtttccat

SEQ ID NO: 260132 - DNA, 75 bp, Artificial Sequence
  Synthetic
gtcctgtacatgagtgatttatacaagaatatgccaggaattctactctctaatattgcagctacaatatctcac

SEQ ID NO: 260133 - DNA, 75 bp, Artificial Sequence
  Synthetic
tacagtattcggaccacaaatcacttcacctgctttaaacaagctgactattcaggcactttacaatctagctgg

SEQ ID NO: 260134 - DNA, 75 bp, Artificial Sequence
  Synthetic
ctatctgagagtgagaggtctcaacaacatcgtcttatacatgagtgacttatacaagaatatgccagggatttt

SEQ ID NO: 260135 - DNA, 75 bp, Artificial Sequence
  Synthetic
caacaagagaaatcccgaaaataagaggcttatctgcggaagagaaatgttcagtacttactgagtacctactgt

SEQ ID NO: 260136 - DNA, 75 bp, Artificial Sequence
  Synthetic
tgaatgcagtaggtctggtcggtcatgacggttcgcaccagcttgcagacacagatttcattgaaatgtctgcga

SEQ ID NO: 260137 - DNA, 75 bp, Artificial Sequence
  Synthetic
ggatttgcatatggtgctgtccagcttcttgaaccgtcaggtacatttgcaggggatttcttcgcattcaacctg

SEQ ID NO: 260138 - DNA, 75 bp, Artificial Sequence
  Synthetic
caagagctcaaagacaccttgatcaacctacttcccaaggatatagcagagtctgtgactcatgcaatagccact

SEQ ID NO: 260139 - DNA, 75 bp, Artificial Sequence
  Synthetic
gaggacagggatactatcttggcattgttgttccctcaagaaccgctgctcgagtttcctctggtacgagatatt

SEQ ID NO: 260140 - DNA, 75 bp, Artificial Sequence
  Synthetic
tctcatatctctcctatgctcccactcacaagtgatgaggaaccatgttgcccttgcgggtaaacagaatgaggc

SEQ ID NO: 260141 - DNA, 75 bp, Artificial Sequence
  Synthetic
tcctatagcaaatgcctctccccaggttgctaaaatactctggagccaaactgcgcacctgcggagtgtaaaagt

SEQ ID NO: 260142 - DNA, 75 bp, Artificial Sequence
  Synthetic
ggtgctcgtgtaaaagatccatttacccgacaacctgcggcgtttttacaagagttagatttgagtgctccggca

SEQ ID NO: 260143 - DNA, 75 bp, Artificial Sequence
  Synthetic
aatggtagacttcgatatgatcctccaggtattgtctttctttaaaggaacaatcatcaatggatacagaaagaa

SEQ ID NO: 260144 - DNA, 75 bp, Artificial Sequence
  Synthetic
gaaacacaccattgctaaatacaatcctttcaaaaagtaagttgcatccctgagactgcgatccacccgctttcc

SEQ ID NO: 260145 - DNA, 75 bp, Artificial Sequence
  Synthetic
tcattgggcagctacatgctgattcagcagagatttcacacgatatcatgttgagagagtataagagtttatctg

SEQ ID NO: 260146 - DNA, 75 bp, Artificial Sequence
  Synthetic
attgccgaacccagaagaggattacttagtacggtatttgttcagaggaatagggactgcttcatcttcttggta

SEQ ID NO: 260147 - DNA, 75 bp, Artificial Sequence
  Synthetic
atctgtctctgattgccatgcattctgtgaaggagggcggggtcgtgattatcaaagtactgtatgcaatgggat

SEQ ID NO: 260148 - DNA, 75 bp, Artificial Sequence
  Synthetic
gggcctacatttgtacatgaggtggtgaggatggcaaaaacgctagtacagcggcacggcacacttttgtctaag

SEQ ID NO: 260149 - DNA, 75 bp, Artificial Sequence
  Synthetic
aatacaacagcacggtacacttctgtctaaatcggatgagattaagttaactaagctatttacctcacagcagca

SEQ ID NO: 260150 - DNA, 75 bp, Artificial Sequence
  Synthetic
tcggaccgacccctacacagtttctaaattcagttgtttataggaacctacaggcggaagtgccatgcaaagacg

SEQ ID NO: 260151 - DNA, 75 bp, Artificial Sequence
  Synthetic
tatcccggcgcctactacaggatcaggttgcactcgaataccctcatttgacatgagtgctacccattactgcta

SEQ ID NO: 260152 - DNA, 75 bp, Artificial Sequence
  Synthetic
acagatcttagaggtcacaatactgggtctcagagtcaaaaatctcaataaagtaggtgatgtaatcagcctagt

SEQ ID NO: 260153 - DNA, 75 bp, Artificial Sequence
  Synthetic
ataggcaatgcagtcaagggatactatagtaactgtgactcttaaaggcaaccacatatcaataggccctctttc

SEQ ID NO: 260154 - DNA, 75 bp, Artificial Sequence
  Synthetic
ttgcagagatatccaataccctattcggggaatttaggatcgttcccttattagttgagatcctcaaggatgata

SEQ ID NO: 260155 - DNA, 75 bp, Artificial Sequence
  Synthetic
tcgtgctcaacaaaaattctacatgaaaaccataggtaatgcagccaagggatattacagtaacaatgactccta

SEQ ID NO: 260156 - DNA, 75 bp, Artificial Sequence
  Synthetic
ctggaaattaactgggctaccactccctgacgaatgtgacttcgaccacctcattctcagccgacaatggaagaa

SEQ ID NO: 260157 - DNA, 75 bp, Artificial Sequence
  Synthetic
taacatcctaactaggcctcccggaaatggagattgggccagcctgtgtaacgacccatattctttcaacttcga

SEQ ID NO: 260158 - DNA, 75 bp, Artificial Sequence
  Synthetic
ccggagacccgtctccttatgtgactcaaggaggtgaaatggcacttaataaactttcgcaaccagtgcaacatc

SEQ ID NO: 260159 - DNA, 75 bp, Artificial Sequence
  Synthetic
accaaacagagaatctgtgaggtacgataaaaggcgaagaagcaatcgaaatcgtacgggtagaaggtgtgaacc

SEQ ID NO: 260160 - DNA, 75 bp, Artificial Sequence
  Synthetic
tcttcatagtccttatacattcaatgccttcactcggccaggtagtatcccttgccaggcttcagcaagatgccc

SEQ ID NO: 260161 - DNA, 75 bp, Artificial Sequence
  Synthetic
ggatataagcaaccaaagggcaatacacgggtagaacggtcggagaggccacccctcattcaggaaccaggcttc

SEQ ID NO: 260162 - DNA, 75 bp, Artificial Sequence
  Synthetic
tagaggacctcatcccactaaggacatacctgaagcacagtacatgcccgaagtatttgaaggcggtcctaggga

SEQ ID NO: 260163 - DNA, 75 bp, Artificial Sequence
  Synthetic
attcgggacaatgcttgatggtgtacaagcaagacttaaccctgcgtctgcagtattcgatagcacatcccgcag

SEQ ID NO: 260164 - DNA, 75 bp, Artificial Sequence
  Synthetic
ctaagaattaagaaaaaatacgggtagaatcggagtgccccgattgtgccaagatggattcatccaggacaatcg

SEQ ID NO: 260165 - DNA, 75 bp, Artificial Sequence
  Synthetic
ataggtgccattataggcagtgtagctcttggggttgcgacatcggcacagataacagcagctgcggccctaata

SEQ ID NO: 260166 - DNA, 75 bp, Artificial Sequence
  Synthetic
gaaaaaaatacgggtagaagagagacatccagagaccaggacgggtcaccaagttctctgttctcccttctaccc

SEQ ID NO: 260167 - DNA, 75 bp, Artificial Sequence
  Synthetic
aatccacccagagcccaaggtattagaaaaaaatacgggtagaagagagacatccagagaccaggacgggtcacc

SEQ ID NO: 260168 - DNA, 75 bp, Artificial Sequence
  Synthetic
cgggaacctagagtacaaggtaaattttgtctctttgaccgtggtaccgaggaaggatgtctacaagatcccaac

SEQ ID NO: 260169 - DNA, 75 bp, Artificial Sequence
  Synthetic
atctctttacagggtgtcaccttacattcacatatccaatgattcccaaaggttgttcactgaagaaggggtcaa

SEQ ID NO: 260170 - DNA, 75 bp, Artificial Sequence
  Synthetic
gcttcagctgatatcacggttatgctgcctgtacacggtgctctttgctacaacaagagaaatcccgaaaataag

SEQ ID NO: 260171 - DNA, 75 bp, Artificial Sequence
  Synthetic
acgaccccaccaacaaaagctcccccccaccctctcccccactcccagccacacgatcccacccacccgggacaa

SEQ ID NO: 260172 - DNA, 75 bp, Artificial Sequence
  Synthetic
agccgggggacaacccgtccgtccgttctgtgcagacagcttggtgaggacactagcggacacaactcagatgac

SEQ ID NO: 260173 - DNA, 75 bp, Artificial Sequence
  Synthetic
accggtaaccctattctatacgactcacagactcaactcttgggtatacaggtaactctaccttcagtcgggaac

SEQ ID NO: 260174 - DNA, 75 bp, Artificial Sequence
  Synthetic
ggatcaagaggctcacaaggataataaattactctagcatgcatgccatgctcttccgagatgatgtcttcttgt

SEQ ID NO: 260175 - DNA, 75 bp, Artificial Sequence
  Synthetic
tggaatacttgacaacccttgagtacctaagagatgacagtgtggcagtatcgtactcactcaaagagaaggagg

SEQ ID NO: 260176 - DNA, 75 bp, Artificial Sequence
  Synthetic
ccatatatgactctcaaaggctcagttattgccaactgtaagatgacaacatgtagatgtgcagaccccccgggt

SEQ ID NO: 260177 - DNA, 75 bp, Artificial Sequence
  Synthetic
ctaatctatattacatgtctcggaaaagcctgaatttgatcagagaaagagaggacagggatactatcttggcac

SEQ ID NO: 260178 - DNA, 75 bp, Artificial Sequence
  Synthetic
gggtttaagaagctagatctggccggttgagtcgaacacaggatggttgggaagatgatgctgtatcacctatct

SEQ ID NO: 260179 - DNA, 75 bp, Artificial Sequence
  Synthetic
ccatctccttacgtgacacaagggggtgaaatgacgctcaataaactctcacaaccggtgcagcacccttctgaa

SEQ ID NO: 260180 - DNA, 75 bp, Artificial Sequence
  Synthetic
ggaacaatcatcaacgggtacagaaagaagaatgcaggtgtgtggccgcgagtcaaagtggatacaatatatggg

SEQ ID NO: 260181 - DNA, 75 bp, Artificial Sequence
  Synthetic
atgctgatgtgatcagtctgaatcttgtccatagtcactttattaagaaaaaatatgaaaggtagtgagatataa

SEQ ID NO: 260182 - DNA, 75 bp, Artificial Sequence
  Synthetic
tctgcacttgaatttgagccatgtatagaatatgaccctgtcaccaacctgagcatgttcctaaaagacaaggca

SEQ ID NO: 260183 - DNA, 75 bp, Artificial Sequence
  Synthetic
tactaatctgggcatatggtgacaatgacatcaattggacagccgcattgaagctggcacgatcaagatgcaata

SEQ ID NO: 260184 - DNA, 75 bp, Artificial Sequence
  Synthetic
ctttatacttggcagaaggaagtggagccatcatgagtcttctcgaactgcatgtaccgcatgagactatctatt

SEQ ID NO: 260185 - DNA, 75 bp, Artificial Sequence
  Synthetic
gttattcgcccatgccatcaatcagttgatgggcctacctcactttttcgagtggattcatcttagactaatgga

SEQ ID NO: 260186 - DNA, 75 bp, Artificial Sequence
  Synthetic
gaagaaaatacttgaatctgccactcctgacactgagagaatgataaaactcgggcgggcagtgcaccagactct

SEQ ID NO: 260187 - DNA, 75 bp, Artificial Sequence
  Synthetic
cagttgtttatcggaatttacaggcagaggtaccatgtaaggatggatttgtccaggagttccgcccattatgga

SEQ ID NO: 260188 - DNA, 75 bp, Artificial Sequence
  Synthetic
gtactccatcccaggtgtttagaagaactggctagtattgaggtccctgattcaaccaacaaatttcggaagatc

SEQ ID NO: 260189 - DNA, 75 bp, Artificial Sequence
  Synthetic
aactggctagtattgaggtccctgattcaaccaacaaatttcggaagatcgaaaagaagatccagattcacaaca

SEQ ID NO: 260190 - DNA, 75 bp, Artificial Sequence
  Synthetic
gtgatatgctgtgctcgaaagtcacggagacagaggaagaagattataactcagctgtccctacgcggatggtac

SEQ ID NO: 260191 - DNA, 75 bp, Artificial Sequence
  Synthetic
atcatgctcctagggctctctctgatagagtcattattccctatgactgtcacaaaaacatatgatgaaatcact

SEQ ID NO: 260192 - DNA, 75 bp, Artificial Sequence
  Synthetic
cagcatccgtacagatccggcattctggtttcactcaaaatggtccagagccaagtttgcatggctccatataaa

SEQ ID NO: 260193 - DNA, 75 bp, Artificial Sequence
  Synthetic
gacagacatcctatccagtcctttaccgagattactaaagttcttgagaaggaatattgatactgcgttgattga

SEQ ID NO: 260194 - DNA, 75 bp, Artificial Sequence
  Synthetic
actcctcttggcgactccatccgcaagatccaagggtctgtgtccacgtccggaggaaggagacaaaaacgtttt

SEQ ID NO: 260195 - DNA, 75 bp, Artificial Sequence
  Synthetic
aggacccggtgctgactataccgcccaacacagttacacttatgggggccgaaggcagaattctcacagtaggga

SEQ ID NO: 260196 - DNA, 75 bp, Artificial Sequence
  Synthetic
ctcacaatcagacagtctctggcggtccgcatcttcttggttagcgagcttaagagaggccgcaacacggcaggt

SEQ ID NO: 260197 - DNA, 75 bp, Artificial Sequence
  Synthetic
gataaagggcgaagaagcaatcgaaatcgtacgggtagaaggtgtgaacctcgagtgcgaggccgaagctcaaac

SEQ ID NO: 260198 - DNA, 75 bp, Artificial Sequence
  Synthetic
aatcctacgctgccagttggccataatcagttagcgctaatgtgattggattgaatcttgtcgatagtcacttga

SEQ ID NO: 260199 - DNA, 75 bp, Artificial Sequence
  Synthetic
aagacctattgtctcagcattgctgaaatatctaatactctcttcggagaattcagaatcgtcccgttactagtt

SEQ ID NO: 260200 - DNA, 75 bp, Artificial Sequence
  Synthetic
tcgagtgcgaggccgaagctcaaactcgagggagccttctgccggtatgtcatccgtctttgacgagtacgagca

SEQ ID NO: 260201 - DNA, 75 bp, Artificial Sequence
  Synthetic
ggactcctgccttttaggactcgtgttcgaattcaaataggcgtcttagaaaaaaagtgcgcataattgtccttg

SEQ ID NO: 260202 - DNA, 75 bp, Artificial Sequence
  Synthetic
tatgctcccattctcaagtgatgagaaatcatgttgcccttgcaggaaggcagaacgaggccacactggctgttc

SEQ ID NO: 260203 - DNA, 75 bp, Artificial Sequence
  Synthetic
cctaagagatgacagtgtggcagtatcatactcactcaaagagaaggaggtgaaagttaatgggcggattttcgc

SEQ ID NO: 260204 - DNA, 75 bp, Artificial Sequence
  Synthetic
taagttaacaaagaaattaaggaactgccaggtaatggcagaaggaattctagctgaccagattgcacctttttt

SEQ ID NO: 260205 - DNA, 75 bp, Artificial Sequence
  Synthetic
tgccaggtaatggcagaaggaattctagctgaccagattgcaccttttttccagggaaatggggtcattcaagat

SEQ ID NO: 260206 - DNA, 75 bp, Artificial Sequence
  Synthetic
ccttattgtctggagtgcacacagaggataatgaggcagaagagaaggcattggctgaattcttgcttaatcaag

SEQ ID NO: 260207 - DNA, 75 bp, Artificial Sequence
  Synthetic
taactcagatgacattcacccctgcatctctctacagggtgtcaccttacattcacatatccaatgattctcaaa

SEQ ID NO: 260208 - DNA, 75 bp, Artificial Sequence
  Synthetic
taaagagatggaatatttgacgacccttgagtacctaagagatgacaatgtggcagtatcatactcactcaaaga

SEQ ID NO: 260209 - DNA, 75 bp, Artificial Sequence
  Synthetic
aaccaggacatatgatgagatcacactgcacctacatagtaaatttagttgctgtatcagggaagcacctgttgc

SEQ ID NO: 260210 - DNA, 75 bp, Artificial Sequence
  Synthetic
ttcctaaggatttctgttattatttaaactacctaatgagctgcgtgcagacatactttgattctgagttttcca

SEQ ID NO: 260211 - DNA, 75 bp, Artificial Sequence
  Synthetic
aaattggcagtgtggacattcccactcaacaggctggggtcctcactgggctcagtgacgaaggcccccgaggct

SEQ ID NO: 260212 - DNA, 75 bp, Artificial Sequence
  Synthetic
cagctgggaggactgagtaaccttcaatactcaaggctctacacaaggaatattggtgacccggggactactgct

SEQ ID NO: 260213 - DNA, 75 bp, Artificial Sequence
  Synthetic
tttgcggaggtcaagcgattagaagcagtggggttgctgagtcctagcattatgactaacatcttaactaggcca

SEQ ID NO: 260214 - DNA, 75 bp, Artificial Sequence
  Synthetic
gagcagtggcaaacagcatgcgagaatcaccaaactccacacagagcaccactcaccaggagccccccccgactc

SEQ ID NO: 260215 - DNA, 75 bp, Artificial Sequence
  Synthetic
gtaagcggagggtgtacaaaatgtgacagcggagatgaacaatttacttggttccatcttccgagcaatatagaa

SEQ ID NO: 260216 - DNA, 75 bp, Artificial Sequence
  Synthetic
actcaccaggagccccccccgactcctgggccaacccaagacaacgacatcgactgggggtactgatcaacaaca

SEQ ID NO: 260217 - DNA, 75 bp, Artificial Sequence
  Synthetic
tgattcggcagagatctcacatgatgtcatgttgagggagtacaagagtttatctgctcttgaatttgagccatg

SEQ ID NO: 260218 - DNA, 75 bp, Artificial Sequence
  Synthetic
tgtgcaacgatccatactcttttaattttgagactgtcgcaagcccaaatattgtccttaagaaacatacacaga

SEQ ID NO: 260219 - DNA, 75 bp, Artificial Sequence
  Synthetic
ccaaaccctccgcccaaacctcccccaaactccccaacctaccgccccacacggccaaaccggcaggagcacccc

SEQ ID NO: 260220 - DNA, 75 bp, Artificial Sequence
  Synthetic
ccacggctgggaatctccaacatagactagatgacggcataactcagatgacattcacccctgcatctctctata

SEQ ID NO: 260221 - DNA, 75 bp, Artificial Sequence
  Synthetic
attaagattgcgctgactaggaggcccctcggtatcaagaggctgatgcggatagtcaattactcgagcatgcat

SEQ ID NO: 260222 - DNA, 75 bp, Artificial Sequence
  Synthetic
ctgcatcttcctcttggtataaggcatcccatctcctttctgtacccgaggtaagatgtgcaagacacgggaact

SEQ ID NO: 260223 - DNA, 75 bp, Artificial Sequence
  Synthetic
acatgggaacacccagccaccagctggccaggacacctccgaacaacaagacaggccagacaaacagccatccat

SEQ ID NO: 260224 - DNA, 75 bp, Artificial Sequence
  Synthetic
tgaaattcctccagggtccaatcaaagcttactagatcaactagctatcaatttatctctgattgccatgcattc

SEQ ID NO: 260225 - DNA, 75 bp, Artificial Sequence
  Synthetic
tgtctatcaaattagaaaaaacacgggtagaagattctggatcccggttgacgccttcagggtgcaagatgggct

SEQ ID NO: 260226 - DNA, 75 bp, Artificial Sequence
  Synthetic
gcggcacggtacgcttttgtctaaatcagatgagatcacactgaccaggttattcacctcacagcggcagcgtgt

SEQ ID NO: 260227 - DNA, 75 bp, Artificial Sequence
  Synthetic
ggctggcgacacacagctcaagacaggagcaagcaattctcttctgtctatgcttgacaagctgagcagtaaatc

SEQ ID NO: 260228 - DNA, 75 bp, Artificial Sequence
  Synthetic
agtgaagctcagaattcagatgtggtccgcctattcgagtatgcagcacttgaagtgctcctcgactgttcttat

SEQ ID NO: 260229 - DNA, 75 bp, Artificial Sequence
  Synthetic
agggcaaagccaagacagtactcctgcatctgcggatcatgtccaaccacctgtcgactttgtgcaagcgatgat

SEQ ID NO: 260230 - DNA, 75 bp, Artificial Sequence
  Synthetic
aagggagcactttaaaagttgaggtcccagtatttacccttaacagtgatgatccagaggatagatggaattttg

SEQ ID NO: 260231 - DNA, 75 bp, Artificial Sequence
  Synthetic
atccaacagcttaaaacatctgtagcgatcatggaagctaatttaggtatgatgaagattctggaccctggttgt

SEQ ID NO: 260232 - DNA, 75 bp, Artificial Sequence
  Synthetic
aacattctttcaatatctagtgggaagttgattggtcagtccgtggtttcctatgatgaagatacctctataaag

SEQ ID NO: 260233 - DNA, 75 bp, Artificial Sequence
  Synthetic
tagtacaagatattggtgctcgagtgaaggatccatttacccgacaacctgcagcatttcttcaggagttagatc

SEQ ID NO: 260234 - DNA, 75 bp, Artificial Sequence
  Synthetic
ggagtgtctgaagagagagcacaaagattcatggtaatagcaggatctctccctcgggcatgcagcaatggtact

SEQ ID NO: 260235 - DNA, 75 bp, Artificial Sequence
  Synthetic
cgcccgatgcatccaaactcctcaaccaagctcctgaataagctggatgcagccaagtcgatcgaagagatcaga

SEQ ID NO: 260236 - DNA, 75 bp, Artificial Sequence
  Synthetic
actctccaatattgcggccacgatatcccaccccatcattcactcaaggttgaatgcagtaggtctagtcaacca

SEQ ID NO: 260237 - DNA, 75 bp, Artificial Sequence
  Synthetic
aggctcctgccccattagtgtcacaaggaatctttcttgagccttccctcacaaacccatgcttcagcacctcaa

SEQ ID NO: 260238 - DNA, 75 bp, Artificial Sequence
  Synthetic
gctcagggaagtagtatcaatgaggacatggctgctgagctaaaactaaccccggcagcaaggagaggcctggca

SEQ ID NO: 260239 - DNA, 75 bp, Artificial Sequence
  Synthetic
aggcaaggtgctctcatatctctcttatgttcccactctcaagtgatgaggaaccatgttgctcttgcggggaaa

SEQ ID NO: 260240 - DNA, 75 bp, Artificial Sequence
  Synthetic
gtctacaagatcccaactgcagcattgaaaatatctggctcaagcctatataatctcgcactcaatgtcactatt

SEQ ID NO: 260241 - DNA, 75 bp, Artificial Sequence
  Synthetic
aagccctgagcacagcatgggagaagcacgggagcgtccagccacacgccagtcaggacactcctgaccaacaag

SEQ ID NO: 260242 - DNA, 75 bp, Artificial Sequence
  Synthetic
gctgttgcagtgactgccgatcatgaagtcacctctactaagatagagaagaggcacaccattgccaaatacaat

SEQ ID NO: 260243 - DNA, 75 bp, Artificial Sequence
  Synthetic
acctgagcaggcgactccacacaacaacccgccgatcacatccaccgaaccgcctcccactcaggccgcaagcga

SEQ ID NO: 260244 - DNA, 75 bp, Artificial Sequence
  Synthetic
ccggccacattcgccgaacaagcccccacccaagacagagacgaaggcgtcgacacagaggttaggaccggagca

SEQ ID NO: 260245 - DNA, 75 bp, Artificial Sequence
  Synthetic
cacattcttcatatacagcaaacgaatattcaaagatggagcaatactcagtcaggtccttaaaaattcatctaa

SEQ ID NO: 260246 - DNA, 75 bp, Artificial Sequence
  Synthetic
tatcttgattgcttatagttagttcacctgtctatctaattagaaaaaacacgggtagaagagtctggatcccgg

SEQ ID NO: 260247 - DNA, 75 bp, Artificial Sequence
  Synthetic
cacaagacagatcttagaggtcacaatactgggtctcagagtcaaagatctcaataaagtaggtgatgtaattgg

SEQ ID NO: 260248 - DNA, 75 bp, Artificial Sequence
  Synthetic
caacagaacactgactgctttactcaacccccttggtgattccatccgcaagatacaaggatctgtatccacacc

SEQ ID NO: 260249 - DNA, 75 bp, Artificial Sequence
  Synthetic
gagacccagttcttggacttgatgagagcggtggcgaacagcatgcgagaagcgcaaaatcccgctcagagcacc

SEQ ID NO: 260250 - DNA, 75 bp, Artificial Sequence
  Synthetic
ggtgtgaaccccgagcgcgaggccgaggctcgaatttgagggaaccttctaccgatatgacgtctatcttcgatg

SEQ ID NO: 260251 - DNA, 75 bp, Artificial Sequence
  Synthetic
caagccaaccagaatgccgccaacatcctccggcttaaggagagcattgctgcaaccaatgaagctgtgcatgag

SEQ ID NO: 260252 - DNA, 75 bp, Artificial Sequence
  Synthetic
gtgaaatgacgctcaataaactctcgcaaccggtacagcacccttctgaactaattaagtctgccactgcaagcg

SEQ ID NO: 260253 - DNA, 75 bp, Artificial Sequence
  Synthetic
ccaattctcctgctcgcaccccacctctcaatccgcagtcccacacggccaaacccacaaacgaaccctctcgtc

SEQ ID NO: 260254 - DNA, 75 bp, Artificial Sequence
  Synthetic
ctggggcatcccaagacaacgacactgactgggggtactgatcgactacacccagcctgccttcacaggatcata

SEQ ID NO: 260255 - DNA, 75 bp, Artificial Sequence
  Synthetic
aaagttgaattccgattctttgaaactcgtattcggattcaattaattatcttaaaacagcagtgaacgtagttg

SEQ ID NO: 260256 - DNA, 75 bp, Artificial Sequence
  Synthetic
aagttctggtagtctgtcagttcggagagtttagaaaaaactaccggttgtagatgaccaaaggacgatatacgg

SEQ ID NO: 260257 - DNA, 75 bp, Artificial Sequence
  Synthetic
ctcgtattcggattcaattaattatcttaaaacagcagtgaacgtagttgtccttaattatagtcctgtcattca

SEQ ID NO: 260258 - DNA, 75 bp, Artificial Sequence
  Synthetic
cggaatccttcgggggctcctcctcacaaacccacgcttcaacaacccaaacaacagctctctctcacccctcct

SEQ ID NO: 260259 - DNA, 75 bp, Artificial Sequence
  Synthetic
agacagtaaagaggactcagtgttcatcaccacatacggattcatattccaggtcggaaatgaggagacatctgt

SEQ ID NO: 260260 - DNA, 75 bp, Artificial Sequence
  Synthetic
ggtggggggcacctatccatgacccagattttatcggggggataggcaaagaactcattgtagatgatgctagtg

SEQ ID NO: 260261 - DNA, 75 bp, Artificial Sequence
  Synthetic
gggaaccttaataatatgcgtgccacctatttggggactttatctgtaagcacaaccaaagggtttgcctcagca

SEQ ID NO: 260262 - DNA, 75 bp, Artificial Sequence
  Synthetic
gacaaccctgatcgagaggacagatcagacaaacaactgtccacacccgagcaagtgagtccacatgacagcccg

SEQ ID NO: 260263 - DNA, 75 bp, Artificial Sequence
  Synthetic
cttgtcccgaaggtagtgacacaagtcggctccgtgatagaagaacttgacacctcacactgtatagagtctgat

SEQ ID NO: 260264 - DNA, 75 bp, Artificial Sequence
  Synthetic
acaacattatttgaggactgggtggccaactacccaggagtagggggtggatcttttattgacagccgcgtatgg

SEQ ID NO: 260265 - DNA, 75 bp, Artificial Sequence
  Synthetic
agcaactctctgttgtcgatgcttgataagctcagcaataagtcgtctaatgctaaaaagggcccatggtcgagc

SEQ ID NO: 260266 - DNA, 75 bp, Artificial Sequence
  Synthetic
ataagctcagcaataagtcgtctaatgctaaaaagggcccatggtcgagcccccaggaagggcaccatcaacgtc

SEQ ID NO: 260267 - DNA, 75 bp, Artificial Sequence
  Synthetic
tgacagtgaccagatgagttttgcaccagctgagtatgcacaactttattcttttgccatgggtatggcatcagt

SEQ ID NO: 260268 - DNA, 75 bp, Artificial Sequence
  Synthetic
tgtataaacaaaaggcacaacaaaagactttgatatggcttgggaataatacccttgatcagatgagagccacta

SEQ ID NO: 260269 - DNA, 75 bp, Artificial Sequence
  Synthetic
cacagtgttcttatttaccccttacaatctctctacagacggtaaaaagagaacatcacttaaacagtgcacaag

SEQ ID NO: 260270 - DNA, 75 bp, Artificial Sequence
  Synthetic
atataggagtggagagagacactgtccgtgcattgatcatgtcacgccctatgcatccgagctcctcagctaagc

SEQ ID NO: 260271 - DNA, 75 bp, Artificial Sequence
  Synthetic
aggcctggcggctgctgcccaacgagtatccgaagagatcagcagcgtggatattcccactcaacaggcaggggt

SEQ ID NO: 260272 - DNA, 75 bp, Artificial Sequence
  Synthetic
atagaagacttaagaaaaaattactggatatacgcaacccaaaagcaatacacgggtagaacggttgaagaagct

SEQ ID NO: 260273 - DNA, 75 bp, Artificial Sequence
  Synthetic
tggggatggggagacccaattcatggatctgatgagagcggtggcaaacagcatgcgagaagcaccaactcctgc

SEQ ID NO: 260274 - DNA, 75 bp, Artificial Sequence
  Synthetic
ccgttcaatcagcattacaaggtatctgcaccaagctcctctctgcaaacccaaggtccaatactccaagcgaca

SEQ ID NO: 260275 - DNA, 75 bp, Artificial Sequence
  Synthetic
atcacatattgataggctccttttctagttaactgagcccttgtcgatttaatgatactatattagaaaaaaatt

SEQ ID NO: 260276 - DNA, 75 bp, Artificial Sequence
  Synthetic
atcgacaatgtccagcctgcctccagagagccatcacaaacacccttcctaaaattctcccatgctccctaactc

SEQ ID NO: 260277 - DNA, 75 bp, Artificial Sequence
  Synthetic
agttttacttctagtagtaatgaccttagctatctctgcggctgtcctggtgcatagcatgagggccagtacgcc

SEQ ID NO: 260278 - DNA, 75 bp, Artificial Sequence
  Synthetic
gagagccatcacaaacacccttcctaaaattctcccatgctccctaactcacaaccctgcgtgacaagactaaaa

SEQ ID NO: 260279 - DNA, 75 bp, Artificial Sequence
  Synthetic
aaagatactgggtgtatctaatcctgatactatagaacttgtagagggtgagatccttagtgtcagcggaggatg

SEQ ID NO: 260280 - DNA, 75 bp, Artificial Sequence
  Synthetic
gtcaacatctttgggtaaggacccggtgctgactattccacctaatacaatcacactcatgggagccgaaggcag

SEQ ID NO: 260281 - DNA, 75 bp, Artificial Sequence
  Synthetic
gcccgccaacagtctaaccagatcccgaggtattagaaaaaaatacgggtagaagagagacacccagagatcagg

SEQ ID NO: 260282 - DNA, 75 bp, Artificial Sequence
  Synthetic
gggaaaacaaccaacaggagggaacacgggtaggacatggcgggctccggtcccgaaagggcagagcaccagatc

SEQ ID NO: 260283 - DNA, 75 bp, Artificial Sequence
  Synthetic
cgaggtattagaaaaaaatacgggtagaagagagacacccagagatcaggacgattcaccaagacctccgctctc

SEQ ID NO: 260284 - DNA, 75 bp, Artificial Sequence
  Synthetic
aatatgcccaaggataaagaggcgtgtgcaaaagccccattagaggcatataacagaacactgactactttgctc

SEQ ID NO: 260285 - DNA, 75 bp, Artificial Sequence
  Synthetic
gggactgttatcgacagcataattacggcccagggtaagtcggtcgagaccatcggaaagagcacaattccgcaa

SEQ ID NO: 260286 - DNA, 75 bp, Artificial Sequence
  Synthetic
tttatcccggcgcctactacaggatcaggttgcactcggataccctcatttgacatgagtgctacccactactgt

SEQ ID NO: 260287 - DNA, 75 bp, Artificial Sequence
  Synthetic
ataggtgccgttattggcagtgtagctcttggggttgcaacagcggcacagataacagcagctgcggccctaata

SEQ ID NO: 260288 - DNA, 75 bp, Artificial Sequence
  Synthetic
gccccaagccagccatgacacccccgaccaacaagccaggtcggacgaacagctatccacacccgagcaggcaaa

SEQ ID NO: 260289 - DNA, 75 bp, Artificial Sequence
  Synthetic
aagataccaactgcagcactaaaggtctctggctcgagtctgtacaatcttgcgctcaatgtcactattgatgtg

SEQ ID NO: 260290 - DNA, 75 bp, Artificial Sequence
  Synthetic
gctcaagaccggagcaagcaactctcttctgtctatgcttgacaagctgagcaataaatcgtctaatgctaaaaa

SEQ ID NO: 260291 - DNA, 75 bp, Artificial Sequence
  Synthetic
tttaatcctccaagtgacccgactgactgtgatctatcaagagtcccaaatgatgacatatatattgtcagtgct

SEQ ID NO: 260292 - DNA, 75 bp, Artificial Sequence
  Synthetic
gggtggcaaattacccgggagtgggaagtggatcttttattgatgaccgtgtatggttcccaatttacggagggc

SEQ ID NO: 260293 - DNA, 75 bp, Artificial Sequence
  Synthetic
acgggtaggacatggcgagctccggtcctgaaagggcagagcatcagattatcctaccagagtcacacctgtctt

SEQ ID NO: 260294 - DNA, 75 bp, Artificial Sequence
  Synthetic
agagagagcacagaggttcatgatgatagcgggttctctccctcgggcgtgcagcaatggtaccccattcgtcac

SEQ ID NO: 260295 - DNA, 75 bp, Artificial Sequence
  Synthetic
ctgatgaacaaagttatcaaatccggatggctaaagcttcgtacaagcctgggcggttcggtggaaagcgcgtgc

SEQ ID NO: 260296 - DNA, 75 bp, Artificial Sequence
  Synthetic
ttacgctcatgggggccgaaggcagaattcttacaatagggacatctcatttcttgtatcaacgtggatcttcat

SEQ ID NO: 260297 - DNA, 75 bp, Artificial Sequence
  Synthetic
atttctctcccgccttattatatcctatgacagtctataataaaacagctactcttcatagtccttatacattta

SEQ ID NO: 260298 - DNA, 75 bp, Artificial Sequence
  Synthetic
acacaagggggcgaattgacactcaataaactctcgcaaccggtacagcatccttctgagctaattaaatctgcc

SEQ ID NO: 260299 - DNA, 75 bp, Artificial Sequence
  Synthetic
tcttgcagctgcagggattgtggtaacaggagacaaagcagtcaacatatacacctcatcccagacagggtcaat

SEQ ID NO: 260300 - DNA, 75 bp, Artificial Sequence
  Synthetic
acgccggggatggggagacccaattcctggatctgatgagagcagtggcaaacagcatgagagaagcgccaagct

SEQ ID NO: 260301 - DNA, 75 bp, Artificial Sequence
  Synthetic
cccaactcatgtatcactggagtctatactgatccgtaccccttaatcttccatagaaaccacaccttgagaggg

SEQ ID NO: 260302 - DNA, 75 bp, Artificial Sequence
  Synthetic
gtagaagacttaagaaaaaactgctgggtacaagcaaccaaagagcaatacacgggtagaacggtcagaggagcc

SEQ ID NO: 260303 - DNA, 75 bp, Artificial Sequence
  Synthetic
agctagatgcagccaggtcgattgaagagatcaggaagatcaaacgccttgcgctgaatggttgattgccatcac

SEQ ID NO: 260304 - DNA, 75 bp, Artificial Sequence
  Synthetic
aacttacaataggctcttgtctctccaacgccatacggaatccctccaagggcccccccaacaaacccgcgatcc

SEQ ID NO: 260305 - DNA, 75 bp, Artificial Sequence
  Synthetic
ctagttgagattcttaagggtgataaggtttaagaagccagatctgaccagctgagtcgaacataggattactcg

SEQ ID NO: 260306 - DNA, 75 bp, Artificial Sequence
  Synthetic
ccaccaataatccacacagggccaaagaaattagaaaaaagtacgggtagaagggagacattcagagatcagggc

SEQ ID NO: 260307 - DNA, 75 bp, Artificial Sequence
  Synthetic
cattagagattaagaaaaaatacgggtagaatcgaagtgccccgactgcgccaaaatggactcatccaggacaat

SEQ ID NO: 260308 - DNA, 75 bp, Artificial Sequence
  Synthetic
gaaaatggtgctgtgccacctatctctcacaacaccaaggatcaaactagatatcactgcaagcccaactctcat

SEQ ID NO: 260309 - DNA, 75 bp, Artificial Sequence
  Synthetic
aggccaagtctttgttactcctgagcttgtcattgtgactcatacagatgagaacaagttcacatgcctcaccca

SEQ ID NO: 260310 - DNA, 75 bp, Artificial Sequence
  Synthetic
ttgacgagctatttgagaccagtggaactgtcattgacagcataattacagcccagggcaagccgatagagactg

SEQ ID NO: 260311 - DNA, 75 bp, Artificial Sequence
  Synthetic
cgggaagaagcagatcaccccacaatatagaatccagcgtcttgactcatggacagacagcaaagaagactcggt

SEQ ID NO: 260312 - DNA, 75 bp, Artificial Sequence
  Synthetic
tatagaatccagcgtcttgactcatggacagacagcaaagaagactcggtattcatcacaacctatggattcatc

SEQ ID NO: 260313 - DNA, 75 bp, Artificial Sequence
  Synthetic
tatactcacaatgtgatattatctggttgcagagatcactcacactcacatcaatacttagcacttggtgtgctt

SEQ ID NO: 260314 - DNA, 75 bp, Artificial Sequence
  Synthetic
ttcttgtatcaacgagggtcttcatatttctcccctgccttattgtatcccatgacagtaaataacaaaacggct

SEQ ID NO: 260315 - DNA, 75 bp, Artificial Sequence
  Synthetic
gaggagagatgtgtatagggtttcaactgcagtgctcaaagtatccggctcaagcctgtacaatcttgcgcttaa

SEQ ID NO: 260316 - DNA, 75 bp, Artificial Sequence
  Synthetic
gtatggttcccagtttacggagggctaaaacccaattcacccagtgacactgcacaagaagggaaatatgtaata

SEQ ID NO: 260317 - DNA, 75 bp, Artificial Sequence
  Synthetic
ccaaatttgcatggctccatataaaacaggcccagaggcatctgattgtagcagcaagaacaaggtccgcagtca

SEQ ID NO: 260318 - DNA, 75 bp, Artificial Sequence
  Synthetic
catatggcgggtccctgcctattcagcatcacaaggaacctgcaccaagcctctctcagcaaacctaaggtccaa

SEQ ID NO: 260319 - DNA, 75 bp, Artificial Sequence
  Synthetic
tgatatctcgactgaacttgggaatgtcaacaactcgataagtaatgctttggataagttagaggaaagcaacag

SEQ ID NO: 260320 - DNA, 75 bp, Artificial Sequence
  Synthetic
gagcttgtcattgtgacacatacagatgagaacaagttcacatgcctcactcaagaacttgtattaatgtatgca

SEQ ID NO: 260321 - DNA, 75 bp, Artificial Sequence
  Synthetic
gttaaaaagcgaaggagcaattgaagtcgcacgggtagaaggtttgaatctcgagtgcgagcccgaagcacaaat

SEQ ID NO: 260322 - DNA, 75 bp, Artificial Sequence
  Synthetic
aaaccatgttgctcttgcggggaaacagaatgaggccacactggctgtccttgagatcgatggttttaccaacaa

SEQ ID NO: 260323 - DNA, 75 bp, Artificial Sequence
  Synthetic
tcaagtctatgacgttgtatcattgatggagggatttgcgtacagtgctgttcagctgcttgaaccatcaggtac

SEQ ID NO: 260324 - DNA, 75 bp, Artificial Sequence
  Synthetic
taagtacaatcctttcaggaaataagttgcatccttaagactgcaattcactcactttcctgcatcattattaca

SEQ ID NO: 260325 - DNA, 75 bp, Artificial Sequence
  Synthetic
gggcctgcctcactatggtagtcacatgcaagaagagtgcaactaatactgagagaatggttttctcagtggtgc

SEQ ID NO: 260326 - DNA, 75 bp, Artificial Sequence
  Synthetic
aagtctgacagcctgtcaattagaagaattaagaaaaaactaccagatatagataaccaaagggcaatatacggg

SEQ ID NO: 260327 - DNA, 75 bp, Artificial Sequence
  Synthetic
tgcagtattcgacaacatatcccgcagtcgtgtaacccgggtgagttcaagcagcaccaaggcagcatacacgac

SEQ ID NO: 260328 - DNA, 75 bp, Artificial Sequence
  Synthetic
aacaagcaagacttaaccccgtatctgcagtattcgacaacatatcccgcagtcgtgtaacccgggtgagttcaa

SEQ ID NO: 260329 - DNA, 75 bp, Artificial Sequence
  Synthetic
gaattaagaaaaaactaccagatatagataaccaaagggcaatatacgggtagaacagtcagagaggccgtccct

SEQ ID NO: 260330 - DNA, 75 bp, Artificial Sequence
  Synthetic
tcctgcagtgtaagtgcaactcctttaggttgtgatatactgtgctctaaggtcacagagactgaggaagaggat

SEQ ID NO: 260331 - DNA, 75 bp, Artificial Sequence
  Synthetic
gtctggatcccgaccaacacattcagaacacaatatgggctccaaaccttctaccaggatcctaccacccttgat

SEQ ID NO: 260332 - DNA, 75 bp, Artificial Sequence
  Synthetic
atgtcccacgatcagaggaattcaacagcatccgtacagatccggcattctggtttcactcaaaatggtccagag

SEQ ID NO: 260333 - DNA, 75 bp, Artificial Sequence
  Synthetic
tagccaagtcgcgctagagaatgatgaaagggaggcaaagaacacatggcgcctggtattccggatcgcaatcct

SEQ ID NO: 260334 - DNA, 75 bp, Artificial Sequence
  Synthetic
tgcagggattgtaataacaggagataaggcagtcaaaatatacacctcatctcagaccggatctatcatagtcaa

SEQ ID NO: 260335 - DNA, 75 bp, Artificial Sequence
  Synthetic
aagaaagtgacgtttgacaagctggaaaggaagataaggagacttgacctatctgtcgggctcagtgacgtgctc

SEQ ID NO: 260336 - DNA, 75 bp, Artificial Sequence
  Synthetic
cccacgatgcctagagtcaagctgaatattaacataagccagggtcccatgctgttgggcagccacaatctgaca

SEQ ID NO: 260337 - DNA, 75 bp, Artificial Sequence
  Synthetic
caccttgctcactccccttggcgattccatccgcaagatacaagggtctgtgtccacatccggaggaagaagacg

SEQ ID NO: 260338 - DNA, 75 bp, Artificial Sequence
  Synthetic
aatcatttgattggccataatttgaaggatcgtgaaaccatcaggtcagacacattcttcatatacagcaaacga

SEQ ID NO: 260339 - DNA, 75 bp, Artificial Sequence
  Synthetic
atcatgctgagggagtacaagagtttatctgcccttgaattcgagccatgtatagaatatgaccctgtcaccaat

SEQ ID NO: 260340 - DNA, 75 bp, Artificial Sequence
  Synthetic
ctgaatgatcgctcaactgtaattaatctagctacactaaggattaagaaaaaatacgggtagaattggagtgcc

SEQ ID NO: 260341 - DNA, 75 bp, Artificial Sequence
  Synthetic
acgtcacatcattctatccctctgcgttccaagaacacctgaactttatcccggcgcctactacaggatcaggtt

SEQ ID NO: 260342 - DNA, 75 bp, Artificial Sequence
  Synthetic
aagttgcatccgtctgacaagctctcttgatggcaggcctctagcagctgcaggaattgtggtaacaggagacaa

SEQ ID NO: 260343 - DNA, 75 bp, Artificial Sequence
  Synthetic
gactgtgttaaaattacacaacaggtcggtgtagaactcagcctttacctaactgaattgactacagcattcggg

SEQ ID NO: 260344 - DNA, 75 bp, Artificial Sequence
  Synthetic
aactgaattgactacagcattcgggccacagattacttctcctgctttaacacagctgaccatccaggcacttta

SEQ ID NO: 260345 - DNA, 75 bp, Artificial Sequence
  Synthetic
tgacacccacaatcgaaagtcttgcagtgtgagtgcaacccccttgggttgtgatatgctgtgctctaaagtcac

SEQ ID NO: 260346 - DNA, 75 bp, Artificial Sequence
  Synthetic
gaacttgacacctcatattgtatagaaaccgacttggatttatattgtacaagaatagtgacattccctatgtct

SEQ ID NO: 260347 - DNA, 75 bp, Artificial Sequence
  Synthetic
gtgatatgctgtgctctaaagtcacagagactgaggaagaggattataattcagctatccctacgtcgatggtac

SEQ ID NO: 260348 - DNA, 75 bp, Artificial Sequence
  Synthetic
gggaatgtcaacaactcaataagcaatgccctggataagttatcagaaagtaacagcaaactagacaaagtcaat

SEQ ID NO: 260349 - DNA, 75 bp, Artificial Sequence
  Synthetic
tgcaaagagagggtttcctcaaaacgcaatcatgacttgaagagcaagaatcgtcgaagagttgctactttcatc

SEQ ID NO: 260350 - DNA, 75 bp, Artificial Sequence
  Synthetic
ttcccagtttacggagggctaaaacccaattcgcctagcgacactgcacaagaagggaaatatgtaatatacaag

SEQ ID NO: 260351 - DNA, 75 bp, Artificial Sequence
  Synthetic
gaagaaagtaacagcaaactagacaaagtcaacgtcaaattgaccagcacatctgctctcattacctatatcatt

SEQ ID NO: 260352 - DNA, 75 bp, Artificial Sequence
  Synthetic
cgatacaatgacacatgtccagatgagcaagattaccagattcgaatggccaagtcttcgtataagcctgggcgg

SEQ ID NO: 260353 - DNA, 75 bp, Artificial Sequence
  Synthetic
atgtcccacgatcagaggaattcagcagcatccgcacagatccggcattctggtttcactcaaaatggtccagag

SEQ ID NO: 260354 - DNA, 75 bp, Artificial Sequence
  Synthetic
tcatgggggccgaaggcagagttctcacagtagggacatctcatttcttgtaccagcgagggtcatcatacttct

SEQ ID NO: 260355 - DNA, 75 bp, Artificial Sequence
  Synthetic
atggaccgcgcagttagccaagttgcgctagagaatgatgaaagagaggcaaagaatacatggcgcttggtattc

SEQ ID NO: 260356 - DNA, 75 bp, Artificial Sequence
  Synthetic
ggataactctgaggctcagcggagaatttgatgcagcctatcaaaagaatatctcaatactcgattctcaggtca

SEQ ID NO: 260357 - DNA, 75 bp, Artificial Sequence
  Synthetic
aatcatctgattggccacaacctgaaagatcgtgaaaccatcaggtcagacacattcttcatatacagcaagcgg

SEQ ID NO: 260358 - DNA, 75 bp, Artificial Sequence
  Synthetic
tgcgaaaatagcccatatgtcaccacatgtgaaagcagcactaagggcatcatccgtgttaatctgggcttatgg

SEQ ID NO: 260359 - DNA, 75 bp, Artificial Sequence
  Synthetic
tggcagagagtaacagcaagctagacaaggtcaacgtcagactaaccagcacatccgctctcattacctatattg

SEQ ID NO: 260360 - DNA, 75 bp, Artificial Sequence
  Synthetic
caaggtcaacgtcagactaaccagcacatccgctctcattacctatattgtcctaactgtcttatctcttgtgtt

SEQ ID NO: 260361 - DNA, 75 bp, Artificial Sequence
  Synthetic
aatgattttgatccatataaagaaatggaatacctgacaacccttgagtacctaagagatgacagtgtggcagta

SEQ ID NO: 260362 - DNA, 75 bp, Artificial Sequence
  Synthetic
tggaatacctgacaacccttgagtacctaagagatgacagtgtggcagtatcgtactcactcaaagagaaggagg

SEQ ID NO: 260363 - DNA, 75 bp, Artificial Sequence
  Synthetic
tgggaataatacccttgagcagatgagagccacgacaagagcataaacgtggatgagaggtggatgtatgcctga

SEQ ID NO: 260364 - DNA, 75 bp, Artificial Sequence
  Synthetic
atcggaagtcttgcagtgtgagtgcaactcccttaggttgtgatatgctatgctctaaagtcacggagactgagg

SEQ ID NO: 260365 - DNA, 75 bp, Artificial Sequence
  Synthetic
agagccacgacaagagcataaacgtggatgagaggtggatgtatgcctgacagcaacttgtaggccaattctgac

SEQ ID NO: 260366 - DNA, 75 bp, Artificial Sequence
  Synthetic
cctggatcgaggacatttcttttgtacactcatatgttttgactcctgctcagctgggaggactgagtaaccttc

SEQ ID NO: 260367 - DNA, 75 bp, Artificial Sequence
  Synthetic
agcatatccttgaccaagagtatgttagcgatgagtcaactgtcctttaacagcaataagaaacgtatcactgac

SEQ ID NO: 260368 - DNA, 75 bp, Artificial Sequence
  Synthetic
cagagaagccgctcttcgatcggaagttgggcttcacaatatccgttctaccgcatcaccaataacaagcgtcag

SEQ ID NO: 260369 - DNA, 75 bp, Artificial Sequence
  Synthetic
tggggactgggtggcaaactatccaggagtagggggtgggtcctttattgacaaccgcgtatggttccctgtcta

SEQ ID NO: 260370 - DNA, 75 bp, Artificial Sequence
  Synthetic
gttgggcttcacaatatccgttctaccgcatcaccaataacaagcgtcagtcatggaccgcgcagtcaacagaat

SEQ ID NO: 260371 - DNA, 75 bp, Artificial Sequence
  Synthetic
gcaatcatgatccgaagagcaagaatcgtcgaagagttgccacttttatcacaactgacctgcaaaagtattgtc

SEQ ID NO: 260372 - DNA, 75 bp, Artificial Sequence
  Synthetic
ttttgagactgtcgcaagcccaaatattgtccttaagaaacatacccaaaaagtcttatttgagacttgttcaaa

SEQ ID NO: 260373 - DNA, 75 bp, Artificial Sequence
  Synthetic
ctcgtattcggactcagtcgattatctctaagcagaaatgcgcgtagctgtccttaattgcagtcctgtcattca

SEQ ID NO: 260374 - DNA, 75 bp, Artificial Sequence
  Synthetic
tgtaagggagggcggggtggtgatcatcaaagtgttgtatgcaatgggatactactttcatctactcatgaactt

SEQ ID NO: 260375 - DNA, 75 bp, Artificial Sequence
  Synthetic
cccagtccgccctcacagggccatctcaaaccctttgccccaaactctcccacactcctcgactcacaatcccac

SEQ ID NO: 260376 - DNA, 75 bp, Artificial Sequence
  Synthetic
ccctcggtatcaagaggctgacacggataatcaattactcgagcatgcatgcaatgctattcagagatgatgttt

SEQ ID NO: 260377 - DNA, 75 bp, Artificial Sequence
  Synthetic
agggttggaaagatgacattgtgtcacctatcttttgtgatgccaagaatcaaactgaataccgacacaagctcg

SEQ ID NO: 260378 - DNA, 75 bp, Artificial Sequence
  Synthetic
aatattgtcttatatatgggtgatttatacaagaatatgccaggaattctactttccaacattgcagctacaata

SEQ ID NO: 260379 - DNA, 75 bp, Artificial Sequence
  Synthetic
ggatacaaggcaaagcgactcatggtagatagcacgggtaggatatgcagagctccggtcccgaaagggcagagc

SEQ ID NO: 260380 - DNA, 75 bp, Artificial Sequence
  Synthetic
ttgacagcataattacggcccagggtaaatcagcagagaccgtcggaagaagcgcaatcccacaaggcaagacca

SEQ ID NO: 260381 - DNA, 75 bp, Artificial Sequence
  Synthetic
gcgaattgacactcaataaactctcgcaaccggtacaacacccttctgagttaattaaatctgccactgcatgcg

SEQ ID NO: 260382 - DNA, 75 bp, Artificial Sequence
  Synthetic
ggatttgcatacggcgccgtccagctgcttgagccgtcaggtacgtttgcaggggatttcttcgcattcaacctg

SEQ ID NO: 260383 - DNA, 75 bp, Artificial Sequence
  Synthetic
tactgtcggatgctgtgaaaccattacttagccccgatcaagtgagctctatcatgtctcctaacataattacat

SEQ ID NO: 260384 - DNA, 75 bp, Artificial Sequence
  Synthetic
ttttgagactgttgcaagcccaaatattgtcctcaagaaacatacacagaaagtcttatttgagacttgttcaaa

SEQ ID NO: 260385 - DNA, 75 bp, Artificial Sequence
  Synthetic
acgggccatctcaggacaacgacactgactgggggtactgatcgacgacattcagcccgcccccatagggtcacc

SEQ ID NO: 260386 - DNA, 75 bp, Artificial Sequence
  Synthetic
accaaattcagatggccaaatcctcgtataaacctaggcgattcggtggaaagcgtgtccagcaagccatccttt

SEQ ID NO: 260387 - DNA, 75 bp, Artificial Sequence
  Synthetic
cagaccccctgacccactgccccatacggctaaaccggcaggagcacccccccaccctcctccccacccccagcc

SEQ ID NO: 260388 - DNA, 75 bp, Artificial Sequence
  Synthetic
ctcgtttaggcgaaaccttctctctgaggaccagaagaaacatgtaaaggaggcaacctcgactaaccgtctctt

SEQ ID NO: 260389 - DNA, 75 bp, Artificial Sequence
  Synthetic
tagacctagtcttgaaacagacatcctccatccctatgatgcgatctgaaatccagcagcttaaaacatctgttg

SEQ ID NO: 260390 - DNA, 75 bp, Artificial Sequence
  Synthetic
agccaggtcgattgaagagatcaggaagatcaaacgccttgcgctgaatggttgattgccatcacaacttacaac

SEQ ID NO: 260391 - DNA, 75 bp, Artificial Sequence
  Synthetic
atacttgagaccagtggagctgtcatcgacagcataattacggcccagggcaaatcagtagagactgtcgggaag

SEQ ID NO: 260392 - DNA, 75 bp, Artificial Sequence
  Synthetic
agatgacaatgtagcagtatcatactcgctcaaagagaaggaggtgaaagtaaatgggcggatttttgctaagct

SEQ ID NO: 260393 - DNA, 75 bp, Artificial Sequence
  Synthetic
gacgtctcacttcttgtaccaacgagggtcttcgtatttctcccccgccttgttataccctatgacaatacataa

SEQ ID NO: 260394 - DNA, 75 bp, Artificial Sequence
  Synthetic
tgcttgacaagctgagcaacaaatcgtctaatgctaaaaaggggccaaggtcgagcccccaggaaggccaccatc

SEQ ID NO: 260395 - DNA, 75 bp, Artificial Sequence
  Synthetic
gatgtttgtgggagaccctttcaatcccccgagtgacccgactgactgtgatctctcaagagtcccaaatgatga

SEQ ID NO: 260396 - DNA, 75 bp, Artificial Sequence
  Synthetic
tgaatgcagtgggtctaatcaaccatgatgggtcacaccagcttgctgacatagatttcatcgaaatgtccgcga

SEQ ID NO: 260397 - DNA, 75 bp, Artificial Sequence
  Synthetic
tcatttgtgcactcatatgtcctgacccccgcccagttggggggactgagcaaccttcaatactcaaggctctac

SEQ ID NO: 260398 - DNA, 75 bp, Artificial Sequence
  Synthetic
ccgttttagacgacaacctgagtgaaaagatgcttcagctgatttcccggttatgctgtctgtatacagtgcttt

SEQ ID NO: 260399 - DNA, 75 bp, Artificial Sequence
  Synthetic
gtaatcatcaaagtgttgtatgcaatgggatactactttcatctactcatgaacttgtttgctccgtgttccaca

SEQ ID NO: 260400 - DNA, 75 bp, Artificial Sequence
  Synthetic
gtgaaatggcactcaataaactctcgcaaccagtacagcacccttctgagttaattaaatctgccacggtgagcg

SEQ ID NO: 260401 - DNA, 75 bp, Artificial Sequence
  Synthetic
gccaagctgaatatcaacatgaccccggatcctatgctgccaggcagccaccatcctacgatgctgacatgacta

SEQ ID NO: 260402 - DNA, 75 bp, Artificial Sequence
  Synthetic
attcaggggctggttgacacaacaaacactgtgattaaaatcgcattgaccaggagaccacttggcatcaagagg

SEQ ID NO: 260403 - DNA, 75 bp, Artificial Sequence
  Synthetic
caggagaccacttggcatcaagaggctgatgcggatagttaattactcgagcatgcatgcaatgctgtttaggga

SEQ ID NO: 260404 - DNA, 75 bp, Artificial Sequence
  Synthetic
actccctcgaatgatcgcacaactgcagtcaatctaacagcattagagattaagaaaaaatacgggtagaatcaa

SEQ ID NO: 260405 - DNA, 75 bp, Artificial Sequence
  Synthetic
ctgaccgaccaccagtccgacctctcgaggccaccgcagctgcaacaccaatcaccgtataccaatcatcacaac

SEQ ID NO: 260406 - DNA, 75 bp, Artificial Sequence
  Synthetic
gcaggcaatggaaaaaaatactagagtcagccactcctgacactgagagaatgataaaactagggcgggcagtac

SEQ ID NO: 260407 - DNA, 75 bp, Artificial Sequence
  Synthetic
tgctcggaatagaagctggtcacctttgacgggaggtaggaaaatactgggtgtatctaatcctgataccataga

SEQ ID NO: 260408 - DNA, 75 bp, Artificial Sequence
  Synthetic
aaggcaatcatacgccaatcagttatcttcctaactgatgactctctcactgacttagttatactagattagaaa

SEQ ID NO: 260409 - DNA, 75 bp, Artificial Sequence
  Synthetic
tgacccgggaactactgcttttgcagagatcaagcgattagaggcagtggggttactgagtcctagcattatgac

SEQ ID NO: 260410 - DNA, 75 bp, Artificial Sequence
  Synthetic
tgacacaacaaacactgtgattaagattgcactgactaggaggcccctcggtatcaaaaggctgatgcggataat

SEQ ID NO: 260411 - DNA, 75 bp, Artificial Sequence
  Synthetic
tcgtgctcaacaaaaattctacatgaaaactataggcaatgcagtcaaaggatattacagtaactgtgactctta

SEQ ID NO: 260412 - DNA, 75 bp, Artificial Sequence
  Synthetic
cccggcagcaaggaggggcctggcagctgctgcccaacgagtatctgaggaaatcggtggcatggatatcccagc

SEQ ID NO: 260413 - DNA, 75 bp, Artificial Sequence
  Synthetic
atttacacttagtcaggttcattctgaactcacatcgccaaatccggaggaagactacttagtgcgttacttgtt

SEQ ID NO: 260414 - DNA, 75 bp, Artificial Sequence
  Synthetic
aaagttgaaccctgactccttaggactcgaattcgaactcaaataaatgtcttaaaaaaaggttgcgcacaatta

SEQ ID NO: 260415 - DNA, 75 bp, Artificial Sequence
  Synthetic
atccatcttgattgcttatagctagttcacctgtctatctaattagaaaaaacacgggtagaagagtctggaccc

SEQ ID NO: 260416 - DNA, 75 bp, Artificial Sequence
  Synthetic
gaactcacatcgccaaatccggaggaagactacttagtgcgttacttgttcagaggaatagggactgcatcctca

SEQ ID NO: 260417 - DNA, 75 bp, Artificial Sequence
  Synthetic
gtcgcacgggtagaaggtgtgaatctcgagtgcgagcccgaagctcaaactcgagagagccttctgccaaaatgt

SEQ ID NO: 260418 - DNA, 75 bp, Artificial Sequence
  Synthetic
gataccatagaactcgtagagggtgagatccttagcgtcagcggagggtgcacaagatgtgacagcggagatgaa

SEQ ID NO: 260419 - DNA, 75 bp, Artificial Sequence
  Synthetic
agatccttagcgtcagcggagggtgcacaagatgtgacagcggagatgaacaatacacttggttccaccttccga

SEQ ID NO: 260420 - DNA, 75 bp, Artificial Sequence
  Synthetic
aggtggtgaggatggcaaaaactctaatacaacggcatggtacgcttctgtctaaatcagatgagattacgttaa

SEQ ID NO: 260421 - DNA, 75 bp, Artificial Sequence
  Synthetic
gaattgcatataccacatgagactatctattacaatacgcttttctcgaatgagatgaaccctccacagcgacat

SEQ ID NO: 260422 - DNA, 75 bp, Artificial Sequence
  Synthetic
ccggatcagacaagcagtcatccacgcctgagcaggcgaccccacgcaataccccaccggccacatccaccgaac

SEQ ID NO: 260423 - DNA, 75 bp, Artificial Sequence
  Synthetic
ccatccccttacgtgacacaagggggtgaaatagcgctcaataaactctcacaaccggtacagcatccctctgat

SEQ ID NO: 260424 - DNA, 75 bp, Artificial Sequence
  Synthetic
atggagtgttacctggtatttgtcatgggttatctgggcgggcccacatttgtacacgaggtggtgaggatggca

SEQ ID NO: 260425 - DNA, 75 bp, Artificial Sequence
  Synthetic
ctggatttatattgtacaaaaatagtgacattccccatgtctccaggtatttattcctgtctgagcggcaataca

SEQ ID NO: 260426 - DNA, 75 bp, Artificial Sequence
  Synthetic
cgactgggggtattgattgacaaaacccagcctgcttctacaaaaacatcccaatgccctcacccgtagtcgacc

SEQ ID NO: 260427 - DNA, 75 bp, Artificial Sequence
  Synthetic
cgctgacacagtgttcttgtttactccttacaatctctctgcagacggtaaaaagaggacatcacttaaacagtg

SEQ ID NO: 260428 - DNA, 75 bp, Artificial Sequence
  Synthetic
cgttaccaatctaagcatgttcttaaaggacaaggcgatcgcccatccaaaagataactggcttgcctcatttag

SEQ ID NO: 260429 - DNA, 75 bp, Artificial Sequence
  Synthetic
aagatcaaacgccttgcgctgaatggttgattgccatcacagcttacaacaggttcgggcctccttagtgtcgca

SEQ ID NO: 260430 - DNA, 75 bp, Artificial Sequence
  Synthetic
cttggtactcagaggtatggtttctctagaggacctcatcccactaaggacatacctgaagcgcagtacttgccc

SEQ ID NO: 260431 - DNA, 75 bp, Artificial Sequence
  Synthetic
gacaaaaggcgaagaggcaatcgaaatcgcacgggtagaaggtgtgaaccccgagcacgaggccgaaactcgaac

SEQ ID NO: 260432 - DNA, 75 bp, Artificial Sequence
  Synthetic
caacattgcagctacaatatctcatcccatcattcattcaagattacatgcagtaggcctggtcaatcatgacgg

SEQ ID NO: 260433 - DNA, 75 bp, Artificial Sequence
  Synthetic
ccaaaagtagtgacacaggtcggttccgtgatagaagagcttgacacttcgtactgtatagagaccgatttggat

SEQ ID NO: 260434 - DNA, 75 bp, Artificial Sequence
  Synthetic
ctgagggaaccttctaccgatatgtcgtctgtctttgatgaatatgaacagctccttgctgctcagacccgacct

SEQ ID NO: 260435 - DNA, 75 bp, Artificial Sequence
  Synthetic
cggtcaataccatgagaaagacttagacatcactgtcttatttaaggattgggtggcaaattacccgggagtggg

SEQ ID NO: 260436 - DNA, 75 bp, Artificial Sequence
  Synthetic
cagcatccgtgcggatccggcattctggtttcactcgagatggtccagagctaagtttgcatggctccatataaa

SEQ ID NO: 260437 - DNA, 75 bp, Artificial Sequence
  Synthetic
gatccagaggatagatggaattttgcggtgttctgtcttcggattgctgttagcgaggatgccaacaaaccactc

SEQ ID NO: 260438 - DNA, 75 bp, Artificial Sequence
  Synthetic
tctatccaggctcaagtatgggtcacagtagcaaaagccatgactgcgtatgagactgcagatgagtcggaaaca

SEQ ID NO: 260439 - DNA, 75 bp, Artificial Sequence
  Synthetic
ctcgtattcggattcaattagttaactttaagcaggagtgcgcatagtcgtcctcaaccacaatcctgtcattca

SEQ ID NO: 260440 - DNA, 75 bp, Artificial Sequence
  Synthetic
agcagaatcagtgactcacgcaatcgccaccgtattctctggcttagaacagaatcaagcagctgagatgttgtg

SEQ ID NO: 260441 - DNA, 75 bp, Artificial Sequence
  Synthetic
caaaaggcgaagaagcaatcgaaattgcacgggtagaaggtgtgaacctcgagtgcgaggccgaaactcaaatct

SEQ ID NO: 260442 - DNA, 75 bp, Artificial Sequence
  Synthetic
agaattggatttgagcgctccagcaaggtatgatgcatttacacttagtcaggttcattctgaacatacatcacc

SEQ ID NO: 260443 - DNA, 75 bp, Artificial Sequence
  Synthetic
tggaatacttgacaacccttgaatacctaagagatgacagtgtagcagtatcgtactcacttaaagagaaggagg

SEQ ID NO: 260444 - DNA, 75 bp, Artificial Sequence
  Synthetic
attaataagtatatgcagcaaggtagaattcagaagaagtacatcctccaccctgtatgcaggagcgcaattcaa

SEQ ID NO: 260445 - DNA, 75 bp, Artificial Sequence
  Synthetic
actgtaccgcccaacacagtaacactcatgggggccgaaggcagaattctcacagtagggacatctcatttcctt

SEQ ID NO: 260446 - DNA, 75 bp, Artificial Sequence
  Synthetic
gataaaggtactgggaaataccaatttgccagggactttatgagcacatcattctggagacttggagtagagtac

SEQ ID NO: 260447 - DNA, 75 bp, Artificial Sequence
  Synthetic
atattcaaagatggtgcaatactcagccaggtccttaaaaactcatctaaattagtgctaatatcaggtgatctt

SEQ ID NO: 260448 - DNA, 75 bp, Artificial Sequence
  Synthetic
gcgcgtgctcgaattccatgtcgccagttggccataatcagctagtgctcatgcgatcagattaaatcttgtcaa

SEQ ID NO: 260449 - DNA, 75 bp, Artificial Sequence
  Synthetic
ggctcaggtatgggtcacagtagcaaaagccatgactgcatatgagacagcagatgagtcagaaacaagaaggat

SEQ ID NO: 260450 - DNA, 75 bp, Artificial Sequence
  Synthetic
aaattgctttagtaccttagaaaaaactgagtctcattggagaaatggtgaagatatacgggtagaacagttgga

SEQ ID NO: 260451 - DNA, 75 bp, Artificial Sequence; identical to SEQ ID NO: 96191
  Synthetic

SEQ ID NO: 260452 - DNA, 75 bp, Artificial Sequence
  Synthetic
acagtcattcgatctgtgatctacatggaagctgagggtgatctcgctgacacagtattcttatttaccccttac

SEQ ID NO: 260453 - DNA, 75 bp, Artificial Sequence
  Synthetic
cagttgtttataggaatctacaggcggaggtaccatgtaaggatggatttgtccaggagttccatccattatgga

SEQ ID NO: 260454 - DNA, 75 bp, Artificial Sequence
  Synthetic
gggcttatggggacaatgaagtaaactggactgctgctcttaagattgcaaggtctcgatgtaacataagctcag

SEQ ID NO: 260455 - DNA, 75 bp, Artificial Sequence
  Synthetic
aaaatctctgctctctcctctacccattagattagagtgaagatggccacttttacagatgcggagatagacgat

SEQ ID NO: 260456 - DNA, 75 bp, Artificial Sequence
  Synthetic
attggcaatgtggatattcctactcaacaggccggggtcctcaccgggctcagcgacgaaggtccccgagctccg

SEQ ID NO: 260457 - DNA, 75 bp, Artificial Sequence
  Synthetic
taaaccagtagagaccatcggaaggagcgcaatcccacaaggcaacaccaaagctctgagcgcagcatgggataa

SEQ ID NO: 260458 - DNA, 75 bp, Artificial Sequence
  Synthetic
gcagtggcaaacagcatgcgagaagcaccagactctgcacagagcaccatccacccggagaccctcccaactcat

SEQ ID NO: 260459 - DNA, 75 bp, Artificial Sequence
  Synthetic
gggccatctcaggacaacgacaccgactgggggtactgatcgacaacattcagcctgccttcacagggtcatccc

SEQ ID NO: 260460 - DNA, 75 bp, Artificial Sequence
  Synthetic
gaactcctaccctttaggactcgtgttcgaattcaaatagatgtcttagaaaaaagttgcgcataattgtccttg

SEQ ID NO: 260461 - DNA, 75 bp, Artificial Sequence
  Synthetic
ttagttaactttaagcaagagtgcgcaaagtcgtccctaattatagttatgtcattcaccaaatctctgtttggt

SEQ ID NO: 260462 - DNA, 75 bp, Artificial Sequence
  Synthetic
ggagttaatgaacattctttcaatatctagcgggaagttgattggccagtccgtggtttcttatgatgaagatac

SEQ ID NO: 260463 - DNA, 75 bp, Artificial Sequence
  Synthetic
ttaccgatgctgagatagaggatatatttgagaccagtggaactgtcattgacagcataattacggcccagggca

SEQ ID NO: 260464 - DNA, 75 bp, Artificial Sequence
  Synthetic
aagggagcactttaaaagttgaggttccagtattcacactcaacagtgacgatccggaggataggtggaattttg

SEQ ID NO: 260465 - DNA, 75 bp, Artificial Sequence
  Synthetic
tagtgaggatgccaacaaaccgctcaggcaaggtgctctcatttccctcctgtgttctcattcccaggtgatgag

SEQ ID NO: 260466 - DNA, 75 bp, Artificial Sequence
  Synthetic
gccctgagcatagcatgggaaaagcatgggagcatccagccgtccgctggtcaggacacctccaaccaacaggac

SEQ ID NO: 260467 - DNA, 75 bp, Artificial Sequence
  Synthetic
aggcctaaacaacatcgtcctatacatgagtgacctatacaagaacatgccagggattctactctccaatattgc

SEQ ID NO: 260468 - DNA, 75 bp, Artificial Sequence
  Synthetic
gatttatgatgatagcagggtctcttcctcgggcatgcagtaatggtactccgtttgtcacggctggcgttgagg

SEQ ID NO: 260469 - DNA, 75 bp, Artificial Sequence
  Synthetic
tcagtaatgccctagacaagctagaggaaagtaacagcaagctagacaaggtaaatgtgaaacttaccagtacct

SEQ ID NO: 260470 - DNA, 75 bp, Artificial Sequence
  Synthetic
aagatcaaacgccttgcgctgaatggttgattgccatcacagcccacaacaggctcctgcctccttagtgtcgca

SEQ ID NO: 260471 - DNA, 75 bp, Artificial Sequence
  Synthetic
cacgggcacaacccaatccaccaacaatccgtgcagaacccaaaacattagaaaaaaatacgggtagaagagaga

SEQ ID NO: 260472 - DNA, 75 bp, Artificial Sequence
  Synthetic
ataatcacatttccagctaatctatattacatgtctaggaagagcctgaatctgatcagggaacgagaagacaga

SEQ ID NO: 260473 - DNA, 75 bp, Artificial Sequence
  Synthetic
taggggatgtggactcgtacatcaggaataccgggctcactgcattcttcttaacactcaaatatggaattaata

SEQ ID NO: 260474 - DNA, 75 bp, Artificial Sequence
  Synthetic
cttctcttaaatgatcgcacaactgtaatcaatctaacagcatcagtgattaagaaaaaatacgggtagaatcga

SEQ ID NO: 260475 - DNA, 75 bp, Artificial Sequence
  Synthetic
gtgaaagacccgttaacccgacaacctgcatcattcatacaagagctagatttgagtgctccagcaaggtatgac

SEQ ID NO: 260476 - DNA, 75 bp, Artificial Sequence
  Synthetic
ggaagattacttagtacggtacttgttcagaggaatagggactgcttcatcttcttggtataaggcatctcatct

SEQ ID NO: 260477 - DNA, 75 bp, Artificial Sequence
  Synthetic
acatggctgctgagttaaaactaaccccggcagcaaggagaggcctggcagctgccgcccaacgagcgtccgagg

SEQ ID NO: 260478 - DNA, 75 bp, Artificial Sequence
  Synthetic
ggagaggcctggcagctgctgcccaacgagtgtctgaggagaccagcaacatagacatgcccactcaacaagccg

SEQ ID NO: 260479 - DNA, 75 bp, Artificial Sequence
  Synthetic
cacaaagtggatcgggcaagttacaagagcaaccaggtgccggggatggggagactcaattcttggacttaatga

SEQ ID NO: 260480 - DNA, 75 bp, Artificial Sequence
  Synthetic
atagaaatttacaagcagaagtgccatgtaaagatggatatgttcaagaattctgcccattatggagagagaatg

SEQ ID NO: 260481 - DNA, 75 bp, Artificial Sequence
  Synthetic
agagcaaccaggtgccggggatggggagactcaattcttggacttaatgagagcagtagcaaatagcatgcgaga

SEQ ID NO: 260482 - DNA, 75 bp, Artificial Sequence
  Synthetic
tgattgggggtactgacaggcagtgcccaatcctcctccgcacggtcatcccaacctttccgtccgaacccctct

SEQ ID NO: 260483 - DNA, 75 bp, Artificial Sequence
  Synthetic
cccaatcctcctccgcacggtcatcccaacctttccgtccgaacccctctccccccccacaacccacaactctgc

SEQ ID NO: 260484 - DNA, 75 bp, Artificial Sequence
  Synthetic
atctactcatgaatttatttactccatgctccacaagaggatacatactctccaatggttatgcctgtagagggg

SEQ ID NO: 260485 - DNA, 75 bp, Artificial Sequence
  Synthetic
cgcagacccgactcgatctaccagcaatccatacggattcgaggatattagaaaaaaatacgggtagaagagaga

SEQ ID NO: 260486 - DNA, 75 bp, Artificial Sequence
  Synthetic
gacatttgacaagatagaggaaaaaataagaagactcaatctatctgtcgggctcagtgatgtgcttggaccctc

SEQ ID NO: 260487 - DNA, 75 bp, Artificial Sequence
  Synthetic
caaagactctaatacaacgacacggcacacttctttctaaatcagatgaaattacattgactaggctatttacct

SEQ ID NO: 260488 - DNA, 75 bp, Artificial Sequence
  Synthetic
aaacataatgacaaacattctgactagaccgccagggaacggggactgggccagcttatgtaatgatccctattc

SEQ ID NO: 260489 - DNA, 75 bp, Artificial Sequence
  Synthetic
aaggtctccgatctcctttctacccagtggaccagggcggaaatggctgcctttacggacgcagagatagatgac

SEQ ID NO: 260490 - DNA, 75 bp, Artificial Sequence
  Synthetic
tcagtgatgtcacatcattttatccttctgcatatcaagaacacttgaattttatcccggcgcctactacaggat

SEQ ID NO: 260491 - DNA, 75 bp, Artificial Sequence
  Synthetic
ggccaaggccgcccctggaaaccagggcacagacgtgaacacagcatatcatggacaatgggaggagtcacaacc

SEQ ID NO: 260492 - DNA, 75 bp, Artificial Sequence
  Synthetic
attacattgactaggctatttacctcacagcagcatcgtgtaacggacattctatctagccctttaccgaggcta

SEQ ID NO: 260493 - DNA, 75 bp, Artificial Sequence
  Synthetic
taagaaaaaatacgggtagaatcaaagtactccaactgtgcaaaaatggactcatccagaacaatcaggctgtat

SEQ ID NO: 260494 - DNA, 75 bp, Artificial Sequence
  Synthetic
aagcgctgagcacagcatgggagaaacacgggagcatccaaccatccgcctgccaaggaacccccaatcaacatg

SEQ ID NO: 260495 - DNA, 75 bp, Artificial Sequence
  Synthetic
tgccagccacattgacacagtcattagatctgtaatctacatggaggctgaaggtgaccttgccgacacagtgtt

SEQ ID NO: 260496 - DNA, 75 bp, Artificial Sequence
  Synthetic
catcccccacccaggccacagatgacaccgacgatacgcagctcaagaccggagcaagtaactctcttctgtcta

SEQ ID NO: 260497 - DNA, 75 bp, Artificial Sequence
  Synthetic
ttcacctgtccatctagttagaaaaaacacgggtagaagagtctggatcccgactagcacactcaaaacgcgata

SEQ ID NO: 260498 - DNA, 75 bp, Artificial Sequence
  Synthetic
tccaccttccaagcaatattgaactgacagatgatacgagcaagaatcctcctatgagggtcccttacctaggct

SEQ ID NO: 260499 - DNA, 75 bp, Artificial Sequence
  Synthetic
ccaaaactcaggaaaggagagctgcatctcttgcaaaaattgcacatatgtcaccgcatgttaaagcagcactca

SEQ ID NO: 260500 - DNA, 75 bp, Artificial Sequence
  Synthetic
tcgagtctccaagaagggaaccatcaacctcccattcaacagcaggggaaccagccgagccgtggacacaaccaa

SEQ ID NO: 260501 - DNA, 75 bp, Artificial Sequence
  Synthetic
tacggtttctctggaggacctcatcccactaaggacatacatgaagcgtagtacttgccctaagtacctgaaagc

SEQ ID NO: 260502 - DNA, 75 bp, Artificial Sequence
  Synthetic
tctgtctgacaagctcccttgacggtagacctcttgcagctgcagggattgtagtaacaggagataaggcagtca

SEQ ID NO: 260503 - DNA, 75 bp, Artificial Sequence
  Synthetic
tagacctcttgcagctgcagggattgtagtaacaggagataaggcagtcaatatatacacctcatctcagacagg

SEQ ID NO: 260504 - DNA, 75 bp, Artificial Sequence
  Synthetic
gtagtaacaggagataaggcagtcaatatatacacctcatctcagacagggtcaatcatagtcaagttgctcccg

SEQ ID NO: 260505 - DNA, 75 bp, Artificial Sequence
  Synthetic
ggtcttagagtcgaaaatctcaataaaataggcgatgtaatcagcctagtgcttaaaggcatgatctccatggag

SEQ ID NO: 260506 - DNA, 75 bp, Artificial Sequence
  Synthetic
acctacggatttatctttcaagttgggaatgaggaagtcactgtcggcgtgatcaatgacaatcccagacacgaa

SEQ ID NO: 260507 - DNA, 75 bp, Artificial Sequence
  Synthetic
ttactctcctctgcaatgctttgcttaggaagcgtcccaaatgacggagatcttgttgagctggcgagagcctgc

SEQ ID NO: 260508 - DNA, 75 bp, Artificial Sequence
  Synthetic
gtgcaaaagccccattagaggcatacaacagaacactgaccaccttactcactcccctgggcgattctatccgta

SEQ ID NO: 260509 - DNA, 75 bp, Artificial Sequence
  Synthetic
attctacatgaaaactataggtaatgcagcaaagggatattacagcaatgatgattcttaaatgcaattacacac

SEQ ID NO: 260510 - DNA, 75 bp, Artificial Sequence
  Synthetic
gttcctgcggatcatgtccagccacctgtcgactttgtgcaggcaatgatgtctatgatggaagcgctatctcag

SEQ ID NO: 260511 - DNA, 75 bp, Artificial Sequence
  Synthetic
caatcaactatcttatcaattgattatctccttactgactaagttataccatattagaaaaaagttgagtcccgg

SEQ ID NO: 260512 - DNA, 75 bp, Artificial Sequence
  Synthetic
tgtcgcagtgactgctgatcatgaggttacctctactaagatagaaaagaggcacaccattgctaagtacaatcc

SEQ ID NO: 260513 - DNA, 75 bp, Artificial Sequence
  Synthetic
cggtcatggaagccaatctaggcatgatgaaaattctggaccctggttgcgctaatgtatcatccttaagtgatc

SEQ ID NO: 260514 - DNA, 75 bp, Artificial Sequence
  Synthetic
gtgaaatgttgctcaataaactttcacaaccggtccagcatccctctgaattaattaaacctgccaaggcagccg

SEQ ID NO: 260515 - DNA, 75 bp, Artificial Sequence
  Synthetic
gtcaccgacggattatcacaactagcagtggcagtcgggaagatgcaacagtttgtcaacgaccagtttaataat

SEQ ID NO: 260516 - DNA, 75 bp, Artificial Sequence
  Synthetic
caatcttgcgctcaatgtcactattgatgtggaggtggactcgaagagccctttagtcaaatccctctctaagtc

SEQ ID NO: 260517 - DNA, 75 bp, Artificial Sequence
  Synthetic
acaaccggtccagcatccctctgaattaattaaacctgccaaggcagccggacctgatatgggagtagaaaaaga

SEQ ID NO: 260518 - DNA, 75 bp, Artificial Sequence
  Synthetic
aattactctgatactgagctgcatctgcctgacgagctctcttgatggcaggcctcttgcagctgcggggattgt

SEQ ID NO: 260519 - DNA, 75 bp, Artificial Sequence
  Synthetic
actacagtattcggaccgcagatcacttccccggccttgactcaactaactatccaggctctttataacttagct

SEQ ID NO: 260520 - DNA, 75 bp, Artificial Sequence
  Synthetic
agccgggtcaattgaggagatcagaaaaatcaaacgacttgcactgaatggttgatcaccgccatggctcacaac

SEQ ID NO: 260521 - DNA, 75 bp, Artificial Sequence
  Synthetic
gttgttgggcagccacaatccgacaatgctgacatgattattctgagtcccgcccactatcactttattaagaaa

SEQ ID NO: 260522 - DNA, 75 bp, Artificial Sequence
  Synthetic
aaaatcaaacgacttgcactgaatggttgatcaccgccatggctcacaacaggcttctgccctctcagtgccgca

SEQ ID NO: 260523 - DNA, 75 bp, Artificial Sequence
  Synthetic
acatccccaaacactcgcacaactacaactaatctagcagcattaaagattaagaaaaaatacgggtagaatcaa

SEQ ID NO: 260524 - DNA, 75 bp, Artificial Sequence
  Synthetic
taacagcggctgcggccctaatacaagccaatcagaatgctgccaacatcctccggcttaaggagagcatcgctg

SEQ ID NO: 260525 - DNA, 75 bp, Artificial Sequence
  Synthetic
cgtgccctacctgctccaagatggactcatccaggacaattgggctatactttgattctgcccttccttctagca

SEQ ID NO: 260526 - DNA, 75 bp, Artificial Sequence
  Synthetic
cacttcatactgtatagagtctaatttggatctatattgtacaaggatagtgacattccccatgtctccaggtat

SEQ ID NO: 260527 - DNA, 75 bp, Artificial Sequence
  Synthetic
ggaatgaggaagccacgatcggcacgatcaatgacaacccccggcacgaactactctcctctgcaatgctctgct

SEQ ID NO: 260528 - DNA, 75 bp, Artificial Sequence
  Synthetic
ttaatgaagtagtaaggatggcgaagacattgatacagaggcacgggacgctacttgccaaatcagatgagacgg

SEQ ID NO: 260529 - DNA, 75 bp, Artificial Sequence
  Synthetic
caagaacatgaatgcagacgagatacggatgtgtcctaaacaacaacttgtgtgtcgactctgacgacctgttca

SEQ ID NO: 260530 - DNA, 75 bp, Artificial Sequence
  Synthetic
tcttatcattagacgggataactctgaggctcagtggagaatttgatgcaacttatcaaaagaatatctcaatac

SEQ ID NO: 260531 - DNA, 75 bp, Artificial Sequence
  Synthetic
ttagctttctctgcagctgccctggtatatactatgagggccagtacgccgcacgacctcacaggtatatcgacc

SEQ ID NO: 260532 - DNA, 75 bp, Artificial Sequence
  Synthetic
ggtcttctcagtagtgcaggcgccccgggtgctgcaaagctgtatggttgtggcaaacagatactcatcagtgaa

SEQ ID NO: 260533 - DNA, 75 bp, Artificial Sequence
  Synthetic
caagtggctcttgaatctccactggcgctactaaacactgaatctataattatgaatgcagtaacgtccctctcg

SEQ ID NO: 260534 - DNA, 75 bp, Artificial Sequence
  Synthetic
tttgactgtggtgccacggaaagatgtctatcgtatcccaactgcggcattgaaaatatctggctcgagtctgta

SEQ ID NO: 260535 - DNA, 75 bp, Artificial Sequence
  Synthetic
agcctggttctagcatgttacctgatgtataagcaaaaagcacaacaaaagaccttactatggcttgggaataat

SEQ ID NO: 260536 - DNA, 75 bp, Artificial Sequence
  Synthetic
gatgtagaggtagacccgaagagcccattggtcaaatctctttctaagtctgatagtggatactacgctaacctc

SEQ ID NO: 260537 - DNA, 75 bp, Artificial Sequence
  Synthetic
tgtataagcaaaaagcacaacaaaagaccttactatggcttgggaataataccctcgatcagatgagagccacta

SEQ ID NO: 260538 - DNA, 75 bp, Artificial Sequence
  Synthetic
ggctcagtgatgtgcttggaccttctgtacttgtgaaggctagaggtgcaagaaccaagttgctggcacccttct

SEQ ID NO: 260539 - DNA, 75 bp, Artificial Sequence
  Synthetic
ctgcgcacctgagaagtgtaaagattgtcatccaagcaggcacccagcgtgctgttgcagtgactgctgaccatg

SEQ ID NO: 260540 - DNA, 75 bp, Artificial Sequence
  Synthetic
tgtcatccaagcaggcacccagcgtgctgttgcagtgactgctgaccatgaggttacctctaccaggatagaaaa

SEQ ID NO: 260541 - DNA, 75 bp, Artificial Sequence
  Synthetic
acagcaaattagacaaagtcaatgtcaaattaaccagcacatctgctctcattacctatatcgttctaactgtca

SEQ ID NO: 260542 - DNA, 75 bp, Artificial Sequence
  Synthetic
tatacaccatgagggccagtacgccgcgcgacctcgcaggtatatcaaccatgatctccaaaacggagaataaga

SEQ ID NO: 260543 - DNA, 75 bp, Artificial Sequence
  Synthetic
tgattctccacgaaatcatatactaaactatcctgattgcttatagttagctcatcagtctactgagttagaaaa

SEQ ID NO: 260544 - DNA, 75 bp, Artificial Sequence
  Synthetic
aactatcctgattgcttatagttagctcatcagtctactgagttagaaaaaacacgggtagaagggtctggatcc

SEQ ID NO: 260545 - DNA, 75 bp, Artificial Sequence
  Synthetic
aatactcagtcaagtcctcaaaaattcatctaaattagtgctagtgtcaggtgacctcagtgagaacaccgtaat

SEQ ID NO: 260546 - DNA, 75 bp, Artificial Sequence
  Synthetic
atataagcaaccaaaaagcaatacacgggtagaacggtcggaggagccatcttccaatcaggaactaggcttcac

SEQ ID NO: 260547 - DNA, 75 bp, Artificial Sequence
  Synthetic
tgggccacactgatcatgagctgcatttgtttgacaagctctctcgatggcaggcatcttgcagcagcaggaatc

SEQ ID NO: 260548 - DNA, 75 bp, Artificial Sequence
  Synthetic
agctcaaacttgagagagccttctgctgacatgtcttccgtattcgatgagtatgagcagctcctcgcggctcag

SEQ ID NO: 260549 - DNA, 75 bp, Artificial Sequence
  Synthetic
aatatgcccagggacaaagaggcatgtgcaaaagccccgctggaggcatacaataaaacactgaccactctactc

SEQ ID NO: 260550 - DNA, 75 bp, Artificial Sequence
  Synthetic
gaggagaaaaaggaagtaccttaaaagttgagatcccggtattcactcttaacagcgatgatccagaggacagat

SEQ ID NO: 260551 - DNA, 75 bp, Artificial Sequence
  Synthetic
tggcgcttagtattccggatcgcagttttgcttttgatagtggtgaccttagctatctctgcagctgccttggta

SEQ ID NO: 260552 - DNA, 75 bp, Artificial Sequence
  Synthetic
agtggcccttgaatctccgctggcactcctaaatactgaatctataatcatgaatgcaataacgtctctctctca

SEQ ID NO: 260553 - DNA, 75 bp, Artificial Sequence
  Synthetic
tggtgcatggaaggttagggttcgatggtcaatatcacgagaaggacttggacaccactgtcttatttaaggatt

SEQ ID NO: 260554 - DNA, 75 bp, Artificial Sequence
  Synthetic
gagcacagagattcttgatgatagcaggatctctcccccgagcatgcagcaatggtactccgtttgtcacggctg

SEQ ID NO: 260555 - DNA, 75 bp, Artificial Sequence
  Synthetic
cggtggcggttgggaagatgcagcaatttgttaatgagcagcttaacaatacagcacgagaattagactgtataa

SEQ ID NO: 260556 - DNA, 75 bp, Artificial Sequence
  Synthetic
cttgtgatgctagaggccaggctgaatatcaacacaagcccgaatcccatgctgccgggcaaccacaatccgcca

SEQ ID NO: 260557 - DNA, 75 bp, Artificial Sequence
  Synthetic
atttgttaatgagcagcttaacaatacagcacgagaattagactgtataaaaattacacaacagattggtgtaga

SEQ ID NO: 260558 - DNA, 75 bp, Artificial Sequence
  Synthetic
atatcaacacaagcccgaatcccatgctgccgggcaaccacaatccgccaaagctggcgtgcttggcctgcgtcc

SEQ ID NO: 260559 - DNA, 75 bp, Artificial Sequence
  Synthetic
ctctccatccaggctcaggtatgggtcactgtagcaaaagccatgactgcatatgagacagcagatgagtcggag

SEQ ID NO: 260560 - DNA, 75 bp, Artificial Sequence
  Synthetic
tatccaagcactctacaatttagccggtggcaatgtagattacttgctgactaaattaggtgtagggaataatca

SEQ ID NO: 260561 - DNA, 75 bp, Artificial Sequence
  Synthetic
ctgatgagcaagattaccaaattcggatggccaagtcctcgtataaacctaggcggtttggcggaagacgcgtac

SEQ ID NO: 260562 - DNA, 75 bp, Artificial Sequence
  Synthetic
ggtggcaatgtagattacttgctgactaaattaggtgtagggaataatcaactcagctcattaattggcagcggt

SEQ ID NO: 260563 - DNA, 75 bp, Artificial Sequence
  Synthetic
tagcgaacttaagagaggccgcaacacggcgggtggaagctcgacgtattacaacttagtaggggatgtcgactc

SEQ ID NO: 260564 - DNA, 75 bp, Artificial Sequence
  Synthetic
agttctcacagtagggacatctcacttcttgtaccaacgaggttcttcatatttctcacctgccttattatatcc

SEQ ID NO: 260565 - DNA, 75 bp, Artificial Sequence
  Synthetic
tcggttccgtaatagaagaacttgacacctcatattgtatagagacagatttggatttgtattgtacaagaatag

SEQ ID NO: 260566 - DNA, 75 bp, Artificial Sequence
  Synthetic
atgccttcactcggccaggtagtgtcccttgccaagcatcagcaagatgccctaactcatgtatcactggagtct

SEQ ID NO: 260567 - DNA, 75 bp, Artificial Sequence
  Synthetic
cgcactcagcagcctcacaggcgatatccaaaaaatgaagcagctcatgcgtttatatcggatgaaaggagaaaa

SEQ ID NO: 260568 - DNA, 75 bp, Artificial Sequence
  Synthetic
aaggcgcacttactacaccgtatatggccctcaaaggctcagttatcgccaattgcaagataataacgtgtagat

SEQ ID NO: 260569 - DNA, 75 bp, Artificial Sequence
  Synthetic
ctttgccatgggcatggcatcagtcctggacaaaggaaccggcaaataccaatttgccagagactttatgagtac

SEQ ID NO: 260570 - DNA, 75 bp, Artificial Sequence
  Synthetic
ctggacaaaggaaccggcaaataccaatttgccagagactttatgagtacatcgttttggaggcttggagtagag

SEQ ID NO: 260571 - DNA, 75 bp, Artificial Sequence
  Synthetic
gacggacaagaatatcaaatccggatggctaagtcttcgtacaagcctgggcgattcggtggaaagcgtgtacag

SEQ ID NO: 260572 - DNA, 75 bp, Artificial Sequence
  Synthetic
ctactcatgaacttattcactccgtgttccacaaaaggatatattctctctaatggttatgcatgtcgaggagat

SEQ ID NO: 260573 - DNA, 75 bp, Artificial Sequence
  Synthetic
ttgcagaaatatccaataccctatttggggagttcaggatcgttcctttgctagttgaaatcctcaaggaagtca

SEQ ID NO: 260574 - DNA, 75 bp, Artificial Sequence
  Synthetic
gctgactgttccgcctaatacaattacactcatgggggccgaaggcagaattctcacagtagggacatctcactt

SEQ ID NO: 260575 - DNA, 75 bp, Artificial Sequence
  Synthetic
ggcttggcagctgctgcccagcgagtgtccgaagaggccggtagcatggacattcctgcccaacaagccggggtc

SEQ ID NO: 260576 - DNA, 75 bp, Artificial Sequence
  Synthetic
caaactcgagaaagccttctgccaacatgtcttccgtatttgatgagtacgaacagctcctcgcggctcagactc

SEQ ID NO: 260577 - DNA, 75 bp, Artificial Sequence
  Synthetic
cttgcgatgccaagggccaggctgaatattaacacaagcccgaatcccatgccgccgggcaaccacaatccgcca

SEQ ID NO: 260578 - DNA, 75 bp, Artificial Sequence
  Synthetic
ggggatggggagactcaattcctggatctgatgagagcagtggcaaatagcatgcgagaagtgccaaactccgca

SEQ ID NO: 260579 - DNA, 75 bp, Artificial Sequence
  Synthetic
caacagcaagctgagcaaagtcaatgttaaactgactagtacatctgctctcatcacctatattgtcctaactgt

SEQ ID NO: 260580 - DNA, 75 bp, Artificial Sequence
  Synthetic
tcgtcgaagagttgccacttttatcacgactgacttgcaaaagtattgtcttaactggagataccagacggttaa

SEQ ID NO: 260581 - DNA, 75 bp, Artificial Sequence
  Synthetic
gttaaactgactagtacatctgctctcatcacctatattgtcctaactgtggtatctcttgcatttggtgtaatc

SEQ ID NO: 260582 - DNA, 75 bp, Artificial Sequence
  Synthetic
ccccaactcccgggccgtctcaagacaatgacaccgactgggggtactaaccgacaaaccccagcctgtccctgc

SEQ ID NO: 260583 - DNA, 75 bp, Artificial Sequence
  Synthetic
aaaggatatattctctctaatggctatgcatgtagaggggatatggagtgttacctggtatttgtcatgggctat

SEQ ID NO: 260584 - DNA, 75 bp, Artificial Sequence
  Synthetic
accctcgatcagatgagggccaacataagaacataaatgcagatggaaaataaggatacccacaatcgcagtctg

SEQ ID NO: 260585 - DNA, 75 bp, Artificial Sequence
  Synthetic
caatgacaccgactgggggtactaaccgacaaaccccagcctgtccctgcaggaccaccccaactcccctgccca

SEQ ID NO: 260586 - DNA, 75 bp, Artificial Sequence
  Synthetic
agaagctatggacaatgatctcaattgctgcaatccaacttgctgcagcaagatcgcattgtcgagttgcctgta

SEQ ID NO: 260587 - DNA, 75 bp, Artificial Sequence
  Synthetic
taagaacataaatgcagatggaaaataaggatacccacaatcgcagtctgcgcgtcacctctgacaatctgcgga

SEQ ID NO: 260588 - DNA, 75 bp, Artificial Sequence
  Synthetic
tccccagccgcgcgatcccaccagcccgagtccacgcgggcgcggcccgacccaacaacgatccacgcggggccc

SEQ ID NO: 260589 - DNA, 75 bp, Artificial Sequence
  Synthetic
accatctcattatcagcaggcaatggaaaaaaatactagagtcagccacccccgacacagagagaatgataaaac

SEQ ID NO: 260590 - DNA, 75 bp, Artificial Sequence
  Synthetic
acccttcaatcaagaatcaagcttcacaacatccgctctcccgcgccaccaatatcagacaacagtcatgggccg

SEQ ID NO: 260591 - DNA, 75 bp, Artificial Sequence
  Synthetic
agaatattagaaaaaactacgggtagaagagagacattcagagaccaagacgtatcaccaaggtctctgttctcc

SEQ ID NO: 260592 - DNA, 75 bp, Artificial Sequence
  Synthetic
aaggcgcacttactacgccatatatggccctcaaaggctcagttattgccaattgtaagataacaacatgtagat

SEQ ID NO: 260593 - DNA, 75 bp, Artificial Sequence
  Synthetic
acaacatccgctctcccgcgccaccaatatcagacaacagtcatgggccgttcagttaacagagtcataatggag

SEQ ID NO: 260594 - DNA, 75 bp, Artificial Sequence
  Synthetic
gtactccatcctaggtgcttagaagaattggctagtattgaggtccctgattccaccaacaaatttcggaagatt

SEQ ID NO: 260595 - DNA, 75 bp, Artificial Sequence
  Synthetic
ttccaccaacaaatttcggaagattgaaaagaagatccagattcacaatacaaggtatggagaactgttcacaaa

SEQ ID NO: 260596 - DNA, 75 bp, Artificial Sequence
  Synthetic
gaaccgtcattgacagcataattacggcccagagcaacccagcagagaccgtcgggagaagcgcgatcccgcaag

SEQ ID NO: 260597 - DNA, 75 bp, Artificial Sequence
  Synthetic
ttagccatttctgtggctaccctggtatacagcatgggggccagcacaccgagcgaccttacaggcatatcaact

SEQ ID NO: 260598 - DNA, 75 bp, Artificial Sequence
  Synthetic
atcaatgcaagcctgaatcccgtaccatcaggcgggcacaacctgacaatgctgatgtgatcagtctgaactctg

SEQ ID NO: 260599 - DNA, 75 bp, Artificial Sequence
  Synthetic
tatacagcatgggggccagcacaccgagcgaccttacaggcatatcaactgtggttttaaaaacaggggacaagg

SEQ ID NO: 260600 - DNA, 75 bp, Artificial Sequence
  Synthetic
atgggagaagcatgggagcacccaaccgccggccagccaggacacccccgaccaacaggacagatctgacaagca

SEQ ID NO: 260601 - DNA, 75 bp, Artificial Sequence
  Synthetic
cgttgctaaacactgaatctataattatgaacgcactaacgtctctctcttatcaaatcaacggggctacaaata

SEQ ID NO: 260602 - DNA, 75 bp, Artificial Sequence
  Synthetic
ctcaagaccggggcaagcaactcgctgctgtcgatgctcgacaaacttagcaataaatcgtctaatgctaaaaag

SEQ ID NO: 260603 - DNA, 75 bp, Artificial Sequence
  Synthetic
gataggccacgtctttgttacccctgagctcgtcattgtgacacatacagatgagaacaagttcacatgcctcac

SEQ ID NO: 260604 - DNA, 75 bp, Artificial Sequence
  Synthetic
ctagcgatgttacatcattttatccttccgcttaccaggagcacctgaattttattccggcacctactacagggt

SEQ ID NO: 260605 - DNA, 75 bp, Artificial Sequence
  Synthetic
acaggaacttgtattgatgtatgcagatatgatggagggcagagatatggtcaacataatatcgtctacagcgac

SEQ ID NO: 260606 - DNA, 75 bp, Artificial Sequence
  Synthetic
ctggggcatcccaagacaacgacaccgactgggggtactgatcgactacacccagcctgccttcacaggatcatg

SEQ ID NO: 260607 - DNA, 75 bp, Artificial Sequence
  Synthetic
ggccacagacgcgaacacagcatatcctggacaatggaaggagtcacaaccatcagctggtgtaacccctcatgt

SEQ ID NO: 260608 - DNA, 75 bp, Artificial Sequence
  Synthetic
ggatttgcatacggtgccgtccagctgcttgagccgtcaggtacatttgcgggggatttcttcgcattcaacctg

SEQ ID NO: 260609 - DNA, 75 bp, Artificial Sequence
  Synthetic
agcggtgatgtctttgatggaagcgttatcacagaaggtaagtaaaattgactatcagctagacctagttctaaa

SEQ ID NO: 260610 - DNA, 75 bp, Artificial Sequence
  Synthetic
ttatcacagaaggtaagtaaaattgactatcagctagacctagttctaaaacagacatcttctatccccatgata

SEQ ID NO: 260611 - DNA, 75 bp, Artificial Sequence
  Synthetic
tggtgcatggaaggttatggtttgacggtcactaccatgagaaggatctagacatcacagccttatttagggatt

SEQ ID NO: 260612 - DNA, 75 bp, Artificial Sequence
  Synthetic
cggtcactaccatgagaaggatctagacatcacagccttatttagggattgggtggcaaactatccgggagtggg

SEQ ID NO: 260613 - DNA, 75 bp, Artificial Sequence
  Synthetic
cctggttgtgctaacatttcatctttgagtgatttacgggcggtcgcccgatcccacccagttttaatttcaggt

SEQ ID NO: 260614 - DNA, 75 bp, Artificial Sequence
  Synthetic
tgaacaagaaggaagatatgtaatatacaaacgccataacagcacatgcccagatgaacaggattaccagattcg

SEQ ID NO: 260615 - DNA, 75 bp, Artificial Sequence
  Synthetic
tacaaacgccataacagcacatgcccagatgaacaggattaccagattcggatggctaaatcttcatacaagcct

SEQ ID NO: 260616 - DNA, 75 bp, Artificial Sequence
  Synthetic
cgacaagtgggcctgacataggagtggagagggataccgttcgcgcattgatcacctcacgtccgatgcatccga

SEQ ID NO: 260617 - DNA, 75 bp, Artificial Sequence
  Synthetic
gtgctgactgtcccgcctaacacggttactctcatgggggccgaaggtagagttcttacagtagggacatctcat

SEQ ID NO: 260618 - DNA, 75 bp, Artificial Sequence
  Synthetic
caatcgcacatccgaaagataactggcttgcctcatttaggcggaatctcctctctgaagaccaaaagaaacagg

SEQ ID NO: 260619 - DNA, 75 bp, Artificial Sequence
  Synthetic
gcttgcctcatttaggcggaatctcctctctgaagaccaaaagaaacaggtaaaagaggcgacctcaactaaccg

SEQ ID NO: 260620 - DNA, 75 bp, Artificial Sequence
  Synthetic
ttactctcatgggggccgaaggtagagttcttacagtagggacatctcatttcttgtaccaacgagggtcctcat

SEQ ID NO: 260621 - DNA, 75 bp, Artificial Sequence
  Synthetic
gctcctcagctaagctcctgagtaagctagatgcagccgggtcaattgaagagatcaggaaaatcaagcgccttg

SEQ ID NO: 260622 - DNA, 75 bp, Artificial Sequence
  Synthetic
cctcttgatagagttcttagaatcagacgattttgatccatataaagagatggaatatttgacaacccttgagta

SEQ ID NO: 260623 - DNA, 75 bp, Artificial Sequence
  Synthetic
ctcctccctatacacctaagcttcaatacttcaagtgataaccccctcccacctctcctgctccgctgaatgatc

SEQ ID NO: 260624 - DNA, 75 bp, Artificial Sequence
  Synthetic
acgccttcactcggccaggtagtgtcccttgccaggcatcagcgagatgccctaacccatgtgtcactggagttt

SEQ ID NO: 260625 - DNA, 75 bp, Artificial Sequence
  Synthetic
cccttgccaggcatcagcgagatgccctaacccatgtgtcactggagtttatacagatccgtaccccttggtctt

SEQ ID NO: 260626 - DNA, 75 bp, Artificial Sequence
  Synthetic
agaatatgccaggaattctactttccaacattgcagctacaatatctcatcccatcattcattcaaggttacatg

SEQ ID NO: 260627 - DNA, 75 bp, Artificial Sequence
  Synthetic
gtggcttgaagccgggctccccaacagacaagaagcaagaggggcagtacgttatttacaagaggtataatgata

SEQ ID NO: 260628 - DNA, 75 bp, Artificial Sequence
  Synthetic
tagaatcagagtgccccgactgtgccaaaatggactcgtccaggacaatcgggctgtatttcgattctacccttc

SEQ ID NO: 260629 - DNA, 75 bp, Artificial Sequence
  Synthetic
cgcagtatttgataacatatcccgtagtcgcataacccgagtaagctctagcagtaccaaggcagcatacacgac

SEQ ID NO: 260630 - DNA, 75 bp, Artificial Sequence
  Synthetic
agtcgcataacccgagtaagctctagcagtaccaaggcagcatacacgacgtcgacatgttttaaggttgtcaag

SEQ ID NO: 260631 - DNA, 75 bp, Artificial Sequence
  Synthetic
gacagacagtaaagaagattcagtatttatcaccacctatggattcatcttccaggttgggagtgaggaggccac

SEQ ID NO: 260632 - DNA, 75 bp, Artificial Sequence
  Synthetic
tttatcaccacctatggattcatcttccaggttgggagtgaggaggccactgttggcatgatcaatgacaatccc

SEQ ID NO: 260633 - DNA, 75 bp, Artificial Sequence
  Synthetic
tcgccgaagagttgccacctttatcacaactgaccttcaaaaatattgtcttaactggagataccagacagtcaa

SEQ ID NO: 260634 - DNA, 75 bp, Artificial Sequence
  Synthetic
ctagttgagattctcaaggatgatagagtttaataatccaggcacggcaagccgagtcaaccatgagagggttat

SEQ ID NO: 260635 - DNA, 75 bp, Artificial Sequence
  Synthetic
ataccagctcaagcgcaaatctcaggccattgggcaactataatctgctaatataagtgtaatcgacttgaatct

SEQ ID NO: 260636 - DNA, 75 bp, Artificial Sequence
  Synthetic
agagactgaagaagaggattataactcagctacccccacgtcgatggtacatggaaggttagggttcgacggcca

SEQ ID NO: 260637 - DNA, 75 bp, Artificial Sequence
  Synthetic
actgcgatttatctagagtcccaaatgatgacatctatattgtcagtgctagggggggcattgaaggcttatgcc

SEQ ID NO: 260638 - DNA, 75 bp, Artificial Sequence
  Synthetic
aaggcaccagagaagatccctgggagcggaaccctagaatacaaggtgaattttgtatctctgaccgtggtgccc

SEQ ID NO: 260639 - DNA, 75 bp, Artificial Sequence
  Synthetic
cacagttgcaccaagccagtgataatttcttcaaggaattgattcatgtcaatcatttgattggtcacaacctga

SEQ ID NO: 260640 - DNA, 75 bp, Artificial Sequence
  Synthetic
gtcactattgatgtggaagtagacccgaagagcccattagtcagatcccttactgaatctggcagtggatactac

SEQ ID NO: 260641 - DNA, 75 bp, Artificial Sequence
  Synthetic
gaaaaaaatactcgagtcggcaactcctgacatagagagaatgataaaactcggaaggacagtacaccacaccct

SEQ ID NO: 260642 - DNA, 75 bp, Artificial Sequence
  Synthetic
cctgacatagagagaatgataaaactcggaaggacagtacaccacaccctcaaccataatctaaagataaccgga

SEQ ID NO: 260643 - DNA, 75 bp, Artificial Sequence
  Synthetic
gagaagaagatccagattcacaacacgaggtatggggaattgttcacaaggctttgcacacacatcgaaaataaa

SEQ ID NO: 260644 - DNA, 75 bp, Artificial Sequence
  Synthetic
tctcctcaagtagctaagatactctggagtcaaacagcacacctgcggagcgtaaaggtcattattcaagcgggc

SEQ ID NO: 260645 - DNA, 75 bp, Artificial Sequence
  Synthetic
attcacatatccaatgattctcaaaggctattcactgaagaaggagtcaaagaggggaatgtggtttatcaacaa

SEQ ID NO: 260646 - DNA, 75 bp, Artificial Sequence
  Synthetic
cagcatccgtacagacccggtattctggttccactcaagatggtctaaggccaagtttgcatggctccatataaa

SEQ ID NO: 260647 - DNA, 75 bp, Artificial Sequence
  Synthetic
cctggatcgaagatatctctttcgtacactcctacgtgttaacccctgcccagctgggaggactgagtaaccttc

SEQ ID NO: 260648 - DNA, 75 bp, Artificial Sequence
  Synthetic
gaaccatgtggcattggctggaaggcaaaatgaggcaacactggcaatacttgagattgacggattctcaagtgg

SEQ ID NO: 260649 - DNA, 75 bp, Artificial Sequence
  Synthetic
gatcgagaagagacacaccattgctaaatataatcctttcaagaagtaggctatatctctgaggctgctatccga

SEQ ID NO: 260650 - DNA, 75 bp, Artificial Sequence
  Synthetic
aatactcaagactctacacaagaaatattggtgacccagggactactgcctttgcagaggtcaagcggctagaag

SEQ ID NO: 260651 - DNA, 75 bp, Artificial Sequence
  Synthetic
attagaaaaaacacgggtagaagaatccgggtcccagtcagcacactcaaggtgcatgatgggctctaaatcttc

SEQ ID NO: 260652 - DNA, 75 bp, Artificial Sequence
  Synthetic
ggtgcatgatgggctctaaatcttctacttggatcccgatatctccaatgccgaccatcctaattgcattggcat

SEQ ID NO: 260653 - DNA, 75 bp, Artificial Sequence
  Synthetic
ataaataagtacatgcaacagggtagggtccagaagcggtgcatcctccacccggtgtgtaggagtgcaatccag

SEQ ID NO: 260654 - DNA, 75 bp, Artificial Sequence
  Synthetic
tcaagtctacgatgtcgtagcactaatggagggattcgcatatggtgccgttcagctgctggagccttctggtac

SEQ ID NO: 260655 - DNA, 75 bp, Artificial Sequence
  Synthetic
attctccaagtactatctttcttcaagggaacaatcatcaatgggtatagaaagaagaactcaggtgtctggcca

SEQ ID NO: 260656 - DNA, 75 bp, Artificial Sequence
  Synthetic
ctgacgctagcagattatgcccgaaacagaagctggtcacctttgacaggaggcaggaagatactgggtgtatct

SEQ ID NO: 260657 - DNA, 75 bp, Artificial Sequence
  Synthetic
agctgcacagataacagcagccgcagctctaatacaagccaagcagaacgctgccaacatcctccgactcaagga

SEQ ID NO: 260658 - DNA, 75 bp, Artificial Sequence
  Synthetic
cacagttagcggtggcagtagggaagatgcaacagtttgttaatgaccagttcaataaaacagcgcaagaactgg

SEQ ID NO: 260659 - DNA, 75 bp, Artificial Sequence
  Synthetic
aaccaggcggtcccagcaaaccacagggctctgccgatggaaatgaaggtgagacccaattccttgatctaatgc

SEQ ID NO: 260660 - DNA, 75 bp, Artificial Sequence
  Synthetic
gatgcaacagtttgttaatgaccagttcaataaaacagcgcaagaactggactgtgtaaagattgcacagcaagt

SEQ ID NO: 260661 - DNA, 75 bp, Artificial Sequence
  Synthetic
ccggagggaatcaggacaatgacaccgactggggatattagtcagaacctcgctcggtgaggacccagatcctcc

SEQ ID NO: 260662 - DNA, 75 bp, Artificial Sequence
  Synthetic
tcagctgactatccaggcgctttataatttggctggtagtaatatggattatctgttgactaagttaggtgtggg

SEQ ID NO: 260663 - DNA, 75 bp, Artificial Sequence
  Synthetic
aatttggctggtagtaatatggattatctgttgactaagttaggtgtggggaacaaccagctcagctcattaatc

SEQ ID NO: 260664 - DNA, 75 bp, Artificial Sequence
  Synthetic
aatgattttgatccatataaggaaatggaatatctaacaacccttgagtacttaagagacgacaatgcggcagta

SEQ ID NO: 260665 - DNA, 75 bp, Artificial Sequence
  Synthetic
gaaaccagtggaactgtcatagacagcataattacggcccaggggaaaccagtagagactgttggaaggagtgca

SEQ ID NO: 260666 - DNA, 75 bp, Artificial Sequence
  Synthetic
gggaacctccaacatagattagatgacggcataacccagatgacatttactcctgcatctctctacagagtctca

SEQ ID NO: 260667 - DNA, 75 bp, Artificial Sequence
  Synthetic
ccttcagtcgggagcctaaataatatgcgtgccacttacttggagaccctatctgtaagcacatccaaaggattt

SEQ ID NO: 260668 - DNA, 75 bp, Artificial Sequence
  Synthetic
tgtcaggtaatggcagaagggatcttagccgaccagattgcaccttttttccagggaaatggggtcattcaagac

SEQ ID NO: 260669 - DNA, 75 bp, Artificial Sequence
  Synthetic
tccacaatcagattaattagaaaaaactacgggtagaagagtagtgtctcgagggtgggcatccaaatccacgcc

SEQ ID NO: 260670 - DNA, 75 bp, Artificial Sequence
  Synthetic
tttacatggaggctgagggcgaccttgcagacacagtgttcttatttactccttacaatctctctacagacggga

SEQ ID NO: 260671 - DNA, 75 bp, Artificial Sequence
  Synthetic
tgcgtgccacttacttggagaccctatctgtaagcacatccaaaggatttgcctcggcacttgttccaaaagtgg

SEQ ID NO: 260672 - DNA, 75 bp, Artificial Sequence
  Synthetic
ctgtcgcagtgaccgccgaccacgaggttacctctactaagctggagaaggggcacacccttgccaaatacaatc

SEQ ID NO: 260673 - DNA, 75 bp, Artificial Sequence
  Synthetic
gagacaagcgggactgtcattgacagcataatcacagctcagggcaaaccagtggagactgtagggcggagtgcc

SEQ ID NO: 260674 - DNA, 75 bp, Artificial Sequence
  Synthetic
caagagtcgtgacattccctatgtctcctggcatttactcctgtctgagaggtaatacttcagcatgcacgtatt

SEQ ID NO: 260675 - DNA, 75 bp, Artificial Sequence
  Synthetic
gtaatcacaactcgaagggcaagaatcgtcggagagttgccacttttattacgactgacctgcaaaagtattgtc

SEQ ID NO: 260676 - DNA, 75 bp, Artificial Sequence
  Synthetic
ccacccaggccgcggacgaagccggcgacacacaactcaagaccggagcgagcaactccctgctgtccatgcttg

SEQ ID NO: 260677 - DNA, 75 bp, Artificial Sequence
  Synthetic
atattgggtctcagagtcaaagacatcaataaaataggtgatgtgattagcttagtgctcaggggtatgatttct

SEQ ID NO: 260678 - DNA, 75 bp, Artificial Sequence
  Synthetic
tagccgaccagattgcaccttttttccagggaaatggggtcattcaagacagcatatccttgactaagagcatgc

SEQ ID NO: 260679 - DNA, 75 bp, Artificial Sequence
  Synthetic
gctgtttgctcatgccatcaatcaactgatgggcctacctcacttttttgagtggatccacctgagactaatgga

SEQ ID NO: 260680 - DNA, 75 bp, Artificial Sequence
  Synthetic
cagatacctctttactatacttgactcgtgctcaacagaaattctacatgaaaaccataggcaacgcagcaaaag

SEQ ID NO: 260681 - DNA, 75 bp, Artificial Sequence
  Synthetic
ctctaattgaatcgcttttccccatgacaacaaccaaaacgtatgatgagatcacactacacctccacagcaaat

SEQ ID NO: 260682 - DNA, 75 bp, Artificial Sequence
  Synthetic
gataactctgaggctcagtggggaatttgattcaacctatcagaagaatatctcaatactagattctcaagttat

SEQ ID NO: 260683 - DNA, 75 bp, Artificial Sequence
  Synthetic
tgacttaattatgccatattagaaaaaagttaaattctgactatttggaactcgtattcggactcagtctattaa

SEQ ID NO: 260684 - DNA, 75 bp, Artificial Sequence
  Synthetic
ctcgtattcggactcagtctattaactctaagcagaaatgcgcatagctgtccttaattgcagtcttgtcattca

SEQ ID NO: 260685 - DNA, 75 bp, Artificial Sequence
  Synthetic
caataagcaaggccttgaataagttagaggaaagcaacagcaaactagacaaagttaatgtcaaactggccagca

SEQ ID NO: 260686 - DNA, 75 bp, Artificial Sequence
  Synthetic
tggtacaaggtgacaatcaggtaatagctataacaagagaggtaagctcggatgactccccagatatggttttaa

SEQ ID NO: 260687 - DNA, 75 bp, Artificial Sequence
  Synthetic
aacaggacattgaccactttgctcaccccccttggtgactctatccgtaggatacaagagtctgtgactacatct

SEQ ID NO: 260688 - DNA, 75 bp, Artificial Sequence
  Synthetic
aacattgtcctatatatgagtgatttatacaagaacatgccagggattctactctctaacattgcgactacgata

SEQ ID NO: 260689 - DNA, 75 bp, Artificial Sequence
  Synthetic
gctacctgatgtacaagcagaaggcacagcaaaagactttattatggcttgggaataatacccttgatcagatga

SEQ ID NO: 260690 - DNA, 75 bp, Artificial Sequence
  Synthetic
tgatggatcacaccagctcgcggatatagatttcattgaaatgtctgcgaaactgttagtctcttgcactcgacg

SEQ ID NO: 260691 - DNA, 75 bp, Artificial Sequence
  Synthetic
atattcaaagatggagcaatactcagtcaggtcttaaaaaactcatctaaattggtgctgatatcaggagacctt

SEQ ID NO: 260692 - DNA, 75 bp, Artificial Sequence
  Synthetic
caagcgcaacacgggagaaacacgggagcatccaaccactggccagccaagacacctccgaccaacaaggtagat

SEQ ID NO: 260693 - DNA, 75 bp, Artificial Sequence
  Synthetic
acctgttgattataaggattaagaaaaaactactagacatgagttaaagcagggcaatgcacgggtagaacggtc

SEQ ID NO: 260694 - DNA, 75 bp, Artificial Sequence
  Synthetic
gatttctgttattatttgaactatttaatgagctgcgtgcagacatattttgattctgaattttccatcacaaac

SEQ ID NO: 260695 - DNA, 75 bp, Artificial Sequence
  Synthetic
ttgctacaacaagagaaatcccaaagataaggggcctatcggcagaagagaaatgctcagtactcactgagtacc

SEQ ID NO: 260696 - DNA, 75 bp, Artificial Sequence
  Synthetic
catggatcgtgtagttagcagagttgcgctagagaatgaagaaagagaagcgaagaatacatggcgccttgcatt

SEQ ID NO: 260697 - DNA, 75 bp, Artificial Sequence
  Synthetic
cgaagaatacatggcgccttgcattccggatcgcaatcctacttttaataacaataatcttggccctctctacag

SEQ ID NO: 260698 - DNA, 75 bp, Artificial Sequence
  Synthetic
cagctgggaggactgagtaacctccaatactcaaggctatacacaagaaacattggtgacccggggactaccgct

SEQ ID NO: 260699 - DNA, 75 bp, Artificial Sequence
  Synthetic
aatactcaaggctatacacaagaaacattggtgacccggggactaccgcttttgcagagatcaagagattagaag

SEQ ID NO: 260700 - DNA, 75 bp, Artificial Sequence
  Synthetic
aggagaggatcacctctgcactcagttctaatagagatgtaatggatagggtatataagcaggtagcccttgagt

SEQ ID NO: 260701 - DNA, 75 bp, Artificial Sequence
  Synthetic
agatgtaatagataggatatataagcaggtggctcttgaatccccgctggcgttactaaacactgaatctataat

SEQ ID NO: 260702 - DNA, 75 bp, Artificial Sequence
  Synthetic
atctgtaattatgaatgcaataacgtccctttcttatcagatcaatggagctgcaaataatagcgggtgtggggc

SEQ ID NO: 260703 - DNA, 75 bp, Artificial Sequence
  Synthetic
cggttctgtgatagaagaacttgacacctcatactgtatagaaactgacttagatttatattgtacaagaatagt

SEQ ID NO: 260704 - DNA, 75 bp, Artificial Sequence
  Synthetic
gaggataatgaggcagaagagaaggcgctggccgagtttttactcaatcaagaagcggttcatccccgtgtcgca

SEQ ID NO: 260705 - DNA, 75 bp, Artificial Sequence
  Synthetic
attctatccctctgcattccaagaacacctgaattttatcccggcacctactacaggatcaggttgcacccggat

SEQ ID NO: 260706 - DNA, 75 bp, Artificial Sequence
  Synthetic
accctcatttgacataagtgccacccactactgttacactcacaatgtgatattatctggttgcagagaccattc

SEQ ID NO: 260707 - DNA, 75 bp, Artificial Sequence
  Synthetic
actgcaagatgacaacatgtagatgtgtaaaccccccgggtatcatatcgcaaaactatggagaagccgtgtctc

SEQ ID NO: 260708 - DNA, 75 bp, Artificial Sequence
  Synthetic
ttctatcaatttggatgacaatcagaatcggaagtcatgcagtgtgagtgcaacccccctaggatgtgatatact

SEQ ID NO: 260709 - DNA, 75 bp, Artificial Sequence
  Synthetic
acgttgttgttcccccaagaaccactgttcgagcttcgtccagtacaagacattggtgctcgagtgagagatcct

SEQ ID NO: 260710 - DNA, 75 bp, Artificial Sequence
  Synthetic
aatcggaagtcatgcagtgtgagtgcaacccccctaggatgtgatatactgtgctctaaaatcacagagaccgag

SEQ ID NO: 260711 - DNA, 75 bp, Artificial Sequence
  Synthetic
acacctcatcccagacaggttcaatcatagtcaagttactcccgaatatgcccaaggataaagaggcgtgtgcaa

SEQ ID NO: 260712 - DNA, 75 bp, Artificial Sequence
  Synthetic
tgttcgagcttcgtccagtacaagacattggtgctcgagtgagagatccttttactcaacaacctgcatcattca

SEQ ID NO: 260713 - DNA, 75 bp, Artificial Sequence
  Synthetic
acagaagctggtcacctctgacagggggtagaaagatactgggtgtatctaaccctgataccatagagcttgtag

SEQ ID NO: 260714 - DNA, 75 bp, Artificial Sequence
  Synthetic
aaggacctagatgtcataactttatttaaggactgggtggccaattacccaggggtgggaggtggatctttcatc

SEQ ID NO: 260715 - DNA, 75 bp, Artificial Sequence
  Synthetic
ttccgagcaatatagagttgaccgacgacaccagcaagaatcctccgatgagagtgccatatctcgggtcaaaaa

SEQ ID NO: 260716 - DNA, 75 bp, Artificial Sequence
  Synthetic
aggggtgggaggtggatctttcatcgacggccgtgtctggttcccagtctacggagggcttaaacccaattcgcc

SEQ ID NO: 260717 - DNA, 75 bp, Artificial Sequence
  Synthetic
gaatttattcactccatgttccacaaaaggatatatactctccaatggttatgcctgtagaggggatatggagtg

SEQ ID NO: 260718 - DNA, 75 bp, Artificial Sequence
  Synthetic
catcggtgttggtctgggcttatggggacaatgaagtaaactggactgccgctctcaggattgcaaggtctcggt

SEQ ID NO: 260719 - DNA, 75 bp, Artificial Sequence
  Synthetic
gaggacccaatgttgactgtaccgcctaatacagtcacacttatgggggccgaagggagggtactcactgtaggg

SEQ ID NO: 260720 - DNA, 75 bp, Artificial Sequence
  Synthetic
taggacatggcgagctccagtcccgaaagggcagagcatcagattatcctaccagagtcacatctgtcctcacca

SEQ ID NO: 260721 - DNA, 75 bp, Artificial Sequence
  Synthetic
acatctcatttcttgtaccaacgaggatcttcatacttctctcccgccttattataccccatgatagtcaacaac

SEQ ID NO: 260722 - DNA, 75 bp, Artificial Sequence
  Synthetic
caacaaattatgctcttgggtttatccctaattgaatcacttttcccgatgacagcaaccaagacgtatgatgag

SEQ ID NO: 260723 - DNA, 75 bp, Artificial Sequence
  Synthetic
aaaacggctactcttcatagtccttacacattcaatgctttcactcggccgggcattatcccttgccaggcatca

SEQ ID NO: 260724 - DNA, 75 bp, Artificial Sequence
  Synthetic
gataggccatgtctttgttactcctgagcttgtcattgtgacacatacagatgagaacaagttcacatgcctcac

SEQ ID NO: 260725 - DNA, 75 bp, Artificial Sequence
  Synthetic
tgccgacacagtattcttatttactccttacaatctctctacagacgggaaaaagagaacatcacttaaacagtg

SEQ ID NO: 260726 - DNA, 75 bp, Artificial Sequence
  Synthetic
ttgcggggggtattcgggacaatgcttgatgatgaacaagcaaggcttaaccctgtatctgcagtatttgataac

SEQ ID NO: 260727 - DNA, 75 bp, Artificial Sequence
  Synthetic
ccttacaatctctctacagacgggaaaaagagaacatcacttaaacagtgcacaagacagatcttggagatcaca

SEQ ID NO: 260728 - DNA, 75 bp, Artificial Sequence
  Synthetic
caccctctttggcgaattcaggatcgtccctttactagtggagattctcaaggatggcaggatttaaaatgccag

SEQ ID NO: 260729 - DNA, 75 bp, Artificial Sequence
  Synthetic
gtccctttactagtggagattctcaaggatggcaggatttaaaatgccaggtccggccagttggatcagctgcga

SEQ ID NO: 260730 - DNA, 75 bp, Artificial Sequence
  Synthetic
gcgagaacgggcttcctaaggatttctgttattatttaaactacctaatgagttgtgtgcagacatactttgatt

SEQ ID NO: 260731 - DNA, 75 bp, Artificial Sequence
  Synthetic
aacatcgtcctatacatgagtgatttatacaagaatatgccgggaattctgctatctaatattgcagcgacgata

SEQ ID NO: 260732 - DNA, 75 bp, Artificial Sequence
  Synthetic
gacttctacaccgctgatcacccaaagtcagctagtgttaataagattaatcttaatcctgttgatagtcgctta

SEQ ID NO: 260733 - DNA, 75 bp, Artificial Sequence
  Synthetic
gctatctaatattgcagcgacgatatcccaccccctcattcattcaaggttgagcgcagtcggcctggttaacca

SEQ ID NO: 260734 - DNA, 75 bp, Artificial Sequence
  Synthetic
agtcagctagtgttaataagattaatcttaatcctgttgatagtcgcttagttaagaaaaaatataagcgatagc

SEQ ID NO: 260735 - DNA, 75 bp, Artificial Sequence
  Synthetic
ctcgtattcggactcaatagattaactctaagcagaaacgcgcgtagctgtcattaactgcagccctgtcattca

SEQ ID NO: 260736 - DNA, 75 bp, Artificial Sequence
  Synthetic
cttgcagtgtgagtgcaactcccctgggttgtgatatgctgtgctcgaaagtcacggagacagaggaagaagatt

SEQ ID NO: 260737 - DNA, 75 bp, Artificial Sequence
  Synthetic
ttacaatctctctacagacggtaagaagagaacatcactcaagcagtgcacaaggcaaatcctagaggtcactat

SEQ ID NO: 260738 - DNA, 75 bp, Artificial Sequence
  Synthetic
caccagatcatcctaccggaatcacatctgtcctcaccattggttaagcacaaactgctctattattggaaattg

SEQ ID NO: 260739 - DNA, 75 bp, Artificial Sequence
  Synthetic
aataagtacgatctgctgttcccatccgtcttagatgataacctaagtgagaagatgcttcagctgatctcccgg

SEQ ID NO: 260740 - DNA, 75 bp, Artificial Sequence
  Synthetic
gtgacttcgaccacctcattatcagtcgacaatggaaaaaaatactcgaatcagccactcccgacattgagagga

SEQ ID NO: 260741 - DNA, 75 bp, Artificial Sequence
  Synthetic
tcagtggctatatcaaaggcagaggataaacttacctctgctctcggagtgagccaggatgtaatagacaggata

SEQ ID NO: 260742 - DNA, 75 bp, Artificial Sequence
  Synthetic
aaatgctcagtactcactgaatacctgctgtcggatgctgtaaaaccgttgcttaaatccgagcaagtgagctct

SEQ ID NO: 260743 - DNA, 75 bp, Artificial Sequence
  Synthetic
tgctgtcggatgctgtaaaaccgttgcttaaatccgagcaagtgagctctattatgtcccccaatataatcacgt

SEQ ID NO: 260744 - DNA, 75 bp, Artificial Sequence
  Synthetic
caggagcctatcagagaaaattgatgacattctgcggttagtagatgctctggcaaaagatttgggcaatcaagt

SEQ ID NO: 260745 - DNA, 75 bp, Artificial Sequence
  Synthetic
gtttagaggaactggttagtattgaggtccccgattcaaccaacaagtttcggaagatcgagaagaaggtccaaa

SEQ ID NO: 260746 - DNA, 75 bp, Artificial Sequence
  Synthetic
gcgctcaacaaaaattctacatgaaaaccataggtaatgcagccaagggatattacagcaacaatgactcttaaa

SEQ ID NO: 260747 - DNA, 75 bp, Artificial Sequence
  Synthetic
tggcattattgttccctcaggaaccactgcttgatttttgtccagtacaggatattggtgctagagtgaaagatc

SEQ ID NO: 260748 - DNA, 75 bp, Artificial Sequence
  Synthetic
actgcttgatttttgtccagtacaggatattggtgctagagtgaaagatccattcactcgacgaccagcagcatt

SEQ ID NO: 260749 - DNA, 75 bp, Artificial Sequence
  Synthetic
ggtccggcaacgtctcacgatcagaagaattcaatagcattcgtacagatccagccttctggtttcactcaaaat

SEQ ID NO: 260750 - DNA, 75 bp, Artificial Sequence
  Synthetic
gcagggaacaagtatgatttgcttttcccttctgtcctagatgacaacctgaacgagaagatgctacagctgatc

SEQ ID NO: 260751 - DNA, 75 bp, Artificial Sequence
  Synthetic
ccatataagacagatccaaaggcacctgattgtagcagcaagaacaaggtctgcagtcaataaattagtgacgct

SEQ ID NO: 260752 - DNA, 75 bp, Artificial Sequence
  Synthetic
attaccgaatccagaggaagatcacttagtacgatacttgtttagaggtatagggactgcgtcatcctcttggta

SEQ ID NO: 260753 - DNA, 75 bp, Artificial Sequence
  Synthetic
agagagaatacagaagaaagtgatctgacctcagataaagcagtgggatatatcacatctgcagtgccttacagg

SEQ ID NO: 260754 - DNA, 75 bp, Artificial Sequence
  Synthetic
ttagtacgatacttgtttagaggtatagggactgcgtcatcctcttggtataaggcatcccatcttctttctgta

SEQ ID NO: 260755 - DNA, 75 bp, Artificial Sequence
  Synthetic
aatggagctcacggaggaggagagaaagggagcactttaaaagttgaggtcccagtattcactcttaacagtgat

SEQ ID NO: 260756 - DNA, 75 bp, Artificial Sequence
  Synthetic
atgcctcactcaggagctggtgttgatgtacgcggatatgatggagggcagagatatggtcaacataatctcatc

SEQ ID NO: 260757 - DNA, 75 bp, Artificial Sequence
  Synthetic
cagatgagctttgcaccagccgaatatgcacaactttattcttttgccatgggcatggcatcagtcttagataag

SEQ ID NO: 260758 - DNA, 75 bp, Artificial Sequence
  Synthetic
gaactgcatgtgccccatgagaccatctattacaatacacttttttctaatgagatgaatcccccacagcggcat

SEQ ID NO: 260759 - DNA, 75 bp, Artificial Sequence
  Synthetic
gggcagggtgatgactgtcgggacctctcattacctgtaccagcgcgggtcttcttattactcccctgccatact

SEQ ID NO: 260760 - DNA, 75 bp, Artificial Sequence
  Synthetic
atgtacgcggatatgatggagggcagagatatggtcaacataatctcatccacggcagcacatctcaagagctta

SEQ ID NO: 260761 - DNA, 75 bp, Artificial Sequence
  Synthetic
tctattacaatacacttttttctaatgagatgaatcccccacagcggcatttcgggccgactccgacgcaatttt

SEQ ID NO: 260762 - DNA, 75 bp, Artificial Sequence
  Synthetic
gtagcgctaatggagggattcgcatacggcgcagttcagctgcttgaaccttcaggcacatttgcaggggatttt

SEQ ID NO: 260763 - DNA, 75 bp, Artificial Sequence
  Synthetic
tatggagagagaatacagaagaaagcgacttgatctcagataaagcagtgggatacatcacatctgtggtgcctt

SEQ ID NO: 260764 - DNA, 75 bp, Artificial Sequence
  Synthetic
cgacttgatctcagataaagcagtgggatacatcacatctgtggtgccttacagatctgtatcattactgcattg

SEQ ID NO: 260765 - DNA, 75 bp, Artificial Sequence
  Synthetic
catgcaatcgccaccgtattctctggcctagaacagaaccaagcagctgagatgctgtgtctgctgcgcttgtgg

SEQ ID NO: 260766 - DNA, 75 bp, Artificial Sequence
  Synthetic
gcattctgtgagggaaggtggggtcgtaatcatcaaagtactatatgcgatgggatattatttccatttactctt

SEQ ID NO: 260767 - DNA, 75 bp, Artificial Sequence
  Synthetic
gtaatcatcaaagtactatatgcgatgggatattatttccatttactcttgaatttgtttactccatgttgcacg

SEQ ID NO: 260768 - DNA, 75 bp, Artificial Sequence
  Synthetic
tcaaaccctccgcccaaaaccctcccacaccccccgacccacaatcctgcacgaccccaccaacaaaagctcccc

SEQ ID NO: 260769 - DNA, 75 bp, Artificial Sequence
  Synthetic
ctaggtgggcctacgtttgtgcacgaggtggtgagaatggcaaaaactctagtacaacggcatggcacgctactg

SEQ ID NO: 260770 - DNA, 75 bp, Artificial Sequence
  Synthetic
aggtggtgagaatggcaaaaactctagtacaacggcatggcacgctactgtctaaatcagatgagatcacattaa

SEQ ID NO: 260771 - DNA, 75 bp, Artificial Sequence
  Synthetic
tcgcatgatgtcatgttgagggagtacaagagtctatccgcacttgaattcgagccatgtatagaatatgacccc

SEQ ID NO: 260772 - DNA, 75 bp, Artificial Sequence
  Synthetic
tattactggaaattaactgggctaccgcttcctgatgaatgtgacttcgaccacctcattctcagccgacaatgg

SEQ ID NO: 260773 - DNA, 75 bp, Artificial Sequence
  Synthetic
cccggcagcaaggagaggcctggcagctgctgcccaacgagtgtccgaggaaattggcagcatggatgttcctac

SEQ ID NO: 260774 - DNA, 75 bp, Artificial Sequence
  Synthetic
cgagccatgtatagaatatgaccccgttacgaatcttagcatgtttctaaaagacaaggcaatcgcacatccaag

SEQ ID NO: 260775 - DNA, 75 bp, Artificial Sequence
  Synthetic
gattgaagccgggggacagcccgtccgtccattctgtgcagagagtttagtgagtacattaacagataggactca

SEQ ID NO: 260776 - DNA, 75 bp, Artificial Sequence
  Synthetic
gaccaaccgcctcctgatagaattcttggagtcaggcgattttgatccatataaagagatggagtatctgacgac

SEQ ID NO: 260777 - DNA, 75 bp, Artificial Sequence
  Synthetic
agtcaggacgcccctgaccaacaagacagaacagaaaaacagccatccacacctgagcaggcgactccacacaac

SEQ ID NO: 260778 - DNA, 75 bp, Artificial Sequence
  Synthetic
gatatgattctccaggtgctgtcattttttaaaggaactatcatcaatggatataggaagaagaacgccggtgtc

SEQ ID NO: 260779 - DNA, 75 bp, Artificial Sequence
  Synthetic
gatttttgctaagttaacaaagaaactaaggaactgtcaggtaatggcagaagggattctagccgaccagattgc

SEQ ID NO: 260780 - DNA, 75 bp, Artificial Sequence
  Synthetic
ttaggcctcgaatccgcaatcgaatcatagtggcaaaaataatataaaacagaatagtttgtcacattattctga

SEQ ID NO: 260781 - DNA, 75 bp, Artificial Sequence
  Synthetic
cgcagggtggaccgagcaaaccacaaaggcaaccggacgccggggatggagagacacaattcctggacctgatga

SEQ ID NO: 260782 - DNA, 75 bp, Artificial Sequence
  Synthetic
atctttcaacagcaacaagaaacgtatcaccgactgtaaggagagagtatcctcaatccgcaatcacgacccgaa

SEQ ID NO: 260783 - DNA, 75 bp, Artificial Sequence
  Synthetic
ctggaggacctcatcccactgaggacatatttgaaacgcagtacctgccctaaatacttaaaggcagttctaggc

SEQ ID NO: 260784 - DNA, 75 bp, Artificial Sequence
  Synthetic
cctcaatccgcaatcacgacccgaagagcaaaaatcgtcggagagttgccacctttattacaaccgacctgcaaa

SEQ ID NO: 260785 - DNA, 75 bp, Artificial Sequence
  Synthetic
catatttgaaacgcagtacctgccctaaatacttaaaggcagttctaggcatcaccaaactcaaagaaatgttca

SEQ ID NO: 260786 - DNA, 75 bp, Artificial Sequence
  Synthetic
gcagtctcttactcattgaaagagaaggaggtgaaggttaacggccgcatattcgccaagttgaccaagaagctg

SEQ ID NO: 260787 - DNA, 75 bp, Artificial Sequence
  Synthetic
atcaatcagctaatgggcctacctcacttctttgagtggattcatcttagactcatggatactacaatgtttgta

SEQ ID NO: 260788 - DNA, 75 bp, Artificial Sequence
  Synthetic
gccataatagtgtatgacaacacccggaattggatcagcgaagcccagaattcagatgtggtccgcttatttgag

SEQ ID NO: 260789 - DNA, 75 bp, Artificial Sequence
  Synthetic
gatattacagtagcagtgactcctgaaggcgatcacatactaacagactttccccttagccaattgtacctttat

SEQ ID NO: 260790 - DNA, 75 bp, Artificial Sequence
  Synthetic
acggccaaaccggcaggagcacccccccacccccccctccacccccagccacacgaccccacctgcccaaagcaa

SEQ ID NO: 260791 - DNA, 75 bp, Artificial Sequence
  Synthetic
ctcgtattcggattcacataactatctcataacaggggtgtgcatagttgtcctcgattatagccatgtcattca

SEQ ID NO: 260792 - DNA, 75 bp, Artificial Sequence
  Synthetic
ctcgtattcggattcacataactatctcataacaggggtgtgcatagttgtcctcgattatagccttgtcattca

SEQ ID NO: 260793 - DNA, 75 bp, Artificial Sequence
  Synthetic
ctcgtattcggattcacataactatctcataacaggggtgtgcatagttgtcctcgattatagccctgtcattca

SEQ ID NO: 260794 - DNA, 75 bp, Artificial Sequence
  Synthetic
ctcgtattcggattcacataactatctcataacaggggtgtgcatagttgtcctcgattatagccgtgtcattca

SEQ ID NO: 260795 - DNA, 75 bp, Artificial Sequence
  Synthetic
acacgaccccacctgcccaaagcaacacaggcacaactcggcccgccagcaatccgtgcaggacccaagatatta

SEQ ID NO: 260796 - DNA, 75 bp, Artificial Sequence
  Synthetic
aatccgtgcaggacccaagatattagaaaaaaatacgggtagaagagagatactcggagatcagaactagccacc

SEQ ID NO: 260797 - DNA, 75 bp, Artificial Sequence
  Synthetic
gctgcagcaagatcacattgtcgtgttgcctgtatggtacaaggtgacaaccaagtaatagctgtgacaagagaa

SEQ ID NO: 260798 - DNA, 75 bp, Artificial Sequence
  Synthetic
ttgcctgtatggtacaaggtgacaaccaagtaatagctgtgacaagagaagtaagatcagatgattcccccgaga

SEQ ID NO: 260799 - DNA, 75 bp, Artificial Sequence
  Synthetic
cggtattctgtcttcggattgctgttagcgaggatgccaacaagccactcaggcaaggtgctcttatatccctct

SEQ ID NO: 260800 - DNA, 75 bp, Artificial Sequence
  Synthetic
ataatttaaaagatcgggaaaccatcaggtcggacacattctttatatacagtaaacgcatattcaaagatgggg

SEQ ID NO: 260801 - DNA, 75 bp, Artificial Sequence
  Synthetic
agcacggctctgcgagaatggcctcccaaaggatttctgctactatctcaactacctgatgagttgtatccaaac

SEQ ID NO: 260802 - DNA, 75 bp, Artificial Sequence
  Synthetic
caaagaaggtttggtttttttccccacatacgggttcatttttcaaattggaaaagaagaagtcaccgttggcac

SEQ ID NO: 260803 - DNA, 75 bp, Artificial Sequence
  Synthetic
ggacaggacacctccgaccaacaggacagaccagacaagcagccatccacacccgagcaggcgaccccacacaac

SEQ ID NO: 260804 - DNA, 75 bp, Artificial Sequence
  Synthetic
agtaaacgcatattcaaagatggggcaattctcagtcaggtcctcaagaactcatccaaattagtgctaatatca

SEQ ID NO: 260805 - DNA, 75 bp, Artificial Sequence
  Synthetic
acatacgggttcatttttcaaattggaaaagaagaagtcaccgttggcacgattaacgataaacccaggcaagag

SEQ ID NO: 260806 - DNA, 75 bp, Artificial Sequence
  Synthetic
aggcaaggtgctctcatatctctcttatgctcccactctcaagtgatgaggaaccatgttgcccttgcagggaaa

SEQ ID NO: 260807 - DNA, 75 bp, Artificial Sequence
  Synthetic
aatcccccgaatgatcgcacaactgcaaccaatccagcagcattagaaattaagaaaaaatacgggtagaatcaa

SEQ ID NO: 260808 - DNA, 75 bp, Artificial Sequence
  Synthetic
ctcgctatgggggtaacgtgcaagaagggggcaaaccattatgagagaatagttttttcgatagggcaggccccc

SEQ ID NO: 260809 - DNA, 75 bp, Artificial Sequence
  Synthetic
caaccaatccagcagcattagaaattaagaaaaaatacgggtagaatcaaagtgcctcgattgcaccaaaatgga

SEQ ID NO: 260810 - DNA, 75 bp, Artificial Sequence
  Synthetic
agtgcctcgattgcaccaaaatggactcatccaggacaatcgggctgtactttgattctgccctcccttccagca

SEQ ID NO: 260811 - DNA, 75 bp, Artificial Sequence
  Synthetic
agggggcaaaccattatgagagaatagttttttcgatagggcaggccccccggggggtggaaaactgtaaggttg

SEQ ID NO: 260812 - DNA, 75 bp, Artificial Sequence
  Synthetic
ccaagacatcagccctcgcactcagcagcctcacaggtgatatccaaaaaatgaaacagctcatgcgtttatatc

SEQ ID NO: 260813 - DNA, 75 bp, Artificial Sequence
  Synthetic
caggctcaagtatgggtcacggtagcaaaggccatgactgcatatgagacagcagatgagtcggaaacaagaaga

SEQ ID NO: 260814 - DNA, 75 bp, Artificial Sequence
  Synthetic
cagatgagtttcgcaccagctgagtatgcacaactttattctttcgccatgggtatggcatcaatcctagacaag

SEQ ID NO: 260815 - DNA, 75 bp, Artificial Sequence
  Synthetic
acatggctgctgagctaaaactaaccccagcagcaaggagaggcctggcagctgctgcccaacgagtatctgaag

SEQ ID NO: 260816 - DNA, 75 bp, Artificial Sequence
  Synthetic
gggagctccacctattacaacttggtaggggatgtagactcatacatcaggaacaccgggcttactgcattcttc

SEQ ID NO: 260817 - DNA, 75 bp, Artificial Sequence
  Synthetic
agcccaaatattgtacttaagaaacatacacagaaagtcctatttgaaacttgttcaaatcccttattatccgga

SEQ ID NO: 260818 - DNA, 75 bp, Artificial Sequence
  Synthetic
ccaagacatcagcccttgcactcagcagcctcacaggcgatatccaaaaaatgaagcagctcatgcgtttatatc

SEQ ID NO: 260819 - DNA, 75 bp, Artificial Sequence
  Synthetic
gctgctgcccaacgagtatccgaagagatcggcagtatggatattcctacccaacaggcaggggtcctcaccgga

SEQ ID NO: 260820 - DNA, 75 bp, Artificial Sequence
  Synthetic
aagagaaggcattggctgaattcctgctcaatcaagaggtaattcacccacgcgtcgctcatgccatcatggaag

SEQ ID NO: 260821 - DNA, 75 bp, Artificial Sequence
  Synthetic
tgtcaaataggtactcatcagtgaatgcagtgaagcatgtgaaggcgcccgaaaagatccctgggagcggaaccc

SEQ ID NO: 260822 - DNA, 75 bp, Artificial Sequence
  Synthetic
catgacattgctaggtgacagtgaccagatgagctttgcaccagctgagtatgcacaactttactctttcgccat

SEQ ID NO: 260823 - DNA, 75 bp, Artificial Sequence
  Synthetic
gagacccaattcttggactttatgagagcagtggcgaacagcatgcgggaagcaccaaatcccgcacagagcacc

SEQ ID NO: 260824 - DNA, 75 bp, Artificial Sequence
  Synthetic
gagcagtggcgaacagcatgcgggaagcaccaaatcccgcacagagcaccaccaatccggagcctcccccaactc

SEQ ID NO: 260825 - DNA, 75 bp, Artificial Sequence
  Synthetic
ctaggaggccactcggcttcaagaggctgatgcggatagtcaattactcgggcatgcatgcaatgctatttaggg

SEQ ID NO: 260826 - DNA, 75 bp, Artificial Sequence
  Synthetic
atcaacccttcacccaaaactctctcacactccccgactcataatccctcatgaccacaccaacaaggacacccc

SEQ ID NO: 260827 - DNA, 75 bp, Artificial Sequence
  Synthetic
gctgctgcccaacgagtgtctgaggagaccggcagcatggatattcctactcaacaagccggggtcctcaccggg

SEQ ID NO: 260828 - DNA, 75 bp, Artificial Sequence
  Synthetic
atgcgcggaacagaagctggtcgcctttaacagggggtagaaagatactgggtgtatctaatcccgataccatag

SEQ ID NO: 260829 - DNA, 75 bp, Artificial Sequence
  Synthetic
ggttccatcttccaggcaatatagagctgactgatgataccagcaagaatcctccaatgagagtaccatatctcg

SEQ ID NO: 260830 - DNA, 75 bp, Artificial Sequence
  Synthetic
gagacccaattcctggatttgatgagagcggtggcaaatagcatgcgagaagcgccaaactccgcacagagcacc

SEQ ID NO: 260831 - DNA, 75 bp, Artificial Sequence
  Synthetic
gctgactgatgataccagcaagaatcctccaatgagagtaccatatctcggatcaaagactcaagaaaggagggc

SEQ ID NO: 260832 - DNA, 75 bp, Artificial Sequence
  Synthetic
atccttgagaccagtgggactgtcattgatagcataatcacggcccagggcaaaccagctgagactgtcggaagg

SEQ ID NO: 260833 - DNA, 75 bp, Artificial Sequence
  Synthetic
cccagcctgcctccacaggaccaccccaacccctctgcccgcaccccaccccctgatccgcagccccgcatggcc

SEQ ID NO: 260834 - DNA, 75 bp, Artificial Sequence
  Synthetic
ccaacccctctgcccgcaccccaccccctgatccgcagccccgcatggccaaacccacaaaagaacccccccatc

SEQ ID NO: 260835 - DNA, 75 bp, Artificial Sequence
  Synthetic
atccatctcgactgcttatagttagttcacctgtctagcaaattagaaaaaacacgggtagaagagtctggatcc

SEQ ID NO: 260836 - DNA, 75 bp, Artificial Sequence
  Synthetic
ggcttatggggacaacgaggtaaattggactgctgctctcaagattgcaaggtctcggtgcaacataagttcgga

SEQ ID NO: 260837 - DNA, 75 bp, Artificial Sequence
  Synthetic
agccaggacattcctgaccaacaagacagagcggacaaacagccgtccacacctgagcaggctaccttacacaac

SEQ ID NO: 260838 - DNA, 75 bp, Artificial Sequence
  Synthetic
acagagcggacaaacagccgtccacacctgagcaggctaccttacacaacaacccaccagtcacacccaccggac

SEQ ID NO: 260839 - DNA, 75 bp, Artificial Sequence
  Synthetic
gacgtttacccctgcatccctctatagagtgtcaccttacatccacatatccaatgattctcaaaggttatttac

SEQ ID NO: 260840 - DNA, 75 bp, Artificial Sequence
  Synthetic
cggattatgctgatattgagctgtatccgtctgacaagctctcttgacggcaggccccttgcagctgcaggaatt

SEQ ID NO: 260841 - DNA, 75 bp, Artificial Sequence
  Synthetic
tacagagccaaagatattagaaaaaaatacgggtagaagagaggcattcagagaccaagacgagtcactagggtc

SEQ ID NO: 260842 - DNA, 75 bp, Artificial Sequence
  Synthetic
cttcccaatgacaacaaccaggacatatgatgaaatcacattgcacctccacagtaaatttagttgctgtatcag

SEQ ID NO: 260843 - DNA, 75 bp, Artificial Sequence
  Synthetic
gtccaatgctaaaaagggcccatggtcaggtccccaagaagggtaccaccaacctccggcacagcaacctgggga

SEQ ID NO: 260844 - DNA, 75 bp, Artificial Sequence
  Synthetic
cggaccaagctacttgctcctttcttctctagcagtggaacagcctgctatcctatagcaaatgcctctccccag

SEQ ID NO: 260845 - DNA, 75 bp, Artificial Sequence
  Synthetic
ggaagcacctgttgcagttcctttcgagctgctcgggttggcgccagaactaagggcagttacttcgaataagtt

SEQ ID NO: 260846 - DNA, 75 bp, Artificial Sequence
  Synthetic
ccagccacatccaccgaccagccccccacccaggccgcaggcgaggccggcgacacacagctcaagaccggagca

SEQ ID NO: 260847 - DNA, 75 bp, Artificial Sequence
  Synthetic
tgacctggctgacactgtcttcctattcacaccgtacaatttgtccaccgatgggaagaagagaacatcgctaaa

SEQ ID NO: 260848 - DNA, 75 bp, Artificial Sequence
  Synthetic
aaatttagagtcataccccacaatagagctgatgaacattcttgcaatatctagtgggaagttgattggccaatc

SEQ ID NO: 260849 - DNA, 75 bp, Artificial Sequence
  Synthetic
cagtcatatacatggaagcagagggtgacctggctgacactgtcttcctattcacaccgtacaatttgtccaccg

SEQ ID NO: 260850 - DNA, 75 bp, Artificial Sequence
  Synthetic
agggcagaaccaagacaatactcctgcacctgtggatcatgtccagctacctgtcgactttgtgcaggcgatgat

SEQ ID NO: 260851 - DNA, 75 bp, Artificial Sequence
  Synthetic
cgacacacagctcaagaccggagcaagcaactcacttttgtcgatgctcgacaagcttagcaataaatcgtctaa

SEQ ID NO: 260852 - DNA, 75 bp, Artificial Sequence
  Synthetic
gagctgatgaacattcttgcaatatctagtgggaagttgattggccaatctgtggtttcctatgatgaagacacc

SEQ ID NO: 260853 - DNA, 75 bp, Artificial Sequence
  Synthetic
gtccgcctattcgagtatgcagcacttgaagtgctcctcgactgttcttatcaactttactatttgagggtgaga

SEQ ID NO: 260854 - DNA, 75 bp, Artificial Sequence
  Synthetic
cacacaagatccgccgttctgaagagtttgacagtctccgcacagacccagcattctggttccactcttcatggt

SEQ ID NO: 260855 - DNA, 75 bp, Artificial Sequence
  Synthetic
gctacaatatctcaccccatcatccactcgaggttgaatgcagtaggcctagtcaaccacgacgggtcacaccaa

SEQ ID NO: 260856 - DNA, 75 bp, Artificial Sequence
  Synthetic
actcgaggttgaatgcagtaggcctagtcaaccacgacgggtcacaccaacttgcaaacacagatttcattgaac

SEQ ID NO: 260857 - DNA, 75 bp, Artificial Sequence
  Synthetic
gctgtcgcagtgactgctgatcatgaggttacctctactaagatagagaagaggcacaccattgctaagtacaat

SEQ ID NO: 260858 - DNA, 75 bp, Artificial Sequence
  Synthetic
tgtttccatctgtcctagatgataacctgagcgagaaaatgcttcagttgatatctcgattgtgctgcctgtaca

SEQ ID NO: 260859 - DNA, 75 bp, Artificial Sequence
  Synthetic
aatttcaggtcccggagatccatctccttatgtgacgcaagggggcgaaatgacactcaataaactttcacaacc

SEQ ID NO: 260860 - DNA, 75 bp, Artificial Sequence
  Synthetic
aacacgggtagaagagtctggaccctggccggcacattcaaggtgcaacatgggctccaaaccttccaccaggat

SEQ ID NO: 260861 - DNA, 75 bp, Artificial Sequence
  Synthetic
acaaacccacgcctcaacacctcaaacaacagctccctctcacctcctccactcccccgagtgatcgcacaactg

SEQ ID NO: 260862 - DNA, 75 bp, Artificial Sequence
  Synthetic
ctgagtacttactatcagacgccgtgaagccattgctcagatccgagcaagtgagctctatcatgtctcccaaca

SEQ ID NO: 260863 - DNA, 75 bp, Artificial Sequence
  Synthetic
gaagccattgctcagatccgagcaagtgagctctatcatgtctcccaacataattacattcccagccaatctgta

SEQ ID NO: 260864 - DNA, 75 bp, Artificial Sequence
  Synthetic
ccgtgcattgatcacctcacgtccgatgcatccgagctcctcagctaagctcctgagtaagctggatgcagccgg

SEQ ID NO: 260865 - DNA, 75 bp, Artificial Sequence
  Synthetic
atgcatccgagctcctcagctaagctcctgagtaagctggatgcagccgggtcgattgaagagatcaggaaaatc

SEQ ID NO: 260866 - DNA, 75 bp, Artificial Sequence
  Synthetic
cactatcacaacctacaacaggttcccgccttttcagtgtcacaaggactctgccctgagctttcccccataaac

SEQ ID NO: 260867 - DNA, 75 bp, Artificial Sequence
  Synthetic
gtcagactaactagcacatctgctctcattacctatattgttctaactgtcatttccctaattttcggtgcactt

SEQ ID NO: 260868 - DNA, 75 bp, Artificial Sequence
  Synthetic
cgtttacacccagtcagattcactctgaacacacattgctgaacccagaggaagaccatttagtacgatacctgt

SEQ ID NO: 260869 - DNA, 75 bp, Artificial Sequence
  Synthetic
accctcgatcagatgagagccaccacaagagcatgaatgcagataagaggtggacagatacccagcagcagcctg

SEQ ID NO: 260870 - DNA, 75 bp, Artificial Sequence
  Synthetic
gggagggtcttttattgacaaccgcgtatggttcccagtctatggagggctaaaacccaattcgcctagtgacac

SEQ ID NO: 260871 - DNA, 75 bp, Artificial Sequence
  Synthetic
ggcggaaggaagtggagccattatgagtcttcttgagctgcatgtaccgcatgagactatctattacaatacact

SEQ ID NO: 260872 - DNA, 75 bp, Artificial Sequence
  Synthetic
gtttgttaatgaccaatttaataatacggcgcgagaattggactgcataaaaattacacaacaagtcggtgtaga

SEQ ID NO: 260873 - DNA, 75 bp, Artificial Sequence
  Synthetic
aggaagtcactgtcggcatgatcaatgataatcccaagcacgagttactttcctctgcgatgctctgcctaggaa

SEQ ID NO: 260874 - DNA, 75 bp, Artificial Sequence
  Synthetic
cacagttcctgaattcggtcgtttacaggaatttacaagcggaagtaccatgcaaggatggatttgttcaggagt

SEQ ID NO: 260875 - DNA, 75 bp, Artificial Sequence
  Synthetic
tcgagtgcgagcccgaagctcaagcttgggaataccttctgccaagatgtcttccgtattcgatgaatatgagca

SEQ ID NO: 260876 - DNA, 75 bp, Artificial Sequence
  Synthetic
cagtgccctacaggtctgtatcattattgcattgtgacattgaaatccctctgggatccaatcaaagcttactcg

SEQ ID NO: 260877 - DNA, 75 bp, Artificial Sequence
  Synthetic
gatgtggatgtggatccgaagagcccattggtcaaatccctttctaggtctgatagcggatattacgcgaatctt

SEQ ID NO: 260878 - DNA, 75 bp, Artificial Sequence
  Synthetic
attgcattgtgacattgaaatccctctgggatccaatcaaagcttactcgatcaactggctactaatttatccct

SEQ ID NO: 260879 - DNA, 75 bp, Artificial Sequence
  Synthetic
tctgctcatgaatttgttcgctccatgttccacaaaaggatatattctctctaatggctatgcatgtagagggga

SEQ ID NO: 260880 - DNA, 75 bp, Artificial Sequence
  Synthetic
tatggagtgttacttggtatttatcatgggtcatttaggcggacctacatttgtacatgaggtggtgaggatggc

SEQ ID NO: 260881 - DNA, 75 bp, Artificial Sequence
  Synthetic
catatcggacttatgtccactgtagataagaaggggaagaaagtgacatttgacaagctggagaggaagataagg

SEQ ID NO: 260882 - DNA, 75 bp, Artificial Sequence
  Synthetic
gctgtcgcagtgaccgctgatcacgaggtcacttccactaaaatagagaagaagcataccattgccaaatacaat

SEQ ID NO: 260883 - DNA, 75 bp, Artificial Sequence
  Synthetic
acagcagcatcgcgtaacagacatcctatccagcccgctaccaagactaatgaagttcttgggagagaatatcga

SEQ ID NO: 260884 - DNA, 75 bp, Artificial Sequence
  Synthetic
ctatccagcccgctaccaagactaatgaagttcttgggagagaatatcgatactgcgctgattgaagctggggga

SEQ ID NO: 260885 - DNA, 75 bp, Artificial Sequence
  Synthetic
gtgcagaccccccaggtatcatatcgcaaaactatggagaagctgtatctctaatagatagacattcatgcaatg

SEQ ID NO: 260886 - DNA, 75 bp, Artificial Sequence
  Synthetic
attcatctctactgcttctagttagttcaccaatctagcgaattagaaaaaacacgggtagaagattctggatcc

SEQ ID NO: 260887 - DNA, 75 bp, Artificial Sequence
  Synthetic
gtgaagatggccacttttaccgatgctgagatagaggatatatttgagaccagtggaactgtcattgacagcata

SEQ ID NO: 260888 - DNA, 75 bp, Artificial Sequence
  Synthetic
gccagtcacattgacacagtcattcgatctgtgatctacatggaagccgagggtgatcttgctgacacagtattc

SEQ ID NO: 260889 - DNA, 75 bp, Artificial Sequence
  Synthetic
gatctgtgatctacatggaagccgagggtgatcttgctgacacagtattcttgtttactccttataatctctcta

SEQ ID NO: 260890 - DNA, 75 bp, Artificial Sequence
  Synthetic
caatggcaaactagacaaggtcaatgtcagactaatcaacacatctgctctcattacctatatcgttctaaccgt

SEQ ID NO: 260891 - DNA, 75 bp, Artificial Sequence
  Synthetic
tctgcccggcaagctctctcgatggcaggcctcttgcggctgcagggattgtagtaacaggagacaaggcagtca

SEQ ID NO: 260892 - DNA, 75 bp, Artificial Sequence
  Synthetic
ccaaagatctcaacaaggtgggtgacataattggcctggtgctcagaggtatgatttctctagaggacctaatcc

SEQ ID NO: 260893 - DNA, 75 bp, Artificial Sequence
  Synthetic
cataattggcctggtgctcagaggtatgatttctctagaggacctaatcccactgagaacgtacttaaaacgtag

SEQ ID NO: 260894 - DNA, 75 bp, Artificial Sequence
  Synthetic
cttgattgctcacagttagtttacctgtctatcaaattagaaaaaacacgggtagaagaatttggatcccggttg

SEQ ID NO: 260895 - DNA, 75 bp, Artificial Sequence
  Synthetic
tgtctatcaaattagaaaaaacacgggtagaagaatttggatcccggttggcacattcaaggtgcaagatgggct

SEQ ID NO: 260896 - DNA, 75 bp, Artificial Sequence
  Synthetic
gaatcagctggagaacaggaccagcacgggcagaaccaggccagcaacagcaaccgggcaaccccagaagaagga

SEQ ID NO: 260897 - DNA, 75 bp, Artificial Sequence
  Synthetic
gctccccttggcgattccatccgcaagatccaagggtccgtgtccacgtctggaggaaggagacggaaacgcttt

SEQ ID NO: 260898 - DNA, 75 bp, Artificial Sequence
  Synthetic
atggaagacttaagaaaaaactattggatataagaaaccaaagagcactacacgggtagaacggtcggagaagcc

SEQ ID NO: 260899 - DNA, 75 bp, Artificial Sequence
  Synthetic
gtacttgacccgtgctcagcaaaaattctacatgaaaactataggcaatgcagtcaagggatattacaataatgg

SEQ ID NO: 260900 - DNA, 75 bp, Artificial Sequence
  Synthetic
acaggagataaagcagtcaacatatacacctcatcccagacagggtcaatcatagtcaagttactcccaaatatg

SEQ ID NO: 260901 - DNA, 75 bp, Artificial Sequence
  Synthetic
tatcctagttaacctgattatactatattagaaaaaaattaaatcccgaccctttgagactcgtattcggactca

SEQ ID NO: 260902 - DNA, 75 bp, Artificial Sequence
  Synthetic
tgcagttagcagagttgcgctagagaatgaaaaaagagaggcaaagaacacatggcgcttggttttccggatcgc

SEQ ID NO: 260903 - DNA, 75 bp, Artificial Sequence
  Synthetic
catggcgcttggttttccggatcgcagttttacttttaataatagtgaccttagttatctccgcagccgccttgg

SEQ ID NO: 260904 - DNA, 75 bp, Artificial Sequence
  Synthetic
gctcctcgctgctcagactcgccctaatggagctcacggagggggagagaaagggagcactttaaaagttgaggt

SEQ ID NO: 260905 - DNA, 75 bp, Artificial Sequence
  Synthetic
aaggagacagagacgctttataggtgccattatcggcagtgtagctcttggggttgcaacagctgcacagataac

SEQ ID NO: 260906 - DNA, 75 bp, Artificial Sequence
  Synthetic
ttacgtctttactcagttcgaatcaagatgtagtagatagaatatataagcaagtggcccttgaatctccgctag

SEQ ID NO: 260907 - DNA, 75 bp, Artificial Sequence
  Synthetic
ggttgtgcaaacgtgtcctctctaagtgatctacgcgcagtggctaaatctcaccccgtgttaattgcaggtcca

SEQ ID NO: 260908 - DNA, 75 bp, Artificial Sequence
  Synthetic
tcgcagaaatatccaataccctattcggggaatttaggatcgttcccttactagttgagatcctcaaggatgata

SEQ ID NO: 260909 - DNA, 75 bp, Artificial Sequence
  Synthetic
atcaggaagatcaagcgcctcgcattgaatggataagaagcatggcaaagccaagtaagatgggagtaagcccca

SEQ ID NO: 260910 - DNA, 75 bp, Artificial Sequence
  Synthetic
tgacccagattatatcggggggataggtaaagaactcatagtagacgacaccagtgatgtcacatcattctatcc

SEQ ID NO: 260911 - DNA, 75 bp, Artificial Sequence
  Synthetic
ggaactggtaaataccaattcgccagagacttcatgagtacatcattctggagactcggggtggagtatgctcag

SEQ ID NO: 260912 - DNA, 75 bp, Artificial Sequence
  Synthetic
taggtgtagggaacaaccaactcagctcattaattggtagcggcttgatcaccggcaaccctattctgtacgact

SEQ ID NO: 260913 - DNA, 75 bp, Artificial Sequence
  Synthetic
cctgacacagagagaatgataaaactcgggcgagcagtgcaccagactctcaaccacaattccaagataaccgga

SEQ ID NO: 260914 - DNA, 75 bp, Artificial Sequence
  Synthetic
agaaaaaacacgggtagaaggtatgggatctcgacctgcacccatggcaggcagaatggatcccaagccttctac

SEQ ID NO: 260915 - DNA, 75 bp, Artificial Sequence
  Synthetic
agcgccagattctgcacagagcaccattcacccggagcctctcccaactcatgggccatctcaggacaacgacac

SEQ ID NO: 260916 - DNA, 75 bp, Artificial Sequence
  Synthetic
ggaatagtagtcacaggagacaaagcagttaatatatacacatcgtcgcagacagggacaattatcatcaaacta

SEQ ID NO: 260917 - DNA, 75 bp, Artificial Sequence
  Synthetic
tgcatgtattcaaagactgaaggcgcacttactacgccatatatggctctcaaaggctcagttatcgccaattgc

SEQ ID NO: 260918 - DNA, 75 bp, Artificial Sequence
  Synthetic
ttcagcctgccttcacagaaccatctcaaaccatccgctggaaccctccccaaactccacaactcaccggcccac

SEQ ID NO: 260919 - DNA, 75 bp, Artificial Sequence
  Synthetic
tcattacttatatcgttttaactgtcatttctcttgttttcggtgcacttagtctgattttagcatgttacttga

SEQ ID NO: 260920 - DNA, 75 bp, Artificial Sequence
  Synthetic
tttagaagaactggctagtattgaggtttctgactcaaccaacaaattccgaaagatcgaaaaaaagatccaaat

SEQ ID NO: 260921 - DNA, 75 bp, Artificial Sequence
  Synthetic
caaaagaatatctcaatactagattctcaagttatagtgacaggcaatctcgatatatcaactgagcttgggaat

SEQ ID NO: 260922 - DNA, 75 bp, Artificial Sequence
  Synthetic
aatgaggagagagaagcaaagaatacatggcgtctggttttccggatcgcagtcttacttctaatggtaatgatc

SEQ ID NO: 260923 - DNA, 75 bp, Artificial Sequence
  Synthetic
atatttgagaccagtggaactgtcattgacagtataattacggcccagggcagatcagcagagactgtcgggaag

SEQ ID NO: 260924 - DNA, 75 bp, Artificial Sequence
  Synthetic
catggcgtctggttttccggatcgcagtcttacttctaatggtaatgatcttagccatctctgcagccgccctgg

SEQ ID NO: 260925 - DNA, 75 bp, Artificial Sequence
  Synthetic
agcgcaatcccgcaaggcaagacaaaggccctgagcatagcacgggagaagcacgggagcatccagccatccgcc

SEQ ID NO: 260926 - DNA, 75 bp, Artificial Sequence
  Synthetic
ttgcttgagtctcgtagtgcagcaagagcagtcaggagccagatgtgtgcaccaaagatggtagacttcgatatg

SEQ ID NO: 260927 - DNA, 75 bp, Artificial Sequence
  Synthetic
ttacatctttactcagttcaagtcaagatgtgatagataggatatataagcaggtggctctcgaatctccgctgg

SEQ ID NO: 260928 - DNA, 75 bp, Artificial Sequence
  Synthetic
gttaatgtgaggctcaccagtacatctgccctaatcacatatattgtcttgacgacaatagcactgatatgcggg

SEQ ID NO: 260929 - DNA, 75 bp, Artificial Sequence
  Synthetic
agtcgtgtaacccgggtgagttcaagcagcaccaaggcagcatacacgacatcgacatgttttaaagttgtcaag

SEQ ID NO: 260930 - DNA, 75 bp, Artificial Sequence
  Synthetic
ggagcaagcaactctcttttgtcaatgcttgacaagctgagcaacaaatcgtctaatgctaaaaaggggccaagg

SEQ ID NO: 260931 - DNA, 75 bp, Artificial Sequence
  Synthetic
atcgacatgttttaaagttgtcaagaccaataaagtttattgtcttagcattgcagaaatatctaataccctatt

SEQ ID NO: 260932 - DNA, 75 bp, Artificial Sequence
  Synthetic
cgggcttatgtccactgtagataagaagggaaagaaagtgacatttgacaagatagaggaaaagataaggagact

SEQ ID NO: 260933 - DNA, 75 bp, Artificial Sequence
  Synthetic
gaattaagaaaaagctactggatgtaagtgacaaaaaagcaatacacgggtagaacggtcggagaagccacccct

SEQ ID NO: 260934 - DNA, 75 bp, Artificial Sequence
  Synthetic
ttgcagaaatatctaataccctatttggggaattcaggatcgttcctttactagttgagattcttaaggatgata

SEQ ID NO: 260935 - DNA, 75 bp, Artificial Sequence
  Synthetic
actatgctaatctttttttgcatatcgggcttatgtccactgtagataagaagggaaagaaagtgacatttgaca

SEQ ID NO: 260936 - DNA, 75 bp, Artificial Sequence
  Synthetic
tcttttaatagtaataaccttagccatctctgcagccgccctggtatatagcatggaggctagcacgtctggcga

SEQ ID NO: 260937 - DNA, 75 bp, Artificial Sequence
  Synthetic
atatcaatgcaagcccgaatcccatactgccgagcagatacaacctgacaatgttgatgtgatcaatctaaattt

SEQ ID NO: 260938 - DNA, 75 bp, Artificial Sequence
  Synthetic
gttgatagccatcacagctcacgacaggctcctgcctcaccagtgtcacaaggaatctttctcgaaccctccctc

SEQ ID NO: 260939 - DNA, 75 bp, Artificial Sequence
  Synthetic
actcccccgagtgaccgcgtaactgcaatcaatctaacagcattagagattaagaaaaaatacgggtagaatcaa

SEQ ID NO: 260940 - DNA, 75 bp, Artificial Sequence
  Synthetic
ctcatccagaacaatcaggctgtactttgattctgccctaccttccagcagcctgttagcattcccgatcgtcct

SEQ ID NO: 260941 - DNA, 75 bp, Artificial Sequence
  Synthetic
gcctgttagcattcccgatcgtcctacaaggcacgggagatgggaagaagcgaatcaccccacaatacaggatcc

SEQ ID NO: 260942 - DNA, 75 bp, Artificial Sequence
  Synthetic
cttcttattactcccctgctatactttatcccttgaccattgcaaataagactgcgactctccaggccccttata

SEQ ID NO: 260943 - DNA, 75 bp, Artificial Sequence
  Synthetic
gatactgagctgcatctgcctgacgagctctcttgatggcaggcctcttgcagctgcggggattgtggtaacagg

SEQ ID NO: 260944 - DNA, 75 bp, Artificial Sequence
  Synthetic
tacaagcgctataatgacacatgccctgatgagcaagattaccaaatccggatggctaaatcttcatacaaaccc

SEQ ID NO: 260945 - DNA, 75 bp, Artificial Sequence
  Synthetic
tcatctcagacagggtcaatcatagtcaagttactcccgaatatgcccaaggacaaagaggcatgtgcaaaagcc

SEQ ID NO: 260946 - DNA, 75 bp, Artificial Sequence
  Synthetic
ctcaccatggtgataacttgcaagaagagtgcaactaatactgagagaatagtcttctcagtagtgcaggcacct

SEQ ID NO: 260947 - DNA, 75 bp, Artificial Sequence
  Synthetic
gctcctcgctgctcagacccgccctaatggagctcacggagggggagagaaagggagcactttaaaagttgaggt

SEQ ID NO: 260948 - DNA, 75 bp, Artificial Sequence
  Synthetic
ccaagtttgcatggctccatataaaacaggtccaaaggcatctgattgtagcagcaagaacaaggtccgcagtca

SEQ ID NO: 260949 - DNA, 75 bp, Artificial Sequence
  Synthetic
agagactgaggaagaggattatagttcagttacccccacatctatggtgcatggaaggttagggtttgacggtca

SEQ ID NO: 260950 - DNA, 75 bp, Artificial Sequence
  Synthetic
tctctagcagcgggacggcctgctatcctatagcaaatgcctctcctcaggttgctaagatactctggagtcaaa

SEQ ID NO: 260951 - DNA, 75 bp, Artificial Sequence
  Synthetic
aacaagattaccagattcggatggctaagtcttcgtataagcctgggcggtttggtggaaaacgcgtacagcaag

SEQ ID NO: 260952 - DNA, 75 bp, Artificial Sequence
  Synthetic
gaggacaatgaggcagaagagaaagcattggctgaattcttactcaatcaagaagtgattcacccacgtgtcgca

SEQ ID NO: 260953 - DNA, 75 bp, Artificial Sequence
  Synthetic
ggattacttgttgactaaattaggtatagggaacagtcatctcagctcattaataggtagtggcttgatcacagg

SEQ ID NO: 260954 - DNA, 75 bp, Artificial Sequence
  Synthetic
cgaattactctggtactgagctgcatctgcctgacgagctctcttgacggcaggccacttgcagctgcggggatt

SEQ ID NO: 260955 - DNA, 75 bp, Artificial Sequence
  Synthetic
ggtttgcctcagcacttgtcccgaaggtagtgacacaagtcggctctgtgatagaagaactcgacacctcatact

SEQ ID NO: 260956 - DNA, 75 bp, Artificial Sequence
  Synthetic
tccagcccgccctcacagaaccatcccaaaccatccgctggaaccctccccaaactccacaactcaccgacccat

SEQ ID NO: 260957 - DNA, 75 bp, Artificial Sequence
  Synthetic
aaaacatattgcctcagcattgcagaaatatccaataccctcttcggggaattcaggatcgttcctttactagtt

SEQ ID NO: 260958 - DNA, 75 bp, Artificial Sequence
  Synthetic
ctggatttatactgtacaaggatagtgacattccccatgtctccaggtatttattcttgtctgagcggcaataca

SEQ ID NO: 260959 - DNA, 75 bp, Artificial Sequence
  Synthetic
agcggaatcagtaactcacgctattgccactgtattctctggtctagaacagaatcaagcagctgagatgttgtg

SEQ ID NO: 260960 - DNA, 75 bp, Artificial Sequence
  Synthetic
attcaggatcgttcctttactagttgagattctcaaggaagatggggtttaagaagccaggtccggccagttgag

SEQ ID NO: 260961 - DNA, 75 bp, Artificial Sequence
  Synthetic
gcgcgagcccgaatcctacgctgccagtcagccataattagctagtgctaatatgattagtcttaatcttgtcga

SEQ ID NO: 260962 - DNA, 75 bp, Artificial Sequence
  Synthetic
tcctagccctatatcagagagggattttgcgagacttgacttagctatcttcaagagttatgagcttaatttgga

SEQ ID NO: 260963 - DNA, 75 bp, Artificial Sequence
  Synthetic
aaggcacaacaaaagactttactatggcttgggaacaataccctcgatcagatgagagccactacaagaacatga

SEQ ID NO: 260964 - DNA, 75 bp, Artificial Sequence
  Synthetic
gaatcccgaccctttaagactcgtattcggattcaaataattatcttaaaacagaagtgcgcatagttgttcttg

SEQ ID NO: 260965 - DNA, 75 bp, Artificial Sequence
  Synthetic
ttaactggagatatcagacagttaagctattcgcccatgctatcaatcagctgatgggcctacctcacttcttcg

SEQ ID NO: 260966 - DNA, 75 bp, Artificial Sequence
  Synthetic
ctaacactcaagtacggaatcaataccaagacatcagcccttgcactcagcagcctcacaggtgatatccaaaaa

SEQ ID NO: 260967 - DNA, 75 bp, Artificial Sequence
  Synthetic
atcttccaatcgggaactaggcttcacaacatccgttccaccacaccaccaatatcagatttcagccatggacca

SEQ ID NO: 260968 - DNA, 75 bp, Artificial Sequence
  Synthetic
ccggaggggatcaggacaacgacaccgactggggatactagtcaaagccttgctcagcaatgacccagatcttcc

SEQ ID NO: 260969 - DNA, 75 bp, Artificial Sequence
  Synthetic
aatgaagaaagagaagcgaagagcacatggcgcttggttttccggatcgcagttttacttttaatagtggtgacc

SEQ ID NO: 260970 - DNA, 75 bp, Artificial Sequence
  Synthetic
tgcagtcagcaaagttgcgttagaaaatgaagaaagagaagcgaagagcacatggcgcttggttttccggatcgc

SEQ ID NO: 260971 - DNA, 75 bp, Artificial Sequence
  Synthetic
agaagcaaagaatacttggcgcttagtattccggatcgcagttttgcttttgatagtggtgaccttagctatctc

SEQ ID NO: 260972 - DNA, 75 bp, Artificial Sequence
  Synthetic
cactactaaatactgaatctataatcatgaatgcaataacgtctctctctcatcaaattaacggggctgcaaaca

SEQ ID NO: 260973 - DNA, 75 bp, Artificial Sequence
  Synthetic
gatttctgttattatttaaattacctaatgagttgtgtgcagacatattttgattctgagttttctattactcac

SEQ ID NO: 260974 - DNA, 75 bp, Artificial Sequence
  Synthetic
tgattctgagttttctattactcacagctcgcaaccagattccaaccagtcttggattgaggacatctctttcgt

SEQ ID NO: 260975 - DNA, 75 bp, Artificial Sequence
  Synthetic
cggtcaataccatgagaaggacttagacaccacagtcttatttaaggattgggtggcaaattacccgggagtggg

SEQ ID NO: 260976 - DNA, 75 bp, Artificial Sequence
  Synthetic
tctattacaatacacttttctcgaatgagatgaaccctccacagcgacatttcggacctacaccaacacagtttc

SEQ ID NO: 260977 - DNA, 75 bp, Artificial Sequence
  Synthetic
gatcaacgacaatcccagacatgagttactttcctctgcaatgctctgcctaggaagtgtcccaaatgacggaga

SEQ ID NO: 260978 - DNA, 75 bp, Artificial Sequence
  Synthetic
tgtgcaatgatccttactctttcaattttgagactgttgcaagcccaaatattgtccttaagaaacatacacaga

SEQ ID NO: 260979 - DNA, 75 bp, Artificial Sequence
  Synthetic
acctgaacacctcatagtcaaatcttcaatactattgattatgcatacacagtaattaagaaaaaatacgggtag

SEQ ID NO: 260980 - DNA, 75 bp, Artificial Sequence
  Synthetic
aaagctgctctaagggcatcatccgtgttgatctgggcttatggggataatgaagtaaattggactgctgctctt

SEQ ID NO: 260981 - DNA, 75 bp, Artificial Sequence
  Synthetic
gttgagtcgaatgcaggatggctgggaagatgatactgtatcacctatctctcgcaacaccaaggatcaaactgg

SEQ ID NO: 260982 - DNA, 75 bp, Artificial Sequence
  Synthetic
atatcaatgcaagcctgaatcccataccatcagacaggcaaaacctgacaatgctgatgtgatcagtctgaattt

SEQ ID NO: 260983 - DNA, 75 bp, Artificial Sequence
  Synthetic
acagaagctggtcacctttgacagggggtaggaaaatactgggtgtatctaaccccgataccatagaacttgtgg

SEQ ID NO: 260984 - DNA, 75 bp, Artificial Sequence
  Synthetic
ccctcgggcgtgcagcaatggtactccgtttgtcacggctggggttgaagatgatgcaccagaagatatcactga

SEQ ID NO: 260985 - DNA, 75 bp, Artificial Sequence
  Synthetic
caggctcaggtatgggtcacagtagcaaaggctatgactgcatatgagacagcagatgagtcagaaacaagaaga

SEQ ID NO: 260986 - DNA, 75 bp, Artificial Sequence
  Synthetic
tgaaggttaatgggcggattttcgctaagttgacaaagaaattaaggaactgccaggtaatggcagaagggattc

SEQ ID NO: 260987 - DNA, 75 bp, Artificial Sequence
  Synthetic
acatggctgctgagctaaaactaaccccggcagcaaggagaggcctggcagctgctgcccaacgagtatccgaag

SEQ ID NO: 260988 - DNA, 75 bp, Artificial Sequence
  Synthetic
tcagaggaattcagcagcatccgtacagatccagcattctggtttcactcaaaatggtccagagccaagtttgca

SEQ ID NO: 260989 - DNA, 75 bp, Artificial Sequence
  Synthetic
agggcaaccagatgctggggatggggagacccaattcttggattttatgagagcagtggcgaacagcatgcggga

SEQ ID NO: 260990 - DNA, 75 bp, Artificial Sequence
  Synthetic
tcctccggcttaaggagagcattgctgcaaccaatgaagctgtgcatgaggtcaccgacggattgtcacaactag

SEQ ID NO: 260991 - DNA, 75 bp, Artificial Sequence
  Synthetic
gacattggtgctcgagtgagggatccttttactcaacaacctgcatcatttatacaagagttagatctgagtgct

SEQ ID NO: 260992 - DNA, 75 bp, Artificial Sequence
  Synthetic
gctgctgcccaacgagtatctgaggaaataggcagtgtggatgttcctactcaacaggccggggtcctcattggg

SEQ ID NO: 260993 - DNA, 75 bp, Artificial Sequence
  Synthetic
tatataagaacatgccagggatcctactctccaatattgcgactacgatatcccaccccatcattcactcaaggt

SEQ ID NO: 260994 - DNA, 75 bp, Artificial Sequence
  Synthetic
ccctttattatcaggagtacacacagaggacaatgaggcagaagagaaggcactggctgaattcctactcaatca

SEQ ID NO: 260995 - DNA, 75 bp, Artificial Sequence
  Synthetic
gagcagttgcgaatagcatgcgggaagcgccaaattctgcacagagcatcactcagccagagcctccctcaactc

SEQ ID NO: 260996 - DNA, 75 bp, Artificial Sequence
  Synthetic
cccgacctctcgcctgaacttccctcaaactccccgactccctgcctcgcatggccaaaccagcaagagtgccct

SEQ ID NO: 260997 - DNA, 75 bp, Artificial Sequence
  Synthetic
caaactccccgactccctgcctcgcatggccaaaccagcaagagtgccctgctatcctctccccaactcccagcc

SEQ ID NO: 260998 - DNA, 75 bp, Artificial Sequence
  Synthetic
agcaagccatcttatccatcaaagtgtcaacatctttgggtgaggacccggtgctgactgttccacctaatacaa

SEQ ID NO: 260999 - DNA, 75 bp, Artificial Sequence
  Synthetic
gaaaaaaatacgggtagaagagagacatatagagatcaagacgaatcaccaaggtctccgctctcccttctacct

SEQ ID NO: 261000 - DNA, 75 bp, Artificial Sequence
  Synthetic
catatagagatcaagacgaatcaccaaggtctccgctctcccttctacctagtagcccaaggtcaagatggccac

SEQ ID NO: 261001 - DNA, 75 bp, Artificial Sequence
  Synthetic
cgtttacccgacagcctgcatcattcatacaagagctagatctgagtgcccctgcaaggtacgatgcttttacac

SEQ ID NO: 261002 - DNA, 75 bp, Artificial Sequence
  Synthetic
taaaccagcagagactgtcggaaggagcgcaatcccacaaggcaaaaccaaaactccaagcacagcgtgggagaa

SEQ ID NO: 261003 - DNA, 75 bp, Artificial Sequence
  Synthetic
gcacgggaacgtccagccatccgccggccaagacacccccgaccaacaggacagaccagacaaacagccatctcc

SEQ ID NO: 261004 - DNA, 75 bp, Artificial Sequence
  Synthetic
caaagagaaggaggtgaaggttaatgggcggatttttgctaagttgacaaagagattaaggaactgccaggtaat

SEQ ID NO: 261005 - DNA, 75 bp, Artificial Sequence
  Synthetic
gcttaagtccgaacaagtgagctctattatgtctcccaacataattacgttcccagccaatctatattacatgtc

SEQ ID NO: 261006 - DNA, 75 bp, Artificial Sequence
  Synthetic
ggagcaagcaactctcttttgtccatgctcgacaagctgagcaataaatcgtctaatgctaaaaagggggtacgg

SEQ ID NO: 261007 - DNA, 75 bp, Artificial Sequence
  Synthetic
tttacatggaggctgagggtgaccttgctgacacagtgttcttatttactccttacaatctctctacagacggta

SEQ ID NO: 261008 - DNA, 75 bp, Artificial Sequence
  Synthetic
gggtcattcaagatagcatatccttgactaagagtatgttagcgatgagtcaactgtcttttaacagcaataaga

SEQ ID NO: 261009 - DNA, 75 bp, Artificial Sequence
  Synthetic
ccttacaatctctctacagacggtaagaagagaacatcactcaaacagtgcacaaggcagatcctagaggtcaca

SEQ ID NO: 261010 - DNA, 75 bp, Artificial Sequence
  Synthetic
tgacattgaaattcctccagggtccaatcaaagcctgttagatcaactggctactaatttatctttgattgccat

SEQ ID NO: 261011 - DNA, 75 bp, Artificial Sequence
  Synthetic
ttgtaggagaccctttcaatcctccaagtgacccgaccgactgtgatctatcaagagtcccaaatgatgatatat

SEQ ID NO: 261012 - DNA, 75 bp, Artificial Sequence
  Synthetic
gtgatcatcaaagtactgtatgcaatggggtactactttcatctactcatgaacttattcactccgtgttcaaca

SEQ ID NO: 261013 - DNA, 75 bp, Artificial Sequence
  Synthetic
aaaattaaattctgatcctttgaggctcgtactcggattcaagtaattatcttgaagcagaagtgaaagtagttg

SEQ ID NO: 261014 - DNA, 75 bp, Artificial Sequence
  Synthetic
ctcgtactcggattcaagtaattatcttgaagcagaagtgaaagtagttgtccttaattatagttctgtcattca

SEQ ID NO: 261015 - DNA, 75 bp, Artificial Sequence
  Synthetic
tgatttgatagtaccgtattagaaaaaagttaaattctgatcctttgaagctcgtattcggattcaagcaattat

SEQ ID NO: 261016 - DNA, 75 bp, Artificial Sequence
  Synthetic
agagtgcaactaacactgagagaatagtcttctcagtagtgcaggcacctcgggtgctgcaaagctgtatggttg

SEQ ID NO: 261017 - DNA, 75 bp, Artificial Sequence
  Synthetic
tatgctcccattctcaagtgatgagaaaccatgttgcccttgcagggaaacagaatgaggccacactggctgttc

SEQ ID NO: 261018 - DNA, 75 bp, Artificial Sequence
  Synthetic
attgacacagttattcgatctgtgatctacatggaggctgagggtgaccttgctgacacagtgttcttatttacc

SEQ ID NO: 261019 - DNA, 75 bp, Artificial Sequence
  Synthetic
gttgatcgtcatcacaacttacaacaggcccctgcctcattagagtcacaaagggtccttcctgagcccccctcc

SEQ ID NO: 261020 - DNA, 75 bp, Artificial Sequence
  Synthetic
caatcaacccaacagaatcagagattaagaaaaaatacgggtagaatcaaagtgccccgactatgccagaatgga

SEQ ID NO: 261021 - DNA, 75 bp, Artificial Sequence
  Synthetic
gatattacagtaataatgactcttaaaggcaatcacacgccgacaaactatcttcttagctgattgttttccaac

SEQ ID NO: 261022 - DNA, 75 bp, Artificial Sequence
  Synthetic
caagtgctgcagagctgtatggttgtagcaaataggtactcttcagtgaatgcggtgaagcatgtgaaagcaccc

SEQ ID NO: 261023 - DNA, 75 bp, Artificial Sequence
  Synthetic
tttgcagaggtcaagcgattagaagcagtggggttactgagtcctagcattatgactaatatcttaactaggcca

SEQ ID NO: 261024 - DNA, 75 bp, Artificial Sequence
  Synthetic
tactacgatgtttgtaggagaccctttcaatcctccaagtgacccgactgactgcgatttatccagagtccccaa

SEQ ID NO: 261025 - DNA, 75 bp, Artificial Sequence
  Synthetic
gagacccaattcctggacctgatgagagcagtggcaaacagcatgcgagaagcaccagattctgcacagagcacc

SEQ ID NO: 261026 - DNA, 75 bp, Artificial Sequence
  Synthetic
ataaggagactcaatctatctgttgggctcagtgatgtgcttggaccttctgtgcttgtgaaggcgagaggtgca

SEQ ID NO: 261027 - DNA, 75 bp, Artificial Sequence
  Synthetic
ccaaatcccccccccacccccagccacacggtcccgcccacccagagcaacacgggcacaacccaatccaccaac

SEQ ID NO: 261028 - DNA, 75 bp, Artificial Sequence
  Synthetic
gccgtcgcagtgactgctgattatgaggttacctctactaaaatagagaagaagcacaccattgctaaatacaat

SEQ ID NO: 261029 - DNA, 75 bp, Artificial Sequence
  Synthetic
tcactcttcccaatgacaacaaccaagacatatgatgagattacattacacctccacagtaaatttagctgctgt

SEQ ID NO: 261030 - DNA, 75 bp, Artificial Sequence
  Synthetic
aacacgggtagaagagtctggatcccggccggcacattcaaggcacaacatgggctccaaaccttccaccagaat

SEQ ID NO: 261031 - DNA, 75 bp, Artificial Sequence
  Synthetic
ggccctcaaaggctcagtcattgccaattgcaaaataacaacttgcaggtgtgcagaccccccaggtatcatatc

SEQ ID NO: 261032 - DNA, 75 bp, Artificial Sequence
  Synthetic
acagacctgcgccccaatacccctagcaacgaccctctctcacctctctcactcccccgagtgaccgcgtaactg

SEQ ID NO: 261033 - DNA, 75 bp, Artificial Sequence
  Synthetic
cgactgggggtactgatcgacaacattcagcctgccttcacagggtcatcccaaatcctccgccgaaacctcccc

SEQ ID NO: 261034 - DNA, 75 bp, Artificial Sequence
  Synthetic
tatccaggcactttataatttagctggtggcaacatggattacttgttgactaagttaggtgtagggaacaatca

SEQ ID NO: 261035 - DNA, 75 bp, Artificial Sequence
  Synthetic
ctaagttaggtgtagggaacaatcaactcagctcattaattggtagcggcttgatcaccggcaaccctatattgt

SEQ ID NO: 261036 - DNA, 75 bp, Artificial Sequence
  Synthetic
gcaatcccgcaaggcaagacaaaggccctgagcatagcatgggagaagcatgggagcatccagccgtccgctggc

SEQ ID NO: 261037 - DNA, 75 bp, Artificial Sequence
  Synthetic
gtctatgatggaggcattatcacagaaggtaagtaaagttgatcatcagctagacctagtcttgaaacagacatc

SEQ ID NO: 261038 - DNA, 75 bp, Artificial Sequence
  Synthetic
caggacacctccaaccaacaggacaaaccagacaagcagccatccacatctgagcaggcgactccacacaatgac

SEQ ID NO: 261039 - DNA, 75 bp, Artificial Sequence
  Synthetic
cgatcatggaagccaacttaggcatgatgaaaattctggaccctggttgtgctaacgtttcatccttaagtgatc

SEQ ID NO: 261040 - DNA, 75 bp, Artificial Sequence
  Synthetic
atgccttcactcggccgggtagtgtcccttgccaggcatcagcaagatgccccaactcatgcatcactggggtct

SEQ ID NO: 261041 - DNA, 75 bp, Artificial Sequence
  Synthetic
ggaaatgttaacaattcaataagtaatgccctggataggttagcagaaagtaacagaaaactaaacaaagtcaat

SEQ ID NO: 261042 - DNA, 75 bp, Artificial Sequence
  Synthetic
acgggtaggacatggcgggctccggtcccgaaagggcagagcaccagatcatcctaccagagtcacatctatctt

SEQ ID NO: 261043 - DNA, 75 bp, Artificial Sequence
  Synthetic
aattgaggccgggggacagcccgtccgtccattttgcgcagaaagtttagtaagcacaataacagatatgaccca

SEQ ID NO: 261044 - DNA, 75 bp, Artificial Sequence
  Synthetic
caaatcaccccacaatacaggatccagcgtcttgactcgtggacagacagtaaggaagactcggtattcatcacc

SEQ ID NO: 261045 - DNA, 75 bp, Artificial Sequence
  Synthetic
tgtgtcaattccgacaacctgttcaacagaagattttagaaaaaaataccagatataagcaactcaaaggcaatg

SEQ ID NO: 261046 - DNA, 75 bp, Artificial Sequence
  Synthetic
acaagacacaggagatgggaagaagcaaatcaccccacaatacaggatccagcgtcttgactcgtggacagacag

SEQ ID NO: 261047 - DNA, 75 bp, Artificial Sequence
  Synthetic
gagcctcctcagtactaatctgggcatacggagacaatgacaccaactgggccgctgcattaaaattagcacgat

SEQ ID NO: 261048 - DNA, 75 bp, Artificial Sequence
  Synthetic
aatgaagaaagagaagcaaagaacacatggcgcttggttttccggatcacagttttactttcaatagtaatgact

SEQ ID NO: 261049 - DNA, 75 bp, Artificial Sequence
  Synthetic
tgcagtgaagcatgtgaaggcaccagaaaagatccctgggagcggaaccctagagtataaagtgaattttgtctc

SEQ ID NO: 261050 - DNA, 75 bp, Artificial Sequence
  Synthetic
gtgatctctaagatggaagacaagattacgtctttactcagttccaatcaggatgtagtagataggatatataag

SEQ ID NO: 261051 - DNA, 75 bp, Artificial Sequence
  Synthetic
tgcagtcaagcacgtgaaagcgccagagaagatccccgggagtggaaccctagaatacaaggtgaactttgtctc

SEQ ID NO: 261052 - DNA, 75 bp, Artificial Sequence
  Synthetic
tttggatgacacccaaaaccggaagtcctgcagtgtgagtgctactcctctaggttgcgatatgctttgctctaa

SEQ ID NO: 261053 - DNA, 75 bp, Artificial Sequence
  Synthetic
aacacgggtagaagattctggatcccggccggcgcaccaaaagcgcaagatgggctccagatcttctaccaggat

SEQ ID NO: 261054 - DNA, 75 bp, Artificial Sequence
  Synthetic
gtgcaactaatactgagagaatagtcttctcagtagtgcaggcaccccgggtgctgcaaagctgtatggttgtgg

SEQ ID NO: 261055 - DNA, 75 bp, Artificial Sequence
  Synthetic
cggtcagtatcatgataaggacttacacgtcacagccttatttaaggattgggttgccaattatccaggagtggg

SEQ ID NO: 261056 - DNA, 75 bp, Artificial Sequence
  Synthetic
tataagcgctataataacacatgccccgatgaacaggattaccaagttcggatggctaagtcttcatataagcct

SEQ ID NO: 261057 - DNA, 75 bp, Artificial Sequence
  Synthetic
gctaagatactctggagtcaaactgcgcacctgcggagtgtaaaagtcatcattcaagctggcacccaacgtgct

SEQ ID NO: 261058 - DNA, 75 bp, Artificial Sequence
  Synthetic
cagcctcacgggtgatatccaaaaaatgaaacagctcatgcgtttatatcggatgaaaggagaaaatgcaccgta

SEQ ID NO: 261059 - DNA, 75 bp, Artificial Sequence
  Synthetic
aagcagtcaggagccagatgtgcgcacctaaaatggtagactttgatatgatcctccaagtattatccttcttta

SEQ ID NO: 261060 - DNA, 75 bp, Artificial Sequence
  Synthetic
ctcacaatgccaaggatcacactggacatcaatgcaagcccgaatcccatgcctccgggcagccacaacctgaca

SEQ ID NO: 261061 - DNA, 75 bp, Artificial Sequence
  Synthetic
cccagcccgccctcacagaatcaccccaaaccatccgccggaaccctccccaaaccccacaacccaccggcccac

SEQ ID NO: 261062 - DNA, 75 bp, Artificial Sequence
  Synthetic
caagaatctgaatgcagatgagaggcagaggtatccccaatagcaatctgtgtgtcaattctggcagcctgttaa

SEQ ID NO: 261063 - DNA, 75 bp, Artificial Sequence
  Synthetic
ttcaaccaacaaatttcggaagatcgaaaagaagatccaaattcacaacacgagatacggtgatctgttcacgag

SEQ ID NO: 261064 - DNA, 75 bp, Artificial Sequence
  Synthetic
cgctactaaacactgaatctataattatgaatgcaataacctctctttcttatcaaatcaacggggctgcgaata

SEQ ID NO: 261065 - DNA, 75 bp, Artificial Sequence
  Synthetic
caatcatggaggccaatttaggcatgatgaaaattctggaccctggttgtgccaacatttcgtccttaagcgatc

SEQ ID NO: 261066 - DNA, 75 bp, Artificial Sequence
  Synthetic
gtatggttcccagtttacggagggctcaaacccaattcacccagtgacactgcacaggaagggaaatatgtaata

SEQ ID NO: 261067 - DNA, 75 bp, Artificial Sequence
  Synthetic
gatattacagtaacaatgactcctaaaggcaatcatacgttaatgaactatcttcctaattgactgctccctcat

SEQ ID NO: 261068 - DNA, 75 bp, Artificial Sequence
  Synthetic
tccgctgcgatgctctgcctaggaagcgtcccaaataccggagaccttgttgagctggcaagggcctgtctcact

SEQ ID NO: 261069 - DNA, 75 bp, Artificial Sequence
  Synthetic
atgtgtccccaataataacttgtgtgttaattctgacaacctgttcaatggaagatttaagaaaaaactactgga

SEQ ID NO: 261070 - DNA, 75 bp, Artificial Sequence
  Synthetic
tggaatacctgacaacccttgattacctaagagatgacagtgtggcaatatcgtactcactcaaagagaaagaag

SEQ ID NO: 261071 - DNA, 75 bp, Artificial Sequence
  Synthetic
aatggagctcatggcggaggagagaaggggagcaccttaaaagtagaagtcccggtattcactctcaacagtgat

SEQ ID NO: 261072 - DNA, 75 bp, Artificial Sequence
  Synthetic
cggcaaactccattgatggcaggcctcttgcagctgcaggaattgtggttacaggagacaaagcagtcaacatat

SEQ ID NO: 261073 - DNA, 75 bp, Artificial Sequence
  Synthetic
acctatgatgctgactatccgggtcgcgctggtactgagttgcatctgtccggcaaactccattgatggcaggcc

SEQ ID NO: 261074 - DNA, 75 bp, Artificial Sequence
  Synthetic
aaagaactcatagtagacgacatcagtggtgtcacatcattctacccatctgcataccaagaacacctgaatttt

SEQ ID NO: 261075 - DNA, 75 bp, Artificial Sequence
  Synthetic
gaagatgctccagctgatctcccggttatgctgtctgtacacggtactttttgctacaacaagagaaatcccaaa

SEQ ID NO: 261076 - DNA, 75 bp, Artificial Sequence
  Synthetic
tctgtaacaccaagaatcaaatcgaataccagtgcgagctcgaatcctacgctgccagtcagccataatcggctg

SEQ ID NO: 261077 - DNA, 75 bp, Artificial Sequence
  Synthetic
ataccagtgcgagctcgaatcctacgctgccagtcagccataatcggctggtgctaatgtggttagcctgaatct

SEQ ID NO: 261078 - DNA, 75 bp, Artificial Sequence
  Synthetic
atacttagcacttggtgtgcttcggacatctgcgacagggagggtattcttttctactctgcgttccatcaattt

SEQ ID NO: 261079 - DNA, 75 bp, Artificial Sequence
  Synthetic
agatgacacccaaaatcggaagtcttgcagtgtgagtgcaactcctctaggttgtgatatactgtgctctaaagt

SEQ ID NO: 261080 - DNA, 75 bp, Artificial Sequence
  Synthetic
tgaataagttagaggaaagcaacagaaaactagacaaagtcaatgtcaaactgaccagcacatctgctctcatta

SEQ ID NO: 261081 - DNA, 75 bp, Artificial Sequence
  Synthetic
aagggagtaccttaaaagtagacgtcccagtattcactcttaacagtgatgacccagaagataggtggaactttg

SEQ ID NO: 261082 - DNA, 75 bp, Artificial Sequence
  Synthetic
agcaaaaggcgcaacaaaagaccttattatggcttgggaataataccctagatcagatgagagccactacaaaaa

SEQ ID NO: 261083 - DNA, 75 bp, Artificial Sequence
  Synthetic
aggcaaggtgctctcatatctcttttatgctcccactcacaagtgatgaggaaccatgttgcccttgcagggaaa

SEQ ID NO: 261084 - DNA, 75 bp, Artificial Sequence
  Synthetic
ggagtgtctgaagagagagcacagagattcgcgatgatagcagggtctctccctcgggcatgcagtaatggcacc

SEQ ID NO: 261085 - DNA, 75 bp, Artificial Sequence
  Synthetic
taccctggagaggatcctctctatccaggcgcaagtatgtgtcacagtagcaaaagccatgactgcgtatgagac

SEQ ID NO: 261086 - DNA, 75 bp, Artificial Sequence
  Synthetic
ttgtaccaacgagggtcttcgtatttctcccctgccttattatatcctatgacagtctataacaaaacagctact

SEQ ID NO: 261087 - DNA, 75 bp, Artificial Sequence
  Synthetic
ccccgtatgcaggagcacaatccaactcacgatcagacagtctcttgcagtccgcatctttttggttagcgagct

SEQ ID NO: 261088 - DNA, 75 bp, Artificial Sequence
  Synthetic
gacaacaactaagacatatgatgagatcacattacacctccacagtaaatttagctgctgtatcagggaagcacc

SEQ ID NO: 261089 - DNA, 75 bp, Artificial Sequence
  Synthetic
ccaagacatcagcccttgcacttagtagcctctcaggcgacatccagaagatgaagcagctcatgcgtttgtatc

SEQ ID NO: 261090 - DNA, 75 bp, Artificial Sequence
  Synthetic
aaggtcaagcgtcttgcgctgaatggttgatagccatcacagcccacgacaggctcctgcctcaccagtgccaca

SEQ ID NO: 261091 - DNA, 75 bp, Artificial Sequence
  Synthetic
gcaccaaggcagcatacacgacatcaacatgctttaaagttgtcaagaccaataaagtttattgccttagcattg

SEQ ID NO: 261092 - DNA, 75 bp, Artificial Sequence
  Synthetic
tttaagaagctagatctggctggttgagtcgaatggaggatggttggggggatgatgctgcatcacctatctctc

SEQ ID NO: 261093 - DNA, 75 bp, Artificial Sequence
  Synthetic
gtaacataagctcagagtatcttcggctattgtcgcccctgcccacagctgggaatctccaacatagattggatg

SEQ ID NO: 261094 - DNA, 75 bp, Artificial Sequence
  Synthetic
ttactttcctctgcaatgctctgcctaggaagtgtcccgaatgacggagatcttgttgaactggcgagggcctgc

SEQ ID NO: 261095 - DNA, 75 bp, Artificial Sequence
  Synthetic
ggcgccaaactctgcacagggcactccccaatcggggcctcccccaactcctgggccatcccaagataacgacac

SEQ ID NO: 261096 - DNA, 75 bp, Artificial Sequence
  Synthetic
ttagctgctgtatcagggaagcgcctgttgccgtacccttcgagctactcgggttagcaccagaactaagggcag

SEQ ID NO: 261097 - DNA, 75 bp, Artificial Sequence
  Synthetic
tgaaaatctctggctccagcctgtacaacctcgcgctcaatgtcactattgacgtggaggtagacccgaagagcc

SEQ ID NO: 261098 - DNA, 75 bp, Artificial Sequence
  Synthetic
aacagagccgagggaattagaaaaaagtacgggtagaagagggatattcagagatcagggcaagtctcccgagtc

SEQ ID NO: 261099 - DNA, 75 bp, Artificial Sequence
  Synthetic
catccgtacagatccagcattctggtttcactcaaaatggtccagagccaagtttgcatggctccatataaaaca

SEQ ID NO: 261100 - DNA, 75 bp, Artificial Sequence
  Synthetic
gagcatccagccaccggccagtcaagacaaccccgatcgacaggacagatctgacaaacaaccatccacacccga

SEQ ID NO: 261101 - DNA, 75 bp, Artificial Sequence
  Synthetic
agggtgcacaaaatgtgacagcggagatgaacagtttacttggttccatcttccaagcaatatagagctgactga

SEQ ID NO: 261102 - DNA, 75 bp, Artificial Sequence
  Synthetic
cgacacacagctcaggaccggagcaagcaactctctgctgttgatgcttgacaagctcagcaataaatcgtccaa

SEQ ID NO: 261103 - DNA, 75 bp, Artificial Sequence
  Synthetic
atgctgatgtgatcagtctgaattttgtctgcagtcactttattaagaaaaaatatggatggtagtgaaatacaa

SEQ ID NO: 261104 - DNA, 75 bp, Artificial Sequence
  Synthetic
gtcaccgacggattatcgcaactagcagtagcagttgggaagatgcaacagtttgtcaatgaccaatttaataat

SEQ ID NO: 261105 - DNA, 75 bp, Artificial Sequence
  Synthetic
cagctgaaaacatctgttgcagtcatggaagccaacttgggaatgatgaagattctggatcccggttgtgccaac

SEQ ID NO: 261106 - DNA, 75 bp, Artificial Sequence
  Synthetic
ccagcaaggtatgacgcgtttacccataatgaggtttgcttcgagcacacattaccgagcccagaagaagattac

SEQ ID NO: 261107 - DNA, 75 bp, Artificial Sequence
  Synthetic
gattctggatcccggttgtgccaacatttcatctctgagtgatctacgggcagttgcccgatctcacccggtttt

SEQ ID NO: 261108 - DNA, 75 bp, Artificial Sequence
  Synthetic
ctcagcagagatttcacatgatgtcatgttgagagagtacaagagtttatccgcccttgaatttgagccatgtat

SEQ ID NO: 261109 - DNA, 75 bp, Artificial Sequence
  Synthetic
cagttgcccgatctcacccggttttagtttcaggccctggagacccctctccctatgtgacacaaggaggcgaaa

SEQ ID NO: 261110 - DNA, 75 bp, Artificial Sequence
  Synthetic
atataggagtggagagggacactgtccgtgcattgatcatgtcacgcccaatgcacccgagttcttcagccaagc

SEQ ID NO: 261111 - DNA, 75 bp, Artificial Sequence
  Synthetic
gataaaaggcgaaggagcaatcgaagtcgtacgggtagaaggtgtgaatctcgagtgcgagcccgaagctcaaac

SEQ ID NO: 261112 - DNA, 75 bp, Artificial Sequence
  Synthetic
atcctctctcgcttcctcagccccactgaatgatcgcgcaaccgcaattaatctagctacattaaggattaagaa

SEQ ID NO: 261113 - DNA, 75 bp, Artificial Sequence
  Synthetic
atctagctacattaaggattaagaaaaaatacgggtagaattggagtgccccaattgtgccaagatggactcatc

SEQ ID NO: 261114 - DNA, 75 bp, Artificial Sequence
  Synthetic
tctctagcggtgagaagctgcgctatcctatgacaaatgccccaccgctggatgccaagatactctggagtcaga

SEQ ID NO: 261115 - DNA, 75 bp, Artificial Sequence
  Synthetic
aggggagtaccttaaaagtagaagtcccggtattcactctcaacagtgacgacccagaagatagatggaactttg

SEQ ID NO: 261116 - DNA, 75 bp, Artificial Sequence
  Synthetic
gaaccatgttgcccttgcagggaaacagaatgaggccacactggctgttcttgagatcgatggttttaccaacgg

SEQ ID NO: 261117 - DNA, 75 bp, Artificial Sequence
  Synthetic
tcgtgtaatagacatcctatccagccctttaccgagactaatgaagtacttgaggagaaatattgatgctgcgct

SEQ ID NO: 261118 - DNA, 75 bp, Artificial Sequence
  Synthetic
aaactggcaatgcggatattcctactcaacaggctggggtccttactgggctcagcgacaaaagtccccgagctc

SEQ ID NO: 261119 - DNA, 75 bp, Artificial Sequence
  Synthetic
tgagctggcaagggcctgtctcactatgatagtcacatgcaagaagagtgcaactaatactgagagaatggtttt

SEQ ID NO: 261120 - DNA, 75 bp, Artificial Sequence
  Synthetic
ccagatcatcgctagtcacattgacacagtcatccggtctgtgatatatatggaagctgagggtgatctcgctga

SEQ ID NO: 261121 - DNA, 75 bp, Artificial Sequence
  Synthetic
taagagaggccgtaacacggcaggtgggacttccacctattacaacttggtaggggatgtagactcatatattag

SEQ ID NO: 261122 - DNA, 75 bp, Artificial Sequence
  Synthetic
tgcgctcaatgtcactattaatgtggaggtagacccgaggagtcctttggttaaatctctgtctaagtctgacag

SEQ ID NO: 261123 - DNA, 75 bp, Artificial Sequence
  Synthetic
cttagtactcaggggtatggtttctctggaggatctcatcccactaaggacatatctgaagcacagtacctgccc

SEQ ID NO: 261124 - DNA, 75 bp, Artificial Sequence
  Synthetic
taggggatgtagactcatatattaggaacaccgggcttactgcgttcttcctgacacttaagtatggaattaaca

SEQ ID NO: 261125 - DNA, 75 bp, Artificial Sequence
  Synthetic
catattggacttatgaccaccgtagataggaaggggaagaaagtgacatttgacaagctggaaaagaaaataagg

SEQ ID NO: 261126 - DNA, 75 bp, Artificial Sequence
  Synthetic
gggtggcaaattacccgggagttgggagcggatcttttattgatgaccgtgtatggttcccagtttacggagggt

SEQ ID NO: 261127 - DNA, 75 bp, Artificial Sequence
  Synthetic
ctagtacgatacttgttcagaggaatcgggactgcttcatcttcttgtctaaagacatctcatctgctgtccggg

SEQ ID NO: 261128 - DNA, 75 bp, Artificial Sequence
  Synthetic
gatattacagtaacaatgacccataagggcaaccgcacatcaacgaattatctttctaatcaatcgcttcctcac

SEQ ID NO: 261129 - DNA, 75 bp, Artificial Sequence
  Synthetic
atcatgacacaaaaaactaatctgtcttgattatttacagttagtttacctgtctatcaagttagaaaaaacacg

SEQ ID NO: 261130 - DNA, 75 bp, Artificial Sequence
  Synthetic
ctcgtattcggattcaaataattatctcagaaaaaaagtgcacgtagttgttcttgattatagtcatgtcattca

SEQ ID NO: 261131 - DNA, 75 bp, Artificial Sequence
  Synthetic
ccgaccctcccccctgcccccagtcgcatgatcccgcctgtccgaagcaacacatgcacaacccgatctgccagc

SEQ ID NO: 261132 - DNA, 75 bp, Artificial Sequence
  Synthetic
accaataaagtttattgtcttagcattgcagaaatatccaacaccctatttggggaattcagaatcgttccttta

SEQ ID NO: 261133 - DNA, 75 bp, Artificial Sequence
  Synthetic
cccagcttgcttttatgaaatcatcccaactcccccgtttgcaccccaccacccagtccgcagtcccgcacggcc

SEQ ID NO: 261134 - DNA, 75 bp, Artificial Sequence
  Synthetic
tcttgcagctgcaggaattgtggttacaggagacaaagccgtcaacatatacacctcatcccagacaggatcaat

SEQ ID NO: 261135 - DNA, 75 bp, Artificial Sequence
  Synthetic
cacaatgcgacccactaacaatcaatgtagagccaaagaaattagaaaaaagtacgggtagaagggaggcattca

SEQ ID NO: 261136 - DNA, 75 bp, Artificial Sequence
  Synthetic
aacctcctgcccaacaacacgggaacccgccaaaccatggaagcaaccaggaaagaccgcagcaccaggccaagg

SEQ ID NO: 261137 - DNA, 75 bp, Artificial Sequence
  Synthetic
gagaccagggcgagtcacccgggtctctgttctcccttctgcctagtggattagggtgaagatggccaccttcac

SEQ ID NO: 261138 - DNA, 75 bp, Artificial Sequence
  Synthetic
gggttgcaactgccgcacaaataacagcggccgcagctctgatacaagccaaacaaaatgctgccaacatcctcc

SEQ ID NO: 261139 - DNA, 75 bp, Artificial Sequence
  Synthetic
tgagcgcagcatgggagaagtacgggagcatccagccaccagccaaccaagacacccccgaccgacaagacaaat

SEQ ID NO: 261140 - DNA, 75 bp, Artificial Sequence
  Synthetic
ttcaaccaacaaatttcggaagattgaaaagaagatccaaattcacaacacgaggtatggagacctgttcgccag

SEQ ID NO: 261141 - DNA, 75 bp, Artificial Sequence
  Synthetic
ccccaggaagggcatcatcaacgtccgccgcaacagcaggggagccaaccaagccgcggaaacagtcaagagaga

SEQ ID NO: 261142 - DNA, 75 bp, Artificial Sequence
  Synthetic
ctggaaaccagggcacagacgcgaacacagcatatcatggacaatgggaggagtcacaactatcagctggtgcaa

SEQ ID NO: 261143 - DNA, 75 bp, Artificial Sequence
  Synthetic
cacagcatatcatggacaatgggaggagtcacaactatcagctggtgcaacccatcatgctctccgatcagggca

SEQ ID NO: 261144 - DNA, 75 bp, Artificial Sequence
  Synthetic
cctcaaataagttcatgtatgatcctagccctatatcagagagagattttgcgagacttgacttggctatcttca

SEQ ID NO: 261145 - DNA, 75 bp, Artificial Sequence
  Synthetic
tgatttgatagtaccatattagaaaaaaattaaattctgatcctttgaggctcgtattcggattcaagcaattat

SEQ ID NO: 261146 - DNA, 75 bp, Artificial Sequence
  Synthetic
cagaagaatatctcaatacaagattctcaagtaataataacaggcaatcttgatatctcaactgagcttgggaat

SEQ ID NO: 261147 - DNA, 75 bp, Artificial Sequence
  Synthetic
gggagaacaacctgagggaaagggcacgggtaggacatggcgggctccggtcccgaaagggcggagcaccagatc

SEQ ID NO: 261148 - DNA, 75 bp, Artificial Sequence
  Synthetic
ccaaggtccaataatccgagcgacgaccccctcccgttacctctgcctcgctgaatgatcacgcaactgtaatta

SEQ ID NO: 261149 - DNA, 75 bp, Artificial Sequence
  Synthetic
gatagagttcttagagtcaaatgattttgatccatataaggaaatggaatatctgacgacccttgagtacctaag

SEQ ID NO: 261150 - DNA, 75 bp, Artificial Sequence
  Synthetic
ctgaatgatcacgcaactgtaattaatccagctacattaaagattaagaaaaaatacgggtagaatcggagtgcc

SEQ ID NO: 261151 - DNA, 75 bp, Artificial Sequence
  Synthetic
gagttaagaaaaaactaccggttgtagatgaccaaaggacgatatacgggtagaacggtaagagaggccgcccct

SEQ ID NO: 261152 - DNA, 75 bp, Artificial Sequence
  Synthetic
agatcgcattgtcgagttgcctgcatggtacaaggtgacaatcaagtaatagctgtaacaagagaagtaaggtca

SEQ ID NO: 261153 - DNA, 75 bp, Artificial Sequence
  Synthetic
agatgaccaaaggacgatatacgggtagaacggtaagagaggccgcccctcaattgcgagccaggcttcacaacc

SEQ ID NO: 261154 - DNA, 75 bp, Artificial Sequence
  Synthetic
gccccgcaatacaggatccagcgtcttgactcgtggacagacagcaaagaagactcggtattcatcactacctat

SEQ ID NO: 261155 - DNA, 75 bp, Artificial Sequence
  Synthetic
gttctagcgtgctacctgatgtacaagcaaaaggcgcaacagaagactctgttatggcttgggaataataccctg

SEQ ID NO: 261156 - DNA, 75 bp, Artificial Sequence
  Synthetic
aggttcattctgaacacacattaccaaatccagaggacgactacttagtacgatacctgttcagaggaataggga

SEQ ID NO: 261157 - DNA, 75 bp, Artificial Sequence
  Synthetic
tgtacaaacaaaaggcacagcaaaagactttactgtggcttgggaacaataccctcgatcagatgagagccacta

SEQ ID NO: 261158 - DNA, 75 bp, Artificial Sequence
  Synthetic
gtctacaggatcccaactgcagtattgaaagtatctggctcaagcctgtacaatcttgcgctcaatgtcactatt

SEQ ID NO: 261159 - DNA, 75 bp, Artificial Sequence
  Synthetic
gagattctcaaggatgatggggtcagagaggccaggtctggccggttgagtcagctgcaagagggttggaaagat

SEQ ID NO: 261160 - DNA, 75 bp, Artificial Sequence
  Synthetic
tctccggctcgagtctgtacaatcttgcgctcaatgtcactattgatgtggaggtagacccgaagagcccgttgg

SEQ ID NO: 261161 - DNA, 75 bp, Artificial Sequence
  Synthetic
ctataggaaccacaccttgcgaggggtattcgggacaatgcttgatgatgaacaagcaagactcaaccccgtatc

SEQ ID NO: 261162 - DNA, 75 bp, Artificial Sequence
  Synthetic
accatcaggcaggcacaacccgacaatgctgatgtgatcagtctgaattctgtctgcagtcgctttattaagaaa

SEQ ID NO: 261163 - DNA, 75 bp, Artificial Sequence
  Synthetic
gcctgcggagtgtcaaagtaattatccaagcaggtacccagcgcgccgtcgcagtgaccgctgaccacgaggtca

SEQ ID NO: 261164 - DNA, 75 bp, Artificial Sequence
  Synthetic
taccattgccaaatacaatcctttcaagaaataggctgcatctccgagattgcactctgttcatttccctggatc

SEQ ID NO: 261165 - DNA, 75 bp, Artificial Sequence
  Synthetic
aacaagattaccaaattcggatggctaagtcttcatataaacccgggcgatttggtggaaagcgcgtacagcaag

SEQ ID NO: 261166 - DNA, 75 bp, Artificial Sequence
  Synthetic
tgacaagctcccttgatggcaggcctcttgcagctgcagggattgtggtaacaggagacaaagcagtcaacatat

SEQ ID NO: 261167 - DNA, 75 bp, Artificial Sequence
  Synthetic
ggatttgtccaggagttctgcccattatggagagagaatgcagaagaaagtgacttgacctcggataaggcagtg

SEQ ID NO: 261168 - DNA, 75 bp, Artificial Sequence
  Synthetic
aagatcaaacgccttgcgctgaatggttgatggccatcacaactcataacaggctcctgtcacttcagcgtcaca

SEQ ID NO: 261169 - DNA, 75 bp, Artificial Sequence
  Synthetic
atccatatcccttaatcttccataggaatcatactctacgaggggtcttcgggacgatgcttgatgatgaacaag

SEQ ID NO: 261170 - DNA, 75 bp, Artificial Sequence
  Synthetic
aagtagtgaggatggcaaaaactctaatacaacagcacggtacacttctgtctaaatcagatgagattacgttaa

SEQ ID NO: 261171 - DNA, 75 bp, Artificial Sequence
  Synthetic
caatgaggctgtgcacgaagtcactgacggattatcacaactagccgtggcagtcgggaagatgcaacaatttgt

SEQ ID NO: 261172 - DNA, 75 bp, Artificial Sequence
  Synthetic
ggcattgtatcacctatcttctgcgacatcaagaatcaaaccgaatgccggcgcgtgctcgaattccatgttgcc

SEQ ID NO: 261173 - DNA, 75 bp, Artificial Sequence
  Synthetic
atggcataacccagatgacatttactcctgcatctctctacagagtatcaccttacattcacatatccaatgatt

SEQ ID NO: 261174 - DNA, 75 bp, Artificial Sequence
  Synthetic
tagtctcttgattaagaaaaaatgtaagtggcaatgagatacaaggcaaaacagctcatggtaaataatacgggt

SEQ ID NO: 261175 - DNA, 75 bp, Artificial Sequence
  Synthetic
tcaacaagcgggagtcctcaccgggctcagtgacgaaggcccccgaactccacagggcggatcaaacaagccgca

SEQ ID NO: 261176 - DNA, 75 bp, Artificial Sequence
  Synthetic
atactgcatagagaccgatttagatttatattgtacaagaatagtgacattccctatgtctcctggtatttactc

SEQ ID NO: 261177 - DNA, 75 bp, Artificial Sequence
  Synthetic
tcattctcagccgacaatggaaaaaaatacttgaatcggcctctcctgatactgagagaatgataaaactcggaa

SEQ ID NO: 261178 - DNA, 75 bp, Artificial Sequence
  Synthetic
aagatccaaattcacaacacgagatatggagaactgttcacaaggctgtgtacgcatatagagaagaaactgctg

SEQ ID NO: 261179 - DNA, 75 bp, Artificial Sequence
  Synthetic
gttaacaactcgataagtaatgctctagataagttagaggaaagcaacagcaaactagacaaggtcaatgtcaaa

SEQ ID NO: 261180 - DNA, 75 bp, Artificial Sequence
  Synthetic
ttgcatggctccatataaaacagatccagaggcatctgatggtggcagctaggacaaggtctgcggccaacaaat

SEQ ID NO: 261181 - DNA, 75 bp, Artificial Sequence
  Synthetic
acaagttcacatgtcttacccaggaacttgtattgatgtatgcagatatgatggagggcagagatatggtcaaca

SEQ ID NO: 261182 - DNA, 75 bp, Artificial Sequence
  Synthetic
gttctagcatgctacctgatgtacaagcaaaaggcgcaacagaagaccttgttatggcttgggaataataccctg

SEQ ID NO: 261183 - DNA, 75 bp, Artificial Sequence
  Synthetic
atggagggcagagatatggtcaacataatatcaaccacggcggtgcatctcagaagcttatcagagaaaattgat

SEQ ID NO: 261184 - DNA, 75 bp, Artificial Sequence
  Synthetic
tggcaaaagacttgggtaatcaagtctacgatgttgtatcactaatggagggatttgcatacggagctgtccagc

SEQ ID NO: 261185 - DNA, 75 bp, Artificial Sequence
  Synthetic
aagtccggcagcctgttaattagaagacttaagaaaaaactgccggatgtagatgaccaaaggataatatacggg

SEQ ID NO: 261186 - DNA, 75 bp, Artificial Sequence
  Synthetic
gagaagccaggtctggctagttgagtcaactatgaaagagttggaaagatggcattgtatcacctatcttctgcg

SEQ ID NO: 261187 - DNA, 75 bp, Artificial Sequence
  Synthetic
tagaacggtcggagaggccgcccctcaatcgggagccgggcctcgcaacatccgttctaccgcatcaccaacagc

SEQ ID NO: 261188 - DNA, 75 bp, Artificial Sequence
  Synthetic
tccgttctaccgcatcaccaacagcagtcttcagtcatggaccgcgcagttagccaagttgcgttagagaatgat

SEQ ID NO: 261189 - DNA, 75 bp, Artificial Sequence
  Synthetic
gcctcctccccaatgatatagcagaatccgtgactcatgcaatcgctactgtattctctggtttagaacagaatc

SEQ ID NO: 261190 - DNA, 75 bp, Artificial Sequence
  Synthetic
agtttctggccccggagacccatctccttatgtgactcaaggaggtgaaatggcacttaataaactctcgcaacc

SEQ ID NO: 261191 - DNA, 75 bp, Artificial Sequence
  Synthetic
tagccaagttgcgttagagaatgatgagagagaggcaaagaatacatggcgtttggtattccggatcgcgatcct

SEQ ID NO: 261192 - DNA, 75 bp, Artificial Sequence
  Synthetic
aagcagctgagatgttgtgtctgttgcgtctgtggggtcacccactgcttgagtcccgtattgccgcaaaggcag

SEQ ID NO: 261193 - DNA, 75 bp, Artificial Sequence
  Synthetic
ccttgtaggcataccgactgcgatctctagagcagaggaaaggattacatctgcactcggttccaaccaagatgt

SEQ ID NO: 261194 - DNA, 75 bp, Artificial Sequence
  Synthetic
taaacaccgagtctacaattatgaatgcaataacgtctctctcttatcagatcaatggggccgcaaatagcagcg

SEQ ID NO: 261195 - DNA, 75 bp, Artificial Sequence
  Synthetic
tgcaataacgtctctctcttatcagatcaatggggccgcaaatagcagcgggtgtggggcacctattcatgatcc

SEQ ID NO: 261196 - DNA, 75 bp, Artificial Sequence
  Synthetic
ggtgtggggcacctattcatgatccggattatatcgggggaataggtaaagaacttattgtagatgatgctagtg

SEQ ID NO: 261197 - DNA, 75 bp, Artificial Sequence
  Synthetic
cacaccccaacgataattggcttgcctcgtttaggcggaaccttctctccgaagaccagaagaaacatgtaaaag

SEQ ID NO: 261198 - DNA, 75 bp, Artificial Sequence
  Synthetic
ctgcaaagctgcagggttgtggcaaacaaatactcgtcggtgaatgcagtcaagcacgtgaaagcgccagagaag

SEQ ID NO: 261199 - DNA, 75 bp, Artificial Sequence
  Synthetic
tttgatccatataaagagatggaatatctgacgacccttgagtaccttagagatgacaatgtggcagtatcatac

SEQ ID NO: 261200 - DNA, 75 bp, Artificial Sequence
  Synthetic
aacacgggtagaagagtctggatcccggccggcacatccaaagtgcaatatggactccaaaccccacatcaggat

SEQ ID NO: 261201 - DNA, 75 bp, Artificial Sequence
  Synthetic
ctactctgcgttccattaacctggatgacacccaaaaccgaaagtcttgcagtgtgagtgcaactcccttaggtt

SEQ ID NO: 261202 - DNA, 75 bp, Artificial Sequence
  Synthetic
tccttgaccaagagtatgctagcgatgagtcaactgtcttttaacagcaataagaaacgtatcactgactgtaaa

SEQ ID NO: 261203 - DNA, 75 bp, Artificial Sequence
  Synthetic
atggaaggttagggttcgacggccaataccatgagaaggacctagatgtcacaacactattcggagactgggtgg

SEQ ID NO: 261204 - DNA, 75 bp, Artificial Sequence
  Synthetic
cacattgaggttatgtccaccgtagacaagaaaggaaagaaagtgacatttgtcatgctggagaggaagataagg

SEQ ID NO: 261205 - DNA, 75 bp, Artificial Sequence
  Synthetic
agcagatgagtcggaaacaagaagaatcaataagtacatgcagcaaggcagagtccagaagaagtacatcctcca

SEQ ID NO: 261206 - DNA, 75 bp, Artificial Sequence
  Synthetic
ttcacctaagactgatggacactacgatgttcgtaggagaccctttcaatcctccaagtgaccctactgactgtg

SEQ ID NO: 261207 - DNA, 75 bp, Artificial Sequence
  Synthetic
ttcggtgggaaacgcgtgcaacaggccatcttatctatcaaagtgtctacatccttgggcgaagacccggtgctg

SEQ ID NO: 261208 - DNA, 75 bp, Artificial Sequence
  Synthetic
tcatgggggctgaaggcagagttctcacagtagggacatctcacttcttgtatcaacgagggtcatcatacttct

SEQ ID NO: 261209 - DNA, 75 bp, Artificial Sequence
  Synthetic
gggcatggcatcagtcttagataaaggaactggcaaataccaattcgccagagacttcatgagcacatcattctg

SEQ ID NO: 261210 - DNA, 75 bp, Artificial Sequence
  Synthetic
tcactcgaccaggtagtgtcccttgccaggcttcagcaagatgccctaattcatgtgttaccggagtctatactg

SEQ ID NO: 261211 - DNA, 75 bp, Artificial Sequence
  Synthetic
gtgaaaccatcaggtcagacacattcttcatatacagcaaacgaatcttcaaagatggagcaatcctcagtcaag

SEQ ID NO: 261212 - DNA, 75 bp, Artificial Sequence
  Synthetic
caagactcaaccctgtatctgcagtattcgacagcatatcccgcagtcgcataacccgggtgagttcaagcagca

SEQ ID NO: 261213 - DNA, 75 bp, Artificial Sequence
  Synthetic
gctgctgcccaacgagtgtctgaggaaactggcagcgtggatattcctactcaacaagccggggtcctcactggg

SEQ ID NO: 261214 - DNA, 75 bp, Artificial Sequence
  Synthetic
ttgcctctactgtagcacggctatgcgagaacgggcttcccaaagacttctgttactatttaaactatataatga

SEQ ID NO: 261215 - DNA, 75 bp, Artificial Sequence
  Synthetic
gagacccaattcttggatttgatgagagcagtggcgaacagcatgcgagaagcgccaaactccgcacagagcacc

SEQ ID NO: 261216 - DNA, 75 bp, Artificial Sequence
  Synthetic
gagcagtggcgaacagcatgcgagaagcgccaaactccgcacagagcaccacccacccggaaccccccccgactc

SEQ ID NO: 261217 - DNA, 75 bp, Artificial Sequence
  Synthetic
gagattctcaaggatgatggggtcagagaggccaggtctggtcgattgagtcagctgcaagagggttggaaggat

SEQ ID NO: 261218 - DNA, 75 bp, Artificial Sequence
  Synthetic
ttgaggacatctcttttgtgcactcatatgttctgactcctgcccaattagggggactgagtaaccttcaatact

SEQ ID NO: 261219 - DNA, 75 bp, Artificial Sequence
  Synthetic
gggggactgagtaaccttcaatactcaaggctctacactagaaatatcggtgacccggggactactgcttttgca

SEQ ID NO: 261220 - DNA, 75 bp, Artificial Sequence
  Synthetic
ccaaatcctccgcccgagcccctcccccactccccgacccacagccccgtatggccaaaccaacgaaagcactcc

SEQ ID NO: 261221 - DNA, 75 bp, Artificial Sequence
  Synthetic
cacaggcacaacccgatccaccgataatccaaacagagccaaagatattagaaaaaaatacgggtagaagagaga

SEQ ID NO: 261222 - DNA, 75 bp, Artificial Sequence
  Synthetic
caagtagcccttgaatctccgctggcactgctaaatactgaatctataattatgaatgcaataacgtctctctct

SEQ ID NO: 261223 - DNA, 75 bp, Artificial Sequence
  Synthetic
actaccgaacccaaaggaagattacctagtacggtacttgttcagaggaatagggactgcttcatcttcttggta

SEQ ID NO: 261224 - DNA, 75 bp, Artificial Sequence
  Synthetic
ctttacagatgcggagatagatgatatatttgagaccagtggaactgtcattgacagcataattacggcccaggg

SEQ ID NO: 261225 - DNA, 75 bp, Artificial Sequence
  Synthetic
tcattctcagccgacaatggaagaaaatacttgaatcggcctctcctgacactgagagaatgataaaacttggaa

SEQ ID NO: 261226 - DNA, 75 bp, Artificial Sequence
  Synthetic
gctgtcgcagtgaccgctgatcacgaggtaacctccactaagatagagaagaggcacaccattgctaaatacaat

SEQ ID NO: 261227 - DNA, 75 bp, Artificial Sequence
  Synthetic
taggaagagccttaatttgatcagggaaagagaggacagggatactatcttggcattgttgttccctcaagaacc

SEQ ID NO: 261228 - DNA, 75 bp, Artificial Sequence
  Synthetic
cccgaggtcagatgtgcaaggcatggaaactccttatacttggcagaaggaagtggagccatcatgagtcttctc

SEQ ID NO: 261229 - DNA, 75 bp, Artificial Sequence
  Synthetic
agccaggacaaccccgaccaacaggatagaccagacaaacagctatccacacctgagcaggcgaccccacacaac

SEQ ID NO: 261230 - DNA, 75 bp, Artificial Sequence
  Synthetic
ctagtattgaggtccctgattcaaccaacaaatttcggaagattgagaagaagatccaaattcacaacacaagat

SEQ ID NO: 261231 - DNA, 75 bp, Artificial Sequence
  Synthetic
aagatccaaattcacaacacaagatacggagaactgttcacaaggctgtgcacgcatgtagagaggaaattattg

SEQ ID NO: 261232 - DNA, 75 bp, Artificial Sequence
  Synthetic
ccaactcccccgcttgcaccccaccccccagtccgcagtcccgcacggccaaacccacaaacgaaccccctcatc

SEQ ID NO: 261233 - DNA, 75 bp, Artificial Sequence
  Synthetic
ctcttctaatatgtgttctctgacactggcagactatgcacggaatagaagctggtcacctttgacgggaggcag

SEQ ID NO: 261234 - DNA, 75 bp, Artificial Sequence
  Synthetic
ccaactcgcctagtgacactgcacaagaagggaaatatgtaatatacaagcgatacaatgacacatgtccagatg

SEQ ID NO: 261235 - DNA, 75 bp, Artificial Sequence
  Synthetic
tgctcgacaagctgagcaataaaccatctaatgctaaaaagggcccatggtcgagtccccaggaaggatatcatc

SEQ ID NO: 261236 - DNA, 75 bp, Artificial Sequence
  Synthetic
ccgcccctggaagccggggcacagacgcgagcacagcatatcatggacaatggaaggagtcacaactatcagctg

SEQ ID NO: 261237 - DNA, 75 bp, Artificial Sequence
  Synthetic
gtaaagggcgaagaagcaattgaaatcgtacgggtagaaggtgtgaacctcgagtgcgaggccgaagcttaaacc

SEQ ID NO: 261238 - DNA, 75 bp, Artificial Sequence
  Synthetic
agggcagagccaagacagtactcctgtacctgtggatcatgtccagccacctgtcgactttgtgcaggcgatgat

SEQ ID NO: 261239 - DNA, 75 bp, Artificial Sequence
  Synthetic
aggacatggcgggctccggtcccgaaagggcggagcatcagattatcctaccagagtcacacctgtcttcaccat

SEQ ID NO: 261240 - DNA, 75 bp, Artificial Sequence
  Synthetic
agttttaatttcaggccccggagatccgtccccctacgtgacacaagggggtgagatgacactcaataaactctc

SEQ ID NO: 261241 - DNA, 75 bp, Artificial Sequence
  Synthetic
gacctgatatgggagtggaaaaggacactgtccgtgcattgatcacctcgcgcccgatgcatccaagctcctcag

SEQ ID NO: 261242 - DNA, 75 bp, Artificial Sequence
  Synthetic
gaatgcaggtgtttggccacgtgtcaaggtagacacgatatacgggaaggtcattgggcagctgcacgctgattc

SEQ ID NO: 261243 - DNA, 75 bp, Artificial Sequence
  Synthetic
agcagagatttcacacgatatcatgttgagagagtataagagtttatctgcgcttgaattcgagccatgtataga

SEQ ID NO: 261244 - DNA, 75 bp, Artificial Sequence
  Synthetic
agtccagaagaagtacatcctccaccccgtatgcaggagtgcaattcaactcacaatcagacattctctggcagt

SEQ ID NO: 261245 - DNA, 75 bp, Artificial Sequence
  Synthetic
aggtttctgcccttttagtgtcacaaggaatccgccccgagccccctctttcaaacccatgctccaacattctaa

SEQ ID NO: 261246 - DNA, 75 bp, Artificial Sequence
  Synthetic
ttgagagagtataagagtttatctgcgcttgaattcgagccatgtatagagtatgaccctgtcactaatctgagt

SEQ ID NO: 261247 - DNA, 75 bp, Artificial Sequence
  Synthetic
ggagctctacgtattacaacttagttggggatgtagactcatacataaggaacaccgggcttactgcattcttcc

SEQ ID NO: 261248 - DNA, 75 bp, Artificial Sequence
  Synthetic
gaggaccagaagaagcatgttaaggaggcaacctcgactaaccgcctcctaatagagttcttagagtcaaatgat

SEQ ID NO: 261249 - DNA, 75 bp, Artificial Sequence
  Synthetic
aggcaacctcgactaaccgcctcctaatagagttcttagagtcaaatgattttgatccgtataaagagatggaat

SEQ ID NO: 261250 - DNA, 75 bp, Artificial Sequence
  Synthetic
tgtcaacagtagacaagaaaggaagaaaggtgacattcgacaagttggaaagaaaactccggaggctcgatctgt

SEQ ID NO: 261251 - DNA, 75 bp, Artificial Sequence
  Synthetic
ttaatgggcggattttcgccaagctaacaaagaaattaaggaactgtcaagtgatggcagaagggatcttagctg

SEQ ID NO: 261252 - DNA, 75 bp, Artificial Sequence
  Synthetic
taaagaggattcggtattcatcaccacctatggattcatcttccaagttgggaatgaggaagtcactgtcggcat

SEQ ID NO: 261253 - DNA, 75 bp, Artificial Sequence
  Synthetic
tagtatcttgcacccgacgtgtgatctccggcttatattcaggaaataagtatgatctgctgttcccatctgtct

SEQ ID NO: 261254 - DNA, 75 bp, Artificial Sequence
  Synthetic
tgcagtgaagcatgtgaaagcaccagagaagatccctgggagcggaaccttagagtataaggtgaactttgtctc

SEQ ID NO: 261255 - DNA, 75 bp, Artificial Sequence
  Synthetic
gagcctcaatttgatcagggaaagggaggacagggatactatcctggtgttgttgttcccccaagagccattatt

SEQ ID NO: 261256 - DNA, 75 bp, Artificial Sequence
  Synthetic
agcagtggcaaacagcatgcgagaagcgccagactctgcacagagcaccatccatctggagcctccttcaactca

SEQ ID NO: 261257 - DNA, 75 bp, Artificial Sequence
  Synthetic
tgaaagtatctggctcaagcctgtacaatcttgcgctcaatgtcactattgatgtggaggtggacccgaagagcc

SEQ ID NO: 261258 - DNA, 75 bp, Artificial Sequence
  Synthetic
caatcttgcgctcaatgtcactattgatgtggaggtggacccgaagagcccgttagtcaaatccctttccaagtc

SEQ ID NO: 261259 - DNA, 75 bp, Artificial Sequence
  Synthetic
tccatctggagcctccttcaactcatggaccatcccaagacaacgacaccgactgggggtactgatcgacaacat

SEQ ID NO: 261260 - DNA, 75 bp, Artificial Sequence
  Synthetic
cccgacaacctgcggcatttttgcaagagttagatttgagtgctccagcaaggtatgacgcattcacacttagtc

SEQ ID NO: 261261 - DNA, 75 bp, Artificial Sequence
  Synthetic
acaggcacgactcggcccaccagcaatccgtgcaaaacctaagatattagaaaaaaatacgggtagaagagagac

SEQ ID NO: 261262 - DNA, 75 bp, Artificial Sequence
  Synthetic
aatagctcatatgttaccacatgtaaaagctgctctaagggcatcatctgtgttgatctgggcttatggagacaa

SEQ ID NO: 261263 - DNA, 75 bp, Artificial Sequence
  Synthetic
ataaggagactcaatctatctgtcgggctcagtgatgtgctcggaccttccgtgcttgtgaaggcgagaggtgca

SEQ ID NO: 261264 - DNA, 75 bp, Artificial Sequence
  Synthetic
tctctagcagtgggacagcctgctatcctatagcaaatgcctctccccaggttgctaagatactctggagtcaaa

SEQ ID NO: 261265 - DNA, 75 bp, Artificial Sequence
  Synthetic
catgtaccacatgaaactatctattacaatacgctcttttcaaatgagatgaaccccccgcaacgacatttcggg

SEQ ID NO: 261266 - DNA, 75 bp, Artificial Sequence
  Synthetic
tgacagcataatcacggcccagggcaaatcagtagagactgtcgggaagagcgcaatcccgcaaggcaagacgaa

SEQ ID NO: 261267 - DNA, 75 bp, Artificial Sequence
  Synthetic
gctgtcgcagtgaccgctgatcatgaggttacctctaccaagatagagaagaggcataccattgctaaatacaat

SEQ ID NO: 261268 - DNA, 75 bp, Artificial Sequence
  Synthetic
tcgtcgaagagttgccacttttatcacgactgacctacaaaagtattgtcttaactggagatatcagacagttaa

SEQ ID NO: 261269 - DNA, 75 bp, Artificial Sequence
  Synthetic
tagaccagacaaacagtcatccacaccagagcaggcgaccccacacaacgacccgccgaccgcgcccaaagagcc

SEQ ID NO: 261270 - DNA, 75 bp, Artificial Sequence
  Synthetic
tgaatcatcgcaacactatataatgatctgtcttgattgcttacagttagttcacctgtttatctagttagaaaa

SEQ ID NO: 261271 - DNA, 75 bp, Artificial Sequence
  Synthetic
tcgagtcactcttcccaatgacgacaaccaggacatatgatgagatcacattacacctccacagtaagtttagct

SEQ ID NO: 261272 - DNA, 75 bp, Artificial Sequence
  Synthetic
ccagagcaggcgaccccacacaacgacccgccgaccgcgcccaaagagccgccccccacccaggcagcaggcaac

SEQ ID NO: 261273 - DNA, 75 bp, Artificial Sequence
  Synthetic
aacacgggtagaagagttcggatcccgattggcacattcaaggcgcaatatgggctccaagtcttctaccaggat

SEQ ID NO: 261274 - DNA, 75 bp, Artificial Sequence
  Synthetic
tctaatgctaaaaaagggccaaggtcgagcccccagggaggccacaatcaacccctggcccaacaacatgggaat

SEQ ID NO: 261275 - DNA, 75 bp, Artificial Sequence
  Synthetic
agagaatctgtgagttacggtaaagggcgaataagcaatcgaaatcgcacgggtagaaggtgtgaacctcgagtg

SEQ ID NO: 261276 - DNA, 75 bp, Artificial Sequence
  Synthetic
tgtcgactttgtgcaggcgatgatgtctatgatggaggcgttatcacagaaggtaagtaaagttgactatcagct

SEQ ID NO: 261277 - DNA, 75 bp, Artificial Sequence
  Synthetic
ccaagattaataaagtacttgaggaagaatattgacactgcgctgattgaagccgggggacagcccgtccgtcca

SEQ ID NO: 261278 - DNA, 75 bp, Artificial Sequence
  Synthetic
tccaacagctcaaaacatctgttgcgatcatggaagccaatttaggcatgatgaaaattctggaccctggttgtg

SEQ ID NO: 261279 - DNA, 75 bp, Artificial Sequence
  Synthetic
atccatctcgactgcttatagttagttcacctgtctagcaaattagaaaaaacacgggtagaagattctggatcc

SEQ ID NO: 261280 - DNA, 75 bp, Artificial Sequence
  Synthetic
cagtggcagttgggaagatgcagcagtttgttaatgaccagtttaataatacagcgcgagaattggactgtataa

SEQ ID NO: 261281 - DNA, 75 bp, Artificial Sequence
  Synthetic
agatcaaacgccttgcgctgaacggttgatagctatcacagctcacaacaggcttctgcctcatcagtgtcacaa

SEQ ID NO: 261282 - DNA, 75 bp, Artificial Sequence
  Synthetic
tgcaggagtgcaattcaactcacaatcagacattctctagcagtccgcatttttttagttagtgagcttaagaga

SEQ ID NO: 261283 - DNA, 75 bp, Artificial Sequence
  Synthetic
atcagcccttgcactcagcagcctcacaggtgatatccaaaaaatgaaacagctcatgcgtttatatcggatgaa

SEQ ID NO: 261284 - DNA, 75 bp, Artificial Sequence
  Synthetic
ataaatgtcttaaaaaaaggttgcgcacaattattcttgagtgtagtctcgtcattcaccaaatctttgtttggt

SEQ ID NO: 261285 - DNA, 75 bp, Artificial Sequence
  Synthetic
agctcatgcgtttatatcggatgaaaggagaaaatgcaccgtacatgacattgctaggtgacagtgaccagatga

SEQ ID NO: 261286 - DNA, 75 bp, Artificial Sequence
  Synthetic
ccaaaccctccgaccaaaaccctcccacactccccgacccacaaccccgcacgaccacaccaacaaaagctcccc

SEQ ID NO: 261287 - DNA, 75 bp, Artificial Sequence
  Synthetic
catgtgccgcatgagactatctattacaatacgctcttctcaaatgagatgaaccctccacagcgacatttcgga

SEQ ID NO: 261288 - DNA, 75 bp, Artificial Sequence
  Synthetic
tgctgagctgaaactaactccagcagcaaggaggggcctggcagctgctgcccaacgagtatctgaggaaattgg

SEQ ID NO: 261289 - DNA, 75 bp, Artificial Sequence
  Synthetic
agcttactagatcaactggctaccaatctatctctgattgccatgcattctgtaagggaaggcggggttgtgatc

SEQ ID NO: 261290 - DNA, 75 bp, Artificial Sequence
  Synthetic
tgtataaacaaaaggcacaacaaaagaccttactatggcttgggaataataccctcgatcagatgagagccacca

SEQ ID NO: 261291 - DNA, 75 bp, Artificial Sequence
  Synthetic
cggagcctctctcaactcatgggccatctcaggacaacgacaccgactgggggtactgatcgacagaattcagcc

SEQ ID NO: 261292 - DNA, 75 bp, Artificial Sequence
  Synthetic
atcaaagtgttgtatgcaatgggatattacttccatctactcatgaatttattcactccgtgttccacaaaagga

SEQ ID NO: 261293 - DNA, 75 bp, Artificial Sequence
  Synthetic
tatttacctcacagcggcagcgtgttacagatatcttatctagtcctttaccgagactaatgaagttcttgagaa

SEQ ID NO: 261294 - DNA, 75 bp, Artificial Sequence
  Synthetic
tgcagttagcagagttgtgctagagaatgaagaaagagaagcgaagaatacatggcgcttggttttccggatcgc

SEQ ID NO: 261295 - DNA, 75 bp, Artificial Sequence
  Synthetic
ttagccatctctgcagctgccctggtatacagcatgggagttagcacaccaagcgactttgtaggcatatcaact

SEQ ID NO: 261296 - DNA, 75 bp, Artificial Sequence
  Synthetic
ccagatcattgctagtcacattgacacggtcattagatctgtgatctacatggaggctgagggtgatctcgctga

SEQ ID NO: 261297 - DNA, 75 bp, Artificial Sequence
  Synthetic
agcatccagccatctgctggccaagacacctccaaccaacaggacaaaccagacaaacagccatccgcatctgag

SEQ ID NO: 261298 - DNA, 75 bp, Artificial Sequence
  Synthetic
tgaaacgtagtacttgccctaagtacttgaaggctgtcctaggtatcactaaactcaaagaaatgtttacagaca

SEQ ID NO: 261299 - DNA, 75 bp, Artificial Sequence
  Synthetic
ctgggccatcccaagataacgacaccgactggggctattgattgacaaaacccagcttgcttccacaaaatcatc

SEQ ID NO: 261300 - DNA, 75 bp, Artificial Sequence
  Synthetic
tcagcaaaaattctacatgaaaactataggcaatgcagttaagggatattacagtaactgtgactcttaaagaca

SEQ ID NO: 261301 - DNA, 75 bp, Artificial Sequence
  Synthetic
tcagtacttagcacttggtgtgcttcggacatctgcaacagggagggtattcttttctactctgcgttccatcaa

SEQ ID NO: 261302 - DNA, 75 bp, Artificial Sequence
  Synthetic
tcttttctactctgcgttccatcaatttagatgacacccaaaatcggaagtcttgcagtgtgagtgcaactcctt

SEQ ID NO: 261303 - DNA, 75 bp, Artificial Sequence
  Synthetic
tggtgcatggaaggttagggtttgacggtcaataccatgagaaggacctagataccacagtcttattcaaggatt

SEQ ID NO: 261304 - DNA, 75 bp, Artificial Sequence
  Synthetic
aagccaaccagaatgccgccaatatcctccggctcaaggagagcattgctgcaaccaatgaagctgtgcatgagg

SEQ ID NO: 261305 - DNA, 75 bp, Artificial Sequence
  Synthetic
gagttcagaagaagtacatccttcaccctgtatgcaggagtgcaattcaactcacaatcagacattctctggcag

SEQ ID NO: 261306 - DNA, 75 bp, Artificial Sequence
  Synthetic
tacaagcgctataataacacatgtcccgatgaacaagattatcagattcggatggctaaatcttcgtacaagcct

SEQ ID NO: 261307 - DNA, 75 bp, Artificial Sequence
  Synthetic
gggactttatgagcacatcattctggagacttggagtagagtatgctcaggctcagggaagtagcatcaatgagg

SEQ ID NO: 261308 - DNA, 75 bp, Artificial Sequence
  Synthetic
accaaagatggtagacttcgatatgatcctccaggtattatctttctttaagggaacaatcatcaatggatacag

SEQ ID NO: 261309 - DNA, 75 bp, Artificial Sequence
  Synthetic
accaaacaagggagaatatggatacgttaaaatatataacgtatttttaaaacttaggaaccaagacaaacactt

SEQ ID NO: 261310 - DNA, 75 bp, Artificial Sequence
  Synthetic
gttaaaatatataacgtatttttaaaacttaggaaccaagacaaacacttttggtcttggtattggatcctcaag

SEQ ID NO: 261311 - DNA, 75 bp, Artificial Sequence
  Synthetic
ttggtcttggtattggatcctcaagaaatatatcatcatgagtgatatctttgaagaggcggctagttttaggag

SEQ ID NO: 261312 - DNA, 75 bp, Artificial Sequence
  Synthetic
ttatcaatctaagttagggagagatgggagggctagtgcagcaactgctactttgacaaccaagataaggatatt

SEQ ID NO: 261313 - DNA, 75 bp, Artificial Sequence
  Synthetic
tgtaccagctactaatagtccagagctcagatgggaactaacattgtttgcacttgatgtgattagatctccgag

SEQ ID NO: 261314 - DNA, 75 bp, Artificial Sequence
  Synthetic
cacttgatgtgattagatctccgagtgctgccgagtcaatgaaagttggagctgctttcacactcatctctatgt

SEQ ID NO: 261315 - DNA, 75 bp, Artificial Sequence
  Synthetic
gatcaatggtcaacggaataccagtaatggagaggagaggagacaaggctcaggaggagatggaaggcttgatga

SEQ ID NO: 261316 - DNA, 75 bp, Artificial Sequence
  Synthetic
aatggagaggagaggagacaaggctcaggaggagatggaaggcttgatgagaatcctcaaaactgctcgagacag

SEQ ID NO: 261317 - DNA, 75 bp, Artificial Sequence
  Synthetic
cagcaagggaaaaacaccttttgttgacagccgagcttacggcctacggataacagacatgagcaccctggtctc

SEQ ID NO: 261318 - DNA, 75 bp, Artificial Sequence
  Synthetic
tgcagttatcaccatcgaggcccagatctggatactgatcgctaaagcagttacagctcccgacactgccgagga

SEQ ID NO: 261319 - DNA, 75 bp, Artificial Sequence
  Synthetic
aagtgaaactagaagatgggctaaatacgtccaacaaaagagagtcaatccgttctttgctctaactcagcaatg

SEQ ID NO: 261320 - DNA, 75 bp, Artificial Sequence
  Synthetic
gctaacagaaatgaggaatctgctctcccagagtctatcagtaaggaagttcatggttgagatcctcatagaagt

SEQ ID NO: 261321 - DNA, 75 bp, Artificial Sequence
  Synthetic
caagaaaggaggatctgctaaaggcagagcagtagaaataatctcagacatcggaaactatgtcgaggaaactgg

SEQ ID NO: 261322 - DNA, 75 bp, Artificial Sequence
  Synthetic
tcggaaactatgtcgaggaaactggtatggcaggattcttcgcaaccatcagattcgggttggagacaaggtatc

SEQ ID NO: 261323 - DNA, 75 bp, Artificial Sequence
  Synthetic
cagcacttgcactcaacgaattccagagtgacctcaacaccatcaaaagcttgatgctactctacagagaaattg

SEQ ID NO: 261324 - DNA, 75 bp, Artificial Sequence
  Synthetic
ttgatgctactctacagagaaattggcccaagagccccttatatggtgcttcttgaagaatcaattcagactaaa

SEQ ID NO: 261325 - DNA, 75 bp, Artificial Sequence
  Synthetic
tttgcccctggaggttacccattattgtggagctttgccatgggtgtggctactactattgacaggtctatgggg

SEQ ID NO: 261326 - DNA, 75 bp, Artificial Sequence
  Synthetic
gcattgaatatcaatcgtggttatcttgagcctatgtatttcagactaggccaaaaatcagcacgtcaccatgct

SEQ ID NO: 261327 - DNA, 75 bp, Artificial Sequence
  Synthetic
ggaggaattgatcagaacatggcaaatagactgggactaagttcagatcaagttgcagaactcgctgctgcagtt

SEQ ID NO: 261328 - DNA, 75 bp, Artificial Sequence
  Synthetic
caggaaacatcagcaggaaggcaagagagtaatgttcaggctagagaggcaaaatttgctgcaggaggtgtgctc

SEQ ID NO: 261329 - DNA, 75 bp, Artificial Sequence
  Synthetic
attggaggcagtgatcaagatatcgatgaaggggaagaacctatagaacagagtggcagacagtcagttaccttc

SEQ ID NO: 261330 - DNA, 75 bp, Artificial Sequence
  Synthetic
aaaagggagatgagtatttcatcccttgctaacagtgtgccgagcagttctgtgagcacatccggtgggaccaga

SEQ ID NO: 261331 - DNA, 75 bp, Artificial Sequence
  Synthetic
ttgactaattcattactaaacctcagatcaagactggctgcaaaagcagcaaaagaagccgcctcatccaatgca

SEQ ID NO: 261332 - DNA, 75 bp, Artificial Sequence
  Synthetic
acagatgatccagcaatcagcaacagaactcaaggggaatcagagaagaagaataatcaagacctcaaacctgct

SEQ ID NO: 261333 - DNA, 75 bp, Artificial Sequence
  Synthetic
caaaatgaccttgatttcgtcagagctgatgtgtgacgtctatttccaatattctacagtatccaaaaatctttc

SEQ ID NO: 261334 - DNA, 75 bp, Artificial Sequence
  Synthetic
tatagtacactatcataatacgacactaagggatcaaccatatcaaagttacgaatcgttttaattatattaatc

SEQ ID NO: 261335 - DNA, 75 bp, Artificial Sequence
  Synthetic
aaatgatactcttttatgggcaaaccgaagaaccaatgtctacatgtaaattgagctttggtattgcaatctaat

SEQ ID NO: 261336 - DNA, 75 bp, Artificial Sequence
  Synthetic
acttgctcaaaatcttgaactattagtgtaatttctatcatcatagagttatcaagattttattatataagttgg

SEQ ID NO: 261337 - DNA, 75 bp, Artificial Sequence
  Synthetic
tgcagatctttggacatgaattacacactacactctaatgaagacaaaatttacattacatatttaaggactatt

SEQ ID NO: 261338 - DNA, 75 bp, Artificial Sequence
  Synthetic
tcctatcctttcaatggtacttggttatgaaggtttcttaatttaactaagctactgtctttgcactggaatata

SEQ ID NO: 261339 - DNA, 75 bp, Artificial Sequence
  Synthetic
caatacctcttacctcatttcttactttaatatcatgttatttttttgataagtcacttaacttgaccaaggtct

SEQ ID NO: 261340 - DNA, 75 bp, Artificial Sequence
  Synthetic
accaggtaatgctcgcacaagtgaactgcaatctcaacttagattaaacataatcatgcaaaatcactattttgt

SEQ ID NO: 261341 - DNA, 75 bp, Artificial Sequence
  Synthetic
actactaactcattaagaaaaacttaggatccaagagatttactctaggatctcctattaagcttagcagtcatt

SEQ ID NO: 261342 - DNA, 75 bp, Artificial Sequence
  Synthetic
agttgagagttcaacttgcaaaactctaaccttcactctaataacaattcatccaatggataaattggaactagt

SEQ ID NO: 261343 - DNA, 75 bp, Artificial Sequence
  Synthetic
caatgatggcctcaatattattgactttattcagaagaaccaaaaagaaatacagaagacatacggacgatcaag

SEQ ID NO: 261344 - DNA, 75 bp, Artificial Sequence
  Synthetic
tacagaagacatacggacgatcaagtattcaacaacccagcatcaaagatcaaacaaaagcctgggaagattttc

SEQ ID NO: 261345 - DNA, 75 bp, Artificial Sequence
  Synthetic
acaagttgaggggggaatgtctaaggatgatggagatgttgaaagaagaaacttggaggatctatccagtacttc

SEQ ID NO: 261346 - DNA, 75 bp, Artificial Sequence
  Synthetic
tcccacagatggaactattggaaagagagtgtcgaacacccgtgactgggcagaaggttcagatgacatacaact

SEQ ID NO: 261347 - DNA, 75 bp, Artificial Sequence
  Synthetic
ggacccagtggttacagacgttgtataccatgatcatggaggagaatgtaccggatatggatttacttcaagccc

SEQ ID NO: 261348 - DNA, 75 bp, Artificial Sequence
  Synthetic
ccggatatggatttacttcaagccctgagagagggtggagtgattacacatcaggagcaaacaatgggaatgtat

SEQ ID NO: 261349 - DNA, 75 bp, Artificial Sequence
  Synthetic
gtcttgtatctgatgcaaagatgctgtcctatgctcccgaaattgcagtttctaaagaagatcgggaaactgatc

SEQ ID NO: 261350 - DNA, 75 bp, Artificial Sequence
  Synthetic
tagttcatcttgagaataaactatctactacaggactgaatcccacagcagtaccgttcactctgagaaacctgt

SEQ ID NO: 261351 - DNA, 75 bp, Artificial Sequence
  Synthetic
ctgatcctgcaaaagactctcctgtgattgctgaacactactacggactaggagttaaagagcaaaacgttggcc

SEQ ID NO: 261352 - DNA, 75 bp, Artificial Sequence
  Synthetic
ctcagactagcagaaatgtcaatttggacagcatcaaattgtacacatcagatgacgaagaggcagatcagcttg

SEQ ID NO: 261353 - DNA, 75 bp, Artificial Sequence
  Synthetic
aattcgaagatgagtttgcaggaagctcaagtgaagtgatagtcggcatttctcctgaagatgaagagccttcaa

SEQ ID NO: 261354 - DNA, 75 bp, Artificial Sequence
  Synthetic
gtgttggcggaaaacccaatgaatccattggacgtacaatcgaaggccaatcaatccgagacaaccttcaagcca

SEQ ID NO: 261355 - DNA, 75 bp, Artificial Sequence
  Synthetic
aggacaacaaatcaacagatgtaccaggagcaggaccgaaagattcagcagtgaaggaagaaccaccccagaaga

SEQ ID NO: 261356 - DNA, 75 bp, Artificial Sequence
  Synthetic
ggctacctatgttagctgaagaatttgagtgctctggatcggaagacccaatcattcgggagctgctgaaggaga

SEQ ID NO: 261357 - DNA, 75 bp, Artificial Sequence
  Synthetic
actcactcataaattgtcagcaagggaaagatgctcagcctccatatcattggagcatcgagaggtcaataagcc

SEQ ID NO: 261358 - DNA, 75 bp, Artificial Sequence
  Synthetic
cggataaaactgagatcgtcaacggtgctgtgcaaactgctgacaggcaaagaccaggaactccgatgccaaagt

SEQ ID NO: 261359 - DNA, 75 bp, Artificial Sequence
  Synthetic
tgctgtgcaaactgctgacaggcaaagaccaggaactccgatgccaaagtcccgaggtattcccattaaaaaggg

SEQ ID NO: 261360 - DNA, 75 bp, Artificial Sequence
  Synthetic
cacagacgcgaaatatccatctgctgggacggaaaacgtgcctgggtcgaagagtggtgcaacccggcatgttcg

SEQ ID NO: 261361 - DNA, 75 bp, Artificial Sequence
  Synthetic
agagtggtgcaacccggcatgttcgaggatcacccccctaccaagaaggcaagagtgtcaatgcggagaatgtcc

SEQ ID NO: 261362 - DNA, 75 bp, Artificial Sequence
  Synthetic
aactgaatgcttccactgcggttaaggaaactgataagtcagaagtaaaccccgtagacgacaacgactcacttg

SEQ ID NO: 261363 - DNA, 75 bp, Artificial Sequence
  Synthetic
atgataaatacatcatgccttcagatgatttctcaaacactttcttcccgcacgacactgatcgcttgaattatc

SEQ ID NO: 261364 - DNA, 75 bp, Artificial Sequence
  Synthetic
acgcagatcatttaggtgattatgaccttgaaaccctgtgtgaagagtcggttctaatgggagtgatcaactcta

SEQ ID NO: 261365 - DNA, 75 bp, Artificial Sequence
  Synthetic
taaaattaattaatctggatatgcgcttaaatcacattgaagaacaagttaaagagatcccaaagatcatcaata

SEQ ID NO: 261366 - DNA, 75 bp, Artificial Sequence
  Synthetic
agcttgagtccattgacagagttctggccaagactaacaccgcactctcaaccattgaaggacacctggtttcca

SEQ ID NO: 261367 - DNA, 75 bp, Artificial Sequence
  Synthetic
tgatgataatgataccagggaaagggaaaggagaaagaaaggggaaaaataatcctgagcttaaaccagtgatag

SEQ ID NO: 261368 - DNA, 75 bp, Artificial Sequence
  Synthetic
gaagagacattctagagcagcaatctcttttttcttttgacaatgtcaagaatttcagagatggatcgttgacaa

SEQ ID NO: 261369 - DNA, 75 bp, Artificial Sequence
  Synthetic
acgaaccgtatggggcagctgtacagttgagagaagatcttattcttcctgaacttaattttgaggagacaaatg

SEQ ID NO: 261370 - DNA, 75 bp, Artificial Sequence
  Synthetic
catctcaatttgttcctatggcagatgattcatccagagatgttatcaagacattgataaggactcacattaaag

SEQ ID NO: 261371 - DNA, 75 bp, Artificial Sequence
  Synthetic
atagagagttgagatcagaactgattggttacctgaataaagcggaaaatgatgaggaaattcaggagatagcga

SEQ ID NO: 261372 - DNA, 75 bp, Artificial Sequence
  Synthetic
acactgtcaatgacatcattgacggtaatatttgatcactgaattgtcagcagaaatacaatgatctaacaacaa

SEQ ID NO: 261373 - DNA, 75 bp, Artificial Sequence
  Synthetic
tctcccacaagtagacaatggtttcaggtcaataataacaacctcaatactaatctttcacataagcattactca

SEQ ID NO: 261374 - DNA, 75 bp, Artificial Sequence
  Synthetic
ttccagccctcagacgataacacaatacttgatacatgtttattgaagtgtatgtagcatgattgaactattcaa

SEQ ID NO: 261375 - DNA, 75 bp, Artificial Sequence
  Synthetic
taactgtatttctcactcttgctcttagttagtcattgtgtctaataattattattacagtacaaggtattatga

SEQ ID NO: 261376 - DNA, 75 bp, Artificial Sequence
  Synthetic
attcaaagatacgcaataaatctgatatcagcatagagtagaaaattgttgtttttgtcatgatcattcgaagat

SEQ ID NO: 261377 - DNA, 75 bp, Artificial Sequence
  Synthetic
ttaacaatgatgtcaactttcatacctaaacataataacataaaatggtcgatttgtattgtagatctctcacgc

SEQ ID NO: 261378 - DNA, 75 bp, Artificial Sequence
  Synthetic
attttagtgtcatgaattagtgtttcaaatcagttgcatatcaattaagaaaaacttaggagacaggtatagaac

SEQ ID NO: 261379 - DNA, 75 bp, Artificial Sequence
  Synthetic
ctctctttcagataactggtcaattaaggacagaaattctgtttctcaaatccgctagcctttgtcaaagaggac

SEQ ID NO: 261380 - DNA, 75 bp, Artificial Sequence
  Synthetic
acaagcaatggagccggacatcaagagtatttcaagtgagtcaatggaaggagtatctgatttcagccctagttc

SEQ ID NO: 261381 - DNA, 75 bp, Artificial Sequence
  Synthetic
ttgggagcatggtgggtatcttgataaggttgaaccagaaattgatgaaaatggcagtatgattccaaaatacaa

SEQ ID NO: 261382 - DNA, 75 bp, Artificial Sequence
  Synthetic
gatctataccccaggagctaacgagaggaaatacaacaactacatgtaccttatatgttacggctttgttgaaga

SEQ ID NO: 261383 - DNA, 75 bp, Artificial Sequence
  Synthetic
tgttgagagaaccccagagacagggaaacgcaagaagatcaggacaattgctgcctaccctctgggtgttggtaa

SEQ ID NO: 261384 - DNA, 75 bp, Artificial Sequence
  Synthetic
gagtgcctctcatccccaagatcttctggaggaactctgttccctcaaagttactgtgagaagaacagctggatc

SEQ ID NO: 261385 - DNA, 75 bp, Artificial Sequence
  Synthetic
aactgagaaaattgtgtttggatcatctggccctctaaatcacctcgttccgtggaagaaagtactgactagtgg

SEQ ID NO: 261386 - DNA, 75 bp, Artificial Sequence
  Synthetic
ttcaatttttaatgcagtcaaggtttgtcggaacgttgatcagatacagcttgacaagcatcaagctctgagaat

SEQ ID NO: 261387 - DNA, 75 bp, Artificial Sequence
  Synthetic
attttttctcagtatcacaaagctcaatgattctggaatctacatgattccacgaaccatgcttgagttcaggag

SEQ ID NO: 261388 - DNA, 75 bp, Artificial Sequence
  Synthetic
aaacaatgccattgccttcaatcttctagtgtacttgaagattgatgctgatttatccaaaatggggatccaggg

SEQ ID NO: 261389 - DNA, 75 bp, Artificial Sequence
  Synthetic
aagcctcgataaagatggcttcaaggttgcctccttcatgctacacttggggaactttgtccgtcgtgcagggaa

SEQ ID NO: 261390 - DNA, 75 bp, Artificial Sequence
  Synthetic
gtattactctgttgattattgtaggaggaagattgataggatgaaattgcagttttcactgggttccataggcgg

SEQ ID NO: 261391 - DNA, 75 bp, Artificial Sequence
  Synthetic
actaagtctccacattaagatcaatggtgtaatcagcaaacggctgtttgctcaaatgggattccaaaaaaacct

SEQ ID NO: 261392 - DNA, 75 bp, Artificial Sequence
  Synthetic
ttgtttctctttgatggacatcaatccttggctcaacagattgacctggaacaacagttgtgagatcagccgagt

SEQ ID NO: 261393 - DNA, 75 bp, Artificial Sequence
  Synthetic
agcagctgtgttgcagccttctattccaagagagttcatgatctatgatgatgtcttcattgacaatacagggag

SEQ ID NO: 261394 - DNA, 75 bp, Artificial Sequence
  Synthetic
aattctaaagggctaaacagaattcttctaaaatttaatcagtcatgagtttagtaatcatacctagtcataata

SEQ ID NO: 261395 - DNA, 75 bp, Artificial Sequence
  Synthetic
catcacacaggactatttacaaaagacagttaaaaaatggaataatcatgtagtagtaattgagaacattattag

SEQ ID NO: 261396 - DNA, 75 bp, Artificial Sequence
  Synthetic
aatagtataactaaaatgtagtttttttgagtatttgatttaaaattagataactattacaaaaaacttaggagc

SEQ ID NO: 261397 - DNA, 75 bp, Artificial Sequence
  Synthetic
caagctcttgcctcgttcagaaggttaaacaagcattcttaccattggatcaacaaaaggattggttttatcgtc

SEQ ID NO: 261398 - DNA, 75 bp, Artificial Sequence
  Synthetic
taagaaatttattgaaaggcaaagaaattcctggttttatgttgaatgaggtgtatcaaactaaggagaccttct

SEQ ID NO: 261399 - DNA, 75 bp, Artificial Sequence
  Synthetic
aacagccaggtcataggaatataaataaaaataagaataaaattgattccatcggaagattcatttcaagaagtg

SEQ ID NO: 261400 - DNA, 75 bp, Artificial Sequence
  Synthetic
atcaaatcaaagcggttggcagacctaccaatcatataccacaagactcgacaatggtagttatacttgacaaga

SEQ ID NO: 261401 - DNA, 75 bp, Artificial Sequence
  Synthetic
gatgttattgtaatcttttaatattgattttgatgatctcggagtgtagtgttgggattctacattatgagaaat

SEQ ID NO: 261402 - DNA, 75 bp, Artificial Sequence
  Synthetic
tgagtaaaattggacttgtcaaaggagtaacaagaaaatacaagattaaaagcaatcctctcacaaaagacattg

SEQ ID NO: 261403 - DNA, 75 bp, Artificial Sequence
  Synthetic
ttataaaaatgattccgaatgtgtcgaacatgtctcagtgcacagggagtgtcatggaaaattataaaacacgat

SEQ ID NO: 261404 - DNA, 75 bp, Artificial Sequence
  Synthetic
taaacggtatcttaacacctataaagggagcgttagagatctacaaaaacaacactcatgaccttgtcggtgatg

SEQ ID NO: 261405 - DNA, 75 bp, Artificial Sequence
  Synthetic
tgagattagccggagttataatggcaggagttgctattgggattgcaaccgcagctcaaatcactgcaggtgtag

SEQ ID NO: 261406 - DNA, 75 bp, Artificial Sequence
  Synthetic
cactatatgaggcaatgaagaatgctgacaacatcaacaaactcaaaagcagcattgaatcaactaatgaagctg

SEQ ID NO: 261407 - DNA, 75 bp, Artificial Sequence
  Synthetic
tcgttaaacttcaagagactgcagaaaagacagtctatgtgctgactgctctacaggattacattaatactaatt

SEQ ID NO: 261408 - DNA, 75 bp, Artificial Sequence
  Synthetic
tagtaccgacaattgacaagataagctgcaaacagacagaactctcactagatctggcattatcaaagtacctct

SEQ ID NO: 261409 - DNA, 75 bp, Artificial Sequence
  Synthetic
ctgatttgctttttgtatttggccccaaccttcaagacccagtttctaattcaatgactatacaggctatatctc

SEQ ID NO: 261410 - DNA, 75 bp, Artificial Sequence
  Synthetic
caaccttcaagacccagtttctaattcaatgactatacaggctatatctcaggcattcggtggaaattatgaaac

SEQ ID NO: 261411 - DNA, 75 bp, Artificial Sequence
  Synthetic
aggcattcggtggaaattatgaaacactgctaagaacattgggttacgctacagaagactttgatgatcttctag

SEQ ID NO: 261412 - DNA, 75 bp, Artificial Sequence
  Synthetic
aaagtgacagcataacaggtcaaatcatctatgttgatctaagtagctactatataattgtcagggtttattttc

SEQ ID NO: 261413 - DNA, 75 bp, Artificial Sequence
  Synthetic
ctattctgactgaaattcaacaggcctatatccaagagttgttaccagtgagcttcaacaatgataattcagaat

SEQ ID NO: 261414 - DNA, 75 bp, Artificial Sequence
  Synthetic
ggatcagtattgtcccaaatttcatattggtaaggaatacattaatatcaaatatagagattggattttgcctaa

SEQ ID NO: 261415 - DNA, 75 bp, Artificial Sequence
  Synthetic
ttacaaagaggagcgtgatctgcaaccaagattatgccacacctatgaccaacaacatgagagaatgtttaacgg

SEQ ID NO: 261416 - DNA, 75 bp, Artificial Sequence
  Synthetic
gatcgactgagaagtgtcctcgagagctggttgtttcatcacatgttcccagatttgcactatctaacggggttc

SEQ ID NO: 261417 - DNA, 75 bp, Artificial Sequence
  Synthetic
tgtttgccaattgcataagtgttacatgtcagtgtcaaacaacaggcagggcaatctcacaatcaggagaacaaa

SEQ ID NO: 261418 - DNA, 75 bp, Artificial Sequence
  Synthetic
ctctgctgatgattgacaacaccacctgtcctacagccgtactcggtaatgtgattatcagcttagggaaatatc

SEQ ID NO: 261419 - DNA, 75 bp, Artificial Sequence
  Synthetic
tggggtcagtaaattataattctgaaggcattgctatcggtcctccagtctttacagataaagttgatatatcaa

SEQ ID NO: 261420 - DNA, 75 bp, Artificial Sequence
  Synthetic
gtcagatatccagcatgaatcagtccttacaacagtctaaggactatatcaaagaggctcaacgactccttgata

SEQ ID NO: 261421 - DNA, 75 bp, Artificial Sequence
  Synthetic
ctgttaatccatcattaataagcatgttgtctatgatcatactgtatgtattatcgatcgcatcgttgtgtatag

SEQ ID NO: 261422 - DNA, 75 bp, Artificial Sequence
  Synthetic
ggttgattacatttatcagttttatcattgttgagaaaaagagaaacacctacagcagattagaggataggagag

SEQ ID NO: 261423 - DNA, 75 bp, Artificial Sequence
  Synthetic
tcagacctacaagcagtggggatctctactacattgggacatagtgtattcagattgatgaaattatgttagaga

SEQ ID NO: 261424 - DNA, 75 bp, Artificial Sequence
  Synthetic
aatcagaaaacttctgactttcagaaatggattgtatacaattagttagatcatcctgaataatcgaggtgagaa

SEQ ID NO: 261425 - DNA, 75 bp, Artificial Sequence
  Synthetic
cattgcaactataaaatcagatcatgtaaatagttgtaaaaaattaaaagcttcttttaattcttttgaacaata

SEQ ID NO: 261426 - DNA, 75 bp, Artificial Sequence
  Synthetic
atttaattaatatataacatattctctcacacgagcgctaacctatacactctctactaatattttatactcata

SEQ ID NO: 261427 - DNA, 75 bp, Artificial Sequence
  Synthetic
attaatgatataatgacaaataaggattcaaattggattatgatatagtttcatactacaatagcatttcgacca

SEQ ID NO: 261428 - DNA, 75 bp, Artificial Sequence
  Synthetic
agaaaatatccttacaattatacaatgtacttaaccgtgaatatgtaattgataatttccctttagaaatttaat

SEQ ID NO: 261429 - DNA, 75 bp, Artificial Sequence
  Synthetic
aaaaaacttaggacccaggtccataactcattggatacttaactgtatctttctaagctatcacatatcaaagga

SEQ ID NO: 261430 - DNA, 75 bp, Artificial Sequence
  Synthetic
gagattgaatgcttttttggagatctagatcattactatatgtgtctcctataatcacatcataggagtgaacca

SEQ ID NO: 261431 - DNA, 75 bp, Artificial Sequence
  Synthetic
tagatcattactatatgtgtctcctataatcacatcataggagtgaaccataatacacatctttgggtaggggaa

SEQ ID NO: 261432 - DNA, 75 bp, Artificial Sequence
  Synthetic
ggaaagtattgttgacgtactgattgatctgcttgagtcaaataatcagtcataacaattcaagaaaatgccggc

SEQ ID NO: 261433 - DNA, 75 bp, Artificial Sequence
  Synthetic
cataacaattcaagaaaatgccggcagaaaacaagaaagttagattcgaaaatactacttcagacaaagggaaaa

SEQ ID NO: 261434 - DNA, 75 bp, Artificial Sequence
  Synthetic
aaatattaagtgctttcaacacagtaatagcattgcttggatctatcgtgatcatagtgatgaatataatgatca

SEQ ID NO: 261435 - DNA, 75 bp, Artificial Sequence
  Synthetic
tccaaaattacacaagatcaacagacaatcaggccgtgatcaaagatgcgttgcagggtatccaacagcagatca

SEQ ID NO: 261436 - DNA, 75 bp, Artificial Sequence
  Synthetic
aagggcttgctgacaaaatcggcacagagatagggcccaaagtatcactgattgacacatccagtaccattacta

SEQ ID NO: 261437 - DNA, 75 bp, Artificial Sequence
  Synthetic
attgacacatccagtaccattactatcccagctaacattgggctgttaggttcaaagatcagccagtcgactgca

SEQ ID NO: 261438 - DNA, 75 bp, Artificial Sequence
  Synthetic
agtataaatgagaatgtgaatgaaaaatgcaaattcacactgcctcccttgaaaatccacgaatgtaacatttct

SEQ ID NO: 261439 - DNA, 75 bp, Artificial Sequence
  Synthetic
aatgcaaattcacactgcctcccttgaaaatccacgaatgtaacatttcttgtcctaacccactcccttttagag

SEQ ID NO: 261440 - DNA, 75 bp, Artificial Sequence
  Synthetic
tgtcctaacccactcccttttagagagtataggccacagacagaaggggtgagcaatctagtaggattacctaat

SEQ ID NO: 261441 - DNA, 75 bp, Artificial Sequence
  Synthetic
aatatttgcctgcaaaagacatctaatcagatattgaagccaaagctgatttcatacactttacccgtagtcggt

SEQ ID NO: 261442 - DNA, 75 bp, Artificial Sequence
  Synthetic
caaagtggtacctgtatcacagacccattgctggctatggacgagggctattttgcatatagccacctggaaaga

SEQ ID NO: 261443 - DNA, 75 bp, Artificial Sequence
  Synthetic
atcggatcatgttcaagaggggtctccaaacaaagaataataggagttggagaggtactagacagaggtgatgaa

SEQ ID NO: 261444 - DNA, 75 bp, Artificial Sequence
  Synthetic
gttccttctttatttatgaccaatgtctggaccccaccaaatccaaacaccgtttaccactgtagtgctgtatac

SEQ ID NO: 261445 - DNA, 75 bp, Artificial Sequence
  Synthetic
aacaatgaattctattatgtactttgtgcagtgtcaactgttggagaccctattctgaatagcacctactggtcc

SEQ ID NO: 261446 - DNA, 75 bp, Artificial Sequence
  Synthetic
ggatctctaatgatgacccgtctagctgtgaaacccaagagtaatggtgggggttacaatcaacatcaacttgcc

SEQ ID NO: 261447 - DNA, 75 bp, Artificial Sequence
  Synthetic
ctacgaagtatcgagaaagggaggtatgataaagttatgccgtatggaccttcaggcatcaaacagggtgacacc

SEQ ID NO: 261448 - DNA, 75 bp, Artificial Sequence
  Synthetic
ctgtattttcctgctgtaggatttttggtcaggacagagtttaaatacaatgattcaaattgtcccatcacgaag

SEQ ID NO: 261449 - DNA, 75 bp, Artificial Sequence
  Synthetic
tgtcaatacagtaaacctgaaaattgcaggctatctatggggattagaccaaacagccattatatccttcgatct

SEQ ID NO: 261450 - DNA, 75 bp, Artificial Sequence
  Synthetic
aaacagccattatatccttcgatctggactattaaaatacaatctatcagatggggagaaccccaaagttgtatt

SEQ ID NO: 261451 - DNA, 75 bp, Artificial Sequence
  Synthetic
cattgaaatatctgatcaaagattatctattggatctcctagcaaaatctatgattctttgggtcaacctgtttt

SEQ ID NO: 261452 - DNA, 75 bp, Artificial Sequence
  Synthetic
ctaccaagcgtcattttcatgggatactatgattaaatttggagatgttctaacagtcaaccctctggttgtcaa

SEQ ID NO: 261453 - DNA, 75 bp, Artificial Sequence
  Synthetic
ttggcgtaataacacggtaatatcaagacccgggcaatcacaatgccctagattcaatacatgtccagagatctg

SEQ ID NO: 261454 - DNA, 75 bp, Artificial Sequence
  Synthetic
ctgggaaggagtttataatgatgcattcctaattgacagaatcaattggataagcgcgggtgtattccttgacag

SEQ ID NO: 261455 - DNA, 75 bp, Artificial Sequence
  Synthetic
caatcagaccgcagaaaatcctgtttttactgtattcaaagataatgaaatactttatagggcacaactggcttc

SEQ ID NO: 261456 - DNA, 75 bp, Artificial Sequence
  Synthetic
tgaggacaccaatgcacaaaaaacaataactaattgttttctcttgaagaataagatttggtgcatatcattggt

SEQ ID NO: 261457 - DNA, 75 bp, Artificial Sequence
  Synthetic
tgagatatatgacacaggagacaatgtcataagacccaaactattcgcggttaagataccagagcaatgtacata

SEQ ID NO: 261458 - DNA, 75 bp, Artificial Sequence
  Synthetic
aaaatcaacctcataatttaatggattgatctaatataatgataataatcgtacaaagacatgtgatgtaaacaa

SEQ ID NO: 261459 - DNA, 75 bp, Artificial Sequence
  Synthetic
aattgttgtaattaaataagtcctcagctgaatacttttttaagattagcaatagcatgtttttccagttattgg

SEQ ID NO: 261460 - DNA, 75 bp, Artificial Sequence
  Synthetic
atagttgataatataattctgaaactgggttaataaataatcttgatcggtgatctttgagaacaatgatatcat

SEQ ID NO: 261461 - DNA, 75 bp, Artificial Sequence
  Synthetic
atagttcatcaagtgataatcaattctttatatgtacactttagagtatattttgagacttagtattttcggccc

SEQ ID NO: 261462 - DNA, 75 bp, Artificial Sequence
  Synthetic
gaatgttaaatttaatagttcatacataacctaaactcaagttctaagcataatgataacaattaatgcgaactt

SEQ ID NO: 261463 - DNA, 75 bp, Artificial Sequence
  Synthetic
gtcttgatgtaaggaagatttgatattaactgagactccacttgatatagtagagctgaatcttgtaaataaatt

SEQ ID NO: 261464 - DNA, 75 bp, Artificial Sequence
  Synthetic
ataatgaatagtttattcaaagattatcattcatattagtgtaaattaagaaaaacttaggacccaggtccttga

SEQ ID NO: 261465 - DNA, 75 bp, Artificial Sequence
  Synthetic
ttatgccaattttctcgagaaatcattcaattgaccatagactgaaagcgttgttacctagttcttcagaagaga

SEQ ID NO: 261466 - DNA, 75 bp, Artificial Sequence
  Synthetic
tcttattagaattaatttatatgatctaattcccttaaaaactgaataccaaaaaacaaaaatggccgatgaatt

SEQ ID NO: 261467 - DNA, 75 bp, Artificial Sequence
  Synthetic
ctaattcccttaaaaactgaataccaaaaaacaaaaatggccgatgaattatcaatatccgacatcatttaccct

SEQ ID NO: 261468 - DNA, 75 bp, Artificial Sequence
  Synthetic
gaatgtcatttggatagtcctatagtctctggtaaactaatatcagctattgaatatgctcaattgagacacaat

SEQ ID NO: 261469 - DNA, 75 bp, Artificial Sequence
  Synthetic
cagcccagtgatgataaaagactgtctgagaatattaggttaaaccttcacgggaaaagaaagagtctatacata

SEQ ID NO: 261470 - DNA, 75 bp, Artificial Sequence
  Synthetic
ttaagacaatccaaacagggtgattacattagaaacaacataaaaaacctaaaggaattcatgcatattgcgtac

SEQ ID NO: 261471 - DNA, 75 bp, Artificial Sequence
  Synthetic
cctgaatgcaataacattctattctccatcacatcccaaggcatgactagcaaacttgataacatcatgaaaaag

SEQ ID NO: 261472 - DNA, 75 bp, Artificial Sequence
  Synthetic
tcattcaaagcatacaatatcattagtaagaaagtaattgggatgctgcaaaatatcactagaaatctcataact

SEQ ID NO: 261473 - DNA, 75 bp, Artificial Sequence
  Synthetic
caagatagaagagatgaaataattaatatacatgagtgtaggcgattaggggatttagggaagaatatgagtcaa

SEQ ID NO: 261474 - DNA, 75 bp, Artificial Sequence
  Synthetic
tttggtttactatcaaaacagagatgcgagcagtgatcaagaattcgcaaaagccgaaattccgttcagattcat

SEQ ID NO: 261475 - DNA, 75 bp, Artificial Sequence
  Synthetic
aagccgaaattccgttcagattcatgcataatacacatgcgagacaaaagtactgaaataatcctaaatccgaat

SEQ ID NO: 261476 - DNA, 75 bp, Artificial Sequence
  Synthetic
cttatctgcattttcaaatcagacaaaactggaaagaagtgttattatcttacacccgaaatggttctaatgtat

SEQ ID NO: 261477 - DNA, 75 bp, Artificial Sequence
  Synthetic
tgtgatgtcctagagggaaggatgatgatggagacaacagtcaaatcggatatcaagtaccaacctctaatctcg

SEQ ID NO: 261478 - DNA, 75 bp, Artificial Sequence
  Synthetic
agatccaatgccctctgggggctaattgatcccttgttccctgtcatgggaaacagaatttacaatatagtgtct

SEQ ID NO: 261479 - DNA, 75 bp, Artificial Sequence
  Synthetic
atgatagagcctttagttcttgcactactccaactcaaggatgaggctaggatcctgaggggtgcatttctgcat

SEQ ID NO: 261480 - DNA, 75 bp, Artificial Sequence
  Synthetic
cactgcataaaggaaatgcatcaagaattgagtgagtgtggttttacagatcagaagattcggtctatgtttatt

SEQ ID NO: 261481 - DNA, 75 bp, Artificial Sequence
  Synthetic
gatgatcttttatccattctaaatatcgataatatacatctgttggcagagttcttttctttctttcgtacgttt

SEQ ID NO: 261482 - DNA, 75 bp, Artificial Sequence
  Synthetic
gttcttttctttctttcgtacgtttggccatcctattcttgaggctaaagttgctgcagaaaaagtgagagaaca

SEQ ID NO: 261483 - DNA, 75 bp, Artificial Sequence
  Synthetic
tatgttggcagataaagttcttgaatatgcccctataatgaaagcacatgctatattctgcgggactataataaa

SEQ ID NO: 261484 - DNA, 75 bp, Artificial Sequence
  Synthetic
tgggtatagggatagacacggaggagcctggcctcctctttacctccccgcacatgcatctaaacatataatccg

SEQ ID NO: 261485 - DNA, 75 bp, Artificial Sequence
  Synthetic
tttgaaaaattctggggaatctttgaccattgatgactgtgtcaagaattgggaatcattctgtgggattcaatt

SEQ ID NO: 261486 - DNA, 75 bp, Artificial Sequence
  Synthetic
tgattgtttcatggagctgaaattggacagtgatctgagtatgtatatgaaagataaagctttatctccaatcaa

SEQ ID NO: 261487 - DNA, 75 bp, Artificial Sequence
  Synthetic
agacgaatgggacagtgtatacccacgtgaagtgttgagctataccccaccgaagtcaaccgagccaagaagatt

SEQ ID NO: 261488 - DNA, 75 bp, Artificial Sequence
  Synthetic
ggttgacgtttttgtaaatgatgaaaactttgatccatacaacatgctggaatatgtcttatccggtgcttatct

SEQ ID NO: 261489 - DNA, 75 bp, Artificial Sequence
  Synthetic
cgaggatgaacaattcaatgtttcttatagcttgaaggagaaagagacgaagcaagctggacgattgttcgcaaa

SEQ ID NO: 261490 - DNA, 75 bp, Artificial Sequence
  Synthetic
gatgacctacaaaatgcgtgcatgtcaagtcatagcagaggccctgatagcctcaggtgtcggtaaatattttaa

SEQ ID NO: 261491 - DNA, 75 bp, Artificial Sequence
  Synthetic
ggagaacgggatggttaaggatgagcacgaacttttgaagacactcttccaattgtctatttcctcagttcctcg

SEQ ID NO: 261492 - DNA, 75 bp, Artificial Sequence
  Synthetic
agggaacagtcagggtaatgatcctcaatccatcaataatatagaaagagatttccaatactttaaaggggtcac

SEQ ID NO: 261493 - DNA, 75 bp, Artificial Sequence
  Synthetic
taccaatgtgaaagacaaaaagaataactcttttaataaggttaaatctgctctcaataatccgtgccaagctga

SEQ ID NO: 261494 - DNA, 75 bp, Artificial Sequence
  Synthetic
cggagtccatcataacatgtcacccaatacacgaaatcgttataagtgtagtaatacaagtaagtcttttctcga

SEQ ID NO: 261495 - DNA, 75 bp, Artificial Sequence
  Synthetic
ttatcataccgagtttaatcctcacaatcactataaatcagacaatacagaggcggccgtactgtccaggtatga

SEQ ID NO: 261496 - DNA, 75 bp, Artificial Sequence
  Synthetic
ggacaacactgggacaaaatttgatacagtaagtgcatttcttacaactgatcttaagaaattctgtctcaattg

SEQ ID NO: 261497 - DNA, 75 bp, Artificial Sequence
  Synthetic
gagatacgaatcaatggctatatttgctgaacgtctggatgagatatacggtttacctggattttttaattggat

SEQ ID NO: 261498 - DNA, 75 bp, Artificial Sequence
  Synthetic
gcacaaacgactagaaagatctgttatctatgttgcagaccctaattgcccccctaatattgacaaacatatgga

SEQ ID NO: 261499 - DNA, 75 bp, Artificial Sequence
  Synthetic
atctatgttgcagaccctaattgcccccctaatattgacaaacatatggaactagaaaaaactcctgaagatgat

SEQ ID NO: 261500 - DNA, 75 bp, Artificial Sequence
  Synthetic
atattcattcattatcctaaaggcggtattgaaggatatagccaaaaaacatggactatagcaactatccccttt

SEQ ID NO: 261501 - DNA, 75 bp, Artificial Sequence
  Synthetic
ttattcttgagtgcctatgagacaaacacgaggattgctgcaattgtccaaggagacaatgaatcaattgctatc

SEQ ID NO: 261502 - DNA, 75 bp, Artificial Sequence
  Synthetic
actcaaaaagttcatcctaatcttccctacaaggtaaagaaagagatctgtgcaaagcaagctcagctttatttt

SEQ ID NO: 261503 - DNA, 75 bp, Artificial Sequence
  Synthetic
gaaaggttaaggatgaacttaagagccctcggccacaatcttaaagctacagaaactatcatcagtacacatctt

SEQ ID NO: 261504 - DNA, 75 bp, Artificial Sequence
  Synthetic
tttatttattcgaagaaaattcattatgatggtgctgtgctgtctcaggcactcaaatcaatgtcaagatgttgc

SEQ ID NO: 261505 - DNA, 75 bp, Artificial Sequence
  Synthetic
ttttggtcagagactctggtggatgaaactagatcagcttgtagtaacatcagcactacaatagctaaagctata

SEQ ID NO: 261506 - DNA, 75 bp, Artificial Sequence
  Synthetic
gaaaatgggttgtcaagaaatgtcggctattgcatcaatattttgaaagtaattcagcagcttctcatatcaact

SEQ ID NO: 261507 - DNA, 75 bp, Artificial Sequence
  Synthetic
gagtttagtattaacgagacattgacactggatgtgacatctcccatttcaaataatttagattggcttataaca

SEQ ID NO: 261508 - DNA, 75 bp, Artificial Sequence
  Synthetic
gctgcattaatcccggcacctattggaggattcaattaccttaatttgtctagaatttttgttagaaatataggt

SEQ ID NO: 261509 - DNA, 75 bp, Artificial Sequence
  Synthetic
gatccggttacagcatctttggctgatcttaagagaatgattgatcacagtattatgactgaaagcgtattacaa

SEQ ID NO: 261510 - DNA, 75 bp, Artificial Sequence
  Synthetic
aaagttatgaatcaagaacctggtgatgcgagtttcttggactgggccagtgatccatactcgggcaacttgcct

SEQ ID NO: 261511 - DNA, 75 bp, Artificial Sequence
  Synthetic
gactcacaaagcatcactaaaacaattaaaaatatcacagcaaggactatactgaggaactcaccgaacccaatg

SEQ ID NO: 261512 - DNA, 75 bp, Artificial Sequence
  Synthetic
ctaaaaggtttatttcatgacaaatcttttgatgaagatcttgaactagctagcttcttaatggacaggagggtt

SEQ ID NO: 261513 - DNA, 75 bp, Artificial Sequence
  Synthetic
atattacctagagccgctcatgagatactggataattcattgacaggtgccagagaggaaattgctggtttatta

SEQ ID NO: 261514 - DNA, 75 bp, Artificial Sequence
  Synthetic
gatacaactaaaggcttgatcagatcagggctaagaaagagtggacttcagccaaagttagtttctagattatct

SEQ ID NO: 261515 - DNA, 75 bp, Artificial Sequence
  Synthetic
catcatgattataatcaatttttaatactgaacaaacttctatcaaacagaagacaaaatgacttgatatcatca

SEQ ID NO: 261516 - DNA, 75 bp, Artificial Sequence
  Synthetic
aatacttgctcagttgacttggcacgagcattgagatctcacatgtggagggaattagcgttaggtagagtaata

SEQ ID NO: 261517 - DNA, 75 bp, Artificial Sequence
  Synthetic
tacggtcttgaggtaccagatgcacttgaggctatggtgggaaggtatataacagggagcttagagtgccaaatt

SEQ ID NO: 261518 - DNA, 75 bp, Artificial Sequence
  Synthetic
tgtgagcagggaaacacgatgtatgggtggttctttgtacctagggattcccaattggatcaggtagatagagag

SEQ ID NO: 261519 - DNA, 75 bp, Artificial Sequence
  Synthetic
cactcatcaataagagtaccttatgtaggatcaagtacggatgaaagatcggatatcaaactagggaatgtcaaa

SEQ ID NO: 261520 - DNA, 75 bp, Artificial Sequence
  Synthetic
agaccaactaaggccttgcgttctgctatcagaattgcgacagtatatacttgggcctatggggacaatgaagag

SEQ ID NO: 261521 - DNA, 75 bp, Artificial Sequence
  Synthetic
tgttggtatgaagcttggtacctagcgtctcagagggtaaacatagacttagatgtattgaaagctataacccca

SEQ ID NO: 261522 - DNA, 75 bp, Artificial Sequence
  Synthetic
gtttccacttcaaacaatttatcccatagattgagagataaatccacacaatttaagtttgcagggagtgtactc

SEQ ID NO: 261523 - DNA, 75 bp, Artificial Sequence
  Synthetic
aacagagtttctagatatgttaacataagcaatgacaatctagatttcagaattgagggagaaaaggtagatacg

SEQ ID NO: 261524 - DNA, 75 bp, Artificial Sequence
  Synthetic
aatcttatttatcaacaagcaatgctattagggttatcggtattggaaggtaaattcagattgagattagaaact

SEQ ID NO: 261525 - DNA, 75 bp, Artificial Sequence
  Synthetic
gatgattacaacgggatatatcacttacacgtaaaggataattgttgtgtcaaagaagtggctgatgtaggccaa

SEQ ID NO: 261526 - DNA, 75 bp, Artificial Sequence
  Synthetic
gtagacgctgagttgcctatcccagaatatactgaagtggataacaatcatcttatatatgatccagaccccgtt

SEQ ID NO: 261527 - DNA, 75 bp, Artificial Sequence
  Synthetic
tcagaaatagattgcagccgtctttctaatcaggagtccaaatcaagagaattagactttcctttatggtcaact

SEQ ID NO: 261528 - DNA, 75 bp, Artificial Sequence
  Synthetic
ctaatcaggagtccaaatcaagagaattagactttcctttatggtcaactgaggaacttcatgatgtcctagcta

SEQ ID NO: 261529 - DNA, 75 bp, Artificial Sequence
  Synthetic
agactgttgctcagaccgttcttgagattataacaaaggctgacaaggatgttttaaagcaacaccttgcaatag

SEQ ID NO: 261530 - DNA, 75 bp, Artificial Sequence
  Synthetic
actctgacgataacatcaacagcttaatcacagaatttctaatagttgatcctgaactgtttgcactttatctag

SEQ ID NO: 261531 - DNA, 75 bp, Artificial Sequence
  Synthetic
gacaatctatatcaataaaatgggcctttgaaattcatcataggcgtcctagaggaagacatactatggtcgacc

SEQ ID NO: 261532 - DNA, 75 bp, Artificial Sequence
  Synthetic
tattgtcagatcttgtatcaaatacatcaaagcacacttacaaagtgttgtcaaatgccttgtcacatcctagag

SEQ ID NO: 261533 - DNA, 75 bp, Artificial Sequence
  Synthetic
tattcaagagatttgtaaactgtggcttgctattgcctacacagggtccttaccttcatcaacaagattttgaaa

SEQ ID NO: 261534 - DNA, 75 bp, Artificial Sequence
  Synthetic
agttgtctcaaaaccttcttgtaacatcttatatgatttatctaatgaactggtgtgacttcaagaaatccccct

SEQ ID NO: 261535 - DNA, 75 bp, Artificial Sequence
  Synthetic
ttttaatcgccgaacaggatgaaactgtgataagtctacgagaggatataataacatccaaacatctctgtgtta

SEQ ID NO: 261536 - DNA, 75 bp, Artificial Sequence
  Synthetic
taattgacttatatgcaaatcaccataaacctccttggataatagatctaaacccacaagaaaaaatatgtgtac

SEQ ID NO: 261537 - DNA, 75 bp, Artificial Sequence
  Synthetic
tgcgtgactttatttctaaatctaggcatgtggacacgtcctccagatcatggaatacttctgacctggattttg

SEQ ID NO: 261538 - DNA, 75 bp, Artificial Sequence
  Synthetic
taatattctatgcatctttgacttatttgagaagaggtataataaaacaattaaggataagacaagttactgagg

SEQ ID NO: 261539 - DNA, 75 bp, Artificial Sequence
  Synthetic
tttgagaagaggtataataaaacaattaaggataagacaagttactgaggttatagataccacaacaatgttaag

SEQ ID NO: 261540 - DNA, 75 bp, Artificial Sequence
  Synthetic
ggacaatataattgtagagaatcctcctattaaaacaggagtgttagacatcagaggttgtataatatacaattt

SEQ ID NO: 261541 - DNA, 75 bp, Artificial Sequence
  Synthetic
agaggaaatcctgtctatgaacacaaaatcagcatcaaaaaagatctttaatcttaatagtaggccgtcagtgga

SEQ ID NO: 261542 - DNA, 75 bp, Artificial Sequence
  Synthetic
gaatcataaatatagaaggataggtctcaactcatcatcttgttacaaggcattaaatctatcacctctgattca

SEQ ID NO: 261543 - DNA, 75 bp, Artificial Sequence
  Synthetic
aaggtatttgccgtcgggagctcaaaggttgtttataggagaaggttctgggagcatgatgttattatatcagtc

SEQ ID NO: 261544 - DNA, 75 bp, Artificial Sequence
  Synthetic
tacattggggcaatcaatttctttttacaattcaggtatagatggagattatataccaggtcaaagagaactgaa

SEQ ID NO: 261545 - DNA, 75 bp, Artificial Sequence
  Synthetic
actatttccctctgaatactcaattgctgaggaagacccatctctgacggggaaattgaaaggactagtggtgcc

SEQ ID NO: 261546 - DNA, 75 bp, Artificial Sequence
  Synthetic
ggaaattgaaaggactagtggtgcccctattcaatggaagaccagaaacaacatggatcgggaatttagactcct

SEQ ID NO: 261547 - DNA, 75 bp, Artificial Sequence
  Synthetic
acgagtatatcataaataggacagcggggcgaagtataggtcttgtccattctgacatggagtctgggattgaca

SEQ ID NO: 261548 - DNA, 75 bp, Artificial Sequence
  Synthetic
ggggcgaagtataggtcttgtccattctgacatggagtctgggattgacaaaaatgtagaggagatactagtaga

SEQ ID NO: 261549 - DNA, 75 bp, Artificial Sequence
  Synthetic
aaaatgtagaggagatactagtagaacattcccatctaatatctatcgcgataaatgttatgatggaggacggac

SEQ ID NO: 261550 - DNA, 75 bp, Artificial Sequence
  Synthetic
tattagtatccaagatagcatacacccctggattcccaatctcaagattatttaacatgtacagatcatatttcg

SEQ ID NO: 261551 - DNA, 75 bp, Artificial Sequence
  Synthetic
gactagtactggtgtgtttcccagtatatagtaatccagattctactgaagtatatcttctttgcttacagaaga

SEQ ID NO: 261552 - DNA, 75 bp, Artificial Sequence
  Synthetic
cggtcaagactattgttcccccgcaaaaagtccttgagcactctaatttgcacgatgaagtcaatgaccagggaa

SEQ ID NO: 261553 - DNA, 75 bp, Artificial Sequence
  Synthetic
taacatcagtgatttttaaaatcaagaattcacagtctaagcagttccacgatgatctaaagaagtactatcaga

SEQ ID NO: 261554 - DNA, 75 bp, Artificial Sequence
  Synthetic
ttgaccaacctttttttgtaccaactaaaatcactagtgatgaacaagtacttctccaagcagggctgaaactca

SEQ ID NO: 261555 - DNA, 75 bp, Artificial Sequence
  Synthetic
taaaatcactagtgatgaacaagtacttctccaagcagggctgaaactcaatgggccagaaattcttaagagtga

SEQ ID NO: 261556 - DNA, 75 bp, Artificial Sequence
  Synthetic
aatcagttatgatatcggttcagatatcaatacattaagagacaccatcataattatgttaaatgaggctatgaa

SEQ ID NO: 261557 - DNA, 75 bp, Artificial Sequence
  Synthetic
ttattttgatgacaacagatcaccttcacaccacctagaaccctatccagttttggagagaactagaattaaaac

SEQ ID NO: 261558 - DNA, 75 bp, Artificial Sequence
  Synthetic
aataatgaattgtgtgactaaaaaagtgattgtctactcacttatcaagttcaaggacaccaaaagctcagaact

SEQ ID NO: 261559 - DNA, 75 bp, Artificial Sequence
  Synthetic
ttatcacatcaaaaataacatcagaagaaaagttctaatcttagatttcagatcgaagctcatgacaaagactct

SEQ ID NO: 261560 - DNA, 75 bp, Artificial Sequence
  Synthetic
acctaaagggatgcaagagagaagagaaaaaaacggtttcaaagaagtttggatagtagatttatcgaatcgaga

SEQ ID NO: 261561 - DNA, 75 bp, Artificial Sequence
  Synthetic
agttaaaatctggtggaagataatcggatacatatctattatctgatttaaccttccaaatccaagaccaactga

SEQ ID NO: 261562 - DNA, 75 bp, Artificial Sequence
  Synthetic
ctgataacttatgttgatctaaggttcagttattaagaaaaacttaataacgattcttctttacccttgttcggt

SEQ ID NO: 261563 - DNA, 75 bp, Artificial Sequence
  Synthetic
tagatcattactatatgtgtctcctataatcacatcataggagtgagccataatacacatcttcgggtaggagaa

SEQ ID NO: 261564 - DNA, 75 bp, Artificial Sequence
  Synthetic
atcctagtaaagttattaagagctactacggaaccatggacattaagaaaataaatgaaggattattggacagca

SEQ ID NO: 261565 - DNA, 75 bp, Artificial Sequence
  Synthetic
ccgataacgtatgttgatctaaggttcagttattaagaaaaacttaataacgattcttctttacccttgttcggt

SEQ ID NO: 261566 - DNA, 75 bp, Artificial Sequence
  Synthetic
accaaacaagggaaaatatggatacgttaaaatatataacgtatttctaaaacttaggaaccaagacaaacactt

SEQ ID NO: 261567 - DNA, 75 bp, Artificial Sequence
  Synthetic
ttatcaatctaagttaggaagagatgggagggctagtgcggcaactgctactttgacaaccaagataaggatatt

SEQ ID NO: 261568 - DNA, 75 bp, Artificial Sequence
  Synthetic
tgtaccggctactaatagtccagagctcagatgggaactaacattatttgcacttgatgtgatcagatctccgag

SEQ ID NO: 261569 - DNA, 75 bp, Artificial Sequence
  Synthetic
cacttgatgtgatcagatctccgagtgcagccgagtcaatgaaagttggagctgcttttacactcatctctatgt

SEQ ID NO: 261570 - DNA, 75 bp, Artificial Sequence
  Synthetic
attcagagagacccggggccctcattagaagtctcctcaatgacccagacattgaagctgtaataatagatgttg

SEQ ID NO: 261571 - DNA, 75 bp, Artificial Sequence
  Synthetic
gatcaatggtcaacgggataccagtgatggaaaggaggggagacaaagctcaagaggagatggaaggcttgatga

SEQ ID NO: 261572 - DNA, 75 bp, Artificial Sequence
  Synthetic
gaatcctcaagactgctcgggacagcagcaagggaaagacaccttttgttgatagccgagcttatggcctacgga

SEQ ID NO: 261573 - DNA, 75 bp, Artificial Sequence
  Synthetic
taacagacatgagcactctggtctctgcagttatcaccatcgaggcccaaatctggatactgattgccaaagcag

SEQ ID NO: 261574 - DNA, 75 bp, Artificial Sequence
  Synthetic
ttacagctcccgacactgccgaggatagtgaaactagaagatgggctaagtacgttcaacaaaagagagtcaatc

SEQ ID NO: 261575 - DNA, 75 bp, Artificial Sequence
  Synthetic
tacgttcaacaaaagagagtcaatccgttctttgctctaactcaacaatggctaacagagatgagaaatctgctt

SEQ ID NO: 261576 - DNA, 75 bp, Artificial Sequence
  Synthetic
gctaacagagatgagaaatctgctttctcagagtctgtcagtaagaaagtttatggttgagatcctcatcgaagt

SEQ ID NO: 261577 - DNA, 75 bp, Artificial Sequence
  Synthetic
caagaaaggaggatctgctaaaggcagagcagtggaaataatctcagacattggaaactatgtcgaggaaactgg

SEQ ID NO: 261578 - DNA, 75 bp, Artificial Sequence
  Synthetic
ttggaaactatgtcgaggaaactggcatggcaggattcttcgcaaccatcagatttgggttggagacaaggtatc

SEQ ID NO: 261579 - DNA, 75 bp, Artificial Sequence
  Synthetic
tttgcccctggaggttacccgctattgtggagctttgctatgggtgtggctactactattgacaggtctatgggg

SEQ ID NO: 261580 - DNA, 75 bp, Artificial Sequence
  Synthetic
gcattaaacatcaatcgtggttatcttgaacctatgtatttcagactaggccaaaaatcagcacgtcaccatgct

SEQ ID NO: 261581 - DNA, 75 bp, Artificial Sequence
  Synthetic
ggagggattgatcagaacatggcgaatagactaggattaagttcaaatcaagttgcagaactcgctgccgcagtt

SEQ ID NO: 261582 - DNA, 75 bp, Artificial Sequence
  Synthetic
caagaaacatcagcaggaaggcaagagagtaacgttcaggccagagaagctaaatttgctgcaggaggtgtgctc

SEQ ID NO: 261583 - DNA, 75 bp, Artificial Sequence
  Synthetic
agagtaacgttcaggccagagaagctaaatttgctgcaggaggtgtgctcatcggaggcagtgatcaagatgtcg

SEQ ID NO: 261584 - DNA, 75 bp, Artificial Sequence
  Synthetic
acgaagaggaagaacctatagaacagagtggccgacagtcagttactttcaaaagggaaatgagtatttcatctc

SEQ ID NO: 261585 - DNA, 75 bp, Artificial Sequence
  Synthetic
ttgctgacagtgtgccgagcagttctgtgagcacctcaggtgggaccagattgactaattctttgctaaacctca

SEQ ID NO: 261586 - DNA, 75 bp, Artificial Sequence
  Synthetic
aagatcaaagggaatcagaaaagaagaataaccaagatctcaaacccactcaaaatgatcttgactttgtcagag

SEQ ID NO: 261587 - DNA, 75 bp, Artificial Sequence
  Synthetic
gaataaccaagatctcaaacccactcaaaatgatcttgactttgtcagagctgatgtgtgacgcttattttcaat

SEQ ID NO: 261588 - DNA, 75 bp, Artificial Sequence
  Synthetic
attctacaatatccaaaaatctttttataatacactatcataacacaacactaagggaccaattacattaaagtt

SEQ ID NO: 261589 - DNA, 75 bp, Artificial Sequence
  Synthetic
tgcaggtctttggacatgaattacacactacactctaataaagataaaatttatattacatatttaaagactata

SEQ ID NO: 261590 - DNA, 75 bp, Artificial Sequence
  Synthetic
tcctatcctttcaatggtgcttggttacgaaggtttctcaatttaaattagctattgtctttgcactggagtata

SEQ ID NO: 261591 - DNA, 75 bp, Artificial Sequence
  Synthetic
caatacctcttacctcatttcttacttcaatatcatgttatttttttgataagtcacttaacttgaccaagatct

SEQ ID NO: 261592 - DNA, 75 bp, Artificial Sequence
  Synthetic
actaggtaatgctcacataaatgaattgcaatcttaacttagattaaacataatcatgcaaagtcattattttac

SEQ ID NO: 261593 - DNA, 75 bp, Artificial Sequence
  Synthetic
ttgcaatcttaacttagattaaacataatcatgcaaagtcattattttacactactaactcattaagaaaaactt

SEQ ID NO: 261594 - DNA, 75 bp, Artificial Sequence
  Synthetic
aggatccaagagatttactctaggatctcctattaaatttagcagttatcagctgggagttcaacttacaaaact

SEQ ID NO: 261595 - DNA, 75 bp, Artificial Sequence
  Synthetic
agctgggagttcaacttacaaaactctaaccttcactttaataacaattcattcaatggataaattggaactagt

SEQ ID NO: 261596 - DNA, 75 bp, Artificial Sequence
  Synthetic
tacagaagacatacggacgatcaagcattcaacaacccagcatcaaagaccgaacaaaagcatgggaggattttc

SEQ ID NO: 261597 - DNA, 75 bp, Artificial Sequence
  Synthetic
tgcagtgcaccagtggagaatctgaacaagttgaggggggaatgtctaaggatgatggaggtgttgaaagaagaa

SEQ ID NO: 261598 - DNA, 75 bp, Artificial Sequence
  Synthetic
acaagttgaggggggaatgtctaaggatgatggaggtgttgaaagaagaagcttggaggatctatccagtacttc

SEQ ID NO: 261599 - DNA, 75 bp, Artificial Sequence
  Synthetic
ccggatatggatttacttcaagccctgagagagggtggagtgatcactcatcaggagcaaacaatggggatgtat

SEQ ID NO: 261600 - DNA, 75 bp, Artificial Sequence
  Synthetic
tagttcaccttgaggacaaactatctgctacaggactgaaccctacagcaataccattcactccaaaaaatctgt

SEQ ID NO: 261601 - DNA, 75 bp, Artificial Sequence
  Synthetic
ctgttcctgcaaaagattctcctgtgattgctgaacactactacggactaggagttagagagcaaaacgttgatc

SEQ ID NO: 261602 - DNA, 75 bp, Artificial Sequence
  Synthetic
ggagttagagagcaaaacgttgatccccagactaacagaaatgtcaatttggacagcatcaaattgtacacatca

SEQ ID NO: 261603 - DNA, 75 bp, Artificial Sequence
  Synthetic
ggacagcatcaaattgtacacatcagatgacgaagaggcagaccagcttgaatttgaggatgagtttgcagggag

SEQ ID NO: 261604 - DNA, 75 bp, Artificial Sequence
  Synthetic
ttcaagtgaagtgatagtcggcatttctcctgaagaggaagagccttcaagtgctggcaggaaacccattgaatc

SEQ ID NO: 261605 - DNA, 75 bp, Artificial Sequence
  Synthetic
tctcctgaagaggaagagccttcaagtgctggcaggaaacccattgaatccgttggacatataattgagggccaa

SEQ ID NO: 261606 - DNA, 75 bp, Artificial Sequence
  Synthetic
gtgaaggaaaaatcaccccagaagaggctgcctatgttagcagaagagtttgaatgctctggatctgaagaccca

SEQ ID NO: 261607 - DNA, 75 bp, Artificial Sequence
  Synthetic
attatccaagagttgctgaaagagaattcattcataaatagtcaacaagggaaagatgcccagcctctatattac

SEQ ID NO: 261608 - DNA, 75 bp, Artificial Sequence
  Synthetic
attcattcataaatagtcaacaagggaaagatgcccagcctctatattacaggggcattgagggatcgagaagcc

SEQ ID NO: 261609 - DNA, 75 bp, Artificial Sequence
  Synthetic
gaaagatgcccagcctctatattacaggggcattgagggatcgagaagcccagataagactgagatcaccagcga

SEQ ID NO: 261610 - DNA, 75 bp, Artificial Sequence
  Synthetic
tgctgtacaaactgctaacaagcaaaggccaggaactccgatgccaaaatcccgaggcatccctattaaaaaggg

SEQ ID NO: 261611 - DNA, 75 bp, Artificial Sequence
  Synthetic
aattgaatgttcccactgttgtgaaggaaactgataaatcagaagcaaaccctgcagatgacaacgactcacttg

SEQ ID NO: 261612 - DNA, 75 bp, Artificial Sequence
  Synthetic
atgataaatatatcatgccttcagatgatttctcaaacactttcttcccgcatgacactgatcgcttaaattatc

SEQ ID NO: 261613 - DNA, 75 bp, Artificial Sequence
  Synthetic
acgcagaccacttaggtgattatgacctcgaaaccctgtgcgaagaatcagttttgatgggagtaatcaactcta

SEQ ID NO: 261614 - DNA, 75 bp, Artificial Sequence
  Synthetic
gttttgatgggagtaatcaactctatcaaattaattaatctggacatgcgcctaaatcacattgaagaacaagtt

SEQ ID NO: 261615 - DNA, 75 bp, Artificial Sequence
  Synthetic
aaagagatcccaaagatcatcaataaacttgagtctattgacagggttctggccaaaaccaatactgcactctca

SEQ ID NO: 261616 - DNA, 75 bp, Artificial Sequence
  Synthetic
actattgaaggacacttggtttccatgatgataatgataccggggaaggggaaaggagaaagaaaaggcaaaagt

SEQ ID NO: 261617 - DNA, 75 bp, Artificial Sequence
  Synthetic
aatcctgagcttaaaccagtgataggaagagatgttctggagcagcaatctcttttctcatttgacaatgtcaag

SEQ ID NO: 261618 - DNA, 75 bp, Artificial Sequence
  Synthetic
aatttcagagatgggtcgttgacaaatgaaccgtatggggcagctgtccaattgagaggagatctgattcttcct

SEQ ID NO: 261619 - DNA, 75 bp, Artificial Sequence
  Synthetic
gaactcaattttgaggaaacgaatgcgtctcagtttgttcccatggcagatgattcgtccagagacgttgtcaag

SEQ ID NO: 261620 - DNA, 75 bp, Artificial Sequence
  Synthetic
acattgataaggactcatattaaggatagagaattgagatcagaactgattggttacctgaatagagcagaaaat

SEQ ID NO: 261621 - DNA, 75 bp, Artificial Sequence
  Synthetic
gatgaggaaattcaggagatagcaaatactgtcaatgacatcattgacggtaacatttgatcactgaattgtcag

SEQ ID NO: 261622 - DNA, 75 bp, Artificial Sequence
  Synthetic
cagaaatgagatgatccaacaacaatcttctacatgtagacagtagtttcaggtcagtgataacaacctcattac

SEQ ID NO: 261623 - DNA, 75 bp, Artificial Sequence
  Synthetic
taatctttcacataagcattacccattctagctctcgggcgataacacagtacttgatacatgtttattgaagtg

SEQ ID NO: 261624 - DNA, 75 bp, Artificial Sequence
  Synthetic
tatgtagcatgatcaaattacttaataactatacctcttaatcttgctcttagttagtcattgcatctaataatt

SEQ ID NO: 261625 - DNA, 75 bp, Artificial Sequence
  Synthetic
attattacagtacaaggtattatgaacacaaagatacacaataaatctgatatcagcatggagcagagaattatt

SEQ ID NO: 261626 - DNA, 75 bp, Artificial Sequence
  Synthetic
gtttttatcatgataatttgaaagtctaacagtgatgtcaactttcatacataagtatgatactataaaatggtc

SEQ ID NO: 261627 - DNA, 75 bp, Artificial Sequence
  Synthetic
gattcgtattgtagttcattcacgcattttagtgttataaattagtgtttcaaatcagttgcatatcaattaaga

SEQ ID NO: 261628 - DNA, 75 bp, Artificial Sequence
  Synthetic
aaaacttaggagacaggtatagaacttctctctccaataactggtcaattgaggacagaaatcctgtttctcaaa

SEQ ID NO: 261629 - DNA, 75 bp, Artificial Sequence
  Synthetic
ttcaccagcccttgccaagaaggacgcaagcaatggagccagacatcaagagcatttcaagtgagtctatggaag

SEQ ID NO: 261630 - DNA, 75 bp, Artificial Sequence
  Synthetic
gagtatctgattttagccctagttcttgggagaatggtgggtatcttgataaggttgagccagaaatcgatgaaa

SEQ ID NO: 261631 - DNA, 75 bp, Artificial Sequence
  Synthetic
atggcagtatgattcccaaatacaagatctacaccccaggagctaacgagaggaaatacaacaactacatgtatc

SEQ ID NO: 261632 - DNA, 75 bp, Artificial Sequence
  Synthetic
ttatatgttatggctttgttgaagatgttgagcgaaccccagagacagggaagcgtaagaagatcaggacaattg

SEQ ID NO: 261633 - DNA, 75 bp, Artificial Sequence
  Synthetic
ctgcctaccctttgggtgttggcaagagtgcctctcatcctcaagatcttctggaggaactctgttccctcaaag

SEQ ID NO: 261634 - DNA, 75 bp, Artificial Sequence
  Synthetic
tcactgtgaggagaacagctggatcaactgagaaagttgtattcggatcatctggacctctaaatcaccttgtcc

SEQ ID NO: 261635 - DNA, 75 bp, Artificial Sequence
  Synthetic
cgtggaagaaagtattgaccggtggttcaattttcaatgcagttaaggtctgccgaaacgttgatcagatacagc

SEQ ID NO: 261636 - DNA, 75 bp, Artificial Sequence
  Synthetic
tcgacaagcatcaagccctgagaatattttttctcagtattacaaaactcaacgattctggaatctacatgattc

SEQ ID NO: 261637 - DNA, 75 bp, Artificial Sequence
  Synthetic
cacgaactatgcttgagttcaggagaaacaatgccattgcgttcaatcttctggtgtacctgaagattgatgctg

SEQ ID NO: 261638 - DNA, 75 bp, Artificial Sequence
  Synthetic
atctatccaaaatgggaatccagggaagcctcgacaaagatggcttcaaagttgcttccttcatgctgcacttgg

SEQ ID NO: 261639 - DNA, 75 bp, Artificial Sequence
  Synthetic
gaaactttgtccgtcgcgcaggaaagtactattctgttgattattgtaggagaaagattgataggatgaaattgc

SEQ ID NO: 261640 - DNA, 75 bp, Artificial Sequence
  Synthetic
agttttcattgggttccataggtgggttaagtctccacattaagatcaatggtgtaatcagcaaacgtctgtttg

SEQ ID NO: 261641 - DNA, 75 bp, Artificial Sequence
  Synthetic
ctcaaatgggtttccaaaaaaacctttgtttttccttgatggatattaatccttggctcaacagactaacctgga

SEQ ID NO: 261642 - DNA, 75 bp, Artificial Sequence
  Synthetic
acaacagctgtgagatcagccgagtggcagctgtgttgcagccttctgttccgagagagttcatgatctatgatg

SEQ ID NO: 261643 - DNA, 75 bp, Artificial Sequence
  Synthetic
ccgagagagttcatgatctatgatgatgtcttcattgacaatacagggagaattctaaagggctaagtagaatcc

SEQ ID NO: 261644 - DNA, 75 bp, Artificial Sequence
  Synthetic
ttctcaaatttaatcaattatggatttagtaatcttatctggtcttaatacatcacgcaggactatttacaaaaa

SEQ ID NO: 261645 - DNA, 75 bp, Artificial Sequence
  Synthetic
catcacgcaggactatttacaaaaaccagcaaaaaaatagaataatcatgtagtattaattgaaaacatcattaa

SEQ ID NO: 261646 - DNA, 75 bp, Artificial Sequence
  Synthetic
aatagtgtagctaaaatgtagtttttgtgaatattcggttaataattagacaactattatgaaaaacttaggagc

SEQ ID NO: 261647 - DNA, 75 bp, Artificial Sequence
  Synthetic
caactattatgaaaaacttaggagccaagctctcgcctttttcaaaaaattaaacaagcattattactatctgat

SEQ ID NO: 261648 - DNA, 75 bp, Artificial Sequence
  Synthetic
caacaaaaggattggtttaatcatctaagaaatctctcgaaagacaaagagattctaggttttatgttgaaggaa

SEQ ID NO: 261649 - DNA, 75 bp, Artificial Sequence
  Synthetic
gtgtgttaaacctaggagacccttcaacagtcaggtcgcgggaatacaaacaaagacaaaaacaaaaataaaatt

SEQ ID NO: 261650 - DNA, 75 bp, Artificial Sequence
  Synthetic
tagacctatcaatcatatcccgtaagactcgacaatggcagttatacttaacaagagatattattctaatctctt

SEQ ID NO: 261651 - DNA, 75 bp, Artificial Sequence
  Synthetic
aatactgattttgatgatctcggagtgcagtgtcgggattttgcattatgagaaattgagtaagattgggcttgt

SEQ ID NO: 261652 - DNA, 75 bp, Artificial Sequence
  Synthetic
caaaggaataacaagaaaatacaagatcaaaagcaatcctctcacaaaagacattgttattaaaatgattccgaa

SEQ ID NO: 261653 - DNA, 75 bp, Artificial Sequence
  Synthetic
tgtgtcaaacatgtctcaatgcacggggagtgtcatggaaaattataaaacacgattaaacggtatcctaacgcc

SEQ ID NO: 261654 - DNA, 75 bp, Artificial Sequence
  Synthetic
tataaagggggcattagagatttacaagaacaacactcatgaccttgtcggtgatgtaagactggccggagttat

SEQ ID NO: 261655 - DNA, 75 bp, Artificial Sequence
  Synthetic
aatggcaggagttgctattggaattgcaaccgcagctcaaattactgcaggtgtagcattatatgaggcaatgaa

SEQ ID NO: 261656 - DNA, 75 bp, Artificial Sequence
  Synthetic
aaatgctgacaacatcaacaaactcaaaagcagcatagaatcaactaatgaagctgttgttaagcttcaagagac

SEQ ID NO: 261657 - DNA, 75 bp, Artificial Sequence
  Synthetic
aaaagcagcatagaatcaactaatgaagctgttgttaagcttcaagagactgcagaaaagacagtctatgtactg

SEQ ID NO: 261658 - DNA, 75 bp, Artificial Sequence
  Synthetic
accgctttgcaggattacattaatactaacttggtaccgacaattgacaagataagctgcaaacagacggaactc

SEQ ID NO: 261659 - DNA, 75 bp, Artificial Sequence
  Synthetic
ctaacttggtaccgacaattgacaagataagctgcaaacagacggaactctcattagatctagcactatcaaagt

SEQ ID NO: 261660 - DNA, 75 bp, Artificial Sequence
  Synthetic
gataagctgcaaacagacggaactctcattagatctagcactatcaaagtactcctctgatttgctttttgtatt

SEQ ID NO: 261661 - DNA, 75 bp, Artificial Sequence
  Synthetic
tgaaacactgctaagaacgttgggttacgctacagaaggctttgatgatcttctagaaagtgacagcataacggg

SEQ ID NO: 261662 - DNA, 75 bp, Artificial Sequence
  Synthetic
tcaaattatctacgttgatttaagtggctactacataattgtcagggtttattttcctatcctgactgaaatcca

SEQ ID NO: 261663 - DNA, 75 bp, Artificial Sequence
  Synthetic
acaggcctatatccaagaattgttgccagtgagctttaacaatgacaattcagaatggatcagcattgtcccaaa

SEQ ID NO: 261664 - DNA, 75 bp, Artificial Sequence
  Synthetic
tttcatattggtaaggaacacattaatatcaaatatagagattggattttgcctaattacaaagaggagtgtgat

SEQ ID NO: 261665 - DNA, 75 bp, Artificial Sequence
  Synthetic
ctgcaaccaagattatgcaacacccatgacaaacaatatgagggaatgtttgacggggtcgactgagaagtgtcc

SEQ ID NO: 261666 - DNA, 75 bp, Artificial Sequence
  Synthetic
tcgagagctggttgtttcatcacacgttcccagatttgcactatctaacggggttttgtttgctaattgcataag

SEQ ID NO: 261667 - DNA, 75 bp, Artificial Sequence
  Synthetic
cgtcacatgccagtgtcaaacaacaggtagggcaatctcacagtcaggagaacaaactctgctaatgattgataa

SEQ ID NO: 261668 - DNA, 75 bp, Artificial Sequence
  Synthetic
caccacctgtcctacagctgtactcggtaatgtgatcatcagcttggggaaatatcttgggtcagtaaattataa

SEQ ID NO: 261669 - DNA, 75 bp, Artificial Sequence
  Synthetic
ctctgaaggcattgctattggtcctcctgtctttactgataaagttgacatatcaagtcaaatatctagcatgaa

SEQ ID NO: 261670 - DNA, 75 bp, Artificial Sequence
  Synthetic
tcagtccttacaacaatctaaggactatatcaaagaagctcaacgactccttgatactgttaacccgtcattaat

SEQ ID NO: 261671 - DNA, 75 bp, Artificial Sequence
  Synthetic
tatatcaaagaagctcaacgactccttgatactgttaacccgtcattaataagcatgttgtctatgatcatactg

SEQ ID NO: 261672 - DNA, 75 bp, Artificial Sequence
  Synthetic
tatgtactatcaattgcatcattgtgtataggattgattacatttatcagttttatcattgttgagaaaaaaaga

SEQ ID NO: 261673 - DNA, 75 bp, Artificial Sequence
  Synthetic
ttttatcattgttgagaaaaaaagaaacacctatagcagattagaggacaggagagtcagacctacaagtagtgg

SEQ ID NO: 261674 - DNA, 75 bp, Artificial Sequence
  Synthetic
ggatctctattacattgggacgtagtgtattcagattgattgaattacatcaaagagatcaaaggacttctaatt

SEQ ID NO: 261675 - DNA, 75 bp, Artificial Sequence
  Synthetic
ttcagaaatggattgtatgtaattgattagatcatcttggatacttgagataggaatgttgcaactttaaaatta

SEQ ID NO: 261676 - DNA, 75 bp, Artificial Sequence
  Synthetic
attagatcatcttggatacttgagataggaatgttgcaactttaaaattaaaccatgtaaataattgtgacaaat

SEQ ID NO: 261677 - DNA, 75 bp, Artificial Sequence
  Synthetic
tataagtttctttcattttcttaaagtaataatttgatgaatatacaatatattctctcgcaagagctctaatct

SEQ ID NO: 261678 - DNA, 75 bp, Artificial Sequence
  Synthetic
atacactccctcctaatattttatactcataattaatgatatgatgataaataaagattcaaattgacttatgat

SEQ ID NO: 261679 - DNA, 75 bp, Artificial Sequence
  Synthetic
caaccaaggaaatgtacttgcaattatacattgtactcaaccatgaatgaacagttgatattctttttttgaaaa

SEQ ID NO: 261680 - DNA, 75 bp, Artificial Sequence
  Synthetic
aattataaaaaacttaggacccaggtccataactcattggatattaaactgtgtcctttaaagttatcatatatc

SEQ ID NO: 261681 - DNA, 75 bp, Artificial Sequence
  Synthetic
tcttctttaatcacattataggagtgagccacaatatacatctttgagtaaagagaagaaagcattgctggcaca

SEQ ID NO: 261682 - DNA, 75 bp, Artificial Sequence
  Synthetic
gagccacaatatacatctttgagtaaagagaagaaagcattgctggcacacaagctgatctgccttaattaaata

SEQ ID NO: 261683 - DNA, 75 bp, Artificial Sequence
  Synthetic
gccgacagaaagcaagaaagttagattcgaaaatactgcttcagacaaggggaaaaatcctagtaaagttattaa

SEQ ID NO: 261684 - DNA, 75 bp, Artificial Sequence
  Synthetic
gagctactacggaaccatggacattaagaaaataaatgaagggttattggacagcaagatattaagtgctttcaa

SEQ ID NO: 261685 - DNA, 75 bp, Artificial Sequence
  Synthetic
cacagtgatagcactgcttggatccattgtaatcatagtgatgaatataatgatcatccaaaactacacaagatc

SEQ ID NO: 261686 - DNA, 75 bp, Artificial Sequence
  Synthetic
aacagataatcaggccatgatcaaagatgcattgcagagtatccagcagcagatcaaggggcttgccgacaaaat

SEQ ID NO: 261687 - DNA, 75 bp, Artificial Sequence
  Synthetic
tggcacagagatagggccgaaagtatcactgattgatacatccagtactatcactatcccagctaatattgggct

SEQ ID NO: 261688 - DNA, 75 bp, Artificial Sequence
  Synthetic
tcactatcccagctaatattgggctgttaggttcaaagatcagccagtcaactgcaagtataaatgagaatgtga

SEQ ID NO: 261689 - DNA, 75 bp, Artificial Sequence
  Synthetic
ttagagagtataagccgcagacagaaggagtgagcaatctggtaggattacctaataatatctgtctgcaaaaga

SEQ ID NO: 261690 - DNA, 75 bp, Artificial Sequence
  Synthetic
catctaatcagatactgaaaccaaagctgatttcatacaccttacccgtagtcggtcaaagtggcacctgtatca

SEQ ID NO: 261691 - DNA, 75 bp, Artificial Sequence
  Synthetic
cagacccactgctggctatggatgagggctactttgcatatagccacctggaaaaaatcggatcatgttcaagag

SEQ ID NO: 261692 - DNA, 75 bp, Artificial Sequence
  Synthetic
gggtctccaaacaaagaataataggagttggagaggtactagacagaggtgacgaagtaccttctttgtttatga

SEQ ID NO: 261693 - DNA, 75 bp, Artificial Sequence
  Synthetic
ctaacgtctggaccccatcaaatccaaacaccgtttaccattgcagtgccgtgtacaacaatgaattctattatg

SEQ ID NO: 261694 - DNA, 75 bp, Artificial Sequence
  Synthetic
tgctttgtgcagtgtcagttgttggagaccctattctgaatagcacctactggtccggatcactaatgatgactc

SEQ ID NO: 261695 - DNA, 75 bp, Artificial Sequence
  Synthetic
gtctagctgtaaaacctaagaataatggtgagagttacaatcaacatcaatttgccttacggaatattgagaaag

SEQ ID NO: 261696 - DNA, 75 bp, Artificial Sequence
  Synthetic
ggaagtatgataaagttatgccatatggaccctcaggcatcaaacaaggtgacaccctgtactttcctgctgtag

SEQ ID NO: 261697 - DNA, 75 bp, Artificial Sequence
  Synthetic
gatttttggtcaggacagagttcaaatacaatgattcaaattgtcccatcgcagagtgtcaatacagcaaacctg

SEQ ID NO: 261698 - DNA, 75 bp, Artificial Sequence
  Synthetic
aaaactgcaggctatctatggggattagaccaaacagtcattatatccttcgatctggactactaaaatacaatc

SEQ ID NO: 261699 - DNA, 75 bp, Artificial Sequence
  Synthetic
tagaccaaacagtcattatatccttcgatctggactactaaaatacaatctatcggatgaggagaactctaaaat

SEQ ID NO: 261700 - DNA, 75 bp, Artificial Sequence
  Synthetic
tgtattcattgaaatatctgatcaaagactatctattggatctcctagcaaaatctatgattctttgggtcaacc

SEQ ID NO: 261701 - DNA, 75 bp, Artificial Sequence
  Synthetic
tgttttctaccaagcatctttttcatgggacactatgattaaatttggagatgtccaaacagttaaccctttagt

SEQ ID NO: 261702 - DNA, 75 bp, Artificial Sequence
  Synthetic
tgtaaattggcgtgacaacacggtaatctcaagacctgggcaatcacaatgccctagattcaacaagtgcccaga

SEQ ID NO: 261703 - DNA, 75 bp, Artificial Sequence
  Synthetic
ggtttgctgggaaggggtttataatgatgccttcctgattgatagaatcaattggataagcgcgggtgtattcct

SEQ ID NO: 261704 - DNA, 75 bp, Artificial Sequence
  Synthetic
tgacagcaaccagaccgcagagaatcctgtttttactgtattcaaagataatgaagtactttacagagcacaact

SEQ ID NO: 261705 - DNA, 75 bp, Artificial Sequence
  Synthetic
agcttccgaggacaccaatgcacaaaaaacaataactaattgcttccttttgaagaataagatctggtgtatatc

SEQ ID NO: 261706 - DNA, 75 bp, Artificial Sequence
  Synthetic
actggttgagatatacgacacaggagacaatgttataagacctaaactattcgcagttaagataccagagcaatg

SEQ ID NO: 261707 - DNA, 75 bp, Artificial Sequence
  Synthetic
tacataaaagttaatctcataatttaatggattgatctggtgcaataatagcaactgtgcaaaggcatgtgatgt

SEQ ID NO: 261708 - DNA, 75 bp, Artificial Sequence
  Synthetic
aatggattgatctggtgcaataatagcaactgtgcaaaggcatgtgatgtgaacaaaattgtcataattacataa

SEQ ID NO: 261709 - DNA, 75 bp, Artificial Sequence
  Synthetic
gtcttcagctgaatatttttttaggggtaataataacatgtttcttcaattataggattactgataatgtaattc

SEQ ID NO: 261710 - DNA, 75 bp, Artificial Sequence
  Synthetic
ggagaccgagtcaataaataatcttgatcaatgatctttgaaaataatgataacatgtcgttcatcaattgataa

SEQ ID NO: 261711 - DNA, 75 bp, Artificial Sequence
  Synthetic
ccaactctttctatgtacaccttggagcaagtcttgggacttaatatattcgatttggatatcagagttaacagt

SEQ ID NO: 261712 - DNA, 75 bp, Artificial Sequence
  Synthetic
ctatacataatcttaacttacgctttaagcatagtgatgacaatcaatgtgaacttgtcccaatgtaaagagaat

SEQ ID NO: 261713 - DNA, 75 bp, Artificial Sequence
  Synthetic
ttgatcttgactgaaactccatttgatatagtagagctaaatcttgtaaataaattataataaatggtttattca

SEQ ID NO: 261714 - DNA, 75 bp, Artificial Sequence
  Synthetic
aagattatcgtttatattaatgtaaattaagaaaaaattaggacccaggtccttgattgtgctaattttcttgag

SEQ ID NO: 261715 - DNA, 75 bp, Artificial Sequence
  Synthetic
ccttgattgtgctaattttcttgagaaatcatttaatttcttacagactgaagacgttattacctatttttttag

SEQ ID NO: 261716 - DNA, 75 bp, Artificial Sequence
  Synthetic
aagacgttattacctatttttttaggggaaattttattagaattgatctatattatctaattctcctaaaaattg

SEQ ID NO: 261717 - DNA, 75 bp, Artificial Sequence
  Synthetic
actaccaaaaaacaaagatggccgatgaattatccatatctgacatcatctaccctgaatgtcatttggatagtc

SEQ ID NO: 261718 - DNA, 75 bp, Artificial Sequence
  Synthetic
ctatagtctctggtaaactaatatcagctattgaatatgctcaattgaaacacaatcaacctagtgatgacaaaa

SEQ ID NO: 261719 - DNA, 75 bp, Artificial Sequence
  Synthetic
gactgtctgaaaatattaggttaaaccttcacgggaaaagaaagagcttatatatattaagacaatccaagcaag

SEQ ID NO: 261720 - DNA, 75 bp, Artificial Sequence
  Synthetic
tatatattaagacaatccaagcaaggtaattatatcagaaataacgttaaaaacctaaaagagttcatgcatatt

SEQ ID NO: 261721 - DNA, 75 bp, Artificial Sequence
  Synthetic
gcgtaccctgaatgtaataacactttattttccattacatcccaaggcatgactagcaaacttgataacatcatg

SEQ ID NO: 261722 - DNA, 75 bp, Artificial Sequence
  Synthetic
agaaagtcattcaaagcatacaatatcattagtaagaaagtaattggaatgctacaaaatatcactagaaatctc

SEQ ID NO: 261723 - DNA, 75 bp, Artificial Sequence
  Synthetic
taatcaatatacatgagtgtagacggttaggagatttagggaagaatatgagtcaatctaaatggtatgaatgtt

SEQ ID NO: 261724 - DNA, 75 bp, Artificial Sequence
  Synthetic
agtcaatctaaatggtatgaatgttttttgttttggtttactatcaaaacagagatgcgagcagtgatcaagaat

SEQ ID NO: 261725 - DNA, 75 bp, Artificial Sequence
  Synthetic
attcatgcataatacatatgcgagataaaagtactgagataatcctgaatccaaatcttatctgcattttcaaat

SEQ ID NO: 261726 - DNA, 75 bp, Artificial Sequence
  Synthetic
cagacaaaactggaaagaagtgttattatcttacacccgaaatggttctaatgtattgtgatgtcctagaaggga

SEQ ID NO: 261727 - DNA, 75 bp, Artificial Sequence
  Synthetic
ggatgatgatggagacaacaatcaaatcagatatcaaataccagcctttaatctcgaggtccaatgccctctggg

SEQ ID NO: 261728 - DNA, 75 bp, Artificial Sequence
  Synthetic
gattaattgatcccttgttccctgtcatgggaaacaggatttacaatatagtgtctatgatagaacccttagttc

SEQ ID NO: 261729 - DNA, 75 bp, Artificial Sequence
  Synthetic
ttgcactactccaactcaaggacgaagctagaatcctgaggggtgcattcctacatcactgcataaaggagatgc

SEQ ID NO: 261730 - DNA, 75 bp, Artificial Sequence
  Synthetic
ctacatcactgcataaaggagatgcatcaagaattgagtgagtgtggctttacagaccagaagattcggtctatg

SEQ ID NO: 261731 - DNA, 75 bp, Artificial Sequence
  Synthetic
tttattgatgaccttttatccatcctgaatatcgacaatatacatctattggcagagttcttttctttctttcgt

SEQ ID NO: 261732 - DNA, 75 bp, Artificial Sequence
  Synthetic
ggcagagttcttttctttctttcgtacgtttggtcatcctattcttgaggctaaagttgctgcagaaaaagtacg

SEQ ID NO: 261733 - DNA, 75 bp, Artificial Sequence
  Synthetic
agaacatatgttggcagataaagttcttgaatatgcccctataatgaaggcacatgctatattctgcgggactat

SEQ ID NO: 261734 - DNA, 75 bp, Artificial Sequence
  Synthetic
aataaacgggtatagggatagacacggaggggcctggcctcctctctacctccccgcacatgcatctaagcatat

SEQ ID NO: 261735 - DNA, 75 bp, Artificial Sequence
  Synthetic
aatccgcttgaaaaattctggggaatctttaaccattgatgattgtgtcaagaactgggaatcattctgtgggat

SEQ ID NO: 261736 - DNA, 75 bp, Artificial Sequence
  Synthetic
tcaatttgattgtttcatggagctgaaattagacagtgatttgagtatgtatatgaaagataaagccttgtctcc

SEQ ID NO: 261737 - DNA, 75 bp, Artificial Sequence
  Synthetic
tatcaaagacgagtgggacagtgtatatccacgagaagtgctgagctataccccaccgaaatcaaccgagccaag

SEQ ID NO: 261738 - DNA, 75 bp, Artificial Sequence
  Synthetic
aagattggttgacgtttttgtaaacgatgaaaactttgatccgtacaacatgctagaatatgtcttgtccggcgc

SEQ ID NO: 261739 - DNA, 75 bp, Artificial Sequence
  Synthetic
ttatctcgaagatgatcaattcaatgtttcttacagtttgaaggagaaagagacaaagcaggctggacgattgtt

SEQ ID NO: 261740 - DNA, 75 bp, Artificial Sequence
  Synthetic
tgcgaagatgacctacaagatgcgtgcatgtcaagttatagcagaagccctaatagcatcaggtgtaggtaaata

SEQ ID NO: 261741 - DNA, 75 bp, Artificial Sequence
  Synthetic
tttcaaggagaacgggatggttaaggatgagcacgaacttttgaagacactcttccaattatccatttcctcagt

SEQ ID NO: 261742 - DNA, 75 bp, Artificial Sequence
  Synthetic
tcctcgtggaaacagtcagggtaatgatcctcaatccatcaataatatagagaaagatttccaatgctttaaagg

SEQ ID NO: 261743 - DNA, 75 bp, Artificial Sequence
  Synthetic
agaaagatttccaatgctttaaaggagttaccaccagtgtgaaagacaaaaagaatgaccctttttacaaagtta

SEQ ID NO: 261744 - DNA, 75 bp, Artificial Sequence
  Synthetic
aatctgctctcaataatccgtgccaagctgacggggtctatcataacatgtcacccaacatacgaaatcgttata

SEQ ID NO: 261745 - DNA, 75 bp, Artificial Sequence
  Synthetic
aatgtagtaatacaagtaaatcttttctcgattaccacactgagtttaatccccacaatcactacaaatcagaca

SEQ ID NO: 261746 - DNA, 75 bp, Artificial Sequence
  Synthetic
atacggaggcagctgtactctccaagtatgaagataataccgggactaaatttgatacagtaagtgcatttctta

SEQ ID NO: 261747 - DNA, 75 bp, Artificial Sequence
  Synthetic
caactgatcttaagaaattctgtctcaattggagatacgagtcaatggccatatttgctgaacgtctagatgaga

SEQ ID NO: 261748 - DNA, 75 bp, Artificial Sequence
  Synthetic
tatacggtttacctggattctttaattggatgcataaacgactagaaaggtcagttatctatgttgcggatccta

SEQ ID NO: 261749 - DNA, 75 bp, Artificial Sequence
  Synthetic
tcagttatctatgttgcggatcctaattgcccccctaatattgacaaacacatggagttagaagaaactcctgaa

SEQ ID NO: 261750 - DNA, 75 bp, Artificial Sequence
  Synthetic
gatgatatattcattcattatcctaaaggcggtattgaaggatatagccaaaaaacatggactatagcaaccatc

SEQ ID NO: 261751 - DNA, 75 bp, Artificial Sequence
  Synthetic
aaggcggtattgaaggatatagccaaaaaacatggactatagcaaccatccccttcttattcttgagtgcctatg

SEQ ID NO: 261752 - DNA, 75 bp, Artificial Sequence
  Synthetic
agacaaacacgaggattgctgcaattgtccaaggagacaacgaatcaattgctatcactcaaaaagttcacccta

SEQ ID NO: 261753 - DNA, 75 bp, Artificial Sequence
  Synthetic
atcttccctacaaggttaagaaagagatctgtgcaaaacaagctcagctttactttgaaagattaaggatgaact

SEQ ID NO: 261754 - DNA, 75 bp, Artificial Sequence
  Synthetic
taagagctctcggccacaaccttaaagctaccgaaaccatcatcagtacacatctttttgtttattcgaagaaaa

SEQ ID NO: 261755 - DNA, 75 bp, Artificial Sequence
  Synthetic
ttcattatgatggtgctgtgttgtcccaggcactcaagtcaatgtcaagatgctgcttttggtcagagaccctgg

SEQ ID NO: 261756 - DNA, 75 bp, Artificial Sequence
  Synthetic
atgtcggctattgtatcaatattctgaaagtaattcagcaactccttatatcaactgagtttagtattaatgaga

SEQ ID NO: 261757 - DNA, 75 bp, Artificial Sequence
  Synthetic
cattgacactggatgtgacatctcccatttcaaataatttagattggctcataacagcagcattaatcccagcac

SEQ ID NO: 261758 - DNA, 75 bp, Artificial Sequence
  Synthetic
ctatcgggggatttaattaccttaatttgtctagaatttttgttaggaatataggtgatccggtcacagcatctt

SEQ ID NO: 261759 - DNA, 75 bp, Artificial Sequence
  Synthetic
tggctgatctcaaaagaatgattgaccacagcattatgactgaaagcgtattacaaaaagttatgaatcaagaac

SEQ ID NO: 261760 - DNA, 75 bp, Artificial Sequence
  Synthetic
ctggtgatgcaagtttcttggactgggccagtgatccatactcaggtaacttgcctgactcgcaaagtattacta

SEQ ID NO: 261761 - DNA, 75 bp, Artificial Sequence
  Synthetic
aaaccattaaaaatatcacagcaaggactatactgaggaactcaccgaatccaatgcttaaaggtctatttcatg

SEQ ID NO: 261762 - DNA, 75 bp, Artificial Sequence
  Synthetic
acaaatcttttgatgaggaccttgaactagctagcttcctgatggacaggagggtgatattacctagagccgctc

SEQ ID NO: 261763 - DNA, 75 bp, Artificial Sequence
  Synthetic
agggtgatattacctagagccgctcatgagatactggacaattcattgacaggtgccagggaggaaattgctggt

SEQ ID NO: 261764 - DNA, 75 bp, Artificial Sequence
  Synthetic
ctattagatacaactaaaggcctgataagatcagggttgagaaagagtggaattcagccaaggttagtttccaga

SEQ ID NO: 261765 - DNA, 75 bp, Artificial Sequence
  Synthetic
ttgtctcatcatgattacaatcaatttttaatattaaataaacttctatcaaacagaaaacagaatgatttgata

SEQ ID NO: 261766 - DNA, 75 bp, Artificial Sequence
  Synthetic
tcatcaaatacttgctcagttgacttagcacgagcattgagatcccacatgtggagggaattagctttaggaaga

SEQ ID NO: 261767 - DNA, 75 bp, Artificial Sequence
  Synthetic
gtaatatacggtcttgaggtaccagatgcccttgaagctatggtggggaggtatataacagggagcttagaatgc

SEQ ID NO: 261768 - DNA, 75 bp, Artificial Sequence
  Synthetic
caaatctgtgagcagggaaacacgatgtatgggtggttttttgtacctagggattcccaattagatcaggtagat

SEQ ID NO: 261769 - DNA, 75 bp, Artificial Sequence
  Synthetic
aaagagcactcatcaataagagtaccttatgtaggatcaagtacagatgagagatcagatatcaagctggggaat

SEQ ID NO: 261770 - DNA, 75 bp, Artificial Sequence
  Synthetic
gtcaagagaccgactaaagccttacgttctgctatcaggattgcgacagtatatacttgggcctatggagataat

SEQ ID NO: 261771 - DNA, 75 bp, Artificial Sequence
  Synthetic
gaagagtgttggtatgaagcttggtacctagcgtctcagagagtaaacatagatttagatgtattgaaggctata

SEQ ID NO: 261772 - DNA, 75 bp, Artificial Sequence
  Synthetic
agatttagatgtattgaaggctataaccccagtctccacttcaaacaatttatcccatagattgagagacaaatc

SEQ ID NO: 261773 - DNA, 75 bp, Artificial Sequence
  Synthetic
tatcccatagattgagagacaaatccacacaatttaagttcgcagggagtgtactcaacagggtttctagatatg

SEQ ID NO: 261774 - DNA, 75 bp, Artificial Sequence
  Synthetic
tcaacataagcaatgataatctggatttcagaattgagggggagaaggtagatacgaatcttatttatcaacagg

SEQ ID NO: 261775 - DNA, 75 bp, Artificial Sequence
  Synthetic
caatgctgttaggattatcagtattggaaggtaaattcagattgagattggagacagatgattacaatgggatat

SEQ ID NO: 261776 - DNA, 75 bp, Artificial Sequence
  Synthetic
atcacttacatgttaaggataattgttgtgtcaaagaagtggctgatgtaggccaagtggacgctgaattgccta

SEQ ID NO: 261777 - DNA, 75 bp, Artificial Sequence
  Synthetic
tcccagagtatactgaggttgataacaatcatcttatatatgatccagatcctgtttcagaaatagattgcagcc

SEQ ID NO: 261778 - DNA, 75 bp, Artificial Sequence
  Synthetic
gtctttctaatcaggagtcaaaatcaagagaattagacttccctttatggtcaactgaggagcttcatgatgccc

SEQ ID NO: 261779 - DNA, 75 bp, Artificial Sequence
  Synthetic
aagagaattagacttccctttatggtcaactgaggagcttcatgatgcccttgctaagaccgttgctcagaccgt

SEQ ID NO: 261780 - DNA, 75 bp, Artificial Sequence
  Synthetic
caatagactctgacgataacatcaacagtttaatcacagaatttctaatagttgatcctgaactgtttgcacttt

SEQ ID NO: 261781 - DNA, 75 bp, Artificial Sequence
  Synthetic
atcttggacaatctatagcaataaaatgggctttcgaaattcatcataggcgtcctagaggaagacatactatgg

SEQ ID NO: 261782 - DNA, 75 bp, Artificial Sequence
  Synthetic
ttgatctgttgtcagatcttatatcaaacacatcaaagcacacttacaaagtgctgtcaaacgccttgtcacatc

SEQ ID NO: 261783 - DNA, 75 bp, Artificial Sequence
  Synthetic
ctagagtatttaagagatttgtaaactgtggcttactgttgcctacacagggtccttaccttcatcaacaagatt

SEQ ID NO: 261784 - DNA, 75 bp, Artificial Sequence
  Synthetic
ttgaaaagctgtctcaaaatctccttgtaacatcttacatgatttatctaatgaactggtgtgacttcaagaaat

SEQ ID NO: 261785 - DNA, 75 bp, Artificial Sequence
  Synthetic
acccctttttaatcgccgaacaggatgaaactgtgattaacctacgagaggatataataacatccaaacatctct

SEQ ID NO: 261786 - DNA, 75 bp, Artificial Sequence
  Synthetic
gcgttataattgacttatacgcaaatcaccataaacctccttggataatagatctgaacccacaagaaaaaatat

SEQ ID NO: 261787 - DNA, 75 bp, Artificial Sequence
  Synthetic
gtgtacttcgtgactttatttccaaatctaggcatatggatacgtcctctagatcatggaatacttctgacctgg

SEQ ID NO: 261788 - DNA, 75 bp, Artificial Sequence
  Synthetic
attttgtgatattctatgcgtctttaacttatttgagaagaggcataataaagcaattaaggataagacaagtta

SEQ ID NO: 261789 - DNA, 75 bp, Artificial Sequence
  Synthetic
ccgaagttgtagataccacaacaatgttaagggacaatataattgtggagaatcctcctatcaaaacaggggtgt

SEQ ID NO: 261790 - DNA, 75 bp, Artificial Sequence
  Synthetic
tagatatcagaggttgtataatatacaatttagaggaaatcctgtctatgaacacgaaatcatcgtccaaaaaga

SEQ ID NO: 261791 - DNA, 75 bp, Artificial Sequence
  Synthetic
tctttaaccttaatagtaagccatcggtggagaatcacaaatatagaaggataggcctcaactcatcatcatgtt

SEQ ID NO: 261792 - DNA, 75 bp, Artificial Sequence
  Synthetic
acaaggcattgaatttatcacctctaattcagaggtatttgccgtcaggagctcaaagattgtttataggagaag

SEQ ID NO: 261793 - DNA, 75 bp, Artificial Sequence
  Synthetic
gttctggaagcatgatgttgttatatcagtctacactggggcaatcaatttctttttacaattcaggcatagacg

SEQ ID NO: 261794 - DNA, 75 bp, Artificial Sequence
  Synthetic
gagattatataccaggtcagagagaactgaagctatttccatccgaatactcgattgctgaggaagacccatctt

SEQ ID NO: 261795 - DNA, 75 bp, Artificial Sequence
  Synthetic
tggcgggaaagttgaaaggactggtggtgcctttatttaatgggagaccagaaacaacatggattgggaatttag

SEQ ID NO: 261796 - DNA, 75 bp, Artificial Sequence
  Synthetic
ggtgcctttatttaatgggagaccagaaacaacatggattgggaatttagattcttacgagtatatcataaatag

SEQ ID NO: 261797 - DNA, 75 bp, Artificial Sequence
  Synthetic
agtagaacattctcatctaatatccatcgcgataaatgttatgatggaggatggattattagtatctaagatagc

SEQ ID NO: 261798 - DNA, 75 bp, Artificial Sequence
  Synthetic
atacacccccggattcccaatctcaagattatttaacatgtacaggtcatattttggactagtactggtgtgttt

SEQ ID NO: 261799 - DNA, 75 bp, Artificial Sequence
  Synthetic
cccagtgtatagcaacccagattctactgaggtatatcttctttgcttacaaaagacagtcaagactattatccc

SEQ ID NO: 261800 - DNA, 75 bp, Artificial Sequence
  Synthetic
tccacaaagagtccttgagcactctgatttgcacgatgaggtcaatgatcaggggataacatcagtaatttttaa

SEQ ID NO: 261801 - DNA, 75 bp, Artificial Sequence
  Synthetic
gatcaagaattctcaatctaaacagttccatgaagatctaaagaaatactatcatattgaccaacctttctttgt

SEQ ID NO: 261802 - DNA, 75 bp, Artificial Sequence
  Synthetic
accaactaaaatcactagtgatgaacaagtacttctccaagcagggctaaaactcaatgggccagaaatccttaa

SEQ ID NO: 261803 - DNA, 75 bp, Artificial Sequence
  Synthetic
gagtgaaatcagttatgatatcggttcagatatcaacacattaagagacaccatcataattatgttaaatgaggc

SEQ ID NO: 261804 - DNA, 75 bp, Artificial Sequence
  Synthetic
tcagatatcaacacattaagagacaccatcataattatgttaaatgaggccatgaattattttgatgataacagg

SEQ ID NO: 261805 - DNA, 75 bp, Artificial Sequence
  Synthetic
tcgccttcacatcatttggaaccgtatccagttttggagagaactagaattaaaacaataatgaatcgtgtaact

SEQ ID NO: 261806 - DNA, 75 bp, Artificial Sequence
  Synthetic
atccagttttggagagaactagaattaaaacaataatgaatcgtgtaactaagaaagtgattgtttactcactca

SEQ ID NO: 261807 - DNA, 75 bp, Artificial Sequence
  Synthetic
tcaagttcaaagataccaaaagttcagagctttaccacattaaaaataatatcagaaggaaagttctaatcttag

SEQ ID NO: 261808 - DNA, 75 bp, Artificial Sequence
  Synthetic
atcagaaggaaagttctaatcttagatttcagatcaaagctcatgacaaagactctacctaaaggcatgcaagag

SEQ ID NO: 261809 - DNA, 75 bp, Artificial Sequence
  Synthetic
agaagagaaaaaagcggtttcaaagaggtttggatagtagacttatcgaaccgagaagtcaaaatctggtggaag

SEQ ID NO: 261810 - DNA, 75 bp, Artificial Sequence
  Synthetic
ataatcggatacatatccattatctgatttgatcttccaagtccagaaccgaccgacaatttatgctggtccaaa

SEQ ID NO: 261811 - DNA, 75 bp, Artificial Sequence
  Synthetic
ttacagctccagacactgccgaggagagtgaaactagaagatgggctaagtacgttcaacaaaagagagtcaatc

SEQ ID NO: 261812 - DNA, 75 bp, Artificial Sequence
  Synthetic
tgcaggtctctggacatgaattacacactacaccctaataaagataaaatctatattacatatttaaagactata

SEQ ID NO: 261813 - DNA, 75 bp, Artificial Sequence
  Synthetic
caatacctcttacctcatttcttacttcaatatcatgttatttttttgataagtcacttaatttgactaagatct

SEQ ID NO: 261814 - DNA, 75 bp, Artificial Sequence
  Synthetic
tgttggacgtataattgagggccaatcaactcgagacagcctccaaattaagggcaacaagccagcagatgcacc

SEQ ID NO: 261815 - DNA, 75 bp, Artificial Sequence
  Synthetic
gatgaggaaattcaggagatagctaatactgtcaatgacattattgacggcaacatttgatcactgaattatcag

SEQ ID NO: 261816 - DNA, 75 bp, Artificial Sequence
  Synthetic
cagaaatgagatgatccaacaacaatcctttacatgtagacagtggtttcaggtcagtgacaacaacctcactac

SEQ ID NO: 261817 - DNA, 75 bp, Artificial Sequence
  Synthetic
tatgtagcatgatcaaatcacttaataactgtacctcttaatcttgctcttagttagtcactgcatctaataatt

SEQ ID NO: 261818 - DNA, 75 bp, Artificial Sequence
  Synthetic
gtttttatcatgataatttgaaagtccaacagtgatgtcaactttcatacataagtataatactataaaatggtc

SEQ ID NO: 261819 - DNA, 75 bp, Artificial Sequence
  Synthetic
atggcagtatgattcccaaatacaagatctacaccccaggagctaacgagaggaaatacaataactacatgtacc

SEQ ID NO: 261820 - DNA, 75 bp, Artificial Sequence
  Synthetic
catcacgcaggactatttacaaaaaccagcaaaaaaatagaataatcatgtagtagtaattgaagacatcattta

SEQ ID NO: 261821 - DNA, 75 bp, Artificial Sequence
  Synthetic
caactattatgaaaaacttaggagccaagctctcgcctttttcaaaagattaaacaagcattattaccatcggat

SEQ ID NO: 261822 - DNA, 75 bp, Artificial Sequence
  Synthetic
caaagacaaaaacaaaaataaaattgattctgtcagaagattcattccaaaaagtgatcaaatcaaagcagttgg

SEQ ID NO: 261823 - DNA, 75 bp, Artificial Sequence
  Synthetic
gataagctgcaaacagacggaactctcattagatctagcactatcaaagtacctctctgatttgctttttgtatt

SEQ ID NO: 261824 - DNA, 75 bp, Artificial Sequence
  Synthetic
ttttatcattgttgagaaaaaaagaaatacctatagcagattagaggacaggagggtcagacctacaagtagtgg

SEQ ID NO: 261825 - DNA, 75 bp, Artificial Sequence
  Synthetic
ttcagaaatggactgtatgtaattgattagatcatcttggatacttgagataggaatgttgcaactccaaaacta

SEQ ID NO: 261826 - DNA, 75 bp, Artificial Sequence
  Synthetic
attagatcatcttggatacttgagataggaatgttgcaactccaaaactaaaccgtgtaaataattgtgataaat

SEQ ID NO: 261827 - DNA, 75 bp, Artificial Sequence
  Synthetic
ctcataattaatgatatgatgataaataaagattcaaattgacttatgatataatctcatactataacaacatct

SEQ ID NO: 261828 - DNA, 75 bp, Artificial Sequence
  Synthetic
atcacccaaaaaaatcaaagagaatgccgacagaaagcaagaaagttagattcgaaaatactgcttcagacaagg

SEQ ID NO: 261829 - DNA, 75 bp, Artificial Sequence
  Synthetic
tacataaaagttaatctcataatttgatggaatgatctggtgcaataatagcaactgtgcaaaggaatgtgatgt

SEQ ID NO: 261830 - DNA, 75 bp, Artificial Sequence
  Synthetic
gatggaatgatctggtgcaataatagcaactgtgcaaaggaatgtgatgtgaacaaaattgtcataattacataa

SEQ ID NO: 261831 - DNA, 75 bp, Artificial Sequence
  Synthetic
ctatacataatcttaacttacgcttcaagcatagtgatgacaattaatgtaaacttgtctcaatgtaaagagaat

SEQ ID NO: 261832 - DNA, 75 bp, Artificial Sequence
  Synthetic
aagaagtcattcaaagcatacaatatcattagtaagaaagtaatcggaatgctacaaaacatcactagaaatctc

SEQ ID NO: 261833 - DNA, 75 bp, Artificial Sequence
  Synthetic
ataacccaagacagaagggatgaaataatcaatatacatgagtgtagacggttaggagatttagggaagaatatg

SEQ ID NO: 261834 - DNA, 75 bp, Artificial Sequence
  Synthetic
ctacatcactgcataaaggagatgcatcaggaattgagtgagtgtggctttacagatcagaaaattcggtctatg

SEQ ID NO: 261835 - DNA, 75 bp, Artificial Sequence
  Synthetic
agaaagatttccaatgctttaaaggagttaccaccaatgtgaaagacaaaaagaataaccctttttataaagtta

SEQ ID NO: 261836 - DNA, 75 bp, Artificial Sequence
  Synthetic
tggatgaaactagatcggcttgtagtaacatcagcactacaatcgctaaagctatagaaaatgggttatcaagaa

SEQ ID NO: 261837 - DNA, 75 bp, Artificial Sequence
  Synthetic
gtaatatacggtcttgaggtaccagatgcccttgaagctatggtggggaggtatataacaggaagcttagagtgc

SEQ ID NO: 261838 - DNA, 75 bp, Artificial Sequence
  Synthetic
ccgacaatttgtgctggtccaaagttcagttattaagaaaaacttaataacgattcttctttacccttgttcggt

SEQ ID NO: 261839 - DNA, 75 bp, Artificial Sequence
  Synthetic
gagtgaaactagaagatgggctaagtacgttcaacaaaagagagtcaatccgttctttgctctaactcagcaatg

SEQ ID NO: 261840 - DNA, 75 bp, Artificial Sequence
  Synthetic
gatcaaggctggctgctaaagcagcaaaggaagccgcttcgtctaatgcaacagatgatccagcaatcagcaaca

SEQ ID NO: 261841 - DNA, 75 bp, Artificial Sequence
  Synthetic
gcgaatcgttttaactgtattaatcaagtgatactcttttatgggcaaagcgaacaaccaatgtctacatgtaaa

SEQ ID NO: 261842 - DNA, 75 bp, Artificial Sequence
  Synthetic
aagtgatactcttttatgggcaaagcgaacaaccaatgtctacatgtaaattaagctctggtattgcaatctaat

SEQ ID NO: 261843 - DNA, 75 bp, Artificial Sequence
  Synthetic
atttactcaaaatcttgagctattagtgcaattcataccaccatagatttatcaagattttattatataagttgg

SEQ ID NO: 261844 - DNA, 75 bp, Artificial Sequence
  Synthetic
tcaactcgagacagcctccaaattaagggcaacaagccagcagatgcaccaggagcaggaccgaaagattcagca

SEQ ID NO: 261845 - DNA, 75 bp, Artificial Sequence
  Synthetic
gaaagatgcccagcctctatattacaggggcattgagggatcgagaagcccagacaaggctgagatcaccagcga

SEQ ID NO: 261846 - DNA, 75 bp, Artificial Sequence
  Synthetic
aggggagaaataaaaggttttttaaggtttttagatcatcataatatgtatcttctttaatcacattataggagt

SEQ ID NO: 261847 - DNA, 75 bp, Artificial Sequence
  Synthetic
ctacatcactgcataaaggagatgcatcaggaactgagtgagtgtggctttacagatcagaagattcggtctatg

SEQ ID NO: 261848 - DNA, 75 bp, Artificial Sequence
  Synthetic
accagttatgctccctatgcctgatattaggaacaaattatttcattacaatcaagtggatgacccaaagcttag

SEQ ID NO: 261849 - DNA, 75 bp, Artificial Sequence
  Synthetic
actctttggtgtgttctggaacccgcctgatgtatccaattttatagcgtcccttcttcctgatttccatcttca

SEQ ID NO: 261850 - DNA, 75 bp, Artificial Sequence
  Synthetic
tgtcacttttaaacgagccctcggggcgcggcctaaacagccccccccgagggaaataccacaaagacccccacg

SEQ ID NO: 261851 - DNA, 75 bp, Artificial Sequence
  Synthetic
tcttaccagaccaaccccagactttgaatttatgtttttggttccccctactgttgaatctaaaactaagccttt

SEQ ID NO: 261852 - DNA, 75 bp, Artificial Sequence
  Synthetic
gggacctgaagacttggcacgagatctagtcccagtgattcttggtggtataggattagccattgggttcaccag

SEQ ID NO: 261853 - DNA, 75 bp, Artificial Sequence
  Synthetic
gaatttatgtttttggttccccctactgttgaatctaaaactaagcctttctctttgcctagtcttactcttgat

SEQ ID NO: 261854 - DNA, 75 bp, Artificial Sequence
  Synthetic
gtgccaaagatggcgtttccggtttgcctgagctttccaccgtcaggcaaccggaagaaaccaatacggccttca

SEQ ID NO: 261855 - DNA, 75 bp, Artificial Sequence
  Synthetic
cctcagaatggaagatgcaccatagatggtctcctgcagggcactacgcaacttgtgtcttgtaatgtttgcagc

SEQ ID NO: 261856 - DNA, 75 bp, Artificial Sequence
  Synthetic
atggtctcctgcagggcactacgcaacttgtgtcttgtaatgtttgcagctttagggggactattggtgatggcc

SEQ ID NO: 261857 - DNA, 75 bp, Artificial Sequence
  Synthetic
gaagagaaggccaggaagctctctgctaaaaacgctgacccacatgtgatatcctcaacaaatgccctaatatcg

SEQ ID NO: 261858 - DNA, 75 bp, Artificial Sequence
  Synthetic
ttgatggcacaccctatgacccagctgatgacatccctgcagtattgggctcccccgattttcagggggtcatat

SEQ ID NO: 261859 - DNA, 75 bp, Artificial Sequence
  Synthetic
atcctcaacaaatgccctaatatcgcgcatatccatggcacgatctgcattggccaaggcccaggctgagatgac

SEQ ID NO: 261860 - DNA, 75 bp, Artificial Sequence
  Synthetic
tgatgacatccctgcagtattgggctcccccgattttcagggggtcatatttggcatccttagccagagaaacac

SEQ ID NO: 261861 - DNA, 75 bp, Artificial Sequence
  Synthetic
cagtcgaatgcgaccagttgtcattatgatgtgtggcccacctgggattgggaagaccaaggctgctgagcacct

SEQ ID NO: 261862 - DNA, 75 bp, Artificial Sequence
  Synthetic
atgatgtgtggcccacctgggattgggaagaccaaggctgctgagcacctagctaagcgtctagccaatgagatc

SEQ ID NO: 261863 - DNA, 75 bp, Artificial Sequence
  Synthetic
cgtggccaccgtagagagcacagatttccacgccaaccaacctagtaggttcacccctgttgggttgggcggtga

SEQ ID NO: 261864 - DNA, 75 bp, Artificial Sequence
  Synthetic
agaccaggtggtaaggtggggttggttccccgtgaagctgtcgaccactgggacggttatcatggtgaggaagtg

SEQ ID NO: 261865 - DNA, 75 bp, Artificial Sequence
  Synthetic
gtgtccccccactcaatcagagggagaatagggatgctaaggaaccactgactggaacaattctggaaatgtggg

SEQ ID NO: 261866 - DNA, 75 bp, Artificial Sequence
  Synthetic
cggttgccggcctacggcggcgcactgacgaataacaccaatcttgccccgcccgtgatgcctgtctatccagga

SEQ ID NO: 261867 - DNA, 75 bp, Artificial Sequence
  Synthetic
ttcagatgcaatagtcatcaccaccaacgccccaggccccgcccctgtggactttgtcaaccttggaccagtgtg

SEQ ID NO: 261868 - DNA, 75 bp, Artificial Sequence
  Synthetic
ccccaggagtgggttcaacactttttccaggagtcggccacctctcaaagcgatgtggccctagtcaggtatata

SEQ ID NO: 261869 - DNA, 75 bp, Artificial Sequence
  Synthetic
tccaggagtcggccacctctcaaagcgatgtggccctagtcaggtatataaaccccaccacaggcagggtgctct

SEQ ID NO: 261870 - DNA, 75 bp, Artificial Sequence
  Synthetic
gtgatttcgagttacaaggacctgaggaccttgtagtggagctcgtccctgtagtaatggggggaattggtttgg

SEQ ID NO: 261871 - DNA, 75 bp, Artificial Sequence
  Synthetic
ggaccttgtagtggagctcgtccctgtagtaatggggggaattggtttggtgctgggattcaccaaagagaagat

SEQ ID NO: 261872 - DNA, 75 bp, Artificial Sequence
  Synthetic
aacgccccaggccccgcccctgtggactttgtcaaccttggaccagtgtgtagacgggtcgactttttggtgtac

SEQ ID NO: 261873 - DNA, 75 bp, Artificial Sequence
  Synthetic
ccagatttctcacatttaaaaatggagctggctccacaaggtgggtttgataatcaagggaacacaccatttggc

SEQ ID NO: 261874 - DNA, 75 bp, Artificial Sequence
  Synthetic
atggctactttagatttgaatcttgggtgaatcaattttacaccttggcccccatgggaaatggtagtgggcgca

SEQ ID NO: 261875 - DNA, 75 bp, Artificial Sequence
  Synthetic
agctggctccacaaggtgggtttgataatcaagggaacacaccatttggcaggggcaccatgaagccaacaacca

SEQ ID NO: 261876 - DNA, 75 bp, Artificial Sequence
  Synthetic
ggtgaatcaattttacaccttggcccccatgggaaatggtagtgggcgcaggagagctcgttaatggctggacag

SEQ ID NO: 261877 - DNA, 75 bp, Artificial Sequence
  Synthetic
atgactttgatgatgacagggtgtcagcgttcaccaccatggcacgtgacaatggcctgggcatcttgagcatgg

SEQ ID NO: 261878 - DNA, 75 bp, Artificial Sequence
  Synthetic
aatcagaaggttgaatatgattttaataagaagttgcagtcttcctcttttgcccatgataaagaaatgctacag

SEQ ID NO: 261879 - DNA, 75 bp, Artificial Sequence
  Synthetic
gaaaacaaccatatgaccaccttgctcaaagacaaagacagcctggcaacctacatgagaacccttgacctcgag

SEQ ID NO: 261880 - DNA, 75 bp, Artificial Sequence
  Synthetic
ataagaagttgcagtcttcctcttttgcccatgataaagaaatgctacaggcacaagtggatgcaaccaggcaat

SEQ ID NO: 261881 - DNA, 75 bp, Artificial Sequence
  Synthetic
ctacatgagaacccttgacctcgaggaagagaaagccagaaaactctcaaccaagtctgcttcacctgacatcgt

SEQ ID NO: 261882 - DNA, 75 bp, Artificial Sequence
  Synthetic
gtgcgtgcacaataaaatggcaggctaaagtgtactcactagagtcagatggcaacagtgtcaacattaaagagg

SEQ ID NO: 261883 - DNA, 75 bp, Artificial Sequence
  Synthetic
taaagtgtactcactagagtcagatggcaacagtgtcaacattaaagaggagaggaacatcttaactcaacaaca

SEQ ID NO: 261884 - DNA, 75 bp, Artificial Sequence
  Synthetic
gctctcttggcgtgcctatgactaaagctttggactggaatggcacgagatactgggctcccaactctatgggta

SEQ ID NO: 261885 - DNA, 75 bp, Artificial Sequence
  Synthetic
agctttggactggaatggcacgagatactgggctcccaactctatgggtacctctagttattcagggcgtttttc

SEQ ID NO: 261886 - DNA, 75 bp, Artificial Sequence
  Synthetic
ccaatcggctataacttctatactacaaattgctggctcagccctagtggtcaacagagcagtgaagagaatgtt

SEQ ID NO: 261887 - DNA, 75 bp, Artificial Sequence
  Synthetic
tcccacgcaatggcgtcgatcactgggatgcgtacaagggggagagggtcgtcctatgggacgactatggaatga

SEQ ID NO: 261888 - DNA, 75 bp, Artificial Sequence
  Synthetic
atgggcatgcttctgacaggatccaacgccaaaagcatggatctaggcaccacaccaggtgactgcggctgtccc

SEQ ID NO: 261889 - DNA, 75 bp, Artificial Sequence
  Synthetic
ttcagggtccacgagtgcctcttcggcctcgtcagtttcaaccacgtcgacagggctttccagtacttccacaac

SEQ ID NO: 261890 - DNA, 75 bp, Artificial Sequence
  Synthetic
cagggctttccagtacttccacaactccatcaagactgtcaagatcctcgaccaccacagataggaccagggagt

SEQ ID NO: 261891 - DNA, 75 bp, Artificial Sequence
  Synthetic
aatgcagggtccacatggccaaggccgcaggaaaggggcctattggccatgatgatgtggtagaaaagtatgggc

SEQ ID NO: 261892 - DNA, 75 bp, Artificial Sequence
  Synthetic
ggagctctagtgtcggcacagtctcgaccgtgccagactttgttttggactcatggaccccttcctttaacacaa

SEQ ID NO: 261893 - DNA, 75 bp, Artificial Sequence
  Synthetic
ggaggcaaccgcttttcgcacacctgcgtaggcggggagagtcacaagcttagcagcttagtgaaagatagggct

SEQ ID NO: 261894 - DNA, 75 bp, Artificial Sequence
  Synthetic
cgccagctagggctggtgacaggttccgacattcggaagagaaaaccaatcgactggaccccacccaagtcagca

SEQ ID NO: 261895 - DNA, 75 bp, Artificial Sequence
  Synthetic
atgaagatggcgtctaacgacgcttccgctgccgctgctgccaacagcaacaacgacatcgcaaaatcttcaagt

SEQ ID NO: 261896 - DNA, 75 bp, Artificial Sequence
  Synthetic
cgactggaccccacccaagtcagcatgggcagatgatgagcgtgaggtggattacaatgagaagatcagttttga

SEQ ID NO: 261897 - DNA, 75 bp, Artificial Sequence
  Synthetic
gagtctgatggcaagggcaatgtgaaagttgacagaatccagagcacctccgtacagaccaacaatgagctggct

SEQ ID NO: 261898 - DNA, 75 bp, Artificial Sequence
  Synthetic
gcctgagctcaccactgtcaaacaaccggaagaaaccaacacggcgttcagtgttcccccactcaaccagaggga

SEQ ID NO: 261899 - DNA, 75 bp, Artificial Sequence
  Synthetic
gagggagaagccacacttgaaggcggtgacaacaagggaacctactgtggtgcaccaatcttaggtccaggaagt

SEQ ID NO: 261900 - DNA, 75 bp, Artificial Sequence
  Synthetic
tgcaccaatcttaggtccaggaagtgccccaaagctcagcaccaagactaagttctggagatcatccacagcacc

SEQ ID NO: 261901 - DNA, 75 bp, Artificial Sequence
  Synthetic
atacagggccgccttgtccatgggcagtccggcatgttgctcaccggggctaatgctaagggcatggaccttgga

SEQ ID NO: 261902 - DNA, 75 bp, Artificial Sequence
  Synthetic
acaagttatgagggaccagctgaaaccattcactgagcccaggggtaaaccaccaaaaccaagtgtgttagaggc

SEQ ID NO: 261903 - DNA, 75 bp, Artificial Sequence
  Synthetic
atttcatctgacgacattaaaactgagggtaagaaagggaagaacaagactggccgtggcaagaagcacacagcc

SEQ ID NO: 261904 - DNA, 75 bp, Artificial Sequence
  Synthetic
gctgccaccaaatcaggcaacaccgttgtgtgcgccgttcaggccagtgaaggagaaaccacgcttgaaggcggt

SEQ ID NO: 261905 - DNA, 75 bp, Artificial Sequence
  Synthetic
aggagaaaccacgcttgaaggcggtgacaaaggtcactatgctggacatgaaataattaagcatggttgtggacc

SEQ ID NO: 261906 - DNA, 75 bp, Artificial Sequence
  Synthetic
ttctgtgaagaggaggaggccaagatccggcaaaggatctttagaccaacaaggaaacaacgcaaggaagaaaga

SEQ ID NO: 261907 - DNA, 75 bp, Artificial Sequence
  Synthetic
agccctgtcaaccaaaaccaaattctggaaatcatcccccgaaccactaccccctggggtctatgaacccgccta

SEQ ID NO: 261908 - DNA, 75 bp, Artificial Sequence
  Synthetic
tgggctgacgatgacagaagtgtggactacaatgagaaactcagttttgaggccccaccaagcatctggtcaagg

SEQ ID NO: 261909 - DNA, 75 bp, Artificial Sequence
  Synthetic
tgctgagccacgaggacgcatgccagagccaggtctcttggaggccgcagttgagactgtgacttcatcattaga

SEQ ID NO: 261910 - DNA, 75 bp, Artificial Sequence
  Synthetic
cttcgcaggcatagtggagtccttgatactcatggcagaactctttggagttttctggacacccccagatgtgtc

SEQ ID NO: 261911 - DNA, 75 bp, Artificial Sequence
  Synthetic
aatactcaggcaaatgtattggactaggggccccaaccatgaagacccatctgaaacaatgataccacactccca

SEQ ID NO: 261912 - DNA, 75 bp, Artificial Sequence
  Synthetic
gcaggttatggacactcccgttccttggagctatagtgatgcgtgccagtcccttgataagaccactagttctgg

SEQ ID NO: 261913 - DNA, 75 bp, Artificial Sequence
  Synthetic
agtgatggggggaataggtttggtgctaggatttaccaaagagaaaattggaaagatgttgtcatctgctgcatc

SEQ ID NO: 261914 - DNA, 75 bp, Artificial Sequence
  Synthetic
acacgctaataacatgtatgaacaggctaaaagtatgaaacccatgtacacggcagcgcttaaagatgaactagt

SEQ ID NO: 261915 - DNA, 75 bp, Artificial Sequence
  Synthetic
caaaccagagaaggtataccaaaaagtgaagaagcgcttgttatggggggcagacttgggcacggtggttcgggc

SEQ ID NO: 261916 - DNA, 75 bp, Artificial Sequence
  Synthetic
ttcaattgaggatgggccactgatctatgcagaacattcaaagtataagtaccattttgatgcagattacacagc

SEQ ID NO: 261917 - DNA, 75 bp, Artificial Sequence
  Synthetic
tatgcagaacattcaaagtataagtaccattttgatgcagattacacagcttgggattcaactcaaaatagacaa

SEQ ID NO: 261918 - DNA, 75 bp, Artificial Sequence
  Synthetic
ttgcttgcaccctcagagatggatgttggcgactatgtcataagagtgaaggaaggcctcccatctggttttcca

SEQ ID NO: 261919 - DNA, 75 bp, Artificial Sequence
  Synthetic
ttggcgactatgtcataagagtgaaggaaggcctcccatctggttttccatgtacatcacaggttaatagtataa

SEQ ID NO: 261920 - DNA, 75 bp, Artificial Sequence
  Synthetic
ccgcgcaatggtgtcgaccattgggacgcgtacaagggagaaagggttgtcctgtgggacgactatggaatgagt

SEQ ID NO: 261921 - DNA, 75 bp, Artificial Sequence
  Synthetic
ccaaagccaagtgtgttagaagctgccaagaaaaccatcatcaatgtccttgaacaaacaattgacccacctgag

SEQ ID NO: 261922 - DNA, 75 bp, Artificial Sequence
  Synthetic
atttctctttctatggtgatgatgaaatagtgtcaactgacatagaatttgatccagcaaaactgacacaagtcc

SEQ ID NO: 261923 - DNA, 75 bp, Artificial Sequence
  Synthetic
tcagagagtatggacttaaacccacccgccccgacaaaagcgaggacccaataattgtgaggaagagtgtggatg

SEQ ID NO: 261924 - DNA, 75 bp, Artificial Sequence
  Synthetic
aagtggtcgttcgcacaagcttgcgcctcccttgacaagaccacttctagcggccatccgcaccatatgcggaaa

SEQ ID NO: 261925 - DNA, 75 bp, Artificial Sequence
  Synthetic
aaagacaaatctactggactagaggacccaaccattcagacccttttgagaccctggtgccacaccaacaaagga

SEQ ID NO: 261926 - DNA, 75 bp, Artificial Sequence
  Synthetic
acccaaccattcagacccttttgagaccctggtgccacaccaacaaaggaaggtccaactaatatcattattggg

SEQ ID NO: 261927 - DNA, 75 bp, Artificial Sequence
  Synthetic
ggtagcagaccaattgtggtgccagctaatggttacttcaggtttgactcttgggttaatcaattctattctctc

SEQ ID NO: 261928 - DNA, 75 bp, Artificial Sequence
  Synthetic
atggatgaactcaaagcacactgtgtcacacttcctattagagttggtatgaatatgaatgaggatggccccatc

SEQ ID NO: 261929 - DNA, 75 bp, Artificial Sequence
  Synthetic
ggttactccatgagaggctagatgaatatgaactgcaaggcccaactctcaccactttcaactttgaccgcaaca

SEQ ID NO: 261930 - DNA, 75 bp, Artificial Sequence
  Synthetic
ccttgaaatgtatgtgccagcatggcaagccatgttccgttggatgcggttccatgaccttggtttgtggacagg

SEQ ID NO: 261931 - DNA, 75 bp, Artificial Sequence
  Synthetic
caagccatgttccgttggatgcggttccatgaccttggtttgtggacaggagatcgcaatctcctgcccgaattt

SEQ ID NO: 261932 - DNA, 75 bp, Artificial Sequence
  Synthetic
tcatccaggaaattaaaacagggggccttgaaatgtatgtgccagcatggcaagccatgttccgttggatgcggt

SEQ ID NO: 261933 - DNA, 75 bp, Artificial Sequence
  Synthetic
gacacaatgagagttggaaaacagctcagggatgtcaagaccatgccagacctcaaacaagcactcaagaatgtc

SEQ ID NO: 261934 - DNA, 75 bp, Artificial Sequence
  Synthetic
ggttaatacagctgaccccttacccatggaacctgtggctgggccaacaacagccgtagccactgctgggcaagt

SEQ ID NO: 261935 - DNA, 75 bp, Artificial Sequence
  Synthetic
tacccccggtgatattttgtttgatttacaattaggtccacatctaaaccctttcttgtcacatttgtcccaaat

SEQ ID NO: 261936 - DNA, 75 bp, Artificial Sequence
  Synthetic
tccaggaggcactgtactccattatccaaattgctggggctgcatttgtcaccacgcgcattactaagcgcatga

SEQ ID NO: 261937 - DNA, 75 bp, Artificial Sequence
  Synthetic
agagtcagaattctccttgctgggaatgcattctcagctggaaagattatagtttgttttgtcccccctggcttt

SEQ ID NO: 261938 - DNA, 75 bp, Artificial Sequence
  Synthetic
tgtgacccgcgacccagctggttggtttggaaaactggatcagagctcaatactcaggcaaatgtactggactag

SEQ ID NO: 261939 - DNA, 75 bp, Artificial Sequence
  Synthetic
atagaaatgcccctcgaggatgtacgcaatgtcctctatcacaccaatgataatcaaccaacaatgcggctggtg

SEQ ID NO: 261940 - DNA, 75 bp, Artificial Sequence
  Synthetic
taatcaaccaacaatgcggctggtgtgtatgctatacacgccgctccgcactggtggggggtctggtagttctga

SEQ ID NO: 261941 - DNA, 75 bp, Artificial Sequence
  Synthetic
tgtatgctatacacgccgctccgcactggtggggggtctggtagttctgattcctttgtagttgctggcagggtt

SEQ ID NO: 261942 - DNA, 75 bp, Artificial Sequence
  Synthetic
actgtgcctaatatccccttgcaaaccttgtccaattctaggtttccttccctcatccaggggatgattctgtcc

SEQ ID NO: 261943 - DNA, 75 bp, Artificial Sequence
  Synthetic
gctacatcaggacagctgttcagagtaagaggaaagataaatcagggagcccgcacacttaacctcacagaggtg

SEQ ID NO: 261944 - DNA, 75 bp, Artificial Sequence
  Synthetic
ccccaccaagcatctggtcgcggatagtcaactttggttcaggttggggcttctgggtctcccccagtctgttta

SEQ ID NO: 261945 - DNA, 75 bp, Artificial Sequence
  Synthetic
gatggtaaaccattcatggcatttgattcccctgcacctgtggggttccccgattttggaaaatgtgattggcac

SEQ ID NO: 261946 - DNA, 75 bp, Artificial Sequence
  Synthetic
cgattttggaaaatgtgattggcacatgagaatcagcaaaaccccaaacaacacaagttcaggtgaccccatgcg

SEQ ID NO: 261947 - DNA, 75 bp, Artificial Sequence
  Synthetic
aatcaggtgaattctgccggttaagattcccaaaaccaatcagaactgatgtgacgggcatgattctagaagaag

SEQ ID NO: 261948 - DNA, 75 bp, Artificial Sequence
  Synthetic
aggaaccttggggagttcaagctataccctggaggttacctcacctgtgtaccaaacggggtaggtgccgggcct

SEQ ID NO: 261949 - DNA, 75 bp, Artificial Sequence
  Synthetic
caaaactcagtactaagactaagttttggagatcatccacaacaccactcccacctggcacctacgaaccagcct

SEQ ID NO: 261950 - DNA, 75 bp, Artificial Sequence
  Synthetic
acagccagtacggcaagaggtaggcttggagtacgccgtatataatggcccaagccatcataggagcaattgccg

SEQ ID NO: 261951 - DNA, 75 bp, Artificial Sequence
  Synthetic
aggcaccacccaactgtctcccgtcaacatctgcaccttcagaggggatgtcacccacattgcaggttctcgtaa

SEQ ID NO: 261952 - DNA, 75 bp, Artificial Sequence
  Synthetic
aagaaaaccatcatcaatgttcttgagcaaacaattgacccaccccaaaaatggtcattcgcgcaagcttgcgca

SEQ ID NO: 261953 - DNA, 75 bp, Artificial Sequence
  Synthetic
tacttttgaacatgataaggatatgctttcctaccaggtccaggcaagtaatgcacttttggcaaagaatctcaa

SEQ ID NO: 261954 - DNA, 75 bp, Artificial Sequence
  Synthetic
acaggaaaattggcagatcaggcctccaaggccaatctaatgtttgaagaggggaagaacatgactccagtctac

SEQ ID NO: 261955 - DNA, 75 bp, Artificial Sequence
  Synthetic
tgattttgaaactcaccaaaacacaaaattcaccccagtcggtgtcatccaggatggtggcaccacccaccgaaa

SEQ ID NO: 261956 - DNA, 75 bp, Artificial Sequence
  Synthetic
aacacaattgattgattggaacggcactcgggttgccgcccccaggtcaagtgcaacaactctgaggtctggtgg

SEQ ID NO: 261957 - DNA, 75 bp, Artificial Sequence
  Synthetic
cgaccacccactccagagttgatcaaaaaggtcccccctcccccgcccaatggggaggatgaaccagtggtctcc

SEQ ID NO: 261958 - DNA, 75 bp, Artificial Sequence
  Synthetic
aaaaggtcccccctcccccgcccaatggggaggatgaaccagtggtctcctatagcgtcaaagatggcgtttccg

SEQ ID NO: 261959 - DNA, 75 bp, Artificial Sequence
  Synthetic
aaattcaccccagtcggtgtcatccaggatggtggcaccacccaccgaaatgaaccccaacaatgggtgctccca

SEQ ID NO: 261960 - DNA, 75 bp, Artificial Sequence
  Synthetic
gcgcccgagcttttggaggccttatggatgaactcaaggcacattgtgtcaccctccctgtcagagttggtatga

SEQ ID NO: 261961 - DNA, 75 bp, Artificial Sequence
  Synthetic
cctctgggttttctaatcctgcttatgacacgtccacagtttcttctaggacttcttcttgggtgcagtcacaga

SEQ ID NO: 261962 - DNA, 75 bp, Artificial Sequence
  Synthetic
tttggattgcctactcccccaggagtgggtgcagcacttctaccaagaggcagctccagcacaatctgatgtggc

SEQ ID NO: 261963 - DNA, 75 bp, Artificial Sequence
  Synthetic
gggagaacagggatgccaaggagccactgactggaacaatcctggaaatgtgggatggggagatttaccattatg

SEQ ID NO: 261964 - DNA, 75 bp, Artificial Sequence
  Synthetic
actgactggaacaatcctggaaatgtgggatggggagatttaccattatggcttgtatgtggaacaaggcctggt

SEQ ID NO: 261965 - DNA, 75 bp, Artificial Sequence
  Synthetic
cctcttcttctgtttcctcaacaccttatggtgtttttaatacggataggatgccgctattcgcaaatttgcggc

SEQ ID NO: 261966 - DNA, 75 bp, Artificial Sequence
  Synthetic
atggttaaattctctccagaaccacacctggctcaaatagttgcagaagacctactttcccctagtgtaatggat

SEQ ID NO: 261967 - DNA, 75 bp, Artificial Sequence
  Synthetic
gttaatgttgtaatataatgcagcagtgggcactatattcaatttggtttaattagtgaataatttggctattga

SEQ ID NO: 261968 - DNA, 75 bp, Artificial Sequence
  Synthetic
acctgtgtacaccccccagtatctcatctccccagacactcttaggaggctccatggggaatcgttcccttacac

SEQ ID NO: 261969 - DNA, 75 bp, Artificial Sequence
  Synthetic
aactaaaccattctctgtcccaattttaactgttgaggagatgaccaattcaagattccccattcctttggaaaa

SEQ ID NO: 261970 - DNA, 75 bp, Artificial Sequence
  Synthetic
atctccccagacactcttaggaggctccatggggaatcgttcccttacacagcttttgacaacaactgctatgcc

SEQ ID NO: 261971 - DNA, 75 bp, Artificial Sequence
  Synthetic
aacggaacggggcgtaggcgcgccttataatggctggagctttctttgctggattggcatctgatgtccttggct

SEQ ID NO: 261972 - DNA, 75 bp, Artificial Sequence
  Synthetic
agaccttaccaagattggaatagaaagccccttcccaccatggatgactccaaactgaagaaggtggccaatatt

SEQ ID NO: 261973 - DNA, 75 bp, Artificial Sequence
  Synthetic
ctcaaggagtacgggctgaaaccaacccgccccgacaaaactgaaggacccctcgttatctctgaagatctggat

SEQ ID NO: 261974 - DNA, 75 bp, Artificial Sequence
  Synthetic
agccccttcccaccatggatgactccaaactgaagaaggtggccaatattttcctgtgtgctttgtcttcactat

SEQ ID NO: 261975 - DNA, 75 bp, Artificial Sequence
  Synthetic
cctcgttatctctgaagatctggatggcctgacattcctgcggaggactgtgacccgtgacccagctggttggtt

SEQ ID NO: 261976 - DNA, 75 bp, Artificial Sequence
  Synthetic
agattcaccccagtcggtgttgtccaggatggtagtaccacccaccaaaatgaaccccaacaatgggtactccca

SEQ ID NO: 261977 - DNA, 75 bp, Artificial Sequence
  Synthetic
cctgatcctcttggcagagctctttggagttttctggacacccccagatgtgtctgcgatgatcgcccccttact

SEQ ID NO: 261978 - DNA, 75 bp, Artificial Sequence
  Synthetic
aacaatgataccacactcccaaagacccatacaattgatgtctctgctgggcgaggctgcactccacggcccggc

SEQ ID NO: 261979 - DNA, 75 bp, Artificial Sequence
  Synthetic
ggagttttctggacacccccagatgtgtctgcgatgatcgcccccttactgggtgactacgagctgcaggggcct

SEQ ID NO: 261980 - DNA, 75 bp, Artificial Sequence
  Synthetic
tgtctgcgatgatcgcccccttactgggtgactacgagctgcaggggcctgaggacctcgcggtagaactagtgc

SEQ ID NO: 261981 - DNA, 75 bp, Artificial Sequence
  Synthetic
gtcattgcagagttgaaggaaggtggcatggatttttacgtgcccagacaagagccaatgttcagatggatgaga

SEQ ID NO: 261982 - DNA, 75 bp, Artificial Sequence
  Synthetic
cgtccacattgagagcttgtaaagaccttggtgcgtacgggctggagatcttaaaattagtcatgaaatggttct

SEQ ID NO: 261983 - DNA, 75 bp, Artificial Sequence
  Synthetic
ccttggtgcgtacgggctggagatcttaaaattagtcatgaaatggttcttcccgaagaaagaggaggcgagcga

SEQ ID NO: 261984 - DNA, 75 bp, Artificial Sequence
  Synthetic
ttcaacgagacttggttctacagctggttctggtaccaatgtctcgagtctcccgtcaactgcaaggactaggag

SEQ ID NO: 261985 - DNA, 75 bp, Artificial Sequence
  Synthetic
acttaaagataaggacagcctggcggcttacatgagaactctcgaccttgaggaagagaaagccagaaagctctc

SEQ ID NO: 261986 - DNA, 75 bp, Artificial Sequence
  Synthetic
gcttacatgagaactctcgaccttgaggaagagaaagccagaaagctctcaaccaaatctgcttcacccgacatc

SEQ ID NO: 261987 - DNA, 75 bp, Artificial Sequence
  Synthetic
atcctctagccaaggcacagtctcaaccgtgcctaaagaagttttggactcctggactggcgctttcaacacgcg

SEQ ID NO: 261988 - DNA, 75 bp, Artificial Sequence
  Synthetic
tccagtaggccgagacccgttgttgtgatgatatcgggaaaaccagggatagggaagacccatcttgccagagaa

SEQ ID NO: 261989 - DNA, 75 bp, Artificial Sequence
  Synthetic
tgatgatatcgggaaaaccagggatagggaagacccatcttgccagagaactggccaaaaagatcgcagctactc

SEQ ID NO: 261990 - DNA, 75 bp, Artificial Sequence
  Synthetic
gtaccacccctagagctctctcccccaacaagggaggaagaaccaacatccccccagtaccgcccccaccaccca

SEQ ID NO: 261991 - DNA, 75 bp, Artificial Sequence
  Synthetic
tcgtcctttgggatgactacgggatgagcaaccccatccatgatgctctcagaatacaggagcttgctgacactt

SEQ ID NO: 261992 - DNA, 75 bp, Artificial Sequence
  Synthetic
agaatacaggagcttgctgacacttgccccctaacattaaactgtgatagaattgaaaacaaagggaaagttttt

SEQ ID NO: 261993 - DNA, 75 bp, Artificial Sequence
  Synthetic
agattccccattcctttggaaaggttgtacacgggtcccagcagtgcttttgttgtccagccacaaaacggcagg

SEQ ID NO: 261994 - DNA, 75 bp, Artificial Sequence
  Synthetic
tcgaggcgcattgatttcctcgtgtatgccgacgcccctgatgtcgaaaaggcgaagcgcgacttcccaggccaa

SEQ ID NO: 261995 - DNA, 75 bp, Artificial Sequence
  Synthetic
atgccgacgcccctgatgtcgaaaaggcgaagcgcgacttcccaggccaacctgacatgtggaaaaatgctttta

SEQ ID NO: 261996 - DNA, 75 bp, Artificial Sequence
  Synthetic
actcacattgcaggctctcgcaattatacaatgaatttggcctctcaaaattggaacaactatgatccaacagaa

SEQ ID NO: 261997 - DNA, 75 bp, Artificial Sequence
  Synthetic
atacaatgaatttggcctctcaaaattggaacaactatgatccaacagaagaaatcccagcccccctgggcaccc

SEQ ID NO: 261998 - DNA, 75 bp, Artificial Sequence
  Synthetic
ggaagggcgtcatgaaaaccctcaccgttggttccctcatcgcccgtgcatcaggactcctccatgagagactgg

SEQ ID NO: 261999 - DNA, 75 bp, Artificial Sequence
  Synthetic
cgttggttccctcatcgcccgtgcatcaggactcctccatgagagactggatgagtacgaactacagggcccagc

SEQ ID NO: 262000 - DNA, 75 bp, Artificial Sequence
  Synthetic
ctcgtggctgagtaggagaatgatccagagaacaactggcttcttcagaccctaccaagattggaataggaaacc

SEQ ID NO: 262001 - DNA, 75 bp, Artificial Sequence
  Synthetic
ccacagtgctcactgggagtgccgacttcgccccaaaattgggcagagttcaattcgccactgacacagacaacg

SEQ ID NO: 262002 - DNA, 75 bp, Artificial Sequence
  Synthetic
cttcgccccaaaattgggcagagttcaattcgccactgacacagacaacgatttcgaatctggccaaaacacgaa

SEQ ID NO: 262003 - DNA, 75 bp, Artificial Sequence
  Synthetic
ttttgggtctcccccagtctgttcataacatcaacccatgtcataccccagggcgcaaaggagttctttggagtc

SEQ ID NO: 262004 - DNA, 75 bp, Artificial Sequence
  Synthetic
aatggacacaatgagagtcggagggcagctcaagggtgtcagaaccatgtcagagctcaaacaagcactcaaaaa

SEQ ID NO: 262005 - DNA, 75 bp, Artificial Sequence
  Synthetic
caggcccataaaagacataatagggaagttaaggcctctcaacatcatcaacatcctggcttcatgtgattggac

SEQ ID NO: 262006 - DNA, 75 bp, Artificial Sequence
  Synthetic
cagctcaagggtgtcagaaccatgtcagagctcaaacaagcactcaaaaacatctcagttaaaaggtgccagata

SEQ ID NO: 262007 - DNA, 75 bp, Artificial Sequence
  Synthetic
ttactcaggtagaactggtcataatgtgcatctagcccctgctgttgcccccacttacccgggtgagcaactcct

SEQ ID NO: 262008 - DNA, 75 bp, Artificial Sequence
  Synthetic
tgcgatgattgcccccttactcggtgatttcgagttacaaggacctgaggaccttgtagtggagctcgtccctgt

SEQ ID NO: 262009 - DNA, 75 bp, Artificial Sequence
  Synthetic
actgtgcagaccaacaacgagttagccggcgccctgcaccatctcaggtgcgccaggattaggtactatgtcaag

SEQ ID NO: 262010 - DNA, 75 bp, Artificial Sequence
  Synthetic
ctacagtgtacctcccttggacctaagagagaaggttgacgcaaaggaacccctgacaggttcgatacttgaaat

SEQ ID NO: 262011 - DNA, 75 bp, Artificial Sequence
  Synthetic
caccttgagagcttgtaaagatcttggtgcatatgggctagagatcctaaagttagtcatgaagtggttcttccc

SEQ ID NO: 262012 - DNA, 75 bp, Artificial Sequence
  Synthetic
atgaacatacaggacctttggtccaagccacagctggaggacacaggagaagctgtcagcaaagaagggtgccca

SEQ ID NO: 262013 - DNA, 75 bp, Artificial Sequence
  Synthetic
gccattgctagggcgactgaggaggacttctgtgaagaagaagaagccaaaattcgacagaggatcttcagacca

SEQ ID NO: 262014 - DNA, 75 bp, Artificial Sequence
  Synthetic
cgaccacctactccagaactggtcaaaaagatccctcctcccccgcccaacggagaggatgaaatagtggtttct

SEQ ID NO: 262015 - DNA, 75 bp, Artificial Sequence
  Synthetic
acttctgtgaagaagaagaagccaaaattcgacagaggatcttcagaccaacaaggaaacaacgtaaagaggaga

SEQ ID NO: 262016 - DNA, 75 bp, Artificial Sequence
  Synthetic
ctcttctctttttatggtgatgatgaaattgttagcacagacataaaattggacccagaaaaattgacagcaaag

SEQ ID NO: 262017 - DNA, 75 bp, Artificial Sequence
  Synthetic
tgattacaatgagaagctcagttttgaagccccaccaagcatctggtcaagaatagtcaactttggttcgggctg

SEQ ID NO: 262018 - DNA, 75 bp, Artificial Sequence
  Synthetic
cctcactctaaattgtgacaggattgagaataaaggaaaggtctttgacagcgatgtcatcattatcactactaa

SEQ ID NO: 262019 - DNA, 75 bp, Artificial Sequence
  Synthetic
agtgtctatcaaacaaatccaaatacacaaatcaggtgagttttgccgcttgaggttcccaaagccaatcaggac

SEQ ID NO: 262020 - DNA, 75 bp, Artificial Sequence
  Synthetic
cacaaatcaggtgagttttgccgcttgaggttcccaaagccaatcaggactgacgtgacaggtatgatcttagag

SEQ ID NO: 262021 - DNA, 75 bp, Artificial Sequence
  Synthetic
ttcccccacataatagtagatgttaggcaattggaacctgtgttgattcccttacccgatgttaggaataatttc

SEQ ID NO: 262022 - DNA, 75 bp, Artificial Sequence
  Synthetic
aatgaacctcaacaatgggtgctcccaagctactcaggtagaactggtcataatgtacacctagcccccgccgta

SEQ ID NO: 262023 - DNA, 75 bp, Artificial Sequence
  Synthetic
aggatgggaactcacgcaaccatgaagatccaaggtcgcactgttgggggccaaatgggtatgctcctaacagga

SEQ ID NO: 262024 - DNA, 75 bp, Artificial Sequence
  Synthetic
ctcactcctctttctctatactggagggtagtttacaccccaccttacctaatagccccagaaaccctcaggaaa

SEQ ID NO: 262025 - DNA, 75 bp, Artificial Sequence
  Synthetic
agatccaaggtcgcactgttgggggccaaatgggtatgctcctaacaggatccaatgctaaaagtatggacctgg

SEQ ID NO: 262026 - DNA, 75 bp, Artificial Sequence
  Synthetic
acttggtgtgcacaaaccaccagctgccatcagcctcgccaaggtcgaactaacaccactctccttgttctggag

SEQ ID NO: 262027 - DNA, 75 bp, Artificial Sequence
  Synthetic
cagctgctgcccgtggggggaacactgtcatatgtgccacccagggtaatgaaggtgaggccatacttgagggcg

SEQ ID NO: 262028 - DNA, 75 bp, Artificial Sequence
  Synthetic
tgtcatatgtgccacccagggtaatgaaggtgaggccatacttgagggcggagatgacaaaggcacctactgtgg

SEQ ID NO: 262029 - DNA, 75 bp, Artificial Sequence
  Synthetic
agcctttgacaacaattgctatgccttctgttgttgggtcttagacctaaacgactcgtggctgagtaggcgaat

SEQ ID NO: 262030 - DNA, 75 bp, Artificial Sequence
  Synthetic
actcccgcctggcacctacgaaccagcctacctcggtggcaaggaccccagagtcaagagtggcccctcattaca

SEQ ID NO: 262031 - DNA, 75 bp, Artificial Sequence
  Synthetic
tggactgtctgctcccccaggaatgggtgcagtatttctaccaggaggcagccccagcacaatctgatgtggctc

SEQ ID NO: 262032 - DNA, 75 bp, Artificial Sequence
  Synthetic
caaattaaagaaggtagctaacatattcctgtgtgctctatcttcactattcaccaggcccatcaaagacataat

SEQ ID NO: 262033 - DNA, 75 bp, Artificial Sequence
  Synthetic
agaatcaggtactatgtcaagtgtgtccaggaggccctgtattctatcatccagattgctggggctgcatttgtc

SEQ ID NO: 262034 - DNA, 75 bp, Artificial Sequence
  Synthetic
tgccaagaaaaccatcatcaatgttcttgaacaaacaatagacccgcctcaaaaatggtcatttgcgcaagcttg

SEQ ID NO: 262035 - DNA, 75 bp, Artificial Sequence
  Synthetic
ccagattgctggggctgcatttgtcaccacgcgcatcatcaagcgtgtgaacattcaagacttatggtccaagcc

SEQ ID NO: 262036 - DNA, 75 bp, Artificial Sequence
  Synthetic
agggaagctgagacctcttaacattctcaacatcctggcctcatgtgattggacttttgcaggcatagtggaatc

SEQ ID NO: 262037 - DNA, 75 bp, Artificial Sequence
  Synthetic
tgagggcaagaaagggaagaacaagactggtcgcggcaagaagcacacagccttctcaagcaaaggtctcagtga

SEQ ID NO: 262038 - DNA, 75 bp, Artificial Sequence
  Synthetic
aggaggggaagaacatgaccccagtctacacaggtgccctcaaggatgagttagtcaaaactgacaagatatatg

SEQ ID NO: 262039 - DNA, 75 bp, Artificial Sequence
  Synthetic
catccaccttaagagcttgtaaagatcttggtgcatacgggctggaaatcctaaaattagtcatgaagtggttct

SEQ ID NO: 262040 - DNA, 75 bp, Artificial Sequence
  Synthetic
ctcaagtaaaggtctcagtgatgaagagtatgatgagtacaagagaattagagaggaaaggaatggcaagtactc

SEQ ID NO: 262041 - DNA, 75 bp, Artificial Sequence
  Synthetic
gtgaatgaagatggcgtctaacgacgcttctgctgccgctgctgttaacagcaacaacgacaacacaaaatcttc

SEQ ID NO: 262042 - DNA, 75 bp, Artificial Sequence
  Synthetic
gacaaatactatgaggaggtggccattgccagggcgaccgaggaagacttctgtgaagaggaggaggccaagatc

SEQ ID NO: 262043 - DNA, 75 bp, Artificial Sequence
  Synthetic
gcaacaacgacaacacaaaatcttcaagtgacggaatgtttaacaacgtggccgtcacccttaaacgagccctcg

SEQ ID NO: 262044 - DNA, 75 bp, Artificial Sequence
  Synthetic
tgatggacgaacttaaagcccactgtgtcacactccctgtcagagttggtatgaacatgaatgaggatggcccca

SEQ ID NO: 262045 - DNA, 75 bp, Artificial Sequence
  Synthetic
aagtgacggaatgtttaacaacgtggccgtcacccttaaacgagccctcggggcccggtccaaacagccggcccc

SEQ ID NO: 262046 - DNA, 75 bp, Artificial Sequence
  Synthetic
atgtatcaaggaccacgggtttctacaggccctaccaagagtggaataggaaacccctaccaaccatggatgagg

SEQ ID NO: 262047 - DNA, 75 bp, Artificial Sequence
  Synthetic
gagccgtactagctgcagccctagagatcatggtcaaattctccccagagccacacttggcccaggtagttgcag

SEQ ID NO: 262048 - DNA, 75 bp, Artificial Sequence
  Synthetic
tgatggggacgaaccaaccgtgatgtttagcactgtaggtggtgtgtctggcctacctgagctcacaacagtcgg

SEQ ID NO: 262049 - DNA, 75 bp, Artificial Sequence
  Synthetic
tttagcactgtaggtggtgtgtctggcctacctgagctcacaacagtcggtcaaccacctgaagctaacacggcc

SEQ ID NO: 262050 - DNA, 75 bp, Artificial Sequence
  Synthetic
catcccacgcaatggcgtcgaccactgggacgcgtacaagggggagagggtcgttctatgggacgactatggaat

SEQ ID NO: 262051 - DNA, 75 bp, Artificial Sequence
  Synthetic
tgggatggggagatctatcattatggactgtatgtggaaagagggcttgtgttaggcgtgcacaagccgccagct

SEQ ID NO: 262052 - DNA, 75 bp, Artificial Sequence
  Synthetic
gactgtatgtggaaagagggcttgtgttaggcgtgcacaagccgccagctgccatcagcatagccaaagtggaat

SEQ ID NO: 262053 - DNA, 75 bp, Artificial Sequence
  Synthetic
tgtgcactctctgaagtcacggacctgtcccctgacatcattcaagccaattccttattctctttctatggtgat

SEQ ID NO: 262054 - DNA, 75 bp, Artificial Sequence
  Synthetic
ccaacccgccctgacaagactgagggacctctgatcatttctgaggatctggatggtttaacctttctgcggaga

SEQ ID NO: 262055 - DNA, 75 bp, Artificial Sequence
  Synthetic
gatcgagaacaaaggaaaggtctttgacagtgatgccataattatcactaccaatctggccaacccagcgccact

SEQ ID NO: 262056 - DNA, 75 bp, Artificial Sequence
  Synthetic
tccatggtgaattgtttccctatacagcctttgaaaacaactgttatgccttctgctgttgggttttggatctta

SEQ ID NO: 262057 - DNA, 75 bp, Artificial Sequence
  Synthetic
agcctttgaaaacaactgttatgccttctgctgttgggttttggatcttaacgattcatggctaagcaggaggat

SEQ ID NO: 262058 - DNA, 75 bp, Artificial Sequence
  Synthetic
gacctctgatcatttctgaggatctggatggtttaacctttctgcggagaactgtaacccgtgatccagctggtt

SEQ ID NO: 262059 - DNA, 75 bp, Artificial Sequence
  Synthetic
cacaccaggtgattgcggctgtccctacatctacaagagaggaaatgactatgtggtcattggagtccacacggc

SEQ ID NO: 262060 - DNA, 75 bp, Artificial Sequence
  Synthetic
ctgaaacaatgataccacattcccaaaggcccatacagttgatgtctctgctaggtgaagctgcattgcacggtc

SEQ ID NO: 262061 - DNA, 75 bp, Artificial Sequence
  Synthetic
tacatctacaagagaggaaatgactatgtggtcattggagtccacacggctgccgctcgtgggggaaacactgtc

SEQ ID NO: 262062 - DNA, 75 bp, Artificial Sequence
  Synthetic
aaaattgaagaaggtcgcaaacatcgttctgtgtgcattgtcatcattgttcactagacccatcaaggatataat

SEQ ID NO: 262063 - DNA, 75 bp, Artificial Sequence
  Synthetic
gttctgtgtgcattgtcatcattgttcactagacccatcaaggatataattggcaaacttaaacccctcaacatc

SEQ ID NO: 262064 - DNA, 75 bp, Artificial Sequence
  Synthetic
gatgtgttctggacacccccagatgtgtctgcaatgatcgcacccctcctcggtgactacgagctacaaggcccc

SEQ ID NO: 262065 - DNA, 75 bp, Artificial Sequence
  Synthetic
tgtctgcaatgatcgcacccctcctcggtgactacgagctacaaggccccgaagacatcgctgtggagctcgtgc

SEQ ID NO: 262066 - DNA, 75 bp, Artificial Sequence
  Synthetic
atagacccctggattagaatgaactttgtccaagccccaaatggagaattcacagtgtctccccgcaattctcct

SEQ ID NO: 262067 - DNA, 75 bp, Artificial Sequence
  Synthetic
ttgtccaagccccaaatggagaattcacagtgtctccccgcaattctcctggtgaaatcttgctaaatttggaat

SEQ ID NO: 262068 - DNA, 75 bp, Artificial Sequence
  Synthetic
cgtcaaccctgagggcatgcaaagatcttggagcctatggattggagatcttgaaactagtcatgaaatggtttt

SEQ ID NO: 262069 - DNA, 75 bp, Artificial Sequence
  Synthetic
tcttggagcctatggattggagatcttgaaactagtcatgaaatggtttttcccaaagaaggatgaggccaacga

SEQ ID NO: 262070 - DNA, 75 bp, Artificial Sequence
  Synthetic
tgccagaattagatattatgtcaagtgtgcccaggaggccctgtattccatcattcaaattgccggagctgcatt

SEQ ID NO: 262071 - DNA, 75 bp, Artificial Sequence
  Synthetic
aggtactactcgctgggaacgcgttcacagcgggaaaactggtgtttgcagcaatccccccgcacttccctcttg

SEQ ID NO: 262072 - DNA, 75 bp, Artificial Sequence
  Synthetic
cacagcgggaaaactggtgtttgcagcaatccccccgcacttccctcttgagaatctgagtcctggacaaattac

SEQ ID NO: 262073 - DNA, 75 bp, Artificial Sequence
  Synthetic
attgaaagacaagaacagccttgcagcctacatgaagaccttggacatggaagaggaaaaagctaggaagttatc

SEQ ID NO: 262074 - DNA, 75 bp, Artificial Sequence
  Synthetic
gcctacatgaagaccttggacatggaagaggaaaaagctaggaagttatccaccaaatcagcctcccctgacatt

SEQ ID NO: 262075 - DNA, 75 bp, Artificial Sequence
  Synthetic
aaacccaaagatgatgaggagttcgtcgtctcatccgacgacatcaaaactgagggcaagaaagggaagaacaag

SEQ ID NO: 262076 - DNA, 75 bp, Artificial Sequence
  Synthetic
tttctttcattacaatcagcagcccgagccccgtatgagacttgtagctatgttgtatactcctcttagatctaa

SEQ ID NO: 262077 - DNA, 75 bp, Artificial Sequence
  Synthetic
gagccccgtatgagacttgtagctatgttgtatactcctcttagatctaatggttctggtgatgatgtgttcaca

SEQ ID NO: 262078 - DNA, 75 bp, Artificial Sequence
  Synthetic
tctagcagaccaagaccggtcgttctgatgatctctggcaaaccagggataggaaagacccacttggccagagaa

SEQ ID NO: 262079 - DNA, 75 bp, Artificial Sequence
  Synthetic
atatgaatgaggatggccccatcatcttcgagaagcattccaggtacagataccactatgatgctgattactctc

SEQ ID NO: 262080 - DNA, 75 bp, Artificial Sequence
  Synthetic
tgatgatctctggcaaaccagggataggaaagacccacttggccagagaactggcaaagaaaattgcctcgacgc

SEQ ID NO: 262081 - DNA, 75 bp, Artificial Sequence
  Synthetic
aaaactaaaccattcaccctgccaatcctaactattggagaattgtcaaattctagattcccagttccaatagat

SEQ ID NO: 262082 - DNA, 75 bp, Artificial Sequence
  Synthetic
tcctaactattggagaattgtcaaattctagattcccagttccaatagatgaattgtacaccagccccaatgaag

SEQ ID NO: 262083 - DNA, 75 bp, Artificial Sequence
  Synthetic
tggtgctctgggatgactacgggatgagcaaccccatccacgatgcgctgaggttgcaggaactggcagacacat

SEQ ID NO: 262084 - DNA, 75 bp, Artificial Sequence
  Synthetic
gagcaaccccatccacgatgcgctgaggttgcaggaactggcagacacatgtccattaactttaaattgtgacag

SEQ ID NO: 262085 - DNA, 75 bp, Artificial Sequence
  Synthetic
caaacatctgtgcgctacgagggcgcattaacgcccaggtgccagatgatcaccatcaatggaacctacaggtaa

SEQ ID NO: 262086 - DNA, 75 bp, Artificial Sequence
  Synthetic
cattaacgcccaggtgccagatgatcaccatcaatggaacctacaggtaacaaacacaaatgggactcctttcga

SEQ ID NO: 262087 - DNA, 75 bp, Artificial Sequence
  Synthetic
ggattacgtcaactttgaggcctgctccagacgtatagacttccttgtgtatgctgatgccccagaagtcgagaa

SEQ ID NO: 262088 - DNA, 75 bp, Artificial Sequence
  Synthetic
tccagacgtatagacttccttgtgtatgctgatgccccagaagtcgagaaggcaaagcgggacttccctggtcaa

SEQ ID NO: 262089 - DNA, 75 bp, Artificial Sequence
  Synthetic
aaaccccaacaacacttgccgtgcccatgatggggttttggcaacttggagccccaaatttacacccaagttagg

SEQ ID NO: 262090 - DNA, 75 bp, Artificial Sequence
  Synthetic
ccttgttatttctgaagacttagatggtttgactttcctgcggagaactgtgacccgcgacccagctggttggtt

SEQ ID NO: 262091 - DNA, 75 bp, Artificial Sequence
  Synthetic
gacaaaaatggaaacaccccacatggtaaaggagtgatgaagactctcactgccagttcactggttgcacgtgcc

SEQ ID NO: 262092 - DNA, 75 bp, Artificial Sequence
  Synthetic
tgacccgcgacccagctggttggtttgggaaactggagcagagctcaatactcaggcaaatgtactggactaggg

SEQ ID NO: 262093 - DNA, 75 bp, Artificial Sequence
  Synthetic
gtaaaggagtgatgaagactctcactgccagttcactggttgcacgtgcctctggtctcttgcacgagagattag

SEQ ID NO: 262094 - DNA, 75 bp, Artificial Sequence
  Synthetic
catgatggggttttggcaacttggagccccaaatttacacccaagttaggatctgtgattttgggcacttgggaa

SEQ ID NO: 262095 - DNA, 75 bp, Artificial Sequence
  Synthetic
ccacactactcatcaagaggccaactggagaacttatgcccttagcagccagaatgggaacccatgcaaccatga

SEQ ID NO: 262096 - DNA, 75 bp, Artificial Sequence
  Synthetic
tgggccttgcctagttattctggaagattaaccctaaacatgaatttggcaccctctgtttcccccctctttcca

SEQ ID NO: 262097 - DNA, 75 bp, Artificial Sequence
  Synthetic
gattaaccctaaacatgaatttggcaccctctgtttcccccctctttccaggtgaacagctacttttcttcaggt

SEQ ID NO: 262098 - DNA, 75 bp, Artificial Sequence
  Synthetic
gagaggccgcactccacggcccaacattctacagtaaaatcagcaaattagtcattgcagagctaaaagaaggtg

SEQ ID NO: 262099 - DNA, 75 bp, Artificial Sequence
  Synthetic
tcgccgctgaaaataagtatggtctggtggacacgatgagggtgggcaaccagctcagaaatgttacgaccatgg

SEQ ID NO: 262100 - DNA, 75 bp, Artificial Sequence
  Synthetic
ggtggacacgatgagggtgggcaaccagctcagaaatgttacgaccatggatgaactcaagaaggctatcaagaa

SEQ ID NO: 262101 - DNA, 75 bp, Artificial Sequence
  Synthetic
tttatcaggagtcagccccatcgcccacggacgtggctctaattagatacaccaatcctgacacaggccgcgttt

SEQ ID NO: 262102 - DNA, 75 bp, Artificial Sequence
  Synthetic
cacggacgtggctctaattagatacaccaatcctgacacaggccgcgttttgtttgaagctaaactgcacaggca

SEQ ID NO: 262103 - DNA, 75 bp, Artificial Sequence
  Synthetic
tgtggttgagagggtgcagagcgccagcgtgcaaatcaacaatgagatcgctggtgcagtacaccaccttagatg

SEQ ID NO: 262104 - DNA, 75 bp, Artificial Sequence
  Synthetic
cgccaacccatctgatgggtccgcagccaacctcgtcccagaggtcaacaatgaggttatggctttggagcccgt

SEQ ID NO: 262105 - DNA, 75 bp, Artificial Sequence
  Synthetic
agcgtgcaaatcaacaatgagatcgctggtgcagtacaccaccttagatgtgccaggataaggtattatgtcaag

SEQ ID NO: 262106 - DNA, 75 bp, Artificial Sequence
  Synthetic
tgcaccaatcctaggtccaggaagtgccccaaaactcagcaccaagactaaattctggagatcatccacaacacc

SEQ ID NO: 262107 - DNA, 75 bp, Artificial Sequence
  Synthetic
gtagcgggccaacaaaatgtaattgacccctggattagaaataattttgtacaagcccctggtggagagttcaca

SEQ ID NO: 262108 - DNA, 75 bp, Artificial Sequence
  Synthetic
gtcgttgcaactaatgttgcaagcaacaacaatgctaacaacactagtgctacatctcgatttttatcgagattt

SEQ ID NO: 262109 - DNA, 75 bp, Artificial Sequence
  Synthetic
aattctggagatcatccacaacaccactcccacctggcacctatgaaccagcctaccttggtggtaaggacccca

SEQ ID NO: 262110 - DNA, 75 bp, Artificial Sequence
  Synthetic
atgaacatccaaaatttatggtccaggccactaaccgaagatgcagatgaggccactatgaaagaggggtgcccc

SEQ ID NO: 262111 - DNA, 75 bp, Artificial Sequence
  Synthetic
ttgggttaatcaattctattctctcgcccccatgggaactgggaacgggcgcagaagagtgcagtaatggctgga

SEQ ID NO: 262112 - DNA, 75 bp, Artificial Sequence
  Synthetic
acaacaatgctaacaacactagtgctacatctcgatttttatcgagatttaagggcttaggaggtggcgcaagcc

SEQ ID NO: 262113 - DNA, 75 bp, Artificial Sequence
  Synthetic
ggccactaaccgaagatgcagatgaggccactatgaaagaggggtgccccaaacctagggaagaagaggaatttg

SEQ ID NO: 262114 - DNA, 75 bp, Artificial Sequence
  Synthetic
acaacaagcaactacagcaggcttctttcaatcatgacaaagagatgctgcaagctcaaatccaagccaccaaac

SEQ ID NO: 262115 - DNA, 75 bp, Artificial Sequence
  Synthetic
gcccccatgggaactgggaacgggcgcagaagagtgcagtaatggctggagcttttatagcagggcttgctggtg

SEQ ID NO: 262116 - DNA, 75 bp, Artificial Sequence
  Synthetic
cattctcaagcaaaggtctcagtgatgaggagtacgaagagtacaaaaggatcagagaggagagaaatggcaagt

SEQ ID NO: 262117 - DNA, 75 bp, Artificial Sequence
  Synthetic
tgaggagtacgaagagtacaaaaggatcagagaggagagaaatggcaagtactccatagaggaatacctacagga

SEQ ID NO: 262118 - DNA, 75 bp, Artificial Sequence
  Synthetic
tttcaatcatgacaaagagatgctgcaagctcaaatccaagccaccaaacagctacaggctgacatgattgctct

SEQ ID NO: 262119 - DNA, 75 bp, Artificial Sequence
  Synthetic
gcaggtcttggactggaatgggactaggtattgggcccccggagccacaaaaaccaccgctttctccggtgggtt

SEQ ID NO: 262120 - DNA, 75 bp, Artificial Sequence
  Synthetic
aggtattgggcccccggagccacaaaaaccaccgctttctccggtgggttcactagctcttcccatgccaggact

SEQ ID NO: 262121 - DNA, 75 bp, Artificial Sequence
  Synthetic
ctaccattaaattgatagcaatgctgtatacaccacttagggctaataatgctggggaagatgtcttcacagtct

SEQ ID NO: 262122 - DNA, 75 bp, Artificial Sequence
  Synthetic
gattcgtcagaggatcttcaggccaacaagaaaacaacgcaaggaagaaagagccaaccttggcctcgttaccgg

SEQ ID NO: 262123 - DNA, 75 bp, Artificial Sequence
  Synthetic
gctggggaagatgtcttcacagtctcttgtcgagtcctcacgaggccatcccctgattttgattttatatttttg

SEQ ID NO: 262124 - DNA, 75 bp, Artificial Sequence
  Synthetic
gggctcagacttagcgaccatgatccggtgcgctagagcattcgggggcctgatggatgaactcaaggctcactg

SEQ ID NO: 262125 - DNA, 75 bp, Artificial Sequence
  Synthetic
ccctgattttgattttatatttttggtgccacctacagttgagtcaagaactaaaccatttactgtcccaatctt

SEQ ID NO: 262126 - DNA, 75 bp, Artificial Sequence
  Synthetic
gcctctactcgctcaacattggttagcgggtcttctaaccttccttcttcagctaggagttcttctagtgtcttt

SEQ ID NO: 262127 - DNA, 75 bp, Artificial Sequence
  Synthetic
cggtgcgctagagcattcgggggcctgatggatgaactcaaggctcactgtgttacacttcctgtcagagttggt

SEQ ID NO: 262128 - DNA, 75 bp, Artificial Sequence
  Synthetic
gaggccccaccaagtatatggtctagaattgtcaactttggttctggatgggggttttgggtgtcacctagcctc

SEQ ID NO: 262129 - DNA, 75 bp, Artificial Sequence
  Synthetic
acaagaaaacaacgcaaggaagaaagagccaaccttggcctcgttaccgggtctgagatcagaaagaggaaccca

SEQ ID NO: 262130 - DNA, 75 bp, Artificial Sequence
  Synthetic
tgttcacgggtcccagcggtgcctttgttgttcaaccacaaaatggcagatgcacgactgatggcgtgctcttag

SEQ ID NO: 262131 - DNA, 75 bp, Artificial Sequence
  Synthetic
tgttgttcaaccacaaaatggcagatgcacgactgatggcgtgctcttaggtaccacccaactgtctcctgtcaa

SEQ ID NO: 262132 - DNA, 75 bp, Artificial Sequence
  Synthetic
accatccagcccatagccgcttggtggagagtttgttacataccccaacccaagcacagactgagttacgaccaa

SEQ ID NO: 262133 - DNA, 75 bp, Artificial Sequence
  Synthetic
tgacgcctccttctagtagagcatctagtaatggcacagtctcaaccgtgccgaaagaagttttggactcctgga

SEQ ID NO: 262134 - DNA, 75 bp, Artificial Sequence
  Synthetic
gagggaaataccacaaagacccccacgaccacctactccagaactggtcaaaaagatcccccctcccccgcctaa

SEQ ID NO: 262135 - DNA, 75 bp, Artificial Sequence
  Synthetic
tgagattcccaaaacccatcaggacagatgtgtcaggtatgatactggaggagggagcgcctgaaggcactgttg

SEQ ID NO: 262136 - DNA, 75 bp, Artificial Sequence
  Synthetic
catctgtgtttaacactcacagacagccgctcttcgctcatctccgtcggagaggggagtcacaagtttagtgaa

SEQ ID NO: 262137 - DNA, 75 bp, Artificial Sequence
  Synthetic
gggccgtgctagcagcagccctagaaatcatggttaaattctccccagaaccgcatctggcccagatagttgcag

SEQ ID NO: 262138 - DNA, 75 bp, Artificial Sequence
  Synthetic
gaaattccagcccctctaggaactccagatttcgtgggaaagatccaaggtgtgctcactcaaaccacaaaggga

SEQ ID NO: 262139 - DNA, 75 bp, Artificial Sequence
  Synthetic
cagatttcgtgggaaagatccaaggtgtgctcactcaaaccacaaagggagatggctcgacccgtggccataaag

SEQ ID NO: 262140 - DNA, 75 bp, Artificial Sequence
  Synthetic
atgaagatggcctctaacgacgcttccgctgccgctgttgctaacagacacaacgacaccgcgaaatcttcaagt

SEQ ID NO: 262141 - DNA, 75 bp, Artificial Sequence
  Synthetic
ttccctcttctccttttacggtgatgatgaaattgtcagtacagatataaagttggacccagagaaactgacagc

SEQ ID NO: 262142 - DNA, 75 bp, Artificial Sequence
  Synthetic
ccagatgggaatgctgctcactgggtccaatgcaaagagcatggatcttggcaccacgcccggtgattgtgggtg

SEQ ID NO: 262143 - DNA, 75 bp, Artificial Sequence
  Synthetic
ggatgtgggtgacttcaaaatatcaatcaatgagggcctcccctctggagtaccctgcacttctcaatggaattc

SEQ ID NO: 262144 - DNA, 75 bp, Artificial Sequence
  Synthetic
gatgaaattgtcagtacagatataaagttggacccagagaaactgacagcaaagctcaaggaatacggattgaaa

SEQ ID NO: 262145 - DNA, 75 bp, Artificial Sequence
  Synthetic
agatgtgtcaggtatgatactggaggagggagcgcctgaaggcactgttgccaccatactcatcaaaagaaccac

SEQ ID NO: 262146 - DNA, 75 bp, Artificial Sequence
  Synthetic
tccaatgcaaagagcatggatcttggcaccacgcccggtgattgtgggtgtccctacatttacaaaaggggcaac

SEQ ID NO: 262147 - DNA, 75 bp, Artificial Sequence
  Synthetic
tcacagcagacccctgagttccagcaagatagcaagttagagttggtcagggatgctatattagctgcagtgaat

SEQ ID NO: 262148 - DNA, 75 bp, Artificial Sequence
  Synthetic
gagggtgaggccacgctcgagggtggtgacaacaaaggaacatactgtggggcgccaatcctaggccccgggaat

SEQ ID NO: 262149 - DNA, 75 bp, Artificial Sequence
  Synthetic
gtgacaacaaaggaacatactgtggggcgccaatcctaggccccgggaatgccccaaaactgagcaccaaaacca

SEQ ID NO: 262150 - DNA, 75 bp, Artificial Sequence
  Synthetic
aggacctgaagacttggcacgagatctagtcccagtgattcttggcggcataggattggccatcgggttcaccag

SEQ ID NO: 262151 - DNA, 75 bp, Artificial Sequence
  Synthetic
gagtcaaaggtgggccatctctgcaacaagttatgcgagaccaactgaagccattcaccgaaccccgtggtaagc

SEQ ID NO: 262152 - DNA, 75 bp, Artificial Sequence
  Synthetic
gctagtcattgcagagctgaaggaaggtggcatggatttttacgtgcccagacaagagccaatgttcagatggat

SEQ ID NO: 262153 - DNA, 75 bp, Artificial Sequence
  Synthetic
agaaatattctcactactcaagaagtatttctttgggggggaccagactgagcgcaccctcaaaggcattgaggc

SEQ ID NO: 262154 - DNA, 75 bp, Artificial Sequence
  Synthetic
cttgatactcttggcagagctctttggagttttctggacacccccagatgtgtctgcgatgattgcccccttact

SEQ ID NO: 262155 - DNA, 75 bp, Artificial Sequence
  Synthetic
acaagttatgcgagaccaactgaagccattcaccgaaccccgtggtaagccaccaaaaccaagtgtcctcgaagc

SEQ ID NO: 262156 - DNA, 75 bp, Artificial Sequence
  Synthetic
cgcgtctcttgacaaaactacatctagtgggtacccccaccacgtgcgcaaaaacgagcactggaatggggaatc

SEQ ID NO: 262157 - DNA, 75 bp, Artificial Sequence
  Synthetic
agtgggtacccccaccacgtgcgcaaaaacgagcactggaatggggaatctttcacaggaaaattggctgaccag

SEQ ID NO: 262158 - DNA, 75 bp, Artificial Sequence
  Synthetic
tgattttgaaaataacagaaaattgcagcaagcttccttccagtttagcagtgatctacaacaggcttcctttca

SEQ ID NO: 262159 - DNA, 75 bp, Artificial Sequence
  Synthetic
gcagttccaccaaactttccaactgaaggcctaagccccagccaggttactatgttcccccatataattgtagat

SEQ ID NO: 262160 - DNA, 75 bp, Artificial Sequence
  Synthetic
ttggtcaaaactgagaaagtgtatgggaagataaagaagaggttgctttggggctctgacctggctaccatggtg

SEQ ID NO: 262161 - DNA, 75 bp, Artificial Sequence
  Synthetic
tatgttcccccatataattgtagatgttaggcaattggaacctgtgttaatccccctacctgatgttaggaataa

SEQ ID NO: 262162 - DNA, 75 bp, Artificial Sequence
  Synthetic
caccgccgggaaagtcatatttgcagcagttccaccaaactttccaactgaaggcctaagccccagccaggttac

SEQ ID NO: 262163 - DNA, 75 bp, Artificial Sequence
  Synthetic
ggacggttatcatggtgaggaagtgatgctgtgggacgactatggcatgacaaaaatacaagatgactgtaataa

SEQ ID NO: 262164 - DNA, 75 bp, Artificial Sequence
  Synthetic
ggaagataaagaagaggttgctttggggctctgacctggctaccatggtgcggtgcgcgcgctcctttggcggtt

SEQ ID NO: 262165 - DNA, 75 bp, Artificial Sequence
  Synthetic
tagtctttgagaagcactccagatacaggtatcactatgatgcagattattccaggtgggattcaacacagcaga

SEQ ID NO: 262166 - DNA, 75 bp, Artificial Sequence
  Synthetic
tttggactggagcggaacaaggtactgggcccctgatgctaggactacaacatacaatgcaggccgcttttccac

SEQ ID NO: 262167 - DNA, 75 bp, Artificial Sequence
  Synthetic
gtctcttgtcgagttcttacgaggccatcccccgattttgattttatattcctggtgccacccacagttgaatca

SEQ ID NO: 262168 - DNA, 75 bp, Artificial Sequence
  Synthetic
caatcaacgcccccatgacaaaggctttggactggagcggaacaaggtactgggcccctgatgctaggactacaa

SEQ ID NO: 262169 - DNA, 75 bp, Artificial Sequence
  Synthetic
catcccccgattttgattttatattcctggtgccacccacagttgaatcaagaactaaaccattcactgtcccaa

SEQ ID NO: 262170 - DNA, 75 bp, Artificial Sequence
  Synthetic
caggtatcactatgatgcagattattccaggtgggattcaacacagcagagagccgttctggccgcggccatgga

SEQ ID NO: 262171 - DNA, 75 bp, Artificial Sequence
  Synthetic
tgggcccctgatgctaggactacaacatacaatgcaggccgcttttccacccctcaaccctcgggggcactgcca

SEQ ID NO: 262172 - DNA, 75 bp, Artificial Sequence
  Synthetic
tgacgtgggcgacttcaaaatttccatcaacgaaggattgccgtcgggtgtcccttgcacctctcaatggaattc

SEQ ID NO: 262173 - DNA, 75 bp, Artificial Sequence
  Synthetic
atcaacgaaggattgccgtcgggtgtcccttgcacctctcaatggaattccatcgcacactggctcctcacctta

SEQ ID NO: 262174 - DNA, 75 bp, Artificial Sequence
  Synthetic
cttttgttgtccaaccacaaaatggcagatgtacgactgatggcgtactcttaggcactacccagctgtcagctg

SEQ ID NO: 262175 - DNA, 75 bp, Artificial Sequence
  Synthetic
ttctggcaccaatgtctcgagtctcccgtcaactgcaaggactaggagttgggttgaggatcaaaacagaaattt

SEQ ID NO: 262176 - DNA, 75 bp, Artificial Sequence
  Synthetic
gatgaaattgtgagcacagatatcaaattagacccagaaaagttgacggggaagttgagagaatatggcctcaaa

SEQ ID NO: 262177 - DNA, 75 bp, Artificial Sequence
  Synthetic
aaaattggagcaattatgacccaacagaagaaatcccagcccccctgggaacgccagattttgtgggaaagatcc

SEQ ID NO: 262178 - DNA, 75 bp, Artificial Sequence
  Synthetic
agtctcaaccgtgcctaaagaagttttggactcctggactggcgctttcaacacgcgcaggcagcctctcttcgc

SEQ ID NO: 262179 - DNA, 75 bp, Artificial Sequence
  Synthetic
ttggactcctggactggcgctttcaacacgcgcaggcagcctctcttcgctcacattcgtaggcgaggggagtca

SEQ ID NO: 262180 - DNA, 75 bp, Artificial Sequence
  Synthetic
aattagacccagaaaagttgacggggaagttgagagaatatggcctcaaacccactcgtccagacaaaactgaag

SEQ ID NO: 262181 - DNA, 75 bp, Artificial Sequence
  Synthetic
aatggcctgggcatcttgagcatggcaggtctgggcaagaagctacgtggtgttacaacgatggagggcttaaag

SEQ ID NO: 262182 - DNA, 75 bp, Artificial Sequence
  Synthetic
ccaatggcaatgaaaagcaaacaaaaatgcccacctcgggcatttttaccaacgtcaaggttggtattaaaaaga

SEQ ID NO: 262183 - DNA, 75 bp, Artificial Sequence
  Synthetic
ggtttggcaaactggaccaaagttccatacttaggcaactgtattggaccaaaggccccaatcatgaagatccct

SEQ ID NO: 262184 - DNA, 75 bp, Artificial Sequence
  Synthetic
tcacttttaaacgagccctcggggcgcggcctaaacagcctcccccgagggaaataccacaaagacccccacgac

SEQ ID NO: 262185 - DNA, 75 bp, Artificial Sequence
  Synthetic
ccgctgccgctgttgccaacagcaacaacgacaccgcaaaatcttcaagtgacaaaatgttttctagcatggctg

SEQ ID NO: 262186 - DNA, 75 bp, Artificial Sequence
  Synthetic
caaaattcaccccagttggtgtcatccaagacggtgatcaccatcagaatgaaccccaacaatgggtactcccaa

SEQ ID NO: 262187 - DNA, 75 bp, Artificial Sequence
  Synthetic
tctcaccaccttcaactttgatcgcaacaaagtgcttgcctttaggcagcttgctgctgaaaacaaatatgggtt

SEQ ID NO: 262188 - DNA, 75 bp, Artificial Sequence
  Synthetic
caaagtgtactcactagaatcagatggcaacagtgtcaacattaaagaggagaggaacgtcttaactcagcaaca

SEQ ID NO: 262189 - DNA, 75 bp, Artificial Sequence
  Synthetic
cccacctgagggctgtgtggcttatcacaaggatggtgacaggatcgacgggctccctaggggacccgccgacgc

SEQ ID NO: 262190 - DNA, 75 bp, Artificial Sequence
  Synthetic
cagctcaaggatgtcagaaccatgccagaacttaaacaagcactcaagaatatctcaatcaagaagtgccagata

SEQ ID NO: 262191 - DNA, 75 bp, Artificial Sequence
  Synthetic
cccacttttccgggcgagcagcttcttttctttagatccactgtgcccggttgtagcgggtaccccaacatgaat

SEQ ID NO: 262192 - DNA, 75 bp, Artificial Sequence
  Synthetic
tatctcaatcaagaagtgccagatagtgtacagtggttgcacctacacacttgagtctgatggcaagggcaatgt

SEQ ID NO: 262193 - DNA, 75 bp, Artificial Sequence
  Synthetic
gagacccatacaactcatgtcactcttgggcgaagcagcactgcatgaaccatcattctacagcaagatcagcaa

SEQ ID NO: 262194 - DNA, 75 bp, Artificial Sequence
  Synthetic
cacaaggatggtgacaggatcgacgggctccctaggggacccgccgacgccgaacccaagtgcatggcttatagc

SEQ ID NO: 262195 - DNA, 75 bp, Artificial Sequence
  Synthetic
ggtgtgcacaaaccaccagctgccattagcctcgccaaggtcgaactaacaccactctccttgttctggagacct

SEQ ID NO: 262196 - DNA, 75 bp, Artificial Sequence
  Synthetic
ggtgaaatatatcactacgggctctatgtcaacgacggcctagttcttggagtccaccgccccgcatctgccatt

SEQ ID NO: 262197 - DNA, 75 bp, Artificial Sequence
  Synthetic
atgtcaacgacggcctagttcttggagtccaccgccccgcatctgccatttgcaccgccaccattgagttaaccc

SEQ ID NO: 262198 - DNA, 75 bp, Artificial Sequence
  Synthetic
gagaaaagttcccctatacggcatttgataacaattgctatgcattctgctgctgggttttagacttgaacgatt

SEQ ID NO: 262199 - DNA, 75 bp, Artificial Sequence
  Synthetic
tgataacaattgctatgcattctgctgctgggttttagacttgaacgattcctggctgtcccgcaagatgataaa

SEQ ID NO: 262200 - DNA, 75 bp, Artificial Sequence
  Synthetic
actaacaacgagttggctggcgtcctatcacacctcagaaatgcaaggattagatattatgtaaaatgtgtgcag

SEQ ID NO: 262201 - DNA, 75 bp, Artificial Sequence
  Synthetic
gattggcatctgatgtcctcggctctggacttggttctctaatcaatgctggagctggagccatcaatcaaaaag

SEQ ID NO: 262202 - DNA, 75 bp, Artificial Sequence
  Synthetic
caggcccataaaagacataataggaaagttaaggcctctcaacatcatcaacatcctggcttcatgtgattggac

SEQ ID NO: 262203 - DNA, 75 bp, Artificial Sequence
  Synthetic
agtaatctacaacaggcttccttccaacatgataaggagatgctccaagcacaaattgaggctactcagaaattg

SEQ ID NO: 262204 - DNA, 75 bp, Artificial Sequence
  Synthetic
gaagaaagtgacaaatgttttgctctgtgccctatcttccctcttcacccgcccgatcaaggacgtgatcggcag

SEQ ID NO: 262205 - DNA, 75 bp, Artificial Sequence
  Synthetic
tgtgccctatcttccctcttcacccgcccgatcaaggacgtgatcggcagcttgaagccccttaatttacttaat

SEQ ID NO: 262206 - DNA, 75 bp, Artificial Sequence
  Synthetic
tgctttataccccccttaggtctaatggttcaggtgatgatgtgtttacagtctcctgcagggtgttgactagac

SEQ ID NO: 262207 - DNA, 75 bp, Artificial Sequence
  Synthetic
tggttcaggtgatgatgtgtttacagtctcctgcagggtgttgactagaccctcccctgattttgatttcacata

SEQ ID NO: 262208 - DNA, 75 bp, Artificial Sequence
  Synthetic
ttctggactcccccggatgtttcagccttccttgcccccctgcttggcgattatgagctccaggggccccaagac

SEQ ID NO: 262209 - DNA, 75 bp, Artificial Sequence
  Synthetic
ccttccttgcccccctgcttggcgattatgagctccaggggccccaagacctggccacggagcttgtgcccatac

SEQ ID NO: 262210 - DNA, 75 bp, Artificial Sequence
  Synthetic
tgtgggctgacgatgacagaagtgtggactacaatgagaaactcagttttgaggccccaccaagcatctggtcga

SEQ ID NO: 262211 - DNA, 75 bp, Artificial Sequence
  Synthetic
ctgggcccccgatgccagggtcacaacatacaatgcaggccgcttttccacccctcagccttcgggggcattgcc

SEQ ID NO: 262212 - DNA, 75 bp, Artificial Sequence
  Synthetic
atctcacaggtatgatccttgaggagggttgccccgagggcacggtgtgttcagtactaataaaaagggactctg

SEQ ID NO: 262213 - DNA, 75 bp, Artificial Sequence
  Synthetic
ttctagattcccagtgtccatagaccagatgtacaccagccccaatgaagttatatcagtgcagtgtcaaaatgg

SEQ ID NO: 262214 - DNA, 75 bp, Artificial Sequence
  Synthetic
cagatgtacaccagccccaatgaagttatatcagtgcagtgtcaaaatggtaggtgcacactggatggggagctc

SEQ ID NO: 262215 - DNA, 75 bp, Artificial Sequence
  Synthetic
ccctgcggtcgtgccgagacatcggggcctatgggctggacgtcctcaagctaatcatgaaatggttcttcccca

SEQ ID NO: 262216 - DNA, 75 bp, Artificial Sequence
  Synthetic
ggcctatgggctggacgtcctcaagctaatcatgaaatggttcttccccaaggccgatgaggagagtgagcttgc

SEQ ID NO: 262217 - DNA, 75 bp, Artificial Sequence
  Synthetic
atacagggccgccttgtccatgggcaatctggcatgttactcaccggggcaaatgctaagggcatggaccttgga

SEQ ID NO: 262218 - DNA, 75 bp, Artificial Sequence
  Synthetic
gatcatctatataatgtcaccatcacaaacttgaatgggtccccctttgacccctccgaggacatccctgcccct

SEQ ID NO: 262219 - DNA, 75 bp, Artificial Sequence
  Synthetic
tgggttgaggaccaaaacaggaatttgtcacctttcatgaggggggctctcaacacatcattcgtcacccctcca

SEQ ID NO: 262220 - DNA, 75 bp, Artificial Sequence
  Synthetic
agacagggacagccttgccaccttcatgaagacacttgatgttgaggaagaaaaagcaagacgcctctcaactaa

SEQ ID NO: 262221 - DNA, 75 bp, Artificial Sequence
  Synthetic
caaacttgaatgggtccccctttgacccctccgaggacatccctgcccctctgggcgtacctgactttcagggaa

SEQ ID NO: 262222 - DNA, 75 bp, Artificial Sequence
  Synthetic
atgaagacacttgatgttgaggaagaaaaagcaagacgcctctcaactaagtcagcatctcctgacatagtggga

SEQ ID NO: 262223 - DNA, 75 bp, Artificial Sequence
  Synthetic
acgctgtggtccctacttacacatcacagtacactccaaaattgggtcagattcaaattggcacatggcaaaccg

SEQ ID NO: 262224 - DNA, 75 bp, Artificial Sequence
  Synthetic
agctctatcaaccaaaaccaaattctggaaatcatcccccgaaccactgccccctggggtctacgagcccgccta

SEQ ID NO: 262225 - DNA, 75 bp, Artificial Sequence
  Synthetic
cgagtgaaaccggttgtggttatgatctcgggcaggcccgggattgggaagacacacatggcccgggaactagca

SEQ ID NO: 262226 - DNA, 75 bp, Artificial Sequence
  Synthetic
acagtacactccaaaattgggtcagattcaaattggcacatggcaaaccgatgatcttacagtcaaccaaccagt

SEQ ID NO: 262227 - DNA, 75 bp, Artificial Sequence
  Synthetic
tctcgggcaggcccgggattgggaagacacacatggcccgggaactagcacggaaaatcggtgccacgatgtcag

SEQ ID NO: 262228 - DNA, 75 bp, Artificial Sequence
  Synthetic
gggaggaggatgtgcaagaggaggtcagaaaaccagaacccaaatgcgatgaggaattcatcgttgtgtccgaag

SEQ ID NO: 262229 - DNA, 75 bp, Artificial Sequence
  Synthetic
aaaccttaacacaaaccttgccccttctgttgctccagtatttccaggggagcgcctgctctttttcagatcata

SEQ ID NO: 262230 - DNA, 75 bp, Artificial Sequence
  Synthetic
tctgttgctccagtatttccaggggagcgcctgctctttttcagatcatacatccccctcaagggtggttatgga

SEQ ID NO: 262231 - DNA, 75 bp, Artificial Sequence
  Synthetic
tgtgggacgactatggtatgagtaaccctgttaaggatgccctgacactacaggagttggccgacacctgccccg

SEQ ID NO: 262232 - DNA, 75 bp, Artificial Sequence
  Synthetic
ccctgttaaggatgccctgacactacaggagttggccgacacctgccccgtgaccttaaattgtgacaggataga

SEQ ID NO: 262233 - DNA, 75 bp, Artificial Sequence
  Synthetic
gggcgtcatgaagactctcaccactggctccctcattgcccgggcatcagggctgctccatgagagattagatga

SEQ ID NO: 262234 - DNA, 75 bp, Artificial Sequence
  Synthetic
gaggtggcccttgtcagatacatcaacccggatactggtcgggcactgtttgaggccaagctccacagagctggt

SEQ ID NO: 262235 - DNA, 75 bp, Artificial Sequence
  Synthetic
gtttgaactacagggcccagctcttaccaccttcaactttgaccgcaacaaagtgcttgccttcaggcagcttgc

SEQ ID NO: 262236 - DNA, 75 bp, Artificial Sequence
  Synthetic
tgtcaactttgaggcgtgttcacgtcgcatagatttcctagtctatgctgaagcacctgacgtggagaaggctaa

SEQ ID NO: 262237 - DNA, 75 bp, Artificial Sequence
  Synthetic
cgcatagatttcctagtctatgctgaagcacctgacgtggagaaggctaagagggattttcctggacagcctgac

SEQ ID NO: 262238 - DNA, 75 bp, Artificial Sequence
  Synthetic
cggatacttcagatttgattcttgggtgaaccaattctattctctcgcccccatgggaactggaaatgggcgtag

SEQ ID NO: 262239 - DNA, 75 bp, Artificial Sequence
  Synthetic
aatggcaacaccccctacggcaagggtgtcatgaagaccctgactcaggcctccctcacggcacgtgttctaggg

SEQ ID NO: 262240 - DNA, 75 bp, Artificial Sequence
  Synthetic
gtgtcatgaagaccctgactcaggcctccctcacggcacgtgttctagggttagtccatgagagaattgatgaat

SEQ ID NO: 262241 - DNA, 75 bp, Artificial Sequence
  Synthetic
atgaatatgaatgaggatggccccatcatcttcgagaggcattccaggtacagataccactatgatgctgattac

SEQ ID NO: 262242 - DNA, 75 bp, Artificial Sequence
  Synthetic
ccgacaacaaatacggcttgatggagacaatgagagtgggggccaaactacagagtgtcaagaacattgaccaac

SEQ ID NO: 262243 - DNA, 75 bp, Artificial Sequence
  Synthetic
gcaggcagacatgatggctataaagcagggggtcctgaccgctggcggcttttcccctgctgacgcagccagagg

SEQ ID NO: 262244 - DNA, 75 bp, Artificial Sequence
  Synthetic
ttggtgactacgtcataagagtgaaggaaggtctcccatctggtttcccatgcacatcacaagttaatagcataa

SEQ ID NO: 262245 - DNA, 75 bp, Artificial Sequence
  Synthetic
gacaatgagagtgggggccaaactacagagtgtcaagaacattgaccaactccgcgccaacctgcgggacataac

SEQ ID NO: 262246 - DNA, 75 bp, Artificial Sequence
  Synthetic
accaacaaggacgggtgcccaaaacccaaagatgatgaggagttcgtcatttcatctgacgacattaaaactgag

SEQ ID NO: 262247 - DNA, 75 bp, Artificial Sequence
  Synthetic
aagttgtacacgggtcccagcagtgcttttgttgtccaaccacaaaatggcaggtgcacgactgatggcgtgctc

SEQ ID NO: 262248 - DNA, 75 bp, Artificial Sequence
  Synthetic
cacatcttactctggaagattcacaccaaccgccccagtgaggcaggccgacttccagcacacccaaagccggcc

SEQ ID NO: 262249 - DNA, 75 bp, Artificial Sequence
  Synthetic
caagaaggttgagaaccaggttgtccagtccagaaacaccatccacactgccatcctcaggatgaaacaagcaaa

SEQ ID NO: 262250 - DNA, 75 bp, Artificial Sequence
  Synthetic
catcgcccactggcttctcactctctgtgcgctctctgaagttacaaatttgtcccctgacatcatacaggctaa

SEQ ID NO: 262251 - DNA, 75 bp, Artificial Sequence
  Synthetic
tgtcccctgacatcatacaggctaattcccacttctccttttatggtgatgacgaaattgttagtacagacataa

SEQ ID NO: 262252 - DNA, 75 bp, Artificial Sequence
  Synthetic
tttgctactcagtcttcaaggccaactctgactacaaccactgggtcctcacatggcacagcctcatcaaactcg

SEQ ID NO: 262253 - DNA, 75 bp, Artificial Sequence
  Synthetic
cagtccagaaacaccatccacactgccatcctcaggatgaaacaagcaaagattaggtattacatcaagtgtatc

SEQ ID NO: 262254 - DNA, 75 bp, Artificial Sequence
  Synthetic
gtacaagcggatcagggaagagagaaacggaaaatactcaatagaagagtaccttcaggacagagacaaatacta

SEQ ID NO: 262255 - DNA, 75 bp, Artificial Sequence
  Synthetic
cgcgacgcgtggtcccactgggacaacacccctgaccaggctccccccgtacccacaccaccacaggatgcctcc

SEQ ID NO: 262256 - DNA, 75 bp, Artificial Sequence
  Synthetic
acacccctgaccaggctccccccgtacccacaccaccacaggatgcctcctgggaaatagctgccgccgatgtca

SEQ ID NO: 262257 - DNA, 75 bp, Artificial Sequence
  Synthetic
gtgatgaggaatacgatgaatacaagaggatcagggaggaaagaaatggtaagtactctattgaggaatatctgc

SEQ ID NO: 262258 - DNA, 75 bp, Artificial Sequence
  Synthetic
gaggatcagggaggaaagaaatggtaagtactctattgaggaatatctgcaagacagggaccgcttctatgaaga

SEQ ID NO: 262259 - DNA, 75 bp, Artificial Sequence
  Synthetic
accaagcaagaagcagcgcaaagaggagcgcggggttttgggtctagtcacaggttcagagatccggaaaagaaa

SEQ ID NO: 262260 - DNA, 75 bp, Artificial Sequence
  Synthetic
gagcgcggggttttgggtctagtcacaggttcagagatccggaaaagaaaacccgatgacttcaaaccccgtgga

SEQ ID NO: 262261 - DNA, 75 bp, Artificial Sequence
  Synthetic
tctcgcattgtcaactttggcacgggctgggcgttttgggtctctcccagtctactcataacatcaacacatgtt

SEQ ID NO: 262262 - DNA, 75 bp, Artificial Sequence
  Synthetic
gctgggcgttttgggtctctcccagtctactcataacatcaacacatgttataccaagaggtatcactgaagcct

SEQ ID NO: 262263 - DNA, 75 bp, Artificial Sequence
  Synthetic
gacccgacgtttcaggcatgattctagaggagggagcccctgagggcaccgtgtgttccatcttgatcaagagaa

SEQ ID NO: 262264 - DNA, 75 bp, Artificial Sequence
  Synthetic
agaggagggagcccctgagggcaccgtgtgttccatcttgatcaagagaacaactggtgaaatgatgccgctcgc

SEQ ID NO: 262265 - DNA, 75 bp, Artificial Sequence
  Synthetic
tgtatgctgtacacgccgctccgcactggtggggggtctggtaattctgattcttttgtagttgctggcagggtg

SEQ ID NO: 262266 - DNA, 75 bp, Artificial Sequence
  Synthetic
gtggtcgttcgcacaagcctgcgcgtcccttgacaagaccacttctagcggccatccgcaccacatgcggaaaaa

SEQ ID NO: 262267 - DNA, 75 bp, Artificial Sequence
  Synthetic
acaggcaagctggcagaccaggcttccaaggccaacctgatgtttgaagaagggaagaacatgaccccagtctac

SEQ ID NO: 262268 - DNA, 75 bp, Artificial Sequence
  Synthetic
tgggtccaacgccaagaacatggacttgggcacgacccctggcgattgtgggtgtccttacatctataagagagg

SEQ ID NO: 262269 - DNA, 75 bp, Artificial Sequence
  Synthetic
ttgggcacgacccctggcgattgtgggtgtccttacatctataagagaggtaacgactatgtggtggctggagtc

SEQ ID NO: 262270 - DNA, 75 bp, Artificial Sequence
  Synthetic
cctgacgcatctcaagtggtccaattccaaaatggacgttgtcttatagatggtcaactcctaggcactacaccc

SEQ ID NO: 262271 - DNA, 75 bp, Artificial Sequence
  Synthetic
catttggccagaatgtataatggttatgcaggtggttttgaagtgcaggtaatcctcgcggggaacgcgttcacc

SEQ ID NO: 262272 - DNA, 75 bp, Artificial Sequence
  Synthetic
ggtagtggaagctttggcacttactgtggggcgccaatattgggtgtaggagacgctcccaaactcagcaccaaa

SEQ ID NO: 262273 - DNA, 75 bp, Artificial Sequence
  Synthetic
ctcgactcaaacggatcagggagagtcaacgttaaaaaggttgcagatcacaaggtccaaaccaacaatgagctc

SEQ ID NO: 262274 - DNA, 75 bp, Artificial Sequence
  Synthetic
gtggggcgccaatattgggtgtaggagacgctcccaaactcagcaccaaaaccaaattctggaggtcttcaacca

SEQ ID NO: 262275 - DNA, 75 bp, Artificial Sequence
  Synthetic
ttcagcaggttatgagagaccaactcaagccctttacagaacccagaggaaagatgccaaaacctgctactcttg

SEQ ID NO: 262276 - DNA, 75 bp, Artificial Sequence
  Synthetic
caagccctttacagaacccagaggaaagatgccaaaacctgctactcttgagtcggccaaggccacgataatcaa

SEQ ID NO: 262277 - DNA, 75 bp, Artificial Sequence
  Synthetic
ccatcccacaggtgactacattggcaccattgaatggatttcccagccatctacaccccctggaacagatattaa

SEQ ID NO: 262278 - DNA, 75 bp, Artificial Sequence
  Synthetic
tgttcaattcaccactgacacaaacaatgatcttgaaactggccaaaacacgaaattcaccccagtcggtgtcgt

SEQ ID NO: 262279 - DNA, 75 bp, Artificial Sequence
  Synthetic
ctccagcgggcacccacaccacgtccggaagaacgaccactggaatggtgactctttcacgggccccctcgctga

SEQ ID NO: 262280 - DNA, 75 bp, Artificial Sequence
  Synthetic
cggaagaacgaccactggaatggtgactctttcacgggccccctcgctgaccaagcatccaaggccaacttgatg

SEQ ID NO: 262281 - DNA, 75 bp, Artificial Sequence
  Synthetic
acccactttgtcagtgaacaagccccaacgatgggtgacgcagctttgctgcattatgtcgaccctgataccaac

SEQ ID NO: 262282 - DNA, 75 bp, Artificial Sequence
  Synthetic
tacaagaagatcaagaaacggctcctttgggggtctgacttagggaccatggtaaggtgtgcacgtgcctttggc

SEQ ID NO: 262283 - DNA, 75 bp, Artificial Sequence
  Synthetic
tgacccgcgacccagctggttggtttggaaaactggagcagagctcaatactcaggcaaatgtactggactaggg

SEQ ID NO: 262284 - DNA, 75 bp, Artificial Sequence
  Synthetic
caaattaaagaaggtagctaacatattcctgtgcaccctgtcttcgctattcaccaggcccataaaagacataat

SEQ ID NO: 262285 - DNA, 75 bp, Artificial Sequence
  Synthetic
tttgggggtctgacttagggaccatggtaaggtgtgcacgtgcctttggcgggctgctagatgaactcaaggcaa

SEQ ID NO: 262286 - DNA, 75 bp, Artificial Sequence
  Synthetic
ggtctggatggggcttctgggtctcccctagtctattcatcacatcaacccatgtgataccaccaggcataacag

SEQ ID NO: 262287 - DNA, 75 bp, Artificial Sequence
  Synthetic
gatacacctaccacctggatgctgattattcaagatgggattcaacgcaacaaagggccatccttgccacggcca

SEQ ID NO: 262288 - DNA, 75 bp, Artificial Sequence
  Synthetic
ttattcaagatgggattcaacgcaacaaagggccatccttgccacggccatggagatcatggttcgcttctcacc

SEQ ID NO: 262289 - DNA, 75 bp, Artificial Sequence
  Synthetic
ctctggacttggttccctaatcaatgctggggctggggccatcaaccaaaaagttgaatttgaaaataacagaaa

SEQ ID NO: 262290 - DNA, 75 bp, Artificial Sequence
  Synthetic
ctaacttggccaacccagcaccactggactatgtcaactttgaagcgtgctcgaggcgcatcgatttcctcgtgt

SEQ ID NO: 262291 - DNA, 75 bp, Artificial Sequence
  Synthetic
ctcggtccttgaaggcctgccctcaggcgtcccttgcacatcacagtggaactccatagcgcattggcttctaac

SEQ ID NO: 262292 - DNA, 75 bp, Artificial Sequence
  Synthetic
ggcgtcccttgcacatcacagtggaactccatagcgcattggcttctaacactctgtgcaatctctgagtcaaca

SEQ ID NO: 262293 - DNA, 75 bp, Artificial Sequence
  Synthetic
ggaggtctttctaatgctgatgcttctcgggctgttgctggagccccagtaacacaattgattgattggaacggc

SEQ ID NO: 262294 - DNA, 75 bp, Artificial Sequence
  Synthetic
catttggccagaatgtataatggttatgcaggtggttttgaagtgcaggtgatcctcgcggggaacgcgttcacc

SEQ ID NO: 262295 - DNA, 75 bp, Artificial Sequence
  Synthetic
atagagatcaaaccagaggttctcacagaaaagctcaagagctatggtttaatacccaccagaccagacaaaagc

SEQ ID NO: 262296 - DNA, 75 bp, Artificial Sequence
  Synthetic
cagaaaagctcaagagctatggtttaatacccaccagaccagacaaaagcgaggggccactagtcattagcaaag

SEQ ID NO: 262297 - DNA, 75 bp, Artificial Sequence
  Synthetic
actccattttgaggcagctttactggaccagggggcccaaccatgatgacccctatgagaccatgaccacacact

SEQ ID NO: 262298 - DNA, 75 bp, Artificial Sequence
  Synthetic
cgctaatgttgtaatataatgcagcagtgggcactatattcaatttggtttaattagtaaataatttggctattg

SEQ ID NO: 262299 - DNA, 75 bp, Artificial Sequence
  Synthetic
ggcaattggaacccgtgttgatccccttacctgatgttaggaataacttctatcattataatcagtcaaatgatt

SEQ ID NO: 262300 - DNA, 75 bp, Artificial Sequence
  Synthetic
gaccagggggcccaaccatgatgacccctatgagaccatgaccacacactcacagagagccacacagcttatggc

SEQ ID NO: 262301 - DNA, 75 bp, Artificial Sequence
  Synthetic
agaaagtggcctggagttttacgtgcccaggcaagaggccatgtttaggtggatgaggttttctgacctcagcac

SEQ ID NO: 262302 - DNA, 75 bp, Artificial Sequence
  Synthetic
cccaggcaagaggccatgtttaggtggatgaggttttctgacctcagcacgtgggagggcgatcgcaatctggct

SEQ ID NO: 262303 - DNA, 75 bp, Artificial Sequence
  Synthetic
ttcgtaagcgaggggagtcacgggtgtaatgtgaaaagacaaaattgattatctttcttttctttagtgtctttt

SEQ ID NO: 262304 - DNA, 75 bp, Artificial Sequence
  Synthetic
gatactcgaggagggagcgcctgaaggaaccgtggcctcccttctcatcaagagaccaacaggtgaactcatgcc

SEQ ID NO: 262305 - DNA, 75 bp, Artificial Sequence
  Synthetic
tgttgttcaaccacaaaatggcaggtgcacgactgatggcgtgctcttaggcaccacccaactgtctcctgtcaa

SEQ ID NO: 262306 - DNA, 75 bp, Artificial Sequence
  Synthetic
tgcacgactgatggcgtgctcttaggcaccacccaactgtctcctgtcaacatctgcaccttcagaggggatgtc

SEQ ID NO: 262307 - DNA, 75 bp, Artificial Sequence
  Synthetic
ggtcaccaatgagaccatggcactggaacccgtcgcaggggcggccttggccgcgcctgtcgtagggcagcataa

SEQ ID NO: 262308 - DNA, 75 bp, Artificial Sequence
  Synthetic
gaacccgtcgcaggggcggccttggccgcgcctgtcgtagggcagcataacgttattgacccctggattagaggt

SEQ ID NO: 262309 - DNA, 75 bp, Artificial Sequence
  Synthetic
gaattaggccctgaattaaacccttatctggctcatcttgcccgtatgtacaacgggtacgctggtggaatggag

SEQ ID NO: 262310 - DNA, 75 bp, Artificial Sequence
  Synthetic
gaaacacaccgccttctccagcaagggcctcagtgatgaagagtacgatgagtacaagagaatcagggaggagag

SEQ ID NO: 262311 - DNA, 75 bp, Artificial Sequence
  Synthetic
atctggctcatcttgcccgtatgtacaacgggtacgctggtggaatggaggttcaggtggtgctcgctgggaatg

SEQ ID NO: 262312 - DNA, 75 bp, Artificial Sequence
  Synthetic
taacaatgtgcccccacgttatagtggatgtgagacaactggagccagtattgctccctatgccagatgttagga

SEQ ID NO: 262313 - DNA, 75 bp, Artificial Sequence
  Synthetic
ggatgtgagacaactggagccagtattgctccctatgccagatgttaggaataatttctttcattataaccagag

SEQ ID NO: 262314 - DNA, 75 bp, Artificial Sequence
  Synthetic
tttaacacgcgcaggcagcctctcttcgctcacattcgtaagcgaggggagtcacgggcataatgtgaaaagaca

SEQ ID NO: 262315 - DNA, 75 bp, Artificial Sequence
  Synthetic
tactgtgtcttgtagagttcttacgaggccatcccctgattttgagttcacctttttgataccacccacagttga

SEQ ID NO: 262316 - DNA, 75 bp, Artificial Sequence
  Synthetic
aggccatcccctgattttgagttcacctttttgataccacccacagttgagtccaaaagcaagccttttaccatt

SEQ ID NO: 262317 - DNA, 75 bp, Artificial Sequence
  Synthetic
gataacattgtggtgcagccccagaatggaagatgcacacttggtggtgaactacaaggcacaacccagctccaa

SEQ ID NO: 262318 - DNA, 75 bp, Artificial Sequence
  Synthetic
atggaagatgcacacttggtggtgaactacaaggcacaacccagctccaaccaagccttatctgctcctttcgag

SEQ ID NO: 262319 - DNA, 75 bp, Artificial Sequence
  Synthetic
taatggctggagctttctttgctggattggcatctgatgtccttggctctggacttggttccctaatcaatgctg

SEQ ID NO: 262320 - DNA, 75 bp, Artificial Sequence
  Synthetic
atggaccttggcacgaccccgggcgactgtgggtgtccctacatttacaaaaggggtaatgattatgtggttatt

SEQ ID NO: 262321 - DNA, 75 bp, Artificial Sequence
  Synthetic
aagcccgcgccttcaaccatgaataccatcttcagctgcaaaatttagatggcactgactatgaccctgcagggg

SEQ ID NO: 262322 - DNA, 75 bp, Artificial Sequence
  Synthetic
ccatcttcagctgcaaaatttagatggcactgactatgaccctgcaggggatctccccgcaaccttaggggcacc

SEQ ID NO: 262323 - DNA, 75 bp, Artificial Sequence
  Synthetic
tgtcccctgacattatccaggccaactccctcttttccttctacggtgatgatgaaattgtgagcacagacataa

SEQ ID NO: 262324 - DNA, 75 bp, Artificial Sequence
  Synthetic
gaattgtcaactttggttctggatgggggttttgggtgtcacctagcctcttcataacatcaacacatgtcatac

SEQ ID NO: 262325 - DNA, 75 bp, Artificial Sequence
  Synthetic
caaaatcaccactagtgaccccaggtatgctcccaagcttggatcagttgagttcgtaacagagtcaacagatat

SEQ ID NO: 262326 - DNA, 75 bp, Artificial Sequence
  Synthetic
tatgctcccaagcttggatcagttgagttcgtaacagagtcaacagatattgtgctgaatgaccagaccaagttt

SEQ ID NO: 262327 - DNA, 75 bp, Artificial Sequence
  Synthetic
acagccaacaccaatttagcccctcctgtggcgcctgtttaccccggtgaacaattgcttttcttccgctcaaac

SEQ ID NO: 262328 - DNA, 75 bp, Artificial Sequence
  Synthetic
ctgtggcgcctgtttaccccggtgaacaattgcttttcttccgctcaaaccttccccttgcaggtggtacagccg

SEQ ID NO: 262329 - DNA, 75 bp, Artificial Sequence
  Synthetic
aacatatcgtttgtcaccccaccatctagcagatcctctagccaaggcacagtctcaaccgtgcctaaagaagtt

SEQ ID NO: 262330 - DNA, 75 bp, Artificial Sequence
  Synthetic
acattgcactcctgaggtatgtgaaccccgacacaggtagagttctctttgaagcaaaattgcaccgacagggtt

SEQ ID NO: 262331 - DNA, 75 bp, Artificial Sequence
  Synthetic
atgaagatggcgtctaacgacgcttccgctgccgctgttgctaacagcaacaacgacaccgcaaaatcttcaagt

SEQ ID NO: 262332 - DNA, 75 bp, Artificial Sequence
  Synthetic
ccccgacacaggtagagttctctttgaagcaaaattgcaccgacagggttacataactgtggctggtgctggcac

SEQ ID NO: 262333 - DNA, 75 bp, Artificial Sequence
  Synthetic
catgggatctggaacggggcgcaggaggaatcagtaatggcggggcaaattatagccgggattgctgctgatctg

SEQ ID NO: 262334 - DNA, 75 bp, Artificial Sequence
  Synthetic
gaggatgaagtagtggtttcttatagtgccaaagatggcgtttccggtttacctgagctttccaccgtcaggcaa

SEQ ID NO: 262335 - DNA, 75 bp, Artificial Sequence
  Synthetic
aggaatcagtaatggcggggcaaattatagccgggattgctgctgatctgtttagttctggacttggctcactta

SEQ ID NO: 262336 - DNA, 75 bp, Artificial Sequence
  Synthetic
tctatatattcaaatcaaactgcttcaacgagacttggttctacagctggctctggcaccaatgtctcgagtctc

SEQ ID NO: 262337 - DNA, 75 bp, Artificial Sequence
  Synthetic
catactgtggagcaccaatactaggacctggtaatgcacctaaactaagtacaaagaccaaattttggcgatcat

SEQ ID NO: 262338 - DNA, 75 bp, Artificial Sequence
  Synthetic
ggtgcagcacttctaccaagaagcagctccagcacaatctgatgtggctctattgagatttgtgaatccagacac

SEQ ID NO: 262339 - DNA, 75 bp, Artificial Sequence
  Synthetic
ctcatgatagggaaatgctgcaggcgcaggtcgcagccacacggcaactgcagcaagatatgattaagatcaagg

SEQ ID NO: 262340 - DNA, 75 bp, Artificial Sequence
  Synthetic
gcaggtcgcagccacacggcaactgcagcaagatatgattaagatcaaggaagacacactcatgctcgccggctt

SEQ ID NO: 262341 - DNA, 75 bp, Artificial Sequence
  Synthetic
gtgtacactcctcagtacctcatctctccagacactctcaagaaattacacggagagacattcccctacacagcc

SEQ ID NO: 262342 - DNA, 75 bp, Artificial Sequence
  Synthetic
ctgggctccaggtgctatgcgcacctcatcttattctgggcggttttcctctcaagtgccccagaccacctttta

SEQ ID NO: 262343 - DNA, 75 bp, Artificial Sequence
  Synthetic
tcatcttattctgggcggttttcctctcaagtgccccagaccaccttttataaggaaccacccaagataccatct

SEQ ID NO: 262344 - DNA, 75 bp, Artificial Sequence
  Synthetic
tccgggagcagttccggttcaggatcagtctcgtctcactctacccagtcaacctccctttccactgtgcgttcc

SEQ ID NO: 262345 - DNA, 75 bp, Artificial Sequence
  Synthetic
cagtctcgtctcactctacccagtcaacctccctttccactgtgcgttcccccaattcaacactgtcacggaccg

SEQ ID NO: 262346 - DNA, 75 bp, Artificial Sequence
  Synthetic
agttggtcatgaagtggttcttcccgaagaaagaggaagcaaatgaactggctatggtgagatccatcgaggatg

SEQ ID NO: 262347 - DNA, 75 bp, Artificial Sequence
  Synthetic
ctgatactttttctagtagatcatcagtttcttctagatcttcactttcgggaacggtctcaaccgtccccaaag

SEQ ID NO: 262348 - DNA, 75 bp, Artificial Sequence
  Synthetic
atttaacacacgcaggcaaccgctctttgctcgcctccgcaggaggggggagtcacaagtttagtgaaaagttat

SEQ ID NO: 262349 - DNA, 75 bp, Artificial Sequence
  Synthetic
acagctcaaaccattcactgaaccacgtggaaagccaccaaaacccagtgtcctggaagcagccaaaaacaccat

SEQ ID NO: 262350 - DNA, 75 bp, Artificial Sequence
  Synthetic
ggtgtgcacaaaccaccagctgccattagcctcgccaaggtcgaactgacaccactctccttgttctggagacct

SEQ ID NO: 262351 - DNA, 75 bp, Artificial Sequence
  Synthetic
gccaacgctaaaggcatggaccttggcaccatacctggagactgtggagcgccttatgtccacaagagaggaaat

SEQ ID NO: 262352 - DNA, 75 bp, Artificial Sequence
  Synthetic
gacaaatactatgaggaggtggccattgccagggcgaccgaggaagacttttgtgaagaggaggaggccaagatc

SEQ ID NO: 262353 - DNA, 75 bp, Artificial Sequence
  Synthetic
ttcgagcaccatctcattagagggccccactagagaacaccaatgtagagcccacgtcgccaaggccaatggagg

SEQ ID NO: 262354 - DNA, 75 bp, Artificial Sequence
  Synthetic
gtatacaccacttagggctaataatgctggggatgatgtcttcacagtctcttgtcgagtcctcacgaggccatc

SEQ ID NO: 262355 - DNA, 75 bp, Artificial Sequence
  Synthetic
gggcgcggcctaaacagccgcccccgaaggaaataccacccagacccccgcgaccacccacaccagaattggtca

SEQ ID NO: 262356 - DNA, 75 bp, Artificial Sequence
  Synthetic
gactactctggggttctgacctgtcaacaatgatacggtgtgctagggcttttggtggcctcatggatgagatga

SEQ ID NO: 262357 - DNA, 75 bp, Artificial Sequence
  Synthetic
aacaaacaattgacccacctgagaagtggtcgttcgcacaagcttgcgcgtcccttgacaagaccacttctagcg

SEQ ID NO: 262358 - DNA, 75 bp, Artificial Sequence
  Synthetic
gatcaagaagaggcttctctggggctcggatttagcgaccatgatccggtgtgctcgagcattcggaggcctaat

SEQ ID NO: 262359 - DNA, 75 bp, Artificial Sequence
  Synthetic
gactgcctgagctcaccactgtcagacaaccggaagaaaccaacacggcgttcagtgtccccccactcaaccaaa

SEQ ID NO: 262360 - DNA, 75 bp, Artificial Sequence
  Synthetic
ggtgggattcaacacaacagagagccgtgctggcagctgctctagaaatcatggttaaattctcctcagaaccac

SEQ ID NO: 262361 - DNA, 75 bp, Artificial Sequence
  Synthetic
gcctgtacgttgaacgaggtcttatacttggtgtgcacaagccaccggcagccatcagccttgccaaggtcgagc

SEQ ID NO: 262362 - DNA, 75 bp, Artificial Sequence
  Synthetic
acttggtgtgcacaagccaccggcagccatcagccttgccaaggtcgagctagcaccgctctctttgttctggag

SEQ ID NO: 262363 - DNA, 75 bp, Artificial Sequence
  Synthetic
gtgggtgacttcacaatatcaatcaacgagggtcttccctctggggtgccctgcacctcccaatggaactccatc

SEQ ID NO: 262364 - DNA, 75 bp, Artificial Sequence
  Synthetic
tgcatttgacaacaattgctacgccttttgttgttgggtattagacctaaacgactcatggctaagcaggagaat

SEQ ID NO: 262365 - DNA, 75 bp, Artificial Sequence
  Synthetic
ttttgttgttgggtattagacctaaacgactcatggctaagcaggagaatgattcagagaacaacaggtttcttc

SEQ ID NO: 262366 - DNA, 75 bp, Artificial Sequence
  Synthetic
ttcttgtgcactttgtcttcactattcaccagacccattaaggacataatagggaagttgaaacctcttaacatc

SEQ ID NO: 262367 - DNA, 75 bp, Artificial Sequence
  Synthetic
acaacaagtgctcagagaccagcttaaaccttttgctgaacctcgtggtaggttaccagaagctgggctattaga

SEQ ID NO: 262368 - DNA, 75 bp, Artificial Sequence
  Synthetic
ttaaagttggtcatgaagtggttcttcccaaagaaagaggaagcaaatgaactggctatggtgagatccatcgag

SEQ ID NO: 262369 - DNA, 75 bp, Artificial Sequence
  Synthetic
acctacatgagaacccttgaccttgaggaggagaaagccagaaaactctcaaccaaatctgcttcacccgatatt

SEQ ID NO: 262370 - DNA, 75 bp, Artificial Sequence
  Synthetic
tccagcaggccgagacctgtcgttgtgatgatatcgggaagaccagggatagggaaaactcaccttgccagggag

SEQ ID NO: 262371 - DNA, 75 bp, Artificial Sequence
  Synthetic
agggaaaactcaccttgccagggagctggccaagaagatcgcggcctccctcacaggggaccagcgtgtgggtct

SEQ ID NO: 262372 - DNA, 75 bp, Artificial Sequence
  Synthetic
gagcaaccccatccatgatgccctcaggttgcaggagcttgctgacacttgccccctcacgctaaattgtgacag

SEQ ID NO: 262373 - DNA, 75 bp, Artificial Sequence
  Synthetic
aggttgcaggagcttgctgacacttgccccctcacgctaaattgtgacagaattgagaacaaagggaaagtcttt

SEQ ID NO: 262374 - DNA, 75 bp, Artificial Sequence
  Synthetic
ggaccttcgcaggcatagtggagtccttaatactcttggcagaactctttggagttttctggacacccccagatg

SEQ ID NO: 262375 - DNA, 75 bp, Artificial Sequence
  Synthetic
gacagtgatgccataattatcaccaccaatctggccaacccagcaccactggattatgtcaactttgaagcgtgc

SEQ ID NO: 262376 - DNA, 75 bp, Artificial Sequence
  Synthetic
ccaatctggccaacccagcaccactggattatgtcaactttgaagcgtgctcgagacgcattgacttcctcgtgt

SEQ ID NO: 262377 - DNA, 75 bp, Artificial Sequence
  Synthetic
agttctggccacccccatcacaaaaagaagaacgatgattggaacggaagctcatttgtacgggaactgggagat

SEQ ID NO: 262378 - DNA, 75 bp, Artificial Sequence
  Synthetic
ccacttttccgggtgaacaacttcttttctttaggtccactatgcccggatgcagcgggtatcccaacatggatt

SEQ ID NO: 262379 - DNA, 75 bp, Artificial Sequence
  Synthetic
ccatctggagtgccttgcacctcccagtggaactcaattagtcactggttgctaacactgtgtgccctttctgaa

SEQ ID NO: 262380 - DNA, 75 bp, Artificial Sequence
  Synthetic
cagctcaaggatgtcaagaccatgtcagaccttaaacaagcactcaagaacatcgcgatcaagaagtgccagata

SEQ ID NO: 262381 - DNA, 75 bp, Artificial Sequence
  Synthetic
tgcgtccaggaggcactgtattccatcatccaaatcgctggggctgcattcgtcaccacgcgcatcgctaagcgc

SEQ ID NO: 262382 - DNA, 75 bp, Artificial Sequence
  Synthetic
tgggcccctgatgctaggactacaacatacaatgcaggccgtttttccacccctcaaccttcgggggcactgcca

SEQ ID NO: 262383 - DNA, 75 bp, Artificial Sequence
  Synthetic
tcaatcaagaagtgtcagattgtgtatagtggttgcacctacacacttgagtctgatggcaagggcaatgtgaaa

SEQ ID NO: 262384 - DNA, 75 bp, Artificial Sequence
  Synthetic
aaacccaaagatgatgaagagtttgtcgtctcatccgacgacatcaaaactgagggcaagaaagggaagaacaag

SEQ ID NO: 262385 - DNA, 75 bp, Artificial Sequence
  Synthetic
acaataaaattaagaaaaggctgttgtggggagcggacctcggcaccgttatccgagctgctagagcgtttggtc

SEQ ID NO: 262386 - DNA, 75 bp, Artificial Sequence
  Synthetic
tgtcacttttaaacgagccctcggggcgcggcctaaacagccccccccgagggaaataccacaaggacccccacg

SEQ ID NO: 262387 - DNA, 75 bp, Artificial Sequence
  Synthetic
aattaacagcaaagctgaaggagtatggtctgaggccgacacgcccagacaaaactgagggacccttagttttga

SEQ ID NO: 262388 - DNA, 75 bp, Artificial Sequence
  Synthetic
acaaggaaacaacgcaaagaagagagggcctctctcggcttggtcacaggctctgaaatcaggaagagaaaccca

SEQ ID NO: 262389 - DNA, 75 bp, Artificial Sequence
  Synthetic
gcggcctaaacagcctcccccgagggaaataccacaaagacccccacgaccacccactccagaactaatcaaaaa

SEQ ID NO: 262390 - DNA, 75 bp, Artificial Sequence
  Synthetic
cacaaatcaggtgaattctgccggttgagattcccaaagccaatcagaactgatgtgacgggcatgattctagaa

SEQ ID NO: 262391 - DNA, 75 bp, Artificial Sequence
  Synthetic
tccagagaacaactggcttcttcagaccctaccaagattggaataggaaacccctccccactatggatgactcca

SEQ ID NO: 262392 - DNA, 75 bp, Artificial Sequence
  Synthetic
agaatggggacccatgcaaccatgaaaattcaggggcgcacagttggagggcaaatgggtatgctcctgacggga

SEQ ID NO: 262393 - DNA, 75 bp, Artificial Sequence
  Synthetic
gactacgtggtcataggagtccatacggccgctgcccgtggaggaaacactgtcatatgtgccacccaggggagt

SEQ ID NO: 262394 - DNA, 75 bp, Artificial Sequence
  Synthetic
cggccgctgcccgtggaggaaacactgtcatatgtgccacccaggggagtgagggagaagccacacttgaaggag

SEQ ID NO: 262395 - DNA, 75 bp, Artificial Sequence
  Synthetic
gtataaatatcattatgatgctgattacacagcttgggactcaacccaaaacagggaaatcatgatggagtcctt

SEQ ID NO: 262396 - DNA, 75 bp, Artificial Sequence
  Synthetic
gaagagaaagccagaaaactctcaaccaagtctgcttcacctgacatcgtgggcacaatcaacgcccttctggcg

SEQ ID NO: 262397 - DNA, 75 bp, Artificial Sequence
  Synthetic
tgcaccgagcgaaggaggagctttccagcagaccaagacctgtagtcttgatgatatcaggcagaccaggaatag

SEQ ID NO: 262398 - DNA, 75 bp, Artificial Sequence
  Synthetic
tgccaagaaaaccatcatcaatgtccttgagcaaacaattgatccaccccaaaaatggtcatttgcgcaagcttg

SEQ ID NO: 262399 - DNA, 75 bp, Artificial Sequence
  Synthetic
cttgagcaaacaattgatccaccccaaaaatggtcatttgcgcaagcttgcgcatctcttgacaaaaccacctcc

SEQ ID NO: 262400 - DNA, 75 bp, Artificial Sequence
  Synthetic
tacaagaactcgctgacacttgccccctcaccttaaactgtgacaggattgagaacaaaggaaaggtctttgaca

SEQ ID NO: 262401 - DNA, 75 bp, Artificial Sequence
  Synthetic
gcctccaaggccaacctaatgtttgaagagggaaagaacatgactccagtctacacaggtgcacttaaagatgag

SEQ ID NO: 262402 - DNA, 75 bp, Artificial Sequence
  Synthetic
ctacacaggtgcacttaaagatgagttggtaaagaccgataaagtttatggtaaggtcaagaagaggcttctgtg

SEQ ID NO: 262403 - DNA, 75 bp, Artificial Sequence
  Synthetic
tcccggtgggactcaacacaacaaagggatgtgctagcagcagcactagaaatcatggttaagttctctccagaa

SEQ ID NO: 262404 - DNA, 75 bp, Artificial Sequence
  Synthetic
aatcatggttaagttctctccagaaccacacctggcccagatagttgcagaagacctcctttcccctagcgtaat

SEQ ID NO: 262405 - DNA, 75 bp, Artificial Sequence
  Synthetic
gtatagtggttgcacctacacacttgagtctgatggcaagggcaatgtgaaagttgacagagttcagagcacctc

SEQ ID NO: 262406 - DNA, 75 bp, Artificial Sequence
  Synthetic
gagtctgatggcaagggcaatgtgaaagttgacagagttcagagcacctccgttcagaccaacaatgagctggct

SEQ ID NO: 262407 - DNA, 75 bp, Artificial Sequence
  Synthetic
catcgcccactggctcctcactctttgtgcactctctgaagtcacggacctgtcccctgacatcattcaggccaa

SEQ ID NO: 262408 - DNA, 75 bp, Artificial Sequence
  Synthetic
ggtttggaaaattggaacaaagttcaattctcaggcaaatgtactggaccaggggtcccaaccatgaagatccat

SEQ ID NO: 262409 - DNA, 75 bp, Artificial Sequence
  Synthetic
agggtaagaaagggaagaacaagactggccgtggcaagaagcacacagccttctcaagtaaaggtctcagtgatg

SEQ ID NO: 262410 - DNA, 75 bp, Artificial Sequence
  Synthetic
tgcaagaactcgctgacacttgccccctcaccctaaattgtgacaggattgagaataaaggaaaggtctttgaca

SEQ ID NO: 262411 - DNA, 75 bp, Artificial Sequence
  Synthetic
gactgatggcgtgctcctaggtaccacccaactgtctcctgtcaacatctgcaccttcagaggggatgtcaccca

SEQ ID NO: 262412 - DNA, 75 bp, Artificial Sequence
  Synthetic
ggtggcatggatttttacgtgcccagacaagagccaatgttcagatggatgagattctcagatctgagcacgtgg

SEQ ID NO: 262413 - DNA, 75 bp, Artificial Sequence
  Synthetic
ttgaatttgacccaaataaattgacacaggtgctcaaggaatatggcctaaaacccacaagacccgataaaactg

SEQ ID NO: 262414 - DNA, 75 bp, Artificial Sequence
  Synthetic
atcccatttggccagaatgtacaatggttatgcaggtggttttgaagtgcaggtaattctcgcggggaacgcgtt

SEQ ID NO: 262415 - DNA, 75 bp, Artificial Sequence
  Synthetic
ctatgtggtcattggagtccacacggctgccgctcgtgggggaaacactgtcatatgtgccacccaggggggtga

SEQ ID NO: 262416 - DNA, 75 bp, Artificial Sequence
  Synthetic
agatttgtgaatccagacacaggtagggttttgtttgagtgtaagcttcataaatcaggctatgttacagtggct

SEQ ID NO: 262417 - DNA, 75 bp, Artificial Sequence
  Synthetic
gaccccaccattaagttgatagcaatgttgtatacaccacttagggctaataatgctggggatgatgtcttcaca

SEQ ID NO: 262418 - DNA, 75 bp, Artificial Sequence
  Synthetic
cccaaaacttagcaccaaaaccaaattctggagatcatccacagcaccactcccacctggcacctatgaaccagc

SEQ ID NO: 262419 - DNA, 75 bp, Artificial Sequence
  Synthetic
ggggccatcaaccaaaaagttgaatttgaaaataacagaaaattgcaacaagcttccttccaatttagtagcaat

SEQ ID NO: 262420 - DNA, 75 bp, Artificial Sequence
  Synthetic
ttgaaaataacagaaaattgcaacaagcttccttccaatttagtagcaatctacaacaggcttcctttcaacatg

SEQ ID NO: 262421 - DNA, 75 bp, Artificial Sequence
  Synthetic
agaagaaatcccagcccctctaggaactccagattttgtggggaagattcaaggcgtgctcacccaaaccacaag

SEQ ID NO: 262422 - DNA, 75 bp, Artificial Sequence
  Synthetic
aaagctacagtgtacactgggagcgccgactttgctccaaaactgggtagagttcaatttgaaactgacacagac

SEQ ID NO: 262423 - DNA, 75 bp, Artificial Sequence
  Synthetic
caaagttcaccccagtcggtgtcatccaagatggtggcaccacccaccgaaatgaaccccagcagtgggtgctcc

SEQ ID NO: 262424 - DNA, 75 bp, Artificial Sequence
  Synthetic
atccttatttggcccacttggcacgcatgtacaatgcttatgctggcggttttgaagtgcaagtgctgctggccg

SEQ ID NO: 262425 - DNA, 75 bp, Artificial Sequence
  Synthetic
agatcctttagccaaggcacagtttcaaccgtgcccaaaaaagttttggactcctggacgggggctttcaacacg

SEQ ID NO: 262426 - DNA, 75 bp, Artificial Sequence
  Synthetic
caaccgtgcccaaaaaagttttggactcctggacgggggctttcaacacgggcaggcagcctttttttgctcaca

SEQ ID NO: 262427 - DNA, 75 bp, Artificial Sequence
  Synthetic
aaagccaacctcatgtatgaacaggctaaacatgtgcagcccgtgtacacggccgcgctcaaagatgagcttgtt

SEQ ID NO: 262428 - DNA, 75 bp, Artificial Sequence
  Synthetic
gccagggcttttggtggtctcatggacagcatgaaggcaagctgtatagctcttccatgcagggtaggaatgaac

SEQ ID NO: 262429 - DNA, 75 bp, Artificial Sequence
  Synthetic
gtactgggctcccgatgctaggactacaacatacaatgcaggccgcttttccacccctcaaccatcgggggcact

SEQ ID NO: 262430 - DNA, 75 bp, Artificial Sequence
  Synthetic
tgtggttgatgtgagacaattggaacccgtggtcctacctctcccagacgtgcgtgcgggcttctaccattacaa

SEQ ID NO: 262431 - DNA, 75 bp, Artificial Sequence
  Synthetic
cagggagtacggcctggtccccacccgacctgataaaactgaaggtcccctcgtcataactgaagacctcaccgg

SEQ ID NO: 262432 - DNA, 75 bp, Artificial Sequence
  Synthetic
ttggtcatcccccccaatggttattttaggtttgattcctgggttaatcaattctacacacttgcccccatggga

SEQ ID NO: 262433 - DNA, 75 bp, Artificial Sequence
  Synthetic
aacatacaatgcaggccgtttttccacccctcaaccttcgggggcactgccaggaagaatcaatcccaggactcc

SEQ ID NO: 262434 - DNA, 75 bp, Artificial Sequence
  Synthetic
acatcttctaatgcttctactgctacttctatatattcaaatcaaactgtttcaacgagacttggttctacagct

SEQ ID NO: 262435 - DNA, 75 bp, Artificial Sequence
  Synthetic
gtgaatgaagatggcgtctaaccgcgctccgcatgcctttggcagtcaaaactctgtcaatgacagtatcaacgc

SEQ ID NO: 262436 - DNA, 75 bp, Artificial Sequence
  Synthetic
tccaaaatggtaggatcacactggatggggagctccagggtacaacactacccacttcaaccagcattggcagga

SEQ ID NO: 262437 - DNA, 75 bp, Artificial Sequence
  Synthetic
agatcgggcccaaaacattaacaattccccctgagcccccaaatggtgaagacactgtgcagtttgatgcaaagt

SEQ ID NO: 262438 - DNA, 75 bp, Artificial Sequence
  Synthetic
aaccggaagaaaccaatacggccttcagtgtccctccactcaatcagagggagaatagagatgctaaggaaccac

SEQ ID NO: 262439 - DNA, 75 bp, Artificial Sequence
  Synthetic
cattaagtgagagggagcacagatcggccactgaaccacttcctggcacaatattggagatgtgggatggtgaat

SEQ ID NO: 262440 - DNA, 75 bp, Artificial Sequence
  Synthetic
cgatggcaaagctctgggggtccacaaaccaccggctgctataagcctcgcgacgatagagctcacccccatatc

SEQ ID NO: 262441 - DNA, 75 bp, Artificial Sequence
  Synthetic
cgctggtaatgccttcacagcgggtaaaataataattagttgtgttccccctggttttgcagcccaaaatgtctc

SEQ ID NO: 262442 - DNA, 75 bp, Artificial Sequence
  Synthetic
tctctactggagacccgtttacacccccaactatttggtctccccagacacattgaaaggcctcgctggtgagaa

SEQ ID NO: 262443 - DNA, 75 bp, Artificial Sequence
  Synthetic
cattgaaaggcctcgctggtgagaagttcccctacacggccttcagtaacaattgttataacttttgttgttggg

SEQ ID NO: 262444 - DNA, 75 bp, Artificial Sequence
  Synthetic
cttggaacaggaagcccctcccaaccgttgatgatggaaagatcaaaagggtggccaacgcgatcctctgtgcac

SEQ ID NO: 262445 - DNA, 75 bp, Artificial Sequence
  Synthetic
caaagatttgttaggcaaacttaagccattgaacctgctacacttgcttgcgtcatgcgattggacgtttgcagg

SEQ ID NO: 262446 - DNA, 75 bp, Artificial Sequence
  Synthetic
gtcctatgggacgactatggaatgagcaatcccatccacgacgccctcaggctgcaagaactcgctgacacttgc

SEQ ID NO: 262447 - DNA, 75 bp, Artificial Sequence
  Synthetic
tgtagtggagacagtcatattaatggcagaacttttcaatatcttctggaccccgccagatgtctctaattttat

SEQ ID NO: 262448 - DNA, 75 bp, Artificial Sequence
  Synthetic
agcctccctgataggtgattttgaattacaagggcctgaggacctggctgtggaactcgttcctgtggttatggg

SEQ ID NO: 262449 - DNA, 75 bp, Artificial Sequence
  Synthetic
tttaactgagaacaactggactgaattccagccattcaatgaccaacccgccccacttgggtgcccagacttcaa

SEQ ID NO: 262450 - DNA, 75 bp, Artificial Sequence
  Synthetic
gctgctgaaaacaaatatgggttgatggacacaatgaaagttgggaggcagctcaaggatgtcaaaaccatgcca

SEQ ID NO: 262451 - DNA, 75 bp, Artificial Sequence
  Synthetic
ggcatgcaaagacctagggaactatgcccttgacattctcaaattggtcatgaagtggttcttcccaaagaagga

SEQ ID NO: 262452 - DNA, 75 bp, Artificial Sequence
  Synthetic
gcccttgacattctcaaattggtcatgaagtggttcttcccaaagaaggaagagaaagctgagatggaaaccttg

SEQ ID NO: 262453 - DNA, 75 bp, Artificial Sequence
  Synthetic
gacagcctcacggcttttatgaagaccctggacctagaagaggaaaaagctagaaaactgtccactaagtcatct

SEQ ID NO: 262454 - DNA, 75 bp, Artificial Sequence
  Synthetic
tagaaaactgtccactaagtcatcttcaccggacatcgtcggcaccattaatgccatactagctaggattgctgc

SEQ ID NO: 262455 - DNA, 75 bp, Artificial Sequence
  Synthetic
aataatgactccactccaactatgagattgatttgtatgttgtatacccctctccgtgctagtggcagctcctct

SEQ ID NO: 262456 - DNA, 75 bp, Artificial Sequence
  Synthetic
aaggaaacaacgcaaggaagaaagagcttctctcggtttagtcacaggttctgaaattaggaaaagaaacccaga

SEQ ID NO: 262457 - DNA, 75 bp, Artificial Sequence
  Synthetic
ctgaaattaggaaaagaaacccagaagacttcaagcccaaggggaaactatgggctgacgatgacagaagtgtgg

SEQ ID NO: 262458 - DNA, 75 bp, Artificial Sequence
  Synthetic
cagacctggcattggcaaaacccacatggcaagacatttggctaagagcatcgccaacaccatgagtggcgacca

SEQ ID NO: 262459 - DNA, 75 bp, Artificial Sequence
  Synthetic
aaagatgccttaacactacaggagttggccgacacctgtccagtcactttaaattgtgataggattgagaacgag

SEQ ID NO: 262460 - DNA, 75 bp, Artificial Sequence
  Synthetic
ttcgaggcgtgttccaggagagttgacttcttggtctatgcagagtcaccagagattgaaaaggtcaagagggac

SEQ ID NO: 262461 - DNA, 75 bp, Artificial Sequence
  Synthetic
accgggcacgccgctgtccactctgaccaacaggcaggccatttagcccaaggctacaaaattcaattctcccca

SEQ ID NO: 262462 - DNA, 75 bp, Artificial Sequence
  Synthetic
cacagaaatggcattgggtttgattggcaagacaacccaagaggcagcagggaccaatggcctgccacctaaaca

SEQ ID NO: 262463 - DNA, 75 bp, Artificial Sequence
  Synthetic
cagggcgggtttgacaagaatggtaacactccacacggtaagggaaccatgcggtccctgacccaggggtccctg

SEQ ID NO: 262464 - DNA, 75 bp, Artificial Sequence
  Synthetic
acactccacacggtaagggaaccatgcggtccctgacccaggggtccctgactgcaagagttgcgggccttgtcc

SEQ ID NO: 262465 - DNA, 75 bp, Artificial Sequence
  Synthetic
gaatgttaagtcatgggaggaacttgacacctctaccaaggaagagatcttggacagccacaaagaatggttcga

SEQ ID NO: 262466 - DNA, 75 bp, Artificial Sequence
  Synthetic
cattcagaaaactggctgcagataacaagtatggtatcatggaaacgatgagagtaggtgcggcactcaaaaatg

SEQ ID NO: 262467 - DNA, 75 bp, Artificial Sequence
  Synthetic
aaccatttagtgtacctaatctccccctcaatgttctctcaaattctagggttccctctttgataaagtctatga

SEQ ID NO: 262468 - DNA, 75 bp, Artificial Sequence
  Synthetic
gagtgtgaaataatttacaagaactctaagtatcgagtctcttccaacggtaaaggctcagtttctgttgacaaa

SEQ ID NO: 262469 - DNA, 75 bp, Artificial Sequence
  Synthetic
tctccagacatcatacaggctaattctctcttctccttctatggtgatgatgaaattgttagtacagacataaaa

SEQ ID NO: 262470 - DNA, 75 bp, Artificial Sequence
  Synthetic
caggctcagacaagcgagggccagatattacatcagctgcttccaagacctcgtctacactctcatacaggttgc

SEQ ID NO: 262471 - DNA, 75 bp, Artificial Sequence
  Synthetic
tcgtctacactctcatacaggttgccggagcatcattcgttgtcaacagaatttccaaaaggttctgctgggaaa

SEQ ID NO: 262472 - DNA, 75 bp, Artificial Sequence
  Synthetic
gacccatacaattgatgtccttactgggagaggccgcactccacggcccaacattctacagtaaaatcagcaaat

SEQ ID NO: 262473 - DNA, 75 bp, Artificial Sequence
  Synthetic
agcccaaggacacagaaccagaaggcaagaagggtaaaaacaagaaaggaaggggcaagaaacacacagctttct

SEQ ID NO: 262474 - DNA, 75 bp, Artificial Sequence
  Synthetic
ggccatatgcagctatcaccaacaattgttttgagttttgctgtcaagttatgaatcttgaggacacatggttac

SEQ ID NO: 262475 - DNA, 75 bp, Artificial Sequence
  Synthetic
caagaagggtaaaaacaagaaaggaaggggcaagaaacacacagctttctctagcaaaggcctgagtgatgaaga

SEQ ID NO: 262476 - DNA, 75 bp, Artificial Sequence
  Synthetic
agatgccatactggccgcggtgaatggccttgtttcacaaccctttaaaaatttcttgaataagctcaagcccct

SEQ ID NO: 262477 - DNA, 75 bp, Artificial Sequence
  Synthetic
atttcttgaataagctcaagccccttaacatcctaagcatcttatctaactgtgattggacttttatgggggtgg

SEQ ID NO: 262478 - DNA, 75 bp, Artificial Sequence
  Synthetic
ttcagcttatatctctgcttggtgaggcctcactacatggggaaaagttttacaggaagatagctggtaaggtta

SEQ ID NO: 262479 - DNA, 75 bp, Artificial Sequence
  Synthetic
catcagaaagaggagaccagacgattttcaaccaaaaggcaatctgtgggcagatgacaccaggagtgtggacta

SEQ ID NO: 262480 - DNA, 75 bp, Artificial Sequence
  Synthetic
caagattccccattcctttggaaaagttgttcacgggtcccagcggtgcctttgttgttcaaccacaaaatggca

SEQ ID NO: 262481 - DNA, 75 bp, Artificial Sequence
  Synthetic
ctgggtttcatccaaccttctaatcacaacaacacacgtcctgcctaaaggggttaaggaactctttggagttga

SEQ ID NO: 262482 - DNA, 75 bp, Artificial Sequence
  Synthetic
agacaaggtcactaaagtcatgaaaagtgctgtagatgggctccgggccgctacgcagctagggcaatatggatt

SEQ ID NO: 262483 - DNA, 75 bp, Artificial Sequence
  Synthetic
acaacaacacacgtcctgcctaaaggggttaaggaactctttggagttgaaatcaaacagatccaagttcacaag

SEQ ID NO: 262484 - DNA, 75 bp, Artificial Sequence
  Synthetic
gccccagaaggcactgtctgttctatactcataaagagacctacaggtgagatgatccccttggcagtgaggatg

SEQ ID NO: 262485 - DNA, 75 bp, Artificial Sequence
  Synthetic
agttcaatttgaaactgacacagaccatgattttgaagttaaccaaaacacaaagttcaccccagttggtgtcat

SEQ ID NO: 262486 - DNA, 75 bp, Artificial Sequence
  Synthetic
gatgatccccttggcagtgaggatgggcacacacgcatccatgaaaatacaaggcaggaccgttggtggccagat

SEQ ID NO: 262487 - DNA, 75 bp, Artificial Sequence
  Synthetic
gccctggtgactgcggttgtccctacatctacaaacgcggcaacgacatagttgtcgcgggtgtccacaccgcag

SEQ ID NO: 262488 - DNA, 75 bp, Artificial Sequence
  Synthetic
ctacagtttacactgggagtgccgactttactccaaagctgggcagtgttcaatttgctactgatacagaaaatg

SEQ ID NO: 262489 - DNA, 75 bp, Artificial Sequence
  Synthetic
ctacagtttacactgggagtgccgactttactccaaagctgggcagtgttcaatttgctactgatacagataatg

SEQ ID NO: 262490 - DNA, 75 bp, Artificial Sequence
  Synthetic
ctacagtttacactgggagtgccgactttactccaaagctgggcagtgttcaatttgctactgatacagacaatg

SEQ ID NO: 262491 - DNA, 75 bp, Artificial Sequence
  Synthetic
ctacagtttacactgggagtgccgactttactccaaagctgggcagtgttcaatttgctactgatacagagaatg

SEQ ID NO: 262492 - DNA, 75 bp, Artificial Sequence
  Synthetic
gttgtcgcgggtgtccacaccgcagcagcccggggaggtaacactgtcatatgcgccactcaagggcaagatggg

SEQ ID NO: 262493 - DNA, 75 bp, Artificial Sequence
  Synthetic
aaactcagcacgaagaccaagttttggcgctcatcaccagacgccttgccacctggtacatatgaacctgcttac

SEQ ID NO: 262494 - DNA, 75 bp, Artificial Sequence
  Synthetic
ggcgctcatcaccagacgccttgccacctggtacatatgaacctgcttacctgggaggcaaagaccccagagtgg

SEQ ID NO: 262495 - DNA, 75 bp, Artificial Sequence
  Synthetic
tgttctgccccagaggtggagcaaataaggagagtcagccctggtgacacatcagcgcttaaagactgcttcaaa

SEQ ID NO: 262496 - DNA, 75 bp, Artificial Sequence
  Synthetic
tctctgaaacagatgcagcccgtggggcaatcaacgcccccatgacaaaggctttggactggagcggaacaaggt

SEQ ID NO: 262497 - DNA, 75 bp, Artificial Sequence
  Synthetic
gacctgcagtcttagaagaagccaagaagacagtgatgaatgttttagaacaaaccattgaccctgcaaaaccgt

SEQ ID NO: 262498 - DNA, 75 bp, Artificial Sequence
  Synthetic
caaaccattgaccctgcaaaaccgtggtcctactcgcaagcatgtgcctcactggacaaaaccacttctagtggt

SEQ ID NO: 262499 - DNA, 75 bp, Artificial Sequence
  Synthetic
gtcacgggcgtaatgtgaaaagacaaaattgattatctttctttttctttagtgtcttttaaaaaaaaaaaaaaa

SEQ ID NO: 262500 - DNA, 75 bp, Artificial Sequence
  Synthetic
accactggaatggggagtccttcactggtccccttgcagatcaggcatctaaagccaacctcatgtatgaacagg

SEQ ID NO: 262501 - DNA, 75 bp, Artificial Sequence
  Synthetic
ccgctgccgctgttgctaacagcaacaacgacaccgcaaaatcttcaagtgacggagtgctttctagcatggctg

SEQ ID NO: 262502 - DNA, 75 bp, Artificial Sequence
  Synthetic
ccactatgatgctgactattctaggtgggattcaacccagcaaaggagcattctttctgccgctatggaagtgat

SEQ ID NO: 262503 - DNA, 75 bp, Artificial Sequence
  Synthetic
ctagagggcccccccaaagaacacaagtgcagggtccaccaggctaaggccgcagggaaggggcccattggccat

SEQ ID NO: 262504 - DNA, 75 bp, Artificial Sequence
  Synthetic
tgggattcaacccagcaaaggagcattctttctgccgctatggaagtgatggtgcgattttctgctgaaccagaa

SEQ ID NO: 262505 - DNA, 75 bp, Artificial Sequence
  Synthetic
gagggcctgccatcaggagtcccatgtacatcacaatggaattcaatagcacactggatcctaactttgagtgcg

SEQ ID NO: 262506 - DNA, 75 bp, Artificial Sequence
  Synthetic
agagaagggtggaaattacagcattcaggagtacctagaagatagacaaaggtatgaagaggagcttgctgaggt

SEQ ID NO: 262507 - DNA, 75 bp, Artificial Sequence
  Synthetic
cttttcattttatggggacgatgagatcgtcagcactgacatcaaccttgaccccatgaagttgacacagaaact

SEQ ID NO: 262508 - DNA, 75 bp, Artificial Sequence
  Synthetic
tatgattgatccttggattttcaataactttgtccaagcccctcagggtgaatttacaatctcccctaataatac

SEQ ID NO: 262509 - DNA, 75 bp, Artificial Sequence
  Synthetic
cctaccaagattggaataggaaacccctccccactatggatgactccaagttaaagaaggtagctaacatattcc

SEQ ID NO: 262510 - DNA, 75 bp, Artificial Sequence
  Synthetic
gaaaattggaccaagattcaatcctcaggcaactatactggacaagggggcctaaccatgagaacccgtacgaga

SEQ ID NO: 262511 - DNA, 75 bp, Artificial Sequence
  Synthetic
tttacaagaaagttagcaagatggttattaatgagattaagagtggtggtctggaattttatgtgcccagacagg

SEQ ID NO: 262512 - DNA, 75 bp, Artificial Sequence
  Synthetic
tcagacctggcgaccatgatacggtgcgcccgagcttttggaggccttatggatgaactcaaggcacattgtgtc

SEQ ID NO: 262513 - DNA, 75 bp, Artificial Sequence
  Synthetic
gatcgcaatcttgctcccgaaggtgtgaatgaagatggcgtcgaatgacgctactccatctgatgatggtgcagc

SEQ ID NO: 262514 - DNA, 75 bp, Artificial Sequence
  Synthetic
cacactactcatcaaaaggtctactggagaactcatgcccctagcagctagaatggggacccatgcaaccatgaa

SEQ ID NO: 262515 - DNA, 75 bp, Artificial Sequence
  Synthetic
agtcggccaacagaatataattgatccctggattagaaataattttgtacaagcccctgctggtgaattcacagt

SEQ ID NO: 262516 - DNA, 75 bp, Artificial Sequence
  Synthetic
aaacaaccatatgaccaccttgctcaaagacaaagacagtctggcaacctacatgagaacccttgaccttgagga

SEQ ID NO: 262517 - DNA, 75 bp, Artificial Sequence
  Synthetic
ccctggattagaaataattttgtacaagcccctgctggtgaattcacagtttcccctagaaactctcctggagaa

SEQ ID NO: 262518 - DNA, 75 bp, Artificial Sequence
  Synthetic
acatgagaacccttgaccttgaggaggagaaagccaggaaactctcaaccaagtctgcttcacctgacatcgtgg

SEQ ID NO: 262519 - DNA, 75 bp, Artificial Sequence
  Synthetic
aagtctgcttcacctgacatcgtgggcacaatcaacgcccttctggcgagaatcgctgctgcacgttctctggtg

SEQ ID NO: 262520 - DNA, 75 bp, Artificial Sequence
  Synthetic
gcacaatcaacgcccttctggcgagaatcgctgctgcacgttctctggtgcatcgagcgaaggaggaactttcta

SEQ ID NO: 262521 - DNA, 75 bp, Artificial Sequence
  Synthetic
gcaggaggaatggaagtgcagatagtactggctgggaatgcgttcacagctggtaagatcctatttgctgccatc

SEQ ID NO: 262522 - DNA, 75 bp, Artificial Sequence
  Synthetic
ccgcctagcttcccctatgaaaatttgtcacccgctcaattgactatgtgcccccatgtgatagtggatgtgagg

SEQ ID NO: 262523 - DNA, 75 bp, Artificial Sequence
  Synthetic
tgtcacccgctcaattgactatgtgcccccatgtgatagtggatgtgaggcaattagaaccagtgcttctgccaa

SEQ ID NO: 262524 - DNA, 75 bp, Artificial Sequence
  Synthetic
gtcagggtcatcctggcaggtaacgcatttaccgccggtaaagtgataatttgctgtgtcccccctggcttccaa

SEQ ID NO: 262525 - DNA, 75 bp, Artificial Sequence
  Synthetic
ccacgcaatggcgtcgaccattgggatgcgtacaagggggagagggtcgttctatgggacgactatggaatgagc

SEQ ID NO: 262526 - DNA, 75 bp, Artificial Sequence
  Synthetic
aaacttaggcttgtagctatgctttatacccctctgagggctaacaactcaggtgatgacgtgttcacggtgtct

SEQ ID NO: 262527 - DNA, 75 bp, Artificial Sequence
  Synthetic
cagatctaggaacagtgatccgggctgcacgagccttcggcccgttctgtgacgccataaagtcccacacaatca

SEQ ID NO: 262528 - DNA, 75 bp, Artificial Sequence
  Synthetic
tgccgcgttttaacacgtccttctccagatttccagttcacctttctggtcccacctacagttgagtctaaaact

SEQ ID NO: 262529 - DNA, 75 bp, Artificial Sequence
  Synthetic
gacgccataaagtcccacacaatcaaattacctatcaaagttgggatgaattcaattgaggatgggccactaatt

SEQ ID NO: 262530 - DNA, 75 bp, Artificial Sequence
  Synthetic
tatgtcaactttgaagcatgctcgaggcgcatcgacttcctcgtgtatgcagaagcccctgaggtcgaaaaggcg

SEQ ID NO: 262531 - DNA, 75 bp, Artificial Sequence
  Synthetic
tatacaagcaggaatgaaaacatcattgtccaaccccaaaacggcaggtgcacgactgacggtgagctgcttggc

SEQ ID NO: 262532 - DNA, 75 bp, Artificial Sequence
  Synthetic
ttgtccaaccccaaaacggcaggtgcacgactgacggtgagctgcttggcactaccatcttgcagtctgtgtcta

SEQ ID NO: 262533 - DNA, 75 bp, Artificial Sequence
  Synthetic
aagcgtgacttcccaggccaacccgacatgtggaagaacgccttcagttctgatttctcacacataaaactaaca

SEQ ID NO: 262534 - DNA, 75 bp, Artificial Sequence
  Synthetic
agaacgggaacaccccacacgggaagggcgtcatgaagactctcaccactggctcccttattgcccgggcatcag

SEQ ID NO: 262535 - DNA, 75 bp, Artificial Sequence
  Synthetic
atgggtcacccatagatccaacagatgatatgcctgcccctcttggcacaccagacttccaggccatgttatatg

SEQ ID NO: 262536 - DNA, 75 bp, Artificial Sequence
  Synthetic
ggctcccttattgcccgggcatcagggctactccatgagaggctagatgaatttgaactacagggcccaactctc

SEQ ID NO: 262537 - DNA, 75 bp, Artificial Sequence
  Synthetic
gcgttgcaagccaacgctcttccatagacaatgccaccagggcacatgatgcacagattgacactgcgggtgaca

SEQ ID NO: 262538 - DNA, 75 bp, Artificial Sequence
  Synthetic
aagtgcttgcctttagacaacttgctgctgaaaacaaatatgggttgatggacacaatgaaagttgggaggcagc

SEQ ID NO: 262539 - DNA, 75 bp, Artificial Sequence
  Synthetic
ttaaggagtatggccttaagcccacccgtcccgacaagagtgaaggtccaataattgtgaggaagagtgtggatg

SEQ ID NO: 262540 - DNA, 75 bp, Artificial Sequence
  Synthetic
tgctgaaaacaaatatgggttgatggacacaatgaaagttgggaggcagctcaaggatgtcagaacaatgccaga

SEQ ID NO: 262541 - DNA, 75 bp, Artificial Sequence
  Synthetic
tcgttttaaatcaagctctaatgattttgacctacatgaccctacaaaattcacacctattggtgtcaatgtgga

SEQ ID NO: 262542 - DNA, 75 bp, Artificial Sequence
  Synthetic
tttgacctacatgaccctacaaaattcacacctattggtgtcaatgtggatgatcagcacccttttagacagtgg

SEQ ID NO: 262543 - DNA, 75 bp, Artificial Sequence
  Synthetic
gagcagattttgttcttcaggtcatacattccgagcgccggaggccacacagacggtgctatggactgcttgctg

SEQ ID NO: 262544 - DNA, 75 bp, Artificial Sequence
  Synthetic
atacactgtaccataacaatgacagccagccgacaatgcgtttattgtgcatgctgtacacgccacttcgcactg

SEQ ID NO: 262545 - DNA, 75 bp, Artificial Sequence
  Synthetic
tccaggaggccctgtattccatcatccagattgctggggctgcatttgtcaccacgcgcatcgtcaagcgcatga

SEQ ID NO: 262546 - DNA, 75 bp, Artificial Sequence
  Synthetic
aaccctgatacaggaagagtgctctttgaagctaaattgcataaacaaggtttcctcacaattgcagcatctgga

SEQ ID NO: 262547 - DNA, 75 bp, Artificial Sequence
  Synthetic
ttgaagctaaattgcataaacaaggtttcctcacaattgcagcatctggagatcaccctattgtgatgcccacta

SEQ ID NO: 262548 - DNA, 75 bp, Artificial Sequence
  Synthetic
ccaaagatgatgaagagttcgtcatttcatccgacgacatcaaaactgagggcaagaaagggaaaaacaagactg

SEQ ID NO: 262549 - DNA, 75 bp, Artificial Sequence
  Synthetic
tttcctcacaattgcagcatctggagatcaccctattgtgatgcccactaatggttactttaggtttgaagcttg

SEQ ID NO: 262550 - DNA, 75 bp, Artificial Sequence
  Synthetic
catttctagcccatctctcacagatgtataatggttgggtcggcaatatgcgtgtgcgcatactgttggccggga

SEQ ID NO: 262551 - DNA, 75 bp, Artificial Sequence
  Synthetic
ttccttgcaggcttggcaggtgacgttgtgacttccagcttgggctcacttgtgggcgctggagccaacgccatc

SEQ ID NO: 262552 - DNA, 75 bp, Artificial Sequence
  Synthetic
catagaagagtaccttcaggacagggacaaatactatgaggaggtggccattgccagggcgactgaggaagactt

SEQ ID NO: 262553 - DNA, 75 bp, Artificial Sequence
  Synthetic
ttgtgacttccagcttgggctcacttgtgggcgctggagccaacgccatcaaccagaaagtggagtatgacttca

SEQ ID NO: 262554 - DNA, 75 bp, Artificial Sequence
  Synthetic
ttcaacaggccatgatagacatcaagcgggaggcattgaccgcaggcggcttttcccccgctgatgctgcaagag

SEQ ID NO: 262555 - DNA, 75 bp, Artificial Sequence
  Synthetic
gattcttgactggaatggttctaggtattgggcccccaactccatgaagacaactggctattcaggtacatttgc

SEQ ID NO: 262556 - DNA, 75 bp, Artificial Sequence
  Synthetic
tgtacaagcccctggtggagagttcacagtatcccctagaaacgctccaggtgaaatactatggagcgcgccctt

SEQ ID NO: 262557 - DNA, 75 bp, Artificial Sequence
  Synthetic
atctatatctagttcttctagtgaatatagttctccttctactgccccttcacaatcaacacaatcaacaacgct

SEQ ID NO: 262558 - DNA, 75 bp, Artificial Sequence
  Synthetic
atctatatctagttcttctagtgtatatagttctccttctactgccccttcacaatcaacacaatcaacaacgct

SEQ ID NO: 262559 - DNA, 75 bp, Artificial Sequence
  Synthetic
atctatatctagttcttctagtgcatatagttctccttctactgccccttcacaatcaacacaatcaacaacgct

SEQ ID NO: 262560 - DNA, 75 bp, Artificial Sequence
  Synthetic
atctatatctagttcttctagtggatatagttctccttctactgccccttcacaatcaacacaatcaacaacgct

SEQ ID NO: 262561 - DNA, 75 bp, Artificial Sequence
  Synthetic
tatagttctccttctactgccccttcacaatcaacacaatcaacaacgctgtctgcaggaacagggtcctccaga

SEQ ID NO: 262562 - DNA, 75 bp, Artificial Sequence
  Synthetic
agtcaggcgaattctgtcgcttgagattcccaaaaccaatcaggactgatgtgacgggcatgatcttagaagaag

SEQ ID NO: 262563 - DNA, 75 bp, Artificial Sequence
  Synthetic
ccagtctcgctcagccaactctgcaagattaggggtaaaacttctagcaatgctagggtgctcaacttaagtgag

SEQ ID NO: 262564 - DNA, 75 bp, Artificial Sequence
  Synthetic
ggaacaaaagacacgcccttttagtgtacccaatatcccactccagaatctttccaactcccgagttcctagtct

SEQ ID NO: 262565 - DNA, 75 bp, Artificial Sequence
  Synthetic
ggcccgttcatgagtggtgcactccaaactgcttatgtcacaccaccatcgagcagggcctcatcacaagggacg

SEQ ID NO: 262566 - DNA, 75 bp, Artificial Sequence
  Synthetic
tggggacccatgcaaccatgaaaatccaaggacgcactgttggaggtcaaatgggcatgcttctgacaggatcca

SEQ ID NO: 262567 - DNA, 75 bp, Artificial Sequence
  Synthetic
catgtaaatttcactttccaggcccaaaatcaggacccatcccaaagtgtgacctttgcaactaatgatgctagc

SEQ ID NO: 262568 - DNA, 75 bp, Artificial Sequence
  Synthetic
gacctttgcaactaatgatgctagctttgtcccttacctaggtagcatttcccctcacaatgggggggattttca

SEQ ID NO: 262569 - DNA, 75 bp, Artificial Sequence
  Synthetic
cacccacaggcagcctctcttcgcccacttgcgtaggcgaggggagtcacagatttagtgaaaaggatgattagg

SEQ ID NO: 262570 - DNA, 75 bp, Artificial Sequence
  Synthetic
tgccgctcgtgggggcaacactgtcatatgtgccacccaggggagtgagggagaggctacacttgaaggtggtga

SEQ ID NO: 262571 - DNA, 75 bp, Artificial Sequence
  Synthetic
caagggtggcccttcactgcagcaggtcatgagggatcagctgaagccattcacagagcccaggggcaagccacc

SEQ ID NO: 262572 - DNA, 75 bp, Artificial Sequence
  Synthetic
aagaaaaccatcatcaatgtccttgagcaaacaattgatccacctgagaaatggtcgttcgcacaagcttgcgcg

SEQ ID NO: 262573 - DNA, 75 bp, Artificial Sequence
  Synthetic
gctagtaatgctcttttagctaagaatcttaacactaggtatgctctcctgcaggcaggaggcctgtctagtgct

SEQ ID NO: 262574 - DNA, 75 bp, Artificial Sequence
  Synthetic
tcggatttggcgaccatgatccggtgtgctcgagcattcggaggcctaatggatgaactcaaagcgcactgtgtc

SEQ ID NO: 262575 - DNA, 75 bp, Artificial Sequence
  Synthetic
tctgctggccagctcatgaaattcagaggtaaggtaacttcaggttcaaaagtgctaaacctaacagaactagat

SEQ ID NO: 262576 - DNA, 75 bp, Artificial Sequence
  Synthetic
tagattgcctctgttcgcaaacagaaggtaaaattttgtaataggatgccagtgggcaccatattcagatttggt

SEQ ID NO: 262577 - DNA, 75 bp, Artificial Sequence
  Synthetic
aggtaaaattttgtaataggatgccagtgggcaccatattcagatttggtttaattagattgttttaatcaaatt

SEQ ID NO: 262578 - DNA, 75 bp, Artificial Sequence
  Synthetic
acgcgtgttgtggattggaacggcaccagggtgtcagctccacggtcatctgccactacgttgaagtctgggggt

SEQ ID NO: 262579 - DNA, 75 bp, Artificial Sequence
  Synthetic
gattgattttgaaaataacagaaaattgcagcaagcttccttccagtttagcagtaatctacaacaggcttcctt

SEQ ID NO: 262580 - DNA, 75 bp, Artificial Sequence
  Synthetic
agatccaaggtcgcactgttggaggccaaatgggtatgctcctgacagggtccaatgccaaaagtatggacctgg

SEQ ID NO: 262581 - DNA, 75 bp, Artificial Sequence
  Synthetic
ccaaatgggtatgctcctgacagggtccaatgccaaaagtatggacctgggcaccacacctggcgactgtggttg

SEQ ID NO: 262582 - DNA, 75 bp, Artificial Sequence
  Synthetic
atcatgcagaccctattgtgctgcatgccattgaacccaattcatcttcctttgttccgcaccttggcagtgttt

SEQ ID NO: 262583 - DNA, 75 bp, Artificial Sequence
  Synthetic
tgttggtgccgccattgcggcacctgtagcgggccaacaaaatgtaattgacccctggattagaaacaattttgt

SEQ ID NO: 262584 - DNA, 75 bp, Artificial Sequence
  Synthetic
tttgtcacctttcatgaggggggctcacaacatatcgtttgtcaccccaccatctagcagatcctctagccaagg

SEQ ID NO: 262585 - DNA, 75 bp, Artificial Sequence
  Synthetic
aggaggggaagaacatgactccagtttacacaggtgccctcaaggatgagttggtcaaaactgacaagatatatg

SEQ ID NO: 262586 - DNA, 75 bp, Artificial Sequence
  Synthetic
acaacaacgacaaggaaaaatcttcgggtgaaggcttgtttacaaacatgtcttctaccctaaagaaagccctcg

SEQ ID NO: 262587 - DNA, 75 bp, Artificial Sequence
  Synthetic
aagtgacggagtattatctaatatggccgtcacttttaaacgagccctcggggcgcggcccaaacaaccgccccc

SEQ ID NO: 262588 - DNA, 75 bp, Artificial Sequence
  Synthetic
aagtgacggggtattatctaatatggctgtcactttcaaacgagccctcggggcgcggcctaaacaaccgccccc

SEQ ID NO: 262589 - DNA, 75 bp, Artificial Sequence
  Synthetic
aaaatatgcccccccccccgcctaacggtgaagacgagccaaccgttaggtacgaagttacaaaaggggtctccg

SEQ ID NO: 262590 - DNA, 75 bp, Artificial Sequence
  Synthetic
cggggaggacgagccaaccatttcttacaacgtcaaagagggtgtttctggcttgcctgaactctcaacggtcac

SEQ ID NO: 262591 - DNA, 75 bp, Artificial Sequence
  Synthetic
cggtgaagacgagccaaccgttaggtacgaagttacaaaaggggtctccggcctacctgagctcacgacagtcac

SEQ ID NO: 262592 - DNA, 75 bp, Artificial Sequence
  Synthetic
cttgtcgggttctcacgagaccatcccccgattttgatttcatatttttagtgccacccacagttgagtcaagaa

SEQ ID NO: 262593 - DNA, 75 bp, Artificial Sequence
  Synthetic
actgaccggggcaatactggaaatgtgggatggagagatttaccactatggtttgtatgtggagaaaggtctcgt

SEQ ID NO: 262594 - DNA, 75 bp, Artificial Sequence
  Synthetic
tgggatggagagatttaccactatggtttgtatgtggagaaaggtctcgtgctgggtgtgcacaaaccacccgca

SEQ ID NO: 262595 - DNA, 75 bp, Artificial Sequence
  Synthetic
tgggacggggagatctaccattatggcttatatgtggaacgaggattagtgctcggtgtacacaaaccaccggca

SEQ ID NO: 262596 - DNA, 75 bp, Artificial Sequence
  Synthetic
atttcccctgacacgctcaggagactcgacggagaggcgtttccatataccgcatttgacaacaattgttacgcc

SEQ ID NO: 262597 - DNA, 75 bp, Artificial Sequence
  Synthetic
tcgacggagaggcgtttccatataccgcatttgacaacaattgttacgccttttgctgctgggtgttagacctta

SEQ ID NO: 262598 - DNA, 75 bp, Artificial Sequence
  Synthetic
aacccctccccacgatggacgactccaaagtgaagaaggtggccaatgttctcctctgtgctctctcatcattgt

SEQ ID NO: 262599 - DNA, 75 bp, Artificial Sequence
  Synthetic
aacctttgcccaccatggatgattccaagatcaagaaagtggcgaacatatttttatgctctttatccacactat

SEQ ID NO: 262600 - DNA, 75 bp, Artificial Sequence
  Synthetic
tgtgctcacccaaaccacaagggcagatggctcgacccgcggccacaaagctacagtgtacactgggagcgccga

SEQ ID NO: 262601 - DNA, 75 bp, Artificial Sequence
  Synthetic
caagatcaagaaagtggcgaacatatttttatgctctttatccacactattcactaggcctattaaagacattat

SEQ ID NO: 262602 - DNA, 75 bp, Artificial Sequence
  Synthetic
gctaatcttgtttgctgagctctttggagtgttctggacacccccagatgtgtctgcaatgattgcccccctact

SEQ ID NO: 262603 - DNA, 75 bp, Artificial Sequence
  Synthetic
ggagtgttctggacacccccagatgtgtctgcaatgattgcccccctacttggtgactacgagttacaaggacct

SEQ ID NO: 262604 - DNA, 75 bp, Artificial Sequence
  Synthetic
gtgcacctggcccccgctgtagcccccacttttccgggtgagcaacttctcttcttcagatccactatgcccgga

SEQ ID NO: 262605 - DNA, 75 bp, Artificial Sequence
  Synthetic
cttcttcagatccactatgcccggatgcagcgggtaccccaacatggatttggactgtctgctcccccaggaatg

SEQ ID NO: 262606 - DNA, 75 bp, Artificial Sequence
  Synthetic
atcggcaaaatgctttcatctgctgcttcaaccctgagggcatgtaaagatcttggtgcatatgggctggaaatc

SEQ ID NO: 262607 - DNA, 75 bp, Artificial Sequence
  Synthetic
ataggcaagatgttgtcttcagcagcatcaacactcagagcctgtaaagaccttggggcctatggattggaaata

SEQ ID NO: 262608 - DNA, 75 bp, Artificial Sequence
  Synthetic
attggcaaaatgctttcatctgctgcttcaaccctgagggcgtgtaaagatctcggagcttatgggctggagata

SEQ ID NO: 262609 - DNA, 75 bp, Artificial Sequence
  Synthetic
catcaacactcagagcctgtaaagaccttggggcctatggattggaaatactcaagctggtcatgaaatggttct

SEQ ID NO: 262610 - DNA, 75 bp, Artificial Sequence
  Synthetic
gatgcagtgctagacctcgaggccattgagaacaaccatatgacagccctactcaaggataaggacagccttgca

SEQ ID NO: 262611 - DNA, 75 bp, Artificial Sequence
  Synthetic
tagaaaacaaccacatgacagcactgctcaaagacaaagacagtctcgcaacctacatgagaacactggaccttg

SEQ ID NO: 262612 - DNA, 75 bp, Artificial Sequence
  Synthetic
gctcaaagacaaagacagtctcgcaacctacatgagaacactggaccttgaggaagaaaaagccaggaagttgtc

SEQ ID NO: 262613 - DNA, 75 bp, Artificial Sequence
  Synthetic
agatttgattcctgggtcaaccagttctacacacttgcccccatgggaaatggaacggggcgtagacgtgcatta

SEQ ID NO: 262614 - DNA, 75 bp, Artificial Sequence
  Synthetic
gtgaatgaagatggcgtctaacgacgctaccgctgccgctggcaactttaacattgccaacaacagtgaaaacac

SEQ ID NO: 262615 - DNA, 75 bp, Artificial Sequence
  Synthetic
gtgggcacgattaacgccctactgtcaaggattgcagctgcccggtctctagtacacagggctaaggaggaattg

SEQ ID NO: 262616 - DNA, 75 bp, Artificial Sequence
  Synthetic
ggttcacagggccaaggaggaactgtctagtagaattaggccagttgttgtcatgatgtctggtagaccaggtat

SEQ ID NO: 262617 - DNA, 75 bp, Artificial Sequence
  Synthetic
tgatgatttcagggagaccaggtatagggaaaacccatctagctagagagttggcaaagaagatcgcctcctcac

SEQ ID NO: 262618 - DNA, 75 bp, Artificial Sequence
  Synthetic
tgaatttgaaaataacagaaaattgcaacaagcttccttccaatttagcagcaatctacaacaggcttcctttca

SEQ ID NO: 262619 - DNA, 75 bp, Artificial Sequence
  Synthetic
tctagtagaattaggccagttgttgtcatgatgtctggtagaccaggtatagggaagacacacctggccagggaa

SEQ ID NO: 262620 - DNA, 75 bp, Artificial Sequence
  Synthetic
catttcgtcagtgaacaagcccccgcaattggtgaggccgccctcttacattatgttgatccagataccaatcgg

SEQ ID NO: 262621 - DNA, 75 bp, Artificial Sequence
  Synthetic
caacaagcttccttccaatttagcagcaatctacaacaggcttcctttcaacatgataaagagatgctccaagca

SEQ ID NO: 262622 - DNA, 75 bp, Artificial Sequence
  Synthetic
tgggatgcatacaaaggtgaaagagtcgttctctgggacgactacgggatgagcaaccctatccacgacgccctt

SEQ ID NO: 262623 - DNA, 75 bp, Artificial Sequence
  Synthetic
tgggatgcatacaagggcgaaagggtcgtgctatgggacgactatggcatgagtaaccccattcatgatgccctg

SEQ ID NO: 262624 - DNA, 75 bp, Artificial Sequence
  Synthetic
tcgtgctatgggacgactatggcatgagtaaccccattcatgatgccctgcgcctgcaggagctggccgacacat

SEQ ID NO: 262625 - DNA, 75 bp, Artificial Sequence
  Synthetic
tccccctcccgttaaggaagaggcgagtgtcctatccaacgtaaaagttggattcaagaaaatattgggggctgt

SEQ ID NO: 262626 - DNA, 75 bp, Artificial Sequence
  Synthetic
cgaaccttgcaaacccagcccctcttgattatgtcaactttgaggcttgctccaggcgcattgacttcctggttt

SEQ ID NO: 262627 - DNA, 75 bp, Artificial Sequence
  Synthetic
tgattatgtcaactttgaggcttgctccaggcgcattgacttcctggtttatgccgaagcaccggaagtagaaaa

SEQ ID NO: 262628 - DNA, 75 bp, Artificial Sequence
  Synthetic
tcaagacgtatagacttcctcgtctatgctgatgcccctgaagttgagaaggctaaacgggacttcccaggccag

SEQ ID NO: 262629 - DNA, 75 bp, Artificial Sequence
  Synthetic
atgctgatgcccctgaagttgagaaggctaaacgggacttcccaggccagccagatatgtggaaggacaccttca

SEQ ID NO: 262630 - DNA, 75 bp, Artificial Sequence
  Synthetic
acaacttgcaccccagggaggcttcgacaaaaatgggaacaccccacatggaaaaggtgtgatgaaaacactcac

SEQ ID NO: 262631 - DNA, 75 bp, Artificial Sequence
  Synthetic
gacaaaaatgggaacaccccacatggaaaaggtgtgatgaaaacactcaccactggctctctgatcgctagggcg

SEQ ID NO: 262632 - DNA, 75 bp, Artificial Sequence
  Synthetic
ggaagggtgttatgaagaccctcactgctagctccctcgttgcccgagcatcagggctcctccacgagagactag

SEQ ID NO: 262633 - DNA, 75 bp, Artificial Sequence
  Synthetic
tgggttgaggaccaaaacaggaatttgtcacctttcatgaggggggctctcaacacatcatttgtcacccctcca

SEQ ID NO: 262634 - DNA, 75 bp, Artificial Sequence
  Synthetic
aacaaaattgccgcgttcagacaattggctgcggaaaataaatatggaataatggacaccatgcggattggcaac

SEQ ID NO: 262635 - DNA, 75 bp, Artificial Sequence
  Synthetic
tcgctgctgagaacaagtacggtctcgttgacacaatgagggtcggatcacagctcaagaatgtcaaaaccatga

SEQ ID NO: 262636 - DNA, 75 bp, Artificial Sequence
  Synthetic
tggctgcggaaaataaatatggaataatggacaccatgcggattggcaaccaactgaaaggggtgaaaaccatgg

SEQ ID NO: 262637 - DNA, 75 bp, Artificial Sequence
  Synthetic
gacggagtgctttctagcatggctgtcacttttaaacgagccctcggggcgcggcctaaacagcctcccccgagg

SEQ ID NO: 262638 - DNA, 75 bp, Artificial Sequence
  Synthetic
catctcagtcaagaaatgccagcttgtgtatggcgggagcacgtacacactcgaatctgatggtaaaggcaatgt

SEQ ID NO: 262639 - DNA, 75 bp, Artificial Sequence
  Synthetic
gtgtatggcgggagcacgtacacactcgaatctgatggtaaaggcaatgtgtgtgttgagaaggtgaagaacaca

SEQ ID NO: 262640 - DNA, 75 bp, Artificial Sequence
  Synthetic
ttgagtctgatggcaaaggcaaggttttggtagagaagatcaaaagtgccactattcaaaccagtaatgaactgg

SEQ ID NO: 262641 - DNA, 75 bp, Artificial Sequence
  Synthetic
tttggtagagaagatcaaaagtgccactattcaaaccagtaatgaactggctggggctctgcgccacctcaggag

SEQ ID NO: 262642 - DNA, 75 bp, Artificial Sequence
  Synthetic
gaggatgaaatagtggtttcttatagtgtcaaggatggtgtttccggcttgcctgacctttccaccgtcaggcaa

SEQ ID NO: 262643 - DNA, 75 bp, Artificial Sequence
  Synthetic
cttcctgggtgtcaagattttatcaactcaagcctgtgggaacggcttctttagccagaggtaggcttggcatca

SEQ ID NO: 262644 - DNA, 75 bp, Artificial Sequence
  Synthetic
cgtcaccacgcgcattgcacgccgcatgaacatacaagaactctgggcaaaaccaccaatagaccagggtgaatc

SEQ ID NO: 262645 - DNA, 75 bp, Artificial Sequence
  Synthetic
catcaccacgcgcattgcaaagcgcatgaacatacaaaacctctggtccaaaccacaagtggaagatttggagga

SEQ ID NO: 262646 - DNA, 75 bp, Artificial Sequence
  Synthetic
atgaacatacaagaactctgggcaaaaccaccaatagaccagggtgaatcagagcccaaagaagagaaccctaag

SEQ ID NO: 262647 - DNA, 75 bp, Artificial Sequence
  Synthetic
tcagcctcgctaaggttgagctagcaccactctccttgtactggagacctgtgtacactcctcagtacctcatct

SEQ ID NO: 262648 - DNA, 75 bp, Artificial Sequence
  Synthetic
cgagggcaagaaaggaaagaacaagactggccgtggcaagaagcacacagccttttccagcaaaggcctcagtga

SEQ ID NO: 262649 - DNA, 75 bp, Artificial Sequence
  Synthetic
cgtggcaagaaacacaccgcattctccagcaagggtctaagtgatgaggagtatgatgagtacaagaggataaga

SEQ ID NO: 262650 - DNA, 75 bp, Artificial Sequence
  Synthetic
ccagcaagggtctaagtgatgaggagtatgatgagtacaagaggataagagaggaaagaaatggtaagtactcta

SEQ ID NO: 262651 - DNA, 75 bp, Artificial Sequence
  Synthetic
cggagaaacgttcccctacacagcctttgacaacaactgttatgccttttgttgctgggtcctggacctgaatga

SEQ ID NO: 262652 - DNA, 75 bp, Artificial Sequence
  Synthetic
cagagacagatactatgaggaggtggccatagccagagcaactgaggaagatttctgtgaagaagaggaggctaa

SEQ ID NO: 262653 - DNA, 75 bp, Artificial Sequence
  Synthetic
gaagatgtgatttactataatagcaaagatgacactgtgcatggcctgccaaatttgacaacagtcagctgtgaa

SEQ ID NO: 262654 - DNA, 75 bp, Artificial Sequence
  Synthetic
gtgaggaagaggagatcaaaattcgccagaggatctttcgccccacaagaaaacagagaaaggaagaaagggcta

SEQ ID NO: 262655 - DNA, 75 bp, Artificial Sequence
  Synthetic
ccagaggatctttcgccccacaagaaaacagagaaaggaagaaagggctacgttgggactggtgactggttcaga

SEQ ID NO: 262656 - DNA, 75 bp, Artificial Sequence
  Synthetic
acaagaaaacaacgcaaagaggaaagggtctctcttggtttggtcacaggttctgagattaggaagagaaatcca

SEQ ID NO: 262657 - DNA, 75 bp, Artificial Sequence
  Synthetic
cttgatactcttggctgagctctttggagtcttttggacacccccagatgtgtctgcgatgattgcccccttgct

SEQ ID NO: 262658 - DNA, 75 bp, Artificial Sequence
  Synthetic
caacgaaaaactggatttcgaggctcccccgagcatctggtctagaatcgtcagttttggctcaggttggggttt

SEQ ID NO: 262659 - DNA, 75 bp, Artificial Sequence
  Synthetic
gaggctccaccaagcatttggtcacgaatagtcaactttggctcagggtggggcttttgggtctcgcctagcctc

SEQ ID NO: 262660 - DNA, 75 bp, Artificial Sequence
  Synthetic
atactcttggcagaactctttggagttttctggacacccccagatgtgtctgcgatgattgcccccttacttggt

SEQ ID NO: 262661 - DNA, 75 bp, Artificial Sequence
  Synthetic
cccccgagcatctggtctagaatcgtcagttttggctcaggttggggtttctgggtgtcaccaagcctgtttata

SEQ ID NO: 262662 - DNA, 75 bp, Artificial Sequence
  Synthetic
tcaggcgaattttgccgtttcagatttccaaaaccaatcaggacagatgtgacaggaatgatcctagaagaggga

SEQ ID NO: 262663 - DNA, 75 bp, Artificial Sequence
  Synthetic
ttccaaaaccaatcaggacagatgtgacaggaatgatcctagaagagggagccccagaaggcaccgtggcaacca

SEQ ID NO: 262664 - DNA, 75 bp, Artificial Sequence
  Synthetic
agtcaaaggtatcagcaagatttgaccttacagcaaaattcatttaaacatgataaagagatgattgcctatcaa

SEQ ID NO: 262665 - DNA, 75 bp, Artificial Sequence
  Synthetic
gaagaaggaggaggcaaatgagctggctatagtgaggtctatcgaggatgcagtcctagatctcgaggcaattga

SEQ ID NO: 262666 - DNA, 75 bp, Artificial Sequence
  Synthetic
agggacgcatggtcggtggacagatgggcatgttgctcaccggttcgaacgccaaaggcatggatttagggacaa

SEQ ID NO: 262667 - DNA, 75 bp, Artificial Sequence
  Synthetic
gggcatgttgctcaccggttcgaacgccaaaggcatggatttagggacaactcccggagactgcggctgcccata

SEQ ID NO: 262668 - DNA, 75 bp, Artificial Sequence
  Synthetic
atatgagaacacttgaccttgaggaggagaaagccaggaaactctcaaccaagtctgcctcacccgacatcgtgg

SEQ ID NO: 262669 - DNA, 75 bp, Artificial Sequence
  Synthetic
gcacaacccctggcgattgtggctgtccctacatctacaagagggggaacgactacgtggtcattggagttcaca

SEQ ID NO: 262670 - DNA, 75 bp, Artificial Sequence
  Synthetic
tccctacatctacaagagggggaacgactacgtggtcattggagttcacaccgccgctgctcgtggaggaaacac

SEQ ID NO: 262671 - DNA, 75 bp, Artificial Sequence
  Synthetic
agttctaccattatgcgatatacgtctctggtggcaaggccataggggtgcacaaacccccagctgcaatcagcc

SEQ ID NO: 262672 - DNA, 75 bp, Artificial Sequence
  Synthetic
gtgacaacaaaggaacttactgtggagcaccaatattaggccctggaaatgcccccaaactcagcaccaaaacca

SEQ ID NO: 262673 - DNA, 75 bp, Artificial Sequence
  Synthetic
ctgtgctacacaagggagtgaaggtgaagcaacacttgagggtggagatgacaaaggaacatattgtggggcacc

SEQ ID NO: 262674 - DNA, 75 bp, Artificial Sequence
  Synthetic
gaagcaacacttgagggtggagatgacaaaggaacatattgtggggcacccatcctcggtcctggtggggcacca

SEQ ID NO: 262675 - DNA, 75 bp, Artificial Sequence
  Synthetic
gagtgaaaggtggtccctcactgcaacaggttatgagggatcaactaaaaccattcactgagcccagaggcaaac

SEQ ID NO: 262676 - DNA, 75 bp, Artificial Sequence
  Synthetic
cttgggggccgcgacccacgtgttaagggcgggccctccctgcaacaagtcatgagggaccaactgaaaccattc

SEQ ID NO: 262677 - DNA, 75 bp, Artificial Sequence
  Synthetic
agggcgggccctccctgcaacaagtcatgagggaccaactgaaaccattcaccgaacccaggggcaaacctccaa

SEQ ID NO: 262678 - DNA, 75 bp, Artificial Sequence
  Synthetic
cctatgggacgattatggaatgagcaaccctattcacgatgccctcaggctgcaagaactcgctgacacttgccc

SEQ ID NO: 262679 - DNA, 75 bp, Artificial Sequence
  Synthetic
ggacttacgcacaagcgtgtgcgtcacttgacaaaaccacctccagcgggcacccccaccacacccgaaagaatg

SEQ ID NO: 262680 - DNA, 75 bp, Artificial Sequence
  Synthetic
acttgacaaaaccacctccagcgggcacccccaccacacccgaaagaatgagttttggaacggagagactttcac

SEQ ID NO: 262681 - DNA, 75 bp, Artificial Sequence
  Synthetic
gtacacaggagctttgaaggatgagctagtcaagactgataagatctatgggaagatcaaaaagagactcctgtg

SEQ ID NO: 262682 - DNA, 75 bp, Artificial Sequence
  Synthetic
tgatttctcacacataaaactagcactggccccacagggtggtttcgacaagaacgggaacaccccgcacggaaa

SEQ ID NO: 262683 - DNA, 75 bp, Artificial Sequence
  Synthetic
ggcagcccttaaggatgagctagtcaagacagacaagatttatgggaagatcaagaaaaggttgctgtggggttc

SEQ ID NO: 262684 - DNA, 75 bp, Artificial Sequence
  Synthetic
aagacagacaagatttatgggaagatcaagaaaaggttgctgtggggttctgatctgtccaccatggttcggtgt

SEQ ID NO: 262685 - DNA, 75 bp, Artificial Sequence
  Synthetic
ctggcgctcctgtgactcgcatcgttgattggaatggcactaggattgcagccccgaattcatcagcaacaacct

SEQ ID NO: 262686 - DNA, 75 bp, Artificial Sequence
  Synthetic
atgcaggtggttttgaagtgcaggtaatcctcgcggggaatgcgttcaccgccgggaaaatcatatttgcagcag

SEQ ID NO: 262687 - DNA, 75 bp, Artificial Sequence
  Synthetic
atgaatgaagatggtccaataatatttgagaagcattccaggtataaataccattatgatgcagattactcccga

SEQ ID NO: 262688 - DNA, 75 bp, Artificial Sequence
  Synthetic
atgaatatgaatgaggatggacccataatatttgagaaacattccagatacagatatcattatgatgcagattac

SEQ ID NO: 262689 - DNA, 75 bp, Artificial Sequence
  Synthetic
ttgagaagcattccaggtataaataccattatgatgcagattactcccgatgggactccacccaacagagagctg

SEQ ID NO: 262690 - DNA, 75 bp, Artificial Sequence
  Synthetic
aagacctcttgtcccccagtgtgatggacgtgggtgatttcaagatatcaatcaacgaggggttgccctctggtg

SEQ ID NO: 262691 - DNA, 75 bp, Artificial Sequence
  Synthetic
tcaatcaagaagtgccaaatagtgtatagtggttgcacctacatacttgagtctgatggcaagggcaatgtgaaa

SEQ ID NO: 262692 - DNA, 75 bp, Artificial Sequence
  Synthetic
cctcatctggcccaagtggttgcagaagacctcttgtcccccagtgtgatggatgtgggtgatttcaagatatca

SEQ ID NO: 262693 - DNA, 75 bp, Artificial Sequence
  Synthetic
tgttggcccccagtgtggtggacgttggagactttaaaatttcaataaatgaagggcttccatccggtgtcccgt

SEQ ID NO: 262694 - DNA, 75 bp, Artificial Sequence
  Synthetic
tggagactttaaaatttcaataaatgaagggcttccatccggtgtcccgtgcacctcacagtggaattccatcac

SEQ ID NO: 262695 - DNA, 75 bp, Artificial Sequence
  Synthetic
aagacctcttgtcccccagtgtgatggatgtgggtgatttcaagatatcaatcaatgaggggttaccctctggtg

SEQ ID NO: 262696 - DNA, 75 bp, Artificial Sequence
  Synthetic
aaagtttccatacactgcatttagcaacaactgttataatttctgttgctgggttcttgatttgaaagattcgtg

SEQ ID NO: 262697 - DNA, 75 bp, Artificial Sequence
  Synthetic
tgtcccctgacatcatccaggcaaactccctattctccttttatggtgatgatgaaatagtgagcacagatatca

SEQ ID NO: 262698 - DNA, 75 bp, Artificial Sequence
  Synthetic
gttctcattctatggtgatgacgagatcgttagcaccgatataaaattggacccagaaaaattgaccacaaaatt

SEQ ID NO: 262699 - DNA, 75 bp, Artificial Sequence
  Synthetic
atcgttagcaccgatataaaattggacccagaaaaattgaccacaaaattgagagagtatggtttgaaaccgacc

SEQ ID NO: 262700 - DNA, 75 bp, Artificial Sequence
  Synthetic
aattggacccagagaaactgacagcaaagttgaaggaatacgggctaaaaccaacccgtcctgataaaacagaag

SEQ ID NO: 262701 - DNA, 75 bp, Artificial Sequence
  Synthetic
tcccgtgatccagctggctggtttgggaaattggaccaaagttcaatactcaggcaaatgtactggaccagagga

SEQ ID NO: 262702 - DNA, 75 bp, Artificial Sequence
  Synthetic
cagggacaagtactatgaggaggtggccattgccagggcaaccgaggaggacttctgtgaggaggaggaggccaa

SEQ ID NO: 262703 - DNA, 75 bp, Artificial Sequence
  Synthetic
ttggaacagttatgacccaacagaagaaatcccagcccctctaggaactccagatttcgtgggaaagattcaagg

SEQ ID NO: 262704 - DNA, 75 bp, Artificial Sequence
  Synthetic
catacaactcatggccctacttggtgaagcctctctacacgggccctccttctacagcaaaattagcaaattggt

SEQ ID NO: 262705 - DNA, 75 bp, Artificial Sequence
  Synthetic
aagacccatacaactgatgtcactactaggtgaagctgcactacatggcccatcattctatagtaaaattagcaa

SEQ ID NO: 262706 - DNA, 75 bp, Artificial Sequence
  Synthetic
tgacactatgtcccgtgtctcctcttgggtacaatcacaaaattcttcagtaagaagtgtttccccttttcaccg

SEQ ID NO: 262707 - DNA, 75 bp, Artificial Sequence
  Synthetic
gtcagacaaccggaagaatccaacacggccttcagtgtccctccactcagtcagagggagaacagagacgctaag

SEQ ID NO: 262708 - DNA, 75 bp, Artificial Sequence
  Synthetic
tgaatgaagatggcgtcgaatgacgctactccatcaaatgatggtgccgccggcctcgtgccagaaagtaataat

SEQ ID NO: 262709 - DNA, 75 bp, Artificial Sequence
  Synthetic
gttttgtgaatgaagatggcgtcgaatgacgccgctccatctaacgatggtgctacaggtctcgtaccagagatc

SEQ ID NO: 262710 - DNA, 75 bp, Artificial Sequence
  Synthetic
cactggccaaactaatataatagacccctggattagaactaattttgtccaagcccctaatggtgaattcacagt

SEQ ID NO: 262711 - DNA, 75 bp, Artificial Sequence
  Synthetic
attgatccctggattagaaataattttgtgcaggcgcctaatggtgagtttacagtctcccctagaaattcccct

SEQ ID NO: 262712 - DNA, 75 bp, Artificial Sequence
  Synthetic
aagcccctaatggtgaattcacagtttcccctagaaattcccctggagagatattggtcaatttggagttaggtc

SEQ ID NO: 262713 - DNA, 75 bp, Artificial Sequence
  Synthetic
gctataccccctaatttcccaattgataatctaagcgcacgacagattacaatgtgcccacatgtgattgtggat

SEQ ID NO: 262714 - DNA, 75 bp, Artificial Sequence
  Synthetic
ttgtgcaggcgcctaatggtgagtttacagtctcccctagaaattcccctggtgaaattttaatgaacttggagt

SEQ ID NO: 262715 - DNA, 75 bp, Artificial Sequence
  Synthetic
aaagttgccaatgctgtcctatgtgctcttggttcactattctcaaaacctattaaagacttgattgggaaactg

SEQ ID NO: 262716 - DNA, 75 bp, Artificial Sequence
  Synthetic
tgctcgcggggaacgcgttcaccgctggcaagattatctttgccgccgtgccaccttactttccagtggaaaatc

SEQ ID NO: 262717 - DNA, 75 bp, Artificial Sequence
  Synthetic
aagtgctcctagctgggaatgcgttcacggcaggaaagatcctttttgcagcagtccccccaaatttccccgttg

SEQ ID NO: 262718 - DNA, 75 bp, Artificial Sequence
  Synthetic
cccctacatctacaagagggaaaatgactacgtggttattggagtccacacggctgccgctcgtgggggaaacac

SEQ ID NO: 262719 - DNA, 75 bp, Artificial Sequence
  Synthetic
tggcaagattatctttgccgccgtgccaccttactttccagtggaaaatcttagcccttcccaaataacaatgtt

SEQ ID NO: 262720 - DNA, 75 bp, Artificial Sequence
  Synthetic
cacggcaggaaagatcctttttgcagcagtccccccaaatttccccgttgatatgctcagtcctgctcaaatcac

SEQ ID NO: 262721 - DNA, 75 bp, Artificial Sequence
  Synthetic
ccactttaatcaaaaggatgaacctaagatgagacttgttgccatgctttacacccctcttcgttctaatggttc

SEQ ID NO: 262722 - DNA, 75 bp, Artificial Sequence
  Synthetic
tttctatcactttaataaccagcctgccccaagaatgagattggttgccatgctctacacccctttaagatccaa

SEQ ID NO: 262723 - DNA, 75 bp, Artificial Sequence
  Synthetic
atatgtgccacccaggggagtgaaggagaggctacacttgaaggtggtgacaacaaggggacatactgtggtgca

SEQ ID NO: 262724 - DNA, 75 bp, Artificial Sequence
  Synthetic
atgggcaccacccaactcttacctagtcaaatctgtgctttcatgggcgtgctcaccaggtcaacaagcagggcc

SEQ ID NO: 262725 - DNA, 75 bp, Artificial Sequence
  Synthetic
gccccaagaatgagattggttgccatgctctacacccctttaagatccaatgggtccggtgatgacgtattcacc

SEQ ID NO: 262726 - DNA, 75 bp, Artificial Sequence
  Synthetic
ctgaatttgattttacatatttggtaccaccaacagtggaatcaaagactaagccattcacactacctgtgctaa

SEQ ID NO: 262727 - DNA, 75 bp, Artificial Sequence
  Synthetic
aaaaccaaacctttcaccctacccatcctaacaattggagagttgacaaactctagatttccagccccgatcgat

SEQ ID NO: 262728 - DNA, 75 bp, Artificial Sequence
  Synthetic
tcctaacaattggagagttgacaaactctagatttccagccccgatcgatcagttgtacacttcacccaacgctg

SEQ ID NO: 262729 - DNA, 75 bp, Artificial Sequence
  Synthetic
ttgttcagccacagaatggtagggtcacactagatggggagctgttaggcacaacccaactgcaagcatgcaaca

SEQ ID NO: 262730 - DNA, 75 bp, Artificial Sequence
  Synthetic
aaaaccaagtgtattagaagctgccaagaagaccatcatcaatgtccttgagcaaacaattgatccacctgagaa

SEQ ID NO: 262731 - DNA, 75 bp, Artificial Sequence
  Synthetic
ttcgcaaatagaggccaataatgttgtaataagaatgtgggcatcttattcagaattagataattttaattggaa

SEQ ID NO: 262732 - DNA, 75 bp, Artificial Sequence
  Synthetic
cagcaatatgctcatacaggggcatgacatcaaaccccactagtgactactgggatgatcacctcctgcacctgg

SEQ ID NO: 262733 - DNA, 75 bp, Artificial Sequence
  Synthetic
gacatcaaaccccactagtgactactgggatgatcacctcctgcacctggttcaccccaatggggcaacatatga

SEQ ID NO: 262734 - DNA, 75 bp, Artificial Sequence
  Synthetic
agcaaacaattgatccacctgagaaatggtcgttcgcacaagcttgcgcgtcccttgacaagaccacttccagtg

SEQ ID NO: 262735 - DNA, 75 bp, Artificial Sequence
  Synthetic
gtgaatgaagatggcgtctaacgacgctgccactgcgaccgctggcaaaaccagcacaaacagtgtaattcacaa

SEQ ID NO: 262736 - DNA, 75 bp, Artificial Sequence
  Synthetic
taaatgggacgcaatttgaccctacagatgatgtcccagccccccttggtgtgcccgattttgcaggtgaggtct

SEQ ID NO: 262737 - DNA, 75 bp, Artificial Sequence
  Synthetic
ttggtgtactcagccagagaaacagaggtgaaagcaacccagcaaacagggctcatgatgctgtcgtggccacct

SEQ ID NO: 262738 - DNA, 75 bp, Artificial Sequence
  Synthetic
cccccgaacctccggggacgaagccgccaactcccatgggatctacatctcatccaccagtgaaaagttcactcc

SEQ ID NO: 262739 - DNA, 75 bp, Artificial Sequence
  Synthetic
gccaactcccatgggatctacatctcatccaccagtgaaaagttcactccaaaattgggtacaattggcttacac

SEQ ID NO: 262740 - DNA, 75 bp, Artificial Sequence
  Synthetic
ggaccccccccgacgtgtcgaacttcatcgcgtcactcatcggagactttgaattgcagggcccagaggatttag

SEQ ID NO: 262741 - DNA, 75 bp, Artificial Sequence
  Synthetic
gggcttagtgcaaattggaacttggaacaccaatgatgttgaaaaccagccaacaaaattcaccccaattggttt

SEQ ID NO: 262742 - DNA, 75 bp, Artificial Sequence
  Synthetic
tttgaacagtggactttgcctaggtattctggtgccctgacattaaatatgaatttagcccctgctgtggccccg

SEQ ID NO: 262743 - DNA, 75 bp, Artificial Sequence
  Synthetic
cctttcagacagtgggaactcccaaactactctggtgccctcaccctcaacacaaaccttgcaccagcggttggg

SEQ ID NO: 262744 - DNA, 75 bp, Artificial Sequence
  Synthetic
gagccgtgttagcagcagccctagaaatcatggttaaattctccccagaaccacacctggcccagatagttgcag

SEQ ID NO: 262745 - DNA, 75 bp, Artificial Sequence
  Synthetic
actactctggtgccctcaccctcaacacaaaccttgcaccagcggttgggcccaacttccctggggagcaaatcc

SEQ ID NO: 262746 - DNA, 75 bp, Artificial Sequence
  Synthetic
tcttccgctcttacgtcccattaaaaggtggatttggaaaccctgctatagattgtctggtgcctcaggagtggg

SEQ ID NO: 262747 - DNA, 75 bp, Artificial Sequence
  Synthetic
tccaacatttctatcaggaatctgccccctctctgggggatgtggccttagtcaggtacgtcaacccagacaccg

SEQ ID NO: 262748 - DNA, 75 bp, Artificial Sequence
  Synthetic
gggtctcccatttttatcaagaatcagccccttctcagagtgatgtggccttggtcaggtatgtcaaccctgaca

SEQ ID NO: 262749 - DNA, 75 bp, Artificial Sequence
  Synthetic
cccctctctgggggatgtggccttagtcaggtacgtcaacccagacaccgggcgcgtactttttgaggccaaact

SEQ ID NO: 262750 - DNA, 75 bp, Artificial Sequence
  Synthetic
agccccttctcagagtgatgtggccttggtcaggtatgtcaaccctgacacagggcgcacaatctttgaggccaa

SEQ ID NO: 262751 - DNA, 75 bp, Artificial Sequence
  Synthetic
tgaggcaacaaagaggttacaggctgacatgattgctatcaaacaaggggttttgaccgctggcggcttctcccc

SEQ ID NO: 262752 - DNA, 75 bp, Artificial Sequence
  Synthetic
atttgactcctgggtcaatcaattttactctcttgcccccatgggaactgggaatgggcgcagaaggtttcagta

SEQ ID NO: 262753 - DNA, 75 bp, Artificial Sequence
  Synthetic
cagatttgattcctgggtcaaccagttttatgcactcgcccccatgggaactgggaatgggcgcagaagagttca

SEQ ID NO: 262754 - DNA, 75 bp, Artificial Sequence
  Synthetic
tactctcttgcccccatgggaactgggaatgggcgcagaaggtttcagtaatggcgggagctttcatagcaggtt

SEQ ID NO: 262755 - DNA, 75 bp, Artificial Sequence
  Synthetic
aacgcccccatgacaaaagtcctagattggaatgggacgaggtactgggcaccaaatgccacctccacaacctcg

SEQ ID NO: 262756 - DNA, 75 bp, Artificial Sequence
  Synthetic
ggacccagagaaattgacagcaaagctcagagaatatgggttaaaaccaacccgccctgacaaaactgaaggacc

SEQ ID NO: 262757 - DNA, 75 bp, Artificial Sequence
  Synthetic
actgtgacccgcgacccagctggctggtttggaaaattggaacagagctcaatacttaggcaaatgtactggact

SEQ ID NO: 262758 - DNA, 75 bp, Artificial Sequence
  Synthetic
ttttatgcactcgcccccatgggaactgggaatgggcgcagaagagttcagtaatggctggagctttcatagcag

SEQ ID NO: 262759 - DNA, 75 bp, Artificial Sequence
  Synthetic
agtttgattttaataggcaattgcaacaaaattctttcaatcatgataaggagatgttaaatgcccaaattcaag

SEQ ID NO: 262760 - DNA, 75 bp, Artificial Sequence
  Synthetic
ttgaatatgacttcaccaaacaactgcaaagtgcctccttccaacatgacaaggacatgcttcaagcccagatca

SEQ ID NO: 262761 - DNA, 75 bp, Artificial Sequence
  Synthetic
acaaaattctttcaatcatgataaggagatgttaaatgcccaaattcaagcaacaaaacagttgcaggctgatat

SEQ ID NO: 262762 - DNA, 75 bp, Artificial Sequence
  Synthetic
gcaaagtgcctccttccaacatgacaaggacatgcttcaagcccagatcaacgcaacaaaacaattgcagagtga

SEQ ID NO: 262763 - DNA, 75 bp, Artificial Sequence
  Synthetic
acccatgacccaagcactagattggagtggcactaggtactgggcccctggttcaatgaagaccaccagctattc

SEQ ID NO: 262764 - DNA, 75 bp, Artificial Sequence
  Synthetic
tgctccaatgacaaaagtcttagattggtcagggacgcgttactgggcacccaactcaaccaaaacaacaagcca

SEQ ID NO: 262765 - DNA, 75 bp, Artificial Sequence
  Synthetic
tggtcagggacgcgttactgggcacccaactcaaccaaaacaacaagccaatctggccagttctcctctacaact

SEQ ID NO: 262766 - DNA, 75 bp, Artificial Sequence
  Synthetic
tgggtgactatgaaatgcagggccccgaggatatcgcggttgaagtcgtaccggtgatcctcggcggtataggca

SEQ ID NO: 262767 - DNA, 75 bp, Artificial Sequence
  Synthetic
gtagcgggccaacaaaatgtaattgacccctggattagaaacaattttgtacaagcccctggtggagagtttaca

SEQ ID NO: 262768 - DNA, 75 bp, Artificial Sequence
  Synthetic
tagggcatgcaaagacctaggcaactacgcccttgacatacttaaactggttatgaagtggttcttcccaaagaa

SEQ ID NO: 262769 - DNA, 75 bp, Artificial Sequence
  Synthetic
aagcgccagctctgtgtcctctggtaggaccaatttgacaaattccacccaatcaactgttgtcagtacttcctc

SEQ ID NO: 262770 - DNA, 75 bp, Artificial Sequence
  Synthetic
cgcagcctttctactcaatcaacaatgctttcaaattctagctcctcttctcgtgggactccttcaactcaatca

SEQ ID NO: 262771 - DNA, 75 bp, Artificial Sequence
  Synthetic
tggatttgatttggaatcttttaaaaaaaaaaaaaaaaaaaaaaaaaaaaaaaaaaaaaaaaaaaaaaaaaaaaa

SEQ ID NO: 262772 - DNA, 75 bp, Artificial Sequence
  Synthetic
tgctttcaaattctagctcctcttctcgtgggactccttcaactcaatcaacagatatttcttcctcgcgaacgg

SEQ ID NO: 262773 - DNA, 75 bp, Artificial Sequence
  Synthetic
ggaacaaaacaggaatttggaaccctacatgaggggtgcccttcaaacaacatttgtcacccccccttccagccg

SEQ ID NO: 262774 - DNA, 75 bp, Artificial Sequence
  Synthetic
tatgttcccccatataattgtagatgttagacaactggaacctgtgttgattcccctacctgatgtcaggaataa

SEQ ID NO: 262775 - DNA, 75 bp, Artificial Sequence
  Synthetic
catcaagcagagcttcttctacaggcaccgtctcaacagtgcctaaaggggttttggactcctggacacctgcgt

SEQ ID NO: 262776 - DNA, 75 bp, Artificial Sequence
  Synthetic
actgtaccaaaaggtgttttggactcctggacacctgcgtttaacacccgcaggcagccgctttttgcttacctt

SEQ ID NO: 262777 - DNA, 75 bp, Artificial Sequence
  Synthetic
tcaacacccgcaggcagccgcttttcgcacacctcaggaagaggggggagtcacaagcctagtgaaaagaattat

SEQ ID NO: 262778 - DNA, 75 bp, Artificial Sequence
  Synthetic
cctggacacctgcgtttaacacccgcaggcagccgctttttgcttaccttcgtaagaagggggagtcacaagttt

SEQ ID NO: 262779 - DNA, 75 bp, Artificial Sequence
  Synthetic
cttttgttgtacaaccacaaaatggcagatgcacgactgacggcgtgctcttaggcactacccagctgtcagctg

SEQ ID NO: 262780 - DNA, 75 bp, Artificial Sequence
  Synthetic
catctgcaccttcagaggggatgtcacccatattccaggcagtcgtaactacacaatgaatttggcctcccaaaa

SEQ ID NO: 262781 - DNA, 75 bp, Artificial Sequence
  Synthetic
tctcaatcaagaagtgccagattgtgtacagtggttgcacctacacacttgagtctgatggcaagggcaatgtga

SEQ ID NO: 262782 - DNA, 75 bp, Artificial Sequence
  Synthetic
gaaatcccagcccctctaggaactccagatttcgtggggaagattcaaggtgtgctcacccaaaccacaaggaca

SEQ ID NO: 262783 - DNA, 75 bp, Artificial Sequence
  Synthetic
aaagctacagtgagcactgggagtgtccacttcactccaaagctgggtagtgttcaattcaccactgacacaaac

SEQ ID NO: 262784 - DNA, 75 bp, Artificial Sequence
  Synthetic
agggacagcctcctgacctacatgaagaccctagacctcgaagaagagaaggcgagaaaattgtccacaaaatca

SEQ ID NO: 262785 - DNA, 75 bp, Artificial Sequence
  Synthetic
tgttcaattcaccactgacacaaacaatgatttccaaactggccaaaacacgaaattcaccccagttggtgtcat

SEQ ID NO: 262786 - DNA, 75 bp, Artificial Sequence
  Synthetic
tgtgcacctggcccctgccgttgcccccacttttccgggtgagcaactccttttctttagatccactatgcccgg

SEQ ID NO: 262787 - DNA, 75 bp, Artificial Sequence
  Synthetic
aaccccaacaatgggtgctcccaagttactcaggcagaaacattcataatgtgcacctggcccccgctgtagccc

SEQ ID NO: 262788 - DNA, 75 bp, Artificial Sequence
  Synthetic
agctccagcacaatctgatgtggctctgctgagatttgtgaatccagacacaggtagggttctgtttgagtgcaa

SEQ ID NO: 262789 - DNA, 75 bp, Artificial Sequence
  Synthetic
tgatcctcttggcagagctctttggagttttctggacacccccagatgtgtctgcgatgatcgcccccttactag

SEQ ID NO: 262790 - DNA, 75 bp, Artificial Sequence
  Synthetic
agtataaaagaatcagagaagagagacaaggaaaatactccatagaagaataccttcaggatagggatcggtatt

SEQ ID NO: 262791 - DNA, 75 bp, Artificial Sequence
  Synthetic
caaattgaggccaccaaaaagttgcaacaggaaatgatgagagttaaacaagcaatgctcctagagggtggattc

SEQ ID NO: 262792 - DNA, 75 bp, Artificial Sequence
  Synthetic
ctaggcctgtcgtggtgatgatatcaggaagaccaggagttggtaaaacccacatggccaggcacctcgccaaaa

SEQ ID NO: 262793 - DNA, 75 bp, Artificial Sequence
  Synthetic
cactttccaatgcttctactgctacttctgtatattcaaatcaaactgtttcaacgagactaggttcttcagctg

SEQ ID NO: 262794 - DNA, 75 bp, Artificial Sequence
  Synthetic
cccttacctgatgttaggaataacttctatcattataatcagtcaaatgattctaccattaaattgatagcaatg

SEQ ID NO: 262795 - DNA, 75 bp, Artificial Sequence
  Synthetic
gttctggcaccggtgtctcgagtttcccgtcaactgtaaggactaggaactgggttgaggaccaaaacagaaatc

SEQ ID NO: 262796 - DNA, 75 bp, Artificial Sequence
  Synthetic
ctcaggggccagacggtgaggccacgcttgaggggggagacaaccacgggacttactgtggggcaccaatactcg

SEQ ID NO: 262797 - DNA, 75 bp, Artificial Sequence
  Synthetic
agtttcaaccgtgcccaaagaagttttggactcctggactggcgctttcaacacgcgcaggcagccttttttcgc

SEQ ID NO: 262798 - DNA, 75 bp, Artificial Sequence
  Synthetic
attcgtaaacgaggggagtcacgggtgtaatgtgaaaagacaaaattgattatctttcctttctttagtgtcttt

SEQ ID NO: 262799 - DNA, 75 bp, Artificial Sequence
  Synthetic
gtgaatgaagatggcgtctaacgacgcttccgctgccgctgctgctatcagcaacaacgacatcgcaaaatcttc

SEQ ID NO: 262800 - DNA, 75 bp, Artificial Sequence
  Synthetic
attcttccaccgttaaagttactggtcctctagccgcaaaagctagtgatccagattccaccttcgctaagctca

SEQ ID NO: 262801 - DNA, 75 bp, Artificial Sequence
  Synthetic
gagggaaacaacacaaaaacaaaaacctccacgaccgcccaccccggagttagtcaaaaagattccacctccccc

SEQ ID NO: 262802 - DNA, 75 bp, Artificial Sequence
  Synthetic
tggctgcgcccccccttggcagccccccgattcccctccccccagggtgggagcccgcggagcccaagcgagagg

SEQ ID NO: 262803 - DNA, 75 bp, Artificial Sequence
  Synthetic
cctccacgaccgcccaccccggagttagtcaaaaagattccacctcccccgcccaacggggaggacgatatagtg

SEQ ID NO: 262804 - DNA, 75 bp, Artificial Sequence
  Synthetic
cccgattcccctccccccagggtgggagcccgcggagcccaagcgagaggatgtggatcagttcccagtgcgctt

SEQ ID NO: 262805 - DNA, 75 bp, Artificial Sequence
  Synthetic
ggacgactatggtatgggtaacccagtaaaagatgcccttgcattgcaagaactagcagacacttgtccagtcac

SEQ ID NO: 262806 - DNA, 75 bp, Artificial Sequence
  Synthetic
acagcatttagtgtccccccactcaaccagagggaaaatagggatgctaaagaaccgctgcctggtaccatattg

SEQ ID NO: 262807 - DNA, 75 bp, Artificial Sequence
  Synthetic
cccgccagtcgagcagcggagcacagagccccctgtcgaaccacccgtaggaactattttggaattctacgaggg

SEQ ID NO: 262808 - DNA, 75 bp, Artificial Sequence
  Synthetic
accagagggaaaatagggatgctaaagaaccgctgcctggtaccatattggaaatgtgggacggagagatctacc

SEQ ID NO: 262809 - DNA, 75 bp, Artificial Sequence
  Synthetic
gagccccctgtcgaaccacccgtaggaactattttggaattctacgagggctacatcttccattacgccatctat

SEQ ID NO: 262810 - DNA, 75 bp, Artificial Sequence
  Synthetic
ttgaactaacaccactgtctctgtactggagaccagtgtacacccctcagtacctcatatccccggaaacactca

SEQ ID NO: 262811 - DNA, 75 bp, Artificial Sequence
  Synthetic
atccaaattgctggagctgcatttgtaaccacgcgcattgtcaagcgcatgaacatacaagacctctggtccaag

SEQ ID NO: 262812 - DNA, 75 bp, Artificial Sequence
  Synthetic
ctgtctgcttggtggcgcgtggcatacatcccacgcgatcccccacctcgagaccagctcttgtcccttgagggt

SEQ ID NO: 262813 - DNA, 75 bp, Artificial Sequence
  Synthetic
ctggagaccagtgtacacccctcagtacctcatatccccggaaacactcaaaaagctacatggagagacattccc

SEQ ID NO: 262814 - DNA, 75 bp, Artificial Sequence
  Synthetic
acatcccacgcgatcccccacctcgagaccagctcttgtcccttgagggtgaacgatggccttatgcatctgtta

SEQ ID NO: 262815 - DNA, 75 bp, Artificial Sequence
  Synthetic
gaggatgattcagagaacaactggcttcttcagaccctaccaggactggaacaggaaacctctccccactatgga

SEQ ID NO: 262816 - DNA, 75 bp, Artificial Sequence
  Synthetic
caggccctttccaccacccaagccagccttggaacaaagcagtcccagagttccaccaagacagcaaaatggagc

SEQ ID NO: 262817 - DNA, 75 bp, Artificial Sequence
  Synthetic
gccttggaacaaagcagtcccagagttccaccaagacagcaaaatggagctggttcgcgatgccattttaacagc

SEQ ID NO: 262818 - DNA, 75 bp, Artificial Sequence
  Synthetic
cactattcaccaggcccattaaggacataataggaaaactaaggcccttaaacatactcaacatactagcttcct

SEQ ID NO: 262819 - DNA, 75 bp, Artificial Sequence
  Synthetic
gtcccattgcgactggacgtttaccggcatcgttgaagctgccgtcctcctcgcagaactttttggcattttgtg

SEQ ID NO: 262820 - DNA, 75 bp, Artificial Sequence
  Synthetic
ggcatcgttgaagctgccgtcctcctcgcagaactttttggcattttgtggcaacccccagatgtggctagcttc

SEQ ID NO: 262821 - DNA, 75 bp, Artificial Sequence
  Synthetic
gatcaatcctcaatcatgagacaattgttctggaccaaggggcccaaccatgacgaccccaatgagacaatgatt

SEQ ID NO: 262822 - DNA, 75 bp, Artificial Sequence
  Synthetic
cagatgtgtctgcgatgatcgcccccttactaggtgactacgaactacagggacctgaagatctcgctgtggaac

SEQ ID NO: 262823 - DNA, 75 bp, Artificial Sequence
  Synthetic
gggggaattggactggccctcggcttcaccaaggataaggccacgaaactcttgaagtcagccgcagatggcctt

SEQ ID NO: 262824 - DNA, 75 bp, Artificial Sequence
  Synthetic
tcaccaaggataaggccacgaaactcttgaagtcagccgcagatggccttcgggccgctagcagccttggccagt

SEQ ID NO: 262825 - DNA, 75 bp, Artificial Sequence
  Synthetic
ctgccgcgtccaccctcagagcttgtaaagaccttggggcatatgggttagaaatcctgaagttggtcatgaaat

SEQ ID NO: 262826 - DNA, 75 bp, Artificial Sequence
  Synthetic
taaagaccttggggcatatgggttagaaatcctgaagttggtcatgaaatggttcttcccgaagaaagacgaggc

SEQ ID NO: 262827 - DNA, 75 bp, Artificial Sequence
  Synthetic
aactttgaggcttgttcccgcagaattgacttcctcgtctacgcagatgccccgaccattgagaaggcgaagaag

SEQ ID NO: 262828 - DNA, 75 bp, Artificial Sequence
  Synthetic
agcacgccgttattgatctcgaggtcctcgcctcaaataacatcacagaggtggttagggaccgccagtccaccc

SEQ ID NO: 262829 - DNA, 75 bp, Artificial Sequence
  Synthetic
cctcgcctcaaataacatcacagaggtggttagggaccgccagtccaccctggcctacatcaagacccttgatat

SEQ ID NO: 262830 - DNA, 75 bp, Artificial Sequence
  Synthetic
aggtttccaaaaccaatcagaactgacgtgacaggcatgatcttagaagaaggtgcacccgaagggaccgtggtc

SEQ ID NO: 262831 - DNA, 75 bp, Artificial Sequence
  Synthetic
caccctactcaaagacaaagacagtttggcaacctacatgaagactctggatcttgaagaggagaaagctaggaa

SEQ ID NO: 262832 - DNA, 75 bp, Artificial Sequence
  Synthetic
ttggcaacctacatgaagactctggatcttgaagaggagaaagctaggaaactctccaccaaatccgcttctcct

SEQ ID NO: 262833 - DNA, 75 bp, Artificial Sequence
  Synthetic
tggaaggattgctatggctcggtccgccctcgccaaagcccaatcagagatgtccaaccgagtgcgccccgttgt

SEQ ID NO: 262834 - DNA, 75 bp, Artificial Sequence
  Synthetic
attcaagggcgcactgttggaggtcaaatgggcatgctcctaacaggatccaacgccaagagtatggacctgggc

SEQ ID NO: 262835 - DNA, 75 bp, Artificial Sequence
  Synthetic
gccctcgccaaagcccaatcagagatgtccaaccgagtgcgccccgttgtcatcatgttgagcgggcccccgggc

SEQ ID NO: 262836 - DNA, 75 bp, Artificial Sequence
  Synthetic
gagctttccagtaggccaaggcccgttgttgttatgatatcaggaaagccaggaatagggaaaacccatcttgcc

SEQ ID NO: 262837 - DNA, 75 bp, Artificial Sequence
  Synthetic
ttgttgttatgatatcaggaaagccaggaatagggaaaacccatcttgccagagatttggcaaagaaagttgcag

SEQ ID NO: 262838 - DNA, 75 bp, Artificial Sequence
  Synthetic
ctcgtcccccgcgaggctgttgaccactgggatggctataagggccaggaagtgatgctgtgggacgattacggc

SEQ ID NO: 262839 - DNA, 75 bp, Artificial Sequence
  Synthetic
actgggatggctataagggccaggaagtgatgctgtgggacgattacggcatggccaacatagccgcggactgca

SEQ ID NO: 262840 - DNA, 75 bp, Artificial Sequence
  Synthetic
agagagtcgtcctttgggatgactatggaatgagtaaccccattcatgacgcccttaggctacaagaacttgctg

SEQ ID NO: 262841 - DNA, 75 bp, Artificial Sequence
  Synthetic
tggaatgagtaaccccattcatgacgcccttaggctacaagaacttgctgacacttgccccctaacattaaattg

SEQ ID NO: 262842 - DNA, 75 bp, Artificial Sequence
  Synthetic
gtcagaagcaccctctttcacttcaatcaaaaggatgaacctaagatgagacttgttgccatgctttacacccct

SEQ ID NO: 262843 - DNA, 75 bp, Artificial Sequence
  Synthetic
tcacctcggaggccatagttatcaccacaaatgcccctgggccagcccccctggaccacatgaatcttgggccag

SEQ ID NO: 262844 - DNA, 75 bp, Artificial Sequence
  Synthetic
cacaaatgcccctgggccagcccccctggaccacatgaatcttgggccagtgtgtcgacgggttgacttcctcgt

SEQ ID NO: 262845 - DNA, 75 bp, Artificial Sequence
  Synthetic
accactggactatgttaactttgaagcatgttcgaggcgtatcgacttccttgtgtacgctgatgcccccgacgt

SEQ ID NO: 262846 - DNA, 75 bp, Artificial Sequence
  Synthetic
gatttcacatacttggtgccaccaacagtagaatcaaagaccaagccattcacactacctgtgctgaccctggga

SEQ ID NO: 262847 - DNA, 75 bp, Artificial Sequence
  Synthetic
ccaaaaccaagtgtgttagaagctgccaagaaaaccatcgtcaatgtccttgaacaaacaattgatccacctcaa

SEQ ID NO: 262848 - DNA, 75 bp, Artificial Sequence
  Synthetic
gcatgttcgaggcgtatcgacttccttgtgtacgctgatgcccccgacgttgaaaaggcaaaacgcgacttccca

SEQ ID NO: 262849 - DNA, 75 bp, Artificial Sequence
  Synthetic
caagaaggacttcacccatctccagcttcagcttgcgccccaaggtgggtttgactgtctcggcaacacgcccta

SEQ ID NO: 262850 - DNA, 75 bp, Artificial Sequence
  Synthetic
cttcagcttgcgccccaaggtgggtttgactgtctcggcaacacgccctatggtaagggcgccatgtctaagacc

SEQ ID NO: 262851 - DNA, 75 bp, Artificial Sequence
  Synthetic
ggctggatttcagccccgtctgacaatacacaacttaatgtctggacaataccaaagtatgggtctagtctccag

SEQ ID NO: 262852 - DNA, 75 bp, Artificial Sequence
  Synthetic
ggttttgataagaacggcaacaccccacatggaaaaggtgtcatgaaaaccctcacatctggctccctcgttgcc

SEQ ID NO: 262853 - DNA, 75 bp, Artificial Sequence
  Synthetic
cacatggaaaaggtgtcatgaaaaccctcacatctggctccctcgttgcccgtgcttcaggactcctccacgaaa

SEQ ID NO: 262854 - DNA, 75 bp, Artificial Sequence
  Synthetic
gagtacgactttgacaagaaccgggtcctggccttttcaaagatggccaacgacaatgggctcggcatgctctcc

SEQ ID NO: 262855 - DNA, 75 bp, Artificial Sequence
  Synthetic
acacgggtgcgcttaaggacgagctggtcaagactgacaaaatttatggcaagatcaaaaagaggcttctctggg

SEQ ID NO: 262856 - DNA, 75 bp, Artificial Sequence
  Synthetic
tcctggccttttcaaagatggccaacgacaatgggctcggcatgctctccgccatgagagtggccaacaaattga

SEQ ID NO: 262857 - DNA, 75 bp, Artificial Sequence
  Synthetic
ggcagctcgccgctgaaaatagatacgggctgatggacaccatgagagtgggaagccagctcaagaatgtcaaaa

SEQ ID NO: 262858 - DNA, 75 bp, Artificial Sequence
  Synthetic
cgggctgatggacaccatgagagtgggaagccagctcaagaatgtcaaaactgtgtcagagctcaaacaggcact

SEQ ID NO: 262859 - DNA, 75 bp, Artificial Sequence
  Synthetic
gcaacacaccacatgggaagggaactatgaaaaccttaacccagggttccctcacagcaagagtggccggacttg

SEQ ID NO: 262860 - DNA, 75 bp, Artificial Sequence
  Synthetic
gggggactcactatgagctccagtctgacgggcagaagctgaccatcaaccaacttgccaccccccagcccaccg

SEQ ID NO: 262861 - DNA, 75 bp, Artificial Sequence
  Synthetic
tgacgggcagaagctgaccatcaaccaacttgccaccccccagcccaccgttgagattaactatgccttgaaacg

SEQ ID NO: 262862 - DNA, 75 bp, Artificial Sequence
  Synthetic
taatgtaagggttgagaaggtgcaaagtccagctgtgcagaccaacaatgagctaactggcgcactacaccatct

SEQ ID NO: 262863 - DNA, 75 bp, Artificial Sequence
  Synthetic
gaggtgcgctaggattagatattatgttaagtgtgttcaggaagctttgtactccatcatccaaattgctggagc

SEQ ID NO: 262864 - DNA, 75 bp, Artificial Sequence
  Synthetic
ctccgcccttgtcatccaccgggcagtccagcggatccgtgccccatccacccagttggagtcccacaactgcag

SEQ ID NO: 262865 - DNA, 75 bp, Artificial Sequence
  Synthetic
gtccagcggatccgtgccccatccacccagttggagtcccacaactgcaggtaccaccgggcagagcaagaaaac

SEQ ID NO: 262866 - DNA, 75 bp, Artificial Sequence
  Synthetic
gggagagaccaccagcaaagacgggtgcccaaaaccaaaggatgaggaggagtttgtcatctcgtctgaagacat

SEQ ID NO: 262867 - DNA, 75 bp, Artificial Sequence
  Synthetic
tgcccaaaaccaaaggatgaggaggagtttgtcatctcgtctgaagacattaaagtcgaaggcaagaagggaaag

SEQ ID NO: 262868 - DNA, 75 bp, Artificial Sequence
  Synthetic
gagaagccagcccccaatgagggcagaaagaagaaggcccaggccccggtgcagttggagtcgaagaaaggcagg

SEQ ID NO: 262869 - DNA, 75 bp, Artificial Sequence
  Synthetic
gaaagaagaaggcccaggccccggtgcagttggagtcgaagaaaggcaggaggaagaccaacgccttctcccggc

SEQ ID NO: 262870 - DNA, 75 bp, Artificial Sequence
  Synthetic
aaaagaattagagaagaaagaaatggtaagtactccatagaagaatacctccaggacagagacaagtactatgag

SEQ ID NO: 262871 - DNA, 75 bp, Artificial Sequence
  Synthetic
gtaagtactccatagaagaatacctccaggacagagacaagtactatgaggaggtggccatagccagggctactg

SEQ ID NO: 262872 - DNA, 75 bp, Artificial Sequence
  Synthetic
agtaccttgaggaccgcgagcgctacgagcgcgagttggccgagcgccaggctgacgatgaagcttatgatgaca

SEQ ID NO: 262873 - DNA, 75 bp, Artificial Sequence
  Synthetic
cgagcgcgagttggccgagcgccaggctgacgatgaagcttatgatgacagttccatccgccagaagtactttgg

SEQ ID NO: 262874 - DNA, 75 bp, Artificial Sequence
  Synthetic
aggagagggcttcactcgggctggttacaggctcagaaatcaggaaaaggaacccggatgacttcaaacccaaag

SEQ ID NO: 262875 - DNA, 75 bp, Artificial Sequence
  Synthetic
tacaggctcagaaatcaggaaaaggaacccggatgacttcaaacccaaaggaaaactgtgggctgatgatgacag

SEQ ID NO: 262876 - DNA, 75 bp, Artificial Sequence
  Synthetic
gcgggaggtggactacaacgaggtgatagagttccaggcccccccctcaatatggtcgcggatccagcgctttgg

SEQ ID NO: 262877 - DNA, 75 bp, Artificial Sequence
  Synthetic
atagagttccaggcccccccctcaatatggtcgcggatccagcgctttggctccggctggggctgctgggtgtcc

SEQ ID NO: 262878 - DNA, 75 bp, Artificial Sequence
  Synthetic
caataactatggattcctggagacaatgagagtcggttcctcactcaaggatgtcaagacagtggaggacctcaa

SEQ ID NO: 262879 - DNA, 75 bp, Artificial Sequence
  Synthetic
caagagccaatgttcagatggatgagattctcggatctgagcacgtgggagggcgatcgcaatctggctcccagt

SEQ ID NO: 262880 - DNA, 75 bp, Artificial Sequence
  Synthetic
aggttggggcttctgggtctcaccaagcctttttgtaacatccacccatgtcatacctcaaggggcacaagaatt

SEQ ID NO: 262881 - DNA, 75 bp, Artificial Sequence
  Synthetic
agcctttttgtaacatccacccatgtcatacctcaaggggcacaagaatttttcggtgtttccatcaaacagatc

SEQ ID NO: 262882 - DNA, 75 bp, Artificial Sequence
  Synthetic
atcgcggtcagttcccacggcgagttcacccaattccgctttccccggcccatacggccagatgtgagtgggctg

SEQ ID NO: 262883 - DNA, 75 bp, Artificial Sequence
  Synthetic
tcacccaattccgctttccccggcccatacggccagatgtgagtgggctggttcttgaggagggggcccctgaag

SEQ ID NO: 262884 - DNA, 75 bp, Artificial Sequence
  Synthetic
ggttgagttcccgcagcccaaaaagagtgcggccataccatcaagcgccagctctgtgtcttctggtaggaccaa

SEQ ID NO: 262885 - DNA, 75 bp, Artificial Sequence
  Synthetic
ctggaggagggggcccctgaagggactgtggccacactgctcataaagaggccaactggagagctgatgccactg

SEQ ID NO: 262886 - DNA, 75 bp, Artificial Sequence
  Synthetic
ctgtggccacactgctcataaagaggccaactggagagctgatgccactggcagctagaatgggtacccatgcaa

SEQ ID NO: 262887 - DNA, 75 bp, Artificial Sequence
  Synthetic
ccagcacgaaagtgcagggtaaggtcatcaatggccagactgggatgctcctcactggctccaacgccaagggca

SEQ ID NO: 262888 - DNA, 75 bp, Artificial Sequence
  Synthetic
gctctgtgtcttctggtaggaccaattttacaaattctactcaatcaactgtagttagcacttcctcaatgccac

SEQ ID NO: 262889 - DNA, 75 bp, Artificial Sequence
  Synthetic
catcaatggccagactgggatgctcctcactggctccaacgccaagggcatggatttgggcacttttcctggtga

SEQ ID NO: 262890 - DNA, 75 bp, Artificial Sequence
  Synthetic
atttgggtaccacaccaggtgactgtggatgcccatacatatacaaaagaggaaatgactacgtagtcatcgggg

SEQ ID NO: 262891 - DNA, 75 bp, Artificial Sequence
  Synthetic
tggatgcccatacatatacaaaagaggaaatgactacgtagtcatcggggtccacacagctgccgcccgtggagg

SEQ ID NO: 262892 - DNA, 75 bp, Artificial Sequence
  Synthetic
tggcaacacggtcatctgtgccattccaaactcccaggagtcggtcgcgcttgagggcgggcacggcacctatgt

SEQ ID NO: 262893 - DNA, 75 bp, Artificial Sequence
  Synthetic
ccaaactcccaggagtcggtcgcgcttgagggcgggcacggcacctatgttggccaccccataatcggccagggg

SEQ ID NO: 262894 - DNA, 75 bp, Artificial Sequence
  Synthetic
cctgcgtttaacacccgcaggcagccgcttttcgctcaccttcgcaagaagggggagtcacaagcttagtgaaaa

SEQ ID NO: 262895 - DNA, 75 bp, Artificial Sequence
  Synthetic
ttgtggcgccccaatcctaggtccaggaaatgcccccaaactcagtactaaaaccaaattctggaggtcctcaac

SEQ ID NO: 262896 - DNA, 75 bp, Artificial Sequence
  Synthetic
ggaaatgcccccaaactcagtactaaaaccaaattctggaggtcctcaacagcaccactcccacctggcacatat

SEQ ID NO: 262897 - DNA, 75 bp, Artificial Sequence
  Synthetic
ccggcatacctcggcggcaaggaccctcgagtgcagggcggcccctctctccaacaggtgatgcgggaccagttg

SEQ ID NO: 262898 - DNA, 75 bp, Artificial Sequence
  Synthetic
gagaataaaggaaaggtctttgacagcgatgtcatcattatcaccactaatctggccaacccagcaccactggac

SEQ ID NO: 262899 - DNA, 75 bp, Artificial Sequence
  Synthetic
ctcgagtgcagggcggcccctctctccaacaggtgatgcgggaccagttggcccagttctcagccccccgtggca

SEQ ID NO: 262900 - DNA, 75 bp, Artificial Sequence
  Synthetic
ctgaaaccatttacagaacccagaggtaagccaccaaagcccagtgtactagaagcagccaaaaagacaatcatt

SEQ ID NO: 262901 - DNA, 75 bp, Artificial Sequence
  Synthetic
gtaagccaccaaagcccagtgtactagaagcagccaaaaagacaatcattaatgtccttgagcaaacaatagacc

SEQ ID NO: 262902 - DNA, 75 bp, Artificial Sequence
  Synthetic
caaaaccctggagctatcaagacgcctgcatgtccctggataaaaccacaagctctggctacccccattacaaga

SEQ ID NO: 262903 - DNA, 75 bp, Artificial Sequence
  Synthetic
gagaaacgcaaaaacaaaaaggcttcatctaaggctagtgtctcctttggagcacctagcttactctcttcggag

SEQ ID NO: 262904 - DNA, 75 bp, Artificial Sequence
  Synthetic
catctaaggctagtgtctcctttggagcacctagcttactctcttcggagagtgaagatgaagttaattacatga

SEQ ID NO: 262905 - DNA, 75 bp, Artificial Sequence
  Synthetic
aaactggcagataacaactcccaaacaaccagagaaatcatcacggccgtcactagactacaacaggctcgtgct

SEQ ID NO: 262906 - DNA, 75 bp, Artificial Sequence
  Synthetic
gtgaaatgaggatggcaacgccatcttctgcgtcctctgtgcgcaacacagagaaacgcaaaaacaaaaaggctt

SEQ ID NO: 262907 - DNA, 75 bp, Artificial Sequence
  Synthetic
tgcggaagaatgaacattggaatggggaatctttcacaggaaaattggctgatcaggcttcaaaagctaacctga

SEQ ID NO: 262908 - DNA, 75 bp, Artificial Sequence
  Synthetic
atcgccagggcaagagccagcgcccccgctacactgctgcactgaaggacgagttggtggccccaaggaagattt

SEQ ID NO: 262909 - DNA, 75 bp, Artificial Sequence
  Synthetic
ggaatctttcacaggaaaattggctgatcaggcttcaaaagctaacctgatgtttgaggaaggtaaacacatgac

SEQ ID NO: 262910 - DNA, 75 bp, Artificial Sequence
  Synthetic
tgactcgaagtgatgcacgcgtgctgatcttcaatgagtgggaggagaggaagaagtccgagccgtggctacggt

SEQ ID NO: 262911 - DNA, 75 bp, Artificial Sequence
  Synthetic
gatcttcaatgagtgggaggagaggaagaagtccgagccgtggctacggttggacatgtcagataaggccatctt

SEQ ID NO: 262912 - DNA, 75 bp, Artificial Sequence
  Synthetic
gctatggggttcagatctggcaaccatgatccgctgcgctcgagcgttcggagggttgatggatgaactcaaggc

SEQ ID NO: 262913 - DNA, 75 bp, Artificial Sequence
  Synthetic
atgatccgctgcgctcgagcgttcggagggttgatggatgaactcaaggctcactgtgtcacactccccatcagg

SEQ ID NO: 262914 - DNA, 75 bp, Artificial Sequence
  Synthetic
cgtggtggagctgcccataaagattggaatgaatgccattgaggatggacctgttatctaccagaagcactcagc

SEQ ID NO: 262915 - DNA, 75 bp, Artificial Sequence
  Synthetic
aagagagccagtggtgggatccattcttgagcaggatgaccacaaattctaccactactctgtctacatcggcaa

SEQ ID NO: 262916 - DNA, 75 bp, Artificial Sequence
  Synthetic
cttgagcaggatgaccacaaattctaccactactctgtctacatcggcaatggcatggtgatgggcgtcaataac

SEQ ID NO: 262917 - DNA, 75 bp, Artificial Sequence
  Synthetic
gactactctcggtgggactcaacacagcagagagctgttttagctgcagccctggaaatcatggtaaaattttcc

SEQ ID NO: 262918 - DNA, 75 bp, Artificial Sequence
  Synthetic
tgacatcatgaccaaactcactgcagagcatgaactcgcccgcgtcgttgcggaagacctgcttaagccctcgca

SEQ ID NO: 262919 - DNA, 75 bp, Artificial Sequence
  Synthetic
tgacatcatgaccaaactcactgcagagcttgaactcgcccgcgtcgttgcggaagacctgcttaagccctcgca

SEQ ID NO: 262920 - DNA, 75 bp, Artificial Sequence
  Synthetic
tgacatcatgaccaaactcactgcagagcctgaactcgcccgcgtcgttgcggaagacctgcttaagccctcgca

SEQ ID NO: 262921 - DNA, 75 bp, Artificial Sequence
  Synthetic
tgacatcatgaccaaactcactgcagagcgtgaactcgcccgcgtcgttgcggaagacctgcttaagccctcgca

SEQ ID NO: 262922 - DNA, 75 bp, Artificial Sequence
  Synthetic
cctggaaatcatggtaaaattttccccagaaccacacctggcccagatcgttgcagaggatctcctatctcccag

SEQ ID NO: 262923 - DNA, 75 bp, Artificial Sequence
  Synthetic
cgccaacccctcgacccggctgagttgaggaagtgtgtgggcatgaccgtcccttacgtggcaaccactgtcaac

SEQ ID NO: 262924 - DNA, 75 bp, Artificial Sequence
  Synthetic
gagcatgaactcgcccgcgtcgttgcggaagacctgcttaagccctcgcacctcgacgtgggggacttcctggtg

SEQ ID NO: 262925 - DNA, 75 bp, Artificial Sequence
  Synthetic
gagcttgaactcgcccgcgtcgttgcggaagacctgcttaagccctcgcacctcgacgtgggggacttcctggtg

SEQ ID NO: 262926 - DNA, 75 bp, Artificial Sequence
  Synthetic
gagcctgaactcgcccgcgtcgttgcggaagacctgcttaagccctcgcacctcgacgtgggggacttcctggtg

SEQ ID NO: 262927 - DNA, 75 bp, Artificial Sequence
  Synthetic
gagcgtgaactcgcccgcgtcgttgcggaagacctgcttaagccctcgcacctcgacgtgggggacttcctggtg

SEQ ID NO: 262928 - DNA, 75 bp, Artificial Sequence
  Synthetic
tgaggaagtgtgtgggcatgaccgtcccttacgtggcaaccactgtcaactgctaccaggtctgttgctggattg

SEQ ID NO: 262929 - DNA, 75 bp, Artificial Sequence
  Synthetic
ctgtgtgcgctctcagaagtcaccaacctggacccagatgtggtgcaggcaaacagctatttctccttctatggt

SEQ ID NO: 262930 - DNA, 75 bp, Artificial Sequence
  Synthetic
gaattctattgctcattggctcctcacgctttgtgcactctctgaggtaacagatttgtctcctgacatcatcca

SEQ ID NO: 262931 - DNA, 75 bp, Artificial Sequence
  Synthetic
acgctttgtgcactctctgaggtaacagatttgtctcctgacatcatccaagcaaactcactcttctctttctat

SEQ ID NO: 262932 - DNA, 75 bp, Artificial Sequence
  Synthetic
ggaacactgacccccaggagcccttcattccatccaaacttaggttggtctctgatgccatcctggtggccctct

SEQ ID NO: 262933 - DNA, 75 bp, Artificial Sequence
  Synthetic
acctggacccagatgtggtgcaggcaaacagctatttctccttctatggtgatgatgaaatagtctcgacagatc

SEQ ID NO: 262934 - DNA, 75 bp, Artificial Sequence
  Synthetic
cattccatccaaacttaggttggtctctgatgccatcctggtggccctctcaacggtgattggtcggccgatcaa

SEQ ID NO: 262935 - DNA, 75 bp, Artificial Sequence
  Synthetic
agggtcccattgagcttcgccgtcaggttgacggcctggtcttcctccggcgcacaatttcgcatgacgccaagg

SEQ ID NO: 262936 - DNA, 75 bp, Artificial Sequence
  Synthetic
ctcaagccaacccgtcctgacaagactgaagggcctctggtcatttctgaggacttagatggtctgaccttctta

SEQ ID NO: 262937 - DNA, 75 bp, Artificial Sequence
  Synthetic
ctgaagggcctctggtcatttctgaggacttagatggtctgaccttcttacggaggactgtgacccgtgacccag

SEQ ID NO: 262938 - DNA, 75 bp, Artificial Sequence
  Synthetic
agttaacgccctgatcctccttgctgaattgtttgatgtcttctggacccctcctgatgtcaccaactggatgat

SEQ ID NO: 262939 - DNA, 75 bp, Artificial Sequence
  Synthetic
gaattgtttgatgtcttctggacccctcctgatgtcaccaactggatgatctccgtctttggagagtggcaggcc

SEQ ID NO: 262940 - DNA, 75 bp, Artificial Sequence
  Synthetic
aacgatgggtcaaggctccagagacagatgaacccacaccaagtaacgataagcccgacactgaagaagaatggg

SEQ ID NO: 262941 - DNA, 75 bp, Artificial Sequence
  Synthetic
ccaacgagaccttggtccctcacagcaaccggaaggtccagttgctctgccttcttggcgaagctgccctccacg

SEQ ID NO: 262942 - DNA, 75 bp, Artificial Sequence
  Synthetic
caaccggaaggtccagttgctctgccttcttggcgaagctgccctccacggcgagaagttttaccgccgggtcag

SEQ ID NO: 262943 - DNA, 75 bp, Artificial Sequence
  Synthetic
atcccgctgaaacaatgataccacactcccaaagacccatacagttgatgtccctattaggtgaagctgcattac

SEQ ID NO: 262944 - DNA, 75 bp, Artificial Sequence
  Synthetic
tccgataccatcggacgtaagttggcctccaccaattcagccctgaaggccgctcaggagatgggcaagtttgcg

SEQ ID NO: 262945 - DNA, 75 bp, Artificial Sequence
  Synthetic
atggcccatcattctacagcaaaatcagcaaattggtcatctcagagttgaaagaaggtggtatggacttttacg

SEQ ID NO: 262946 - DNA, 75 bp, Artificial Sequence
  Synthetic
cctccaccaattcagccctgaaggccgctcaggagatgggcaagtttgcgatcgaggtctttaagcagatcatgg

SEQ ID NO: 262947 - DNA, 75 bp, Artificial Sequence
  Synthetic
tgggaaggtagtcgcgacacccttcccgattttgtaaatgaagatgactgacagagataccattgattctgctcc

SEQ ID NO: 262948 - DNA, 75 bp, Artificial Sequence
  Synthetic
gtcaacttgaaaaccagctcacggccatgttgcgggaccgcaacgctggggctgaattcttgaaggcacttgatg

SEQ ID NO: 262949 - DNA, 75 bp, Artificial Sequence
  Synthetic
catgttgcgggaccgcaacgctggggctgaattcttgaaggcacttgatgaagaggagcaggaggtccgcaggat

SEQ ID NO: 262950 - DNA, 75 bp, Artificial Sequence
  Synthetic
cgcccccactgctgggcaggttaacccaattgacccatggatttttgctaattttgtgcaagcccctcaaggcga

SEQ ID NO: 262951 - DNA, 75 bp, Artificial Sequence
  Synthetic
ccaattgacccatggatttttgctaattttgtgcaagcccctcaaggcgaatttactatatcccctaataacaat

SEQ ID NO: 262952 - DNA, 75 bp, Artificial Sequence
  Synthetic
agcctttgagaaggcccgcgccgagcagacctcccgggttcgtcccgtggtgatcatggtctctggcaggcccgg

SEQ ID NO: 262953 - DNA, 75 bp, Artificial Sequence
  Synthetic
cagacctcccgggttcgtcccgtggtgatcatggtctctggcaggcccgggatcgggaaaacctgcttctgtcaa

SEQ ID NO: 262954 - DNA, 75 bp, Artificial Sequence
  Synthetic
tggaattaggccctgaactaaatccatatttggcacacctttccagaatgtacaatggttatgcaggtggagttg

SEQ ID NO: 262955 - DNA, 75 bp, Artificial Sequence
  Synthetic
aatggatggaccggatccatgcgcgtgcgagttctcctggcgggcaacgccttctcggcgggcaaagtggtggtg

SEQ ID NO: 262956 - DNA, 75 bp, Artificial Sequence
  Synthetic
tgcgagttctcctggcgggcaacgccttctcggcgggcaaagtggtggtgttttgtgtcccccctgggtttgata

SEQ ID NO: 262957 - DNA, 75 bp, Artificial Sequence
  Synthetic
cactgggacgcctacaagggcgccagggtggttctctgggatgatttcggcatggacaacgtggtgaaggacgca

SEQ ID NO: 262958 - DNA, 75 bp, Artificial Sequence
  Synthetic
gggtggttctctgggatgatttcggcatggacaacgtggtgaaggacgcactgcggctgcagatgcttgccgaca

SEQ ID NO: 262959 - DNA, 75 bp, Artificial Sequence
  Synthetic
cattagaaaacataagccctggccaaataaccatgttccctcatgtaattattgatgttaggactctagaaccag

SEQ ID NO: 262960 - DNA, 75 bp, Artificial Sequence
  Synthetic
agatgcctcttgaagatgttcgcaacattcttttccaccaggggcctgattcgcgcatgaggctcatggggatgc

SEQ ID NO: 262961 - DNA, 75 bp, Artificial Sequence
  Synthetic
cattcttttccaccaggggcctgattcgcgcatgaggctcatggggatgctctacacccctttgcgtgccaactc

SEQ ID NO: 262962 - DNA, 75 bp, Artificial Sequence
  Synthetic
ccactaaccaacaaacccctgtacccctggattatgtcaacttggaggctgtgtgccgccgcatagacttcttgg

SEQ ID NO: 262963 - DNA, 75 bp, Artificial Sequence
  Synthetic
tggcaatgctctataccccccttagatctaatggttctggtgatgatgtattcactgtctcctgtagagtgctta

SEQ ID NO: 262964 - DNA, 75 bp, Artificial Sequence
  Synthetic
atctaatggttctggtgatgatgtattcactgtctcctgtagagtgcttactcgaccctctcctgattttgattt

SEQ ID NO: 262965 - DNA, 75 bp, Artificial Sequence
  Synthetic
tccccccaccgttgaggaaagggagcccccttttactttaccaaatttgcctgtcaacaatctttcgcattcccg

SEQ ID NO: 262966 - DNA, 75 bp, Artificial Sequence
  Synthetic
cccccttttactttaccaaatttgcctgtcaacaatctttcgcattcccgggttatggagcccatagcccagatg

SEQ ID NO: 262967 - DNA, 75 bp, Artificial Sequence
  Synthetic
cctggattatgtcaacttggaggctgtgtgccgccgcatagacttcttggtctatgctgagagccccgttgttga

SEQ ID NO: 262968 - DNA, 75 bp, Artificial Sequence
  Synthetic
tgaggaatatgacgaattcaagagactgagggaagagaaacagggccgctacacaatagaagagtacctccagga

SEQ ID NO: 262969 - DNA, 75 bp, Artificial Sequence
  Synthetic
tttcatcctggcgccgcagggtgggttcgaccgacaaggcaacactccctacggcaagggcgtcactaagatcat

SEQ ID NO: 262970 - DNA, 75 bp, Artificial Sequence
  Synthetic
aaccaattccagattccctgtgcctatagatgaactctacactagccccaatgagagtttggtggtacaacccca

SEQ ID NO: 262971 - DNA, 75 bp, Artificial Sequence
  Synthetic
atagatgaactctacactagccccaatgagagtttggtggtacaaccccagaacgggagatgcgcgctggatggg

SEQ ID NO: 262972 - DNA, 75 bp, Artificial Sequence
  Synthetic
acaaccccatcgtctcccgccgacctgggcgcttttgtaggcctgattgccgagcccggttcccgggttgttgag

SEQ ID NO: 262973 - DNA, 75 bp, Artificial Sequence
  Synthetic
tgggcgcttttgtaggcctgattgccgagcccggttcccgggttgttgagctgtctcagcccaatcaggaggatt

SEQ ID NO: 262974 - DNA, 75 bp, Artificial Sequence
  Synthetic
ttcgaccgacaaggcaacactccctacggcaagggcgtcactaagatcattggcgccaccgcgctttgcgcaagg

SEQ ID NO: 262975 - DNA, 75 bp, Artificial Sequence
  Synthetic
gtgaccgccttcaaggctatggcggccgacgccggcatcccctggtacaagatggcagcgatcggctgcaaagcc

SEQ ID NO: 262976 - DNA, 75 bp, Artificial Sequence
  Synthetic
ggagagaaccatgtttggaatatgcaagtcaccaacattaacggaaccccttttgatccaacagaggatgttcca

SEQ ID NO: 262977 - DNA, 75 bp, Artificial Sequence
  Synthetic
aagtcaccaacattaacggaaccccttttgatccaacagaggatgttccagctcctctaggtacaccagactttt

SEQ ID NO: 262978 - DNA, 75 bp, Artificial Sequence
  Synthetic
gcgcgacgaccgttggggagcgcactgtgaacacccgtagtcttcaaaattttactcccgctcttgggcacatca

SEQ ID NO: 262979 - DNA, 75 bp, Artificial Sequence
  Synthetic
tgtgaacacccgtagtcttcaaaattttactcccgctcttgggcacatcacatttgatgaggaggctcccgctga

SEQ ID NO: 262980 - DNA, 75 bp, Artificial Sequence
  Synthetic
ccgacgccggcatcccctggtacaagatggcagcgatcggctgcaaagccatgggctgcacctgtgtggaagagg

SEQ ID NO: 262981 - DNA, 75 bp, Artificial Sequence
  Synthetic
gcatcaagggtgcccccatggttgagaaggtcaaggaacctgaactgcccaagacactcgtcaactgtgtcagga

SEQ ID NO: 262982 - DNA, 75 bp, Artificial Sequence
  Synthetic
ctaattctgctaaattcaccccaaaattgggcgctatacaaattggcacatgggaacaagatgatgtacacatca

SEQ ID NO: 262983 - DNA, 75 bp, Artificial Sequence
  Synthetic
gaaggtcaaggaacctgaactgcccaagacactcgtcaactgtgtcaggaggatcaaagaagcccgcctccgctg

SEQ ID NO: 262984 - DNA, 75 bp, Artificial Sequence
  Synthetic
cgatgtgcttggttctgagtttgccccctctgtctctgcccctggtgttggtgaaacccttctcttctttatgtg

SEQ ID NO: 262985 - DNA, 75 bp, Artificial Sequence
  Synthetic
ccctctgtctctgcccctggtgttggtgaaacccttctcttctttatgtgcaatgtccctcgtttaaatggtgct

SEQ ID NO: 262986 - DNA, 75 bp, Artificial Sequence
  Synthetic
ctggagccttaacactcaacatggggttggccccccctgtggcccccacatttcctggcgagcaaattcttttct

SEQ ID NO: 262987 - DNA, 75 bp, Artificial Sequence
  Synthetic
aattgagaagaagtcccgaccttccttctactgggatcacggctacacttaccgtgacggcccaggtgcctttga

SEQ ID NO: 262988 - DNA, 75 bp, Artificial Sequence
  Synthetic
ttctactgggatcacggctacacttaccgtgacggcccaggtgcctttgacctctttgaggatgacaacgatgga

SEQ ID NO: 262989 - DNA, 75 bp, Artificial Sequence
  Synthetic
agtgatgtggcacttttaaattatgttaatcccaataccggtcgggttctgtttgagtgcaagctgtatgctaac

SEQ ID NO: 262990 - DNA, 75 bp, Artificial Sequence
  Synthetic
ttaatcccaataccggtcgggttctgtttgagtgcaagctgtatgctaacggcttcctcaccgtcaaccttggcg

SEQ ID NO: 262991 - DNA, 75 bp, Artificial Sequence
  Synthetic
aacacctttatcaggagtcagccccttcacaaacagatgtagcactgatcagattcacaaatccagacacagggc

SEQ ID NO: 262992 - DNA, 75 bp, Artificial Sequence
  Synthetic
ctcacggatgaggagtacgatgagtttaagaaacgccgcgaatccaagggcggcaagtactccattgatgactac

SEQ ID NO: 262993 - DNA, 75 bp, Artificial Sequence
  Synthetic
ttaagaaacgccgcgaatccaagggcggcaagtactccattgatgactacctcgctgaccgcgagcgagaggaag

SEQ ID NO: 262994 - DNA, 75 bp, Artificial Sequence
  Synthetic
accaaaaagcagaggaaggaggaacgtggggttctgggactcgtcacaggagcagacatcaggaaacgaagaccc

SEQ ID NO: 262995 - DNA, 75 bp, Artificial Sequence
  Synthetic
ggcctgtgggaaatgctagtgttggccgccgtcttccccgtcttgatggcttctgaatttttctcttctcttctc

SEQ ID NO: 262996 - DNA, 75 bp, Artificial Sequence
  Synthetic
ccgccgtcttccccgtcttgatggcttctgaatttttctcttctcttctcggcggggtcgcctccgccgccattt

SEQ ID NO: 262997 - DNA, 75 bp, Artificial Sequence
  Synthetic
aggcagagagggccaggctcggcctagtctcgggcggtgacattcgcgcccgcaagccaatcgactggaacgtgg

SEQ ID NO: 262998 - DNA, 75 bp, Artificial Sequence
  Synthetic
agtctcgggcggtgacattcgcgcccgcaagccaatcgactggaacgtggttggtccgtcctgggctgatgacga

SEQ ID NO: 262999 - DNA, 75 bp, Artificial Sequence
  Synthetic
atgattctgccatgctacagcagcaggttcaggccactcaaatggcccgttcccaatggtttgattttcagaggg

SEQ ID NO: 263000 - DNA, 75 bp, Artificial Sequence
  Synthetic
ggttcaggccactcaaatggcccgttcccaatggtttgattttcagagggcggccctgcagggggctggtttttc

SEQ ID NO: 263001 - DNA, 75 bp, Artificial Sequence
  Synthetic
tggctcactcgtgaacgctggggccaatgcaataaaccaaaaagtagactttgaaaacaataagcaactacagca

SEQ ID NO: 263002 - DNA, 75 bp, Artificial Sequence
  Synthetic
cacgggatggggcttttgggtcagcgggcacgtcttcatcactgccaagcacgtggcgccacccaagggcacgga

SEQ ID NO: 263003 - DNA, 75 bp, Artificial Sequence
  Synthetic
gggcacgtcttcatcactgccaagcacgtggcgccacccaagggcacggaggtcttcgggcgcaagcctgaagag

SEQ ID NO: 263004 - DNA, 75 bp, Artificial Sequence
  Synthetic
cgccccgcaggcccgagtgaccacctctttttctggtggcttcctccccagcacgccccgaattggggtgcagag

SEQ ID NO: 263005 - DNA, 75 bp, Artificial Sequence
  Synthetic
ggaactagacattgggcccccggagccatgaaaacaactgctttctccggtgggttcaccagtgcttctcatacc

SEQ ID NO: 263006 - DNA, 75 bp, Artificial Sequence
  Synthetic
gtcttggaaaacggctgccaggagggcgttgttgcctcggtcctcgtcaagagggcctctggtgagatgctcgct

SEQ ID NO: 263007 - DNA, 75 bp, Artificial Sequence
  Synthetic
cctggttgtcctctgttgagcccttccatccatccgcattgcagacagtttgggtcacccctcctggatctacgg

SEQ ID NO: 263008 - DNA, 75 bp, Artificial Sequence
  Synthetic
gcgttgttgcctcggtcctcgtcaagagggcctctggtgagatgctcgctctggcagtcaggatgggttcccagg

SEQ ID NO: 263009 - DNA, 75 bp, Artificial Sequence
  Synthetic
tctactgtttctacccgttctaccttgattagtggatcctctaatccttcttctctagctaggagttcttccagt

SEQ ID NO: 263010 - DNA, 75 bp, Artificial Sequence
  Synthetic
aagacttgggaaccatcccaggtgattgtggttgcccctatgtctacaagaaaggaaacacctgggttgtgattg

SEQ ID NO: 263011 - DNA, 75 bp, Artificial Sequence
  Synthetic
gtggctagtagtgcctcctatactagctcttttaatcaagggtggtttaatacagatcgaatgccattgttcgca

SEQ ID NO: 263012 - DNA, 75 bp, Artificial Sequence
  Synthetic
ttgtggttgcccctatgtctacaagaaaggaaacacctgggttgtgattggggtgcatgtggcggccactaggtc

SEQ ID NO: 263013 - DNA, 75 bp, Artificial Sequence
  Synthetic
cctctcggactagtgattgggtacgtagccaaaacagagcactggagccttacatgagcggggcgctgcgtacag

SEQ ID NO: 263014 - DNA, 75 bp, Artificial Sequence
  Synthetic
tccccgcccctctggcacctatgcgggtctccccatcgctgattacggcgatgccccgcctttgagcaccaaaac

SEQ ID NO: 263015 - DNA, 75 bp, Artificial Sequence
  Synthetic
ggtctccccatcgctgattacggcgatgccccgcctttgagcaccaaaaccatgttctggcgcacctctccggag

SEQ ID NO: 263016 - DNA, 75 bp, Artificial Sequence
  Synthetic
cctggacatctgcatttaacacacacagacaaccgctgtttgctcatctccgtcggagaggggagtcacaagttt

SEQ ID NO: 263017 - DNA, 75 bp, Artificial Sequence
  Synthetic
cagacaaccgctgtttgctcatctccgtcggagaggggagtcacaagtttagtgaaaagatggtcttttctttca

SEQ ID NO: 263018 - DNA, 75 bp, Artificial Sequence
  Synthetic
gaatcgtcccgcttgggactggctggggattttgggtctcatccaatttgctaattaccactacacatgtgttgc

SEQ ID NO: 263019 - DNA, 75 bp, Artificial Sequence
  Synthetic
caggtcatgcgggatcagctcaagccctattcggagccacgtggcttgctccccccccaagagattctggatgcg

SEQ ID NO: 263020 - DNA, 75 bp, Artificial Sequence
  Synthetic
cctattcggagccacgtggcttgctccccccccaagagattctggatgcggtttgcgacgccattgagaaccgcc

SEQ ID NO: 263021 - DNA, 75 bp, Artificial Sequence
  Synthetic
gcggatacccctaccacaaacagaagagcaaggattggacagggaccgcctttgtgggcgagcttggcgaccagg

SEQ ID NO: 263022 - DNA, 75 bp, Artificial Sequence
  Synthetic
gagcaaggattggacagggaccgcctttgtgggcgagcttggcgaccaggccacccatgccaacaacatgtatga

SEQ ID NO: 263023 - DNA, 75 bp, Artificial Sequence
  Synthetic
gaagataaagaagagacttctctggggctctgatcttggcaccatgattcgcgccgcccgcgcctttggcccctt

SEQ ID NO: 263024 - DNA, 75 bp, Artificial Sequence
  Synthetic
ggctctgatcttggcaccatgattcgcgccgcccgcgcctttggccccttctgtgaagctcttaaagagacctgc

SEQ ID NO: 263025 - DNA, 75 bp, Artificial Sequence
  Synthetic
aaatatcacatggatgcagattactccaggtgggactccacccagcaaagggccatcctgaagcgtgccggcgac

SEQ ID NO: 263026 - DNA, 75 bp, Artificial Sequence
  Synthetic
ccaggtgggactccacccagcaaagggccatcctgaagcgtgccggcgacatcatggtacgcctctcccctgatc

SEQ ID NO: 263027 - DNA, 75 bp, Artificial Sequence
  Synthetic
gcacaatcaacgctcttctggcgagaatcgccgctgcacgctccctggtgcaccgagcgaaggaggagctttcca

SEQ ID NO: 263028 - DNA, 75 bp, Artificial Sequence
  Synthetic
tcgaagaaggactcccatccggctgcccctgcaccacgcagctcaacagtttggcccactggattctgaccctct

SEQ ID NO: 263029 - DNA, 75 bp, Artificial Sequence
  Synthetic
cccctgcaccacgcagctcaacagtttggcccactggattctgaccctctgtgcaatggttgaggtgacccggat

SEQ ID NO: 263030 - DNA, 75 bp, Artificial Sequence
  Synthetic
cgatgtctctgggttgatattagaagaaggggcccctgaaggaacagtgtgctctgttctcatcaagaggtcaac

SEQ ID NO: 263031 - DNA, 75 bp, Artificial Sequence
  Synthetic
attggacatgaccaaatacaccatggccctgaggcggtacggtctccttccgacacgtgcggacaaggaggaggg

SEQ ID NO: 263032 - DNA, 75 bp, Artificial Sequence
  Synthetic
gccctgaggcggtacggtctccttccgacacgtgcggacaaggaggagggacccctggagcgccgtcagacgctg

SEQ ID NO: 263033 - DNA, 75 bp, Artificial Sequence
  Synthetic
gttgacagagttcagagcacctccgttcaaaccaacaatgagctggcttgcgctctgcaccatctaaggtgcgcc

SEQ ID NO: 263034 - DNA, 75 bp, Artificial Sequence
  Synthetic
actgtgacccgcgacccagctggttggtttggaaaattggagcagagttcaatactcaggcaaatgtactggact

SEQ ID NO: 263035 - DNA, 75 bp, Artificial Sequence
  Synthetic
acccctcaaccttcggggacgctgccaggaagaatcaatcccaggactcctacccccgctcggggctcctccagc

SEQ ID NO: 263036 - DNA, 75 bp, Artificial Sequence
  Synthetic
atcgaccgccagctcctttggactaagggacccaaccatcagaacccctttgagactctcccaggacatgctcag

SEQ ID NO: 263037 - DNA, 75 bp, Artificial Sequence
  Synthetic
agggacccaaccatcagaacccctttgagactctcccaggacatgctcagagaccctcccaattgatggccctgc

SEQ ID NO: 263038 - DNA, 75 bp, Artificial Sequence
  Synthetic
gcttccgctgccgctgttgctaacagcaacaacgacaacgcaaaatcttcaagtgacggagtattttctaatatg

SEQ ID NO: 263039 - DNA, 75 bp, Artificial Sequence
  Synthetic
ttgagtctgatggcaagggtgatgtgaaagttgacagagttcagaacgccactgtgcagaccaacaatgaactgg

SEQ ID NO: 263040 - DNA, 75 bp, Artificial Sequence
  Synthetic
gtgggatagaaatggtggtcccacgccaccgatctgttctgcgctgggtgcgctttggaacaatggatgctgaga

SEQ ID NO: 263041 - DNA, 75 bp, Artificial Sequence
  Synthetic
ccaccgatctgttctgcgctgggtgcgctttggaacaatggatgctgagaccccgcaggaacgctcagcagtctt

SEQ ID NO: 263042 - DNA, 75 bp, Artificial Sequence
  Synthetic
agaccacccacaccagaattggttaaagcaatcccccctcccccacccaacggggaggacgaaccaatcatttct

SEQ ID NO: 263043 - DNA, 75 bp, Artificial Sequence
  Synthetic
aagcaatcccccctcccccacccaacggggaggacgaaccaatcatttcttacaacgtcaaagagggtgtttctg

SEQ ID NO: 263044 - DNA, 75 bp, Artificial Sequence
  Synthetic
ccgccgttgaacaggccgtccccattcagcccgtggctggtgcggctcttgccgcccccgccgccgggcaaatca

SEQ ID NO: 263045 - DNA, 75 bp, Artificial Sequence
  Synthetic
tcagcccgtggctggtgcggctcttgccgcccccgccgccgggcaaatcaaccaaattgacccctggatcttcca

SEQ ID NO: 263046 - DNA, 75 bp, Artificial Sequence
  Synthetic
gggagaacagagatgcaaaggaaccattgactggaaccatcctggagatgtgggacggggagatctaccattatg

SEQ ID NO: 263047 - DNA, 75 bp, Artificial Sequence
  Synthetic
ggccctcggaccagggctcaatccttaccttgcccacctctcagccatgtacaccggctgggttgggaacatgga

SEQ ID NO: 263048 - DNA, 75 bp, Artificial Sequence
  Synthetic
gctaggtgtacacaaaccaccagcagccatcagccttgctaaggttgagctgacccccttgtctttgtattggag

SEQ ID NO: 263049 - DNA, 75 bp, Artificial Sequence
  Synthetic
taccttgcccacctctcagccatgtacaccggctgggttgggaacatggaggttcagctggtcctcgccggcaat

SEQ ID NO: 263050 - DNA, 75 bp, Artificial Sequence
  Synthetic
accagtgtacaccccacagtacctcatttcccctgacactctcagaaagttgcatggggagacgttcccttatac

SEQ ID NO: 263051 - DNA, 75 bp, Artificial Sequence
  Synthetic
atttcccctgacactctcagaaagttgcatggggagacgttcccttatacagcctttgacaacaactgttatgcc

SEQ ID NO: 263052 - DNA, 75 bp, Artificial Sequence
  Synthetic
gccaacgctaagaatatggatttaggtaccggtcccggggattgtggttgcccgtacatatacaagaggggcaat

SEQ ID NO: 263053 - DNA, 75 bp, Artificial Sequence
  Synthetic
agcctttgacaacaactgttatgccttctgctgttgggtacttgacttgaacgattcatggctgagtagaaggat

SEQ ID NO: 263054 - DNA, 75 bp, Artificial Sequence
  Synthetic
atcacatgcttcccacatgtcatgtgtgatgtgcgcaccctggagcccattcaactccctcttcttgacgtgcgt

SEQ ID NO: 263055 - DNA, 75 bp, Artificial Sequence
  Synthetic
gtgatgtgcgcaccctggagcccattcaactccctcttcttgacgtgcgtcgagttctttggcatgctacccagg

SEQ ID NO: 263056 - DNA, 75 bp, Artificial Sequence
  Synthetic
cgaccctaccaggactggaacaggaaacccctccccacgatggatgacaccaaagtgaaaaaggtggccaatgtt

SEQ ID NO: 263057 - DNA, 75 bp, Artificial Sequence
  Synthetic
aacccctccccacgatggatgacaccaaagtgaaaaaggtggccaatgttgtcctctgtgctctctcatcattgt

SEQ ID NO: 263058 - DNA, 75 bp, Artificial Sequence
  Synthetic
ttgtggtctctggccgccttctttctaagccggcacctgatttcaattttgtatacctgaccccccccatcgaga

SEQ ID NO: 263059 - DNA, 75 bp, Artificial Sequence
  Synthetic
gcaatgtcctctatcacaccaatgataatcaaccaacaatgcggttggtgtgtatgctctacacgccgctccgta

SEQ ID NO: 263060 - DNA, 75 bp, Artificial Sequence
  Synthetic
taagccggcacctgatttcaattttgtatacctgaccccccccatcgagagaaccatctaccggatggtcgactt

SEQ ID NO: 263061 - DNA, 75 bp, Artificial Sequence
  Synthetic
ggacttttgcaggcatagtggaatccctgatccttttggctgaactgtttggagttttctggacacccccagatg

SEQ ID NO: 263062 - DNA, 75 bp, Artificial Sequence
  Synthetic
aagaccttctctctcccagcgtgatggacgtaggtgacttcaaaatatcaatcaatgagggcctcccctccgggg

SEQ ID NO: 263063 - DNA, 75 bp, Artificial Sequence
  Synthetic
ccttccatccaatccccagtggcagaatggtagagtgcatgttgatgggacccttcttggtacaacacctgtatc

SEQ ID NO: 263064 - DNA, 75 bp, Artificial Sequence
  Synthetic
aatggtagagtgcatgttgatgggacccttcttggtacaacacctgtatctggctcttgggtttcctgctttgca

SEQ ID NO: 263065 - DNA, 75 bp, Artificial Sequence
  Synthetic
ccgtagtaatgggagggataggtttggtgctgggattcaccaaagagaaaatcggcaaaatgctttcatctgctg

SEQ ID NO: 263066 - DNA, 75 bp, Artificial Sequence
  Synthetic
gcatatgtccccggcgacagggcggccccccttgggtaccctgacttctccgggcaactggagatcgaggtgcag

SEQ ID NO: 263067 - DNA, 75 bp, Artificial Sequence
  Synthetic
ccccccttgggtaccctgacttctccgggcaactggagatcgaggtgcagactgaaaccaccaagacgggcgaca

SEQ ID NO: 263068 - DNA, 75 bp, Artificial Sequence
  Synthetic
attggcaatggtgagatccatcgaggatgcagtgctagatcttgaggccattgagaacaaccatatgactgctct

SEQ ID NO: 263069 - DNA, 75 bp, Artificial Sequence
  Synthetic
catacgcgagcctgacggccatggcctcgctcgacctggtggacgggagagttagggcagtcccacgctccatct

SEQ ID NO: 263070 - DNA, 75 bp, Artificial Sequence
  Synthetic
gatcaatcagaaggtgagtggggaaaaccatgtttggaatatgcaggtcaccaacatcaacgggaccccttttga

SEQ ID NO: 263071 - DNA, 75 bp, Artificial Sequence
  Synthetic
ctcgctcgacctggtggacgggagagttagggcagtcccacgctccatctattccttccaagatgagctcccaga

SEQ ID NO: 263072 - DNA, 75 bp, Artificial Sequence
  Synthetic
gagaggaccacggcacctactgtggagccccaatactggcccctggtaaagcgccgaagcttagcacaaagacca

SEQ ID NO: 263073 - DNA, 75 bp, Artificial Sequence
  Synthetic
agggaaaacccatctagctagagagttggcaaagaagatcgcctcctcactcacaggtgaccagagggtgggtct

SEQ ID NO: 263074 - DNA, 75 bp, Artificial Sequence
  Synthetic
tcgcacctacatgcgccagcttgacaccgctgacgccgcagcgcagccgattgactgtgccttgccccaggagtt

SEQ ID NO: 263075 - DNA, 75 bp, Artificial Sequence
  Synthetic
tcacaggtgaccagagggtgggtcttatcccacgcaacggggtcgaccactgggatgcatacaaaggtgaaagag

SEQ ID NO: 263076 - DNA, 75 bp, Artificial Sequence
  Synthetic
tatcccacgcaacggggtcgaccactgggatgcatacaaaggtgaaagagtcgttctctgggacgactacgggat

SEQ ID NO: 263077 - DNA, 75 bp, Artificial Sequence
  Synthetic
accgctgacgccgcagcgcagccgattgactgtgccttgccccaggagtttatctcctggtttgcaagcaacaac

SEQ ID NO: 263078 - DNA, 75 bp, Artificial Sequence
  Synthetic
ctttatagtgaaggctacattgctgtgtcttactcagggtccggccctctcaccttccccactgacggcttcttt

SEQ ID NO: 263079 - DNA, 75 bp, Artificial Sequence
  Synthetic
tgtcttactcagggtccggccctctcaccttccccactgacggcttctttgaggttgtcagctgggtcccccgcc

SEQ ID NO: 263080 - DNA, 75 bp, Artificial Sequence
  Synthetic
gattgagaacaaaggcaaagtctttgacagtgacgccataataataaccaccaatttggccaacccagcgccact

SEQ ID NO: 263081 - DNA, 75 bp, Artificial Sequence
  Synthetic
gtactgggctcccgatgctaggactacaacatacaatgcaggccgcttttccacccctcaaccctcgggggcatc

SEQ ID NO: 263082 - DNA, 75 bp, Artificial Sequence
  Synthetic
tgcgattggaggtggcctgatgggcataattggcaattccatctcaacagtccagaaccttcaggcaaataagca

SEQ ID NO: 263083 - DNA, 75 bp, Artificial Sequence
  Synthetic
ataattggcaattccatctcaacagtccagaaccttcaggcaaataagcaattggctgcacaacaatttggctat

SEQ ID NO: 263084 - DNA, 75 bp, Artificial Sequence
  Synthetic
aacctgacttctcacacataaaactgacattagccccgcaaggaggttttgacaagaatggtaacactcctcatg

SEQ ID NO: 263085 - DNA, 75 bp, Artificial Sequence
  Synthetic
ctccaagccaactctttcaagcatgaccttgagatgcttggcgcccaggtgcaagcccaggcgcaggctcaggag

SEQ ID NO: 263086 - DNA, 75 bp, Artificial Sequence
  Synthetic
accttgagatgcttggcgcccaggtgcaagcccaggcgcaggctcaggagaacgccatcaacatcaggtcggcgc

SEQ ID NO: 263087 - DNA, 75 bp, Artificial Sequence
  Synthetic
acgaatatgagctgcagggcccaactcccacaacattcaacttcgaccgcaacaaggtgcttgcttttaggcagc

SEQ ID NO: 263088 - DNA, 75 bp, Artificial Sequence
  Synthetic
tgttgacacaatgagggtcggatcacagctcaagaatgtcaaaactatgacagaactcaagcaggctctcaagaa

SEQ ID NO: 263089 - DNA, 75 bp, Artificial Sequence
  Synthetic
actggtcggggacacggtattacgccgccaaccagccggttacgggcttctcgggtggcttcaccccaagttaca

SEQ ID NO: 263090 - DNA, 75 bp, Artificial Sequence
  Synthetic
cgccaaccagccggttacgggcttctcgggtggcttcaccccaagttacactccaggtaggcaaatggcagtccg

SEQ ID NO: 263091 - DNA, 75 bp, Artificial Sequence
  Synthetic
tagtaatggcacagtctcaaccgtgccaaaagaggttttggactcctggacatctgcatttaacacccacagaca

SEQ ID NO: 263092 - DNA, 75 bp, Artificial Sequence
  Synthetic
gcatgtcgagaaggtgaacaacaccagtgtgcaaactaacaacgagctctccggggctttgcaccatctcaggtg

SEQ ID NO: 263093 - DNA, 75 bp, Artificial Sequence
  Synthetic
cgatcacacgccgcagacacaaggcacctacacgaacgggcggttcgtgtccttcccaaagatcgggagtagcag

SEQ ID NO: 263094 - DNA, 75 bp, Artificial Sequence
  Synthetic
tgtgtccaggaagctctctactccatcttgcaaattgctggggctgcattcattaccacgcgcattgcaaagcgc

SEQ ID NO: 263095 - DNA, 75 bp, Artificial Sequence
  Synthetic
ccttcccaaagatcgggagtagcagggcataggttggaagagaaacctttctgtgaaaatgatttctgcttactg

SEQ ID NO: 263096 - DNA, 75 bp, Artificial Sequence
  Synthetic
aaacctaaaaatgatgaggagtttgtcatctcctctgatgacatcaaaaccgagggcaagaaaggaaagaacaag

SEQ ID NO: 263097 - DNA, 75 bp, Artificial Sequence
  Synthetic
gtatcctacagtgccaaagagggggtctccggcctgcctgagctatccaccgtcaggcagccggatgagacaaac

SEQ ID NO: 263098 - DNA, 75 bp, Artificial Sequence
  Synthetic
actggccgtggcaagaagcatacagccttttccagcaaaggactcagtgatgaggagtacgatgaatataaaaga

SEQ ID NO: 263099 - DNA, 75 bp, Artificial Sequence
  Synthetic
actccatagaggaatacctacaggacagagacaaatactatgaggaggtggccatagccagggcaactgaggaag

SEQ ID NO: 263100 - DNA, 75 bp, Artificial Sequence
  Synthetic
cagagacaaatactatgaggaggtggccatagccagggcaactgaggaagacttctgtgaagaagaggaggcaaa

SEQ ID NO: 263101 - DNA, 75 bp, Artificial Sequence
  Synthetic
tatcccccctcccccacccaacggagaggatgaaatagtggtttcttatagtgtcaaggatggtgtttccggctt

SEQ ID NO: 263102 - DNA, 75 bp, Artificial Sequence
  Synthetic
ttctgagatcaggaagagaaacccagatgacttcaagcccaaagggaaactatgggccgatgatgacaggagtgt

SEQ ID NO: 263103 - DNA, 75 bp, Artificial Sequence
  Synthetic
ttcataacatcaacccatgtcattccccaaggcgcacaggagttctttggagtgcccatcaaacaaatacaaatt

SEQ ID NO: 263104 - DNA, 75 bp, Artificial Sequence
  Synthetic
cacaagtcaggtgagttctgccggcttaggttcccaaaaccaatcaggacagatgtcacaggcatgatcttggag

SEQ ID NO: 263105 - DNA, 75 bp, Artificial Sequence
  Synthetic
gaaggtgctccagaaggcactgttgccacacttctcatcaagagaccaactggagaactcatgcccttggcagcc

SEQ ID NO: 263106 - DNA, 75 bp, Artificial Sequence
  Synthetic
ccacacttctcatcaagagaccaactggagaactcatgcccttggcagccagaatgggcacccacgcgaccatga

SEQ ID NO: 263107 - DNA, 75 bp, Artificial Sequence
  Synthetic
gtacaactcctggcgattgtggttgtccctatatctacaagagagggaacgactacgtggtcattggagttcaca

SEQ ID NO: 263108 - DNA, 75 bp, Artificial Sequence
  Synthetic
tccctatatctacaagagagggaacgactacgtggtcattggagttcacactgtcgccgctcgtgggggaaacac

SEQ ID NO: 263109 - DNA, 75 bp, Artificial Sequence
  Synthetic
actccatcgcccactggctcctcactctctgtgcgctctctgaagttacaaatttgtctcctgacaccatacagg

SEQ ID NO: 263110 - DNA, 75 bp, Artificial Sequence
  Synthetic
agcaccaatattaggcccagggaatgcccccaaactcagcaccaaaaccaaattctggaggtcttccaccacccc

SEQ ID NO: 263111 - DNA, 75 bp, Artificial Sequence
  Synthetic
ccattcactgagcccagaggcaaaccacccaaaccaagtgtgctagaagccgccaagaagactataatcaatgtg

SEQ ID NO: 263112 - DNA, 75 bp, Artificial Sequence
  Synthetic
gtgaataatgatggcgtctaacgacgtcaacgttgccgctggcgacaacaccaatggcaatgaaaagcaaacaaa

SEQ ID NO: 263113 - DNA, 75 bp, Artificial Sequence
  Synthetic
tgcatcactagacaagaccacttccagcggccacccttaccacatgcggaagaacgattgctggaatggggagac

SEQ ID NO: 263114 - DNA, 75 bp, Artificial Sequence
  Synthetic
tttcacaggaaaactggcagaccaagcatcaaaggctaacctaatgtttgaggaaggaaagaacatgaccccagt

SEQ ID NO: 263115 - DNA, 75 bp, Artificial Sequence
  Synthetic
atctccccagacactctcaagagattgcacggagaatcgttcccctatacagcctttgacaacaattgctatgcc

SEQ ID NO: 263116 - DNA, 75 bp, Artificial Sequence
  Synthetic
gggttcagacctatcaaccatgatacggtgtgcacgagccttcggtgggctaatggacgaactcaaggcccattg

SEQ ID NO: 263117 - DNA, 75 bp, Artificial Sequence
  Synthetic
cgtcacactaccagtcagggttggtatgaacatgaatgaggatggacccataatatttgagaaacattccagata

SEQ ID NO: 263118 - DNA, 75 bp, Artificial Sequence
  Synthetic
tgccacgtggttatttcaatacagacaggttgccattattcgcaaataataggcgatgatgttgtaatatgaaat

SEQ ID NO: 263119 - DNA, 75 bp, Artificial Sequence
  Synthetic
tcccgttgggactcaacacaacaaagagcagtgctggctgcagccctggaaataatggtcaaattctcaccagaa

SEQ ID NO: 263120 - DNA, 75 bp, Artificial Sequence
  Synthetic
aagacctcttgtcccccagtgtgatggatgtgggtgacttcaagatatcaatcaacgagggattaccctctggtg

SEQ ID NO: 263121 - DNA, 75 bp, Artificial Sequence
  Synthetic
tgtgcactgtctgaagtcacagacctgtcccctgacatcatccaggcaaattccctgttctccttttatggtgat

SEQ ID NO: 263122 - DNA, 75 bp, Artificial Sequence
  Synthetic
ccaacccgtcctgacaaaacagaaggacccttaattatctctgaagatttggatggcctgaccttcttacggaga

SEQ ID NO: 263123 - DNA, 75 bp, Artificial Sequence
  Synthetic
ggtttggcaaactggaccaaagttcaatactcaggcagatgtactggaccaggggaccaaaccatgaggacccct

SEQ ID NO: 263124 - DNA, 75 bp, Artificial Sequence
  Synthetic
ggtgcatcgagcgaaggaggagctttccagcagaccaagacctgttgttgtgatgatatcaggcagaccagggat

SEQ ID NO: 263125 - DNA, 75 bp, Artificial Sequence
  Synthetic
catcattctacagtaaaatcagcaaattggtcatctcagaattgaaagagggtggaatggatttttacgtgccca

SEQ ID NO: 263126 - DNA, 75 bp, Artificial Sequence
  Synthetic
gttttgtgaatgaagatggcgtcgaatgacgccgctccatctaatgatggtgccgccggcctcgtcccagagatc

SEQ ID NO: 263127 - DNA, 75 bp, Artificial Sequence
  Synthetic
tcagatcccacattcctcttaaaggaggtgtggcagacccagttattgattgtctcttgccccaagagtggatcc

SEQ ID NO: 263128 - DNA, 75 bp, Artificial Sequence
  Synthetic
tggccgtggcaagaagcatacagccttctcaagtaaaggtctcagtgatgaagagtatgatgagtacaagagaat

SEQ ID NO: 263129 - DNA, 75 bp, Artificial Sequence
  Synthetic
ctggtgatatagtcaccaatggtattggctcactcgtgaacgctggggccaatgcaataaaccaaaaagtagact

SEQ ID NO: 263130 - DNA, 75 bp, Artificial Sequence
  Synthetic
atgcagatgcccctgaagtcgagaaggcgaaacgtgattttccaggccaacctgacatgtggaagaacgctttca

SEQ ID NO: 263131 - DNA, 75 bp, Artificial Sequence
  Synthetic
gacaagaatggaaacaccccacatgggaagggcgtcatgaagactctcaccactggctccctcattgcccgagca

SEQ ID NO: 263132 - DNA, 75 bp, Artificial Sequence
  Synthetic
ataatctaagtgcagcacagatcacaatgtgtccacatgtgattgtggatgtcagacagctggaaccagtcaacc

SEQ ID NO: 263133 - DNA, 75 bp, Artificial Sequence
  Synthetic
gattcgagattgcgcctaattgcaatgctgtatacacctcttagggcaaataattctggggatgatgtttttact

SEQ ID NO: 263134 - DNA, 75 bp, Artificial Sequence
  Synthetic
tgctgtatacacctcttagggcaaataattctggggatgatgtttttactgtgtcttgcagagtgctaactagac

SEQ ID NO: 263135 - DNA, 75 bp, Artificial Sequence
  Synthetic
gacaaaatgttttctaacatggctgtcactcttaaacgagccctcggggcgcggcctaaacagccccccccgagg

SEQ ID NO: 263136 - DNA, 75 bp, Artificial Sequence
  Synthetic
atgggcaccacccaactcttacctagccaaatctgtgctttcaggggcgtgctcaccagatcaacaagcagggcc

SEQ ID NO: 263137 - DNA, 75 bp, Artificial Sequence
  Synthetic
gctcaccagatcaacaagcagggccagtgaccaggccgatacagcaacccctagattgtttaattattattggca

SEQ ID NO: 263138 - DNA, 75 bp, Artificial Sequence
  Synthetic
ccaaaactaggctcattagagatttccactgagtctgatgattttgatcaaaacaaaccaacaagattcacccca

SEQ ID NO: 263139 - DNA, 75 bp, Artificial Sequence
  Synthetic
tctcaccaccttcaatttcgatcgcaataaagtgcttgcctttagacagcttgctgctgaaaataaatatggatt

SEQ ID NO: 263140 - DNA, 75 bp, Artificial Sequence
  Synthetic
ccttttcttccgctcacagttgccatcttctggtgggcgatccaacgggattctagactgcctggtcccccaaga

SEQ ID NO: 263141 - DNA, 75 bp, Artificial Sequence
  Synthetic
tgaggttcccaaaaccaatcaggactgatgtgacgggcatgatcttagaagaaggtgcgcccgaaggcaccgtgg

SEQ ID NO: 263142 - DNA, 75 bp, Artificial Sequence
  Synthetic
aataactgtccctccaaatggatactttaggtttgaatcttgggtgaaccccttttatacacttgcccccatggg

SEQ ID NO: 263143 - DNA, 75 bp, Artificial Sequence
  Synthetic
gcactacaccaggtgactgtggctgtccctacatctacaagagggaaaatgactacgtggttattggagtccaca

SEQ ID NO: 263144 - DNA, 75 bp, Artificial Sequence
  Synthetic
aatactgtaggatctttagttaatgcaggggctaatgccattaatcaaacaattgattttgaaaataataaatat

SEQ ID NO: 263145 - DNA, 75 bp, Artificial Sequence
  Synthetic
aatgcccccatgacaaaagtcctagattggaatggaacgagatactgggcaccaggtgccacctccacaacctcg

SEQ ID NO: 263146 - DNA, 75 bp, Artificial Sequence
  Synthetic
gactagggactgggtcaaccaacaaaattttaatttggaaccacacatgcctggatctcttaggacagcttttgt

SEQ ID NO: 263147 - DNA, 75 bp, Artificial Sequence
  Synthetic
gcttccaaggccaacctgatgttcgaagaggggaagaacatgaccccagtttacacaggtgcgctcaaggatgag

SEQ ID NO: 263148 - DNA, 75 bp, Artificial Sequence
  Synthetic
ctggatctcttaggacagcttttgtcactccaccatctagtacagcctctagctcaggcacagtctcaactgtgc

SEQ ID NO: 263149 - DNA, 75 bp, Artificial Sequence
  Synthetic
ccgctattcgcacaccttcgcagaaggggggagtcgaatgtttagtgaaaagattattttaaatttgatttaaat

SEQ ID NO: 263150 - DNA, 75 bp, Artificial Sequence
  Synthetic
aagaccttctctctcctagtgtgatggatgtgggtgacttcaaaatatcaatcaatgagggcctcccctctgggg

SEQ ID NO: 263151 - DNA, 75 bp, Artificial Sequence
  Synthetic
aatacttaggcaaatgtactggactaggggccccaaccatgaagacccatctgaaacaatgataccacactccca

SEQ ID NO: 263152 - DNA, 75 bp, Artificial Sequence
  Synthetic
gcttccgctgccgctgctgtcaacagcaacaacgacaacgcaaaatcttcaagtgacggagtactatctagtatg

SEQ ID NO: 263153 - DNA, 75 bp, Artificial Sequence
  Synthetic
aggccacccaccccagaactggtgaaaaagatcccacctcccccgcccaacggagaagacgaaccggtcgttcat

SEQ ID NO: 263154 - DNA, 75 bp, Artificial Sequence
  Synthetic
aaaagatcccacctcccccgcccaacggagaagacgaaccggtcgttcattatagtgctaaagatggcataactg

SEQ ID NO: 263155 - DNA, 75 bp, Artificial Sequence
  Synthetic
gagagaatagggacgctaaagagccattgaccggcaccatcttggagatgtgggatggcgagatttaccattatg

SEQ ID NO: 263156 - DNA, 75 bp, Artificial Sequence
  Synthetic
attgaccggcaccatcttggagatgtgggatggcgagatttaccattatggcctatatgtggagcgagggctggt

SEQ ID NO: 263157 - DNA, 75 bp, Artificial Sequence
  Synthetic
gtactgggctcccgatgctaggactacaacatataatgcaggccgcttttccacccctcaaccctcgggggcact

SEQ ID NO: 263158 - DNA, 75 bp, Artificial Sequence
  Synthetic
accagtgtacaccccccagtacctcatcgctcctgacaccctcaggaaactgcacggggagttatttccatacac

SEQ ID NO: 263159 - DNA, 75 bp, Artificial Sequence
  Synthetic
ccacccctcaaccctcgggggcactaccaggaagagctaatcttagggctactgtccccgcccggggttcctcca

SEQ ID NO: 263160 - DNA, 75 bp, Artificial Sequence
  Synthetic
atcgctcctgacaccctcaggaaactgcacggggagttatttccatacacggcctttgataacaactgctatgcc

SEQ ID NO: 263161 - DNA, 75 bp, Artificial Sequence
  Synthetic
taatgccggggatgatgtcttcacagtctcttgtcgagttctcacgaggccatcccccgattttgattttatatt

SEQ ID NO: 263162 - DNA, 75 bp, Artificial Sequence
  Synthetic
tgatttctcacacataaaattggcattggctccacaaggtggctttgacaagaacgggaacaccccacacgggaa

SEQ ID NO: 263163 - DNA, 75 bp, Artificial Sequence
  Synthetic
catcccccgattttgattttatattccttgtgccacccacagttgaatcaagaaccaaaccattcactgtcccaa

SEQ ID NO: 263164 - DNA, 75 bp, Artificial Sequence
  Synthetic
aggccttaccaagattggaataggaagcccctccccaccatggatgactccaagttgaagaaggtggccaacata

SEQ ID NO: 263165 - DNA, 75 bp, Artificial Sequence
  Synthetic
cttttgtgtgccttgtcatcactattcactagacccatcaaggacataattgggaaactcaggcctctcaatatc

SEQ ID NO: 263166 - DNA, 75 bp, Artificial Sequence
  Synthetic
cttttgttgtccaaccacaaaatggcagatgtacgactgatggcgtgctcttaggcactacccagctgtcagctg

SEQ ID NO: 263167 - DNA, 75 bp, Artificial Sequence
  Synthetic
tgtctgcgatgatcgcccccttactgggtgactacgagctgcaaggacccgaagatcttgctgtggaacttgtac

SEQ ID NO: 263168 - DNA, 75 bp, Artificial Sequence
  Synthetic
cttccaccctgaggacctgcaaagaccttggcgcctatgggctggaaattctgaaactggtcatgaaatggtttt

SEQ ID NO: 263169 - DNA, 75 bp, Artificial Sequence
  Synthetic
ccttggcgcctatgggctggaaattctgaaactggtcatgaaatggtttttcccaaagaaagaagaggcaaacga

SEQ ID NO: 263170 - DNA, 75 bp, Artificial Sequence
  Synthetic
actcaaagacaaagatagcctcgcgacatacatgaggactcttgatttggaggaagaaaaggccagaaagctctc

SEQ ID NO: 263171 - DNA, 75 bp, Artificial Sequence
  Synthetic
acatacatgaggactcttgatttggaggaagaaaaggccagaaagctctccactaagtccgcttcacctgatata

SEQ ID NO: 263172 - DNA, 75 bp, Artificial Sequence
  Synthetic
tccagcaggctaaggccagttgttgtgatgatatctggcaaacctggcatcgggaagacccatctggctagagaa

SEQ ID NO: 263173 - DNA, 75 bp, Artificial Sequence
  Synthetic
tgatgatatctggcaaacctggcatcgggaagacccatctggctagagaattggcaaagaagatcgctataaccc

SEQ ID NO: 263174 - DNA, 75 bp, Artificial Sequence
  Synthetic
tcgttctctgggacgattatgggatgagtaaccccgtccatgatgccctaagactccaagaacttgctgacacct

SEQ ID NO: 263175 - DNA, 75 bp, Artificial Sequence
  Synthetic
gagtaaccccgtccatgatgccctaagactccaagaacttgctgacacctgccctttgaccctaaactgtgacag

SEQ ID NO: 263176 - DNA, 75 bp, Artificial Sequence
  Synthetic
agtaacctacaacaggcttccttccaacatgataaagagatgctccaagcacagattgaggctactcaaaaattg

SEQ ID NO: 263177 - DNA, 75 bp, Artificial Sequence
  Synthetic
atatgtgccacccaggggggtgaaggggaagctacacttgaaggtggtgacagtaagggaacatactgtggtgca

SEQ ID NO: 263178 - DNA, 75 bp, Artificial Sequence
  Synthetic
tgattatgtcaactttgaagcttgctccaggcgcattgacttccttgtgtatgccgatgcacctgacgttgagaa

SEQ ID NO: 263179 - DNA, 75 bp, Artificial Sequence
  Synthetic
tccaggcgcattgacttccttgtgtatgccgatgcacctgacgttgagaaagcgaagcgcgacttcccgggacaa

SEQ ID NO: 263180 - DNA, 75 bp, Artificial Sequence
  Synthetic
agggaagctaaggcctcttaacatcctcaacatcttggcctcatgtgattggacttttgcaggcatagtggagtc

SEQ ID NO: 263181 - DNA, 75 bp, Artificial Sequence
  Synthetic
gacaaaaatggcaacaccccacacgggaaaggtgtcatgaagaccctcacaacaggctccctcattgcccgtgct

SEQ ID NO: 263182 - DNA, 75 bp, Artificial Sequence
  Synthetic
ggaaaggtgtcatgaagaccctcacaacaggctccctcattgcccgtgcttcagggctcctccatgaacgattgg

SEQ ID NO: 263183 - DNA, 75 bp, Artificial Sequence
  Synthetic
cactttctaatgcttctactgccacttctgtgtattcaaatcaaactgtttccacgagactaggttcttcagctg

SEQ ID NO: 263184 - DNA, 75 bp, Artificial Sequence
  Synthetic
ttgccgctgaaaacaaatatggcctggtggacacaatgagagtgggtggacaactcaagggtgtcagaactatac

SEQ ID NO: 263185 - DNA, 75 bp, Artificial Sequence
  Synthetic
ggtggacacaatgagagtgggtggacaactcaagggtgtcagaactataccagaactcaagcaggccctcaagaa

SEQ ID NO: 263186 - DNA, 75 bp, Artificial Sequence
  Synthetic
ctcttctccttctatggtgatgatgaaattgttagtacagacataaaattagacccagagaagttgacagcaaag

SEQ ID NO: 263187 - DNA, 75 bp, Artificial Sequence
  Synthetic
gaaagtggaaaaagtgcaaaataccaacatccaaatcaacaacgagctagctggtgctttacaccacctccgatg

SEQ ID NO: 263188 - DNA, 75 bp, Artificial Sequence
  Synthetic
aacatccaaatcaacaacgagctagctggtgctttacaccacctccgatgcgctaggatcaggtactatgttaaa

SEQ ID NO: 263189 - DNA, 75 bp, Artificial Sequence
  Synthetic
ggtttgactttcctgcggagaactgtgacccgcgacccagctggttggtttggaaaactggagcagagctcaata

SEQ ID NO: 263190 - DNA, 75 bp, Artificial Sequence
  Synthetic
atgaacatacaaaacttgtggtcaaggcctccagtaggagatgcggaggaggtcactagccaggatggttgccca

SEQ ID NO: 263191 - DNA, 75 bp, Artificial Sequence
  Synthetic
ggcctccagtaggagatgcggaggaggtcactagccaggatggttgcccaaagcccaaagatgatgaggagttcg

SEQ ID NO: 263192 - DNA, 75 bp, Artificial Sequence
  Synthetic
ccttctcgagcaagggtctcagtgatgaggagtacgatgagtacaaaagaatcagggaagaaaggaatggtaagt

SEQ ID NO: 263193 - DNA, 75 bp, Artificial Sequence
  Synthetic
caaacttcataaatcaggctatgtcacagtggctcacaccggccagcatgatttggtcatcccccccaatggcta

SEQ ID NO: 263194 - DNA, 75 bp, Artificial Sequence
  Synthetic
acagtggctcacaccggccagcatgatttggtcatcccccccaatggctattttaggtttgattcctgggttaat

SEQ ID NO: 263195 - DNA, 75 bp, Artificial Sequence
  Synthetic
tgaggagtacgatgagtacaaaagaatcagggaagaaaggaatggtaagtactccatagaagaataccttcagga

SEQ ID NO: 263196 - DNA, 75 bp, Artificial Sequence
  Synthetic
gatccgacagaggatatttaggccaacgaggaagcaacgcaaggaggagagggcttcccttggccttgtcactgg

SEQ ID NO: 263197 - DNA, 75 bp, Artificial Sequence
  Synthetic
acgaggaagcaacgcaaggaggagagggcttcccttggccttgtcactggctcagagatcagaaagagaaaccca

SEQ ID NO: 263198 - DNA, 75 bp, Artificial Sequence
  Synthetic
gaggcccccccgagcatctggtcaaggatagtcaactttgggtcaggatgggggttctgggtgtcccctagcctg

SEQ ID NO: 263199 - DNA, 75 bp, Artificial Sequence
  Synthetic
ggatagtcaactttgggtcaggatgggggttctgggtgtcccctagcctgtttattacatcaacccatgttatac

SEQ ID NO: 263200 - DNA, 75 bp, Artificial Sequence
  Synthetic
gaggaccttgcagtagaactagtcccaatagtgatgggggggataggtttggtgctaggatttaccaaagagaaa

SEQ ID NO: 263201 - DNA, 75 bp, Artificial Sequence
  Synthetic
tgagattccctaaatcaatcagaactgctgtaacaggcatgatcctagaagagggggccccagaaggaaccgtgg

SEQ ID NO: 263202 - DNA, 75 bp, Artificial Sequence
  Synthetic
tgctgtaacaggcatgatcctagaagagggggccccagaaggaaccgtggtctcactactcatcaagagaccaac

SEQ ID NO: 263203 - DNA, 75 bp, Artificial Sequence
  Synthetic
tcccaaagaaagaggaagcaaacgaattggctatggtgagatccatcgaggatgcggtgctggacctcgaggcaa

SEQ ID NO: 263204 - DNA, 75 bp, Artificial Sequence
  Synthetic
tcagatgggtatgttgctaacagggtccaatgctaaaagcatggatttgggcacgacacctggtgactgtggctg

SEQ ID NO: 263205 - DNA, 75 bp, Artificial Sequence
  Synthetic
tccaatgctaaaagcatggatttgggcacgacacctggtgactgtggctgcccctatatttataagagaggcaat

SEQ ID NO: 263206 - DNA, 75 bp, Artificial Sequence
  Synthetic
tattgagatttgtgaatccagacacgggtagggtcctgtttgagtgcaaacttcataaatcaggctatgtcacag

SEQ ID NO: 263207 - DNA, 75 bp, Artificial Sequence
  Synthetic
gaaggtgaggccacgctcgaaggcggtgataacaaaggcacctactgtggagctccaatactaggccctggtaac

SEQ ID NO: 263208 - DNA, 75 bp, Artificial Sequence
  Synthetic
gtgataacaaaggcacctactgtggagctccaatactaggccctggtaacgctcccaagctcagcaccaagacta

SEQ ID NO: 263209 - DNA, 75 bp, Artificial Sequence
  Synthetic
gggtgaagggtggaccttcactacaacaagtcatgagagaccagctaaaaccattcactgagcctaggggcaaac

SEQ ID NO: 263210 - DNA, 75 bp, Artificial Sequence
  Synthetic
acaagtcatgagagaccagctaaaaccattcactgagcctaggggcaaaccacccaagccaagtgtgctggaagc

SEQ ID NO: 263211 - DNA, 75 bp, Artificial Sequence
  Synthetic
gtaatctacaacaggcttcctttcaacatgataaagagatgctccaagcacaaattgaggccactaaaaagttgc

SEQ ID NO: 263212 - DNA, 75 bp, Artificial Sequence
  Synthetic
tgcgtcgcttgataaaaccacctccagcggccacccccaccacatacggaagaacgattgctggaatggggagtc

SEQ ID NO: 263213 - DNA, 75 bp, Artificial Sequence
  Synthetic
agcggccacccccaccacatacggaagaacgattgctggaatggggagtcttttacaggaaaattggcagatcaa

SEQ ID NO: 263214 - DNA, 75 bp, Artificial Sequence
  Synthetic
ctggtcaagactgacaagatctatgggcagatcaagaaaaggcttctttggggctctgacttggcaacaatgatc

SEQ ID NO: 263215 - DNA, 75 bp, Artificial Sequence
  Synthetic
ggcagatcaagaaaaggcttctttggggctctgacttggcaacaatgatccgttgtgcgcgggcgtttggagggt

SEQ ID NO: 263216 - DNA, 75 bp, Artificial Sequence
  Synthetic
gaggatgacatagtggtttcttataatgttaaagatggtgtctctggtttgcctgatctttccaccgtcaggcaa

SEQ ID NO: 263217 - DNA, 75 bp, Artificial Sequence
  Synthetic
taatttttgaaaagcactccaggttctcataccactatgatgcagattactcacgctgggactcaacccaacaga

SEQ ID NO: 263218 - DNA, 75 bp, Artificial Sequence
  Synthetic
ctcataccactatgatgcagattactcacgctgggactcaacccaacagagggcagtgctagctgcagccttgga

SEQ ID NO: 263219 - DNA, 75 bp, Artificial Sequence
  Synthetic
gtgtatggtggctgcacttataggcttgagtctgatggcaagggtgatgtgaaagttgacagagttcagaacgcc

SEQ ID NO: 263220 - DNA, 75 bp, Artificial Sequence
  Synthetic
ggatgtaggtgatttcaaaataacaattaatgagggactgccctcgggagtaccctgcacatcacagtggaattc

SEQ ID NO: 263221 - DNA, 75 bp, Artificial Sequence
  Synthetic
attaatgagggactgccctcgggagtaccctgcacatcacagtggaattccatcgcccactggctcctcacactc

SEQ ID NO: 263222 - DNA, 75 bp, Artificial Sequence
  Synthetic
tgtgaccacgcgcattgtcaagcgcatgaacatacaagacctctggtccaagccacaggtagaggatacagagga

SEQ ID NO: 263223 - DNA, 75 bp, Artificial Sequence
  Synthetic
gatgaaatcgtaagtactgacataaaattagacccagagaaactcacagcaaaactcaaagaatacggactcaaa

SEQ ID NO: 263224 - DNA, 75 bp, Artificial Sequence
  Synthetic
tgaggagtacgatgagtacaagagaatcagagaagagaggaatggcaagtactccatagaagagtaccttcagga

SEQ ID NO: 263225 - DNA, 75 bp, Artificial Sequence
  Synthetic
aattagacccagagaaactcacagcaaaactcaaagaatacggactcaaaccaacccgcccggacaaaactgaag

SEQ ID NO: 263226 - DNA, 75 bp, Artificial Sequence
  Synthetic
cgagggcaagaaggggaagaacaaatctggccgtggtaagaagcacacggcattctcaagtaaaggtctcagtga

SEQ ID NO: 263227 - DNA, 75 bp, Artificial Sequence
  Synthetic
ggtttggcaagttggaccagagttcaattctcaggcagatatactggactaggggccccaaccatgaggacccgt

SEQ ID NO: 263228 - DNA, 75 bp, Artificial Sequence
  Synthetic
gaggcctatacagctgatgtctcttttgggtgaagcagccttgcatggtccaacattttacaccaaaatcagtaa

SEQ ID NO: 263229 - DNA, 75 bp, Artificial Sequence
  Synthetic
ccacatttggctcaggtagtcgcagaagaccttctttctcctagcgtggtggacgtgggtgacttcacaatatca

SEQ ID NO: 263230 - DNA, 75 bp, Artificial Sequence
  Synthetic
aggtaaaattttgtaataggatgccagtgggcaccatattcagatttgatttaattagattgctttaattaaatt

SEQ ID NO: 263231 - DNA, 75 bp, Artificial Sequence
  Synthetic
ggatagtcaactttggttcaggttggggcttttgggtttcccccagcctgttcataacatcaacccatgtcatac

SEQ ID NO: 263232 - DNA, 75 bp, Artificial Sequence
  Synthetic
agaatgggaacccatgcaaccatgaagattcaagggcgcacagttggaggacaaatgggcatgctcctgacaggg

SEQ ID NO: 263233 - DNA, 75 bp, Artificial Sequence
  Synthetic
atagacccttggattagagcaaattttgtccaggcccctaatggtgaatttacagtttctccccgtaatgcccct

SEQ ID NO: 263234 - DNA, 75 bp, Artificial Sequence
  Synthetic
ggtgaagtgctattaaatctagaattgggtccagaattaaatccttatctggcacatttagcaagaatgtacaac

SEQ ID NO: 263235 - DNA, 75 bp, Artificial Sequence
  Synthetic
gctgtaccacctcatttcccggttgaaaaccttagtccacagcaaattaccatgttccctcatgtgattatagat

SEQ ID NO: 263236 - DNA, 75 bp, Artificial Sequence
  Synthetic
aaaaccttagtccacagcaaattaccatgttccctcatgtgattatagatgttaggactttggaacctgttttat

SEQ ID NO: 263237 - DNA, 75 bp, Artificial Sequence
  Synthetic
gtctgatggcaagggcaatgtgaaggttgacagagttcaaagcacctccgtgcagaccaacaatgagctggctgg

SEQ ID NO: 263238 - DNA, 75 bp, Artificial Sequence
  Synthetic
tgctttatactcccctcaggtccaatggttctggtgatgatgtgttcacagtctcttgcagggtgttgactagac

SEQ ID NO: 263239 - DNA, 75 bp, Artificial Sequence
  Synthetic
tggttctggtgatgatgtgttcacagtctcttgcagggtgttgactagaccctcccctgattttgattttacata

SEQ ID NO: 263240 - DNA, 75 bp, Artificial Sequence
  Synthetic
ttctagatttccagtgtccatagatcagatgtacactagccccaatgaagtcatatctgtgcagtgccagaatgg

SEQ ID NO: 263241 - DNA, 75 bp, Artificial Sequence
  Synthetic
cagatgtacactagccccaatgaagtcatatctgtgcagtgccagaatggaaggtgcacactggatggggagctc

SEQ ID NO: 263242 - DNA, 75 bp, Artificial Sequence
  Synthetic
cgcttcccttgacaagaccacttccagcggtcatccgcaccatatgcgaaaaaatgactgttggaacggggagtc

SEQ ID NO: 263243 - DNA, 75 bp, Artificial Sequence
  Synthetic
gatcacctatacaacatcaccatcacaaacttgaatgggtccccttttgatccctctgaggacatccccgccccc

SEQ ID NO: 263244 - DNA, 75 bp, Artificial Sequence
  Synthetic
ttctgggtctcccccagtttgttcataacatcaacccatgtcataccccagggagcaaaggagttctttggagtc

SEQ ID NO: 263245 - DNA, 75 bp, Artificial Sequence
  Synthetic
caaacttgaatgggtccccttttgatccctctgaggacatccccgcccccctgggtgtgcccgactttcagggaa

SEQ ID NO: 263246 - DNA, 75 bp, Artificial Sequence
  Synthetic
cccatcaaacaaattcaggtacacaagtcaggcgaattctgtcgcttgagattcccaaaaccaatcaggactgat

SEQ ID NO: 263247 - DNA, 75 bp, Artificial Sequence
  Synthetic
agaagaaatcccagcccctctgggaactccagatttcgtgggaaagatccaaggcgtgctcacccaaaccacaag

SEQ ID NO: 263248 - DNA, 75 bp, Artificial Sequence
  Synthetic
atgctgtggtccccacttacacagcccagtataccccaaaattgggtcaggttcaaattggcacatggcagaccg

SEQ ID NO: 263249 - DNA, 75 bp, Artificial Sequence
  Synthetic
tggggacccatgcaaccatgaaaatccaaggacgcactgttggaggccagatgggcatgcttctgacaggatcca

SEQ ID NO: 263250 - DNA, 75 bp, Artificial Sequence
  Synthetic
ccagtataccccaaaattgggtcaggttcaaattggcacatggcagaccgacgatcttaaagtcaaccaaccagt

SEQ ID NO: 263251 - DNA, 75 bp, Artificial Sequence
  Synthetic
tgtcacactacccgtcagagtgggtatgaatatgaatgaggatggtcctatcatctttgagagacactccagata

SEQ ID NO: 263252 - DNA, 75 bp, Artificial Sequence
  Synthetic
aaatctaaacacaaatcttgccccctctgttgctccagtgtttccaggggagcgtctgctcttctttagatcata

SEQ ID NO: 263253 - DNA, 75 bp, Artificial Sequence
  Synthetic
tctgttgctccagtgtttccaggggagcgtctgctcttctttagatcatacctcccccttaagggtggttatgga

SEQ ID NO: 263254 - DNA, 75 bp, Artificial Sequence
  Synthetic
tccaacgacttctttgacaatgaacccattaaattcacaccagttgggattagtgttgatagccaaaacagctac

SEQ ID NO: 263255 - DNA, 75 bp, Artificial Sequence
  Synthetic
gaggtagcccttgtcagatacatcaatccggacactggccgggcgctgtttgaggccaaactccacagagctggt

SEQ ID NO: 263256 - DNA, 75 bp, Artificial Sequence
  Synthetic
cggatacttcagatttgactcttgggtgaaccaattttattctcttgcccccatgggaactggaaatgggcgtag

SEQ ID NO: 263257 - DNA, 75 bp, Artificial Sequence
  Synthetic
acagtggctcacactggccagcatgatttggttatcccccccaatggctattttagatttgattcctgggtcaac

SEQ ID NO: 263258 - DNA, 75 bp, Artificial Sequence
  Synthetic
attaatgcaggtgctaatgcaataaatcagagagcagaatttgattttaatcagaaattacagcaaaattctttt

SEQ ID NO: 263259 - DNA, 75 bp, Artificial Sequence
  Synthetic
ctcagattcaggcaactaagcagctgcaggcagacatgatggctataaagcagggggttctgaccgctggcggct

SEQ ID NO: 263260 - DNA, 75 bp, Artificial Sequence
  Synthetic
gcaggcagacatgatggctataaagcagggggttctgaccgctggcggcttttcccctactgatgcagccagagg

SEQ ID NO: 263261 - DNA, 75 bp, Artificial Sequence
  Synthetic
tacatcctactctgggaggttcacatcgaccgccccggcaaggcaggccgatcttcaacacactcaaaatcggcc

SEQ ID NO: 263262 - DNA, 75 bp, Artificial Sequence
  Synthetic
attgacccctggattagaaataattttgtacaagcccctggtggagagttcacagtgtcccctagaaatgctcca

SEQ ID NO: 263263 - DNA, 75 bp, Artificial Sequence
  Synthetic
tatgccactcaatcttcaagaccaactctaaccacaaccacagggtcctcacatagtacaacctcatccaattcg

SEQ ID NO: 263264 - DNA, 75 bp, Artificial Sequence
  Synthetic
aatagaaatttggaaccctacatgcatggtgccttacagacagcctttgtcaccccaccttccagcagggcatct

SEQ ID NO: 263265 - DNA, 75 bp, Artificial Sequence
  Synthetic
cttgagccccagccaggtcactatgttcccccacataatagtagatgttaggcaattggaacctgtgttgatccc

SEQ ID NO: 263266 - DNA, 75 bp, Artificial Sequence
  Synthetic
tgcgttcaacacccgcaggcagccgctttttgcacacctccgtaagaggggggagtcacaagcttagtgaaaagg

SEQ ID NO: 263267 - DNA, 75 bp, Artificial Sequence
  Synthetic
aagacaaaacccttttccctccctattctgactatctccgaaatgtccaattctaggttcccagtaccaattgat

SEQ ID NO: 263268 - DNA, 75 bp, Artificial Sequence
  Synthetic
cctttgacaacaattgctatgccttctgttgttgggtcctggatctaaatgactcgtggctgagtaggagaatga

SEQ ID NO: 263269 - DNA, 75 bp, Artificial Sequence
  Synthetic
gatccagagaacaactggtttcttcagaccctaccaagattggaataggaaacccctccccactatggatgattc

SEQ ID NO: 263270 - DNA, 75 bp, Artificial Sequence
  Synthetic
ctcaacatcttggcctcatgtgattggactttcgcaggcatagtggaatccttgatactcttggcagagctcttt

SEQ ID NO: 263271 - DNA, 75 bp, Artificial Sequence
  Synthetic
ccactgagtctggagattttgaccaaaaccaaccaacaagattcaccccagttggcattggggttgaccatgagc

SEQ ID NO: 263272 - DNA, 75 bp, Artificial Sequence
  Synthetic
ttctggtaccagtgtctcgagcctcccgtcaactgcaagggctaggagctgggttgaggatcaaaataggaattt

SEQ ID NO: 263273 - DNA, 75 bp, Artificial Sequence
  Synthetic
atgggtgcagcatttctaccaagaatcagccccctcccaaactcaagtggccctagttaggtatgtcaaccctga

SEQ ID NO: 263274 - DNA, 75 bp, Artificial Sequence
  Synthetic
accacctactccagaactggtcaaaaagatccctcctcccccgcccaacggagaggacgaagtagtggtttctta

SEQ ID NO: 263275 - DNA, 75 bp, Artificial Sequence
  Synthetic
tagacacaatgaaagttgggaggcagctcaaggatgtcaaaaccatgccagaacttaaacaagcactcaaaaata

SEQ ID NO: 263276 - DNA, 75 bp, Artificial Sequence
  Synthetic
taaaacgaaccaggcccccaaacccacccccaacagtgggtcctcagtgaggtcaaattcaacccaaattaccag

SEQ ID NO: 263277 - DNA, 75 bp, Artificial Sequence
  Synthetic
tcgtaggcgaggggagtcacgggtgtaatgtgaaaagacaaaattgattatctttctttttctttagtgtctttt

SEQ ID NO: 263278 - DNA, 75 bp, Artificial Sequence
  Synthetic
atgaagatggcgtctaacgacgcttccgctgccgctgttgctaacagcaacaacgacaccgtaaaatcttcaagt

SEQ ID NO: 263279 - DNA, 75 bp, Artificial Sequence
  Synthetic
ccaaaaatgttttggactcctggacatctgcgtttaatacgcgcagacagccgctattcgcacaccttcgcagaa

SEQ ID NO: 263280 - DNA, 75 bp, Artificial Sequence
  Synthetic
ggggggagtcaaatgtttagtgaaaaggttattttaaatttggtttaagattggatttaatttggaatcttttaa

SEQ ID NO: 263281 - DNA, 75 bp, Artificial Sequence
  Synthetic
tgtgttcaggaggccctgtattccatcatccaaattgctggagctgcatttgtcaccacgcgcatcgtcaagcgc

SEQ ID NO: 263282 - DNA, 75 bp, Artificial Sequence
  Synthetic
tcatccaaattgctggagctgcatttgtcaccacgcgcatcgtcaagcgcatgaacatacaagacctctggtcca

SEQ ID NO: 263283 - DNA, 75 bp, Artificial Sequence
  Synthetic
gcctgatctttccaccgtcaggcaaccggaagaatccaacacggccttcagtgtccctccactcaatcagaggga

SEQ ID NO: 263284 - DNA, 75 bp, Artificial Sequence
  Synthetic
gtctgatggcaagggtaatgtgaaagttgacagagttcagagcacctccgttcagaccaacaatgagctggctgg

SEQ ID NO: 263285 - DNA, 75 bp, Artificial Sequence
  Synthetic
gtgaatgatgatggcgtcgaaagacgtcgttgcagctactgctgctagcagtaacaatgctagtgacaatagtaa

SEQ ID NO: 263286 - DNA, 75 bp, Artificial Sequence
  Synthetic
gattcggcaaaggattttcagaccaacaaggaaacaacgcaaggaggaaagggcctctctcggtttagtcacagg

SEQ ID NO: 263287 - DNA, 75 bp, Artificial Sequence
  Synthetic
gtaacaatgctagtgacaatagtaacaccattaaggatcgcctattggcgaaacttaagaatataggcagtaaca

SEQ ID NO: 263288 - DNA, 75 bp, Artificial Sequence
  Synthetic
caccattaaggatcgcctattggcgaaacttaagaatataggcagtaacaacaagcctataaaaatagaaaacac

SEQ ID NO: 263289 - DNA, 75 bp, Artificial Sequence
  Synthetic
gggaaataccacaaagacccccacgaccacccactccagaactggtcaaaaagatccctcctcccccgcccaacg

SEQ ID NO: 263290 - DNA, 75 bp, Artificial Sequence
  Synthetic
ccgcgcccccagaagtgtagtggaaacccagcaggccatgggttgggtggaacaaccactggaccagaacctacc

SEQ ID NO: 263291 - DNA, 75 bp, Artificial Sequence
  Synthetic
acccagcaggccatgggttgggtggaacaaccactggaccagaacctaccaacctgggaagagttgagcgagtcc

SEQ ID NO: 263292 - DNA, 75 bp, Artificial Sequence
  Synthetic
cacaaatcaggcgaattctgccgcttgaggttcccaaagccaatcaggactgatgtgacgggcatgatcctagaa

SEQ ID NO: 263293 - DNA, 75 bp, Artificial Sequence
  Synthetic
acacatgatcgtggcagggaagagggtcctctagggcaccaagtgaagtggactgctgcttctggtgtggacctt

SEQ ID NO: 263294 - DNA, 75 bp, Artificial Sequence
  Synthetic
gtcctctagggcaccaagtgaagtggactgctgcttctggtgtggaccttggagttgttgatctcacaacagtta

SEQ ID NO: 263295 - DNA, 75 bp, Artificial Sequence
  Synthetic
ttggtgatatgctggagttttatgagggccacatttaccactacgccatatatattgggcagggaaaatctattg

SEQ ID NO: 263296 - DNA, 75 bp, Artificial Sequence
  Synthetic
gggccacatttaccactacgccatatatattgggcagggaaaatctattggggtccattcaccacaagccgcatt

SEQ ID NO: 263297 - DNA, 75 bp, Artificial Sequence
  Synthetic
attaacctatgaccagctcaaggagttggagaatgagccatggccatatgcggcagtgaccaacaactgctatga

SEQ ID NO: 263298 - DNA, 75 bp, Artificial Sequence
  Synthetic
ttggagaatgagccatggccatatgcggcagtgaccaacaactgctatgaattctgttgccaggttatgggtgtg

SEQ ID NO: 263299 - DNA, 75 bp, Artificial Sequence
  Synthetic
acaccagattttcagcaagatagcaaattagaaattgttagggatgctgtcttagctgcaatcaatggccttgtc

SEQ ID NO: 263300 - DNA, 75 bp, Artificial Sequence
  Synthetic
aattagaaattgttagggatgctgtcttagctgcaatcaatggccttgtctcaaaaccatttaaagatctccttg

SEQ ID NO: 263301 - DNA, 75 bp, Artificial Sequence
  Synthetic
tgatacttcttatggagctgtttggtgtgttttggaatccacctgatgtgtcaagcttcatcgcatcacttttgc

SEQ ID NO: 263302 - DNA, 75 bp, Artificial Sequence
  Synthetic
tgtgttttggaatccacctgatgtgtcaagcttcatcgcatcacttttgcctgacatgcatttacaaggccctga

SEQ ID NO: 263303 - DNA, 75 bp, Artificial Sequence
  Synthetic
cacaaaggtcatgaaaagtgcagttgaaggccttcgtgctgcaactcagcttggccaatatggtcttgagatctt

SEQ ID NO: 263304 - DNA, 75 bp, Artificial Sequence
  Synthetic
gaaggccttcgtgctgcaactcagcttggccaatatggtcttgagatcttcgcagtccttaagaagtatttcttt

SEQ ID NO: 263305 - DNA, 75 bp, Artificial Sequence
  Synthetic
tcatctttgagaggcattccaggtacaaatatcactatgatgctgattactctcggtgggattcaacacaacaga

SEQ ID NO: 263306 - DNA, 75 bp, Artificial Sequence
  Synthetic
gctataacacaactagtgagagacaaacaatctgcccgaacatacatggccatcctagacgctgaggaggagaaa

SEQ ID NO: 263307 - DNA, 75 bp, Artificial Sequence
  Synthetic
aacaatctgcccgaacatacatggccatcctagacgctgaggaggagaaagctagaaagctctctgttaaacatg

SEQ ID NO: 263308 - DNA, 75 bp, Artificial Sequence
  Synthetic
gtgaatgatgatggcgtcaaaagacgctattgccgttgctgatgtcagcaataacaatgctaacaccaacaatga

SEQ ID NO: 263309 - DNA, 75 bp, Artificial Sequence
  Synthetic
gctattgccgttgctgatgtcagcaataacaatgctaacaccaacaatgaaaacattgggtctcgccttatggcg

SEQ ID NO: 263310 - DNA, 75 bp, Artificial Sequence
  Synthetic
cacaggccgagatgactaacagggttaaacctgtggtcattatgatgtgtggtccaccaggcattggtaagacga

SEQ ID NO: 263311 - DNA, 75 bp, Artificial Sequence
  Synthetic
taaacctgtggtcattatgatgtgtggtccaccaggcattggtaagacgaaggccgctgagtatctagccaagcg

SEQ ID NO: 263312 - DNA, 75 bp, Artificial Sequence
  Synthetic
cttcttcgccggtcacaaacaccctccccatcccggcaagaccaccccccaaaagaccaaagagatcgtccaccg

SEQ ID NO: 263313 - DNA, 75 bp, Artificial Sequence
  Synthetic
ccccatcccggcaagaccaccccccaaaagaccaaagagatcgtccaccgcgcactgctatggaggtgaggaaga

SEQ ID NO: 263314 - DNA, 75 bp, Artificial Sequence
  Synthetic
tcatggtgaagaagttatgttgtgggatgattatgggatgtcaaagatagctgatgactgcaataagttacaggc

SEQ ID NO: 263315 - DNA, 75 bp, Artificial Sequence
  Synthetic
gatgattatgggatgtcaaagatagctgatgactgcaataagttacaggccattgctgacacagcacctttaacc

SEQ ID NO: 263316 - DNA, 75 bp, Artificial Sequence
  Synthetic
aagaggagataatgcgcaataacgagaagctctttgatgctgggggggttgctcctgcaattttaccaagcacat

SEQ ID NO: 263317 - DNA, 75 bp, Artificial Sequence
  Synthetic
gaagctctttgatgctgggggggttgctcctgcaattttaccaagcacattcgagagagccacgccacacgaaag

SEQ ID NO: 263318 - DNA, 75 bp, Artificial Sequence
  Synthetic
ggcccagcacctgtcgattttgttaacctgggaccggtgtgtcggcgcgtggacttcctcgtttattgttcagct

SEQ ID NO: 263319 - DNA, 75 bp, Artificial Sequence
  Synthetic
ctgggagaggccgcactccacggcccagcattctacagcaaaattagcaagttagttattgcagagctaaaagaa

SEQ ID NO: 263320 - DNA, 75 bp, Artificial Sequence
  Synthetic
ccgtggccctccttggaatatgtgccccctgccacctttggaggctcgcaacagtggacctgcaagagagcccct

SEQ ID NO: 263321 - DNA, 75 bp, Artificial Sequence
  Synthetic
cccctgccacctttggaggctcgcaacagtggacctgcaagagagccccttataggggatatggttgagttttat

SEQ ID NO: 263322 - DNA, 75 bp, Artificial Sequence
  Synthetic
acctgggaccggtgtgtcggcgcgtggacttcctcgtttattgttcagctccagacgtggaacagacccgccgca

SEQ ID NO: 263323 - DNA, 75 bp, Artificial Sequence
  Synthetic
cacaaggtggttttgacaaccaaggcaacacaccatttgggaagggcactatgcgcccaaccacattgaacagac

SEQ ID NO: 263324 - DNA, 75 bp, Artificial Sequence
  Synthetic
tcttccaccctaaagaaagccctcggggctcggcccaaacagcctgccccgagggacaactcacaaaagccccca

SEQ ID NO: 263325 - DNA, 75 bp, Artificial Sequence
  Synthetic
ttttctatacctagaataactatccatccattagtagcttggtggcgggtgtgttacacacccacagaccaacaa

SEQ ID NO: 263326 - DNA, 75 bp, Artificial Sequence
  Synthetic
atccattagtagcttggtggcgggtgtgttacacacccacagaccaacaaagactcacctatgaccaattaagag

SEQ ID NO: 263327 - DNA, 75 bp, Artificial Sequence
  Synthetic
caacacaccatttgggaagggcactatgcgcccaaccacattgaacagactgctgatacaggctgtggcacttac

SEQ ID NO: 263328 - DNA, 75 bp, Artificial Sequence
  Synthetic
tgaaccccaacaatgggtgctcccaagttattcaggtagagatgttcataatgtgcacctagcccctgctgtagc

SEQ ID NO: 263329 - DNA, 75 bp, Artificial Sequence
  Synthetic
tttgaggttaagagtggaatctctggcctgcccgagctcacgacagttccccaaccagatgtgaccaatacggca

SEQ ID NO: 263330 - DNA, 75 bp, Artificial Sequence
  Synthetic
tagtctagctcgtgccaatgggctgggccttatagatatggctaaactagggaaaagactaaggagtgtggactc

SEQ ID NO: 263331 - DNA, 75 bp, Artificial Sequence
  Synthetic
ttgatgacacttggctccaacgaaaattggtcaccactggaaaatttaaccaccccacacaggaatggtcaaaag

SEQ ID NO: 263332 - DNA, 75 bp, Artificial Sequence
  Synthetic
attggtcaccactggaaaatttaaccaccccacacaggaatggtcaaaagacactcctgactttcaccaagattc

SEQ ID NO: 263333 - DNA, 75 bp, Artificial Sequence
  Synthetic
ggccttatagatatggctaaactagggaaaagactaaggagtgtggactctattcatggccttaagaatgcactc

SEQ ID NO: 263334 - DNA, 75 bp, Artificial Sequence
  Synthetic
gtcaaaataaaagaaaacaccgcagctcaatcccagcaacaacattcaatagacacagcagtcctggcattgacc

SEQ ID NO: 263335 - DNA, 75 bp, Artificial Sequence
  Synthetic
ctcaatcccagcaacaacattcaatagacacagcagtcctggcattgacccgcttaagagcggcaagagcagcag

SEQ ID NO: 263336 - DNA, 75 bp, Artificial Sequence
  Synthetic
gtcaaaaatcaagcctctgaacctgattaacctattgtcaaattgtgactggacttttatgggagttgtggagct

SEQ ID NO: 263337 - DNA, 75 bp, Artificial Sequence
  Synthetic
attaacctattgtcaaattgtgactggacttttatgggagttgtggagctgatagtgcttgtggccgaactattt

SEQ ID NO: 263338 - DNA, 75 bp, Artificial Sequence
  Synthetic
tgtggtgtatactccccaatacctcatctcccccgacactctcaggaggctcaacggagagacattccctaacac

SEQ ID NO: 263339 - DNA, 75 bp, Artificial Sequence
  Synthetic
tgtggtgtatactccccaatacctcatctcccccgacactctcaggaggctcaacggagagacattcccttacac

SEQ ID NO: 263340 - DNA, 75 bp, Artificial Sequence
  Synthetic
tgtggtgtatactccccaatacctcatctcccccgacactctcaggaggctcaacggagagacattccctcacac

SEQ ID NO: 263341 - DNA, 75 bp, Artificial Sequence
  Synthetic
tgtggtgtatactccccaatacctcatctcccccgacactctcaggaggctcaacggagagacattccctgacac

SEQ ID NO: 263342 - DNA, 75 bp, Artificial Sequence
  Synthetic
atctcccccgacactctcaggaggctcaacggagagacattccctaacactgcctttgataacaactgttatgcc

SEQ ID NO: 263343 - DNA, 75 bp, Artificial Sequence
  Synthetic
atctcccccgacactctcaggaggctcaacggagagacattcccttacactgcctttgataacaactgttatgcc

SEQ ID NO: 263344 - DNA, 75 bp, Artificial Sequence
  Synthetic
atctcccccgacactctcaggaggctcaacggagagacattccctcacactgcctttgataacaactgttatgcc

SEQ ID NO: 263345 - DNA, 75 bp, Artificial Sequence
  Synthetic
atctcccccgacactctcaggaggctcaacggagagacattccctgacactgcctttgataacaactgttatgcc

SEQ ID NO: 263346 - DNA, 75 bp, Artificial Sequence
  Synthetic
tcttaactgttgaggaaatgtccaattcaagattccccattcctttggaaaagttgtacacgggtcccagcagtg

SEQ ID NO: 263347 - DNA, 75 bp, Artificial Sequence
  Synthetic
ctgtaaaacgaatgtttggcacgcattcgagcaccatctcattagagggccccactagagaacaccaatgtagag

SEQ ID NO: 263348 - DNA, 75 bp, Artificial Sequence
  Synthetic
ctggacttggttccctaatcaatgctggggctggggctatcaaccaaaagattgattttgaaaataatagaaaat

SEQ ID NO: 263349 - DNA, 75 bp, Artificial Sequence
  Synthetic
cttttgttgtccaaccacaaaatggcaggtgcacgactgatggcgtgctcttaggcactacccagctgtctgctg

SEQ ID NO: 263350 - DNA, 75 bp, Artificial Sequence
  Synthetic
gaggatttggcaaaggatctggtcccccttatattaggtggaattggccttgcaattggctttacaagggacaaa

SEQ ID NO: 263351 - DNA, 75 bp, Artificial Sequence
  Synthetic
agaccctaccaagagtggaacagaaagcccctacccactatggatgactccaaaattaagaaggtggcaaacata

SEQ ID NO: 263352 - DNA, 75 bp, Artificial Sequence
  Synthetic
agcccctacccactatggatgactccaaaattaagaaggtggcaaacatattcctatgttcactgtccacactgt

SEQ ID NO: 263353 - DNA, 75 bp, Artificial Sequence
  Synthetic
cctgatatgtggaagaacgcttttagtcctgacttctcacacataaaactgacgctggctccgcagggaggcttc

SEQ ID NO: 263354 - DNA, 75 bp, Artificial Sequence
  Synthetic
ggttaaagtttgtctgcccacggctatacaagaaggtaagaataaagggaaaaccaaaaagggaagaggtaggcg

SEQ ID NO: 263355 - DNA, 75 bp, Artificial Sequence
  Synthetic
cccttatattaggtggaattggccttgcaattggctttacaagggacaaagtcaccaaagttatgaagagtgccg

SEQ ID NO: 263356 - DNA, 75 bp, Artificial Sequence
  Synthetic
ttgggggtgaccagacagagagaaccttgcgaggcattgaagatgctgtgatagacatggaggtgctgtccagta

SEQ ID NO: 263357 - DNA, 75 bp, Artificial Sequence
  Synthetic
cttgcgaggcattgaagatgctgtgatagacatggaggtgctgtccagtacaaatgtgacacaattagttaggga

SEQ ID NO: 263358 - DNA, 75 bp, Artificial Sequence
  Synthetic
ggacgttcgccggaatcgtagagtctctaatattacttgctgaactctttggagttttctggacacccccagatg

SEQ ID NO: 263359 - DNA, 75 bp, Artificial Sequence
  Synthetic
tctaatattacttgctgaactctttggagttttctggacacccccagatgtgtctgcgatgatcgctcccttact

SEQ ID NO: 263360 - DNA, 75 bp, Artificial Sequence
  Synthetic
atacaagaaggtaagaataaagggaaaaccaaaaagggaagaggtaggcgtgccaattataatgccttctcaaga

SEQ ID NO: 263361 - DNA, 75 bp, Artificial Sequence
  Synthetic
gagtaccttgaggacaggcaacgctatgaagaagaaatggctgaagtccaggctggtggggatggtggtattgga

SEQ ID NO: 263362 - DNA, 75 bp, Artificial Sequence
  Synthetic
tccacttcactccaaagctgggcagtgttcaatacaccactgacacaaacaatgattttgaaactggccagaaca

SEQ ID NO: 263363 - DNA, 75 bp, Artificial Sequence
  Synthetic
cgctgacccacacatagtaacctcagtaaataatctgatatcccgtatctccatggcaaggtcagctttggctaa

SEQ ID NO: 263364 - DNA, 75 bp, Artificial Sequence
  Synthetic
gtaaataatctgatatcccgtatctccatggcaaggtcagctttggctaaagcccaggcagagatgacatcccgt

SEQ ID NO: 263365 - DNA, 75 bp, Artificial Sequence
  Synthetic
ggtgctaggattcaccaaagagaaaattggcaaaatgctgtcctcagcagcgtcaacgctcagggcttgcaaaga

SEQ ID NO: 263366 - DNA, 75 bp, Artificial Sequence
  Synthetic
atgaagaagaaatggctgaagtccaggctggtggggatggtggtattggagagactgagatggagatacgacatc

SEQ ID NO: 263367 - DNA, 75 bp, Artificial Sequence
  Synthetic
attactcaggtagaactggtcataatgtgcacctagcccctgccgttgcccccacttttccgggtgagcaacttc

SEQ ID NO: 263368 - DNA, 75 bp, Artificial Sequence
  Synthetic
gtgtacactcctcagtacctcatctctccagacactctcaagaaattacacggagaaacattcccctacacagcc

SEQ ID NO: 263369 - DNA, 75 bp, Artificial Sequence
  Synthetic
acattagaaagaggaaaccaattgattggaccccccctaaaaatgaatgggctgatgacaacagagaagttgatt

SEQ ID NO: 263370 - DNA, 75 bp, Artificial Sequence
  Synthetic
cggttggccactgaaatcagaccaggtggcaaggttgggctcgtgccccgtgaatccatagaccattgggacggt

SEQ ID NO: 263371 - DNA, 75 bp, Artificial Sequence
  Synthetic
ctcaaattggtcatgaaatggtttttcccaaagaaagaagaagctagtgaattagccatggtgagagcaatagag

SEQ ID NO: 263372 - DNA, 75 bp, Artificial Sequence
  Synthetic
gtggcaaggttgggctcgtgccccgtgaatccatagaccattgggacggttatcatggtgaagaggtcctgttgt

SEQ ID NO: 263373 - DNA, 75 bp, Artificial Sequence
  Synthetic
ttggaccccccctaaaaatgaatgggctgatgacaacagagaagttgattacaatgagaagatcaattttgaggc

SEQ ID NO: 263374 - DNA, 75 bp, Artificial Sequence
  Synthetic
acctacatgaaaacactggatctagaggaagagaaagctagaaaattgtccacaaaatctgcatcccctgacata

SEQ ID NO: 263375 - DNA, 75 bp, Artificial Sequence
  Synthetic
cacaaccacccatgtcatcccatcaggagctaaagaattctttggcgagcccatagactcaatcgccatccaccg

SEQ ID NO: 263376 - DNA, 75 bp, Artificial Sequence
  Synthetic
cactgaattgtgacaggatagagaacaaaggcatgcagttcgtctctgatgcaataattataacaaccaatgctc

SEQ ID NO: 263377 - DNA, 75 bp, Artificial Sequence
  Synthetic
caaaggcatgcagttcgtctctgatgcaataattataacaaccaatgctcctggcccagccccagtcgactttgt

SEQ ID NO: 263378 - DNA, 75 bp, Artificial Sequence
  Synthetic
ggagctaaagaattctttggcgagcccatagactcaatcgccatccaccgggcaggagaattcacccaattaagg

SEQ ID NO: 263379 - DNA, 75 bp, Artificial Sequence
  Synthetic
tctagcaggatcagaccagttgtcgttatgatatctggcaagccagggataggcaagacccacctggccagggag

SEQ ID NO: 263380 - DNA, 75 bp, Artificial Sequence
  Synthetic
atactcatcaaaagggactctggtgagttgctccccctggctgttcgtatgggggccattgcttcaatgaagata

SEQ ID NO: 263381 - DNA, 75 bp, Artificial Sequence
  Synthetic
agttgctccccctggctgttcgtatgggggccattgcttcaatgaagatacaggggcgactagtccatggtcaat

SEQ ID NO: 263382 - DNA, 75 bp, Artificial Sequence
  Synthetic
ggcccacccaggcgataccaatgctataaaagacttgtataagaaagacttctcacacctaaagatggatctggc

SEQ ID NO: 263383 - DNA, 75 bp, Artificial Sequence
  Synthetic
tcacgggagatcaaagagtcggactcataccgagaaacggtgtggaccattgggatgcatacaaaggtgagaggg

SEQ ID NO: 263384 - DNA, 75 bp, Artificial Sequence
  Synthetic
ataaaagacttgtataagaaagacttctcacacctaaagatggatctggctccacaggggggctttgataaccag

SEQ ID NO: 263385 - DNA, 75 bp, Artificial Sequence
  Synthetic
atgtctacaaaagaaataatgactgggtagtctgtggtgtacatgccgcagccacaaagtctggcaacacagtgg

SEQ ID NO: 263386 - DNA, 75 bp, Artificial Sequence
  Synthetic
ggtagtctgtggtgtacatgccgcagccacaaagtctggcaacacagtggtgtgtgcggtgcaagctggtgaggg

SEQ ID NO: 263387 - DNA, 75 bp, Artificial Sequence
  Synthetic
gtcccctcaccttaaattgtgacagaattgaaaacaagggaaaagtttttgatagtgaagtcataataatcacaa

SEQ ID NO: 263388 - DNA, 75 bp, Artificial Sequence
  Synthetic
accatggaaaggcaagatgaattccaactccaaggcatggtttacaactttgatgaggacagggtggcagcattc

SEQ ID NO: 263389 - DNA, 75 bp, Artificial Sequence
  Synthetic
aggcaatgctcctagagggtggattctctgaaacagatgcagcccgtggggcaatcaacgcccccatgacaaagg

SEQ ID NO: 263390 - DNA, 75 bp, Artificial Sequence
  Synthetic
gatagtgaagtcataataatcacaacaaaccttgccaatccagctccccttgattatgtcaactttgaggcctgt

SEQ ID NO: 263391 - DNA, 75 bp, Artificial Sequence
  Synthetic
aactccaaggcatggtttacaactttgatgaggacagggtggcagcattcaccagcttggctcgtgctaacgggt

SEQ ID NO: 263392 - DNA, 75 bp, Artificial Sequence
  Synthetic
tctctcgagcaagactaagttctggaggtctacaactgaaccattaccaccaggcgtgtacgagccagcctacct

SEQ ID NO: 263393 - DNA, 75 bp, Artificial Sequence
  Synthetic
ctgggcccctgatgccaggaccacaacatacaatgcaggccgcttttccacccctcaaccttcgggggcactgcc

SEQ ID NO: 263394 - DNA, 75 bp, Artificial Sequence
  Synthetic
tggtggggtaccggatagaagagtgtgacataatttggaataccagagcttattcaattaagagtgatggcaaaa

SEQ ID NO: 263395 - DNA, 75 bp, Artificial Sequence
  Synthetic
ccagatatgtggaaggacgccttcaaagcggacttttcgcatatcaagttacaacttgcgcctcagggcggcttt

SEQ ID NO: 263396 - DNA, 75 bp, Artificial Sequence
  Synthetic
aagcggacttttcgcatatcaagttacaacttgcgcctcagggcggctttgacaagaatggcaacaccccacacg

SEQ ID NO: 263397 - DNA, 75 bp, Artificial Sequence
  Synthetic
tgacataatttggaataccagagcttattcaattaagagtgatggcaaaagtgtgacaatcaaggagaagcaaaa

SEQ ID NO: 263398 - DNA, 75 bp, Artificial Sequence
  Synthetic
aggtctacaactgaaccattaccaccaggcgtgtacgagccagcctaccttggaggtcgtgaccctagggtgaaa

SEQ ID NO: 263399 - DNA, 75 bp, Artificial Sequence
  Synthetic
cctggattgttggaagcagctgttgaaactgtgacatctgtcttagaacaagtcatggacacaccagtgccctgg

SEQ ID NO: 263400 - DNA, 75 bp, Artificial Sequence
  Synthetic
aaactgtgacatctgtcttagaacaagtcatggacacaccagtgccctggtcatatgctgatgcttgtcagtctc

SEQ ID NO: 263401 - DNA, 75 bp, Artificial Sequence
  Synthetic
agcgtatgcatcctgcctacaaagtgccgtcctttccatacttcaggtggctggttctgctgtagtggtgagcag

SEQ ID NO: 263402 - DNA, 75 bp, Artificial Sequence
  Synthetic
atgaatttgaactccagggtcccacaatcaccactttcaatttcgaccggaacagaatcaccgcctttagacaat

SEQ ID NO: 263403 - DNA, 75 bp, Artificial Sequence
  Synthetic
aatcaccactttcaatttcgaccggaacagaatcaccgcctttagacaattggctgctgaaaacaaatatgggct

SEQ ID NO: 263404 - DNA, 75 bp, Artificial Sequence
  Synthetic
gccgtcctttccatacttcaggtggctggttctgctgtagtggtgagcagggcggtgaaacgcatgtttggcacg

SEQ ID NO: 263405 - DNA, 75 bp, Artificial Sequence
  Synthetic
gggagttgggtgagcaggctgcccatgctaacaacatgtatgagcaggggaaatcaatgaagcctctctacactg

SEQ ID NO: 263406 - DNA, 75 bp, Artificial Sequence
  Synthetic
tgctaacaacatgtatgagcaggggaaatcaatgaagcctctctacactgctgcactcaaagatgaattagttaa

SEQ ID NO: 263407 - DNA, 75 bp, Artificial Sequence
  Synthetic
catggtcccataggacatgatggggtcattgagcgctacggtctgtgtgagagtgaacaagaggatgaaagtgat

SEQ ID NO: 263408 - DNA, 75 bp, Artificial Sequence
  Synthetic
tgtgtccatcaagaggtgccagattatctacaatggttccacgtttgaccttgagtctgatggcaagggtaaagt

SEQ ID NO: 263409 - DNA, 75 bp, Artificial Sequence
  Synthetic
atctacaatggttccacgtttgaccttgagtctgatggcaagggtaaagttttggtggaaaaggtcaaaaatacc

SEQ ID NO: 263410 - DNA, 75 bp, Artificial Sequence
  Synthetic
tcattgagcgctacggtctgtgtgagagtgaacaagaggatgaaagtgatcaagtcgtggaactgccattagcca

SEQ ID NO: 263411 - DNA, 75 bp, Artificial Sequence
  Synthetic
cagagctttcggtccattctgtgatgccataaagccacatgtaataaaattgcccatcaaagttggcatgaactc

SEQ ID NO: 263412 - DNA, 75 bp, Artificial Sequence
  Synthetic
gccataaagccacatgtaataaaattgcccatcaaagttggcatgaactcaattgaagatggcccaatgatatat

SEQ ID NO: 263413 - DNA, 75 bp, Artificial Sequence
  Synthetic
gtgggctcagtgatgaagagtatgaggagtacaagaagatcagagaagaaaagagtggtaattacagcattcagg

SEQ ID NO: 263414 - DNA, 75 bp, Artificial Sequence
  Synthetic
tgtgtgcaagaagcagtctactccatcctacaaattgccggcgccgcgttcgtcaccacacgtattgcacgccgc

SEQ ID NO: 263415 - DNA, 75 bp, Artificial Sequence
  Synthetic
ggagtacaagaagatcagagaagaaaagagtggtaattacagcattcaggaataccttgaagatcgccaacgcta

SEQ ID NO: 263416 - DNA, 75 bp, Artificial Sequence
  Synthetic
atgacagagtctttttcaataatgtgccgcctgacagcaacaccagaattggcttcggtggtcgccaaggatctc

SEQ ID NO: 263417 - DNA, 75 bp, Artificial Sequence
  Synthetic
gccgcctgacagcaacaccagaattggcttcggtggtcgccaaggatctccttgcaccttctgagatggatgttg

SEQ ID NO: 263418 - DNA, 75 bp, Artificial Sequence
  Synthetic
ttagaagatgatgagttcatcatatcctccaaagacatcaaggaggaaggaaagaagggcaaaaacaaaactggc

SEQ ID NO: 263419 - DNA, 75 bp, Artificial Sequence
  Synthetic
ggtcttctataagtcaaaatctggtatgaggaagcagcgccaggaagagaggcgacaattggggctcgttagtgg

SEQ ID NO: 263420 - DNA, 75 bp, Artificial Sequence
  Synthetic
atgaggaagcagcgccaggaagagaggcgacaattggggctcgttagtggtactgagatccgcaagcgcaagcct

SEQ ID NO: 263421 - DNA, 75 bp, Artificial Sequence
  Synthetic
ctagcaagggcttgagcgatgaggagtatgacgagtacaagaggataagagaagagagaaatgggaagtactcta

SEQ ID NO: 263422 - DNA, 75 bp, Artificial Sequence
  Synthetic
actggctcatcactctctgtgcactctctgaggtcacgggcctttccccagatgtcatacagtcacaatcttact

SEQ ID NO: 263423 - DNA, 75 bp, Artificial Sequence
  Synthetic
tgtcaccacgcgcattgtcaagcgcatgaacatacaagacctatggtccaagccacaagtggaaaacacagagga

SEQ ID NO: 263424 - DNA, 75 bp, Artificial Sequence
  Synthetic
gaggcccctccttcaatttggagcagagttgtcaaatttggtagcggctggggattttgggtgagctcaacagtg

SEQ ID NO: 263425 - DNA, 75 bp, Artificial Sequence
  Synthetic
gtatgacgagtacaagaggataagagaagagagaaatgggaagtactctatagaggagtatcttcaagacaggga

SEQ ID NO: 263426 - DNA, 75 bp, Artificial Sequence
  Synthetic
gagttgtcaaatttggtagcggctggggattttgggtgagctcaacagtgttcatcactacaacccatgttatac

SEQ ID NO: 263427 - DNA, 75 bp, Artificial Sequence
  Synthetic
ctctgaggtcacgggcctttccccagatgtcatacagtcacaatcttacttttccttttatggggatgacgagat

SEQ ID NO: 263428 - DNA, 75 bp, Artificial Sequence
  Synthetic
ccagaggatctttcgtcccaccaggaaacaaaggaaggaagaaagggccacgctagggctagtgactggttcaga

SEQ ID NO: 263429 - DNA, 75 bp, Artificial Sequence
  Synthetic
ccctgacaaaagtgaaggaccaatagtgttgagaaggcagatcgatggcttggttttcctgagaagaacaatatc

SEQ ID NO: 263430 - DNA, 75 bp, Artificial Sequence
  Synthetic
gtgttgagaaggcagatcgatggcttggttttcctgagaagaacaatatcaaaggatgcagctggttttcaaggc

SEQ ID NO: 263431 - DNA, 75 bp, Artificial Sequence
  Synthetic
tccgtttctccaagaagatgagacctgacctcacaggtatggtcttggaagaaggatgctcagagggcacagtgt

SEQ ID NO: 263432 - DNA, 75 bp, Artificial Sequence
  Synthetic
agtcagaaaaagaaaccctgatgacttcaaacctaaagggaaattgtgggccgacgacaacagaagtgttgacta

SEQ ID NO: 263433 - DNA, 75 bp, Artificial Sequence
  Synthetic
tgacctcacaggtatggtcttggaagaaggatgctcagagggcacagtgtgcaccatcatgataaaaagggactc

SEQ ID NO: 263434 - DNA, 75 bp, Artificial Sequence
  Synthetic
ctgataccccacccacaaagaaaggttcagcttatatctctgcttggtgaggcctcactacatggggaaaagttt

SEQ ID NO: 263435 - DNA, 75 bp, Artificial Sequence
  Synthetic
aaaatgctaacaacaatagtagtattaagtctcgtctattggcgagactcaagggttcaggtggggctacgtccc

SEQ ID NO: 263436 - DNA, 75 bp, Artificial Sequence
  Synthetic
taagtctcgtctattggcgagactcaagggttcaggtggggctacgtccccacccaactcgataaagataaccaa

SEQ ID NO: 263437 - DNA, 75 bp, Artificial Sequence
  Synthetic
ctgggtgtcaccaagcctgttcataacatcaactcatgtaatccctgcgggcataacagaggcatttggagtccc

SEQ ID NO: 263438 - DNA, 75 bp, Artificial Sequence
  Synthetic
tcagtcggggatgctgctcactggtgccaacgctaaaggcatggaccttggcaccatacctggagactgtggagc

SEQ ID NO: 263439 - DNA, 75 bp, Artificial Sequence
  Synthetic
gtcgttcctactgctgctagcagtgaaaatgctaacaacaatagtagtattaagtctcgtctattggcgagactc

SEQ ID NO: 263440 - DNA, 75 bp, Artificial Sequence
  Synthetic
acatcaactcatgtaatccctgcgggcataacagaggcatttggagtccccatcaaacaagttcaagtccacaaa

SEQ ID NO: 263441 - DNA, 75 bp, Artificial Sequence
  Synthetic
gcataacagaggcatttggagtccccatcaaacaagttcaagtccacaaatcgggcgagttttgtcggttcagat

SEQ ID NO: 263442 - DNA, 75 bp, Artificial Sequence
  Synthetic
gagggatagaccaccacggactgttgccgaagttcaacaaaatttgcgttggactgagagaccacaagaccagaa

SEQ ID NO: 263443 - DNA, 75 bp, Artificial Sequence
  Synthetic
gccgaagttcaacaaaatttgcgttggactgagagaccacaagaccagaatgttaagacgtgggatgagcttgac

SEQ ID NO: 263444 - DNA, 75 bp, Artificial Sequence
  Synthetic
tgctcatcaagcgccccaccggagaactcatgcccctcgcagccagaatgggaacacacgcaaccatgagaattc

SEQ ID NO: 263445 - DNA, 75 bp, Artificial Sequence
  Synthetic
gaaggtgaagccacactagagggtggtggtcaaaataaaggccactatgctggacacccaatactaaggtatggg

SEQ ID NO: 263446 - DNA, 75 bp, Artificial Sequence
  Synthetic
tcgcaatctcctgcccgaattcgtaaatgatgatggcgtctaaggacgctacaccaagcgcagatggcgcgaacg

SEQ ID NO: 263447 - DNA, 75 bp, Artificial Sequence
  Synthetic
gtggtcaaaataaaggccactatgctggacacccaatactaaggtatgggaatggaccatctctatcaactaaaa

SEQ ID NO: 263448 - DNA, 75 bp, Artificial Sequence
  Synthetic
gctaagggtatggatctggggacaactcctggtgaccgtggctgcccgtacatctacaaaaggggcaatgactat

SEQ ID NO: 263449 - DNA, 75 bp, Artificial Sequence
  Synthetic
cccactagtcatgaacggtacacacatgagaatgatgaaggccaccaggtaaagtggtcggctagggaaggtgta

SEQ ID NO: 263450 - DNA, 75 bp, Artificial Sequence
  Synthetic
atgagaatgatgaaggccaccaggtaaagtggtcggctagggaaggtgtagaccttggcatatccgggctcacga

SEQ ID NO: 263451 - DNA, 75 bp, Artificial Sequence
  Synthetic
cgagagttgacggggggccatctttacaacaagtgctcagagaccagcttaaaccttttgctgaacctcgtggta

SEQ ID NO: 263452 - DNA, 75 bp, Artificial Sequence
  Synthetic
ccttagctactgctggtcaagttaatatgattgatccttggattttcaataactttgtccaagcccctcagggtg

SEQ ID NO: 263453 - DNA, 75 bp, Artificial Sequence
  Synthetic
acattgccaacaacagtgaaaacactccccctcccgttaaggaagaggcgagtgtcctatccaacgtaaaagttg

SEQ ID NO: 263454 - DNA, 75 bp, Artificial Sequence
  Synthetic
ctcctggtgaccgtggctgcccgtacatctacaaaaggggcaatgactatatagtcattggagtacacacagcag

SEQ ID NO: 263455 - DNA, 75 bp, Artificial Sequence
  Synthetic
acaaaggaacatactgtggggcacccatcctgggccctggaggagcaccaaaattgagcaccaaaaccaaatttt

SEQ ID NO: 263456 - DNA, 75 bp, Artificial Sequence
  Synthetic
ccacaattggtgacatgatcgaattctatgaagggcacatctatcattatgctatatacataggtcaaggcaaga

SEQ ID NO: 263457 - DNA, 75 bp, Artificial Sequence
  Synthetic
ctatgaagggcacatctatcattatgctatatacataggtcaaggcaagacggtgggtgtacactcccctcaagc

SEQ ID NO: 263458 - DNA, 75 bp, Artificial Sequence
  Synthetic
ctgcatgtctctagataagaccaccagttctggccacccccatcacaaaaagaagaacgatgattggaacggaag

SEQ ID NO: 263459 - DNA, 75 bp, Artificial Sequence
  Synthetic
taatggttgggttggtaacatgcgagtcagggtcatcctggcaggtaacgcatttaccgccggtaaagtgataat

SEQ ID NO: 263460 - DNA, 75 bp, Artificial Sequence
  Synthetic
ggtgccacccccacctccaaatggtgaagatgtgatttactataatagcaaagatgacactgtgcatggcctgcc

SEQ ID NO: 263461 - DNA, 75 bp, Artificial Sequence
  Synthetic
agggtgggccttctctacaacaagtcatgagagatcagttgaagcccttcaccgagcccaggggtaaacccccaa

SEQ ID NO: 263462 - DNA, 75 bp, Artificial Sequence
  Synthetic
gaaatcccattggaggatgttagaaatacactgtaccataacaatgacagccagccgacaatgcgtttattgtgc

SEQ ID NO: 263463 - DNA, 75 bp, Artificial Sequence
  Synthetic
acagaggctcacatacgaccaactcaaagaattagaaaatgaaccatggccgtatgccgcagtcacgaacaactg

SEQ ID NO: 263464 - DNA, 75 bp, Artificial Sequence
  Synthetic
aaagaattagaaaatgaaccatggccgtatgccgcagtcacgaacaactgcttcgaattttgttgccaggtcatg

SEQ ID NO: 263465 - DNA, 75 bp, Artificial Sequence
  Synthetic
gagcttgtgaagccagacaaagtatacaataaaattaagaaaaggctgttgtggggagcggacctcggcaccgtt

SEQ ID NO: 263466 - DNA, 75 bp, Artificial Sequence
  Synthetic
accatactagagatgtgggatggtgagttctaccattatgcgatatacgtctctggtggcaaggccataggggtg

SEQ ID NO: 263467 - DNA, 75 bp, Artificial Sequence
  Synthetic
catgagagatcagttgaagcccttcaccgagcccaggggtaaacccccaagacctagtgtgctggaggcagccaa

SEQ ID NO: 263468 - DNA, 75 bp, Artificial Sequence
  Synthetic
acttgataagaccacctctagtgggcacccccatcacgcccgaaagaatgaattctggaacggtgagacctttat

SEQ ID NO: 263469 - DNA, 75 bp, Artificial Sequence
  Synthetic
ttctcttcctggtccccccgactgtggaacaaaagacacgcccttttagtgtacccaatatcccactccagaatc

SEQ ID NO: 263470 - DNA, 75 bp, Artificial Sequence
  Synthetic
cgagacactccagaattccaacaagacagcaagttagagatggttagggatgcagtgctagccgctataaatggg

SEQ ID NO: 263471 - DNA, 75 bp, Artificial Sequence
  Synthetic
acagcaagttagagatggttagggatgcagtgctagccgctataaatgggttggtgtcgcggccatttaaagatc

SEQ ID NO: 263472 - DNA, 75 bp, Artificial Sequence
  Synthetic
cattgatctatgcagagcactccaagtataaatatcattatgatgctgattacacagcttgggactcaacccaaa

SEQ ID NO: 263473 - DNA, 75 bp, Artificial Sequence
  Synthetic
acacactcaagagcttagctggtgaaaagtttccatacactgcatttagcaacaactgttataatttctgttgct

SEQ ID NO: 263474 - DNA, 75 bp, Artificial Sequence
  Synthetic
cacccccatcacgcccgaaagaatgaattctggaacggtgagacctttattggcaagttggcagaccaagcatca

SEQ ID NO: 263475 - DNA, 75 bp, Artificial Sequence
  Synthetic
aagaccgacaaaatctatgggaggatcaagaaaaggctgctttggggctctgacttatccaccatggtccgatgt

SEQ ID NO: 263476 - DNA, 75 bp, Artificial Sequence
  Synthetic
tcacctgctggggaccacccccgtttctgctggccagctcatgaaattcagaggtaaggtaacttcaggttcaaa

SEQ ID NO: 263477 - DNA, 75 bp, Artificial Sequence
  Synthetic
agatggtggtcctccttttagaactctttggaatcttttggaacccacctgatgtttccaactttatagcttcac

SEQ ID NO: 263478 - DNA, 75 bp, Artificial Sequence
  Synthetic
ctttggaatcttttggaacccacctgatgtttccaactttatagcttcactcctgccagatttccatctacaggg

SEQ ID NO: 263479 - DNA, 75 bp, Artificial Sequence
  Synthetic
gatggacgtgggagactatgtgataagtgtcaaagacggtttaccatcaggttttccatgcacatcacaggttaa

SEQ ID NO: 263480 - DNA, 75 bp, Artificial Sequence
  Synthetic
gacggtggacgatggaaaaatcaagaaagttgccaatgctgtcctatgtgctcttggttcactattctcaaaacc

SEQ ID NO: 263481 - DNA, 75 bp, Artificial Sequence
  Synthetic
gctagggcctttggtggtctcatggatgagatgaaggcatactgcatatcactcccagtccgagttggcatgaac

SEQ ID NO: 263482 - DNA, 75 bp, Artificial Sequence
  Synthetic
agtgtcaaagacggtttaccatcaggttttccatgcacatcacaggttaacagcatcaaccactggatcctcact

SEQ ID NO: 263483 - DNA, 75 bp, Artificial Sequence
  Synthetic
gagatgagtctttatcaggataacaatcatgcagaccctattgtgctgcatgccattgaacccaattcatcttcc

SEQ ID NO: 263484 - DNA, 75 bp, Artificial Sequence
  Synthetic
caaggtaagtaagatgatgaagaatgctgttgatggacttcgtgcggcaacccagctcggtcaatatggcctaga

SEQ ID NO: 263485 - DNA, 75 bp, Artificial Sequence
  Synthetic
gctgttgatggacttcgtgcggcaacccagctcggtcaatatggcctagaaatattctcattactaaagaagtac

SEQ ID NO: 263486 - DNA, 75 bp, Artificial Sequence
  Synthetic
tgggactcaacacaacagagggctgttctagcagcggccttggaaataatggtcagattctctgcagaaccacaa

SEQ ID NO: 263487 - DNA, 75 bp, Artificial Sequence
  Synthetic
gatgatgaaattgtctccacggatgttgaatttgacccaaataaattgacacaggtgctcaaggaatatggccta

SEQ ID NO: 263488 - DNA, 75 bp, Artificial Sequence
  Synthetic
gctgctgagttatttggagtgttttggaccccccccgacgtgtcgaacttcatcgcgtcactcatcggagacttt

SEQ ID NO: 263489 - DNA, 75 bp, Artificial Sequence
  Synthetic
tggagacttcaaaatttcaataaatgagggactcccttctggtgtaccatgcacttcccagtggaactccatcac

SEQ ID NO: 263490 - DNA, 75 bp, Artificial Sequence
  Synthetic
ataaccctaatgctgatgttgatttctggtctatccctgattatggttccaacttggctgaagcatcacagcttg

SEQ ID NO: 263491 - DNA, 75 bp, Artificial Sequence
  Synthetic
tctacatcagtgactcagctcgtgagggacaaacagtctgcacgggcttatatggccatcttagataatgaagaa

SEQ ID NO: 263492 - DNA, 75 bp, Artificial Sequence
  Synthetic
gggacaaacagtctgcacgggcttatatggccatcttagataatgaagaagaaaaggcaaggaaattatctgtca

SEQ ID NO: 263493 - DNA, 75 bp, Artificial Sequence
  Synthetic
ttgtctgaagtcactaacctgtctcctgacatcgtgcaggcaaattccatgttctcattttacggtgatgacgag

SEQ ID NO: 263494 - DNA, 75 bp, Artificial Sequence
  Synthetic
ggtaccaggggcggcttgaccgcaattccattgaaagacaactttggtggacccgtggcccgaatcatgatgacc

SEQ ID NO: 263495 - DNA, 75 bp, Artificial Sequence
  Synthetic
tgctgtcatcagcagcatcgacccttagggcatgcaaagacctaggcaactacgcccttgacatacttaaactgg

SEQ ID NO: 263496 - DNA, 75 bp, Artificial Sequence
  Synthetic
ctggtctatccctgattatggttccaacttggctgaagcatcacagcttgccccagttgtctatccccctggttt

SEQ ID NO: 263497 - DNA, 75 bp, Artificial Sequence
  Synthetic
cctgttgcctcaagagttcattggacatttcgtcagtgaacaagcccccgcaattggtgaggccgccctcttaca

SEQ ID NO: 263498 - DNA, 75 bp, Artificial Sequence
  Synthetic
ccaaggctcaagctgaaatgaccagcaggatgcgtcctgtggtcattatgatgtgtgggccccctggtataggta

SEQ ID NO: 263499 - DNA, 75 bp, Artificial Sequence
  Synthetic
caggatgcgtcctgtggtcattatgatgtgtgggccccctggtataggtaaaaccaaggcagcagaacatctggc

SEQ ID NO: 263500 - DNA, 75 bp, Artificial Sequence
  Synthetic
ccacctcaccgccctgctgaaagacagggacagcctcctgacctacatgaagaccctagacctcgaagaagagaa

SEQ ID NO: 263501 - DNA, 75 bp, Artificial Sequence
  Synthetic
ctattaggtgaagcagcactccatggtgagaaattctacagaaaaatagcaagcagagtcatccaggaggtaaag

SEQ ID NO: 263502 - DNA, 75 bp, Artificial Sequence
  Synthetic
gagggagtatggtctgaaaccaactcgcccagacaaaacagagggacccctgatcatcagtgaggatttggacgg

SEQ ID NO: 263503 - DNA, 75 bp, Artificial Sequence
  Synthetic
gagggagtatggtctgaaaccaactcgcccagacaaaactgagggacccctgatcatcagtgaggatttggacgg

SEQ ID NO: 263504 - DNA, 75 bp, Artificial Sequence
  Synthetic
gagggagtatggtctgaaaccaactcgcccagacaaaaccgagggacccctgatcatcagtgaggatttggacgg

SEQ ID NO: 263505 - DNA, 75 bp, Artificial Sequence
  Synthetic
gagggagtatggtctgaaaccaactcgcccagacaaaacggagggacccctgatcatcagtgaggatttggacgg

SEQ ID NO: 263506 - DNA, 75 bp, Artificial Sequence
  Synthetic
tggacaggagatcgcgatctcctgcccgattatgtaaatgatgatggcgtctaaggacgccccaacaaacatgga

SEQ ID NO: 263507 - DNA, 75 bp, Artificial Sequence
  Synthetic
cccctaaatggtgtctttgtcttttcttcctgggtgtcaagattttatcaactcaagcctgtgggaacggcttct

SEQ ID NO: 263508 - DNA, 75 bp, Artificial Sequence
  Synthetic
tggatatcacggagaggaagtgatgctgtgggacgactatggaatgacaaagatacaggaagactgtaataaact

SEQ ID NO: 263509 - DNA, 75 bp, Artificial Sequence
  Synthetic
ctgtgggacgactatggaatgacaaagatacaggaagactgtaataaactgcaagccatagccgactcagccccc

SEQ ID NO: 263510 - DNA, 75 bp, Artificial Sequence
  Synthetic
ccaaaccatgaagaccccaatgagacaatgataccccactctcaaagacccatacagctcatggcactgcttggt

SEQ ID NO: 263511 - DNA, 75 bp, Artificial Sequence
  Synthetic
gctaaagaagagatgtacagcagacctaggcctgtcgtggtgatgatatcaggaagaccaggagttggtaaaacc

SEQ ID NO: 263512 - DNA, 75 bp, Artificial Sequence
  Synthetic
ccgattatgtaaatgatgatggcgtctaaggacgccccaacaaacatggatggcaccagtggtgctggtcagctg

SEQ ID NO: 263513 - DNA, 75 bp, Artificial Sequence
  Synthetic
ggtcaagttaatatgattgacccctggattatgagtaattatgttcaagcccctcaaggagagttcacaatttcc

SEQ ID NO: 263514 - DNA, 75 bp, Artificial Sequence
  Synthetic
agccggcgcagaagcagcacttcaaagtcaaaggtatcagcaagatttgaccttacagcaaaattcatttaaaca

SEQ ID NO: 263515 - DNA, 75 bp, Artificial Sequence
  Synthetic
gctcctggcccagccccagtggactttgtcaacctcgggcctgtttgccgaagggtggacttccttgtgtattgc

SEQ ID NO: 263516 - DNA, 75 bp, Artificial Sequence
  Synthetic
ttgtcaacctcgggcctgtttgccgaagggtggacttccttgtgtattgcacggcacctgaagttgaacacacga

SEQ ID NO: 263517 - DNA, 75 bp, Artificial Sequence
  Synthetic
acaggggagaacgagtcgtcttgtgggacgactatggtatgggtaacccagtaaaagatgcccttgcattgcaag

SEQ ID NO: 263518 - DNA, 75 bp, Artificial Sequence
  Synthetic
tgaatgaagatggcgtcgaatgacgccgctccatctaatgatggtgcagccggtctcgtaccagaggtcaacaac

SEQ ID NO: 263519 - DNA, 75 bp, Artificial Sequence
  Synthetic
ggattatgagtaattatgttcaagcccctcaaggagagttcacaatttcccctaacaacactcccggagatatat

SEQ ID NO: 263520 - DNA, 75 bp, Artificial Sequence
  Synthetic
gtaatatgaaagttagggtgctgctcgctggtaatgccttcacagcgggtaaaataataattagttgtgttcccc

SEQ ID NO: 263521 - DNA, 75 bp, Artificial Sequence
  Synthetic
agtgctgatgctgctagggcggtcgctggcgctcctgtgactcgcatcgttgattggaatggcactaggattgca

SEQ ID NO: 263522 - DNA, 75 bp, Artificial Sequence
  Synthetic
tggctccccaagggggctttgataaccaagggaataccccgtttggtaagggtgtgatgaagcccaccaccataa

SEQ ID NO: 263523 - DNA, 75 bp, Artificial Sequence
  Synthetic
ccaagggaataccccgtttggtaagggtgtgatgaagcccaccaccataaacaggctgttaatccaggctgtagc

SEQ ID NO: 263524 - DNA, 75 bp, Artificial Sequence
  Synthetic
ccctggattagattaaattttgtacaagcccccaatggtgagttcacggtttccccccgaaactcgcctggtgaa

SEQ ID NO: 263525 - DNA, 75 bp, Artificial Sequence
  Synthetic
caaccccgccccgcttgactatgtcaactttgaggcttgttcccgcagaattgacttcctcgtctacgcagatgc

SEQ ID NO: 263526 - DNA, 75 bp, Artificial Sequence
  Synthetic
aagcccccaatggtgagttcacggtttccccccgaaactcgcctggtgaaattttgttaaatttggagttagggc

SEQ ID NO: 263527 - DNA, 75 bp, Artificial Sequence
  Synthetic
ggatgtgaggaatgtgctcttccacaataatgactccactccaactatgagattgatttgtatgttgtatacccc

SEQ ID NO: 263528 - DNA, 75 bp, Artificial Sequence
  Synthetic
ttggcatgactaatccaaattacggtgacactatgtcccgtgtctcctcttgggtacaatcacaaaattcttcag

SEQ ID NO: 263529 - DNA, 75 bp, Artificial Sequence
  Synthetic
gttcacgaggatggcccgagccaacgggttgggtctcatatccatggcctccctaggcaaaaagctacgcagtgt

SEQ ID NO: 263530 - DNA, 75 bp, Artificial Sequence
  Synthetic
gggttgggtctcatatccatggcctccctaggcaaaaagctacgcagtgtcaccactattgaaggattaaagaat

SEQ ID NO: 263531 - DNA, 75 bp, Artificial Sequence
  Synthetic
tgctggctggaagtgcgtttacagcgggcaaattggtattcgcagcaatccccccccattttccagtagataatt

SEQ ID NO: 263532 - DNA, 75 bp, Artificial Sequence
  Synthetic
ccgcaaggtggttttgacaagaacggcaacacaccacatgggaagggaactatgaaaaccttaacccagggttcc

SEQ ID NO: 263533 - DNA, 75 bp, Artificial Sequence
  Synthetic
gggcaaattggtattcgcagcaatccccccccattttccagtagataatttgagccccggtcagatcaccatgtt

SEQ ID NO: 263534 - DNA, 75 bp, Artificial Sequence
  Synthetic
ccccccaatgttgagcagaaaactaaaccatttagtgtacctaatctccccctcaatgttctctcaaattctagg

SEQ ID NO: 263535 - DNA, 75 bp, Artificial Sequence
  Synthetic
tttcaatactgatagattgcctcttttcgcaaatagaggccaataatgttgtaataagaatgtgggcatcttatt

SEQ ID NO: 263536 - DNA, 75 bp, Artificial Sequence
  Synthetic
gccagtgtacaaatcaaagaagacaagcaagctttgacccctctgcagcagacaattaacacggcctcacttgcc

SEQ ID NO: 263537 - DNA, 75 bp, Artificial Sequence
  Synthetic
agcaagctttgacccctctgcagcagacaattaacacggcctcacttgccatcactcgactcaaagcagctaggg

SEQ ID NO: 263538 - DNA, 75 bp, Artificial Sequence
  Synthetic
ccattacaatcaacagagtgatcagcgcatgagacttgttgctatgctttacacccctcttagatctaatggttc

SEQ ID NO: 263539 - DNA, 75 bp, Artificial Sequence
  Synthetic
cagctttcaggaagcttgctgcagacaataactatggattcctggagacaatgagagtcggttcctcactcaagg

SEQ ID NO: 263540 - DNA, 75 bp, Artificial Sequence
  Synthetic
cgcatgagacttgttgctatgctttacacccctcttagatctaatggttcaggtgatgatgtcttcactgtgtca

SEQ ID NO: 263541 - DNA, 75 bp, Artificial Sequence
  Synthetic
ccactcccacttcagctagtcagctctgcaaaattcgagggacggtttaccatgcaactggtggccaagggctta

SEQ ID NO: 263542 - DNA, 75 bp, Artificial Sequence
  Synthetic
cggttgcggcaaggtcagcatagagaaactggcagataacaactcccaaacaaccagagaaatcatcacggccgt

SEQ ID NO: 263543 - DNA, 75 bp, Artificial Sequence
  Synthetic
atcgagcggtcaagcgtatgtttggtacccgtacagcagccatggcattagaaggacctgggaaagaacataatt

SEQ ID NO: 263544 - DNA, 75 bp, Artificial Sequence
  Synthetic
tacccgtacagcagccatggcattagaaggacctgggaaagaacataattgcagggtccataaggctaaggaagc

SEQ ID NO: 263545 - DNA, 75 bp, Artificial Sequence
  Synthetic
aaacccttctcagtcccagtgctgaccctcaatgagctgaccaactctcgctttcccgtcccgattgatgctatg

SEQ ID NO: 263546 - DNA, 75 bp, Artificial Sequence
  Synthetic
ccctcaatgagctgaccaactctcgctttcccgtcccgattgatgctatgtacaccagccctaacgattcaattg

SEQ ID NO: 263547 - DNA, 75 bp, Artificial Sequence
  Synthetic
ctgcaaaattcgagggacggtttaccatgcaactggtggccaagggcttaatttgactgagattgatgggactcc

SEQ ID NO: 263548 - DNA, 75 bp, Artificial Sequence
  Synthetic
tcctgctaatgctttcacagatggtagtatcatacacagaattgatgtggcccaggattccacttttgctcccca

SEQ ID NO: 263549 - DNA, 75 bp, Artificial Sequence
  Synthetic
agaatagtcaagaagttcaactgggaacgatgggtcaaggctccagagacagatgaacccacaccaagtaacgat

SEQ ID NO: 263550 - DNA, 75 bp, Artificial Sequence
  Synthetic
ggaccaaattcaaatggtaccaagtgatgccgtcccagaaggaaagaacaaaggcaagaccaaaaagggacgtgg

SEQ ID NO: 263551 - DNA, 75 bp, Artificial Sequence
  Synthetic
gatgccgtcccagaaggaaagaacaaaggcaagaccaaaaagggacgtggtcgcaaaaataactataatgcattc

SEQ ID NO: 263552 - DNA, 75 bp, Artificial Sequence
  Synthetic
tctgctcatttagagggaaaattacaacacatttgtcagatgataggcacttgtggaatatccaagtctccaact

SEQ ID NO: 263553 - DNA, 75 bp, Artificial Sequence
  Synthetic
aacacatttgtcagatgataggcacttgtggaatatccaagtctccaacttgaatggcactccgtttgacccaac

SEQ ID NO: 263554 - DNA, 75 bp, Artificial Sequence
  Synthetic
agtatcatacacagaattgatgtggcccaggattccacttttgctccccatctaggcactatccactataccaac

SEQ ID NO: 263555 - DNA, 75 bp, Artificial Sequence
  Synthetic
gttaacccatgggctattcctcgatacggttcaaccctgactgaggctgcccagttggccccaccaatataccct

SEQ ID NO: 263556 - DNA, 75 bp, Artificial Sequence
  Synthetic
cattctccagcaaagggcttagtgatgaggaatatgacgaattcaagagactgagggaagagaaacagggccgct

SEQ ID NO: 263557 - DNA, 75 bp, Artificial Sequence
  Synthetic
atacaagaatacttggaggaccgccaacgatatgaggaagaattagcagaggtacaggcaggtggtgatggtggc

SEQ ID NO: 263558 - DNA, 75 bp, Artificial Sequence
  Synthetic
aacgatatgaggaagaattagcagaggtacaggcaggtggtgatggtggcataggagaaactgaaatggaaatcc

SEQ ID NO: 263559 - DNA, 75 bp, Artificial Sequence
  Synthetic
aggcaccaaccccgcaaacagggctcatgatgctgcccttgcaacctacagtgccaaatacactcctaagctcgg

SEQ ID NO: 263560 - DNA, 75 bp, Artificial Sequence
  Synthetic
catgatgctgcccttgcaacctacagtgccaaatacactcctaagctcggatcagtccaaattggagcttgggac

SEQ ID NO: 263561 - DNA, 75 bp, Artificial Sequence
  Synthetic
acggttcaaccctgactgaggctgcccagttggccccaccaatataccctcccggatttggcgaggcaattgtct

SEQ ID NO: 263562 - DNA, 75 bp, Artificial Sequence
  Synthetic
tgacccattttgttaatgaacaagcacccactcgtggtgaggctgcactgttgcactatgttgaccctgacacac

SEQ ID NO: 263563 - DNA, 75 bp, Artificial Sequence
  Synthetic
gatcaggcaaaggatattccgccccaccaaaaagcagaggaaggaggaacgtggggttctgggactcgtcacagg

SEQ ID NO: 263564 - DNA, 75 bp, Artificial Sequence
  Synthetic
gatcagacatcagaaaacgtaagcccattgactggaccccgccaaagaatgaatgggcagatgatgacagagagg

SEQ ID NO: 263565 - DNA, 75 bp, Artificial Sequence
  Synthetic
cattgactggaccccgccaaagaatgaatgggcagatgatgacagagaggtggattataatgaaaagatcaattt

SEQ ID NO: 263566 - DNA, 75 bp, Artificial Sequence
  Synthetic
tttgaccaatgggtgttgccaaattattccggtgccctaggactcaacgtgcacctggctcctgctgtatcccca

SEQ ID NO: 263567 - DNA, 75 bp, Artificial Sequence
  Synthetic
attccggtgccctaggactcaacgtgcacctggctcctgctgtatccccactcttccccggggagagattgctgt

SEQ ID NO: 263568 - DNA, 75 bp, Artificial Sequence
  Synthetic
acccactcgtggtgaggctgcactgttgcactatgttgaccctgacacacatcgcaatttgggcgaattcaaatt

SEQ ID NO: 263569 - DNA, 75 bp, Artificial Sequence
  Synthetic
tttcactttcatttcctgggtttctcgcttctatcaattaaagcctgtgggaacgaccggtccggtccgtaggct

SEQ ID NO: 263570 - DNA, 75 bp, Artificial Sequence
  Synthetic
gaagctcctcctagcgtctggtcaagaatcgtcccgcttgggactggctggggattttgggtctcatccaatttg

SEQ ID NO: 263571 - DNA, 75 bp, Artificial Sequence
  Synthetic
gttcatcacaaccacacatgtagtgccaactggtgtgaaagaattctttggtgagcccctatctagtatagcaat

SEQ ID NO: 263572 - DNA, 75 bp, Artificial Sequence
  Synthetic
ccaactggtgtgaaagaattctttggtgagcccctatctagtatagcaatccaccaagcaggtgagttcacacaa

SEQ ID NO: 263573 - DNA, 75 bp, Artificial Sequence
  Synthetic
tacaacacttttatcaagagtcagccccagcacaatcctcggtggctctgctgaggtatgtgaatccagacacag

SEQ ID NO: 263574 - DNA, 75 bp, Artificial Sequence
  Synthetic
cccagcacaatcctcggtggctctgctgaggtatgtgaatccagacacaggtcgcaccctatttgaggccaaatt

SEQ ID NO: 263575 - DNA, 75 bp, Artificial Sequence
  Synthetic
cgcttctatcaattaaagcctgtgggaacgaccggtccggtccgtaggctaggcattcggaggtcataatggccc

SEQ ID NO: 263576 - DNA, 75 bp, Artificial Sequence
  Synthetic
ctgcgctccaacaccagcgctttcagcaggatctcacgttgcaaagtaacaccttcaaacatgacaaagagatgc

SEQ ID NO: 263577 - DNA, 75 bp, Artificial Sequence
  Synthetic
tcaggttcccaaagccagtgaggcccgatgtctctgggttgatattagaagaaggggcccctgaaggaacagtgt

SEQ ID NO: 263578 - DNA, 75 bp, Artificial Sequence
  Synthetic
tgctcagtcctaattaaacgggattcgggtgaactacttccgctagccgtccgtatgggggctattgcctccatg

SEQ ID NO: 263579 - DNA, 75 bp, Artificial Sequence
  Synthetic
cgggtgaactacttccgctagccgtccgtatgggggctattgcctccatgaggatacagggtcggcttgtccatg

SEQ ID NO: 263580 - DNA, 75 bp, Artificial Sequence
  Synthetic
gtttgattcttgggttaaccaattttactcattagcccccatgggaactggcaatgggcgcagaaggatgcagta

SEQ ID NO: 263581 - DNA, 75 bp, Artificial Sequence
  Synthetic
tactcattagcccccatgggaactggcaatgggcgcagaaggatgcagtaatggctggagcttttatagcaggac

SEQ ID NO: 263582 - DNA, 75 bp, Artificial Sequence
  Synthetic
gcaggatctcacgttgcaaagtaacaccttcaaacatgacaaagagatgcttgggttgcaggttggggcgtctac

SEQ ID NO: 263583 - DNA, 75 bp, Artificial Sequence
  Synthetic
acggttggtggttggtgctccagccacgcgtgttgtggattggaacggcaccagggtgtcagctccacggtcatc

SEQ ID NO: 263584 - DNA, 75 bp, Artificial Sequence
  Synthetic
ccagatgggcatgctgctcactggagccaacgctaagaatatggatttaggtaccggtcccggggattgtggttg

SEQ ID NO: 263585 - DNA, 75 bp, Artificial Sequence
  Synthetic
caccatacgtccacaagcgcgggaatgactgggttgtgtgtggagtccacgctgcagccacaaagtcaggcaaca

SEQ ID NO: 263586 - DNA, 75 bp, Artificial Sequence
  Synthetic
tgactgggttgtgtgtggagtccacgctgcagccacaaagtcaggcaacaccgtggtctgcgctgtacaggctgg

SEQ ID NO: 263587 - DNA, 75 bp, Artificial Sequence
  Synthetic
attttgaaaacaacaaacagctgcaacaggcttcttttaatcatgacaaagagatgctgcaagcccaaattcaag

SEQ ID NO: 263588 - DNA, 75 bp, Artificial Sequence
  Synthetic
ctcatattaggtgtgcacaaaccaccagccgccattagcctcgccagaatagaactaacaccactctccttgttc

SEQ ID NO: 263589 - DNA, 75 bp, Artificial Sequence
  Synthetic
acaggcttcttttaatcatgacaaagagatgctgcaagcccaaattcaagccaccaaacagctacaggctgacat

SEQ ID NO: 263590 - DNA, 75 bp, Artificial Sequence
  Synthetic
aactatggctcagtagcctcctctagaactgctgactgggtttcttctcaaaattcaacccggtcttctcttggc

SEQ ID NO: 263591 - DNA, 75 bp, Artificial Sequence
  Synthetic
gatggtgaggcggtgttagaagggggagaggaccacggcacctactgtggagccccaatactggcccctggtaaa

SEQ ID NO: 263592 - DNA, 75 bp, Artificial Sequence
  Synthetic
cccagcactgtcaactaaaacaaaattctggaggtcctccccagaaccactgccccccggagtatatgagccagc

SEQ ID NO: 263593 - DNA, 75 bp, Artificial Sequence
  Synthetic
ttctggaggtcctccccagaaccactgccccccggagtatatgagccagcatacctggggggcaaggacccccgt

SEQ ID NO: 263594 - DNA, 75 bp, Artificial Sequence
  Synthetic
accaatgacccaagtgttggactggaatggaactaggcattgggcccctggagcctcaaggactaccagcttctc

SEQ ID NO: 263595 - DNA, 75 bp, Artificial Sequence
  Synthetic
aatggaactaggcattgggcccctggagcctcaaggactaccagcttctctggtgggttcaccaactccacccgt

SEQ ID NO: 263596 - DNA, 75 bp, Artificial Sequence
  Synthetic
gaactgctgactgggtttcttctcaaaattcaacccggtcttctcttggcccttatcatcctagtgcattacaga

SEQ ID NO: 263597 - DNA, 75 bp, Artificial Sequence
  Synthetic
atactgataggttgcctctattcgcaaatatgaggaaatgatttttgtaatatgaaatgtgggcatcatattcaa

SEQ ID NO: 263598 - DNA, 75 bp, Artificial Sequence
  Synthetic
gcgtggagaaagggccatcacttcagcaagtgatgcgagaccaactcaaacccttcacagagcccaggggcaagc

SEQ ID NO: 263599 - DNA, 75 bp, Artificial Sequence
  Synthetic
cctgagcctggcctactggaggctgcggttgagactgtaacatccatgttagaacagacaatggataccccaagc

SEQ ID NO: 263600 - DNA, 75 bp, Artificial Sequence
  Synthetic
cggttgagactgtaacatccatgttagaacagacaatggataccccaagcccgtggtcttacgctgatgcctgcc

SEQ ID NO: 263601 - DNA, 75 bp, Artificial Sequence
  Synthetic
actgtttcatcttcttccacccgttcgactgtggttactagttcttctactgccccttccactaggtcttctatg

SEQ ID NO: 263602 - DNA, 75 bp, Artificial Sequence
  Synthetic
cgactgtggttactagttcttctactgccccttccactaggtcttctatgactagaaattcaccccgtagtgctt

SEQ ID NO: 263603 - DNA, 75 bp, Artificial Sequence
  Synthetic
gcaagtgatgcgagaccaactcaaacccttcacagagcccaggggcaagccacctagaccgtcagtactggagga

SEQ ID NO: 263604 - DNA, 75 bp, Artificial Sequence
  Synthetic
aaatatgaggaaatgatttttgtaatatgaaatgtgggcatcatattcaattagatctaattatattttgatttg

SEQ ID NO: 263605 - DNA, 75 bp, Artificial Sequence
  Synthetic
cgcttcactggataaaacaacatccagtggcagccctcatcatgtcaggaagaatgaacactggaacggggaatc

SEQ ID NO: 263606 - DNA, 75 bp, Artificial Sequence
  Synthetic
tcgttggagagctcggtgagcaagctgcacacgccaacaatatgtatgagaatgctaaacatatgaaacccattt

SEQ ID NO: 263607 - DNA, 75 bp, Artificial Sequence
  Synthetic
tgcacacgccaacaatatgtatgagaatgctaaacatatgaaacccatttacactgcagccttaaaagatgaact

SEQ ID NO: 263608 - DNA, 75 bp, Artificial Sequence
  Synthetic
ttagagggtcgttgcaaacagccttcgtgtcgccgccctccagtaaggcctctagtaatggcactgtctcaactg

SEQ ID NO: 263609 - DNA, 75 bp, Artificial Sequence
  Synthetic
ttagagggtcgttgcaaacagccttcgtgtcgccgccctccagtaaggcctcttgtaatggcactgtctcaactg

SEQ ID NO: 263610 - DNA, 75 bp, Artificial Sequence
  Synthetic
ttagagggtcgttgcaaacagccttcgtgtcgccgccctccagtaaggcctctcgtaatggcactgtctcaactg

SEQ ID NO: 263611 - DNA, 75 bp, Artificial Sequence
  Synthetic
ttagagggtcgttgcaaacagccttcgtgtcgccgccctccagtaaggcctctggtaatggcactgtctcaactg

SEQ ID NO: 263612 - DNA, 75 bp, Artificial Sequence
  Synthetic
agtggcagccctcatcatgtcaggaagaatgaacactggaacggggaatctttcactgggcctcttgcagatcaa

SEQ ID NO: 263613 - DNA, 75 bp, Artificial Sequence
  Synthetic
ctggtgaaaactgataaaatctacaagaaaatcaagaagaggctgttgtggggatctgatctgggaacaatgctg

SEQ ID NO: 263614 - DNA, 75 bp, Artificial Sequence
  Synthetic
ggccgcccgggcttttggcccattttgtgacgctataaaatcacatgtcatcaaattgccaataaaagttggcat

SEQ ID NO: 263615 - DNA, 75 bp, Artificial Sequence
  Synthetic
tgtgacgctataaaatcacatgtcatcaaattgccaataaaagttggcatgaacacaatagaagatggccccctc

SEQ ID NO: 263616 - DNA, 75 bp, Artificial Sequence
  Synthetic
ggaggggggagtcacaagcttagtgaaaagattatggttttctttctatctcttttcttttgttgaaaatcttat

SEQ ID NO: 263617 - DNA, 75 bp, Artificial Sequence
  Synthetic
gttcttcccgaagaaagaggaggcaaatgagctggctatagtgagatccattgaggacgcagttctggatctcga

SEQ ID NO: 263618 - DNA, 75 bp, Artificial Sequence
  Synthetic
agaaaatcaagaagaggctgttgtggggatctgatctgggaacaatgctgaggtgcgctcgggcatttggaggat

SEQ ID NO: 263619 - DNA, 75 bp, Artificial Sequence
  Synthetic
tcatatttgaaaaacattctaaatacacctaccactatgatgctgattactctagatgggactcaacacagcaga

SEQ ID NO: 263620 - DNA, 75 bp, Artificial Sequence
  Synthetic
caaattatgacagaatccttctccattatgtcgcgccttacggcctcaccagaattggccgaggttgtggcccaa

SEQ ID NO: 263621 - DNA, 75 bp, Artificial Sequence
  Synthetic
ttatgtcgcgccttacggcctcaccagaattggccgaggttgtggcccaagatttgctagcaccatctgagatgg

SEQ ID NO: 263622 - DNA, 75 bp, Artificial Sequence
  Synthetic
cacctaccactatgatgctgattactctagatgggactcaacacagcagagggctgtactgagtgcagccatgga

SEQ ID NO: 263623 - DNA, 75 bp, Artificial Sequence
  Synthetic
tgacgtgggtgatttcgtcatctccgttcaagaaggtcttccatcgggtgtcccctgcacgtcacagtggaattc

SEQ ID NO: 263624 - DNA, 75 bp, Artificial Sequence
  Synthetic
taaatcactggataattactctctgtgcactgtctgaggccactggtttatcacctgatgtggtgcaatccatgt

SEQ ID NO: 263625 - DNA, 75 bp, Artificial Sequence
  Synthetic
tgcactgtctgaggccactggtttatcacctgatgtggtgcaatccatgtcatatttctcattttatggtgatga

SEQ ID NO: 263626 - DNA, 75 bp, Artificial Sequence
  Synthetic
ggaatagggaagacccaccttgctagggaagtggctaagagaattgcagcctcccttacaggagatcagcgtgtg

SEQ ID NO: 263627 - DNA, 75 bp, Artificial Sequence
  Synthetic
ctcccttacaggagatcagcgtgtgggcctcatcccacgcaacggcgtcgaccactgggattcgtacagggggga

SEQ ID NO: 263628 - DNA, 75 bp, Artificial Sequence
  Synthetic
gttcaagaaggtcttccatcgggtgtcccctgcacgtcacagtggaattcaatcgctcactggatcctgaccctc

SEQ ID NO: 263629 - DNA, 75 bp, Artificial Sequence
  Synthetic
gatgaaatagtcagcacagacataaacctggatccggaaaaactcaccaggaaactgagggagtatggcctcgtc

SEQ ID NO: 263630 - DNA, 75 bp, Artificial Sequence
  Synthetic
aacaaggcctgacaaaacagaaggaccaatacaagtgaggaaaaatgtggatggactggtcttcttgcggcgcac

SEQ ID NO: 263631 - DNA, 75 bp, Artificial Sequence
  Synthetic
ccaatacaagtgaggaaaaatgtggatggactggtcttcttgcggcgcaccatttcccgtgatgcggcagggttc

SEQ ID NO: 263632 - DNA, 75 bp, Artificial Sequence
  Synthetic
acctggatccggaaaaactcaccaggaaactgagggagtatggcctcgtcccaactaggccagacaaaactgagg

SEQ ID NO: 263633 - DNA, 75 bp, Artificial Sequence
  Synthetic
tcgaggcgcatcgacttcctcgtgtatgcagaagcccctgaagtcgaaaaggcgaagcgtgacttcccaggccaa

SEQ ID NO: 263634 - DNA, 75 bp, Artificial Sequence
  Synthetic
ggtttggcaaattggaccgtgactccatcctaaggcagttgtattggaccagagggcccaaccatgagaacccct

SEQ ID NO: 263635 - DNA, 75 bp, Artificial Sequence
  Synthetic
gagactctagtgccacacactcaaagaaaaatacagttgatttcacttctaggggaagcttcactccatggtgag

SEQ ID NO: 263636 - DNA, 75 bp, Artificial Sequence
  Synthetic
gaaaaatacagttgatttcacttctaggggaagcttcactccatggtgagaaattttacagaaagatttccagca

SEQ ID NO: 263637 - DNA, 75 bp, Artificial Sequence
  Synthetic
catcctaaggcagttgtattggaccagagggcccaaccatgagaacccctttgaaagcatgattccccactccca

SEQ ID NO: 263638 - DNA, 75 bp, Artificial Sequence
  Synthetic
gcttccatgacctcggattgtggacaggagatcgcgatcttctgcccgaattcgtaaatgatgatggcgtctaag

SEQ ID NO: 263639 - DNA, 75 bp, Artificial Sequence
  Synthetic
aggagatcgcgatcttctgcccgaattcgtaaatgatgatggcgtctaaggacgctacatcaagcgtggatggcg

SEQ ID NO: 263640 - DNA, 75 bp, Artificial Sequence
  Synthetic
gacaggaggccatgttcagatggatgagattttcagacctcagcacgtgggagggcgatcgcaatctggctcccg

SEQ ID NO: 263641 - DNA, 75 bp, Artificial Sequence
  Synthetic
gggttaatggaaacaatgaaagtcgggagacagctcaaggacgtcaggacaatgccagagctaaaacaagcactc

SEQ ID NO: 263642 - DNA, 75 bp, Artificial Sequence
  Synthetic
gggttaatggaaacaatgaaagtcgggagacagctcaaggacgtcaggacaatgccagagcttaaacaagcactc

SEQ ID NO: 263643 - DNA, 75 bp, Artificial Sequence
  Synthetic
gggttaatggaaacaatgaaagtcgggagacagctcaaggacgtcaggacaatgccagagctcaaacaagcactc

SEQ ID NO: 263644 - DNA, 75 bp, Artificial Sequence
  Synthetic
gggttaatggaaacaatgaaagtcgggagacagctcaaggacgtcaggacaatgccagagctgaaacaagcactc

SEQ ID NO: 263645 - DNA, 75 bp, Artificial Sequence
  Synthetic
cgcggctggcctcgtaccagagatcaaccatgaggtcatggccatagaacctgttgcaggggcctctttagcagc

SEQ ID NO: 263646 - DNA, 75 bp, Artificial Sequence
  Synthetic
cgacagcagtcgcgactgctggacaagttaatcctattgatccctggataattaataattttgtgcaagcccccc

SEQ ID NO: 263647 - DNA, 75 bp, Artificial Sequence
  Synthetic
agttaatcctattgatccctggataattaataattttgtgcaagccccccaaggtgaatttactatttccccaaa

SEQ ID NO: 263648 - DNA, 75 bp, Artificial Sequence
  Synthetic
cacacttgagtccgatggcaagggcagtgtgaaagttgacagagttcagagtgcctccgtgcagaccaacaatga

SEQ ID NO: 263649 - DNA, 75 bp, Artificial Sequence
  Synthetic
aaccatgaggtcatggccatagaacctgttgcaggggcctctttagcagcccctgtcgtaggacaactcaatata

SEQ ID NO: 263650 - DNA, 75 bp, Artificial Sequence
  Synthetic
ggtgaatttttattagatctagagttaggccctgagttgaacccctaccttgctcaccttgcacgcatgtataat

SEQ ID NO: 263651 - DNA, 75 bp, Artificial Sequence
  Synthetic
aatgtataatggttgggttggtaacatgagagtcaggattatgctagctggtaatgcctttactgcggggaagat

SEQ ID NO: 263652 - DNA, 75 bp, Artificial Sequence
  Synthetic
atgagagtcaggattatgctagctggtaatgcctttactgcggggaagataatagtttcctgcataccccctggt

SEQ ID NO: 263653 - DNA, 75 bp, Artificial Sequence
  Synthetic
taggccctgagttgaacccctaccttgctcaccttgcacgcatgtataatgggcatgcaggtggtatggaggtgc

SEQ ID NO: 263654 - DNA, 75 bp, Artificial Sequence
  Synthetic
aaaatttgtcacctgcacaattgaccatgtgcccgcatgtagtggtggatgtgaggcagcttgaaccaatcttgc

SEQ ID NO: 263655 - DNA, 75 bp, Artificial Sequence
  Synthetic
cccattgaggtgcctttggaagatgttaggaatgttctctttcataataatgatagaaatcaacaaaccatgcgc

SEQ ID NO: 263656 - DNA, 75 bp, Artificial Sequence
  Synthetic
ttaggaatgttctctttcataataatgatagaaatcaacaaaccatgcgccttgtgtgcatgctgtacacccccc

SEQ ID NO: 263657 - DNA, 75 bp, Artificial Sequence
  Synthetic
catgtgcccgcatgtagtggtggatgtgaggcagcttgaaccaatcttgctgcccatgccagacatccgcaatac

SEQ ID NO: 263658 - DNA, 75 bp, Artificial Sequence
  Synthetic
gtgaatgaagactttgacgacatggattcttccaccgttaaagttactggtcccctagccgcaaaagctagtgat

SEQ ID NO: 263659 - DNA, 75 bp, Artificial Sequence
  Synthetic
ttagttaaaactgacaaaatttatggtaagatcaagaagaggcttctctggggctcggacctggcgaccatgatc

SEQ ID NO: 263660 - DNA, 75 bp, Artificial Sequence
  Synthetic
attcttccaccgttaaagttactggtcccctagccgcaaaagctagtgatccagattctaccttcgctaaactca

SEQ ID NO: 263661 - DNA, 75 bp, Artificial Sequence
  Synthetic
taatgctggtgaagatgttttcacagtttcttgcagggttctgacccgcccatcaccagactttgaatttaattt

SEQ ID NO: 263662 - DNA, 75 bp, Artificial Sequence
  Synthetic
atttcttgtttttagtccctcctacggtggagcagaaaaccaggcccttcacactcccaaatctgccattgagtt

SEQ ID NO: 263663 - DNA, 75 bp, Artificial Sequence
  Synthetic
ggtggagcagaaaaccaggcccttcacactcccaaatctgccattgagttctctgtctaactcacgtgcccctct

SEQ ID NO: 263664 - DNA, 75 bp, Artificial Sequence
  Synthetic
gtttcttgcagggttctgacccgcccatcaccagactttgaatttaatttccttgtccccccttctgttgaatct

SEQ ID NO: 263665 - DNA, 75 bp, Artificial Sequence
  Synthetic
tggccgcgcccccccttggcagtcccccaattgccctccctccaggttgggagcctgcggaacccaaacgagagg

SEQ ID NO: 263666 - DNA, 75 bp, Artificial Sequence
  Synthetic
cccaattgccctccctccaggttgggagcctgcggaacccaaacgagaggaggtggaccaattcccagtacgctt

SEQ ID NO: 263667 - DNA, 75 bp, Artificial Sequence
  Synthetic
cacacggctgccgctcgtgggggaaacactgtcatatgtgccacccaggggagtgagggagaagccacactagaa

SEQ ID NO: 263668 - DNA, 75 bp, Artificial Sequence
  Synthetic
cacacggctgccgctcgtgggggaaacactgtcatatgtgccacccaggggagtgagggagaagccacactagat

SEQ ID NO: 263669 - DNA, 75 bp, Artificial Sequence
  Synthetic
cacacggctgccgctcgtgggggaaacactgtcatatgtgccacccaggggagtgagggagaagccacactagac

SEQ ID NO: 263670 - DNA, 75 bp, Artificial Sequence
  Synthetic
cacacggctgccgctcgtgggggaaacactgtcatatgtgccacccaggggagtgagggagaagccacactagag

SEQ ID NO: 263671 - DNA, 75 bp, Artificial Sequence
  Synthetic
cacacggctgccgctcgtgggggaaacactgtcatatgtgccacccaggggagtgagggagaagccacacttgaa

SEQ ID NO: 263672 - DNA, 75 bp, Artificial Sequence
  Synthetic
cacacggctgccgctcgtgggggaaacactgtcatatgtgccacccaggggagtgagggagaagccacacttgat

SEQ ID NO: 263673 - DNA, 75 bp, Artificial Sequence
  Synthetic
cacacggctgccgctcgtgggggaaacactgtcatatgtgccacccaggggagtgagggagaagccacacttgac

SEQ ID NO: 263674 - DNA, 75 bp, Artificial Sequence
  Synthetic
cacacggctgccgctcgtgggggaaacactgtcatatgtgccacccaggggagtgagggagaagccacacttgag

SEQ ID NO: 263675 - DNA, 75 bp, Artificial Sequence
  Synthetic
cacacggctgccgctcgtgggggaaacactgtcatatgtgccacccaggggagtgagggagaagccacactcgaa

SEQ ID NO: 263676 - DNA, 75 bp, Artificial Sequence
  Synthetic
cacacggctgccgctcgtgggggaaacactgtcatatgtgccacccaggggagtgagggagaagccacactcgat

SEQ ID NO: 263677 - DNA, 75 bp, Artificial Sequence
  Synthetic
cacacggctgccgctcgtgggggaaacactgtcatatgtgccacccaggggagtgagggagaagccacactcgac

SEQ ID NO: 263678 - DNA, 75 bp, Artificial Sequence
  Synthetic
cacacggctgccgctcgtgggggaaacactgtcatatgtgccacccaggggagtgagggagaagccacactcgag

SEQ ID NO: 263679 - DNA, 75 bp, Artificial Sequence
  Synthetic
cacacggctgccgctcgtgggggaaacactgtcatatgtgccacccaggggagtgagggagaagccacactggaa

SEQ ID NO: 263680 - DNA, 75 bp, Artificial Sequence
  Synthetic
cacacggctgccgctcgtgggggaaacactgtcatatgtgccacccaggggagtgagggagaagccacactggat

SEQ ID NO: 263681 - DNA, 75 bp, Artificial Sequence
  Synthetic
cacacggctgccgctcgtgggggaaacactgtcatatgtgccacccaggggagtgagggagaagccacactggac

SEQ ID NO: 263682 - DNA, 75 bp, Artificial Sequence
  Synthetic
cacacggctgccgctcgtgggggaaacactgtcatatgtgccacccaggggagtgagggagaagccacactggag

SEQ ID NO: 263683 - DNA, 75 bp, Artificial Sequence
  Synthetic
cacacggctgccgctcgtgggggaaacactgtcatatgtgccacccaggggagtgagggagatgccacactagaa

SEQ ID NO: 263684 - DNA, 75 bp, Artificial Sequence
  Synthetic
cacacggctgccgctcgtgggggaaacactgtcatatgtgccacccaggggagtgagggagatgccacactagat

SEQ ID NO: 263685 - DNA, 75 bp, Artificial Sequence
  Synthetic
cacacggctgccgctcgtgggggaaacactgtcatatgtgccacccaggggagtgagggagatgccacactagac

SEQ ID NO: 263686 - DNA, 75 bp, Artificial Sequence
  Synthetic
cacacggctgccgctcgtgggggaaacactgtcatatgtgccacccaggggagtgagggagatgccacactagag

SEQ ID NO: 263687 - DNA, 75 bp, Artificial Sequence
  Synthetic
cacacggctgccgctcgtgggggaaacactgtcatatgtgccacccaggggagtgagggagatgccacacttgaa

SEQ ID NO: 263688 - DNA, 75 bp, Artificial Sequence
  Synthetic
cacacggctgccgctcgtgggggaaacactgtcatatgtgccacccaggggagtgagggagatgccacacttgat

SEQ ID NO: 263689 - DNA, 75 bp, Artificial Sequence
  Synthetic
cacacggctgccgctcgtgggggaaacactgtcatatgtgccacccaggggagtgagggagatgccacacttgac

SEQ ID NO: 263690 - DNA, 75 bp, Artificial Sequence
  Synthetic
cacacggctgccgctcgtgggggaaacactgtcatatgtgccacccaggggagtgagggagatgccacacttgag

SEQ ID NO: 263691 - DNA, 75 bp, Artificial Sequence
  Synthetic
cacacggctgccgctcgtgggggaaacactgtcatatgtgccacccaggggagtgagggagatgccacactcgaa

SEQ ID NO: 263692 - DNA, 75 bp, Artificial Sequence
  Synthetic
cacacggctgccgctcgtgggggaaacactgtcatatgtgccacccaggggagtgagggagatgccacactcgat

SEQ ID NO: 263693 - DNA, 75 bp, Artificial Sequence
  Synthetic
cacacggctgccgctcgtgggggaaacactgtcatatgtgccacccaggggagtgagggagatgccacactcgac

SEQ ID NO: 263694 - DNA, 75 bp, Artificial Sequence
  Synthetic
cacacggctgccgctcgtgggggaaacactgtcatatgtgccacccaggggagtgagggagatgccacactcgag

SEQ ID NO: 263695 - DNA, 75 bp, Artificial Sequence
  Synthetic
cacacggctgccgctcgtgggggaaacactgtcatatgtgccacccaggggagtgagggagatgccacactggaa

SEQ ID NO: 263696 - DNA, 75 bp, Artificial Sequence
  Synthetic
cacacggctgccgctcgtgggggaaacactgtcatatgtgccacccaggggagtgagggagatgccacactggat

SEQ ID NO: 263697 - DNA, 75 bp, Artificial Sequence
  Synthetic
cacacggctgccgctcgtgggggaaacactgtcatatgtgccacccaggggagtgagggagatgccacactggac

SEQ ID NO: 263698 - DNA, 75 bp, Artificial Sequence
  Synthetic
cacacggctgccgctcgtgggggaaacactgtcatatgtgccacccaggggagtgagggagatgccacactggag

SEQ ID NO: 263699 - DNA, 75 bp, Artificial Sequence
  Synthetic
cacacggctgccgctcgtgggggaaacactgtcatatgtgccacccaggggagtgagggagacgccacactagaa

SEQ ID NO: 263700 - DNA, 75 bp, Artificial Sequence
  Synthetic
cacacggctgccgctcgtgggggaaacactgtcatatgtgccacccaggggagtgagggagacgccacactagat

SEQ ID NO: 263701 - DNA, 75 bp, Artificial Sequence
  Synthetic
cacacggctgccgctcgtgggggaaacactgtcatatgtgccacccaggggagtgagggagacgccacactagac

SEQ ID NO: 263702 - DNA, 75 bp, Artificial Sequence
  Synthetic
cacacggctgccgctcgtgggggaaacactgtcatatgtgccacccaggggagtgagggagacgccacactagag

SEQ ID NO: 263703 - DNA, 75 bp, Artificial Sequence
  Synthetic
cacacggctgccgctcgtgggggaaacactgtcatatgtgccacccaggggagtgagggagacgccacacttgaa

SEQ ID NO: 263704 - DNA, 75 bp, Artificial Sequence
  Synthetic
cacacggctgccgctcgtgggggaaacactgtcatatgtgccacccaggggagtgagggagacgccacacttgat

SEQ ID NO: 263705 - DNA, 75 bp, Artificial Sequence
  Synthetic
cacacggctgccgctcgtgggggaaacactgtcatatgtgccacccaggggagtgagggagacgccacacttgac

SEQ ID NO: 263706 - DNA, 75 bp, Artificial Sequence
  Synthetic
cacacggctgccgctcgtgggggaaacactgtcatatgtgccacccaggggagtgagggagacgccacacttgag

SEQ ID NO: 263707 - DNA, 75 bp, Artificial Sequence
  Synthetic
cacacggctgccgctcgtgggggaaacactgtcatatgtgccacccaggggagtgagggagacgccacactcgaa

SEQ ID NO: 263708 - DNA, 75 bp, Artificial Sequence
  Synthetic
cacacggctgccgctcgtgggggaaacactgtcatatgtgccacccaggggagtgagggagacgccacactcgat

SEQ ID NO: 263709 - DNA, 75 bp, Artificial Sequence
  Synthetic
cacacggctgccgctcgtgggggaaacactgtcatatgtgccacccaggggagtgagggagacgccacactcgac

SEQ ID NO: 263710 - DNA, 75 bp, Artificial Sequence
  Synthetic
cacacggctgccgctcgtgggggaaacactgtcatatgtgccacccaggggagtgagggagacgccacactcgag

SEQ ID NO: 263711 - DNA, 75 bp, Artificial Sequence
  Synthetic
cacacggctgccgctcgtgggggaaacactgtcatatgtgccacccaggggagtgagggagacgccacactggaa

SEQ ID NO: 263712 - DNA, 75 bp, Artificial Sequence
  Synthetic
cacacggctgccgctcgtgggggaaacactgtcatatgtgccacccaggggagtgagggagacgccacactggat

SEQ ID NO: 263713 - DNA, 75 bp, Artificial Sequence
  Synthetic
cacacggctgccgctcgtgggggaaacactgtcatatgtgccacccaggggagtgagggagacgccacactggac

SEQ ID NO: 263714 - DNA, 75 bp, Artificial Sequence
  Synthetic
cacacggctgccgctcgtgggggaaacactgtcatatgtgccacccaggggagtgagggagacgccacactggag

SEQ ID NO: 263715 - DNA, 75 bp, Artificial Sequence
  Synthetic
cacacggctgccgctcgtgggggaaacactgtcatatgtgccacccaggggagtgagggagaggccacactagaa

SEQ ID NO: 263716 - DNA, 75 bp, Artificial Sequence
  Synthetic
cacacggctgccgctcgtgggggaaacactgtcatatgtgccacccaggggagtgagggagaggccacactagat

SEQ ID NO: 263717 - DNA, 75 bp, Artificial Sequence
  Synthetic
cacacggctgccgctcgtgggggaaacactgtcatatgtgccacccaggggagtgagggagaggccacactagac

SEQ ID NO: 263718 - DNA, 75 bp, Artificial Sequence
  Synthetic
cacacggctgccgctcgtgggggaaacactgtcatatgtgccacccaggggagtgagggagaggccacactagag

SEQ ID NO: 263719 - DNA, 75 bp, Artificial Sequence
  Synthetic
cacacggctgccgctcgtgggggaaacactgtcatatgtgccacccaggggagtgagggagaggccacacttgaa

SEQ ID NO: 263720 - DNA, 75 bp, Artificial Sequence
  Synthetic
cacacggctgccgctcgtgggggaaacactgtcatatgtgccacccaggggagtgagggagaggccacacttgat

SEQ ID NO: 263721 - DNA, 75 bp, Artificial Sequence
  Synthetic
cacacggctgccgctcgtgggggaaacactgtcatatgtgccacccaggggagtgagggagaggccacacttgac

SEQ ID NO: 263722 - DNA, 75 bp, Artificial Sequence
  Synthetic
cacacggctgccgctcgtgggggaaacactgtcatatgtgccacccaggggagtgagggagaggccacacttgag

SEQ ID NO: 263723 - DNA, 75 bp, Artificial Sequence
  Synthetic
cacacggctgccgctcgtgggggaaacactgtcatatgtgccacccaggggagtgagggagaggccacactcgaa

SEQ ID NO: 263724 - DNA, 75 bp, Artificial Sequence
  Synthetic
cacacggctgccgctcgtgggggaaacactgtcatatgtgccacccaggggagtgagggagaggccacactcgat

SEQ ID NO: 263725 - DNA, 75 bp, Artificial Sequence
  Synthetic
cacacggctgccgctcgtgggggaaacactgtcatatgtgccacccaggggagtgagggagaggccacactcgac

SEQ ID NO: 263726 - DNA, 75 bp, Artificial Sequence
  Synthetic
cacacggctgccgctcgtgggggaaacactgtcatatgtgccacccaggggagtgagggagaggccacactcgag

SEQ ID NO: 263727 - DNA, 75 bp, Artificial Sequence
  Synthetic
cacacggctgccgctcgtgggggaaacactgtcatatgtgccacccaggggagtgagggagaggccacactggaa

SEQ ID NO: 263728 - DNA, 75 bp, Artificial Sequence
  Synthetic
cacacggctgccgctcgtgggggaaacactgtcatatgtgccacccaggggagtgagggagaggccacactggat

SEQ ID NO: 263729 - DNA, 75 bp, Artificial Sequence
  Synthetic
cacacggctgccgctcgtgggggaaacactgtcatatgtgccacccaggggagtgagggagaggccacactggac

SEQ ID NO: 263730 - DNA, 75 bp, Artificial Sequence
  Synthetic
cacacggctgccgctcgtgggggaaacactgtcatatgtgccacccaggggagtgagggagaggccacactggag

SEQ ID NO: 263731 - DNA, 75 bp, Artificial Sequence
  Synthetic
cagatgtatactagtaggaatgaaaatatagttgttcaaccacagaatggtagggtgacacttgatggagagcta

SEQ ID NO: 263732 - DNA, 75 bp, Artificial Sequence
  Synthetic
tggccgcctggttggcaccaccccagtttcattgtcacatgttgccaagataagagggacctccaatggcactgt

SEQ ID NO: 263733 - DNA, 75 bp, Artificial Sequence
  Synthetic
gtttcattgtcacatgttgccaagataagagggacctccaatggcactgtaatcaaccttactgaattggatggc

SEQ ID NO: 263734 - DNA, 75 bp, Artificial Sequence
  Synthetic
accaaattctggagatcgtccacagcaccactcccacctagcacctatgaaccagcctatcttggtggaagggaa

SEQ ID NO: 263735 - DNA, 75 bp, Artificial Sequence
  Synthetic
accaaattctggagatcgtccacagcaccactcccacctagcacctatgaaccagcctatcttggtggaagggat

SEQ ID NO: 263736 - DNA, 75 bp, Artificial Sequence
  Synthetic
accaaattctggagatcgtccacagcaccactcccacctagcacctatgaaccagcctatcttggtggaagggac

SEQ ID NO: 263737 - DNA, 75 bp, Artificial Sequence
  Synthetic
accaaattctggagatcgtccacagcaccactcccacctagcacctatgaaccagcctatcttggtggaagggag

SEQ ID NO: 263738 - DNA, 75 bp, Artificial Sequence
  Synthetic
accaaattctggagatcgtccacagcaccactcccacctagcacctatgaaccagcctatcttggtggtagggaa

SEQ ID NO: 263739 - DNA, 75 bp, Artificial Sequence
  Synthetic
accaaattctggagatcgtccacagcaccactcccacctagcacctatgaaccagcctatcttggtggtagggat

SEQ ID NO: 263740 - DNA, 75 bp, Artificial Sequence
  Synthetic
accaaattctggagatcgtccacagcaccactcccacctagcacctatgaaccagcctatcttggtggtagggac

SEQ ID NO: 263741 - DNA, 75 bp, Artificial Sequence
  Synthetic
accaaattctggagatcgtccacagcaccactcccacctagcacctatgaaccagcctatcttggtggtagggag

SEQ ID NO: 263742 - DNA, 75 bp, Artificial Sequence
  Synthetic
accaaattctggagatcgtccacagcaccactcccacctagcacctatgaaccagcctatcttggtggcagggaa

SEQ ID NO: 263743 - DNA, 75 bp, Artificial Sequence
  Synthetic
accaaattctggagatcgtccacagcaccactcccacctagcacctatgaaccagcctatcttggtggcagggat

SEQ ID NO: 263744 - DNA, 75 bp, Artificial Sequence
  Synthetic
accaaattctggagatcgtccacagcaccactcccacctagcacctatgaaccagcctatcttggtggcagggac

SEQ ID NO: 263745 - DNA, 75 bp, Artificial Sequence
  Synthetic
accaaattctggagatcgtccacagcaccactcccacctagcacctatgaaccagcctatcttggtggcagggag

SEQ ID NO: 263746 - DNA, 75 bp, Artificial Sequence
  Synthetic
accaaattctggagatcgtccacagcaccactcccacctagcacctatgaaccagcctatcttggtgggagggaa

SEQ ID NO: 263747 - DNA, 75 bp, Artificial Sequence
  Synthetic
accaaattctggagatcgtccacagcaccactcccacctagcacctatgaaccagcctatcttggtgggagggat

SEQ ID NO: 263748 - DNA, 75 bp, Artificial Sequence
  Synthetic
accaaattctggagatcgtccacagcaccactcccacctagcacctatgaaccagcctatcttggtgggagggac

SEQ ID NO: 263749 - DNA, 75 bp, Artificial Sequence
  Synthetic
accaaattctggagatcgtccacagcaccactcccacctagcacctatgaaccagcctatcttggtgggagggag

SEQ ID NO: 263750 - DNA, 75 bp, Artificial Sequence
  Synthetic
accaaattctggagatcgtccacagcaccactcccaccttgcacctatgaaccagcctatcttggtggaagggaa

SEQ ID NO: 263751 - DNA, 75 bp, Artificial Sequence
  Synthetic
accaaattctggagatcgtccacagcaccactcccaccttgcacctatgaaccagcctatcttggtggaagggat

SEQ ID NO: 263752 - DNA, 75 bp, Artificial Sequence
  Synthetic
accaaattctggagatcgtccacagcaccactcccaccttgcacctatgaaccagcctatcttggtggaagggac

SEQ ID NO: 263753 - DNA, 75 bp, Artificial Sequence
  Synthetic
accaaattctggagatcgtccacagcaccactcccaccttgcacctatgaaccagcctatcttggtggaagggag

SEQ ID NO: 263754 - DNA, 75 bp, Artificial Sequence
  Synthetic
accaaattctggagatcgtccacagcaccactcccaccttgcacctatgaaccagcctatcttggtggtagggaa

SEQ ID NO: 263755 - DNA, 75 bp, Artificial Sequence
  Synthetic
accaaattctggagatcgtccacagcaccactcccaccttgcacctatgaaccagcctatcttggtggtagggat

SEQ ID NO: 263756 - DNA, 75 bp, Artificial Sequence
  Synthetic
accaaattctggagatcgtccacagcaccactcccaccttgcacctatgaaccagcctatcttggtggtagggac

SEQ ID NO: 263757 - DNA, 75 bp, Artificial Sequence
  Synthetic
accaaattctggagatcgtccacagcaccactcccaccttgcacctatgaaccagcctatcttggtggtagggag

SEQ ID NO: 263758 - DNA, 75 bp, Artificial Sequence
  Synthetic
accaaattctggagatcgtccacagcaccactcccaccttgcacctatgaaccagcctatcttggtggcagggaa

SEQ ID NO: 263759 - DNA, 75 bp, Artificial Sequence
  Synthetic
accaaattctggagatcgtccacagcaccactcccaccttgcacctatgaaccagcctatcttggtggcagggat

SEQ ID NO: 263760 - DNA, 75 bp, Artificial Sequence
  Synthetic
accaaattctggagatcgtccacagcaccactcccaccttgcacctatgaaccagcctatcttggtggcagggac

SEQ ID NO: 263761 - DNA, 75 bp, Artificial Sequence
  Synthetic
accaaattctggagatcgtccacagcaccactcccaccttgcacctatgaaccagcctatcttggtggcagggag

SEQ ID NO: 263762 - DNA, 75 bp, Artificial Sequence
  Synthetic
accaaattctggagatcgtccacagcaccactcccaccttgcacctatgaaccagcctatcttggtgggagggaa

SEQ ID NO: 263763 - DNA, 75 bp, Artificial Sequence
  Synthetic
accaaattctggagatcgtccacagcaccactcccaccttgcacctatgaaccagcctatcttggtgggagggat

SEQ ID NO: 263764 - DNA, 75 bp, Artificial Sequence
  Synthetic
accaaattctggagatcgtccacagcaccactcccaccttgcacctatgaaccagcctatcttggtgggagggac

SEQ ID NO: 263765 - DNA, 75 bp, Artificial Sequence
  Synthetic
accaaattctggagatcgtccacagcaccactcccaccttgcacctatgaaccagcctatcttggtgggagggag

SEQ ID NO: 263766 - DNA, 75 bp, Artificial Sequence
  Synthetic
accaaattctggagatcgtccacagcaccactcccacctcgcacctatgaaccagcctatcttggtggaagggaa

SEQ ID NO: 263767 - DNA, 75 bp, Artificial Sequence
  Synthetic
accaaattctggagatcgtccacagcaccactcccacctcgcacctatgaaccagcctatcttggtggaagggat

SEQ ID NO: 263768 - DNA, 75 bp, Artificial Sequence
  Synthetic
accaaattctggagatcgtccacagcaccactcccacctcgcacctatgaaccagcctatcttggtggaagggac

SEQ ID NO: 263769 - DNA, 75 bp, Artificial Sequence
  Synthetic
accaaattctggagatcgtccacagcaccactcccacctcgcacctatgaaccagcctatcttggtggaagggag

SEQ ID NO: 263770 - DNA, 75 bp, Artificial Sequence
  Synthetic
accaaattctggagatcgtccacagcaccactcccacctcgcacctatgaaccagcctatcttggtggtagggaa

SEQ ID NO: 263771 - DNA, 75 bp, Artificial Sequence
  Synthetic
accaaattctggagatcgtccacagcaccactcccacctcgcacctatgaaccagcctatcttggtggtagggat

SEQ ID NO: 263772 - DNA, 75 bp, Artificial Sequence
  Synthetic
accaaattctggagatcgtccacagcaccactcccacctcgcacctatgaaccagcctatcttggtggtagggac

SEQ ID NO: 263773 - DNA, 75 bp, Artificial Sequence
  Synthetic
accaaattctggagatcgtccacagcaccactcccacctcgcacctatgaaccagcctatcttggtggtagggag

SEQ ID NO: 263774 - DNA, 75 bp, Artificial Sequence
  Synthetic
accaaattctggagatcgtccacagcaccactcccacctcgcacctatgaaccagcctatcttggtggcagggaa

SEQ ID NO: 263775 - DNA, 75 bp, Artificial Sequence
  Synthetic
accaaattctggagatcgtccacagcaccactcccacctcgcacctatgaaccagcctatcttggtggcagggat

SEQ ID NO: 263776 - DNA, 75 bp, Artificial Sequence
  Synthetic
accaaattctggagatcgtccacagcaccactcccacctcgcacctatgaaccagcctatcttggtggcagggac

SEQ ID NO: 263777 - DNA, 75 bp, Artificial Sequence
  Synthetic
accaaattctggagatcgtccacagcaccactcccacctcgcacctatgaaccagcctatcttggtggcagggag

SEQ ID NO: 263778 - DNA, 75 bp, Artificial Sequence
  Synthetic
accaaattctggagatcgtccacagcaccactcccacctcgcacctatgaaccagcctatcttggtgggagggaa

SEQ ID NO: 263779 - DNA, 75 bp, Artificial Sequence
  Synthetic
accaaattctggagatcgtccacagcaccactcccacctcgcacctatgaaccagcctatcttggtgggagggat

SEQ ID NO: 263780 - DNA, 75 bp, Artificial Sequence
  Synthetic
accaaattctggagatcgtccacagcaccactcccacctcgcacctatgaaccagcctatcttggtgggagggac

SEQ ID NO: 263781 - DNA, 75 bp, Artificial Sequence
  Synthetic
accaaattctggagatcgtccacagcaccactcccacctcgcacctatgaaccagcctatcttggtgggagggag

SEQ ID NO: 263782 - DNA, 75 bp, Artificial Sequence
  Synthetic
accaaattctggagatcgtccacagcaccactcccacctggcacctatgaaccagcctatcttggtggaagggaa

SEQ ID NO: 263783 - DNA, 75 bp, Artificial Sequence
  Synthetic
accaaattctggagatcgtccacagcaccactcccacctggcacctatgaaccagcctatcttggtggaagggat

SEQ ID NO: 263784 - DNA, 75 bp, Artificial Sequence
  Synthetic
accaaattctggagatcgtccacagcaccactcccacctggcacctatgaaccagcctatcttggtggaagggac

SEQ ID NO: 263785 - DNA, 75 bp, Artificial Sequence
  Synthetic
accaaattctggagatcgtccacagcaccactcccacctggcacctatgaaccagcctatcttggtggaagggag

SEQ ID NO: 263786 - DNA, 75 bp, Artificial Sequence
  Synthetic
accaaattctggagatcgtccacagcaccactcccacctggcacctatgaaccagcctatcttggtggtagggaa

SEQ ID NO: 263787 - DNA, 75 bp, Artificial Sequence
  Synthetic
accaaattctggagatcgtccacagcaccactcccacctggcacctatgaaccagcctatcttggtggtagggat

SEQ ID NO: 263788 - DNA, 75 bp, Artificial Sequence
  Synthetic
accaaattctggagatcgtccacagcaccactcccacctggcacctatgaaccagcctatcttggtggtagggac

SEQ ID NO: 263789 - DNA, 75 bp, Artificial Sequence
  Synthetic
accaaattctggagatcgtccacagcaccactcccacctggcacctatgaaccagcctatcttggtggtagggag

SEQ ID NO: 263790 - DNA, 75 bp, Artificial Sequence
  Synthetic
accaaattctggagatcgtccacagcaccactcccacctggcacctatgaaccagcctatcttggtggcagggaa

SEQ ID NO: 263791 - DNA, 75 bp, Artificial Sequence
  Synthetic
accaaattctggagatcgtccacagcaccactcccacctggcacctatgaaccagcctatcttggtggcagggat

SEQ ID NO: 263792 - DNA, 75 bp, Artificial Sequence
  Synthetic
accaaattctggagatcgtccacagcaccactcccacctggcacctatgaaccagcctatcttggtggcagggac

SEQ ID NO: 263793 - DNA, 75 bp, Artificial Sequence
  Synthetic
accaaattctggagatcgtccacagcaccactcccacctggcacctatgaaccagcctatcttggtggcagggag

SEQ ID NO: 263794 - DNA, 75 bp, Artificial Sequence
  Synthetic
accaaattctggagatcgtccacagcaccactcccacctggcacctatgaaccagcctatcttggtgggagggaa

SEQ ID NO: 263795 - DNA, 75 bp, Artificial Sequence
  Synthetic
accaaattctggagatcgtccacagcaccactcccacctggcacctatgaaccagcctatcttggtgggagggat

SEQ ID NO: 263796 - DNA, 75 bp, Artificial Sequence
  Synthetic
accaaattctggagatcgtccacagcaccactcccacctggcacctatgaaccagcctatcttggtgggagggac

SEQ ID NO: 263797 - DNA, 75 bp, Artificial Sequence
  Synthetic
accaaattctggagatcgtccacagcaccactcccacctggcacctatgaaccagcctatcttggtgggagggag

SEQ ID NO: 263798 - DNA, 75 bp, Artificial Sequence
  Synthetic
gccgccagtggagcaacggagcgcagagccccctgttgaaccgcccgtgggaactattttggaattctacgaggg

SEQ ID NO: 263799 - DNA, 75 bp, Artificial Sequence
  Synthetic
gagccccctgttgaaccgcccgtgggaactattttggaattctacgagggctacatttttcactacgccatctat

SEQ ID NO: 263800 - DNA, 75 bp, Artificial Sequence
  Synthetic
atatagttgttcaaccacagaatggtagggtgacacttgatggagagctacagggcacaaccacactacaaccgg

SEQ ID NO: 263801 - DNA, 75 bp, Artificial Sequence
  Synthetic
ttgagaatttggacggctcacccgtcgacccgacagatgaagtcccagcccctttgggaacaccagatttccagg

SEQ ID NO: 263802 - DNA, 75 bp, Artificial Sequence
  Synthetic
atgacacagtttggccattctagccagacccagtatgatgtagacaccacccctgacacttttgtcccccatctt

SEQ ID NO: 263803 - DNA, 75 bp, Artificial Sequence
  Synthetic
agacccagtatgatgtagacaccacccctgacacttttgtcccccatcttggttcaattcaggcaaatggcattg

SEQ ID NO: 263804 - DNA, 75 bp, Artificial Sequence
  Synthetic
cgacccgacagatgaagtcccagcccctttgggaacaccagatttccaggcccagctgtttggagttatcagtca

SEQ ID NO: 263805 - DNA, 75 bp, Artificial Sequence
  Synthetic
ctctctgcctggtggcgcgtggcatacatcccgcgcgaccccccacctcgagaccagctcttgtcccttgaaggt

SEQ ID NO: 263806 - DNA, 75 bp, Artificial Sequence
  Synthetic
acatcccgcgcgaccccccacctcgagaccagctcttgtcccttgaaggtgaacggtggccttatgcgtctgtca

SEQ ID NO: 263807 - DNA, 75 bp, Artificial Sequence
  Synthetic
cgcccaggtgcgtttcaaatcaccatccaacgacttctttgacaatgaacccattaaattcacaccagttgggat

SEQ ID NO: 263808 - DNA, 75 bp, Artificial Sequence
  Synthetic
ggaagatccccaattatgggtcaagtattacggaggcaacacatctagccccttctgtatacccccctggtttcg

SEQ ID NO: 263809 - DNA, 75 bp, Artificial Sequence
  Synthetic
tattacggaggcaacacatctagccccttctgtatacccccctggtttcggagaggtattggtctttttcatgtc

SEQ ID NO: 263810 - DNA, 75 bp, Artificial Sequence
  Synthetic
ccaagcttcgaaggccaacctgatgtttgaagaagggaaaagcatgaccccaatctacacagctgcgctaaagga

SEQ ID NO: 263811 - DNA, 75 bp, Artificial Sequence
  Synthetic
ccaagcttcgaaggccaacctgatgtttgaagaagggaaaagcatgaccccaatctacacagctgcgcttaagga

SEQ ID NO: 263812 - DNA, 75 bp, Artificial Sequence
  Synthetic
ccaagcttcgaaggccaacctgatgtttgaagaagggaaaagcatgaccccaatctacacagctgcgctcaagga

SEQ ID NO: 263813 - DNA, 75 bp, Artificial Sequence
  Synthetic
ccaagcttcgaaggccaacctgatgtttgaagaagggaaaagcatgaccccaatctacacagctgcgctgaagga

SEQ ID NO: 263814 - DNA, 75 bp, Artificial Sequence
  Synthetic
ccaagcttcgaaggccaacctgatgtttgaagaagggaaaagcatgaccccattctacacagctgcgctaaagga

SEQ ID NO: 263815 - DNA, 75 bp, Artificial Sequence
  Synthetic
ccaagcttcgaaggccaacctgatgtttgaagaagggaaaagcatgaccccattctacacagctgcgcttaagga

SEQ ID NO: 263816 - DNA, 75 bp, Artificial Sequence
  Synthetic
ccaagcttcgaaggccaacctgatgtttgaagaagggaaaagcatgaccccattctacacagctgcgctcaagga

SEQ ID NO: 263817 - DNA, 75 bp, Artificial Sequence
  Synthetic
ccaagcttcgaaggccaacctgatgtttgaagaagggaaaagcatgaccccattctacacagctgcgctgaagga

SEQ ID NO: 263818 - DNA, 75 bp, Artificial Sequence
  Synthetic
ccaagcttcgaaggccaacctgatgtttgaagaagggaaaagcatgaccccactctacacagctgcgctaaagga

SEQ ID NO: 263819 - DNA, 75 bp, Artificial Sequence
  Synthetic
ccaagcttcgaaggccaacctgatgtttgaagaagggaaaagcatgaccccactctacacagctgcgcttaagga

SEQ ID NO: 263820 - DNA, 75 bp, Artificial Sequence
  Synthetic
ccaagcttcgaaggccaacctgatgtttgaagaagggaaaagcatgaccccactctacacagctgcgctcaagga

SEQ ID NO: 263821 - DNA, 75 bp, Artificial Sequence
  Synthetic
ccaagcttcgaaggccaacctgatgtttgaagaagggaaaagcatgaccccactctacacagctgcgctgaagga

SEQ ID NO: 263822 - DNA, 75 bp, Artificial Sequence
  Synthetic
ccaagcttcgaaggccaacctgatgtttgaagaagggaaaagcatgaccccagtctacacagctgcgctaaagga

SEQ ID NO: 263823 - DNA, 75 bp, Artificial Sequence
  Synthetic
ccaagcttcgaaggccaacctgatgtttgaagaagggaaaagcatgaccccagtctacacagctgcgcttaagga

SEQ ID NO: 263824 - DNA, 75 bp, Artificial Sequence
  Synthetic
ccaagcttcgaaggccaacctgatgtttgaagaagggaaaagcatgaccccagtctacacagctgcgctcaagga

SEQ ID NO: 263825 - DNA, 75 bp, Artificial Sequence
  Synthetic
ccaagcttcgaaggccaacctgatgtttgaagaagggaaaagcatgaccccagtctacacagctgcgctgaagga

SEQ ID NO: 263826 - DNA, 75 bp, Artificial Sequence
  Synthetic
ccaagcttcgaaggccaacctgatgtttgaagaagggaatagcatgaccccaatctacacagctgcgctaaagga

SEQ ID NO: 263827 - DNA, 75 bp, Artificial Sequence
  Synthetic
ccaagcttcgaaggccaacctgatgtttgaagaagggaatagcatgaccccaatctacacagctgcgcttaagga

SEQ ID NO: 263828 - DNA, 75 bp, Artificial Sequence
  Synthetic
ccaagcttcgaaggccaacctgatgtttgaagaagggaatagcatgaccccaatctacacagctgcgctcaagga

SEQ ID NO: 263829 - DNA, 75 bp, Artificial Sequence
  Synthetic
ccaagcttcgaaggccaacctgatgtttgaagaagggaatagcatgaccccaatctacacagctgcgctgaagga

SEQ ID NO: 263830 - DNA, 75 bp, Artificial Sequence
  Synthetic
ccaagcttcgaaggccaacctgatgtttgaagaagggaatagcatgaccccattctacacagctgcgctaaagga

SEQ ID NO: 263831 - DNA, 75 bp, Artificial Sequence
  Synthetic
ccaagcttcgaaggccaacctgatgtttgaagaagggaatagcatgaccccattctacacagctgcgcttaagga

SEQ ID NO: 263832 - DNA, 75 bp, Artificial Sequence
  Synthetic
ccaagcttcgaaggccaacctgatgtttgaagaagggaatagcatgaccccattctacacagctgcgctcaagga

SEQ ID NO: 263833 - DNA, 75 bp, Artificial Sequence
  Synthetic
ccaagcttcgaaggccaacctgatgtttgaagaagggaatagcatgaccccattctacacagctgcgctgaagga

SEQ ID NO: 263834 - DNA, 75 bp, Artificial Sequence
  Synthetic
ccaagcttcgaaggccaacctgatgtttgaagaagggaatagcatgaccccactctacacagctgcgctaaagga

SEQ ID NO: 263835 - DNA, 75 bp, Artificial Sequence
  Synthetic
ccaagcttcgaaggccaacctgatgtttgaagaagggaatagcatgaccccactctacacagctgcgcttaagga

SEQ ID NO: 263836 - DNA, 75 bp, Artificial Sequence
  Synthetic
ccaagcttcgaaggccaacctgatgtttgaagaagggaatagcatgaccccactctacacagctgcgctcaagga

SEQ ID NO: 263837 - DNA, 75 bp, Artificial Sequence
  Synthetic
ccaagcttcgaaggccaacctgatgtttgaagaagggaatagcatgaccccactctacacagctgcgctgaagga

SEQ ID NO: 263838 - DNA, 75 bp, Artificial Sequence
  Synthetic
ccaagcttcgaaggccaacctgatgtttgaagaagggaatagcatgaccccagtctacacagctgcgctaaagga

SEQ ID NO: 263839 - DNA, 75 bp, Artificial Sequence
  Synthetic
ccaagcttcgaaggccaacctgatgtttgaagaagggaatagcatgaccccagtctacacagctgcgcttaagga

SEQ ID NO: 263840 - DNA, 75 bp, Artificial Sequence
  Synthetic
ccaagcttcgaaggccaacctgatgtttgaagaagggaatagcatgaccccagtctacacagctgcgctcaagga

SEQ ID NO: 263841 - DNA, 75 bp, Artificial Sequence
  Synthetic
ccaagcttcgaaggccaacctgatgtttgaagaagggaatagcatgaccccagtctacacagctgcgctgaagga

SEQ ID NO: 263842 - DNA, 75 bp, Artificial Sequence
  Synthetic
ccaagcttcgaaggccaacctgatgtttgaagaagggaacagcatgaccccaatctacacagctgcgctaaagga

SEQ ID NO: 263843 - DNA, 75 bp, Artificial Sequence
  Synthetic
ccaagcttcgaaggccaacctgatgtttgaagaagggaacagcatgaccccaatctacacagctgcgcttaagga

SEQ ID NO: 263844 - DNA, 75 bp, Artificial Sequence
  Synthetic
ccaagcttcgaaggccaacctgatgtttgaagaagggaacagcatgaccccaatctacacagctgcgctcaagga

SEQ ID NO: 263845 - DNA, 75 bp, Artificial Sequence
  Synthetic
ccaagcttcgaaggccaacctgatgtttgaagaagggaacagcatgaccccaatctacacagctgcgctgaagga

SEQ ID NO: 263846 - DNA, 75 bp, Artificial Sequence
  Synthetic
ccaagcttcgaaggccaacctgatgtttgaagaagggaacagcatgaccccattctacacagctgcgctaaagga

SEQ ID NO: 263847 - DNA, 75 bp, Artificial Sequence
  Synthetic
ccaagcttcgaaggccaacctgatgtttgaagaagggaacagcatgaccccattctacacagctgcgcttaagga

SEQ ID NO: 263848 - DNA, 75 bp, Artificial Sequence
  Synthetic
ccaagcttcgaaggccaacctgatgtttgaagaagggaacagcatgaccccattctacacagctgcgctcaagga

SEQ ID NO: 263849 - DNA, 75 bp, Artificial Sequence
  Synthetic
ccaagcttcgaaggccaacctgatgtttgaagaagggaacagcatgaccccattctacacagctgcgctgaagga

SEQ ID NO: 263850 - DNA, 75 bp, Artificial Sequence
  Synthetic
ccaagcttcgaaggccaacctgatgtttgaagaagggaacagcatgaccccactctacacagctgcgctaaagga

SEQ ID NO: 263851 - DNA, 75 bp, Artificial Sequence
  Synthetic
ccaagcttcgaaggccaacctgatgtttgaagaagggaacagcatgaccccactctacacagctgcgcttaagga

SEQ ID NO: 263852 - DNA, 75 bp, Artificial Sequence
  Synthetic
ccaagcttcgaaggccaacctgatgtttgaagaagggaacagcatgaccccactctacacagctgcgctcaagga

SEQ ID NO: 263853 - DNA, 75 bp, Artificial Sequence
  Synthetic
ccaagcttcgaaggccaacctgatgtttgaagaagggaacagcatgaccccactctacacagctgcgctgaagga

SEQ ID NO: 263854 - DNA, 75 bp, Artificial Sequence
  Synthetic
ccaagcttcgaaggccaacctgatgtttgaagaagggaacagcatgaccccagtctacacagctgcgctaaagga

SEQ ID NO: 263855 - DNA, 75 bp, Artificial Sequence
  Synthetic
ccaagcttcgaaggccaacctgatgtttgaagaagggaacagcatgaccccagtctacacagctgcgcttaagga

SEQ ID NO: 263856 - DNA, 75 bp, Artificial Sequence
  Synthetic
ccaagcttcgaaggccaacctgatgtttgaagaagggaacagcatgaccccagtctacacagctgcgctcaagga

SEQ ID NO: 263857 - DNA, 75 bp, Artificial Sequence
  Synthetic
ccaagcttcgaaggccaacctgatgtttgaagaagggaacagcatgaccccagtctacacagctgcgctgaagga

SEQ ID NO: 263858 - DNA, 75 bp, Artificial Sequence
  Synthetic
ccaagcttcgaaggccaacctgatgtttgaagaagggaagagcatgaccccaatctacacagctgcgctaaagga

SEQ ID NO: 263859 - DNA, 75 bp, Artificial Sequence
  Synthetic
ccaagcttcgaaggccaacctgatgtttgaagaagggaagagcatgaccccaatctacacagctgcgcttaagga

SEQ ID NO: 263860 - DNA, 75 bp, Artificial Sequence
  Synthetic
ccaagcttcgaaggccaacctgatgtttgaagaagggaagagcatgaccccaatctacacagctgcgctcaagga

SEQ ID NO: 263861 - DNA, 75 bp, Artificial Sequence
  Synthetic
ccaagcttcgaaggccaacctgatgtttgaagaagggaagagcatgaccccaatctacacagctgcgctgaagga

SEQ ID NO: 263862 - DNA, 75 bp, Artificial Sequence
  Synthetic
ccaagcttcgaaggccaacctgatgtttgaagaagggaagagcatgaccccattctacacagctgcgctaaagga

SEQ ID NO: 263863 - DNA, 75 bp, Artificial Sequence
  Synthetic
ccaagcttcgaaggccaacctgatgtttgaagaagggaagagcatgaccccattctacacagctgcgcttaagga

SEQ ID NO: 263864 - DNA, 75 bp, Artificial Sequence
  Synthetic
ccaagcttcgaaggccaacctgatgtttgaagaagggaagagcatgaccccattctacacagctgcgctcaagga

SEQ ID NO: 263865 - DNA, 75 bp, Artificial Sequence
  Synthetic
ccaagcttcgaaggccaacctgatgtttgaagaagggaagagcatgaccccattctacacagctgcgctgaagga

SEQ ID NO: 263866 - DNA, 75 bp, Artificial Sequence
  Synthetic
ccaagcttcgaaggccaacctgatgtttgaagaagggaagagcatgaccccactctacacagctgcgctaaagga

SEQ ID NO: 263867 - DNA, 75 bp, Artificial Sequence
  Synthetic
ccaagcttcgaaggccaacctgatgtttgaagaagggaagagcatgaccccactctacacagctgcgcttaagga

SEQ ID NO: 263868 - DNA, 75 bp, Artificial Sequence
  Synthetic
ccaagcttcgaaggccaacctgatgtttgaagaagggaagagcatgaccccactctacacagctgcgctcaagga

SEQ ID NO: 263869 - DNA, 75 bp, Artificial Sequence
  Synthetic
ccaagcttcgaaggccaacctgatgtttgaagaagggaagagcatgaccccactctacacagctgcgctgaagga

SEQ ID NO: 263870 - DNA, 75 bp, Artificial Sequence
  Synthetic
ccaagcttcgaaggccaacctgatgtttgaagaagggaagagcatgaccccagtctacacagctgcgctaaagga

SEQ ID NO: 263871 - DNA, 75 bp, Artificial Sequence
  Synthetic
ccaagcttcgaaggccaacctgatgtttgaagaagggaagagcatgaccccagtctacacagctgcgcttaagga

SEQ ID NO: 263872 - DNA, 75 bp, Artificial Sequence
  Synthetic
ccaagcttcgaaggccaacctgatgtttgaagaagggaagagcatgaccccagtctacacagctgcgctcaagga

SEQ ID NO: 263873 - DNA, 75 bp, Artificial Sequence
  Synthetic
ccaagcttcgaaggccaacctgatgtttgaagaagggaagagcatgaccccagtctacacagctgcgctgaagga

SEQ ID NO: 263874 - DNA, 75 bp, Artificial Sequence
  Synthetic
caggtccttttcaccatccgagccagccttggaacacagcagtcccagagttccaccaagatagtaagatggagc

SEQ ID NO: 263875 - DNA, 75 bp, Artificial Sequence
  Synthetic
caatctacacagctgcactaaaggatgatttagttaaaactgacaaaatttatggtaagatcaagaagagggttc

SEQ ID NO: 263876 - DNA, 75 bp, Artificial Sequence
  Synthetic
caatctacacagctgcactaaaggatgatttagttaatactgacaaaatttatggtaagatcaagaagagggttc

SEQ ID NO: 263877 - DNA, 75 bp, Artificial Sequence
  Synthetic
caatctacacagctgcactaaaggatgatttagttaacactgacaaaatttatggtaagatcaagaagagggttc

SEQ ID NO: 263878 - DNA, 75 bp, Artificial Sequence
  Synthetic
caatctacacagctgcactaaaggatgatttagttaagactgacaaaatttatggtaagatcaagaagagggttc

SEQ ID NO: 263879 - DNA, 75 bp, Artificial Sequence
  Synthetic
caatctacacagctgctctaaaggatgatttagttaaaactgacaaaatttatggtaagatcaagaagagggttc

SEQ ID NO: 263880 - DNA, 75 bp, Artificial Sequence
  Synthetic
caatctacacagctgctctaaaggatgatttagttaatactgacaaaatttatggtaagatcaagaagagggttc

SEQ ID NO: 263881 - DNA, 75 bp, Artificial Sequence
  Synthetic
caatctacacagctgctctaaaggatgatttagttaacactgacaaaatttatggtaagatcaagaagagggttc

SEQ ID NO: 263882 - DNA, 75 bp, Artificial Sequence
  Synthetic
caatctacacagctgctctaaaggatgatttagttaagactgacaaaatttatggtaagatcaagaagagggttc

SEQ ID NO: 263883 - DNA, 75 bp, Artificial Sequence
  Synthetic
caatctacacagctgccctaaaggatgatttagttaaaactgacaaaatttatggtaagatcaagaagagggttc

SEQ ID NO: 263884 - DNA, 75 bp, Artificial Sequence
  Synthetic
caatctacacagctgccctaaaggatgatttagttaatactgacaaaatttatggtaagatcaagaagagggttc

SEQ ID NO: 263885 - DNA, 75 bp, Artificial Sequence
  Synthetic
caatctacacagctgccctaaaggatgatttagttaacactgacaaaatttatggtaagatcaagaagagggttc

SEQ ID NO: 263886 - DNA, 75 bp, Artificial Sequence
  Synthetic
caatctacacagctgccctaaaggatgatttagttaagactgacaaaatttatggtaagatcaagaagagggttc

SEQ ID NO: 263887 - DNA, 75 bp, Artificial Sequence
  Synthetic
caatctacacagctgcgctaaaggatgatttagttaaaactgacaaaatttatggtaagatcaagaagagggttc

SEQ ID NO: 263888 - DNA, 75 bp, Artificial Sequence
  Synthetic
caatctacacagctgcgctaaaggatgatttagttaatactgacaaaatttatggtaagatcaagaagagggttc

SEQ ID NO: 263889 - DNA, 75 bp, Artificial Sequence
  Synthetic
caatctacacagctgcgctaaaggatgatttagttaacactgacaaaatttatggtaagatcaagaagagggttc

SEQ ID NO: 263890 - DNA, 75 bp, Artificial Sequence
  Synthetic
caatctacacagctgcgctaaaggatgatttagttaagactgacaaaatttatggtaagatcaagaagagggttc

SEQ ID NO: 263891 - DNA, 75 bp, Artificial Sequence
  Synthetic
cattctacacagctgcactaaaggatgatttagttaaaactgacaaaatttatggtaagatcaagaagagggttc

SEQ ID NO: 263892 - DNA, 75 bp, Artificial Sequence
  Synthetic
cattctacacagctgcactaaaggatgatttagttaatactgacaaaatttatggtaagatcaagaagagggttc

SEQ ID NO: 263893 - DNA, 75 bp, Artificial Sequence
  Synthetic
cattctacacagctgcactaaaggatgatttagttaacactgacaaaatttatggtaagatcaagaagagggttc

SEQ ID NO: 263894 - DNA, 75 bp, Artificial Sequence
  Synthetic
cattctacacagctgcactaaaggatgatttagttaagactgacaaaatttatggtaagatcaagaagagggttc

SEQ ID NO: 263895 - DNA, 75 bp, Artificial Sequence
  Synthetic
cattctacacagctgctctaaaggatgatttagttaaaactgacaaaatttatggtaagatcaagaagagggttc

SEQ ID NO: 263896 - DNA, 75 bp, Artificial Sequence
  Synthetic
cattctacacagctgctctaaaggatgatttagttaatactgacaaaatttatggtaagatcaagaagagggttc

SEQ ID NO: 263897 - DNA, 75 bp, Artificial Sequence
  Synthetic
cattctacacagctgctctaaaggatgatttagttaacactgacaaaatttatggtaagatcaagaagagggttc

SEQ ID NO: 263898 - DNA, 75 bp, Artificial Sequence
  Synthetic
cattctacacagctgctctaaaggatgatttagttaagactgacaaaatttatggtaagatcaagaagagggttc

SEQ ID NO: 263899 - DNA, 75 bp, Artificial Sequence
  Synthetic
cattctacacagctgccctaaaggatgatttagttaaaactgacaaaatttatggtaagatcaagaagagggttc

SEQ ID NO: 263900 - DNA, 75 bp, Artificial Sequence
  Synthetic
cattctacacagctgccctaaaggatgatttagttaatactgacaaaatttatggtaagatcaagaagagggttc

SEQ ID NO: 263901 - DNA, 75 bp, Artificial Sequence
  Synthetic
cattctacacagctgccctaaaggatgatttagttaacactgacaaaatttatggtaagatcaagaagagggttc

SEQ ID NO: 263902 - DNA, 75 bp, Artificial Sequence
  Synthetic
cattctacacagctgccctaaaggatgatttagttaagactgacaaaatttatggtaagatcaagaagagggttc

SEQ ID NO: 263903 - DNA, 75 bp, Artificial Sequence
  Synthetic
cattctacacagctgcgctaaaggatgatttagttaaaactgacaaaatttatggtaagatcaagaagagggttc

SEQ ID NO: 263904 - DNA, 75 bp, Artificial Sequence
  Synthetic
cattctacacagctgcgctaaaggatgatttagttaatactgacaaaatttatggtaagatcaagaagagggttc

SEQ ID NO: 263905 - DNA, 75 bp, Artificial Sequence
  Synthetic
cattctacacagctgcgctaaaggatgatttagttaacactgacaaaatttatggtaagatcaagaagagggttc

SEQ ID NO: 263906 - DNA, 75 bp, Artificial Sequence
  Synthetic
cattctacacagctgcgctaaaggatgatttagttaagactgacaaaatttatggtaagatcaagaagagggttc

SEQ ID NO: 263907 - DNA, 75 bp, Artificial Sequence
  Synthetic
cactctacacagctgcactaaaggatgatttagttaaaactgacaaaatttatggtaagatcaagaagagggttc

SEQ ID NO: 263908 - DNA, 75 bp, Artificial Sequence
  Synthetic
cactctacacagctgcactaaaggatgatttagttaatactgacaaaatttatggtaagatcaagaagagggttc

SEQ ID NO: 263909 - DNA, 75 bp, Artificial Sequence
  Synthetic
cactctacacagctgcactaaaggatgatttagttaacactgacaaaatttatggtaagatcaagaagagggttc

SEQ ID NO: 263910 - DNA, 75 bp, Artificial Sequence
  Synthetic
cactctacacagctgcactaaaggatgatttagttaagactgacaaaatttatggtaagatcaagaagagggttc

SEQ ID NO: 263911 - DNA, 75 bp, Artificial Sequence
  Synthetic
cactctacacagctgctctaaaggatgatttagttaaaactgacaaaatttatggtaagatcaagaagagggttc

SEQ ID NO: 263912 - DNA, 75 bp, Artificial Sequence
  Synthetic
cactctacacagctgctctaaaggatgatttagttaatactgacaaaatttatggtaagatcaagaagagggttc

SEQ ID NO: 263913 - DNA, 75 bp, Artificial Sequence
  Synthetic
cactctacacagctgctctaaaggatgatttagttaacactgacaaaatttatggtaagatcaagaagagggttc

SEQ ID NO: 263914 - DNA, 75 bp, Artificial Sequence
  Synthetic
cactctacacagctgctctaaaggatgatttagttaagactgacaaaatttatggtaagatcaagaagagggttc

SEQ ID NO: 263915 - DNA, 75 bp, Artificial Sequence
  Synthetic
cactctacacagctgccctaaaggatgatttagttaaaactgacaaaatttatggtaagatcaagaagagggttc

SEQ ID NO: 263916 - DNA, 75 bp, Artificial Sequence
  Synthetic
cactctacacagctgccctaaaggatgatttagttaatactgacaaaatttatggtaagatcaagaagagggttc

SEQ ID NO: 263917 - DNA, 75 bp, Artificial Sequence
  Synthetic
cactctacacagctgccctaaaggatgatttagttaacactgacaaaatttatggtaagatcaagaagagggttc

SEQ ID NO: 263918 - DNA, 75 bp, Artificial Sequence
  Synthetic
cactctacacagctgccctaaaggatgatttagttaagactgacaaaatttatggtaagatcaagaagagggttc

SEQ ID NO: 263919 - DNA, 75 bp, Artificial Sequence
  Synthetic
cactctacacagctgcgctaaaggatgatttagttaaaactgacaaaatttatggtaagatcaagaagagggttc

SEQ ID NO: 263920 - DNA, 75 bp, Artificial Sequence
  Synthetic
cactctacacagctgcgctaaaggatgatttagttaatactgacaaaatttatggtaagatcaagaagagggttc

SEQ ID NO: 263921 - DNA, 75 bp, Artificial Sequence
  Synthetic
cactctacacagctgcgctaaaggatgatttagttaacactgacaaaatttatggtaagatcaagaagagggttc

SEQ ID NO: 263922 - DNA, 75 bp, Artificial Sequence
  Synthetic
cactctacacagctgcgctaaaggatgatttagttaagactgacaaaatttatggtaagatcaagaagagggttc

SEQ ID NO: 263923 - DNA, 75 bp, Artificial Sequence
  Synthetic
cagtctacacagctgcactaaaggatgatttagttaaaactgacaaaatttatggtaagatcaagaagagggttc

SEQ ID NO: 263924 - DNA, 75 bp, Artificial Sequence
  Synthetic
cagtctacacagctgcactaaaggatgatttagttaatactgacaaaatttatggtaagatcaagaagagggttc

SEQ ID NO: 263925 - DNA, 75 bp, Artificial Sequence
  Synthetic
cagtctacacagctgcactaaaggatgatttagttaacactgacaaaatttatggtaagatcaagaagagggttc

SEQ ID NO: 263926 - DNA, 75 bp, Artificial Sequence
  Synthetic
cagtctacacagctgcactaaaggatgatttagttaagactgacaaaatttatggtaagatcaagaagagggttc

SEQ ID NO: 263927 - DNA, 75 bp, Artificial Sequence
  Synthetic
cagtctacacagctgctctaaaggatgatttagttaaaactgacaaaatttatggtaagatcaagaagagggttc

SEQ ID NO: 263928 - DNA, 75 bp, Artificial Sequence
  Synthetic
cagtctacacagctgctctaaaggatgatttagttaatactgacaaaatttatggtaagatcaagaagagggttc

SEQ ID NO: 263929 - DNA, 75 bp, Artificial Sequence
  Synthetic
cagtctacacagctgctctaaaggatgatttagttaacactgacaaaatttatggtaagatcaagaagagggttc

SEQ ID NO: 263930 - DNA, 75 bp, Artificial Sequence
  Synthetic
cagtctacacagctgctctaaaggatgatttagttaagactgacaaaatttatggtaagatcaagaagagggttc

SEQ ID NO: 263931 - DNA, 75 bp, Artificial Sequence
  Synthetic
cagtctacacagctgccctaaaggatgatttagttaaaactgacaaaatttatggtaagatcaagaagagggttc

SEQ ID NO: 263932 - DNA, 75 bp, Artificial Sequence
  Synthetic
cagtctacacagctgccctaaaggatgatttagttaatactgacaaaatttatggtaagatcaagaagagggttc

SEQ ID NO: 263933 - DNA, 75 bp, Artificial Sequence
  Synthetic
cagtctacacagctgccctaaaggatgatttagttaacactgacaaaatttatggtaagatcaagaagagggttc

SEQ ID NO: 263934 - DNA, 75 bp, Artificial Sequence
  Synthetic
cagtctacacagctgccctaaaggatgatttagttaagactgacaaaatttatggtaagatcaagaagagggttc

SEQ ID NO: 263935 - DNA, 75 bp, Artificial Sequence
  Synthetic
cagtctacacagctgcgctaaaggatgatttagttaaaactgacaaaatttatggtaagatcaagaagagggttc

SEQ ID NO: 263936 - DNA, 75 bp, Artificial Sequence
  Synthetic
cagtctacacagctgcgctaaaggatgatttagttaatactgacaaaatttatggtaagatcaagaagagggttc

SEQ ID NO: 263937 - DNA, 75 bp, Artificial Sequence
  Synthetic
cagtctacacagctgcgctaaaggatgatttagttaacactgacaaaatttatggtaagatcaagaagagggttc

SEQ ID NO: 263938 - DNA, 75 bp, Artificial Sequence
  Synthetic
cagtctacacagctgcgctaaaggatgatttagttaagactgacaaaatttatggtaagatcaagaagagggttc

SEQ ID NO: 263939 - DNA, 75 bp, Artificial Sequence
  Synthetic
ggtaaacataccattatgatgctgattactctcgatgggattctacacaacagagagtcgtgatggcagcagctc

SEQ ID NO: 263940 - DNA, 75 bp, Artificial Sequence
  Synthetic
ggtaaacataccattatgatgctgattactctcgatgggattctacacaacagagagtcgtgttggcagcagctc

SEQ ID NO: 263941 - DNA, 75 bp, Artificial Sequence
  Synthetic
ggtaaacataccattatgatgctgattactctcgatgggattctacacaacagagagtcgtgctggcagcagctc

SEQ ID NO: 263942 - DNA, 75 bp, Artificial Sequence
  Synthetic
ggtaaacataccattatgatgctgattactctcgatgggattctacacaacagagagtcgtggtggcagcagctc

SEQ ID NO: 263943 - DNA, 75 bp, Artificial Sequence
  Synthetic
ggtaaacataccattatgatgctgattactctcgatgggattctacacaacagagtgtcgtgatggcagcagctc

SEQ ID NO: 263944 - DNA, 75 bp, Artificial Sequence
  Synthetic
ggtaaacataccattatgatgctgattactctcgatgggattctacacaacagagtgtcgtgttggcagcagctc

SEQ ID NO: 263945 - DNA, 75 bp, Artificial Sequence
  Synthetic
ggtaaacataccattatgatgctgattactctcgatgggattctacacaacagagtgtcgtgctggcagcagctc

SEQ ID NO: 263946 - DNA, 75 bp, Artificial Sequence
  Synthetic
ggtaaacataccattatgatgctgattactctcgatgggattctacacaacagagtgtcgtggtggcagcagctc

SEQ ID NO: 263947 - DNA, 75 bp, Artificial Sequence
  Synthetic
ggtaaacataccattatgatgctgattactctcgatgggattctacacaacagagcgtcgtgatggcagcagctc

SEQ ID NO: 263948 - DNA, 75 bp, Artificial Sequence
  Synthetic
ggtaaacataccattatgatgctgattactctcgatgggattctacacaacagagcgtcgtgttggcagcagctc

SEQ ID NO: 263949 - DNA, 75 bp, Artificial Sequence
  Synthetic
ggtaaacataccattatgatgctgattactctcgatgggattctacacaacagagcgtcgtgctggcagcagctc

SEQ ID NO: 263950 - DNA, 75 bp, Artificial Sequence
  Synthetic
ggtaaacataccattatgatgctgattactctcgatgggattctacacaacagagcgtcgtggtggcagcagctc

SEQ ID NO: 263951 - DNA, 75 bp, Artificial Sequence
  Synthetic
ggtaaacataccattatgatgctgattactctcgatgggattctacacaacagagggtcgtgatggcagcagctc

SEQ ID NO: 263952 - DNA, 75 bp, Artificial Sequence
  Synthetic
ggtaaacataccattatgatgctgattactctcgatgggattctacacaacagagggtcgtgttggcagcagctc

SEQ ID NO: 263953 - DNA, 75 bp, Artificial Sequence
  Synthetic
ggtaaacataccattatgatgctgattactctcgatgggattctacacaacagagggtcgtgctggcagcagctc

SEQ ID NO: 263954 - DNA, 75 bp, Artificial Sequence
  Synthetic
ggtaaacataccattatgatgctgattactctcgatgggattctacacaacagagggtcgtggtggcagcagctc

SEQ ID NO: 263955 - DNA, 75 bp, Artificial Sequence
  Synthetic
ggtatacataccattatgatgctgattactctcgatgggattctacacaacagagagtcgtgatggcagcagctc

SEQ ID NO: 263956 - DNA, 75 bp, Artificial Sequence
  Synthetic
ggtatacataccattatgatgctgattactctcgatgggattctacacaacagagagtcgtgttggcagcagctc

SEQ ID NO: 263957 - DNA, 75 bp, Artificial Sequence
  Synthetic
ggtatacataccattatgatgctgattactctcgatgggattctacacaacagagagtcgtgctggcagcagctc

SEQ ID NO: 263958 - DNA, 75 bp, Artificial Sequence
  Synthetic
ggtatacataccattatgatgctgattactctcgatgggattctacacaacagagagtcgtggtggcagcagctc

SEQ ID NO: 263959 - DNA, 75 bp, Artificial Sequence
  Synthetic
ggtatacataccattatgatgctgattactctcgatgggattctacacaacagagtgtcgtgatggcagcagctc

SEQ ID NO: 263960 - DNA, 75 bp, Artificial Sequence
  Synthetic
ggtatacataccattatgatgctgattactctcgatgggattctacacaacagagtgtcgtgttggcagcagctc

SEQ ID NO: 263961 - DNA, 75 bp, Artificial Sequence
  Synthetic
ggtatacataccattatgatgctgattactctcgatgggattctacacaacagagtgtcgtgctggcagcagctc

SEQ ID NO: 263962 - DNA, 75 bp, Artificial Sequence
  Synthetic
ggtatacataccattatgatgctgattactctcgatgggattctacacaacagagtgtcgtggtggcagcagctc

SEQ ID NO: 263963 - DNA, 75 bp, Artificial Sequence
  Synthetic
ggtatacataccattatgatgctgattactctcgatgggattctacacaacagagcgtcgtgatggcagcagctc

SEQ ID NO: 263964 - DNA, 75 bp, Artificial Sequence
  Synthetic
ggtatacataccattatgatgctgattactctcgatgggattctacacaacagagcgtcgtgttggcagcagctc

SEQ ID NO: 263965 - DNA, 75 bp, Artificial Sequence
  Synthetic
ggtatacataccattatgatgctgattactctcgatgggattctacacaacagagcgtcgtgctggcagcagctc

SEQ ID NO: 263966 - DNA, 75 bp, Artificial Sequence
  Synthetic
ggtatacataccattatgatgctgattactctcgatgggattctacacaacagagcgtcgtggtggcagcagctc

SEQ ID NO: 263967 - DNA, 75 bp, Artificial Sequence
  Synthetic
ggtatacataccattatgatgctgattactctcgatgggattctacacaacagagggtcgtgatggcagcagctc

SEQ ID NO: 263968 - DNA, 75 bp, Artificial Sequence
  Synthetic
ggtatacataccattatgatgctgattactctcgatgggattctacacaacagagggtcgtgttggcagcagctc

SEQ ID NO: 263969 - DNA, 75 bp, Artificial Sequence
  Synthetic
ggtatacataccattatgatgctgattactctcgatgggattctacacaacagagggtcgtgctggcagcagctc

SEQ ID NO: 263970 - DNA, 75 bp, Artificial Sequence
  Synthetic
ggtatacataccattatgatgctgattactctcgatgggattctacacaacagagggtcgtggtggcagcagctc

SEQ ID NO: 263971 - DNA, 75 bp, Artificial Sequence
  Synthetic
ggtacacataccattatgatgctgattactctcgatgggattctacacaacagagagtcgtgatggcagcagctc

SEQ ID NO: 263972 - DNA, 75 bp, Artificial Sequence
  Synthetic
ggtacacataccattatgatgctgattactctcgatgggattctacacaacagagagtcgtgttggcagcagctc

SEQ ID NO: 263973 - DNA, 75 bp, Artificial Sequence
  Synthetic
ggtacacataccattatgatgctgattactctcgatgggattctacacaacagagagtcgtgctggcagcagctc

SEQ ID NO: 263974 - DNA, 75 bp, Artificial Sequence
  Synthetic
ggtacacataccattatgatgctgattactctcgatgggattctacacaacagagagtcgtggtggcagcagctc

SEQ ID NO: 263975 - DNA, 75 bp, Artificial Sequence
  Synthetic
ggtacacataccattatgatgctgattactctcgatgggattctacacaacagagtgtcgtgatggcagcagctc

SEQ ID NO: 263976 - DNA, 75 bp, Artificial Sequence
  Synthetic
ggtacacataccattatgatgctgattactctcgatgggattctacacaacagagtgtcgtgttggcagcagctc

SEQ ID NO: 263977 - DNA, 75 bp, Artificial Sequence
  Synthetic
ggtacacataccattatgatgctgattactctcgatgggattctacacaacagagtgtcgtgctggcagcagctc

SEQ ID NO: 263978 - DNA, 75 bp, Artificial Sequence
  Synthetic
ggtacacataccattatgatgctgattactctcgatgggattctacacaacagagtgtcgtggtggcagcagctc

SEQ ID NO: 263979 - DNA, 75 bp, Artificial Sequence
  Synthetic
ggtacacataccattatgatgctgattactctcgatgggattctacacaacagagcgtcgtgatggcagcagctc

SEQ ID NO: 263980 - DNA, 75 bp, Artificial Sequence
  Synthetic
ggtacacataccattatgatgctgattactctcgatgggattctacacaacagagcgtcgtgttggcagcagctc

SEQ ID NO: 263981 - DNA, 75 bp, Artificial Sequence
  Synthetic
ggtacacataccattatgatgctgattactctcgatgggattctacacaacagagcgtcgtgctggcagcagctc

SEQ ID NO: 263982 - DNA, 75 bp, Artificial Sequence
  Synthetic
ggtacacataccattatgatgctgattactctcgatgggattctacacaacagagcgtcgtggtggcagcagctc

SEQ ID NO: 263983 - DNA, 75 bp, Artificial Sequence
  Synthetic
ggtacacataccattatgatgctgattactctcgatgggattctacacaacagagggtcgtgatggcagcagctc

SEQ ID NO: 263984 - DNA, 75 bp, Artificial Sequence
  Synthetic
ggtacacataccattatgatgctgattactctcgatgggattctacacaacagagggtcgtgttggcagcagctc

SEQ ID NO: 263985 - DNA, 75 bp, Artificial Sequence
  Synthetic
ggtacacataccattatgatgctgattactctcgatgggattctacacaacagagggtcgtgctggcagcagctc

SEQ ID NO: 263986 - DNA, 75 bp, Artificial Sequence
  Synthetic
ggtacacataccattatgatgctgattactctcgatgggattctacacaacagagggtcgtggtggcagcagctc

SEQ ID NO: 263987 - DNA, 75 bp, Artificial Sequence
  Synthetic
ggtagacataccattatgatgctgattactctcgatgggattctacacaacagagagtcgtgatggcagcagctc

SEQ ID NO: 263988 - DNA, 75 bp, Artificial Sequence
  Synthetic
ggtagacataccattatgatgctgattactctcgatgggattctacacaacagagagtcgtgttggcagcagctc

SEQ ID NO: 263989 - DNA, 75 bp, Artificial Sequence
  Synthetic
ggtagacataccattatgatgctgattactctcgatgggattctacacaacagagagtcgtgctggcagcagctc

SEQ ID NO: 263990 - DNA, 75 bp, Artificial Sequence
  Synthetic
ggtagacataccattatgatgctgattactctcgatgggattctacacaacagagagtcgtggtggcagcagctc

SEQ ID NO: 263991 - DNA, 75 bp, Artificial Sequence
  Synthetic
ggtagacataccattatgatgctgattactctcgatgggattctacacaacagagtgtcgtgatggcagcagctc

SEQ ID NO: 263992 - DNA, 75 bp, Artificial Sequence
  Synthetic
ggtagacataccattatgatgctgattactctcgatgggattctacacaacagagtgtcgtgttggcagcagctc

SEQ ID NO: 263993 - DNA, 75 bp, Artificial Sequence
  Synthetic
ggtagacataccattatgatgctgattactctcgatgggattctacacaacagagtgtcgtgctggcagcagctc

SEQ ID NO: 263994 - DNA, 75 bp, Artificial Sequence
  Synthetic
ggtagacataccattatgatgctgattactctcgatgggattctacacaacagagtgtcgtggtggcagcagctc

SEQ ID NO: 263995 - DNA, 75 bp, Artificial Sequence
  Synthetic
ggtagacataccattatgatgctgattactctcgatgggattctacacaacagagcgtcgtgatggcagcagctc

SEQ ID NO: 263996 - DNA, 75 bp, Artificial Sequence
  Synthetic
ggtagacataccattatgatgctgattactctcgatgggattctacacaacagagcgtcgtgttggcagcagctc

SEQ ID NO: 263997 - DNA, 75 bp, Artificial Sequence
  Synthetic
ggtagacataccattatgatgctgattactctcgatgggattctacacaacagagcgtcgtgctggcagcagctc

SEQ ID NO: 263998 - DNA, 75 bp, Artificial Sequence
  Synthetic
ggtagacataccattatgatgctgattactctcgatgggattctacacaacagagcgtcgtggtggcagcagctc

SEQ ID NO: 263999 - DNA, 75 bp, Artificial Sequence
  Synthetic
ggtagacataccattatgatgctgattactctcgatgggattctacacaacagagggtcgtgatggcagcagctc

SEQ ID NO: 264000 - DNA, 75 bp, Artificial Sequence
  Synthetic
ggtagacataccattatgatgctgattactctcgatgggattctacacaacagagggtcgtgttggcagcagctc

SEQ ID NO: 264001 - DNA, 75 bp, Artificial Sequence
  Synthetic
ggtagacataccattatgatgctgattactctcgatgggattctacacaacagagggtcgtgctggcagcagctc

SEQ ID NO: 264002 - DNA, 75 bp, Artificial Sequence
  Synthetic
ggtagacataccattatgatgctgattactctcgatgggattctacacaacagagggtcgtggtggcagcagctc

SEQ ID NO: 264003 - DNA, 75 bp, Artificial Sequence
  Synthetic
ttccccggcgagcagattctcttcttccgctcgttcatgccaggtgctagtggtcacactgatggtgctattgac

SEQ ID NO: 264004 - DNA, 75 bp, Artificial Sequence
  Synthetic
acaagcccctactgtaggtgaggctgccctgctccactatgttgaccctgataccggtcggaatcttggggaatt

SEQ ID NO: 264005 - DNA, 75 bp, Artificial Sequence
  Synthetic
gccctgctccactatgttgaccctgataccggtcggaatcttggggaattcaaagcataccctgatggtttcctc

SEQ ID NO: 264006 - DNA, 75 bp, Artificial Sequence
  Synthetic
gccttggaacacagcagtcccagagttccaccaagatagtaagatggagctggttcgtgacgccattctgacagc

SEQ ID NO: 264007 - DNA, 75 bp, Artificial Sequence
  Synthetic
atctcattgtgactggacgttcaccggcattgttgaggctgccgtcctccttgcagaactcttcggcattttgtg

SEQ ID NO: 264008 - DNA, 75 bp, Artificial Sequence
  Synthetic
ggcattgttgaggctgccgtcctccttgcagaactcttcggcattttgtggcagcccccagatgtggccagtttc

SEQ ID NO: 264009 - DNA, 75 bp, Artificial Sequence
  Synthetic
tccgctcgttcatgccaggtgctagtggtcacactgatggtgctattgactgccttttgccacaagaatgggttg

SEQ ID NO: 264010 - DNA, 75 bp, Artificial Sequence
  Synthetic
gagtgttatttgaagggaagttacacaagcagggctttataaccatctctaacagtggggaccaccctattgtta

SEQ ID NO: 264011 - DNA, 75 bp, Artificial Sequence
  Synthetic
gtgtccagattttatcaattaaagcctgtgggaactgccagctcggcaagaggtaggcttggtctgcgccgataa

SEQ ID NO: 264012 - DNA, 75 bp, Artificial Sequence
  Synthetic
ctgtgggaactgccagctcggcaagaggtaggcttggtctgcgccgataatggcccaagccataattggtgcaat

SEQ ID NO: 264013 - DNA, 75 bp, Artificial Sequence
  Synthetic
aatgaaccccaacaatgggtgctcccaagttactcaggcagaaacattcacaatgtgcacctggcccccgctgta

SEQ ID NO: 264014 - DNA, 75 bp, Artificial Sequence
  Synthetic
ggggggatcgggctggccctaggcttcaccaaggacagggccacaaaactcttgaagtcggccgcggatggcctc

SEQ ID NO: 264015 - DNA, 75 bp, Artificial Sequence
  Synthetic
tcaccaaggacagggccacaaaactcttgaagtcggccgcggatggcctccgggccgctagcagccttggtcaat

SEQ ID NO: 264016 - DNA, 75 bp, Artificial Sequence
  Synthetic
caagcagggctttataaccatctctaacagtggggaccaccctattgttatgcccgctaatgggtacttcaggtt

SEQ ID NO: 264017 - DNA, 75 bp, Artificial Sequence
  Synthetic
cagcaaaactcagggaatatgggctgaagccaacacgccctgacaaaaccgaaggaccccttgtcatctctgaag

SEQ ID NO: 264018 - DNA, 75 bp, Artificial Sequence
  Synthetic
cagcaaaactcagggattatgggctgaagccaacacgccctgacaaaaccgaaggaccccttgtcatctctgaag

SEQ ID NO: 264019 - DNA, 75 bp, Artificial Sequence
  Synthetic
cagcaaaactcagggactatgggctgaagccaacacgccctgacaaaaccgaaggaccccttgtcatctctgaag

SEQ ID NO: 264020 - DNA, 75 bp, Artificial Sequence
  Synthetic
cagcaaaactcagggagtatgggctgaagccaacacgccctgacaaaaccgaaggaccccttgtcatctctgaag

SEQ ID NO: 264021 - DNA, 75 bp, Artificial Sequence
  Synthetic
cagcaaatctcagggaatatgggctgaagccaacacgccctgacaaaaccgaaggaccccttgtcatctctgaag

SEQ ID NO: 264022 - DNA, 75 bp, Artificial Sequence
  Synthetic
cagcaaatctcagggattatgggctgaagccaacacgccctgacaaaaccgaaggaccccttgtcatctctgaag

SEQ ID NO: 264023 - DNA, 75 bp, Artificial Sequence
  Synthetic
cagcaaatctcagggactatgggctgaagccaacacgccctgacaaaaccgaaggaccccttgtcatctctgaag

SEQ ID NO: 264024 - DNA, 75 bp, Artificial Sequence
  Synthetic
cagcaaatctcagggagtatgggctgaagccaacacgccctgacaaaaccgaaggaccccttgtcatctctgaag

SEQ ID NO: 264025 - DNA, 75 bp, Artificial Sequence
  Synthetic
cagcaaacctcagggaatatgggctgaagccaacacgccctgacaaaaccgaaggaccccttgtcatctctgaag

SEQ ID NO: 264026 - DNA, 75 bp, Artificial Sequence
  Synthetic
cagcaaacctcagggattatgggctgaagccaacacgccctgacaaaaccgaaggaccccttgtcatctctgaag

SEQ ID NO: 264027 - DNA, 75 bp, Artificial Sequence
  Synthetic
cagcaaacctcagggactatgggctgaagccaacacgccctgacaaaaccgaaggaccccttgtcatctctgaag

SEQ ID NO: 264028 - DNA, 75 bp, Artificial Sequence
  Synthetic
cagcaaacctcagggagtatgggctgaagccaacacgccctgacaaaaccgaaggaccccttgtcatctctgaag

SEQ ID NO: 264029 - DNA, 75 bp, Artificial Sequence
  Synthetic
cagcaaagctcagggaatatgggctgaagccaacacgccctgacaaaaccgaaggaccccttgtcatctctgaag

SEQ ID NO: 264030 - DNA, 75 bp, Artificial Sequence
  Synthetic
cagcaaagctcagggattatgggctgaagccaacacgccctgacaaaaccgaaggaccccttgtcatctctgaag

SEQ ID NO: 264031 - DNA, 75 bp, Artificial Sequence
  Synthetic
cagcaaagctcagggactatgggctgaagccaacacgccctgacaaaaccgaaggaccccttgtcatctctgaag

SEQ ID NO: 264032 - DNA, 75 bp, Artificial Sequence
  Synthetic
cagcaaagctcagggagtatgggctgaagccaacacgccctgacaaaaccgaaggaccccttgtcatctctgaag

SEQ ID NO: 264033 - DNA, 75 bp, Artificial Sequence
  Synthetic
gtatcaacaaaatttgcaactgcaagaaaattcttttaaacatgacagggaaatgattgggtatcaggttgaagc

SEQ ID NO: 264034 - DNA, 75 bp, Artificial Sequence
  Synthetic
gaaaattcttttaaacatgacagggaaatgattgggtatcaggttgaagcttcaaatcaattattggctaaaaat

SEQ ID NO: 264035 - DNA, 75 bp, Artificial Sequence
  Synthetic
gctggagcttttcttgcaggtctggctggtgatgtggtgacctctggcatcgggtcgctcatcaatgcaggtgct

SEQ ID NO: 264036 - DNA, 75 bp, Artificial Sequence
  Synthetic
agcacgctgtcattgaccttgaggtcctcgcctcaaacaacatcacagaggtagttagggaccgccaatccacac

SEQ ID NO: 264037 - DNA, 75 bp, Artificial Sequence
  Synthetic
cctcgcctcaaacaacatcacagaggtagttagggaccgccaatccacactggcctacatcaagacccttgacat

SEQ ID NO: 264038 - DNA, 75 bp, Artificial Sequence
  Synthetic
ctggtgatgtggtgacctctggcatcgggtcgctcatcaatgcaggtgctaatgcagtaaaccaaaaggttgaat

SEQ ID NO: 264039 - DNA, 75 bp, Artificial Sequence
  Synthetic
caaccaaattgcagagggacatgatcgccatcaagcagggggtcttgaccgctggcggcttttcccccactgatg

SEQ ID NO: 264040 - DNA, 75 bp, Artificial Sequence
  Synthetic
ccagtcacccgcattgtagattggaatggcgtgagagtgtctgctcccgagtcctctgctaccacattgagatcc

SEQ ID NO: 264041 - DNA, 75 bp, Artificial Sequence
  Synthetic
atggcgtgagagtgtctgctcccgagtcctctgctaccacattgagatccggtggcttcatgtcagttcccatac

SEQ ID NO: 264042 - DNA, 75 bp, Artificial Sequence
  Synthetic
cgccatcaagcagggggtcttgaccgctggcggcttttcccccactgatgctgcaagaggttccatcaatgctcc

SEQ ID NO: 264043 - DNA, 75 bp, Artificial Sequence
  Synthetic
cggaaggattgccatggctaggtccgccctggccaaagctcagtcagagatgtccaatcgagtgcgccctgttgt

SEQ ID NO: 264044 - DNA, 75 bp, Artificial Sequence
  Synthetic
gccctggccaaagctcagtcagagatgtccaatcgagtgcgccctgttgtcatcatgttaagcgggccccctggc

SEQ ID NO: 264045 - DNA, 75 bp, Artificial Sequence
  Synthetic
taatttcacctcacaaggagttaagcagcccacacctatagttaaatctgtgaaacctcaagtacagcaatctcc

SEQ ID NO: 264046 - DNA, 75 bp, Artificial Sequence
  Synthetic
gaaccactagttgggtcgagtcacaaaactcatcgagatttggaaatctttctccataccacgcggaggctctca

SEQ ID NO: 264047 - DNA, 75 bp, Artificial Sequence
  Synthetic
cagcccacacctatagttaaatctgtgaaacctcaagtacagcaatctcctgccccttcttctgtttattctgta

SEQ ID NO: 264048 - DNA, 75 bp, Artificial Sequence
  Synthetic
ctcgtcccccgcgaggccgtcgaccactgggacggctacaagggccaggaagtaatgctgtgggacgactacggc

SEQ ID NO: 264049 - DNA, 75 bp, Artificial Sequence
  Synthetic
actgggacggctacaagggccaggaagtaatgctgtgggacgactacggcatggccaacattgctgcagactgca

SEQ ID NO: 264050 - DNA, 75 bp, Artificial Sequence
  Synthetic
tcaacaactacaacattgtctaggacaagtgagtgggtaaggagtcaaaatgatagactgagcccctttatggga

SEQ ID NO: 264051 - DNA, 75 bp, Artificial Sequence
  Synthetic
caagtgagtgggtaaggagtcaaaatgatagactgagcccctttatgggaggcgcgcttcagacagctttcgtca

SEQ ID NO: 264052 - DNA, 75 bp, Artificial Sequence
  Synthetic
cagacaggttgccattattcgcaaataataggcgatgatgttgtaatatgaaatgtgggcatcatattcatttaa

SEQ ID NO: 264053 - DNA, 75 bp, Artificial Sequence
  Synthetic
tcacctcagaggccatagtcatcaccactaatgcccctgggcctgctcccttggaccacatgaatctggggccag

SEQ ID NO: 264054 - DNA, 75 bp, Artificial Sequence
  Synthetic
agttgacagtatcccctagaaacgctccaggtgaaatactatggagcgcgaccttcggccctgatatgaaaccct

SEQ ID NO: 264055 - DNA, 75 bp, Artificial Sequence
  Synthetic
agttgacagtatcccctagaaacgctccaggtgaaatactatggagcgcgaccttcggccctgatttgaaaccct

SEQ ID NO: 264056 - DNA, 75 bp, Artificial Sequence
  Synthetic
agttgacagtatcccctagaaacgctccaggtgaaatactatggagcgcgaccttcggccctgatctgaaaccct

SEQ ID NO: 264057 - DNA, 75 bp, Artificial Sequence
  Synthetic
agttgacagtatcccctagaaacgctccaggtgaaatactatggagcgcgaccttcggccctgatgtgaaaccct

SEQ ID NO: 264058 - DNA, 75 bp, Artificial Sequence
  Synthetic
agttgacagtatcccctagaaacgctccaggtgaaatactatggagcgcgtccttcggccctgatatgaaaccct

SEQ ID NO: 264059 - DNA, 75 bp, Artificial Sequence
  Synthetic
agttgacagtatcccctagaaacgctccaggtgaaatactatggagcgcgtccttcggccctgatttgaaaccct

SEQ ID NO: 264060 - DNA, 75 bp, Artificial Sequence
  Synthetic
agttgacagtatcccctagaaacgctccaggtgaaatactatggagcgcgtccttcggccctgatctgaaaccct

SEQ ID NO: 264061 - DNA, 75 bp, Artificial Sequence
  Synthetic
agttgacagtatcccctagaaacgctccaggtgaaatactatggagcgcgtccttcggccctgatgtgaaaccct

SEQ ID NO: 264062 - DNA, 75 bp, Artificial Sequence
  Synthetic
agttgacagtatcccctagaaacgctccaggtgaaatactatggagcgcgcccttcggccctgatatgaaaccct

SEQ ID NO: 264063 - DNA, 75 bp, Artificial Sequence
  Synthetic
agttgacagtatcccctagaaacgctccaggtgaaatactatggagcgcgcccttcggccctgatttgaaaccct

SEQ ID NO: 264064 - DNA, 75 bp, Artificial Sequence
  Synthetic
agttgacagtatcccctagaaacgctccaggtgaaatactatggagcgcgcccttcggccctgatctgaaaccct

SEQ ID NO: 264065 - DNA, 75 bp, Artificial Sequence
  Synthetic
agttgacagtatcccctagaaacgctccaggtgaaatactatggagcgcgcccttcggccctgatgtgaaaccct

SEQ ID NO: 264066 - DNA, 75 bp, Artificial Sequence
  Synthetic
agttgacagtatcccctagaaacgctccaggtgaaatactatggagcgcggccttcggccctgatatgaaaccct

SEQ ID NO: 264067 - DNA, 75 bp, Artificial Sequence
  Synthetic
agttgacagtatcccctagaaacgctccaggtgaaatactatggagcgcggccttcggccctgatttgaaaccct

SEQ ID NO: 264068 - DNA, 75 bp, Artificial Sequence
  Synthetic
agttgacagtatcccctagaaacgctccaggtgaaatactatggagcgcggccttcggccctgatctgaaaccct

SEQ ID NO: 264069 - DNA, 75 bp, Artificial Sequence
  Synthetic
agttgacagtatcccctagaaacgctccaggtgaaatactatggagcgcggccttcggccctgatgtgaaaccct

SEQ ID NO: 264070 - DNA, 75 bp, Artificial Sequence
  Synthetic
agttgacagtttcccctagaaacgctccaggtgaaatactatggagcgcgaccttcggccctgatatgaaaccct

SEQ ID NO: 264071 - DNA, 75 bp, Artificial Sequence
  Synthetic
agttgacagtttcccctagaaacgctccaggtgaaatactatggagcgcgaccttcggccctgatttgaaaccct

SEQ ID NO: 264072 - DNA, 75 bp, Artificial Sequence
  Synthetic
agttgacagtttcccctagaaacgctccaggtgaaatactatggagcgcgaccttcggccctgatctgaaaccct

SEQ ID NO: 264073 - DNA, 75 bp, Artificial Sequence
  Synthetic
agttgacagtttcccctagaaacgctccaggtgaaatactatggagcgcgaccttcggccctgatgtgaaaccct

SEQ ID NO: 264074 - DNA, 75 bp, Artificial Sequence
  Synthetic
agttgacagtttcccctagaaacgctccaggtgaaatactatggagcgcgtccttcggccctgatatgaaaccct

SEQ ID NO: 264075 - DNA, 75 bp, Artificial Sequence
  Synthetic
agttgacagtttcccctagaaacgctccaggtgaaatactatggagcgcgtccttcggccctgatttgaaaccct

SEQ ID NO: 264076 - DNA, 75 bp, Artificial Sequence
  Synthetic
agttgacagtttcccctagaaacgctccaggtgaaatactatggagcgcgtccttcggccctgatctgaaaccct

SEQ ID NO: 264077 - DNA, 75 bp, Artificial Sequence
  Synthetic
agttgacagtttcccctagaaacgctccaggtgaaatactatggagcgcgtccttcggccctgatgtgaaaccct

SEQ ID NO: 264078 - DNA, 75 bp, Artificial Sequence
  Synthetic
agttgacagtttcccctagaaacgctccaggtgaaatactatggagcgcgcccttcggccctgatatgaaaccct

SEQ ID NO: 264079 - DNA, 75 bp, Artificial Sequence
  Synthetic
agttgacagtttcccctagaaacgctccaggtgaaatactatggagcgcgcccttcggccctgatttgaaaccct

SEQ ID NO: 264080 - DNA, 75 bp, Artificial Sequence
  Synthetic
agttgacagtttcccctagaaacgctccaggtgaaatactatggagcgcgcccttcggccctgatctgaaaccct

SEQ ID NO: 264081 - DNA, 75 bp, Artificial Sequence
  Synthetic
agttgacagtttcccctagaaacgctccaggtgaaatactatggagcgcgcccttcggccctgatgtgaaaccct

SEQ ID NO: 264082 - DNA, 75 bp, Artificial Sequence
  Synthetic
agttgacagtttcccctagaaacgctccaggtgaaatactatggagcgcggccttcggccctgatatgaaaccct

SEQ ID NO: 264083 - DNA, 75 bp, Artificial Sequence
  Synthetic
agttgacagtttcccctagaaacgctccaggtgaaatactatggagcgcggccttcggccctgatttgaaaccct

SEQ ID NO: 264084 - DNA, 75 bp, Artificial Sequence
  Synthetic
agttgacagtttcccctagaaacgctccaggtgaaatactatggagcgcggccttcggccctgatctgaaaccct

SEQ ID NO: 264085 - DNA, 75 bp, Artificial Sequence
  Synthetic
agttgacagtttcccctagaaacgctccaggtgaaatactatggagcgcggccttcggccctgatgtgaaaccct

SEQ ID NO: 264086 - DNA, 75 bp, Artificial Sequence
  Synthetic
agttgacagtctcccctagaaacgctccaggtgaaatactatggagcgcgaccttcggccctgatatgaaaccct

SEQ ID NO: 264087 - DNA, 75 bp, Artificial Sequence
  Synthetic
agttgacagtctcccctagaaacgctccaggtgaaatactatggagcgcgaccttcggccctgatttgaaaccct

SEQ ID NO: 264088 - DNA, 75 bp, Artificial Sequence
  Synthetic
agttgacagtctcccctagaaacgctccaggtgaaatactatggagcgcgaccttcggccctgatctgaaaccct

SEQ ID NO: 264089 - DNA, 75 bp, Artificial Sequence
  Synthetic
agttgacagtctcccctagaaacgctccaggtgaaatactatggagcgcgaccttcggccctgatgtgaaaccct

SEQ ID NO: 264090 - DNA, 75 bp, Artificial Sequence
  Synthetic
agttgacagtctcccctagaaacgctccaggtgaaatactatggagcgcgtccttcggccctgatatgaaaccct

SEQ ID NO: 264091 - DNA, 75 bp, Artificial Sequence
  Synthetic
agttgacagtctcccctagaaacgctccaggtgaaatactatggagcgcgtccttcggccctgatttgaaaccct

SEQ ID NO: 264092 - DNA, 75 bp, Artificial Sequence
  Synthetic
agttgacagtctcccctagaaacgctccaggtgaaatactatggagcgcgtccttcggccctgatctgaaaccct

SEQ ID NO: 264093 - DNA, 75 bp, Artificial Sequence
  Synthetic
agttgacagtctcccctagaaacgctccaggtgaaatactatggagcgcgtccttcggccctgatgtgaaaccct

SEQ ID NO: 264094 - DNA, 75 bp, Artificial Sequence
  Synthetic
agttgacagtctcccctagaaacgctccaggtgaaatactatggagcgcgcccttcggccctgatatgaaaccct

SEQ ID NO: 264095 - DNA, 75 bp, Artificial Sequence
  Synthetic
agttgacagtctcccctagaaacgctccaggtgaaatactatggagcgcgcccttcggccctgatttgaaaccct

SEQ ID NO: 264096 - DNA, 75 bp, Artificial Sequence
  Synthetic
agttgacagtctcccctagaaacgctccaggtgaaatactatggagcgcgcccttcggccctgatctgaaaccct

SEQ ID NO: 264097 - DNA, 75 bp, Artificial Sequence
  Synthetic
agttgacagtctcccctagaaacgctccaggtgaaatactatggagcgcgcccttcggccctgatgtgaaaccct

SEQ ID NO: 264098 - DNA, 75 bp, Artificial Sequence
  Synthetic
agttgacagtctcccctagaaacgctccaggtgaaatactatggagcgcggccttcggccctgatatgaaaccct

SEQ ID NO: 264099 - DNA, 75 bp, Artificial Sequence
  Synthetic
agttgacagtctcccctagaaacgctccaggtgaaatactatggagcgcggccttcggccctgatttgaaaccct

SEQ ID NO: 264100 - DNA, 75 bp, Artificial Sequence
  Synthetic
agttgacagtctcccctagaaacgctccaggtgaaatactatggagcgcggccttcggccctgatctgaaaccct

SEQ ID NO: 264101 - DNA, 75 bp, Artificial Sequence
  Synthetic
agttgacagtctcccctagaaacgctccaggtgaaatactatggagcgcggccttcggccctgatgtgaaaccct

SEQ ID NO: 264102 - DNA, 75 bp, Artificial Sequence
  Synthetic
agttgacagtgtcccctagaaacgctccaggtgaaatactatggagcgcgaccttcggccctgatatgaaaccct

SEQ ID NO: 264103 - DNA, 75 bp, Artificial Sequence
  Synthetic
agttgacagtgtcccctagaaacgctccaggtgaaatactatggagcgcgaccttcggccctgatttgaaaccct

SEQ ID NO: 264104 - DNA, 75 bp, Artificial Sequence
  Synthetic
agttgacagtgtcccctagaaacgctccaggtgaaatactatggagcgcgaccttcggccctgatctgaaaccct

SEQ ID NO: 264105 - DNA, 75 bp, Artificial Sequence
  Synthetic
agttgacagtgtcccctagaaacgctccaggtgaaatactatggagcgcgaccttcggccctgatgtgaaaccct

SEQ ID NO: 264106 - DNA, 75 bp, Artificial Sequence
  Synthetic
agttgacagtgtcccctagaaacgctccaggtgaaatactatggagcgcgtccttcggccctgatatgaaaccct

SEQ ID NO: 264107 - DNA, 75 bp, Artificial Sequence
  Synthetic
agttgacagtgtcccctagaaacgctccaggtgaaatactatggagcgcgtccttcggccctgatttgaaaccct

SEQ ID NO: 264108 - DNA, 75 bp, Artificial Sequence
  Synthetic
agttgacagtgtcccctagaaacgctccaggtgaaatactatggagcgcgtccttcggccctgatctgaaaccct

SEQ ID NO: 264109 - DNA, 75 bp, Artificial Sequence
  Synthetic
agttgacagtgtcccctagaaacgctccaggtgaaatactatggagcgcgtccttcggccctgatgtgaaaccct

SEQ ID NO: 264110 - DNA, 75 bp, Artificial Sequence
  Synthetic
agttgacagtgtcccctagaaacgctccaggtgaaatactatggagcgcgcccttcggccctgatatgaaaccct

SEQ ID NO: 264111 - DNA, 75 bp, Artificial Sequence
  Synthetic
agttgacagtgtcccctagaaacgctccaggtgaaatactatggagcgcgcccttcggccctgatttgaaaccct

SEQ ID NO: 264112 - DNA, 75 bp, Artificial Sequence
  Synthetic
agttgacagtgtcccctagaaacgctccaggtgaaatactatggagcgcgcccttcggccctgatctgaaaccct

SEQ ID NO: 264113 - DNA, 75 bp, Artificial Sequence
  Synthetic
agttgacagtgtcccctagaaacgctccaggtgaaatactatggagcgcgcccttcggccctgatgtgaaaccct

SEQ ID NO: 264114 - DNA, 75 bp, Artificial Sequence
  Synthetic
agttgacagtgtcccctagaaacgctccaggtgaaatactatggagcgcggccttcggccctgatatgaaaccct

SEQ ID NO: 264115 - DNA, 75 bp, Artificial Sequence
  Synthetic
agttgacagtgtcccctagaaacgctccaggtgaaatactatggagcgcggccttcggccctgatttgaaaccct

SEQ ID NO: 264116 - DNA, 75 bp, Artificial Sequence
  Synthetic
agttgacagtgtcccctagaaacgctccaggtgaaatactatggagcgcggccttcggccctgatctgaaaccct

SEQ ID NO: 264117 - DNA, 75 bp, Artificial Sequence
  Synthetic
agttgacagtgtcccctagaaacgctccaggtgaaatactatggagcgcggccttcggccctgatgtgaaaccct

SEQ ID NO: 264118 - DNA, 75 bp, Artificial Sequence
  Synthetic
cactaatgcccctgggcctgctcccttggaccacatgaatctggggccagtgtgccggcgagttgacttcctcgt

SEQ ID NO: 264119 - DNA, 75 bp, Artificial Sequence
  Synthetic
ctcctgcatttaacacgcgcaggcagccgctcttcgctcacatacgtaagcgaggggagtcacgggcttagtgaa

SEQ ID NO: 264120 - DNA, 75 bp, Artificial Sequence
  Synthetic
gccgctcttcgctcacatacgtaagcgaggggagtcacgggcttagtgaaaagaatgatttggttagattatcct

SEQ ID NO: 264121 - DNA, 75 bp, Artificial Sequence
  Synthetic
gagtacaagaggatcagagaagaaaggaatggcaagtactccatagaagagtaccttcaggacagggacaaatac

SEQ ID NO: 264122 - DNA, 75 bp, Artificial Sequence
  Synthetic
gagtacaagaggatcagagaagataggaatggcaagtactccatagaagagtaccttcaggacagggacaaatac

SEQ ID NO: 264123 - DNA, 75 bp, Artificial Sequence
  Synthetic
gagtacaagaggatcagagaagacaggaatggcaagtactccatagaagagtaccttcaggacagggacaaatac

SEQ ID NO: 264124 - DNA, 75 bp, Artificial Sequence
  Synthetic
gagtacaagaggatcagagaagagaggaatggcaagtactccatagaagagtaccttcaggacagggacaaatac

SEQ ID NO: 264125 - DNA, 75 bp, Artificial Sequence
  Synthetic
gcttccgttgccgttgcttgcaacaacaacaacgacaaggaaaaatcttcgggtgaaggcttatttacaaatatg

SEQ ID NO: 264126 - DNA, 75 bp, Artificial Sequence
  Synthetic
caaaaaggacttcacccacctccagcttcagcttgcgccccaaggcgggtttgactgcctcggcaatacgcccta

SEQ ID NO: 264127 - DNA, 75 bp, Artificial Sequence
  Synthetic
caaaagcatggatctcggcaccacaccaggagattgtggctgaccctacatctacaagagaggaaaagactatgt

SEQ ID NO: 264128 - DNA, 75 bp, Artificial Sequence
  Synthetic
caaaagcatggatctcggcaccacaccaggagattgtggctgaccctacatctacaagagaggaaatgactatgt

SEQ ID NO: 264129 - DNA, 75 bp, Artificial Sequence
  Synthetic
caaaagcatggatctcggcaccacaccaggagattgtggctgaccctacatctacaagagaggaaacgactatgt

SEQ ID NO: 264130 - DNA, 75 bp, Artificial Sequence
  Synthetic
caaaagcatggatctcggcaccacaccaggagattgtggctgaccctacatctacaagagaggaaaggactatgt

SEQ ID NO: 264131 - DNA, 75 bp, Artificial Sequence
  Synthetic
caaaagcatggatctcggcaccacaccaggagattgtggctgtccctacatctacaagagaggaaaagactatgt

SEQ ID NO: 264132 - DNA, 75 bp, Artificial Sequence
  Synthetic
caaaagcatggatctcggcaccacaccaggagattgtggctgtccctacatctacaagagaggaaatgactatgt

SEQ ID NO: 264133 - DNA, 75 bp, Artificial Sequence
  Synthetic
caaaagcatggatctcggcaccacaccaggagattgtggctgtccctacatctacaagagaggaaacgactatgt

SEQ ID NO: 264134 - DNA, 75 bp, Artificial Sequence
  Synthetic
caaaagcatggatctcggcaccacaccaggagattgtggctgtccctacatctacaagagaggaaaggactatgt

SEQ ID NO: 264135 - DNA, 75 bp, Artificial Sequence
  Synthetic
caaaagcatggatctcggcaccacaccaggagattgtggctgcccctacatctacaagagaggaaaagactatgt

SEQ ID NO: 264136 - DNA, 75 bp, Artificial Sequence
  Synthetic
caaaagcatggatctcggcaccacaccaggagattgtggctgcccctacatctacaagagaggaaatgactatgt

SEQ ID NO: 264137 - DNA, 75 bp, Artificial Sequence
  Synthetic
caaaagcatggatctcggcaccacaccaggagattgtggctgcccctacatctacaagagaggaaacgactatgt

SEQ ID NO: 264138 - DNA, 75 bp, Artificial Sequence
  Synthetic
caaaagcatggatctcggcaccacaccaggagattgtggctgcccctacatctacaagagaggaaaggactatgt

SEQ ID NO: 264139 - DNA, 75 bp, Artificial Sequence
  Synthetic
caaaagcatggatctcggcaccacaccaggagattgtggctggccctacatctacaagagaggaaaagactatgt

SEQ ID NO: 264140 - DNA, 75 bp, Artificial Sequence
  Synthetic
caaaagcatggatctcggcaccacaccaggagattgtggctggccctacatctacaagagaggaaatgactatgt

SEQ ID NO: 264141 - DNA, 75 bp, Artificial Sequence
  Synthetic
caaaagcatggatctcggcaccacaccaggagattgtggctggccctacatctacaagagaggaaacgactatgt

SEQ ID NO: 264142 - DNA, 75 bp, Artificial Sequence
  Synthetic
caaaagcatggatctcggcaccacaccaggagattgtggctggccctacatctacaagagaggaaaggactatgt

SEQ ID NO: 264143 - DNA, 75 bp, Artificial Sequence
  Synthetic
caaaagcatggatctcggcaccacaccaggtgattgtggctgaccctacatctacaagagaggaaaagactatgt

SEQ ID NO: 264144 - DNA, 75 bp, Artificial Sequence
  Synthetic
caaaagcatggatctcggcaccacaccaggtgattgtggctgaccctacatctacaagagaggaaatgactatgt

SEQ ID NO: 264145 - DNA, 75 bp, Artificial Sequence
  Synthetic
caaaagcatggatctcggcaccacaccaggtgattgtggctgaccctacatctacaagagaggaaacgactatgt

SEQ ID NO: 264146 - DNA, 75 bp, Artificial Sequence
  Synthetic
caaaagcatggatctcggcaccacaccaggtgattgtggctgaccctacatctacaagagaggaaaggactatgt

SEQ ID NO: 264147 - DNA, 75 bp, Artificial Sequence
  Synthetic
caaaagcatggatctcggcaccacaccaggtgattgtggctgtccctacatctacaagagaggaaaagactatgt

SEQ ID NO: 264148 - DNA, 75 bp, Artificial Sequence
  Synthetic
caaaagcatggatctcggcaccacaccaggtgattgtggctgtccctacatctacaagagaggaaatgactatgt

SEQ ID NO: 264149 - DNA, 75 bp, Artificial Sequence
  Synthetic
caaaagcatggatctcggcaccacaccaggtgattgtggctgtccctacatctacaagagaggaaacgactatgt

SEQ ID NO: 264150 - DNA, 75 bp, Artificial Sequence
  Synthetic
caaaagcatggatctcggcaccacaccaggtgattgtggctgtccctacatctacaagagaggaaaggactatgt

SEQ ID NO: 264151 - DNA, 75 bp, Artificial Sequence
  Synthetic
caaaagcatggatctcggcaccacaccaggtgattgtggctgcccctacatctacaagagaggaaaagactatgt

SEQ ID NO: 264152 - DNA, 75 bp, Artificial Sequence
  Synthetic
caaaagcatggatctcggcaccacaccaggtgattgtggctgcccctacatctacaagagaggaaatgactatgt

SEQ ID NO: 264153 - DNA, 75 bp, Artificial Sequence
  Synthetic
caaaagcatggatctcggcaccacaccaggtgattgtggctgcccctacatctacaagagaggaaacgactatgt

SEQ ID NO: 264154 - DNA, 75 bp, Artificial Sequence
  Synthetic
caaaagcatggatctcggcaccacaccaggtgattgtggctgcccctacatctacaagagaggaaaggactatgt

SEQ ID NO: 264155 - DNA, 75 bp, Artificial Sequence
  Synthetic
caaaagcatggatctcggcaccacaccaggtgattgtggctggccctacatctacaagagaggaaaagactatgt

SEQ ID NO: 264156 - DNA, 75 bp, Artificial Sequence
  Synthetic
caaaagcatggatctcggcaccacaccaggtgattgtggctggccctacatctacaagagaggaaatgactatgt

SEQ ID NO: 264157 - DNA, 75 bp, Artificial Sequence
  Synthetic
caaaagcatggatctcggcaccacaccaggtgattgtggctggccctacatctacaagagaggaaacgactatgt

SEQ ID NO: 264158 - DNA, 75 bp, Artificial Sequence
  Synthetic
caaaagcatggatctcggcaccacaccaggtgattgtggctggccctacatctacaagagaggaaaggactatgt

SEQ ID NO: 264159 - DNA, 75 bp, Artificial Sequence
  Synthetic
caaaagcatggatctcggcaccacaccaggcgattgtggctgaccctacatctacaagagaggaaaagactatgt

SEQ ID NO: 264160 - DNA, 75 bp, Artificial Sequence
  Synthetic
caaaagcatggatctcggcaccacaccaggcgattgtggctgaccctacatctacaagagaggaaatgactatgt

SEQ ID NO: 264161 - DNA, 75 bp, Artificial Sequence
  Synthetic
caaaagcatggatctcggcaccacaccaggcgattgtggctgaccctacatctacaagagaggaaacgactatgt

SEQ ID NO: 264162 - DNA, 75 bp, Artificial Sequence
  Synthetic
caaaagcatggatctcggcaccacaccaggcgattgtggctgaccctacatctacaagagaggaaaggactatgt

SEQ ID NO: 264163 - DNA, 75 bp, Artificial Sequence
  Synthetic
caaaagcatggatctcggcaccacaccaggcgattgtggctgtccctacatctacaagagaggaaaagactatgt

SEQ ID NO: 264164 - DNA, 75 bp, Artificial Sequence
  Synthetic
caaaagcatggatctcggcaccacaccaggcgattgtggctgtccctacatctacaagagaggaaatgactatgt

SEQ ID NO: 264165 - DNA, 75 bp, Artificial Sequence
  Synthetic
caaaagcatggatctcggcaccacaccaggcgattgtggctgtccctacatctacaagagaggaaacgactatgt

SEQ ID NO: 264166 - DNA, 75 bp, Artificial Sequence
  Synthetic
caaaagcatggatctcggcaccacaccaggcgattgtggctgtccctacatctacaagagaggaaaggactatgt

SEQ ID NO: 264167 - DNA, 75 bp, Artificial Sequence
  Synthetic
caaaagcatggatctcggcaccacaccaggcgattgtggctgcccctacatctacaagagaggaaaagactatgt

SEQ ID NO: 264168 - DNA, 75 bp, Artificial Sequence
  Synthetic
caaaagcatggatctcggcaccacaccaggcgattgtggctgcccctacatctacaagagaggaaatgactatgt

SEQ ID NO: 264169 - DNA, 75 bp, Artificial Sequence
  Synthetic
caaaagcatggatctcggcaccacaccaggcgattgtggctgcccctacatctacaagagaggaaacgactatgt

SEQ ID NO: 264170 - DNA, 75 bp, Artificial Sequence
  Synthetic
caaaagcatggatctcggcaccacaccaggcgattgtggctgcccctacatctacaagagaggaaaggactatgt

SEQ ID NO: 264171 - DNA, 75 bp, Artificial Sequence
  Synthetic
caaaagcatggatctcggcaccacaccaggcgattgtggctggccctacatctacaagagaggaaaagactatgt

SEQ ID NO: 264172 - DNA, 75 bp, Artificial Sequence
  Synthetic
caaaagcatggatctcggcaccacaccaggcgattgtggctggccctacatctacaagagaggaaatgactatgt

SEQ ID NO: 264173 - DNA, 75 bp, Artificial Sequence
  Synthetic
caaaagcatggatctcggcaccacaccaggcgattgtggctggccctacatctacaagagaggaaacgactatgt

SEQ ID NO: 264174 - DNA, 75 bp, Artificial Sequence
  Synthetic
caaaagcatggatctcggcaccacaccaggcgattgtggctggccctacatctacaagagaggaaaggactatgt

SEQ ID NO: 264175 - DNA, 75 bp, Artificial Sequence
  Synthetic
caaaagcatggatctcggcaccacaccaggggattgtggctgaccctacatctacaagagaggaaaagactatgt

SEQ ID NO: 264176 - DNA, 75 bp, Artificial Sequence
  Synthetic
caaaagcatggatctcggcaccacaccaggggattgtggctgaccctacatctacaagagaggaaatgactatgt

SEQ ID NO: 264177 - DNA, 75 bp, Artificial Sequence
  Synthetic
caaaagcatggatctcggcaccacaccaggggattgtggctgaccctacatctacaagagaggaaacgactatgt

SEQ ID NO: 264178 - DNA, 75 bp, Artificial Sequence
  Synthetic
caaaagcatggatctcggcaccacaccaggggattgtggctgaccctacatctacaagagaggaaaggactatgt

SEQ ID NO: 264179 - DNA, 75 bp, Artificial Sequence
  Synthetic
caaaagcatggatctcggcaccacaccaggggattgtggctgtccctacatctacaagagaggaaaagactatgt

SEQ ID NO: 264180 - DNA, 75 bp, Artificial Sequence
  Synthetic
caaaagcatggatctcggcaccacaccaggggattgtggctgtccctacatctacaagagaggaaatgactatgt

SEQ ID NO: 264181 - DNA, 75 bp, Artificial Sequence
  Synthetic
caaaagcatggatctcggcaccacaccaggggattgtggctgtccctacatctacaagagaggaaacgactatgt

SEQ ID NO: 264182 - DNA, 75 bp, Artificial Sequence
  Synthetic
caaaagcatggatctcggcaccacaccaggggattgtggctgtccctacatctacaagagaggaaaggactatgt

SEQ ID NO: 264183 - DNA, 75 bp, Artificial Sequence
  Synthetic
caaaagcatggatctcggcaccacaccaggggattgtggctgcccctacatctacaagagaggaaaagactatgt

SEQ ID NO: 264184 - DNA, 75 bp, Artificial Sequence
  Synthetic
caaaagcatggatctcggcaccacaccaggggattgtggctgcccctacatctacaagagaggaaatgactatgt

SEQ ID NO: 264185 - DNA, 75 bp, Artificial Sequence
  Synthetic
caaaagcatggatctcggcaccacaccaggggattgtggctgcccctacatctacaagagaggaaacgactatgt

SEQ ID NO: 264186 - DNA, 75 bp, Artificial Sequence
  Synthetic
caaaagcatggatctcggcaccacaccaggggattgtggctgcccctacatctacaagagaggaaaggactatgt

SEQ ID NO: 264187 - DNA, 75 bp, Artificial Sequence
  Synthetic
caaaagcatggatctcggcaccacaccaggggattgtggctggccctacatctacaagagaggaaaagactatgt

SEQ ID NO: 264188 - DNA, 75 bp, Artificial Sequence
  Synthetic
caaaagcatggatctcggcaccacaccaggggattgtggctggccctacatctacaagagaggaaatgactatgt

SEQ ID NO: 264189 - DNA, 75 bp, Artificial Sequence
  Synthetic
caaaagcatggatctcggcaccacaccaggggattgtggctggccctacatctacaagagaggaaacgactatgt

SEQ ID NO: 264190 - DNA, 75 bp, Artificial Sequence
  Synthetic
caaaagcatggatctcggcaccacaccaggggattgtggctggccctacatctacaagagaggaaaggactatgt

SEQ ID NO: 264191 - DNA, 75 bp, Artificial Sequence
  Synthetic
tcaaagcacactgtgtcacacttcccataagagttggtatgaatatgaatgaggatggccccatcatcttcgaga

SEQ ID NO: 264192 - DNA, 75 bp, Artificial Sequence
  Synthetic
tcaaagcacactgtgtcacacttcccattagagttggtatgaatatgaatgaggatggccccatcatcttcgaga

SEQ ID NO: 264193 - DNA, 75 bp, Artificial Sequence
  Synthetic
tcaaagcacactgtgtcacacttcccatcagagttggtatgaatatgaatgaggatggccccatcatcttcgaga

SEQ ID NO: 264194 - DNA, 75 bp, Artificial Sequence
  Synthetic
tcaaagcacactgtgtcacacttcccatgagagttggtatgaatatgaatgaggatggccccatcatcttcgaga

SEQ ID NO: 264195 - DNA, 75 bp, Artificial Sequence
  Synthetic
tcaaagctcactgtgtcacacttcccataagagttggtatgaatatgaatgaggatggccccatcatcttcgaga

SEQ ID NO: 264196 - DNA, 75 bp, Artificial Sequence
  Synthetic
tcaaagctcactgtgtcacacttcccattagagttggtatgaatatgaatgaggatggccccatcatcttcgaga

SEQ ID NO: 264197 - DNA, 75 bp, Artificial Sequence
  Synthetic
tcaaagctcactgtgtcacacttcccatcagagttggtatgaatatgaatgaggatggccccatcatcttcgaga

SEQ ID NO: 264198 - DNA, 75 bp, Artificial Sequence
  Synthetic
tcaaagctcactgtgtcacacttcccatgagagttggtatgaatatgaatgaggatggccccatcatcttcgaga

SEQ ID NO: 264199 - DNA, 75 bp, Artificial Sequence
  Synthetic
tcaaagcccactgtgtcacacttcccataagagttggtatgaatatgaatgaggatggccccatcatcttcgaga

SEQ ID NO: 264200 - DNA, 75 bp, Artificial Sequence
  Synthetic
tcaaagcccactgtgtcacacttcccattagagttggtatgaatatgaatgaggatggccccatcatcttcgaga

SEQ ID NO: 264201 - DNA, 75 bp, Artificial Sequence
  Synthetic
tcaaagcccactgtgtcacacttcccatcagagttggtatgaatatgaatgaggatggccccatcatcttcgaga

SEQ ID NO: 264202 - DNA, 75 bp, Artificial Sequence
  Synthetic
tcaaagcccactgtgtcacacttcccatgagagttggtatgaatatgaatgaggatggccccatcatcttcgaga

SEQ ID NO: 264203 - DNA, 75 bp, Artificial Sequence
  Synthetic
tcaaagcgcactgtgtcacacttcccataagagttggtatgaatatgaatgaggatggccccatcatcttcgaga

SEQ ID NO: 264204 - DNA, 75 bp, Artificial Sequence
  Synthetic
tcaaagcgcactgtgtcacacttcccattagagttggtatgaatatgaatgaggatggccccatcatcttcgaga

SEQ ID NO: 264205 - DNA, 75 bp, Artificial Sequence
  Synthetic
tcaaagcgcactgtgtcacacttcccatcagagttggtatgaatatgaatgaggatggccccatcatcttcgaga

SEQ ID NO: 264206 - DNA, 75 bp, Artificial Sequence
  Synthetic
tcaaagcgcactgtgtcacacttcccatgagagttggtatgaatatgaatgaggatggccccatcatcttcgaga

SEQ ID NO: 264207 - DNA, 75 bp, Artificial Sequence
  Synthetic
cttcagcttgcgccccaaggcgggtttgactgcctcggcaatacgccctatggcaagggcgccatgtccaagacc

SEQ ID NO: 264208 - DNA, 75 bp, Artificial Sequence
  Synthetic
gtatgtggagcgaggtcttgtactaggtgtgcacaaaccaccagctgccatcagcctcgctagggttgagctagc

SEQ ID NO: 264209 - DNA, 75 bp, Artificial Sequence
  Synthetic
gagtatgactttgataagaaccgggtcctggccttttcaaagatggccaatgacaatgggctcggtatgctctct

SEQ ID NO: 264210 - DNA, 75 bp, Artificial Sequence
  Synthetic
tcctggccttttcaaagatggccaatgacaatgggctcggtatgctctctgccatgagggtggctaacaaactga

SEQ ID NO: 264211 - DNA, 75 bp, Artificial Sequence
  Synthetic
accgctgactggggcaatactagagatgtgggatggagagatataccactatggcttgtatgtggagaaaggctt

SEQ ID NO: 264212 - DNA, 75 bp, Artificial Sequence
  Synthetic
atgtgggatggagagatataccactatggcttgtatgtggagaaaggcttggtgttgggtgtacacaaaccacct

SEQ ID NO: 264213 - DNA, 75 bp, Artificial Sequence
  Synthetic
gggggactcattacgagctccagtctgacgggcaaaaattgaccattaaccaacttgccaccccccagcccaccg

SEQ ID NO: 264214 - DNA, 75 bp, Artificial Sequence
  Synthetic
tgacgggcaaaaattgaccattaaccaacttgccaccccccagcccaccgttgaaatcaattatgccttaaaacg

SEQ ID NO: 264215 - DNA, 75 bp, Artificial Sequence
  Synthetic
actggaaccatcctggagatgtgggacggggagatctaccattatggcttatatgtggaacgagggttagtgcta

SEQ ID NO: 264216 - DNA, 75 bp, Artificial Sequence
  Synthetic
ctcatctcccctgaaactctcaagaggctcaacggagaggcattcccttatactgcctttgataacaactgttat

SEQ ID NO: 264217 - DNA, 75 bp, Artificial Sequence
  Synthetic
ctccgccctcgtcatccaccgggcggttcagcggatccgggccccatccacccagctggaatcccacaactgcag

SEQ ID NO: 264218 - DNA, 75 bp, Artificial Sequence
  Synthetic
gttcagcggatccgggccccatccacccagctggaatcccacaactgcaggtaccaccgggcagagcaagaaaac

SEQ ID NO: 264219 - DNA, 75 bp, Artificial Sequence
  Synthetic
gaaaacccctacccactatggatgactccaaaattaagaaggtggcaaacatattcttatgttcattgtccacgc

SEQ ID NO: 264220 - DNA, 75 bp, Artificial Sequence
  Synthetic
gagaagccagctcctaatgaggacaagaagaagaaggttcaggcccctgtgcagctggagtccaagaaaggcagg

SEQ ID NO: 264221 - DNA, 75 bp, Artificial Sequence
  Synthetic
agaagaagaaggttcaggcccctgtgcagctggagtccaagaaaggcaggaggaagaccaacgccttctcccggc

SEQ ID NO: 264222 - DNA, 75 bp, Artificial Sequence
  Synthetic
agtaccttgaggatcgtgagcgctacgagcgtgagctggccgagcgccaggctgacgacgaggcctatgatgaca

SEQ ID NO: 264223 - DNA, 75 bp, Artificial Sequence
  Synthetic
cgagcgtgagctggccgagcgccaggctgacgacgaggcctatgatgacagttccatccgccaaaagtactttgg

SEQ ID NO: 264224 - DNA, 75 bp, Artificial Sequence
  Synthetic
gcgggtcttctaaccttccttcttcagctaggagttcttctagtgtcttttcccaatccacttccccttcctccc

SEQ ID NO: 264225 - DNA, 75 bp, Artificial Sequence
  Synthetic
gcgggaggtggactacaatgaggtgatagagttccaggctcccccctcaatatggtcgcggatccagcgcttcgg

SEQ ID NO: 264226 - DNA, 75 bp, Artificial Sequence
  Synthetic
atactcaaattagtcatgaaatggtttttcccaaagaaagaagaggccaatgaactagccatggtgagagcaata

SEQ ID NO: 264227 - DNA, 75 bp, Artificial Sequence
  Synthetic
atagagttccaggctcccccctcaatatggtcgcggatccagcgcttcggctccggctggggctgctgggtctct

SEQ ID NO: 264228 - DNA, 75 bp, Artificial Sequence
  Synthetic
ttgggattcaccaaagagaaaatcggcaaaatgctttcatctgctgcttcaaccctgagggcatgtaaagatctc

SEQ ID NO: 264229 - DNA, 75 bp, Artificial Sequence
  Synthetic
attgcggtcagttcccatggtgagttcacccagttccgctttccccggccgatacggccagatgtgagtgggctg

SEQ ID NO: 264230 - DNA, 75 bp, Artificial Sequence
  Synthetic
tcacccagttccgctttccccggccgatacggccagatgtgagtgggctgattcttgaggagggggcccctgagg

SEQ ID NO: 264231 - DNA, 75 bp, Artificial Sequence
  Synthetic
tggggacccatgcaaccatgaaaattcaagggcgcactgttggaggccagatgggcatgcttctgacaggatcca

SEQ ID NO: 264232 - DNA, 75 bp, Artificial Sequence
  Synthetic
ccagcaccaaagtgcagggcaaagtcatcaatggccagactgggatgctcctcaccggctccaacgccaagggca

SEQ ID NO: 264233 - DNA, 75 bp, Artificial Sequence
  Synthetic
ggagaaggcgaggaaactttccaccaagtctgcctcaccggatattgtgggcacgataaatgccctactgtcaag

SEQ ID NO: 264234 - DNA, 75 bp, Artificial Sequence
  Synthetic
catcaatggccagactgggatgctcctcaccggctccaacgccaagggcatggatttaggcactttccccggtga

SEQ ID NO: 264235 - DNA, 75 bp, Artificial Sequence
  Synthetic
ctctcacgggggatcaaagagtcggactcataccgagaaacggtgtggaccattgggacgcatacaaaggcgaga

SEQ ID NO: 264236 - DNA, 75 bp, Artificial Sequence
  Synthetic
aagtctgcctcaccggatattgtgggcacgataaatgccctactgtcaaggattgcagctgcccggtctctagtg

SEQ ID NO: 264237 - DNA, 75 bp, Artificial Sequence
  Synthetic
tggcaacacggtcatttgtgccattccaaactcccaggagtcggtcgcgctcgagggcggacacggcacctatgt

SEQ ID NO: 264238 - DNA, 75 bp, Artificial Sequence
  Synthetic
ccaaactcccaggagtcggtcgcgctcgagggcggacacggcacctatgttggccaccccataattggccagggg

SEQ ID NO: 264239 - DNA, 75 bp, Artificial Sequence
  Synthetic
ccagcatatctcggtggcaaggaccctcgagtccagggcggcccctccctccaacaggtgatgcgggatcagctg

SEQ ID NO: 264240 - DNA, 75 bp, Artificial Sequence
  Synthetic
ctcgagtccagggcggcccctccctccaacaggtgatgcgggatcagctggcccagttctcagctcctcgtggca

SEQ ID NO: 264241 - DNA, 75 bp, Artificial Sequence
  Synthetic
cgaagccttggagctaccaagacgcctgcatgtctctggacaagaccacaagctctggctacccccattataaga

SEQ ID NO: 264242 - DNA, 75 bp, Artificial Sequence
  Synthetic
accgtcaaggcaagagtcagcgtcctcgctacaccgcagcgctgaaagatgagctggtggccccgagaaagatct

SEQ ID NO: 264243 - DNA, 75 bp, Artificial Sequence
  Synthetic
gaatgtgaccattaagaggtgccagattatctacaatggttccacgttcgaccttgagtctgacggtaagggtaa

SEQ ID NO: 264244 - DNA, 75 bp, Artificial Sequence
  Synthetic
attatctacaatggttccacgttcgaccttgagtctgacggtaagggtaaagttttggtggaaaaggtcaaaaac

SEQ ID NO: 264245 - DNA, 75 bp, Artificial Sequence
  Synthetic
ccttctgcgacgccatcaaggagcacgtggtggagttgcccataaagattggaatgaatgccattgaggatggac

SEQ ID NO: 264246 - DNA, 75 bp, Artificial Sequence
  Synthetic
cgtggtggagttgcccataaagattggaatgaatgccattgaggatggacctgttatatatcaaaaacactcaac

SEQ ID NO: 264247 - DNA, 75 bp, Artificial Sequence
  Synthetic
tgatatcatgaccaagcttactgcagagcctgagctcgcccgcgttgttgcggaagacttgcttaagccctcaca

SEQ ID NO: 264248 - DNA, 75 bp, Artificial Sequence
  Synthetic
gagcctgagctcgcccgcgttgttgcggaagacttgcttaagccctcacaccttgacgtgggggacttcctggtg

SEQ ID NO: 264249 - DNA, 75 bp, Artificial Sequence
  Synthetic
ctgtgcgcactctcagaggtcaccaatctggacccagatgtggtgcaggcgaacagttacttctctttctatggt

SEQ ID NO: 264250 - DNA, 75 bp, Artificial Sequence
  Synthetic
atctggacccagatgtggtgcaggcgaacagttacttctctttctatggtgatgatgagatagtgtcaacagacc

SEQ ID NO: 264251 - DNA, 75 bp, Artificial Sequence
  Synthetic
gtgaatgaagatggcgtctaacgacgctacctctgcctttggcagtcaaaactctgtcaatgacagtatcaacac

SEQ ID NO: 264252 - DNA, 75 bp, Artificial Sequence
  Synthetic
caccccttccaataaagaagaggttggtgcattctccaacatcaaagttggacttaagaaaatgctgggtgccgt

SEQ ID NO: 264253 - DNA, 75 bp, Artificial Sequence
  Synthetic
agggtcctattgagctccgccgtcaggttgacggcctggtcttccttcggcgcacaatctcgcacgatgccaagg

SEQ ID NO: 264254 - DNA, 75 bp, Artificial Sequence
  Synthetic
cccaccagaacccccaaacggtgaggacattgtgcagttcgacgcaaaatcagaaactgtgcgtggactacccga

SEQ ID NO: 264255 - DNA, 75 bp, Artificial Sequence
  Synthetic
gacattgtgcagttcgacgcaaaatcagaaactgtgcgtggactacccgacctgacgacagtgcagaatgaacat

SEQ ID NO: 264256 - DNA, 75 bp, Artificial Sequence
  Synthetic
cgagcgaaaccctggtcccccacagcaaccggaaagttcagttgctctgcctcctcggtgaagctgccctccacg

SEQ ID NO: 264257 - DNA, 75 bp, Artificial Sequence
  Synthetic
caaccggaaagttcagttgctctgcctcctcggtgaagctgccctccacggtgagaaattttatcgccgggtgag

SEQ ID NO: 264258 - DNA, 75 bp, Artificial Sequence
  Synthetic
atattagagatgtgggatggtgaattctaccattactccatctacgtcagtggaggcaaagctctgggggtgcac

SEQ ID NO: 264259 - DNA, 75 bp, Artificial Sequence
  Synthetic
tctaccattactccatctacgtcagtggaggcaaagctctgggggtgcacaaacccccagcggctataagcctcg

SEQ ID NO: 264260 - DNA, 75 bp, Artificial Sequence
  Synthetic
cgggcataacagaggcgtttggagtccccatcaaacaagtccaagtccacaaatcaggtgagttttgccggttca

SEQ ID NO: 264261 - DNA, 75 bp, Artificial Sequence
  Synthetic
gatgagatttcatgatttgtcattgtgggaaggtagtcgcgacacccttcccgattttgtaaatgaagatgactg

SEQ ID NO: 264262 - DNA, 75 bp, Artificial Sequence
  Synthetic
tgggaaggtagtcgcgacacccttcccgattttgtaaatgaagatgactgacagagacattactgattccgctcc

SEQ ID NO: 264263 - DNA, 75 bp, Artificial Sequence
  Synthetic
cactgaagggtcttgctggtgaaaagtttccctacacggcctttagtaacaactgctacaatttctgttgttggg

SEQ ID NO: 264264 - DNA, 75 bp, Artificial Sequence
  Synthetic
gtttccctacacggcctttagtaacaactgctacaatttctgttgttgggtgcttgaacttaacgacacgtggct

SEQ ID NO: 264265 - DNA, 75 bp, Artificial Sequence
  Synthetic
cgcccccactgctgggcaggtcaacccaattgacccatggatttttgccaattttgtgcaggccccccagggaga

SEQ ID NO: 264266 - DNA, 75 bp, Artificial Sequence
  Synthetic
ccaattgacccatggatttttgccaattttgtgcaggccccccagggagagtttaccatatccccaaacaacaac

SEQ ID NO: 264267 - DNA, 75 bp, Artificial Sequence
  Synthetic
cattgatgatggaaaaatcaagaaggtggccaatgcaattctctgcgcacttggctcattgttctcaaagccaat

SEQ ID NO: 264268 - DNA, 75 bp, Artificial Sequence
  Synthetic
gtggccaatgcaattctctgcgcacttggctcattgttctcaaagccaatcaaagacctactgggcaaactcaag

SEQ ID NO: 264269 - DNA, 75 bp, Artificial Sequence
  Synthetic
caactcctggtgactgtggctgcccgtacatctacaaaaggggcaatgactatgtagtcattggagtgcacacag

SEQ ID NO: 264270 - DNA, 75 bp, Artificial Sequence
  Synthetic
gcttgcctgagcttatcactgtcaggcagccggatgaagtcaacacggcgttcagtgttcccccactcaaccaaa

SEQ ID NO: 264271 - DNA, 75 bp, Artificial Sequence
  Synthetic
aatggatggaccggatccatgcgcgtgcgagtcctcctggcggggaacgccttttcagcaggcaaggtggtggtg

SEQ ID NO: 264272 - DNA, 75 bp, Artificial Sequence
  Synthetic
gcagccggatgaagtcaacacggcgttcagtgttcccccactcaaccaaagggagaatagggacgcccaggaacc

SEQ ID NO: 264273 - DNA, 75 bp, Artificial Sequence
  Synthetic
gcggaactcttcaatgtattctggaccccacctgatgtttccaatttcatagcctccttgataggtgattttcag

SEQ ID NO: 264274 - DNA, 75 bp, Artificial Sequence
  Synthetic
acgctaagagtatggacctgggtacaactcctggcgattgtggttgtccctacatctacaagagggggaacgact

SEQ ID NO: 264275 - DNA, 75 bp, Artificial Sequence
  Synthetic
ccccacctgatgtttccaatttcatagcctccttgataggtgattttcagttacaaggacccgaggacttggctg

SEQ ID NO: 264276 - DNA, 75 bp, Artificial Sequence
  Synthetic
tgcgagtcctcctggcggggaacgccttttcagcaggcaaggtggtggtgttttgtgttccccctgggtttgaca

SEQ ID NO: 264277 - DNA, 75 bp, Artificial Sequence
  Synthetic
agatgcctcttgaagatgttcgcaacatccttttccatcaggggcccgattcgcgcatgaggctcatggggatgc

SEQ ID NO: 264278 - DNA, 75 bp, Artificial Sequence
  Synthetic
catccttttccatcaggggcccgattcgcgcatgaggctcatggggatgctgtacacccccctgcgcgccaattc

SEQ ID NO: 264279 - DNA, 75 bp, Artificial Sequence
  Synthetic
acccatcctgggtcctggaggagcaccaaaattgagcaccaaaaccaaattttggagatcatcaaacacgcccct

SEQ ID NO: 264280 - DNA, 75 bp, Artificial Sequence
  Synthetic
tgtcatctgctgcgtcaaccctaagggcatgcaaagatctggggaactacgccctagacatactaaaactagtca

SEQ ID NO: 264281 - DNA, 75 bp, Artificial Sequence
  Synthetic
agtcatgagagatcagttgaagcccttcactgagcccaggggtaaacctccaaaacctaatgtgctggaggcagc

SEQ ID NO: 264282 - DNA, 75 bp, Artificial Sequence
  Synthetic
ggcatgcaaagatctggggaactacgccctagacatactaaaactagtcatgaagtggttctttccaaagaaaga

SEQ ID NO: 264283 - DNA, 75 bp, Artificial Sequence
  Synthetic
aactcctggcgattgtggttgtccctacatctacaagagggggaacgactacgtggtcattggggttcacactgc

SEQ ID NO: 264284 - DNA, 75 bp, Artificial Sequence
  Synthetic
ttctgttgttgggtcctggacctaaatgactcgtggttgagtaggagaatgattcagaggacaactggtttcttt

SEQ ID NO: 264285 - DNA, 75 bp, Artificial Sequence
  Synthetic
cccccccaccgttgaggaaagggagcccccttttactttgccaaatctgcctgttaataatctttcacattcccg

SEQ ID NO: 264286 - DNA, 75 bp, Artificial Sequence
  Synthetic
cccccttttactttgccaaatctgcctgttaataatctttcacattcccgggttgtggaacagatagcccagatg

SEQ ID NO: 264287 - DNA, 75 bp, Artificial Sequence
  Synthetic
cccccttttactttgccaaatctgcctgttaataatctttcacattcccgggttgtggaactgatagcccagatg

SEQ ID NO: 264288 - DNA, 75 bp, Artificial Sequence
  Synthetic
cccccttttactttgccaaatctgcctgttaataatctttcacattcccgggttgtggaaccgatagcccagatg

SEQ ID NO: 264289 - DNA, 75 bp, Artificial Sequence
  Synthetic
cccccttttactttgccaaatctgcctgttaataatctttcacattcccgggttgtggaacggatagcccagatg

SEQ ID NO: 264290 - DNA, 75 bp, Artificial Sequence
  Synthetic
cctcacgacactccttaaggacaaggacagccttactgcatttatgaaaaccctagacctagaggaggagaaagc

SEQ ID NO: 264291 - DNA, 75 bp, Artificial Sequence
  Synthetic
aggccctaccaagactggaataggaaaccccttcctaccatggatgattccaagttgaagaaggtagctaacgtg

SEQ ID NO: 264292 - DNA, 75 bp, Artificial Sequence
  Synthetic
gacagccttactgcatttatgaaaaccctagacctagaggaggagaaagcaagaaagctatcgacgaagtcatcc

SEQ ID NO: 264293 - DNA, 75 bp, Artificial Sequence
  Synthetic
gggcacccccatcacgtccgaaagaatgaattctggaacggtgagacctttgttggtaagttggcagaccaagca

SEQ ID NO: 264294 - DNA, 75 bp, Artificial Sequence
  Synthetic
acgaccccatcatccccttccgatttgggcgcttttgtgggcctgattgccgagcctgggtctcgggttgtcgag

SEQ ID NO: 264295 - DNA, 75 bp, Artificial Sequence
  Synthetic
atggacatacgcacaggcgtgtgcatcactagacaagaccacttccagcggccacccttaccacatgcggaagaa

SEQ ID NO: 264296 - DNA, 75 bp, Artificial Sequence
  Synthetic
gtcaagactgacaaaatctatggaaagatcaagaagagattgctttggggctctgacttgtccaccatgatccga

SEQ ID NO: 264297 - DNA, 75 bp, Artificial Sequence
  Synthetic
aaggaagagatgtttagcagaattagaccagtagttgtcatgatctcaggtagacctggcattggtaaaacccat

SEQ ID NO: 264298 - DNA, 75 bp, Artificial Sequence
  Synthetic
ggagttttctggacacccccagatgtgtctgcgatgatcgcccccttactgggtgactacgagctgcaggggccc

SEQ ID NO: 264299 - DNA, 75 bp, Artificial Sequence
  Synthetic
cttaacatcttggcctcatgtgattggacttttgcaggcatagtggaatccttgatactcttggcagagctcttt

SEQ ID NO: 264300 - DNA, 75 bp, Artificial Sequence
  Synthetic
tgtgccagggcctttggtggactcatggatgagatgaaggcacactgcatatcactcccagtccgagttggtatg

SEQ ID NO: 264301 - DNA, 75 bp, Artificial Sequence
  Synthetic
gcgcgacgaccgttggagagcgcactgtgaatacccgcaacccccaaaattttactcctgctcttgggcacatca

SEQ ID NO: 264302 - DNA, 75 bp, Artificial Sequence
  Synthetic
gaccagtagttgtcatgatctcaggtagacctggcattggtaaaacccatatggcaaggcatctggctaagagta

SEQ ID NO: 264303 - DNA, 75 bp, Artificial Sequence
  Synthetic
tgggcgcttttgtgggcctgattgccgagcctgggtctcgggttgtcgagttgtctcagcccaaccaggaggact

SEQ ID NO: 264304 - DNA, 75 bp, Artificial Sequence
  Synthetic
ggggggagagagtggtcctgtgggacgactatggtatggggaaccctgtcaaagatgccttgacactgcaagaac

SEQ ID NO: 264305 - DNA, 75 bp, Artificial Sequence
  Synthetic
cgactatggtatggggaaccctgtcaaagatgccttgacactgcaagaactggccgacacctgtccagtcacttt

SEQ ID NO: 264306 - DNA, 75 bp, Artificial Sequence
  Synthetic
tgtgaatacccgcaacccccaaaattttactcctgctcttgggcacatcacctttgatgaggaggcccctgccga

SEQ ID NO: 264307 - DNA, 75 bp, Artificial Sequence
  Synthetic
tgaagtgctcggttctgagtttgcaccctctgtttctgccccaggtgttggtgaaacccttcttttcttcatgtg

SEQ ID NO: 264308 - DNA, 75 bp, Artificial Sequence
  Synthetic
tcccaaagaaagaggaagcaaatgagctggctatggtgagatccatcgaggacgcggtgctggacctcgaggcaa

SEQ ID NO: 264309 - DNA, 75 bp, Artificial Sequence
  Synthetic
ccctctgtttctgccccaggtgttggtgaaacccttcttttcttcatgtgcaatgttcctcgtttaaatggcgcc

SEQ ID NO: 264310 - DNA, 75 bp, Artificial Sequence
  Synthetic
ccctgcacccctcgattatgtgaacttcgaggcttgctccaggaggattgatttccttgtctatgcagagtcacc

SEQ ID NO: 264311 - DNA, 75 bp, Artificial Sequence
  Synthetic
ttcgaggcttgctccaggaggattgatttccttgtctatgcagagtcaccagaaatagaaaaggtcaagagagac

SEQ ID NO: 264312 - DNA, 75 bp, Artificial Sequence
  Synthetic
agcgacgtggcgctcttgaattatgttaatcccaataccggccgggtcctgtttgagtgcaagctatacgccaat

SEQ ID NO: 264313 - DNA, 75 bp, Artificial Sequence
  Synthetic
aaccaagtctgcttcacctgatatcgtgggtacaatcaacgctcttctggcgagaatcgccgctgcgcgttccct

SEQ ID NO: 264314 - DNA, 75 bp, Artificial Sequence
  Synthetic
ttaatcccaataccggccgggtcctgtttgagtgcaagctatacgccaatggttttctcaccgttaatcttggcg

SEQ ID NO: 264315 - DNA, 75 bp, Artificial Sequence
  Synthetic
cagggcgggtttgataagaatggcaacaccccacatggtaaaggcaccatgcgttctctgacccaggggtctctg

SEQ ID NO: 264316 - DNA, 75 bp, Artificial Sequence
  Synthetic
tagaccctgaaaagttaaccaccaaattgagggagtatggtctgaaaccaacccgcccagacaaaaccgagggac

SEQ ID NO: 264317 - DNA, 75 bp, Artificial Sequence
  Synthetic
acaccccacatggtaaaggcaccatgcgttctctgacccaggggtctctgactgcaagagtggcgggtcttgttc

SEQ ID NO: 264318 - DNA, 75 bp, Artificial Sequence
  Synthetic
cactgtctgaggttacagacctgtctcctgacatcatccaggcaaattccctgttctccttttatggtgatgatg

SEQ ID NO: 264319 - DNA, 75 bp, Artificial Sequence
  Synthetic
ggcctgtgggaaatgctagtgttggccgccgccttcctcgccttgatggcttctgagtttttctcctctcttctc

SEQ ID NO: 264320 - DNA, 75 bp, Artificial Sequence
  Synthetic
tcacaggggaccagcgtgtgggtctcatccctcgcaatggcgttgaccattgggacgcatacaagggagaaagag

SEQ ID NO: 264321 - DNA, 75 bp, Artificial Sequence
  Synthetic
ccgccgccttcctcgccttgatggcttctgagtttttctcctctcttctcggcggggttgcttccgccgccattt

SEQ ID NO: 264322 - DNA, 75 bp, Artificial Sequence
  Synthetic
cgtttaggaaactggccgcagacaacaagtatggaatcatggagacaatgagagtgggtgcggcactcaagaatg

SEQ ID NO: 264323 - DNA, 75 bp, Artificial Sequence
  Synthetic
actgaggcagatgtattggaccagaggaccaaaccatgaagaccccaatgaaacaatgataccccactctcaaag

SEQ ID NO: 264324 - DNA, 75 bp, Artificial Sequence
  Synthetic
caagtatggaatcatggagacaatgagagtgggtgcggcactcaagaatgtcaagactttggaagacctcagagt

SEQ ID NO: 264325 - DNA, 75 bp, Artificial Sequence
  Synthetic
attgagggagtatggtctgaaaccaacccgcccagacaaaaccgagggacctctgattatcagtgaggatttgaa

SEQ ID NO: 264326 - DNA, 75 bp, Artificial Sequence
  Synthetic
atgattccgccatgctacagcagcaggttcaggccactcaactggcccgctcccaatggtttgattttcagaggg

SEQ ID NO: 264327 - DNA, 75 bp, Artificial Sequence
  Synthetic
ggtgaggcctctcttcacggaccctctttctacagcaagattagtaaattggtcataaccgaactcaaagaaggt

SEQ ID NO: 264328 - DNA, 75 bp, Artificial Sequence
  Synthetic
ggttcaggccactcaactggcccgctcccaatggtttgattttcagagggcggccctgcagggagctggtttttc

SEQ ID NO: 264329 - DNA, 75 bp, Artificial Sequence
  Synthetic
caaaggcacagtctctgttaacaaagtcgaggacctcacttcccaaaccgcaaacgaggtgagttcagccctcct

SEQ ID NO: 264330 - DNA, 75 bp, Artificial Sequence
  Synthetic
gtcgaggacctcacttcccaaaccgcaaacgaggtgagttcagccctcctcaggctcagacaagccagggccaga

SEQ ID NO: 264331 - DNA, 75 bp, Artificial Sequence
  Synthetic
cgccccacaggcccgggtgaccacttctttttctggcggttttctccccagcatgccccgaaccggggtgcagag

SEQ ID NO: 264332 - DNA, 75 bp, Artificial Sequence
  Synthetic
ggcaaaacgtgacttcccaggtcaacctgatatgtggaagaacgcttttagtcctgacttctcacacataaaact

SEQ ID NO: 264333 - DNA, 75 bp, Artificial Sequence
  Synthetic
caccgagcgaaggaggagctttccagcagaccaagacctgtggtcttgatgatatcaggcagaccaggaataggg

SEQ ID NO: 264334 - DNA, 75 bp, Artificial Sequence
  Synthetic
atctccaagaggttctgctgggaaagatgggtaaaaccgaccgagacccaggagacgagtgagcccgagaaggaa

SEQ ID NO: 264335 - DNA, 75 bp, Artificial Sequence
  Synthetic
gatgggtaaaaccgaccgagacccaggagacgagtgagcccgagaaggaaactgcccagagtgaatgggagattg

SEQ ID NO: 264336 - DNA, 75 bp, Artificial Sequence
  Synthetic
ttctcagatttgagcacgtgggagggcgatcgcaatctggctcccagttttgtgaatgaagatggcgtcgaatga

SEQ ID NO: 264337 - DNA, 75 bp, Artificial Sequence
  Synthetic
gcgatcgcaatctggctcccagttttgtgaatgaagatggcgtcgaatgacgccgctccatctaatgatggtgcc

SEQ ID NO: 264338 - DNA, 75 bp, Artificial Sequence
  Synthetic
tcagggctactccatgagaggttggatgagtacgagctgcagggcccaacccccaccaccttcaacttcgaccgc

SEQ ID NO: 264339 - DNA, 75 bp, Artificial Sequence
  Synthetic
gatccctggattagaacaaattttgtacaagcacccaatggagagttcactgtctcacctagaaactcccctgga

SEQ ID NO: 264340 - DNA, 75 bp, Artificial Sequence
  Synthetic
cctggctgtcctctgttgagccctttcacccctctgcactacagacggtttgggttactcctcctgggtccacag

SEQ ID NO: 264341 - DNA, 75 bp, Artificial Sequence
  Synthetic
ccagtaaaggcctgagtgatgaagagtatgatgagtacaaaaggattagggaagaaagaaatggaaagtactcca

SEQ ID NO: 264342 - DNA, 75 bp, Artificial Sequence
  Synthetic
gctcttttaatcaaggatggtttaatacagatcggatgccattgttcgcaaaccttggcagacgtttttgaaata

SEQ ID NO: 264343 - DNA, 75 bp, Artificial Sequence
  Synthetic
gtatgatgagtacaaaaggattagggaagaaagaaatggaaagtactccattgaggaataccttcaagaccgtga

SEQ ID NO: 264344 - DNA, 75 bp, Artificial Sequence
  Synthetic
tcctcctagcagggaacgcgttcactgcagggaagatcctcttcgctgccgtaccaccaaatttcccagttgaat

SEQ ID NO: 264345 - DNA, 75 bp, Artificial Sequence
  Synthetic
cagagctcaaacaggcactcaagaatatctcaatcaagaggtgtcagatagtgtacagtggctgcacctacacgc

SEQ ID NO: 264346 - DNA, 75 bp, Artificial Sequence
  Synthetic
atgagtacgagctgcagggcccaacccccaccaccttcaacttcgaccgcaacaaggtgcttgcttttagacagc

SEQ ID NO: 264347 - DNA, 75 bp, Artificial Sequence
  Synthetic
gtgtacagtggctgcacctacacgcttgaatctgatggcaagggtgacgtgaaagttgatagagttcagagcgcc

SEQ ID NO: 264348 - DNA, 75 bp, Artificial Sequence
  Synthetic
gcaaagaatcttccgcccaacaaggaagcaaagaaaagaggaaaggggtgtgcttggtctagtcactggcacgga

SEQ ID NO: 264349 - DNA, 75 bp, Artificial Sequence
  Synthetic
aagcaaagaaaagaggaaaggggtgtgcttggtctagtcactggcacggatatcaggaagagaagaccagatgac

SEQ ID NO: 264350 - DNA, 75 bp, Artificial Sequence
  Synthetic
atgcaggtggatttgaagtgcaggtggtcctagctggaaatgcgtttacagcaggaaagataatctttgcagcta

SEQ ID NO: 264351 - DNA, 75 bp, Artificial Sequence
  Synthetic
ctttcattacaacaatcaacccgccaaccgcatgcgattggtggctatgttgtatacccctttgagatctaatgg

SEQ ID NO: 264352 - DNA, 75 bp, Artificial Sequence
  Synthetic
tgcagggaagatcctcttcgctgccgtaccaccaaatttcccagttgaattcttgagtcctgcacagattactat

SEQ ID NO: 264353 - DNA, 75 bp, Artificial Sequence
  Synthetic
aaccgcatgcgattggtggctatgttgtatacccctttgagatctaatggttctggtgatgatgtcttcactgtt

SEQ ID NO: 264354 - DNA, 75 bp, Artificial Sequence
  Synthetic
cccccaagcgtgtggtcaaggatagtcccactgggcaccggctggggcttctgggtctcatccaacctcctaatt

SEQ ID NO: 264355 - DNA, 75 bp, Artificial Sequence
  Synthetic
tcccactgggcaccggctggggcttctgggtctcatccaacctcctaattacaacaacacatgtcctgcctaagg

SEQ ID NO: 264356 - DNA, 75 bp, Artificial Sequence
  Synthetic
actaaacccttttctctgcctatattaacaatttctgaattaaccaattcaagatttcctgcacccatagattca

SEQ ID NO: 264357 - DNA, 75 bp, Artificial Sequence
  Synthetic
taacaatttctgaattaaccaattcaagatttcctgcacccatagattcattgtttacagcccagaataacaatc

SEQ ID NO: 264358 - DNA, 75 bp, Artificial Sequence
  Synthetic
tcccaaaaccaatcagaccagacgtctcagggcttgtattggaagaaggtgcaccagagggcactgtctgctcca

SEQ ID NO: 264359 - DNA, 75 bp, Artificial Sequence
  Synthetic
ctcagggcttgtattggaagaaggtgcaccagagggcactgtctgctccatactcgtgaagagaccaacaggtga

SEQ ID NO: 264360 - DNA, 75 bp, Artificial Sequence
  Synthetic
gtatatgtgctttcaggggaagactaacagcagatgtagacggaagtcacgatgacagatggcacatgcagttga

SEQ ID NO: 264361 - DNA, 75 bp, Artificial Sequence
  Synthetic
aacagcagatgtagacggaagtcacgatgacagatggcacatgcagttgaccaacctcaatggaaccccctttga

SEQ ID NO: 264362 - DNA, 75 bp, Artificial Sequence
  Synthetic
aggttcccagtaccaattgattctctgcacaccagtcctactgagaacattgttgtccagtgccagaacggacgc

SEQ ID NO: 264363 - DNA, 75 bp, Artificial Sequence
  Synthetic
gggaatgctcctcactggggcgaacgcaaagaacatggacctcggcaccggcccgggagattgcggttgcccata

SEQ ID NO: 264364 - DNA, 75 bp, Artificial Sequence
  Synthetic
gcaaagaacatggacctcggcaccggcccgggagattgcggttgcccatacatttacaagcgcggcaatgacata

SEQ ID NO: 264365 - DNA, 75 bp, Artificial Sequence
  Synthetic
acaaggaaacaacgcaaggaggagagagcctctctcggcctggtcacaggctctgaaatcagaaaaagaaaccca

SEQ ID NO: 264366 - DNA, 75 bp, Artificial Sequence
  Synthetic
gaatgttggatccaacccaaacaccactagggcgcacgaggctgtgatctccacaaccagttcacagtttgtgcc

SEQ ID NO: 264367 - DNA, 75 bp, Artificial Sequence
  Synthetic
actagggcgcacgaggctgtgatctccacaaccagttcacagtttgtgccaaaattaggatcagtcaactttggt

SEQ ID NO: 264368 - DNA, 75 bp, Artificial Sequence
  Synthetic
aatttgaccagccctgccccacttgactatgttaattttgaggcttgctctagacgggtggacttcctggtctat

SEQ ID NO: 264369 - DNA, 75 bp, Artificial Sequence
  Synthetic
gaagcagttcttgaagggaatgagagccttggcacttactgtggtgccccaatcctaggtcctggcaaggcgccc

SEQ ID NO: 264370 - DNA, 75 bp, Artificial Sequence
  Synthetic
cttatgaccctgcagaagatataccaggccccctagggacaccagatttccggggcaaagtctttggcgtggcca

SEQ ID NO: 264371 - DNA, 75 bp, Artificial Sequence
  Synthetic
gccttggcacttactgtggtgccccaatcctaggtcctggcaaggcgcccaagctcagcacgaagaccaagttct

SEQ ID NO: 264372 - DNA, 75 bp, Artificial Sequence
  Synthetic
agcctttgacaacaattgctatgccttttgttgctgggtcctggatctaaatgactcgtggctgagtaggagaat

SEQ ID NO: 264373 - DNA, 75 bp, Artificial Sequence
  Synthetic
cggggcaaagtctttggcgtggccagccagagaaatcctgatgccacgactagggcacatgaagcaaagatagac

SEQ ID NO: 264374 - DNA, 75 bp, Artificial Sequence
  Synthetic
gaatttgatcagtgggccctacctagatactcaggtcatttgaccctcaatatgaaccttgccccacctattgcc

SEQ ID NO: 264375 - DNA, 75 bp, Artificial Sequence
  Synthetic
gatactcaggtcatttgaccctcaatatgaaccttgccccacctattgccccaaatttccctggtgagcagttgt

SEQ ID NO: 264376 - DNA, 75 bp, Artificial Sequence
  Synthetic
agaagggaccttccctgcagcaagtcatgagggatcagttgaaacctttcacggaacccaggggcaaaccaccaa

SEQ ID NO: 264377 - DNA, 75 bp, Artificial Sequence
  Synthetic
catgagggatcagttgaaacctttcacggaacccaggggcaaaccaccaagacccacagtcctggaagaagctaa

SEQ ID NO: 264378 - DNA, 75 bp, Artificial Sequence
  Synthetic
ggatagtcaactttggctcaggttggggcttttgggtctcccccagtctgttcataacatcaactcatgtcatac

SEQ ID NO: 264379 - DNA, 75 bp, Artificial Sequence
  Synthetic
ggatacagcacttctatcaggagtctgctccatcccagtctgatgtggctctgatcaggtatgtcaaccctgaca

SEQ ID NO: 264380 - DNA, 75 bp, Artificial Sequence
  Synthetic
tgctccatcccagtctgatgtggctctgatcaggtatgtcaaccctgacactggccgcacactcttcgaggcgaa

SEQ ID NO: 264381 - DNA, 75 bp, Artificial Sequence
  Synthetic
cttggataagaccacttccagtggcagcccccatcacatcaggaagaacgaccattggaacggagagtcttttac

SEQ ID NO: 264382 - DNA, 75 bp, Artificial Sequence
  Synthetic
caacttccccggtgagcagctccttttctttcgctcacagttgccatcttctggcggtcggtccaacgggattct

SEQ ID NO: 264383 - DNA, 75 bp, Artificial Sequence
  Synthetic
accattggaacggagagtcttttacaggccccctcgcagaccaagcatccaaagctaatctcatgtatgagcagg

SEQ ID NO: 264384 - DNA, 75 bp, Artificial Sequence
  Synthetic
tagatttgattcctgggtcaaccagttttactcactcgcccccatgggaacaggaaatgggcgcagacgggtgca

SEQ ID NO: 264385 - DNA, 75 bp, Artificial Sequence
  Synthetic
ttttactcactcgcccccatgggaacaggaaatgggcgcagacgggtgcagtaatggcaggagctttcatagcag

SEQ ID NO: 264386 - DNA, 75 bp, Artificial Sequence
  Synthetic
ggttaggtatgtcaaccctgacactggtagagtgttatttgaggccaagctgcacaaattaggtttcatgactat

SEQ ID NO: 264387 - DNA, 75 bp, Artificial Sequence
  Synthetic
tgtcatatgtgccacccaggggagtgagggagaagccacacttgaaggtggtgacagcaagggaacctactgtgg

SEQ ID NO: 264388 - DNA, 75 bp, Artificial Sequence
  Synthetic
gagggagaagccacacttgaaggtggtgacagcaagggaacctactgtggtgcaccaatcttaggtccaggcagt

SEQ ID NO: 264389 - DNA, 75 bp, Artificial Sequence
  Synthetic
ggaccttggcacaatggtcaggtgcgccagggcctttggtggtctcatggacagcatgaaagcaagttgcatagc

SEQ ID NO: 264390 - DNA, 75 bp, Artificial Sequence
  Synthetic
tggattttgagaacaacaaacagctccaagcagcctcttttcaacatgacaaagacatgcttcaagcacaggtgg

SEQ ID NO: 264391 - DNA, 75 bp, Artificial Sequence
  Synthetic
ccaagcagcctcttttcaacatgacaaagacatgcttcaagcacaggtggctgccacaaaacaattgcaggctga

SEQ ID NO: 264392 - DNA, 75 bp, Artificial Sequence
  Synthetic
ccactatgatgctgactactctaggtgggactcaactcaacaaagaagcatcttgtccgccgccatggaagtgat

SEQ ID NO: 264393 - DNA, 75 bp, Artificial Sequence
  Synthetic
tgggactcaactcaacaaagaagcatcttgtccgccgccatggaagtgatggtgcggttctctgcagaaccagaa

SEQ ID NO: 264394 - DNA, 75 bp, Artificial Sequence
  Synthetic
tgcacccatgaccaaggtcctcgattggtctggtactcgttactgggcgccaaactccacgaggacaactggtta

SEQ ID NO: 264395 - DNA, 75 bp, Artificial Sequence
  Synthetic
tggtctggtactcgttactgggcgccaaactccacgaggacaactggttactcagggcagttcacatcaacgccc

SEQ ID NO: 264396 - DNA, 75 bp, Artificial Sequence
  Synthetic
gaaggcctaccatcaggagtcccgtgcacgtcacaatggaattcaatagcccactggatcttgactttgagtgca

SEQ ID NO: 264397 - DNA, 75 bp, Artificial Sequence
  Synthetic
gcacgtcacaatggaattcaatagcccactggatcttgactttgagtgcaatggcagaagtgtcaggcctctcgc

SEQ ID NO: 264398 - DNA, 75 bp, Artificial Sequence
  Synthetic
gatgcagcccgcggggcaattaatgcccccatgacaaaagtcctagattggaatggaacgagatactgggcgcca

SEQ ID NO: 264399 - DNA, 75 bp, Artificial Sequence
  Synthetic
atctacagcctttcaacacaaagtactgttttgactaaaccttcttctggttcttccgtttcttctgcttcaacg

SEQ ID NO: 264400 - DNA, 75 bp, Artificial Sequence
  Synthetic
ctgttttgactaaaccttcttctggttcttccgtttcttctgcttcaacgcaatctacaaaattgagttcagttt

SEQ ID NO: 264401 - DNA, 75 bp, Artificial Sequence
  Synthetic
acccttcaaaactgacacagaaactcagggagtatggtctggtccccacccgacctgacaaaactgaaggccccc

SEQ ID NO: 264402 - DNA, 75 bp, Artificial Sequence
  Synthetic
cagggagtatggtctggtccccacccgacctgacaaaactgaaggccccctggtcataactgaggacctcaccgg

SEQ ID NO: 264403 - DNA, 75 bp, Artificial Sequence
  Synthetic
ccagcagtgggtcttcagtgaggtcaaattcaacccaaatcactagcctgagctcacactcgtccgggtcgtctc

SEQ ID NO: 264404 - DNA, 75 bp, Artificial Sequence
  Synthetic
tatctcatgtaacacctccatcaagtagggcttcgagttcgggaacagtctcgactgtacccaaggaagttttgg

SEQ ID NO: 264405 - DNA, 75 bp, Artificial Sequence
  Synthetic
acgcagacagccgctcttcgcacacctcagagtgaggggggagtcacgtgtttagtgaaaagaatcaattaattt

SEQ ID NO: 264406 - DNA, 75 bp, Artificial Sequence
  Synthetic
caggcagttgtattggacaagagggcccaaccatgagaacccatatgaaagcatggtcccccactcccaacgggc

SEQ ID NO: 264407 - DNA, 75 bp, Artificial Sequence
  Synthetic
cccaaccatgagaacccatatgaaagcatggtcccccactcccaacgggccacacaactcatggcccttcttggt

SEQ ID NO: 264408 - DNA, 75 bp, Artificial Sequence
  Synthetic
tgtgcactttctgaggtcacaaacctgtcccctgacattatccaggccaattccctcttttccttctatggtgat

SEQ ID NO: 264409 - DNA, 75 bp, Artificial Sequence
  Synthetic
gaggttatggcacttgaaccggtggtgggagcctcaattgcagctcctgtcgtcggtcaacaaaatataattgac

SEQ ID NO: 264410 - DNA, 75 bp, Artificial Sequence
  Synthetic
aaaactcaaggaatacgggctgaaaccaacccgccctgacaagactgaggggccccttgttatctctgaggacct

SEQ ID NO: 264411 - DNA, 75 bp, Artificial Sequence
  Synthetic
atgcttttaaatcttgaattaggcccagagctcaatccttacctgagtcatttatcccgcatgtataatggttat

SEQ ID NO: 264412 - DNA, 75 bp, Artificial Sequence
  Synthetic
cagagctcaatccttacctgagtcatttatcccgcatgtataatggttatgctggtggcatgcaggttcaggtgg

SEQ ID NO: 264413 - DNA, 75 bp, Artificial Sequence
  Synthetic
aggggccctaatcatgaagacccatctgaaacaatgataccacactcccaaagacccatacaattaatgtctttg

SEQ ID NO: 264414 - DNA, 75 bp, Artificial Sequence
  Synthetic
ctaaaccatttactgtcccagtcttaactgttgaagaaatgaccaattcaagattccccattcctttggaaaagt

SEQ ID NO: 264415 - DNA, 75 bp, Artificial Sequence
  Synthetic
ttagtgcagctcaaatcacaatgtgcccccatgtgattgttgatgtgagacaacttgagcctgtgcttttgcccc

SEQ ID NO: 264416 - DNA, 75 bp, Artificial Sequence
  Synthetic
cccccatgtgattgttgatgtgagacaacttgagcctgtgcttttgcccctccctgacataaggaatagattctt

SEQ ID NO: 264417 - DNA, 75 bp, Artificial Sequence
  Synthetic
tccaccttgagagcttgtaaagaccttggtgcatatgggctagagatcctaaagttggtcatgaagtggttcttc

SEQ ID NO: 264418 - DNA, 75 bp, Artificial Sequence
  Synthetic
cccagggcgcaaaggagttctttggagtccccatcaaacaaattcaggtacacaagtcaggcgaattctgtcgct

SEQ ID NO: 264419 - DNA, 75 bp, Artificial Sequence
  Synthetic
gttttgtgaatgaagatggcgtcgaatgacgccgctccatcaaatgatggtgcagctagtctcgtaccagagggc

SEQ ID NO: 264420 - DNA, 75 bp, Artificial Sequence
  Synthetic
tggctatagtgagatctatcgaggatgcagtcctggatctcgaggcaattgaaaacaaccatatgaccaccttgc

SEQ ID NO: 264421 - DNA, 75 bp, Artificial Sequence
  Synthetic
tgaggacgtgttcacagtgtcttgcagggtcttgacccgcccagcccctgactttgagttcacgttcttagtgcc

SEQ ID NO: 264422 - DNA, 75 bp, Artificial Sequence
  Synthetic
agggtcttgacccgcccagcccctgactttgagttcacgttcttagtgccaccaaccgtagaatcaaagactaag

SEQ ID NO: 264423 - DNA, 75 bp, Artificial Sequence
  Synthetic
attgacccctggataagaacaaattttgtacaagcccctaatggagagtttacagtgtcaccaagaaattcccct

SEQ ID NO: 264424 - DNA, 75 bp, Artificial Sequence
  Synthetic
ttgtacaagcccctaatggagagtttacagtgtcaccaagaaattcccctggagaaattttattaaatttagaat

SEQ ID NO: 264425 - DNA, 75 bp, Artificial Sequence
  Synthetic
gaggagaaagccaggaaactctcaaccaagtctgcctcacctgacatcgtgggcacaatcaacgcccttctggcg

SEQ ID NO: 264426 - DNA, 75 bp, Artificial Sequence
  Synthetic
ccaagtctgcctcacctgacatcgtgggcacaatcaacgcccttctggcgagaatcgctgctgcacgctctctgg

SEQ ID NO: 264427 - DNA, 75 bp, Artificial Sequence
  Synthetic
acagatcccaatgagacaattgtggtacaaccacaaaatggcagatgcaccctagatgggacactccaagggacc

SEQ ID NO: 264428 - DNA, 75 bp, Artificial Sequence
  Synthetic
tacaaccacaaaatggcagatgcaccctagatgggacactccaagggaccacccagctggtgcctacccaaattt

SEQ ID NO: 264429 - DNA, 75 bp, Artificial Sequence
  Synthetic
aagtgctccttgctgggaacgcgttcacagcaggtaagatattgtttgcagcaatcccacctaactttcctgtag

SEQ ID NO: 264430 - DNA, 75 bp, Artificial Sequence
  Synthetic
cacagcaggtaagatattgtttgcagcaatcccacctaactttcctgtagatatgattagcccagctcaaattac

SEQ ID NO: 264431 - DNA, 75 bp, Artificial Sequence
  Synthetic
accaccccctccacgttcagctgaagaacctcgacgggacaccatatgacccaacagatgaggtaccggcagtcc

SEQ ID NO: 264432 - DNA, 75 bp, Artificial Sequence
  Synthetic
gaacctcgacgggacaccatatgacccaacagatgaggtaccggcagtcctgggtgccatagatttcaaaggaac

SEQ ID NO: 264433 - DNA, 75 bp, Artificial Sequence
  Synthetic
gttctatcattttaataatcaacctcaacctagaatgagattagtggctatgctctacaccccattgaggtctaa

SEQ ID NO: 264434 - DNA, 75 bp, Artificial Sequence
  Synthetic
caacctagaatgagattagtggctatgctctacaccccattgaggtctaatggttcaggggatgatgtcttcact

SEQ ID NO: 264435 - DNA, 75 bp, Artificial Sequence
  Synthetic
aagaagggaaaaacatgaccccagtctacacaggtgcacttaaggatgaattagtcaaaactgacaaaatttatg

SEQ ID NO: 264436 - DNA, 75 bp, Artificial Sequence
  Synthetic
agacaccacaaaccctagatacaccccaaaacttggttctgtgttgatgtattctgagtctagtgattttgatga

SEQ ID NO: 264437 - DNA, 75 bp, Artificial Sequence
  Synthetic
ccaaaacttggttctgtgttgatgtattctgagtctagtgattttgatgatggacaaccaactcgctttaccccc

SEQ ID NO: 264438 - DNA, 75 bp, Artificial Sequence
  Synthetic
gagtcaggccgtggcggactcgcggtcaagaagctagaggaccgctatgcccaaagctctggttccttatttggt

SEQ ID NO: 264439 - DNA, 75 bp, Artificial Sequence
  Synthetic
aaaactaaaccattcacactaccaatattaaccatttctgaattgaccaactcccggttccctattccaatcgag

SEQ ID NO: 264440 - DNA, 75 bp, Artificial Sequence
  Synthetic
gcagaagcccctgaagtcgaaaaggcgaagcgtgacttcccaggccaacctgacatgtggaagaacgccttcagt

SEQ ID NO: 264441 - DNA, 75 bp, Artificial Sequence
  Synthetic
tattaaccatttctgaattgaccaactcccggttccctattccaatcgagcaattgtatacggctccaaatgaga

SEQ ID NO: 264442 - DNA, 75 bp, Artificial Sequence
  Synthetic
gctattgccgttgctgatgtcagcaataacaatgctaacaccaacaatgataacattggatcccgcctcatggcg

SEQ ID NO: 264443 - DNA, 75 bp, Artificial Sequence
  Synthetic
ctagcccccgcagttgcccctgctttccccggtgagcgcattctcttcttcaggtcagtggttccatctgctggt

SEQ ID NO: 264444 - DNA, 75 bp, Artificial Sequence
  Synthetic
tccccggtgagcgcattctcttcttcaggtcagtggttccatctgctggtggttacggatcaggtcaaatagact

SEQ ID NO: 264445 - DNA, 75 bp, Artificial Sequence
  Synthetic
ctgctacgccgatcacaaacaccttccccatcccggcaagagagcccccccaagagtcagagagaccgccccccc

SEQ ID NO: 264446 - DNA, 75 bp, Artificial Sequence
  Synthetic
gtgcagtttgctcttacaggggcaggactgtggccaataatggggataattgggaccaaaatttgctccagctga

SEQ ID NO: 264447 - DNA, 75 bp, Artificial Sequence
  Synthetic
gactgtggccaataatggggataattgggaccaaaatttgctccagctgacctatccaaatggtgcaagctatga

SEQ ID NO: 264448 - DNA, 75 bp, Artificial Sequence
  Synthetic
ccccatcccggcaagagagcccccccaagagtcagagagaccgccccccccggaccgcttctgaggtaaagaaag

SEQ ID NO: 264449 - DNA, 75 bp, Artificial Sequence
  Synthetic
gatatgttaaccctgacactgggagaaacatctttgaggcaaagctacatagagaagggttcatcactgtggcaa

SEQ ID NO: 264450 - DNA, 75 bp, Artificial Sequence
  Synthetic
aaacatctttgaggcaaagctacatagagaagggttcatcactgtggcaaattctggaaacaaccccatagttgt

SEQ ID NO: 264451 - DNA, 75 bp, Artificial Sequence
  Synthetic
aggaggagataatgcgtaataatgaaaagctcttcgacgctgggggaatcaccccatcaactttgcctagtacgt

SEQ ID NO: 264452 - DNA, 75 bp, Artificial Sequence
  Synthetic
caatgtgaatgtgagcacaggagaggccaaaaatgctaagggaatatacatatccaccactagtgggaaatttac

SEQ ID NO: 264453 - DNA, 75 bp, Artificial Sequence
  Synthetic
gccaaaaatgctaagggaatatacatatccaccactagtgggaaatttaccccaaaaattgggtcaattggattg

SEQ ID NO: 264454 - DNA, 75 bp, Artificial Sequence
  Synthetic
aaagctcttcgacgctgggggaatcaccccatcaactttgcctagtacgtttgagagggccgacccaattgacag

SEQ ID NO: 264455 - DNA, 75 bp, Artificial Sequence
  Synthetic
ggggcgtaggagagtccaataatggcaggagctttctttgctggattagcaggcgacgccataacaaatggtgtc

SEQ ID NO: 264456 - DNA, 75 bp, Artificial Sequence
  Synthetic
caggagctttctttgctggattagcaggcgacgccataacaaatggtgtcgggtccctgatcaacgctggggcca

SEQ ID NO: 264457 - DNA, 75 bp, Artificial Sequence
  Synthetic
ccgtggcccattttggaacttgtgtcccctcccgccactggatgcccggaataatggccccgctaaggaacccct

SEQ ID NO: 264458 - DNA, 75 bp, Artificial Sequence
  Synthetic
acccccttccagcaatgggttctaccacattatgcaggtagtctcgctctcaacaccaatttggcacctgctgtt

SEQ ID NO: 264459 - DNA, 75 bp, Artificial Sequence
  Synthetic
cacattatgcaggtagtctcgctctcaacaccaatttggcacctgctgttgccccgactttccctggtgagcaat

SEQ ID NO: 264460 - DNA, 75 bp, Artificial Sequence
  Synthetic
cccctcccgccactggatgcccggaataatggccccgctaaggaacccctcataggggacatgatagagttctat

SEQ ID NO: 264461 - DNA, 75 bp, Artificial Sequence
  Synthetic
tgctgcaatcacaagttctggccaccaaacagctccagcaggaaatgatgaacataaggcaaggggtcttgaccg

SEQ ID NO: 264462 - DNA, 75 bp, Artificial Sequence
  Synthetic
caaacagctccagcaggaaatgatgaacataaggcaaggggtcttgaccgctggcggcttttcccctacagatgc

SEQ ID NO: 264463 - DNA, 75 bp, Artificial Sequence
  Synthetic
ttctccataccaagaataaccatccaccctctagtagcctggtggcgcgtatgctacgttccaactaatcagcag

SEQ ID NO: 264464 - DNA, 75 bp, Artificial Sequence
  Synthetic
cccaagagtgggtgaatcatttttatcaagaggcagccccttcccaagcagacgtcgcccttattaggtatgtca

SEQ ID NO: 264465 - DNA, 75 bp, Artificial Sequence
  Synthetic
gaacatacaagacctatggtccaagccacaagtggaaaacacagaggagaccaccagcaaggacgggtgtccaaa

SEQ ID NO: 264466 - DNA, 75 bp, Artificial Sequence
  Synthetic
tcaagaggcagccccttcccaagcagacgtcgcccttattaggtatgtcaaccctgatactggtcgcacgctgtt

SEQ ID NO: 264467 - DNA, 75 bp, Artificial Sequence
  Synthetic
accctctagtagcctggtggcgcgtatgctacgttccaactaatcagcagcgcctcacttatgaccagctcaaag

SEQ ID NO: 264468 - DNA, 75 bp, Artificial Sequence
  Synthetic
catgaaaacaaccagttattcgggtcagttctccagcaatcctgtgcacaggcaacccactttgtcccgttctga

SEQ ID NO: 264469 - DNA, 75 bp, Artificial Sequence
  Synthetic
tggccgcggcaagaagcacacagccttttcaagcaaaggtctcagtgatgaagagtacgatgagtacaagaggat

SEQ ID NO: 264470 - DNA, 75 bp, Artificial Sequence
  Synthetic
ttgacgacacatggcttgagaggaggttagtcagcactggaaaattcaaccaccccacacaagattggtcacagg

SEQ ID NO: 264471 - DNA, 75 bp, Artificial Sequence
  Synthetic
tggtcattttaggtttgattcttgggttaatcaattttactcactcgcccccatgggaactggcaatgggcgtag

SEQ ID NO: 264472 - DNA, 75 bp, Artificial Sequence
  Synthetic
cagttctccagcaatcctgtgcacaggcaacccactttgtcccgttctgattccccaaaagttaaaattaatagt

SEQ ID NO: 264473 - DNA, 75 bp, Artificial Sequence
  Synthetic
gttaatcaattttactcactcgcccccatgggaactggcaatgggcgtagaaggatccagtaatggcaggagcat

SEQ ID NO: 264474 - DNA, 75 bp, Artificial Sequence
  Synthetic
gttagtcagcactggaaaattcaaccaccccacacaagattggtcacaggacaccccagattttcaccaagattc

SEQ ID NO: 264475 - DNA, 75 bp, Artificial Sequence
  Synthetic
tctggatcatccaggacaacctcctcttccacagcaacttctaccctatctaggaccagtgactgggtgagggga

SEQ ID NO: 264476 - DNA, 75 bp, Artificial Sequence
  Synthetic
cttccacagcaacttctaccctatctaggaccagtgactgggtgaggggacaaaatgagaggcttagcccgttca

SEQ ID NO: 264477 - DNA, 75 bp, Artificial Sequence
  Synthetic
gtcaaagatcaaaccattaaatgttctcaatctcttatcaaattgtgactggacttttatgggggttgtagaact

SEQ ID NO: 264478 - DNA, 75 bp, Artificial Sequence
  Synthetic
atcagaaattgaattttgattacaacaaacaactccaaaatgcatccttccagcatgataaggaaatgttgcagg

SEQ ID NO: 264479 - DNA, 75 bp, Artificial Sequence
  Synthetic
caaacaactccaaaatgcatccttccagcatgataaggaaatgttgcaggctcaaattgatgccacaaagaaact

SEQ ID NO: 264480 - DNA, 75 bp, Artificial Sequence
  Synthetic
ctgaaattaggaaaagaaacccagatgatttcaaacccaaggggaaactgtgggctgacgatgacagaagtgtgg

SEQ ID NO: 264481 - DNA, 75 bp, Artificial Sequence
  Synthetic
ctcaatctcttatcaaattgtgactggacttttatgggggttgtagaactgatcgtgctcctagcagagttgttt

SEQ ID NO: 264482 - DNA, 75 bp, Artificial Sequence
  Synthetic
ttcccaaagctgttttggactcctggactcctatgtttaacacccataggcagcctctcttcgctcacttgcgta

SEQ ID NO: 264483 - DNA, 75 bp, Artificial Sequence
  Synthetic
aatgcccacctcgggcatttttaccaacgtcaaggttggtattaaaaagatcctgggtgatcgcgattgcgatgc

SEQ ID NO: 264484 - DNA, 75 bp, Artificial Sequence
  Synthetic
gaagacctagctaaggacttggtccctctcattctaggtggcataggcttggctattggctttacaagggataaa

SEQ ID NO: 264485 - DNA, 75 bp, Artificial Sequence
  Synthetic
ggcagtcaatgccccaatgactagagtgctggattggtcagggacacgttactatgctccaaattctgtgcaaac

SEQ ID NO: 264486 - DNA, 75 bp, Artificial Sequence
  Synthetic
cagcctctcttcgctcacttgcgtaggcgaggggagtcacaaatttagtgaaaagattgattaggttttcttctc

SEQ ID NO: 264487 - DNA, 75 bp, Artificial Sequence
  Synthetic
gtgctggattggtcagggacacgttactatgctccaaattctgtgcaaactactagctattctggacaattcacc

SEQ ID NO: 264488 - DNA, 75 bp, Artificial Sequence
  Synthetic
cagggcgcaaaggagttctttggagtccccatcaaacaaattcaggtacacaagtcaggcgagttctgtcgcttg

SEQ ID NO: 264489 - DNA, 75 bp, Artificial Sequence
  Synthetic
ctctcattctaggtggcataggcttggctattggctttacaagggataaagtgacaagagtgatgaagagcgccg

SEQ ID NO: 264490 - DNA, 75 bp, Artificial Sequence
  Synthetic
ttggaggggaccaagcggaaaagaccttgcggggtatagaggatgcagtgatagatatggaggtgttgtccagca

SEQ ID NO: 264491 - DNA, 75 bp, Artificial Sequence
  Synthetic
cgtagtctgtcaactcaatcaacttctgtaacaggctctacctccctaggggggtcctctgcaacctcctctagc

SEQ ID NO: 264492 - DNA, 75 bp, Artificial Sequence
  Synthetic
ctgtaacaggctctacctccctaggggggtcctctgcaacctcctctagctctaggacagcagactgggtacagc

SEQ ID NO: 264493 - DNA, 75 bp, Artificial Sequence
  Synthetic
cttgcggggtatagaggatgcagtgatagatatggaggtgttgtccagcaccaatgtgacacaattggttaaaga

SEQ ID NO: 264494 - DNA, 75 bp, Artificial Sequence
  Synthetic
aatgaaccccaacaatgggtgctcccaagttattcaggtagaaatgtccataatgtacacctagcccctgctgta

SEQ ID NO: 264495 - DNA, 75 bp, Artificial Sequence
  Synthetic
ccagtgtgagctctgtctcaacagtgcccaaaggggttttggactcctggacacctgtgtttaacacacgcaggc

SEQ ID NO: 264496 - DNA, 75 bp, Artificial Sequence
  Synthetic
tgccgacccacacatagtgacctcagtcaacaatttgatatcacggatatccatggcgaggtcagccttagctaa

SEQ ID NO: 264497 - DNA, 75 bp, Artificial Sequence
  Synthetic
gcccccacttttccgggtgaacaacttcttttcttcaggtccactatgcccggatgcagcgggtatcccaacatg

SEQ ID NO: 264498 - DNA, 75 bp, Artificial Sequence
  Synthetic
agccgctgtttgcacacctcaggaagaggggggagtcacaggcttagtgaaaaggatgattaatgcttaagtatg

SEQ ID NO: 264499 - DNA, 75 bp, Artificial Sequence
  Synthetic
gtcaacaatttgatatcacggatatccatggcgaggtcagccttagctaaagcccaggctgagatgacatgtcgc

SEQ ID NO: 264500 - DNA, 75 bp, Artificial Sequence
  Synthetic
gaaacacacggccttctccagcaagggactcagtgatgaggagtatgatgagtataaaaggataagggaggaacg

SEQ ID NO: 264501 - DNA, 75 bp, Artificial Sequence
  Synthetic
cgattggcaaatgaaatcagaccgggaggtaaggttggacttgtaccccgggaatccatagaccactgggacgga

SEQ ID NO: 264502 - DNA, 75 bp, Artificial Sequence
  Synthetic
gaggtaaggttggacttgtaccccgggaatccatagaccactgggacggataccatggcgaggatgtcctactat

SEQ ID NO: 264503 - DNA, 75 bp, Artificial Sequence
  Synthetic
gtcaagggtggcccttcactgcagcaagtcatgagggaacagttgaagccattcacagagcccaggggcaagcca

SEQ ID NO: 264504 - DNA, 75 bp, Artificial Sequence
  Synthetic
cagttaattgtgacaggatagagaacaaaggcatgcaattttcttcagatgctataattataaccactaacgccc

SEQ ID NO: 264505 - DNA, 75 bp, Artificial Sequence
  Synthetic
caaaggcatgcaattttcttcagatgctataattataaccactaacgcccctggcccggccccagtggactttgt

SEQ ID NO: 264506 - DNA, 75 bp, Artificial Sequence
  Synthetic
tgagcaaacaattgatccacctgagaaatggtcattcgcacaagcttgcgcgtcccttgacaagaccacttccag

SEQ ID NO: 264507 - DNA, 75 bp, Artificial Sequence
  Synthetic
aacccaccctggtgatgccaatgccattaaggacctatataaaagggactattcgcacctaaaaatggaattagc

SEQ ID NO: 264508 - DNA, 75 bp, Artificial Sequence
  Synthetic
attaaggacctatataaaagggactattcgcacctaaaaatggaattagccccacaaggtggctttgatagccag

SEQ ID NO: 264509 - DNA, 75 bp, Artificial Sequence
  Synthetic
cagacccataaaagatataatagggaagataaggcctcttaacatcctcaacatcttagcctcatgtgattggac

SEQ ID NO: 264510 - DNA, 75 bp, Artificial Sequence
  Synthetic
gctatggagcggcaagatgagttccagctccaaggggctatctataacttcgatgaagacagggtgtccgccttt

SEQ ID NO: 264511 - DNA, 75 bp, Artificial Sequence
  Synthetic
agctccaaggggctatctataacttcgatgaagacagggtgtccgcctttacaagcctggcccgtgctaatggct

SEQ ID NO: 264512 - DNA, 75 bp, Artificial Sequence
  Synthetic
tggtaggctataaaattggagagtgtgatataatctggaataccagagtgtactcaattaaaagtgatggtagtg

SEQ ID NO: 264513 - DNA, 75 bp, Artificial Sequence
  Synthetic
tgatataatctggaataccagagtgtactcaattaaaagtgatggtagtgctgtcacaatcaaggagaaacagac

SEQ ID NO: 264514 - DNA, 75 bp, Artificial Sequence
  Synthetic
tcatggttaaattctccccagaaccacatttggctcaggtagtcgcggaagaccttctttctcctagcgtggtgg

SEQ ID NO: 264515 - DNA, 75 bp, Artificial Sequence
  Synthetic
gatgagatgaggctccgccagagaattttcaggcccaccaagaagcagaggagggaggagagagccactcttggc

SEQ ID NO: 264516 - DNA, 75 bp, Artificial Sequence
  Synthetic
tgcgtatgcctcctgcctacagagtgcagtactgtcaatactccaagtagctggctctgccctggtggtgagcag

SEQ ID NO: 264517 - DNA, 75 bp, Artificial Sequence
  Synthetic
gcagtactgtcaatactccaagtagctggctctgccctggtggtgagcagggccgtgaaacgcatgtttggcacg

SEQ ID NO: 264518 - DNA, 75 bp, Artificial Sequence
  Synthetic
catggtcctattgggcatgatggagtcattgaacgctatggcctttgtgagagtgaacaagaagaagaaggcgag

SEQ ID NO: 264519 - DNA, 75 bp, Artificial Sequence
  Synthetic
tcattgaacgctatggcctttgtgagagtgaacaagaagaagaaggcgagcaaacagtcgagttgcccactgcca

SEQ ID NO: 264520 - DNA, 75 bp, Artificial Sequence
  Synthetic
gtggcctcagtgatgaagagtatgaagaatacaaaaagatcagagaagaaaagagtggcaattacagcatccaag

SEQ ID NO: 264521 - DNA, 75 bp, Artificial Sequence
  Synthetic
gtggcctcagtgatgaagagtatgaagattacaaaaagatcagagaagaaaagagtggcaattacagcatccaag

SEQ ID NO: 264522 - DNA, 75 bp, Artificial Sequence
  Synthetic
gtggcctcagtgatgaagagtatgaagactacaaaaagatcagagaagaaaagagtggcaattacagcatccaag

SEQ ID NO: 264523 - DNA, 75 bp, Artificial Sequence
  Synthetic
gtggcctcagtgatgaagagtatgaagagtacaaaaagatcagagaagaaaagagtggcaattacagcatccaag

SEQ ID NO: 264524 - DNA, 75 bp, Artificial Sequence
  Synthetic
gtggcctcagtgatgaagagtatgatgaatacaaaaagatcagagaagaaaagagtggcaattacagcatccaag

SEQ ID NO: 264525 - DNA, 75 bp, Artificial Sequence
  Synthetic
gtggcctcagtgatgaagagtatgatgattacaaaaagatcagagaagaaaagagtggcaattacagcatccaag

SEQ ID NO: 264526 - DNA, 75 bp, Artificial Sequence
  Synthetic
gtggcctcagtgatgaagagtatgatgactacaaaaagatcagagaagaaaagagtggcaattacagcatccaag

SEQ ID NO: 264527 - DNA, 75 bp, Artificial Sequence
  Synthetic
gtggcctcagtgatgaagagtatgatgagtacaaaaagatcagagaagaaaagagtggcaattacagcatccaag

SEQ ID NO: 264528 - DNA, 75 bp, Artificial Sequence
  Synthetic
gtggcctcagtgatgaagagtatgacgaatacaaaaagatcagagaagaaaagagtggcaattacagcatccaag

SEQ ID NO: 264529 - DNA, 75 bp, Artificial Sequence
  Synthetic
gtggcctcagtgatgaagagtatgacgattacaaaaagatcagagaagaaaagagtggcaattacagcatccaag

SEQ ID NO: 264530 - DNA, 75 bp, Artificial Sequence
  Synthetic
gtggcctcagtgatgaagagtatgacgactacaaaaagatcagagaagaaaagagtggcaattacagcatccaag

SEQ ID NO: 264531 - DNA, 75 bp, Artificial Sequence
  Synthetic
gtggcctcagtgatgaagagtatgacgagtacaaaaagatcagagaagaaaagagtggcaattacagcatccaag

SEQ ID NO: 264532 - DNA, 75 bp, Artificial Sequence
  Synthetic
gtggcctcagtgatgaagagtatgaggaatacaaaaagatcagagaagaaaagagtggcaattacagcatccaag

SEQ ID NO: 264533 - DNA, 75 bp, Artificial Sequence
  Synthetic
gtggcctcagtgatgaagagtatgaggattacaaaaagatcagagaagaaaagagtggcaattacagcatccaag

SEQ ID NO: 264534 - DNA, 75 bp, Artificial Sequence
  Synthetic
gtggcctcagtgatgaagagtatgaggactacaaaaagatcagagaagaaaagagtggcaattacagcatccaag

SEQ ID NO: 264535 - DNA, 75 bp, Artificial Sequence
  Synthetic
gtggcctcagtgatgaagagtatgaggagtacaaaaagatcagagaagaaaagagtggcaattacagcatccaag

SEQ ID NO: 264536 - DNA, 75 bp, Artificial Sequence
  Synthetic
tcaaggatgtcagaaccatgccagaactcaaacaagcactcaagaatgtctcaatcaagaagtgccaaatagtgt

SEQ ID NO: 264537 - DNA, 75 bp, Artificial Sequence
  Synthetic
agaatacaaaaagatcagagaagaaaagagtggcaattacagcatccaagagtacctcgaggatcgccaacgcta

SEQ ID NO: 264538 - DNA, 75 bp, Artificial Sequence
  Synthetic
agattacaaaaagatcagagaagaaaagagtggcaattacagcatccaagagtacctcgaggatcgccaacgcta

SEQ ID NO: 264539 - DNA, 75 bp, Artificial Sequence
  Synthetic
agactacaaaaagatcagagaagaaaagagtggcaattacagcatccaagagtacctcgaggatcgccaacgcta

SEQ ID NO: 264540 - DNA, 75 bp, Artificial Sequence
  Synthetic
agagtacaaaaagatcagagaagaaaagagtggcaattacagcatccaagagtacctcgaggatcgccaacgcta

SEQ ID NO: 264541 - DNA, 75 bp, Artificial Sequence
  Synthetic
tgaatacaaaaagatcagagaagaaaagagtggcaattacagcatccaagagtacctcgaggatcgccaacgcta

SEQ ID NO: 264542 - DNA, 75 bp, Artificial Sequence
  Synthetic
tgattacaaaaagatcagagaagaaaagagtggcaattacagcatccaagagtacctcgaggatcgccaacgcta

SEQ ID NO: 264543 - DNA, 75 bp, Artificial Sequence
  Synthetic
tgactacaaaaagatcagagaagaaaagagtggcaattacagcatccaagagtacctcgaggatcgccaacgcta

SEQ ID NO: 264544 - DNA, 75 bp, Artificial Sequence
  Synthetic
tgagtacaaaaagatcagagaagaaaagagtggcaattacagcatccaagagtacctcgaggatcgccaacgcta

SEQ ID NO: 264545 - DNA, 75 bp, Artificial Sequence
  Synthetic
cgaatacaaaaagatcagagaagaaaagagtggcaattacagcatccaagagtacctcgaggatcgccaacgcta

SEQ ID NO: 264546 - DNA, 75 bp, Artificial Sequence
  Synthetic
cgattacaaaaagatcagagaagaaaagagtggcaattacagcatccaagagtacctcgaggatcgccaacgcta

SEQ ID NO: 264547 - DNA, 75 bp, Artificial Sequence
  Synthetic
cgactacaaaaagatcagagaagaaaagagtggcaattacagcatccaagagtacctcgaggatcgccaacgcta

SEQ ID NO: 264548 - DNA, 75 bp, Artificial Sequence
  Synthetic
cgagtacaaaaagatcagagaagaaaagagtggcaattacagcatccaagagtacctcgaggatcgccaacgcta

SEQ ID NO: 264549 - DNA, 75 bp, Artificial Sequence
  Synthetic
ggaatacaaaaagatcagagaagaaaagagtggcaattacagcatccaagagtacctcgaggatcgccaacgcta

SEQ ID NO: 264550 - DNA, 75 bp, Artificial Sequence
  Synthetic
ggattacaaaaagatcagagaagaaaagagtggcaattacagcatccaagagtacctcgaggatcgccaacgcta

SEQ ID NO: 264551 - DNA, 75 bp, Artificial Sequence
  Synthetic
ggactacaaaaagatcagagaagaaaagagtggcaattacagcatccaagagtacctcgaggatcgccaacgcta

SEQ ID NO: 264552 - DNA, 75 bp, Artificial Sequence
  Synthetic
ggagtacaaaaagatcagagaagaaaagagtggcaattacagcatccaagagtacctcgaggatcgccaacgcta

SEQ ID NO: 264553 - DNA, 75 bp, Artificial Sequence
  Synthetic
agaatcagatactatgtcaagtgtgtccaggaggccctgtattccatcattcaaattgctggggctgcatttgtc

SEQ ID NO: 264554 - DNA, 75 bp, Artificial Sequence
  Synthetic
ggttttctataaatcaaaatccggcatgagaaaacaacgccaagaagaacggcgccaactaggtctcgtcagcgg

SEQ ID NO: 264555 - DNA, 75 bp, Artificial Sequence
  Synthetic
atgagaaaacaacgccaagaagaacggcgccaactaggtctcgtcagcggttctgagatccgcaagcgtaagccc

SEQ ID NO: 264556 - DNA, 75 bp, Artificial Sequence
  Synthetic
gaagcccctccctcaatttggagcagggtggtgaagtttggtagtggttggggtttttgggtaagctcaacagtg

SEQ ID NO: 264557 - DNA, 75 bp, Artificial Sequence
  Synthetic
gggtggtgaagtttggtagtggttggggtttttgggtaagctcaacagtgttcatagccacaacccatgtcatac

SEQ ID NO: 264558 - DNA, 75 bp, Artificial Sequence
  Synthetic
acacaggtgcgcttaaggatgaattagtcaaaactgacaaaatttatggtaagatcaagaagaggcttctctggg

SEQ ID NO: 264559 - DNA, 75 bp, Artificial Sequence
  Synthetic
ccatcaattttgaggccccatcaagcatctggtcacgtgtcgtcccctttggcaccggctgggccttctgggtgt

SEQ ID NO: 264560 - DNA, 75 bp, Artificial Sequence
  Synthetic
tccgtttctccaaaaagatgagacctgacctcaccggtatggtcttagaagaaggctgcccagagggaacagtat

SEQ ID NO: 264561 - DNA, 75 bp, Artificial Sequence
  Synthetic
tgacctcaccggtatggtcttagaagaaggctgcccagagggaacagtatgcaccataatgatcaagagagactc

SEQ ID NO: 264562 - DNA, 75 bp, Artificial Sequence
  Synthetic
acaatcaggaatgttgctcaccggcgctaacgccaaaggcatggaccttggaactatacctggtgattgtggggc

SEQ ID NO: 264563 - DNA, 75 bp, Artificial Sequence
  Synthetic
gctaacgccaaaggcatggaccttggaactatacctggtgattgtggggcaccctatgttcacaagaggggaaac

SEQ ID NO: 264564 - DNA, 75 bp, Artificial Sequence
  Synthetic
ccccaccatcaaattgatagcaatgttgtacacaccacttagggctaataatgctggggacgatgtcttcacagt

SEQ ID NO: 264565 - DNA, 75 bp, Artificial Sequence
  Synthetic
gatggtgaagccacactagagggcggcggtcaaaacaagggccattatgcagggcatccgatactaaggtatggg

SEQ ID NO: 264566 - DNA, 75 bp, Artificial Sequence
  Synthetic
gcggtcaaaacaagggccattatgcagggcatccgatactaaggtatgggaatggcccctcgctatcaaccaaaa

SEQ ID NO: 264567 - DNA, 75 bp, Artificial Sequence
  Synthetic
ccagagttgaggggggcccatccttgcaacaagtgttaagggaccagttaaaaccatttgccgagccccgtggca

SEQ ID NO: 264568 - DNA, 75 bp, Artificial Sequence
  Synthetic
gcaacaagtgttaagggaccagttaaaaccatttgccgagccccgtggcaggttgcccgaagcgggcctgctgga

SEQ ID NO: 264569 - DNA, 75 bp, Artificial Sequence
  Synthetic
ttgcatgtccctagataaaacaaccagttctggccacccccatcataagaagaaaaatgatgactggaatgggaa

SEQ ID NO: 264570 - DNA, 75 bp, Artificial Sequence
  Synthetic
agttctggccacccccatcataagaagaaaaatgatgactggaatgggaactcatttgtgagggaattgggcgac

SEQ ID NO: 264571 - DNA, 75 bp, Artificial Sequence
  Synthetic
gttttgccgcctgagattcccccgacctatgaggactgatgtcaatggcctgatcttggaggagggcgcccccga

SEQ ID NO: 264572 - DNA, 75 bp, Artificial Sequence
  Synthetic
gagctagtcaagccagacaaggtgtacacaaaaatcaaaaagagactgctctggggcgcagaccttggcaccgtc

SEQ ID NO: 264573 - DNA, 75 bp, Artificial Sequence
  Synthetic
acacaaaaatcaaaaagagactgctctggggcgcagaccttggcaccgtcattcgcgctgccagagcatttgggc

SEQ ID NO: 264574 - DNA, 75 bp, Artificial Sequence
  Synthetic
ctttgatttatgcagagcactccaaatataagtttcattatgacgctgactatacagcttgggactcaacacaaa

SEQ ID NO: 264575 - DNA, 75 bp, Artificial Sequence
  Synthetic
cagccccagcacaatctgatgtggctctgctaagatttgtgaatccagacacaggtagggttctgtttgagtgta

SEQ ID NO: 264576 - DNA, 75 bp, Artificial Sequence
  Synthetic
atataagtttcattatgacgctgactatacagcttgggactcaacacaaaacagggaggtcatgatggaatcctt

SEQ ID NO: 264577 - DNA, 75 bp, Artificial Sequence
  Synthetic
aatggacgttggcgactacgtgatcagtgtcaaagatggtctgccatctggctttccatgcacttcacaggtgaa

SEQ ID NO: 264578 - DNA, 75 bp, Artificial Sequence
  Synthetic
agtgtcaaagatggtctgccatctggctttccatgcacttcacaggtgaatagcattaaccactggatcctaacc

SEQ ID NO: 264579 - DNA, 75 bp, Artificial Sequence
  Synthetic
gatgatgaaatagtctcaacagatatagaatttgacccaataaggttgacacaaatactaaaggagtatggtctg

SEQ ID NO: 264580 - DNA, 75 bp, Artificial Sequence
  Synthetic
tagaatttgacccaataaggttgacacaaatactaaaggagtatggtctgaagcctacaagacctgacaaaactg

SEQ ID NO: 264581 - DNA, 75 bp, Artificial Sequence
  Synthetic
gataccaggggcgactcgaccgcaattctattgaaagacagctttggtggactcgcggaccaaaccacgaggacc

SEQ ID NO: 264582 - DNA, 75 bp, Artificial Sequence
  Synthetic
gctttggactggagcgggacaaggtactgggctcccgatgctaggactacaacatacaatgcaggccgcttttcc

SEQ ID NO: 264583 - DNA, 75 bp, Artificial Sequence
  Synthetic
actgggctcccgatgctaggactacaacatacaatgcaggccgcttttccacccctcaaccctcgggggcactgc

SEQ ID NO: 264584 - DNA, 75 bp, Artificial Sequence
  Synthetic
ctattgggtgaagcagcactccatggtgaaaagttctacaggaagatagctggtagggtcattcaagaagtcaag

SEQ ID NO: 264585 - DNA, 75 bp, Artificial Sequence
  Synthetic
cttctgtgcactcaaatcaaactgcttcaacgagacttggttccacagctggttctggtaccagtgtctcgagcc

SEQ ID NO: 264586 - DNA, 75 bp, Artificial Sequence
  Synthetic
tggactggcgctttcaacacgcgcaggcagcctctcttcgctcacattcgtaagcgaggggagtcacgggtgtaa

SEQ ID NO: 264587 - DNA, 75 bp, Artificial Sequence
  Synthetic
ggccaagttaatatgattgacccctggataatgaataattatgtgcaagcccctcaaggtgaattcaccatatcg

SEQ ID NO: 264588 - DNA, 75 bp, Artificial Sequence
  Synthetic
ggataatgaataattatgtgcaagcccctcaaggtgaattcaccatatcgcctaacaacacaccaggtgatattt

SEQ ID NO: 264589 - DNA, 75 bp, Artificial Sequence
  Synthetic
gtgaatgatgatggcgtcgaaagacgtcgttgcgactaatgttgcaagcaacaacaatgctaacaacactagtgc

SEQ ID NO: 264590 - DNA, 75 bp, Artificial Sequence
  Synthetic
cccctaaccccataaagatcaaaagcacagaaatggccttgggtttgattggcaagacaacccaagaggcagcag

SEQ ID NO: 264591 - DNA, 75 bp, Artificial Sequence
  Synthetic
cacagaaatggccttgggtttgattggcaagacaacccaagaggcagcaggggccggtgacctgccacctaaaca

SEQ ID NO: 264592 - DNA, 75 bp, Artificial Sequence
  Synthetic
gcaatatgaaagtgaaggttttattggctggtaatgccttcacggctggtaaaataatcattagctgtatacccc

SEQ ID NO: 264593 - DNA, 75 bp, Artificial Sequence
  Synthetic
ggctggtaatgccttcacggctggtaaaataatcattagctgtataccccctggctttgttgcacaaaatgtttc

SEQ ID NO: 264594 - DNA, 75 bp, Artificial Sequence
  Synthetic
gaccttctttctcctagcgtggtggacgtgggcgacttcacaatatcaatcaatgagggtcttccctctggggtg

SEQ ID NO: 264595 - DNA, 75 bp, Artificial Sequence
  Synthetic
agatgtgaggaatgtgctgttccacaacaatgacaacacaccaaccatgaggttggtgtgcatgctctacacccc

SEQ ID NO: 264596 - DNA, 75 bp, Artificial Sequence
  Synthetic
tggacagccacaaagaatggtttgatgctggcggtttgggcccgtgcacaatgccctcaacttgtgaacaggcta

SEQ ID NO: 264597 - DNA, 75 bp, Artificial Sequence
  Synthetic
aacaatgacaacacaccaaccatgaggttggtgtgcatgctctacacccccttgcgagctagtggcagctcgtct

SEQ ID NO: 264598 - DNA, 75 bp, Artificial Sequence
  Synthetic
caacggtgagtggccccgagtggaatctctgtcctctaccccccactgacctaaggaatatggaaccagctagtg

SEQ ID NO: 264599 - DNA, 75 bp, Artificial Sequence
  Synthetic
ccccccaatgtagaacaaaagactaaaccttttagtgtcccaaatcttccattgaatactctttcaaattcgaga

SEQ ID NO: 264600 - DNA, 75 bp, Artificial Sequence
  Synthetic
aaccttttagtgtcccaaatcttccattgaatactctttcaaattcgagagtcccctctctaattaaatcaatga

SEQ ID NO: 264601 - DNA, 75 bp, Artificial Sequence
  Synthetic
agacagttggtgtgcattccccacaagcggcattctcagtggctagagtaaccatccaacctatagctgcttggt

SEQ ID NO: 264602 - DNA, 75 bp, Artificial Sequence
  Synthetic
ccacgcccacatcagctagccagctgtgtaaaatcaggggcagtgtcttccatgctaatggtgggaatgggtata

SEQ ID NO: 264603 - DNA, 75 bp, Artificial Sequence
  Synthetic
gtgtaaaatcaggggcagtgtcttccatgctaatggtgggaatgggtataacctgacagaattggatgggagccc

SEQ ID NO: 264604 - DNA, 75 bp, Artificial Sequence
  Synthetic
ttgttttgagttttgctgtcaagtcatgaatcttgaggacacatggttgcagaggcggctaataacatcaggtag

SEQ ID NO: 264605 - DNA, 75 bp, Artificial Sequence
  Synthetic
ccctaccacccaattcaatactggtgatgttataaaacaaattaatgtcaaacaagaatcagcatttgcccccca

SEQ ID NO: 264606 - DNA, 75 bp, Artificial Sequence
  Synthetic
gatgttataaaacaaattaatgtcaaacaagaatcagcatttgccccccaccttggtaccatacaggcagacggc

SEQ ID NO: 264607 - DNA, 75 bp, Artificial Sequence
  Synthetic
ggatgccatattggccgcggtgaatggccttgtttcacaacccttcaagaatttcttgggcaagctcaagcctct

SEQ ID NO: 264608 - DNA, 75 bp, Artificial Sequence
  Synthetic
ggccttgtttcacaacccttcaagaatttcttgggcaagctcaagcctcttaacgtattgaacatcctatctaac

SEQ ID NO: 264609 - DNA, 75 bp, Artificial Sequence
  Synthetic
ttgtgaatgaagatggcgtcgaatgacgccgctccatctaacgatggtgctacgggcctcgtcccagagatcaac

SEQ ID NO: 264610 - DNA, 75 bp, Artificial Sequence
  Synthetic
ggagatgtcgacccgtgggtcattccacgctatgggtcgactttgactgaggctgcccaattagcccctccaata

SEQ ID NO: 264611 - DNA, 75 bp, Artificial Sequence
  Synthetic
cacgctatgggtcgactttgactgaggctgcccaattagcccctccaatataccccccaggctttggtgaggcca

SEQ ID NO: 264612 - DNA, 75 bp, Artificial Sequence
  Synthetic
cctgatgtgtctaactttatagcatctctcctccctgatttccatctccagggaccagaagacctggcccgggat

SEQ ID NO: 264613 - DNA, 75 bp, Artificial Sequence
  Synthetic
aatttgtcacccattttgtcaatgaacaggcccctactagaggggaagcagccctattacattatttggatcctg

SEQ ID NO: 264614 - DNA, 75 bp, Artificial Sequence
  Synthetic
acaggcccctactagaggggaagcagccctattacattatttggatcctgacactcataggaatcttggtgaatt

SEQ ID NO: 264615 - DNA, 75 bp, Artificial Sequence
  Synthetic
agacaaagtcactaaggttatgaagagtgctgtagatgggctccgggctgctacgcaactggggcaatacgggtt

SEQ ID NO: 264616 - DNA, 75 bp, Artificial Sequence
  Synthetic
tggtgtctttgtttttgtgtcctgggtttccagattttatcaattaaagcctgtgggaacagccggcccggctcg

SEQ ID NO: 264617 - DNA, 75 bp, Artificial Sequence
  Synthetic
agcagttatagatatggaggtcttgtcctctacatcagtaacacaactggtgagagacaagcaggcagctaaagc

SEQ ID NO: 264618 - DNA, 75 bp, Artificial Sequence
  Synthetic
gtttccagattttatcaattaaagcctgtgggaacagccggcccggctcgtaggcttgggattaggagatcataa

SEQ ID NO: 264619 - DNA, 75 bp, Artificial Sequence
  Synthetic
tgagattcccaaaaccaatcaggactgatgtgacgggcatgatcttagaagaaggcgcacctgagggcaccgtgg

SEQ ID NO: 264620 - DNA, 75 bp, Artificial Sequence
  Synthetic
gaggaaaaagctagaaaactctctgctaagaatgctgacccccatgtaatatcctcaacaaatgccctaatatca

SEQ ID NO: 264621 - DNA, 75 bp, Artificial Sequence
  Synthetic
ctgaagctgccctacaacaccaaaggttccagcaagatttgaccttacaaaagaattcctttatccatgacaaag

SEQ ID NO: 264622 - DNA, 75 bp, Artificial Sequence
  Synthetic
gttccagcaagatttgaccttacaaaagaattcctttatccatgacaaagagatgatgggcctacaggttgatgc

SEQ ID NO: 264623 - DNA, 75 bp, Artificial Sequence
  Synthetic
tggctaaggctcaagctgagatgaccagccgaatgaggccagtcgtcatcatgatgtgcggacctcctggaattg

SEQ ID NO: 264624 - DNA, 75 bp, Artificial Sequence
  Synthetic
aggcctggcggcaaagtgggactagtgccacgtgaggctgttgaccactgggatggctaccatggtgaggaagtg

SEQ ID NO: 264625 - DNA, 75 bp, Artificial Sequence
  Synthetic
tgccacgtgaggctgttgaccactgggatggctaccatggtgaggaagtgatgctatgggatgactatggtatga

SEQ ID NO: 264626 - DNA, 75 bp, Artificial Sequence
  Synthetic
cgcggcacgcatggttgtgggggcgcccgcaactcgtgtcattgattggaatgggactaggattgccgcacctat

SEQ ID NO: 264627 - DNA, 75 bp, Artificial Sequence
  Synthetic
ggatggctaccatggtgaggaagtgatgctatgggatgactatggtatgacaaagatacaagatgactgcaacaa

SEQ ID NO: 264628 - DNA, 75 bp, Artificial Sequence
  Synthetic
actcccacctggcacctatgaaccagcctatcttggtggcaaggaccctagagtcaagggtggcccttcactgca

SEQ ID NO: 264629 - DNA, 75 bp, Artificial Sequence
  Synthetic
cccgcaactcgtgtcattgattggaatgggactaggattgccgcacctatgtcaactgcgacgacacttaggtct

SEQ ID NO: 264630 - DNA, 75 bp, Artificial Sequence
  Synthetic
tacaagcacccaatggagagttcactgtctcacctagaaactcccctggagaaattcttttaaatttagaattgg

SEQ ID NO: 264631 - DNA, 75 bp, Artificial Sequence
  Synthetic
gtaaattatgatccctcagtctcctcctctcggacttctcagtgggtttcttctcaaaattcaatgcgttccacc

SEQ ID NO: 264632 - DNA, 75 bp, Artificial Sequence
  Synthetic
gtcagatgcaatagtcatcaccaccaacgccccagggcccgcccctgtggatttcgtcaatctcggccctgtgtg

SEQ ID NO: 264633 - DNA, 75 bp, Artificial Sequence
  Synthetic
cctctcggacttctcagtgggtttcttctcaaaattcaatgcgttccaccttggaaccatttcacccaggtgccc

SEQ ID NO: 264634 - DNA, 75 bp, Artificial Sequence
  Synthetic
tgttccgccccagaggtagagcagataaggagagtcagccctggcgacacgtcggcactgaaagattgtttcaag

SEQ ID NO: 264635 - DNA, 75 bp, Artificial Sequence
  Synthetic
tctttaatacagaaaggttacccttattcgcgaacaggggtaagtgattttgtaatatgaattagtgggcatcat

SEQ ID NO: 264636 - DNA, 75 bp, Artificial Sequence
  Synthetic
acttggtgtgcacaaaccaccggctgccatcagcctcgccaaggttgaactaacaccactctctctgttttggag

SEQ ID NO: 264637 - DNA, 75 bp, Artificial Sequence
  Synthetic
gccatcagcctcgccaaggttgaactaacaccactctctctgttttggagaccagtgtatacaccacagtatctc

SEQ ID NO: 264638 - DNA, 75 bp, Artificial Sequence
  Synthetic
agttagctcctcaaggggggtttgacaaccaggggaacacaccattcggcaagggtgttatgaaaccaacaacca

SEQ ID NO: 264639 - DNA, 75 bp, Artificial Sequence
  Synthetic
attcgcgaacaggggtaagtgattttgtaatatgaattagtgggcatcatattcaatttggaatcaattagatgt

SEQ ID NO: 264640 - DNA, 75 bp, Artificial Sequence
  Synthetic
tcaatagactcctcatacaagctgtggctctcaccatggagagacaggatgagttccggctccaaggaaaaatgt

SEQ ID NO: 264641 - DNA, 75 bp, Artificial Sequence
  Synthetic
cgagcctaggtaagaaactgcgcggtgtcacatcgatggaaggtctgaagaatgctctgaaaggatacaaagttg

SEQ ID NO: 264642 - DNA, 75 bp, Artificial Sequence
  Synthetic
tgtcacatcgatggaaggtctgaagaatgctctgaaaggatacaaagttggcgcgtgtacaattaagtggcaggc

SEQ ID NO: 264643 - DNA, 75 bp, Artificial Sequence
  Synthetic
gcagtcagtgtgcgctgcctccattgcacttgcccgcctgcgggccgcgcgcgcggttgcgtatgcgtcatgcat

SEQ ID NO: 264644 - DNA, 75 bp, Artificial Sequence
  Synthetic
gcacttgcccgcctgcgggccgcgcgcgcggttgcgtatgcgtcatgcatccaatcagctataacctccatacta

SEQ ID NO: 264645 - DNA, 75 bp, Artificial Sequence
  Synthetic
tctccagacactctcaagaaattacacggagaaacgtttccctacacagcctttgacaacaattgctatgccttt

SEQ ID NO: 264646 - DNA, 75 bp, Artificial Sequence
  Synthetic
ctagagggcccccccaaagaacacaagtgcaaagtccaccaggctaaagccgcagggaaagggcccattggtcat

SEQ ID NO: 264647 - DNA, 75 bp, Artificial Sequence
  Synthetic
tcccaaagaaagaggaagcaaatgagctggctatggtgaggtccatcgaggatgcggtgctggacctcgaggcaa

SEQ ID NO: 264648 - DNA, 75 bp, Artificial Sequence
  Synthetic
ggtagtccatactgagatgccttccgccaccatagaaggcaagaacaaaggtaagaacaagaaagggcgcggccg

SEQ ID NO: 264649 - DNA, 75 bp, Artificial Sequence
  Synthetic
caggagtacctagaggatagacaaaggtatgaagaggagctcgctgaggttcaagcaggtggagacggaggaatc

SEQ ID NO: 264650 - DNA, 75 bp, Artificial Sequence
  Synthetic
cgccaattgggattagtcacgggttccgacatccggaaaaggaaaccaattgattggactccccctaagtcagca

SEQ ID NO: 264651 - DNA, 75 bp, Artificial Sequence
  Synthetic
tcacaggggaccagcgtgtgggtctcatcccgcgcaatggtgttgatcactgggacgcatataagggagaaagag

SEQ ID NO: 264652 - DNA, 75 bp, Artificial Sequence
  Synthetic
catcccgcgcaatggtgttgatcactgggacgcatataagggagaaagagtcgttctatgggacgactatggaat

SEQ ID NO: 264653 - DNA, 75 bp, Artificial Sequence
  Synthetic
ggcgccccccactttgtggagccgagttacaaagtttgggtctgggtggggtttttgggtcagccccacagtctt

SEQ ID NO: 264654 - DNA, 75 bp, Artificial Sequence
  Synthetic
ggctatggtgagatccatcgaggatgcagtactggaccttgaggcaattgaaaacaaccatatgaccaccttgct

SEQ ID NO: 264655 - DNA, 75 bp, Artificial Sequence
  Synthetic
gattgagaacaaaggaaaggtctttgacagtgatgccataatcatcaccactaacctggccaacccagcaccact

SEQ ID NO: 264656 - DNA, 75 bp, Artificial Sequence
  Synthetic
tagggccggagaattcaccctcttcaggttctctaagaaaatcaggcccgatctcacgggcatgattcttgagga

SEQ ID NO: 264657 - DNA, 75 bp, Artificial Sequence
  Synthetic
aggttctctaagaaaatcaggcccgatctcacgggcatgattcttgaggaaggttgtccagaaggtacggtgtgc

SEQ ID NO: 264658 - DNA, 75 bp, Artificial Sequence
  Synthetic
atgcagatgcccctgaggtcgagaaggcaaaacgtgactttccaggtcaacctgacatgtggaagaacgctttca

SEQ ID NO: 264659 - DNA, 75 bp, Artificial Sequence
  Synthetic
atacagggtcgtcttgtccatggtcagtctggtatgttgctcactggggcgaatgctaagggcatggaccttgga

SEQ ID NO: 264660 - DNA, 75 bp, Artificial Sequence
  Synthetic
agtctggtatgttgctcactggggcgaatgctaagggcatggaccttggaactattccaggggactgtggagctc

SEQ ID NO: 264661 - DNA, 75 bp, Artificial Sequence
  Synthetic
tggtgtgcgccgtccaagctagtgaaggggagaccacacttgaaggaggtgacaaaggccactatgccgggcatg

SEQ ID NO: 264662 - DNA, 75 bp, Artificial Sequence
  Synthetic
agccctgtcaaccaaaacaaagttctggaaatcatcccctgaaccattaccccccggggtctatgaacccgcata

SEQ ID NO: 264663 - DNA, 75 bp, Artificial Sequence
  Synthetic
actgtgcagaccaacaatgaactggccggtgccctacaccatcttcggtgtgccagaattagatactatgtcaag

SEQ ID NO: 264664 - DNA, 75 bp, Artificial Sequence
  Synthetic
tgctgagccacgggggcgtatgccagaaccaggtctcctggaggccgcagttgagactgtgacctcatcactgga

SEQ ID NO: 264665 - DNA, 75 bp, Artificial Sequence
  Synthetic
ctgatttctcacacataaaattggcactggctccacaaggtggctttgataagaacgggaacaccccacacggga

SEQ ID NO: 264666 - DNA, 75 bp, Artificial Sequence
  Synthetic
tgttaccacgcgcattgtcaagcgcatgaacatacaagacctttggtccaagccacaggtggaagatacagagga

SEQ ID NO: 264667 - DNA, 75 bp, Artificial Sequence
  Synthetic
tggagttacagtgatgcatgtcaatccctggacaaaactactagctcaggtttcccccaccataagaaaaagaat

SEQ ID NO: 264668 - DNA, 75 bp, Artificial Sequence
  Synthetic
gccaagagcatgaagcccatgtacacggcggcgcttaaggatgaattagtgaagccagaaaaagtgtaccaaaaa

SEQ ID NO: 264669 - DNA, 75 bp, Artificial Sequence
  Synthetic
gtactgggctcccgatgctaggactacaacatataatgcaggccgcttttccacccctcaaccctcgggggcgcc

SEQ ID NO: 264670 - DNA, 75 bp, Artificial Sequence
  Synthetic
gatgccataaagtcccacacaattaaactacctatcaaagttgggatgaattcaatcgaggatggaccattaatt

SEQ ID NO: 264671 - DNA, 75 bp, Artificial Sequence
  Synthetic
aactacctatcaaagttgggatgaattcaatcgaggatggaccattaatttatgcagagcattcaaaatataaat

SEQ ID NO: 264672 - DNA, 75 bp, Artificial Sequence
  Synthetic
tgtgtcggctaactgcttctccagaattggcctcagtggtggcacaagatctgcttgcaccctcggaaatggacg

SEQ ID NO: 264673 - DNA, 75 bp, Artificial Sequence
  Synthetic
accattggttgataactttgtgtgccctctctgaggtgactggcctgtcaccagatgttattcagtctatgtcat

SEQ ID NO: 264674 - DNA, 75 bp, Artificial Sequence
  Synthetic
cctctctgaggtgactggcctgtcaccagatgttattcagtctatgtcatacttttctttctatggtgatgatga

SEQ ID NO: 264675 - DNA, 75 bp, Artificial Sequence
  Synthetic
ccgccctgacaagagtgagggtccaataattgtgaggaagaatgtggatggcctagtcttcttacgtcgcactat

SEQ ID NO: 264676 - DNA, 75 bp, Artificial Sequence
  Synthetic
aaagacagatctattggaccagagggcccaatcactcagacccctttgaaactttggtgccccaccaacaaagga

SEQ ID NO: 264677 - DNA, 75 bp, Artificial Sequence
  Synthetic
cggctgctgcccgtggaggaaacactgtcatatgtgccacccaggggagtgagggagaagccacacttgaaggcg

SEQ ID NO: 264678 - DNA, 75 bp, Artificial Sequence
  Synthetic
gagggagaagccacacttgaaggcggtgacaacaagggaacctattgcggtgcacccatcttaggtccagggagt

SEQ ID NO: 264679 - DNA, 75 bp, Artificial Sequence
  Synthetic
tcatccaagagattaagacagggggccttgaaatgtacgtaccagggtggcaagccatgttccgctggatgcggt

SEQ ID NO: 264680 - DNA, 75 bp, Artificial Sequence
  Synthetic
cagcagtcgcaacggctgggcaagttaacatgattgacccatggatcttcaataactttgtccaagcgccccaag

SEQ ID NO: 264681 - DNA, 75 bp, Artificial Sequence
  Synthetic
cttgaacaaacaattgatccacctcaaaaatggtcattcgcgcaggcatgcgcatccctcgacaagaccacttcc

SEQ ID NO: 264682 - DNA, 75 bp, Artificial Sequence
  Synthetic
aaaacgactgctggaacggggagtccttcacaggcaaattggcagaccaggcttccaaggctaacctgatgtttg

SEQ ID NO: 264683 - DNA, 75 bp, Artificial Sequence
  Synthetic
gtataatggttgggtcggcaatatgcgtgtgcgcatattgttggccggcaacgccttcacagctggaaagataat

SEQ ID NO: 264684 - DNA, 75 bp, Artificial Sequence
  Synthetic
tgctgacgttaggacccttgagcctgtggagcttcctttggaggacgtacgcaacgttctctaccacaacagtag

SEQ ID NO: 264685 - DNA, 75 bp, Artificial Sequence
  Synthetic
gcactggtggtggttctggaggcactgatgcctttgtggtggcgggcagggtgcttacgtgccccgcccctgact

SEQ ID NO: 264686 - DNA, 75 bp, Artificial Sequence
  Synthetic
aagatctctcaaattctcgtgtccctgtgcctatacagggcatgtttatgtccccagatgttaatcagtcagtcc

SEQ ID NO: 264687 - DNA, 75 bp, Artificial Sequence
  Synthetic
tgatggtcaactccagggcaccaccccagtctcgctcagccaactctgcaagattaggggtaaaacttcaagcaa

SEQ ID NO: 264688 - DNA, 75 bp, Artificial Sequence
  Synthetic
ccagtctcgctcagccaactctgcaagattaggggtaaaacttcaagcaatgccagggtgctcaacttgagtgag

SEQ ID NO: 264689 - DNA, 75 bp, Artificial Sequence
  Synthetic
cacgtaaatttctctttccagactcaagatcgggacccatctcaaagtgtgacctttgcaaccaatgatgccagc

SEQ ID NO: 264690 - DNA, 75 bp, Artificial Sequence
  Synthetic
gacctttgcaaccaatgatgccagctttgttccctacctaggtagtgtctcccctcacaatggggaaggttttca

SEQ ID NO: 264691 - DNA, 75 bp, Artificial Sequence
  Synthetic
accaaagtatggatctagtctcccagatgtcacccatcttgctcctgctgtgttccccccaggctttggggaggt

SEQ ID NO: 264692 - DNA, 75 bp, Artificial Sequence
  Synthetic
aggatcagatactatgtcaagtgtgtccaggaggccctgtattccatcatccaaattgctggagctgcatttgtc

SEQ ID NO: 264693 - DNA, 75 bp, Artificial Sequence
  Synthetic
tccaggaggccctgtattccatcatccaaattgctggagctgcatttgtcaccacgcgcatcgtcaagcgcatga

SEQ ID NO: 264694 - DNA, 75 bp, Artificial Sequence
  Synthetic
ggagttcatcacccacttctgcaacgaacaggctcccatcgctggggaggctgccctcctccactacgtggaccc

SEQ ID NO: 264695 - DNA, 75 bp, Artificial Sequence
  Synthetic
gaacaggctcccatcgctggggaggctgccctcctccactacgtggaccctgacacggggcgaaacttgggggaa

SEQ ID NO: 264696 - DNA, 75 bp, Artificial Sequence
  Synthetic
attgacccatggatcagaatgaattttgttcaagccccaaatggagaattcactgtttccccaagaaattcccct

SEQ ID NO: 264697 - DNA, 75 bp, Artificial Sequence
  Synthetic
aatggagtctttgtctttgtttcatgggtatccagattctatcaactcaagcctgtgggaacggcctcagcggct

SEQ ID NO: 264698 - DNA, 75 bp, Artificial Sequence
  Synthetic
ttgttcaagccccaaatggagaattcactgtttccccaagaaattcccctggagaagtactcctaaatttggaat

SEQ ID NO: 264699 - DNA, 75 bp, Artificial Sequence
  Synthetic
aatggcccaagctgtcatcggtgccatagccgcgtctgccgctggtagtatactaggggcgggcatacaggctgg

SEQ ID NO: 264700 - DNA, 75 bp, Artificial Sequence
  Synthetic
agatcatgctagctgggaatgcgttcactgctggtaaactgatctttgctgctgtgcccccacattttcccattg

SEQ ID NO: 264701 - DNA, 75 bp, Artificial Sequence
  Synthetic
cactgctggtaaactgatctttgctgctgtgcccccacattttcccattgaaaatttgagtcccccccagattac

SEQ ID NO: 264702 - DNA, 75 bp, Artificial Sequence
  Synthetic
ggaaatgttaggctatcaggttcaggctagtaatgctcttttagctaagaatcttaacactaggtatgctcttct

SEQ ID NO: 264703 - DNA, 75 bp, Artificial Sequence
  Synthetic
atcttaacactaggtatgctcttctgcgggcagggggcctatctagtgctgatgctgctcgggcagtggctggtg

SEQ ID NO: 264704 - DNA, 75 bp, Artificial Sequence
  Synthetic
tttctttcactttattcagagggatgagccaaagatgaggttggtggcaatgctgtacacgccactgaggtccaa

SEQ ID NO: 264705 - DNA, 75 bp, Artificial Sequence
  Synthetic
gagccaaagatgaggttggtggcaatgctgtacacgccactgaggtccaacggatctggggatgatgtattcaca

SEQ ID NO: 264706 - DNA, 75 bp, Artificial Sequence
  Synthetic
ctggtggttttatggctgtccctataccattgtcttcaaagaccaagcaaccagtgatgtctgggcaggataatc

SEQ ID NO: 264707 - DNA, 75 bp, Artificial Sequence
  Synthetic
aagagtaagcctttcactttacctatattaacattgggagagttgacaaattctaggtttccattacccattgat

SEQ ID NO: 264708 - DNA, 75 bp, Artificial Sequence
  Synthetic
tattaacattgggagagttgacaaattctaggtttccattacccattgatgtcctgtatactaacccaaatgaga

SEQ ID NO: 264709 - DNA, 75 bp, Artificial Sequence
  Synthetic
caaattatgctacttcttctatctctagaactgcttcatgggtgcaatctcaaaattctatgagatctgtttctc

SEQ ID NO: 264710 - DNA, 75 bp, Artificial Sequence
  Synthetic
gttttaatggtgtttttaatacagatagattgcctctgttcgcaaacagaaggtaatattttgtaataggatgcc

SEQ ID NO: 264711 - DNA, 75 bp, Artificial Sequence
  Synthetic
caggcatctgtgcgttcaggggcaaagtcactcaacaggtgcaggatgaacatcggggcacacattggaatatga

SEQ ID NO: 264712 - DNA, 75 bp, Artificial Sequence
  Synthetic
agtcactcaacaggtgcaggatgaacatcggggcacacattggaatatgacagtaaccaacttaaatggcacccc

SEQ ID NO: 264713 - DNA, 75 bp, Artificial Sequence
  Synthetic
aggtaatattttgtaataggatgccggtgggcaccatattcagatttggttttaattgatattttaattacaatt

SEQ ID NO: 264714 - DNA, 75 bp, Artificial Sequence
  Synthetic
tcagaggaataccaacacagttcccggtgaaggaaacctcccggccaacagggctcatgaggcagtgattgcaac

SEQ ID NO: 264715 - DNA, 75 bp, Artificial Sequence
  Synthetic
ggtgaaggaaacctcccggccaacagggctcatgaggcagtgattgcaacctacagtcccaaattcacacccaaa

SEQ ID NO: 264716 - DNA, 75 bp, Artificial Sequence
  Synthetic
aaaagatccctcctcccccacccaacggggaggatgaactagtggtttcttacagcgccaaagatggcgtttccg

SEQ ID NO: 264717 - DNA, 75 bp, Artificial Sequence
  Synthetic
ggcttggcctccgtggatgctaactctcattttgaccaatggaccctccccagctattctggtgccctaactcta

SEQ ID NO: 264718 - DNA, 75 bp, Artificial Sequence
  Synthetic
ctcattttgaccaatggaccctccccagctattctggtgccctaactctaaatatgaacttggccccatctgttg

SEQ ID NO: 264719 - DNA, 75 bp, Artificial Sequence
  Synthetic
ttaaaactgacaaaatttatggcaagatcaagaagaggcttctctggggctcggacttggcgaccatgatccggt

SEQ ID NO: 264720 - DNA, 75 bp, Artificial Sequence
  Synthetic
ctattgattgcttgatgccacaggaatgggtccagcatctctaccaggagtcggcaccatcccttagtgatgtgg

SEQ ID NO: 264721 - DNA, 75 bp, Artificial Sequence
  Synthetic
atgggtccagcatctctaccaggagtcggcaccatcccttagtgatgtggctttagtgaggtatgtgaacccaga

SEQ ID NO: 264722 - DNA, 75 bp, Artificial Sequence
  Synthetic
agcctttgacaacaactgctatgccttctgttgttgggtcctggacctaaacgactcgtggttgtgcaggagaat

SEQ ID NO: 264723 - DNA, 75 bp, Artificial Sequence
  Synthetic
tgtcgtggcccccacaaatggttattttagatttgattcttgggtcaaccaattttacactttagcccccatggg

SEQ ID NO: 264724 - DNA, 75 bp, Artificial Sequence
  Synthetic
ttctgttgttgggtcctggacctaaacgactcgtggttgtgcaggagaatgatccagaggacaactggtttcttc

SEQ ID NO: 264725 - DNA, 75 bp, Artificial Sequence
  Synthetic
ctgcacctcccaatggaactccatcgcccactggcttctcactctctgtgcgctctctgaagttacaaacttgtc

SEQ ID NO: 264726 - DNA, 75 bp, Artificial Sequence
  Synthetic
agaccttaccaagactggaacaggaaacccctccccaccatggatgactccaaattgaagaaggtagccaacata

SEQ ID NO: 264727 - DNA, 75 bp, Artificial Sequence
  Synthetic
tttagatttgattcttgggtcaaccaattttacactttagcccccatgggaaatggcagtgggcgcagaagaatg

SEQ ID NO: 264728 - DNA, 75 bp, Artificial Sequence
  Synthetic
ctgaaaacactagtgacaatagtgattctataaagaaccgcttcttcacaagattgaagaatttaggttctaaca

SEQ ID NO: 264729 - DNA, 75 bp, Artificial Sequence
  Synthetic
ctggtgccaatgcaatcaatcagaaagctgaattcgatttcaatagacaattacaacaaaactctttcaatcatg

SEQ ID NO: 264730 - DNA, 75 bp, Artificial Sequence
  Synthetic
ataagccccctaaagatcagcgggacaaacccccaaggaatgtggccgaaactcaacaagcaatgggatggattg

SEQ ID NO: 264731 - DNA, 75 bp, Artificial Sequence
  Synthetic
caaacccccaaggaatgtggccgaaactcaacaagcaatgggatggattgacccccccgtggatcagaatctacc

SEQ ID NO: 264732 - DNA, 75 bp, Artificial Sequence
  Synthetic
cttaacatcttggcctcatgtgattggacttttgcaggcatagtggaatctttgatcctcttggcagagctcttt

SEQ ID NO: 264733 - DNA, 75 bp, Artificial Sequence
  Synthetic
ggacttttgcaggcatagtggaatctttgatcctcttggcagagctctttggagttttctggacacccccagatg

SEQ ID NO: 264734 - DNA, 75 bp, Artificial Sequence
  Synthetic
tcaagcaacaaagcagctgcaggcagacatgatcgccatcaagcaaggggtgttgaccgctggcggcttctcccc

SEQ ID NO: 264735 - DNA, 75 bp, Artificial Sequence
  Synthetic
cactgacgcagcaagaggagcagtcaacgctcccatgacacaggctttggactggagtggcacgaggtactgggc

SEQ ID NO: 264736 - DNA, 75 bp, Artificial Sequence
  Synthetic
attggcaccagctagcatcccttccggttatgtgaagaacacagagcagcaaccccctgaccaccaagtcaagtg

SEQ ID NO: 264737 - DNA, 75 bp, Artificial Sequence
  Synthetic
ggttatgtgaagaacacagagcagcaaccccctgaccaccaagtcaagtggagtgccaataacggggttgatctg

SEQ ID NO: 264738 - DNA, 75 bp, Artificial Sequence
  Synthetic
ctccaactaggcaggttgagttccctcagcgcaagagtgctgccccctctagtgctgattccacctatagtgggt

SEQ ID NO: 264739 - DNA, 75 bp, Artificial Sequence
  Synthetic
tcagcgcaagagtgctgccccctctagtgctgattccacctatagtgggtcttctaggtctacagtttctactac

SEQ ID NO: 264740 - DNA, 75 bp, Artificial Sequence
  Synthetic
aatggtccagcaagagagccacttattggtgacatgatagagttctatgagggtcacatctaccattatgcaata

SEQ ID NO: 264741 - DNA, 75 bp, Artificial Sequence
  Synthetic
ttggtgacatgatagagttctatgagggtcacatctaccattatgcaatatatattggccaaggaaaaactgttg

SEQ ID NO: 264742 - DNA, 75 bp, Artificial Sequence
  Synthetic
gatgcggtgctggacctcgaagcaattgagaacaatcacatgactgccctcctcaaagacaaagacagcttggca

SEQ ID NO: 264743 - DNA, 75 bp, Artificial Sequence
  Synthetic
ctcaagatcaagaaccagtgactgggtgcgtgagcaaaaccgaagtctagaaccctttatgcatggggctttgca

SEQ ID NO: 264744 - DNA, 75 bp, Artificial Sequence
  Synthetic
gttacataccaacgcctgatcagaggttaaactatgaccaactcaaagagcttgagaatgagccatggccatatg

SEQ ID NO: 264745 - DNA, 75 bp, Artificial Sequence
  Synthetic
gttaaactatgaccaactcaaagagcttgagaatgagccatggccatatgctgcagtcaccaataactgctatga

SEQ ID NO: 264746 - DNA, 75 bp, Artificial Sequence
  Synthetic
tatcattacaatcaatcaaatgaccccaccatcaaattgatagcaatgttgtatacaccacttagggctaataat

SEQ ID NO: 264747 - DNA, 75 bp, Artificial Sequence
  Synthetic
ggactcttggacacctgcgtttaacacccgcaggcagccgcttttcgcataccttcgaccgaagggagagtcacg

SEQ ID NO: 264748 - DNA, 75 bp, Artificial Sequence
  Synthetic
acccgcaggcagccgcttttcgcataccttcgaccgaagggagagtcacgagtttagtgaaaagattaattttct

SEQ ID NO: 264749 - DNA, 75 bp, Artificial Sequence
  Synthetic
cccagcacaagactggtccagggacacacctgacttccaacaagatagcaaactagaaatagttagggacgccgt

SEQ ID NO: 264750 - DNA, 75 bp, Artificial Sequence
  Synthetic
acacctgacttccaacaagatagcaaactagaaatagttagggacgccgtgcttgctgctatcaatggcctggtg

SEQ ID NO: 264751 - DNA, 75 bp, Artificial Sequence
  Synthetic
tcgtcctatgggacgattatggaatgagtaatcccatccacgacgccctcagattacaggaacttgctgacacct

SEQ ID NO: 264752 - DNA, 75 bp, Artificial Sequence
  Synthetic
acatttatgggagtggtggagacgataatattactcatggaattgtttgggattttctggaacccccctgatgtg

SEQ ID NO: 264753 - DNA, 75 bp, Artificial Sequence
  Synthetic
taatattactcatggaattgtttgggattttctggaacccccctgatgtgtccagctttatagcctcactactac

SEQ ID NO: 264754 - DNA, 75 bp, Artificial Sequence
  Synthetic
ctaatctggccaacccagcaccattggactatgtcaactttgaagcatgctcgaggcgcatcgacttcctcgtgt

SEQ ID NO: 264755 - DNA, 75 bp, Artificial Sequence
  Synthetic
caattggatttactaaggacaaagtcacaaaggttatgaaaagtgctgttgaagggctgagggcagccacacaac

SEQ ID NO: 264756 - DNA, 75 bp, Artificial Sequence
  Synthetic
acgcagaagcccctgaggtcgagaaggcaaagcgtgatttcccaggtcaacctgacatgtggaagaacgcattca

SEQ ID NO: 264757 - DNA, 75 bp, Artificial Sequence
  Synthetic
cacaaaggttatgaaaagtgctgttgaagggctgagggcagccacacaactgggtcaatatggcctagaaatatt

SEQ ID NO: 264758 - DNA, 75 bp, Artificial Sequence
  Synthetic
gttctgacttctcgcacataaaactgacgctggctccgcaaggtggcttcgacaagaacggaaacaccccacacg

SEQ ID NO: 264759 - DNA, 75 bp, Artificial Sequence
  Synthetic
actttgaaactggccaaaacacgagattcaccccagtcggtgttgtccaggatggtagtaccacccaccaaaatg

SEQ ID NO: 264760 - DNA, 75 bp, Artificial Sequence
  Synthetic
cgacatggaggtcatctcaacaactgctgtcacgcaactggttagggacaaacaggctgcccgaacttacatgaa

SEQ ID NO: 264761 - DNA, 75 bp, Artificial Sequence
  Synthetic
gatccagaggacaactggtttcttcaggccctaccaagactggaataggaaaccccttcccactatggatgactc

SEQ ID NO: 264762 - DNA, 75 bp, Artificial Sequence
  Synthetic
gctgtcacgcaactggttagggacaaacaggctgcccgaacttacatgaacatcttggatgccgaagaagaaaag

SEQ ID NO: 264763 - DNA, 75 bp, Artificial Sequence
  Synthetic
cttttacgtcggtcacaaacaccatctccatgtcggcaaactaatgacagtgcccccaaagctcaaagggaccgc

SEQ ID NO: 264764 - DNA, 75 bp, Artificial Sequence
  Synthetic
ctccatgtcggcaaactaatgacagtgcccccaaagctcaaagggaccgccccccacggaccgcttcagaggtaa

SEQ ID NO: 264765 - DNA, 75 bp, Artificial Sequence
  Synthetic
ctggctcgctccgcacttgctaaagcacaagctgagatgaccaatagggttaaaccagtagtaataatgatgtgt

SEQ ID NO: 264766 - DNA, 75 bp, Artificial Sequence
  Synthetic
cacaagctgagatgaccaatagggttaaaccagtagtaataatgatgtgtggtcccccaggcataggcaagacaa

SEQ ID NO: 264767 - DNA, 75 bp, Artificial Sequence
  Synthetic
aggagaaggaggagataatgcgtaacaacgagaggctctttgatgctggaggtgtcaccccatcaatcctgccca

SEQ ID NO: 264768 - DNA, 75 bp, Artificial Sequence
  Synthetic
ttgagtctgatggcaagggtgatgtaaaagttgacagagtccagaacgccactgtacagaccaacaatgagcttg

SEQ ID NO: 264769 - DNA, 75 bp, Artificial Sequence
  Synthetic
caacgagaggctctttgatgctggaggtgtcaccccatcaatcctgcccagcacatttgagaggactgactcaag

SEQ ID NO: 264770 - DNA, 75 bp, Artificial Sequence
  Synthetic
aggctgtggatcattgggatggatatcatggtgaagaggttatgctatgggatgattatggtatgtcaaagatag

SEQ ID NO: 264771 - DNA, 75 bp, Artificial Sequence
  Synthetic
tcatggtgaagaggttatgctatgggatgattatggtatgtcaaagatagccgatgactgtaataagttgcaggc

SEQ ID NO: 264772 - DNA, 75 bp, Artificial Sequence
  Synthetic
cacagttcgtggcccgttttggaacatgtgccccctcccaccactggatgcccgtaataatggccctgccaagga

SEQ ID NO: 264773 - DNA, 75 bp, Artificial Sequence
  Synthetic
atgtgccccctcccaccactggatgcccgtaataatggccctgccaaggaaccccttataggggacatggtcgag

SEQ ID NO: 264774 - DNA, 75 bp, Artificial Sequence
  Synthetic
ggcccagctccagtcgactttgtcaatcttggcccagtgtgtcggcgggtagatttcttggtttactgcaccgcg

SEQ ID NO: 264775 - DNA, 75 bp, Artificial Sequence
  Synthetic
cgagggcaagaaagggaagaacaagtctggctgtggcaagaagcacacagccttctcaagcaaaggtctcagtga

SEQ ID NO: 264776 - DNA, 75 bp, Artificial Sequence
  Synthetic
gccgctttctccatacccagaataactatccacccactagtggcctggtggcgcgtgtgttatgtccccactaat

SEQ ID NO: 264777 - DNA, 75 bp, Artificial Sequence
  Synthetic
ctatccacccactagtggcctggtggcgcgtgtgttatgtccccactaatcaacaacgcctcacctacgagcaac

SEQ ID NO: 264778 - DNA, 75 bp, Artificial Sequence
  Synthetic
tctcatctaaaaatggagttagccccacagggcggatttgataatcaaggaaatactccatttggtaaagggacc

SEQ ID NO: 264779 - DNA, 75 bp, Artificial Sequence
  Synthetic
cacagggcggatttgataatcaaggaaatactccatttggtaaagggaccatgcggcccaccacattaaaccgtc

SEQ ID NO: 264780 - DNA, 75 bp, Artificial Sequence
  Synthetic
cagagacaagtattatgaggaggtggccatcgccagggcgaccgaagaggacttctgtgaagaagaagaggccaa

SEQ ID NO: 264781 - DNA, 75 bp, Artificial Sequence
  Synthetic
tggcgcttgatgatacctggctccagaggaaattggtcaatagtggaaaatttaaccaccccacacaggactggt

SEQ ID NO: 264782 - DNA, 75 bp, Artificial Sequence
  Synthetic
gaggaaattggtcaatagtggaaaatttaaccaccccacacaggactggtcacaggacaccccagattttcacca

SEQ ID NO: 264783 - DNA, 75 bp, Artificial Sequence
  Synthetic
acaaggaaacaacgcaaagaggagagggcctctctcggtttggtcacaggctctgaaatcaggaagaggaaccca

SEQ ID NO: 264784 - DNA, 75 bp, Artificial Sequence
  Synthetic
atgctgacagggtttccgcctttactagtttagcaagagccaatggtctgggcctcattagcatggcctctctag

SEQ ID NO: 264785 - DNA, 75 bp, Artificial Sequence
  Synthetic
tagtttagcaagagccaatggtctgggcctcattagcatggcctctctaggaaagaaattgaggggcgtggactc

SEQ ID NO: 264786 - DNA, 75 bp, Artificial Sequence
  Synthetic
cattctgtcaaaaattaaaccattaaatgtgctcagtcttttatcaaactgtgattggactttcatgggcgtcgt

SEQ ID NO: 264787 - DNA, 75 bp, Artificial Sequence
  Synthetic
gaagccccaccaagcatctggtcgaggatagtcaattttggttcgggttggggcttttgggtctcccccagcctg

SEQ ID NO: 264788 - DNA, 75 bp, Artificial Sequence
  Synthetic
aatgtgctcagtcttttatcaaactgtgattggactttcatgggcgtcgtggagctggttgtgctcctggcagaa

SEQ ID NO: 264789 - DNA, 75 bp, Artificial Sequence
  Synthetic
tgacattgaatcagatggtactaatgtacaaataaaggaaaacacctcagcccaaactcaacgccagcagtcaat

SEQ ID NO: 264790 - DNA, 75 bp, Artificial Sequence
  Synthetic
gtacaaataaaggaaaacacctcagcccaaactcaacgccagcagtcaattgacacagctgccctagcactcact

SEQ ID NO: 264791 - DNA, 75 bp, Artificial Sequence
  Synthetic
ggtccagaagacctagccaaagacttagtcccccttatattaggtggtataggtctggcaattggtttcacaaga

SEQ ID NO: 264792 - DNA, 75 bp, Artificial Sequence
  Synthetic
tagtcccccttatattaggtggtataggtctggcaattggtttcacaagagacaaaataacaaaagtgatgaaga

SEQ ID NO: 264793 - DNA, 75 bp, Artificial Sequence
  Synthetic
ggatcggccatcgttataaatcgtgctgtgaaaaggatgtttggggcacactcaagcaccatagcccttgaaggg

SEQ ID NO: 264794 - DNA, 75 bp, Artificial Sequence
  Synthetic
ctgtgaaaaggatgtttggggcacactcaagcaccatagcccttgaagggccgccaagagaacatcggtgtaggg

SEQ ID NO: 264795 - DNA, 75 bp, Artificial Sequence
  Synthetic
acttctttggaggggatcaaacagaaaagaccctgcggggtattgaagatgcggtgatagacatggaagtattgt

SEQ ID NO: 264796 - DNA, 75 bp, Artificial Sequence
  Synthetic
aaagaccctgcggggtattgaagatgcggtgatagacatggaagtattgtccagtaccaatgtgacacaactagt

SEQ ID NO: 264797 - DNA, 75 bp, Artificial Sequence
  Synthetic
ctgaggaggaaggcaccagcgaggagatgaatgtggagcttcccaccgccacttctgagggtaaaaacaaaggaa

SEQ ID NO: 264798 - DNA, 75 bp, Artificial Sequence
  Synthetic
gcaccacaccaggtgactgtggccgtccctacatttacaagagggggaatgactatgtggtcattggagtccaca

SEQ ID NO: 264799 - DNA, 75 bp, Artificial Sequence
  Synthetic
gatgaatgtggagcttcccaccgccacttctgagggtaaaaacaaaggaaagaccaagaaaggaaggggcagaag

SEQ ID NO: 264800 - DNA, 75 bp, Artificial Sequence
  Synthetic
ccgtagcgctgacccacacatagtgacctctgtcaacaacttgatatcacgcatctctatggcaagatcagctct

SEQ ID NO: 264801 - DNA, 75 bp, Artificial Sequence
  Synthetic
acctctgtcaacaacttgatatcacgcatctctatggcaagatcagctctggctaaagcccaagctgagatgacg

SEQ ID NO: 264802 - DNA, 75 bp, Artificial Sequence
  Synthetic
aaagaatggtaattacagtatccaggagtatcttgaagacagacaacgctatgaagaagagctcgcagaagtgca

SEQ ID NO: 264803 - DNA, 75 bp, Artificial Sequence
  Synthetic
agctggtggagatggaggcattggtgagacagaaatggagattcgacacaagatcttctataaatccaaaaaggg

SEQ ID NO: 264804 - DNA, 75 bp, Artificial Sequence
  Synthetic
gctggccgactagctgctgaaattagacctggaggcaaagttggccttgtacctcgggagtccatagatcattgg

SEQ ID NO: 264805 - DNA, 75 bp, Artificial Sequence
  Synthetic
gacctggaggcaaagttggccttgtacctcgggagtccatagatcattgggatggatatcatggcgaggatgtct

SEQ ID NO: 264806 - DNA, 75 bp, Artificial Sequence
  Synthetic
tgccaagaaaaccatcgtcaatgtccttgaacaaacaattgatccacctcaaaaatggtcatttgcgcaggcatg

SEQ ID NO: 264807 - DNA, 75 bp, Artificial Sequence
  Synthetic
gataatagggaagtggattacaatgaaaaactcagttttgaagccccaccaaccctctggagtcgagtcgtgaga

SEQ ID NO: 264808 - DNA, 75 bp, Artificial Sequence
  Synthetic
cactgtcgcttaattgtgacagaatagaaaataaaggcatgcaattctcttctgatgcaataattataaccacca

SEQ ID NO: 264809 - DNA, 75 bp, Artificial Sequence
  Synthetic
agaaaataaaggcatgcaattctcttctgatgcaataattataaccaccaatgctcctggcccagccccagtcga

SEQ ID NO: 264810 - DNA, 75 bp, Artificial Sequence
  Synthetic
cgtgaattctttggggagcccattgaatctatagcaatccatcgtgctggtgaatttacacaattcaggttttca

SEQ ID NO: 264811 - DNA, 75 bp, Artificial Sequence
  Synthetic
gcggagggctcatccaggtgacactaatgccatcaaggatctgtttaaaaaggacttctcacacctaaaaatgga

SEQ ID NO: 264812 - DNA, 75 bp, Artificial Sequence
  Synthetic
tgaagagtacgatgagtacaagaggattagagaagaaaggaatggcaagtactccatagaagagtaccttcagga

SEQ ID NO: 264813 - DNA, 75 bp, Artificial Sequence
  Synthetic
gcaagatcaaaaagaggcttctctggggttcggacctggcgaccatgatccggtgcgctcgagcattcgggggcc

SEQ ID NO: 264814 - DNA, 75 bp, Artificial Sequence
  Synthetic
tgagggtgtcgtgtgttctattcttatcaagcgtgactctggtgagctgctaccccttgctgtccgaatgggcgc

SEQ ID NO: 264815 - DNA, 75 bp, Artificial Sequence
  Synthetic
aatgccatcaaggatctgtttaaaaaggacttctcacacctaaaaatggaattggctccacagggcggctttgat

SEQ ID NO: 264816 - DNA, 75 bp, Artificial Sequence
  Synthetic
gcattagccatggaacggcaagatgaattccaactccaggggactgtttataactttgatgaggacagagtggcc

SEQ ID NO: 264817 - DNA, 75 bp, Artificial Sequence
  Synthetic
tcatctttgagagacactccagatataaatatcattatgatgctgattactcccggtgggactcaacacaacaaa

SEQ ID NO: 264818 - DNA, 75 bp, Artificial Sequence
  Synthetic
aattccaactccaggggactgtttataactttgatgaggacagagtggccgccttcaccaatttggctcgcgcta

SEQ ID NO: 264819 - DNA, 75 bp, Artificial Sequence
  Synthetic
ggtgattgtggtgccccttatgtgtacaaaagaaacaatgactgggtggtttgtggtgtacatgcagctgccacg

SEQ ID NO: 264820 - DNA, 75 bp, Artificial Sequence
  Synthetic
aagaccttctttctcccagcgtgatggacgtgggtgatttcaaaatatcaatcaatgagggcctcccctccgggg

SEQ ID NO: 264821 - DNA, 75 bp, Artificial Sequence
  Synthetic
atgcactactgggatacaagattggagagtgtgatatagtttggaacactagggtgtactcagtcaagagtgacg

SEQ ID NO: 264822 - DNA, 75 bp, Artificial Sequence
  Synthetic
cactatgctggccatgagataatcaagcatagcaagggcccagctttatcaaccaaaaccaagttttggagatca

SEQ ID NO: 264823 - DNA, 75 bp, Artificial Sequence
  Synthetic
gaatagtcaactttggttcaggctggggattttgggtctcccccagtctgttcataacatcaacccatgtcatac

SEQ ID NO: 264824 - DNA, 75 bp, Artificial Sequence
  Synthetic
agagtgtgatatagtttggaacactagggtgtactcagtcaagagtgacgggagcaatgtcataattaaagaaaa

SEQ ID NO: 264825 - DNA, 75 bp, Artificial Sequence
  Synthetic
acaagtggaaaacacagaggagactaccagcaaggacgggtgtccaaaacccaaagatgatgaagagttcgtcat

SEQ ID NO: 264826 - DNA, 75 bp, Artificial Sequence
  Synthetic
agctcttgcgtatgcctcctgtctgcaaagtgcggtgctgtcaatactccaggtggccggctctgccttagtggt

SEQ ID NO: 264827 - DNA, 75 bp, Artificial Sequence
  Synthetic
tcgtgacccaagggtaaaaggtggaccttccctacaacaagtcctgcgtgatcagttgaaaccatttgccgagcc

SEQ ID NO: 264828 - DNA, 75 bp, Artificial Sequence
  Synthetic
caaagtgcggtgctgtcaatactccaggtggccggctctgccttagtggtgagcagggccgtaaaacgtatgttt

SEQ ID NO: 264829 - DNA, 75 bp, Artificial Sequence
  Synthetic
aaaactcaaggaatacgggttgaaaccgacccgccctgacaagactgagggaccccttgttatctctgaagacct

SEQ ID NO: 264830 - DNA, 75 bp, Artificial Sequence
  Synthetic
tccaacgccaagagcatggacctgggtactacaccaggtgattgtggctgcccctatatctacaagagaggtaat

SEQ ID NO: 264831 - DNA, 75 bp, Artificial Sequence
  Synthetic
gccggccacggccctattggtcatgatggaatcattgaacgttatggtctgtgtgagagtgagcaagaaggggaa

SEQ ID NO: 264832 - DNA, 75 bp, Artificial Sequence
  Synthetic
aatactcagacaaatgtattggactaggggccccaaccatgaagacccatctgaaacaatgataccacactccca

SEQ ID NO: 264833 - DNA, 75 bp, Artificial Sequence
  Synthetic
aatggaacttcatttgttggggagcttggagaacaggcggcacatgccaacaacatgtttgaattgggcaagtct

SEQ ID NO: 264834 - DNA, 75 bp, Artificial Sequence
  Synthetic
cggctgccgcacgtggggggaacactgtcatatgtgccacccaggggagtgaaggagaggctacacttgaaggtg

SEQ ID NO: 264835 - DNA, 75 bp, Artificial Sequence
  Synthetic
accgtgacccgcgacccagcaggctggtttggaaagttggaacagagttcaatactcagacaaatgtattggact

SEQ ID NO: 264836 - DNA, 75 bp, Artificial Sequence
  Synthetic
atggaatcattgaacgttatggtctgtgtgagagtgagcaagaaggggaagatgaccatactgtggagctgccca

SEQ ID NO: 264837 - DNA, 75 bp, Artificial Sequence
  Synthetic
ctaggcgtggacttagtgatgaagaatatgaggagtacaagaaagtaagagaagagaagggtggtaactacagca

SEQ ID NO: 264838 - DNA, 75 bp, Artificial Sequence
  Synthetic
atatgaggagtacaagaaagtaagagaagagaagggtggtaactacagcatacaagagtaccttgaggatcgcca

SEQ ID NO: 264839 - DNA, 75 bp, Artificial Sequence
  Synthetic
ccaccgggtcttctataaatcaaagtctggcatgagaaaacaacggcaagaggaacgccgccagttgggccttgt

SEQ ID NO: 264840 - DNA, 75 bp, Artificial Sequence
  Synthetic
tctggcatgagaaaacaacggcaagaggaacgccgccagttgggccttgtgagcggcactgaaatccgtaagcgt

SEQ ID NO: 264841 - DNA, 75 bp, Artificial Sequence
  Synthetic
atgcagattactcggcctgggattccacacaaaatagacagatcatgactgagtcctttgcaatcatgtgccgcc

SEQ ID NO: 264842 - DNA, 75 bp, Artificial Sequence
  Synthetic
cacacaaaatagacagatcatgactgagtcctttgcaatcatgtgccgccttacggcatcaccagaattggcctc

SEQ ID NO: 264843 - DNA, 75 bp, Artificial Sequence
  Synthetic
agctttgaagcccctccttcaatttggagtagagtagtcaaatttggcagtggctggggcttctgggtaagttca

SEQ ID NO: 264844 - DNA, 75 bp, Artificial Sequence
  Synthetic
ggagtagagtagtcaaatttggcagtggctggggcttctgggtaagttcaacagtgttcatcactacaacacatg

SEQ ID NO: 264845 - DNA, 75 bp, Artificial Sequence
  Synthetic
gccatcaggatttccttgcacttcacaggtgaacagtataaaccattggctaatcacattgtgtgctatgtctga

SEQ ID NO: 264846 - DNA, 75 bp, Artificial Sequence
  Synthetic
caggtgaacagtataaaccattggctaatcacattgtgtgctatgtctgaagtcacaggcctgtcacctgatgtc

SEQ ID NO: 264847 - DNA, 75 bp, Artificial Sequence
  Synthetic
cccaattccgtttctctaagaaaatgaggcctgatctctctggtatggtccttgaagaggggtgccctgaaggca

SEQ ID NO: 264848 - DNA, 75 bp, Artificial Sequence
  Synthetic
gaggcctgatctctctggtatggtccttgaagaggggtgccctgaaggcacagtgtgcaccataatgataaaaag

SEQ ID NO: 264849 - DNA, 75 bp, Artificial Sequence
  Synthetic
tatgttcccccacataatagtagatgttaggcaattggaacctgtgttgatccccttacctgatgttaggaataa

SEQ ID NO: 264850 - DNA, 75 bp, Artificial Sequence
  Synthetic
cgcctcactcaagtgcttaaggaatatggattgagacccacccggccagacaaatcagaaggacccattatactt

SEQ ID NO: 264851 - DNA, 75 bp, Artificial Sequence
  Synthetic
atggattgagacccacccggccagacaaatcagaaggacccattatacttagaagacaggtagatggtctcgttt

SEQ ID NO: 264852 - DNA, 75 bp, Artificial Sequence
  Synthetic
atgaatatgaatgaggatggccccatcatcttcgagaggcattccaggtacacatatcactatgatgctgattac

SEQ ID NO: 264853 - DNA, 75 bp, Artificial Sequence
  Synthetic
cacatatcactatgatgctgattactctcgatgggattcaacacaacagagagccgtgttggcagcagctctaga

SEQ ID NO: 264854 - DNA, 75 bp, Artificial Sequence
  Synthetic
gcacgggcaatcaggaatgttgctcactggtgctaatgccaagggcatggaccttgggaccatacctggggactg

SEQ ID NO: 264855 - DNA, 75 bp, Artificial Sequence
  Synthetic
tctggtggactcgaggccctaaccatgatgatcctagtgagactttaatcccacaccctcagaggaaagttcagc

SEQ ID NO: 264856 - DNA, 75 bp, Artificial Sequence
  Synthetic
gtactgggcccctgatgctaggactacaacatacaatgcaggccgcttttccacccctcaaccttcgggggcact

SEQ ID NO: 264857 - DNA, 75 bp, Artificial Sequence
  Synthetic
actggtgctaatgccaagggcatggaccttgggaccatacctggggactgtggagcgccttacatccataagaga

SEQ ID NO: 264858 - DNA, 75 bp, Artificial Sequence
  Synthetic
tgatgatcctagtgagactttaatcccacaccctcagaggaaagttcagcttatatccctccttggcgaggcttc

SEQ ID NO: 264859 - DNA, 75 bp, Artificial Sequence
  Synthetic
ggtggtgaaggtgaagccacgctagagggtggcgatcaaaataagggacactatgcaggacacccaatattaaga

SEQ ID NO: 264860 - DNA, 75 bp, Artificial Sequence
  Synthetic
agggtggcgatcaaaataagggacactatgcaggacacccaatattaagatatggaaatggtccttcactgtcga

SEQ ID NO: 264861 - DNA, 75 bp, Artificial Sequence
  Synthetic
cctttgtcgtccaaccacaaaatggcaggtgcacgactgatggcgtgctcttaggcactacccaactgtcccccg

SEQ ID NO: 264862 - DNA, 75 bp, Artificial Sequence
  Synthetic
gagaccccagagttgaaggcggtccatctttgcagcaggtgttgcgagaccagctgaagccatttgctgaacccc

SEQ ID NO: 264863 - DNA, 75 bp, Artificial Sequence
  Synthetic
atctttgcagcaggtgttgcgagaccagctgaagccatttgctgaaccccgtggcaggttgcccgaagcaggatt

SEQ ID NO: 264864 - DNA, 75 bp, Artificial Sequence
  Synthetic
agaagaaattccagcccctctgggaactccagatttcgtgggaaagatccaaggcatgctcacccaaaccacaaa

SEQ ID NO: 264865 - DNA, 75 bp, Artificial Sequence
  Synthetic
cgacgcctgcatgtccttagataaaacaaccagttctggctacccccatcacaaaaggaagaatgatgattggaa

SEQ ID NO: 264866 - DNA, 75 bp, Artificial Sequence
  Synthetic
ctgaaacaatgattccacactcccaaagacccatacaattgatgtccctactgggggaggccgcactccacggcc

SEQ ID NO: 264867 - DNA, 75 bp, Artificial Sequence
  Synthetic
cgttcagttcgccactgatacagacaatgattttgaaactggccaaaacacaaggttcaccccagtcggtgtcat

SEQ ID NO: 264868 - DNA, 75 bp, Artificial Sequence
  Synthetic
cccacctttctcagatgtataatggttgggtgggcaacatgcgagtgcgtgttgtcttggctggtaatgctttca

SEQ ID NO: 264869 - DNA, 75 bp, Artificial Sequence
  Synthetic
cagcattttacagcaaaatcagcaaattagtcattgcagagctaaaagaaggtggcatggatttttacgtgccca

SEQ ID NO: 264870 - DNA, 75 bp, Artificial Sequence
  Synthetic
aatgattttgaaactggccaaaacacaaggttcaccccagtcggtgtcatccaggatggtagtagtgcccacaga

SEQ ID NO: 264871 - DNA, 75 bp, Artificial Sequence
  Synthetic
acaaccagttctggctacccccatcacaaaaggaagaatgatgattggaatgggagttcatttgtgagagaattg

SEQ ID NO: 264872 - DNA, 75 bp, Artificial Sequence
  Synthetic
aaggatgaactcgtcaaaccagacaaggtgtacaataaaatcaagaaaagactactctggggggcggatcttggc

SEQ ID NO: 264873 - DNA, 75 bp, Artificial Sequence
  Synthetic
gcccccacttttccgggtgagcaacttcttttcttcagatctactatgcccggatgcagtgggtatcccaatatg

SEQ ID NO: 264874 - DNA, 75 bp, Artificial Sequence
  Synthetic
aggtgtacaataaaatcaagaaaagactactctggggggcggatcttggcactgtcatccgtgccgctagggctt

SEQ ID NO: 264875 - DNA, 75 bp, Artificial Sequence
  Synthetic
gatttggattgtctactcccccaggaatgggtacagcacttctaccaagaggcagccccatcacaatctgacgtg

SEQ ID NO: 264876 - DNA, 75 bp, Artificial Sequence
  Synthetic
atggccccttaatttatgcagaacattccaagtataagtatcactttgatgctgactacacagcatgggattcaa

SEQ ID NO: 264877 - DNA, 75 bp, Artificial Sequence
  Synthetic
ggtggctgggcgtgtactcacttgtccgggccctgactttaacttcttattcctagtccctcccacagtcgagca

SEQ ID NO: 264878 - DNA, 75 bp, Artificial Sequence
  Synthetic
ttccaagtataagtatcactttgatgctgactacacagcatgggattcaacacaaaacagggagatcatgatgga

SEQ ID NO: 264879 - DNA, 75 bp, Artificial Sequence
  Synthetic
ccgggccctgactttaacttcttattcctagtccctcccacagtcgagcaaaagacccgcccttttactgtgcct

SEQ ID NO: 264880 - DNA, 75 bp, Artificial Sequence
  Synthetic
ttctgaaatggacgtcggtgattatgtgatcagtgtcaaagatggtctaccatctggttttccatgtacctcaca

SEQ ID NO: 264881 - DNA, 75 bp, Artificial Sequence
  Synthetic
gtgatcagtgtcaaagatggtctaccatctggttttccatgtacctcacaagtaaacagcatcaaccattggatc

SEQ ID NO: 264882 - DNA, 75 bp, Artificial Sequence
  Synthetic
gtaggtgtacaattgacggtcaaccccttgggaccacacctgtctcagttagtcagttatgtaagtttaggggta

SEQ ID NO: 264883 - DNA, 75 bp, Artificial Sequence
  Synthetic
tatggtgatgatgaaatagtttcaacagatattgaatttgactcaaacagactaacacaggtattaaaagagtat

SEQ ID NO: 264884 - DNA, 75 bp, Artificial Sequence
  Synthetic
cccctgcgggctttccagatcttgggtcctgtgattggcatattgaaatgagtaaaatcccaaattccagcaccc

SEQ ID NO: 264885 - DNA, 75 bp, Artificial Sequence
  Synthetic
cagatattgaatttgactcaaacagactaacacaggtattaaaagagtatggcctaaaacccacaagacctgata

SEQ ID NO: 264886 - DNA, 75 bp, Artificial Sequence
  Synthetic
gtcctgtgattggcatattgaaatgagtaaaatcccaaattccagcacccagaacaacccaatagtgaccaattc

SEQ ID NO: 264887 - DNA, 75 bp, Artificial Sequence
  Synthetic
ccatcgggtaccagggtcggcttgaccgtaattccattgaaagacagctctggtggacccggggacccaatcacg

SEQ ID NO: 264888 - DNA, 75 bp, Artificial Sequence
  Synthetic
tgactatattggcactatacaatggacctcacctccttctgattctggcggggccaatacaaatttttggaaaat

SEQ ID NO: 264889 - DNA, 75 bp, Artificial Sequence
  Synthetic
acaacatacaatgcaggccgtttttccacccctcaaccttcgggggcactgccaggaagaactaatcccagggct

SEQ ID NO: 264890 - DNA, 75 bp, Artificial Sequence
  Synthetic
acctcacctccttctgattctggcggggccaatacaaatttttggaaaatccctgactatgggtccagcctagca

SEQ ID NO: 264891 - DNA, 75 bp, Artificial Sequence
  Synthetic
tccatggtgagaaattctatagaaagatagctagtagggtgatccaggaggtcaaagaaggaggattggaaattt

SEQ ID NO: 264892 - DNA, 75 bp, Artificial Sequence
  Synthetic
cctggtcccaatcagtctgggtctcctaatttagtgccatgcctgctcccccaggaatatataacacactttatt

SEQ ID NO: 264893 - DNA, 75 bp, Artificial Sequence
  Synthetic
ccaggaatatataacacactttattagtgagcaggcccccatccagggtgaggctgccttactccactatgtaga

SEQ ID NO: 264894 - DNA, 75 bp, Artificial Sequence
  Synthetic
actgctggacaaattaatatgattgacccctggataatgagtaattttgtgcaagccccacaaggggaattcact

SEQ ID NO: 264895 - DNA, 75 bp, Artificial Sequence
  Synthetic
acccctggataatgagtaattttgtgcaagccccacaaggggaattcactgtctcacctaataacacccctggag

SEQ ID NO: 264896 - DNA, 75 bp, Artificial Sequence
  Synthetic
gcgcccttggtgctggcatccaggctggtgctgaagctgcgttgcaggcacagagatatcaacaagatctgactt

SEQ ID NO: 264897 - DNA, 75 bp, Artificial Sequence
  Synthetic
tggtgctgaagctgcgttgcaggcacagagatatcaacaagatctgactttgcagcaaaattcttttaatcatga

SEQ ID NO: 264898 - DNA, 75 bp, Artificial Sequence
  Synthetic
gggtaggcaatatgcgtgtgaaggtgctgcttgctggcaacgcttttactgcagggaaaataataattagctgca

SEQ ID NO: 264899 - DNA, 75 bp, Artificial Sequence
  Synthetic
gctgcttgctggcaacgcttttactgcagggaaaataataattagctgcatacccccaggttttacctcccaaaa

SEQ ID NO: 264900 - DNA, 75 bp, Artificial Sequence
  Synthetic
tgctgaaaacaaatacgggttgatggacacaatgaaagttgggagacagctcaaggatgtcaaaaccatgccaga

SEQ ID NO: 264901 - DNA, 75 bp, Artificial Sequence
  Synthetic
tctccaggcgggtggcctctcatcctctgatgcggctagggctgtagccggggcccccgtcactaggttggtcga

SEQ ID NO: 264902 - DNA, 75 bp, Artificial Sequence
  Synthetic
ccttgaggatgtgaggaatgtgctgtttcacaccaatgacaaccgcccaacaatgaggcttgtatgcatgttgta

SEQ ID NO: 264903 - DNA, 75 bp, Artificial Sequence
  Synthetic
tttcacaccaatgacaaccgcccaacaatgaggcttgtatgcatgttgtatacccccttgcgagccaatggcagt

SEQ ID NO: 264904 - DNA, 75 bp, Artificial Sequence
  Synthetic
actcccagctcagccaaaacagaagccccttgccagtgaaggttattctaaccctgcttatgaccctgtgcaacg

SEQ ID NO: 264905 - DNA, 75 bp, Artificial Sequence
  Synthetic
ttagtaccccctaatgtagaacaaaagactagaccttttagtgttcccaatatacctctgaatacattgtcaaat

SEQ ID NO: 264906 - DNA, 75 bp, Artificial Sequence
  Synthetic
agactagaccttttagtgttcccaatatacctctgaatacattgtcaaattcaagggtaccatcattgatcaagt

SEQ ID NO: 264907 - DNA, 75 bp, Artificial Sequence
  Synthetic
ggaccagtgacctaccacccaaacagcagagagaccgtccccccaggacccaggaggaagttcagtatggtttgg

SEQ ID NO: 264908 - DNA, 75 bp, Artificial Sequence
  Synthetic
agggcaccacacccacatcagtgagccagttgtgtaaaattagaggcactacataccacgcaactggaggtaatg

SEQ ID NO: 264909 - DNA, 75 bp, Artificial Sequence
  Synthetic
cgttaatgttgtaataagattagtgagcatcctattcaatttttggctttatataatttggttataattggcttt

SEQ ID NO: 264910 - DNA, 75 bp, Artificial Sequence
  Synthetic
ccagttgtgtaaaattagaggcactacataccacgcaactggaggtaatgggataaatttaacagagttgaatgg

SEQ ID NO: 264911 - DNA, 75 bp, Artificial Sequence
  Synthetic
gcagagagaccgtccccccaggacccaggaggaagttcagtatggtttggggtggactgaaaggcccatggacca

SEQ ID NO: 264912 - DNA, 75 bp, Artificial Sequence
  Synthetic
tgccggcggcttaggcccatgcacaatgccctcaacttgtgaacaagccaaagatgacagcccacctggtgaaca

SEQ ID NO: 264913 - DNA, 75 bp, Artificial Sequence
  Synthetic
agcaacccccacgcaggctttcaatgatggagcgaaggtcgtgcgcctgtcagtcacccagggcgcagcctttgc

SEQ ID NO: 264914 - DNA, 75 bp, Artificial Sequence
  Synthetic
gatggagcgaaggtcgtgcgcctgtcagtcacccagggcgcagcctttgcaccacacctgggtaccatacattac

SEQ ID NO: 264915 - DNA, 75 bp, Artificial Sequence
  Synthetic
atgccctcaacttgtgaacaagccaaagatgacagcccacctggtgaacaggtcaaatggtcagtgcgtgatgga

SEQ ID NO: 264916 - DNA, 75 bp, Artificial Sequence
  Synthetic
ctaaggaatatggagccagctagtgaacccaccattggagacatgatagagttttatgaaggccatatctatcac

SEQ ID NO: 264917 - DNA, 75 bp, Artificial Sequence
  Synthetic
cagagtaatgttgacccttggcagataccaacttatgggtcgactttaactgaagccgctcagttggcgcctccc

SEQ ID NO: 264918 - DNA, 75 bp, Artificial Sequence
  Synthetic
taccaacttatgggtcgactttaactgaagccgctcagttggcgcctcccatctttccccctgggtttggagaaa

SEQ ID NO: 264919 - DNA, 75 bp, Artificial Sequence
  Synthetic
aacccaccattggagacatgatagagttttatgaaggccatatctatcactactccatatacattgggcagggta

SEQ ID NO: 264920 - DNA, 75 bp, Artificial Sequence
  Synthetic
ggagggtttgttatataccccaacctaaacataggttgagttatgatcaactcaaagaattggaaaatgaacctt

SEQ ID NO: 264921 - DNA, 75 bp, Artificial Sequence
  Synthetic
aggaatttgtcacccattttgtgaatgaacaggccccaatcagaggagaggccgccctcttacattatgttgatc

SEQ ID NO: 264922 - DNA, 75 bp, Artificial Sequence
  Synthetic
tgaacaggccccaatcagaggagaggccgccctcttacattatgttgatcctgacactcatcgtaatcttggaga

SEQ ID NO: 264923 - DNA, 75 bp, Artificial Sequence
  Synthetic
taaacataggttgagttatgatcaactcaaagaattggaaaatgaaccttggccatatgcagctatcaccaacaa

SEQ ID NO: 264924 - DNA, 75 bp, Artificial Sequence
  Synthetic
atttcatcacccatcccagtcttggtcacagcaaacccctgaatttcagcaggatagcaagctggaactagttag

SEQ ID NO: 264925 - DNA, 75 bp, Artificial Sequence
  Synthetic
caatggagtctttgtctttgtttcttgggtctctcgcttttaccagttgaagcctgtgggaacagccggtgcggc

SEQ ID NO: 264926 - DNA, 75 bp, Artificial Sequence
  Synthetic
tgggtctctcgcttttaccagttgaagcctgtgggaacagccggtgcggctcgtaggcttggaatcaggagatca

SEQ ID NO: 264927 - DNA, 75 bp, Artificial Sequence
  Synthetic
tcacagcaaacccctgaatttcagcaggatagcaagctggaactagttagggatgctatattggccgcagtgaat

SEQ ID NO: 264928 - DNA, 75 bp, Artificial Sequence
  Synthetic
tgtgactggacttttatgggggtggtagagatggttatactgctccttgagctctttggcgtgttctggaacccg

SEQ ID NO: 264929 - DNA, 75 bp, Artificial Sequence
  Synthetic
gcactgaagctgcactgcaacatcagcgctttcaacaagacttgactctacaaagtaacacattcaaacatgata

SEQ ID NO: 264930 - DNA, 75 bp, Artificial Sequence
  Synthetic
gcgctttcaacaagacttgactctacaaagtaacacattcaaacatgataaggagatgttggctatgcaggtgga

SEQ ID NO: 264931 - DNA, 75 bp, Artificial Sequence
  Synthetic
tagagatggttatactgctccttgagctctttggcgtgttctggaacccgcccgatgtatccaattttatagcgt

SEQ ID NO: 264932 - DNA, 75 bp, Artificial Sequence
  Synthetic
tagggctagccattgggttcaccagagacaaggtcactaaggtcatgaagagtgccgtagatggcctccgggccg

SEQ ID NO: 264933 - DNA, 75 bp, Artificial Sequence
  Synthetic
agatgccgccagagcagtggcgggggcccccgtcactcgtgtggtggactggaatggcactcgcatcgccgctcc

SEQ ID NO: 264934 - DNA, 75 bp, Artificial Sequence
  Synthetic
gcccccgtcactcgtgtggtggactggaatggcactcgcatcgccgctccactatcaactgccaccactctccgc

SEQ ID NO: 264935 - DNA, 75 bp, Artificial Sequence
  Synthetic
agacaaggtcactaaggtcatgaagagtgccgtagatggcctccgggccgctacgcagttgggacagtatgggtt

SEQ ID NO: 264936 - DNA, 75 bp, Artificial Sequence
  Synthetic
ttcagtgttcccccactcaaccagagggagaacagggacgccaaggagccgctaaccggaacaatcctggaaatg

SEQ ID NO: 264937 - DNA, 75 bp, Artificial Sequence
  Synthetic
agcagtaatagacatggaggtgttgtcctccacatcagtgacacagctggtgagagacaagcaggcagccaaggc

SEQ ID NO: 264938 - DNA, 75 bp, Artificial Sequence
  Synthetic
aaccccaattacgagactggttcatctgtgtcgcgcacatcgcaatgggtttcctcacaaaactcaatgcggtct

SEQ ID NO: 264939 - DNA, 75 bp, Artificial Sequence
  Synthetic
tcctccacatcagtgacacagctggtgagagacaagcaggcagccaaggcttacatgaacattctggataatgaa

SEQ ID NO: 264940 - DNA, 75 bp, Artificial Sequence
  Synthetic
gtctgtatgtggagcgaggtcttgtacttggtgtgcacaaaccaccagctgccatcagcctcgccaaggttgaac

SEQ ID NO: 264941 - DNA, 75 bp, Artificial Sequence
  Synthetic
cgtatagctatggcgcggtccgcattggccaaggctcaagctgaaatgaccagtcgaatgaggccagtcgtcatt

SEQ ID NO: 264942 - DNA, 75 bp, Artificial Sequence
  Synthetic
gtttcttcagcttcatctatacctagattctttaatactgaaagattacccttgttcgcaaacaataagaggtga

SEQ ID NO: 264943 - DNA, 75 bp, Artificial Sequence
  Synthetic
tgcatggagagtcgttcccctacacagcctttgacaacaactgctatgccttctgttgttgggttctggacctaa

SEQ ID NO: 264944 - DNA, 75 bp, Artificial Sequence
  Synthetic
tggccaaggctcaagctgaaatgaccagtcgaatgaggccagtcgtcattatgatgtgtggcccccctgggattg

SEQ ID NO: 264945 - DNA, 75 bp, Artificial Sequence
  Synthetic
ggatggctatcatggtgaggaagtgatgctatgggatgattatggtatgacaaaaatacaagatgactgcaataa

SEQ ID NO: 264946 - DNA, 75 bp, Artificial Sequence
  Synthetic
ggagttttctggacacccccagatgtgtctgcgatgatcgcccccttactaggtgactacgaactgcaggggcct

SEQ ID NO: 264947 - DNA, 75 bp, Artificial Sequence
  Synthetic
gtgtccctccactcaatcagagggagaatagggatgctaaggagccactgactggaacaattctggaaatgtggg

SEQ ID NO: 264948 - DNA, 75 bp, Artificial Sequence
  Synthetic
aggtgactacgaactgcaggggcctgaggaccttgcagtggaactcgtaccagtagtgatgggggggattggttt

SEQ ID NO: 264949 - DNA, 75 bp, Artificial Sequence
  Synthetic
ggtgctaggattcaccaaagagaagatcggaaaaatgttgtcatctgctgcatccaccttaagagcttgtaaaga

SEQ ID NO: 264950 - DNA, 75 bp, Artificial Sequence
  Synthetic
gtcagatgcaatagtcatcactaccaatgccccagggcccgcccctgtggacttcatcaatcttggccccgtgtg

SEQ ID NO: 264951 - DNA, 75 bp, Artificial Sequence
  Synthetic
aatgccccagggcccgcccctgtggacttcatcaatcttggccccgtgtgcagacgggttgatttcctggtttac

SEQ ID NO: 264952 - DNA, 75 bp, Artificial Sequence
  Synthetic
gctggctatggtgaggtccatcgaggatgcggtgctggacctcgaagcaattgagaacaaccacatgactgccct

SEQ ID NO: 264953 - DNA, 75 bp, Artificial Sequence
  Synthetic
ccagacttctcccatctgaagatggatttggccccacaaggagggtttgacaaccagggaaacacaccatttggc

SEQ ID NO: 264954 - DNA, 75 bp, Artificial Sequence
  Synthetic
atttggccccacaaggagggtttgacaaccagggaaacacaccatttggcaagggcgttatgaagccaacaacca

SEQ ID NO: 264955 - DNA, 75 bp, Artificial Sequence
  Synthetic
gtgggcacaatcaacgctctcctggcgagaatcgccgctgcacgttccctggtgcatcgggcgaaagaggaactc

SEQ ID NO: 264956 - DNA, 75 bp, Artificial Sequence
  Synthetic
atgacttcgacgatgatcgagtgtcagcattcaccaccatggcacgcgacaacgggttgggcatcttgagcatgg

SEQ ID NO: 264957 - DNA, 75 bp, Artificial Sequence
  Synthetic
agcattcaccaccatggcacgcgacaacgggttgggcatcttgagcatggcgggcttaggcaagaagctgcgcgg

SEQ ID NO: 264958 - DNA, 75 bp, Artificial Sequence
  Synthetic
catccctcgcaatggcgttgatcactgggatgcatataagggggaaagagtcgtcctatgggacgattatggaat

SEQ ID NO: 264959 - DNA, 75 bp, Artificial Sequence
  Synthetic
caaggtgtattcactagaatcagatggtaacaatgttaacatcagagaggagaaaaacgttctaacccaacaaca

SEQ ID NO: 264960 - DNA, 75 bp, Artificial Sequence
  Synthetic
ggtaacaatgttaacatcagagaggagaaaaacgttctaacccaacaacaacagtcagtgtgcgctgcttccatc

SEQ ID NO: 264961 - DNA, 75 bp, Artificial Sequence
  Synthetic
caaattgctgcctcggctcttgtggtcaacagggctgtgaaaagaatgtttggcacacgcactgctgctctgtcc

SEQ ID NO: 264962 - DNA, 75 bp, Artificial Sequence
  Synthetic
tcaacagggctgtgaaaagaatgtttggcacacgcactgctgctctgtccttagagggcccccccaaggaacaca

SEQ ID NO: 264963 - DNA, 75 bp, Artificial Sequence
  Synthetic
tgtgtgagactgaggaggacgaagaagtggtccacactgagatgccatctgccaccatagaaggcaagaacaaag

SEQ ID NO: 264964 - DNA, 75 bp, Artificial Sequence
  Synthetic
ttgctgccgaaaacaagtacggattgttggacacaatgagagttggaaaacagctcaaggatgtcaagaccatgc

SEQ ID NO: 264965 - DNA, 75 bp, Artificial Sequence
  Synthetic
agtggtccacactgagatgccatctgccaccatagaaggcaagaacaaaggaaagaacaagaaggggcgtggccg

SEQ ID NO: 264966 - DNA, 75 bp, Artificial Sequence
  Synthetic
agagaagggtggcaactacagcatccaggagtacctagaggataggcaaaggtacgaagaggagcttgcagaggt

SEQ ID NO: 264967 - DNA, 75 bp, Artificial Sequence
  Synthetic
caggagtacctagaggataggcaaaggtacgaagaggagcttgcagaggtccaggcaggtggagacggaggaatc

SEQ ID NO: 264968 - DNA, 75 bp, Artificial Sequence
  Synthetic
cgccaactggggttagtcacaggttccgacattcgaaaaaggaaaccaatcgattggaccccccctaagtcagca

SEQ ID NO: 264969 - DNA, 75 bp, Artificial Sequence
  Synthetic
ttgtctcatccgatgacatcaaaaccgagggcaagaaagggaagaacaagtctggccgtggtaagaagcacacag

SEQ ID NO: 264970 - DNA, 75 bp, Artificial Sequence
  Synthetic
agcgccccccaccttgtggagccgggtcacaaagtttggatctggatggggcttctgggttagccccacagtctt

SEQ ID NO: 264971 - DNA, 75 bp, Artificial Sequence
  Synthetic
ctaggattcaccaaagagaagattggaaaaatgttgtcatctgctgcatccaccttgagagcttgtaaagacctt

SEQ ID NO: 264972 - DNA, 75 bp, Artificial Sequence
  Synthetic
aggttttctaagaagatcaggcccgatctcacgggcatgatccttgaggaaggttgtccagaaggcacggtgtgc

SEQ ID NO: 264973 - DNA, 75 bp, Artificial Sequence
  Synthetic
ctgtgaagaggaggaggccaagatccggcaaaggatcttcaggccaacaaggaaacaacgcaaggaagaaagagc

SEQ ID NO: 264974 - DNA, 75 bp, Artificial Sequence
  Synthetic
atacagggtcgccttgtccatgggcagtctggtatgttgctcactggggctaatgctaagggcatggaccttggg

SEQ ID NO: 264975 - DNA, 75 bp, Artificial Sequence
  Synthetic
agtctggtatgttgctcactggggctaatgctaagggcatggaccttgggaccatcccaggggattgtggagctc

SEQ ID NO: 264976 - DNA, 75 bp, Artificial Sequence
  Synthetic
tagtgtgcgccgtccaagccagtgagggggaaaccacgcttgaaggaggtgacaaaggccactatgccggacatg

SEQ ID NO: 264977 - DNA, 75 bp, Artificial Sequence
  Synthetic
agccctatcaaccaaaacaaaattctggaaatcatctcctgaaccactgccccctggggtctacgagcccgcata

SEQ ID NO: 264978 - DNA, 75 bp, Artificial Sequence
  Synthetic
agaatgggaacccatgcaaccatgaggattcaagggcgcactgttggaggtcaaatgggcatgcttctaacagga

SEQ ID NO: 264979 - DNA, 75 bp, Artificial Sequence
  Synthetic
gaaccaggtctcttggaggccgcagttgagactgtgacctcatcactagagcaggttatggacaccccagtgccg

SEQ ID NO: 264980 - DNA, 75 bp, Artificial Sequence
  Synthetic
gtgacagcaaggggacctactgcggtgcaccaatcttaggtccaggaagtgccccaaagctcagcaccaagacta

SEQ ID NO: 264981 - DNA, 75 bp, Artificial Sequence
  Synthetic
aattctggaggtcatccacggcaccactcccacctggtacctatgagccagcctacctcggcggcaaggacccca

SEQ ID NO: 264982 - DNA, 75 bp, Artificial Sequence
  Synthetic
gatgactggaatggcaccgccttcattagggaactaggagaacaagcagcgcacgctaacaacatgtatgaacaa

SEQ ID NO: 264983 - DNA, 75 bp, Artificial Sequence
  Synthetic
ttagggaactaggagaacaagcagcgcacgctaacaacatgtatgaacaagccaaaagcatgaagcctatgtaca

SEQ ID NO: 264984 - DNA, 75 bp, Artificial Sequence
  Synthetic
cgccctgcaccatctaaggtgcgccagaatcaggtattatgttaagtgtgttcaggaggccctgtattctatcat

SEQ ID NO: 264985 - DNA, 75 bp, Artificial Sequence
  Synthetic
cggacctaggaacagtgatccgggctgcacgagcttttggcccattttgtgatgccataaagtctcacacaatca

SEQ ID NO: 264986 - DNA, 75 bp, Artificial Sequence
  Synthetic
ccttgtcatctctgaagacttgaatggcctaactttcctgcggagaactgtgacccgcgacccagctggttggtt

SEQ ID NO: 264987 - DNA, 75 bp, Artificial Sequence
  Synthetic
tgcacgagcttttggcccattttgtgatgccataaagtctcacacaatcaaactacctatcaaagttgggatgaa

SEQ ID NO: 264988 - DNA, 75 bp, Artificial Sequence
  Synthetic
ttgggattcgacacaaaacaggcaaattatgacagagtcattctccatcatgtgccgtttgactgcttctccaga

SEQ ID NO: 264989 - DNA, 75 bp, Artificial Sequence
  Synthetic
attatgacagagtcattctccatcatgtgccgtttgactgcttctccagaattggcctcagtggtagcgcaagac

SEQ ID NO: 264990 - DNA, 75 bp, Artificial Sequence
  Synthetic
tgtacatcacaggtcaatagcataaatcactggttaataaccttatgtgccctctctgaagtgactggtctatca

SEQ ID NO: 264991 - DNA, 75 bp, Artificial Sequence
  Synthetic
acttcaagcccaaggggaaactatgggctgacgatgacagaagtgtggactacaatgaaaaactcagttttgagg

SEQ ID NO: 264992 - DNA, 75 bp, Artificial Sequence
  Synthetic
atcactggttaataaccttatgtgccctctctgaagtgactggtctatcaccagatgttattcagtccatgtcat

SEQ ID NO: 264993 - DNA, 75 bp, Artificial Sequence
  Synthetic
gtgcgcccgaaggcaccgtggtcacactactcatcaaaaggcctactggagaactcatgcccctagcagctagaa

SEQ ID NO: 264994 - DNA, 75 bp, Artificial Sequence
  Synthetic
gaactcatgcccctagcagctagaatgggaacccacgcaaccatgaaaattcaagggcgcactgttggaggtcag

SEQ ID NO: 264995 - DNA, 75 bp, Artificial Sequence
  Synthetic
cggggaggatgaactagtggtttcttatagtgtcaaagatggcgtttccggtctgcctgagctttccactgtcag

SEQ ID NO: 264996 - DNA, 75 bp, Artificial Sequence
  Synthetic
tcaaagaatacggcctcaaacctacccgacctgataagagcgaaggtccaataattgtaagaaagaatgtggatg

SEQ ID NO: 264997 - DNA, 75 bp, Artificial Sequence
  Synthetic
tgccctgcacctcccaatggaattccatcgcccactggctcctcactctctgtgcactctctgaggttacaaacc

SEQ ID NO: 264998 - DNA, 75 bp, Artificial Sequence
  Synthetic
aaaggcagatctattggaccagagggcccaaccactcagacccttttgaaaccttagtgccccaccagcaaagaa

SEQ ID NO: 264999 - DNA, 75 bp, Artificial Sequence
  Synthetic
aattggacccagaaaaactgacagcaaaactcaaggaatacgggttgaaaccgacccgccctgacaagactgaag

SEQ ID NO: 265000 - DNA, 75 bp, Artificial Sequence
  Synthetic
gatggcgtctaatgacgctaccactgcctttggcagccaaaactctgtcaatgacagtatcaacaccgccccttc

SEQ ID NO: 265001 - DNA, 75 bp, Artificial Sequence
  Synthetic
atgacagtatcaacaccgccccttctaataaagaagaggctggtgcattctccaacatcaaagttggttttaaga

SEQ ID NO: 265002 - DNA, 75 bp, Artificial Sequence
  Synthetic
atgacagtatcaacaccgccccttcttataaagaagaggctggtgcattctccaacatcaaagttggttttaaga

SEQ ID NO: 265003 - DNA, 75 bp, Artificial Sequence
  Synthetic
atgacagtatcaacaccgccccttctcataaagaagaggctggtgcattctccaacatcaaagttggttttaaga

SEQ ID NO: 265004 - DNA, 75 bp, Artificial Sequence
  Synthetic
atgacagtatcaacaccgccccttctgataaagaagaggctggtgcattctccaacatcaaagttggttttaaga

SEQ ID NO: 265005 - DNA, 75 bp, Artificial Sequence
  Synthetic
taataaagaagaggctggtgcattctccaacatcaaagttggttttaagaaaatactgggtgccgttcccaaggg

SEQ ID NO: 265006 - DNA, 75 bp, Artificial Sequence
  Synthetic
ttataaagaagaggctggtgcattctccaacatcaaagttggttttaagaaaatactgggtgccgttcccaaggg

SEQ ID NO: 265007 - DNA, 75 bp, Artificial Sequence
  Synthetic
tcataaagaagaggctggtgcattctccaacatcaaagttggttttaagaaaatactgggtgccgttcccaaggg

SEQ ID NO: 265008 - DNA, 75 bp, Artificial Sequence
  Synthetic
tgataaagaagaggctggtgcattctccaacatcaaagttggttttaagaaaatactgggtgccgttcccaaggg

SEQ ID NO: 265009 - DNA, 75 bp, Artificial Sequence
  Synthetic
gcccccaaatggtgaagacgccgtgcagtttgatgcgaagtcggaaactgtgcgtgggctaccagatttgacaac

SEQ ID NO: 265010 - DNA, 75 bp, Artificial Sequence
  Synthetic
cagtttgatgcgaagtcggaaactgtgcgtgggctaccagatttgacaacggtgcagaatgaacatgaaaacaca

SEQ ID NO: 265011 - DNA, 75 bp, Artificial Sequence
  Synthetic
atggaccctgttgcgggtgcttcaacagcagtcgcaacagctgggcaagttaatatgattgacccatggattttc

SEQ ID NO: 265012 - DNA, 75 bp, Artificial Sequence
  Synthetic
ggatgaactcaaagcacactgtgtcacacttcctgtcagagttggtatgaatatgaatgaggatggccccatcat

SEQ ID NO: 265013 - DNA, 75 bp, Artificial Sequence
  Synthetic
ttacaattaggaccccaccttaatccatttctagcccacctctcacaaatgtataatggttgggtcggcaatatg

SEQ ID NO: 265014 - DNA, 75 bp, Artificial Sequence
  Synthetic
atgtgggatggtgaattctaccattactccgtgtacgtcagcggtggcaaagccctaggggttcacaagccccct

SEQ ID NO: 265015 - DNA, 75 bp, Artificial Sequence
  Synthetic
attgatccctggattatgaataattttgtgcaagcacctggtggtgagtttacagtatcccctaggaattcccct

SEQ ID NO: 265016 - DNA, 75 bp, Artificial Sequence
  Synthetic
actccgtgtacgtcagcggtggcaaagccctaggggttcacaagccccctgcagcgataagcctcgcgacgatag

SEQ ID NO: 265017 - DNA, 75 bp, Artificial Sequence
  Synthetic
catttctagcccacctctcacaaatgtataatggttgggtcggcaatatgcgtgtacgtatattgttggcaggga

SEQ ID NO: 265018 - DNA, 75 bp, Artificial Sequence
  Synthetic
aagcaactctctttccacacttgattgctgatgttaggactcttgagcctgtggagctccctctggaggacgtgc

SEQ ID NO: 265019 - DNA, 75 bp, Artificial Sequence
  Synthetic
gcctcgctggtgagaagttaccctacacggccttcagcaacaactgttacaacttctgttgctgggtgcttgagc

SEQ ID NO: 265020 - DNA, 75 bp, Artificial Sequence
  Synthetic
gcctcgctggtgagaagtttccctacacggccttcagcaacaactgttacaacttctgttgctgggtgcttgagc

SEQ ID NO: 265021 - DNA, 75 bp, Artificial Sequence
  Synthetic
gcctcgctggtgagaagttcccctacacggccttcagcaacaactgttacaacttctgttgctgggtgcttgagc

SEQ ID NO: 265022 - DNA, 75 bp, Artificial Sequence
  Synthetic
gcctcgctggtgagaagttgccctacacggccttcagcaacaactgttacaacttctgttgctgggtgcttgagc

SEQ ID NO: 265023 - DNA, 75 bp, Artificial Sequence
  Synthetic
tgctgatgttaggactcttgagcctgtggagctccctctggaggacgtgcgcaacgttctctatcacaacagcag

SEQ ID NO: 265024 - DNA, 75 bp, Artificial Sequence
  Synthetic
gctataccccctaatttcccaattgataatctaagcgcagcacagatcacaatgtgcccacatgtgattgtggat

SEQ ID NO: 265025 - DNA, 75 bp, Artificial Sequence
  Synthetic
aagcatctccaggaccaccggcttcttcaaaccatatcagtcttggaataggaaacccctcccaaccgttgatga

SEQ ID NO: 265026 - DNA, 75 bp, Artificial Sequence
  Synthetic
actaactggaacaattctggaaatgtgggatggagagatctaccattacggcctatatgtggagcgaggtcttgt

SEQ ID NO: 265027 - DNA, 75 bp, Artificial Sequence
  Synthetic
ttgggcaaacttaaaccattgaacttgctgcacttgctcgcatcatgtgactggacgtttgggggcatagtagag

SEQ ID NO: 265028 - DNA, 75 bp, Artificial Sequence
  Synthetic
tgatgcctttgtggttgcgggcagggtgctcacgtgccccgcccctgatttcagctttctgtttctcgtcccccc

SEQ ID NO: 265029 - DNA, 75 bp, Artificial Sequence
  Synthetic
tgctgcacttgctcgcatcatgtgactggacgtttgggggcatagtagagacagttatcctaatggcggaacttt

SEQ ID NO: 265030 - DNA, 75 bp, Artificial Sequence
  Synthetic
gtgctcacgtgccccgcccctgatttcagctttctgtttctcgtccccccctccgttgagcagaagactagggtt

SEQ ID NO: 265031 - DNA, 75 bp, Artificial Sequence
  Synthetic
tgctgtatacacctcttagggcaaataattctggggatgatgtttttactgtgtcttgtagggtgctgactaggc

SEQ ID NO: 265032 - DNA, 75 bp, Artificial Sequence
  Synthetic
agccttcgacaacaattgctatgccttctgttgctgggtcttagacctaaacgactcgtggctgagtaggagaac

SEQ ID NO: 265033 - DNA, 75 bp, Artificial Sequence
  Synthetic
ctgaggacctggctgtggagcttgtccccgtggtcatgggtggaataggaatggttctcggctttactgctgaga

SEQ ID NO: 265034 - DNA, 75 bp, Artificial Sequence
  Synthetic
ctgaggacctggctgtggagcttgtccccgtggtcatgggtggtataggaatggttctcggctttactgctgaga

SEQ ID NO: 265035 - DNA, 75 bp, Artificial Sequence
  Synthetic
ctgaggacctggctgtggagcttgtccccgtggtcatgggtggcataggaatggttctcggctttactgctgaga

SEQ ID NO: 265036 - DNA, 75 bp, Artificial Sequence
  Synthetic
ctgaggacctggctgtggagcttgtccccgtggtcatgggtgggataggaatggttctcggctttactgctgaga

SEQ ID NO: 265037 - DNA, 75 bp, Artificial Sequence
  Synthetic
tccccagatgtcaatcagtcagtccagttccagaacgggcgctgccagatcgatggtcaactccagggcactacc

SEQ ID NO: 265038 - DNA, 75 bp, Artificial Sequence
  Synthetic
ccccgtggtcatgggtggaataggaatggttctcggctttactgctgagaagataggccgcatgctgtcgtccgc

SEQ ID NO: 265039 - DNA, 75 bp, Artificial Sequence
  Synthetic
ccccgtggtcatgggtggtataggaatggttctcggctttactgctgagaagataggccgcatgctgtcgtccgc

SEQ ID NO: 265040 - DNA, 75 bp, Artificial Sequence
  Synthetic
ccccgtggtcatgggtggcataggaatggttctcggctttactgctgagaagataggccgcatgctgtcgtccgc

SEQ ID NO: 265041 - DNA, 75 bp, Artificial Sequence
  Synthetic
ccccgtggtcatgggtgggataggaatggttctcggctttactgctgagaagataggccgcatgctgtcgtccgc

SEQ ID NO: 265042 - DNA, 75 bp, Artificial Sequence
  Synthetic
ttctgactatctctgaaatgtccaattctaggtttccagtgccgattgattctctgcacaccagcccaactgaaa

SEQ ID NO: 265043 - DNA, 75 bp, Artificial Sequence
  Synthetic
agttccagaacgggcgctgccagatcgatggtcaactccagggcactacccctgtctcgctcagtcaactttgca

SEQ ID NO: 265044 - DNA, 75 bp, Artificial Sequence
  Synthetic
cttcccaaagaaagaagagaaagccgagatggaaaccctaagggcgatcgaggatgccgtcctggacatggaagc

SEQ ID NO: 265045 - DNA, 75 bp, Artificial Sequence
  Synthetic
ttgagtctccagcaccagttggttttcccgacttaggaggttgtgactggcatgtaaacttcactttccaggctc

SEQ ID NO: 265046 - DNA, 75 bp, Artificial Sequence
  Synthetic
gagatggaaaccctaagggcgatcgaggatgccgtcctggacatggaagctataggaaacaaccatctcacaacc

SEQ ID NO: 265047 - DNA, 75 bp, Artificial Sequence
  Synthetic
tcccgacttaggaggttgtgactggcatgtaaacttcactttccaggctcagaatcaggacccatctcaaagtgt

SEQ ID NO: 265048 - DNA, 75 bp, Artificial Sequence
  Synthetic
tctaccaagtcatcctcgccagacatagtcggcactattaatgccatactggccagaatagctgctgccaggtcc

SEQ ID NO: 265049 - DNA, 75 bp, Artificial Sequence
  Synthetic
tctaccaagtcatcctcgccagacattgtcggcactattaatgccatactggccagaatagctgctgccaggtcc

SEQ ID NO: 265050 - DNA, 75 bp, Artificial Sequence
  Synthetic
tctaccaagtcatcctcgccagacatcgtcggcactattaatgccatactggccagaatagctgctgccaggtcc

SEQ ID NO: 265051 - DNA, 75 bp, Artificial Sequence
  Synthetic
tctaccaagtcatcctcgccagacatggtcggcactattaatgccatactggccagaatagctgctgccaggtcc

SEQ ID NO: 265052 - DNA, 75 bp, Artificial Sequence
  Synthetic
tgcaggtgacatcataggcagccttggctggatttcagccccgtctgacaatacacaacttaatgtctggacaat

SEQ ID NO: 265053 - DNA, 75 bp, Artificial Sequence
  Synthetic
ggccagaatagctgctgccaggtccctcttacacaaggcaaaagaagaaatgtttaacaggatcagacccgtggt

SEQ ID NO: 265054 - DNA, 75 bp, Artificial Sequence
  Synthetic
ggccagaatagctgctgccaggtccctcttacacaaggcaaaagaagaaatgtttatcaggatcagacccgtggt

SEQ ID NO: 265055 - DNA, 75 bp, Artificial Sequence
  Synthetic
ggccagaatagctgctgccaggtccctcttacacaaggcaaaagaagaaatgtttaccaggatcagacccgtggt

SEQ ID NO: 265056 - DNA, 75 bp, Artificial Sequence
  Synthetic
ggccagaatagctgctgccaggtccctcttacacaaggcaaaagaagaaatgtttagcaggatcagacccgtggt

SEQ ID NO: 265057 - DNA, 75 bp, Artificial Sequence
  Synthetic
ggccagaatagctgctgccaggtccctcttacacaaggctaaagaagaaatgtttaacaggatcagacccgtggt

SEQ ID NO: 265058 - DNA, 75 bp, Artificial Sequence
  Synthetic
ggccagaatagctgctgccaggtccctcttacacaaggctaaagaagaaatgtttatcaggatcagacccgtggt

SEQ ID NO: 265059 - DNA, 75 bp, Artificial Sequence
  Synthetic
ggccagaatagctgctgccaggtccctcttacacaaggctaaagaagaaatgtttaccaggatcagacccgtggt

SEQ ID NO: 265060 - DNA, 75 bp, Artificial Sequence
  Synthetic
ggccagaatagctgctgccaggtccctcttacacaaggctaaagaagaaatgtttagcaggatcagacccgtggt

SEQ ID NO: 265061 - DNA, 75 bp, Artificial Sequence
  Synthetic
ggccagaatagctgctgccaggtccctcttacacaaggccaaagaagaaatgtttaacaggatcagacccgtggt

SEQ ID NO: 265062 - DNA, 75 bp, Artificial Sequence
  Synthetic
ggccagaatagctgctgccaggtccctcttacacaaggccaaagaagaaatgtttatcaggatcagacccgtggt

SEQ ID NO: 265063 - DNA, 75 bp, Artificial Sequence
  Synthetic
ggccagaatagctgctgccaggtccctcttacacaaggccaaagaagaaatgtttaccaggatcagacccgtggt

SEQ ID NO: 265064 - DNA, 75 bp, Artificial Sequence
  Synthetic
ggccagaatagctgctgccaggtccctcttacacaaggccaaagaagaaatgtttagcaggatcagacccgtggt

SEQ ID NO: 265065 - DNA, 75 bp, Artificial Sequence
  Synthetic
ggccagaatagctgctgccaggtccctcttacacaaggcgaaagaagaaatgtttaacaggatcagacccgtggt

SEQ ID NO: 265066 - DNA, 75 bp, Artificial Sequence
  Synthetic
ggccagaatagctgctgccaggtccctcttacacaaggcgaaagaagaaatgtttatcaggatcagacccgtggt

SEQ ID NO: 265067 - DNA, 75 bp, Artificial Sequence
  Synthetic
ggccagaatagctgctgccaggtccctcttacacaaggcgaaagaagaaatgtttaccaggatcagacccgtggt

SEQ ID NO: 265068 - DNA, 75 bp, Artificial Sequence
  Synthetic
ggccagaatagctgctgccaggtccctcttacacaaggcgaaagaagaaatgtttagcaggatcagacccgtggt

SEQ ID NO: 265069 - DNA, 75 bp, Artificial Sequence
  Synthetic
ggtgctaggatttaccaaagagaagattgggaagatgttgtcatctgctgcatccaccttaagagcttgtaaaga

SEQ ID NO: 265070 - DNA, 75 bp, Artificial Sequence
  Synthetic
atgagcggcgaccagagagtaggactcgtcccacgcaacggggtcgaccactgggatgcctacaggggagagagg

SEQ ID NO: 265071 - DNA, 75 bp, Artificial Sequence
  Synthetic
atgagcggcgaccagagagtaggtctcgtcccacgcaacggggtcgaccactgggatgcctacaggggagagagg

SEQ ID NO: 265072 - DNA, 75 bp, Artificial Sequence
  Synthetic
atgagcggcgaccagagagtaggcctcgtcccacgcaacggggtcgaccactgggatgcctacaggggagagagg

SEQ ID NO: 265073 - DNA, 75 bp, Artificial Sequence
  Synthetic
atgagcggcgaccagagagtagggctcgtcccacgcaacggggtcgaccactgggatgcctacaggggagagagg

SEQ ID NO: 265074 - DNA, 75 bp, Artificial Sequence
  Synthetic
ttgagcggcgaccagagagtaggactcgtcccacgcaacggggtcgaccactgggatgcctacaggggagagagg

SEQ ID NO: 265075 - DNA, 75 bp, Artificial Sequence
  Synthetic
ttgagcggcgaccagagagtaggtctcgtcccacgcaacggggtcgaccactgggatgcctacaggggagagagg

SEQ ID NO: 265076 - DNA, 75 bp, Artificial Sequence
  Synthetic
ttgagcggcgaccagagagtaggcctcgtcccacgcaacggggtcgaccactgggatgcctacaggggagagagg

SEQ ID NO: 265077 - DNA, 75 bp, Artificial Sequence
  Synthetic
ttgagcggcgaccagagagtagggctcgtcccacgcaacggggtcgaccactgggatgcctacaggggagagagg

SEQ ID NO: 265078 - DNA, 75 bp, Artificial Sequence
  Synthetic
ctgagcggcgaccagagagtaggactcgtcccacgcaacggggtcgaccactgggatgcctacaggggagagagg

SEQ ID NO: 265079 - DNA, 75 bp, Artificial Sequence
  Synthetic
ctgagcggcgaccagagagtaggtctcgtcccacgcaacggggtcgaccactgggatgcctacaggggagagagg

SEQ ID NO: 265080 - DNA, 75 bp, Artificial Sequence
  Synthetic
ctgagcggcgaccagagagtaggcctcgtcccacgcaacggggtcgaccactgggatgcctacaggggagagagg

SEQ ID NO: 265081 - DNA, 75 bp, Artificial Sequence
  Synthetic
ctgagcggcgaccagagagtagggctcgtcccacgcaacggggtcgaccactgggatgcctacaggggagagagg

SEQ ID NO: 265082 - DNA, 75 bp, Artificial Sequence
  Synthetic
gtgagcggcgaccagagagtaggactcgtcccacgcaacggggtcgaccactgggatgcctacaggggagagagg

SEQ ID NO: 265083 - DNA, 75 bp, Artificial Sequence
  Synthetic
gtgagcggcgaccagagagtaggtctcgtcccacgcaacggggtcgaccactgggatgcctacaggggagagagg

SEQ ID NO: 265084 - DNA, 75 bp, Artificial Sequence
  Synthetic
gtgagcggcgaccagagagtaggcctcgtcccacgcaacggggtcgaccactgggatgcctacaggggagagagg

SEQ ID NO: 265085 - DNA, 75 bp, Artificial Sequence
  Synthetic
gtgagcggcgaccagagagtagggctcgtcccacgcaacggggtcgaccactgggatgcctacaggggagagagg

SEQ ID NO: 265086 - DNA, 75 bp, Artificial Sequence
  Synthetic
gccggggatgatgtcttcacagtctcttgtcgagtcctcacgaggccatcccctgattttgacttcatatttctg

SEQ ID NO: 265087 - DNA, 75 bp, Artificial Sequence
  Synthetic
ccaaaactaggctcattagagatatccactgaatctggtgactttgatcaaaaccaaccaacaagattcacccca

SEQ ID NO: 265088 - DNA, 75 bp, Artificial Sequence
  Synthetic
ggttctggacaacctagtcagcttcaagtgccatgcctgttgcctcaggagttcatcacccacttctgcaatgaa

SEQ ID NO: 265089 - DNA, 75 bp, Artificial Sequence
  Synthetic
cactggttccctcattgctcgagcatcagggctactccatgagaggttggacgagtacgagctacagggcccagc

SEQ ID NO: 265090 - DNA, 75 bp, Artificial Sequence
  Synthetic
tcgtcccacgcaacggggtcgaccactgggatgcctacaggggagagagggtggtcttatgggatgattatggca

SEQ ID NO: 265091 - DNA, 75 bp, Artificial Sequence
  Synthetic
aggaggagaaagccaggaagctctcaaccaagtctgcttcacctgatatcgtgggtacaatcaacgcccttctgg

SEQ ID NO: 265092 - DNA, 75 bp, Artificial Sequence
  Synthetic
gatggacacaatgaaagttggaagacagctcaaggatgtcagaaccatgccagagcttaaacaagcactcaagaa

SEQ ID NO: 265093 - DNA, 75 bp, Artificial Sequence
  Synthetic
aacatgaacttagccccagctgttgctcccaacttccctggtgagcagctccttttcttccgctcacagttacca

SEQ ID NO: 265094 - DNA, 75 bp, Artificial Sequence
  Synthetic
ggattgagaacaaggggaagatgttcgacagtgatgtcatcataatcacgaccaacttagtcaacccagcgcccc

SEQ ID NO: 265095 - DNA, 75 bp, Artificial Sequence
  Synthetic
tcgattatgtgaacttcgaggcgtgctccagaaggatcgactttctggtctatacagagtcaccagaaattgaga

SEQ ID NO: 265096 - DNA, 75 bp, Artificial Sequence
  Synthetic
tcgattatgtgaacttcgaggcgtgctccagaaggatcgactttctggtctatacagagtcaccagtaattgaga

SEQ ID NO: 265097 - DNA, 75 bp, Artificial Sequence
  Synthetic
tcgattatgtgaacttcgaggcgtgctccagaaggatcgactttctggtctatacagagtcaccagcaattgaga

SEQ ID NO: 265098 - DNA, 75 bp, Artificial Sequence
  Synthetic
tcgattatgtgaacttcgaggcgtgctccagaaggatcgactttctggtctatacagagtcaccaggaattgaga

SEQ ID NO: 265099 - DNA, 75 bp, Artificial Sequence
  Synthetic
tcgattatgtgaacttcgaggcgtgctccagaaggatcgactttctggtctattcagagtcaccagaaattgaga

SEQ ID NO: 265100 - DNA, 75 bp, Artificial Sequence
  Synthetic
tcgattatgtgaacttcgaggcgtgctccagaaggatcgactttctggtctattcagagtcaccagtaattgaga

SEQ ID NO: 265101 - DNA, 75 bp, Artificial Sequence
  Synthetic
tcgattatgtgaacttcgaggcgtgctccagaaggatcgactttctggtctattcagagtcaccagcaattgaga

SEQ ID NO: 265102 - DNA, 75 bp, Artificial Sequence
  Synthetic
tcgattatgtgaacttcgaggcgtgctccagaaggatcgactttctggtctattcagagtcaccaggaattgaga

SEQ ID NO: 265103 - DNA, 75 bp, Artificial Sequence
  Synthetic
tcgattatgtgaacttcgaggcgtgctccagaaggatcgactttctggtctatccagagtcaccagaaattgaga

SEQ ID NO: 265104 - DNA, 75 bp, Artificial Sequence
  Synthetic
tcgattatgtgaacttcgaggcgtgctccagaaggatcgactttctggtctatccagagtcaccagtaattgaga

SEQ ID NO: 265105 - DNA, 75 bp, Artificial Sequence
  Synthetic
tcgattatgtgaacttcgaggcgtgctccagaaggatcgactttctggtctatccagagtcaccagcaattgaga

SEQ ID NO: 265106 - DNA, 75 bp, Artificial Sequence
  Synthetic
tcgattatgtgaacttcgaggcgtgctccagaaggatcgactttctggtctatccagagtcaccaggaattgaga

SEQ ID NO: 265107 - DNA, 75 bp, Artificial Sequence
  Synthetic
tcgattatgtgaacttcgaggcgtgctccagaaggatcgactttctggtctatgcagagtcaccagaaattgaga

SEQ ID NO: 265108 - DNA, 75 bp, Artificial Sequence
  Synthetic
tcgattatgtgaacttcgaggcgtgctccagaaggatcgactttctggtctatgcagagtcaccagtaattgaga

SEQ ID NO: 265109 - DNA, 75 bp, Artificial Sequence
  Synthetic
tcgattatgtgaacttcgaggcgtgctccagaaggatcgactttctggtctatgcagagtcaccagcaattgaga

SEQ ID NO: 265110 - DNA, 75 bp, Artificial Sequence
  Synthetic
tcgattatgtgaacttcgaggcgtgctccagaaggatcgactttctggtctatgcagagtcaccaggaattgaga

SEQ ID NO: 265111 - DNA, 75 bp, Artificial Sequence
  Synthetic
tcgattatgtgaacttcgaggcgtgctccagaaggttcgactttctggtctatacagagtcaccagaaattgaga

SEQ ID NO: 265112 - DNA, 75 bp, Artificial Sequence
  Synthetic
tcgattatgtgaacttcgaggcgtgctccagaaggttcgactttctggtctatacagagtcaccagtaattgaga

SEQ ID NO: 265113 - DNA, 75 bp, Artificial Sequence
  Synthetic
tcgattatgtgaacttcgaggcgtgctccagaaggttcgactttctggtctatacagagtcaccagcaattgaga

SEQ ID NO: 265114 - DNA, 75 bp, Artificial Sequence
  Synthetic
tcgattatgtgaacttcgaggcgtgctccagaaggttcgactttctggtctatacagagtcaccaggaattgaga

SEQ ID NO: 265115 - DNA, 75 bp, Artificial Sequence
  Synthetic
tcgattatgtgaacttcgaggcgtgctccagaaggttcgactttctggtctattcagagtcaccagaaattgaga

SEQ ID NO: 265116 - DNA, 75 bp, Artificial Sequence
  Synthetic
tcgattatgtgaacttcgaggcgtgctccagaaggttcgactttctggtctattcagagtcaccagtaattgaga

SEQ ID NO: 265117 - DNA, 75 bp, Artificial Sequence
  Synthetic
tcgattatgtgaacttcgaggcgtgctccagaaggttcgactttctggtctattcagagtcaccagcaattgaga

SEQ ID NO: 265118 - DNA, 75 bp, Artificial Sequence
  Synthetic
tcgattatgtgaacttcgaggcgtgctccagaaggttcgactttctggtctattcagagtcaccaggaattgaga

SEQ ID NO: 265119 - DNA, 75 bp, Artificial Sequence
  Synthetic
tcgattatgtgaacttcgaggcgtgctccagaaggttcgactttctggtctatccagagtcaccagaaattgaga

SEQ ID NO: 265120 - DNA, 75 bp, Artificial Sequence
  Synthetic
tcgattatgtgaacttcgaggcgtgctccagaaggttcgactttctggtctatccagagtcaccagtaattgaga

SEQ ID NO: 265121 - DNA, 75 bp, Artificial Sequence
  Synthetic
tcgattatgtgaacttcgaggcgtgctccagaaggttcgactttctggtctatccagagtcaccagcaattgaga

SEQ ID NO: 265122 - DNA, 75 bp, Artificial Sequence
  Synthetic
tcgattatgtgaacttcgaggcgtgctccagaaggttcgactttctggtctatccagagtcaccaggaattgaga

SEQ ID NO: 265123 - DNA, 75 bp, Artificial Sequence
  Synthetic
tcgattatgtgaacttcgaggcgtgctccagaaggttcgactttctggtctatgcagagtcaccagaaattgaga

SEQ ID NO: 265124 - DNA, 75 bp, Artificial Sequence
  Synthetic
tcgattatgtgaacttcgaggcgtgctccagaaggttcgactttctggtctatgcagagtcaccagtaattgaga

SEQ ID NO: 265125 - DNA, 75 bp, Artificial Sequence
  Synthetic
tcgattatgtgaacttcgaggcgtgctccagaaggttcgactttctggtctatgcagagtcaccagcaattgaga

SEQ ID NO: 265126 - DNA, 75 bp, Artificial Sequence
  Synthetic
tcgattatgtgaacttcgaggcgtgctccagaaggttcgactttctggtctatgcagagtcaccaggaattgaga

SEQ ID NO: 265127 - DNA, 75 bp, Artificial Sequence
  Synthetic
tcgattatgtgaacttcgaggcgtgctccagaaggctcgactttctggtctatacagagtcaccagaaattgaga

SEQ ID NO: 265128 - DNA, 75 bp, Artificial Sequence
  Synthetic
tcgattatgtgaacttcgaggcgtgctccagaaggctcgactttctggtctatacagagtcaccagtaattgaga

SEQ ID NO: 265129 - DNA, 75 bp, Artificial Sequence
  Synthetic
tcgattatgtgaacttcgaggcgtgctccagaaggctcgactttctggtctatacagagtcaccagcaattgaga

SEQ ID NO: 265130 - DNA, 75 bp, Artificial Sequence
  Synthetic
tcgattatgtgaacttcgaggcgtgctccagaaggctcgactttctggtctatacagagtcaccaggaattgaga

SEQ ID NO: 265131 - DNA, 75 bp, Artificial Sequence
  Synthetic
tcgattatgtgaacttcgaggcgtgctccagaaggctcgactttctggtctattcagagtcaccagaaattgaga

SEQ ID NO: 265132 - DNA, 75 bp, Artificial Sequence
  Synthetic
tcgattatgtgaacttcgaggcgtgctccagaaggctcgactttctggtctattcagagtcaccagtaattgaga

SEQ ID NO: 265133 - DNA, 75 bp, Artificial Sequence
  Synthetic
tcgattatgtgaacttcgaggcgtgctccagaaggctcgactttctggtctattcagagtcaccagcaattgaga

SEQ ID NO: 265134 - DNA, 75 bp, Artificial Sequence
  Synthetic
tcgattatgtgaacttcgaggcgtgctccagaaggctcgactttctggtctattcagagtcaccaggaattgaga

SEQ ID NO: 265135 - DNA, 75 bp, Artificial Sequence
  Synthetic
tcgattatgtgaacttcgaggcgtgctccagaaggctcgactttctggtctatccagagtcaccagaaattgaga

SEQ ID NO: 265136 - DNA, 75 bp, Artificial Sequence
  Synthetic
tcgattatgtgaacttcgaggcgtgctccagaaggctcgactttctggtctatccagagtcaccagtaattgaga

SEQ ID NO: 265137 - DNA, 75 bp, Artificial Sequence
  Synthetic
tcgattatgtgaacttcgaggcgtgctccagaaggctcgactttctggtctatccagagtcaccagcaattgaga

SEQ ID NO: 265138 - DNA, 75 bp, Artificial Sequence
  Synthetic
tcgattatgtgaacttcgaggcgtgctccagaaggctcgactttctggtctatccagagtcaccaggaattgaga

SEQ ID NO: 265139 - DNA, 75 bp, Artificial Sequence
  Synthetic
tcgattatgtgaacttcgaggcgtgctccagaaggctcgactttctggtctatgcagagtcaccagaaattgaga

SEQ ID NO: 265140 - DNA, 75 bp, Artificial Sequence
  Synthetic
tcgattatgtgaacttcgaggcgtgctccagaaggctcgactttctggtctatgcagagtcaccagtaattgaga

SEQ ID NO: 265141 - DNA, 75 bp, Artificial Sequence
  Synthetic
tcgattatgtgaacttcgaggcgtgctccagaaggctcgactttctggtctatgcagagtcaccagcaattgaga

SEQ ID NO: 265142 - DNA, 75 bp, Artificial Sequence
  Synthetic
tcgattatgtgaacttcgaggcgtgctccagaaggctcgactttctggtctatgcagagtcaccaggaattgaga

SEQ ID NO: 265143 - DNA, 75 bp, Artificial Sequence
  Synthetic
tcgattatgtgaacttcgaggcgtgctccagaagggtcgactttctggtctatacagagtcaccagaaattgaga

SEQ ID NO: 265144 - DNA, 75 bp, Artificial Sequence
  Synthetic
tcgattatgtgaacttcgaggcgtgctccagaagggtcgactttctggtctatacagagtcaccagtaattgaga

SEQ ID NO: 265145 - DNA, 75 bp, Artificial Sequence
  Synthetic
tcgattatgtgaacttcgaggcgtgctccagaagggtcgactttctggtctatacagagtcaccagcaattgaga

SEQ ID NO: 265146 - DNA, 75 bp, Artificial Sequence
  Synthetic
tcgattatgtgaacttcgaggcgtgctccagaagggtcgactttctggtctatacagagtcaccaggaattgaga

SEQ ID NO: 265147 - DNA, 75 bp, Artificial Sequence
  Synthetic
tcgattatgtgaacttcgaggcgtgctccagaagggtcgactttctggtctattcagagtcaccagaaattgaga

SEQ ID NO: 265148 - DNA, 75 bp, Artificial Sequence
  Synthetic
tcgattatgtgaacttcgaggcgtgctccagaagggtcgactttctggtctattcagagtcaccagtaattgaga

SEQ ID NO: 265149 - DNA, 75 bp, Artificial Sequence
  Synthetic
tcgattatgtgaacttcgaggcgtgctccagaagggtcgactttctggtctattcagagtcaccagcaattgaga

SEQ ID NO: 265150 - DNA, 75 bp, Artificial Sequence
  Synthetic
tcgattatgtgaacttcgaggcgtgctccagaagggtcgactttctggtctattcagagtcaccaggaattgaga

SEQ ID NO: 265151 - DNA, 75 bp, Artificial Sequence
  Synthetic
tcgattatgtgaacttcgaggcgtgctccagaagggtcgactttctggtctatccagagtcaccagaaattgaga

SEQ ID NO: 265152 - DNA, 75 bp, Artificial Sequence
  Synthetic
tcgattatgtgaacttcgaggcgtgctccagaagggtcgactttctggtctatccagagtcaccagtaattgaga

SEQ ID NO: 265153 - DNA, 75 bp, Artificial Sequence
  Synthetic
tcgattatgtgaacttcgaggcgtgctccagaagggtcgactttctggtctatccagagtcaccagcaattgaga

SEQ ID NO: 265154 - DNA, 75 bp, Artificial Sequence
  Synthetic
tcgattatgtgaacttcgaggcgtgctccagaagggtcgactttctggtctatccagagtcaccaggaattgaga

SEQ ID NO: 265155 - DNA, 75 bp, Artificial Sequence
  Synthetic
tcgattatgtgaacttcgaggcgtgctccagaagggtcgactttctggtctatgcagagtcaccagaaattgaga

SEQ ID NO: 265156 - DNA, 75 bp, Artificial Sequence
  Synthetic
tcgattatgtgaacttcgaggcgtgctccagaagggtcgactttctggtctatgcagagtcaccagtaattgaga

SEQ ID NO: 265157 - DNA, 75 bp, Artificial Sequence
  Synthetic
tcgattatgtgaacttcgaggcgtgctccagaagggtcgactttctggtctatgcagagtcaccagcaattgaga

SEQ ID NO: 265158 - DNA, 75 bp, Artificial Sequence
  Synthetic
tcgattatgtgaacttcgaggcgtgctccagaagggtcgactttctggtctatgcagagtcaccaggaattgaga

SEQ ID NO: 265159 - DNA, 75 bp, Artificial Sequence
  Synthetic
caggctcccatcgctggggaagctgctctcctccattacgtggaccctgacacgggacggaacctgggggaattc

SEQ ID NO: 265160 - DNA, 75 bp, Artificial Sequence
  Synthetic
ctcccaacttccctggtgagcagctccttttcttccgctcacagttaccatcttctggtgggcgatccaacggga

SEQ ID NO: 265161 - DNA, 75 bp, Artificial Sequence
  Synthetic
tgactctagccccacagggtggatttgacaagaatggcaataccccgcatggtaagggaaccatgcgatccctaa

SEQ ID NO: 265162 - DNA, 75 bp, Artificial Sequence
  Synthetic
tgactctagccccacagggtggatttgacaagaatggcaataccccgcatggtaagggtaccatgcgatccctaa

SEQ ID NO: 265163 - DNA, 75 bp, Artificial Sequence
  Synthetic
tgactctagccccacagggtggatttgacaagaatggcaataccccgcatggtaagggcaccatgcgatccctaa

SEQ ID NO: 265164 - DNA, 75 bp, Artificial Sequence
  Synthetic
tgactctagccccacagggtggatttgacaagaatggcaataccccgcatggtaaggggaccatgcgatccctaa

SEQ ID NO: 265165 - DNA, 75 bp, Artificial Sequence
  Synthetic
tgacaagaatggcaataccccgcatggtaagggaaccatgcgatccctaacccaagggtccctgactgcaagggt

SEQ ID NO: 265166 - DNA, 75 bp, Artificial Sequence
  Synthetic
tgacaagaatggcaataccccgcatggtaagggaaccatgcgatccctaacccatgggtccctgactgcaagggt

SEQ ID NO: 265167 - DNA, 75 bp, Artificial Sequence
  Synthetic
tgacaagaatggcaataccccgcatggtaagggaaccatgcgatccctaacccacgggtccctgactgcaagggt

SEQ ID NO: 265168 - DNA, 75 bp, Artificial Sequence
  Synthetic
tgacaagaatggcaataccccgcatggtaagggaaccatgcgatccctaacccaggggtccctgactgcaagggt

SEQ ID NO: 265169 - DNA, 75 bp, Artificial Sequence
  Synthetic
tgacaagaatggcaataccccgcatggtaagggtaccatgcgatccctaacccaagggtccctgactgcaagggt

SEQ ID NO: 265170 - DNA, 75 bp, Artificial Sequence
  Synthetic
tgacaagaatggcaataccccgcatggtaagggtaccatgcgatccctaacccatgggtccctgactgcaagggt

SEQ ID NO: 265171 - DNA, 75 bp, Artificial Sequence
  Synthetic
tgacaagaatggcaataccccgcatggtaagggtaccatgcgatccctaacccacgggtccctgactgcaagggt

SEQ ID NO: 265172 - DNA, 75 bp, Artificial Sequence
  Synthetic
tgacaagaatggcaataccccgcatggtaagggtaccatgcgatccctaacccaggggtccctgactgcaagggt

SEQ ID NO: 265173 - DNA, 75 bp, Artificial Sequence
  Synthetic
tgacaagaatggcaataccccgcatggtaagggcaccatgcgatccctaacccaagggtccctgactgcaagggt

SEQ ID NO: 265174 - DNA, 75 bp, Artificial Sequence
  Synthetic
tgacaagaatggcaataccccgcatggtaagggcaccatgcgatccctaacccatgggtccctgactgcaagggt

SEQ ID NO: 265175 - DNA, 75 bp, Artificial Sequence
  Synthetic
tgacaagaatggcaataccccgcatggtaagggcaccatgcgatccctaacccacgggtccctgactgcaagggt

SEQ ID NO: 265176 - DNA, 75 bp, Artificial Sequence
  Synthetic
tgacaagaatggcaataccccgcatggtaagggcaccatgcgatccctaacccaggggtccctgactgcaagggt

SEQ ID NO: 265177 - DNA, 75 bp, Artificial Sequence
  Synthetic
tgacaagaatggcaataccccgcatggtaaggggaccatgcgatccctaacccaagggtccctgactgcaagggt

SEQ ID NO: 265178 - DNA, 75 bp, Artificial Sequence
  Synthetic
tgacaagaatggcaataccccgcatggtaaggggaccatgcgatccctaacccatgggtccctgactgcaagggt

SEQ ID NO: 265179 - DNA, 75 bp, Artificial Sequence
  Synthetic
tgacaagaatggcaataccccgcatggtaaggggaccatgcgatccctaacccacgggtccctgactgcaagggt

SEQ ID NO: 265180 - DNA, 75 bp, Artificial Sequence
  Synthetic
tgacaagaatggcaataccccgcatggtaaggggaccatgcgatccctaacccaggggtccctgactgcaagggt

SEQ ID NO: 265181 - DNA, 75 bp, Artificial Sequence
  Synthetic
tcacaggagaccagcgtgtaggtctcatcccacgcaatggcgtcgaccactgggacgcatacaagggggagaggg

SEQ ID NO: 265182 - DNA, 75 bp, Artificial Sequence
  Synthetic
cgccagaattaggtattacgtcaagtgtgtccaggaggccctgtattccatcattcaaattgccggagctgcatt

SEQ ID NO: 265183 - DNA, 75 bp, Artificial Sequence
  Synthetic
gggcccagctgtcatcggtgccatagccgcatctgccgctggtagtatactgggggcaggcatacaggctggtgc

SEQ ID NO: 265184 - DNA, 75 bp, Artificial Sequence
  Synthetic
tgtgtccaggaggccctgtattccatcattcaaattgccggagctgcatttgtcaccacacgcatcgttaagcgt

SEQ ID NO: 265185 - DNA, 75 bp, Artificial Sequence
  Synthetic
gatggctcgacccggggccataaagctacagtttacactgggagtgccgacttcactccaaagctgggcagtgtt

SEQ ID NO: 265186 - DNA, 75 bp, Artificial Sequence
  Synthetic
caaccgagacccaggaaacgagtgaaaccgaaaaggaagtagcccaaggcaaatgggagattgaacccaaggaaa

SEQ ID NO: 265187 - DNA, 75 bp, Artificial Sequence
  Synthetic
caaccgagacccaggaaacgagtgaaaccgaaaaggaagtagcccaaggcaaatgggagattgaacccaaggata

SEQ ID NO: 265188 - DNA, 75 bp, Artificial Sequence
  Synthetic
caaccgagacccaggaaacgagtgaaaccgaaaaggaagtagcccaaggcaaatgggagattgaacccaaggaca

SEQ ID NO: 265189 - DNA, 75 bp, Artificial Sequence
  Synthetic
caaccgagacccaggaaacgagtgaaaccgaaaaggaagtagcccaaggcaaatgggagattgaacccaaggaga

SEQ ID NO: 265190 - DNA, 75 bp, Artificial Sequence
  Synthetic
caaccgagacccaggaaacgagtgaatccgaaaaggaagtagcccaaggcaaatgggagattgaacccaaggaaa

SEQ ID NO: 265191 - DNA, 75 bp, Artificial Sequence
  Synthetic
caaccgagacccaggaaacgagtgaatccgaaaaggaagtagcccaaggcaaatgggagattgaacccaaggata

SEQ ID NO: 265192 - DNA, 75 bp, Artificial Sequence
  Synthetic
caaccgagacccaggaaacgagtgaatccgaaaaggaagtagcccaaggcaaatgggagattgaacccaaggaca

SEQ ID NO: 265193 - DNA, 75 bp, Artificial Sequence
  Synthetic
caaccgagacccaggaaacgagtgaatccgaaaaggaagtagcccaaggcaaatgggagattgaacccaaggaga

SEQ ID NO: 265194 - DNA, 75 bp, Artificial Sequence
  Synthetic
caaccgagacccaggaaacgagtgaacccgaaaaggaagtagcccaaggcaaatgggagattgaacccaaggaaa

SEQ ID NO: 265195 - DNA, 75 bp, Artificial Sequence
  Synthetic
caaccgagacccaggaaacgagtgaacccgaaaaggaagtagcccaaggcaaatgggagattgaacccaaggata

SEQ ID NO: 265196 - DNA, 75 bp, Artificial Sequence
  Synthetic
caaccgagacccaggaaacgagtgaacccgaaaaggaagtagcccaaggcaaatgggagattgaacccaaggaca

SEQ ID NO: 265197 - DNA, 75 bp, Artificial Sequence
  Synthetic
caaccgagacccaggaaacgagtgaacccgaaaaggaagtagcccaaggcaaatgggagattgaacccaaggaga

SEQ ID NO: 265198 - DNA, 75 bp, Artificial Sequence
  Synthetic
caaccgagacccaggaaacgagtgaagccgaaaaggaagtagcccaaggcaaatgggagattgaacccaaggaaa

SEQ ID NO: 265199 - DNA, 75 bp, Artificial Sequence
  Synthetic
caaccgagacccaggaaacgagtgaagccgaaaaggaagtagcccaaggcaaatgggagattgaacccaaggata

SEQ ID NO: 265200 - DNA, 75 bp, Artificial Sequence
  Synthetic
caaccgagacccaggaaacgagtgaagccgaaaaggaagtagcccaaggcaaatgggagattgaacccaaggaca

SEQ ID NO: 265201 - DNA, 75 bp, Artificial Sequence
  Synthetic
caaccgagacccaggaaacgagtgaagccgaaaaggaagtagcccaaggcaaatgggagattgaacccaaggaga

SEQ ID NO: 265202 - DNA, 75 bp, Artificial Sequence
  Synthetic
aaccgaaaaggaagtagcccaaggcaaatgggagattgaacccaaggaaacagaaccagaaggtaagaagggtaa

SEQ ID NO: 265203 - DNA, 75 bp, Artificial Sequence
  Synthetic
aaccgaaaaggaagtagcccaaggcaaatgggagattgaacccaaggatacagaaccagaaggtaagaagggtaa

SEQ ID NO: 265204 - DNA, 75 bp, Artificial Sequence
  Synthetic
aaccgaaaaggaagtagcccaaggcaaatgggagattgaacccaaggacacagaaccagaaggtaagaagggtaa

SEQ ID NO: 265205 - DNA, 75 bp, Artificial Sequence
  Synthetic
aaccgaaaaggaagtagcccaaggcaaatgggagattgaacccaaggagacagaaccagaaggtaagaagggtaa

SEQ ID NO: 265206 - DNA, 75 bp, Artificial Sequence
  Synthetic
atccgaaaaggaagtagcccaaggcaaatgggagattgaacccaaggaaacagaaccagaaggtaagaagggtaa

SEQ ID NO: 265207 - DNA, 75 bp, Artificial Sequence
  Synthetic
atccgaaaaggaagtagcccaaggcaaatgggagattgaacccaaggatacagaaccagaaggtaagaagggtaa

SEQ ID NO: 265208 - DNA, 75 bp, Artificial Sequence
  Synthetic
atccgaaaaggaagtagcccaaggcaaatgggagattgaacccaaggacacagaaccagaaggtaagaagggtaa

SEQ ID NO: 265209 - DNA, 75 bp, Artificial Sequence
  Synthetic
atccgaaaaggaagtagcccaaggcaaatgggagattgaacccaaggagacagaaccagaaggtaagaagggtaa

SEQ ID NO: 265210 - DNA, 75 bp, Artificial Sequence
  Synthetic
acccgaaaaggaagtagcccaaggcaaatgggagattgaacccaaggaaacagaaccagaaggtaagaagggtaa

SEQ ID NO: 265211 - DNA, 75 bp, Artificial Sequence
  Synthetic
acccgaaaaggaagtagcccaaggcaaatgggagattgaacccaaggatacagaaccagaaggtaagaagggtaa

SEQ ID NO: 265212 - DNA, 75 bp, Artificial Sequence
  Synthetic
acccgaaaaggaagtagcccaaggcaaatgggagattgaacccaaggacacagaaccagaaggtaagaagggtaa

SEQ ID NO: 265213 - DNA, 75 bp, Artificial Sequence
  Synthetic
acccgaaaaggaagtagcccaaggcaaatgggagattgaacccaaggagacagaaccagaaggtaagaagggtaa

SEQ ID NO: 265214 - DNA, 75 bp, Artificial Sequence
  Synthetic
agccgaaaaggaagtagcccaaggcaaatgggagattgaacccaaggaaacagaaccagaaggtaagaagggtaa

SEQ ID NO: 265215 - DNA, 75 bp, Artificial Sequence
  Synthetic
agccgaaaaggaagtagcccaaggcaaatgggagattgaacccaaggatacagaaccagaaggtaagaagggtaa

SEQ ID NO: 265216 - DNA, 75 bp, Artificial Sequence
  Synthetic
agccgaaaaggaagtagcccaaggcaaatgggagattgaacccaaggacacagaaccagaaggtaagaagggtaa

SEQ ID NO: 265217 - DNA, 75 bp, Artificial Sequence
  Synthetic
agccgaaaaggaagtagcccaaggcaaatgggagattgaacccaaggagacagaaccagaaggtaagaagggtaa

SEQ ID NO: 265218 - DNA, 75 bp, Artificial Sequence
  Synthetic
aggattagctggtgatatgttcacaaacactgtaggatctctagttaatgcaggggctaatgccattaatcaaaa

SEQ ID NO: 265219 - DNA, 75 bp, Artificial Sequence
  Synthetic
caagagaatcagagaagaaaggaacggaaaatactccattgaggaatacctgcaagaccgggatcgatactatga

SEQ ID NO: 265220 - DNA, 75 bp, Artificial Sequence
  Synthetic
caagagaatcagagaagaaaggaacggaaaatactccattgaggaatacctgcaagaccgggatcgttactatga

SEQ ID NO: 265221 - DNA, 75 bp, Artificial Sequence
  Synthetic
caagagaatcagagaagaaaggaacggaaaatactccattgaggaatacctgcaagaccgggatcgctactatga

SEQ ID NO: 265222 - DNA, 75 bp, Artificial Sequence
  Synthetic
caagagaatcagagaagaaaggaacggaaaatactccattgaggaatacctgcaagaccgggatcggtactatga

SEQ ID NO: 265223 - DNA, 75 bp, Artificial Sequence
  Synthetic
gtgatgtctgggcaggataatccaaattatgctgcttcttctatctctagaactgcttcatgggtacaatctcaa

SEQ ID NO: 265224 - DNA, 75 bp, Artificial Sequence
  Synthetic
tcgccccacaaagaaacaaaggaaggaagaaaggggggtgcttggattggtcactggctcagacatcaggaagag

SEQ ID NO: 265225 - DNA, 75 bp, Artificial Sequence
  Synthetic
tcgccccacaaagaaacaaaggaaggaagaaaggggggtgcttggtttggtcactggctcagacatcaggaagag

SEQ ID NO: 265226 - DNA, 75 bp, Artificial Sequence
  Synthetic
tcgccccacaaagaaacaaaggaaggaagaaaggggggtgcttggcttggtcactggctcagacatcaggaagag

SEQ ID NO: 265227 - DNA, 75 bp, Artificial Sequence
  Synthetic
tcgccccacaaagaaacaaaggaaggaagaaaggggggtgcttgggttggtcactggctcagacatcaggaagag

SEQ ID NO: 265228 - DNA, 75 bp, Artificial Sequence
  Synthetic
tcgccccacaaagaaacataggaaggaagaaaggggggtgcttggattggtcactggctcagacatcaggaagag

SEQ ID NO: 265229 - DNA, 75 bp, Artificial Sequence
  Synthetic
tcgccccacaaagaaacataggaaggaagaaaggggggtgcttggtttggtcactggctcagacatcaggaagag

SEQ ID NO: 265230 - DNA, 75 bp, Artificial Sequence
  Synthetic
tcgccccacaaagaaacataggaaggaagaaaggggggtgcttggcttggtcactggctcagacatcaggaagag

SEQ ID NO: 265231 - DNA, 75 bp, Artificial Sequence
  Synthetic
tcgccccacaaagaaacataggaaggaagaaaggggggtgcttgggttggtcactggctcagacatcaggaagag

SEQ ID NO: 265232 - DNA, 75 bp, Artificial Sequence
  Synthetic
tcgccccacaaagaaacacaggaaggaagaaaggggggtgcttggattggtcactggctcagacatcaggaagag

SEQ ID NO: 265233 - DNA, 75 bp, Artificial Sequence
  Synthetic
tcgccccacaaagaaacacaggaaggaagaaaggggggtgcttggtttggtcactggctcagacatcaggaagag

SEQ ID NO: 265234 - DNA, 75 bp, Artificial Sequence
  Synthetic
tcgccccacaaagaaacacaggaaggaagaaaggggggtgcttggcttggtcactggctcagacatcaggaagag

SEQ ID NO: 265235 - DNA, 75 bp, Artificial Sequence
  Synthetic
tcgccccacaaagaaacacaggaaggaagaaaggggggtgcttgggttggtcactggctcagacatcaggaagag

SEQ ID NO: 265236 - DNA, 75 bp, Artificial Sequence
  Synthetic
tcgccccacaaagaaacagaggaaggaagaaaggggggtgcttggattggtcactggctcagacatcaggaagag

SEQ ID NO: 265237 - DNA, 75 bp, Artificial Sequence
  Synthetic
tcgccccacaaagaaacagaggaaggaagaaaggggggtgcttggtttggtcactggctcagacatcaggaagag

SEQ ID NO: 265238 - DNA, 75 bp, Artificial Sequence
  Synthetic
tcgccccacaaagaaacagaggaaggaagaaaggggggtgcttggcttggtcactggctcagacatcaggaagag

SEQ ID NO: 265239 - DNA, 75 bp, Artificial Sequence
  Synthetic
tcgccccacaaagaaacagaggaaggaagaaaggggggtgcttgggttggtcactggctcagacatcaggaagag

SEQ ID NO: 265240 - DNA, 75 bp, Artificial Sequence
  Synthetic
tctcaccactttcaactttgatcgcaacaaggtgcttgcttttaggcagcttgctgctgaaaacaaatacgggct

SEQ ID NO: 265241 - DNA, 75 bp, Artificial Sequence
  Synthetic
gaagaaaggggggtgcttggattggtcactggctcagacatcaggaagaggaggccagacgattttcaaccgaag

SEQ ID NO: 265242 - DNA, 75 bp, Artificial Sequence
  Synthetic
gaagaaaggggggtgcttggattggtcactggctcagacatcaggaagaggaggccagacgattttcatccgaag

SEQ ID NO: 265243 - DNA, 75 bp, Artificial Sequence
  Synthetic
gaagaaaggggggtgcttggattggtcactggctcagacatcaggaagaggaggccagacgattttcacccgaag

SEQ ID NO: 265244 - DNA, 75 bp, Artificial Sequence
  Synthetic
gaagaaaggggggtgcttggattggtcactggctcagacatcaggaagaggaggccagacgattttcagccgaag

SEQ ID NO: 265245 - DNA, 75 bp, Artificial Sequence
  Synthetic
gaagaaaggggggtgcttggtttggtcactggctcagacatcaggaagaggaggccagacgattttcaaccgaag

SEQ ID NO: 265246 - DNA, 75 bp, Artificial Sequence
  Synthetic
gaagaaaggggggtgcttggtttggtcactggctcagacatcaggaagaggaggccagacgattttcatccgaag

SEQ ID NO: 265247 - DNA, 75 bp, Artificial Sequence
  Synthetic
gaagaaaggggggtgcttggtttggtcactggctcagacatcaggaagaggaggccagacgattttcacccgaag

SEQ ID NO: 265248 - DNA, 75 bp, Artificial Sequence
  Synthetic
gaagaaaggggggtgcttggtttggtcactggctcagacatcaggaagaggaggccagacgattttcagccgaag

SEQ ID NO: 265249 - DNA, 75 bp, Artificial Sequence
  Synthetic
gaagaaaggggggtgcttggcttggtcactggctcagacatcaggaagaggaggccagacgattttcaaccgaag

SEQ ID NO: 265250 - DNA, 75 bp, Artificial Sequence
  Synthetic
gaagaaaggggggtgcttggcttggtcactggctcagacatcaggaagaggaggccagacgattttcatccgaag

SEQ ID NO: 265251 - DNA, 75 bp, Artificial Sequence
  Synthetic
gaagaaaggggggtgcttggcttggtcactggctcagacatcaggaagaggaggccagacgattttcacccgaag

SEQ ID NO: 265252 - DNA, 75 bp, Artificial Sequence
  Synthetic
gaagaaaggggggtgcttggcttggtcactggctcagacatcaggaagaggaggccagacgattttcagccgaag

SEQ ID NO: 265253 - DNA, 75 bp, Artificial Sequence
  Synthetic
gaagaaaggggggtgcttgggttggtcactggctcagacatcaggaagaggaggccagacgattttcaaccgaag

SEQ ID NO: 265254 - DNA, 75 bp, Artificial Sequence
  Synthetic
gaagaaaggggggtgcttgggttggtcactggctcagacatcaggaagaggaggccagacgattttcatccgaag

SEQ ID NO: 265255 - DNA, 75 bp, Artificial Sequence
  Synthetic
gaagaaaggggggtgcttgggttggtcactggctcagacatcaggaagaggaggccagacgattttcacccgaag

SEQ ID NO: 265256 - DNA, 75 bp, Artificial Sequence
  Synthetic
gaagaaaggggggtgcttgggttggtcactggctcagacatcaggaagaggaggccagacgattttcagccgaag

SEQ ID NO: 265257 - DNA, 75 bp, Artificial Sequence
  Synthetic
gggcctctcttggtctagtcacaggctctgaaatcaggaagagaaacccagatgatttcaagcccaagggaaagc

SEQ ID NO: 265258 - DNA, 75 bp, Artificial Sequence
  Synthetic
gtgtacagtggttgcacctatacacttgagtctgatggcaagggcagtgtgaaagttgacagagttcagagcgcc

SEQ ID NO: 265259 - DNA, 75 bp, Artificial Sequence
  Synthetic
ttatgggtttttaatacagataggttgcctctgttcgcaaacagaaggtgatatttttgtaataggatgccggtg

SEQ ID NO: 265260 - DNA, 75 bp, Artificial Sequence
  Synthetic
tggtcaagaatagtcccattgggcactggctggggcttctgggtctcatccaacctcctgatcacaacaacacac

SEQ ID NO: 265261 - DNA, 75 bp, Artificial Sequence
  Synthetic
taaaacgaaccaggcccccaaatccacacccagcagtgggtcttcagtgaggtcacactcaacccaaatcactaa

SEQ ID NO: 265262 - DNA, 75 bp, Artificial Sequence
  Synthetic
tgcctctgttcgcaaacagaaggtgatatttttgtaataggatgccggtgggcaccatattcagatttaatttta

SEQ ID NO: 265263 - DNA, 75 bp, Artificial Sequence
  Synthetic
cccagggcgcacaagagttcttcggggtccccgtcaagcaaattcagatacacaaatcgggcgaattctgccgct

SEQ ID NO: 265264 - DNA, 75 bp, Artificial Sequence
  Synthetic
tcaaatacataagtctggagagttctgcaggttcagattcccgagaccaatcagaccagatgtcacagggctcgt

SEQ ID NO: 265265 - DNA, 75 bp, Artificial Sequence
  Synthetic
tcaaattcataagtctggagagttctgcaggttcagattcccgagaccaatcagaccagatgtcacagggctcgt

SEQ ID NO: 265266 - DNA, 75 bp, Artificial Sequence
  Synthetic
tcaaatccataagtctggagagttctgcaggttcagattcccgagaccaatcagaccagatgtcacagggctcgt

SEQ ID NO: 265267 - DNA, 75 bp, Artificial Sequence
  Synthetic
tcaaatgcataagtctggagagttctgcaggttcagattcccgagaccaatcagaccagatgtcacagggctcgt

SEQ ID NO: 265268 - DNA, 75 bp, Artificial Sequence
  Synthetic
ggggggagtcaaatgtttagtgaaaagattactttaaatttggtttaaattggatttgattaggaatcttttaaa

SEQ ID NO: 265269 - DNA, 75 bp, Artificial Sequence
  Synthetic
atcagagaagaaagaaacggcaagtactccatagaagagtaccttcaggacagggacaagtactatgaggaggtg

SEQ ID NO: 265270 - DNA, 75 bp, Artificial Sequence
  Synthetic
gatcttggcaccggtcctggtgactgcggttgtccttacatctacaaacgtggcaatgatatagttgtcgcgggt

SEQ ID NO: 265271 - DNA, 75 bp, Artificial Sequence
  Synthetic
gcggttgtccttacatctacaaacgtggcaatgatatagttgtcgcgggtgtccaaaccgcagcagcccggggag

SEQ ID NO: 265272 - DNA, 75 bp, Artificial Sequence
  Synthetic
gcggttgtccttacatctacaaacgtggcaatgatatagttgtcgcgggtgtccataccgcagcagcccggggag

SEQ ID NO: 265273 - DNA, 75 bp, Artificial Sequence
  Synthetic
gcggttgtccttacatctacaaacgtggcaatgatatagttgtcgcgggtgtccacaccgcagcagcccggggag

SEQ ID NO: 265274 - DNA, 75 bp, Artificial Sequence
  Synthetic
gcggttgtccttacatctacaaacgtggcaatgatatagttgtcgcgggtgtccagaccgcagcagcccggggag

SEQ ID NO: 265275 - DNA, 75 bp, Artificial Sequence
  Synthetic
ctctgaaatcaggaagaggaacccagatgatttcaagcccaagggaaaactgtgggctgatgatgacaggagtgt

SEQ ID NO: 265276 - DNA, 75 bp, Artificial Sequence
  Synthetic
ataacaatgctaacaacactagtgctacatctcgatttttatcgagatttaggggtttaggtggtggcgcgagcc

SEQ ID NO: 265277 - DNA, 75 bp, Artificial Sequence
  Synthetic
actgcggcgccccaattttgggcccaggcaaggcgcccaaactcagcacgaagaccaaattctggcgttcatcac

SEQ ID NO: 265278 - DNA, 75 bp, Artificial Sequence
  Synthetic
agtggtcaacattgccccacagttaagatcgggcctaaaacattaacaattccccctgagcccccaaatggtgaa

SEQ ID NO: 265279 - DNA, 75 bp, Artificial Sequence
  Synthetic
cacagaaatggccttgggtttgattggcaagacaacccaaggggcagcaggggccaatgacctgccacctaaaca

SEQ ID NO: 265280 - DNA, 75 bp, Artificial Sequence
  Synthetic
gccccaaaactcagcaccaagactaaattctggagatcatccacagcaccgctcccacctggtacctatgagcca

SEQ ID NO: 265281 - DNA, 75 bp, Artificial Sequence
  Synthetic
aggcaaggcgcccaaactcagcacgaagaccaaattctggcgttcatcaccagacgccttgccgccgggcactta

SEQ ID NO: 265282 - DNA, 75 bp, Artificial Sequence
  Synthetic
ccgttcacagaacccaggggcaaaccaccaaagccaagtgtgctggaggctgccaagagaaccatcatcaatgtc

SEQ ID NO: 265283 - DNA, 75 bp, Artificial Sequence
  Synthetic
gctaaaacctttcacagaacccaggggaaagccacctagacctgcagtcttagaagaagccaaaaagacagtgat

SEQ ID NO: 265284 - DNA, 75 bp, Artificial Sequence
  Synthetic
gctaaaacctttcacagaacccaggggtaagccacctagacctgcagtcttagaagaagccaaaaagacagtgat

SEQ ID NO: 265285 - DNA, 75 bp, Artificial Sequence
  Synthetic
gctaaaacctttcacagaacccaggggcaagccacctagacctgcagtcttagaagaagccaaaaagacagtgat

SEQ ID NO: 265286 - DNA, 75 bp, Artificial Sequence
  Synthetic
gctaaaacctttcacagaacccagggggaagccacctagacctgcagtcttagaagaagccaaaaagacagtgat

SEQ ID NO: 265287 - DNA, 75 bp, Artificial Sequence
  Synthetic
caccaaagccaagtgtgctggaggctgccaagagaaccatcatcaatgtccttgagcaaacaattgatccacctc

SEQ ID NO: 265288 - DNA, 75 bp, Artificial Sequence
  Synthetic
ggaaagccacctagacctgcagtcttagaagaagccaaaaagacagtgatgaatgttctagaacaaaccattgac

SEQ ID NO: 265289 - DNA, 75 bp, Artificial Sequence
  Synthetic
ggtaagccacctagacctgcagtcttagaagaagccaaaaagacagtgatgaatgttctagaacaaaccattgac

SEQ ID NO: 265290 - DNA, 75 bp, Artificial Sequence
  Synthetic
ggcaagccacctagacctgcagtcttagaagaagccaaaaagacagtgatgaatgttctagaacaaaccattgac

SEQ ID NO: 265291 - DNA, 75 bp, Artificial Sequence
  Synthetic
gggaagccacctagacctgcagtcttagaagaagccaaaaagacagtgatgaatgttctagaacaaaccattgac

SEQ ID NO: 265292 - DNA, 75 bp, Artificial Sequence
  Synthetic
agtcaaatggtcagtgcgtgatggagttgaccttggagtgaatcgcctcacaacggtgagtggccccgagtggaa

SEQ ID NO: 265293 - DNA, 75 bp, Artificial Sequence
  Synthetic
gtcaagaaaaatgaccattggaatggggaatccttcactggcccccttgcagatcaagcatccaaagccaacctc

SEQ ID NO: 265294 - DNA, 75 bp, Artificial Sequence
  Synthetic
agcccgtgtacacggccgcgctcaaagatgagctagttaaaactgacaagatttacaaaaagataaagaaaaggc

SEQ ID NO: 265295 - DNA, 75 bp, Artificial Sequence
  Synthetic
agacagttggtgtgcattccccacaggcggcattctcagtggccagagtaaccatccaacccatagctgcttggt

SEQ ID NO: 265296 - DNA, 75 bp, Artificial Sequence
  Synthetic
gggctcggacttagcgaccatgatccggtgcgctcgagcattcggaggcttgatggatgaactcaaggcacactg

SEQ ID NO: 265297 - DNA, 75 bp, Artificial Sequence
  Synthetic
ccatttacagagcccaggggcaaaccaccaaagccaagtgtgttggaggctgccaagaaaaccatcatcaatgtc

SEQ ID NO: 265298 - DNA, 75 bp, Artificial Sequence
  Synthetic
agttgcatagccctcccatgaagggtaggaatgaacatgaatgaagatggtcccatcatatttgacaaacactct

SEQ ID NO: 265299 - DNA, 75 bp, Artificial Sequence
  Synthetic
agttgcatagccctcccatgtagggtaggaatgaacatgaatgaagatggtcccatcatatttgacaaacactct

SEQ ID NO: 265300 - DNA, 75 bp, Artificial Sequence
  Synthetic
agttgcatagccctcccatgcagggtaggaatgaacatgaatgaagatggtcccatcatatttgacaaacactct

SEQ ID NO: 265301 - DNA, 75 bp, Artificial Sequence
  Synthetic
agttgcatagccctcccatggagggtaggaatgaacatgaatgaagatggtcccatcatatttgacaaacactct

SEQ ID NO: 265302 - DNA, 75 bp, Artificial Sequence
  Synthetic
cggtgcgctcgagcattcggaggcttgatggatgaactcaaggcacactgtgttacacttcccatcagagttggc

SEQ ID NO: 265303 - DNA, 75 bp, Artificial Sequence
  Synthetic
taggaatgaacatgaatgaagatggtcccatcatatttgacaaacactctaagtataagtaccattatgatgctg

SEQ ID NO: 265304 - DNA, 75 bp, Artificial Sequence
  Synthetic
cgcgtccctcgacaagactacttccagtggccatccgcaccacatacggaaaaacgactgctggaacggggaatc

SEQ ID NO: 265305 - DNA, 75 bp, Artificial Sequence
  Synthetic
tctcggtgggattcaacacaacaaagggccgtgttagcagcagccctagaaatcatggttaaattctccccagaa

SEQ ID NO: 265306 - DNA, 75 bp, Artificial Sequence
  Synthetic
ccgaaccagagctggcacaagtggttgcagaggacctcctggctcccagtcaactagatgttggcgactttgtca

SEQ ID NO: 265307 - DNA, 75 bp, Artificial Sequence
  Synthetic
ccgatccagagctggcacaagtggttgcagaggacctcctggctcccagtcaactagatgttggcgactttgtca

SEQ ID NO: 265308 - DNA, 75 bp, Artificial Sequence
  Synthetic
ccgacccagagctggcacaagtggttgcagaggacctcctggctcccagtcaactagatgttggcgactttgtca

SEQ ID NO: 265309 - DNA, 75 bp, Artificial Sequence
  Synthetic
ccgagccagagctggcacaagtggttgcagaggacctcctggctcccagtcaactagatgttggcgactttgtca

SEQ ID NO: 265310 - DNA, 75 bp, Artificial Sequence
  Synthetic
ttgttttgagttttgctgtcaagttatgaaccttgaggacacatggttacagaggcgactaataacatcaggtag

SEQ ID NO: 265311 - DNA, 75 bp, Artificial Sequence
  Synthetic
tgcagaggacctcctggctcccagtcaactagatgttggcgactttgtcatctcagtccaggagggtctgccatc

SEQ ID NO: 265312 - DNA, 75 bp, Artificial Sequence
  Synthetic
agatgccatactggccgcggtgaatggccttgtttcacaaccctttaaaaatttcttgggcaagctcaagcccct

SEQ ID NO: 265313 - DNA, 75 bp, Artificial Sequence
  Synthetic
gggtctctcaccagatgttgttcaagctcactcctgtttctcattctacggtgatgatgagatcgtcagcactga

SEQ ID NO: 265314 - DNA, 75 bp, Artificial Sequence
  Synthetic
atttcttgggcaagctcaagccccttaacgtgttaaacatcttatctaactgtgattggaccttcatgggggtgg

SEQ ID NO: 265315 - DNA, 75 bp, Artificial Sequence
  Synthetic
gctcactcctgtttctcattctacggtgatgatgagatcgtcagcactgacatcaaccttgatcccatgaagttg

SEQ ID NO: 265316 - DNA, 75 bp, Artificial Sequence
  Synthetic
ctctcctccctgacttccacctccaggggccagaagacctagcccgggatctggtgccagtcattcttggtggca

SEQ ID NO: 265317 - DNA, 75 bp, Artificial Sequence
  Synthetic
gatctcaccggcctaacgttcctgcgtagggcaatcgcacgagacccagcagggtggtttggaaaattggatcaa

SEQ ID NO: 265318 - DNA, 75 bp, Artificial Sequence
  Synthetic
gatctcaccggcctaacgttcctgcgtagggcaatcgcacgagacccagctgggtggtttggaaaattggatcaa

SEQ ID NO: 265319 - DNA, 75 bp, Artificial Sequence
  Synthetic
gatctcaccggcctaacgttcctgcgtagggcaatcgcacgagacccagccgggtggtttggaaaattggatcaa

SEQ ID NO: 265320 - DNA, 75 bp, Artificial Sequence
  Synthetic
gatctcaccggcctaacgttcctgcgtagggcaatcgcacgagacccagcggggtggtttggaaaattggatcaa

SEQ ID NO: 265321 - DNA, 75 bp, Artificial Sequence
  Synthetic
gatctcaccggccttacgttcctgcgtagggcaatcgcacgagacccagcagggtggtttggaaaattggatcaa

SEQ ID NO: 265322 - DNA, 75 bp, Artificial Sequence
  Synthetic
gatctcaccggccttacgttcctgcgtagggcaatcgcacgagacccagctgggtggtttggaaaattggatcaa

SEQ ID NO: 265323 - DNA, 75 bp, Artificial Sequence
  Synthetic
gatctcaccggccttacgttcctgcgtagggcaatcgcacgagacccagccgggtggtttggaaaattggatcaa

SEQ ID NO: 265324 - DNA, 75 bp, Artificial Sequence
  Synthetic
gatctcaccggccttacgttcctgcgtagggcaatcgcacgagacccagcggggtggtttggaaaattggatcaa

SEQ ID NO: 265325 - DNA, 75 bp, Artificial Sequence
  Synthetic
gatctcaccggcctcacgttcctgcgtagggcaatcgcacgagacccagcagggtggtttggaaaattggatcaa

SEQ ID NO: 265326 - DNA, 75 bp, Artificial Sequence
  Synthetic
gatctcaccggcctcacgttcctgcgtagggcaatcgcacgagacccagctgggtggtttggaaaattggatcaa

SEQ ID NO: 265327 - DNA, 75 bp, Artificial Sequence
  Synthetic
gatctcaccggcctcacgttcctgcgtagggcaatcgcacgagacccagccgggtggtttggaaaattggatcaa

SEQ ID NO: 265328 - DNA, 75 bp, Artificial Sequence
  Synthetic
gatctcaccggcctcacgttcctgcgtagggcaatcgcacgagacccagcggggtggtttggaaaattggatcaa

SEQ ID NO: 265329 - DNA, 75 bp, Artificial Sequence
  Synthetic
gatctcaccggcctgacgttcctgcgtagggcaatcgcacgagacccagcagggtggtttggaaaattggatcaa

SEQ ID NO: 265330 - DNA, 75 bp, Artificial Sequence
  Synthetic
gatctcaccggcctgacgttcctgcgtagggcaatcgcacgagacccagctgggtggtttggaaaattggatcaa

SEQ ID NO: 265331 - DNA, 75 bp, Artificial Sequence
  Synthetic
gatctcaccggcctgacgttcctgcgtagggcaatcgcacgagacccagccgggtggtttggaaaattggatcaa

SEQ ID NO: 265332 - DNA, 75 bp, Artificial Sequence
  Synthetic
gatctcaccggcctgacgttcctgcgtagggcaatcgcacgagacccagcggggtggtttggaaaattggatcaa

SEQ ID NO: 265333 - DNA, 75 bp, Artificial Sequence
  Synthetic
acttaaacccagagaaactaacagcaaagctcaaggaatacgggttgaaaccaacccgccctgacaaaactgagg

SEQ ID NO: 265334 - DNA, 75 bp, Artificial Sequence
  Synthetic
agatagggtcactaaagtcatgaaaagtgctgtagatgggctccgggccgccacgcagctagggcaatacggatt

SEQ ID NO: 265335 - DNA, 75 bp, Artificial Sequence
  Synthetic
cccatatgagagcatggtccctcaatcccagcgggccacacagctcatggccctcctcggtgaggcttcactgca

SEQ ID NO: 265336 - DNA, 75 bp, Artificial Sequence
  Synthetic
cccatatgagagcatggtccctcattcccagcgggccacacagctcatggccctcctcggtgaggcttcactgca

SEQ ID NO: 265337 - DNA, 75 bp, Artificial Sequence
  Synthetic
cccatatgagagcatggtccctcactcccagcgggccacacagctcatggccctcctcggtgaggcttcactgca

SEQ ID NO: 265338 - DNA, 75 bp, Artificial Sequence
  Synthetic
cccatatgagagcatggtccctcagtcccagcgggccacacagctcatggccctcctcggtgaggcttcactgca

SEQ ID NO: 265339 - DNA, 75 bp, Artificial Sequence
  Synthetic
ttgcctgacctttccaccgtcaggcaaccggaagaatctaacacggccttcagtgtccctccactcaatcagagg

SEQ ID NO: 265340 - DNA, 75 bp, Artificial Sequence
  Synthetic
agttggacccagagaaattgacagcaaaactcaaggaatacgggttgaaaccaacccgccctgacaaaactgaag

SEQ ID NO: 265341 - DNA, 75 bp, Artificial Sequence
  Synthetic
atgatgtgtggacctcctggaattggaaaaactaaggcagcggagcacttggcaaaacgcctggctaatgagatc

SEQ ID NO: 265342 - DNA, 75 bp, Artificial Sequence
  Synthetic
aaattttgtccaagcaccacagggcgagttcaccgtctcaccgaggaactcgccaggtgagatgctattaaatct

SEQ ID NO: 265343 - DNA, 75 bp, Artificial Sequence
  Synthetic
aaattttgtccaagcaccacagggcgagttcaccgtctctccgaggaactcgccaggtgagatgctattaaatct

SEQ ID NO: 265344 - DNA, 75 bp, Artificial Sequence
  Synthetic
aaattttgtccaagcaccacagggcgagttcaccgtctccccgaggaactcgccaggtgagatgctattaaatct

SEQ ID NO: 265345 - DNA, 75 bp, Artificial Sequence
  Synthetic
aaattttgtccaagcaccacagggcgagttcaccgtctcgccgaggaactcgccaggtgagatgctattaaatct

SEQ ID NO: 265346 - DNA, 75 bp, Artificial Sequence
  Synthetic
ggttcaggtggtcctagctgggaatgcgttcacagctgggaaaatcatctttgccgccataccgccacattttcc

SEQ ID NO: 265347 - DNA, 75 bp, Artificial Sequence
  Synthetic
gctccaggccattgctgactctgccccactcactctcaattgtgataggattgaaaacaaggggatgcagtttgt

SEQ ID NO: 265348 - DNA, 75 bp, Artificial Sequence
  Synthetic
acttctgccccttcctgacataaggaacaggttctttcattacaatcaggagaacaccccccggatgagacttgt

SEQ ID NO: 265349 - DNA, 75 bp, Artificial Sequence
  Synthetic
cagacgggttgacttcctggtctactgttctgccccagaagtggagcagataaggagagtcagccctggtgacac

SEQ ID NO: 265350 - DNA, 75 bp, Artificial Sequence
  Synthetic
aacaggttctttcattacaatcaggagaacaccccccggatgagacttgtggctatgctttatacccctctgagg

SEQ ID NO: 265351 - DNA, 75 bp, Artificial Sequence
  Synthetic
ggaccttgcagttgagctcgtccccgtggtgatggggggaattggtttggtgctgggattcaccaaagagaagat

SEQ ID NO: 265352 - DNA, 75 bp, Artificial Sequence
  Synthetic
ttcttagtaccaccaactgttgaatcaaagactaaaccttttacactgcccatattaacccttggtgagctatct

SEQ ID NO: 265353 - DNA, 75 bp, Artificial Sequence
  Synthetic
aagggtgttatgaaaccaacaaccatcaataggctcctcatacaagctgtggctcttaccatggagagacaggat

SEQ ID NO: 265354 - DNA, 75 bp, Artificial Sequence
  Synthetic
catcccccgattttgattttatatttctggtgccacccacagttgaatcaagaactaaaccattcactgtcccag

SEQ ID NO: 265355 - DNA, 75 bp, Artificial Sequence
  Synthetic
gagttccggctccaggggaagatgtatgattttgatgatgatagggtgtcagccttcaccaccatggcacgcgat

SEQ ID NO: 265356 - DNA, 75 bp, Artificial Sequence
  Synthetic
ggaaattgtggttcaaccacaaaatggtaggtgcactcttgatggcactctgcaaggcaccacacaactggtccc

SEQ ID NO: 265357 - DNA, 75 bp, Artificial Sequence
  Synthetic
aatgctttgaaggggtacaaaattggtgcgtgcacaattaagtggcaggccaaggtatattcactggaatcagat

SEQ ID NO: 265358 - DNA, 75 bp, Artificial Sequence
  Synthetic
tgttacccatattgcgggtagccatgattacacaatgaatttggcatcccaaaattggagcaattatgacccaac

SEQ ID NO: 265359 - DNA, 75 bp, Artificial Sequence
  Synthetic
accaacagggtctctgcattaaggaagctggccgcagacaacaagtatgggatcatggagacaatgagagtgggc

SEQ ID NO: 265360 - DNA, 75 bp, Artificial Sequence
  Synthetic
accaacagggtctctgcatttaggaagctggccgcagacaacaagtatgggatcatggagacaatgagagtgggc

SEQ ID NO: 265361 - DNA, 75 bp, Artificial Sequence
  Synthetic
accaacagggtctctgcattcaggaagctggccgcagacaacaagtatgggatcatggagacaatgagagtgggc

SEQ ID NO: 265362 - DNA, 75 bp, Artificial Sequence
  Synthetic
accaacagggtctctgcattgaggaagctggccgcagacaacaagtatgggatcatggagacaatgagagtgggc

SEQ ID NO: 265363 - DNA, 75 bp, Artificial Sequence
  Synthetic
gcagtcggtatgcgctgcctccattgcactcacccgcctgcgggccgcgcgtgcagtggcgtatgcgtcatgcat

SEQ ID NO: 265364 - DNA, 75 bp, Artificial Sequence
  Synthetic
agcggacggctcgacccgtgcccacaaagctacagtgagcactgggagtgtccacttcactccaaagctgggtag

SEQ ID NO: 265365 - DNA, 75 bp, Artificial Sequence
  Synthetic
gtgcagtggcgtatgcgtcatgcatccaatcagccataacctccatactacaaattgctgcctcagccctagtgg

SEQ ID NO: 265366 - DNA, 75 bp, Artificial Sequence
  Synthetic
ctgctgagatttgtgaatccagacacaggtagggttctgtttgagtgcaagctccataaatcaggctatatcaca

SEQ ID NO: 265367 - DNA, 75 bp, Artificial Sequence
  Synthetic
tccacttcactccaaagctgggtagtgttcaattcaccactgacacgaacaatgatttccaagctggccaaaaca

SEQ ID NO: 265368 - DNA, 75 bp, Artificial Sequence
  Synthetic
tgctgggagagatgggtcaaaccaaccgagacccaggaaacgagtgaaaccgaaaaggaagtagcccaaggcaaa

SEQ ID NO: 265369 - DNA, 75 bp, Artificial Sequence
  Synthetic
tgctgggagagatgggtcaaaccaaccgagacccaggaaacgagtgaatccgaaaaggaagtagcccaaggcaaa

SEQ ID NO: 265370 - DNA, 75 bp, Artificial Sequence
  Synthetic
tgctgggagagatgggtcaaaccaaccgagacccaggaaacgagtgaacccgaaaaggaagtagcccaaggcaaa

SEQ ID NO: 265371 - DNA, 75 bp, Artificial Sequence
  Synthetic
tgctgggagagatgggtcaaaccaaccgagacccaggaaacgagtgaagccgaaaaggaagtagcccaaggcaaa

SEQ ID NO: 265372 - DNA, 75 bp, Artificial Sequence
  Synthetic
ctagagggtccccccaaagaacacaagtgcagagtccaccaggctaaggccgcagggaaaggacccattggccac

SEQ ID NO: 265373 - DNA, 75 bp, Artificial Sequence
  Synthetic
attactcaggtagaactggtcacaatgtgcacctggcccctgctgtcgcccccactttccccggtgagcagcttc

SEQ ID NO: 265374 - DNA, 75 bp, Artificial Sequence
  Synthetic
cccactttccccggtgagcagcttcttttctttagatccaccatgccagggtgtagcgggtaccccaacatgaat

SEQ ID NO: 265375 - DNA, 75 bp, Artificial Sequence
  Synthetic
gtgaatgatgatggcgtcgaaagacgtcgttgcaactaacgcttcaagcactggtgacaatagtaacacaatgaa

SEQ ID NO: 265376 - DNA, 75 bp, Artificial Sequence
  Synthetic
gccaccatagaaggcaagaataaagggaagaacaagaaagggcgcggccgaaagaataattacaatgccttttcc

SEQ ID NO: 265377 - DNA, 75 bp, Artificial Sequence
  Synthetic
aacatgataaagagatgctccaagcacaaattgaggctactcaaaaattgcaacaggatctgatgaaggttaaac

SEQ ID NO: 265378 - DNA, 75 bp, Artificial Sequence
  Synthetic
ctggtgacaatagtaacacaatgaaggatcgctttttagcgagactcaaaagtttgggtaacaccaagcccataa

SEQ ID NO: 265379 - DNA, 75 bp, Artificial Sequence
  Synthetic
ggatcgctttttagcgagactcaaaagtttgggtaacaccaagcccataaaaattgaaaacacacaaatggctct

SEQ ID NO: 265380 - DNA, 75 bp, Artificial Sequence
  Synthetic
caggaatacctagaagatagacaaaggtatgaagaggagcttgctgaggttcaagcaggtggagacggagggatc

SEQ ID NO: 265381 - DNA, 75 bp, Artificial Sequence
  Synthetic
gagtgtggctgaaacccaacaggcaatgggatggacagacccacccgttgatcaaaacctgccaacatgggagga

SEQ ID NO: 265382 - DNA, 75 bp, Artificial Sequence
  Synthetic
atgggatggacagacccacccgttgatcaaaacctgccaacatgggaggagttgagccagtctgagaagcagaaa

SEQ ID NO: 265383 - DNA, 75 bp, Artificial Sequence
  Synthetic
ttctgtgtattcaaatcaaactgtttcaacgagactaggttcttcagctggttctggtaccggtgtctcgagtct

SEQ ID NO: 265384 - DNA, 75 bp, Artificial Sequence
  Synthetic
ttctacacactcgcccccatgggaaatggaacggggcgcaggcgtgcattataatggctggagctttctttgctg

SEQ ID NO: 265385 - DNA, 75 bp, Artificial Sequence
  Synthetic
cgccaactgggattagtcacaggttctgacatccggaaaaggaaaccaattgactggaccccccctaagtcagca

SEQ ID NO: 265386 - DNA, 75 bp, Artificial Sequence
  Synthetic
gttcaagacaacggtgatggtgaccagcaggttaaatggagtgctaaagatggtgtcaatctgggggttgatgcc

SEQ ID NO: 265387 - DNA, 75 bp, Artificial Sequence
  Synthetic
agcaggttaaatggagtgctaaagatggtgtcaatctgggggttgatgccctaacaactgtccaaggccccccat

SEQ ID NO: 265388 - DNA, 75 bp, Artificial Sequence
  Synthetic
ggcgccccccactttgtggagccgggtcacaaaatttggatctgggtggggcttttgggttagtcccacagtctt

SEQ ID NO: 265389 - DNA, 75 bp, Artificial Sequence
  Synthetic
ttgagttctatgaagggcacatataccattatgccatgtacataggtcaggggaaaacaattggtgtgcattccc

SEQ ID NO: 265390 - DNA, 75 bp, Artificial Sequence
  Synthetic
ccattatgccatgtacataggtcaggggaaaacaattggtgtgcattcccctagggccgctttctccatacctag

SEQ ID NO: 265391 - DNA, 75 bp, Artificial Sequence
  Synthetic
cagggccggagaattcaccctcttcaggttttctaagaaaatcaggcccgatctcacgggcatgatccttgagga

SEQ ID NO: 265392 - DNA, 75 bp, Artificial Sequence
  Synthetic
gcaatcaacgcccccatgacaaaggctctggactggagcggaacaaggtactgggcccctgatgccagggtcaca

SEQ ID NO: 265393 - DNA, 75 bp, Artificial Sequence
  Synthetic
ccaacttaaagagcttgaaaatgaaccttggccatatgcagctgttactaacaactgctatgagttttgctgcag

SEQ ID NO: 265394 - DNA, 75 bp, Artificial Sequence
  Synthetic
gatgggcgcaatagcatcaatgcgcatacagggtcgccttgtccatggccagtctggtatgttgctcaccggggc

SEQ ID NO: 265395 - DNA, 75 bp, Artificial Sequence
  Synthetic
atacagggtcgccttgtccatggccagtctggtatgttgctcaccggggcgaatgctaagggcatggaccttgga

SEQ ID NO: 265396 - DNA, 75 bp, Artificial Sequence
  Synthetic
gctcctgctcggagctcccccagtgcactttctaatgctcctactgccacttctttgcattcaaatcaaactgtt

SEQ ID NO: 265397 - DNA, 75 bp, Artificial Sequence
  Synthetic
ccttggccatatgcagctgttactaacaactgctatgagttttgctgcaggataatggatctacaggatacgtgg

SEQ ID NO: 265398 - DNA, 75 bp, Artificial Sequence
  Synthetic
actatcccaggggattgtggagctccctatgtctataagagagcaaatgactgggtggtttgtggtgtgcatgct

SEQ ID NO: 265399 - DNA, 75 bp, Artificial Sequence
  Synthetic
cagcaagatagtaagttggaggttgtccgtgatgccgtcttagcagcaattaatggcctggtctcacgcccgttc

SEQ ID NO: 265400 - DNA, 75 bp, Artificial Sequence
  Synthetic
tccgtgatgccgtcttagcagcaattaatggcctggtctcacgcccgttcaagaacttgctaaataagcttaaac

SEQ ID NO: 265401 - DNA, 75 bp, Artificial Sequence
  Synthetic
gacaaaggtcactatgccgggcatgagataatcaagcatggatgtgggccagccctatcaaccaaaacaaagttc

SEQ ID NO: 265402 - DNA, 75 bp, Artificial Sequence
  Synthetic
agccctatcaaccaaaacaaagttctggaagtcgtcccctgaaccactaccccctggagtctatgaacctgcata

SEQ ID NO: 265403 - DNA, 75 bp, Artificial Sequence
  Synthetic
tggaactctttggggtcttttgggacccccctgacgtgtccaacttcatagcttctctcctccctgacatgcacc

SEQ ID NO: 265404 - DNA, 75 bp, Artificial Sequence
  Synthetic
cccccctgacgtgtccaacttcatagcttctctcctccctgacatgcaccttcaaggcccggaagacttggccaa

SEQ ID NO: 265405 - DNA, 75 bp, Artificial Sequence
  Synthetic
tgggctgacgatgacaggagtgtggactacaatgagaaactcagttttgaggccccaccaagcatctggtcgaga

SEQ ID NO: 265406 - DNA, 75 bp, Artificial Sequence
  Synthetic
gaaccaggtctcctggaggccgcagttgagactgtgacctcatcactggagcaggttatggataccccagtgcca

SEQ ID NO: 265407 - DNA, 75 bp, Artificial Sequence
  Synthetic
gaaaagtgcagttgatggtttgcgtgcagctacccaactggggcaatatggcctggaagtcttcgcagtcatcaa

SEQ ID NO: 265408 - DNA, 75 bp, Artificial Sequence
  Synthetic
gcagctacccaactggggcaatatggcctggaagtcttcgcagtcatcaagaagtatttctttggaggtgatcag

SEQ ID NO: 265409 - DNA, 75 bp, Artificial Sequence
  Synthetic
gatgattggaacggcactgccttcatcagggaattgggagagcaagcggcgcacgccaataacatgtatgaacaa

SEQ ID NO: 265410 - DNA, 75 bp, Artificial Sequence
  Synthetic
tcagggaattgggagagcaagcggcgcacgccaataacatgtatgaacaagctaagagcatgaagcccatgtaca

SEQ ID NO: 265411 - DNA, 75 bp, Artificial Sequence
  Synthetic
cgctaccactgcctcttgtggcgaaaacaccactaagaaagacagtgacaagcccttttggagctttagctccaa

SEQ ID NO: 265412 - DNA, 75 bp, Artificial Sequence
  Synthetic
ctagttagagacaagcaatctgccaggacttatatggccatactagatgctgaagaggaaaaggctagaaaacta

SEQ ID NO: 265413 - DNA, 75 bp, Artificial Sequence
  Synthetic
ggacttatatggccatactagatgctgaagaggaaaaggctagaaaactatctgtgaaacacgctgacccccacg

SEQ ID NO: 265414 - DNA, 75 bp, Artificial Sequence
  Synthetic
cccccctgatgatcggggtggggcggaacaggtccaacccctcgaagaacccgcggataccaccctaaggtataa

SEQ ID NO: 265415 - DNA, 75 bp, Artificial Sequence
  Synthetic
gaacaggtccaacccctcgaagaacccgcggataccaccctaaggtataacgcgcgggataacacaattgaaggg

SEQ ID NO: 265416 - DNA, 75 bp, Artificial Sequence
  Synthetic
tgacaaacagggttaagccagtggtgataatgatgtgtggccctcctggtataggcaagacgaaggctgccgagt

SEQ ID NO: 265417 - DNA, 75 bp, Artificial Sequence
  Synthetic
gataatgatgtgtggccctcctggtataggcaagacgaaggctgccgagtacctagccaaacggcttgccaatga

SEQ ID NO: 265418 - DNA, 75 bp, Artificial Sequence
  Synthetic
cctatatctacaagagaggtaatgactatgtggtcattggggtccacacggctgccgcacgtggggggaacactg

SEQ ID NO: 265419 - DNA, 75 bp, Artificial Sequence
  Synthetic
gaacaccaaccagcgcccgaaccactcccgggcgcgataatagagatgtgggatggcgagatttaccactatggt

SEQ ID NO: 265420 - DNA, 75 bp, Artificial Sequence
  Synthetic
attatgactgagtcattctcaatcatgtgccgattgactgcttctccagaattggcctcagtggtggcacaagat

SEQ ID NO: 265421 - DNA, 75 bp, Artificial Sequence
  Synthetic
tcccgggcgcgataatagagatgtgggatggcgagatttaccactatggtatctatgctggtggtggtaaagttc

SEQ ID NO: 265422 - DNA, 75 bp, Artificial Sequence
  Synthetic
ggttatgttgtgggatgactatggaatgtcaaagatagcagatgactgtaacaaactgcaagcaatcgctgatac

SEQ ID NO: 265423 - DNA, 75 bp, Artificial Sequence
  Synthetic
atgtcaaagatagcagatgactgtaacaaactgcaagcaatcgctgatacagcccctttaacactcaactgtgac

SEQ ID NO: 265424 - DNA, 75 bp, Artificial Sequence
  Synthetic
ttggtgactacgtcataagagtaaaggaaggccttccatccggcttcccatgcacgtcacaggtcaatagcataa

SEQ ID NO: 265425 - DNA, 75 bp, Artificial Sequence
  Synthetic
tcgtctacacaccccagaactccatccccatagattcactgcgccgcctggcaggcgagcgctttccttacacag

SEQ ID NO: 265426 - DNA, 75 bp, Artificial Sequence
  Synthetic
ccccatagattcactgcgccgcctggcaggcgagcgctttccttacacagcctttgataacaactgctacacttt

SEQ ID NO: 265427 - DNA, 75 bp, Artificial Sequence
  Synthetic
gttgactttgtcaacttaggacctgtctgtcggcgtgttgacttcctagtctattgctccgccccagaagtcgaa

SEQ ID NO: 265428 - DNA, 75 bp, Artificial Sequence
  Synthetic
tctgtcggcgtgttgacttcctagtctattgctccgccccagaagtcgaacaggtacggcgtgtcagccctggag

SEQ ID NO: 265429 - DNA, 75 bp, Artificial Sequence
  Synthetic
gccctaccaagactggaacaccaaacctgtccctacagtagatgacagcaagctgaaaaaggttgccaacgtgat

SEQ ID NO: 265430 - DNA, 75 bp, Artificial Sequence
  Synthetic
ttaaggagtatggcctcaagcccacccgccccgacaagagtgaaggtccaataattgtgaggaagaatgtggatg

SEQ ID NO: 265431 - DNA, 75 bp, Artificial Sequence
  Synthetic
cctgtccctacagtagatgacagcaagctgaaaaaggttgccaacgtgattctatgcggcctgacctcccttttc

SEQ ID NO: 265432 - DNA, 75 bp, Artificial Sequence
  Synthetic
ttgacaaccaagggaacacaccatttggcaagggcaccatgcgtcccaccaccataaacaggcttttaatccagg

SEQ ID NO: 265433 - DNA, 75 bp, Artificial Sequence
  Synthetic
tggcaagggcaccatgcgtcccaccaccataaacaggcttttaatccaggcagtcgccctcaccatggaacgcca

SEQ ID NO: 265434 - DNA, 75 bp, Artificial Sequence
  Synthetic
aaaggcagatttattggaccagagggcccaatcactcagacccctttgaaaccttggtgccccaccagcaaagaa

SEQ ID NO: 265435 - DNA, 75 bp, Artificial Sequence
  Synthetic
acttttggcggaattgtggagtcccttgtcctggtgggtgagcttttcgggatcttctggacgccgccagatgtt

SEQ ID NO: 265436 - DNA, 75 bp, Artificial Sequence
  Synthetic
ttgtcctggtgggtgagcttttcgggatcttctggacgccgccagatgttaccagttttcttgcttcaatcctag

SEQ ID NO: 265437 - DNA, 75 bp, Artificial Sequence
  Synthetic
agctaatggcttaagcttgattggtatggcaagcctcggaaagaggctacgtagtgtcaactcaatccatggcct

SEQ ID NO: 265438 - DNA, 75 bp, Artificial Sequence
  Synthetic
tgaggcttcattacatggtgaaaagttctacaggaagatctcaagcaaagtcatccaagaggttaaaacaggggg

SEQ ID NO: 265439 - DNA, 75 bp, Artificial Sequence
  Synthetic
atggcaagcctcggaaagaggctacgtagtgtcaactcaatccatggcctcaaaaatgccctgactggttacacc

SEQ ID NO: 265440 - DNA, 75 bp, Artificial Sequence
  Synthetic
tccttggcttcaccacagaaaagattgggcgcatgctgtcatccgctgcttcgacgctgcgcgcctgtaaagacc

SEQ ID NO: 265441 - DNA, 75 bp, Artificial Sequence
  Synthetic
tccatgatcttggcttgtggacaggagatcgcaatctcctgcccgaattcgtaaatgatgatggcgtctaaggac

SEQ ID NO: 265442 - DNA, 75 bp, Artificial Sequence
  Synthetic
agatcgcaatctcctgcccgaattcgtaaatgatgatggcgtctaaggacgccccaacatcccctgatggcgcca

SEQ ID NO: 265443 - DNA, 75 bp, Artificial Sequence
  Synthetic
gagaacacaagtgcacaaacccaacgccaacagtccattgacaccgctgtcctcgcgctcacccggctcagggct

SEQ ID NO: 265444 - DNA, 75 bp, Artificial Sequence
  Synthetic
gccaacagtccattgacaccgctgtcctcgcgctcacccggctcagggctgccagggctgccgcatatgcatctt

SEQ ID NO: 265445 - DNA, 75 bp, Artificial Sequence
  Synthetic
tgggcgcatgctgtcatccgctgcttcgacgctgcgcgcctgtaaagaccttggggcctatggcctcgacatatt

SEQ ID NO: 265446 - DNA, 75 bp, Artificial Sequence
  Synthetic
ggctaatacagctgagcaaatttcaatggaccctgttgcgggtgcttcaacagcagtcgcgacggctgggcaagt

SEQ ID NO: 265447 - DNA, 75 bp, Artificial Sequence
  Synthetic
cgccgttttggaccttgaggcgttggaaaacaaccacctcaccacccttcttaaggacaaggatagcctgacggc

SEQ ID NO: 265448 - DNA, 75 bp, Artificial Sequence
  Synthetic
gaaaacaaccacctcaccacccttcttaaggacaaggatagcctgacggcgtttatgaagactctcgatatggag

SEQ ID NO: 265449 - DNA, 75 bp, Artificial Sequence
  Synthetic
tgttcggcacccacactaatgccgtctccttagagggtcctgacagggaacaccgctgtcgagtgcatcaggcta

SEQ ID NO: 265450 - DNA, 75 bp, Artificial Sequence
  Synthetic
aataactttgtccaggcacctcaaggagaattcactatttcccctaataatacccccggtgatattttgtttgat

SEQ ID NO: 265451 - DNA, 75 bp, Artificial Sequence
  Synthetic
ctccttagagggtcctgacagggaacaccgctgtcgagtgcatcaggctaaggctaatggtcgtggccccattgg

SEQ ID NO: 265452 - DNA, 75 bp, Artificial Sequence
  Synthetic
agaatttcagcagccaggtcgctcctacacaaggcacgggaagaactttgcgccaggattcgcccggtggtcgtc

SEQ ID NO: 265453 - DNA, 75 bp, Artificial Sequence
  Synthetic
gtataatggttgggtcggcaatatgcgtgtgcgcatactgttggccgggaatgcctttacagctggaaagataat

SEQ ID NO: 265454 - DNA, 75 bp, Artificial Sequence
  Synthetic
tacacaaggcacgggaagaactttgcgccaggattcgcccggtggtcgtcatgatctccggcagaccgggcatag

SEQ ID NO: 265455 - DNA, 75 bp, Artificial Sequence
  Synthetic
tgaattgcccactgcaagccatgaaggcaagaacaaagggaaaaccaaaaagggccgaggccgaaaagccaatta

SEQ ID NO: 265456 - DNA, 75 bp, Artificial Sequence
  Synthetic
ggcaagaacaaagggaaaaccaaaaagggccgaggccgaaaagccaattacaatgccttctctagacgtggtctc

SEQ ID NO: 265457 - DNA, 75 bp, Artificial Sequence
  Synthetic
tgctgatgttaggacccttgagcctgtggagcttcctttggaggatgtgcgcaacgttctctaccacaatagtag

SEQ ID NO: 265458 - DNA, 75 bp, Artificial Sequence
  Synthetic
tgcctaggaatggcgttgaccactgggacgcctacaagggagaacgcatagtcttgtgggatgattatggtatga

SEQ ID NO: 265459 - DNA, 75 bp, Artificial Sequence
  Synthetic
gaagatggcgtctaacgacgcttccgctgccgttgctggcaaaaacaacaacaacgacaaggaaaaatcttcaag

SEQ ID NO: 265460 - DNA, 75 bp, Artificial Sequence
  Synthetic
gaagacaggcagcgctatgaggaggagatggctgaagtgcaggccggcggcgatggtggaataggtgagacagag

SEQ ID NO: 265461 - DNA, 75 bp, Artificial Sequence
  Synthetic
agatggctgaagtgcaggccggcggcgatggtggaataggtgagacagagatggagatacgccatcgagtcttct

SEQ ID NO: 265462 - DNA, 75 bp, Artificial Sequence
  Synthetic
ggacgcctacaagggagaacgcatagtcttgtgggatgattatggtatgagtaacccaatcaaggatgccttgac

SEQ ID NO: 265463 - DNA, 75 bp, Artificial Sequence
  Synthetic
agaaacaaaacaaatacaaaaaccaccaaggccaccgacaccggaattggtgaagagaatacctccacccccacc

SEQ ID NO: 265464 - DNA, 75 bp, Artificial Sequence
  Synthetic
tgatgcctttgtggtggcgggtagggtgcttacgtgccccgcccccgattttagtttcctgtttcttgttcctcc

SEQ ID NO: 265465 - DNA, 75 bp, Artificial Sequence
  Synthetic
tagtgacatcattgtgataaccaccaatttgaccagccctgccccacttgactatgttaattttgaggcttgctc

SEQ ID NO: 265466 - DNA, 75 bp, Artificial Sequence
  Synthetic
ctccgttgaacaaaagactagagttttcagtgtccccaatatacccctgaaagatctctcaaattctcgtgtccc

SEQ ID NO: 265467 - DNA, 75 bp, Artificial Sequence
  Synthetic
agagaaaacctatagattggaccccccccaaaaatgaatgggcagatgacgacagagaggtggactacactgaaa

SEQ ID NO: 265468 - DNA, 75 bp, Artificial Sequence
  Synthetic
ccaaggccaccgacaccggaattggtgaagagaatacctccacccccacccaatggcgaggatgaaccagggata

SEQ ID NO: 265469 - DNA, 75 bp, Artificial Sequence
  Synthetic
ccccaaaaatgaatgggcagatgacgacagagaggtggactacactgaaaaaataaactttgaagcccctcccac

SEQ ID NO: 265470 - DNA, 75 bp, Artificial Sequence
  Synthetic
gcttatagtgttcccccacttagccagagagaagtcggcgaagctaaagaaccgctgcctggctccattcttgaa

SEQ ID NO: 265471 - DNA, 75 bp, Artificial Sequence
  Synthetic
caggaccactcgcacatcaagctacagctggcccctcaaggaggttttgataaaaatggtaacaccccttatgga

SEQ ID NO: 265472 - DNA, 75 bp, Artificial Sequence
  Synthetic
agagagaagtcggcgaagctaaagaaccgctgcctggctccattcttgaaatgtgggatggtgagatctaccact

SEQ ID NO: 265473 - DNA, 75 bp, Artificial Sequence
  Synthetic
ccagtctcgctcagccaactctgcaagattaggggtaaaacttctagtaatgccagggtgctcaacttaagcgag

SEQ ID NO: 265474 - DNA, 75 bp, Artificial Sequence
  Synthetic
ccatgttataccaattggggccaaagaattctttggggaaccattggattccattgccatacaccgtgcaggaga

SEQ ID NO: 265475 - DNA, 75 bp, Artificial Sequence
  Synthetic
gaattctttggggaaccattggattccattgccatacaccgtgcaggagagttcacacagttccgtttctcaagg

SEQ ID NO: 265476 - DNA, 75 bp, Artificial Sequence
  Synthetic
agctggcccctcaaggaggttttgataaaaatggtaacaccccttatggaaagggcgtgatgaagacactcaccc

SEQ ID NO: 265477 - DNA, 75 bp, Artificial Sequence
  Synthetic
aaataacaccgctgtctctctactggagagtggtctacactccccagtatttgatagatccaggaactcttaaga

SEQ ID NO: 265478 - DNA, 75 bp, Artificial Sequence
  Synthetic
tgcccctctacaacttcgatgtggacaagataaactccttcaggaagatggctgctgacaacagatacgggttct

SEQ ID NO: 265479 - DNA, 75 bp, Artificial Sequence
  Synthetic
catgtgaatttcactttccaggctcaaaaccaggacccatcccaaagtgtgacctttgcaactaatgatgccagc

SEQ ID NO: 265480 - DNA, 75 bp, Artificial Sequence
  Synthetic
gagagtggtctacactccccagtatttgatagatccaggaactcttaagaacttgagtggagagactttcccata

SEQ ID NO: 265481 - DNA, 75 bp, Artificial Sequence
  Synthetic
aagcgtgattcaggtgagctgctaccattggctgtgcgtatgggggctgtggcttcaatgaagatacagggtcgg

SEQ ID NO: 265482 - DNA, 75 bp, Artificial Sequence
  Synthetic
tttgtcccttacctaggtagcatttcccctcataatgggggagactttcatgcaggcgacatcataggtagcctt

SEQ ID NO: 265483 - DNA, 75 bp, Artificial Sequence
  Synthetic
cattggctgtgcgtatgggggctgtggcttcaatgaagatacagggtcggttggtccatggtcagtcgggtatgc

SEQ ID NO: 265484 - DNA, 75 bp, Artificial Sequence
  Synthetic
aatgatccaaagaacaactggattcttcaaaccttatcaggattggaacagaaaacccttaccaaccatggatga

SEQ ID NO: 265485 - DNA, 75 bp, Artificial Sequence
  Synthetic
ttacaaggggacgatctaccagattgagtcaggccgtggcggactcgcggtcaagaagctagaggaccgctatgc

SEQ ID NO: 265486 - DNA, 75 bp, Artificial Sequence
  Synthetic
ttcaaaccttatcaggattggaacagaaaacccttaccaaccatggatgaaccgaaaatcaagaaggccgcgaat

SEQ ID NO: 265487 - DNA, 75 bp, Artificial Sequence
  Synthetic
caagataaactccttcaggaagatggctgctgacaacagatacgggttctttgagacaatgaaggtcggggctgc

SEQ ID NO: 265488 - DNA, 75 bp, Artificial Sequence
  Synthetic
gatgtcactcatcttgctcctgctgtgttccccccaggctttggggaagtgatcctatacttctattctaccttc

SEQ ID NO: 265489 - DNA, 75 bp, Artificial Sequence
  Synthetic
agagaaacaatgattgggttgtttgcggtgtccacgcagcagccaccaagtcaggcaacactgtggtctgtgcag

SEQ ID NO: 265490 - DNA, 75 bp, Artificial Sequence
  Synthetic
cggtgtccacgcagcagccaccaagtcaggcaacactgtggtctgtgcagtgcaggcaggtgagggggagaccac

SEQ ID NO: 265491 - DNA, 75 bp, Artificial Sequence
  Synthetic
attcttaatatactggcaacctgcgattggacttttgcaggcatagtggaatccttgatccttcttgctgaactc

SEQ ID NO: 265492 - DNA, 75 bp, Artificial Sequence
  Synthetic
cagatcgctggggccgctttcgtgacatcgaggatagttaggaggtctaactggtgcaactcttggcgacaggca

SEQ ID NO: 265493 - DNA, 75 bp, Artificial Sequence
  Synthetic
attggacttttgcaggcatagtggaatccttgatccttcttgctgaactctttggggtgttctggacacccccag

SEQ ID NO: 265494 - DNA, 75 bp, Artificial Sequence
  Synthetic
gaacaagctcccatcgctggggaggctgctctcctccactacgtggaccctgatacgggccggaacttgggggag

SEQ ID NO: 265495 - DNA, 75 bp, Artificial Sequence
  Synthetic
taaaactaaattctggagatcaacaccagaacccctacccccaggtgtctatgaaccagcttacctaggaggaaa

SEQ ID NO: 265496 - DNA, 75 bp, Artificial Sequence
  Synthetic
ccagaacccctacccccaggtgtctatgaaccagcttacctaggaggaaaagaccctagagtcaagggtggccct

SEQ ID NO: 265497 - DNA, 75 bp, Artificial Sequence
  Synthetic
catcgaggatagttaggaggtctaactggtgcaactcttggcgacaggcagctgagcccggcaccttggccccag

SEQ ID NO: 265498 - DNA, 75 bp, Artificial Sequence
  Synthetic
tgcccgtggtgatgggaggaataggtttggtgttaggattcaccaaagaaaagatcggcaagatgctttcatcag

SEQ ID NO: 265499 - DNA, 75 bp, Artificial Sequence
  Synthetic
ggaagaacaaaaagggtcgtggaaagaaacacacggccttctccagcaagggactcagtgatgaggagtatgatg

SEQ ID NO: 265500 - DNA, 75 bp, Artificial Sequence
  Synthetic
ggtgtgctcacccaaaccacaaggacagatggctcgacccgcggccacaaagctacagtgtacactgggagcgcc

SEQ ID NO: 265501 - DNA, 75 bp, Artificial Sequence
  Synthetic
agctacagtgtacactgggagcgccgacttttctccaaaactgggtagagttcaatttgccactgacacagacaa

SEQ ID NO: 265502 - DNA, 75 bp, Artificial Sequence
  Synthetic
ctggaggctgctgttgagacagtgacttctatgctggaacaggttatggacacgcccacgccctggtcatatgct

SEQ ID NO: 265503 - DNA, 75 bp, Artificial Sequence
  Synthetic
tttggtgttaggattcaccaaagaaaagatcggcaagatgctttcatcagctgcgaccacacttagggcctgcaa

SEQ ID NO: 265504 - DNA, 75 bp, Artificial Sequence
  Synthetic
cttctatgctggaacaggttatggacacgcccacgccctggtcatatgctgatgcttgccagtcattagacaaga

SEQ ID NO: 265505 - DNA, 75 bp, Artificial Sequence
  Synthetic
cgaactagccatggtgagggccattgaggatgcagtcctggatttggaggcaatagaaaacaatcacatgaccac

SEQ ID NO: 265506 - DNA, 75 bp, Artificial Sequence
  Synthetic
atagccgcgtctgccgctggtagcatactaggggcaggcatacaggctggtgctgaggctggtcttcaggctcaa

SEQ ID NO: 265507 - DNA, 75 bp, Artificial Sequence
  Synthetic
aacagaagagaacttcgcagaggatgatgagatgaggctccgccagagaattttcaggcccaccaagaagcagag

SEQ ID NO: 265508 - DNA, 75 bp, Artificial Sequence
  Synthetic
gaggatgcagtcctggatttggaggcaatagaaaacaatcacatgaccacccttctcaaggataaagacagcctg

SEQ ID NO: 265509 - DNA, 75 bp, Artificial Sequence
  Synthetic
gtgagcaagcagcccacgcaaacaacatgtatgagctaggtaagtccatgaagcccctatatacagcagccctca

SEQ ID NO: 265510 - DNA, 75 bp, Artificial Sequence
  Synthetic
tactaggggcaggcatacaggctggtgctgaggctggtcttcaggctcaacggtaccagcaggatctacagttgc

SEQ ID NO: 265511 - DNA, 75 bp, Artificial Sequence
  Synthetic
catgtatgagctaggtaagtccatgaagcccctatatacagcagccctcaaagatgaacttgtcaaaccagagaa

SEQ ID NO: 265512 - DNA, 75 bp, Artificial Sequence
  Synthetic
atcttaacactagatatgctcttctgcaggcagggggcctgtctagtgctgatgctgctcgggcagtggctggtg

SEQ ID NO: 265513 - DNA, 75 bp, Artificial Sequence
  Synthetic
atcgtgggtacaataaacgcattattggctaggatagcagccgccaggtcactggtccacaaggctaaggaggag

SEQ ID NO: 265514 - DNA, 75 bp, Artificial Sequence
  Synthetic
agtcgtgaggtcgactacaacgagaccatcaattttgaggccccatcaagcatctggtcacgtgtcgtccccttt

SEQ ID NO: 265515 - DNA, 75 bp, Artificial Sequence
  Synthetic
tggctaggatagcagccgccaggtcactggtccacaaggctaaggaggagctctcgagcagacagagacctgttg

SEQ ID NO: 265516 - DNA, 75 bp, Artificial Sequence
  Synthetic
tttaggtttgattcctgggttaatcaattctacacacttgcccccatgggaaatggaacggggcgtagacgtgct

SEQ ID NO: 265517 - DNA, 75 bp, Artificial Sequence
  Synthetic
tggccccttctgtgacgccataaagtcccatgtaatcaagttgcctattaaagttggtatgaattcaattgagga

SEQ ID NO: 265518 - DNA, 75 bp, Artificial Sequence
  Synthetic
gaatggcacgcgcattgcagcgcccgcctcaagtgccaccacactcagatctggtggttttatggccgtccctat

SEQ ID NO: 265519 - DNA, 75 bp, Artificial Sequence
  Synthetic
tcaacatgataaagagatgctccaagcacaaattgaggccactaaaaagttgcaacaggaaatgatgaaagtcaa

SEQ ID NO: 265520 - DNA, 75 bp, Artificial Sequence
  Synthetic
cactgtcaggcgaccaaaggattggactggtacctagaaatggcgtcgaccattgggacgcctacaagggagaaa

SEQ ID NO: 265521 - DNA, 75 bp, Artificial Sequence
  Synthetic
agattcaagtccataaatcaggcgagttttgccgcctgagattcccccgacctatgaggactgatgtcaatggcc

SEQ ID NO: 265522 - DNA, 75 bp, Artificial Sequence
  Synthetic
actggtacctagaaatggcgtcgaccattgggacgcctacaagggagaaagggtggtcctgtgggatgattatgg

SEQ ID NO: 265523 - DNA, 75 bp, Artificial Sequence
  Synthetic
tctttctcaatcatgtgccgcctcaccgcctcaccagatttggcggctgttgtggctagagacctactagcccct

SEQ ID NO: 265524 - DNA, 75 bp, Artificial Sequence
  Synthetic
tcccatgtaatcaagttgcctattaaagttggtatgaattcaattgaggatggccccctaatctatgctgaacat

SEQ ID NO: 265525 - DNA, 75 bp, Artificial Sequence
  Synthetic
ccgcctcaccagatttggcggctgttgtggctagagacctactagccccttccgaaatggatgtgggagattttg

SEQ ID NO: 265526 - DNA, 75 bp, Artificial Sequence
  Synthetic
taggattgaaaacaaaggaaaagtgttcgacagtgatgccataattataacaaccaaccttgcaaacccagcacc

SEQ ID NO: 265527 - DNA, 75 bp, Artificial Sequence
  Synthetic
cgccaccatgaagatacaaggcagaacaattggcggccagatgggcatgctcctcactggggctaacgcaaagaa

SEQ ID NO: 265528 - DNA, 75 bp, Artificial Sequence
  Synthetic
tcatcaacttcatctgtgcagtctagtttttatggtgtttttaatacagatagattgcctctgttcgcaaacaga

SEQ ID NO: 265529 - DNA, 75 bp, Artificial Sequence
  Synthetic
ttcgacagtgatgccataattataacaaccaaccttgcaaacccagcaccactagactatgtcaactttgaggcc

SEQ ID NO: 265530 - DNA, 75 bp, Artificial Sequence
  Synthetic
ttacattgtgtgccttgtctgaggtcacgggcttggcacccgatgttatacaatcacagtcatatttctccttct

SEQ ID NO: 265531 - DNA, 75 bp, Artificial Sequence
  Synthetic
cacgggcttggcacccgatgttatacaatcacagtcatatttctccttctatggggacgatgagatcgtgtccac

SEQ ID NO: 265532 - DNA, 75 bp, Artificial Sequence
  Synthetic
acaattggcggccagatgggcatgctcctcactggggctaacgcaaagaacatggacctgggaactagtcctgga

SEQ ID NO: 265533 - DNA, 75 bp, Artificial Sequence
  Synthetic
caaccagatatgtggaaagaccatttcagaccagacttctcacacattaagcttcagctggcaccacagggaggt

SEQ ID NO: 265534 - DNA, 75 bp, Artificial Sequence
  Synthetic
ggcggtaacacggtggtctgtgccactcagggtcctgatggtgaggccaccttagagggcggtgagaaccacggc

SEQ ID NO: 265535 - DNA, 75 bp, Artificial Sequence
  Synthetic
tcagaccagacttctcacacattaagcttcagctggcaccacagggaggttttgacaaaaatggcaacaccccac

SEQ ID NO: 265536 - DNA, 75 bp, Artificial Sequence
  Synthetic
ctcagggtcctgatggtgaggccaccttagagggcggtgagaaccacggcacttactgtggcgccccaatcttgg

SEQ ID NO: 265537 - DNA, 75 bp, Artificial Sequence
  Synthetic
aagtgagggccccataatcttgaggaaaaatgttgatggcttggtattccttaggcgcactatctccaaggatgc

SEQ ID NO: 265538 - DNA, 75 bp, Artificial Sequence
  Synthetic
aaaaatgttgatggcttggtattccttaggcgcactatctccaaggatgcagctggttaccagggccgattggat

SEQ ID NO: 265539 - DNA, 75 bp, Artificial Sequence
  Synthetic
tggatgaattcgagctccaaggctctgacctgccaaccttcaattttgaccgcaacaaagtcgccgccttcagac

SEQ ID NO: 265540 - DNA, 75 bp, Artificial Sequence
  Synthetic
cctatgaaccagcctatctgggtgggagagacccccgcgtggaaaatggcccatcactacagcaggtcatgagag

SEQ ID NO: 265541 - DNA, 75 bp, Artificial Sequence
  Synthetic
tgacctgccaaccttcaattttgaccgcaacaaagtcgccgccttcagacaattagcagctgaaaacaaatatgg

SEQ ID NO: 265542 - DNA, 75 bp, Artificial Sequence
  Synthetic
gagagacccccgcgtggaaaatggcccatcactacagcaggtcatgagagaccaacttaagcccttcaccgcccc

SEQ ID NO: 265543 - DNA, 75 bp, Artificial Sequence
  Synthetic
cacccccaaagaaagatccaacttatatcactgctgggagaggcatcacttcatggggaaaagttttacaggaaa

SEQ ID NO: 265544 - DNA, 75 bp, Artificial Sequence
  Synthetic
tatcactgctgggagaggcatcacttcatggggaaaagttttacaggaaaatttcaggtagagtcatccaagaga

SEQ ID NO: 265545 - DNA, 75 bp, Artificial Sequence
  Synthetic
gaacatcagtatcaagaagtgtcagatagtgtataatggatgcacctataccatggaatctgatgggaggggcaa

SEQ ID NO: 265546 - DNA, 75 bp, Artificial Sequence
  Synthetic
tgaacccgctaaaaagtggagttactcacaggcttgccaatccttggacaagaccacctctagcggcgatcccca

SEQ ID NO: 265547 - DNA, 75 bp, Artificial Sequence
  Synthetic
atagtgtataatggatgcacctataccatggaatctgatgggaggggcaaggttgtggttgaaaaggtacaaaac

SEQ ID NO: 265548 - DNA, 75 bp, Artificial Sequence
  Synthetic
tcacaggcttgccaatccttggacaagaccacctctagcggcgatccccaccatgttaggaagaatgaccattgg

SEQ ID NO: 265549 - DNA, 75 bp, Artificial Sequence
  Synthetic
gactttggacaggagatcgcgatctcctgcccgaattcgtaaatgatgatggcgtctaaggacgccccaccatcg

SEQ ID NO: 265550 - DNA, 75 bp, Artificial Sequence
  Synthetic
cctgcccgaattcgtaaatgatgatggcgtctaaggacgccccaccatcgcctgatggcgccagtggcgctggcc

SEQ ID NO: 265551 - DNA, 75 bp, Artificial Sequence
  Synthetic
aaatgtttccaagaagccatttactctctactccaaattgctggtgcagccttcgtcacctcacgcatcgtgagg

SEQ ID NO: 265552 - DNA, 75 bp, Artificial Sequence
  Synthetic
gtccaacccgtctacacggccgccctgaaggatgaacttgtcaagaccgaaaagatttacggcacagtgaagaag

SEQ ID NO: 265553 - DNA, 75 bp, Artificial Sequence
  Synthetic
ctctactccaaattgctggtgcagccttcgtcacctcacgcatcgtgaggcgcatgaacatatcaaacctctggt

SEQ ID NO: 265554 - DNA, 75 bp, Artificial Sequence
  Synthetic
tgaaggatgaacttgtcaagaccgaaaagatttacggcacagtgaagaagaggctcctctggggctcggacctgg

SEQ ID NO: 265555 - DNA, 75 bp, Artificial Sequence
  Synthetic
cagctgggcaagttaatatgattgatccatggatattcaacaattttgtccaggccccccagggtgaatttacca

SEQ ID NO: 265556 - DNA, 75 bp, Artificial Sequence
  Synthetic
tccatggatattcaacaattttgtccaggccccccagggtgaatttaccatttctccaaataatacccccggtga

SEQ ID NO: 265557 - DNA, 75 bp, Artificial Sequence
  Synthetic
tcactattgactctagagacattaaagtggaagggaagaagggcaagaacaagtctggccggggcaagaaacaca

SEQ ID NO: 265558 - DNA, 75 bp, Artificial Sequence
  Synthetic
tcagggtagggatgaacatgaacgaggatggaccagctatcttcgagaggcacgcgcggcacacctaccactttg

SEQ ID NO: 265559 - DNA, 75 bp, Artificial Sequence
  Synthetic
agtggaagggaagaagggcaagaacaagtctggccggggcaagaaacacacagccttctcttccaagggcctcag

SEQ ID NO: 265560 - DNA, 75 bp, Artificial Sequence
  Synthetic
ggatggaccagctatcttcgagaggcacgcgcggcacacctaccactttgatgctgactactcacggtgggactc

SEQ ID NO: 265561 - DNA, 75 bp, Artificial Sequence
  Synthetic
ggttggcaatatgcgggtccgcatattgctggcaggcaatgccttcacagctggtaaggtaatcatatgttgtgt

SEQ ID NO: 265562 - DNA, 75 bp, Artificial Sequence
  Synthetic
ttgctggcaggcaatgccttcacagctggtaaggtaatcatatgttgtgtcccccctggctttgatgctagaata

SEQ ID NO: 265563 - DNA, 75 bp, Artificial Sequence
  Synthetic
agatagggacagatactatgaagagcttgccattgctaaggccactgaggaggacttctgtgaggaggaggagat

SEQ ID NO: 265564 - DNA, 75 bp, Artificial Sequence
  Synthetic
ggtggtggcggaggatctccttgcccccagcgtcctcgacgttggcgatttccgcatctctatcgtggagggcct

SEQ ID NO: 265565 - DNA, 75 bp, Artificial Sequence
  Synthetic
cttgccattgctaaggccactgaggaggacttctgtgaggaggaggagatcaaaatccgccagagaatcttccga

SEQ ID NO: 265566 - DNA, 75 bp, Artificial Sequence
  Synthetic
cccagcgtcctcgacgttggcgatttccgcatctctatcgtggagggcctcccctctggggtcccgtgtacatca

SEQ ID NO: 265567 - DNA, 75 bp, Artificial Sequence
  Synthetic
ctcgaggatgtacgcaatgtcctctaccacaatagcagccagccacagccaaccatgcgactggtggctatgcta

SEQ ID NO: 265568 - DNA, 75 bp, Artificial Sequence
  Synthetic
accacaatagcagccagccacagccaaccatgcgactggtggctatgctatataccccattgcgcacaggcggtg

SEQ ID NO: 265569 - DNA, 75 bp, Artificial Sequence
  Synthetic
ccagatgactttaaaccaaaaggaaaattgtgggctgatgacaacaggagcgtggattacaatgagaggatagat

SEQ ID NO: 265570 - DNA, 75 bp, Artificial Sequence
  Synthetic
attcaggcccattcctgcttttccttctatggtgatgatgagatcgtgagcacggacatcactttggaccccaat

SEQ ID NO: 265571 - DNA, 75 bp, Artificial Sequence
  Synthetic
aattgtgggctgatgacaacaggagcgtggattacaatgagaggatagattttgaggctcccccgagtgtttggt

SEQ ID NO: 265572 - DNA, 75 bp, Artificial Sequence
  Synthetic
tctatggtgatgatgagatcgtgagcacggacatcactttggaccccaataaacttacagaaaaattgaaagaat

SEQ ID NO: 265573 - DNA, 75 bp, Artificial Sequence
  Synthetic
tccttgttcctccctctgtagagcaaaagactagggtctttagtgtccccaatataccactcaaagatctctcaa

SEQ ID NO: 265574 - DNA, 75 bp, Artificial Sequence
  Synthetic
aaagactagggtctttagtgtccccaatataccactcaaagatctctcaaattcccgagtgccaaccttgatcca

SEQ ID NO: 265575 - DNA, 75 bp, Artificial Sequence
  Synthetic
taccaaaaggaatcactgaggcctttggagtgcccataaaccaaatccaaattcacaaatctggagaattttgcc

SEQ ID NO: 265576 - DNA, 75 bp, Artificial Sequence
  Synthetic
tcttgaggaggacgatagtccgcgacccagctggttggtttggtaagcttgacaaggactccatcttgaggcaac

SEQ ID NO: 265577 - DNA, 75 bp, Artificial Sequence
  Synthetic
tggagtgcccataaaccaaatccaaattcacaaatctggagaattttgccgcttgcggtttccaaagccaattag

SEQ ID NO: 265578 - DNA, 75 bp, Artificial Sequence
  Synthetic
gcaaggtaccaccccagtatccctcagccaattatgtaagatcagaggtaggacttccagtaataccagagtgct

SEQ ID NO: 265579 - DNA, 75 bp, Artificial Sequence
  Synthetic
tgaagaccccatggaaactatggtgccacattcgcaaagagcagtacaattgatggccctcctgggagaggcctc

SEQ ID NO: 265580 - DNA, 75 bp, Artificial Sequence
  Synthetic
agccaattatgtaagatcagaggtaggacttccagtaataccagagtgcttaaccttagtgaggttgacgggaca

SEQ ID NO: 265581 - DNA, 75 bp, Artificial Sequence
  Synthetic
aacaggggagctgatgcctcttgcagtcagaatggggactcatgccacaatgaaaatccaaggtagaacggtggg

SEQ ID NO: 265582 - DNA, 75 bp, Artificial Sequence
  Synthetic
ccccaccaagcatctggtcaaggatagtcaactttggctcaggttggggcttctgggtctcccccagtctgttca

SEQ ID NO: 265583 - DNA, 75 bp, Artificial Sequence
  Synthetic
gtcagaatggggactcatgccacaatgaaaatccaaggtagaacggtgggtggtcagatgggtatgcttctcact

SEQ ID NO: 265584 - DNA, 75 bp, Artificial Sequence
  Synthetic
acttttgaggcacgagaccaggacccctctcagaatgtgacctttgcaaccaatgattctagctttgtaccatat

SEQ ID NO: 265585 - DNA, 75 bp, Artificial Sequence
  Synthetic
cctctcagaatgtgacctttgcaaccaatgattctagctttgtaccatatcttggcagtatttcaccccacaatg

SEQ ID NO: 265586 - DNA, 75 bp, Artificial Sequence
  Synthetic
aatgaccttgtggtcattggggtgcacactgcagcagctcgtggaggcaacacggtcatatgtgccacacaggga

SEQ ID NO: 265587 - DNA, 75 bp, Artificial Sequence
  Synthetic
acactgcagcagctcgtggaggcaacacggtcatatgtgccacacagggaagtgaaggtgaagccactcttgaag

SEQ ID NO: 265588 - DNA, 75 bp, Artificial Sequence
  Synthetic
atgtatggtctataccaaagtatggatcatctcttccagatgtcacccatctggcccctgcagtttttccccctg

SEQ ID NO: 265589 - DNA, 75 bp, Artificial Sequence
  Synthetic
ggctttggaaccagttgtgggggctcctctcgctgctcctgtagctggccaacataatattatagacccctggat

SEQ ID NO: 265590 - DNA, 75 bp, Artificial Sequence
  Synthetic
atcatctcttccagatgtcacccatctggcccctgcagtttttccccctggctttggtgaggttatcctttactt

SEQ ID NO: 265591 - DNA, 75 bp, Artificial Sequence
  Synthetic
caaaattctggagatcctctaacgcaccgcttcccccaggtacttatgaaccagcataccttggtgggagagacc

SEQ ID NO: 265592 - DNA, 75 bp, Artificial Sequence
  Synthetic
accgcttcccccaggtacttatgaaccagcataccttggtgggagagacccgcgcgtgaagggaggcccatctct

SEQ ID NO: 265593 - DNA, 75 bp, Artificial Sequence
  Synthetic
cctctcgctgctcctgtagctggccaacataatattatagacccctggattaaaatgaattttgtgcaggcaccc

SEQ ID NO: 265594 - DNA, 75 bp, Artificial Sequence
  Synthetic
acatttctgtaatgagcaagcacccatagcgggggaggctgccctccttcactatgtggaccctgacacaggtag

SEQ ID NO: 265595 - DNA, 75 bp, Artificial Sequence
  Synthetic
aacccttatctttctcacctggcccgcatgtacaacggctatgcgggtggcatggaggtgcaggttgttttagca

SEQ ID NO: 265596 - DNA, 75 bp, Artificial Sequence
  Synthetic
atagcgggggaggctgccctccttcactatgtggaccctgacacaggtaggaacttaggggaattcaagctttat

SEQ ID NO: 265597 - DNA, 75 bp, Artificial Sequence
  Synthetic
gtcagcaaagaagactatcatcaatgttctggaacaaaccattgacccccctcaaaagtggtcatatgcccaagc

SEQ ID NO: 265598 - DNA, 75 bp, Artificial Sequence
  Synthetic
gttctggaacaaaccattgacccccctcaaaagtggtcatatgcccaagcttgtgcatccctcgacaagacaacc

SEQ ID NO: 265599 - DNA, 75 bp, Artificial Sequence
  Synthetic
gcatgtacaacggctatgcgggtggcatggaggtgcaggttgttttagcaggaaatgcttttactgccgggaaga

SEQ ID NO: 265600 - DNA, 75 bp, Artificial Sequence
  Synthetic
tcccgtcaactgcaaggactaggagctgggttgaggatcaaaacagaaatttgtcacctttcatgaggggggctc

SEQ ID NO: 265601 - DNA, 75 bp, Artificial Sequence
  Synthetic
gtatttgtgtcctgggtatccagattttaccaacttaagcctgtgggaacggcctcagcggccaggaggcttggt

SEQ ID NO: 265602 - DNA, 75 bp, Artificial Sequence
  Synthetic
tgatagttgatgtcaggcaattggaaccagtcatgctccccatgcctgatattaggaacaaactatttcattaca

SEQ ID NO: 265603 - DNA, 75 bp, Artificial Sequence
  Synthetic
caggcttcaaaagcaaatctcatgtatgaggaaggcaagcacatgcaaccagtttacaccgcagcactcaaagac

SEQ ID NO: 265604 - DNA, 75 bp, Artificial Sequence
  Synthetic
atgaggaaggcaagcacatgcaaccagtttacaccgcagcactcaaagacgagctcgtgaaaactgacaaaattt

SEQ ID NO: 265605 - DNA, 75 bp, Artificial Sequence
  Synthetic
tttaccaacttaagcctgtgggaacggcctcagcggccaggaggcttggtcttcggcgcatataatggctcaagc

SEQ ID NO: 265606 - DNA, 75 bp, Artificial Sequence
  Synthetic
accagtcatgctccccatgcctgatattaggaacaaactatttcattacaaccaagttgatgatccaaagcttag

SEQ ID NO: 265607 - DNA, 75 bp, Artificial Sequence
  Synthetic
actccaagcccaacggtatcaacaggatctccaactacaacagaatactttccaacatgatagggaaatgatagg

SEQ ID NO: 265608 - DNA, 75 bp, Artificial Sequence
  Synthetic
tcttactaggccaactcctgattttgagtttatgtttttggttccccccactgttgaatctaaaactaagccttt

SEQ ID NO: 265609 - DNA, 75 bp, Artificial Sequence
  Synthetic
gatctccaactacaacagaatactttccaacatgatagggaaatgatagggtaccaggtgcaggccagtaatgcc

SEQ ID NO: 265610 - DNA, 75 bp, Artificial Sequence
  Synthetic
gtctcatggatgaattcaaagcaaattgtattacactccctatcagagttggtatgaatatgaatgaagatggtc

SEQ ID NO: 265611 - DNA, 75 bp, Artificial Sequence
  Synthetic
ttgtattacactccctatcagagttggtatgaatatgaatgaagatggtcccataatatttgagaaacactccag

SEQ ID NO: 265612 - DNA, 75 bp, Artificial Sequence
  Synthetic
gagtttatgtttttggttccccccactgttgaatctaaaactaagcctttttctttacctagtcttacccttgat

SEQ ID NO: 265613 - DNA, 75 bp, Artificial Sequence
  Synthetic
gctgttgcaggcgctcctgttactcgcatagtggattggaacggaacccgtgtggcagcccccacatcgagcgcc

SEQ ID NO: 265614 - DNA, 75 bp, Artificial Sequence
  Synthetic
ccccaaaatgggaggtgcactatagatggcctcttgcagggcaccacacaactcgtgtcctgtaatgtttgcagt

SEQ ID NO: 265615 - DNA, 75 bp, Artificial Sequence
  Synthetic
gcatagtggattggaacggaacccgtgtggcagcccccacatcgagcgccactactttaaaatctggtgggttca

SEQ ID NO: 265616 - DNA, 75 bp, Artificial Sequence
  Synthetic
tgaaatcatggtgagattttctgctgagccacagctggcacaaatagtggcagaggacctgctgtcaccaagtgt

SEQ ID NO: 265617 - DNA, 75 bp, Artificial Sequence
  Synthetic
gagccacagctggcacaaatagtggcagaggacctgctgtcaccaagtgtggttgatgtgggcgatttcaaaatc

SEQ ID NO: 265618 - DNA, 75 bp, Artificial Sequence
  Synthetic
atggcctcttgcagggcaccacacaactcgtgtcctgtaatgtttgcagttttagagggaccatcggtgatggac

SEQ ID NO: 265619 - DNA, 75 bp, Artificial Sequence
  Synthetic
cttcttctatttctagaactgcttcatgggtgcaatcccaaaactctttgagatctatgcccccttttcataatg

SEQ ID NO: 265620 - DNA, 75 bp, Artificial Sequence
  Synthetic
ttgatggctcaccctatgacccaactgatgacatccccgcagtgctgggctcccctgactttcagggtgtcatat

SEQ ID NO: 265621 - DNA, 75 bp, Artificial Sequence
  Synthetic
tgatgacatccccgcagtgctgggctcccctgactttcagggtgtcatatttggcatcctcagtcagaggaatgg

SEQ ID NO: 265622 - DNA, 75 bp, Artificial Sequence
  Synthetic
tcccacgcaatggcgtcgaccactgggatgcgtacaagggggagagggtcgtcctatgggacgactatggaatga

SEQ ID NO: 265623 - DNA, 75 bp, Artificial Sequence
  Synthetic
ttgtgtgccctttctgaagtgacaggattaggtcctgacatcatacaagctaactccatgtactctttctatggt

SEQ ID NO: 265624 - DNA, 75 bp, Artificial Sequence
  Synthetic
gccacctggttcgtcttctacatcttctatgcagtctagtttctatggtgtctttaatacagatagattacccct

SEQ ID NO: 265625 - DNA, 75 bp, Artificial Sequence
  Synthetic
gattaggtcctgacatcatacaagctaactccatgtactctttctatggtgatgatgagattgtgagcacagaca

SEQ ID NO: 265626 - DNA, 75 bp, Artificial Sequence
  Synthetic
tgtggccactgtggagagcacagacttccacgccaatcagcctagcagattcacccctgttgggttaggtgggga

SEQ ID NO: 265627 - DNA, 75 bp, Artificial Sequence
  Synthetic
aggggccgttggtgattagtgaggacctgaatgggttgactttcctccgccgaacagtcacccgtgatccagcag

SEQ ID NO: 265628 - DNA, 75 bp, Artificial Sequence
  Synthetic
aatctaccaacctacggtggcgcgctgacgaacaacaccaacctcgccccacccgtgatgcccgtttacccaggg

SEQ ID NO: 265629 - DNA, 75 bp, Artificial Sequence
  Synthetic
aattggaacaattatgacccaacagaagaaattccagcccctctgggaaccccagatttcgtgggaaagatccaa

SEQ ID NO: 265630 - DNA, 75 bp, Artificial Sequence
  Synthetic
cctgaatgggttgactttcctccgccgaacagtcacccgtgatccagcaggttggtttggaaagttggaccaaaa

SEQ ID NO: 265631 - DNA, 75 bp, Artificial Sequence
  Synthetic
tgtccaggaggccctgtattctatcatccagattgctggggctgcatttgtcaccacgcgcatcatcaagcgcgt

SEQ ID NO: 265632 - DNA, 75 bp, Artificial Sequence
  Synthetic
acaaagacctgtgcagctcatggcactactaggagaatcttccctacatggaccctcattttacagcaaggttag

SEQ ID NO: 265633 - DNA, 75 bp, Artificial Sequence
  Synthetic
atggttatttcagatttgagtcctgggtgaatcagttttatactttagcccccatgggaaatggtagtgggcgta

SEQ ID NO: 265634 - DNA, 75 bp, Artificial Sequence
  Synthetic
ccagttttgtgaatgaagatggcgtcgaatgacgccgctccatctaatgatggtgctgctggtctcgtaccagag

SEQ ID NO: 265635 - DNA, 75 bp, Artificial Sequence
  Synthetic
ggtgaatcagttttatactttagcccccatgggaaatggtagtgggcgtaggagaacccgttaatggcaggacaa

SEQ ID NO: 265636 - DNA, 75 bp, Artificial Sequence
  Synthetic
ttccaaggccaacctgatgtttgaagaagggaagaacatgaccccagtctacacaggtgcacttaaggatgaatt

SEQ ID NO: 265637 - DNA, 75 bp, Artificial Sequence
  Synthetic
ataattgacccctggattagaacaaattttgtgcaagcaccaaatggagagttcacagtgtcacccagaaactct

SEQ ID NO: 265638 - DNA, 75 bp, Artificial Sequence
  Synthetic
aatcagaaggttgagtatgattttaataagaagttgcaatctttctcttttgcccatgataaagagatgctacaa

SEQ ID NO: 265639 - DNA, 75 bp, Artificial Sequence
  Synthetic
attttgtgcaagcaccaaatggagagttcacagtgtcacccagaaactctcctggagaaattttattaaatttag

SEQ ID NO: 265640 - DNA, 75 bp, Artificial Sequence
  Synthetic
ataagaagttgcaatctttctcttttgcccatgataaagagatgctacaagcacaagtggatgcaactagacaat

SEQ ID NO: 265641 - DNA, 75 bp, Artificial Sequence
  Synthetic
ttcaggttctcctggcagggaacgcgttcactgccggaaagatcctcttcgccgccgtcccgccaaatttcccag

SEQ ID NO: 265642 - DNA, 75 bp, Artificial Sequence
  Synthetic
gctctcttggtgtgcccatgactaaggctctggactggaatggtacgagatactgggcacctaattctatgagca

SEQ ID NO: 265643 - DNA, 75 bp, Artificial Sequence
  Synthetic
gttcactgccggaaagatcctcttcgccgccgtcccgccaaatttcccagtggaattcttaagcccggcccagat

SEQ ID NO: 265644 - DNA, 75 bp, Artificial Sequence
  Synthetic
ggctctggactggaatggtacgagatactgggcacctaattctatgagcacctccagctattcagggcgtttctc

SEQ ID NO: 265645 - DNA, 75 bp, Artificial Sequence
  Synthetic
tacattcttccattatagtaaccagcctaacagccgcatgagattagtggctatgctctataccccactcagatc

SEQ ID NO: 265646 - DNA, 75 bp, Artificial Sequence
  Synthetic
ggggtctacgagcgcctcttcggtctcgtcagccccaactgtgtcaacagggctgtccagttcttccactactcc

SEQ ID NO: 265647 - DNA, 75 bp, Artificial Sequence
  Synthetic
ggctgtccagttcttccactactccatcacggtcgtcaaggtcttcaaccaccacagacaggaccagagagtggg

SEQ ID NO: 265648 - DNA, 75 bp, Artificial Sequence
  Synthetic
cctaacagccgcatgagattagtggctatgctctataccccactcagatctaatggctcaggtgatgatgtcttt

SEQ ID NO: 265649 - DNA, 75 bp, Artificial Sequence
  Synthetic
tctaaaactaagcctttttccttacctattttaaccctttctgagctcacaaattcgaggtttccagtccccatc

SEQ ID NO: 265650 - DNA, 75 bp, Artificial Sequence
  Synthetic
ctattttaaccctttctgagctcacaaattcgaggtttccagtccccatcgattcgcttttcaccgcccagaata

SEQ ID NO: 265651 - DNA, 75 bp, Artificial Sequence
  Synthetic
cagacggggagagtcacaagcttaacagcttagtgaaagatagggtttttctttttctttcttttctgttccctg

SEQ ID NO: 265652 - DNA, 75 bp, Artificial Sequence
  Synthetic
caactggcatctgtgcattcagaggacgggtgacagcacaaattaaccaacgtgacaggtggcacatgcaactgc

SEQ ID NO: 265653 - DNA, 75 bp, Artificial Sequence
  Synthetic
acgggtgacagcacaaattaaccaacgtgacaggtggcacatgcaactgcaaaacctcaatggtacaacatatga

SEQ ID NO: 265654 - DNA, 75 bp, Artificial Sequence
  Synthetic
aaatgtgggtaatgatgcgcctggctcaaccagagcccaacaggcgtgggtttcaacctatagcccccaatttgt

SEQ ID NO: 265655 - DNA, 75 bp, Artificial Sequence
  Synthetic
tcaaccagagcccaacaggcgtgggtttcaacctatagcccccaatttgtccccaaattaggttctgtcaatctt

SEQ ID NO: 265656 - DNA, 75 bp, Artificial Sequence
  Synthetic
aacatacaatgcaggccgcttttccacccctcaaccttcgggggcactgccaggaagaatcaatcccaggactcc

SEQ ID NO: 265657 - DNA, 75 bp, Artificial Sequence
  Synthetic
ggccacccgttcagacaatgggaactaccaaactattcaggggagcttaccttgaatatgaatcttgccccccca

SEQ ID NO: 265658 - DNA, 75 bp, Artificial Sequence
  Synthetic
taccaaactattcaggggagcttaccttgaatatgaatcttgcccccccagttgctccaaattttcctggtgaac

SEQ ID NO: 265659 - DNA, 75 bp, Artificial Sequence
  Synthetic
tatcccccctcccccacccaatggagaggatgatgtagtggtttcttatagcgtcaaagatggtatctctggttt

SEQ ID NO: 265660 - DNA, 75 bp, Artificial Sequence
  Synthetic
aagaatggatccaacacttctatcaggaatcagcaccctcccagtcagacgtggccctaatcaggtatgtcaacc

SEQ ID NO: 265661 - DNA, 75 bp, Artificial Sequence
  Synthetic
ggaatcagcaccctcccagtcagacgtggccctaatcaggtatgtcaaccccgatacgggacgtacactgtttga

SEQ ID NO: 265662 - DNA, 75 bp, Artificial Sequence
  Synthetic
gagggagataccacaaagacccccacgaccgcccactccggagttggtcaagaaaatccctccccccccgcccaa

SEQ ID NO: 265663 - DNA, 75 bp, Artificial Sequence
  Synthetic
acactttagatttgattcttgggtaaatcagttttactcactcgccccaatgggaactgggaatgggcgaaggag

SEQ ID NO: 265664 - DNA, 75 bp, Artificial Sequence
  Synthetic
gcaaccagatgagaccaacacggcatttagtgttcccccactcaaccagagagagaacagggatgccaaggagcc

SEQ ID NO: 265665 - DNA, 75 bp, Artificial Sequence
  Synthetic
aatcagttttactcactcgccccaatgggaactgggaatgggcgaaggagggctcagtaatggctggggctttca

SEQ ID NO: 265666 - DNA, 75 bp, Artificial Sequence
  Synthetic
tttagtgttcccccactcaaccagagagagaacagggatgccaaggagccactgactggaacaatcctggagatg

SEQ ID NO: 265667 - DNA, 75 bp, Artificial Sequence
  Synthetic
actgactggaacaattctggaaatgtgggatggagaaatctaccattatggcctgtatgttgagcgaggtcttgt

SEQ ID NO: 265668 - DNA, 75 bp, Artificial Sequence
  Synthetic
aaaagatagactttgaaaacaacaaacaactccagtctgcttcctttcagcatgataaagagatgctccaagcgc

SEQ ID NO: 265669 - DNA, 75 bp, Artificial Sequence
  Synthetic
gccattagccttgccaaggttgaattggcaccactttctttgttctggagacctgtgtacgccccccagtatctc

SEQ ID NO: 265670 - DNA, 75 bp, Artificial Sequence
  Synthetic
taacaccactctccttgttctggagacctgtgtacactcctcagtacctcatctctccagacactctcaagaaat

SEQ ID NO: 265671 - DNA, 75 bp, Artificial Sequence
  Synthetic
acaactccagtctgcttcctttcagcatgataaagagatgctccaagcgcaggtgagggcaaccaagcagctgca

SEQ ID NO: 265672 - DNA, 75 bp, Artificial Sequence
  Synthetic
tggcaccactttctttgttctggagacctgtgtacgccccccagtatctcatctccccagacactctcaggagac

SEQ ID NO: 265673 - DNA, 75 bp, Artificial Sequence
  Synthetic
cattggtgcacccatgacaaaggtgcttgactggtctggcactcgatactgggcgcccaattccacaaagacaac

SEQ ID NO: 265674 - DNA, 75 bp, Artificial Sequence
  Synthetic
acgattcgtggctgagtaggaggatgatacagaggacaactggcttcttcaggccttaccaagactggaatagga

SEQ ID NO: 265675 - DNA, 75 bp, Artificial Sequence
  Synthetic
cttgactggtctggcactcgatactgggcgcccaattccacaaagacaactggctattcgggacaattcacctct

SEQ ID NO: 265676 - DNA, 75 bp, Artificial Sequence
  Synthetic
caaactgaagaaggtggccaacatattcctgtgtgctttgtcttcactattcaccaggcccatcaaggacataat

SEQ ID NO: 265677 - DNA, 75 bp, Artificial Sequence
  Synthetic
tcttctagcagtgtctatagtatgtatactcaatctactcatttaacatctggctcttctagtaatgcttcttct

SEQ ID NO: 265678 - DNA, 75 bp, Artificial Sequence
  Synthetic
atactcaatctactcatttaacatctggctcttctagtaatgcttcttctgcctccacaaaattgacaagtttaa

SEQ ID NO: 265679 - DNA, 75 bp, Artificial Sequence
  Synthetic
cacttaacatctcacatgtcacgccaccctcaagtagggcttccagttctgggacggtctcgaccgtgcccaagg

SEQ ID NO: 265680 - DNA, 75 bp, Artificial Sequence
  Synthetic
attgggaagatgttgtcatctgctgcatccacattgagggcttgtaaagaccttggtgcatatggactggagatc

SEQ ID NO: 265681 - DNA, 75 bp, Artificial Sequence
  Synthetic
ttcgcacacctcagagtgaggggggagtcacgtgtttagtgaaaagaaataattggctataatgtgatttctttc

SEQ ID NO: 265682 - DNA, 75 bp, Artificial Sequence
  Synthetic
ccttggtgcatatggactggagatcctaaaactagtcatgaaatggttcttcccaaagaaagaggaagcaagcga

SEQ ID NO: 265683 - DNA, 75 bp, Artificial Sequence
  Synthetic
acttacatgagaactcttgaccttgaggaagagaaagccaggaagctctcaaccaagtccgcctcacctgatatc

SEQ ID NO: 265684 - DNA, 75 bp, Artificial Sequence
  Synthetic
tccagcagaccgagacccgttgttgtgatgatatcaggaaagccagggataggaaagactcacctagccagagag

SEQ ID NO: 265685 - DNA, 75 bp, Artificial Sequence
  Synthetic
tgatgatatcaggaaagccagggataggaaagactcacctagccagagagctggccaagaagatcgcaaccaccc

SEQ ID NO: 265686 - DNA, 75 bp, Artificial Sequence
  Synthetic
tgatgatatcaggcagaccaggaatagggaagacccaccttgctagggaagtggctaagagaatcgcagcctccc

SEQ ID NO: 265687 - DNA, 75 bp, Artificial Sequence
  Synthetic
tcgtcctttgggacgactacgggatgagcaaccccatccatgacgctctcagattgcaggagcttgctgacactt

SEQ ID NO: 265688 - DNA, 75 bp, Artificial Sequence
  Synthetic
agattgcaggagcttgctgacacttgccccctgacactaaattgtgataggattgaaaacaaaggtaaagttttt

SEQ ID NO: 265689 - DNA, 75 bp, Artificial Sequence
  Synthetic
acctctcctccttctgattccggcggagccaacacaaatttttggaagattcctgactatgggtctagcctatca

SEQ ID NO: 265690 - DNA, 75 bp, Artificial Sequence
  Synthetic
gccctgatttctctcacataaagctgatgctggccccacagggtggttttgacaagaacggcaacaccccacatg

SEQ ID NO: 265691 - DNA, 75 bp, Artificial Sequence
  Synthetic
atgagtacgagctgcaaggcccagccctcacaaccttcaactttgaccgaaacaaagtgctcgctttcagacagc

SEQ ID NO: 265692 - DNA, 75 bp, Artificial Sequence
  Synthetic
cagagctcaagcaagcactcaagaacatttcaattaagaggtgccagatagtgtatggtggcagcacttatacac

SEQ ID NO: 265693 - DNA, 75 bp, Artificial Sequence
  Synthetic
ggaaaggcgtcatgaaaaccctcaccactggttccctcatcgcccgagcatcagggctactccatgagaggttag

SEQ ID NO: 265694 - DNA, 75 bp, Artificial Sequence
  Synthetic
ccggcgccctgcaccacctcaggtgcgccaggatcaggtactatgtcaagtgtgtccaggaggccctgtactcca

SEQ ID NO: 265695 - DNA, 75 bp, Artificial Sequence
  Synthetic
cgccaggatcaggtactatgtcaagtgtgtccaggaggccctgtactccatcatccaaattgcaggggccgcatt

SEQ ID NO: 265696 - DNA, 75 bp, Artificial Sequence
  Synthetic
tgtcaccacgcgcatcatcaagcgtgtgaacattcaagacttatggtccaagccacaagtggaaaacacagagga

SEQ ID NO: 265697 - DNA, 75 bp, Artificial Sequence
  Synthetic
agctgctagcaaagatgggtgcccaaaacccaaagatgatgaggagtttgttgtttcatctgatgacatcaagac

SEQ ID NO: 265698 - DNA, 75 bp, Artificial Sequence
  Synthetic
aaacccaaagatgatgaggagtttgttgtttcatctgatgacatcaagaccgagggtaagaaaggaaagaacaag

SEQ ID NO: 265699 - DNA, 75 bp, Artificial Sequence
  Synthetic
gagaggctacacttgaaggtggtgacaacaaagggacatactgtggtgcaccaatcctaggcccagggagtgccc

SEQ ID NO: 265700 - DNA, 75 bp, Artificial Sequence
  Synthetic
acttctgcgaagaagaagaggccaagatccgtcaaagaatctttagaccaacaaggaagcaacgcaaggaggaga

SEQ ID NO: 265701 - DNA, 75 bp, Artificial Sequence
  Synthetic
gggcttttgggtttcccccagcctgttcataacatcaactcatgtcataccccagggcgcacaggagttctttgg

SEQ ID NO: 265702 - DNA, 75 bp, Artificial Sequence
  Synthetic
ggtgtccatcaaacaaatccaggtacacaaatcaggcgaattttgccgcttgaggttcccaaagccaataaggac

SEQ ID NO: 265703 - DNA, 75 bp, Artificial Sequence
  Synthetic
tgaggttcccaaagccaataaggactgatgtgacgggcatgatcttagaggaaggtgcccccgaagggaccgtgg

SEQ ID NO: 265704 - DNA, 75 bp, Artificial Sequence
  Synthetic
tgtcatatgtgccacccagggaagtgaaggtgaggccacacttgaaggcggggataataaaggtgcttactgtgg

SEQ ID NO: 265705 - DNA, 75 bp, Artificial Sequence
  Synthetic
gaaggtgaggccacacttgaaggcggggataataaaggtgcttactgtggtgccccgatcttaggtccaggaagt

SEQ ID NO: 265706 - DNA, 75 bp, Artificial Sequence
  Synthetic
ccctacctcggtggtaaggatcccagggttaagggtggtccatcactacaacaagtcatgagggaccagttgaaa

SEQ ID NO: 265707 - DNA, 75 bp, Artificial Sequence
  Synthetic
cttgaacaaacaatagacccacctcagaaatggtcatttgcgcaagcttgcgcttctcttgacaaaaccacctcc

SEQ ID NO: 265708 - DNA, 75 bp, Artificial Sequence
  Synthetic
taatggatgaactcaaggctcactgtgtcacactccctgtcagagttggtatgaacatgaatgaagacggcccca

SEQ ID NO: 265709 - DNA, 75 bp, Artificial Sequence
  Synthetic
tgtcacactccctgtcagagttggtatgaacatgaatgaagacggccccatcatctttgaaaaacattctaggta

SEQ ID NO: 265710 - DNA, 75 bp, Artificial Sequence
  Synthetic
gatcatggtcaaattctccccagagccacacttagctcaaatagttgcagaagaccttctatcccccagtgtgat

SEQ ID NO: 265711 - DNA, 75 bp, Artificial Sequence
  Synthetic
gtgccacccacagttgaatcaaaaaccaacccattctctgttccaattctaactattgaggagatgaccaattca

SEQ ID NO: 265712 - DNA, 75 bp, Artificial Sequence
  Synthetic
ccacacttagctcaaatagttgcagaagaccttctatcccccagtgtgatggatgtaggtgattttaagatatca

SEQ ID NO: 265713 - DNA, 75 bp, Artificial Sequence
  Synthetic
tgctgtacacaccacttagggctaataatgctggggatgatgtcttcacagtctcttgtcgagtcctcacgaggc

SEQ ID NO: 265714 - DNA, 75 bp, Artificial Sequence
  Synthetic
tgtgcactctctgaagttacggacctctcccctgacatcatccaggctaattctctcttctctttctatggtgat

SEQ ID NO: 265715 - DNA, 75 bp, Artificial Sequence
  Synthetic
tctcccctgacatcatccaggctaattctctcttctctttctatggtgatgatgaaattgtgagtacagacatac

SEQ ID NO: 265716 - DNA, 75 bp, Artificial Sequence
  Synthetic
gacctctgattatttctgaggacctaaatggtttaaccttccttcggaggaccgtgacccgcgacccagctggtt

SEQ ID NO: 265717 - DNA, 75 bp, Artificial Sequence
  Synthetic
gttcactccaaaactgggtagaatccaacttttcactgacacagacaacgatcttgaagctaaccaaaacacaaa

SEQ ID NO: 265718 - DNA, 75 bp, Artificial Sequence
  Synthetic
caacttttcactgacacagacaacgatcttgaagctaaccaaaacacaaagttcaccccagtcggtgtcatccag

SEQ ID NO: 265719 - DNA, 75 bp, Artificial Sequence
  Synthetic
ctgaaacaatgataccacattcccaaaggcccatacaactgatgtccctgctgggtgaggctgcactgcatggcc

SEQ ID NO: 265720 - DNA, 75 bp, Artificial Sequence
  Synthetic
accactttccttgtactggagacctgtgtatactccccagtacctcatctctccagacgctctcaagaaactaca

SEQ ID NO: 265721 - DNA, 75 bp, Artificial Sequence
  Synthetic
ttaaagaaggtagctaacatattcctgtgtgcactgtcttcgctattcaccaggcctataaaagatataataggg

SEQ ID NO: 265722 - DNA, 75 bp, Artificial Sequence
  Synthetic
gagattctcagatctgagcacgtgggagggcgatcgcaatctggctcccagttttgtgaatgaagatggcgtcga

SEQ ID NO: 265723 - DNA, 75 bp, Artificial Sequence
  Synthetic
gagggcgatcgcaatctggctcccagttttgtgaatgaagatggcgtcgaatgacgccaacccatctgatgggtc

SEQ ID NO: 265724 - DNA, 75 bp, Artificial Sequence
  Synthetic
gatttgtgaatccagatacaggtagggttttgtttgagtgcaagcttcataaatcaggttatgtcacagtggctc

SEQ ID NO: 265725 - DNA, 75 bp, Artificial Sequence
  Synthetic
cacttgcccccatgggaaatggaacggggcgtagacgtgcattataatggctggagctttctttgctggattggc

SEQ ID NO: 265726 - DNA, 75 bp, Artificial Sequence
  Synthetic
ggttatgcaggtggctttgaagtgcaggtaatcctcgcagggaatgcgttcactgccgggaaaatcatatttgca

SEQ ID NO: 265727 - DNA, 75 bp, Artificial Sequence
  Synthetic
atgtgcccagacaagagtcaatgtttaggtggatgaggttctcagatctaagcacatgggagggcgatcgcaatc

SEQ ID NO: 265728 - DNA, 75 bp, Artificial Sequence
  Synthetic
taatgccggggatgatgtcttcacagtctcttgtcgagtcctcacgagaccatcccccgattttgatttcatatt

SEQ ID NO: 265729 - DNA, 75 bp, Artificial Sequence
  Synthetic
ttcaagattccccattcccttagaaaagttgtatacgggtcctagcagtgcttttgttgttcaaccacaaaatgg

SEQ ID NO: 265730 - DNA, 75 bp, Artificial Sequence
  Synthetic
cccggtgctaggactacaacatacaatgcaggctacttttccactccccaacactcgggggcactgccaggaaga

SEQ ID NO: 265731 - DNA, 75 bp, Artificial Sequence
  Synthetic
catacaatgcaggccacttttccacccctcaaccctcgggggcactgccaggaagagctaatcttagggctgctg

SEQ ID NO: 265732 - DNA, 75 bp, Artificial Sequence
  Synthetic
gattacacaatgaatttggtgtcccaaaattggaataactatgatccaacagaggaaatccctgctcccctggga

SEQ ID NO: 265733 - DNA, 75 bp, Artificial Sequence
  Synthetic
tctgtgtactcaaatcaaactacttcaacgagacttggttctacagctggttctggtaccagtgtctcgagcctc

SEQ ID NO: 265734 - DNA, 75 bp, Artificial Sequence
  Synthetic
aaagccacagtgagcactgggagcgttcacttcaccccaaagctgggtagtgtccaattcaccaccgacacaaac

SEQ ID NO: 265735 - DNA, 75 bp, Artificial Sequence
  Synthetic
aaccgtgcccaaagaagttttgaactcccagactggcgttttcaatacgcgcaggcagcctctctttgctcacat

SEQ ID NO: 265736 - DNA, 75 bp, Artificial Sequence
  Synthetic
ttcacttcaccccaaagctgggtagtgtccaattcaccaccgacacaaacaatgactttcaaactggccaaaata

SEQ ID NO: 265737 - DNA, 75 bp, Artificial Sequence
  Synthetic
attactcaggcacctctggtcacaatgtgcatctggcccctgccgttgctcccactttccccggtgagcagcttc

SEQ ID NO: 265738 - DNA, 75 bp, Artificial Sequence
  Synthetic
gggagaatagagatgctaaggaaccactgactggaacaattttggaaatgtgggatggagaaatctatcattatg

SEQ ID NO: 265739 - DNA, 75 bp, Artificial Sequence
  Synthetic
gggtgtcgcacttctatcaggaagcagccccagcacaatcagatgtggccctgctgagatttgtgaatccagata

SEQ ID NO: 265740 - DNA, 75 bp, Artificial Sequence
  Synthetic
tgcaagaactcgctgacacttgccccctcactctaaactgtgacaggattgagaataaaggaaaggtctttgaca

SEQ ID NO: 265741 - DNA, 75 bp, Artificial Sequence
  Synthetic
cagatttgattcttgggtcaaccagttttacacacttgcccccatgggaaatggatcggggcgcaagcgtgtgtt

SEQ ID NO: 265742 - DNA, 75 bp, Artificial Sequence
  Synthetic
ggagccggagcgatcaatcaaagagtggaatttgaaaataataggaaattacagcaagcttccttccaatttagc

SEQ ID NO: 265743 - DNA, 75 bp, Artificial Sequence
  Synthetic
tggaatttgaaaataataggaaattacagcaagcttccttccaatttagcagcaatttacaacaagcttcctttc

SEQ ID NO: 265744 - DNA, 75 bp, Artificial Sequence
  Synthetic
aggcggtgcttctggaaggtgggttttctgcggcagacgccgctcgtggggcaatcaacgcgcccatgacaaaaa

SEQ ID NO: 265745 - DNA, 75 bp, Artificial Sequence
  Synthetic
ttctgcggcagacgccgctcgtggggcaatcaacgcgcccatgacaaaaaccctggactggagtggaactaggta

SEQ ID NO: 265746 - DNA, 75 bp, Artificial Sequence
  Synthetic
ggtgctaggattcaccaaagagaagattggaaaaatgttgtcatctgctgcatccaccttgagagcttgtaaaga

SEQ ID NO: 265747 - DNA, 75 bp, Artificial Sequence
  Synthetic
tgggaggattagttctgtgacttctgcatctgtgcgaaattcccccagcttatcttctaaatcttctactgctac

SEQ ID NO: 265748 - DNA, 75 bp, Artificial Sequence
  Synthetic
gcatctgtgcgaaattcccccagcttatcttctaaatcttctactgctacaactgtgtattctaatcaaactgtt

SEQ ID NO: 265749 - DNA, 75 bp, Artificial Sequence
  Synthetic
tgggttgaggaccaaaacaggagcgtgtcacccttcatgaggggagcactcaacacatcatttgttactcctcca

SEQ ID NO: 265750 - DNA, 75 bp, Artificial Sequence
  Synthetic
aacacgcgcaggcagccgctcttcgcatacatccataagcgaggggagtcacgggtttgaagtgaaaagacaatc

SEQ ID NO: 265751 - DNA, 75 bp, Artificial Sequence
  Synthetic
gtggctaagagaatcgcagcctcccttacaggagaccagcgtgtaggcctcgtcccacgcaatggcgtcgaccat

SEQ ID NO: 265752 - DNA, 75 bp, Artificial Sequence
  Synthetic
catacatccataagcgaggggagtcacgggtttgaagtgaaaagacaatctgatctttctttattttaatgtctt

SEQ ID NO: 265753 - DNA, 75 bp, Artificial Sequence
  Synthetic
gtgaatgaagactttgacgacatggattcctccaacgttaaagttactggtcccctagccgctaaagctagcgat

SEQ ID NO: 265754 - DNA, 75 bp, Artificial Sequence
  Synthetic
tcccctagccgctaaagctagcgatccagattccaccttcgccaagcttaaggcgaagttttctgccctccgcaa

SEQ ID NO: 265755 - DNA, 75 bp, Artificial Sequence
  Synthetic
ccagattccaccttcgccaagcttaaggcgaagttttctgccctccgcaatccacagcctcctgaccccccggag

SEQ ID NO: 265756 - DNA, 75 bp, Artificial Sequence
  Synthetic
gtcccctcaccctaaactgtgacaggattgagaacaaaggaaaggtctttgacagcgatgtcatcattatcacca

SEQ ID NO: 265757 - DNA, 75 bp, Artificial Sequence
  Synthetic
tcgctcacattcgtaggcgaggggagtcacgggtgtaatgtgaaaagacaaaattgattatctttccctttcttt

SEQ ID NO: 265758 - DNA, 75 bp, Artificial Sequence
  Synthetic
gaacccgcagagccccatcgagagcaggcagatcaattcccagtgcgctactcccggggcgccgttgacctcgac

SEQ ID NO: 265759 - DNA, 75 bp, Artificial Sequence
  Synthetic
atgcagaagcccctgaggtcgaaaaggcgaagcgtgacttcccaggccaacccgacatgtggaagaacgccttca

SEQ ID NO: 265760 - DNA, 75 bp, Artificial Sequence
  Synthetic
cgaccgcccaccccagaactggtcaaaaagatcccccctcccccgcccaacggggaggatgagctagtggtttct

SEQ ID NO: 265761 - DNA, 75 bp, Artificial Sequence
  Synthetic
aggcagatcaattcccagtgcgctactcccggggcgccgttgacctcgacgtccaccccccccatgtcgccccag

SEQ ID NO: 265762 - DNA, 75 bp, Artificial Sequence
  Synthetic
ggacggttctagagttttatgagggctacattttccactacgccatctatgttggtaacgggaagacaattggcg

SEQ ID NO: 265763 - DNA, 75 bp, Artificial Sequence
  Synthetic
ctacattttccactacgccatctatgttggtaacgggaagacaattggcgtccactccccccagatggccctctc

SEQ ID NO: 265764 - DNA, 75 bp, Artificial Sequence
  Synthetic
agaccagctcctgtcactcgagggcgagcgatggccgtacgcctccgtgactagcaattgctacaccttctgctg

SEQ ID NO: 265765 - DNA, 75 bp, Artificial Sequence
  Synthetic
gagcgatggccgtacgcctccgtgactagcaattgctacaccttctgctgcaaggttctggaccttgatgacgat

SEQ ID NO: 265766 - DNA, 75 bp, Artificial Sequence
  Synthetic
acctgtgtacaccccccagtatctcatctctccagacactctcaaaaggctgcacggggaaacattcccttacac

SEQ ID NO: 265767 - DNA, 75 bp, Artificial Sequence
  Synthetic
gtgtatagtggtagcacctacacacttgagtctgatggcaagggtaatgtgaaggttgacagagttcaaagcgcc

SEQ ID NO: 265768 - DNA, 75 bp, Artificial Sequence
  Synthetic
ttccaccaggacggcaaaatggagctggtccgggacgccatcctaacagcactgaacgccctggtttcacaacca

SEQ ID NO: 265769 - DNA, 75 bp, Artificial Sequence
  Synthetic
tggtccgggacgccatcctaacagcactgaacgccctggtttcacaaccaatgcgcgaactgatcaacgtcatca

SEQ ID NO: 265770 - DNA, 75 bp, Artificial Sequence
  Synthetic
agaccctatcaagattggaataggaaacccctccccaccatggatgattctaagttaaagaaggtggctaacata

SEQ ID NO: 265771 - DNA, 75 bp, Artificial Sequence
  Synthetic
tagcggaactctttggcatcttgtggcagcctccagacgtggccagctttctagccaacctcacaccggagtgtg

SEQ ID NO: 265772 - DNA, 75 bp, Artificial Sequence
  Synthetic
gcagcctccagacgtggccagctttctagccaacctcacaccggagtgtgttctgcagggcccagaggaccttgc

SEQ ID NO: 265773 - DNA, 75 bp, Artificial Sequence
  Synthetic
cttgatactcttggcagagctctttggagttttctggacacccccagatgtgtctgcgatgattgcccccttgct

SEQ ID NO: 265774 - DNA, 75 bp, Artificial Sequence
  Synthetic
cctgaagtcagccgcagacggtctccgcgcggccagcagcctcggtcagtatgggatagagatattcaacataat

SEQ ID NO: 265775 - DNA, 75 bp, Artificial Sequence
  Synthetic
cgcgcggccagcagcctcggtcagtatgggatagagatattcaacataattaagaaatacctttttggggattct

SEQ ID NO: 265776 - DNA, 75 bp, Artificial Sequence
  Synthetic
gttgggaagatgttgtcatctgctgcatccaccctaagagcttgcaaagaccttggtgcgtacggactggagatc

SEQ ID NO: 265777 - DNA, 75 bp, Artificial Sequence
  Synthetic
gtggtgagagaccgccagtccaccctagcctacatcaaaaccctggacatggaagaggagcgggtccgagagctc

SEQ ID NO: 265778 - DNA, 75 bp, Artificial Sequence
  Synthetic
tagcctacatcaaaaccctggacatggaagaggagcgggtccgagagctctcatcaaggtcctccgacccccatg

SEQ ID NO: 265779 - DNA, 75 bp, Artificial Sequence
  Synthetic
gacgcggtgctagacctcgaggcaattgagaacaaccatatgaccaccctgctcaaagataaagacagcctggca

SEQ ID NO: 265780 - DNA, 75 bp, Artificial Sequence
  Synthetic
tgtccaatcgggtgcgcccagtcgtcatcatgctcagcgggccccccggcattgggaaaaccaagttggcagaac

SEQ ID NO: 265781 - DNA, 75 bp, Artificial Sequence
  Synthetic
catcatgctcagcgggccccccggcattgggaaaaccaagttggcagaacgcatcgcccatcaattggccaaagc

SEQ ID NO: 265782 - DNA, 75 bp, Artificial Sequence
  Synthetic
cgagaattgccgctgcacgctccctggtgcaccgagcgaaggaggagctttccagcagaataagacctgttgttg

SEQ ID NO: 265783 - DNA, 75 bp, Artificial Sequence
  Synthetic
agtaatgctgtgggatgactacggcatggccaacattgccgctgactgcaacaaactccaggccattgcggacac

SEQ ID NO: 265784 - DNA, 75 bp, Artificial Sequence
  Synthetic
tcacaggggaccagcgtgtgggtctcatcccacgtaatggtgtcgaccactgggacgcatacaagggggagaggg

SEQ ID NO: 265785 - DNA, 75 bp, Artificial Sequence
  Synthetic
atggccaacattgccgctgactgcaacaaactccaggccattgcggacactgccccagtctcgcttaactgtgac

SEQ ID NO: 265786 - DNA, 75 bp, Artificial Sequence
  Synthetic
ctagaccacatgaacctggggccagtttgccggcgagtcgactttctggtctattgcaactcgcaagacattgag

SEQ ID NO: 265787 - DNA, 75 bp, Artificial Sequence
  Synthetic
gccccctcacgctgaactgcgataggattgaaaacaaaggaaaggtctttgacagtgatgccataatcatcacca

SEQ ID NO: 265788 - DNA, 75 bp, Artificial Sequence
  Synthetic
tttgccggcgagtcgactttctggtctattgcaactcgcaagacattgagaaccaccgccggcagaagcctgggg

SEQ ID NO: 265789 - DNA, 75 bp, Artificial Sequence
  Synthetic
atgcagaagcccctgaagtcgagaaggcgaaacgtgacttcccaggtcaacccgacatgtggaagaacgctttca

SEQ ID NO: 265790 - DNA, 75 bp, Artificial Sequence
  Synthetic
tcgactgtcttggaaacacgccttatggcaagggtgccatgtccaagacctcgcttccccgtctcttggcggccg

SEQ ID NO: 265791 - DNA, 75 bp, Artificial Sequence
  Synthetic
ggcgaaacgtgacttcccaggtcaacccgacatgtggaagaacgctttcagccctgatttctcgcacataaaact

SEQ ID NO: 265792 - DNA, 75 bp, Artificial Sequence
  Synthetic
tggcaagggtgccatgtccaagacctcgcttccccgtctcttggcggccgcaaccgccctcgcccttgagcggct

SEQ ID NO: 265793 - DNA, 75 bp, Artificial Sequence
  Synthetic
cactggttcgctcattgctcgggcatcagggctactccatgagaggctggatgagtacgagctacaaggtccaac

SEQ ID NO: 265794 - DNA, 75 bp, Artificial Sequence
  Synthetic
tgacaacgggcttggcatgctctcagccatgagggtggccaacaaattgaagggcgtgacctctgtgagtgagct

SEQ ID NO: 265795 - DNA, 75 bp, Artificial Sequence
  Synthetic
tcagggctactccatgagaggctggatgagtacgagctacaaggtccaactccaactacttttaactttgaccgc

SEQ ID NO: 265796 - DNA, 75 bp, Artificial Sequence
  Synthetic
gccatgagggtggccaacaaattgaagggcgtgacctctgtgagtgagctcgaagaggcacttgcaggatttgcc

SEQ ID NO: 265797 - DNA, 75 bp, Artificial Sequence
  Synthetic
cagctcaaggatgtcaaaaccttgccagaactcaaacaggcactcaggaacacctcaattaagaagtgccagata

SEQ ID NO: 265798 - DNA, 75 bp, Artificial Sequence
  Synthetic
caacttgccaccccacagcccactgttgaaatcaactacgccctaaagcggctggctgcggctcgtgcagtgacg

SEQ ID NO: 265799 - DNA, 75 bp, Artificial Sequence
  Synthetic
cagaactcaaacaggcactcaggaacacctcaattaagaagtgccagatagtgtacggtggttccacttacacgc

SEQ ID NO: 265800 - DNA, 75 bp, Artificial Sequence
  Synthetic
ttgaaatcaactacgccctaaagcggctggctgcggctcgtgcagtgacgtactggtcacttgcagccaatcttg

SEQ ID NO: 265801 - DNA, 75 bp, Artificial Sequence
  Synthetic
ccggtgccctacaccatctgaggtgtgccagaatcaggtattatgtcaagtgcgttcaagaggccctgtattcca

SEQ ID NO: 265802 - DNA, 75 bp, Artificial Sequence
  Synthetic
cccagctagagtcccacaactgccggtaccatcgggcagagcaagagaaccgcactgtcggtggcgttggagtca

SEQ ID NO: 265803 - DNA, 75 bp, Artificial Sequence
  Synthetic
tgccagaatcaggtattatgtcaagtgcgttcaagaggccctgtattccatcattcaaattgccggagccgcatt

SEQ ID NO: 265804 - DNA, 75 bp, Artificial Sequence
  Synthetic
gtaccatcgggcagagcaagagaaccgcactgtcggtggcgttggagtcattggccacaagggcatggtggacaa

SEQ ID NO: 265805 - DNA, 75 bp, Artificial Sequence
  Synthetic
caccgccaacaaggacgggtgccccaaacccaaagatgatgaagagttcgttgtctcgtccgatgacattaagac

SEQ ID NO: 265806 - DNA, 75 bp, Artificial Sequence
  Synthetic
ccagctagagtccaagaagggcaggaggaaggtcaatgccttctccaggcgtggcctctctgatgaagagtatga

SEQ ID NO: 265807 - DNA, 75 bp, Artificial Sequence
  Synthetic
ccacatttggcccaggtagtcgcagaagaccttctttctcctagcgtggtggacgtgggtgacttcacaatatca

SEQ ID NO: 265808 - DNA, 75 bp, Artificial Sequence
  Synthetic
aaacccaaagatgatgaagagttcgttgtctcgtccgatgacattaagactgagggcaagaaggggaagaacaag

SEQ ID NO: 265809 - DNA, 75 bp, Artificial Sequence
  Synthetic
aggaaggtcaatgccttctccaggcgtggcctctctgatgaagagtatgatgaatacaagaagatcagagaggag

SEQ ID NO: 265810 - DNA, 75 bp, Artificial Sequence
  Synthetic
gctgatgatgactcctatgatgacagttccatacgccagaagtactttggccgtgggaaggccgccaaggcccag

SEQ ID NO: 265811 - DNA, 75 bp, Artificial Sequence
  Synthetic
gttccatacgccagaagtactttggccgtgggaaggccgccaaggcccagaggagaaagattgattggaacccaa

SEQ ID NO: 265812 - DNA, 75 bp, Artificial Sequence
  Synthetic
acgaggaaacaacgcaaggaagagagggcctctcttggtctagtcacaggctctgaaattaggaaaagaaaccca

SEQ ID NO: 265813 - DNA, 75 bp, Artificial Sequence
  Synthetic
tatggtcgcggatccaacgcttcggctccggctggggctgctgggtttcccccaccctcttcatcaccgcgacac

SEQ ID NO: 265814 - DNA, 75 bp, Artificial Sequence
  Synthetic
ctccggctggggctgctgggtttcccccaccctcttcatcaccgcgacacatgtcatccctgagggttgcaccga

SEQ ID NO: 265815 - DNA, 75 bp, Artificial Sequence
  Synthetic
catacgaccagacgtgagtgggttggtgcttgaggagggagcccctgagggcaccgtggcctcagttctcatcaa

SEQ ID NO: 265816 - DNA, 75 bp, Artificial Sequence
  Synthetic
ctcagggtgcacaagagtttttcggagtgcccatcaaacaaattcagatacacaaatcaggtgagttctgtcgct

SEQ ID NO: 265817 - DNA, 75 bp, Artificial Sequence
  Synthetic
gtgcttgaggagggagcccctgagggcaccgtggcctcagttctcatcaaacgcccgacaggtgagctcatcccc

SEQ ID NO: 265818 - DNA, 75 bp, Artificial Sequence
  Synthetic
aaggcttgagccccagccaggtcactatgttcccccacataatagtagatgttaggcaactggaacctgtgttga

SEQ ID NO: 265819 - DNA, 75 bp, Artificial Sequence
  Synthetic
tcacactactcatcaagaggtcaactggagagcttatgcccctagcagccagaatgggaacccatgcaaccatga

SEQ ID NO: 265820 - DNA, 75 bp, Artificial Sequence
  Synthetic
ctcactggttcaaacgctaagggtatggaccttggcacccttcctggtgactgcgggtgcccctactttttcaag

SEQ ID NO: 265821 - DNA, 75 bp, Artificial Sequence
  Synthetic
tggagagcttatgcccctagcagccagaatgggaacccatgcaaccatgaaaatccaaggacgcactgttggagg

SEQ ID NO: 265822 - DNA, 75 bp, Artificial Sequence
  Synthetic
tggaccttggcacccttcctggtgactgcgggtgcccctactttttcaagcggggcaatgactgggtagtctttg

SEQ ID NO: 265823 - DNA, 75 bp, Artificial Sequence
  Synthetic
tccctacatttacaagagaggaaatgactatgtggttattggggtccacacggctgctgctcgcggtgggaacac

SEQ ID NO: 265824 - DNA, 75 bp, Artificial Sequence
  Synthetic
tcgagggtgggcacggcacgtatgttggccaccccatcattggccaggggtcggcccccaagctgtcaactaaga

SEQ ID NO: 265825 - DNA, 75 bp, Artificial Sequence
  Synthetic
gactatgtggttattggggtccacacggctgctgctcgcggtgggaacactgtcatatgtgccacccagggaagt

SEQ ID NO: 265826 - DNA, 75 bp, Artificial Sequence
  Synthetic
tggccaccccatcattggccaggggtcggcccccaagctgtcaactaagaccaaattttggaggtcctccccggc

SEQ ID NO: 265827 - DNA, 75 bp, Artificial Sequence
  Synthetic
gccccaaaactcagcaccaaaactaaattttggagatcatccacagcaccactcccccctggcacctatgaaccg

SEQ ID NO: 265828 - DNA, 75 bp, Artificial Sequence
  Synthetic
tcagcaggtgatgcgggaccagctagcccagttctcagcgccccgcggcaagctcccccggcctgaacttctgaa

SEQ ID NO: 265829 - DNA, 75 bp, Artificial Sequence
  Synthetic
aattttggagatcatccacagcaccactcccccctggcacctatgaaccggcctatcttggtggcaaggacccta

SEQ ID NO: 265830 - DNA, 75 bp, Artificial Sequence
  Synthetic
gcccagttctcagcgccccgcggcaagctcccccggcctgaacttctgaaggccgccgtcgagacagtcaccaac

SEQ ID NO: 265831 - DNA, 75 bp, Artificial Sequence
  Synthetic
caccaaagccaagtgtgttggaggccgccaagaaaaccgtcatcaatgtccttgagcaaacaattgatccacctg

SEQ ID NO: 265832 - DNA, 75 bp, Artificial Sequence
  Synthetic
agctctggctacccccattataagagaaagaatgacgactggaatggcactgcattcattggggcgttgggcgag

SEQ ID NO: 265833 - DNA, 75 bp, Artificial Sequence
  Synthetic
gaaagaatgacgactggaatggcactgcattcattggggcgttgggcgagcaggcaaaccacgcaaacaacatgt

SEQ ID NO: 265834 - DNA, 75 bp, Artificial Sequence
  Synthetic
aaaatgactgttggaatggggagtccttcacaggcaagttggcagaccaggcttctaaggccaacctgatgtttg

SEQ ID NO: 265835 - DNA, 75 bp, Artificial Sequence
  Synthetic
cttcacaggcaagttggcagaccaggcttctaaggccaacctgatgtttgaagaggggaagaacatgacaccagt

SEQ ID NO: 265836 - DNA, 75 bp, Artificial Sequence
  Synthetic
atgaagttcagaagaagcgcctgctttggggagctgatctctctactgtgattcgggccgccatggcctttgggc

SEQ ID NO: 265837 - DNA, 75 bp, Artificial Sequence
  Synthetic
ttggggagctgatctctctactgtgattcgggccgccatggcctttgggcccttctgcgacgccataaaggaaca

SEQ ID NO: 265838 - DNA, 75 bp, Artificial Sequence
  Synthetic
ctataaatattcctttgacgctgactattcagcgtgggacagcacccagcagcgcgagatcatgcgcctgagctt

SEQ ID NO: 265839 - DNA, 75 bp, Artificial Sequence
  Synthetic
gactacaatgagaaactcagttttgaggccccaccaagcatctggtcgaggatagtcaactttggttcaggttgg

SEQ ID NO: 265840 - DNA, 75 bp, Artificial Sequence
  Synthetic
tgtcacacttcctgttagagttggtatgaacatgaatgaggacggccccatcatctttgagaagcactccagata

SEQ ID NO: 265841 - DNA, 75 bp, Artificial Sequence
  Synthetic
atgaacatgaatgaggacggccccatcatctttgagaagcactccagatacaaataccactatgatgctgactac

SEQ ID NO: 265842 - DNA, 75 bp, Artificial Sequence
  Synthetic
tattcagcgtgggacagcacccagcagcgcgagatcatgcgcctgagcttagacatcatgaccaaactcaccgct

SEQ ID NO: 265843 - DNA, 75 bp, Artificial Sequence
  Synthetic
gcagtgcacgaaggcctcccatcaggcttcccgtgcacgtcccaagtcaattccatcaaccactggatcctgacc

SEQ ID NO: 265844 - DNA, 75 bp, Artificial Sequence
  Synthetic
ccacacttggcccaaatagttgcagaagaccttctatctcctagtgtaatggatgtgggagatttcaagatatct

SEQ ID NO: 265845 - DNA, 75 bp, Artificial Sequence
  Synthetic
aagaccttctatctcctagtgtaatggatgtgggagatttcaagatatctatcaatgagggccttccctctggtg

SEQ ID NO: 265846 - DNA, 75 bp, Artificial Sequence
  Synthetic
gcttcccgtgcacgtcccaagtcaattccatcaaccactggatcctgaccctctgtgccctttcggaagtcacaa

SEQ ID NO: 265847 - DNA, 75 bp, Artificial Sequence
  Synthetic
ttgaatttgacccagataagcttaccaaggttctcaaggggtacggcctgaagcccacccggccagacaaggccg

SEQ ID NO: 265848 - DNA, 75 bp, Artificial Sequence
  Synthetic
tgtcccctgatattatacaagccaattccctcttctctttttatggtgatgatgaaattgtcagtacagacataa

SEQ ID NO: 265849 - DNA, 75 bp, Artificial Sequence
  Synthetic
ttccctcttctctttttatggtgatgatgaaattgtcagtacagacataaaactggatccagagaaactcacagc

SEQ ID NO: 265850 - DNA, 75 bp, Artificial Sequence
  Synthetic
caaggttctcaaggggtacggcctgaagcccacccggccagacaaggccgaaggcccaattgagctccgtcgtca

SEQ ID NO: 265851 - DNA, 75 bp, Artificial Sequence
  Synthetic
gtcgatactccgacagctctattggactcgtgggcccaatcacgacgacccgagtgagaccctggttcctcacag

SEQ ID NO: 265852 - DNA, 75 bp, Artificial Sequence
  Synthetic
ggacggcctcaccttcctgcggcgaactgtaacccgtgacccagcaggttggtttggaaaactggagcagagctc

SEQ ID NO: 265853 - DNA, 75 bp, Artificial Sequence
  Synthetic
actcgtgggcccaatcacgacgacccgagtgagaccctggttcctcacagcaaccggaaggtccagctgctctgc

SEQ ID NO: 265854 - DNA, 75 bp, Artificial Sequence
  Synthetic
agaggccccaatcatgatgacccatctgaatcaatgataccacactcccaaagacccatacaattaatgtctctg

SEQ ID NO: 265855 - DNA, 75 bp, Artificial Sequence
  Synthetic
gaggggggaatggagatctttgtgccatcacaccgctccatgtttgcttggatgaggtttcatgatctgtcactg

SEQ ID NO: 265856 - DNA, 75 bp, Artificial Sequence
  Synthetic
catcacaccgctccatgtttgcttggatgaggtttcatgatctgtcactgtgggaaggtagtcgcgacacccttc

SEQ ID NO: 265857 - DNA, 75 bp, Artificial Sequence
  Synthetic
gaggttgaggcgtccgtccccgttgagccaacagctggcgcccccgtcgccgcttccactgctgggcgggttaat

SEQ ID NO: 265858 - DNA, 75 bp, Artificial Sequence
  Synthetic
agccaacagctggcgcccccgtcgccgcttccactgctgggcgggttaatccaattgatccttggatttttgcta

SEQ ID NO: 265859 - DNA, 75 bp, Artificial Sequence
  Synthetic
aacttggccctgatctgaatccttatttggcccaccttcgtcgcatgtataatgggtggaccggatccatgcgcg

SEQ ID NO: 265860 - DNA, 75 bp, Artificial Sequence
  Synthetic
tttggcccaccttcgtcgcatgtataatgggtggaccggatccatgcgcgtgcgagtcctcctggcagggaacgc

SEQ ID NO: 265861 - DNA, 75 bp, Artificial Sequence
  Synthetic
gttacacttcctatcagagttggtatgaatatgaatgaggacggttcgatcatcttcgagaggcattccaggcac

SEQ ID NO: 265862 - DNA, 75 bp, Artificial Sequence
  Synthetic
cacccagtttccccatgtgctgatcgatgtgcgcgctccagagcctgtcgatatgccccttgaagatgttcgtaa

SEQ ID NO: 265863 - DNA, 75 bp, Artificial Sequence
  Synthetic
gatgtgcgcgctccagagcctgtcgatatgccccttgaagatgttcgtaacatcctttttcatcaggggcccgat

SEQ ID NO: 265864 - DNA, 75 bp, Artificial Sequence
  Synthetic
catgttcccccatataattgtagatgttagacaattggagcctgtgttgattcccctacctgatgttaggaataa

SEQ ID NO: 265865 - DNA, 75 bp, Artificial Sequence
  Synthetic
ggtcgtgtcctcacttgtcccagccccaatttttccttcttctttctggttccccccaccgttgaggagagggag

SEQ ID NO: 265866 - DNA, 75 bp, Artificial Sequence
  Synthetic
taatgctggggacgatgtcttcacagtctcttgtcgagtcctcacgagaccatcccctgattttgacttcatatt

SEQ ID NO: 265867 - DNA, 75 bp, Artificial Sequence
  Synthetic
ccaatttttccttcttctttctggttccccccaccgttgaggagagggagccccccttcactttgccaaatttgc

SEQ ID NO: 265868 - DNA, 75 bp, Artificial Sequence
  Synthetic
cagttcagttccagaatggccgctgcaccctttctggcgaccttctgggtacgactccatcatcccctgccgatc

SEQ ID NO: 265869 - DNA, 75 bp, Artificial Sequence
  Synthetic
caccctttctggcgaccttctgggtacgactccatcatcccctgccgatctgggcgctttcgtgggcctgattgc

SEQ ID NO: 265870 - DNA, 75 bp, Artificial Sequence
  Synthetic
ttcagtgttcccccactcaaccaaagggagaatagggacgccaaggagccactaactggaacaatcctggaaatg

SEQ ID NO: 265871 - DNA, 75 bp, Artificial Sequence
  Synthetic
ctttggctttccagatttttccgaatgttctgtgacttttgtggtggctagtgcgacaaccgtcggcgaacgcac

SEQ ID NO: 265872 - DNA, 75 bp, Artificial Sequence
  Synthetic
tgttctgtgacttttgtggtggctagtgcgacaaccgtcggcgaacgcactgtgaatgcccgcaacccccaaaat

SEQ ID NO: 265873 - DNA, 75 bp, Artificial Sequence
  Synthetic
agaagaaattccagcccctctggggaccccagattttgtgggaaagatccaaggcatgctcacccaaaccacaag

SEQ ID NO: 265874 - DNA, 75 bp, Artificial Sequence
  Synthetic
ctctgggagccaaccgagcactccttctggaggatcccagattatcgagctgatgtgcttggttctgattttgcc

SEQ ID NO: 265875 - DNA, 75 bp, Artificial Sequence
  Synthetic
agttcaattcgctactgacacagacaatgattttgaatccaaccaaaacacaaaattcaccccagtcggtgtcat

SEQ ID NO: 265876 - DNA, 75 bp, Artificial Sequence
  Synthetic
aatgattttgaatccaaccaaaacacaaaattcaccccagtcggtgtcatccaggatggcaacaccacccatcaa

SEQ ID NO: 265877 - DNA, 75 bp, Artificial Sequence
  Synthetic
tctggaggatcccagattatcgagctgatgtgcttggttctgattttgccccttctgtttcagccccaggcgttg

SEQ ID NO: 265878 - DNA, 75 bp, Artificial Sequence
  Synthetic
ttccccaggagtggattacccatttcgtttctgagcgcgccgctcttcagagcgatgtggcgctcctcaattatg

SEQ ID NO: 265879 - DNA, 75 bp, Artificial Sequence
  Synthetic
gcccccacctacccgggtgagcaactccttttctttaggtccaccatgcccggatgtagcgggtatcccaacatg

SEQ ID NO: 265880 - DNA, 75 bp, Artificial Sequence
  Synthetic
cgtttctgagcgcgccgctcttcagagcgatgtggcgctcctcaattatgttaatcccaacaccggccgggttct

SEQ ID NO: 265881 - DNA, 75 bp, Artificial Sequence
  Synthetic
cggagaggatgaagtagtggtttcttatagtgccaaagatggcgtttccggtttacctgagctttccaccgtcag

SEQ ID NO: 265882 - DNA, 75 bp, Artificial Sequence
  Synthetic
gaggaccttgcagtggaactcgttccaatagtgatgggggggattggtttggtgctaggattcaccaaagagaag

SEQ ID NO: 265883 - DNA, 75 bp, Artificial Sequence
  Synthetic
aatgggtgcagcacttctaccaagaagcagctccagcacaatctgaagtggctctgctaagatttgtgaatccag

SEQ ID NO: 265884 - DNA, 75 bp, Artificial Sequence
  Synthetic
ggacgggatatttaaatttgtttcttgggtttctttctattaccagttgcggcccgtgggaaatattagtgttgg

SEQ ID NO: 265885 - DNA, 75 bp, Artificial Sequence
  Synthetic
tgggtttctttctattaccagttgcggcccgtgggaaatattagtgttggccgccgccttccccgtcttgatggc

SEQ ID NO: 265886 - DNA, 75 bp, Artificial Sequence
  Synthetic
atttggttattccccccaatggttattttagatttgattcctgggtcaaccagttttacacacttgcccccatgg

SEQ ID NO: 265887 - DNA, 75 bp, Artificial Sequence
  Synthetic
ggaccaggcctaccggcagagtttggagttgcaggcccgctctttttcccatgattccgccatgttgcagcagca

SEQ ID NO: 265888 - DNA, 75 bp, Artificial Sequence
  Synthetic
gagttgcaggcccgctctttttcccatgattccgccatgttgcagcagcaagtccaggccacccagatggcccgc

SEQ ID NO: 265889 - DNA, 75 bp, Artificial Sequence
  Synthetic
tctcttgtcgagtcctcacaaggccatcccccgattttgattttatatttttggtgccacccacagttgaatcaa

SEQ ID NO: 265890 - DNA, 75 bp, Artificial Sequence
  Synthetic
ctgggggcttctcccacaaccctggtcgactggaacggcactcggctcgctgccccgcaagcccgggtgactacc

SEQ ID NO: 265891 - DNA, 75 bp, Artificial Sequence
  Synthetic
ccgggcgcccccactcgagtatcttcttggctgtcttctattgagcctttccacccctctgcattacagacagtt

SEQ ID NO: 265892 - DNA, 75 bp, Artificial Sequence
  Synthetic
gccaggtagaactaatcttagggccactgtccccgctcggggctcctctagtgcatttcctaatacttcccctgt

SEQ ID NO: 265893 - DNA, 75 bp, Artificial Sequence
  Synthetic
ttgctgctgaaaacaagtacgggttgatggacacaatgagagtcggaagacagctcaaggatgtcaggaccatgc

SEQ ID NO: 265894 - DNA, 75 bp, Artificial Sequence
  Synthetic
ccactttactccaaagctgggcagtgtccaatacaccactgacacaaacaatgattttcaaactggccaaaacac

SEQ ID NO: 265895 - DNA, 75 bp, Artificial Sequence
  Synthetic
ataacaatgctaacaccaacaatgaaaatattgggtcccgccttatggcgaggatccgtgggcgcataggcccac

SEQ ID NO: 265896 - DNA, 75 bp, Artificial Sequence
  Synthetic
agcagcaatctacaacaggcttcctttcaacatgataaagagatgctccaagcacaaattgaggccaccaaaaag

SEQ ID NO: 265897 - DNA, 75 bp, Artificial Sequence
  Synthetic
ccccagctcgacaagagagtccccccaaagatcagagagatcgtcctccacgaaccgtttcagaggttaaaaggg

SEQ ID NO: 265898 - DNA, 75 bp, Artificial Sequence
  Synthetic
caaagatcagagagatcgtcctccacgaaccgtttcagaggttaaaagggccatgaagtgggatgttgaaccaga

SEQ ID NO: 265899 - DNA, 75 bp, Artificial Sequence
  Synthetic
ctggcgccctgcaccatctaaggtgcgccagaatcaggtactatgtcaagtgtgttcaggaggccctgtattcta

SEQ ID NO: 265900 - DNA, 75 bp, Artificial Sequence
  Synthetic
gaagctgtttgatgctgggggagtcactccatcaactctacccagcacatttgaaagggctgaaacaaacaatga

SEQ ID NO: 265901 - DNA, 75 bp, Artificial Sequence
  Synthetic
tgctgagatttgtgaatccagatacaggtagggttctgtttgagtgcaagcttcataaatcaggctatgtcacag

SEQ ID NO: 265902 - DNA, 75 bp, Artificial Sequence
  Synthetic
tacttctgtgtattcaaatcaaaccacttcaacgagacttggttctacagctggttctggtaccagtgtctcgag

SEQ ID NO: 265903 - DNA, 75 bp, Artificial Sequence
  Synthetic
tggtctgctaatgatggagtgaatattggcgttagtgatctgaccactgtccatggaccattttggaatatgtgc

SEQ ID NO: 265904 - DNA, 75 bp, Artificial Sequence
  Synthetic
tgaatttgaaaataacagaaaattgcaacaagcttccttccaatttagtagcaacctacacaaggcttctttcca

SEQ ID NO: 265905 - DNA, 75 bp, Artificial Sequence
  Synthetic
gaaggccacatattccactacgccatttatatagggcaaggtaagactattggggtccactcgccacaggctgct

SEQ ID NO: 265906 - DNA, 75 bp, Artificial Sequence
  Synthetic
tttatatagggcaaggtaagactattggggtccactcgccacaggctgctttttccatacccagaataaccatcc

SEQ ID NO: 265907 - DNA, 75 bp, Artificial Sequence
  Synthetic
aattggagaatgaaccatggccatatgccgctgttactaacaactgctatgaattttgttgtagagtgatggcgc

SEQ ID NO: 265908 - DNA, 75 bp, Artificial Sequence
  Synthetic
tgccgctgttactaacaactgctatgaattttgttgtagagtgatggcgctagatgacacttggctccaaaggag

SEQ ID NO: 265909 - DNA, 75 bp, Artificial Sequence
  Synthetic
gaagttagaaatggtgagagatgctgtattgtcagccattaacggtcttgtgtcacaacccttcaaaaacattct

SEQ ID NO: 265910 - DNA, 75 bp, Artificial Sequence
  Synthetic
tgaggtttccaaaaccaatcagaactgatgtgacaggcatgatcctagaagaaggtgcgcccgaagggaccgtgg

SEQ ID NO: 265911 - DNA, 75 bp, Artificial Sequence
  Synthetic
gtattgtcagccattaacggtcttgtgtcacaacccttcaaaaacattctttcaaagatcaagccattaaatgtg

SEQ ID NO: 265912 - DNA, 75 bp, Artificial Sequence
  Synthetic
gatatattctggactccaccagatatctcgagctttattgcatcgctgttgccagattttcatcttcaaggccca

SEQ ID NO: 265913 - DNA, 75 bp, Artificial Sequence
  Synthetic
tctcgagctttattgcatcgctgttgccagattttcatcttcaaggcccagaggacttagctagggacctggtcc

SEQ ID NO: 265914 - DNA, 75 bp, Artificial Sequence
  Synthetic
acacgcgcaggcagcctctcttcgctcacattcgtaagcgaggggagtcacgggtgtaatgtgaaaagacaaaat

SEQ ID NO: 265915 - DNA, 75 bp, Artificial Sequence
  Synthetic
gtgaatgaagatggcgtctaatgacgctattgttgccgttgcaggcaaaaaccacaacgacaatgaaaatcaaaa

SEQ ID NO: 265916 - DNA, 75 bp, Artificial Sequence
  Synthetic
ttgatggtctgcggtcagcgacacagcttggacagtatggattagaaatattctcaatcataaagaaatacttct

SEQ ID NO: 265917 - DNA, 75 bp, Artificial Sequence
  Synthetic
accacaacgacaatgaaaatcaaaacaaagacggcatattgtcaaacatggccgtcacttttaaaaaggctttgg

SEQ ID NO: 265918 - DNA, 75 bp, Artificial Sequence
  Synthetic
gcttggacagtatggattagaaatattctcaatcataaagaaatacttctttggaggtgaccagacagaaaagac

SEQ ID NO: 265919 - DNA, 75 bp, Artificial Sequence
  Synthetic
caaagacggcatattgtcaaacatggccgtcacttttaaaaaggctttgggggcgagacctaaaaggcccccccc

SEQ ID NO: 265920 - DNA, 75 bp, Artificial Sequence
  Synthetic
caagaagttggccagaacttacatgaatgtactggataatgaggaagaaaaggctagaaaactctcagtccgcag

SEQ ID NO: 265921 - DNA, 75 bp, Artificial Sequence
  Synthetic
tgaaactactgttaagtatgaggtggacaaagggatcactgggctgccagagctgacaacagtaacacagccagc

SEQ ID NO: 265922 - DNA, 75 bp, Artificial Sequence
  Synthetic
aatgtactggataatgaggaagaaaaggctagaaaactctcagtccgcagtgctgacccacacatagtaacctca

SEQ ID NO: 265923 - DNA, 75 bp, Artificial Sequence
  Synthetic
gacaaagggatcactgggctgccagagctgacaacagtaacacagccagcagagaataacacggcatttagtgtc

SEQ ID NO: 265924 - DNA, 75 bp, Artificial Sequence
  Synthetic
ccacgcccagtggtcataatgatgtgtggtccccctggcattgggaaaacgaaagctgctgagcatctggcgggc

SEQ ID NO: 265925 - DNA, 75 bp, Artificial Sequence
  Synthetic
gaaatataccattatgggttgtatgttgagaaagggttggtccttggagttcacaaaccgcccgcagcaataagt

SEQ ID NO: 265926 - DNA, 75 bp, Artificial Sequence
  Synthetic
gtggtccccctggcattgggaaaacgaaagctgctgagcatctggcgggccgattggctgccgaaataagaccag

SEQ ID NO: 265927 - DNA, 75 bp, Artificial Sequence
  Synthetic
ttgagaaagggttggtccttggagttcacaaaccgcccgcagcaataagtatggccaaggtcgagctgaccccat

SEQ ID NO: 265928 - DNA, 75 bp, Artificial Sequence
  Synthetic
aagagggaaagaacatgaccccagtctacacaggtgcgcttaaggacgagctggtcaagactgacaaaatttatg

SEQ ID NO: 265929 - DNA, 75 bp, Artificial Sequence
  Synthetic
gggatgattatggtatgtcaaaaataacagaagattgcaataaattgcaagccatagctgacactgcaccactgt

SEQ ID NO: 265930 - DNA, 75 bp, Artificial Sequence
  Synthetic
agtcattcccatatatagcttttgacaacaattgctacaccttttgctgttgggtgcttgatctaaatgactcgt

SEQ ID NO: 265931 - DNA, 75 bp, Artificial Sequence
  Synthetic
aacagaagattgcaataaattgcaagccatagctgacactgcaccactgtcactcaattgtgacaggatagaaaa

SEQ ID NO: 265932 - DNA, 75 bp, Artificial Sequence
  Synthetic
caacaattgctacaccttttgctgttgggtgcttgatctaaatgactcgtggctgagcagaaggatgatacaacg

SEQ ID NO: 265933 - DNA, 75 bp, Artificial Sequence
  Synthetic
taatctgggtcctgtgtgcaggcgggtagactttttagtatactgctctgctccagaaattgaacaaatgcggag

SEQ ID NO: 265934 - DNA, 75 bp, Artificial Sequence
  Synthetic
gaaagtggccaacatgtttttgtgtagcttatcaaccctgttcacccgtcctataaaagatatattagggaaggt

SEQ ID NO: 265935 - DNA, 75 bp, Artificial Sequence
  Synthetic
gtagactttttagtatactgctctgctccagaaattgaacaaatgcggagggcccacccaggtgacactaatgct

SEQ ID NO: 265936 - DNA, 75 bp, Artificial Sequence
  Synthetic
agcttatcaaccctgttcacccgtcctataaaagatatattagggaaggtaaagccactcaacatcttgaacata

SEQ ID NO: 265937 - DNA, 75 bp, Artificial Sequence
  Synthetic
ggcaacacgccgtttggaaaaggtgttatgaagcccacaaccctcaataggctattgatccaggccacagcatta

SEQ ID NO: 265938 - DNA, 75 bp, Artificial Sequence
  Synthetic
tggacacccccagatgtgtctgcaatgatcgctcccttgcttggtgaatacgagctacagggcccagaagacatc

SEQ ID NO: 265939 - DNA, 75 bp, Artificial Sequence
  Synthetic
ttatgaagcccacaaccctcaataggctattgatccaggccacagcattagccatggagcggcaagatgagtttc

SEQ ID NO: 265940 - DNA, 75 bp, Artificial Sequence
  Synthetic
tgatcgctcccttgcttggtgaatacgagctacagggcccagaagacatcgctgtagagctcgtccccgtggtga

SEQ ID NO: 265941 - DNA, 75 bp, Artificial Sequence
  Synthetic
aaaacttaaggaatacgggttgaaaccgacccgccctgacaagactgagggaccccttgttatctctgaggacct

SEQ ID NO: 265942 - DNA, 75 bp, Artificial Sequence
  Synthetic
tggggctcataagcatggcaacattgggtaagaaattgaggggtgtcaaatcaatggaggggctgcgcaatgcac

SEQ ID NO: 265943 - DNA, 75 bp, Artificial Sequence
  Synthetic
aaagctacagtttacactgggagtgccccctttactccaaagctgggcagtgttcaattcagtactgatacagaa

SEQ ID NO: 265944 - DNA, 75 bp, Artificial Sequence
  Synthetic
tgagggcttgcaaagatcttggggcatatggcttggaaatcctgaaattagtgatgaagtggttctttccaaaga

SEQ ID NO: 265945 - DNA, 75 bp, Artificial Sequence
  Synthetic
gggtaagaaattgaggggtgtcaaatcaatggaggggctgcgcaatgcactattgggctataaaatagaagaatg

SEQ ID NO: 265946 - DNA, 75 bp, Artificial Sequence
  Synthetic
atatggcttggaaatcctgaaattagtgatgaagtggttctttccaaagaaggatgaagctaatgagctggccat

SEQ ID NO: 265947 - DNA, 75 bp, Artificial Sequence
  Synthetic
accaacctcgccccaacaccaggctatctgcacggccaccctcgcgctctcccggttgcgggctgctagggccct

SEQ ID NO: 265948 - DNA, 75 bp, Artificial Sequence
  Synthetic
taaggatagcctttccacttacatgagaaccctggacttagaggaagaaaaggctcgcaagttgtcaactaaatc

SEQ ID NO: 265949 - DNA, 75 bp, Artificial Sequence
  Synthetic
atctgcacggccaccctcgcgctctcccggttgcgggctgctagggcccttgcatatgcttcttgcttacagagt

SEQ ID NO: 265950 - DNA, 75 bp, Artificial Sequence
  Synthetic
agaaccctggacttagaggaagaaaaggctcgcaagttgtcaactaaatcagcctccccagatatagttggcacc

SEQ ID NO: 265951 - DNA, 75 bp, Artificial Sequence
  Synthetic
cgcaccgaacagcctatgctagaaggtaagcacaaggaacataattgcagagtgcaccgagctgaggcagccggc

SEQ ID NO: 265952 - DNA, 75 bp, Artificial Sequence
  Synthetic
cccagaccagttgtgctcatgatttcaggcagaccaggcataggcaagactcacgtggcaagggagattgcaaag

SEQ ID NO: 265953 - DNA, 75 bp, Artificial Sequence
  Synthetic
gtaagcacaaggaacataattgcagagtgcaccgagctgaggcagccggccatggccccattggccacgatgggg

SEQ ID NO: 265954 - DNA, 75 bp, Artificial Sequence
  Synthetic
caggcagaccaggcataggcaagactcacgtggcaagggagattgcaaagagggtggcctcatccctgacaggag

SEQ ID NO: 265955 - DNA, 75 bp, Artificial Sequence
  Synthetic
ggggaagtcctattaaatttggaattaggccccgaactaaatccatacctagcacacctttctagaatgtataat

SEQ ID NO: 265956 - DNA, 75 bp, Artificial Sequence
  Synthetic
gtgaggagggcaagaacaaaggtaagaccaagaagggtcgtgggcgaaagtctaatttcaatgccttctccagac

SEQ ID NO: 265957 - DNA, 75 bp, Artificial Sequence
  Synthetic
gggatgactatggaatgagcaacaccatacaggatgccctgaggctgcaggaactggcggacacgtgcccgctaa

SEQ ID NO: 265958 - DNA, 75 bp, Artificial Sequence
  Synthetic
gaccaagaagggtcgtgggcgaaagtctaatttcaatgccttctccagacgcggccttagtgatgaggagtatga

SEQ ID NO: 265959 - DNA, 75 bp, Artificial Sequence
  Synthetic
catacaggatgccctgaggctgcaggaactggcggacacgtgcccgctaaccctcaactgtgacaggatagagaa

SEQ ID NO: 265960 - DNA, 75 bp, Artificial Sequence
  Synthetic
tatgttccctcatgtaattattgatgttaggactttagaaccagttttgttgccccttcctgatgttaggaataa

SEQ ID NO: 265961 - DNA, 75 bp, Artificial Sequence
  Synthetic
cgaggaagagcttgctgaagtgcaggcgggcggagatggcggaataggtgaaactgaggcagaaatccgccatcg

SEQ ID NO: 265962 - DNA, 75 bp, Artificial Sequence
  Synthetic
caattttgaggcctgttccaggagaatagatttccttgtgtatgccgacgcgccagaggttgaaaaggcaaaacg

SEQ ID NO: 265963 - DNA, 75 bp, Artificial Sequence
  Synthetic
cctacccccgctcggggctcccccagcacatcttctaatgcttctactgctacttctatatattcaaatcaaact

SEQ ID NO: 265964 - DNA, 75 bp, Artificial Sequence
  Synthetic
gcgggcggagatggcggaataggtgaaactgaggcagaaatccgccatcgggtcttctataaatcaaaatctggt

SEQ ID NO: 265965 - DNA, 75 bp, Artificial Sequence
  Synthetic
atagatttccttgtgtatgccgacgcgccagaggttgaaaaggcaaaacgcgactttcctggccaacctgacatg

SEQ ID NO: 265966 - DNA, 75 bp, Artificial Sequence
  Synthetic
atagactggaccccccccaagaacgattggtcagaggacactagaacagtcaattatgacgaacatatcagtttt

SEQ ID NO: 265967 - DNA, 75 bp, Artificial Sequence
  Synthetic
gtatggatttttacgtgcccaggcaagaaccaatgttcagatggatgagattctcagatctgagcacgtgggagg

SEQ ID NO: 265968 - DNA, 75 bp, Artificial Sequence
  Synthetic
tcttgactataggggagttaaccaactccaggttccctgtgcctatagatgagctctacaccagtcccaatgaga

SEQ ID NO: 265969 - DNA, 75 bp, Artificial Sequence
  Synthetic
ggcaacacaccccatggtaagggcttaatgaagactttaaccctgagctcgctcgttgcaagggcctctggctta

SEQ ID NO: 265970 - DNA, 75 bp, Artificial Sequence
  Synthetic
ctccaggttccctgtgcctatagatgagctctacaccagtcccaatgagagtctggtggtgcaaccccagaacgg

SEQ ID NO: 265971 - DNA, 75 bp, Artificial Sequence
  Synthetic
attggtcagaggacactagaacagtcaattatgacgaacatatcagttttgaagcaccaccctcaatctggagta

SEQ ID NO: 265972 - DNA, 75 bp, Artificial Sequence
  Synthetic
taatgaagactttaaccctgagctcgctcgttgcaagggcctctggcttactacatgagaggctagacgagtttg

SEQ ID NO: 265973 - DNA, 75 bp, Artificial Sequence
  Synthetic
cacctggggccaaggaagtttttggtgaaagcatcagtaatgtggctatccatagagtcggtgaattcacccagt

SEQ ID NO: 265974 - DNA, 75 bp, Artificial Sequence
  Synthetic
aaaacaaatatgggttggtggaaaccatgagagttggcaaccatctaaagggtgtgaaaacgatggaggagttaa

SEQ ID NO: 265975 - DNA, 75 bp, Artificial Sequence
  Synthetic
tgaaagcatcagtaatgtggctatccatagagtcggtgaattcacccagtttcgcttccctaaaaagatgagacc

SEQ ID NO: 265976 - DNA, 75 bp, Artificial Sequence
  Synthetic
catgagagttggcaaccatctaaagggtgtgaaaacgatggaggagttaaagcaagccatcaagggcgtcaccat

SEQ ID NO: 265977 - DNA, 75 bp, Artificial Sequence
  Synthetic
tccaacagaggatgtcccggctcctctaggcaccccagatttctctggcaagctctttggtgtactaagcccgag

SEQ ID NO: 265978 - DNA, 75 bp, Artificial Sequence
  Synthetic
tggtgagctgttaccacttgctgttcgcatgggtgcagtggcctcaatgaaaatccaaggaaagctcatgcatgg

SEQ ID NO: 265979 - DNA, 75 bp, Artificial Sequence
  Synthetic
caaagtcatcagcaccactgtccaaactaacaacgagttggctggcgtcctatcacacctcagaaatgcaaggat

SEQ ID NO: 265980 - DNA, 75 bp, Artificial Sequence
  Synthetic
catgatgcagtaattgcaaccaactctgccaaattcaccccaaaattgggcgctatacaaattggcacatgggaa

SEQ ID NO: 265981 - DNA, 75 bp, Artificial Sequence
  Synthetic
cgcatgggtgcagtggcctcaatgaaaatccaaggaaagctcatgcatggacaatcaggaatgttgctcactggc

SEQ ID NO: 265982 - DNA, 75 bp, Artificial Sequence
  Synthetic
actctgtcaatgacagtgtcaacaccaccccttcaaataaagaagaggttggtgcattttccaacatcaaagttg

SEQ ID NO: 265983 - DNA, 75 bp, Artificial Sequence
  Synthetic
caccccttcaaataaagaagaggttggtgcattttccaacatcaaagttggatttaagaagatgctgggtgccgt

SEQ ID NO: 265984 - DNA, 75 bp, Artificial Sequence
  Synthetic
gtgaatgaagatggcgtctaacgacgctaccgctgcccttggcagtcaaaactctgtcaatgacagtgtcaacac

SEQ ID NO: 265985 - DNA, 75 bp, Artificial Sequence
  Synthetic
gattgggttgtttgcggagtccatgcagctgccacaaaatcaggtaacactgtagtttgtgctatacaaggtggt

SEQ ID NO: 265986 - DNA, 75 bp, Artificial Sequence
  Synthetic
tggacactccccaattattctggagccttaacacttaatatggggttggcccctcctgtggcccccaccttccct

SEQ ID NO: 265987 - DNA, 75 bp, Artificial Sequence
  Synthetic
agcaatctctggtcaaaaccactcagggaggaggatgtgcaagaggaggtcagaaaaccagaacccaaatgcgat

SEQ ID NO: 265988 - DNA, 75 bp, Artificial Sequence
  Synthetic
ccctcctgtggcccccaccttccctggtgaacaaattcttttctttagatcccacattcctcttaaaggaggtgt

SEQ ID NO: 265989 - DNA, 75 bp, Artificial Sequence
  Synthetic
cccccctgaacccccaaatggtgaagacaccgtacagtttgatgcaaagtcagaaactataagtgggctaccgga

SEQ ID NO: 265990 - DNA, 75 bp, Artificial Sequence
  Synthetic
gacaccgtacagtttgatgcaaagtcagaaactataagtgggctaccggacttgacaacagtgcaaaatgaacac

SEQ ID NO: 265991 - DNA, 75 bp, Artificial Sequence
  Synthetic
cagctgccacaaaatcaggtaacactgtagtttgtgctatacaaggtggtgagggtgaagccacgctagagggtg

SEQ ID NO: 265992 - DNA, 75 bp, Artificial Sequence
  Synthetic
caaaattttggaagtcaaccccacaacccctacctccaggtacttacgaaccagcttatctcggaggtagagacc

SEQ ID NO: 265993 - DNA, 75 bp, Artificial Sequence
  Synthetic
gcctcagcgatgaggagtacgaggagtacaagcggatcagggaagagagaaacggaaaatactcaatagaagagt

SEQ ID NO: 265994 - DNA, 75 bp, Artificial Sequence
  Synthetic
atcagatgtagcactgattaggtttacaaatccagacacaggacgtgttctatttgaagcaaaattacacaggag

SEQ ID NO: 265995 - DNA, 75 bp, Artificial Sequence
  Synthetic
acaaatccagacacaggacgtgttctatttgaagcaaaattacacaggagtggttacatcacagtggccaatact

SEQ ID NO: 265996 - DNA, 75 bp, Artificial Sequence
  Synthetic
atattggagatgtgggatggtgaattctaccactattccgtgtacgtcagcggcggcaaagctctaggggttcac

SEQ ID NO: 265997 - DNA, 75 bp, Artificial Sequence
  Synthetic
tctaccactattccgtgtacgtcagcggcggcaaagctctaggggttcacaagcccccggcagctataagcctcg

SEQ ID NO: 265998 - DNA, 75 bp, Artificial Sequence
  Synthetic
acccctacctccaggtacttacgaaccagcttatctcggaggtagagaccccagggtcgaagggggcccatcact

SEQ ID NO: 265999 - DNA, 75 bp, Artificial Sequence
  Synthetic
agccgcagttgagacagtcaccaatgcacttgaacaggtcatggacacaccagtggcatggagtttcagtgatgc

SEQ ID NO: 266000 - DNA, 75 bp, Artificial Sequence
  Synthetic
tttccgtccaaccaggaaacagaggaaagaggaaagggcaaaccttggccttgtgaccggctctgaaatcaggaa

SEQ ID NO: 266001 - DNA, 75 bp, Artificial Sequence
  Synthetic
gcccccatgggaactggaaatgggcgcagaagggtgcaataatggctggagcttttatagcagggcttgctggtg

SEQ ID NO: 266002 - DNA, 75 bp, Artificial Sequence
  Synthetic
gcacttgaacaggtcatggacacaccagtggcatggagtttcagtgatgcttgcatgtctttggataaaacaact

SEQ ID NO: 266003 - DNA, 75 bp, Artificial Sequence
  Synthetic
cattgaaaggtctcgctggtgaaaagttcccctacacggccttcagtaacaattgttataacttctgttgctggg

SEQ ID NO: 266004 - DNA, 75 bp, Artificial Sequence
  Synthetic
acatagtcaccaatggcattggctcacttgtgaacgctggggccaatgcaataaatcaaaaagtagactttgaaa

SEQ ID NO: 266005 - DNA, 75 bp, Artificial Sequence
  Synthetic
gttcccctacacggccttcagtaacaattgttataacttctgttgctgggtgcttgagctcaatgacacgtggct

SEQ ID NO: 266006 - DNA, 75 bp, Artificial Sequence
  Synthetic
caagcagcccacgccaataacatgtatgaacttggcaaacccatgaagcccgtgtacacagcagccctcaaggac

SEQ ID NO: 266007 - DNA, 75 bp, Artificial Sequence
  Synthetic
atttggtccagaatagtcaattttgggtctggatggggcttctgggtctcccctagtctattcatcacatcaacc

SEQ ID NO: 266008 - DNA, 75 bp, Artificial Sequence
  Synthetic
atgaacttggcaaacccatgaagcccgtgtacacagcagccctcaaggacgagcttgttaaaccagataaggttt

SEQ ID NO: 266009 - DNA, 75 bp, Artificial Sequence
  Synthetic
aaagaggaaagggcaaaccttggccttgtgaccggctctgaaatcaggaaaagaaacccagatgattttaaacca

SEQ ID NO: 266010 - DNA, 75 bp, Artificial Sequence
  Synthetic
agctgcaggctgatatgattgcaatcagacaaggggtgttgaccgcgggcggcttctcccccactgatgcagcaa

SEQ ID NO: 266011 - DNA, 75 bp, Artificial Sequence
  Synthetic
cgttgatgatggaaaagtcaaaaaggtggccaacgcgatcctctgtgcactcggctcgctgttctcaaagccaat

SEQ ID NO: 266012 - DNA, 75 bp, Artificial Sequence
  Synthetic
gctgccactgcgactgctggcaaaaccagcacaaacagtgaaattcacaatcaagatgtaaaccctacatcaaac

SEQ ID NO: 266013 - DNA, 75 bp, Artificial Sequence
  Synthetic
cattctgtgaggccataaagccacatgtgattaagttgcctatcaaagtgggcatgaatgccatagaagatggcc

SEQ ID NO: 266014 - DNA, 75 bp, Artificial Sequence
  Synthetic
caattagaactgatgtgactggtatgatactcgaggagggagcgcctgaaggaaccgtggcctcccttctcatca

SEQ ID NO: 266015 - DNA, 75 bp, Artificial Sequence
  Synthetic
tgtgattaagttgcctatcaaagtgggcatgaatgccatagaagatggccctctgatatatgcagaacattctaa

SEQ ID NO: 266016 - DNA, 75 bp, Artificial Sequence
  Synthetic
tatagtggagacagtcatcttaatggcggaacttttcaacgtcttttggactccgccagatgtctctaatttcat

SEQ ID NO: 266017 - DNA, 75 bp, Artificial Sequence
  Synthetic
aaactactactttctccggtggattcaccaatgtttctcatgccagaactgtcgacctgaccaagaagacatcag

SEQ ID NO: 266018 - DNA, 75 bp, Artificial Sequence
  Synthetic
tcccccaataaggagagagggctcggtaccacccctagagctctctcccccaacaagggaggaagaaccaacatc

SEQ ID NO: 266019 - DNA, 75 bp, Artificial Sequence
  Synthetic
gcggaacttttcaacgtcttttggactccgccagatgtctctaatttcatagcctccctgataggtgattttgaa

SEQ ID NO: 266020 - DNA, 75 bp, Artificial Sequence
  Synthetic
caatatcatgtgcaagctcacagccaatccctccttggctgcggtggtggctcaggacctactctccccatctga

SEQ ID NO: 266021 - DNA, 75 bp, Artificial Sequence
  Synthetic
cttgacaggatccaatgctaaaggtatggaccttggcacgaccccgggcgactgtgggtgtccctacatttacaa

SEQ ID NO: 266022 - DNA, 75 bp, Artificial Sequence
  Synthetic
caccaatgtttctcatgccagaactgtcgacctgaccaagaagacatcagccacaccagcccctacgcctgtttc

SEQ ID NO: 266023 - DNA, 75 bp, Artificial Sequence
  Synthetic
agctaggagttcttctagtgtttctactcaacccacctcctcctcttctcggaccagtgagtgggtgcgcagcca

SEQ ID NO: 266024 - DNA, 75 bp, Artificial Sequence
  Synthetic
accgctgagaagataggtcgcatgctgtcgtccgctgcatcaacactgcgggcatgcaaagacctagggaactat

SEQ ID NO: 266025 - DNA, 75 bp, Artificial Sequence
  Synthetic
acgtttctcccacgcacaacaccgcctacagtgtacctcccttggacctaagagagaaggttgacgcaaaggaac

SEQ ID NO: 266026 - DNA, 75 bp, Artificial Sequence
  Synthetic
tgtcgtccgctgcatcaacactgcgggcatgcaaagacctagggaactatgcccttgacatacttaaattggtca

SEQ ID NO: 266027 - DNA, 75 bp, Artificial Sequence
  Synthetic
ctatgtgcactatcagaggtcactggcttatcccctgatgtaatacaatcacaatcctacttctccttctacggt

SEQ ID NO: 266028 - DNA, 75 bp, Artificial Sequence
  Synthetic
ctcgagggtggtgacggcctgggcacatactgtggagcaccaatactaggacctggtaatgcacctaaactaagt

SEQ ID NO: 266029 - DNA, 75 bp, Artificial Sequence
  Synthetic
aatccctccttggctgcggtggtggctcaggacctactctccccatctgagatggatgttggtgattatgtaatc

SEQ ID NO: 266030 - DNA, 75 bp, Artificial Sequence
  Synthetic
atatggaggctatagggaacaaccatctcacgaccctcctcaaggataaggacagtctcacggctttcatgaaga

SEQ ID NO: 266031 - DNA, 75 bp, Artificial Sequence
  Synthetic
tgccataagttttgcacgcatagaactcactcctctttctctatactggagggtagtttacaccccaccttacct

SEQ ID NO: 266032 - DNA, 75 bp, Artificial Sequence
  Synthetic
accgctattcgctcatctccgtcggagaggggagtcacaagtttagtgaaaagataatctttattttctttcctt

SEQ ID NO: 266033 - DNA, 75 bp, Artificial Sequence
  Synthetic
tctcacgaccctcctcaaggataaggacagtctcacggctttcatgaagaccctggacctagaagaggagaaggc

SEQ ID NO: 266034 - DNA, 75 bp, Artificial Sequence
  Synthetic
atggccccattatagtcaggcaacaggtggatggtctggtcttccttcgtcgcacaatttcgaaggacgctattg

SEQ ID NO: 266035 - DNA, 75 bp, Artificial Sequence
  Synthetic
catcactccaacaagtcatgagggaacagctcaaaccattcactgaaccacgtggaaagccaccaaaacccagtg

SEQ ID NO: 266036 - DNA, 75 bp, Artificial Sequence
  Synthetic
gcttatcccctgatgtaatacaatcacaatcctacttctccttctacggtgatgatgagatagtctcaacagaca

SEQ ID NO: 266037 - DNA, 75 bp, Artificial Sequence
  Synthetic
cgccagatccctcctgcacaaggccaaagaagagatgttcagtaggatcagaccagtggttgtcatgatctcagg

SEQ ID NO: 266038 - DNA, 75 bp, Artificial Sequence
  Synthetic
cggggaggatgaaccagtggtttcttacagcgtcaaagatggcgtttccggcttgcctgagcttactactgtcag

SEQ ID NO: 266039 - DNA, 75 bp, Artificial Sequence
  Synthetic
aacgattcttggctcaataggaagtatgtatcaaggaccacgggtttctacaggccctaccaagagtggaatagg

SEQ ID NO: 266040 - DNA, 75 bp, Artificial Sequence
  Synthetic
aaagaagagatgttcagtaggatcagaccagtggttgtcatgatctcaggcagacctggcattggcaaaacccat

SEQ ID NO: 266041 - DNA, 75 bp, Artificial Sequence
  Synthetic
acaaagaaaagttcaattgatatccctactgggtgaggccgccctacatggtgaaaaattctacaggaagatagc

SEQ ID NO: 266042 - DNA, 75 bp, Artificial Sequence
  Synthetic
gacaacctccagcggttacccacaccacgtgaaaaagaacgattactggaatggtgaatctttcacaggaaagct

SEQ ID NO: 266043 - DNA, 75 bp, Artificial Sequence
  Synthetic
ggtggatggtctggtcttccttcgtcgcacaatttcgaaggacgctattgggtaccaaggtcgacttgaccgcaa

SEQ ID NO: 266044 - DNA, 75 bp, Artificial Sequence
  Synthetic
ggagtcgaccactgggacgcctacaggggagagagagtggttttatgggacgactatggcatgggaaaccccgtc

SEQ ID NO: 266045 - DNA, 75 bp, Artificial Sequence
  Synthetic
taggaaaactgaggccactgaacatactcaacatcatcaccaactgtgattggacatttcccggggttgtggagg

SEQ ID NO: 266046 - DNA, 75 bp, Artificial Sequence
  Synthetic
ggggagagagagtggttttatgggacgactatggcatgggaaaccccgtcaaagatgctttaacactacaagaat

SEQ ID NO: 266047 - DNA, 75 bp, Artificial Sequence
  Synthetic
ctactgggtgaggccgccctacatggtgaaaaattctacaggaagatagccagtagggtcatccaagaagttaag

SEQ ID NO: 266048 - DNA, 75 bp, Artificial Sequence
  Synthetic
aagatttatgacaagatcaaaaagagactactctggggttctgacctgtcaacaatgatacggtgtgctagggct

SEQ ID NO: 266049 - DNA, 75 bp, Artificial Sequence
  Synthetic
actcaacatcatcaccaactgtgattggacatttcccggggttgtggaggctctcatactgcttgcagaactctt

SEQ ID NO: 266050 - DNA, 75 bp, Artificial Sequence
  Synthetic
cacgtgaaaaagaacgattactggaatggtgaatctttcacaggaaagctggcagatcagggctcaaaggccaac

SEQ ID NO: 266051 - DNA, 75 bp, Artificial Sequence
  Synthetic
tcataattacgaccaatctagttaatcctgcacctctcgattatgtgaacttcgaggcgtgctctagaagagttg

SEQ ID NO: 266052 - DNA, 75 bp, Artificial Sequence
  Synthetic
tgaggatatcgcggttgaggtcgtgccggtgatcctcggtggcataggtatggtacttggattcaccaaagaaag

SEQ ID NO: 266053 - DNA, 75 bp, Artificial Sequence
  Synthetic
tcctgcacctctcgattatgtgaacttcgaggcgtgctctagaagagttgacttcttggtctatgcagagtcacc

SEQ ID NO: 266054 - DNA, 75 bp, Artificial Sequence
  Synthetic
ccggtgatcctcggtggcataggtatggtacttggattcaccaaagaaaggatcggccgactgttgagctcggct

SEQ ID NO: 266055 - DNA, 75 bp, Artificial Sequence
  Synthetic
ggtcaggtaaatatgattgacccctggataatgaataattttgtacaggctccccaaggggagtttaccatttcc

SEQ ID NO: 266056 - DNA, 75 bp, Artificial Sequence
  Synthetic
actccaggtataagtgccattatgatgcagactattcgagatgggattccactcaacaaagggcggtgttggccg

SEQ ID NO: 266057 - DNA, 75 bp, Artificial Sequence
  Synthetic
ggataatgaataattttgtacaggctccccaaggggagtttaccatttccccaaataatacacctggtgatattt

SEQ ID NO: 266058 - DNA, 75 bp, Artificial Sequence
  Synthetic
ccacataaagctgactctggcccctcagggcggatttgacaagaatggcaacaccccgcatggtaagggtaccat

SEQ ID NO: 266059 - DNA, 75 bp, Artificial Sequence
  Synthetic
ttccccaccaaggatgaggcaaacgagatggacatggtgagggcaatagaggatgctgtgctcgattttgaagct

SEQ ID NO: 266060 - DNA, 75 bp, Artificial Sequence
  Synthetic
cagggcggatttgacaagaatggcaacaccccgcatggtaagggtaccatgcgatccctaactcaagggtccctg

SEQ ID NO: 266061 - DNA, 75 bp, Artificial Sequence
  Synthetic
tgcagactattcgagatgggattccactcaacaaagggcggtgttggccgcggccttggaaatcatggtcaaatt

SEQ ID NO: 266062 - DNA, 75 bp, Artificial Sequence
  Synthetic
ggaatatgcaggtccgcataatgcttgctggtaatgccttttcagctggaaagattattgtgtgctgcataccgc

SEQ ID NO: 266063 - DNA, 75 bp, Artificial Sequence
  Synthetic
caaagtgtcgatcaacgaaggtctaccatctggagtgccttgcacctcccagtggaactcaattagtcactggtt

SEQ ID NO: 266064 - DNA, 75 bp, Artificial Sequence
  Synthetic
atacagaacaaccatatgacagcattgctcaaggacaaaaacagtctagcaaccttcctcagggagctagatatg

SEQ ID NO: 266065 - DNA, 75 bp, Artificial Sequence
  Synthetic
aactttgacaccaacagggtctccgcattcaggaagctggccgcagacaacaagtatggaatcgtggaaacaatg

SEQ ID NO: 266066 - DNA, 75 bp, Artificial Sequence
  Synthetic
cattcaggaagctggccgcagacaacaagtatggaatcgtggaaacaatgagagtgggtgcggcactcaaaaacg

SEQ ID NO: 266067 - DNA, 75 bp, Artificial Sequence
  Synthetic
tgctggtaatgccttttcagctggaaagattattgtgtgctgcataccgccgggtttttcttctcaatctatttc

SEQ ID NO: 266068 - DNA, 75 bp, Artificial Sequence
  Synthetic
gccagaattgccgctgctaggtccctagtccacaaggccaaagaagaaatgtcatctaggatgcgtcctgttgtc

SEQ ID NO: 266069 - DNA, 75 bp, Artificial Sequence
  Synthetic
tgatgttagaaatgtcctttttcataataatgataacccccaaacgatgagattgctttgcatgttgtatacacc

SEQ ID NO: 266070 - DNA, 75 bp, Artificial Sequence
  Synthetic
acagatataaaagttgaccctgctaaattaacagcaaagctgaaggagtatggtctgaggccgacacgcccagac

SEQ ID NO: 266071 - DNA, 75 bp, Artificial Sequence
  Synthetic
aataatgataacccccaaacgatgagattgctttgcatgttgtatacaccccttcggtctggtggtacatcttca

SEQ ID NO: 266072 - DNA, 75 bp, Artificial Sequence
  Synthetic
ccaagtatcgagtctcttccaacggtaagggctctgtttctgttgacaaagttgaggaccacacatctcagactg

SEQ ID NO: 266073 - DNA, 75 bp, Artificial Sequence
  Synthetic
taagggctctgtttctgttgacaaagttgaggaccacacatctcagactgcaaacgaggtgagctcagcactcct

SEQ ID NO: 266074 - DNA, 75 bp, Artificial Sequence
  Synthetic
tagtccacaaggccaaagaagaaatgtcatctaggatgcgtcctgttgtcatcatgatctctggtcggcccggaa

SEQ ID NO: 266075 - DNA, 75 bp, Artificial Sequence
  Synthetic
tcgtaccgagaaatggtgttgaccattgggatgcatacaaaggggagaggattgtgctttgggacgactacggta

SEQ ID NO: 266076 - DNA, 75 bp, Artificial Sequence
  Synthetic
cctcctgatatcgagcaaagaactaagccattcagtgtacccaatatccctatgaacctgatgtccaattcccgt

SEQ ID NO: 266077 - DNA, 75 bp, Artificial Sequence
  Synthetic
accagagctccattttaagacaaatgtactggaccaaaggacccaaccacgatgaccctaatgaaaccatggtcc

SEQ ID NO: 266078 - DNA, 75 bp, Artificial Sequence
  Synthetic
agccattcagtgtacccaatatccctatgaacctgatgtccaattcccgtgtttcaatgttgattgatggtatga

SEQ ID NO: 266079 - DNA, 75 bp, Artificial Sequence
  Synthetic
tggggcatccttcgttgttaacagaatctccaaaaggttctgctgggaaaggtgggtaaaaccaaccgagaccca

SEQ ID NO: 266080 - DNA, 75 bp, Artificial Sequence
  Synthetic
gatgaccctaatgaaaccatggtcccgcactcccaacgaccagtacaactgatggcacttttgggtgaggcagca

SEQ ID NO: 266081 - DNA, 75 bp, Artificial Sequence
  Synthetic
ttgggatgcatacaaaggggagaggattgtgctttgggacgactacggtatgagcaaccctgtgaccgatgcact

SEQ ID NO: 266082 - DNA, 75 bp, Artificial Sequence
  Synthetic
cgagggcaagaaaggaaagaacaagtctggccgtggtaagaagcacacagcattctcaagcaaaggtctcagtga

SEQ ID NO: 266083 - DNA, 75 bp, Artificial Sequence
  Synthetic
ccaccacagtttcagctgcgtgtgtagcaaggatgaggggacgcatttttaataataatggcaattatggtgtga

SEQ ID NO: 266084 - DNA, 75 bp, Artificial Sequence
  Synthetic
agaagcgagtgagcccgaaaaggaagtggctcaaggtagatgggagattgagcccaaggacgcagaaccagaagg

SEQ ID NO: 266085 - DNA, 75 bp, Artificial Sequence
  Synthetic
tgacagtgacaccataattattaccaccaatctggctaatcctgctcctctagactatgttaattttgaagcttg

SEQ ID NO: 266086 - DNA, 75 bp, Artificial Sequence
  Synthetic
agcaaggatgaggggacgcatttttaataataatggcaattatggtgtgaacctgactgaactggatggcaatcc

SEQ ID NO: 266087 - DNA, 75 bp, Artificial Sequence
  Synthetic
accaatctggctaatcctgctcctctagactatgttaattttgaagcttgctcccgccgtatcgatttccttgtt

SEQ ID NO: 266088 - DNA, 75 bp, Artificial Sequence
  Synthetic
gtatgacgagttcaagagaatcagagaagagaggaacggaaaatactccattgaggaatacctgcaagaccggga

SEQ ID NO: 266089 - DNA, 75 bp, Artificial Sequence
  Synthetic
aagtcagacttttcacacataaaactccagttggcgccacaagggggctttgacaagaacgggaatactcctcat

SEQ ID NO: 266090 - DNA, 75 bp, Artificial Sequence
  Synthetic
taaaattaaccccaatgagttgtcctctggagacccttctggcaaagtggtcattcattcctacgatgccacttt

SEQ ID NO: 266091 - DNA, 75 bp, Artificial Sequence
  Synthetic
ccgctactatgaagaagtggcagttgcccgtgcaacagaggaggatttctgtgaagaggaagaggccaagataag

SEQ ID NO: 266092 - DNA, 75 bp, Artificial Sequence
  Synthetic
tccagagagtcaacaggaggttttggctttgcaaccagttgctggcgcacaaatagctgcacctgtagctgggca

SEQ ID NO: 266093 - DNA, 75 bp, Artificial Sequence
  Synthetic
tctggagacccttctggcaaagtggtcattcattcctacgatgccacttttgccccccatcttggtactgtcaaa

SEQ ID NO: 266094 - DNA, 75 bp, Artificial Sequence
  Synthetic
tccagttggcgccacaagggggctttgacaagaacgggaatactcctcatgggaagggtgtcatgaaaacactga

SEQ ID NO: 266095 - DNA, 75 bp, Artificial Sequence
  Synthetic
gctttgcaaccagttgctggcgcacaaatagctgcacctgtagctgggcaattcaatgtaattgacccctggata

SEQ ID NO: 266096 - DNA, 75 bp, Artificial Sequence
  Synthetic
agctgcctgtgtacaactttgaccacaacagggtggctgcgttcaggagacttgcagctgacaacaagtatggcc

SEQ ID NO: 266097 - DNA, 75 bp, Artificial Sequence
  Synthetic
gagggtgccacccttaatctatgggctgttccaaattatggttccagtttgacacaggcgtcacagcttgcccca

SEQ ID NO: 266098 - DNA, 75 bp, Artificial Sequence
  Synthetic
aatttggaattaggtccacagttgaatccttatttggcccacttggcacgcatgtacaatgcttatgctggcggt

SEQ ID NO: 266099 - DNA, 75 bp, Artificial Sequence
  Synthetic
tttcaaccaaaaggcaacctgtgggcagatgacaccaggagtgtagactacaatgagagacttgacttcgaggct

SEQ ID NO: 266100 - DNA, 75 bp, Artificial Sequence
  Synthetic
ctgttccaaattatggttccagtttgacacaggcgtcacagcttgccccaccaatttacccccctgggtttggtg

SEQ ID NO: 266101 - DNA, 75 bp, Artificial Sequence
  Synthetic
tggagaactcatgcccttggcagccagaatgggaacccatgcaaccatgaagatacaagggcgcactgttggggg

SEQ ID NO: 266102 - DNA, 75 bp, Artificial Sequence
  Synthetic
caacagggtggctgcgttcaggagacttgcagctgacaacaagtatggcctcatggagaccatgaaagtgggcaa

SEQ ID NO: 266103 - DNA, 75 bp, Artificial Sequence
  Synthetic
agtctacaactcgatggcttacgacctcgactcaaacggatcagggagagtcaacgttaaaaaggttgcagatca

SEQ ID NO: 266104 - DNA, 75 bp, Artificial Sequence
  Synthetic
acaacaacacacgtcctgcccaagggggtcaaggaactctttggagttgaaatcaaacaaatccaaattcacaag

SEQ ID NO: 266105 - DNA, 75 bp, Artificial Sequence
  Synthetic
ttgtttcacattttgtcaatgaacaggcccccacacgcggcgatgccgctcttcttcattatgttgatcctgaca

SEQ ID NO: 266106 - DNA, 75 bp, Artificial Sequence
  Synthetic
cacaggccacacaacttccccatgttgtggttgatgtgagacaattggaacccgtggtcctacctctcccagacg

SEQ ID NO: 266107 - DNA, 75 bp, Artificial Sequence
  Synthetic
atgcagaagcccccgaggtcgaaaaggcgaagcgcgacttcccgggccaacctgacatgtggaaaaacgctttta

SEQ ID NO: 266108 - DNA, 75 bp, Artificial Sequence
  Synthetic
aatcaaacaaatccaaattcacaagtctggagagttttgtaggtttagattcccaagaccaatcaggccagatgt

SEQ ID NO: 266109 - DNA, 75 bp, Artificial Sequence
  Synthetic
ggcccccacacgcggcgatgccgctcttcttcattatgttgatcctgacacacatcgtaatcttggagagtttaa

SEQ ID NO: 266110 - DNA, 75 bp, Artificial Sequence
  Synthetic
ctcctccagatcgctggtgcggccttcgtcacttcaaggatgacacggagactgaacatcggcagtatctgggcc

SEQ ID NO: 266111 - DNA, 75 bp, Artificial Sequence
  Synthetic
atttgtcttcatttcttgggtttctagatattaccagttaaagcctgtgggaactgccggtgcggctaggaggct

SEQ ID NO: 266112 - DNA, 75 bp, Artificial Sequence
  Synthetic
gatgatccccctagcagtgaggatgggcacgcatgcatccatgaaaatacagggtaggaccgtcggtggccagat

SEQ ID NO: 266113 - DNA, 75 bp, Artificial Sequence
  Synthetic
tgcatttacagtctcctgccgcatcctcaccagaccagcacctgattttagcttctttttcttaataccccccac

SEQ ID NO: 266114 - DNA, 75 bp, Artificial Sequence
  Synthetic
agatattaccagttaaagcctgtgggaactgccggtgcggctaggaggcttggtcttaggagatcataatggccc

SEQ ID NO: 266115 - DNA, 75 bp, Artificial Sequence
  Synthetic
tcgtcacttcaaggatgacacggagactgaacatcggcagtatctgggccagaccagaacaacaagtggagactg

SEQ ID NO: 266116 - DNA, 75 bp, Artificial Sequence
  Synthetic
ctcaccagaccagcacctgattttagcttctttttcttaataccccccacaatagaatctaaaacaacacctttc

SEQ ID NO: 266117 - DNA, 75 bp, Artificial Sequence
  Synthetic
gtaagaacaagagtggtagaggcaagaaacacaccgccttctccagcaagggcctcagtgatgaagagtacgatg

SEQ ID NO: 266118 - DNA, 75 bp, Artificial Sequence
  Synthetic
aatcatggttaagttctccccagaaccgaatctggcccaaaaggttgcagaagaccttctctctcccagcgtgat

SEQ ID NO: 266119 - DNA, 75 bp, Artificial Sequence
  Synthetic
gttgtcgcgggtgtccacaccgcagcagcccgggggggcaatactgttatatgtgccactcaagggcaagatggg

SEQ ID NO: 266120 - DNA, 75 bp, Artificial Sequence
  Synthetic
ccgccctacaacatcaaaggtatcaacaggatttaaatatgcagtccctatcctttcaacatgataaagaaatgt

SEQ ID NO: 266121 - DNA, 75 bp, Artificial Sequence
  Synthetic
cctaatcttccattgcaagctaacttccaaaatggtaggatcacactggatggggagctccagggtacaacacta

SEQ ID NO: 266122 - DNA, 75 bp, Artificial Sequence
  Synthetic
cagcccgggggggcaatactgttatatgtgccactcaagggcaagatggggaggcagtccttgaaggaaatgaaa

SEQ ID NO: 266123 - DNA, 75 bp, Artificial Sequence
  Synthetic
acaggatttaaatatgcagtccctatcctttcaacatgataaagaaatgttaggcttacaagtagatgcttctaa

SEQ ID NO: 266124 - DNA, 75 bp, Artificial Sequence
  Synthetic
aacagaagagaacttttgtgaggaggaagagataaaaattaggcagaggatcttccgccccaccaggaaacaacg

SEQ ID NO: 266125 - DNA, 75 bp, Artificial Sequence
  Synthetic
tagggtgatagcaggtgctccaccaactaaagtagtggattggaatggagtcagaatatctgcccccacatcaag

SEQ ID NO: 266126 - DNA, 75 bp, Artificial Sequence
  Synthetic
ggcgctcatcaccagatgccctacctcctggcacatatgaacctgcttacctgggaggtaaggaccccagagtag

SEQ ID NO: 266127 - DNA, 75 bp, Artificial Sequence
  Synthetic
gagtcttcaatccagtgtggatggatttaactgagaacaactggactgaattccagccattcaatgaccaacccg

SEQ ID NO: 266128 - DNA, 75 bp, Artificial Sequence
  Synthetic
tcctggcacatatgaacctgcttacctgggaggtaaggaccccagagtagaaaaagggccctccctgcagcaagt

SEQ ID NO: 266129 - DNA, 75 bp, Artificial Sequence
  Synthetic
actaaagtagtggattggaatggagtcagaatatctgcccccacatcaagtgcaataaccctaaaatctggcagt

SEQ ID NO: 266130 - DNA, 75 bp, Artificial Sequence
  Synthetic
gaagagataaaaattaggcagaggatcttccgccccaccaggaaacaacgtaaggaggagagagcaactctgggc

SEQ ID NO: 266131 - DNA, 75 bp, Artificial Sequence
  Synthetic
gaccgcagtgtgaactacaatgagaagatagactttgaagcgccccccagcctttggtcccgaatagtgaacttc

SEQ ID NO: 266132 - DNA, 75 bp, Artificial Sequence
  Synthetic
agtggctcatcaatggttagtcgcaccagccaatgggtggaatctcaaaattcattgcgctcgcttgatcctttc

SEQ ID NO: 266133 - DNA, 75 bp, Artificial Sequence
  Synthetic
aaagacagtgatgaatgttctagaacaaaccattgaccctgctaagccatggacctactcgcaagcatgtgcttc

SEQ ID NO: 266134 - DNA, 75 bp, Artificial Sequence
  Synthetic
acaacatggcacttttgcaccatacaccgggcacgccgctgtccactctgaccaacaggcaggccatttagccca

SEQ ID NO: 266135 - DNA, 75 bp, Artificial Sequence
  Synthetic
caaaccattgaccctgctaagccatggacctactcgcaagcatgtgcttcactggacaagaccacttctagtggt

SEQ ID NO: 266136 - DNA, 75 bp, Artificial Sequence
  Synthetic
ccagccaatgggtggaatctcaaaattcattgcgctcgcttgatcctttccataggagcgcgttgcaaacaacgt

SEQ ID NO: 266137 - DNA, 75 bp, Artificial Sequence
  Synthetic
agatagactttgaagcgccccccagcctttggtcccgaatagtgaacttcggatcaggctggggcttctgggtgt

SEQ ID NO: 266138 - DNA, 75 bp, Artificial Sequence
  Synthetic
aaatacaagtacacaggagtggtgagttctgcaaaatgaggttccctaaagctataagacccgatgtctcaggta

SEQ ID NO: 266139 - DNA, 75 bp, Artificial Sequence
  Synthetic
aaagacttccgttattcgcaaatctgcggaagtaagtttttgtaatataaagtgggcattatattcagattggct

SEQ ID NO: 266140 - DNA, 75 bp, Artificial Sequence
  Synthetic
gggctggctccagcggccgcgcccgatttccccggtgagatgatcctttactttgtctctgacatgccagtccgt

SEQ ID NO: 266141 - DNA, 75 bp, Artificial Sequence
  Synthetic
caaaacatgtgcagcccgtgtacacggccgcgctcaaagatgagcttgttaagactgataagatctacaaaaaga

SEQ ID NO: 266142 - DNA, 75 bp, Artificial Sequence
  Synthetic
gttctgcaaaatgaggttccctaaagctataagacccgatgtctcaggtatgatccttgaggaaggagcccccga

SEQ ID NO: 266143 - DNA, 75 bp, Artificial Sequence
  Synthetic
atttccccggtgagatgatcctttactttgtctctgacatgccagtccgtaacccaaatggggaaaggagggaca

SEQ ID NO: 266144 - DNA, 75 bp, Artificial Sequence
  Synthetic
gcggaagtaagtttttgtaatataaagtgggcattatattcagattggcttttgattataattaatttaatttgg

SEQ ID NO: 266145 - DNA, 75 bp, Artificial Sequence
  Synthetic
tgccaccatgaaaatacaagggaagatgcttgggggtcaaatgggcatgttactcacagggtccaatgccaaaaa

SEQ ID NO: 266146 - DNA, 75 bp, Artificial Sequence
  Synthetic
tcgcgcttgtgcgttacatcaatgccgagactggtagagtcatgttcgagggaaagctgcatagaaatggattct

SEQ ID NO: 266147 - DNA, 75 bp, Artificial Sequence
  Synthetic
acagtatgaaagcaagttgcatagcccttccatgcagggtggggatgaatatgaatgaggatggccccatcatat

SEQ ID NO: 266148 - DNA, 75 bp, Artificial Sequence
  Synthetic
atgcttgggggtcaaatgggcatgttactcacagggtccaatgccaaaaacatggatcttggcactatccccggg

SEQ ID NO: 266149 - DNA, 75 bp, Artificial Sequence
  Synthetic
cgagactggtagagtcatgttcgagggaaagctgcatagaaatggattcttcacagtttctgccactgcaagaac

SEQ ID NO: 266150 - DNA, 75 bp, Artificial Sequence
  Synthetic
ccactatgatgctgactactctagatgggattcaacccagcaaaggagcattctttctgccgctatggaggtgat

SEQ ID NO: 266151 - DNA, 75 bp, Artificial Sequence
  Synthetic
ggcggcaacacagtgatctgcgccacccagggaccagatggtgaggccacgcttgaagggggggacaaccatggg

SEQ ID NO: 266152 - DNA, 75 bp, Artificial Sequence
  Synthetic
aggcaatggccgcagaagggctcgcatgcttgagtaatggctggagcgttctttgcaggtttgggtgctgacctt

SEQ ID NO: 266153 - DNA, 75 bp, Artificial Sequence
  Synthetic
cccagggaccagatggtgaggccacgcttgaagggggggacaaccatgggacttactgtggtgcaccaatacttg

SEQ ID NO: 266154 - DNA, 75 bp, Artificial Sequence
  Synthetic
atgcttgagtaatggctggagcgttctttgcaggtttgggtgctgaccttttaacaacaggtgtcagctctttag

SEQ ID NO: 266155 - DNA, 75 bp, Artificial Sequence
  Synthetic
tggcgattttgtcatctcagttcaggagggtctgccatcaggagtcccatgtacatcacaatggaattcaatagc

SEQ ID NO: 266156 - DNA, 75 bp, Artificial Sequence
  Synthetic
cttatgagcctgcctacttaggtgggaaggacccaagagtcaagggggggccatctctgcagcaagtcatgaggg

SEQ ID NO: 266157 - DNA, 75 bp, Artificial Sequence
  Synthetic
acactggattctaactctgagcgcaatggcagaagtatcaggtctctcaccagatgttgttcaagcccactcctg

SEQ ID NO: 266158 - DNA, 75 bp, Artificial Sequence
  Synthetic
aacatgataaagaaatgctgcaagcccagatagctgccactgccaacttgcaaaaacagatgatagatatcaaaa

SEQ ID NO: 266159 - DNA, 75 bp, Artificial Sequence
  Synthetic
aattctggagatcatccacagcaccactcccacctggcacctatgaaccagcctaccttggtggcaaagacccca

SEQ ID NO: 266160 - DNA, 75 bp, Artificial Sequence
  Synthetic
gaaggacccaagagtcaagggggggccatctctgcagcaagtcatgagggatcaactcaagcccttcaccgctcc

SEQ ID NO: 266161 - DNA, 75 bp, Artificial Sequence
  Synthetic
ccagatagctgccactgccaacttgcaaaaacagatgatagatatcaaaagggagatcctcacacaaggtggctt

SEQ ID NO: 266162 - DNA, 75 bp, Artificial Sequence
  Synthetic
ccatttacagagcctaggggtaagccaccaaagccaagtgtgttagaagctgccaagaaaaccatcatcaatgtc

SEQ ID NO: 266163 - DNA, 75 bp, Artificial Sequence
  Synthetic
tgatccaccccaaaaatggtcttatgcacaagcctgtgcctcattggataagacaacatcgagtggtcatcctca

SEQ ID NO: 266164 - DNA, 75 bp, Artificial Sequence
  Synthetic
ctatgcaccaggggctatgagaacaacaccctactctggaaactttctgaggcagagtgtcccccacaccacacc

SEQ ID NO: 266165 - DNA, 75 bp, Artificial Sequence
  Synthetic
gcacaagcctgtgcctcattggataagacaacatcgagtggtcatcctcaccacatgaaaaagaatgacaactgg

SEQ ID NO: 266166 - DNA, 75 bp, Artificial Sequence
  Synthetic
gcacgggatccagctgggtggtttggaaaattggatcaagactcaattctcaggcaattatactggacaaggggg

SEQ ID NO: 266167 - DNA, 75 bp, Artificial Sequence
  Synthetic
acaccctactctggaaactttctgaggcagagtgtcccccacaccacaccaaaggctaactacagacaggcaggc

SEQ ID NO: 266168 - DNA, 75 bp, Artificial Sequence
  Synthetic
atgcagcctgtgtacactgctgccctcaaggacgagctcgttaagaccagcaaggtttatgagagtatcaagaaa

SEQ ID NO: 266169 - DNA, 75 bp, Artificial Sequence
  Synthetic
gctgtctctgcatcaacagcatcgagcagaacctcagattgggtgtcacaacactcaaacttggcccctttccat

SEQ ID NO: 266170 - DNA, 75 bp, Artificial Sequence
  Synthetic
tcaaggacgagctcgttaagaccagcaaggtttatgagagtatcaagaaaaggctactatggggctcagatttgg

SEQ ID NO: 266171 - DNA, 75 bp, Artificial Sequence
  Synthetic
gaggcctcattgcatggcccccagttttacaagaaagttagcaagatggtcatcaatgagattaagagtggtggt

SEQ ID NO: 266172 - DNA, 75 bp, Artificial Sequence
  Synthetic
gcagaacctcagattgggtgtcacaacactcaaacttggcccctttccatgaaaacgctctcaggacagcatatg

SEQ ID NO: 266173 - DNA, 75 bp, Artificial Sequence
  Synthetic
ctggaattttatgtgcccagacaagaggccatgtttaggtggatgagattctctgacctcagcacatgggagggc

SEQ ID NO: 266174 - DNA, 75 bp, Artificial Sequence
  Synthetic
tcagagttggcatgaacatgaatgaggatggacccattatttttgaaaagcattcaaagtataagtaccattatg

SEQ ID NO: 266175 - DNA, 75 bp, Artificial Sequence
  Synthetic
cattcaacacccataggcagccagcttttgcccatctgagaaagagagggatttctgaagcttgaaaataatcac

SEQ ID NO: 266176 - DNA, 75 bp, Artificial Sequence
  Synthetic
ggatggacccattatttttgaaaagcattcaaagtataagtaccattatgatgctgactactctaggtgggactc

SEQ ID NO: 266177 - DNA, 75 bp, Artificial Sequence
  Synthetic
atttctgaagcttgaaaataatcactaatgattaaaattctaattttgtaatcagtgaaatgtaaattcatgatt

SEQ ID NO: 266178 - DNA, 75 bp, Artificial Sequence
  Synthetic
tcagcgcaagagtgctgccccctctagtgctggttccaactatagtgggtcttctaggtctacagcttctaccac

SEQ ID NO: 266179 - DNA, 75 bp, Artificial Sequence
  Synthetic
caacctcgtaccagaggccaacaatgaggttatggcacttgaaccggtggtaggagcctcaatcgcagctcctgt

SEQ ID NO: 266180 - DNA, 75 bp, Artificial Sequence
  Synthetic
gattgtgtctgaagacctcctagcccccagtgtggtggacgttggtgactttaaaatcgccataaacgagggttt

SEQ ID NO: 266181 - DNA, 75 bp, Artificial Sequence
  Synthetic
cccagtgtggtggacgttggtgactttaaaatcgccataaacgagggtttgccctctggggtgccgtgtacatca

SEQ ID NO: 266182 - DNA, 75 bp, Artificial Sequence
  Synthetic
ccctggattagagaaaattttgtccaagcaccacagggcgagtttactgtttcgccaaggaattcgcctggtgag

SEQ ID NO: 266183 - DNA, 75 bp, Artificial Sequence
  Synthetic
gtacaatcaaactcctgcttctctttctacggggatgatgaaatagtcagcactgacatcaagttagatcccatg

SEQ ID NO: 266184 - DNA, 75 bp, Artificial Sequence
  Synthetic
gctggtggcatgcaggttcaggtggtcctagctgggaatgcgttcacagctgggaaaatcatctttgccgccgta

SEQ ID NO: 266185 - DNA, 75 bp, Artificial Sequence
  Synthetic
tcctagctgggaatgcgttcacagctgggaaaatcatctttgccgccgtaccaccacattttcctgtggataata

SEQ ID NO: 266186 - DNA, 75 bp, Artificial Sequence
  Synthetic
tctacggggatgatgaaatagtcagcactgacatcaagttagatcccatgaaactaactaacaagctgaaagagt

SEQ ID NO: 266187 - DNA, 75 bp, Artificial Sequence
  Synthetic
tcctgagaagggacgtgtgccgggacccagctggttggtatggaaaacttgaccaatcctcgatcatgagacaac

SEQ ID NO: 266188 - DNA, 75 bp, Artificial Sequence
  Synthetic
tccccgatataaggaataggttcttccattacaatcaggagaacaccccccggatgagactcgtggccatgctct

SEQ ID NO: 266189 - DNA, 75 bp, Artificial Sequence
  Synthetic
ccattacaatcaggagaacaccccccggatgagactcgtggccatgctctacacgcccctgagggccaattctgg

SEQ ID NO: 266190 - DNA, 75 bp, Artificial Sequence
  Synthetic
tccatagaagagtaccttcaggacagggacaaatactatgaggaggtggccattgccagggcgaccgaggaggac

SEQ ID NO: 266191 - DNA, 75 bp, Artificial Sequence
  Synthetic
tgatgtctctactaggggaggcagcactgcacggaccagccttctacaagaaagtcagcaaattggttatcactg

SEQ ID NO: 266192 - DNA, 75 bp, Artificial Sequence
  Synthetic
accaactgttgaatcaaaaacaaaaccttttaccctacctattctaactcttggtgagttgtctaactcccgttt

SEQ ID NO: 266193 - DNA, 75 bp, Artificial Sequence
  Synthetic
ccttttaccctacctattctaactcttggtgagttgtctaactcccgttttccggctgctatagatatgctttat

SEQ ID NO: 266194 - DNA, 75 bp, Artificial Sequence
  Synthetic
tgctgtatacaccacttagggccaataatgctggggatgatgtcttcacagtctcttgtcgagtcctcacgaggc

SEQ ID NO: 266195 - DNA, 75 bp, Artificial Sequence
  Synthetic
actcccacctggcacctacgaaccagcctacctcggtggcaaagaccctagagtcaaaggtggcccttcattgca

SEQ ID NO: 266196 - DNA, 75 bp, Artificial Sequence
  Synthetic
tcagcacttgggagggcgatcgcaatcttgctcccgaaggtgtgaatgaagatggcgtcgaatgacgctgctcca

SEQ ID NO: 266197 - DNA, 75 bp, Artificial Sequence
  Synthetic
acacaattggttccaacacagatttgtgcttttagaggcaccctgatcagccagaccgcgagagcggccgactca

SEQ ID NO: 266198 - DNA, 75 bp, Artificial Sequence
  Synthetic
gtgcttttagaggcaccctgatcagccagaccgcgagagcggccgactcaacagattctccccagagagcccgtg

SEQ ID NO: 266199 - DNA, 75 bp, Artificial Sequence
  Synthetic
ttcaagattccccattcctttggaaaaattgttcacgggtcccagcagtgcctttgttgttcaaccacaaaatgg

SEQ ID NO: 266200 - DNA, 75 bp, Artificial Sequence
  Synthetic
gctatcgcagcccctctcactggacaaacaaatataattgatccctggattagaaataattttgtgcaagcccca

SEQ ID NO: 266201 - DNA, 75 bp, Artificial Sequence
  Synthetic
aaacaaatataattgatccctggattagaaataattttgtgcaagccccaaatggtgaattcaccatatctccta

SEQ ID NO: 266202 - DNA, 75 bp, Artificial Sequence
  Synthetic
tgggggctattgacttcaaaggcacagtatttggagtggctagtcagagggatgtctctggaccacaagaacagg

SEQ ID NO: 266203 - DNA, 75 bp, Artificial Sequence
  Synthetic
agtatttggagtggctagtcagagggatgtctctggaccacaagaacagggccactatgccacccgagcccatga

SEQ ID NO: 266204 - DNA, 75 bp, Artificial Sequence
  Synthetic
gaatgtacaatggttttgcaggtggtatggaggtacaggtattgatggcggggaatgctttcaccgctggaaagg

SEQ ID NO: 266205 - DNA, 75 bp, Artificial Sequence
  Synthetic
tatggaggtacaggtattgatggcggggaatgctttcaccgctggaaaggtcatctttgctgcagttccacccca

SEQ ID NO: 266206 - DNA, 75 bp, Artificial Sequence
  Synthetic
aaagctacagtttacactgggagtgccgactttactccaaagctgggcagtgttcaatttggtactgatacagaa

SEQ ID NO: 266207 - DNA, 75 bp, Artificial Sequence
  Synthetic
tttcaccacaaatcaacccattaggttcactccagtgggcatgggtgataacaattggagacagtgggaattacc

SEQ ID NO: 266208 - DNA, 75 bp, Artificial Sequence
  Synthetic
ttcactccagtgggcatgggtgataacaattggagacagtgggaattacctgattattctggcagattagcctta

SEQ ID NO: 266209 - DNA, 75 bp, Artificial Sequence
  Synthetic
accagtcttgttgcccatgcccgatgtgagaaatcaattcttccattacaatcaggtgaacgaacccaggatgcg

SEQ ID NO: 266210 - DNA, 75 bp, Artificial Sequence
  Synthetic
gtgagaaatcaattcttccattacaatcaggtgaacgaacccaggatgcggttagtggccatgctctacacaccc

SEQ ID NO: 266211 - DNA, 75 bp, Artificial Sequence
  Synthetic
tcagctggaggctacgggtctggctatatagactatctcataccccaggaatgggtgcaacacttctaccaggaa

SEQ ID NO: 266212 - DNA, 75 bp, Artificial Sequence
  Synthetic
atatagactatctcataccccaggaatgggtgcaacacttctaccaggaagcagcaccttcacaatccgctgtcg

SEQ ID NO: 266213 - DNA, 75 bp, Artificial Sequence
  Synthetic
gagttcaattacctggtgcccccaactgtggagtcaagaacaaaacccttcaccttacctgtcctcacaattgga

SEQ ID NO: 266214 - DNA, 75 bp, Artificial Sequence
  Synthetic
ctgtggagtcaagaacaaaacccttcaccttacctgtcctcacaattggagagatgacaaattcacgcttccccg

SEQ ID NO: 266215 - DNA, 75 bp, Artificial Sequence
  Synthetic
ccgtggccaattctggaaacaatcctattgtagttccccctaatggttattttagatttgaggcttgggttaatc

SEQ ID NO: 266216 - DNA, 75 bp, Artificial Sequence
  Synthetic
tattgtagttccccctaatggttattttagatttgaggcttgggttaatcagttttacacacttgcccccatggg

SEQ ID NO: 266217 - DNA, 75 bp, Artificial Sequence
  Synthetic
atggtgagcttcagggaagcacacaactagtcccagcaaatgtgtgtgcatttagaggtaaaatcacagcaagga

SEQ ID NO: 266218 - DNA, 75 bp, Artificial Sequence
  Synthetic
actagtcccagcaaatgtgtgtgcatttagaggtaaaatcacagcaaggatcgttgatcaggcagcacaccagtg

SEQ ID NO: 266219 - DNA, 75 bp, Artificial Sequence
  Synthetic
aacggcatcggttccatcatcaatgcaggtgccaatgcagtcaatcaaaaggttgagtatgatttcaataagcaa

SEQ ID NO: 266220 - DNA, 75 bp, Artificial Sequence
  Synthetic
ggttgagtatgatttcaataagcaacttcagatggcatcattcaaacatgacaaggagatgttacaatcacaggt

SEQ ID NO: 266221 - DNA, 75 bp, Artificial Sequence
  Synthetic
tgacttcaaagccaagatattcggggtcatatctcaaaggaatgattacaatgatggtagtcagggacctgcaaa

SEQ ID NO: 266222 - DNA, 75 bp, Artificial Sequence
  Synthetic
gtcatatctcaaaggaatgattacaatgatggtagtcagggacctgcaaacagagcacatgatgccgtggtaccc

SEQ ID NO: 266223 - DNA, 75 bp, Artificial Sequence
  Synthetic
tgcggatgctgctagaggggctgtcaatgctccaatgacaaaaatactggactggaatggcacaaggtattgggc

SEQ ID NO: 266224 - DNA, 75 bp, Artificial Sequence
  Synthetic
aatgctccaatgacaaaaatactggactggaatggcacaaggtattgggcacctaacagtatgaaaaccacaagc

SEQ ID NO: 266225 - DNA, 75 bp, Artificial Sequence
  Synthetic
cagccttccaaattcactccagttggcctgctcgagatgaatgacttcaatcagtggtcacttccaaattattca

SEQ ID NO: 266226 - DNA, 75 bp, Artificial Sequence
  Synthetic
gcctgctcgagatgaatgacttcaatcagtggtcacttccaaattattcaggggccctaaccctcaatatgggcc

SEQ ID NO: 266227 - DNA, 75 bp, Artificial Sequence
  Synthetic
aagttgcaaagtggttctgctagtgtgtatagctccccctctactgtttcttcacaatcaacccattcaacaatg

SEQ ID NO: 266228 - DNA, 75 bp, Artificial Sequence
  Synthetic
tgtatagctccccctctactgtttcttcacaatcaacccattcaacaatgttgtctgcaggaactgggtcgtcca

SEQ ID NO: 266229 - DNA, 75 bp, Artificial Sequence
  Synthetic
gccacggcaatccagccatcgactgccttctcccgcaagagtggatacagcacttctaccaggagtctgccccct

SEQ ID NO: 266230 - DNA, 75 bp, Artificial Sequence
  Synthetic
ccttctcccgcaagagtggatacagcacttctaccaggagtctgccccctcccaaaccagtgttgctctgattag

SEQ ID NO: 266231 - DNA, 75 bp, Artificial Sequence
  Synthetic
ttagcccgttcatggatgatgctctccaaactacctttgtcacaccaccatcgagcaaggcttcatcaaatggga

SEQ ID NO: 266232 - DNA, 75 bp, Artificial Sequence
  Synthetic
gtcaggagatggaccaattgttgtgcccccaaatggatattttaggtttgactcttgggtgaatcaattttactc

SEQ ID NO: 266233 - DNA, 75 bp, Artificial Sequence
  Synthetic
cccccaaatggatattttaggtttgactcttgggtgaatcaattttactcacttgcccccatgggaaacggaaac

SEQ ID NO: 266234 - DNA, 75 bp, Artificial Sequence
  Synthetic
aacacacataggcagcctctcttcgcccatttgcgtaggcgaggggagtcacaaatttagtgaaaagagtgatta

SEQ ID NO: 266235 - DNA, 75 bp, Artificial Sequence
  Synthetic
ggtcattagttaatgcaggggctaatgctatcaatcaaaaagttgattttgaaaataataaatatcttcaatcag

SEQ ID NO: 266236 - DNA, 75 bp, Artificial Sequence
  Synthetic
tgctatcaatcaaaaagttgattttgaaaataataaatatcttcaatcagcatcatttgctcatgataaggagat

SEQ ID NO: 266237 - DNA, 75 bp, Artificial Sequence
  Synthetic
tggcgggttcgcacctgcggacgcggcaaggggatcagtcaatgcacccatgacaaaggtccttgattggggtgg

SEQ ID NO: 266238 - DNA, 75 bp, Artificial Sequence
  Synthetic
gcaaggggatcagtcaatgcacccatgacaaaggtccttgattggggtggcactagatattgggcaccaaattcg

SEQ ID NO: 266239 - DNA, 75 bp, Artificial Sequence
  Synthetic
ttcagtgtccccccgctcaatcagagggagaatagggatgctaaggagccactgactggaacaattctggaaatg

SEQ ID NO: 266240 - DNA, 75 bp, Artificial Sequence
  Synthetic
agtcaactttggctcaggttggggcttctgggtctcccccagcctattcataacatcaacccacgttatacccca

SEQ ID NO: 266241 - DNA, 75 bp, Artificial Sequence
  Synthetic
agcaagcccgtgccgagtgttgcatcatcctcccacaagtccaattccacagcatcaacccagctcggctctgtg

SEQ ID NO: 266242 - DNA, 75 bp, Artificial Sequence
  Synthetic
catcctcccacaagtccaattccacagcatcaacccagctcggctctgtgtcgtctggttcgtccagatccagcg

SEQ ID NO: 266243 - DNA, 75 bp, Artificial Sequence
  Synthetic
aaccgcacatgcccggatcgctgaggacggcctttgtcacaccgccatctagcacggcctctagctcgggcatag

SEQ ID NO: 266244 - DNA, 75 bp, Artificial Sequence
  Synthetic
ggaggtctttctagtgctgatgcttcacgggctgttgctggagccccagtaacacgattgattgattggaacggc

SEQ ID NO: 266245 - DNA, 75 bp, Artificial Sequence
  Synthetic
acacataggcagccgcttttcgcatacctccataagaggggggagtcaaaagtttagtgaaaagaaagatttttc

SEQ ID NO: 266246 - DNA, 75 bp, Artificial Sequence
  Synthetic
caagttaaagaaggtagctaatatattcctgtgtgctctgtcttcgctgttcaccaggcccataaaagacataat

SEQ ID NO: 266247 - DNA, 75 bp, Artificial Sequence
  Synthetic
tcacaggagaccagcgtgtaggcctcatcccacgcaatggcgtcgatcactgggatgcgtacaagggggagaggg

SEQ ID NO: 266248 - DNA, 75 bp, Artificial Sequence
  Synthetic
ttggaacaattatgacccaacagaagaaattccagcccctctgggaactccagatttcgtgggaaagatccaagg

SEQ ID NO: 266249 - DNA, 75 bp, Artificial Sequence
  Synthetic
ggaagggcgtcatgaagactctcaccactggctcccttattgcccgggcatcagggctactccatgagaggctag

SEQ ID NO: 266250 - DNA, 75 bp, Artificial Sequence
  Synthetic
tgtctgcgatgattgcccccttacttggtgactacgagctacaaggacctgaggaccttgcagtggagctcgtcc

SEQ ID NO: 266251 - DNA, 75 bp, Artificial Sequence
  Synthetic
gtctgatggcaagggcaatgtgaaagttgacagagttcaaagcgcctccgtgcagaccaacaatgagctgactgg

SEQ ID NO: 266252 - DNA, 75 bp, Artificial Sequence
  Synthetic
gctaccgctgcctttggcagtcaaaactctgtcaatgacagtaataacgccaccccttctaacaaagaagaggtc

SEQ ID NO: 266253 - DNA, 75 bp, Artificial Sequence
  Synthetic
gaaagttgacagagttcagagcacctccgtgcagaccagcaatgagctgactggcgccctgcaccacctaaggtg

SEQ ID NO: 266254 - DNA, 75 bp, Artificial Sequence
  Synthetic
agatcgggcctaaaacattaacaatcccccctgagcccccaaatggtgaagacaccgtacagtttgatgcaaagt

SEQ ID NO: 266255 - DNA, 75 bp, Artificial Sequence
  Synthetic
aaacccaaagatgatgaggagttcgtcatttcatccgacgacattaaaactgagggtaagaaagggaagaacaag

SEQ ID NO: 266256 - DNA, 75 bp, Artificial Sequence
  Synthetic
actggtcgcggcaagaagcacacagccttctcaagcaaaggtctcagtgatgaagagtatgatgagtacaagagg

SEQ ID NO: 266257 - DNA, 75 bp, Artificial Sequence
  Synthetic
aaaccaccggcggctataagcctcgcgacgatagagctcacccccatatcactttactggaggcccgtttatacc

SEQ ID NO: 266258 - DNA, 75 bp, Artificial Sequence
  Synthetic
aactgttataacttctgttgctgggtgctagagctcaacgacacgtggcttaacagaagatgcatttccagaact

SEQ ID NO: 266259 - DNA, 75 bp, Artificial Sequence
  Synthetic
tgctagagctcaacgacacgtggcttaacagaagatgcatttccagaactaccggcttcttcaaaccataccagt

SEQ ID NO: 266260 - DNA, 75 bp, Artificial Sequence
  Synthetic
tcggctcgctgttctcaaaaccaatcaaagacctattaggcaaactcaagccattgaatctactgcacttgctcg

SEQ ID NO: 266261 - DNA, 75 bp, Artificial Sequence
  Synthetic
gcagagcttttcaatgtcttctggaccccgccagatgtctctaattttgtagcctccctaataggtgattttgaa

SEQ ID NO: 266262 - DNA, 75 bp, Artificial Sequence
  Synthetic
gactatgtggtcattggagtccacacggctgccgctcgtgggggaaacactgtcatatgtgccacccaggggagt

SEQ ID NO: 266263 - DNA, 75 bp, Artificial Sequence
  Synthetic
gtgacagtaagggaacatactgtggtgcaccaatcctaggcccagggagtgccccaaaacttagcaccaagacca

SEQ ID NO: 266264 - DNA, 75 bp, Artificial Sequence
  Synthetic
gacagcctcacggctttcatgaagaccctggatctggaggaggagaaggctaggaaactgtccactaaatcatct

SEQ ID NO: 266265 - DNA, 75 bp, Artificial Sequence
  Synthetic
tgcaccaatcctaggcccagggagtgccccaaaacttagcaccaagaccaaattctggagatcgtccacagcacc

SEQ ID NO: 266266 - DNA, 75 bp, Artificial Sequence
  Synthetic
aattctggagatcgtccacagcaccactcccacctggcacctatgaaccagcctatcttggtggcaaggacccca

SEQ ID NO: 266267 - DNA, 75 bp, Artificial Sequence
  Synthetic
taggaaactgtccactaaatcatcttcaccggacatagtcggcaccatcaatgccatactggctaggatagctgc

SEQ ID NO: 266268 - DNA, 75 bp, Artificial Sequence
  Synthetic
actcccacctggcacctatgaaccagcctatcttggtggcaaggaccccagggtcaagggtggcccttcattgca

SEQ ID NO: 266269 - DNA, 75 bp, Artificial Sequence
  Synthetic
cgactgctggaacggggagtccttcacaggcaagctagcagaccaggcttccaaggccaacctgatgtttgaaga

SEQ ID NO: 266270 - DNA, 75 bp, Artificial Sequence
  Synthetic
tgactacggtatggggagccctgttaaagacgccctaacactacaagagctggccgatacatgtccagtcacttt

SEQ ID NO: 266271 - DNA, 75 bp, Artificial Sequence
  Synthetic
ttcgaggcgtgttctaggagagttgacttcctggtctatgcagagtcaccagaaattgaaaaggtcaagagagac

SEQ ID NO: 266272 - DNA, 75 bp, Artificial Sequence
  Synthetic
cgatgtgctcgagcattcggaggcctaatggatgaactcaaagcacactgtgttacacttcctatcagagttggt

SEQ ID NO: 266273 - DNA, 75 bp, Artificial Sequence
  Synthetic
cagggtgggtttgacaaaaatggcaacaccccacacggcaagggtaccatgcggtccctaacccaggggtccctg

SEQ ID NO: 266274 - DNA, 75 bp, Artificial Sequence
  Synthetic
acaccccacacggcaagggtaccatgcggtccctaacccaggggtccctgactgcgagagttgcaggccttgtcc

SEQ ID NO: 266275 - DNA, 75 bp, Artificial Sequence
  Synthetic
tctcggtgggattcaacacaacagagagctgtgttggcagcagctctagaaatcatggttaaattctcctcagaa

SEQ ID NO: 266276 - DNA, 75 bp, Artificial Sequence
  Synthetic
aatcatggttaaattctcctcagaaccacatttggctcaggtagtcgcagaagaccttctttctcctagcgtggt

SEQ ID NO: 266277 - DNA, 75 bp, Artificial Sequence
  Synthetic
cattcaggaaattggctgcagataacaagtatgggatcatggagacgatgagagtgggtgcggcactcaagaatg

SEQ ID NO: 266278 - DNA, 75 bp, Artificial Sequence
  Synthetic
tgcattgagggatgtaaaattcaatgagtgtgaaataatttacaagaactctaagtaccgagtctcttccaacgg

SEQ ID NO: 266279 - DNA, 75 bp, Artificial Sequence
  Synthetic
tcgtctacactctcatacaggttgccggagcatcattcgttgtcaacaggatctccagaaggttctgctgggaaa

SEQ ID NO: 266280 - DNA, 75 bp, Artificial Sequence
  Synthetic
ccaccatcaaattgatagcaatgctgtatacaccactcagggctaacaatgctggggacgatgtcttcacagtct

SEQ ID NO: 266281 - DNA, 75 bp, Artificial Sequence
  Synthetic
ggtgaaatactatggagcgcgcccttgggccctgatctgaatccctacctttctcatttggccagaatgtacaat

SEQ ID NO: 266282 - DNA, 75 bp, Artificial Sequence
  Synthetic
catcagaaagaggagaccagatgacttccaaccaaaaggcaacctatgggcagatgacaccaggagtgtggacta

SEQ ID NO: 266283 - DNA, 75 bp, Artificial Sequence
  Synthetic
gcagtcccaccaaatttcccaactgaaggcttgagccccagccaggtcactatgttcccccatataatagtagat

SEQ ID NO: 266284 - DNA, 75 bp, Artificial Sequence
  Synthetic
acaacaacacacgtcctgcctaaaggggttaaggagctctttggagttgaaatcaaacaaatccaagttcataag

SEQ ID NO: 266285 - DNA, 75 bp, Artificial Sequence
  Synthetic
ttggaacaattatgacccaacagaagaaatcccagcccctctgggaaccccagattttgtaggaaagatccaagg

SEQ ID NO: 266286 - DNA, 75 bp, Artificial Sequence
  Synthetic
agaactaaaccattcaccgtcccaattttaactgttgaggaaatgaccaattcaagattccccattcctttggaa

SEQ ID NO: 266287 - DNA, 75 bp, Artificial Sequence
  Synthetic
gatggctcgacccgcggtcacaaagccacagtgagcactggaagtgtccacttcaccccaaagctgggcagtgtc

SEQ ID NO: 266288 - DNA, 75 bp, Artificial Sequence
  Synthetic
gtcctggtgactgcggttgcccctacatctacaaacgcggcaacgacattgttgtcgcgggtgttcataccgcag

SEQ ID NO: 266289 - DNA, 75 bp, Artificial Sequence
  Synthetic
gtgaatgaggatggcgtcgagtgacgtcgctactgcctttggcagccagaaagctaccaatgacagctataacac

SEQ ID NO: 266290 - DNA, 75 bp, Artificial Sequence
  Synthetic
aagctaccaatgacagctataacacaccccctcccaacaaggaggaggctagtgtgctcaccaacgttaaagttg

SEQ ID NO: 266291 - DNA, 75 bp, Artificial Sequence
  Synthetic
gttgtcgcgggtgttcataccgcagcagcccggggaggcaacactgttatatgtgccacccaagggcaagatggg

SEQ ID NO: 266292 - DNA, 75 bp, Artificial Sequence
  Synthetic
aattacacaatgaatttggcttctcaaaattggaacaattatgacccaacagaagaaatcccagcccctctgggg

SEQ ID NO: 266293 - DNA, 75 bp, Artificial Sequence
  Synthetic
accccctcccaacaaggaggaggctagtgtgctcaccaacgttaaagttggttttaagaagatcctcggggccgt

SEQ ID NO: 266294 - DNA, 75 bp, Artificial Sequence
  Synthetic
tttctttaggtccactatgcccgggtgcagcgggtatcccaacatgaatttggattgcctactcccccaggagtg

SEQ ID NO: 266295 - DNA, 75 bp, Artificial Sequence
  Synthetic
gccctctccccccccaaacggcgaggacgcggttcactttgtgaaggaaacggagaccatcaagggattgccaga

SEQ ID NO: 266296 - DNA, 75 bp, Artificial Sequence
  Synthetic
aaagctacagtgagcactggggatgtccacttcactccaaagctgggcagtattcagttcaacactgatacaaac

SEQ ID NO: 266297 - DNA, 75 bp, Artificial Sequence
  Synthetic
gacgcggttcactttgtgaaggaaacggagaccatcaagggattgccagatttgtccaccgtggaaaacgaatct

SEQ ID NO: 266298 - DNA, 75 bp, Artificial Sequence
  Synthetic
acagaacccaggggcaaaccacctagacctgcagtcttggaggaagccaaaaagacagtgatgaatgttctagaa

SEQ ID NO: 266299 - DNA, 75 bp, Artificial Sequence
  Synthetic
gacctgcagtcttggaggaagccaaaaagacagtgatgaatgttctagaacaaaccattgaccccgccaagccat

SEQ ID NO: 266300 - DNA, 75 bp, Artificial Sequence
  Synthetic
atacttgaaatgtgggatggtgagttctaccactactccatatatgtggacaatggcaaggcccttggtgtgcac

SEQ ID NO: 266301 - DNA, 75 bp, Artificial Sequence
  Synthetic
tctaccactactccatatatgtggacaatggcaaggcccttggtgtgcacaaaccaccagcagcaatcagccttg

SEQ ID NO: 266302 - DNA, 75 bp, Artificial Sequence
  Synthetic
taatgtacacctagcccccgccgtagcccccacttttccgggtgagcaacttcttttcttcaggtccactatgcc

SEQ ID NO: 266303 - DNA, 75 bp, Artificial Sequence
  Synthetic
aatgggtgcagcacttctaccaagaggcagctccagcacaatctgatgtggctctgctaagatttgtgaatccag

SEQ ID NO: 266304 - DNA, 75 bp, Artificial Sequence
  Synthetic
cactcaaagggctggctggtgaaaagtttccctatacagctttcaacaacaactgctacaacttctgttgctggg

SEQ ID NO: 266305 - DNA, 75 bp, Artificial Sequence
  Synthetic
gtttccctatacagctttcaacaacaactgctacaacttctgttgctgggttctggacctcaatgattcatggtt

SEQ ID NO: 266306 - DNA, 75 bp, Artificial Sequence
  Synthetic
taaagaagaggctcctatgggggtcggaccttggcacaatgatcaggtgcgccagggcttttggtggtctcatgg

SEQ ID NO: 266307 - DNA, 75 bp, Artificial Sequence
  Synthetic
atttggttatcccccccaatggctactttagatttgattcctgggtcaaccaattctacacacttgcccccatgg

SEQ ID NO: 266308 - DNA, 75 bp, Artificial Sequence
  Synthetic
tgtggatgatggtaagatcaagaaggttgcgaatgcagttctgtgcgccctaggatcacttttctcaaaacccat

SEQ ID NO: 266309 - DNA, 75 bp, Artificial Sequence
  Synthetic
gttgcgaatgcagttctgtgcgccctaggatcacttttctcaaaacccatcaaggacctccttgggaagctaaaa

SEQ ID NO: 266310 - DNA, 75 bp, Artificial Sequence
  Synthetic
ccattatgatgctgactattctaggtgggactcaacccaacaaaggagcattctttctgccgctatggaagtaat

SEQ ID NO: 266311 - DNA, 75 bp, Artificial Sequence
  Synthetic
tgggctcccgatgctaggactacaacatacaatgcaggccgcttttccaaccctcaacccccgggggcagcgcca

SEQ ID NO: 266312 - DNA, 75 bp, Artificial Sequence
  Synthetic
gcagagctcttcaatgtcttttggaccccccctgatgtctctaacttcattgcctccataattggtgactttgag

SEQ ID NO: 266313 - DNA, 75 bp, Artificial Sequence
  Synthetic
ccccccctgatgtctctaacttcattgcctccataattggtgactttgagatgcaaggaccagaaaacctcgctg

SEQ ID NO: 266314 - DNA, 75 bp, Artificial Sequence
  Synthetic
caagttgaagaaggtagctaacatattcttgtgtgcgctatcttcgctattcactaggcccatcaaagacataat

SEQ ID NO: 266315 - DNA, 75 bp, Artificial Sequence
  Synthetic
tgtcatctgcagcatccactcttagagcttgtaaggatcttggtaattacgccctggacattctaaagctggtca

SEQ ID NO: 266316 - DNA, 75 bp, Artificial Sequence
  Synthetic
agcttgtaaggatcttggtaattacgccctggacattctaaagctggtcatgaaatggttcttccccaagaagga

SEQ ID NO: 266317 - DNA, 75 bp, Artificial Sequence
  Synthetic
acaacatacaatgcaggccgcttttccacccctcaaccctcgggggcactgccaggaaggaccaatcccagggct

SEQ ID NO: 266318 - DNA, 75 bp, Artificial Sequence
  Synthetic
aggaggagaaagccaggaagctttcaaccaagtctgcttcacctgatatcgtgggcacaatcaacgctctcctgg

SEQ ID NO: 266319 - DNA, 75 bp, Artificial Sequence
  Synthetic
tctcacaacattgctcaaagacaaggacagcctaaacgcctacatgaagaccttagacatggaggaggaaaaggc

SEQ ID NO: 266320 - DNA, 75 bp, Artificial Sequence
  Synthetic
gtgtaccttctaatacttctactgctacttctgtgtattcaaatcaaactgtttcaacgagacttggttctacag

SEQ ID NO: 266321 - DNA, 75 bp, Artificial Sequence
  Synthetic
ggtgcatcgggcgaaagaggagctctccagcagaccaagacctgttgttgttatgatatcaggcaggccagggat

SEQ ID NO: 266322 - DNA, 75 bp, Artificial Sequence
  Synthetic
cctgacgttcctccgtaggtcgattgctcgggacccagctggctggtttggaaagctggaccaagactcaatcct

SEQ ID NO: 266323 - DNA, 75 bp, Artificial Sequence
  Synthetic
gctcgggacccagctggctggtttggaaagctggaccaagactcaatcctcaggcagctgtactggacaaggggg

SEQ ID NO: 266324 - DNA, 75 bp, Artificial Sequence
  Synthetic
agggaaaacccaccttgccagggaattggccaagagaatcgcagcttctctcacaggggaccagcgtgtgggtct

SEQ ID NO: 266325 - DNA, 75 bp, Artificial Sequence
  Synthetic
gacagcctaaacgcctacatgaagaccttagacatggaggaggaaaaggccaggaaactctcaaccaaatcatca

SEQ ID NO: 266326 - DNA, 75 bp, Artificial Sequence
  Synthetic
aaagaggagatgttcagtcgggcgaggcctgttgtcgtaatggtctccgggagaccagggatcgggaagacttac

SEQ ID NO: 266327 - DNA, 75 bp, Artificial Sequence
  Synthetic
ggcctgttgtcgtaatggtctccgggagaccagggatcgggaagacttacctggctagacaacttgctaagtcaa

SEQ ID NO: 266328 - DNA, 75 bp, Artificial Sequence
  Synthetic
ctctgacctcagcacatgggagggcgatcgcaatcttgctcccgaaggtgtgaatgaagatggcgtcgaatgacg

SEQ ID NO: 266329 - DNA, 75 bp, Artificial Sequence
  Synthetic
gccccctcacgctaaattgtgacaggattgagaacaaaggaaaggtctttgacagtgatgccataatcatcacca

SEQ ID NO: 266330 - DNA, 75 bp, Artificial Sequence
  Synthetic
ggggtgagagagtcgtcctgtgggatgactatggtatgggaaacacaattaaagacgccctgactctacaggagt

SEQ ID NO: 266331 - DNA, 75 bp, Artificial Sequence
  Synthetic
gatcgcaatcttgctcccgaaggtgtgaatgaagatggcgtcgaatgacgcagctccatctaatgatggtgcagc

SEQ ID NO: 266332 - DNA, 75 bp, Artificial Sequence
  Synthetic
tgactatggtatgggaaacacaattaaagacgccctgactctacaggagttggcagacacctgcccagtcaccct

SEQ ID NO: 266333 - DNA, 75 bp, Artificial Sequence
  Synthetic
ggcaaagcgtgatttcccaggtcaacctgacatgtggaagaacgctttcagtcctgacttctcgcacataaaact

SEQ ID NO: 266334 - DNA, 75 bp, Artificial Sequence
  Synthetic
tgtcgggcaacaaaatataattgatccctggataagaaataattttgtacaagctcctgcaggtgagtttacagt

SEQ ID NO: 266335 - DNA, 75 bp, Artificial Sequence
  Synthetic
ccccgcccccctcgattacgtcaactttgaggcttgctgtagacgaattgacttccttgtctatgccgaggcacc

SEQ ID NO: 266336 - DNA, 75 bp, Artificial Sequence
  Synthetic
ccctggataagaaataattttgtacaagctcctgcaggtgagtttacagtttcccctagaaattcccctggtgaa

SEQ ID NO: 266337 - DNA, 75 bp, Artificial Sequence
  Synthetic
tttgaggcttgctgtagacgaattgacttccttgtctatgccgaggcaccagacattgagaaagtcaaaaaggat

SEQ ID NO: 266338 - DNA, 75 bp, Artificial Sequence
  Synthetic
gctggtggcatggaagtgcaaattgtgttggctgggaacgcgttcacagctggcaagatcatatttgctgccatc

SEQ ID NO: 266339 - DNA, 75 bp, Artificial Sequence
  Synthetic
cagggtggtttcgacaaaaacggaaacacccctcatgggaagggcaccatgaaaaccctcacgctgcattcactc

SEQ ID NO: 266340 - DNA, 75 bp, Artificial Sequence
  Synthetic
tgttggctgggaacgcgttcacagctggcaagatcatatttgctgccatccctccagggttcccatatgaaaatt

SEQ ID NO: 266341 - DNA, 75 bp, Artificial Sequence
  Synthetic
acacccctcatgggaagggcaccatgaaaaccctcacgctgcattcactcactgcacgtgtgatgggcttagtgt

SEQ ID NO: 266342 - DNA, 75 bp, Artificial Sequence
  Synthetic
tgccagatattagaaacaacttcttccattacaatcagggcaatgatccaaaattgagactgatagctatgctct

SEQ ID NO: 266343 - DNA, 75 bp, Artificial Sequence
  Synthetic
catttagaaaattggcagctgacaacaagtatagttttgtggagacaatgaaagttggtgcggtcctcaagaatg

SEQ ID NO: 266344 - DNA, 75 bp, Artificial Sequence
  Synthetic
ccattacaatcagggcaatgatccaaaattgagactgatagctatgctctacacccctttaagggctaacaattc

SEQ ID NO: 266345 - DNA, 75 bp, Artificial Sequence
  Synthetic
caagtatagttttgtggagacaatgaaagttggtgcggtcctcaagaatgtgcgaaccctggaggacctaaaatc

SEQ ID NO: 266346 - DNA, 75 bp, Artificial Sequence
  Synthetic
ctctgaaatcaggaagaggaacccagacgacttcaagcctaaaggaaagctgtgggctgatgacgacaggagtgt

SEQ ID NO: 266347 - DNA, 75 bp, Artificial Sequence
  Synthetic
cccccctacggttgaatctaagaccaaacagttcacattgcccatcctcaaaatatcagagatgaccaactcaag

SEQ ID NO: 266348 - DNA, 75 bp, Artificial Sequence
  Synthetic
ctgtggcagtgtctcggtctccaagatcaaggatgttgcatcacagacagccaatgaagtgcatacagcgctcct

SEQ ID NO: 266349 - DNA, 75 bp, Artificial Sequence
  Synthetic
aaacagttcacattgcccatcctcaaaatatcagagatgaccaactcaagattcccagtgccagtggaaatgatg

SEQ ID NO: 266350 - DNA, 75 bp, Artificial Sequence
  Synthetic
atcaaggatgttgcatcacagacagccaatgaagtgcatacagcgctcctgagactgaggcaggcccgggccaga

SEQ ID NO: 266351 - DNA, 75 bp, Artificial Sequence
  Synthetic
accacacccttgttggctgtcaacatctgcaaattcaagggggaggtcatagctaagaatggagatgtgagatcc

SEQ ID NO: 266352 - DNA, 75 bp, Artificial Sequence
  Synthetic
atctcaaagagattctcctgggaccgttggattaaacccagtgagagccctcaagaggaagaacaacctagcagt

SEQ ID NO: 266353 - DNA, 75 bp, Artificial Sequence
  Synthetic
tctgcaaattcaagggggaggtcatagctaagaatggagatgtgagatcctataggatggatatggaaattacca

SEQ ID NO: 266354 - DNA, 75 bp, Artificial Sequence
  Synthetic
gttggattaaacccagtgagagccctcaagaggaagaacaacctagcagtgaggaggccacaggaagatgggaaa

SEQ ID NO: 266355 - DNA, 75 bp, Artificial Sequence
  Synthetic
tctttggcgttgccagccaacgcaacaagaatgagcaaaaccctgccacgagagcccatgaagccaacattaaca

SEQ ID NO: 266356 - DNA, 75 bp, Artificial Sequence
  Synthetic
gcaccacaccaggtgactgtggctgtccctacatttacaagagggggaatgactacgtagtcattggagtccaca

SEQ ID NO: 266357 - DNA, 75 bp, Artificial Sequence
  Synthetic
tctctagcaagggtcttagtgatgaagagtacgatgagttcaagagaatcagagaggagaagaacggcaagtact

SEQ ID NO: 266358 - DNA, 75 bp, Artificial Sequence
  Synthetic
caagaatgagcaaaaccctgccacgagagcccatgaagccaacattaacactggtggggaccaatacgcccccaa

SEQ ID NO: 266359 - DNA, 75 bp, Artificial Sequence
  Synthetic
agagtacgatgagttcaagagaatcagagaggagaagaacggcaagtactctatagaagaatacctccaggaccg

SEQ ID NO: 266360 - DNA, 75 bp, Artificial Sequence
  Synthetic
tgtggcaggcgacacttcccaccctttcagacagtgggtcctgcctcgatacggtggacatctcaccaacaacac

SEQ ID NO: 266361 - DNA, 75 bp, Artificial Sequence
  Synthetic
tagacagagaattttcagacccacaaagaaacagaggaaggaggaacggggcgtccttggactagtcaccggttc

SEQ ID NO: 266362 - DNA, 75 bp, Artificial Sequence
  Synthetic
ttcagacagtgggtcctgcctcgatacggtggacatctcaccaacaacacccacttggctccagcagtggccccc

SEQ ID NO: 266363 - DNA, 75 bp, Artificial Sequence
  Synthetic
aagaaacagaggaaggaggaacggggcgtccttggactagtcaccggttcggaaatcaggaagagaagaccagat

SEQ ID NO: 266364 - DNA, 75 bp, Artificial Sequence
  Synthetic
gcctaccttggcggcaaggaccccagagtcaagggtggcccttcattgcaacaagttatgagggaccagctgaaa

SEQ ID NO: 266365 - DNA, 75 bp, Artificial Sequence
  Synthetic
ttgaaccggtggctggggcttcaatagccgccccactcaccggccaaaacaatgttatagacccctggattagat

SEQ ID NO: 266366 - DNA, 75 bp, Artificial Sequence
  Synthetic
gactgccttgtcccacaagaatgggtccaacacttctatcaagaagctgccacagctcagtctgaggtggcactc

SEQ ID NO: 266367 - DNA, 75 bp, Artificial Sequence
  Synthetic
gcccctccaagtgtgtggtcacgcatcgtaccccttggtactggttggggtttctgggtctcctccaacctcctc

SEQ ID NO: 266368 - DNA, 75 bp, Artificial Sequence
  Synthetic
cgcatccctcgacaagaccacttccagtggtcacccgcaccacatgcggaaaaacgactgctggaacggggagtc

SEQ ID NO: 266369 - DNA, 75 bp, Artificial Sequence
  Synthetic
tccaacacttctatcaagaagctgccacagctcagtctgaggtggcactcataaggttcatcaacccagacactg

SEQ ID NO: 266370 - DNA, 75 bp, Artificial Sequence
  Synthetic
tcgtaccccttggtactggttggggtttctgggtctcctccaacctcctcatctctctggaacgagtcctgccaa

SEQ ID NO: 266371 - DNA, 75 bp, Artificial Sequence
  Synthetic
ctttacaggcaaattggcagaccaggcttccaaggccaacctgatgttcgaagagggaaagaacatgaccccagt

SEQ ID NO: 266372 - DNA, 75 bp, Artificial Sequence
  Synthetic
tcatgccaccaaatgggtactttagatttgaagcctgggttaatcagttttactcactcgcccccgtgggaactg

SEQ ID NO: 266373 - DNA, 75 bp, Artificial Sequence
  Synthetic
ggtttccaagacctatcagaccagatgtcacaggcctcatccttgaagaaggagcccctgaaggcacggtgtgtt

SEQ ID NO: 266374 - DNA, 75 bp, Artificial Sequence
  Synthetic
atttgaagcctgggttaatcagttttactcactcgcccccgtgggaactgggaatgggcgcaggaggatccaata

SEQ ID NO: 266375 - DNA, 75 bp, Artificial Sequence
  Synthetic
tgatggaggaactcaaagcacattgtgtcacactacccgtcagagtaggtatgaatatgaatgaggatggtccta

SEQ ID NO: 266376 - DNA, 75 bp, Artificial Sequence
  Synthetic
tgtcacaggcctcatccttgaagaaggagcccctgaaggcacggtgtgttctatcctcgtcaaaagaccgactgg

SEQ ID NO: 266377 - DNA, 75 bp, Artificial Sequence
  Synthetic
gctaatgctatcaaccaaaaggttgagtttgattataataaacaactccaaaatgcatccttctcccatgataag

SEQ ID NO: 266378 - DNA, 75 bp, Artificial Sequence
  Synthetic
aatgggcatgttgctcacaggggcaaatgccaaaaacatggacctgggcacgaaccctggtgactgtggctgccc

SEQ ID NO: 266379 - DNA, 75 bp, Artificial Sequence
  Synthetic
agtttgattataataaacaactccaaaatgcatccttctcccatgataaggaaatgctccaagcccaaattgaag

SEQ ID NO: 266380 - DNA, 75 bp, Artificial Sequence
  Synthetic
aatgccaaaaacatggacctgggcacgaaccctggtgactgtggctgcccgtacatttttaaaaggggcaatgac

SEQ ID NO: 266381 - DNA, 75 bp, Artificial Sequence
  Synthetic
atcaatgagggcctcccctccggggtgccctgcacctcccaatggaattccatcgcccactggctcctcactctc

SEQ ID NO: 266382 - DNA, 75 bp, Artificial Sequence
  Synthetic
catcgcccactggctcctcactctctgtgcactttctgaggttacaaacctgtcccctgacattatccaggccaa

SEQ ID NO: 266383 - DNA, 75 bp, Artificial Sequence
  Synthetic
atgccgcgaggggttctgtcggcgcgccaatgacaaaattagttgattggagtggcactagatattgggcgcctg

SEQ ID NO: 266384 - DNA, 75 bp, Artificial Sequence
  Synthetic
ggagaggccgttcttgaaggaggagaggacaaaggaacatactgtggtgccccaatacttggacttgggaaggcc

SEQ ID NO: 266385 - DNA, 75 bp, Artificial Sequence
  Synthetic
gccaatgacaaaattagttgattggagtggcactagatattgggcgcctggtgccatgaggacaacaggctattc

SEQ ID NO: 266386 - DNA, 75 bp, Artificial Sequence
  Synthetic
aggacaaaggaacatactgtggtgccccaatacttggacttgggaaggcccctaagctctgcactaaaacaaagt

SEQ ID NO: 266387 - DNA, 75 bp, Artificial Sequence
  Synthetic
agatccttctcctccttcttcgagtggttcttctgtttcttctgtcaaaacacaatcaactaccctctcaggcac

SEQ ID NO: 266388 - DNA, 75 bp, Artificial Sequence
  Synthetic
ttgagaagggcccatcactccagcaggttatgagagaacaacttaaacccttcaccgaacccagaggaaaaccgc

SEQ ID NO: 266389 - DNA, 75 bp, Artificial Sequence
  Synthetic
ggttcttctgtttcttctgtcaaaacacaatcaactaccctctcaggcacttcaagggtgggctcctcatctcag

SEQ ID NO: 266390 - DNA, 75 bp, Artificial Sequence
  Synthetic
ggttatgagagaacaacttaaacccttcaccgaacccagaggaaaaccgccaaagcccagcgttctcgatgaggc

SEQ ID NO: 266391 - DNA, 75 bp, Artificial Sequence
  Synthetic
atggatggagcgttgcaaacaacgtatgtaacgccaccatccagtagggcatcaagtgtcagcacagtctcgacc

SEQ ID NO: 266392 - DNA, 75 bp, Artificial Sequence
  Synthetic
ctcacttgacaaaacgacttcaagtggtagcccacaccacctaaggaagaatgatcactggaatggtgagtcttt

SEQ ID NO: 266393 - DNA, 75 bp, Artificial Sequence
  Synthetic
ggtagcccacaccacctaaggaagaatgatcactggaatggtgagtctttcaccggccctttagccgaccaagct

SEQ ID NO: 266394 - DNA, 75 bp, Artificial Sequence
  Synthetic
aggcgaggggagtcacagatttagtgaaaagattggttaggaaagttgattagtttgttcttcctttctactatt

SEQ ID NO: 266395 - DNA, 75 bp, Artificial Sequence
  Synthetic
gtcaagactgacaagatttataataagataaagaagaggttgctatggggttctgacctgggtaccatggtcagg

SEQ ID NO: 266396 - DNA, 75 bp, Artificial Sequence
  Synthetic
agataaagaagaggttgctatggggttctgacctgggtaccatggtcaggtgtgccagagcctttggtgggttaa

SEQ ID NO: 266397 - DNA, 75 bp, Artificial Sequence
  Synthetic
gcagttccccctcattttccattagaaaacataagccctggccagataactatgttccctcatgtaattattgat

SEQ ID NO: 266398 - DNA, 75 bp, Artificial Sequence
  Synthetic
tttttgacaaacatgcaaaatataaataccactatgatgcagactactccagatgggactccacgcagcaaagat

SEQ ID NO: 266399 - DNA, 75 bp, Artificial Sequence
  Synthetic
ataccactatgatgcagactactccagatgggactccacgcagcaaagatgcatcttgtctgctgccatggaggt

SEQ ID NO: 266400 - DNA, 75 bp, Artificial Sequence
  Synthetic
tggttctggtgatgatgtatttactgtctcctgcagggtgcttacccgaccttcccctgattttgattttaatta

SEQ ID NO: 266401 - DNA, 75 bp, Artificial Sequence
  Synthetic
cgtgggcgattttgtggtgtcagttcaggaaggccttccttcaggtgtcccatgtacctcccagtggaactctat

SEQ ID NO: 266402 - DNA, 75 bp, Artificial Sequence
  Synthetic
caggaaggccttccttcaggtgtcccatgtacctcccagtggaactctatagcacactggatcattacccttagt

SEQ ID NO: 266403 - DNA, 75 bp, Artificial Sequence
  Synthetic
gagatagttagcacagatattaatctggacccagcaaaattaaccttgaaacttagggaatatggattggtcccc

SEQ ID NO: 266404 - DNA, 75 bp, Artificial Sequence
  Synthetic
tggacccagcaaaattaaccttgaaacttagggaatatggattggtccccaccagaccagacaaaactgagggcc

SEQ ID NO: 266405 - DNA, 75 bp, Artificial Sequence
  Synthetic
ttggtaagttagaccaggattcaattttgagacagctctattggaccagaggacccaaccatgagaatccctatg

SEQ ID NO: 266406 - DNA, 75 bp, Artificial Sequence
  Synthetic
tttgagacagctctattggaccagaggacccaaccatgagaatccctatgagagcatggttccgcactcacagcg

SEQ ID NO: 266407 - DNA, 75 bp, Artificial Sequence
  Synthetic
ggtcatcaatgagatcaaaagtggtggtctggaattttacgtgcccagacaggaggccatgttcagatggatgag

SEQ ID NO: 266408 - DNA, 75 bp, Artificial Sequence
  Synthetic
tgcggcaggactcgttccagagagtcaacaagaagtcttgcctttagagcccgtcgcgggagtccagctggctgc

SEQ ID NO: 266409 - DNA, 75 bp, Artificial Sequence
  Synthetic
caacaagaagtcttgcctttagagcccgtcgcgggagtccagctggctgctcccgttgcagggcaaagtaacata

SEQ ID NO: 266410 - DNA, 75 bp, Artificial Sequence
  Synthetic
ggtgaggtacttattgatttagaattaggaccagaattaaacccctatctcaaccaccttgcaagaatgtataat

SEQ ID NO: 266411 - DNA, 75 bp, Artificial Sequence
  Synthetic
taggaccagaattaaacccctatctcaaccaccttgcaagaatgtataatgggtatgtaggaggaatggaggtgg

SEQ ID NO: 266412 - DNA, 75 bp, Artificial Sequence
  Synthetic
aggcattgggcccccggagccacgaaaaccactgctttctccggtggattcaccaatgcttctcatgccggaact

SEQ ID NO: 266413 - DNA, 75 bp, Artificial Sequence
  Synthetic
atggtatctctgcagcacaggctactatgctaccccatgtgattgtggatgtcaggcagttggagcctgttcggc

SEQ ID NO: 266414 - DNA, 75 bp, Artificial Sequence
  Synthetic
tatgctaccccatgtgattgtggatgtcaggcagttggagcctgttcggctccccctccctgacgtcaggaatgt

SEQ ID NO: 266415 - DNA, 75 bp, Artificial Sequence
  Synthetic
gtcgacctgaccaagaagacatcagccacaccagcccctacgtctgtttctagacctagctctattgcctctaca

SEQ ID NO: 266416 - DNA, 75 bp, Artificial Sequence
  Synthetic
caacggagctggtgatgatgttttcaccgtctcatgtcgtgtgctaacaagaccctcaccagattttgattttat

SEQ ID NO: 266417 - DNA, 75 bp, Artificial Sequence
  Synthetic
accgtctcatgtcgtgtgctaacaagaccctcaccagattttgattttattttcttggtccccccctctgtagag

SEQ ID NO: 266418 - DNA, 75 bp, Artificial Sequence
  Synthetic
acacagctttataccagtccaaacaccaatttggttgtccagttccaaaatggcaggtgcctacttgatggtaca

SEQ ID NO: 266419 - DNA, 75 bp, Artificial Sequence
  Synthetic
gttgacaggatccaaagcgccgccgtgcagaccaacaatgagctggctggtgccctgcaccacttaaggtgtgcc

SEQ ID NO: 266420 - DNA, 75 bp, Artificial Sequence
  Synthetic
ccaatttggttgtccagttccaaaatggcaggtgcctacttgatggtacacttcttggtactacccctgtcagag

SEQ ID NO: 266421 - DNA, 75 bp, Artificial Sequence
  Synthetic
acgagggtcttccctctggggtgccctgcacctcccaatggaactccatcgcccactggctcctcactctttgtg

SEQ ID NO: 266422 - DNA, 75 bp, Artificial Sequence
  Synthetic
cacatagaattatggtacagcttagggagccagatggagaggagttttcacccacaggtcccaaccctgcccctg

SEQ ID NO: 266423 - DNA, 75 bp, Artificial Sequence
  Synthetic
ggagccagatggagaggagttttcacccacaggtcccaaccctgcccctgttggcaccccagactttcaagcagc

SEQ ID NO: 266424 - DNA, 75 bp, Artificial Sequence
  Synthetic
tcttgttatctctgaagacttagatggtttgactttcctgcggagaactgtgacccgcgacccagctggttggtt

SEQ ID NO: 266425 - DNA, 75 bp, Artificial Sequence
  Synthetic
ctacacaagaaaccccacctttgcaccaggcatagggactgttgtattttcttttgacaccactgattttcaaaa

SEQ ID NO: 266426 - DNA, 75 bp, Artificial Sequence
  Synthetic
ccaggcatagggactgttgtattttcttttgacaccactgattttcaaaatcgtcaacctaccaaattttcccct

SEQ ID NO: 266427 - DNA, 75 bp, Artificial Sequence
  Synthetic
gcagtggacgctggaaaactggctccacctgtggcacccaattatccaggtgagcagattctttatttcagaggg

SEQ ID NO: 266428 - DNA, 75 bp, Artificial Sequence
  Synthetic
cacctgtggcacccaattatccaggtgagcagattctttatttcagagggagtgtacctttcaaaggtggttatg

SEQ ID NO: 266429 - DNA, 75 bp, Artificial Sequence
  Synthetic
gtgacgcagccctgctgcgctactacaaccctgacactggtagagtcctctttgagtgcaaactccatcgtgaag

SEQ ID NO: 266430 - DNA, 75 bp, Artificial Sequence
  Synthetic
caaccctgacactggtagagtcctctttgagtgcaaactccatcgtgaaggattcatcacaatcaactacacggg

SEQ ID NO: 266431 - DNA, 75 bp, Artificial Sequence
  Synthetic
ccccatgggaaatggcaatggccgcaggggtagaagaagggagttataatggctggagctttctttgcaggtctt

SEQ ID NO: 266432 - DNA, 75 bp, Artificial Sequence
  Synthetic
aggggtagaagaagggagttataatggctggagctttctttgcaggtcttgcttctgatgttcttggcagcggtt

SEQ ID NO: 266433 - DNA, 75 bp, Artificial Sequence
  Synthetic
agcaaacaattgatccacctgagaagtggtcgttcgcacaagcttgcgcgtcccttgacaagaccacttccagtg

SEQ ID NO: 266434 - DNA, 75 bp, Artificial Sequence
  Synthetic
cagcttctttccaacatgataaggacatgctcagttcacaggtggaagccacaaaacacctgcagagggaaatga

SEQ ID NO: 266435 - DNA, 75 bp, Artificial Sequence
  Synthetic
catgctcagttcacaggtggaagccacaaaacacctgcagagggaaatgatggccatcaaggaaggcatgctgct

SEQ ID NO: 266436 - DNA, 75 bp, Artificial Sequence
  Synthetic
tggcaccagatattgggccccaggtgcaatgaaaaccacggcctactcaggtcgttttgtcagccaatccactca

SEQ ID NO: 266437 - DNA, 75 bp, Artificial Sequence
  Synthetic
gcaatgaaaaccacggcctactcaggtcgttttgtcagccaatccactcacaggcccattcccaatgttgtgcac

SEQ ID NO: 266438 - DNA, 75 bp, Artificial Sequence
  Synthetic
gttccatcatccacatcctcatctagtagtacttctagaacaagagactgggtgtctgaacaacaaagactcagc

SEQ ID NO: 266439 - DNA, 75 bp, Artificial Sequence
  Synthetic
gtagtacttctagaacaagagactgggtgtctgaacaacaaagactcagccctttcatgagaggttctcttcaaa

SEQ ID NO: 266440 - DNA, 75 bp, Artificial Sequence
  Synthetic
attcatggaccccttcttttaacactaagcatttacccctgtttgcccacgttaagaaaaggggacaatctcaag

SEQ ID NO: 266441 - DNA, 75 bp, Artificial Sequence
  Synthetic
gttaagaaaaggggacaatctcaagtttaatctaccactcatggttttattgatttgttttgtaattagtgaaat

SEQ ID NO: 266442 - DNA, 75 bp, Artificial Sequence
  Synthetic
gcctgagctttccaccgtcaggcaaccggaagaagccaatacggccttcagtgtccccccactcaatcagaggga

SEQ ID NO: 266443 - DNA, 75 bp, Artificial Sequence
  Synthetic
ccggaagaagccaatacggccttcagtgtccccccactcaatcagagggagaatagggatgctaaggaaccacta

SEQ ID NO: 266444 - DNA, 75 bp, Artificial Sequence
  Synthetic
ggcgtacacaagccaccagctgccattagcctcgccaaggtcgaattaacaccactctccttgtactggagacct

SEQ ID NO: 266445 - DNA, 75 bp, Artificial Sequence
  Synthetic
cttcataaatcaggctatgtcacagtggctcacaccggccagcatgatttggttatcccccccaatggctatttt

SEQ ID NO: 266446 - DNA, 75 bp, Artificial Sequence
  Synthetic
ggtgcatatgggctagagatcctaaagttagtcatgaagtggttcttcccgaagaaagaggaagcgaatgaactg

SEQ ID NO: 266447 - DNA, 75 bp, Artificial Sequence
  Synthetic
acttaaacaagcactcaagaatatctcaatcaagaagtgccagattgtgtatagtggttgcacctacacacttga

SEQ ID NO: 266448 - DNA, 75 bp, Artificial Sequence
  Synthetic
atcaacgagggtctcccctctggggtaccctgcacctcccaatggaactccatcgcccactggcttctcactctc

SEQ ID NO: 266449 - DNA, 75 bp, Artificial Sequence
  Synthetic
cgagaatcgccgctgcacgctccctggtgcaccgagcgaaggaggagctttccagcagaccaagacctgtagtct

SEQ ID NO: 266450 - DNA, 75 bp, Artificial Sequence
  Synthetic
cgactgctggaacggggaatccttcacaggcaagctggcagaccaggcttccaaggccaacctgatgttcgaaga

SEQ ID NO: 266451 - DNA, 75 bp, Artificial Sequence
  Synthetic
tatctcaatcaagaagtgccagattgtgtatagtggttgcacctacacacttgagtctgatggcaagggcaatgt

SEQ ID NO: 266452 - DNA, 75 bp, Artificial Sequence
  Synthetic
gtgaatgaagatggcgtctaacgacgctaccgctgcctttggcagtcaaaactctgtcaatgacagtatcaacgc

SEQ ID NO: 266453 - DNA, 75 bp, Artificial Sequence
  Synthetic
actctgtcaatgacagtatcaacgccaccccttccaataaggaagaggttggtgcattctccaacatcaaagttg

SEQ ID NO: 266454 - DNA, 75 bp, Artificial Sequence
  Synthetic
ttcataacatcaacccacgtcataccccagggcgcaaaggagttctttggagtccccatcaaacaaattcaggta

SEQ ID NO: 266455 - DNA, 75 bp, Artificial Sequence
  Synthetic
gtcgttgcagctactgctgctagtgctgaaaacactagtgacaatagtgattctataaagaaccgtttcttcaca

SEQ ID NO: 266456 - DNA, 75 bp, Artificial Sequence
  Synthetic
ggtgtcgaccactgggatgcctacagaggagagagggtggtcttgtgggatgactacggtatggggagccctgtt

SEQ ID NO: 266457 - DNA, 75 bp, Artificial Sequence
  Synthetic
ctgaaaacactagtgacaatagtgattctataaagaaccgtttcttcacaaggttgaagaacttaggttctaaca

SEQ ID NO: 266458 - DNA, 75 bp, Artificial Sequence
  Synthetic
ctcaaggaattagagaatgagccatggccatatgcggccataaccaataattgttttgaattctgctgtcaagtc

SEQ ID NO: 266459 - DNA, 75 bp, Artificial Sequence
  Synthetic
ccccgcgcccctcgactatgtgaacttcgaggcgtgttccaggagagttgacttcttggtctatgcagagtcacc

SEQ ID NO: 266460 - DNA, 75 bp, Artificial Sequence
  Synthetic
ataaaccccctaaagaccagagggataaacccccaaggaatgtggctgagacccagcaggcaatgggatggatcg

SEQ ID NO: 266461 - DNA, 75 bp, Artificial Sequence
  Synthetic
taaacccccaaggaatgtggctgagacccagcaggcaatgggatggatcgacccccccatggaccagaatctacc

SEQ ID NO: 266462 - DNA, 75 bp, Artificial Sequence
  Synthetic
attccaccaccccacccaatcgtggtcacaacagacccctgagttccagcaagatagcaagttagagttggtcag

SEQ ID NO: 266463 - DNA, 75 bp, Artificial Sequence
  Synthetic
tcacaacagacccctgagttccagcaagatagcaagttagagttggtcagggacgccatattagctgcagtaaat

SEQ ID NO: 266464 - DNA, 75 bp, Artificial Sequence
  Synthetic
tttggcaccagctagcatccctactggttatgtgaagaatacagagcaacaaccccctgaccaccaagtcaagtg

SEQ ID NO: 266465 - DNA, 75 bp, Artificial Sequence
  Synthetic
ggttatgtgaagaatacagagcaacaaccccctgaccaccaagtcaagtggagtgccagtaatggggttgatctt

SEQ ID NO: 266466 - DNA, 75 bp, Artificial Sequence
  Synthetic
tgtgattggaccttcatgggagtggtggagatggtcatactattacttgaactctttggcgtgttctggaacccg

SEQ ID NO: 266467 - DNA, 75 bp, Artificial Sequence
  Synthetic
aatggtccagcaaaggaaccacttattggtgacatgatagaattctatgaggggcacatttaccattatgcaata

SEQ ID NO: 266468 - DNA, 75 bp, Artificial Sequence
  Synthetic
gggacctgaagacttggcacgagatctagtcccagtgattcttggcggtataggactggccatcgggttcaccag

SEQ ID NO: 266469 - DNA, 75 bp, Artificial Sequence
  Synthetic
ttggtgacatgatagaattctatgaggggcacatttaccattatgcaatatacattggccaaggaaaaactgttg

SEQ ID NO: 266470 - DNA, 75 bp, Artificial Sequence
  Synthetic
ccgctattatgaagaagtggcagttgcccgggcaacagaggaggacttctgtgaagaggaagaggccaaaataag

SEQ ID NO: 266471 - DNA, 75 bp, Artificial Sequence
  Synthetic
gttatgtgccaacacctgatcagaggttaaattatgaccaactcaaagaacttgagaatgagccatggccatatg

SEQ ID NO: 266472 - DNA, 75 bp, Artificial Sequence
  Synthetic
gttaaattatgaccaactcaaagaacttgagaatgagccatggccatatgctgcagttactaataattgctatga

SEQ ID NO: 266473 - DNA, 75 bp, Artificial Sequence
  Synthetic
gttcaccccagtcggtgttatccaggatggtggcactacccaccgaaatgaaccccaacaatgggtgctcccaag

SEQ ID NO: 266474 - DNA, 75 bp, Artificial Sequence
  Synthetic
ttatatgaacatcttggacaatgaagaagagaaggccaggaagctctctgctaaaaacgctgacccacatgtgat

SEQ ID NO: 266475 - DNA, 75 bp, Artificial Sequence
  Synthetic
cccagcacaagactggtccagggacacgcctgacttccaacaagatagcaagttagaaatagtcagggatgccgt

SEQ ID NO: 266476 - DNA, 75 bp, Artificial Sequence
  Synthetic
gtgcacctggcccccgctgtagcccccacttttccgggtgagcaactcctcttcttcagatctaccatgccagga

SEQ ID NO: 266477 - DNA, 75 bp, Artificial Sequence
  Synthetic
acgcctgacttccaacaagatagcaagttagaaatagtcagggatgccgtgcttgctgctatcaatggcttggta

SEQ ID NO: 266478 - DNA, 75 bp, Artificial Sequence
  Synthetic
acatttatgggggtggttgagacgataatactacttatggagctgtttgggatcttctggaatccccctgatgtg

SEQ ID NO: 266479 - DNA, 75 bp, Artificial Sequence
  Synthetic
taatactacttatggagctgtttgggatcttctggaatccccctgatgtgtccagctttatagcctcattattgc

SEQ ID NO: 266480 - DNA, 75 bp, Artificial Sequence
  Synthetic
caattgggttcaccaaggacaaagttacaaaggtcatgaagagtgctgttgaaggactcagggcagccacacaat

SEQ ID NO: 266481 - DNA, 75 bp, Artificial Sequence
  Synthetic
tacaaaggtcatgaagagtgctgttgaaggactcagggcagccacacaattaggccagtatggcctagagatatt

SEQ ID NO: 266482 - DNA, 75 bp, Artificial Sequence
  Synthetic
tagacgggtcgacttcttggtctactgctctgccccagaggtggaacagatacggagggttagccctggtgatac

SEQ ID NO: 266483 - DNA, 75 bp, Artificial Sequence
  Synthetic
tgacatggaggtcatctcaacaactgctgttactcaactagtcagggacaaacaggctgcccggacctacatgaa

SEQ ID NO: 266484 - DNA, 75 bp, Artificial Sequence
  Synthetic
gcaatctacaacaggcttcctttcaacatgataaagagatgctccaatcacaaattgatgccaccaaaaagttgc

SEQ ID NO: 266485 - DNA, 75 bp, Artificial Sequence
  Synthetic
gctgttactcaactagtcagggacaaacaggctgcccggacctacatgaacatcttagatgctgaagaagagaag

SEQ ID NO: 266486 - DNA, 75 bp, Artificial Sequence
  Synthetic
caatcaagggaacacaccgtttggcaaaggtaccatgaagccaacaaccattaacagacttctcatacaagctgt

SEQ ID NO: 266487 - DNA, 75 bp, Artificial Sequence
  Synthetic
aaaggtaccatgaagccaacaaccattaacagacttctcatacaagctgtggcccttaccatggaaaggcaggat

SEQ ID NO: 266488 - DNA, 75 bp, Artificial Sequence
  Synthetic
caatcaacgcccccatgacaaaagttttggactggagcgggacaaggtactgggctcccgatgctaggactacaa

SEQ ID NO: 266489 - DNA, 75 bp, Artificial Sequence
  Synthetic
ttggctcgctccgcacttgctaaggcacaagctgagatgactaatagggtcaaaccagtagtgataatgatgtgt

SEQ ID NO: 266490 - DNA, 75 bp, Artificial Sequence
  Synthetic
cacaagctgagatgactaatagggtcaaaccagtagtgataatgatgtgtggtcccccaggtataggcaagacaa

SEQ ID NO: 266491 - DNA, 75 bp, Artificial Sequence
  Synthetic
aatggcctaggcatcctgagcatggcaggtctgggtaagaagctacgcggtgtcacaacgatggagggcttaaaa

SEQ ID NO: 266492 - DNA, 75 bp, Artificial Sequence
  Synthetic
aggctgtggatcattgggatggatatcacggtgaagaggttatgctatgggatgactatggtatgtctaagatag

SEQ ID NO: 266493 - DNA, 75 bp, Artificial Sequence
  Synthetic
caaagtgtactcactagaatcagatggtaacagtgtcaacattaaagaggagaggaacatcctaactcagcaaca

SEQ ID NO: 266494 - DNA, 75 bp, Artificial Sequence
  Synthetic
tcacggtgaagaggttatgctatgggatgactatggtatgtctaagatagctgatgactgtaataaattacaggc

SEQ ID NO: 266495 - DNA, 75 bp, Artificial Sequence
  Synthetic
catagtgataacaacaaatgccccaggaccagccccagtcgactttgtcaatcttggcccagtgtgtcggcgggt

SEQ ID NO: 266496 - DNA, 75 bp, Artificial Sequence
  Synthetic
ggaccagccccagtcgactttgtcaatcttggcccagtgtgtcggcgggtggatttcttggtttattgcactgca

SEQ ID NO: 266497 - DNA, 75 bp, Artificial Sequence
  Synthetic
tctcatctaaaaatggagttggctccacagggcggattcgacaatcaaggaaacactccatttggcaaagggacc

SEQ ID NO: 266498 - DNA, 75 bp, Artificial Sequence
  Synthetic
gatgatgtggtagaaaagtatgggctttgcgaaactgaggaggacgaagaagtggcccacactgaaatcccttct

SEQ ID NO: 266499 - DNA, 75 bp, Artificial Sequence
  Synthetic
cacagggcggattcgacaatcaaggaaacactccatttggcaaagggaccatgcggcctaccacattaaaccgcc

SEQ ID NO: 266500 - DNA, 75 bp, Artificial Sequence
  Synthetic
cgcagaggactcaatgatgaagagtacgaagagtacaagaagatacgcgaggagaaaggtggcaattatagcata

SEQ ID NO: 266501 - DNA, 75 bp, Artificial Sequence
  Synthetic
atgctgacaggatcactgcctttaccagtttagcaagagccaatggtttgggtctcattagcatggcctctctag

SEQ ID NO: 266502 - DNA, 75 bp, Artificial Sequence
  Synthetic
cagtttagcaagagccaatggtttgggtctcattagcatggcctctctaggaaagaaattaaggggtgtggactc

SEQ ID NO: 266503 - DNA, 75 bp, Artificial Sequence
  Synthetic
ggggaaactgaaatggaaatccgccacagagtgttctacaaatccaagagcagaaagcatcaccaggaagagcga

SEQ ID NO: 266504 - DNA, 75 bp, Artificial Sequence
  Synthetic
tgacattgaatcagatggtaccaatgtacgcataaaggaaaacacctcagcccagacacaacgccagcaatcaat

SEQ ID NO: 266505 - DNA, 75 bp, Artificial Sequence
  Synthetic
gtacgcataaaggaaaacacctcagcccagacacaacgccagcaatcaattgacacagcagccctagcacttacc

SEQ ID NO: 266506 - DNA, 75 bp, Artificial Sequence
  Synthetic
tcatttcatccgacgacatcaaaactgagggcaagaaagggaagaacaagactggccgcggcaagaagcacacag

SEQ ID NO: 266507 - DNA, 75 bp, Artificial Sequence
  Synthetic
gggtcagccatcgttataaatcgtgctgttaaaaggatgttcggtgcacactcgagcactatagctcttgaagga

SEQ ID NO: 266508 - DNA, 75 bp, Artificial Sequence
  Synthetic
ctgttaaaaggatgttcggtgcacactcgagcactatagctcttgaaggacccccaagagaacatcggtgcaggg

SEQ ID NO: 266509 - DNA, 75 bp, Artificial Sequence
  Synthetic
cataaccacaacgcacgttataccaaccagtgcgaaggagttctttggtgaacccctaaccagcatagccatcca

SEQ ID NO: 266510 - DNA, 75 bp, Artificial Sequence
  Synthetic
ctgaagaagaggacaccagtgaggagataaatgtggagctacccaccgccacttccgaaggtaaaaataaaggaa

SEQ ID NO: 266511 - DNA, 75 bp, Artificial Sequence
  Synthetic
gataaatgtggagctacccaccgccacttccgaaggtaaaaataaaggaaagaccaagaaaggaaggggcagaag

SEQ ID NO: 266512 - DNA, 75 bp, Artificial Sequence
  Synthetic
tacttctatatattcaaatcaaactgtttcaacgagacttggttctacagctggttctggcaccaatgtctcgag

SEQ ID NO: 266513 - DNA, 75 bp, Artificial Sequence
  Synthetic
gtgaactactgccattggccgtgagaatgggcgcgatagcatcaatgcgcatacagggccgccttgtccatgggc

SEQ ID NO: 266514 - DNA, 75 bp, Artificial Sequence
  Synthetic
atacagggccgccttgtccatgggcaatctggcatgttactcactggtgctaatgctaagggcatggatcttgga

SEQ ID NO: 266515 - DNA, 75 bp, Artificial Sequence
  Synthetic
aaagaatggcaactacagcattcaggagtaccttgaagacaggcaacgctatgaagaagagctcgcagaagtgca

SEQ ID NO: 266516 - DNA, 75 bp, Artificial Sequence
  Synthetic
gctgccactgcgaccgctggcaaaaccagcacaaacagtgtgattcacaaccaagatgtaaattctacatctagc

SEQ ID NO: 266517 - DNA, 75 bp, Artificial Sequence
  Synthetic
agctggtggtgatggaggcattggtgagacagaaatggagatccgacataaaatcttttacaagtccaaaaaggg

SEQ ID NO: 266518 - DNA, 75 bp, Artificial Sequence
  Synthetic
gtgaatgaagatggcgtctaacgacgcttccgttgccgttgctggcaaaaacaacaacaacgacaaggaaaaatc

SEQ ID NO: 266519 - DNA, 75 bp, Artificial Sequence
  Synthetic
gcttccgttgccgttgctggcaaaaacaacaacaacgacaaggaaaaatcttcaggtgacagcttgttttctaac

SEQ ID NO: 266520 - DNA, 75 bp, Artificial Sequence
  Synthetic
tcccccaatagggagggaaaacatgaaaccacccccagagctccccccccgaacaagggaggaaaggctaacatc

SEQ ID NO: 266521 - DNA, 75 bp, Artificial Sequence
  Synthetic
cccccccaaaaacgattgggcagatgataatagggaagtggactacaatgaaaaactcagttttgaagccccacc

SEQ ID NO: 266522 - DNA, 75 bp, Artificial Sequence
  Synthetic
agccctatcaactaagaccaaattctggaaatcatcccccgaaccactgccccctggggtttatgaacccgccta

SEQ ID NO: 266523 - DNA, 75 bp, Artificial Sequence
  Synthetic
aaaccacccccagagctccccccccgaacaagggaggaaaggctaacatcccaccaataccacccccaccgccca

SEQ ID NO: 266524 - DNA, 75 bp, Artificial Sequence
  Synthetic
aaaccaccaagaccaccaacaccggaattggtgaaaagaatacccccaccaccacccaacggcgaggatgaacca

SEQ ID NO: 266525 - DNA, 75 bp, Artificial Sequence
  Synthetic
aattggtgaaaagaatacccccaccaccacccaacggcgaggatgaaccaaaggtggtatatagggtgggagaag

SEQ ID NO: 266526 - DNA, 75 bp, Artificial Sequence
  Synthetic
gataatagggaagtggactacaatgaaaaactcagttttgaagccccaccaaccctctggagccgggttgtgaga

SEQ ID NO: 266527 - DNA, 75 bp, Artificial Sequence
  Synthetic
atgttccccccacacacaacaccgcctacagtgtcccccccctggatcagagggaaaagattgaagcgaaggagc

SEQ ID NO: 266528 - DNA, 75 bp, Artificial Sequence
  Synthetic
cgtgaattctttggggaacccatcgagtccattgcaatccatcgtgctggtgaattcacacaattcagattttca

SEQ ID NO: 266529 - DNA, 75 bp, Artificial Sequence
  Synthetic
ctacagtgtcccccccctggatcagagggaaaagattgaagcgaaggagcccttgacaggttcgatacttgagat

SEQ ID NO: 266530 - DNA, 75 bp, Artificial Sequence
  Synthetic
cccttgacaagaccactagttctggcttcccctaccacagaaggaagaatgacgactggaatggcaccacctttg

SEQ ID NO: 266531 - DNA, 75 bp, Artificial Sequence
  Synthetic
ttagccaaagagaggtcggcgaagctaaagaaccgctacctggatccattctggaaatgtgggatggtgagatct

SEQ ID NO: 266532 - DNA, 75 bp, Artificial Sequence
  Synthetic
taaagaaccgctacctggatccattctggaaatgtgggatggtgagatctaccactatgggctgtacgttgagcg

SEQ ID NO: 266533 - DNA, 75 bp, Artificial Sequence
  Synthetic
tgagggtgtcgtgtgttctattctcattaaacgtgactctggtgagctgctaccccttgctgtccgaatgggcgc

SEQ ID NO: 266534 - DNA, 75 bp, Artificial Sequence
  Synthetic
tgccataagctttgcacgcatagagctcacccccctctctctatactggagaacagtctacactccaccttacct

SEQ ID NO: 266535 - DNA, 75 bp, Artificial Sequence
  Synthetic
cttcccctaccacagaaggaagaatgacgactggaatggcaccacctttgttagggagttaggtgagcaggcggc

SEQ ID NO: 266536 - DNA, 75 bp, Artificial Sequence
  Synthetic
caaaccagagaaagtataccagaaagtgaaaaagcgcttgttatggggggcagacttgggcacggtagttcgggc

SEQ ID NO: 266537 - DNA, 75 bp, Artificial Sequence
  Synthetic
ctactggagagtggtttacactccccagtacttgatagccccggacactctgaagggcttgagtggagaatcatt

SEQ ID NO: 266538 - DNA, 75 bp, Artificial Sequence
  Synthetic
ggggatggatttaggtaccctaccaggtgattgtggtgccccttatgtgtacaaaaggaacaacgactgggtggt

SEQ ID NO: 266539 - DNA, 75 bp, Artificial Sequence
  Synthetic
ctccatggggagtcattcccatacacagcctttgacaacaattgctactccttctgctgttgggtcctggacctg

SEQ ID NO: 266540 - DNA, 75 bp, Artificial Sequence
  Synthetic
tgcacgggcttttggcccattctgtgatgctataaaatcccacacaatcaagttgcctatcaaagttggaatgaa

SEQ ID NO: 266541 - DNA, 75 bp, Artificial Sequence
  Synthetic
cagtacttgatagccccggacactctgaagggcttgagtggagaatcattcccatacacagcctttgacaacaac

SEQ ID NO: 266542 - DNA, 75 bp, Artificial Sequence
  Synthetic
ggtgattgtggtgccccttatgtgtacaaaaggaacaacgactgggtggtttgtggtgtacatgcagccgctaca

SEQ ID NO: 266543 - DNA, 75 bp, Artificial Sequence
  Synthetic
aagcctttaccaaccatggatgaaggaaagctcaagaaagtggccaatgtgcttctatgtggtctctctgggctt

SEQ ID NO: 266544 - DNA, 75 bp, Artificial Sequence
  Synthetic
ggcttcttcaggccgtaccaagattggaacagaaaacccctgccaaccatggatgagccaaaaattaagaaggcc

SEQ ID NO: 266545 - DNA, 75 bp, Artificial Sequence
  Synthetic
cactatgcaggtcatgaaataatcaaacatagtaagggcccagctctatctactaaaaccaagttttggagatca

SEQ ID NO: 266546 - DNA, 75 bp, Artificial Sequence
  Synthetic
ttgggactcaactcaaaataggcaaatcatgacagagtcattttcaatcatgtgtcggctaactgcatcacccga

SEQ ID NO: 266547 - DNA, 75 bp, Artificial Sequence
  Synthetic
ggaacagaaaacccctgccaaccatggatgagccaaaaattaagaaggccgcgaatgctattctgtgtgctatct

SEQ ID NO: 266548 - DNA, 75 bp, Artificial Sequence
  Synthetic
gaaagctcaagaaagtggccaatgtgcttctatgtggtctctctgggcttttcactaggcccatcaaggatctta

SEQ ID NO: 266549 - DNA, 75 bp, Artificial Sequence
  Synthetic
ctctcatactgcttgcagaactctttggagttttctggacaccaccagacatttccaccttcatagcttcacttc

SEQ ID NO: 266550 - DNA, 75 bp, Artificial Sequence
  Synthetic
cttgtgactggacttttgcaggcatagtggagtctcttattcttcttgctgaactttttggggtgttctggacac

SEQ ID NO: 266551 - DNA, 75 bp, Artificial Sequence
  Synthetic
tcgtgatccaagggtaaaaggcgggccctctctgcagcaggtcttgcgtgatcagctgaaaccatttgctgagcc

SEQ ID NO: 266552 - DNA, 75 bp, Artificial Sequence
  Synthetic
ttggcgactacgtcataagagtgaaggaaggcctcccatctggtttcccatgcacatcacaagttaatagtataa

SEQ ID NO: 266553 - DNA, 75 bp, Artificial Sequence
  Synthetic
atttccaccttcatagcttcacttctgggtgactatgaaatgcagggccctgaggatatcgcagttgaagtcgta

SEQ ID NO: 266554 - DNA, 75 bp, Artificial Sequence
  Synthetic
agtggagtctcttattcttcttgctgaactttttggggtgttctggacacccccagacgtgtctgcgatgattgc

SEQ ID NO: 266555 - DNA, 75 bp, Artificial Sequence
  Synthetic
ggatacaccaatcccctggtctttctctgatgcatgtcaatcacttgacaaaaccacaagttcgggacacccata

SEQ ID NO: 266556 - DNA, 75 bp, Artificial Sequence
  Synthetic
tgggtgactatgaaatgcagggccctgaggatatcgcagttgaagtcgtaccggtaatcctcggtggtataggca

SEQ ID NO: 266557 - DNA, 75 bp, Artificial Sequence
  Synthetic
gataggtttggtgttgggattcaccaaggagaagatcggcaagatgctttcatcagctgcatccacgcttaaggc

SEQ ID NO: 266558 - DNA, 75 bp, Artificial Sequence
  Synthetic
agatcggcaactatgggatagaggtggtgaagctggtgatgaaatggtttttccccaccaaagatgagacaaatg

SEQ ID NO: 266559 - DNA, 75 bp, Artificial Sequence
  Synthetic
ccgccccgacaaaagcgagggcccaataattgtaaggaagagtgtggatggtttggtcttcttacgtcgcactat

SEQ ID NO: 266560 - DNA, 75 bp, Artificial Sequence
  Synthetic
aatggaacttcatttgttggagagcttggagaacaggcagcacatgccaacaacatgtacgaattaggcaaatct

SEQ ID NO: 266561 - DNA, 75 bp, Artificial Sequence
  Synthetic
aaggagaagatcggcaagatgctttcatcagctgcatccacgcttaaggcctgcaaagatctaggagcctatgga

SEQ ID NO: 266562 - DNA, 75 bp, Artificial Sequence
  Synthetic
gccatcgaggatgcagtcctggatttagaggcaatagaaaacaaccacatgaccactctcctcaaggacaaagac

SEQ ID NO: 266563 - DNA, 75 bp, Artificial Sequence
  Synthetic
aggcttctctggggtgctgatctctcaacagttataagggctgccagggcctttggaccattttgtgatgctata

SEQ ID NO: 266564 - DNA, 75 bp, Artificial Sequence
  Synthetic
tgcttaaagacaaaaacagcctcgcaaccttcctcagggagctagatatggaagaggagaaggcgcggaagctat

SEQ ID NO: 266565 - DNA, 75 bp, Artificial Sequence
  Synthetic
ctttggaccattttgtgatgctataaagccccatgtcattaaactccccattaaagtcggtatgaactccataga

SEQ ID NO: 266566 - DNA, 75 bp, Artificial Sequence
  Synthetic
tagaggcaatagaaaacaaccacatgaccactctcctcaaggacaaagacagtctggctacatacatgaggactc

SEQ ID NO: 266567 - DNA, 75 bp, Artificial Sequence
  Synthetic
tagtccacaaggccaaggaagaaatgtcatctaggatgcgtcctgttgtcatcatgatctccggccgacccggga

SEQ ID NO: 266568 - DNA, 75 bp, Artificial Sequence
  Synthetic
cattattggcaaggattgcagccgctaggtcactagtccacaaggctaaggaggagctctcaagtagacagaggc

SEQ ID NO: 266569 - DNA, 75 bp, Artificial Sequence
  Synthetic
atgcagattattcggcctgggattccacgcaaaatagacagattatgactgaatcctttgcaatcatgtgccgcc

SEQ ID NO: 266570 - DNA, 75 bp, Artificial Sequence
  Synthetic
taggtcactagtccacaaggctaaggaggagctctcaagtagacagaggcctgtcgtcgtgatgatatctggcag

SEQ ID NO: 266571 - DNA, 75 bp, Artificial Sequence
  Synthetic
cacgcaaaatagacagattatgactgaatcctttgcaatcatgtgccgcctcacagcatcaccggaattggcttc

SEQ ID NO: 266572 - DNA, 75 bp, Artificial Sequence
  Synthetic
tcgtgccgagaaatggtgttgaccattgggatgcatataaaggagagaggatcgtactctgggatgattatggaa

SEQ ID NO: 266573 - DNA, 75 bp, Artificial Sequence
  Synthetic
ttgggatgcatataaaggagagaggatcgtactctgggatgattatggaatgagcaaccctgtaactgatgcgct

SEQ ID NO: 266574 - DNA, 75 bp, Artificial Sequence
  Synthetic
gattggactggtgcccagaaacggtgtagaccactgggacgcctacaagggggagagagtggtactatgggatga

SEQ ID NO: 266575 - DNA, 75 bp, Artificial Sequence
  Synthetic
gccatcaggattcccttgcacatcacaggtgaacagtataaaccactggctgatcacactgtgtgctatgtctga

SEQ ID NO: 266576 - DNA, 75 bp, Artificial Sequence
  Synthetic
gtagaccactgggacgcctacaagggggagagagtggtactatgggatgactatggcatgagcaaccccatacag

SEQ ID NO: 266577 - DNA, 75 bp, Artificial Sequence
  Synthetic
caggtgaacagtataaaccactggctgatcacactgtgtgctatgtctgaagtcacgggtttgtcacctgatgtc

SEQ ID NO: 266578 - DNA, 75 bp, Artificial Sequence
  Synthetic
tgacagtgacactataatcattaccaccaatttggccaatcctgctcctctagattatgtcaactttgaagcttg

SEQ ID NO: 266579 - DNA, 75 bp, Artificial Sequence
  Synthetic
agtttgttgtgtcccccctggcttcacgtcttcctctctcaccatagctcaggctacattgtttccccatgtgat

SEQ ID NO: 266580 - DNA, 75 bp, Artificial Sequence
  Synthetic
aaagtgtttgacagtgatgccataatcataacaaccaaccttgcaaatccagcaccgctggactatgtcaacttt

SEQ ID NO: 266581 - DNA, 75 bp, Artificial Sequence
  Synthetic
gggcgcggcctaaacagcctcccccgagggaaataccacaaagacccccacgaccacctactccagaactggtta

SEQ ID NO: 266582 - DNA, 75 bp, Artificial Sequence
  Synthetic
cgcctcacccaagtgcttaaggaatatgggttgagacccaccagaccagacaagtcagaagggcccatcatactc

SEQ ID NO: 266583 - DNA, 75 bp, Artificial Sequence
  Synthetic
tcataacaaccaaccttgcaaatccagcaccgctggactatgtcaactttgaggcttgctccagacgcatagact

SEQ ID NO: 266584 - DNA, 75 bp, Artificial Sequence
  Synthetic
accaatttggccaatcctgctcctctagattatgtcaactttgaagcttgctcccgccgaatcgacttcctcgtc

SEQ ID NO: 266585 - DNA, 75 bp, Artificial Sequence
  Synthetic
aaaccagacttttcacacataaaacttcagttggcaccacagggaggctttgataagaacgggaacacccctcat

SEQ ID NO: 266586 - DNA, 75 bp, Artificial Sequence
  Synthetic
ttcagttggcaccacagggaggctttgataagaacgggaacacccctcatgggaaaggtgtcatgaaaacactaa

SEQ ID NO: 266587 - DNA, 75 bp, Artificial Sequence
  Synthetic
atcactacagaccagactttacacacatcaaacttcagctagcaccacagggaggttttgacaagaatggcaaca

SEQ ID NO: 266588 - DNA, 75 bp, Artificial Sequence
  Synthetic
tgtggtggactcggggccctaaccatgatgatcccagtgaaactctgattccacacccccagaggaaagttcagc

SEQ ID NO: 266589 - DNA, 75 bp, Artificial Sequence
  Synthetic
catcaaacttcagctagcaccacagggaggttttgacaagaatggcaacaccccacatggtaaaggtgtagtgaa

SEQ ID NO: 266590 - DNA, 75 bp, Artificial Sequence
  Synthetic
gtttcttgttccttgtcccacctactatagaacagaagactcgggcttttactgtgcctaatatccccttgcaaa

SEQ ID NO: 266591 - DNA, 75 bp, Artificial Sequence
  Synthetic
atgggttgagacccaccagaccagacaagtcagaagggcccatcatactcagaagacaggtggatggtcttgttt

SEQ ID NO: 266592 - DNA, 75 bp, Artificial Sequence
  Synthetic
agttacccgtgtacaattttgaccacaacagggtggctgctttcaggagactggcagctgacaacaagtatgggc

SEQ ID NO: 266593 - DNA, 75 bp, Artificial Sequence
  Synthetic
actgtgcctaatatccccttgcaaaccttgtccaattctagatttccttccctcatccaggggatgatcctgtct

SEQ ID NO: 266594 - DNA, 75 bp, Artificial Sequence
  Synthetic
aggccctaatctaccaaccttcaattttgaccgcaacaagatcgctgccttcaggcaattggcagctgaaaacaa

SEQ ID NO: 266595 - DNA, 75 bp, Artificial Sequence
  Synthetic
gtatgtgccaggttggcaggccatgttccgctggatgcgcttccatgatctcggattgtggacaggagatcgcaa

SEQ ID NO: 266596 - DNA, 75 bp, Artificial Sequence
  Synthetic
tttgaccgcaacaagatcgctgccttcaggcaattggcagctgaaaacaaatatggtatggtggacacactgagg

SEQ ID NO: 266597 - DNA, 75 bp, Artificial Sequence
  Synthetic
caacagggtggctgctttcaggagactggcagctgacaacaagtatgggcttatggaaaccataaaggtgggcaa

SEQ ID NO: 266598 - DNA, 75 bp, Artificial Sequence
  Synthetic
tgatgatcccagtgaaactctgattccacacccccagaggaaagttcagcttatatcccttcttggtgaggcttc

SEQ ID NO: 266599 - DNA, 75 bp, Artificial Sequence
  Synthetic
agtctacaactcgatggcttacgacctcgactcgaacggatcagggagagtcaatgtcaaaaaggttgtagacca

SEQ ID NO: 266600 - DNA, 75 bp, Artificial Sequence
  Synthetic
gatggcgtctaaggacgctacaccaagcgcagatggcgccactggcgccggccagctggtaccggaggttaatac

SEQ ID NO: 266601 - DNA, 75 bp, Artificial Sequence
  Synthetic
tgccaaatagtgtacaacgggtgtacctacacaatggagtctgatgggagaggcaaggtctcagttgacaaggtg

SEQ ID NO: 266602 - DNA, 75 bp, Artificial Sequence
  Synthetic
caagatccaaaccaacaacgaactcaattccgcactcaacaacctgcgcggcgccagagtgagatactatgttaa

SEQ ID NO: 266603 - DNA, 75 bp, Artificial Sequence
  Synthetic
cctacacaatggagtctgatgggagaggcaaggtctcagttgacaaggtgcaaagcgcaacagtccaaactaaca

SEQ ID NO: 266604 - DNA, 75 bp, Artificial Sequence
  Synthetic
tgatccctggataatcaataattttgtgcaagcccctcagggcgagttcacaatatccccaaataatacccccgg

SEQ ID NO: 266605 - DNA, 75 bp, Artificial Sequence
  Synthetic
cagggttttgtaccacacctgggaagcatacagtttgatgaagtgttcaaccaccccacaggtgactacattggc

SEQ ID NO: 266606 - DNA, 75 bp, Artificial Sequence
  Synthetic
tctattctttattacaaattgctggtgcggcttttgtcacctcacgcattgtgaggcgcatgaacatctcgagcc

SEQ ID NO: 266607 - DNA, 75 bp, Artificial Sequence
  Synthetic
gttgaacgtcagcagcatctgggccagaccagaaaagcaagtggaggccactgaggaacccccatcccccccaac

SEQ ID NO: 266608 - DNA, 75 bp, Artificial Sequence
  Synthetic
cccatctttctcagatgtacaatggctgggtgggcaacatgcgagtacgtgttgttttggctggtaatgctttta

SEQ ID NO: 266609 - DNA, 75 bp, Artificial Sequence
  Synthetic
tgcggcttttgtcacctcacgcattgtgaggcgcatgaacatctcgagcctctggtcgaaaccgcctgttgaaga

SEQ ID NO: 266610 - DNA, 75 bp, Artificial Sequence
  Synthetic
agaccagaaaagcaagtggaggccactgaggaacccccatcccccccaactgaggactggactataaccccagca

SEQ ID NO: 266611 - DNA, 75 bp, Artificial Sequence
  Synthetic
tcatccctttcccaagcagctaatctggcccccccagtattcccccctggatttggtgaggctcttgtgtacttt

SEQ ID NO: 266612 - DNA, 75 bp, Artificial Sequence
  Synthetic
ggcctaagtgatgaggagtatgatgagtataaaagaatcagggaagagagacagggaaaatactccatagaagaa

SEQ ID NO: 266613 - DNA, 75 bp, Artificial Sequence
  Synthetic
tccagcagaccaagacctgtggtgttgatgatatcaggcagaccaggaatagggaagacccacctcgctagggaa

SEQ ID NO: 266614 - DNA, 75 bp, Artificial Sequence
  Synthetic
tatttccccatgttattgctgatgttaggactcttgatcctgtagaagtgccccttgaagatgttaggaatgtgt

SEQ ID NO: 266615 - DNA, 75 bp, Artificial Sequence
  Synthetic
catcaaagtggaaggaaagaaaggcaagaacaagtccggccggggtaagaaacacacagctttctcatctaaggg

SEQ ID NO: 266616 - DNA, 75 bp, Artificial Sequence
  Synthetic
ccccttgaagatgttaggaatgtgttgtatcataataatgatacccaacctaccatgcgcctcctttgcatgttg

SEQ ID NO: 266617 - DNA, 75 bp, Artificial Sequence
  Synthetic
aagaacaagtccggccggggtaagaaacacacagctttctcatctaagggcctcagtgatgaagagtacgatgag

SEQ ID NO: 266618 - DNA, 75 bp, Artificial Sequence
  Synthetic
agtataaaagaatcagggaagagagacagggaaaatactccatagaagaatacctccaggatagggatcggtatt

SEQ ID NO: 266619 - DNA, 75 bp, Artificial Sequence
  Synthetic
gaagagctagccattgccaaggccactgaagagaacttctgtgaggaggaagagatcaaaatccgtcagagaatt

SEQ ID NO: 266620 - DNA, 75 bp, Artificial Sequence
  Synthetic
ggtggctgggcgtgtgcttacttgcccaggccctgactttaacttcttattcctagttcctcctacagtcgagca

SEQ ID NO: 266621 - DNA, 75 bp, Artificial Sequence
  Synthetic
tctttcgtccgaccaggaaacaacgcaaagaagaaagggcaactctaggactggtcacaggcagtgaaataagga

SEQ ID NO: 266622 - DNA, 75 bp, Artificial Sequence
  Synthetic
accctggaggttacctcacctgtgtaccaaacggggtgggtgccgggcctcaacagcttcctcttaatggtgttt

SEQ ID NO: 266623 - DNA, 75 bp, Artificial Sequence
  Synthetic
ctgaagagaacttctgtgaggaggaagagatcaaaatccgtcagagaattttccgccccaccaaaaagcagcgga

SEQ ID NO: 266624 - DNA, 75 bp, Artificial Sequence
  Synthetic
ctggtcacaggcagtgaaataaggaagaggaacccagacgatttcaagccaagaggaaaattgtgggctgatgat

SEQ ID NO: 266625 - DNA, 75 bp, Artificial Sequence
  Synthetic
ccaggccctgactttaacttcttattcctagttcctcctacagtcgagcaaaagactcgcccttttactgtgcct

SEQ ID NO: 266626 - DNA, 75 bp, Artificial Sequence
  Synthetic
aagggaaactgtgggctgatgataacaggagtgtggactacaatgagaggatagattttgaagcgccccctagcg

SEQ ID NO: 266627 - DNA, 75 bp, Artificial Sequence
  Synthetic
acccaaaatgttcaattccagaatggtaggtgtacaattgacggtcagcccctcgggaccacacctgtctcagtt

SEQ ID NO: 266628 - DNA, 75 bp, Artificial Sequence
  Synthetic
cctttggtcccgaatagtcaacttcggatcaggttggggtttttgggtttcttccaacttgctcatcacatcaac

SEQ ID NO: 266629 - DNA, 75 bp, Artificial Sequence
  Synthetic
caggagtgtggactacaatgagaggatagattttgaagcgccccctagcgtttggtcaaggatagtcaactttgg

SEQ ID NO: 266630 - DNA, 75 bp, Artificial Sequence
  Synthetic
ggatcaggttggggtttttgggtttcttccaacttgctcatcacatcaacacatgtcatccccccgaacatgact

SEQ ID NO: 266631 - DNA, 75 bp, Artificial Sequence
  Synthetic
aacaagacttagccctgcaaaggaatacttttgaacatgataaagatatgctttcctaccaggttcaggcaagta

SEQ ID NO: 266632 - DNA, 75 bp, Artificial Sequence
  Synthetic
gtaggtgtacaattgacggtcagcccctcgggaccacacctgtctcagttagccagttatgtaagtttaggggta

SEQ ID NO: 266633 - DNA, 75 bp, Artificial Sequence
  Synthetic
ggcgtttggggtgcccatgagccaaatccaaattcacaaatcaggggaattctgccgcttacggttcccaaaacc

SEQ ID NO: 266634 - DNA, 75 bp, Artificial Sequence
  Synthetic
gctataagacctgatgtctcaggcatgatccttgaagagggagctcccgagggaacggtggtgaccatactgatc

SEQ ID NO: 266635 - DNA, 75 bp, Artificial Sequence
  Synthetic
tacccgctattctatgcttattgcaggaggtctttctagtgctgatgcttcacgggctgttgctggagccccagt

SEQ ID NO: 266636 - DNA, 75 bp, Artificial Sequence
  Synthetic
cccccgcgggctttccagatctcgggtcttgtgattggcatattgaaatgagtaaaattccaaactccagcaccc

SEQ ID NO: 266637 - DNA, 75 bp, Artificial Sequence
  Synthetic
atccaaattcacaaatcaggggaattctgccgcttacggttcccaaaaccaatcaggccagacgtgagtgggatg

SEQ ID NO: 266638 - DNA, 75 bp, Artificial Sequence
  Synthetic
tgatccttgaagagggagctcccgagggaacggtggtgaccatactgatcaagaggaccaccggtgagctcatgc

SEQ ID NO: 266639 - DNA, 75 bp, Artificial Sequence
  Synthetic
gtcttgtgattggcatattgaaatgagtaaaattccaaactccagcacccagaataatccaatagtagttaattc

SEQ ID NO: 266640 - DNA, 75 bp, Artificial Sequence
  Synthetic
cttgcagccagaatgggaacccacgccacaatgaaaatccagggaagaacggtgggtggtcagatgggcatgtta

SEQ ID NO: 266641 - DNA, 75 bp, Artificial Sequence
  Synthetic
tcctcacggggtccaacgccaagaacatggacctcggtaccattcctggagactgtggttgtccctatgtgtaca

SEQ ID NO: 266642 - DNA, 75 bp, Artificial Sequence
  Synthetic
caacccaaatctaagaccccacaatcctctgggttctctaatcctgcttatgatatgtccacagtttcctctagg

SEQ ID NO: 266643 - DNA, 75 bp, Artificial Sequence
  Synthetic
tgactatattggcactatacaatggacctctcctccttctgattccggcggagccaacacaaatttttggaagat

SEQ ID NO: 266644 - DNA, 75 bp, Artificial Sequence
  Synthetic
ccacaatgaaaatccagggaagaacggtgggtggtcagatgggcatgttactcacaggttcaaatgccaaaagca

SEQ ID NO: 266645 - DNA, 75 bp, Artificial Sequence
  Synthetic
ggtggcaacactgtgatttgcgccactcaggggccagatggtgaggccacgcttgaggggggagacaaccacggg

SEQ ID NO: 266646 - DNA, 75 bp, Artificial Sequence
  Synthetic
cctctgggttctctaatcctgcttatgatatgtccacagtttcctctaggacttcttcttgggtgcagtcacaaa

SEQ ID NO: 266647 - DNA, 75 bp, Artificial Sequence
  Synthetic
gcgtgcacactgcagcagcacgtggaggaaacacagtcatatgtgccacgcaaggaagcgaaggtgaagccactc

SEQ ID NO: 266648 - DNA, 75 bp, Artificial Sequence
  Synthetic
cctggtcccaatcaatctggttcccccaatttggtgccatgccttctcccccaggaatatataacacattttatc

SEQ ID NO: 266649 - DNA, 75 bp, Artificial Sequence
  Synthetic
aggaaacacagtcatatgtgccacgcaaggaagcgaaggtgaagccactcttgagggaggtgacgacaagggcac

SEQ ID NO: 266650 - DNA, 75 bp, Artificial Sequence
  Synthetic
tcacactactcatcaaaaggtccactggggaactcatgcccctagcagctaggatggggacccatgcaaccatga

SEQ ID NO: 266651 - DNA, 75 bp, Artificial Sequence
  Synthetic
ccaggaatatataacacattttatcagtgagcaggcccccattcagggtgaggctgccttactccattatgtaga

SEQ ID NO: 266652 - DNA, 75 bp, Artificial Sequence
  Synthetic
cttatgagcctgcctacctaggcggaaaagacccaagagtcaaggggggaccatcactacagcaagtcatgaggg

SEQ ID NO: 266653 - DNA, 75 bp, Artificial Sequence
  Synthetic
ctcaggggccagatggtgaggccacgcttgaggggggagacaaccacgggacttactgtggagcgccaatacttg

SEQ ID NO: 266654 - DNA, 75 bp, Artificial Sequence
  Synthetic
caacgcaccgctcccgccaggcacctatgaaccagcatacctaggtgggaaagatccacgtgtgaagggcggtcc

SEQ ID NO: 266655 - DNA, 75 bp, Artificial Sequence
  Synthetic
aacaactcaaaccttttactgccccccgagggaagccaccacgaccggcgatcctggaggctgctaaggaaacca

SEQ ID NO: 266656 - DNA, 75 bp, Artificial Sequence
  Synthetic
tagtactggacctcaacagcttcctcttgatggtgtgtttgtctttgcttcttgggtttctagattttatcaatt

SEQ ID NO: 266657 - DNA, 75 bp, Artificial Sequence
  Synthetic
cttgatggtgtgtttgtctttgcttcttgggtttctagattttatcaattaaagcctgtgggaacagccggaccg

SEQ ID NO: 266658 - DNA, 75 bp, Artificial Sequence
  Synthetic
tatgaaccagcatacctaggtgggaaagatccacgtgtgaagggcggtccgtctctgcaacaggtcatgagagac

SEQ ID NO: 266659 - DNA, 75 bp, Artificial Sequence
  Synthetic
atcaatgttctagagcaggttattgaccccccccagaagtggtcctatgcccaagcttgtgcatcccttgacaaa

SEQ ID NO: 266660 - DNA, 75 bp, Artificial Sequence
  Synthetic
aaacaacatccagtggccatccccaccatatgaaaaagaatgacaactggaacggagagtctttcaccggtgtgt

SEQ ID NO: 266661 - DNA, 75 bp, Artificial Sequence
  Synthetic
gtgccctgggtgctggcattcaggctggtgctgaagctgcattacaggcacagagatatcaacaagatttaactt

SEQ ID NO: 266662 - DNA, 75 bp, Artificial Sequence
  Synthetic
accccccccagaagtggtcctatgcccaagcttgtgcatcccttgacaaaacaacttccagtggatacccgcatc

SEQ ID NO: 266663 - DNA, 75 bp, Artificial Sequence
  Synthetic
tggtgctgaagctgcattacaggcacagagatatcaacaagatttaactttacagcagaattctttcaatcatga

SEQ ID NO: 266664 - DNA, 75 bp, Artificial Sequence
  Synthetic
tcaaagacgagctcgtcaagactagcaagatctatgagaaaattaagaagagactcctatggggttcagatctgg

SEQ ID NO: 266665 - DNA, 75 bp, Artificial Sequence
  Synthetic
tcatgtacgaagaaggcaaacacatgccaccggtttacaccgcagcgctcaaggatgagctggtgaaaactgaca

SEQ ID NO: 266666 - DNA, 75 bp, Artificial Sequence
  Synthetic
gccaccggtttacaccgcagcgctcaaggatgagctggtgaaaactgacaaaatctatggcaaaattaagaaaag

SEQ ID NO: 266667 - DNA, 75 bp, Artificial Sequence
  Synthetic
tctccaggcgggtggtctctccccctctgatgcggctagggctgtggccggggcccctgtcactaggttggttga

SEQ ID NO: 266668 - DNA, 75 bp, Artificial Sequence
  Synthetic
tcagagttggcatgaatatgaatgaagatggacccatcattttcgagaaacattcaaagtataagtaccattatg

SEQ ID NO: 266669 - DNA, 75 bp, Artificial Sequence
  Synthetic
agatggacccatcattttcgagaaacattcaaagtataagtaccattatgatgctgactactctaggtgggactc

SEQ ID NO: 266670 - DNA, 75 bp, Artificial Sequence
  Synthetic
agcaaattgtatcacacttcctgtcagagttggcatgaacatgaatgaagatggtcccataatatttgagaaaca

SEQ ID NO: 266671 - DNA, 75 bp, Artificial Sequence
  Synthetic
actcccagcccagccaaagcagaaacctcttgctagtgagggatattccaatccagcttatgaccctatgcagcg

SEQ ID NO: 266672 - DNA, 75 bp, Artificial Sequence
  Synthetic
agagttggcatgaacatgaatgaagatggtcccataatatttgagaaacattccagatacagataccactatgat

SEQ ID NO: 266673 - DNA, 75 bp, Artificial Sequence
  Synthetic
aattgtatctgaagatctcctagcccccagcgtggtggacgttggcgacttcaaaatcaccataaatgaaggttt

SEQ ID NO: 266674 - DNA, 75 bp, Artificial Sequence
  Synthetic
cccagcgtggtggacgttggcgacttcaaaatcaccataaatgaaggtttaccctctggagtaccgtgcacatca

SEQ ID NO: 266675 - DNA, 75 bp, Artificial Sequence
  Synthetic
gtgggtgaccccccctggttctacttcttcttcttctgtttctactgcccctcgagggtattttaatacagatag

SEQ ID NO: 266676 - DNA, 75 bp, Artificial Sequence
  Synthetic
tctgctgaaccacagctagcacaaatagtagctgaagacctgctagcaccaagtgtggttgatgtgggtgacttc

SEQ ID NO: 266677 - DNA, 75 bp, Artificial Sequence
  Synthetic
tagtagctgaagacctgctagcaccaagtgtggttgatgtgggtgacttcaagatcaccattaatgagggcctac

SEQ ID NO: 266678 - DNA, 75 bp, Artificial Sequence
  Synthetic
cgctaatgttgtaataagattagtgagcatcctattcaatttttggcttcatataatttgattgtatttggcttt

SEQ ID NO: 266679 - DNA, 75 bp, Artificial Sequence
  Synthetic
gtacaaacaaactcctgtttctccttctatggggatgatgagatagtcagcactgacattaagttggatcccatg

SEQ ID NO: 266680 - DNA, 75 bp, Artificial Sequence
  Synthetic
tctatggggatgatgagatagtcagcactgacattaagttggatcccatgaaactaaccaacaagttgaaagagt

SEQ ID NO: 266681 - DNA, 75 bp, Artificial Sequence
  Synthetic
tgacaggactaggccccgacatcatacaagctaattccatgtactctttctatggtgatgatgagattgtaagca

SEQ ID NO: 266682 - DNA, 75 bp, Artificial Sequence
  Synthetic
acaagctaattccatgtactctttctatggtgatgatgagattgtaagcactgacataaaattggacccagagaa

SEQ ID NO: 266683 - DNA, 75 bp, Artificial Sequence
  Synthetic
tcttgaggagggatgtgtgtcgggacccagctggttggtatggaaaacttgatcaatcctcaatcatgagacaat

SEQ ID NO: 266684 - DNA, 75 bp, Artificial Sequence
  Synthetic
cccagctggttggtatggaaaacttgatcaatcctcaatcatgagacaattgttttggaccaaggggcccaacca

SEQ ID NO: 266685 - DNA, 75 bp, Artificial Sequence
  Synthetic
tgaagacctgaatggtttaacgttcctccgccgaacagtcacccgtgacccagcaggttggtttggaaagctgga

SEQ ID NO: 266686 - DNA, 75 bp, Artificial Sequence
  Synthetic
gatcaatcctcaatcatgagacaattgttttggaccaaggggcccaaccatgatgaccccaatgagacaatgatt

SEQ ID NO: 266687 - DNA, 75 bp, Artificial Sequence
  Synthetic
acatgcgcagagacccgtgcagctcatggcactactgggagaatcctccctgcatggaccctcattctacagcaa

SEQ ID NO: 266688 - DNA, 75 bp, Artificial Sequence
  Synthetic
aaagtcagtaaattagttatcactgagctcaaagagggtgggatggatttctacgtgccaaggcaggaacctatg

SEQ ID NO: 266689 - DNA, 75 bp, Artificial Sequence
  Synthetic
gatggcgtcgaatgacgccgctccatctactgatggtgcagccggcctcgtgccagaaagtaacaatgaggttat

SEQ ID NO: 266690 - DNA, 75 bp, Artificial Sequence
  Synthetic
taatgctggggacgatgtcttcacagtttcttgtcgagttctcacgagaccatcccccgattttgatttcatatt

SEQ ID NO: 266691 - DNA, 75 bp, Artificial Sequence
  Synthetic
gctttagcagccccggttactggccaaacaaatattatagacccttggatcagagcaaattttgtccaggccccc

SEQ ID NO: 266692 - DNA, 75 bp, Artificial Sequence
  Synthetic
aaacaaatattatagacccttggatcagagcaaattttgtccaggcccccaatggtgaattcaccgtttcccccc

SEQ ID NO: 266693 - DNA, 75 bp, Artificial Sequence
  Synthetic
tgaataattttgtgcaagcacctggtggtgagtttacagtgtcacctaggaattcccctggtgaagtgcttctta

SEQ ID NO: 266694 - DNA, 75 bp, Artificial Sequence
  Synthetic
ggatgtacaacggttatgctggtggtatggaggtgcaggtcatgctagctggaaatgcgtttacagctggaaaat

SEQ ID NO: 266695 - DNA, 75 bp, Artificial Sequence
  Synthetic
tatggaggtgcaggtcatgctagctggaaatgcgtttacagctggaaaattggtctttgccgccgtaccacccca

SEQ ID NO: 266696 - DNA, 75 bp, Artificial Sequence
  Synthetic
ttgaagtgcaagtggtcctagctggaaatgcgtttacggcaggaaaggttatctttgcagctataccccctaatt

SEQ ID NO: 266697 - DNA, 75 bp, Artificial Sequence
  Synthetic
aaatgcgtttacggcaggaaaggttatctttgcagctataccccctaatttccctattgacaatctgagcgcggc

SEQ ID NO: 266698 - DNA, 75 bp, Artificial Sequence
  Synthetic
agttcaatttgccactgacacagacaatgattttgatgctaaccaaaacacaaagttcaccccagtcggtgttat

SEQ ID NO: 266699 - DNA, 75 bp, Artificial Sequence
  Synthetic
acctgttttattaccactccctgatgttaggaacaactttttccattataatcagaaagatgaccctaaaatgag

SEQ ID NO: 266700 - DNA, 75 bp, Artificial Sequence
  Synthetic
gttaggaacaactttttccattataatcagaaagatgaccctaaaatgaggattgtggccatgctctacaccccc

SEQ ID NO: 266701 - DNA, 75 bp, Artificial Sequence
  Synthetic
ccgcaacaatttctttcattataatcaaggttctgattcaagattacgtttgattgcaatgttgtatacacctct

SEQ ID NO: 266702 - DNA, 75 bp, Artificial Sequence
  Synthetic
caaggttctgattcaagattacgtttgattgcaatgttgtatacacctcttagggcaaataattctggagatgat

SEQ ID NO: 266703 - DNA, 75 bp, Artificial Sequence
  Synthetic
cctcaccaccttcaactttgatcgcaacaaagtgcttgcctttaggcaacttgctgctgaaaacaaatatgggtt

SEQ ID NO: 266704 - DNA, 75 bp, Artificial Sequence
  Synthetic
gacttcacatatctggtaccaccaacagtggagtccaaaacaaaaccattcaccctaccaatcctcacacttggt

SEQ ID NO: 266705 - DNA, 75 bp, Artificial Sequence
  Synthetic
cagtggagtccaaaacaaaaccattcaccctaccaatcctcacacttggtgaattgtccaattccagatttcctg

SEQ ID NO: 266706 - DNA, 75 bp, Artificial Sequence
  Synthetic
gtggaatcaaagacaaagctttttaccctccccattttaaccatctctgaaatgtccaattccaggtttccagtt

SEQ ID NO: 266707 - DNA, 75 bp, Artificial Sequence
  Synthetic
ccctccccattttaaccatctctgaaatgtccaattccaggtttccagttccaattgactctttacacaccagcc

SEQ ID NO: 266708 - DNA, 75 bp, Artificial Sequence
  Synthetic
atggggagcttcaaggaacaacacagctccaggttagtggtatctgtgtattcaagggagaggtgactgctcact

SEQ ID NO: 266709 - DNA, 75 bp, Artificial Sequence
  Synthetic
gctccaggttagtggtatctgtgtattcaagggagaggtgactgctcacttgcacgataatgaccacctttacaa

SEQ ID NO: 266710 - DNA, 75 bp, Artificial Sequence
  Synthetic
tcttaccgagccaaatatgtgctttcaggggcacactcactagatcaacaagcagggccagcgaccaaaccgaca

SEQ ID NO: 266711 - DNA, 75 bp, Artificial Sequence
  Synthetic
caggggcacactcactagatcaacaagcagggccagcgaccaaaccgacacaccaacccctaggctattcaacca

SEQ ID NO: 266712 - DNA, 75 bp, Artificial Sequence
  Synthetic
ttttcaaggaagagtttttggtgttatcagccaaagagacaaccataacgccagtgggcacaatcaacccgcaaa

SEQ ID NO: 266713 - DNA, 75 bp, Artificial Sequence
  Synthetic
atcagccaaagagacaaccataacgccagtgggcacaatcaacccgcaaacagaggccacgatgccgtggttccc

SEQ ID NO: 266714 - DNA, 75 bp, Artificial Sequence
  Synthetic
cacaccagacttccggggtaaggtctttggcgtggccagccagagaaaccccgacagcacaacaagggcacatga

SEQ ID NO: 266715 - DNA, 75 bp, Artificial Sequence
  Synthetic
tttggcgtggccagccagagaaaccccgacagcacaacaagggcacatgaagcaaaagtggacacaacatctggc

SEQ ID NO: 266716 - DNA, 75 bp, Artificial Sequence
  Synthetic
aatcagcctgttaaattcaccccagttggccttaatgatgtggaacatttcaaccaatgggtggttcccagatat

SEQ ID NO: 266717 - DNA, 75 bp, Artificial Sequence
  Synthetic
ttggccttaatgatgtggaacatttcaaccaatgggtggttcccagatatgctggtgctctaaacctaaatacaa

SEQ ID NO: 266718 - DNA, 75 bp, Artificial Sequence
  Synthetic
ttcaccccagttggcatcggggttgacaatgaggcagaatttcagcaatggtccttacccaactattctggtcag

SEQ ID NO: 266719 - DNA, 75 bp, Artificial Sequence
  Synthetic
acaatgaggcagaatttcagcaatggtccttacccaactattctggtcagtttactcataacatgaacttagccc

SEQ ID NO: 266720 - DNA, 75 bp, Artificial Sequence
  Synthetic
gtggttatggtaacccagtcatcgactgcctgctaccacaggaatgggtgcaacacttttatcaggaggccgccc

SEQ ID NO: 266721 - DNA, 75 bp, Artificial Sequence
  Synthetic
ctgcctgctaccacaggaatgggtgcaacacttttatcaggaggccgccccttcaatgagtgaggtagctcttgt

SEQ ID NO: 266722 - DNA, 75 bp, Artificial Sequence
  Synthetic
ctaacggggttctagactgcttggtcccccaggaatgggttcaacacttttaccaagaatcagcccccgcccaaa

SEQ ID NO: 266723 - DNA, 75 bp, Artificial Sequence
  Synthetic
aagcaacaccagcgccccagtggtggtgcccgccaacgggtattttagatttgattcttgggttaatcagtttta

SEQ ID NO: 266724 - DNA, 75 bp, Artificial Sequence
  Synthetic
gtgcccgccaacgggtattttagatttgattcttgggttaatcagttttactctcttgcccccatgggaactggg

SEQ ID NO: 266725 - DNA, 75 bp, Artificial Sequence
  Synthetic
gttttatgactatagcaaagaatggtgactccccaataactgtccctccaaatggatactttagatttgaatctt

SEQ ID NO: 266726 - DNA, 75 bp, Artificial Sequence
  Synthetic
aatggatactttagatttgaatcttgggttaaccccttttatacacttgcccccatgggaactggaaacgggcgt

SEQ ID NO: 266727 - DNA, 75 bp, Artificial Sequence
  Synthetic
ttccctcttctccttttatggtgatgatgaaatcgttagcacagacataaaattggacccagagaagttgacagc

SEQ ID NO: 266728 - DNA, 75 bp, Artificial Sequence
  Synthetic
tagggtctttagttggtgcaggggctaatgcaattaatcagaaagttgattttgagaataataaatatttgcaaa

SEQ ID NO: 266729 - DNA, 75 bp, Artificial Sequence
  Synthetic
taatgcaattaatcagaaagttgattttgagaataataaatatttgcaaaatgcatcatttgctcatgataagga

SEQ ID NO: 266730 - DNA, 75 bp, Artificial Sequence
  Synthetic
tggttaatgcaggggccgatgctattaatcaaaaagtcgattttgaaaataataaatatttgcaaaatgcttctt

SEQ ID NO: 266731 - DNA, 75 bp, Artificial Sequence
  Synthetic
cgctggcggcttctcccccgctgacgccgcaagaggtgcaatcaacgcacccatgactaaggttctagattggaa

SEQ ID NO: 266732 - DNA, 75 bp, Artificial Sequence
  Synthetic
tgcacaaattgaggcaacaaagaggctgcaggctgacatgattgcaatcaaacaaggggtcttgaccgctggcgg

SEQ ID NO: 266733 - DNA, 75 bp, Artificial Sequence
  Synthetic
gccgcaagaggtgcaatcaacgcacccatgactaaggttctagattggaatggcacacggtactgggcaccaggc

SEQ ID NO: 266734 - DNA, 75 bp, Artificial Sequence
  Synthetic
gtactgggcaccaaacgccgccttcacaacttcaatgtcaggtggcttcacaagccaagttgtgcacagaaccac

SEQ ID NO: 266735 - DNA, 75 bp, Artificial Sequence
  Synthetic
tcccagacatctagacctgctctcagtagtgggtcatctgtgaggtcaaactcgacccagattaccagcttgagt

SEQ ID NO: 266736 - DNA, 75 bp, Artificial Sequence
  Synthetic
acaacttcaatgtcaggtggcttcacaagccaagttgtgcacagaaccacaccagatcttaaaacgagccaggcc

SEQ ID NO: 266737 - DNA, 75 bp, Artificial Sequence
  Synthetic
gtagtgggtcatctgtgaggtcaaactcgacccagattaccagcttgagttctcactcttcagggtcttcacgat

SEQ ID NO: 266738 - DNA, 75 bp, Artificial Sequence
  Synthetic
tccgggtcgtcccgatccagtgggtctacggttgtcagctcgctgccgtcctccagtaggactagggactgggtc

SEQ ID NO: 266739 - DNA, 75 bp, Artificial Sequence
  Synthetic
atttggaaccctacttgcctgggtccctcaggacagcctttgtcactccaccttcaagcattgcttctagtgcag

SEQ ID NO: 266740 - DNA, 75 bp, Artificial Sequence
  Synthetic
ctacggttgtcagctcgctgccgtcctccagtaggactagggactgggtcaaccaacaaaatctcaatttggaac

SEQ ID NO: 266741 - DNA, 75 bp, Artificial Sequence
  Synthetic
gttcaacacccgcaagcagccgctttttgctcaccttcgaagaaggggggagtcaaatgtttagtgaaaagatta

SEQ ID NO: 266742 - DNA, 75 bp, Artificial Sequence
  Synthetic
caaccgtgcccaaaaatgttttggactcctggacatctgcgtttaacacgcgcagacagccgctgtttgcacacc

SEQ ID NO: 266743 - DNA, 75 bp, Artificial Sequence
  Synthetic
cgcagacagccgctgtttgcacaccttcgtagaaggggggagtcaaatgtttagtgaaaagattattcctaaatt

SEQ ID NO: 266744 - DNA, 75 bp, Artificial Sequence
  Synthetic
aagtgacggagtactttctagtatggctgtcacctttaaacgagccctcggggcgcggcctaagcagccgccccc

SEQ ID NO: 266745 - DNA, 75 bp, Artificial Sequence
  Synthetic
gggcgcggcctaagcagccgcccccgagggagataccacaaagacccccacgaccgcccactccggagttgatca

SEQ ID NO: 266746 - DNA, 75 bp, Artificial Sequence
  Synthetic
gagggagataccacaaagacccccacgaccgcccactccggagttgatcaagaaggtccctccccccccgcccaa

SEQ ID NO: 266747 - DNA, 75 bp, Artificial Sequence
  Synthetic
gcaaccagatgagaacaacacggcatttagtgtccccccacttaaccaaagggagaacagggatgccaaggagcc

SEQ ID NO: 266748 - DNA, 75 bp, Artificial Sequence
  Synthetic
gggagaacagggatgccaaggagccactaactggaacaatcctggagatgtgggatggggagatctaccactatg

SEQ ID NO: 266749 - DNA, 75 bp, Artificial Sequence
  Synthetic
ttacaccactctctttgttttggagacctgtctacactccccagtacctcatctccccagacacccttaggagat

SEQ ID NO: 266750 - DNA, 75 bp, Artificial Sequence
  Synthetic
acctgtctacactccccagtacctcatctccccagacacccttaggagattgcatggtgaatcgttcccttacac

SEQ ID NO: 266751 - DNA, 75 bp, Artificial Sequence
  Synthetic
ggtgcatatgggctagagatcctaaagttggtcatgaagtggttcttcccgaagaaggaggaggcaaatgagctg

SEQ ID NO: 266752 - DNA, 75 bp, Artificial Sequence
  Synthetic
gatacagaggacaactggcttcttcagaccttaccaggattggaacaggaagccccttcccaccatggatgattc

SEQ ID NO: 266753 - DNA, 75 bp, Artificial Sequence
  Synthetic
caaattaaagaaagtggccaacatattcctgtgtgctttatcttcactattcactagacctatcaaggacataat

SEQ ID NO: 266754 - DNA, 75 bp, Artificial Sequence
  Synthetic
tgtctgcgatgattgcccccttactgggtgactacgaactgcaggggcctgaggacctcgcagtagagctagtgc

SEQ ID NO: 266755 - DNA, 75 bp, Artificial Sequence
  Synthetic
ggctactccatgagaggttagatgaatttgaactacagggcccagctctcaccaccttcaatttcgatcgcaata

SEQ ID NO: 266756 - DNA, 75 bp, Artificial Sequence
  Synthetic
catccacactgagggcctgtaaagaccttggtgcatatgggctggagatcttaaaactagtcatgaagtggttct

SEQ ID NO: 266757 - DNA, 75 bp, Artificial Sequence
  Synthetic
ccttggtgcatatgggctggagatcttaaaactagtcatgaagtggttcttcccgaagaaagaggaggcgagtga

SEQ ID NO: 266758 - DNA, 75 bp, Artificial Sequence
  Synthetic
ccttggtgcatacggactggaaatcttaaaattggtcatgaagtggttcttcccaaagaaagaggaagcaaatga

SEQ ID NO: 266759 - DNA, 75 bp, Artificial Sequence
  Synthetic
gcttaaggacaaggacagcctggcaacttacatgagaactcttgaccttgaggaagagaaagccaggaaactctc

SEQ ID NO: 266760 - DNA, 75 bp, Artificial Sequence
  Synthetic
acttacatgagaactcttgaccttgaggaagagaaagccaggaaactctcaaccaagtctgcctcacctgacatc

SEQ ID NO: 266761 - DNA, 75 bp, Artificial Sequence
  Synthetic
tccagcaggccgagacccgttgtcgtgatgatatcaggaaaaccaggaatagggaagacccaccttgccagagag

SEQ ID NO: 266762 - DNA, 75 bp, Artificial Sequence
  Synthetic
caccaaagccaagtgtgttggaagctgccaagaaaaccatcatcaatgtccttgagcaaacaattgatccacctg

SEQ ID NO: 266763 - DNA, 75 bp, Artificial Sequence
  Synthetic
gtcctgacttctcacacataaaactgtcattggctccacagggtggttttgataagaacggcaacaccccgcatg

SEQ ID NO: 266764 - DNA, 75 bp, Artificial Sequence
  Synthetic
tgggacgcgtacaagggagagagggtcgtcctttgggatgactacggtatgagtaatcccatccacgatgccctc

SEQ ID NO: 266765 - DNA, 75 bp, Artificial Sequence
  Synthetic
gccccctaacactaaattgtgacaggattgagaacaaaggtaaagtttttgacagtgatgctataattatcacca

SEQ ID NO: 266766 - DNA, 75 bp, Artificial Sequence
  Synthetic
tggggacccatgcgaccatgaagatccaagggcgcactgttggaggccagatgggcatgcttctgacaggatcca

SEQ ID NO: 266767 - DNA, 75 bp, Artificial Sequence
  Synthetic
gaaagttgacaaagtgcaaagtgccactgtgcagaccaacaatgaactagccggtgccctacaccacctaaggtg

SEQ ID NO: 266768 - DNA, 75 bp, Artificial Sequence
  Synthetic
cctgatatgtggaagaatgccttcagccctgacttctctcacataaagctgatgctggccccgcagggtggcttt

SEQ ID NO: 266769 - DNA, 75 bp, Artificial Sequence
  Synthetic
gatgaaattgttagcacagacataaaattggacccagagaagttgacagcaaagctcagggaatatgggttaaag

SEQ ID NO: 266770 - DNA, 75 bp, Artificial Sequence
  Synthetic
ggaagggtgtcatgaagaccctcaccatcggttctctcatcgcccgtgcttcaggactcctccatgaaaggctgg

SEQ ID NO: 266771 - DNA, 75 bp, Artificial Sequence
  Synthetic
cagagacaggtactacgaggaggtggccattgccagggcaaccgaagaggacttctgtgaagaagaagaggccaa

SEQ ID NO: 266772 - DNA, 75 bp, Artificial Sequence
  Synthetic
caactcaagggcgtcagaaccatgccagagctcaagcaagcactcaagaacatctcaattaagaggtgccagata

SEQ ID NO: 266773 - DNA, 75 bp, Artificial Sequence
  Synthetic
cagagctcaagcaagcactcaagaacatctcaattaagaggtgccagatagtgtatggtggcagcacctacacac

SEQ ID NO: 266774 - DNA, 75 bp, Artificial Sequence
  Synthetic
ccggcgccctgcatcatctcaggtgcgccaggatcaggtactatgtcaagtgtgtccaggaagctctgtactcca

SEQ ID NO: 266775 - DNA, 75 bp, Artificial Sequence
  Synthetic
agttttggagatcatccacaacaccactcccacctggcacctacgaaccagcctacctcggtggcaaagacccta

SEQ ID NO: 266776 - DNA, 75 bp, Artificial Sequence
  Synthetic
tgtcaccacgcgcattgtcaagcgcatgaacatacaggatctatggtccaagccacaactggaggacacggaaga

SEQ ID NO: 266777 - DNA, 75 bp, Artificial Sequence
  Synthetic
ctcttctctttttatggtgatgatgaaattgttagcacagacataaaattggacccagagaaattgacagcaaag

SEQ ID NO: 266778 - DNA, 75 bp, Artificial Sequence
  Synthetic
gtctcttgtcgagttctcacgagaccatcccccgattttgatttcatatttttggtgccacccacagttgagtca

SEQ ID NO: 266779 - DNA, 75 bp, Artificial Sequence
  Synthetic
actggtcgcggcaagaagcacacagccttctcgagtaaaggtctcagtgatgaggagtacgacgagtacaaaaga

SEQ ID NO: 266780 - DNA, 75 bp, Artificial Sequence
  Synthetic
atcagggaggaaagaaacggcaagtattctatagaggagtacctccaagacagagacaagtattatgaggaggtt

SEQ ID NO: 266781 - DNA, 75 bp, Artificial Sequence
  Synthetic
tggaaaactggagcagagttcaatactcaggcaaatgtactggactaggggtcccaaccatggagacccatctga

SEQ ID NO: 266782 - DNA, 75 bp, Artificial Sequence
  Synthetic
gccatcgccagggcgactgaagaggatttctgtgaagaggaagaggccaagatccgacagagaatctttagacca

SEQ ID NO: 266783 - DNA, 75 bp, Artificial Sequence
  Synthetic
atttctgtgaagaggaagaggccaagatccgacagagaatctttagaccaacaaggaaacaacgcaaggaggaga

SEQ ID NO: 266784 - DNA, 75 bp, Artificial Sequence
  Synthetic
aatcctcgcggggaacgcgttcaccgccgggaaaatcatatttgcagcagtcccaccaaatttcccaactgaagg

SEQ ID NO: 266785 - DNA, 75 bp, Artificial Sequence
  Synthetic
aaggcgtgctcacccaaaccacaaggagggatggctcgacccgcggtcacaaagccacagtgagcactggaagtg

SEQ ID NO: 266786 - DNA, 75 bp, Artificial Sequence
  Synthetic
gtgaaatgaagatggcgtctaacgacgctaccactgcctcttgtggcgaaaacaccgctaagaaagacagtgaca

SEQ ID NO: 266787 - DNA, 75 bp, Artificial Sequence
  Synthetic
tgtgggccgatgacgacagaagtgtcgattacaacgagaagctcagttttgaagccccaccaagcatctggtcaa

SEQ ID NO: 266788 - DNA, 75 bp, Artificial Sequence
  Synthetic
cgattacaacgagaagctcagttttgaagccccaccaagcatctggtcaaggatagtcaactttggttcgggttg

SEQ ID NO: 266789 - DNA, 75 bp, Artificial Sequence
  Synthetic
cgctaccactgcctcttgtggcgaaaacaccgctaagaaagacagtgacaagtccttttggagctttaactccaa

SEQ ID NO: 266790 - DNA, 75 bp, Artificial Sequence
  Synthetic
cccccctgacgacaggggtgggacggaacagattcaaccccttgaagaacccgcggacaccactctaaggtacaa

SEQ ID NO: 266791 - DNA, 75 bp, Artificial Sequence
  Synthetic
agtgtccatcaagcaaatccagatacacaaatcaggcgaattctgccgcctgaggttcccaaaaccaatcaggac

SEQ ID NO: 266792 - DNA, 75 bp, Artificial Sequence
  Synthetic
cttgtcgagttctcacgagaccatcccccgattttgatttcatatttttggtgccacccacagttgaatcaagaa

SEQ ID NO: 266793 - DNA, 75 bp, Artificial Sequence
  Synthetic
tgaggttcccaaaaccaatcaggaccgatgtgacaggcatgatcttagaggagggtgcccccgaaggcaccgtgg

SEQ ID NO: 266794 - DNA, 75 bp, Artificial Sequence
  Synthetic
gaacagattcaaccccttgaagaacccgcggacaccactctaaggtacaacgcgcgggatgataccatcgaaggg

SEQ ID NO: 266795 - DNA, 75 bp, Artificial Sequence
  Synthetic
tgttcacgggccccagtagtgcctttgttgttcaaccacaaaacggcaggtgcacgactgatggcgtgctcctag

SEQ ID NO: 266796 - DNA, 75 bp, Artificial Sequence
  Synthetic
gaacaccaaccagcgcccgaaccactcccgggcgcaataatagagatgtgggacggcgagatttaccactacggc

SEQ ID NO: 266797 - DNA, 75 bp, Artificial Sequence
  Synthetic
tgcacgactgatggcgtgctcctaggtactacccaactgtctcctgtcaacatctgcaccttcagaggggatgtc

SEQ ID NO: 266798 - DNA, 75 bp, Artificial Sequence
  Synthetic
tcccgggcgcaataatagagatgtgggacggcgagatttaccactacggcatttacgctggtggcggtaaggttt

SEQ ID NO: 266799 - DNA, 75 bp, Artificial Sequence
  Synthetic
gctggggctggggccatcaaccaaaaagttgagtttgaaaataacagaaaattgcaacaagcttccttccaattt

SEQ ID NO: 266800 - DNA, 75 bp, Artificial Sequence
  Synthetic
gactacgtggtcatcggggttcacacggctgctgcccgaggagggaacactgtcatatgtgccacccagggaagt

SEQ ID NO: 266801 - DNA, 75 bp, Artificial Sequence
  Synthetic
tcgtttacacaccccagaactccatccccatagactcactgcgccgcctggcaggtgagcgctttccctacacag

SEQ ID NO: 266802 - DNA, 75 bp, Artificial Sequence
  Synthetic
ccccatagactcactgcgccgcctggcaggtgagcgctttccctacacagcctttgacaacaactgttacacctt

SEQ ID NO: 266803 - DNA, 75 bp, Artificial Sequence
  Synthetic
accctaccaagactggaacactaaacctgtccctacagtggatgacagtaagctgaagaaggttgccaacgtgat

SEQ ID NO: 266804 - DNA, 75 bp, Artificial Sequence
  Synthetic
cctgtccctacagtggatgacagtaagctgaagaaggttgccaacgtgattctatgtggcctaacctccctcttc

SEQ ID NO: 266805 - DNA, 75 bp, Artificial Sequence
  Synthetic
agatttgattcctgggtcaaccagttctacacacttgcccccatgggaaatgggacggggcgtagacgtgcatta

SEQ ID NO: 266806 - DNA, 75 bp, Artificial Sequence
  Synthetic
aaccaaagccaagtgtgttggaagctgccaagagaaccattattaacgtcctcgaacaaacaatagacccacctc

SEQ ID NO: 266807 - DNA, 75 bp, Artificial Sequence
  Synthetic
acctttggtggaatcgtggaatcccttatcctggtgggtgaactcttcggaatcttttggacaccaccagatgtc

SEQ ID NO: 266808 - DNA, 75 bp, Artificial Sequence
  Synthetic
acctttggtggaatcgtggaatcccttatcctggtgggtgaactcttcggaatcttttggacacctccagatgtc

SEQ ID NO: 266809 - DNA, 75 bp, Artificial Sequence
  Synthetic
acctttggtggaatcgtggaatcccttatcctggtgggtgaactcttcggaatcttttggacacccccagatgtc

SEQ ID NO: 266810 - DNA, 75 bp, Artificial Sequence
  Synthetic
acctttggtggaatcgtggaatcccttatcctggtgggtgaactcttcggaatcttttggacaccgccagatgtc

SEQ ID NO: 266811 - DNA, 75 bp, Artificial Sequence
  Synthetic
ctcgaacaaacaatagacccacctcagaaatggacgtttgcgcaagcttgcgcgtctcttgacaagaccacctcc

SEQ ID NO: 266812 - DNA, 75 bp, Artificial Sequence
  Synthetic
ttatcctggtgggtgaactcttcggaatcttttggacaccaccagatgtcaccagttttcttgcttcaattttag

SEQ ID NO: 266813 - DNA, 75 bp, Artificial Sequence
  Synthetic
ttatcctggtgggtgaactcttcggaatcttttggacacctccagatgtcaccagttttcttgcttcaattttag

SEQ ID NO: 266814 - DNA, 75 bp, Artificial Sequence
  Synthetic
ttatcctggtgggtgaactcttcggaatcttttggacacccccagatgtcaccagttttcttgcttcaattttag

SEQ ID NO: 266815 - DNA, 75 bp, Artificial Sequence
  Synthetic
ttatcctggtgggtgaactcttcggaatcttttggacaccgccagatgtcaccagttttcttgcttcaattttag

SEQ ID NO: 266816 - DNA, 75 bp, Artificial Sequence
  Synthetic
cttcacaggcaagttggcagatcaggcctcaaaggccaacttgatgtttgaggaggggaagaacatgaccccagt

SEQ ID NO: 266817 - DNA, 75 bp, Artificial Sequence
  Synthetic
gcctcaaaggccaacttgatgtttgaggaggggaagaacatgaccccagtttacacaggtgccctcaaggatgag

SEQ ID NO: 266818 - DNA, 75 bp, Artificial Sequence
  Synthetic
tccttggcttcaccacggaaaaggttgggcgtatgctgtcatccgctgcttcaactctgcgtgcctgtaaggacc

SEQ ID NO: 266819 - DNA, 75 bp, Artificial Sequence
  Synthetic
tgggcgtatgctgtcatccgctgcttcaactctgcgtgcctgtaaggaccttggggcctatggccttgacatatt

SEQ ID NO: 266820 - DNA, 75 bp, Artificial Sequence
  Synthetic
ggaagagctaatcttagggctactgtccccgcccggggttcctctagcacgtcttctaactcttctattgctact

SEQ ID NO: 266821 - DNA, 75 bp, Artificial Sequence
  Synthetic
caacgagacttggttctacagctggttctggtaccagtgtctcgagcctcccgtcaactgcaaggactaggagct

SEQ ID NO: 266822 - DNA, 75 bp, Artificial Sequence
  Synthetic
taatggatgagctcaaggcccactgtgtcacacttcctgtcagagttggtatgaacatgaatgaggatggcccca

SEQ ID NO: 266823 - DNA, 75 bp, Artificial Sequence
  Synthetic
cgccgtcctagaccttgaggcgttggaaaataatcaccttacaactctactcaaggataaagacagcttgacggc

SEQ ID NO: 266824 - DNA, 75 bp, Artificial Sequence
  Synthetic
tgtcacacttcctgtcagagttggtatgaacatgaatgaggatggccccatcatctttgaaaagcattccaggta

SEQ ID NO: 266825 - DNA, 75 bp, Artificial Sequence
  Synthetic
gaaaataatcaccttacaactctactcaaggataaagacagcttgacggcgttcatgaagaccctcgacatggag

SEQ ID NO: 266826 - DNA, 75 bp, Artificial Sequence
  Synthetic
gatcatggtcaaattctccccagagccacacttagcccagatagttgcagaagaccttctatcccccagcgtgat

SEQ ID NO: 266827 - DNA, 75 bp, Artificial Sequence
  Synthetic
aggatctcagcagccaggtcgctccttcacaaggctcgggaagaactctgtgccaggatccgccctgtggtggtc

SEQ ID NO: 266828 - DNA, 75 bp, Artificial Sequence
  Synthetic
ccacacttagcccagatagttgcagaagaccttctatcccccagcgtgatggacgtgggtgatttcaagatttca

SEQ ID NO: 266829 - DNA, 75 bp, Artificial Sequence
  Synthetic
ttcacaaggctcgggaagaactctgtgccaggatccgccctgtggtggtcatgatttccggcaggccaggtatag

SEQ ID NO: 266830 - DNA, 75 bp, Artificial Sequence
  Synthetic
tgtgctctctctgaagtcacggatctctcccctgacatcgttcaggccaattctctcttctctttctatggtgat

SEQ ID NO: 266831 - DNA, 75 bp, Artificial Sequence
  Synthetic
tacccaggaatggcgtcgaccattgggatgcctacaagggagaacgaatagtcctctgggatgattatggaatga

SEQ ID NO: 266832 - DNA, 75 bp, Artificial Sequence
  Synthetic
tctcccctgacatcgttcaggccaattctctcttctctttctatggtgatgatgaaattgtgagcacagatataa

SEQ ID NO: 266833 - DNA, 75 bp, Artificial Sequence
  Synthetic
ggatgcctacaagggagaacgaatagtcctctgggatgattatggaatgagcaatccaatcaaagatgccttgac

SEQ ID NO: 266834 - DNA, 75 bp, Artificial Sequence
  Synthetic
gacctctaatcatttctgaggatctaaatggtttgaccttcctgcgaaggactgtaacccgtgatccagctggtt

SEQ ID NO: 266835 - DNA, 75 bp, Artificial Sequence
  Synthetic
cagtgacattattgtgataaccaccaacttgaccagtcccgccccacttgactacgtcaatttcgaggcttgttc

SEQ ID NO: 266836 - DNA, 75 bp, Artificial Sequence
  Synthetic
aacttgaccagtcccgccccacttgactacgtcaatttcgaggcttgttccaggcgggtggatttcttggtctat

SEQ ID NO: 266837 - DNA, 75 bp, Artificial Sequence
  Synthetic
ctgaaacaatgataccacattcccaaaggcccacgcagttgatgtctttgctgggtgaggctgcactgcacggcc

SEQ ID NO: 266838 - DNA, 75 bp, Artificial Sequence
  Synthetic
caagaccactcacacatcaaactgcagttggctccacagggtggctttgataaaaacggcaacaccccttatggg

SEQ ID NO: 266839 - DNA, 75 bp, Artificial Sequence
  Synthetic
agttggctccacagggtggctttgataaaaacggcaacaccccttatgggaagggcgtgatgaagacgctcaccc

SEQ ID NO: 266840 - DNA, 75 bp, Artificial Sequence
  Synthetic
gacaagagccgatgttcaggtggatgagattctcagacctgagcacgtgggagggcgatcgcaatctggctccca

SEQ ID NO: 266841 - DNA, 75 bp, Artificial Sequence
  Synthetic
tgcccctctacaacttcgatgtggacaagataaactctttcaggaagatggctgctgacaataggtatgggttct

SEQ ID NO: 266842 - DNA, 75 bp, Artificial Sequence
  Synthetic
caagataaactctttcaggaagatggctgctgacaataggtatgggttctttgagacaatgaaagtcggagctgc

SEQ ID NO: 266843 - DNA, 75 bp, Artificial Sequence
  Synthetic
cacagtgtcccctagaaacgctccaggtgagatactatggagcgcgcccttgggccctgatttgaacccctatct

SEQ ID NO: 266844 - DNA, 75 bp, Artificial Sequence
  Synthetic
ggtgagatactatggagcgcgcccttgggccctgatttgaacccctatctttctcacctgtccagaatgtacaat

SEQ ID NO: 266845 - DNA, 75 bp, Artificial Sequence
  Synthetic
ttataaggggacaatctaccagattgaatcaggtcgtggcgggcttgtaattaagaaattggaggaccgctacgc

SEQ ID NO: 266846 - DNA, 75 bp, Artificial Sequence
  Synthetic
ggttatgcaggtggttttgaagtgcaagtgatcctcgcagggaacgcgttcaccgccgggaaagtcatatttgca

SEQ ID NO: 266847 - DNA, 75 bp, Artificial Sequence
  Synthetic
gaatcaggtcgtggcgggcttgtaattaagaaattggaggaccgctacgcccagagctctggatccctatttggt

SEQ ID NO: 266848 - DNA, 75 bp, Artificial Sequence
  Synthetic
gttaggcaattggaacctgtattgatccccctacctgatgttaggaataatttctatcattataatcaagcacat

SEQ ID NO: 266849 - DNA, 75 bp, Artificial Sequence
  Synthetic
caggttgccggagccgcatttgtgacatcaaggataatcaaaagatccaattggtgcaattcctggcggcaggcg

SEQ ID NO: 266850 - DNA, 75 bp, Artificial Sequence
  Synthetic
catcaaggataatcaaaagatccaattggtgcaattcctggcggcaggcggctgagtctagtgccccgactccgg

SEQ ID NO: 266851 - DNA, 75 bp, Artificial Sequence
  Synthetic
taatgccggggatgatgtctttacagtctcttgtcgagtcctcacgagaccatcccccgattttgattttatatt

SEQ ID NO: 266852 - DNA, 75 bp, Artificial Sequence
  Synthetic
ggaagaacaaaaagggccgtgggaagaagcacacggctttctccagcaaagggctcagtgatgaagagtacgacg

SEQ ID NO: 266853 - DNA, 75 bp, Artificial Sequence
  Synthetic
gaagcacacggctttctccagcaaagggctcagtgatgaagagtacgacgagtacaagaggataagggaagagcg

SEQ ID NO: 266854 - DNA, 75 bp, Artificial Sequence
  Synthetic
aacagaggagaactttgcagaggatgatgagatgagactccgtcaaaggatcttcaggcccactaagaaacagag

SEQ ID NO: 266855 - DNA, 75 bp, Artificial Sequence
  Synthetic
gatgagatgagactccgtcaaaggatcttcaggcccactaagaaacagaggagggaagagagagccactcttggc

SEQ ID NO: 266856 - DNA, 75 bp, Artificial Sequence
  Synthetic
tgtcacccgtgttgggatcagccatgattatacaatgaatttggtgtcccaaaattggaataattatgatccaac

SEQ ID NO: 266857 - DNA, 75 bp, Artificial Sequence
  Synthetic
agtcgtgaggtcgactataatgaaaccatcaactttgaggccccctcgagcatttggtcgcgcgtcgtccccttt

SEQ ID NO: 266858 - DNA, 75 bp, Artificial Sequence
  Synthetic
ccatcaactttgaggccccctcgagcatttggtcgcgcgtcgtcccctttggcaccggctgggcgttttgggtgt

SEQ ID NO: 266859 - DNA, 75 bp, Artificial Sequence
  Synthetic
agatccaagttcacaaatcaggtgagttctgccgcctaagattcccccgacctatgagaactgatgttagtggcc

SEQ ID NO: 266860 - DNA, 75 bp, Artificial Sequence
  Synthetic
gttctgccgcctaagattcccccgacctatgagaactgatgttagtggcctgattttagaggagggcgcccctga

SEQ ID NO: 266861 - DNA, 75 bp, Artificial Sequence
  Synthetic
cgccaccatgaagattcagggcaggacgatcggcggccagatgggtatgctcctcactggggccaatgcaaagaa

SEQ ID NO: 266862 - DNA, 75 bp, Artificial Sequence
  Synthetic
acgatcggcggccagatgggtatgctcctcactggggccaatgcaaagaacatggatttaggaactagccccggg

SEQ ID NO: 266863 - DNA, 75 bp, Artificial Sequence
  Synthetic
cccatcaaacaaattcaggtgcacaagtcaggcgaattctgtcgcttgaggttcccaaagccaatcaggactgat

SEQ ID NO: 266864 - DNA, 75 bp, Artificial Sequence
  Synthetic
ggcggtaacacagtcgtctgcgccactcagggtcctgatggtgaggccactctggagggtggtgagaatcatggc

SEQ ID NO: 266865 - DNA, 75 bp, Artificial Sequence
  Synthetic
ctcagggtcctgatggtgaggccactctggagggtggtgagaatcatggcacctactgtggtgccccaattttgg

SEQ ID NO: 266866 - DNA, 75 bp, Artificial Sequence
  Synthetic
tctggccaacccagcaccactggactatgtcaactttgaagcgtgctcgaggcgcatcgatttcctcgtgtatgc

SEQ ID NO: 266867 - DNA, 75 bp, Artificial Sequence
  Synthetic
cctatgaaccagcctacttgggggggagggacccccgcgtggaaaacggtccatcgttacagcaagtcatgaggg

SEQ ID NO: 266868 - DNA, 75 bp, Artificial Sequence
  Synthetic
gagggacccccgcgtggaaaacggtccatcgttacagcaagtcatgagggatcaactcaaaccttttactgcccc

SEQ ID NO: 266869 - DNA, 75 bp, Artificial Sequence
  Synthetic
tgaacccgccaaaaagtggagttactcgcaagcctgccagtcactggacaagaccacctctagcggtgaccccca

SEQ ID NO: 266870 - DNA, 75 bp, Artificial Sequence
  Synthetic
tcgcaagcctgccagtcactggacaagaccacctctagcggtgacccccaccatgtgaggaagaacgaccactgg

SEQ ID NO: 266871 - DNA, 75 bp, Artificial Sequence
  Synthetic
ctctggactggagcggaacaaggtactgggcccctgatgccagggccacaacatacaatgcaggccgcttctcca

SEQ ID NO: 266872 - DNA, 75 bp, Artificial Sequence
  Synthetic
ctgggcccctgatgccagggccacaacatacaatgcaggccgcttctccacccctcagcctttgggggcattacc

SEQ ID NO: 266873 - DNA, 75 bp, Artificial Sequence
  Synthetic
gcccagcccgtctacacggccgccttgaaggacgagcttgtcaagactgaaaagatctacggcacagtgaagaag

SEQ ID NO: 266874 - DNA, 75 bp, Artificial Sequence
  Synthetic
tggaagaatcaatcctagggttcctgcacctgctcggagctcccccagttcactttccaatgctcctactgctac

SEQ ID NO: 266875 - DNA, 75 bp, Artificial Sequence
  Synthetic
cagtaagggaacatactgtggtgcaccaatcctaggcccagggagcgccccaaaacttagcaccaaaaccaaatt

SEQ ID NO: 266876 - DNA, 75 bp, Artificial Sequence
  Synthetic
tgaaggacgagcttgtcaagactgaaaagatctacggcacagtgaagaagaggctcctttggggttcggatttgg

SEQ ID NO: 266877 - DNA, 75 bp, Artificial Sequence
  Synthetic
caagggtggcccctcgttgcagcaagtcatgagagaccagctgaaaccatttacagagcccaggggtaagccacc

SEQ ID NO: 266878 - DNA, 75 bp, Artificial Sequence
  Synthetic
ttagggttgggatgaacatgaatgaagatgggccagctatatttgagaggcacgcgcggcatacctaccactttg

SEQ ID NO: 266879 - DNA, 75 bp, Artificial Sequence
  Synthetic
agatgggccagctatatttgagaggcacgcgcggcatacctaccactttgatgctgattattcacggtgggactc

SEQ ID NO: 266880 - DNA, 75 bp, Artificial Sequence
  Synthetic
gccatccgcaccacatgcggaaaaacgactgctggaacggggagtccttcacaggcaagctggcagaccaggctt

SEQ ID NO: 266881 - DNA, 75 bp, Artificial Sequence
  Synthetic
ggtggtggcggaggacctccttgcccctagtgtccttgatgttggcgattttcgtatctccattgtggagggtct

SEQ ID NO: 266882 - DNA, 75 bp, Artificial Sequence
  Synthetic
cctagtgtccttgatgttggcgattttcgtatctccattgtggagggtctcccctccggagttccgtgcacatca

SEQ ID NO: 266883 - DNA, 75 bp, Artificial Sequence
  Synthetic
atccaggcccattcctgcttttccttctatggcgatgatgagatcgtgagcacagacatcaccttggaccccaac

SEQ ID NO: 266884 - DNA, 75 bp, Artificial Sequence
  Synthetic
tctatggcgatgatgagatcgtgagcacagacatcaccttggaccccaacatgctcacagagaagttgaaagaat

SEQ ID NO: 266885 - DNA, 75 bp, Artificial Sequence
  Synthetic
ggaccgctggtccaccgcccaaacaacagagagaccgacctcctagaactcaggaggaggtccagtatggtatgg

SEQ ID NO: 266886 - DNA, 75 bp, Artificial Sequence
  Synthetic
tcctgagaaggacgatagtccgtgacccggctggatggttcggcaagcttgacagagattccatcttgaggcagc

SEQ ID NO: 266887 - DNA, 75 bp, Artificial Sequence
  Synthetic
tgaagaccctatggaaaccatggtgccccactcacaaagagcaatacaattgatggccctgctgggagaagcctc

SEQ ID NO: 266888 - DNA, 75 bp, Artificial Sequence
  Synthetic
cgctggtggtttgggcccttgcacaatgcctccaacatatgaacgggtcagggatgacagtccacctggtgaaca

SEQ ID NO: 266889 - DNA, 75 bp, Artificial Sequence
  Synthetic
tagacaaccacaaagaatggtttgacgctggtggtttgggcccttgcacaatgcctccaacatatgaacgggtca

SEQ ID NO: 266890 - DNA, 75 bp, Artificial Sequence
  Synthetic
gggatgacagtccacctggtgaacaggttaaatggtccgcacgtgatggagtcaacattggagtggaacgcctca

SEQ ID NO: 266891 - DNA, 75 bp, Artificial Sequence
  Synthetic
ttacgtgcccagacatgaagccatgttccgctggatgcggttctcagacctcagcacgtgggagggcgatcgcaa

SEQ ID NO: 266892 - DNA, 75 bp, Artificial Sequence
  Synthetic
ttccgctggatgcggttctcagacctcagcacgtgggagggcgatcgcaatctggctcccagtggtgtgaatgaa

SEQ ID NO: 266893 - DNA, 75 bp, Artificial Sequence
  Synthetic
aacccactattggagatatgatagaattctatgaaggccacatctatcattactccatatacattgggcaaggca

SEQ ID NO: 266894 - DNA, 75 bp, Artificial Sequence
  Synthetic
ggccttggaaccagtggtgggcgctcctcttgctgctcccgttgctggtcaacataatattatagacccctggat

SEQ ID NO: 266895 - DNA, 75 bp, Artificial Sequence
  Synthetic
cctcttgctgctcccgttgctggtcaacataatattatagacccctggattaaaatgaattttgtgcaggcaccc

SEQ ID NO: 266896 - DNA, 75 bp, Artificial Sequence
  Synthetic
ggccatacgcggccataaccaataattgttttgaattctgctgtcaagtcatgaaccttgaggacacgtggttgc

SEQ ID NO: 266897 - DNA, 75 bp, Artificial Sequence
  Synthetic
aacccttatctttcacatttggctcgcatgtacaatggttacgcaggtggcatggaggtgcaagtcgtgttagcc

SEQ ID NO: 266898 - DNA, 75 bp, Artificial Sequence
  Synthetic
gcatgtacaatggttacgcaggtggcatggaggtgcaagtcgtgttagccggcaatgccttcaccgctgggaaga

SEQ ID NO: 266899 - DNA, 75 bp, Artificial Sequence
  Synthetic
aagatagcaagttagagttggttagggacgccatattggctgcagtgaatggtcttgtttcgcagccctttaaga

SEQ ID NO: 266900 - DNA, 75 bp, Artificial Sequence
  Synthetic
ggacgccatattggctgcagtgaatggtcttgtttcgcagccctttaagaacttcttgggtaaactcaaacccct

SEQ ID NO: 266901 - DNA, 75 bp, Artificial Sequence
  Synthetic
tgatagttgatgttagacaattggaaccagttatgctccctatgcctgatattaggaacaaattatttcattaca

SEQ ID NO: 266902 - DNA, 75 bp, Artificial Sequence
  Synthetic
atgagttcttcaatcaaatctgttcccaaaccaagaaacggcaccgtgtctggcagactgcctgtcaggccggga

SEQ ID NO: 266903 - DNA, 75 bp, Artificial Sequence
  Synthetic
gccgacagcatcgtcaagatgcagaggagggggcgaaccggccgtggtaaaccaggaacgtactaccaggtatgt

SEQ ID NO: 266904 - DNA, 75 bp, Artificial Sequence
  Synthetic
agaagacttcgtgcctacgttgtaaacgtaagaaaaagctctgagcgcggttcgcgaccaccacgacgcaaacgc

SEQ ID NO: 266905 - DNA, 75 bp, Artificial Sequence
  Synthetic
ccccaggctgacacgagcggcatagtccctgacgcttgcatttacgaggctttcgactccggcctggcatacttc

SEQ ID NO: 266906 - DNA, 75 bp, Artificial Sequence
  Synthetic
agggaccttggctaccgttaccctacggtggctaagggggccagagctatcaatggtgtgacgagggacgccatg

SEQ ID NO: 266907 - DNA, 75 bp, Artificial Sequence
  Synthetic
ggcagaacacccgctgaagttgccacacacttgagcttctaccacaatcaggttgggttgccaaccatcaaggtg

SEQ ID NO: 266908 - DNA, 75 bp, Artificial Sequence
  Synthetic
caattcctgctaccatcggcggcttacccgcctggcgaccctcgaaacaaatccaggttcctcggtcacataatc

SEQ ID NO: 266909 - DNA, 75 bp, Artificial Sequence
  Synthetic
attatccccgaggtacaagccatcttcatgcaaattggctatgtccaaagtaactacctcgagatgatgaaaaac

SEQ ID NO: 266910 - DNA, 75 bp, Artificial Sequence
  Synthetic
gatggaaccctgggttggaccaccgacctcgtgcaccatgtgccgatcgttggttcaatccttggccacccttgc

SEQ ID NO: 266911 - DNA, 75 bp, Artificial Sequence
  Synthetic
agggtagattcgtacacctacctttacgctgctcagtaccaattggccaaggctgagggcgcaatggcccctaat

SEQ ID NO: 266912 - DNA, 75 bp, Artificial Sequence
  Synthetic
aggtggctctgccgtggcatcagggcgttggaggacggagtgaacatggtcacctccccggcgggcgtgtacctc

SEQ ID NO: 266913 - DNA, 75 bp, Artificial Sequence
  Synthetic
gacaatcctgcttggaggggcctttcaggcaaggcaaaattccccttgctctaccaccttgaagagtacgatcta

SEQ ID NO: 266914 - DNA, 75 bp, Artificial Sequence
  Synthetic
ttcctcttgtgctgcctcaccctgatggcaccggctgcggaggccaatctgctcaaaaacgtgattgactacctc

SEQ ID NO: 266915 - DNA, 75 bp, Artificial Sequence
  Synthetic
gacaaggtccaggcgcacagtattgcttccagcatccaggggtgctacgaagaatactttgccgagacggttatg

SEQ ID NO: 266916 - DNA, 75 bp, Artificial Sequence
  Synthetic
caaattcaacgctacaacttctctgatggcctccccgagcatcaaaccttcggactcgtaccactcaccaactgc

SEQ ID NO: 266917 - DNA, 75 bp, Artificial Sequence
  Synthetic
acccttgcgggcgtggggctggcagtgtcctgtgtcttcatggcgatcgacctcttcggcaactgcgccatactc

SEQ ID NO: 266918 - DNA, 75 bp, Artificial Sequence
  Synthetic
tgcaactattcccaggtccagtactgctccgaaaagtcgtgcctccacgacgccgggtgcaccatctgtgagcaa

SEQ ID NO: 266919 - DNA, 75 bp, Artificial Sequence
  Synthetic
cgagcttgggacttgacgggcgactcctccgccgccttaaacccctctccagaaatgtccatcctggaggaggtg

SEQ ID NO: 266920 - DNA, 75 bp, Artificial Sequence
  Synthetic
actgacgagggggtcaggtgctggctgaaccacgggcctatggtttccaggcacccagactacgagggggttgat

SEQ ID NO: 266921 - DNA, 75 bp, Artificial Sequence
  Synthetic
gaggaatgctcgacacagtggggctcggaagccctagctgaaggagcccaaaaagctgcccagtggctcggagat

SEQ ID NO: 266922 - DNA, 75 bp, Artificial Sequence
  Synthetic
ccgcaggtggctgaacacatcgatgctatctgcgggctcgtcttcctctgcgatctgtctggaatcaatgagatc

SEQ ID NO: 266923 - DNA, 75 bp, Artificial Sequence
  Synthetic
aaaatgacagaactgggtggcaagctgggaggcaagacagcactcgagaggaagatcactgaatttctgccccac

SEQ ID NO: 266924 - DNA, 75 bp, Artificial Sequence
  Synthetic
tgaggcgcggtggcacttgtctcatcctggtggtttgagttcgcccccatagcgattcagcttaacaccacagct

SEQ ID NO: 266925 - DNA, 75 bp, Artificial Sequence
  Synthetic
tgtggcgcggtggcacttgtctcatcctggtggtttgagttcgcccccatagcgattcagcttaacaccacagct

SEQ ID NO: 266926 - DNA, 75 bp, Artificial Sequence
  Synthetic
tgcggcgcggtggcacttgtctcatcctggtggtttgagttcgcccccatagcgattcagcttaacaccacagct

SEQ ID NO: 266927 - DNA, 75 bp, Artificial Sequence
  Synthetic
tggggcgcggtggcacttgtctcatcctggtggtttgagttcgcccccatagcgattcagcttaacaccacagct

SEQ ID NO: 266928 - DNA, 75 bp, Artificial Sequence
  Synthetic
atcctggcaggggttcagtacttcgctggattaacatgcctccgcgaggctccgggagtcggcgctgtattgggg

SEQ ID NO: 266929 - DNA, 75 bp, Artificial Sequence
  Synthetic
gaatgttacctactggaggctacaggggctgaccccgggttccttgggttcctgggttgggtggcaagcgaggcg

SEQ ID NO: 266930 - DNA, 75 bp, Artificial Sequence
  Synthetic
tttgtgggcagttcgctgtcccctctccccttaaaagtaaacctcttcctcagcgcgctcggaggagccttcgcc

SEQ ID NO: 266931 - DNA, 75 bp, Artificial Sequence
  Synthetic
aaagccttcacggctgttttggacttcgtggtaaagcttcccgcggctgtcgcggcagcttttggcagcggccac

SEQ ID NO: 266932 - DNA, 75 bp, Artificial Sequence
  Synthetic
acaaagctaacaacacaaacaggcgctgccgtctttggggctgcgggcgctatcggggcgctggtgggtgcagca

SEQ ID NO: 266933 - DNA, 75 bp, Artificial Sequence
  Synthetic
atgatcgccctggcctccataataggcatggctatgaacggacactccatcaaagcaacggctctcctcgtcctg

SEQ ID NO: 266934 - DNA, 75 bp, Artificial Sequence
  Synthetic
aacctaggggctatggtgggccacgccttcctaacctacgggtcagctacatctgcttgcctcgttgtgctcaag

SEQ ID NO: 266935 - DNA, 75 bp, Artificial Sequence
  Synthetic
tacgtggagtcggctgtcgccgtcccagtgcctagtatgaatcctcaactgtcagtctgctccccgcatgtgctg

SEQ ID NO: 266936 - DNA, 75 bp, Artificial Sequence
  Synthetic
ctcatcgatggccagtggcctgatttctctgagtgggcctctctcgccatgtctgtggccagtcctggctcgttc

SEQ ID NO: 266937 - DNA, 75 bp, Artificial Sequence
  Synthetic
cccgacccttgtggcgtcatcactgccaatgatactattgagttcttttgcttcaatccttacagaggcaaaccc

SEQ ID NO: 266938 - DNA, 75 bp, Artificial Sequence
  Synthetic
atagtaggcgcaggagctgctatcatggtagctttctgcacccgctctgaaagccaggtttggatgaacaggctg

SEQ ID NO: 266939 - DNA, 75 bp, Artificial Sequence
  Synthetic
ctgcggcagaaggttctcacgacgcccgacgcacagaacgggaccatagaccttggccagtacaagtggtcctgg

SEQ ID NO: 266940 - DNA, 75 bp, Artificial Sequence
  Synthetic
ctagccatgctccatcgcggcacatcatgcgatgagtacttcgtccaagccaccacactcagacaaaccatcatc

SEQ ID NO: 266941 - DNA, 75 bp, Artificial Sequence
  Synthetic
ggctgctttgcttggaagcttgatggcaacttcacctgctgctctaatagaaagctcccctcttactgcaaatgt

SEQ ID NO: 266942 - DNA, 75 bp, Artificial Sequence
  Synthetic
aagtggctggaaacagcctccatttggtcagctttcaggcagctggctgactggattatgagggccgatgaggac

SEQ ID NO: 266943 - DNA, 75 bp, Artificial Sequence
  Synthetic
gccacagactgcagttggatggacaagcgcaacacctatgaacgatgtggcgcgctccccatagtgtccaccgct

SEQ ID NO: 266944 - DNA, 75 bp, Artificial Sequence
  Synthetic
gtctgcacgagcccaagagcagcgtgggctgcttttatgatggcagttggcggcatatgccggaccttggttgaa

SEQ ID NO: 266945 - DNA, 75 bp, Artificial Sequence
  Synthetic
tgcgacccttacaatgcaacatcagatacttgtgtccctagagtggtggccgggttggacctgccaggcttcagc

SEQ ID NO: 266946 - DNA, 75 bp, Artificial Sequence
  Synthetic
atggctcgtggcgtttgtaggcacctctttaagattccaggttgcccgctctatgcctgccgacccggctacaag

SEQ ID NO: 266947 - DNA, 75 bp, Artificial Sequence
  Synthetic
tcctactataccacctaccactggccgaccctccgggtattaaccatggagggcaagggcataacaataaggtat

SEQ ID NO: 266948 - DNA, 75 bp, Artificial Sequence
  Synthetic
ggaccgtggaaggggtcgggcatggtgaaatcaacatgtgagtgcggcactgagggcctttggaacatctcagaa

SEQ ID NO: 266949 - DNA, 75 bp, Artificial Sequence
  Synthetic
gactccaagacccttgaaaagctgccccctgcccgctgggcccggctgcccttcaggcctgtgctgtcgcatggg

SEQ ID NO: 266950 - DNA, 75 bp, Artificial Sequence
  Synthetic
ggcaaagcaatctatgtctcctcaacagcatggtgcagatgctggtggtcaggcggtgtccctgtcaacaactcc

SEQ ID NO: 266951 - DNA, 75 bp, Artificial Sequence
  Synthetic
tcttggatggtagttcccaaaggcttctactcgagctatacagatctttccactggcctcattaccaaggacaag

SEQ ID NO: 266952 - DNA, 75 bp, Artificial Sequence
  Synthetic
ttcacaggcgtaccgaggcctgcacctgtgggctggactagcatggcggtacgggatggttacagtgcatactgc

SEQ ID NO: 266953 - DNA, 75 bp, Artificial Sequence
  Synthetic
catcacgaggactaccaactccactataccgccagtggggctctgtccatggagggcgtcacctaccacatcatt

SEQ ID NO: 266954 - DNA, 75 bp, Artificial Sequence
  Synthetic
gtttacgagcggcggggggaagacatctaccttgtaggtgtatcctaccccggccaggtagtggacgcaggtgtg

SEQ ID NO: 266955 - DNA, 75 bp, Artificial Sequence
  Synthetic
gtgatcgccctcctggcggccttaggagcaaagtggtgccttgtcatctacgccaccctcctgatggccggtgtg

SEQ ID NO: 266956 - DNA, 75 bp, Artificial Sequence
  Synthetic
ccggacttctcggctgccgtggctgtggacggcgtgcaggtcaagcccttcggcggaactgattggcggaagtgt

SEQ ID NO: 266957 - DNA, 75 bp, Artificial Sequence
  Synthetic
agcgaagcagtgcccactgcagtctatgctgccactgtcgcctcggcgtacggtgacgtgttgtggagggctatt

SEQ ID NO: 266958 - DNA, 75 bp, Artificial Sequence
  Synthetic
cacaagttcgccgtgcggtacgggagcgacaatgaggaaaagcagctaccgctcaaggtatcaggctcaccgccc

SEQ ID NO: 266959 - DNA, 75 bp, Artificial Sequence
  Synthetic
gtctacctggtgatctgcaaatggcccaagctacgcactttcctatcccccactctccattgcctgcttctcatg

SEQ ID NO: 266960 - DNA, 75 bp, Artificial Sequence
  Synthetic
ccgaaagaggagaagaaggcggccaaggcggggcttttggccgaagagatccccttgcgaaggctgtgtcgagat

SEQ ID NO: 266961 - DNA, 75 bp, Artificial Sequence
  Synthetic
tattttgctggctttgtgcgcgctgaacagttcgatgctctttgctttgcttgcttggtgtatggcgtggtggta

SEQ ID NO: 266962 - DNA, 75 bp, Artificial Sequence
  Synthetic
gtggataaccgagccatcggcctgagcaagagacaatccagagcagcgcgggactgcgtagatctcccgtatgac

SEQ ID NO: 266963 - DNA, 75 bp, Artificial Sequence
  Synthetic
gctctcactggctcatctctgctcctagccctcagattgcgggtgctgacttcctacctcatgacccgcgtggac

SEQ ID NO: 266964 - DNA, 75 bp, Artificial Sequence
  Synthetic
accgaggaaaccagtttcgtgacgttcggggccccaaaaccatccgctccctcgtgcgacacggactccatgcta

SEQ ID NO: 266965 - DNA, 75 bp, Artificial Sequence
  Synthetic
ctgtcaaccgccagcgcccacaaaacaaccctgtacctgtgtgtccttctgttcccgaaggcaacctggtactgc

SEQ ID NO: 266966 - DNA, 75 bp, Artificial Sequence
  Synthetic
acggctggtacgtatgatgtggtcaacatgtgcacgcatgaaagacatctcacgtactgtggtgactgtcagcgc

SEQ ID NO: 266967 - DNA, 75 bp, Artificial Sequence
  Synthetic
tgcatgtggttctggaccatgtatataattgggtttgccatcacaaaaatgctgccagaacttctcggaatacac

SEQ ID NO: 266968 - DNA, 75 bp, Artificial Sequence
  Synthetic
cccatagccgaggagtatgagactgccccttcatcagtgcagtccattccccctacggtggtcacaagatccacc

SEQ ID NO: 266969 - DNA, 75 bp, Artificial Sequence
  Synthetic
tcccgcaccgggttagtgctcttcctcaggaaaaccaggaagctcaagtccgcgatgatgcgcttgttcaagcgc

SEQ ID NO: 266970 - DNA, 75 bp, Artificial Sequence
  Synthetic
gcgagcaaagcgtctcgcgcgccgagcccggctcggcagataatgacgagcgtgggggtcgacaacccaacgttc

SEQ ID NO: 266971 - DNA, 75 bp, Artificial Sequence
  Synthetic
gtagtggtctgggcttgcggggagaacggctggttcgcctacaaccacatcgacggtgatctaggcctcgattgg

SEQ ID NO: 266972 - DNA, 75 bp, Artificial Sequence
  Synthetic
ctttgggacgaggttgaagagccacctgctccgatcactcctccccctgaggcattcagggtgagaactccccca

SEQ ID NO: 266973 - DNA, 75 bp, Artificial Sequence
  Synthetic
gaaaatcaagagccctacttcccattcgaaaccctcctggtgcaggaaacggacaaagcccacaacctcgcctgc

SEQ ID NO: 266974 - DNA, 75 bp, Artificial Sequence
  Synthetic
cggttggagattcccatggagattctgagggagtacgagaccagcaatgatcacgtccccaaagaggactcatgg

SEQ ID NO: 266975 - DNA, 75 bp, Artificial Sequence
  Synthetic
ggcgacaccctcaggggcctcccagtgtttgcccggcgtggagatgaaatcctggctggggtggggaagctgccg

SEQ ID NO: 266976 - DNA, 75 bp, Artificial Sequence
  Synthetic
aatcggcaagtagtggtggcggaggtgcatcctgttccagaatccatctcagacggaagctcctggagcacgagc

SEQ ID NO: 266977 - DNA, 75 bp, Artificial Sequence
  Synthetic
gcggggtggcagcttaccaagcctttcatcgctaggctaacccacaacagaggtgagctcaagaccctggccatc

SEQ ID NO: 266978 - DNA, 75 bp, Artificial Sequence
  Synthetic
tcatccttagaccctgaggctccggaattcactccagatccccccatgtcagggctaccagaggttgtgcccctt

SEQ ID NO: 266979 - DNA, 75 bp, Artificial Sequence
  Synthetic
tccctcactggcagtgacaaggcacaaatagacgccaccatagtgctcatgtccacccccctccgcacgtggatg

SEQ ID NO: 266980 - DNA, 75 bp, Artificial Sequence
  Synthetic
ccatctcgacctccggtccgccaacccaaaacaaaaccgcttaaaattaagggcaaggtcaaattggccaaggga

SEQ ID NO: 266981 - DNA, 75 bp, Artificial Sequence
  Synthetic
gggtttggctacggcacttggctccaaacctgctttcatggcagcagaggcaggatgcttgccacggacaagggg

SEQ ID NO: 266982 - DNA, 75 bp, Artificial Sequence
  Synthetic
gccaaacccctcccaaaaaccaagcccacagacccagacacctacagcttacactccagcagctgggagactcag

SEQ ID NO: 266983 - DNA, 75 bp, Artificial Sequence
  Synthetic
gcccaacctcccctcgccgtgtccagagcggccgactcagtgagataccaacttccacagggcatgaaggctttc

SEQ ID NO: 266984 - DNA, 75 bp, Artificial Sequence
  Synthetic
tcttctgggtcatggaccgactgttcttggtcgtattcatggtcggttcctcaattggtttacaaaggcttccaa

SEQ ID NO: 266985 - DNA, 75 bp, Artificial Sequence
  Synthetic
aagcactgctgctgcgggtcggccgagggctaccttatcaccaaggggggcctggttacaccagtggtaaaagtg

SEQ ID NO: 266986 - DNA, 75 bp, Artificial Sequence
  Synthetic
agggttagggccgcgattcacacgtacacattcggcttgatgcgcaatcccaatctggtatactccactacccac

SEQ ID NO: 266987 - DNA, 75 bp, Artificial Sequence
  Synthetic
aatgacaattggatacctacccaaccactcaccctcagggaggctaaaggctcgtcgggtgcccccctggtctgc

SEQ ID NO: 266988 - DNA, 75 bp, Artificial Sequence
  Synthetic
gcaagcgctaatgagcgcgtccgcaaggtaaccattcagcggacccgggaggagactcctgagttgcgttaccag

SEQ ID NO: 266989 - DNA, 75 bp, Artificial Sequence
  Synthetic
aagtgcagaggcgtcaagggcatgttcctagcggccagaactgctagaggcatggtaacatcagtccgggtgctg

SEQ ID NO: 266990 - DNA, 75 bp, Artificial Sequence
  Synthetic
attgcaatggcccgcgccagagtgcaaacacttatggcgtctgaactaacattagaggaagcactttcactgaca

SEQ ID NO: 266991 - DNA, 75 bp, Artificial Sequence
  Synthetic
gaagacttaggcataaaacccgacgaacgcccccaatctggctcattcgtcgttccccctcctgtgggcaagcag

SEQ ID NO: 266992 - DNA, 75 bp, Artificial Sequence
  Synthetic
agcaacacgaccgcaaaatcggcagtgacgggaatgactgccaaagacctcaaatccgggaaaacagaaattgtc

SEQ ID NO: 266993 - DNA, 75 bp, Artificial Sequence
  Synthetic
aaggagatcatacccttcgtggctcccactggcagtggaaagaccaccaaactccccaaatcatactatgacaaa

SEQ ID NO: 266994 - DNA, 75 bp, Artificial Sequence
  Synthetic
aagaccctgtattcaaagttggaagaaggcattcagtccccctggaatcaagtctgtgtgatgccaaaaattgag

SEQ ID NO: 266995 - DNA, 75 bp, Artificial Sequence
  Synthetic
ggttaccatgtgctagtacttaacccgtcagtagccaccaccatctctgtcgggaagtacatgaaggatgagttc

SEQ ID NO: 266996 - DNA, 75 bp, Artificial Sequence
  Synthetic
accttcgtggaaaccccggaaaagaaaagccacaagcctgcacgtcttattgcttacccccaccttgagatgcgg

SEQ ID NO: 266997 - DNA, 75 bp, Artificial Sequence
  Synthetic
ggcatctcaccgaacgtgcggtgcggcgattacaccagccagacgggcagccggctctcgtacatgacctacggc

SEQ ID NO: 266998 - DNA, 75 bp, Artificial Sequence
  Synthetic
gtggtggagaagatggtgctcggtcaaattggcccaaagaccgtaaaggctgtgtgcggggatgcatatgggttt

SEQ ID NO: 266999 - DNA, 75 bp, Artificial Sequence
  Synthetic
atgttcctggcgacccagtgtcccatggactacgacgtgatcatatgcgatgaatgccattccactgacggcacc

SEQ ID NO: 267000 - DNA, 75 bp, Artificial Sequence
  Synthetic
gtcacgccgcaagaacgtgtgcggaaattggtaagcatgtggcaatccaaacaaaaacctgccggattcacttgt

SEQ ID NO: 267001 - DNA, 75 bp, Artificial Sequence
  Synthetic
accgtcctcggcattggtggcgccctggccgcattcgcagacgtggaaaggcccaagctcctcctcttggctaca

SEQ ID NO: 267002 - DNA, 75 bp, Artificial Sequence
  Synthetic
gacaccgtgtgctttgacagcactatcacgcccgcagacgtggcggttgagagttcgctctatgaagctgccacg

SEQ ID NO: 267003 - DNA, 75 bp, Artificial Sequence
  Synthetic
gcaaccccgccggggacgggcatggtagaccatccaaacatcaagaccatcgccctcacagacgagggtgatttc

SEQ ID NO: 267004 - DNA, 75 bp, Artificial Sequence
  Synthetic
actgatgagagaacccgtaggcgcataagatcattacatgacaacctatacgctggagggcccatggtaatgcaa

SEQ ID NO: 267005 - DNA, 75 bp, Artificial Sequence
  Synthetic
cccttccatgggaagaagatcaaattagacagactcaggagaggcagacatctgatcttcgaggcatccaaaaag

SEQ ID NO: 267006 - DNA, 75 bp, Artificial Sequence
  Synthetic
ggtgctgaagtgggctacaggaggtgccgagcgtctggagtttttacgacctcaagctccaacactatgacgtgc

SEQ ID NO: 267007 - DNA, 75 bp, Artificial Sequence
  Synthetic
cactgtgacgagcttgccagagacctggagatggccgggatcacggcagtttcgtactacagggggaaaagctgc

SEQ ID NO: 267008 - DNA, 75 bp, Artificial Sequence
  Synthetic
ttccttaaggtatccgcggccgccaaagctgcgggtatcgcatcacccagctggttgatttgtggagatgacacg

SEQ ID NO: 267009 - DNA, 75 bp, Artificial Sequence
  Synthetic
tcggcaatcccgccggagggtgacgtggttgtagtggccactgacgcactcatgacgggttactcgggtaacttt

SEQ ID NO: 267010 - DNA, 75 bp, Artificial Sequence
  Synthetic
gtgtgcatatttgagtctagcggtgaggagactgacaaacagaaatgcgctcaatttgcagtggccatgaagcgc

SEQ ID NO: 267011 - DNA, 75 bp, Artificial Sequence
  Synthetic
gactcggtgtatgactgctgcctggctgttgaaggttctgtcgaggttgacatgtgccccactttcacggtggga

SEQ ID NO: 267012 - DNA, 75 bp, Artificial Sequence
  Synthetic
atgggggccccccagggggaggtcccgaaaccttattatcatttggaactactggactcctgttccagcaatgtc

SEQ ID NO: 267013 - DNA, 75 bp, Artificial Sequence
  Synthetic
atccaaaccaagcctgcctgctccatcaaaagaatgcaacgcaggggtagaaccggtcgtgggagagagggtttc

SEQ ID NO: 267014 - DNA, 75 bp, Artificial Sequence
  Synthetic
tcctctgccaacactaaattaggcttatattactacatgactagggatccgcgcataccattggcgcgatcgtca

SEQ ID NO: 267015 - DNA, 75 bp, Artificial Sequence
  Synthetic
tactacccggtaacagaagcatgtacccccggtggcatagtgcctgacgcgagcatctacgaggcatttgactcc

SEQ ID NO: 267016 - DNA, 75 bp, Artificial Sequence
  Synthetic
attgagggaaagggctacaacccactgggcacttggcttgggtatatattggcaaactaccctgcagtgtgggtt

SEQ ID NO: 267017 - DNA, 75 bp, Artificial Sequence
  Synthetic
gggagagcgtacttcggtctcactgtggccgaggtagcacgctatctcgactactacaaaaaccagactttccta

SEQ ID NO: 267018 - DNA, 75 bp, Artificial Sequence
  Synthetic
tgtagagtgctgtgtgtgcaattcttacagcaactgttaacacaggaatcagtaaaagaaataacctttgattgg

SEQ ID NO: 267019 - DNA, 75 bp, Artificial Sequence
  Synthetic
ccaatttggcactgtgagactgaggacgtggagaacctatacgctaccctgccccacccaaagccatcaacactc

SEQ ID NO: 267020 - DNA, 75 bp, Artificial Sequence
  Synthetic
tatggcaacaattataagattcctgttgcaaagattccttacatcatagaatcattacatgggaagcagtgctgg

SEQ ID NO: 267021 - DNA, 75 bp, Artificial Sequence
  Synthetic
gaccactgcaaggaacatgcagagaatttcccctacctgcacgccgtacagctggatcacgcctccaccaatgga

SEQ ID NO: 267022 - DNA, 75 bp, Artificial Sequence
  Synthetic
caaattcaagcatacacgcccagagaaatacagcgtgtgagccaggcgttgcatgataacaccatcaggccccta

SEQ ID NO: 267023 - DNA, 75 bp, Artificial Sequence
  Synthetic
tgaatggctcccaattcagaccccgtgtggaggcctctgaagggtaaagaaaagttcttcatgctttacaggctc

SEQ ID NO: 267024 - DNA, 75 bp, Artificial Sequence
  Synthetic
tgtatggctcccaattcagaccccgtgtggaggcctctgaagggtaaagaaaagttcttcatgctttacaggctc

SEQ ID NO: 267025 - DNA, 75 bp, Artificial Sequence
  Synthetic
tgcatggctcccaattcagaccccgtgtggaggcctctgaagggtaaagaaaagttcttcatgctttacaggctc

SEQ ID NO: 267026 - DNA, 75 bp, Artificial Sequence
  Synthetic
tggatggctcccaattcagaccccgtgtggaggcctctgaagggtaaagaaaagttcttcatgctttacaggctc

SEQ ID NO: 267027 - DNA, 75 bp, Artificial Sequence
  Synthetic
agatactacaaaagagcagcaaggcaagtcttcgcagcatgcatgcagcggaaagggaccttacggttcctcgct

SEQ ID NO: 267028 - DNA, 75 bp, Artificial Sequence
  Synthetic
gggaagtacgaggaaggcaagaccatcgagagctacctgacagaggagattgagaaggtgttctgcaactactac

SEQ ID NO: 267029 - DNA, 75 bp, Artificial Sequence
  Synthetic
aagacgctgctgtggtgggtgcaccaggtgaaggttgaactcgacccccgcaaggtggccatggtgaaagaattc

SEQ ID NO: 267030 - DNA, 75 bp, Artificial Sequence
  Synthetic
tgcggacttgtggctacaatatctggtatagggttgtcttgcgcggcgatctacctggcgatcgatatgtttggc

SEQ ID NO: 267031 - DNA, 75 bp, Artificial Sequence
  Synthetic
tccccttacgatccctatagcaatccagatattttggaggaaaaaccatcaatcaattggatgtatctaggcatg

SEQ ID NO: 267032 - DNA, 75 bp, Artificial Sequence
  Synthetic
cacatcaccatcaagagaggctggcagatcacggatgacaccaccgccgctaagggggccgaaccgaaaccctta

SEQ ID NO: 267033 - DNA, 75 bp, Artificial Sequence
  Synthetic
cacatcaccatcaagagaggctggcagatcacggatgacaccaccgccgctaagggggccgaaccgataccctta

SEQ ID NO: 267034 - DNA, 75 bp, Artificial Sequence
  Synthetic
cacatcaccatcaagagaggctggcagatcacggatgacaccaccgccgctaagggggccgaaccgacaccctta

SEQ ID NO: 267035 - DNA, 75 bp, Artificial Sequence
  Synthetic
cacatcaccatcaagagaggctggcagatcacggatgacaccaccgccgctaagggggccgaaccgagaccctta

SEQ ID NO: 267036 - DNA, 75 bp, Artificial Sequence
  Synthetic
atcaattggatgtatctaggcatgggaatcatagcgctgtgtgcgctgtgcctagcaaatttcaaaatatggtag

SEQ ID NO: 267037 - DNA, 75 bp, Artificial Sequence
  Synthetic
gagcaggagatggacaccgcaggaatggaggagtgcgcgaacgagcccatcattgacgcagcccacaagatctgg

SEQ ID NO: 267038 - DNA, 75 bp, Artificial Sequence
  Synthetic
gagaggctgcaggccacctggaacacgcttctcaatggcgccaaccccacggccaaccaaatgattccccatctg

SEQ ID NO: 267039 - DNA, 75 bp, Artificial Sequence
  Synthetic
cttgccggcatgcaatggttggccggcctttgggcgctgggcgacgcccctggtgtgggtgttgtcttgggctgc

SEQ ID NO: 267040 - DNA, 75 bp, Artificial Sequence
  Synthetic
ataggcggctatatgtccccctttcctcttgcttccaacctcttcatcaccggcataggagcggcattcgccacc

SEQ ID NO: 267041 - DNA, 75 bp, Artificial Sequence
  Synthetic
ataggcggctatatgtccccctttcctcttgcttccaacctcttcatcaccggcattggagcggcattcgccacc

SEQ ID NO: 267042 - DNA, 75 bp, Artificial Sequence
  Synthetic
ataggcggctatatgtccccctttcctcttgcttccaacctcttcatcaccggcatcggagcggcattcgccacc

SEQ ID NO: 267043 - DNA, 75 bp, Artificial Sequence
  Synthetic
ataggcggctatatgtccccctttcctcttgcttccaacctcttcatcaccggcatgggagcggcattcgccacc

SEQ ID NO: 267044 - DNA, 75 bp, Artificial Sequence
  Synthetic
aagattgctcctccgcgggctgctgccgcttttggggtggctggcgcgcttggcgctgcagctgcagtcgccggg

SEQ ID NO: 267045 - DNA, 75 bp, Artificial Sequence
  Synthetic
tggggcagcgtcctctgctcaattctttctgcttactctgctagcacttcagcttgcctggtcgtaattaagctc

SEQ ID NO: 267046 - DNA, 75 bp, Artificial Sequence
  Synthetic
cttaacggccagttgcccactgtggccgaggctgcttctgccttctttgccttggctagccctggtggcgccctc

SEQ ID NO: 267047 - DNA, 75 bp, Artificial Sequence
  Synthetic
atgggggccgccacagccatgctcatcatctggctgaccagggccgaggacaacacctggatgaataggttgctc

SEQ ID NO: 267048 - DNA, 75 bp, Artificial Sequence
  Synthetic
gccatgctccacaagggcacgtcgtgcgacaactactttacccaggctaccaccatgcgccagactgtgatcacg

SEQ ID NO: 267049 - DNA, 75 bp, Artificial Sequence
  Synthetic
ttcctggaaaacgccaacatctgggccgtgttcaacaggctggctacctggttcaacacatcagaagaggagatc

SEQ ID NO: 267050 - DNA, 75 bp, Artificial Sequence
  Synthetic
tgcgacggatccactatccggggccggctgcacgacatagcagaggcgctgggtcgattcatgcggttcatagtg

SEQ ID NO: 267051 - DNA, 75 bp, Artificial Sequence
  Synthetic
gaatccgttagaggcctaatcgctagaggcctccccaggcccattttgcccttaatgggctgtgacaagtcatac

SEQ ID NO: 267052 - DNA, 75 bp, Artificial Sequence
  Synthetic
aaggggccgtggatgggcagtggaccagtgagatccacgtgcggttgtggattagaaggcacgtggatgatttct

SEQ ID NO: 267053 - DNA, 75 bp, Artificial Sequence
  Synthetic
gaaggcaaggccagacaggtggctgtgtctaagaggtgtaaggcgtactggacggggggcgtgccgattaacaac

SEQ ID NO: 267054 - DNA, 75 bp, Artificial Sequence
  Synthetic
acaacccaggcaggtcctacccccgctcccatgggatgggagactatggtaattcgcgtgggctacgacgattac

SEQ ID NO: 267055 - DNA, 75 bp, Artificial Sequence
  Synthetic
cgccagtaccacaggaaggatggcgaagtttggctcatggcggtcagtcaccaggactgctatgtgaagcctgac

SEQ ID NO: 267056 - DNA, 75 bp, Artificial Sequence
  Synthetic
gcccctttacttgagaacgcagtcgtggtcgacggcgtacaaatcgtgcccactgcaggggatgggtggaagcag

SEQ ID NO: 267057 - DNA, 75 bp, Artificial Sequence
  Synthetic
tgcggtacatacaaggtgcgggtccttgagggcgacaaggtcactgaggtgaagcccccctttaaattgtccgac

SEQ ID NO: 267058 - DNA, 75 bp, Artificial Sequence
  Synthetic
tacaaaatagttgaggataagggacacccatccgaagaccagaaggctcgattggccgccttcatcaccacagcg

SEQ ID NO: 267059 - DNA, 75 bp, Artificial Sequence
  Synthetic
gagggctacgcatccaccttgcgtaagctcaaccaattggacaaacaggacgtggtgagcgagacaagctcaatg

SEQ ID NO: 267060 - DNA, 75 bp, Artificial Sequence
  Synthetic
gcagattatgccatccggcgcaagagggccgacatcaagaggaaggccctgggttctgagggtggcctcgggaag

SEQ ID NO: 267061 - DNA, 75 bp, Artificial Sequence
  Synthetic
aaggccgccgatgacttgccaccactcccaaagaaagaggaattggtcgtcaccagtgaaatgtggcatgctgcc

SEQ ID NO: 267062 - DNA, 75 bp, Artificial Sequence
  Synthetic
aggggtgtaagggaacggctggctaggagctttcctacaaaggaggcgatcagccccacttgcttcgacacctta

SEQ ID NO: 267063 - DNA, 75 bp, Artificial Sequence
  Synthetic
aaaggccctgtccccaaggagtgctttgtgacgttcggcgctccagcgtcaactgagagtgtgcgctccatcgcc

SEQ ID NO: 267064 - DNA, 75 bp, Artificial Sequence
  Synthetic
aaaaccccccaggaacctgacgaccaaaagtcagcaggagatttgtcacccgcccccctaatccagggcaggccc

SEQ ID NO: 267065 - DNA, 75 bp, Artificial Sequence
  Synthetic
gcccctgtggagaagaccaagccctccccccagacgcttgtggtggccgacgtccacaggcgcagtgcaacgccg

SEQ ID NO: 267066 - DNA, 75 bp, Artificial Sequence
  Synthetic
tcggtggccccgtcagccaactcagtccagagtggtgtggggtctgactcatgggaaacaatggattcggaggag

SEQ ID NO: 267067 - DNA, 75 bp, Artificial Sequence
  Synthetic
ttgtgttcggactcgtggctaaacaagtgccacaccactacagctcggcccgccaacccaggttggtctagctgt

SEQ ID NO: 267068 - DNA, 75 bp, Artificial Sequence
  Synthetic
agtaagtcctacacctggctcctaccaaggctcgtttacaaggcaactcgacgcgtattctctgcagtgtcaacc

SEQ ID NO: 267069 - DNA, 75 bp, Artificial Sequence
  Synthetic
ttcaccagcggcatgatggagaacaaataccaggcgtacgccacaacccccgagtcggtcaacgaaaggattaag

SEQ ID NO: 267070 - DNA, 75 bp, Artificial Sequence
  Synthetic
aaggtcaccatcagcaggtctcgagttgagacggaccatctcagagaggtgatccaggaggccagggaagctgtc

SEQ ID NO: 267071 - DNA, 75 bp, Artificial Sequence
  Synthetic
aaggtcaccatcagcaggtctcgagttgagacggaccatctcagtgaggtgatccaggaggccagggaagctgtc

SEQ ID NO: 267072 - DNA, 75 bp, Artificial Sequence
  Synthetic
aaggtcaccatcagcaggtctcgagttgagacggaccatctcagcgaggtgatccaggaggccagggaagctgtc

SEQ ID NO: 267073 - DNA, 75 bp, Artificial Sequence
  Synthetic
aaggtcaccatcagcaggtctcgagttgagacggaccatctcagggaggtgatccaggaggccagggaagctgtc

SEQ ID NO: 267074 - DNA, 75 bp, Artificial Sequence
  Synthetic
tctggcttagggttggctgaaatgaccctcggggaagcactgtccatcacggctaataaaacagccaagagccag

SEQ ID NO: 267075 - DNA, 75 bp, Artificial Sequence
  Synthetic
atcactggtgcaacggctgcaacactcaaggctggctacacggatgatgtctggagagtctacgacgcactgacc

SEQ ID NO: 267076 - DNA, 75 bp, Artificial Sequence
  Synthetic
ctcggcaacgtaccagaaccatggaatcaagtgtgtgtgatgcccaaatcagaagtatttgtaaggacccctgaa

SEQ ID NO: 267077 - DNA, 75 bp, Artificial Sequence
  Synthetic
aaacccacgcagaagccggccagaattatagcttacccccatctggaaatgagagtagtggaaaagatggtgctg

SEQ ID NO: 267078 - DNA, 75 bp, Artificial Sequence
  Synthetic
ggccacatagggccagctaccgtcaagaaggtgtgcgggccggcatatgggttccaatacaatcccaaggagcgt

SEQ ID NO: 267079 - DNA, 75 bp, Artificial Sequence
  Synthetic
gtgagcaggctgcttagcatgtggtattccaaggagaggcctatgggcttctcttgtgatacagtgtgctttgac

SEQ ID NO: 267080 - DNA, 75 bp, Artificial Sequence
  Synthetic
tccacgatcactccggaagacatggacgtggaatgcgagctttattgtcttgcagcagcggacaacacaacgcgc

SEQ ID NO: 267081 - DNA, 75 bp, Artificial Sequence
  Synthetic
tgtaggataagggccctccacgaccacctctacaagggaggccccatggtgatgcagggcactcatgtaggtcag

SEQ ID NO: 267082 - DNA, 75 bp, Artificial Sequence
  Synthetic
cgccactgtagggcttcaggagtttttacaaccagcagcagcaacaccatcaccgcttacctcaaggtcaaagca

SEQ ID NO: 267083 - DNA, 75 bp, Artificial Sequence
  Synthetic
gccgctagggctgccggcatccaaaatccctcctggctagtttgcggggacgatgtaatttgcatttgtgagcag

SEQ ID NO: 267084 - DNA, 75 bp, Artificial Sequence
  Synthetic
tccgcggatgacaaggggaagctggagcggttcgctctagagatgcgccggatgggggccccgcaaggggagatc

SEQ ID NO: 267085 - DNA, 75 bp, Artificial Sequence
  Synthetic
ccagtcccggcctattctctggagttgattgattcgtgctcctctaatgtgtccgtggcccaactcaagaatggg

SEQ ID NO: 267086 - DNA, 75 bp, Artificial Sequence
  Synthetic
aaacaatatcattatctcactagatccccggaaatccccttagccagggcctccgtagaaggtaagagatttaat

SEQ ID NO: 267087 - DNA, 75 bp, Artificial Sequence
  Synthetic
cccttaggcacttggttaggctatataattgctaattatcccgctgtgtgggtttctaggcttttatgtgtgatt

SEQ ID NO: 267088 - DNA, 75 bp, Artificial Sequence
  Synthetic
tttttacaacaattaagcttacaagatgatttaaatagtatagagtttgaatggtatggcaatcactatacagta

SEQ ID NO: 267089 - DNA, 75 bp, Artificial Sequence
  Synthetic
cccctggccaaaatcccgtacgtgattgagcacctccatggagaggagtgctgggatattaagtcatacactgcc

SEQ ID NO: 267090 - DNA, 75 bp, Artificial Sequence
  Synthetic
agggaaataacccgtacaggaagtaggctccaggccatcaaaatgaaaccactacggttctggaagcggctagga

SEQ ID NO: 267091 - DNA, 75 bp, Artificial Sequence
  Synthetic
aggtctatttatgcatcttgtgtccgacggcgcggggtgcacgccttcctggctaagactctcctgtcatgggta

SEQ ID NO: 267092 - DNA, 75 bp, Artificial Sequence
  Synthetic
ccaggtaaacatcccaacctggataaaagtaaggtgagggccgttcaattacggttctatgacccttactacaaa

SEQ ID NO: 267093 - DNA, 75 bp, Artificial Sequence
  Synthetic
tttacagaggaggagaagagtgtgaagtattggttcgcggcggctctgctattcacactagcggcagccgttgcc

SEQ ID NO: 267094 - DNA, 75 bp, Artificial Sequence
  Synthetic
agtgtgaagtattggttcgcggcggctctgctattcacactagcggcagccgttgccctctttactctccactaa

SEQ ID NO: 267095 - DNA, 75 bp, Artificial Sequence
  Synthetic
atgtcccacagcgagcctgggataaccgggggtcggttcccagcctacagcctgatagggtcctgcggagggccg

SEQ ID NO: 267096 - DNA, 75 bp, Artificial Sequence
  Synthetic
aggcgtttccgctgtaaaccatctatggcttgcaatctctttttcaacttcccttccacaaaaaaaaaccaaaca

SEQ ID NO: 267097 - DNA, 75 bp, Artificial Sequence
  Synthetic
aaaagtgtgctccacctgtggtggagcttgtgtgtgtgtgtgtgtggcgtggtgatgtccaagcccgtccgcccg

SEQ ID NO: 267098 - DNA, 75 bp, Artificial Sequence
  Synthetic
ggccagtacattgtcacgaccaagcgccgaagtgacccaggcgctaagaggcgcaggaggcatcggcgggaccag

SEQ ID NO: 267099 - DNA, 75 bp, Artificial Sequence
  Synthetic
ggagggtggcgcaggtcacccatgggccctgttgatccgtacgtgcgacaagggttgcaaatcctcctgccatct

SEQ ID NO: 267100 - DNA, 75 bp, Artificial Sequence
  Synthetic
gctgcttaccccgttcgagatccgcgacggaagtcgaggttcctgggtcatatcatcgacggaactcttggctgg

SEQ ID NO: 267101 - DNA, 75 bp, Artificial Sequence
  Synthetic
accgctgatctcctgcatcacgttccgctggtcggcccgctggtcggtcaccctgctcgcctcatctgcagggcg

SEQ ID NO: 267102 - DNA, 75 bp, Artificial Sequence
  Synthetic
gttcgtgcgtgcgaggacgggatcaactcgttcacgggcattgccggggtccatcttttcctcatctgttgggcc

SEQ ID NO: 267103 - DNA, 75 bp, Artificial Sequence
  Synthetic
cacatgctttctccggctagcgctggcattttcccgtacttgcctggccccctggacgagtttgctacctctacc

SEQ ID NO: 267104 - DNA, 75 bp, Artificial Sequence
  Synthetic
tttggaactattgctagactttcttacgatctgctcaccgccactgaggaaacccccacggtctctcctaccgtg

SEQ ID NO: 267105 - DNA, 75 bp, Artificial Sequence
  Synthetic
ccctctgtcggtggtcggcagtcgtacccacagctagtccctctcactaattgctgcaaccactctcaagtttcc

SEQ ID NO: 267106 - DNA, 75 bp, Artificial Sequence
  Synthetic
tactgtactgagctttcctgcatgcatgatactggctgtgtcatctgcgagcaagtgggtaacgcttccttgtgt

SEQ ID NO: 267107 - DNA, 75 bp, Artificial Sequence
  Synthetic
tgggtcccacaaggccccatggtatccaggtcaccgcactaccaaggagctgacccctttctcgcccaccatata

SEQ ID NO: 267108 - DNA, 75 bp, Artificial Sequence
  Synthetic
gactttgtcgcaggaatgatctatatgtgtgatctggccgcaatgcatgaattgtgcggcgcgatggtcctgctc

SEQ ID NO: 267109 - DNA, 75 bp, Artificial Sequence
  Synthetic
gcaagggcgggcatcgctacagtgcctgtggccatccagctgaataccaccgctgactgctacctggaagtgcag

SEQ ID NO: 267110 - DNA, 75 bp, Artificial Sequence
  Synthetic
tccggcgtggacccgtccatcctgggttgggtgggttggctgaaggatgagttcgtttctgtaactgccttattc

SEQ ID NO: 267111 - DNA, 75 bp, Artificial Sequence
  Synthetic
agctttgcttcaaagatcccttctgctcttgcctttgcttttggcaagtctcattacatcaccctggcggccatc

SEQ ID NO: 267112 - DNA, 75 bp, Artificial Sequence
  Synthetic
tgcgggttggcgctgaatggacatgtcccgaaagctgtcgcgctcacagtactgtatgtggaggcggcagtcgct

SEQ ID NO: 267113 - DNA, 75 bp, Artificial Sequence
  Synthetic
gcgccggtctctatgccggggctcgattgcccctggaatgctcagcctcctccctgcaacttttccgccgggtgg

SEQ ID NO: 267114 - DNA, 75 bp, Artificial Sequence
  Synthetic
actaatctggcctgctatggccagaaaggtcctttcctgccccctccgattgccaggttcgcttccgacatcata

SEQ ID NO: 267115 - DNA, 75 bp, Artificial Sequence
  Synthetic
ggaacactggttgcgaatggcgtcaacgcctcgcgtgctgaggaagctgtcacatcaagaaaggcataccatgtg

SEQ ID NO: 267116 - DNA, 75 bp, Artificial Sequence
  Synthetic
ggaggctttggttgcataggcacactaggcgggaaccggacgtgctgctcactgcggcgcgtgccttcactctgt

SEQ ID NO: 267117 - DNA, 75 bp, Artificial Sequence
  Synthetic
gacgcctgcgcatccgattgctcctggatgggtaaggaactcacctatgagagatgtggcaccacaccctggcta

SEQ ID NO: 267118 - DNA, 75 bp, Artificial Sequence
  Synthetic
acaactggatgtgacctacaaaacggcacgtgccgtggcgaggtcctggctggcttcaacctacctgccaccttc

SEQ ID NO: 267119 - DNA, 75 bp, Artificial Sequence
  Synthetic
ccccccggtgtcgctcagtggaccaccatacgattccaggacggacatcccgtgatggtttggtacaaggtatgg

SEQ ID NO: 267120 - DNA, 75 bp, Artificial Sequence
  Synthetic
gacaagcctgcctcacagtgggccagactcccgggcacaccagagcagtaccgggggtcgtggatgaaagttcct

SEQ ID NO: 267121 - DNA, 75 bp, Artificial Sequence
  Synthetic
aagggatattattcgtcccggcgggacttgagcactggcctcatttccaaagacagcaactaccctgactaccag

SEQ ID NO: 267122 - DNA, 75 bp, Artificial Sequence
  Synthetic
cttttttactccgcttcgggttcacttcagatcgccgggatcaccacgcacctcgtcattgttgcttgcctggcg

SEQ ID NO: 267123 - DNA, 75 bp, Artificial Sequence
  Synthetic
gccttgggggcccgttggtgccttgtagcctatgctctgttcaactctatgctgcccgtcggtgctttggaagtt

SEQ ID NO: 267124 - DNA, 75 bp, Artificial Sequence
  Synthetic
gtcaaggctgccaccgcggcctcgacacacgacctatggattgtgcgggcggtagtctacattgtgtgccttcgc

SEQ ID NO: 267125 - DNA, 75 bp, Artificial Sequence
  Synthetic
tggtctatgttggctaagctgcttactaaacagtcctgctttttcattttgctttccctggcagatgtggttgag

SEQ ID NO: 267126 - DNA, 75 bp, Artificial Sequence
  Synthetic
gcttacgagggcggtgagttgcggtttgctggagccctagtgatctttgccaccctgttatctggtcttctctcc

SEQ ID NO: 267127 - DNA, 75 bp, Artificial Sequence
  Synthetic
acccttgtgcctcgattggttctcactctgagctacctgcgctggcggctaaggttctttggcatctaccttgct

SEQ ID NO: 267128 - DNA, 75 bp, Artificial Sequence
  Synthetic
gacaggcgcattgtattgcttggtgttctgcttgctcccaatgctgtagctttctgctgctggaccttctggttc

SEQ ID NO: 267129 - DNA, 75 bp, Artificial Sequence
  Synthetic
tgctatctaggcttggtatgtttgcagcaagtggtcgtgcactgcttgggcatcaggacacgccagggcttcttc

SEQ ID NO: 267130 - DNA, 75 bp, Artificial Sequence
  Synthetic
accaccattaagaaactggagggtagcgcgaattggctcaggcgcttcctactaaaagttgccatctgggctgga

SEQ ID NO: 267131 - DNA, 75 bp, Artificial Sequence
  Synthetic
gccgaggaagggaatttctggtacaaccacctgcacggagacctccgtatcaattggcaattccaagatccctat

SEQ ID NO: 267132 - DNA, 75 bp, Artificial Sequence
  Synthetic
ttccctttccaaactgaagtagagaccgctgaggacactggttttaaattggcctgtggcgacaccctaaagggc

SEQ ID NO: 267133 - DNA, 75 bp, Artificial Sequence
  Synthetic
ctgccagtgtacgcaagattgggcaagacggtcagagcgggcatctcctctctcccacggggatggaggttcacc

SEQ ID NO: 267134 - DNA, 75 bp, Artificial Sequence
  Synthetic
gcccccttcaatctaagaacagtccagagtagacgagagctgtcgcacctggctctctgtcttacggggcatgat

SEQ ID NO: 267135 - DNA, 75 bp, Artificial Sequence
  Synthetic
tcagcagtctacaatggatcgatctgtgtaattggcactcccctgtcacgcttcatgggctttgggtgtaacggt

SEQ ID NO: 267136 - DNA, 75 bp, Artificial Sequence
  Synthetic
gtgctttacacggcggcacacggaacaaacgggagacacctggcccttgatggcggatcaaggccccccatcgtg

SEQ ID NO: 267137 - DNA, 75 bp, Artificial Sequence
  Synthetic
tatgacaaggtgaaggactttgccacttatcccctccccaaggggatgaagtgtttagaggccggatcctgtagt

SEQ ID NO: 267138 - DNA, 75 bp, Artificial Sequence
  Synthetic
tgtacagagttctacttggctaccaggttgggcaatctggtaccctgtgtcaagatagatggctcatatgtcaac

SEQ ID NO: 267139 - DNA, 75 bp, Artificial Sequence
  Synthetic
accacaccgctgactcttaaggaggctaagggctcttccggggccccgatcatctgcaagtgtcggtatgttcat

SEQ ID NO: 267140 - DNA, 75 bp, Artificial Sequence
  Synthetic
gccatctttctaaggtgcaggagttctaagggagtggttagtagcctgacaggactccccattgactccgctaag

SEQ ID NO: 267141 - DNA, 75 bp, Artificial Sequence
  Synthetic
gttggggcccaggtacctgaggccgcagacctgggcaagttaccaccagtgctaaaggaggaacagtcaattagg

SEQ ID NO: 267142 - DNA, 75 bp, Artificial Sequence
  Synthetic
atgatagtagcgcccaccggttcgggaaagtcaacaaaaatccccatggaatactacaagcaagggtacaaggtc

SEQ ID NO: 267143 - DNA, 75 bp, Artificial Sequence
  Synthetic
ctcgtgcttaatcccagtgtcgcgacgacgctgaactttgaagagtacatggctaagcagtacggggtccgaccg

SEQ ID NO: 267144 - DNA, 75 bp, Artificial Sequence
  Synthetic
aacatccactgtggcgatacccatcatgacaacggctcaaggctcacgtacatgacgtatggcatgttcttggcg

SEQ ID NO: 267145 - DNA, 75 bp, Artificial Sequence
  Synthetic
aagaacctgctggacgcagacgtgatcatctgcgacgagtgccacgccgttgacgccaccaccgtgcttggaatt

SEQ ID NO: 267146 - DNA, 75 bp, Artificial Sequence
  Synthetic
ggtgccgcgctccacaaatttgagaattctcctgtagcaaagttgctgcttcttgctacggccacgcctccagga

SEQ ID NO: 267147 - DNA, 75 bp, Artificial Sequence
  Synthetic
accccagtcaccccacatcccaatgtggagaccatcgatctggaccaggacggcgagatcccattccatggcaag

SEQ ID NO: 267148 - DNA, 75 bp, Artificial Sequence
  Synthetic
aagattaaaattggcaatatccaaaaaggcaggcatctcatcttccagacgtctaaatcccactgtgacaatttg

SEQ ID NO: 267149 - DNA, 75 bp, Artificial Sequence
  Synthetic
gccaacgatctgagggcggcaggtcttaacgcggtgtcctattaccgggggaaagacattagttgcattcctagc

SEQ ID NO: 267150 - DNA, 75 bp, Artificial Sequence
  Synthetic
tccggcgactgtgtcgtcgttgccacggatgcgctgatgactgggtacaccggtaacttcgactccgtatacgac

SEQ ID NO: 267151 - DNA, 75 bp, Artificial Sequence
  Synthetic
tgctgcctaatggtcgaacccacgctggaagttgacatgatgccaacattcaaattggggctgagaactaaggct

SEQ ID NO: 267152 - DNA, 75 bp, Artificial Sequence
  Synthetic
agaagttcatctgtgtgaacttcgtgattgacagctcaacacgagtgcgggcaaccgtaaacacagtttgaacgt

SEQ ID NO: 267153 - DNA, 75 bp, Artificial Sequence
  Synthetic
gattgacagctcaacacgagtgcgggcaaccgtaaacacagtttgaacgttttttggagagagactactatgtca

SEQ ID NO: 267154 - DNA, 75 bp, Artificial Sequence
  Synthetic
aacaaaaaaccaggaagacccggggcaacccgggttgtcaatatgctaaagcgcggcgcatcccgcggaaatccg

SEQ ID NO: 267155 - DNA, 75 bp, Artificial Sequence
  Synthetic
atatctcggatcaagaggatgttggatgggctattcaagggaataggacccatcaggattgtccttgcattcctg

SEQ ID NO: 267156 - DNA, 75 bp, Artificial Sequence
  Synthetic
acgtttttcaaatttacagctttgaaaccgacggcaggattgttgagacgatggaagattgttggtgtggcggaa

SEQ ID NO: 267157 - DNA, 75 bp, Artificial Sequence
  Synthetic
gccacgcgacatctaaaaagttttaggaaggacataggacagatgttggatggactcaacaagagaggaaagaag

SEQ ID NO: 267158 - DNA, 75 bp, Artificial Sequence
  Synthetic
aaaagaggaggaagcactggtggtttgcttttgattattagcttctcatgtgcgtgtgcccttaaggtgggatcg

SEQ ID NO: 267159 - DNA, 75 bp, Artificial Sequence
  Synthetic
tacaatggaaagccgctgatcactgtaaaccaagcggacgtgcagaacccaattgagctaccaacagcacaggga

SEQ ID NO: 267160 - DNA, 75 bp, Artificial Sequence
  Synthetic
acgaaccgatgcatggtgaaagctttggatgttggactcatgtgtcctgacgacataacatatttgtgccccaag

SEQ ID NO: 267161 - DNA, 75 bp, Artificial Sequence
  Synthetic
cttgaaaatggatatgaccctgaggacattgattgctggtgcaacggaacggaagtgtacatacattatggtcgg

SEQ ID NO: 267162 - DNA, 75 bp, Artificial Sequence
  Synthetic
tgcacgccgacgagacatgccagacggtcaagaagagcgatcacagtccatcatcatggcgaaagcctattggaa

SEQ ID NO: 267163 - DNA, 75 bp, Artificial Sequence
  Synthetic
gcgaagaacacaccatggatggactcaacaaaagccacaaagtacttgactaaggttgagaactgggctattcga

SEQ ID NO: 267164 - DNA, 75 bp, Artificial Sequence
  Synthetic
aatccaggatacgctctagccgcagccatagtgggttggaacttggggaccaccaaagcacaaaagataatcttt

SEQ ID NO: 267165 - DNA, 75 bp, Artificial Sequence
  Synthetic
accatcatgctcatgctcattgcaccagcgtacagtttcaattgcttgggcatgcagaaccgtgactttgttgaa

SEQ ID NO: 267166 - DNA, 75 bp, Artificial Sequence
  Synthetic
ggcgtgaatggagttgagtggattgatgttgtaatggaaggaggaagttgtgtgactataacggcgaaagacaaa

SEQ ID NO: 267167 - DNA, 75 bp, Artificial Sequence
  Synthetic
ccaacaattgatgtcaaaatgatgaacatggaggcaactgacttggccctcgtccgctcttattgctatgaaccc

SEQ ID NO: 267168 - DNA, 75 bp, Artificial Sequence
  Synthetic
aaaataaccgatgtcagtacagagccacgctgcccaaccatgggagaggcccacaatacaaaggcatccagtcaa

SEQ ID NO: 267169 - DNA, 75 bp, Artificial Sequence
  Synthetic
gactacgtatgtaagaaaggattgacggacagaggatggggaaatggctgtggactgtttggaaaaggaagcatt

SEQ ID NO: 267170 - DNA, 75 bp, Artificial Sequence
  Synthetic
catacatgtgcaaaattcgaatgcacacataaagctgaagggagggtagtgcagaaagaaaacatccagtttgaa

SEQ ID NO: 267171 - DNA, 75 bp, Artificial Sequence
  Synthetic
gtggctgtcttcgtgcatggctcgacggaagtcggaacttataacaactactctatacagcaatcactgaaacat

SEQ ID NO: 267172 - DNA, 75 bp, Artificial Sequence
  Synthetic
gctgcgagatttgtcatcacacccaaagctccggtgcacacagcagagctgagtgagtatggaacggtcactctg

SEQ ID NO: 267173 - DNA, 75 bp, Artificial Sequence
  Synthetic
gaatgtgaaccgcggtcaggtcttgatatgagtcaattttatgtgatgaccatgaacatgaagagctggctagtg

SEQ ID NO: 267174 - DNA, 75 bp, Artificial Sequence
  Synthetic
aacagagactggttccatgatttaaatctgccatggaccggttcagcagcaggaaattggcaaaatagagagtca

SEQ ID NO: 267175 - DNA, 75 bp, Artificial Sequence
  Synthetic
ctagttgaatttgaggaggcgcacgccaccaagcaatcagtggttgctttggcctctcaagaaggagccctgcac

SEQ ID NO: 267176 - DNA, 75 bp, Artificial Sequence
  Synthetic
gcggcactggccggagcaattcctgtgaagtacacaagcagcaagctggaaatgacatcaggacacttgaaatgt

SEQ ID NO: 267177 - DNA, 75 bp, Artificial Sequence
  Synthetic
agggtaaaattgcaaggattgaagttaaaaggaatgacttacccaatgtgctctaacaaattcagcctagctagg

SEQ ID NO: 267178 - DNA, 75 bp, Artificial Sequence
  Synthetic
aatcccacagacacggggcatggaacagtggtggtgaaattgagctatgctggctctgatggaccatgcagaata

SEQ ID NO: 267179 - DNA, 75 bp, Artificial Sequence
  Synthetic
ccaatctcaatgacagcaaatctacaggacttgaccccgatcggccgcatgataactgtgaacccatatgtttcc

SEQ ID NO: 267180 - DNA, 75 bp, Artificial Sequence
  Synthetic
acatcctccaccggaacgaaagtgatagttgaattggaaccaccctttggcgactcgttcatcctagttggtagt

SEQ ID NO: 267181 - DNA, 75 bp, Artificial Sequence
  Synthetic
ggagaaaatcaaattaaatatcagtggcataagagtgggagctcaattggtaaagcatttgtttccaccctcaag

SEQ ID NO: 267182 - DNA, 75 bp, Artificial Sequence
  Synthetic
ggagcccagcgtatggtggcacttggggatactgcctgggatttcggatcagtaggaggtttctttacctctctt

SEQ ID NO: 267183 - DNA, 75 bp, Artificial Sequence
  Synthetic
ggaaaaggaattcaccaagtctttggaacagcattcagaagcttgttcggaggcatgtcatggataacacaggga

SEQ ID NO: 267184 - DNA, 75 bp, Artificial Sequence
  Synthetic
cttctagggatcctaatgctttggatggggctgaatgccagagaccggtcaatatcgatcacattcttagcagtg

SEQ ID NO: 267185 - DNA, 75 bp, Artificial Sequence
  Synthetic
ggaggagtcctagtgtttctagcgaccaatgtccatgcggacactggttgtgctctggacatgtcaagaaaggaa

SEQ ID NO: 267186 - DNA, 75 bp, Artificial Sequence
  Synthetic
ctgaaatgtggaagtggcatctttgtgttcaatgatgttgagacttggagagacaattacaaatactacccagca

SEQ ID NO: 267187 - DNA, 75 bp, Artificial Sequence
  Synthetic
acaccaaggaatttggctaaagtgatcgtggaatcatacaggaaaggaatatgtggagtcagatcagtgagccgg

SEQ ID NO: 267188 - DNA, 75 bp, Artificial Sequence
  Synthetic
ttggaacacaacatgtgggattcgatcaagcatgaactcaatgccattctggaagacaacggggaggatttgaca

SEQ ID NO: 267189 - DNA, 75 bp, Artificial Sequence
  Synthetic
gtcgtggtggaaccaattgtgggacgtctcaggtcgacacagcgaagattgacgtggacggaagaagagttggaa

SEQ ID NO: 267190 - DNA, 75 bp, Artificial Sequence
  Synthetic
tatggatggaagaaatgggggaaaaccctctttacgagtccaggcatgtcaaacagaacttttgtggtggatggg

SEQ ID NO: 267191 - DNA, 75 bp, Artificial Sequence
  Synthetic
ccaaaaacgaaagagtgtcccgatgacaagagagcttggaacagcttgtacgttgaggactttggatttggcatc

SEQ ID NO: 267192 - DNA, 75 bp, Artificial Sequence
  Synthetic
acatccactagagtgtggatgggactgcgaaaggtgaacaccacggactgtgatacggcagtgatgggcacagcg

SEQ ID NO: 267193 - DNA, 75 bp, Artificial Sequence
  Synthetic
gtgaaaggagacgttgctgtgcacagtgacctgagctactggattgagagccgcaacaacaagacctggaaatta

SEQ ID NO: 267194 - DNA, 75 bp, Artificial Sequence
  Synthetic
gaacgagcagtgctaggagaagttaaatcgtgcacatggcctgagacacacactctgtggagtgaaagtgttatg

SEQ ID NO: 267195 - DNA, 75 bp, Artificial Sequence
  Synthetic
gagagtgacttaatcataccggttaccattgcgggaccacgtagtagacacaacatgagacctggatacaaagtg

SEQ ID NO: 267196 - DNA, 75 bp, Artificial Sequence
  Synthetic
cagaattctggaccttgggatgagaaggaaatcaccatagattttgactactgcccaggaacaacagtgaaagtg

SEQ ID NO: 267197 - DNA, 75 bp, Artificial Sequence
  Synthetic
acttcgacctgccatgacagggcagcatcagctcgaaccaccactgccagcgggaagctcattcaagactggtgt

SEQ ID NO: 267198 - DNA, 75 bp, Artificial Sequence
  Synthetic
tgcaggtcatgcacactcccaccattgagatacatgacaaaaagtggatgctggtatgccatggaaatccggccg

SEQ ID NO: 267199 - DNA, 75 bp, Artificial Sequence
  Synthetic
acaacacacggtgaggacacccttatcaagtctaaggtgagcgcattcagaggcgatggcatggaaccatttcaa

SEQ ID NO: 267200 - DNA, 75 bp, Artificial Sequence
  Synthetic
ctgggggttctcttgatgtttgtggccacacaggaagtcttgcggaagagatggacagcaggcatggcattacca

SEQ ID NO: 267201 - DNA, 75 bp, Artificial Sequence
  Synthetic
gcaatgctcatgtttttatgtgctttgatctttggtgggataacatacatggatctggttaggtacgtcatacta

SEQ ID NO: 267202 - DNA, 75 bp, Artificial Sequence
  Synthetic
gtggctgcagcttttgcggaaagcaacagtggaggtgacatcgtgcacttagcgctaatcgctgctttcaaaatt

SEQ ID NO: 267203 - DNA, 75 bp, Artificial Sequence
  Synthetic
cagccaggattactagttgcatactcactgaaaaggaaatggagcaaccaggagagtgttttggttggaattgcc

SEQ ID NO: 267204 - DNA, 75 bp, Artificial Sequence
  Synthetic
ctttcaatgttgaccttggccatgcaagattgggacatgacaatcccgagcctgcttaactcgggagcggccgct

SEQ ID NO: 267205 - DNA, 75 bp, Artificial Sequence
  Synthetic
tggttgctgctgagagctgtgagtgagggaacagtaagtgccgtctgcattccagtgctgggcatgctggctcct

SEQ ID NO: 267206 - DNA, 75 bp, Artificial Sequence
  Synthetic
ggacttcgcatcgcgggaattgacgtggttcgcataggattgctgatcatagggattatgtcgctgatgagggaa

SEQ ID NO: 267207 - DNA, 75 bp, Artificial Sequence
  Synthetic
cgcaacaatgcagcagcaaaaaagaaaggaggattgttgataggactggccctagcagaatctgggttgatcagc

SEQ ID NO: 267208 - DNA, 75 bp, Artificial Sequence
  Synthetic
cctcttgtttatgccggactaaccttggcactaaaaccaaacatgaggagaggatggccggtgagtgaagcactg

SEQ ID NO: 267209 - DNA, 75 bp, Artificial Sequence
  Synthetic
acagccgttggattgacgttcgcactggctggtggcatcgcacattttgatgaaggaaatatggccattccgtta

SEQ ID NO: 267210 - DNA, 75 bp, Artificial Sequence
  Synthetic
gcagtgggcggcataatgttggttgtggcagttgtgacagggttcacaacagatctatggctggaaaaagctgga

SEQ ID NO: 267211 - DNA, 75 bp, Artificial Sequence
  Synthetic
gaaatgacatggtctgaggaggcccaaataacgggtagctcccaacgatatgatgtggaaattgatagtgatggc

SEQ ID NO: 267212 - DNA, 75 bp, Artificial Sequence
  Synthetic
aacatgcgacttttgaatgatcctggaatacccttctcagtgtgggcgcttcgaacaggattgatacttttatcc

SEQ ID NO: 267213 - DNA, 75 bp, Artificial Sequence
  Synthetic
gcttacaacccttatctccttccagtgacgttgggagcttattggctcacagtcaaggctccgaaacgtagcgga

SEQ ID NO: 267214 - DNA, 75 bp, Artificial Sequence
  Synthetic
gcgatttgggatgttccagcaccaaaggaaagaaggaaagcagaaattagcacgggggtgtttagaatcatggcc

SEQ ID NO: 267215 - DNA, 75 bp, Artificial Sequence
  Synthetic
agaggaatttttggaaaataccaagctggagtaggcgtgatgtacgagggagtatttcacacaatgtggcatgtc

SEQ ID NO: 267216 - DNA, 75 bp, Artificial Sequence
  Synthetic
acgaacggtgccacgattaacgtgggtgacgggtgcctggtcccctactgggctagtgtcagggaagacctcata

SEQ ID NO: 267217 - DNA, 75 bp, Artificial Sequence
  Synthetic
tcctatggagggccatggaagctgggaaaaaagtggaatggagttgatgaagtgcaggtcgtggtggtccagcca

SEQ ID NO: 267218 - DNA, 75 bp, Artificial Sequence
  Synthetic
ggaaagccagccacaaatgtgcaaactaaacctgggatatttcgaacacatgcaggggaagttggagccgtcaca

SEQ ID NO: 267219 - DNA, 75 bp, Artificial Sequence
  Synthetic
ttggattaccccacaggaacatctggttcaccaatcattgataaagaaggcaacataattggcttgtatgggaat

SEQ ID NO: 267220 - DNA, 75 bp, Artificial Sequence
  Synthetic
ggcatcctcgtcggagcgggaaactttgtgagtatgatatcacaaggaaaccgtatggaagaagagattccacag

SEQ ID NO: 267221 - DNA, 75 bp, Artificial Sequence
  Synthetic
gtgtttaatgatgatatgctacgcaagcgacaactcacggtgcttgatttacatccaggatcagggaaaacccgc

SEQ ID NO: 267222 - DNA, 75 bp, Artificial Sequence
  Synthetic
aaagtgctcccacagattgttaaagctgccattgaaaaaaggttgagaactgcaatcttggcacccacacgtgtc

SEQ ID NO: 267223 - DNA, 75 bp, Artificial Sequence
  Synthetic
gtggcggctgagatagctgaggcgttgaaggaatacccaatcaggtatttgacccctgccgtcaagagagaacac

SEQ ID NO: 267224 - DNA, 75 bp, Artificial Sequence
  Synthetic
actggcactgaaataattgacgtgatgtgccatgccactttgacagcacggttgttaacaccacaaagggtgcct

SEQ ID NO: 267225 - DNA, 75 bp, Artificial Sequence
  Synthetic
aactacaacttattcgttatggatgaagcacatttcactgacccagccagcattgcggctcgtgggtacatttcc

SEQ ID NO: 267226 - DNA, 75 bp, Artificial Sequence
  Synthetic
acaaaagttgacctaggagaagcggcagccatattcatgactgcgacaccaccaggaacgagagatgcctttcct

SEQ ID NO: 267227 - DNA, 75 bp, Artificial Sequence
  Synthetic
gattcaaattcacctatcatggatgtggaggaacaaataccagatcgagcatggaactcagggtatgactggatt

SEQ ID NO: 267228 - DNA, 75 bp, Artificial Sequence
  Synthetic
acggactatactgggaaaacggtgtggtttgttccaagcgtgaaaatggggaatgaaattgctatgtgtctgaca

SEQ ID NO: 267229 - DNA, 75 bp, Artificial Sequence
  Synthetic
aaagcggggaagaaagtcattcaattgaacaggaagagttttgacaacgaatatccaaagtgtaagacaggagac

SEQ ID NO: 267230 - DNA, 75 bp, Artificial Sequence
  Synthetic
tgggactttgttgtgacaacagacatatcagagatgggagccaattttggagccagtagagtgatagacagccgc

SEQ ID NO: 267231 - DNA, 75 bp, Artificial Sequence
  Synthetic
aagtgcataaaaccagttattattgaagacggggaaggcagtgttcaattaaatgggccagttcccatcacagcg

SEQ ID NO: 267232 - DNA, 75 bp, Artificial Sequence
  Synthetic
gctagtgcagcacaaaggaggggaagagtgggcagaaatccagtgcaagttggggatgaataccactttgctgga

SEQ ID NO: 267233 - DNA, 75 bp, Artificial Sequence
  Synthetic
ccgaccagtgaggatgatcacgatttcgcccattggaaggaagcgaagatcttgctagacaacatcaacctacca

SEQ ID NO: 267234 - DNA, 75 bp, Artificial Sequence
  Synthetic
aacggactggtggcgcaattgtatgagcctgaacgagagaaggtcttttccattgatggggagtacaggctgaga

SEQ ID NO: 267235 - DNA, 75 bp, Artificial Sequence
  Synthetic
actgagcaacggaaaaactttgtagagttcttgagaacgggagacctgccagtttggatatcgcacaaactggct

SEQ ID NO: 267236 - DNA, 75 bp, Artificial Sequence
  Synthetic
gacgctggaatagcttacaacgaccgacgatggtgctttgatggacccaccgtgaacacagtgctagaagacaac

SEQ ID NO: 267237 - DNA, 75 bp, Artificial Sequence
  Synthetic
aatcctgttgagctctggacgaagactggagagaagaagatcctgaggcctcgttggcgagacggaaggctttgg

SEQ ID NO: 267238 - DNA, 75 bp, Artificial Sequence
  Synthetic
gctgaccatcaagcgctaaaatcattcaaagagtttgcttgtggaaaaaggtcggccattggggtttttgaagta

SEQ ID NO: 267239 - DNA, 75 bp, Artificial Sequence
  Synthetic
gttaaaatgcttcccgaacattttgcgcataggatgggagaatccatggacaacatttacatgctgagcaccgca

SEQ ID NO: 267240 - DNA, 75 bp, Artificial Sequence
  Synthetic
gagcgtggaagcagggcgcatagggaagcattggaggaactccccgaaactctagaaacaatcctactaatcaca

SEQ ID NO: 267241 - DNA, 75 bp, Artificial Sequence
  Synthetic
atgatggctttagcatcatgtggagtctttctattctttgtgcagaggagggggttgggaaaaaccggtctaggt

SEQ ID NO: 267242 - DNA, 75 bp, Artificial Sequence
  Synthetic
gcaatgatccttatgacagctacagtgttgttgtggattgcagaagtacagccccagaagatagcagggatcttg

SEQ ID NO: 267243 - DNA, 75 bp, Artificial Sequence
  Synthetic
cttgtgtcacttctcttaatgatagtgttaatcccagaaccagagcgacaacgctcacaaacagacagccacctc

SEQ ID NO: 267244 - DNA, 75 bp, Artificial Sequence
  Synthetic
gcagtcttcatgatagttgtcctactgattgttggggctgtggcttccaacgaaatgggttggctagagcagaca

SEQ ID NO: 267245 - DNA, 75 bp, Artificial Sequence
  Synthetic
aaaagggatatatccggtttgtttgggagaacccaggagcagagaactgaaaagtgggattttccttggccagat

SEQ ID NO: 267246 - DNA, 75 bp, Artificial Sequence
  Synthetic
ttgagacctgccacagcctgggcagcatatgctggagcgacaacgctgctcactccactattaaagcatctaata

SEQ ID NO: 267247 - DNA, 75 bp, Artificial Sequence
  Synthetic
gtcactgagtacgtgaatttctcactcatggctgtgacagcacaagctggagctttgtttggattaggaaaaggg

SEQ ID NO: 267248 - DNA, 75 bp, Artificial Sequence
  Synthetic
atgccctttgtgtccatggacctgtcagtgcctcttcttttactcggatgttggggacagttcaccatgaccacc

SEQ ID NO: 267249 - DNA, 75 bp, Artificial Sequence
  Synthetic
acactcacgacaatcgtgttgttgattgtgcactatgcattcctcgtgccaggatggcaagctgaagcaatgcgt

SEQ ID NO: 267250 - DNA, 75 bp, Artificial Sequence
  Synthetic
gcagcgcaaaggaggacagctgctggagtgatgaagaatccagtggtggatggaatagtcgccacagacatacct

SEQ ID NO: 267251 - DNA, 75 bp, Artificial Sequence
  Synthetic
gatctagacgccagtactccgattacagagaagaaattcggccaagttattctaatagttgtgggagtctgtgca

SEQ ID NO: 267252 - DNA, 75 bp, Artificial Sequence
  Synthetic
gttttcctaaaaccagggaccatgtcgctaacagagtttggaatgctgacatctgcagccgcagtcacactgata

SEQ ID NO: 267253 - DNA, 75 bp, Artificial Sequence
  Synthetic
gaaggagcagcaggacgtatttggaatgccacaacagctgtggccatgtgccatctcttgcggaaaaattggctg

SEQ ID NO: 267254 - DNA, 75 bp, Artificial Sequence
  Synthetic
gccggagcctctctggcttggaccatatccaggaacctgcaaagtggagcgttgcgacgaggtggaggaagaggt

SEQ ID NO: 267255 - DNA, 75 bp, Artificial Sequence
  Synthetic
cgcatgttgggtgagatgtggaaggcacaactaaaccagttgacgagacaggagttcatggagtacagaagggac

SEQ ID NO: 267256 - DNA, 75 bp, Artificial Sequence
  Synthetic
ggtataatagaggttgacagatctgcggctagaaaagcacggagagaaggtaatgtgactgggggacatcccgtc

SEQ ID NO: 267257 - DNA, 75 bp, Artificial Sequence
  Synthetic
tcacgtggaaccgcaaaactacggtggatggtcgagagaggttttgtgaagccacacggaaaggttatagacttg

SEQ ID NO: 267258 - DNA, 75 bp, Artificial Sequence
  Synthetic
ggctgcggcagaggaggctggagttattactgcgccaccttaaaattagttcaagaggtgaagggttacacaaaa

SEQ ID NO: 267259 - DNA, 75 bp, Artificial Sequence
  Synthetic
gggggaccaggtcatgaagaacctgtgatgatgcagagctacggctggaatttggtctcgctgaagagcggtgtt

SEQ ID NO: 267260 - DNA, 75 bp, Artificial Sequence
  Synthetic
gatgtgttttacagaccatctgaacaatcagacacactattatgcgacataggggaagcctcaccagtgccagaa

SEQ ID NO: 267261 - DNA, 75 bp, Artificial Sequence
  Synthetic
attgaagaagcacggaccgtgaaagtactgcaaatggtggaagaatggctctcacgtggagttgaagatttctgt

SEQ ID NO: 267262 - DNA, 75 bp, Artificial Sequence
  Synthetic
gtaaaaattctttgtccatacatgcccaaggtgcttaaagagctggaaaagatgcaattaagatggggaggtggc

SEQ ID NO: 267263 - DNA, 75 bp, Artificial Sequence
  Synthetic
ctgatccgggttccactttcgaggaattccaaccatgagatgtactgggtgagtggagccagtggaaacatcaca

SEQ ID NO: 267264 - DNA, 75 bp, Artificial Sequence
  Synthetic
gaaagatatgtggactatatgcccactctaaacagatttaaggcagtggaatcgtggtcagagggagtgctgtag

SEQ ID NO: 267265 - DNA, 75 bp, Artificial Sequence
  Synthetic
aattccgtcaacacagtaagtcaaatgctgatcaacagaatgaacagaaccaacaggaatgggcccaagtatgag

SEQ ID NO: 267266 - DNA, 75 bp, Artificial Sequence
  Synthetic
gaagatgtgcatctaggatctggaacaagagccgtggtcacaaaaaagataaaaacaaactggaagatggtagaa

SEQ ID NO: 267267 - DNA, 75 bp, Artificial Sequence
  Synthetic
gacagagtgaaaaaactggcagatgagttttccaccacatggcactatgactcggagcacccttacaaaacttgg

SEQ ID NO: 267268 - DNA, 75 bp, Artificial Sequence
  Synthetic
aactatcatggaagttatgaagtcaaagcgaccggatcagctagctccatggtgaatggggtggtccgggtgctc

SEQ ID NO: 267269 - DNA, 75 bp, Artificial Sequence
  Synthetic
tcgaaaccatgggacacactgcagagtgtggtgaacatggccatgactgacacaacaccatttggccagcaacgg

SEQ ID NO: 267270 - DNA, 75 bp, Artificial Sequence
  Synthetic
gtgttcaaggaaaaggttgacacaaaagcaccagaaccccctaaaggaacagcagaagttatgagagtcacagca

SEQ ID NO: 267271 - DNA, 75 bp, Artificial Sequence
  Synthetic
aaatggatgtggaaatttgttggtagaagcaagacgccaagggtgtgcacgaaagaggaatttatagcaaaagtc

SEQ ID NO: 267272 - DNA, 75 bp, Artificial Sequence
  Synthetic
aacagtcatgcagcgcttggggccatttttaaggaacaaaacagatgggcatcagcccgagaagcagtggaagac

SEQ ID NO: 267273 - DNA, 75 bp, Artificial Sequence
  Synthetic
cccgctttctgggaaatggtggacagagaaagagaagcccatctacaaggacgatgtgaaatgtgtacatacaac

SEQ ID NO: 267274 - DNA, 75 bp, Artificial Sequence
  Synthetic
atgatgggaaaacgcgagaagaagatgggtgaatttggaaaagcaaaaggtagccgggccatctggtacatgtgg

SEQ ID NO: 267275 - DNA, 75 bp, Artificial Sequence
  Synthetic
ttaggttcaagatatcttgaatttgaagctctggggttcttaaacgaagaccattggatgagcagagagaacaca

SEQ ID NO: 267276 - DNA, 75 bp, Artificial Sequence
  Synthetic
cttggaggagtcgagggcttaggcctgcagaagcttggatacgtgctgagagacatagcaaagaatccaggaggc

SEQ ID NO: 267277 - DNA, 75 bp, Artificial Sequence
  Synthetic
ctcatgtatgcagacgacacggctggctgggacacaaggatcacgaaagcagatcttgaaaatgagtcaatcgtg

SEQ ID NO: 267278 - DNA, 75 bp, Artificial Sequence
  Synthetic
ttagaaatgatgactccggaacaccgagcgctggctgaaccactgattaagtttgcatacatgaacaaagtcgtg

SEQ ID NO: 267279 - DNA, 75 bp, Artificial Sequence
  Synthetic
aaagtaatgagaccaggagctgatggcataacagtgatggacgtcatctcacgggaagaccagagagggagtgga

SEQ ID NO: 267280 - DNA, 75 bp, Artificial Sequence
  Synthetic
caggtggtaacatatgcactcaacacgttcaccaacctttgtgtgcagctcatacgatgcatggaaggagagggt

SEQ ID NO: 267281 - DNA, 75 bp, Artificial Sequence
  Synthetic
ttgctgaagccagaggaggtggagaaacttgagagagggaaacaaaggaaaatccaagactggttggacaagaat

SEQ ID NO: 267282 - DNA, 75 bp, Artificial Sequence
  Synthetic
ggaactgaacgcctagcgtccatggcagtgagtggagacgattgcgtggtaaaaccaaaagatgacagattcgca

SEQ ID NO: 267283 - DNA, 75 bp, Artificial Sequence
  Synthetic
accgctctccattttctcaatagcatgtcaaaaatcaggaaggatattccagagtggaaacaatcaacaggatgg

SEQ ID NO: 267284 - DNA, 75 bp, Artificial Sequence
  Synthetic
agaaactggcaggatgttccattctgctcacatcatttccacgaactcaccatgaaggatggacgccaaattgtg

SEQ ID NO: 267285 - DNA, 75 bp, Artificial Sequence
  Synthetic
gtaccttgccgccatcaagatgaactgatagggagggccaggctatcacctggctctggatggtcactgacggaa

SEQ ID NO: 267286 - DNA, 75 bp, Artificial Sequence
  Synthetic
acagcatgcttgagcaaggcttatgggcagatgtggctgttgatgtacttccacagacgggacctccgtctgatg

SEQ ID NO: 267287 - DNA, 75 bp, Artificial Sequence
  Synthetic
gctaacgcaatctgctcagccgtgccagtgagttgggtgcccaccgggagaacaacctggtccatccatggaaaa

SEQ ID NO: 267288 - DNA, 75 bp, Artificial Sequence
  Synthetic
ggggaatggatgacaactgaagacatgctaagagtgtggaatcgcgtgtggattgaggaaaatgagcacatggag

SEQ ID NO: 267289 - DNA, 75 bp, Artificial Sequence
  Synthetic
gataagaccccagtcagcagttggaatgacgtgccataccttggaaaaagggaagacagttggtgtgggagctta

SEQ ID NO: 267290 - DNA, 75 bp, Artificial Sequence
  Synthetic
attgggcatagagctagatccacctgggcggagaacatatacactcccatcatgcagataagagggctgataggc

SEQ ID NO: 267291 - DNA, 75 bp, Artificial Sequence
  Synthetic
ccagaaagatatgtggactatatgcccactctaaacagatttaaggcagtggaatcgtggtcagagggagtgctg

SEQ ID NO: 267292 - DNA, 75 bp, Artificial Sequence
  Synthetic
tagacaaacaaccaagcaataaacagtagatatataatcagtgtaaataatagaatgattatgataagctttgtt

SEQ ID NO: 267293 - DNA, 75 bp, Artificial Sequence
  Synthetic
ttagaccttagaagatagatttagatttattttagggcgatagtcaggccaggcaatgcctgccaccggaagttg

SEQ ID NO: 267294 - DNA, 75 bp, Artificial Sequence
  Synthetic
gatgacggtgctgtctgcgctccaaccccaggcggactgggttaacaaagtggtgatccaggagacgcaaagcgt

SEQ ID NO: 267295 - DNA, 75 bp, Artificial Sequence
  Synthetic
tcactaccgtttcggagaactccctggcgttcgaatggaacactgcccaaagtcaggccgtaggttttacgccac

SEQ ID NO: 267296 - DNA, 75 bp, Artificial Sequence
  Synthetic
tagcatgcagtgctgcctgagacaagacatgccccaggaggactgggaaaacaaagccgttaaggcccccgcggc

SEQ ID NO: 267297 - DNA, 75 bp, Artificial Sequence
  Synthetic
ccaagcaagggaatggtgtgccccttgtggaaggtctagaggttagaggagaccccgcggaaatcaaagcaaggc

SEQ ID NO: 267298 - DNA, 75 bp, Artificial Sequence
  Synthetic
ccaacctggcaaagctgtaaaccaggggaaggactagaggttagaggagaccccttgcgagtgaacaccacacaa

SEQ ID NO: 267299 - DNA, 75 bp, Artificial Sequence
  Synthetic
gaggagaccccttgcgagtgaacaccacacaaaaacagcatattgacacctgggaaagactaggagaccctctgt

SEQ ID NO: 267300 - DNA, 75 bp, Artificial Sequence
  Synthetic
atgtcaaacaaaaaaccaggaagacccggggcaacccgggttgtcaatatgctaaagcgcggcgcatcccgcgga

SEQ ID NO: 267301 - DNA, 75 bp, Artificial Sequence
  Synthetic
atggctgcgtgacacacacacgcagcttacgggtatcatactgctctactctgcattgcaagagattaaagtacc

SEQ ID NO: 267302 - DNA, 75 bp, Artificial Sequence
  Synthetic
cttacgggtatcatactgctctactctgcattgcaagagattaaagtacccatcatggattcagtgtatgtagac

SEQ ID NO: 267303 - DNA, 75 bp, Artificial Sequence
  Synthetic
aaaaggtccctgctgaatttgacagcttcgtgataccaagcctgtggtcgtcaggtttatcaatcccgctgagaa

SEQ ID NO: 267304 - DNA, 75 bp, Artificial Sequence
  Synthetic
atagatgctgacagcgcgtttctgaaggcgttgcagcgagcataccccatgtttgaggtggaaccaaagcaggtc

SEQ ID NO: 267305 - DNA, 75 bp, Artificial Sequence
  Synthetic
agaaactgcaacgtaacgcagatgagggaactacccactatggactccgcagtgtttaacgtggagtgttttaag

SEQ ID NO: 267306 - DNA, 75 bp, Artificial Sequence
  Synthetic
gtttgaggtggaaccaaagcaggtcacgccaaacgaccatgcaaacgctagagcattttcgcatctagcaataaa

SEQ ID NO: 267307 - DNA, 75 bp, Artificial Sequence
  Synthetic
agctccaaaacacgagcaactaccacacagcggaaacgcagaggaagcagctcaggctgaaatggatgcagcgga

SEQ ID NO: 267308 - DNA, 75 bp, Artificial Sequence
  Synthetic
actgatagagcaggaaatcgatccaggctcaaccattctaggcattggtagtgcaccagctaggaggatgatgtc

SEQ ID NO: 267309 - DNA, 75 bp, Artificial Sequence
  Synthetic
tgatagaaaataccactgcgtctgcccgatgcgcagcgcagaagaccccgagaggctcgcgaattacgcgagaaa

SEQ ID NO: 267310 - DNA, 75 bp, Artificial Sequence
  Synthetic
acttgcatcagccgctggaaaggtgacagataaaaacatctccggaaaaattaatgatctacaagctgtgatggc

SEQ ID NO: 267311 - DNA, 75 bp, Artificial Sequence
  Synthetic
aggcggcagaaccactggcaacagcatacctgtgtggcatacacagagagttggtgagaagactaaatgcagttc

SEQ ID NO: 267312 - DNA, 75 bp, Artificial Sequence
  Synthetic
cgtaccgaatatggaaacatccacattctgcctacacactgatgctacatgcaagcaaagaggagacgtcgccat

SEQ ID NO: 267313 - DNA, 75 bp, Artificial Sequence
  Synthetic
tgctaccgaatgtccacacactgttcgatatgtcagccgaagacttcgatgcaattatagccacccatttcaaac

SEQ ID NO: 267314 - DNA, 75 bp, Artificial Sequence
  Synthetic
ttatcaagacgtctacgccgtccatgcacctacctcgctgtaccaccaggcgatcaaaggagtccacgtggcata

SEQ ID NO: 267315 - DNA, 75 bp, Artificial Sequence
  Synthetic
cgggcgatgctgtactagaaactgacatagcctcatttgataagagtcaagacgactcgcttgcgtcgaccgcca

SEQ ID NO: 267316 - DNA, 75 bp, Artificial Sequence
  Synthetic
ttggatagggttcgatacgacacctttcatgtacaatgcaatggctggcgcatacccatcatattcaacaaactg

SEQ ID NO: 267317 - DNA, 75 bp, Artificial Sequence
  Synthetic
tgatgttgctagaagaccttggggtagatcaacctatcctggatctgatagaagcagcattcggcgaaatatcca

SEQ ID NO: 267318 - DNA, 75 bp, Artificial Sequence
  Synthetic
ttccggcaagtcggctataatcaaaaacctggtaaccaggcaagacttggtgactagtggaaaaaaagaaaactg

SEQ ID NO: 267319 - DNA, 75 bp, Artificial Sequence
  Synthetic
ggctgatgagcaggtactgaaggctaagaatatagggctgtgttcaacagacctatctgagggtagacgaggcaa

SEQ ID NO: 267320 - DNA, 75 bp, Artificial Sequence
  Synthetic
gaagcagcattcggcgaaatatccagttgtcatctaccgacgggtacgcggttcaagttcggcgcaatgatgaaa

SEQ ID NO: 267321 - DNA, 75 bp, Artificial Sequence
  Synthetic
attatccatcatgagaggcaaaaaatttaagccatgcgaccgagtgctattctcggtcggctcaacactctaccc

SEQ ID NO: 267322 - DNA, 75 bp, Artificial Sequence
  Synthetic
cttgtcattcgggaaccctgttggcactgatagccatggttagaccgcgtcagaaggtcgtactttgtggcgacc

SEQ ID NO: 267323 - DNA, 75 bp, Artificial Sequence
  Synthetic
cagaaggtcgtactttgtggcgacccaaagcagtgcggattcttcaatatgatgcaaatgaaggttaactataat

SEQ ID NO: 267324 - DNA, 75 bp, Artificial Sequence
  Synthetic
tgaaagtcgcaaacttctacaaagctggcatttaccatcggtatttcacctgaagggtaaactcagcttcacctg

SEQ ID NO: 267325 - DNA, 75 bp, Artificial Sequence
  Synthetic
tcaataccctcctgaacatcaccattgccagtcgggtgttagaggagcgattgactacttcagcctgtgcagctt

SEQ ID NO: 267326 - DNA, 75 bp, Artificial Sequence
  Synthetic
ccgctgtgacacaatcgtctcatgcgaaggatacgtcgtcaagagagtgacaatgagtccaggcatctacggaaa

SEQ ID NO: 267327 - DNA, 75 bp, Artificial Sequence
  Synthetic
gacatcagggtatgctgtaactcatcatgccgacggcttcctgatgtgcaagacgacagatacagtagacggtga

SEQ ID NO: 267328 - DNA, 75 bp, Artificial Sequence
  Synthetic
aagggtatcattctccgtgtgtacttacgtaccagctactatctgcgatcagatgactggaatccttgccactga

SEQ ID NO: 267329 - DNA, 75 bp, Artificial Sequence
  Synthetic
aagacgtgctctggcagatgaggttactagatggcaaagaaccggcttagtcacagaattggaaaaagcagtata

SEQ ID NO: 267330 - DNA, 75 bp, Artificial Sequence
  Synthetic
ggtaaccccagaagacgcacagaaactactggttgggctaaaccaacggatagtggtcaatggcaggacgcaacg

SEQ ID NO: 267331 - DNA, 75 bp, Artificial Sequence
  Synthetic
cttcagagcacgttaacgtgttattgacacgcacagagggcaagttgatatggaaaacactctcgggcgatccat

SEQ ID NO: 267332 - DNA, 75 bp, Artificial Sequence
  Synthetic
tagtggtcaatggcaggacgcaacgcaatacaaacaccatgaaaaattacctgctcccaatagttgctcaggcct

SEQ ID NO: 267333 - DNA, 75 bp, Artificial Sequence
  Synthetic
ttcaaggtatgaagtacaaggaataacagccgtaataacatcaatggctacctttgcgaatagcaaagaaaactt

SEQ ID NO: 267334 - DNA, 75 bp, Artificial Sequence
  Synthetic
tcagcaagtgggccaaagaatgtcgaaaggacatggaggacgaaaagctcttgggtgtccgagagaggaccttaa

SEQ ID NO: 267335 - DNA, 75 bp, Artificial Sequence
  Synthetic
taagaaactaagagggcccgtcgtaaccttgtacggcggacctaaataggtacgcactacagctacctacttaga

SEQ ID NO: 267336 - DNA, 75 bp, Artificial Sequence
  Synthetic
aaaggacatggaggacgaaaagctcttgggtgtccgagagaggaccttaacgtgctgttgcctgtgggcattcag

SEQ ID NO: 267337 - DNA, 75 bp, Artificial Sequence
  Synthetic
gcatacatcgctaatagccatggagttcataccagcacaaacttactacaatagaagataccagcctagaccctg

SEQ ID NO: 267338 - DNA, 75 bp, Artificial Sequence
  Synthetic
aaagcacaagacgcatacggtgtacaaaagaccggatacccagtcaatccaaaaggtccctgctgaatttgacag

SEQ ID NO: 267339 - DNA, 75 bp, Artificial Sequence
  Synthetic
gactcaacgccctactatccaggtgatcaggccaaaaccacgccgaagaaggcctgcaggacaactcgcacaact

SEQ ID NO: 267340 - DNA, 75 bp, Artificial Sequence
  Synthetic
cttcgtgataccaagtctgtggtcgtcaggtttatcaattccgctgagaaccagaatcaagtggctcttgagcaa

SEQ ID NO: 267341 - DNA, 75 bp, Artificial Sequence
  Synthetic
gaaaccaacataataccggccaaccgaagactgccgcactcactcgtggctgaacaccatacagtgagaggggaa

SEQ ID NO: 267342 - DNA, 75 bp, Artificial Sequence
  Synthetic
ccagaatcaagtggctcttgagcaaagctccaaaacacgagcaactaccacacagcggaaacgcagaggaagcag

SEQ ID NO: 267343 - DNA, 75 bp, Artificial Sequence
  Synthetic
agctccaaaacacgagcaactaccacacagcggaaacgcagaggaagcagctcaggctgaaacggatgcggtgga

SEQ ID NO: 267344 - DNA, 75 bp, Artificial Sequence
  Synthetic
agaacgggaggctgagctaacccgagaagctatgccaccattgcaagcgacacaggatgacgttcaggtagaaat

SEQ ID NO: 267345 - DNA, 75 bp, Artificial Sequence
  Synthetic
agtactacgaaccagaagaaaaaggcgccgaaacaaaagcagacccaaaagaaaaagagaccaggacgaagggaa

SEQ ID NO: 267346 - DNA, 75 bp, Artificial Sequence
  Synthetic
cacaggatgacgttcaggtagaaattgatgtagagcaacttgaagaccgagcaggagcgggcatagtcgaaacac

SEQ ID NO: 267347 - DNA, 75 bp, Artificial Sequence
  Synthetic
tgatgtagagcaacttgaagaccgagcaggagcgggcatagtcgaaacaccaaggggagcaatcaaagtcacagc

SEQ ID NO: 267348 - DNA, 75 bp, Artificial Sequence
  Synthetic
gccagaatcattcagaaacagtgcaacgccagtgggtactgcaaagacaatcatgtgcggtcaataccccgtcat

SEQ ID NO: 267349 - DNA, 75 bp, Artificial Sequence
  Synthetic
acgccagtgggtactgcaaagacaatcatgtgcggtcaataccccgtcatccacgcggtaggcccaaacttctca

SEQ ID NO: 267350 - DNA, 75 bp, Artificial Sequence
  Synthetic
aggaaaagtaacggggtatgcatgcctagtaggtgataaggtaatgaaaccagcacacgtgaaaggaactattga

SEQ ID NO: 267351 - DNA, 75 bp, Artificial Sequence
  Synthetic
cgccgaaacaaaagcagacccaaaagaaaaagagaccaggacgaagggaaaggatgtgcatgaagattgaaaatg

SEQ ID NO: 267352 - DNA, 75 bp, Artificial Sequence
  Synthetic
caacgcagacctagcgaagttggcgttcaaaagatcatccaaatatgatctagagtgcgcacagataccagtgca

SEQ ID NO: 267353 - DNA, 75 bp, Artificial Sequence
  Synthetic
tctgattcatgcgcttgcagagcaggtaaaaacgtgcacacatagtgggcgagcaggcaggtacgcggttgaagc

SEQ ID NO: 267354 - DNA, 75 bp, Artificial Sequence
  Synthetic
tagagtgcgcacagataccagtgcacatgaaatcggacgcctcaaagttcacccatgaaaaaccagaaggctatt

SEQ ID NO: 267355 - DNA, 75 bp, Artificial Sequence
  Synthetic
gagcaggcaggtacgcggttgaagcatacgacgggcgtgttctagtgccctcgggctacgcgataccccaggaag

SEQ ID NO: 267356 - DNA, 75 bp, Artificial Sequence
  Synthetic
aggcaaagatagactgctgcaatcactaaaccatcttttcacagcgatggattcgacagatgcagatgttgtcat

SEQ ID NO: 267357 - DNA, 75 bp, Artificial Sequence
  Synthetic
acaactggcatcacggagcagtacagtattctggagggaggttcacgatccctacaggcgcaggaaagcctgggg

SEQ ID NO: 267358 - DNA, 75 bp, Artificial Sequence
  Synthetic
atttccagagcttaagcgaaagcgccactatggtatttaatgagcgagagtttgtgaaccggaagttgcaccaca

SEQ ID NO: 267359 - DNA, 75 bp, Artificial Sequence
  Synthetic
ctaaaccatcttttcacagcgatggattcgacagatgcagatgttgtcatctattgcagggataaggaatgggag

SEQ ID NO: 267360 - DNA, 75 bp, Artificial Sequence
  Synthetic
acagcggaagaccaatctttgacaacaaggggcgtgtcgtggctattgttctaggcggagcaaacgaaggaacca

SEQ ID NO: 267361 - DNA, 75 bp, Artificial Sequence
  Synthetic
tcgccatgcacggcccagcgctgaacaccgatgaagagtcatacgaactggtaagggttgagaaaacagaacacg

SEQ ID NO: 267362 - DNA, 75 bp, Artificial Sequence
  Synthetic
gcttggcaggccgaaaggggtacagcacagtagagggagcactctactcgtacctagagggaacaagattccacc

SEQ ID NO: 267363 - DNA, 75 bp, Artificial Sequence
  Synthetic
gtaagggttgagaaaacagaacacgagtacgtctatgacgttgatcagaagaaatgctgcaagagagaggaagca

SEQ ID NO: 267364 - DNA, 75 bp, Artificial Sequence
  Synthetic
aaactgctgtagatatggcagaaatatataccatgtggccaaaacaaactgaagccaatgaacaggtctgcctat

SEQ ID NO: 267365 - DNA, 75 bp, Artificial Sequence
  Synthetic
acaggactagtgctagtaggcgacttaactagcccaccataccatgagttcgcctacgaaggactaaaaatccgc

SEQ ID NO: 267366 - DNA, 75 bp, Artificial Sequence
  Synthetic
gaagccaatgaacaggtctgcctatatgctctgggggagagcatagagtcagtcaggcaaaaatgtcctgtagac

SEQ ID NO: 267367 - DNA, 75 bp, Artificial Sequence
  Synthetic
cgcctacgaaggactaaaaatccgcccagcatgtccatacaaaacggcagttataggtgtcttcggagtaccggg

SEQ ID NO: 267368 - DNA, 75 bp, Artificial Sequence
  Synthetic
gctacgaaaagaaaccggaagaaaccttgagaatgctggaggacaacgtcatgcaaccaggatattaccagttac

SEQ ID NO: 267369 - DNA, 75 bp, Artificial Sequence
  Synthetic
ttctggcaagtcggctataatcaaaaatctggtaaccaggcaagacttggtgaccagtggcaaaaaagaaaactg

SEQ ID NO: 267370 - DNA, 75 bp, Artificial Sequence
  Synthetic
tcgattcagcattggcctgctcacaacgtcgtcaaaaacgtaatgcaagagaaaacttcaatgtctacaaagtca

SEQ ID NO: 267371 - DNA, 75 bp, Artificial Sequence
  Synthetic
gtctcgagtgagcccgagaacgtacaggcctgcggacgaaatcatacagacacctcaaataccaactgaagcgtg

SEQ ID NO: 267372 - DNA, 75 bp, Artificial Sequence
  Synthetic
ccaagaaatctccaatgatgtaatgcggcaaaggaaattggagatatctgcacgtacagtcgactcactactcct

SEQ ID NO: 267373 - DNA, 75 bp, Artificial Sequence
  Synthetic
ctaggccgtacttagcccactgtcctgactgcggggagggacactcatgccacagcccaatagcattagaacgga

SEQ ID NO: 267374 - DNA, 75 bp, Artificial Sequence
  Synthetic
ccaggacgcacaattcgtgcagtcaataactgatgaagcagtgccagttccgtcagacttagaggcttgtgacgc

SEQ ID NO: 267375 - DNA, 75 bp, Artificial Sequence
  Synthetic
gaatggatgtaacaagccagtggaagtactgtacgtggatgaggcatttgcttgtcattcgggaaccctgttggc

SEQ ID NO: 267376 - DNA, 75 bp, Artificial Sequence
  Synthetic
gtactgtacgtggatgaggcatttgcttgtcattcgggaaccctgttggcactaatagccatggttagaccgcgt

SEQ ID NO: 267377 - DNA, 75 bp, Artificial Sequence
  Synthetic
aactatggactggccctctatcgacatcgtaccaacaagacaaagaagcgactcatttgacagcgagtatagttc

SEQ ID NO: 267378 - DNA, 75 bp, Artificial Sequence
  Synthetic
atcgtaccaacaagacaaagaagcgactcatttgacagcgagtatagttccagaagtaacatacagctggtgaca

SEQ ID NO: 267379 - DNA, 75 bp, Artificial Sequence
  Synthetic
ggatagccatacacctgtggatgcagaccgatccgggttgtttgtcagaacgtcagcaccgtgcaccatcacggg

SEQ ID NO: 267380 - DNA, 75 bp, Artificial Sequence
  Synthetic
cacaacatctgcacacaggtgtatcataaaagcatatcaaggcggtgtacactgcctgtaacagccatcgtgtcc

SEQ ID NO: 267381 - DNA, 75 bp, Artificial Sequence
  Synthetic
actgcctgtaacagccatcgtgtcctcgttgcattacgagagcaagatgcgtactacaaatgagtacaaccagcc

SEQ ID NO: 267382 - DNA, 75 bp, Artificial Sequence
  Synthetic
caagctcagaacggcataatgatactacctgattcagaagacacagatagtataagcagagtaagcacaccgatc

SEQ ID NO: 267383 - DNA, 75 bp, Artificial Sequence
  Synthetic
cggtaggatttgtagacagtagaaggatcagtcacacgtgcatgcacccgttccgccacgagccaccgctgatag

SEQ ID NO: 267384 - DNA, 75 bp, Artificial Sequence
  Synthetic
aatcgtagtggatactacgggcacaacaaaaccagaacccggggacttagtgttaacgtgtttccggggatgggt

SEQ ID NO: 267385 - DNA, 75 bp, Artificial Sequence
  Synthetic
acaaaaccagaacccggggacttagtgttaacgtgtttccggggatgggttaagcagttgcaaatagactaccgt

SEQ ID NO: 267386 - DNA, 75 bp, Artificial Sequence
  Synthetic
gccccacccaggagacgtttgggaaggactataaatgtgacttgtgacgagcgggaagggaaaatactccctatg

SEQ ID NO: 267387 - DNA, 75 bp, Artificial Sequence
  Synthetic
gccagcgacaggctcttcactgctaagccatacactgtcgcactgggcgtatcaacagcagacataactgcgtac

SEQ ID NO: 267388 - DNA, 75 bp, Artificial Sequence
  Synthetic
ggaaacgaagtcatgacagcagctgcttctcaggggctgactagaaaaggtgtttatgcagtaaggcagaaagtc

SEQ ID NO: 267389 - DNA, 75 bp, Artificial Sequence
  Synthetic
ggagagagaagtttcactcccgcccgcagcatggcaaagaactaccttgcagtacatacgtccataccacagcgg

SEQ ID NO: 267390 - DNA, 75 bp, Artificial Sequence
  Synthetic
cccatccaggcaccgctaggatcgacacaaccgcctgccctcgaacagatcactttcggagatttcgccgaaggt

SEQ ID NO: 267391 - DNA, 75 bp, Artificial Sequence
  Synthetic
aacgaaaaccctctgtatgcatcaacttcagaacacgttaacgtgttattgacacgcacagagggcaagttgata

SEQ ID NO: 267392 - DNA, 75 bp, Artificial Sequence
  Synthetic
agtacatacgtccataccacagcggcaactgctgaggaaatagaagtgcatatgccgccagatacccctgactac

SEQ ID NO: 267393 - DNA, 75 bp, Artificial Sequence
  Synthetic
cttcagaacacgttaacgtgttattgacacgcacagagggcaagttgatatggaaaacactctcaggcgacccat

SEQ ID NO: 267394 - DNA, 75 bp, Artificial Sequence
  Synthetic
ggataaagatactgcagaaccccccaaaagggaactttaaggcaacaatcaaggagtgggaagcagaacacgcct

SEQ ID NO: 267395 - DNA, 75 bp, Artificial Sequence
  Synthetic
caaagtagaccaatgccacacagcggttacaaaccacaagaaatggcaatacaattcaccgctgaccccgcggaa

SEQ ID NO: 267396 - DNA, 75 bp, Artificial Sequence
  Synthetic
ctccgaacaaggagatagaaaaggtaagatccatatcccatttccactggtgaacacaacctgcagggtaccaaa

SEQ ID NO: 267397 - DNA, 75 bp, Artificial Sequence
  Synthetic
ccagatggcttttgacacatttcagaacaaagctaatgtatgctgggctaaatgcctggtccctattcttgacac

SEQ ID NO: 267398 - DNA, 75 bp, Artificial Sequence
  Synthetic
accggtaaacattgttgaagaggtccacgaagagaaatgctacccacctaaattggatgagatcaaagagcaact

SEQ ID NO: 267399 - DNA, 75 bp, Artificial Sequence
  Synthetic
tgctggaatcaaactaagtgacaggcagtggtctcagatagtgcaagcttttaaagaagatagggcctactctcc

SEQ ID NO: 267400 - DNA, 75 bp, Artificial Sequence
  Synthetic
agcaagaaatccgactgtcacatacggtaaaaacagagtcactctgctgttacatccagaccacccaacactcct

SEQ ID NO: 267401 - DNA, 75 bp, Artificial Sequence
  Synthetic
ttcgtaccgcgccatgggaaggatcccggattaccatgaagagtggataacaaacaagaaggaaataagtatcac

SEQ ID NO: 267402 - DNA, 75 bp, Artificial Sequence
  Synthetic
agaagttgcactgaatgaaatatgtacccgcatatatggggtagatctggacagcggactattttcaaagccgct

SEQ ID NO: 267403 - DNA, 75 bp, Artificial Sequence
  Synthetic
agtaccagcagaaggcttagaggttacgtggggtaataatgacccatacaaatattggccccaactgtctacaaa

SEQ ID NO: 267404 - DNA, 75 bp, Artificial Sequence
  Synthetic
gatatccgtctactatgcagacaaccactgggacaatagaccaggaggaaaaatgttcgggttcaaccctgaggt

SEQ ID NO: 267405 - DNA, 75 bp, Artificial Sequence
  Synthetic
cactgggacaatagaccaggaggaaaaatgttcgggttcaaccctgaggtggcacttatgcttgaaaagaaatac

SEQ ID NO: 267406 - DNA, 75 bp, Artificial Sequence
  Synthetic
tggtactgcgcacgggcacccacatgaaataatcctctattactatgagctgtacccaactaccacaattgctgt

SEQ ID NO: 267407 - DNA, 75 bp, Artificial Sequence
  Synthetic
ttaccgaatcacatacccggcgccggtctactcgccttcaatcagtatcaaattgaataacccagagaccgcagt

SEQ ID NO: 267408 - DNA, 75 bp, Artificial Sequence
  Synthetic
ccctttacaaaaggtaagtggaacatcaacaagcagatatgtataactaccagaaaggttgacgaatttaacccc

SEQ ID NO: 267409 - DNA, 75 bp, Artificial Sequence
  Synthetic
actagctgctgcttctatcgtaataacatctttggtaggtctatcattaggcatgtgcatatgcgcgagacgcag

SEQ ID NO: 267410 - DNA, 75 bp, Artificial Sequence
  Synthetic
cagaaaggttgacgaatttaaccccgaaaccaacataataccggccaaccgaagactgccgcactcactcgtggc

SEQ ID NO: 267411 - DNA, 75 bp, Artificial Sequence
  Synthetic
agaaactatccaactgtggcatcctaccaagttactgacgagtacgacgcgtacttggacatggtagacgggtcc

SEQ ID NO: 267412 - DNA, 75 bp, Artificial Sequence
  Synthetic
gtgcatcacgccatatgagctgactccaggagctaccatcccattcctcctaggtgtactatgctgtgccaggac

SEQ ID NO: 267413 - DNA, 75 bp, Artificial Sequence
  Synthetic
tgaacaccactcagtgagaggggaaagaatggaatggctggtaaacaaaatcaacggtcaccacatgttgttggt

SEQ ID NO: 267414 - DNA, 75 bp, Artificial Sequence
  Synthetic
agaatggaatggctggtaaacaaaatcaacggtcaccacatgttgttggttagtggttataatcttatattacca

SEQ ID NO: 267415 - DNA, 75 bp, Artificial Sequence
  Synthetic
ttaacccgtctaaactcaggagttacccaaaacaacactcttaccacgcacccaccatcagaagtgcagtgccat

SEQ ID NO: 267416 - DNA, 75 bp, Artificial Sequence
  Synthetic
ccaggagctaccatcccattcctcctaggtgtactatgctgtgccaggactgcaaaagcagcatcgtactacgaa

SEQ ID NO: 267417 - DNA, 75 bp, Artificial Sequence
  Synthetic
acaaaaagagtcacctgggtagcaccgttaggcaccagaggtgcagactacacatataacctggaacttggtcta

SEQ ID NO: 267418 - DNA, 75 bp, Artificial Sequence
  Synthetic
ccagccacactaggcagatatgacctggtagttatcaatatccatactccattccgcatacatcattaccagcag

SEQ ID NO: 267419 - DNA, 75 bp, Artificial Sequence
  Synthetic
gcccgcactgtgaccgcgtacgagcacgcaacagtgatcccgaacacggtgggagtaccgtgtaagactcttgtt

SEQ ID NO: 267420 - DNA, 75 bp, Artificial Sequence
  Synthetic
tgtgtagatcacgcaatgaagctccagatgctagggggggactctctacggctgttaaagccgggaggttcactt

SEQ ID NO: 267421 - DNA, 75 bp, Artificial Sequence
  Synthetic
taccaaatgtccacacactgttcgatatgtcagccgaagatttcgatgcaatcatatctacacatttcaaaccgg

SEQ ID NO: 267422 - DNA, 75 bp, Artificial Sequence
  Synthetic
agcagaccagggtacagccctatggtcttagaaatggagctacagtcggtcactctggaaccagcattatccttg

SEQ ID NO: 267423 - DNA, 75 bp, Artificial Sequence
  Synthetic
ctgattagagcttacgggtacgccgaccgaaccagtgaaagggtcattagcgtattgggacgcaagttcagatcg

SEQ ID NO: 267424 - DNA, 75 bp, Artificial Sequence
  Synthetic
accgaaccagtgaaagggtcattagcgtattgggacgcaagttcagatcgtccagggctctaaaacctcagtgca

SEQ ID NO: 267425 - DNA, 75 bp, Artificial Sequence
  Synthetic
gcgatgctgtactagaaaccgatatagcctcatttgacaagagtcaagacgattcgcttgcgctgaccgccatga

SEQ ID NO: 267426 - DNA, 75 bp, Artificial Sequence
  Synthetic
agcctcatttgacaagagtcaagacgattcgcttgcgctgaccgccatgatgctgctagaagaccttggggtaga

SEQ ID NO: 267427 - DNA, 75 bp, Artificial Sequence
  Synthetic
tcacgagcaatacagaaatgttcttcctatttagccgattcgacaacggaagaaggaacttcaccacacatgtta

SEQ ID NO: 267428 - DNA, 75 bp, Artificial Sequence
  Synthetic
tcttagaaatggagctacagtcggtcactctggaaccagcattatccttggattacattacgtgtgagtataaaa

SEQ ID NO: 267429 - DNA, 75 bp, Artificial Sequence
  Synthetic
taagttcggcgcaatgatgaaatcaggcatgtttctaaccctgtttgtcaataccctcctgaacatcaccattgc

SEQ ID NO: 267430 - DNA, 75 bp, Artificial Sequence
  Synthetic
agaaggaacttcaccacacatgttatgaacaaccagctgaatgcagtgtatgcaggactggccactagagcgggc

SEQ ID NO: 267431 - DNA, 75 bp, Artificial Sequence
  Synthetic
tgcaggactggccactagagcgggctgtgctccgtcataccgtgtgaaacggatggacatcgcgaaaaacactga

SEQ ID NO: 267432 - DNA, 75 bp, Artificial Sequence
  Synthetic
atttatgtggggaggagcatactgcttctgtgacgcagagaacacacagctcagcgaggcacacgttgagaaatc

SEQ ID NO: 267433 - DNA, 75 bp, Artificial Sequence
  Synthetic
ggcatgtttctaaccctgtttgtcaataccctcctgaacatcaccattgctagtcgggtgctagaggagcgattg

SEQ ID NO: 267434 - DNA, 75 bp, Artificial Sequence
  Synthetic
ggaatgcgtggtaaacgccgccaatccacgcggagtaccaggcgatggagtatgtaaagccgtgtatagaaaatg

SEQ ID NO: 267435 - DNA, 75 bp, Artificial Sequence
  Synthetic
tatgtaaagccgtgtatagaaaatggccagagtcattcagaaacagtgcaacaccagtggggactgcaaagacaa

SEQ ID NO: 267436 - DNA, 75 bp, Artificial Sequence
  Synthetic
cggtgacaggcacgtcgtgcagagtagcagaccctttaaagagactgttcaagttaggcaaacctctggcagctg

SEQ ID NO: 267437 - DNA, 75 bp, Artificial Sequence
  Synthetic
acaccagtggggactgcaaagacaatcatgtgcggccaataccccgtcatccacgcagtaggtcctaacttctca

SEQ ID NO: 267438 - DNA, 75 bp, Artificial Sequence
  Synthetic
tctgcatacgccaatggtgatcatgcagttacggtggaagacgcgaagtttgtcatcggtccactatcgtccgcc

SEQ ID NO: 267439 - DNA, 75 bp, Artificial Sequence
  Synthetic
agatggcaaagaaccggcttaatcacagaattagaaaaagcagtatactccaggtatgaagtacaaggaataaca

SEQ ID NO: 267440 - DNA, 75 bp, Artificial Sequence
  Synthetic
aactattctgaggctgaaggggatagggaattggcttcagcgtatagagaagtggcgaaagaagtgtctaggcta

SEQ ID NO: 267441 - DNA, 75 bp, Artificial Sequence
  Synthetic
agtggcgaaagaagtgtctaggctaggagtgagcagtgtagccatccctttgctttcaaccggtgtgtactcagg

SEQ ID NO: 267442 - DNA, 75 bp, Artificial Sequence
  Synthetic
aggcaaagacagattgctgcaatcactaaaccatcttttcgcagcgatggattcgacagatgcagatgttgtcat

SEQ ID NO: 267443 - DNA, 75 bp, Artificial Sequence
  Synthetic
ttgtacggtggacctaaataggtacgcactacagctacctactttgagacaaacatcgctaatagccatggagtt

SEQ ID NO: 267444 - DNA, 75 bp, Artificial Sequence
  Synthetic
accttcgggctttaagtactggctcaaggaaaaaggggcatcattgcagcatactgcaccatttggctgtcagat

SEQ ID NO: 267445 - DNA, 75 bp, Artificial Sequence
  Synthetic
cataccagcacaaacttattataacagaagataccagcctagaccttggacccaacgccctactatccaggtgat

SEQ ID NO: 267446 - DNA, 75 bp, Artificial Sequence
  Synthetic
aagaagatcactgaagccatatcactaagatcccaggtagaactactagatgatcacatctcagtggattgcgac

SEQ ID NO: 267447 - DNA, 75 bp, Artificial Sequence
  Synthetic
ctaaaccatcttttcgcagcgatggattcgacagatgcagatgttgtcatctattgcagggacaaggaatgggag

SEQ ID NO: 267448 - DNA, 75 bp, Artificial Sequence
  Synthetic
tgatcacatctcagtggattgcgacattgtacgcgttcatccagacagcagcctggcaggccgaaaggggtacag

SEQ ID NO: 267449 - DNA, 75 bp, Artificial Sequence
  Synthetic
agaagataccagcctagaccttggacccaacgccctactatccaggtgatcaggccaaaaccacgccggagcagg

SEQ ID NO: 267450 - DNA, 75 bp, Artificial Sequence
  Synthetic
tatccgcagtcagcagactagcactgcgtacagttcctcagaaaccacgccggacccgaaaaactaagaagcaaa

SEQ ID NO: 267451 - DNA, 75 bp, Artificial Sequence
  Synthetic
cacagtagagggagcactctactcttacctagagggaacaagattccaccaaactgctgtagatatggctgagat

SEQ ID NO: 267452 - DNA, 75 bp, Artificial Sequence
  Synthetic
tagcttcgtgtacccattcatctgattttggaggtgccgcagtcataaagtacacagctagtaaaaaaggaaaat

SEQ ID NO: 267453 - DNA, 75 bp, Artificial Sequence
  Synthetic
tctccattgacatcccagatgcagctttcaccagggtcactgacgctccttccatcacagacatgtcctgcgaag

SEQ ID NO: 267454 - DNA, 75 bp, Artificial Sequence
  Synthetic
atataccatgtggccaaaacaaactgaagccaacgaacaggtctgcctatatgctctgggggagagtatagagtc

SEQ ID NO: 267455 - DNA, 75 bp, Artificial Sequence
  Synthetic
gcgccgtgcactctgtaacaaatgcggtcactatccgcgaacctaacgtagatgtcaagggaacagcacaattgc

SEQ ID NO: 267456 - DNA, 75 bp, Artificial Sequence
  Synthetic
gaagccaacgaacaggtctgcctatatgctctgggggagagtatagagtccgtcaggcaaaaatgtcccgtagac

SEQ ID NO: 267457 - DNA, 75 bp, Artificial Sequence
  Synthetic
agtaggtgataaggtaatgaaaccagcacacgtgaaagggactattgacaatgcagacctagcgaagttggcgtt

SEQ ID NO: 267458 - DNA, 75 bp, Artificial Sequence
  Synthetic
gacgccgacgcctcattccctccgaaaacagtcccgtgcctatgccgttatgccatgacgcctgaacgagttgca

SEQ ID NO: 267459 - DNA, 75 bp, Artificial Sequence
  Synthetic
aaattgccttctcgaccgcactagctagtgcggaattcaaggtgcagatctgctccacactggtacactgctcag

SEQ ID NO: 267460 - DNA, 75 bp, Artificial Sequence
  Synthetic
cgcctacgcatgaatcatactactagcatcatagtgtgctcgtcttttccgctgccgaagtacaaaatcgagggc

SEQ ID NO: 267461 - DNA, 75 bp, Artificial Sequence
  Synthetic
cgacgtgccatcctcctaaagaccatatagtcaattacccgtcacctcacaccacactaggagtgcaggacattt

SEQ ID NO: 267462 - DNA, 75 bp, Artificial Sequence
  Synthetic
gtgcaaaaagtaaaatgttcaaaagcactcttgtttgatcacaacgtaccgtctcgagtgagcccgagaacgtac

SEQ ID NO: 267463 - DNA, 75 bp, Artificial Sequence
  Synthetic
taattatagttctctgcgtatcatttagcagacactaaagtacacatgccccaaagtaatatactgtacaggtat

SEQ ID NO: 267464 - DNA, 75 bp, Artificial Sequence
  Synthetic
tcaggacgcacaactcgtgcagtcaataaatgatgaagcagtgccagttccctcggacttagaggcttgtgacgc

SEQ ID NO: 267465 - DNA, 75 bp, Artificial Sequence
  Synthetic
acgtgctccctgagcagcacgatatatgtattatccataaaagaaaaacaaaacaaaaatataaaaattataaaa

SEQ ID NO: 267466 - DNA, 75 bp, Artificial Sequence
  Synthetic
aactatggactggccctctatcggcaccgtaccaacaagacaaagacacgactcatttgacagcgagtatagttc

SEQ ID NO: 267467 - DNA, 75 bp, Artificial Sequence
  Synthetic
tacaaaagtataaaaacaggtattggtacccccttagaggtacattatttaaccagtgaaaataggtattggtgc

SEQ ID NO: 267468 - DNA, 75 bp, Artificial Sequence
  Synthetic
accgtaccaacaagacaaagacacgactcatttgacagcgagtatagttccagaagcaacatacagctagtgacg

SEQ ID NO: 267469 - DNA, 75 bp, Artificial Sequence
  Synthetic
gcggacgtgcatgcaccaatgtacgcaaattcgctggcgtccagcggaggttcaatgctgtcgctgtccagtgaa

SEQ ID NO: 267470 - DNA, 75 bp, Artificial Sequence
  Synthetic
ccccttagaggcacattatagaaccaggtataggtgcccccttagaggtacaccaacaataggtataagtgcccc

SEQ ID NO: 267471 - DNA, 75 bp, Artificial Sequence
  Synthetic
caccaacaataggtataagtgcccccttagtggcacactaaccaccacaatcggtaatatgaagagacgtaggta

SEQ ID NO: 267472 - DNA, 75 bp, Artificial Sequence
  Synthetic
ccagctcagaacggcataatgatactacctgactcagaagacacagatagtataagcagagtaagcacaccgatc

SEQ ID NO: 267473 - DNA, 75 bp, Artificial Sequence
  Synthetic
tataagcagagtaagcacaccgatcgccccgcccaggagacgtttgggaaggaccataaatgttacttgtgacga

SEQ ID NO: 267474 - DNA, 75 bp, Artificial Sequence
  Synthetic
cggaataaagacagacgacagccacgattggacgaagctgcggtatatggatagccatacacctgtggatgcaga

SEQ ID NO: 267475 - DNA, 75 bp, Artificial Sequence
  Synthetic
gcgggaagggaaaatactccctatggccagcgacaggttcttcactgctaagccatacactgtcgcactgagcgt

SEQ ID NO: 267476 - DNA, 75 bp, Artificial Sequence
  Synthetic
atgtaggcgtaccgaactcttcgacaattctccgacgcagggacgtaggagaagttattttgtttttaatatttc

SEQ ID NO: 267477 - DNA, 75 bp, Artificial Sequence
  Synthetic
atcaacagcagacataactgcgtaccccatccaggcaccgctaggattgacacaaccacctaccctcgaacagat

SEQ ID NO: 267478 - DNA, 75 bp, Artificial Sequence
  Synthetic
cccatccaggcaccgctaggattgacacaaccacctaccctcgaacagatcactttcggagattttgccgaaggt

SEQ ID NO: 267479 - DNA, 75 bp, Artificial Sequence
  Synthetic
tgccgccagatacccctgactacacgctaatgacacagcaagcgggaaacgttaagatcacagttgacggccaga

SEQ ID NO: 267480 - DNA, 75 bp, Artificial Sequence
  Synthetic
gaaatagacaacctcctgacaggggcattgacatttggggacttcgagccaggtgaagtggaagagctgacggat

SEQ ID NO: 267481 - DNA, 75 bp, Artificial Sequence
  Synthetic
aggtgaagtggaagagctgacggatagcgagtggtcaacatgctcggacacagatgaagagttacgactagacag

SEQ ID NO: 267482 - DNA, 75 bp, Artificial Sequence
  Synthetic
agcagggggttacatattctcctctgacactggccaaggtcatctacagcaaaaatcagtacgtcaaacgacgct

SEQ ID NO: 267483 - DNA, 75 bp, Artificial Sequence
  Synthetic
aatccacatcccatttccactggtaaacacaacctgcagggtaccaaaagcaagaaatccgaccatcacatacgg

SEQ ID NO: 267484 - DNA, 75 bp, Artificial Sequence
  Synthetic
accagtaaacattgttgaagaggtccacgaagagaaatgctatccacctaaattggatgagaccaaagagcaact

SEQ ID NO: 267485 - DNA, 75 bp, Artificial Sequence
  Synthetic
cctacttaagagactccaggagagtgcttccacggctaaccggagtaggtaccaatctagaaaagtggaaaacat

SEQ ID NO: 267486 - DNA, 75 bp, Artificial Sequence
  Synthetic
gcttccacggctaaccggagtaggtaccaatctagaaaagtggaaaacatgaaagccacgattatccacagactg

SEQ ID NO: 267487 - DNA, 75 bp, Artificial Sequence
  Synthetic
agtaagaaggaaataagtatcacagtaccagcagaaggcttagaggtcacatggggtaataatgacccatacaaa

SEQ ID NO: 267488 - DNA, 75 bp, Artificial Sequence
  Synthetic
taccagcagaaggcttagaggtcacatggggtaataatgacccatacaaatattggccccaactgtctacaaatg

SEQ ID NO: 267489 - DNA, 75 bp, Artificial Sequence
  Synthetic
aaagagggttgcaggctctacttggcgtcagatacaccgagggtcccatcttaccgaatcacatacccggcgcct

SEQ ID NO: 267490 - DNA, 75 bp, Artificial Sequence
  Synthetic
ttaccgaatcacatacccggcgcctgtctactcgccttcaatcaatatcaaattgagtaacccagagactgcagt

SEQ ID NO: 267491 - DNA, 75 bp, Artificial Sequence
  Synthetic
aataatcctctattactatgagctgtacccaactaccacaattgctgtactggctgctgcatctatcgtagtggc

SEQ ID NO: 267492 - DNA, 75 bp, Artificial Sequence
  Synthetic
agcagtgtgtaacgagtttttggccagaaactatccaactgtggcatcctaccaagttactgacgagtacgacgc

SEQ ID NO: 267493 - DNA, 75 bp, Artificial Sequence
  Synthetic
agaaactatccaactgtggcatcctaccaagttactgacgagtacgacgcgtacttggatatggtagacgggtct

SEQ ID NO: 267494 - DNA, 75 bp, Artificial Sequence
  Synthetic
gcatcacgccgtatgagctaactccgggagctaccatcccgttcctcctaggtgtactatgctgtgtcaagactg

SEQ ID NO: 267495 - DNA, 75 bp, Artificial Sequence
  Synthetic
gaaagctgcctagacagagctacatttaacccgtctaaactcaggagttacccaaaacaacactcttaccacgcg

SEQ ID NO: 267496 - DNA, 75 bp, Artificial Sequence
  Synthetic
cccaaaacaacactcttaccacgcgcccaccatcagaagtgcagtgccatcaccattccaaaatacgttgcagaa

SEQ ID NO: 267497 - DNA, 75 bp, Artificial Sequence
  Synthetic
caccattccaaaatacgttgcagaatgtcttggcagcggccacaaaaagaaactgcaacgtaacgcagatgaggg

SEQ ID NO: 267498 - DNA, 75 bp, Artificial Sequence
  Synthetic
tgtcttggcagcggccacaaaaagaaactgcaacgtaacgcagatgagggaattgcccactatggactccgcagt

SEQ ID NO: 267499 - DNA, 75 bp, Artificial Sequence
  Synthetic
gtttaacgtggagtgttttaagaagtacgcatgcaaccaagagtactggagagagttcgcctcaagccctataag

SEQ ID NO: 267500 - DNA, 75 bp, Artificial Sequence
  Synthetic
ggtaacgacagagaatctgacaatgtatgtgacgaaactaaaggggcctaaagcggcggcactcttcgcaaaaac

SEQ ID NO: 267501 - DNA, 75 bp, Artificial Sequence
  Synthetic
aagcggcggcactcttcgcaaaaacacacaacttgctgccgctacaagaggtaccaatggacaggttcacaatgg

SEQ ID NO: 267502 - DNA, 75 bp, Artificial Sequence
  Synthetic
gtatcagctaaactacgtgtcttttaccaagggaataatatcactgtgtctgcatacgctaatggtgatcacgca

SEQ ID NO: 267503 - DNA, 75 bp, Artificial Sequence
  Synthetic
acatgaaacgtgatgtaaaagtgacaccaggtacaaagcacaccgaggaaaggccgaaagtacaggtcatacagg

SEQ ID NO: 267504 - DNA, 75 bp, Artificial Sequence
  Synthetic
cggcagaaccgctggcaacagcatatctgtgtggcatacacagagagttggtaagaagactaaatgcagttctgc

SEQ ID NO: 267505 - DNA, 75 bp, Artificial Sequence
  Synthetic
atgtctatgcgaatacgcagttaatactgcaaagaccagcggcaggagcaatacacgtgccttactcccaggcac

SEQ ID NO: 267506 - DNA, 75 bp, Artificial Sequence
  Synthetic
gtaagaagactaaatgcagttctgctaccgaatgtccacacactgttcgatatgtcagccgaagacttcgatgca

SEQ ID NO: 267507 - DNA, 75 bp, Artificial Sequence
  Synthetic
atcatagccacacatttcaaaccgggcgatgctgtactagaaaccgacatagcctcatttgacaagagtcaagac

SEQ ID NO: 267508 - DNA, 75 bp, Artificial Sequence
  Synthetic
agcctcatttgacaagagtcaagacgactcgcttgcgctgaccgccatgatgctgctagaagatcttggggtaga

SEQ ID NO: 267509 - DNA, 75 bp, Artificial Sequence
  Synthetic
cgtcacagacatgtcctgtgaagtggcttcgtgtacccattcatctgattttggaggtgccgcagttgtaaagta

SEQ ID NO: 267510 - DNA, 75 bp, Artificial Sequence
  Synthetic
ccaacctatcctggatctgatagaagcagcattcggcgaaatatccagttgccatctaccgacgggcacgcggtt

SEQ ID NO: 267511 - DNA, 75 bp, Artificial Sequence
  Synthetic
ggcatgtttctaaccctgtttgtcaataccctcctgaatatcaccattgctagtcgggtgttggaggagagattg

SEQ ID NO: 267512 - DNA, 75 bp, Artificial Sequence
  Synthetic
actacttcagcctgtgcagctttcattggggacgacaacataatacatggagttgtctctgacgcactaatggct

SEQ ID NO: 267513 - DNA, 75 bp, Artificial Sequence
  Synthetic
gcacgttgtgctacgtggatgaacatggaagtgaaaatcatcgatgcagtagtgtcagagaaggcgccatacttc

SEQ ID NO: 267514 - DNA, 75 bp, Artificial Sequence
  Synthetic
tggaagtgaaaatcatcgatgcagtagtgtcagagaaggcgccatacttctgcgggggatttattttacacgaca

SEQ ID NO: 267515 - DNA, 75 bp, Artificial Sequence
  Synthetic
ggttgctatagctgctttgatcttaatcatagttctctgcgtatcgtttagcagacactaaagcatacatgcccc

SEQ ID NO: 267516 - DNA, 75 bp, Artificial Sequence
  Synthetic
gcagacactaaagcatacatgccccaaagtaacatactatacaggtatacgtgctccctgagcagcacaatatat

SEQ ID NO: 267517 - DNA, 75 bp, Artificial Sequence
  Synthetic
agcagaccctttaaagagactgttcaagttaggcaaacctctggcagctggagacgaacaggatgaggacagaag

SEQ ID NO: 267518 - DNA, 75 bp, Artificial Sequence
  Synthetic
gagacgaacaggatgaggacagaagacgtgctctggcagatgaggttactagatggcaaagaaccggcttagtca

SEQ ID NO: 267519 - DNA, 75 bp, Artificial Sequence
  Synthetic
agatggcaaagaaccggcttagtcacagaactggaaaaagcagtatactcaaggtatgaagtacaaggaataaca

SEQ ID NO: 267520 - DNA, 75 bp, Artificial Sequence
  Synthetic
acgtaggtatgaagcttcataaaagctgccgaacttactttaagatgtaggcgtaccgaactcttcgacaattct

SEQ ID NO: 267521 - DNA, 75 bp, Artificial Sequence
  Synthetic
gccgtaataacatcaatggctacctttgcgagtagtaaagaaaactttaaaaaactaagagggcccgtcgtaacc

SEQ ID NO: 267522 - DNA, 75 bp, Artificial Sequence
  Synthetic
taggcgtaccgaactcttcgacaattctccgaacccgcagggacgtaggagaagttattttgtttttaatatttc

SEQ ID NO: 267523 - DNA, 75 bp, Artificial Sequence
  Synthetic
ttgtacggcggacctaaataggtacgcattacagctacctactttgagacaaacaccgctaatagccatggagtt

SEQ ID NO: 267524 - DNA, 75 bp, Artificial Sequence
  Synthetic
atagctgcgtgatacacacacgcagcttacgggtttcatactgctctactctgcattgcaagagattaaagtacc

SEQ ID NO: 267525 - DNA, 75 bp, Artificial Sequence
  Synthetic
cataccagcacaaacttactataatagaagataccagcctagaccttggacccaacgccctactatccaggtgat

SEQ ID NO: 267526 - DNA, 75 bp, Artificial Sequence
  Synthetic
agaagataccagcctagaccttggacccaacgccctactatccaggtgatcaggccaaaaccacgccggagaaga

SEQ ID NO: 267527 - DNA, 75 bp, Artificial Sequence
  Synthetic
actgatagagcaggaaattgatccagactcaaccattctagacattggtagcgcaccagctaggaggatgatgtc

SEQ ID NO: 267528 - DNA, 75 bp, Artificial Sequence
  Synthetic
cctgcaggacaactcgcacaactgatatccgcagtcagcagactagcactgcgtacagttccccagaaaccacgc

SEQ ID NO: 267529 - DNA, 75 bp, Artificial Sequence
  Synthetic
gcgtacagttccccagaaaccacgccggacccgaaaaattaagaagcaaaaacaagtaaagcaagaacaacagag

SEQ ID NO: 267530 - DNA, 75 bp, Artificial Sequence
  Synthetic
aacaagtaaagcaagaacaacagagcactaggaaccagaagaaaaaggcgccgaaacaaaagcagactcaaaaga

SEQ ID NO: 267531 - DNA, 75 bp, Artificial Sequence
  Synthetic
ttatcaagacgtctacgccgtccatgcacctacctcgctgtaccatcaggcgattaaaggagtccgcgtggcata

SEQ ID NO: 267532 - DNA, 75 bp, Artificial Sequence
  Synthetic
cactaggaaccagaagaaaaaggcgccgaaacaaaagcagactcaaaagaaaaagagaccaggacgcagggaaag

SEQ ID NO: 267533 - DNA, 75 bp, Artificial Sequence
  Synthetic
gatgtgcatgaagattgaaaatgactgcatcttcgaagtcaaacatgaaggaaaagtaacggggtatgcatgcct

SEQ ID NO: 267534 - DNA, 75 bp, Artificial Sequence
  Synthetic
tgcatcttcgaagtcaaacatgaaggaaaagtaacggggtatgcatgcctagtaggtgataaggtaatgaaacca

SEQ ID NO: 267535 - DNA, 75 bp, Artificial Sequence
  Synthetic
gaaaagtaacggggtatgcatgcctagtaggtgataaggtaatgaaaccagcacatgtgaaagggactattgaca

SEQ ID NO: 267536 - DNA, 75 bp, Artificial Sequence
  Synthetic
ggctgatgagcaggtactgaaagctaagaacatagggctgtgttcaacagacctatctgagggtagacgaggcaa

SEQ ID NO: 267537 - DNA, 75 bp, Artificial Sequence
  Synthetic
caaaagatcatccaaatatgatctagaatgcgcacagataccagtgcacatgaaatcggacgcctcaaagttcac

SEQ ID NO: 267538 - DNA, 75 bp, Artificial Sequence
  Synthetic
actatccatcatgagaggcaaaaaattgaagccatgcgaccgagtgctattctcggtcggctcaacactctaccc

SEQ ID NO: 267539 - DNA, 75 bp, Artificial Sequence
  Synthetic
gaatgcgcacagataccagtgcacatgaaatcggacgcctcaaagttcacccatgaaaaaccagaaggctactac

SEQ ID NO: 267540 - DNA, 75 bp, Artificial Sequence
  Synthetic
tgaaagtcgtaaacttctacaaagctggcatttaccatcggtatttcatctgaagggtaaactcagcttcacctg

SEQ ID NO: 267541 - DNA, 75 bp, Artificial Sequence
  Synthetic
aactggcatcacggagcggtacagtattctggagggaggttcacaatccctacaggcgcgggaaagcctggggac

SEQ ID NO: 267542 - DNA, 75 bp, Artificial Sequence
  Synthetic
tacaggcgcgggaaagcctggggacagcggaagaccaatctttgacaacaaggggcgcgtcgtggctattgttct

SEQ ID NO: 267543 - DNA, 75 bp, Artificial Sequence
  Synthetic
ccgctgtgacacgatcgtctcatgcgaaggatacgttgtcaagagagtgaccatgagtccaggcatctacggaaa

SEQ ID NO: 267544 - DNA, 75 bp, Artificial Sequence
  Synthetic
aggcggggcaaacgaaggaaccaggacagcactatctgtagtgacttggaataaagacatagtcacaaaaatcac

SEQ ID NO: 267545 - DNA, 75 bp, Artificial Sequence
  Synthetic
acagcactatctgtagtgacttggaataaagacatagtcacaaaaatcacaccggaggggtcagttgaatggagc

SEQ ID NO: 267546 - DNA, 75 bp, Artificial Sequence
  Synthetic
gacatcggggtatgctgtaactcatcatgccggcggcttcctgatgtgcaagacgacagatacagtagacggcga

SEQ ID NO: 267547 - DNA, 75 bp, Artificial Sequence
  Synthetic
cttgccctccctgtcatgtgcctgttggcaaacacaaccttcccatgttcccaaccgccttgcgcgccgtgctgc

SEQ ID NO: 267548 - DNA, 75 bp, Artificial Sequence
  Synthetic
ccaaccgccttgcgcgccgtgctgctacgaaaagaaaccggaagaaaccttgaggatgctggaggacaacgtcat

SEQ ID NO: 267549 - DNA, 75 bp, Artificial Sequence
  Synthetic
tagtggtcaatggcaggacgcaacgtaatacaaacaccatgaaaaactacctgctcccaatagttgctcaggcct

SEQ ID NO: 267550 - DNA, 75 bp, Artificial Sequence
  Synthetic
gcaaccagggtactaccagttactcgattcagcattggcctgctcacaacatcgtcaaagacgtaatgcaagaga

SEQ ID NO: 267551 - DNA, 75 bp, Artificial Sequence
  Synthetic
aaaggacatggaggacgaaaaactcttgggtgtccgagagaggaccttaacgtgctgttgcctatgggcatttag

SEQ ID NO: 267552 - DNA, 75 bp, Artificial Sequence
  Synthetic
aaacttcaatgtctacaaagtcactaggccgtacttagcccactgccctgactgcggggagggacattcatgtca

SEQ ID NO: 267553 - DNA, 75 bp, Artificial Sequence
  Synthetic
cagcccaatagcattagaacggatcagaagtgaggcaacagatggtaccttgaaaatccaggtatctctgcaaat

SEQ ID NO: 267554 - DNA, 75 bp, Artificial Sequence
  Synthetic
agctccaaaatacgagcaactaccgcacagcggaaacgccgaggaagcagcccaggctgaaacagatgcggtaga

SEQ ID NO: 267555 - DNA, 75 bp, Artificial Sequence
  Synthetic
gattggacgaagctgcggtatatggatagccatacacctgtggatgcagaccgatctggtttgttcgtcagaacg

SEQ ID NO: 267556 - DNA, 75 bp, Artificial Sequence
  Synthetic
cccaggctgaaacagatgcggtagaagaacaggaggcagagctaacccgagaagctatgccaccattgcaggcga

SEQ ID NO: 267557 - DNA, 75 bp, Artificial Sequence
  Synthetic
tcagcaccgtgcaccatcacgggaacgatgggacatttcatactagcacgctgtccgaaaggagagacgctgacg

SEQ ID NO: 267558 - DNA, 75 bp, Artificial Sequence
  Synthetic
ctgtccgaaaggagagacgctgacggtaggatttgtagacagtagaaggatcagtcacacatgcatgcacccgtt

SEQ ID NO: 267559 - DNA, 75 bp, Artificial Sequence
  Synthetic
ccaaccgtcagaccttgttgtcggagagtacttagtactgacaccgcaggcggtcctgcgcagccaaaaactcag

SEQ ID NO: 267560 - DNA, 75 bp, Artificial Sequence
  Synthetic
ccaccacgagccgccgctgatagggagagagaagtttcactcccgcccacagcatggcaaagaactaccttgcag

SEQ ID NO: 267561 - DNA, 75 bp, Artificial Sequence
  Synthetic
tacgtacgtccataccacagcggccactactgaggaaatagaagtgcatatgccgccagatacccctgactacac

SEQ ID NO: 267562 - DNA, 75 bp, Artificial Sequence
  Synthetic
gttaagatcacagttgacggccagacggtacgatacaagtgcaaatgtgacggctccaatgaaggattaataacc

SEQ ID NO: 267563 - DNA, 75 bp, Artificial Sequence
  Synthetic
acttccagagcttaagcgaaagtgccaccatggtatttaacgagcgagagtttgtgaaccggaagttacaccaca

SEQ ID NO: 267564 - DNA, 75 bp, Artificial Sequence
  Synthetic
cggtacgatacaagtgcaaatgtgacggctccaatgaaggattaataaccactgacaaagtcataaataactgca

SEQ ID NO: 267565 - DNA, 75 bp, Artificial Sequence
  Synthetic
actgacaaagtcataaataactgcaaagtagaccaatgccacacagcagttacaaaccacaagaaatggcaatac

SEQ ID NO: 267566 - DNA, 75 bp, Artificial Sequence
  Synthetic
tcgccatgcacggcccagcgctgaacactgatgaagagtcatatgaactggtaagggtagagaaaacagaacacg

SEQ ID NO: 267567 - DNA, 75 bp, Artificial Sequence
  Synthetic
tacaaaccacaagaaatggcaatacaactcaccgttgaccccgcggaactccgaacaaggagatagaaaaggtaa

SEQ ID NO: 267568 - DNA, 75 bp, Artificial Sequence
  Synthetic
gtaagggtagagaaaacagaacacgagtacgtctatgacgttgatcagaagaaatgttgtaagagggaggaagca

SEQ ID NO: 267569 - DNA, 75 bp, Artificial Sequence
  Synthetic
aactcaccgttgaccccgcggaactccgaacaaggagatagaaaaggtaaaatccatatcccatttccattggtg

SEQ ID NO: 267570 - DNA, 75 bp, Artificial Sequence
  Synthetic
ttataggtgtcttcggagtaccgggttctggcaagtcggctataatcaaaaacctggtaaccaggcaagacttgg

SEQ ID NO: 267571 - DNA, 75 bp, Artificial Sequence
  Synthetic
aacacaacctgcagggtaccaaaagcaagaaatccgactgtcacatacggtaaaaacagagtcactctgctgttg

SEQ ID NO: 267572 - DNA, 75 bp, Artificial Sequence
  Synthetic
taaaaacagagtcactctgctgttgtatccagaccatccaacactcctttcgtatcgcgccatgggaaggatccc

SEQ ID NO: 267573 - DNA, 75 bp, Artificial Sequence
  Synthetic
tatccagaccatccaacactcctttcgtatcgcgccatgggaaggatcccggattaccatgaagagtggataaca

SEQ ID NO: 267574 - DNA, 75 bp, Artificial Sequence
  Synthetic
cacgtacagtcgactcactactcctgaatggatgtaacaagccagtggaagtactgtacgtggacgaggcattcg

SEQ ID NO: 267575 - DNA, 75 bp, Artificial Sequence
  Synthetic
agcaagaaggaaataagtattacagtaccagcagaaggtttagaggtcacgtggggtaataatgacccatataaa

SEQ ID NO: 267576 - DNA, 75 bp, Artificial Sequence
  Synthetic
taccagcagaaggtttagaggtcacgtggggtaataatgacccatataaatattggccgcaactgtctacaaatg

SEQ ID NO: 267577 - DNA, 75 bp, Artificial Sequence
  Synthetic
aataatcctctattactatgagctgtacccaactaccacaattgctgtactagctgctgcttctatcgtagtagc

SEQ ID NO: 267578 - DNA, 75 bp, Artificial Sequence
  Synthetic
atctttggtaggtctatcattaggcatgtgcatatgcgcgagacgcaggtgcatcacgccgtatgagctaactcc

SEQ ID NO: 267579 - DNA, 75 bp, Artificial Sequence
  Synthetic
gcatcacgccgtatgagctaactccaggagctaccatcccattcctcctaggtatactatgctgtgtcaagactg

SEQ ID NO: 267580 - DNA, 75 bp, Artificial Sequence
  Synthetic
aacgaaaaccctctgtatgcaccaacatcagaacacgttaacgtgctattgacacgcacagagggcaagttgaca

SEQ ID NO: 267581 - DNA, 75 bp, Artificial Sequence
  Synthetic
caaaagcagcatcgtactacgaagctgcaacatacctctggaatgagcaacaaccattattttggttacagcttt

SEQ ID NO: 267582 - DNA, 75 bp, Artificial Sequence
  Synthetic
catcagaacacgttaacgtgctattgacacgcacagagggcaagttgacatggaagacactctcaggcgacccat

SEQ ID NO: 267583 - DNA, 75 bp, Artificial Sequence
  Synthetic
taatccctctgtcagctgcaattgttgtgtgtaattgcctaaaacttttaccatgctgctgcaaaacattgactt

SEQ ID NO: 267584 - DNA, 75 bp, Artificial Sequence
  Synthetic
ttttagccgtcatgagcatcggtgcccgcactgtgtccgcgtacgagcacgcaacagtgatcccgaacacggtgg

SEQ ID NO: 267585 - DNA, 75 bp, Artificial Sequence
  Synthetic
ccatcatggcaggaatatgcaatcaccagatggcttttgacacatttcagaacaaagctaatgtatgctgggcta

SEQ ID NO: 267586 - DNA, 75 bp, Artificial Sequence
  Synthetic
gagtaccgtataagactcttgttagcagaccagggtatagccctatggtcttagaaatggagctacagtcggtca

SEQ ID NO: 267587 - DNA, 75 bp, Artificial Sequence
  Synthetic
cagaccagggtatagccctatggtcttagaaatggagctacagtcggtcactctggaaccaacattgttcttgga

SEQ ID NO: 267588 - DNA, 75 bp, Artificial Sequence
  Synthetic
agaagttgcactgaatgaaatatgcactcgcatatatggggtagacctggacagcggactattctcaaagccact

SEQ ID NO: 267589 - DNA, 75 bp, Artificial Sequence
  Synthetic
ttacatcacgtgtgagtataaaacaatcacaccgtccccgtacgtaaaatgctgtggtacagctgaatgtaaggc

SEQ ID NO: 267590 - DNA, 75 bp, Artificial Sequence
  Synthetic
gctgtggtacagctgaatgtaaggccaagaacctaccagattataactgcaaagtattcacaggcgtctacccat

SEQ ID NO: 267591 - DNA, 75 bp, Artificial Sequence
  Synthetic
aaagtattcacaggcgtctacccatttatgtggggaggagcatattgcttctgtgacgcagagaacacacaactc

SEQ ID NO: 267592 - DNA, 75 bp, Artificial Sequence
  Synthetic
agtgaggcacacgttgagaaatcagaatcatgcaaaactgagtttgcatcagcctacagagcccacacagcttca

SEQ ID NO: 267593 - DNA, 75 bp, Artificial Sequence
  Synthetic
agcctacagagcccacacagcttcagtatcagctaaactacgtgtcttttaccaagggaataatatcaccgtgtc

SEQ ID NO: 267594 - DNA, 75 bp, Artificial Sequence
  Synthetic
gtatcagctaaactacgtgtcttttaccaagggaataatatcaccgtgtctgcatacgctaatggtgatcatgca

SEQ ID NO: 267595 - DNA, 75 bp, Artificial Sequence
  Synthetic
agaatggaatggctggtaaacaaaatcagcggtcaccacatgttgttggttagcggtcataatcttatattacca

SEQ ID NO: 267596 - DNA, 75 bp, Artificial Sequence
  Synthetic
gtcacggtaaaagacgcgaagtttgtcatcggtccactatcgtccgcctggtcaccatttgataataagatcgtg

SEQ ID NO: 267597 - DNA, 75 bp, Artificial Sequence
  Synthetic
tcatcggtccactatcgtccgcctggtcaccatttgataataagatcgtggtgtacaaaggcgaagtctacaaca

SEQ ID NO: 267598 - DNA, 75 bp, Artificial Sequence
  Synthetic
tggactatccacctttcggcgcagggaggccaggacagttcggtgacatccagagccgcacgccagacagcaagg

SEQ ID NO: 267599 - DNA, 75 bp, Artificial Sequence
  Synthetic
tgcaggactggccactagagcgggctgtgccccgtcataccgagtgaaacggatggacatcgcaaagaacactga

SEQ ID NO: 267600 - DNA, 75 bp, Artificial Sequence
  Synthetic
cttcgggctttaagtactggctcaaagaaaaaggggcatcattgcagcatacggcaccatttggctgtcagatag

SEQ ID NO: 267601 - DNA, 75 bp, Artificial Sequence
  Synthetic
acggcaccatttggctgtcagatagcaacaaacccggtaagagcagtgaactgtgcagtgggcaacataccagtc

SEQ ID NO: 267602 - DNA, 75 bp, Artificial Sequence
  Synthetic
ctgtgcagtgggcaacataccagtctccattgacatcccagatgcagctttcaccagggtcactgacgctccttc

SEQ ID NO: 267603 - DNA, 75 bp, Artificial Sequence
  Synthetic
acaccagtggggactgcaaagacaatcatgtgcggtcaataccccgtcatccacgcagtaggccctaacttctca

SEQ ID NO: 267604 - DNA, 75 bp, Artificial Sequence
  Synthetic
tcaccagggtcactgacgctccttccgtcacagacatgtcctgtgaagtggcttcgtgtacccattcatctgatt

SEQ ID NO: 267605 - DNA, 75 bp, Artificial Sequence
  Synthetic
cgtcacagacatgtcctgtgaagtggcttcgtgtacccattcatctgattttggaggtgccgcagtcataaagta

SEQ ID NO: 267606 - DNA, 75 bp, Artificial Sequence
  Synthetic
cacagctagtaaaaaggggaaatgcgctgtgcactctttaacaaacgcggtcactatccgcgaacctaacgtaga

SEQ ID NO: 267607 - DNA, 75 bp, Artificial Sequence
  Synthetic
aggcaaagacagactgctgcaatcactaaaccatcttttcgcagcgatggattcgacagatgcagacgttgtcat

SEQ ID NO: 267608 - DNA, 75 bp, Artificial Sequence
  Synthetic
gctgtgcactctttaacaaacgcggtcactatccgcgaacctaacgtagatgtcgagggaacagcacaattacag

SEQ ID NO: 267609 - DNA, 75 bp, Artificial Sequence
  Synthetic
ctaaaccatcttttcgcagcgatggattcgacagatgcagacgttgtcatctactgcagggacaaggaatgggag

SEQ ID NO: 267610 - DNA, 75 bp, Artificial Sequence
  Synthetic
attgccttctcgaccgcactagctagtgcggaatttaaggtgcagatctgctccacacaggtacactgctcagcg

SEQ ID NO: 267611 - DNA, 75 bp, Artificial Sequence
  Synthetic
ctccacacaggtacactgctcagcgacgtgccatcctcctaaagatcacatagtcaactacccgtcaccgcacac

SEQ ID NO: 267612 - DNA, 75 bp, Artificial Sequence
  Synthetic
cacagtagagggagcactctactcgtacctagagggaacaagattccaccaaactgcagtagatatggcagagat

SEQ ID NO: 267613 - DNA, 75 bp, Artificial Sequence
  Synthetic
cacactaggagtgcaggacatctcaacgacagctatgtcttgggtccagaagattacaggaggagtgggactcgt

SEQ ID NO: 267614 - DNA, 75 bp, Artificial Sequence
  Synthetic
ggttgctatagctgctttgatcttaattatagttctctgcgtatcatttagcagacactaaagtatacatgcccc

SEQ ID NO: 267615 - DNA, 75 bp, Artificial Sequence
  Synthetic
cgtctacgcatgaatcataccaccagcatcatagtgtgctcgtcttttccgctgccgaaatacaaaatcgagggc

SEQ ID NO: 267616 - DNA, 75 bp, Artificial Sequence
  Synthetic
gcagacactaaagtatacatgccccaaagtaatatactatacaggtatacgtgctccctgagcagcacaacatat

SEQ ID NO: 267617 - DNA, 75 bp, Artificial Sequence
  Synthetic
gtattatctataaaagaaaaacaaaaatataaaaattataaaatacaaaagtataaaaacaggtatcagtacccc

SEQ ID NO: 267618 - DNA, 75 bp, Artificial Sequence
  Synthetic
cttagaggtacatcacttaaccaggtattagtgcccccttagaggcacattatataaccaggtataggtgccccc

SEQ ID NO: 267619 - DNA, 75 bp, Artificial Sequence
  Synthetic
ttagaggcacactaacaataggtataagtgcccccttagtggcacactaaccaccacaattggtaatatgaagag

SEQ ID NO: 267620 - DNA, 75 bp, Artificial Sequence
  Synthetic
aactatggactggccctctatcggcaccgtatcaacaagacaaagacacgactcatctgacagcgagtatagtgg

SEQ ID NO: 267621 - DNA, 75 bp, Artificial Sequence
  Synthetic
actcatctgacagcgagtatagtggctccagaagtaacatacaactagtgacggcggacgtgcatgcaccaatgt

SEQ ID NO: 267622 - DNA, 75 bp, Artificial Sequence
  Synthetic
ctgccgaacttactttaagatgtaggcgtaccgaactcttcaacaattctccgaacccgcagggacgtaggagaa

SEQ ID NO: 267623 - DNA, 75 bp, Artificial Sequence
  Synthetic
gtaggcgtaccgaactcttcaacaattctccgaacccgcagggacgtaggagaagttattttgtttttaatattc

SEQ ID NO: 267624 - DNA, 75 bp, Artificial Sequence
  Synthetic
acgcacattcgctggcgtccagcggaggttcaatgctgtcgctgtccagtgaaccagctcagaacggcacaatga

SEQ ID NO: 267625 - DNA, 75 bp, Artificial Sequence
  Synthetic
tactacttgactcagaagacacagacagtataagcagagtaagcacaccgatcgccccgcccagaagacgtttgg

SEQ ID NO: 267626 - DNA, 75 bp, Artificial Sequence
  Synthetic
gagcattttcgcatctagcaataaaactgatagagcaggaaattgatccagactcaaccattctagacattggtc

SEQ ID NO: 267627 - DNA, 75 bp, Artificial Sequence
  Synthetic
atcgccccgcccagaagacgtttgggaaggaccataaatgtgacctgcgacgagcgggaagggaaaatactccct

SEQ ID NO: 267628 - DNA, 75 bp, Artificial Sequence
  Synthetic
actgatagagcaggaaattgatccagactcaaccattctagacattggtcctgcaccagctaggaggatgatgtc

SEQ ID NO: 267629 - DNA, 75 bp, Artificial Sequence
  Synthetic
atggccagcgacaggttcttcactgctaagccatacactgtcgcactgagcgtatcaacagcagatatgactgtg

SEQ ID NO: 267630 - DNA, 75 bp, Artificial Sequence
  Synthetic
tatcccatccaggcaccgctaggattgataccaccacctaccctcgaaccgatcactttcggagacttcgccgaa

SEQ ID NO: 267631 - DNA, 75 bp, Artificial Sequence
  Synthetic
tgataccaccacctaccctcgaaccgatcactttcggagacttcgccgaaggtgaaatagacaacctcctgacag

SEQ ID NO: 267632 - DNA, 75 bp, Artificial Sequence
  Synthetic
gatagcgagtggtcaacgtgctcggacacagacgaagagttacgactagacagagcagggggttacatattctcc

SEQ ID NO: 267633 - DNA, 75 bp, Artificial Sequence
  Synthetic
attatctatcatgagaggcaaaaaattgaagccatgcgaccgagtgttattctcggtcggctcaacactctaccc

SEQ ID NO: 267634 - DNA, 75 bp, Artificial Sequence
  Synthetic
ctaaattggatgagatcaaagagcaactactacttaagagacttcaggagagtgcttccacggctaaccggagta

SEQ ID NO: 267635 - DNA, 75 bp, Artificial Sequence
  Synthetic
tgaaagtcgcaaacttttacaaagctggcatttaccatcggtattccacctgaagggtaaactcagcttcacctg

SEQ ID NO: 267636 - DNA, 75 bp, Artificial Sequence
  Synthetic
ggtaccaatctagaaaagtggaaaacatgaaagccacgattatccacagactgaaagagggttgcagactctatt

SEQ ID NO: 267637 - DNA, 75 bp, Artificial Sequence
  Synthetic
ccgctgtgacacgattgtctcatgcgaaggatacgtcgtcaagagagtgacgatgagtccaggcatctacggaaa

SEQ ID NO: 267638 - DNA, 75 bp, Artificial Sequence
  Synthetic
tggcgtcagaaacaccgagggtcccatcttaccgagtcacatacccggcgcccatctactcgccttcaatcaata

SEQ ID NO: 267639 - DNA, 75 bp, Artificial Sequence
  Synthetic
cccatctactcgccttcaatcaatatcaaactgactaacccagagactgcagtagcagtgtgtaacgagtttttg

SEQ ID NO: 267640 - DNA, 75 bp, Artificial Sequence
  Synthetic
cgcgtacttggatatggtagacgggtccgaaagttgcctagacagagctacattcaacccgtctaaactcaggag

SEQ ID NO: 267641 - DNA, 75 bp, Artificial Sequence
  Synthetic
aaaggacatggaggacgaaaaactcttgggtgtccgagagaggaccttaacatgctgttgcctatgggcattcag

SEQ ID NO: 267642 - DNA, 75 bp, Artificial Sequence
  Synthetic
cgcacagtggatcctaggcttttagctaacgcattgcctgactgattacgccttgcacacctcaatacaacactt

SEQ ID NO: 267643 - DNA, 75 bp, Artificial Sequence
  Synthetic
gatttcatcaacaaagaaggaaatgaacctggtgattttaaggatttattgagttcagagttcacaaaggacaca

SEQ ID NO: 267644 - DNA, 75 bp, Artificial Sequence
  Synthetic
attgtttttcttagttgtacaccaagagtagaacaacaaaggaagacaaagaaaatgggtcaagtgattgggttc

SEQ ID NO: 267645 - DNA, 75 bp, Artificial Sequence
  Synthetic
ttgactcttgatttttgtatccaagtatcacacattaaaaggtcagtcaaattcaatgtgaaaaggacacttgtc

SEQ ID NO: 267646 - DNA, 75 bp, Artificial Sequence
  Synthetic
ttccaatctttacctaacatcattaatgaggctctgaacatcgcactcctctgtgtggcactgattgccattctg

SEQ ID NO: 267647 - DNA, 75 bp, Artificial Sequence
  Synthetic
tatactcttgctgtgagaactcaaattgagaaaaagatcatcttagaagcaattgggacagatgatcagattagc

SEQ ID NO: 267648 - DNA, 75 bp, Artificial Sequence
  Synthetic
aagggagtggttaatatttggagatctgggttcctgcaactcttactctttttgatgttagcagggagatcctgt

SEQ ID NO: 267649 - DNA, 75 bp, Artificial Sequence
  Synthetic
ttaatagtctcagagttggatctgttttgtagtggacacactggcaatcattttgtgcttgatgcagctccttta

SEQ ID NO: 267650 - DNA, 75 bp, Artificial Sequence
  Synthetic
tctcattctttctcagttggaagaaatcatgtgttccaatccatcacactgaatttcacacagttcatggactat

SEQ ID NO: 267651 - DNA, 75 bp, Artificial Sequence
  Synthetic
atttacagtgagccactaatagcaggatctctaaaatttgacctcctttcaatgttgagagaccaggaattatct

SEQ ID NO: 267652 - DNA, 75 bp, Artificial Sequence
  Synthetic
gcaccaacctcatgctccatcaacaacacacaccactatttcaaaggtccacaaaatacatcatggggaatagaa

SEQ ID NO: 267653 - DNA, 75 bp, Artificial Sequence
  Synthetic
ctcacatcaagtgaaaaaatgcccacatttaactttgattttagttctcaaaaacaccacattgtgaataaattt

SEQ ID NO: 267654 - DNA, 75 bp, Artificial Sequence
  Synthetic
ctcactttgaccaatgattctatcatcaatgcaacaaactctcttagagtttataccaacatccatcataacatt

SEQ ID NO: 267655 - DNA, 75 bp, Artificial Sequence
  Synthetic
gcatacaagctcgtaggaccctctgtctatgatgaacccttggttttgaataaaggcattgtttattctggggag

SEQ ID NO: 267656 - DNA, 75 bp, Artificial Sequence
  Synthetic
acaaattgtgttcagaatgtgacagagcaggttgaattaatgaaatggctcttagagtccatgcaccttcagatt

SEQ ID NO: 267657 - DNA, 75 bp, Artificial Sequence
  Synthetic
agaaagctcacttctctaggagttgatgtcagcggagaaagaatagtgcaagcaatgggtgaattggacagcatc

SEQ ID NO: 267658 - DNA, 75 bp, Artificial Sequence
  Synthetic
atgagaccaggaaaacacttgcccccaattctttgtgaaaaaaacagaggccttttggttgagtacaatctgaca

SEQ ID NO: 267659 - DNA, 75 bp, Artificial Sequence
  Synthetic
tcagaacaagagttgttcctgaccaacttatggggatactcaaaagaaactgatattaaagtcaggataattcaa

SEQ ID NO: 267660 - DNA, 75 bp, Artificial Sequence
  Synthetic
aatctggcttcgcgtgaggagaaacattttgaatattggagtcaattgctctatggccttgcaaagttgctaggc

SEQ ID NO: 267661 - DNA, 75 bp, Artificial Sequence
  Synthetic
gacaatctaaagattttgactgacaactattttgtgcaacttaaaaattccttgaagacctttgctgagtggctt

SEQ ID NO: 267662 - DNA, 75 bp, Artificial Sequence
  Synthetic
tcaacaaaaagactttggtttgattactgtcaaaaacatgattgtcaaatgattgagggtagtagccatcttaaa

SEQ ID NO: 267663 - DNA, 75 bp, Artificial Sequence
  Synthetic
aatttaggcaactacatgctatgttatagcaaaacattagacactattatgatttcagatgtcagtggcaggata

SEQ ID NO: 267664 - DNA, 75 bp, Artificial Sequence
  Synthetic
tgtaactactctaagtgtagcgggcataccacatacaaatatttgatcttaaagaacactacatgggaaaatcat

SEQ ID NO: 267665 - DNA, 75 bp, Artificial Sequence
  Synthetic
aagttaaaaggtgttatatgcaggaaattgattgaggatgaagtcatggaggtggagtaaacaccaccccgggct

SEQ ID NO: 267666 - DNA, 75 bp, Artificial Sequence
  Synthetic
tgtgaatataatcacctgaacacaattcatttgttgatgggttccacaggtcaatcgttcataacaagaaggctt

SEQ ID NO: 267667 - DNA, 75 bp, Artificial Sequence
  Synthetic
cagccccgggggggcccccggggcgagggacccccttgggggtccctcgccgggggagcccgtgtttcagggctc

SEQ ID NO: 267668 - DNA, 75 bp, Artificial Sequence
  Synthetic
caggcattcctaacatggacactttcagattcatctggaaatgatcttccaggagggtactgtttagaacagtgg

SEQ ID NO: 267669 - DNA, 75 bp, Artificial Sequence
  Synthetic
tggaggtgctgttggagcagtggtcacagcgatgtgggttggtatcggtttcccacagatctcacaattctgacc

SEQ ID NO: 267670 - DNA, 75 bp, Artificial Sequence
  Synthetic
gctattgtttgggcaggtataaaatgctttggaaacactgcagtagccaaatgcaatcaaaatcatgattcagag

SEQ ID NO: 267671 - DNA, 75 bp, Artificial Sequence
  Synthetic
ccttctgagcatagagcttatacactttagacaaagataatggtcactacattccaccaagttcttgttttgaaa

SEQ ID NO: 267672 - DNA, 75 bp, Artificial Sequence
  Synthetic
ttttgtgacatgctgagactatttgactataatagaaatgctattaaaagcttgaatgaccagtcacaaagcaga

SEQ ID NO: 267673 - DNA, 75 bp, Artificial Sequence
  Synthetic
ccaacagcacttacaattgtatctcccataaagtgagggtcttgcctcccttataagagatacccttggttgatt

SEQ ID NO: 267674 - DNA, 75 bp, Artificial Sequence
  Synthetic
ctaaatttgttgagcaacacaataaactcactcatttcagacaaccttttaatgaagaacaaacttgctgagata

SEQ ID NO: 267675 - DNA, 75 bp, Artificial Sequence
  Synthetic
ggtgtgagaaagccctagtgaaggaacattctcaaaaccagagcttttggagctctttgatcccattttgtgact

SEQ ID NO: 267676 - DNA, 75 bp, Artificial Sequence
  Synthetic
atgaacataccctactgtaattacactagattctggtatatcaataataccagaacaggaagacacacgttacca

SEQ ID NO: 267677 - DNA, 75 bp, Artificial Sequence
  Synthetic
atcccattttgtgactcttttcacaccttgaaaacctagaagcgtgaacagtttgtgcctaggatccccggtgcg

SEQ ID NO: 267678 - DNA, 75 bp, Artificial Sequence
  Synthetic
cagtgctggttaatttcaaatggatcatatctgaatgaaactaaattcagaacacagtggctttcagaaagcaat

SEQ ID NO: 267679 - DNA, 75 bp, Artificial Sequence
  Synthetic
gctttgtatactgagatgctgactgaagattatgagaaaagacaaggtgcaacaccactgagtttagttgatctg

SEQ ID NO: 267680 - DNA, 75 bp, Artificial Sequence
  Synthetic
tgcttttggtcaactttgttctatgtaaccactttgtttgcccaccttgttggtttcccaacacacagacatctg

SEQ ID NO: 267681 - DNA, 75 bp, Artificial Sequence
  Synthetic
gttgaaggtccatgtccaaagccccatcgaataacaagaaggggtgtttgtgcatgcggacactttgctgctgct

SEQ ID NO: 267682 - DNA, 75 bp, Artificial Sequence
  Synthetic
ggaaaaccagtgcagtgggttaaaaatcggtgaacacaagcaccccaccatcctgggcctattggcccaggatgg

SEQ ID NO: 267683 - DNA, 75 bp, Artificial Sequence
  Synthetic
tggggcagccccctcgacccacggcaaaagccgtgggtcgaggggggttgcacttacattgcaacagttgattca

SEQ ID NO: 267684 - DNA, 75 bp, Artificial Sequence
  Synthetic
gccctgaacacaagagcacttggcaggagtgcctttggttggacatcagacactttgccttcgaaagttgcttgg

SEQ ID NO: 267685 - DNA, 75 bp, Artificial Sequence
  Synthetic
aacatcaggcaatcaagaagtgcacaatgtggttctccagagttgcctcctttcttttttctactcagcaccaca

SEQ ID NO: 267686 - DNA, 75 bp, Artificial Sequence
  Synthetic
ccgttgtgcttagtacaaagtgagccgtacttttcccagacaacaccctcatagaacctagcctggtcagatgga

SEQ ID NO: 267687 - DNA, 75 bp, Artificial Sequence
  Synthetic
aaacttaagtcaattgttgcgatgtcatgccttccattaagttccagcagtctcttgatgtcatctgagccttga

SEQ ID NO: 267688 - DNA, 75 bp, Artificial Sequence
  Synthetic
caggtgaaaactagacttgaaggtagtttaattaatattctgctcaataaacctggtcttgcattttctatgtct

SEQ ID NO: 267689 - DNA, 75 bp, Artificial Sequence
  Synthetic
ctcagcagtatcccatgagaatacttactgccatttttgaagcctttttcatcatgaggaagtctgaagcaatgg

SEQ ID NO: 267690 - DNA, 75 bp, Artificial Sequence
  Synthetic
atgtagttgcctgtggatggttgatagattgcaagttcaaccggatcattgggaggtccttcaatgtcaatccag

SEQ ID NO: 267691 - DNA, 75 bp, Artificial Sequence
  Synthetic
attgtctcatctgggttcagttttgagattgcttctttgatcactgcttcttgtgtgtctgtcaatgggttcagc

SEQ ID NO: 267692 - DNA, 75 bp, Artificial Sequence
  Synthetic
cgtatgtttcccccattcttcacaggacttggtgggccataaataacttctcttgagaagtcaacagaggtgttt

SEQ ID NO: 267693 - DNA, 75 bp, Artificial Sequence
  Synthetic
tcccacgctcttccgacaatttgggaacgtgaaccaatgtagggccatccctcacctgaaagacaaattttatac

SEQ ID NO: 267694 - DNA, 75 bp, Artificial Sequence
  Synthetic
aagatgttttcataggggttcctctgtccgggtttttcattcacaaacatcttctcttgatgtttgacaattaga

SEQ ID NO: 267695 - DNA, 75 bp, Artificial Sequence
  Synthetic
agagatttgatgatgtcagggaaattctctggtttcacgtagattgtttctagcatgtttcctccatcaactaga

SEQ ID NO: 267696 - DNA, 75 bp, Artificial Sequence
  Synthetic
catgcacctgctttgacagccgcagacagactgagggtgtaaccagaaatgttgttggcactttcctctcttgtg

SEQ ID NO: 267697 - DNA, 75 bp, Artificial Sequence
  Synthetic
atgaactgtagacaggtatgctcatttgacaacttttcaagatcatccaagttgggatacttcacagtgtagagc

SEQ ID NO: 267698 - DNA, 75 bp, Artificial Sequence
  Synthetic
agcccaagtgttgtcaggccctgcaccacatcattcatctgctcagctccttgcactgacatgcaagcaatggtc

SEQ ID NO: 267699 - DNA, 75 bp, Artificial Sequence
  Synthetic
aatgctggcattgacccaaactgatttatgaggagtttttggtcttttatgtcccaaattctgaccacaccactg

SEQ ID NO: 267700 - DNA, 75 bp, Artificial Sequence
  Synthetic
ttttgtccttgccttgactgaaacccaagggttctcaaaatggcagaacgtctatcaagttgagctgttgtcaga

SEQ ID NO: 267701 - DNA, 75 bp, Artificial Sequence
  Synthetic
ttgccctgataaactccaggtgtagctctctcattcatgttgatcttccttctgagcttctccaagtcagttgct

SEQ ID NO: 267702 - DNA, 75 bp, Artificial Sequence
  Synthetic
aattccataagctcatctctcgatagactcccgattttcagggaaacattgttctgcttgttcctcatgaccata

SEQ ID NO: 267703 - DNA, 75 bp, Artificial Sequence
  Synthetic
agtccatcaacagctttgttcaagtctctcaatttgaggagatcatcgtcagttctcctctccttcctcatgact

SEQ ID NO: 267704 - DNA, 75 bp, Artificial Sequence
  Synthetic
ctttgaacctgggagacttgactgaagtctaaaccatcaaccaaagattttgcatctcgaagcacatcccctttg

SEQ ID NO: 267705 - DNA, 75 bp, Artificial Sequence
  Synthetic
gtctgagttgtgaagtgactcagacctcttcttagagactgagtccacctaaagctaggtacttcacttgcacca

SEQ ID NO: 267706 - DNA, 75 bp, Artificial Sequence
  Synthetic
gacattgtcaaaggctaatgctaaaggtttagcacttgcaaaaggtttgtttaagtgcaaagcgttatcctatat

SEQ ID NO: 267707 - DNA, 75 bp, Artificial Sequence
  Synthetic
ctaaaggtttagcacttgcaaaaggtttgtttaagtgcaaagcgttatcctatatgcctaggatccccggtgcgc

SEQ ID NO: 267708 - DNA, 75 bp, Artificial Sequence
  Synthetic
gcgcaccggggatcctaggcttttaactaacgcattacagagggattcaaccctgtgcaattcaaagtcacagtt

SEQ ID NO: 267709 - DNA, 75 bp, Artificial Sequence
  Synthetic
tttgtgacagttagttgtcaaccccctttttgacaaccattatgggtcaagtcattgggttcttccaatccttac

SEQ ID NO: 267710 - DNA, 75 bp, Artificial Sequence
  Synthetic
ccaacatcattaatgaggcactaaacattgccctcatctgtgtggcattaattgccatattgaaaggtattgtta

SEQ ID NO: 267711 - DNA, 75 bp, Artificial Sequence
  Synthetic
acatatggaaatcaggtctgattcagctgttcatattcctcatcctagcggggaggagctgttctcacacctttc

SEQ ID NO: 267712 - DNA, 75 bp, Artificial Sequence
  Synthetic
agattggccgaaaccatgagttccaaagtatcactctaaacttcacacagtttttgggctacgcacccagctcct

SEQ ID NO: 267713 - DNA, 75 bp, Artificial Sequence
  Synthetic
gttctgttaacaacactcatcactactttagaggtcctggcaatgtctcttggggcatcgagctcacattgacca

SEQ ID NO: 267714 - DNA, 75 bp, Artificial Sequence
  Synthetic
acaactccgtgatcaatgcaagcaactcactgaaggtgttcaccaacattcaccacaacatcaccaactgcgttc

SEQ ID NO: 267715 - DNA, 75 bp, Artificial Sequence
  Synthetic
agaatatcgatgagcaagaccacctaatgaaatggctcatagaaacaatgcatctacagatcatgaaaccaggaa

SEQ ID NO: 267716 - DNA, 75 bp, Artificial Sequence
  Synthetic
agagactaccaccaatcctgtgtgagaaagacaaagggttactaattgaatacaacctaaccaacattgcatctc

SEQ ID NO: 267717 - DNA, 75 bp, Artificial Sequence
  Synthetic
gcgaagaaaagcactctgagtactggagccaacttctctatggtctatcaaaactattaggctccagtaagtcat

SEQ ID NO: 267718 - DNA, 75 bp, Artificial Sequence
  Synthetic
tgtggtttgattactgtcagagagcagattgcatgatgcaagagcacagctcacacttgaagtgcaactactcag

SEQ ID NO: 267719 - DNA, 75 bp, Artificial Sequence
  Synthetic
agtgttctggccataccaccttcaaatacctcattctacaaaacaccacttgggagaaccattgtgagttcaacc

SEQ ID NO: 267720 - DNA, 75 bp, Artificial Sequence
  Synthetic
atctaaacacaattcacctgttgatgagctctactggtcagtctttcataactagaaggttgcaggcttttctaa

SEQ ID NO: 267721 - DNA, 75 bp, Artificial Sequence
  Synthetic
cttggactttgtcagatgctacaggcaatgacctccctgggggttactgcctagagcagtgggccatagtttggg

SEQ ID NO: 267722 - DNA, 75 bp, Artificial Sequence
  Synthetic
caggcatcaagtgctttgggaacacagcagttgcaaagtgtaatcaaaatcatgactctgaattctgtgacatgt

SEQ ID NO: 267723 - DNA, 75 bp, Artificial Sequence
  Synthetic
tgaggctctttgattacaataggaatgctattaagagtctgaatgatcagtctcaaagtcgtctaaatcttctaa

SEQ ID NO: 267724 - DNA, 75 bp, Artificial Sequence
  Synthetic
caaatacaataaattcactgatttcggataatctgttgatgaaaaacaagttggctgagataatgaacattccgt

SEQ ID NO: 267725 - DNA, 75 bp, Artificial Sequence
  Synthetic
attgcaattacacaaaattctggtacatcaacgacactaggactggaaggcacacccttccccaatgctggttaa

SEQ ID NO: 267726 - DNA, 75 bp, Artificial Sequence
  Synthetic
tctcaaatgggtcttacttgaatgagactaaattcagaactcagtggctgtcagagagcaatgcactctatacag

SEQ ID NO: 267727 - DNA, 75 bp, Artificial Sequence
  Synthetic
aaatgctaacagaagattatgacaaaaggcagggtagcacaccactctccttggttgatctatgtttttggtcaa

SEQ ID NO: 267728 - DNA, 75 bp, Artificial Sequence
  Synthetic
ccttattctatgtgaccacattgtttgctcatcttgttggtttcccaacacacagacacatcttagatggtcctt

SEQ ID NO: 267729 - DNA, 75 bp, Artificial Sequence
  Synthetic
gccctaaaccccacagattaacaaagaaaggaatttgttcctgtggacattttggaataccgggcaaacctgttc

SEQ ID NO: 267730 - DNA, 75 bp, Artificial Sequence
  Synthetic
gatgggtgaaacgatcacggtgagtcttcaggctccccatcactctgggcccattgggcccagggtgatggggcg

SEQ ID NO: 267731 - DNA, 75 bp, Artificial Sequence
  Synthetic
gccccctcgacccacggcaaaaccgtgggccgagggggggtgcatttacattgcaaccactgattcagacttaaa

SEQ ID NO: 267732 - DNA, 75 bp, Artificial Sequence
  Synthetic
cactagagcacttggaagtagaggcttgggctctatgcttggcacattgccctcaaatgctgcttgaaacatgag

SEQ ID NO: 267733 - DNA, 75 bp, Artificial Sequence
  Synthetic
acagtcaagcagtgcacaatgaggttcacctgaattgccacctttcttctttcttgaaagcacaacaccattgtg

SEQ ID NO: 267734 - DNA, 75 bp, Artificial Sequence
  Synthetic
tttagtgcaaagtgatccaaatttctcccaaacaacactctcatagaatcttgcttggtctgttgggaagctgag

SEQ ID NO: 267735 - DNA, 75 bp, Artificial Sequence
  Synthetic
atcaattgtggagatgtcaggtcttccattcagttccattagttttttgatgtcatcagaaccttgacatgtcaa

SEQ ID NO: 267736 - DNA, 75 bp, Artificial Sequence
  Synthetic
aactaattttgaaggcagcttgattagaattctgctcagcaggcctgatcttgcgttctcgatgtctctcagtaa

SEQ ID NO: 267737 - DNA, 75 bp, Artificial Sequence
  Synthetic
aattccatgagagtatttgcttccatttttgaagcccttctcatcatgtgggagtctgaagcaatgtatgtagta

SEQ ID NO: 267738 - DNA, 75 bp, Artificial Sequence
  Synthetic
accagttgtgggctgatacaaagcaagctcaacagggtctgttggtgggccctcaatatccacccagatggtttc

SEQ ID NO: 267739 - DNA, 75 bp, Artificial Sequence
  Synthetic
atctggattcagctttgagattgcttctttgatcactgcttcctgtgtgtctgtcaaaggattaagtcttatgtt

SEQ ID NO: 267740 - DNA, 75 bp, Artificial Sequence
  Synthetic
gccaccatttttgacaggtgggggaggaccatacatgacatcttttgagaagtcaatagtggtgttatcccaagc

SEQ ID NO: 267741 - DNA, 75 bp, Artificial Sequence
  Synthetic
tctgcctgtgatctgggatcttgagccaatgtatggccaaccttcaccagagaggcaaatcttgtaaaggatgtt

SEQ ID NO: 267742 - DNA, 75 bp, Artificial Sequence
  Synthetic
ctcatagggattcctcatccctggtttttctgagacaaacattctttcttgatgcttcaccctaaggagggattt

SEQ ID NO: 267743 - DNA, 75 bp, Artificial Sequence
  Synthetic
gatgatgtcagcaaacacatctggcttaacatagattgtttccaacatgtttcccccatcaaccagacatgcacc

SEQ ID NO: 267744 - DNA, 75 bp, Artificial Sequence
  Synthetic
ggctttcactgcagcagcaagactcagattgtacccagagatgttgttagcactttcctctcttgtgatgaattg

SEQ ID NO: 267745 - DNA, 75 bp, Artificial Sequence
  Synthetic
gagacaagtgtgttcagcagacagcttttcaagatcatcaaggttggggtatttgactgtgtaaaggagcccaag

SEQ ID NO: 267746 - DNA, 75 bp, Artificial Sequence
  Synthetic
tgtggtcaaaccttgtaccacatcattcatctgttcagctccttgcactgacatgcaagcaattgtcaaagcagg

SEQ ID NO: 267747 - DNA, 75 bp, Artificial Sequence
  Synthetic
cattgatccaaactgattgatcaattgcttctgatccttaatgtcccagatccttaccacaccgttgttttgacc

SEQ ID NO: 267748 - DNA, 75 bp, Artificial Sequence
  Synthetic
ttgtctggactgaaacccaagggatctcagtatagctgagcgcctgtccagttgagcagttgtgagattcccttg

SEQ ID NO: 267749 - DNA, 75 bp, Artificial Sequence
  Synthetic
gtaaacaccaggggtgctcctttcattcgtgttgatcttcctcttcagtttttccagatcagttgctaactccat

SEQ ID NO: 267750 - DNA, 75 bp, Artificial Sequence
  Synthetic
gagttcatccttggaaagacctccaaccttcagtgaaacattgctttgtttgtttctcatcatcatcaaaccatc

SEQ ID NO: 267751 - DNA, 75 bp, Artificial Sequence
  Synthetic
aactgctttgttaagatctctgagcttcaggagatcatcatcagacctccgttctttcctcatcactcgctgaac

SEQ ID NO: 267752 - DNA, 75 bp, Artificial Sequence
  Synthetic
ttgcgagacttgactgaagtcaagtccgtccaccagagactttgcatcacgcaagacatctcctttggtttgagt

SEQ ID NO: 267753 - DNA, 75 bp, Artificial Sequence
  Synthetic
ggtgtagtgactcaggcctcgcctcagtgactgagtccatctgaagctgggtatgtcacttgcaccagacattgt

SEQ ID NO: 267754 - DNA, 75 bp, Artificial Sequence
  Synthetic
gcgagacaatggtgagaggtgtcgtgtgacaaaaggtttgtaaaagagcaaagcgttatcctatatgcctaggat

SEQ ID NO: 267755 - DNA, 75 bp, Artificial Sequence
  Synthetic
ggtgagaggtgtcgtgtgacaaaaggtttgtaaaagagcaaagcgttatcctatatgcctaggatccactgtgcg

SEQ ID NO: 267756 - DNA, 75 bp, Artificial Sequence
  Synthetic
cgcaccggggatcctaggcattccttgatcatggatgaaagtgtgtcttcgctttttgatctcctcaggaaacac

SEQ ID NO: 267757 - DNA, 75 bp, Artificial Sequence
  Synthetic
tttcctgctaaagaggagatcagtcgtcagatcactgttgtcacctcacaaactgaaatgagaatgattctcaca

SEQ ID NO: 267758 - DNA, 75 bp, Artificial Sequence
  Synthetic
gaaggcttcaagctactctcactattgattgagttggactcatgtgaggtaaacaattgttctcacaacaaagag

SEQ ID NO: 267759 - DNA, 75 bp, Artificial Sequence
  Synthetic
gatctcacagttgaggcaatcctcagtaaagacaacattcttacaatagctttaccaagaattgtacctgatggc

SEQ ID NO: 267760 - DNA, 75 bp, Artificial Sequence
  Synthetic
tacagtctttatggaaatgtgctaatactgctagaaacctttgtcagagtgaacccgtcatcatttgaacaaaag

SEQ ID NO: 267761 - DNA, 75 bp, Artificial Sequence
  Synthetic
tacaatcaagacatgaacaaactcttgtccttaaaaaatgatcttcaattgtgtggcataacccttgtccctttg

SEQ ID NO: 267762 - DNA, 75 bp, Artificial Sequence
  Synthetic
gttgatggaagaacaaattattacaacaagtttgttgatgattgggtgatcgaaaggttcagatggctgttgact

SEQ ID NO: 267763 - DNA, 75 bp, Artificial Sequence
  Synthetic
caaattatgaaggttgctaaggaaagtggtgagagcattgaggaacttgaatatcaaaggcttgtgacaagtctg

SEQ ID NO: 267764 - DNA, 75 bp, Artificial Sequence
  Synthetic
tctaaactagaaaatcaaagcttgggatttgagaatattattaaaatgccacaaactggtattgattatagagac

SEQ ID NO: 267765 - DNA, 75 bp, Artificial Sequence
  Synthetic
aaattgaaagctagaatgtttgccaatctatcaaataagatgaaggaatcagaaattaatcaaagtttattaagc

SEQ ID NO: 267766 - DNA, 75 bp, Artificial Sequence
  Synthetic
cttaaactagcttttgatgaggcatacaatgatgaaagccacctaaaaaagtttcagaagactaacaaagaagac

SEQ ID NO: 267767 - DNA, 75 bp, Artificial Sequence
  Synthetic
ttaatctttaaactgggccaacaaatcaatctaagtgatgagaagttgtcatgtatgtcctgcagttcaaagtta

SEQ ID NO: 267768 - DNA, 75 bp, Artificial Sequence
  Synthetic
ttttccatagtgagctctatcactcagaatagagacaaacttgattctcatgtgatgtcagtaagtaatgccaag

SEQ ID NO: 267769 - DNA, 75 bp, Artificial Sequence
  Synthetic
ttatggcatcatgaatcaggcattgccaatgtgaatgagtaccttcggattttaagtgtgtgtaataaaatcaaa

SEQ ID NO: 267770 - DNA, 75 bp, Artificial Sequence
  Synthetic
agtgccaaaattttgaatactagaagaaacaccctcttattcttggacatgattgttttgaatttcattgatgac

SEQ ID NO: 267771 - DNA, 75 bp, Artificial Sequence
  Synthetic
tgttggaaaaacgacccaacgatactttttcaatttaagaaatctgggcttctggtggggcagctagcatacttt

SEQ ID NO: 267772 - DNA, 75 bp, Artificial Sequence
  Synthetic
gtaaatgatagatttttcgatctactcttattaaaagaactattatctaaaaagctgaagagttctcctgattgg

SEQ ID NO: 267773 - DNA, 75 bp, Artificial Sequence
  Synthetic
atacacagatgtttatgcaatataagaaagcaagaattctttgacatctctggtgtagagttttggatcagacaa

SEQ ID NO: 267774 - DNA, 75 bp, Artificial Sequence
  Synthetic
cctgattatgaaagtgttgaggagctttgttgtgcacttgagcctgtaaaacccaaacttcaatactgtagagat

SEQ ID NO: 267775 - DNA, 75 bp, Artificial Sequence
  Synthetic
gaggacaaccatgagaatcataagttggatttggcagataaggataattattttacctgcctaagtgttctttca

SEQ ID NO: 267776 - DNA, 75 bp, Artificial Sequence
  Synthetic
tctgtgtgtcttggacttgtaaattctatgaaaacctcctttacttctaaaatggtaattaatgaaaagtcccca

SEQ ID NO: 267777 - DNA, 75 bp, Artificial Sequence
  Synthetic
aataacttttatggtgaggttgaattgaaagaatgttattgtcaaagattttatgtctctgatgaaataaccgga

SEQ ID NO: 267778 - DNA, 75 bp, Artificial Sequence
  Synthetic
ttgcttttttatcagaagacaggggagaagtcaaggtgttattcaattggtgtaaccatgcatggctcatacaaa

SEQ ID NO: 267779 - DNA, 75 bp, Artificial Sequence
  Synthetic
tacattggctctttttactgtgatccaaaaaggttctttttgcccatattttcacaagtagtcttatttcaaatg

SEQ ID NO: 267780 - DNA, 75 bp, Artificial Sequence
  Synthetic
actgaagaaatgatgagttggttgccagaagaaccttcttataaagaaccagtggttgcaaacttgaggaaactc

SEQ ID NO: 267781 - DNA, 75 bp, Artificial Sequence
  Synthetic
attttgatgctactgtgcaatccgtcaaaaaggaaccaaaatttcctacaaggtatgagatacttcataatggct

SEQ ID NO: 267782 - DNA, 75 bp, Artificial Sequence
  Synthetic
tatgtaaatcaattccacagtgtggaattgatgagcaaactagaggtgccatgtaaaagtgtttccgaggagtgt

SEQ ID NO: 267783 - DNA, 75 bp, Artificial Sequence
  Synthetic
gtccagaagctgacatataatcttctagttgatgttttgaccaaaggggatgtcaatgaacatatgactagaaaa

SEQ ID NO: 267784 - DNA, 75 bp, Artificial Sequence
  Synthetic
tttaaattttgtttgaatgttagttatctatgccacctaataacaaaagaaacacctgacagactaactgatcag

SEQ ID NO: 267785 - DNA, 75 bp, Artificial Sequence
  Synthetic
attaagtgctttgagaagttcctagaaccaaaactgaagttcaaatcagtaatcatcaatcccaaccttactggt

SEQ ID NO: 267786 - DNA, 75 bp, Artificial Sequence
  Synthetic
gacctcactgaggaacaagaagaacaactcttgaatagcatagagaagttgctgggcaaaggtttgcaggacatc

SEQ ID NO: 267787 - DNA, 75 bp, Artificial Sequence
  Synthetic
aatgactcatcagagccaggtatttctcgtgaactcttaagcatgtgcatctcagctttcaacagagatttgttg

SEQ ID NO: 267788 - DNA, 75 bp, Artificial Sequence
  Synthetic
agagtcaatggcaagttgaaaaatgatccatataaacccaatttcactagtactgcacttgatttgtctagcaac

SEQ ID NO: 267789 - DNA, 75 bp, Artificial Sequence
  Synthetic
aagagtgttgtgattccaaaacttgatgaactgggcaatccaatttcaaagtatgattatgaattgcttgtatcc

SEQ ID NO: 267790 - DNA, 75 bp, Artificial Sequence
  Synthetic
tcatgcattgcatcgatggcagagtcattcaaaacaaaaggtaaatacaagttggatccaacatctcaagagttt

SEQ ID NO: 267791 - DNA, 75 bp, Artificial Sequence
  Synthetic
cttatccttaagaatttgtatagcttgatgagcaaatccaagagggatgatcatatgaaagactcagaggactca

SEQ ID NO: 267792 - DNA, 75 bp, Artificial Sequence
  Synthetic
aagcaaaacttatcttcagatttggagaatttatcagaagagcaagttttaattctagaacaagtcaaaagagat

SEQ ID NO: 267793 - DNA, 75 bp, Artificial Sequence
  Synthetic
gtgaatttggctttgtcaaaaatgagggaaacaaaattaaaagagaagacagaagccaggcaatcatcatcaggc

SEQ ID NO: 267794 - DNA, 75 bp, Artificial Sequence
  Synthetic
tcctctcttaaaaatcaacaaaagagacaagctgaactgcaagaaaggctttcagagctctggagtgaatttatg

SEQ ID NO: 267795 - DNA, 75 bp, Artificial Sequence
  Synthetic
tgcatgaaaattattactgttgaggtctctttgcatgaaattaaagattttgatcctgatctgatcgaccacaca

SEQ ID NO: 267796 - DNA, 75 bp, Artificial Sequence
  Synthetic
accttgaaatctatgttggacaaattgtacaattcagatttggcttcagaatttttcttagaagagattctcaat

SEQ ID NO: 267797 - DNA, 75 bp, Artificial Sequence
  Synthetic
ccttgtcctcttgagttcctagttaagaatatgacaacatcatcctatttggaaggtgatctatttgaatgtttt

SEQ ID NO: 267798 - DNA, 75 bp, Artificial Sequence
  Synthetic
aaatacacattgatcagtgcagggtttgaccagaaactgggtacctatgagcataaaaacaagacaagattgggg

SEQ ID NO: 267799 - DNA, 75 bp, Artificial Sequence
  Synthetic
tttaaatatgaagctttaaaagtaagagaggaaggcaggatgagtctcagagaaagcaactctgaagcaattgct

SEQ ID NO: 267800 - DNA, 75 bp, Artificial Sequence
  Synthetic
cgaaggttggataggtcagtgttttcaaattctgccttaaggaatctatgtttttattctgatgagtcacccatt

SEQ ID NO: 267801 - DNA, 75 bp, Artificial Sequence
  Synthetic
tcatatagtcatgtatcatctgacactggtaaactaaaatttggtttgagttataaagaacaggtgggatctaac

SEQ ID NO: 267802 - DNA, 75 bp, Artificial Sequence
  Synthetic
cgtgagttatatgtcggtgatttaaatacgaaactcatgacaaggctcattgaggatttttcagaatcagttgtc

SEQ ID NO: 267803 - DNA, 75 bp, Artificial Sequence
  Synthetic
tcaaacatgaactattcatgtttaaatagtgaaaaggagtttgaaagatctgtgatggagatgaaaatgagtgtc

SEQ ID NO: 267804 - DNA, 75 bp, Artificial Sequence
  Synthetic
aaccttggggagatgaattttagtttagatcactcaaaatggggaccatatatgtctccagtcatctttgcggct

SEQ ID NO: 267805 - DNA, 75 bp, Artificial Sequence
  Synthetic
tttcttcaaggattgaagttagaacagggatcaatgtgcactcctgtttcagttgagcccataataactctgctg

SEQ ID NO: 267806 - DNA, 75 bp, Artificial Sequence
  Synthetic
tcatggcatatccataaagttgtggaagttccttataatgttatacatgcatacatgactggcatgattaaaaga

SEQ ID NO: 267807 - DNA, 75 bp, Artificial Sequence
  Synthetic
cagcttggattgatgagccctggagaatcatctaagacagaggcatttatccaccggttgttggtggatgaaaga

SEQ ID NO: 267808 - DNA, 75 bp, Artificial Sequence
  Synthetic
gaacctctgagccatgtgatgtctgttttggatatgggtcaaggcattcttcacaacacttcagacttgtacggt

SEQ ID NO: 267809 - DNA, 75 bp, Artificial Sequence
  Synthetic
ttagtaacagaacagttcatcaattatgctatgagaattctttatgatgttagtatgacttcattcacatcaagt

SEQ ID NO: 267810 - DNA, 75 bp, Artificial Sequence
  Synthetic
gatgatcaaataacaatggtcaaattaaatgaagatttgaaagatatggacaatcctgaggtgatatccaattgg

SEQ ID NO: 267811 - DNA, 75 bp, Artificial Sequence
  Synthetic
gaaaggatgatcaattttcacacattcatatcatcaaaattcaataaatttgtaagccctaaaacagtaattggc

SEQ ID NO: 267812 - DNA, 75 bp, Artificial Sequence
  Synthetic
acttttgctgcagaattcaaatcaagattttttgtttggggagaagaggttcccttattaacaaagtttgtttct

SEQ ID NO: 267813 - DNA, 75 bp, Artificial Sequence
  Synthetic
gctgcattacataacataaaatgcaaaacaccaatacagttgtccgaaaccattgacacaatctctgatcaatgt

SEQ ID NO: 267814 - DNA, 75 bp, Artificial Sequence
  Synthetic
gtggctaatggagtttcagtggagattgtgtcttgcatctcaaacagaactaataaactggtaagatatagtggt

SEQ ID NO: 267815 - DNA, 75 bp, Artificial Sequence
  Synthetic
tttcctgataatccctttttaagtgttgagaatatggatgttaaagattgggtagatggaaacagaggatatcga

SEQ ID NO: 267816 - DNA, 75 bp, Artificial Sequence
  Synthetic
ctccaaaggaacattgaatcacatttggaggtggatgggtgtactagattcgttcgccaggctgccagaaaagtt

SEQ ID NO: 267817 - DNA, 75 bp, Artificial Sequence
  Synthetic
tttagaaacattaagtcaggtaaaattatggaacagactcttgttaacttagtgcaggaagatggagacaaggca

SEQ ID NO: 267818 - DNA, 75 bp, Artificial Sequence
  Synthetic
tttcaaggtttcatgaaaagtgtggatgtttctgatgatgacatcaagctattacaaaactttaggtggattaat

SEQ ID NO: 267819 - DNA, 75 bp, Artificial Sequence
  Synthetic
ttgtctacacatggtgatatgagattggtgctgagaaccaaattgatgagttctagaagaattatagagcaggaa

SEQ ID NO: 267820 - DNA, 75 bp, Artificial Sequence
  Synthetic
gaaatcccaggccttataaagtctatacagtctaaattatccaagaattttgttagaggagcaaaacgtatatta

SEQ ID NO: 267821 - DNA, 75 bp, Artificial Sequence
  Synthetic
gcagattccatcaataaatcagcattccagtcatcaattgcttcagggttcataggattttgtaagagcatgggc

SEQ ID NO: 267822 - DNA, 75 bp, Artificial Sequence
  Synthetic
agtaagtgtgttagacttggtggaggaggatttggatatattaaagacattaaaaataaagtaaaacatgattgt

SEQ ID NO: 267823 - DNA, 75 bp, Artificial Sequence
  Synthetic
ctttgtgacatatgtttcagatggagaggctgtgtttactgtcccagctcgtgtgctgatgtctttgaattcagc

SEQ ID NO: 267824 - DNA, 75 bp, Artificial Sequence
  Synthetic
agacccttaatgtgggattactttacacttgtgttgactaatgcatgtgaactgggagagtgggtttttgaagat

SEQ ID NO: 267825 - DNA, 75 bp, Artificial Sequence
  Synthetic
gtggaaatcccaaaagatctgtattttttgagaaatccaaatctcttctggctggtgaaaccaagagtaacctgt

SEQ ID NO: 267826 - DNA, 75 bp, Artificial Sequence
  Synthetic
caactggaagaaagattgggtctctcccatatcttgcagtcaattagaaaaaactatccaacactcttcgaaacg

SEQ ID NO: 267827 - DNA, 75 bp, Artificial Sequence
  Synthetic
catctctctcctttcatgagtgactttatggttggtaaaaccttagggtctctgactgttaagttcttggattta

SEQ ID NO: 267828 - DNA, 75 bp, Artificial Sequence
  Synthetic
tgtgtagcgttagacctggctaatgagaaccttggaataacaaaacattttctgaaggaaagaaggcatgagatc

SEQ ID NO: 267829 - DNA, 75 bp, Artificial Sequence
  Synthetic
tatgttgttaagcaagatgagagctcacaatcacacatcagaaatgtcaaaggcattgaaagttcagttgagtta

SEQ ID NO: 267830 - DNA, 75 bp, Artificial Sequence
  Synthetic
aactcaatgcaagtgtgcaataatttcttaacacagctcctgatgagctctttcatacagccacttgtcttgact

SEQ ID NO: 267831 - DNA, 75 bp, Artificial Sequence
  Synthetic
agctctgtgttcaaaaagtttaactggtttgctgaggtcctctgtctgaaaacagaagaagaagtttgtctgaag

SEQ ID NO: 267832 - DNA, 75 bp, Artificial Sequence
  Synthetic
caattgacagattttgtccttcaggtcaagaaattcaatgtggacagggcaatgcatattgaagacctaagtgcc

SEQ ID NO: 267833 - DNA, 75 bp, Artificial Sequence
  Synthetic
ggttacattagttcaaccatcaatgtcacaagttttagtttatcagtccccacctttcttgagtgtgttgattct

SEQ ID NO: 267834 - DNA, 75 bp, Artificial Sequence
  Synthetic
agattttcttgcacgtgcgtgcgcttgcttcagacagcaatagcagcggcagggttggtggaaggaattgcccgc

SEQ ID NO: 267835 - DNA, 75 bp, Artificial Sequence
  Synthetic
atcagccagtcgtgaacgtgttgagaaaaagacagcttaggagaacaagagctggggatggccgggaaggccatt

SEQ ID NO: 267836 - DNA, 75 bp, Artificial Sequence
  Synthetic
ctgaaaggaaaggggggcggtccccctcgacgagtgtcgaaagagaccgctaagaagacgcgtcaacgcgtggtc

SEQ ID NO: 267837 - DNA, 75 bp, Artificial Sequence
  Synthetic
caaatgccaaatggactagtgttgaagcgcataatggagattttgtggcatgccatggtcggaaccgcccgaagt

SEQ ID NO: 267838 - DNA, 75 bp, Artificial Sequence
  Synthetic
cctctcttaaaatcattctggaaggtagtccccctcaaacaggcgatggcagcactccggaagataaagaaggcg

SEQ ID NO: 267839 - DNA, 75 bp, Artificial Sequence
  Synthetic
gtcagcaccctgatgattggcttgcaaaaacgagggaaaaggaggtcaacaacagattggacaggatggctgctg

SEQ ID NO: 267840 - DNA, 75 bp, Artificial Sequence
  Synthetic
gtagccatgctgcttagcatcgcactagccgcaaccgtgagaaaagagggagacggcaccacagtcatcagagcc

SEQ ID NO: 267841 - DNA, 75 bp, Artificial Sequence
  Synthetic
gaaggaaaggacgcagctacccaggtacgcgtggagaatggcacctgtgtgatcctggcgacagacatgggggca

SEQ ID NO: 267842 - DNA, 75 bp, Artificial Sequence
  Synthetic
tggtgtgaagactccttgtcatacgaatgtgtgaccatagatcaaggagaagaacccgtggacgtggactgtttc

SEQ ID NO: 267843 - DNA, 75 bp, Artificial Sequence
  Synthetic
tgcaggaacgtggatcgtgtctaccttgagtatgggagatgtggaaaacaggagggaacacgatcacgacgctca

SEQ ID NO: 267844 - DNA, 75 bp, Artificial Sequence
  Synthetic
gttctaatcccttcccacgctcagaaggacctgacggggagaggccagagatggctggagggagacactatacgg

SEQ ID NO: 267845 - DNA, 75 bp, Artificial Sequence
  Synthetic
tctcacctcacccgagttgagggctgggtgtggaagaataaatcactcacgctggcagtggtagtcattgtgtgg

SEQ ID NO: 267846 - DNA, 75 bp, Artificial Sequence
  Synthetic
atgaccgtggaaagtgcggtaaccaggattgtcatcgtgtcagcactgctctgcttagccccagcgtacgcctca

SEQ ID NO: 267847 - DNA, 75 bp, Artificial Sequence
  Synthetic
cgatgcacgcatctggaaaatagggactttgtgactggcacccagggaaccacacgcgtgacgctggtgctggaa

SEQ ID NO: 267848 - DNA, 75 bp, Artificial Sequence
  Synthetic
cttggtggatgtgtcactatcacagctgaagggaaaccgtcaatggacgtgtggcttgactccatctatcaagaa

SEQ ID NO: 267849 - DNA, 75 bp, Artificial Sequence
  Synthetic
aaccccgccaagacacgtgagtactgcctgcacgcaaaactatcaaacaccaaggtcgcggcaaggtgtccagca

SEQ ID NO: 267850 - DNA, 75 bp, Artificial Sequence
  Synthetic
atggggccagcgactttggatgaggaacaccagagtggaacagtctgcaagagagatcagagtgaccgaggctgg

SEQ ID NO: 267851 - DNA, 75 bp, Artificial Sequence
  Synthetic
ggaaatcactgtggactgtttgggaagggcagtattgtcacctgtgtcaaggcgtcgtgtgaggcaaagaagaaa

SEQ ID NO: 267852 - DNA, 75 bp, Artificial Sequence
  Synthetic
gccacaggacatgtgtacgacgctaacaagatagtgtacacagtcaaggttgagccacatacaggaaactatgtc

SEQ ID NO: 267853 - DNA, 75 bp, Artificial Sequence
  Synthetic
gcggccaatgaaacccacagtgggaggaaaaccgcattgttcacagtctcttcggaaaaaacaattctaaccatg

SEQ ID NO: 267854 - DNA, 75 bp, Artificial Sequence
  Synthetic
ggcgaatacggagacgtgtcgctgatgtgcagagtcgctagtggcgtcgatctggcacaaaccgttgttcttgag

SEQ ID NO: 267855 - DNA, 75 bp, Artificial Sequence
  Synthetic
ctcgacaagacagcagaacacctccccacggcatggcaggttcacagagattggtttaacgatctagctctgcct

SEQ ID NO: 267856 - DNA, 75 bp, Artificial Sequence
  Synthetic
tggaaacatgagggaatggtgggttggaacaatgctgaacgcctggttgagtttggagttcctcatgccgtgaag

SEQ ID NO: 267857 - DNA, 75 bp, Artificial Sequence
  Synthetic
atggatgtttacaaccttggggaccagactggggtgctattaaaatcactcgccggagccccactggcgcacatc

SEQ ID NO: 267858 - DNA, 75 bp, Artificial Sequence
  Synthetic
gagggaaccaaatatcacctgaagagcggccatgtcacctgtgaggtgggactggaaaaactcaagatgaagggt

SEQ ID NO: 267859 - DNA, 75 bp, Artificial Sequence
  Synthetic
cttacctatacaatgtgcgacaaggcaaagttcacgtggaaaagagctcccacagacagtgggcacgacacagtt

SEQ ID NO: 267860 - DNA, 75 bp, Artificial Sequence
  Synthetic
caaagttcacgtggaaaagagctcccacagacagtgggcacgacacagttgtcatggaagtcgctttttctggaa

SEQ ID NO: 267861 - DNA, 75 bp, Artificial Sequence
  Synthetic
caaagccttgcagaatacccgtcagggctgtggcacatggagccccagatgtggatgtggccatgctcataacgc

SEQ ID NO: 267862 - DNA, 75 bp, Artificial Sequence
  Synthetic
caaatccaacaatggaaaacaatggaggtggctttatagagatgcagctccccccaggagacaacatcatctatg

SEQ ID NO: 267863 - DNA, 75 bp, Artificial Sequence
  Synthetic
ttggggaactaaaacaccagtggttccagaaggggagtagcattggtagagttttccagaaaacaaggaaaggca

SEQ ID NO: 267864 - DNA, 75 bp, Artificial Sequence
  Synthetic
tagagaggctgacagtgctgggggaacatgcgtgggacttcggttccacgggcggatttttgagctcaatcggaa

SEQ ID NO: 267865 - DNA, 75 bp, Artificial Sequence
  Synthetic
aggcggtgcacactgtcctcggaggcgcattcaacagcgtcttcgggggggtgggattcctaccgaggattctgt

SEQ ID NO: 267866 - DNA, 75 bp, Artificial Sequence
  Synthetic
tgggaatatcccttgcgtggctgggtttaaacatgagaaaccccaccatgtcaatgagtttcctactggcgggag

SEQ ID NO: 267867 - DNA, 75 bp, Artificial Sequence
  Synthetic
gcctggtcctaaccatgacgcttggagtgggggctgacgttggatgtgctgtggacactgaaagaatggaacttc

SEQ ID NO: 267868 - DNA, 75 bp, Artificial Sequence
  Synthetic
gctgtggtgaaggtttggtcgtgtggagagaggtgtcagaatggtatgataactatgctttttaccctgaaacac

SEQ ID NO: 267869 - DNA, 75 bp, Artificial Sequence
  Synthetic
cggcggcccttgcttcggctttgaaggagatggttgaagagggggactgtggcatagttccccaaaacaggcttg

SEQ ID NO: 267870 - DNA, 75 bp, Artificial Sequence
  Synthetic
agatggccatgtggagaagctcggtatcagaactgaatcttgcgctggccgaaggagatgcaaacctcaccgtgg

SEQ ID NO: 267871 - DNA, 75 bp, Artificial Sequence
  Synthetic
tggtggataaacacgatcctaccgactaccggggtggtgtccctgggctgttaaagaaaggaaaggacatgaaaa

SEQ ID NO: 267872 - DNA, 75 bp, Artificial Sequence
  Synthetic
tctcctggaagagttggggtcagtcaatgatctggagtgtcccggaggccccccgacggtttctggtgggcacag

SEQ ID NO: 267873 - DNA, 75 bp, Artificial Sequence
  Synthetic
agggaagcagtgagtgtccactggcaaagagaagaacaggtgtcttcacagtggctgaatttggaatgggcttga

SEQ ID NO: 267874 - DNA, 75 bp, Artificial Sequence
  Synthetic
gaacaaaagtctttttggacttcaggcaagaaataacacgggaatgcgacacaggagtgatgggggctgctgtca

SEQ ID NO: 267875 - DNA, 75 bp, Artificial Sequence
  Synthetic
agaatgggatagcggtccacacagaccaaagcctatggatgaaatctataagaaatgagactggaacatacattg

SEQ ID NO: 267876 - DNA, 75 bp, Artificial Sequence
  Synthetic
ttgaactcctggtcacagatttgagaaactgctcatggccagcaagtcataccattgacaatgctgatgtcgtgg

SEQ ID NO: 267877 - DNA, 75 bp, Artificial Sequence
  Synthetic
actcagagctctttctgccggccagcctagccggacctcggtcttggtacaacagaatacccggttactcggaac

SEQ ID NO: 267878 - DNA, 75 bp, Artificial Sequence
  Synthetic
aagtgaggggaccatggaaatacacacccatcaagatcaccagagaggagtgccccgggactaaggttgccatag

SEQ ID NO: 267879 - DNA, 75 bp, Artificial Sequence
  Synthetic
atgccagctgcgataagcggggtgcgtctgtgagaagcacctcagaaagcggcaagatcatcccagaatggtgct

SEQ ID NO: 267880 - DNA, 75 bp, Artificial Sequence
  Synthetic
gccggaagtgcactctgccaccggtgacattcagaacagggactgactgctggtatgccatggagatacggccag

SEQ ID NO: 267881 - DNA, 75 bp, Artificial Sequence
  Synthetic
ttcatgatcaaggtggcctggtgcgctcgatggtggtggctgacaatggagagctgctcagcgaaggaggaatcc

SEQ ID NO: 267882 - DNA, 75 bp, Artificial Sequence
  Synthetic
ctggaattgtggcagtgttcgtggtccttgaatacatcattcgcaaaaggccgagtgcaggactgacggttgtgt

SEQ ID NO: 267883 - DNA, 75 bp, Artificial Sequence
  Synthetic
ggggaggagtcgtggtcttggcgctgcttgtcactggcatggtaacgctgcagagcatgctgcgttatgttattg

SEQ ID NO: 267884 - DNA, 75 bp, Artificial Sequence
  Synthetic
ctgtgggggtgacatttcacctcgagctagggccagaaatcgtggctttgatgctgctccaggcagtgttcgagc

SEQ ID NO: 267885 - DNA, 75 bp, Artificial Sequence
  Synthetic
taagggtcggactcctcggtgcgtttgtgctgcgcagaagtctaacaacccgcgaggtggtgaccatctattttc

SEQ ID NO: 267886 - DNA, 75 bp, Artificial Sequence
  Synthetic
tcctcttggtcctggaacttggtctgccgagcgcaaacctggaggccttgtgggggtgggcagacgcattagcca

SEQ ID NO: 267887 - DNA, 75 bp, Artificial Sequence
  Synthetic
tgggagcaatgatattcagagcttgcacggctgagggaaaaaccggactgggactcctgttggtggctctcatga

SEQ ID NO: 267888 - DNA, 75 bp, Artificial Sequence
  Synthetic
cccagcagaatgcagtgatagtgcaccaagggcttgtgatctttttgagcgtggcttcagcttgttcagtgtgga

SEQ ID NO: 267889 - DNA, 75 bp, Artificial Sequence
  Synthetic
aattgctcagggggcagagggaacaaaaggggctatcctggatagtcccactcgctggaaggcttggaggaaagg

SEQ ID NO: 267890 - DNA, 75 bp, Artificial Sequence
  Synthetic
gctctggaattaggctgctggctttttgggaactggcttcacgcagggacagacggtcattcagtgaaccgttga

SEQ ID NO: 267891 - DNA, 75 bp, Artificial Sequence
  Synthetic
ccgttgtgggggtcatgttgaccttggcaagcggcatgatgcgacacacatcccaggaggccctctgtgccttgg

SEQ ID NO: 267892 - DNA, 75 bp, Artificial Sequence
  Synthetic
cagcggcttcgtttctcctgctgatgctggtcttgggaacgaggaagatgcaactagtcgctgagtggagtggtt

SEQ ID NO: 267893 - DNA, 75 bp, Artificial Sequence
  Synthetic
gtgtggaatggcacccagacctggccgatgagggtggagaaatcagcttgcgagtccgacaggacgctttgggaa

SEQ ID NO: 267894 - DNA, 75 bp, Artificial Sequence
  Synthetic
attttcacctgacagagctggagaaggaggagagaatgatggccttctggctactggccggcttgacggcctcgg

SEQ ID NO: 267895 - DNA, 75 bp, Artificial Sequence
  Synthetic
ccttacactggacaggaatccttgtagtgatgggattgtggaccatgtcggaaatgttgaggtcggcacgcaggt

SEQ ID NO: 267896 - DNA, 75 bp, Artificial Sequence
  Synthetic
ctgacttagtcttctccggacagagcggctcagagcggggcagccagcctttcgaggtcagagatggtgtctata

SEQ ID NO: 267897 - DNA, 75 bp, Artificial Sequence
  Synthetic
ggattctgagtcccggcctgctttggggacaccgccaggtcggagttggctttggttctaagggcgtcctccaca

SEQ ID NO: 267898 - DNA, 75 bp, Artificial Sequence
  Synthetic
caatgtggcacgtgactaggggagctgccatattcattgacaatgcagtggctggaccctattgggcagatgtga

SEQ ID NO: 267899 - DNA, 75 bp, Artificial Sequence
  Synthetic
aggaggatgttgtgtgctacgggggagcctggagcctggaggagaaatggaaaggagaaaaggttcaagttcatg

SEQ ID NO: 267900 - DNA, 75 bp, Artificial Sequence
  Synthetic
cctttcctccaggaagagctcatgaagtgcatcagtgccaacctggagaattggttctggatactggaaggagga

SEQ ID NO: 267901 - DNA, 75 bp, Artificial Sequence
  Synthetic
ttggtgcaatacccattgatctggcgaaagggacatccggcagccccatactcaacgcccagggggcggtggttg

SEQ ID NO: 267902 - DNA, 75 bp, Artificial Sequence
  Synthetic
ggttatatgggaatggactgagaacaaatgagacttatgtcagcagcatcgcccaaggagaagtggaaaaaagcc

SEQ ID NO: 267903 - DNA, 75 bp, Artificial Sequence
  Synthetic
ggcccaacttgcctcaagcagttgtgggcacaggctggacttcgaagggaacgatcacagtgctggacatgcacc

SEQ ID NO: 267904 - DNA, 75 bp, Artificial Sequence
  Synthetic
ctggatcagggaagactcacagagttctcccagagctcatccgtcaatgcatagataaacgtctgagaacactgg

SEQ ID NO: 267905 - DNA, 75 bp, Artificial Sequence
  Synthetic
tgttggctccaactcgcgtggtactcaaggaaatggagcgtgcattgagtggaaaaagagtgaggtttcattcac

SEQ ID NO: 267906 - DNA, 75 bp, Artificial Sequence
  Synthetic
ctgcagtaggggatcagcagacgggaaacgctatcgttgatgtgatgtgtcatgcgacctacgtcaacagaaggc

SEQ ID NO: 267907 - DNA, 75 bp, Artificial Sequence
  Synthetic
tgctgcctcagggacgccaaaattgggaagtggctataatggatgaggcccactggacagaccctcacagcatag

SEQ ID NO: 267908 - DNA, 75 bp, Artificial Sequence
  Synthetic
ccgccagaggccacttatattcaatggcaaaagaaaacaaatgtgcactggtcttgatgacagcaacgccgccgg

SEQ ID NO: 267909 - DNA, 75 bp, Artificial Sequence
  Synthetic
gaaagagtgagcccttcccagagtccaatggagctatcaccagtgaagaaagacaaatccctgaaggggaatggc

SEQ ID NO: 267910 - DNA, 75 bp, Artificial Sequence
  Synthetic
gtgatggcttcgactggatcaccgagtacgaggggcggacagcatggttcgtcccttcaatagcaaaaggtgggg

SEQ ID NO: 267911 - DNA, 75 bp, Artificial Sequence
  Synthetic
tcattgcccgtactctgagacaaaaagggaagagtgtgatttgcctaaacagcaagacctttgaaaaagactatt

SEQ ID NO: 267912 - DNA, 75 bp, Artificial Sequence
  Synthetic
ccagagttagagatgagaaaccagattttgtggtgacaacagacatttcagaaatgggggcaaatcttgatgtga

SEQ ID NO: 267913 - DNA, 75 bp, Artificial Sequence
  Synthetic
gtcgcgtcatagatgggcgaacgaacattaagccagaggaggttgatgggaaagttgaactcaccggaactagac

SEQ ID NO: 267914 - DNA, 75 bp, Artificial Sequence
  Synthetic
gtgtgacaacggcctctgcagcccaacgccgagggagagtcggcaggcatgacggaagaacagacgagtatatct

SEQ ID NO: 267915 - DNA, 75 bp, Artificial Sequence
  Synthetic
actctggccagtgtgacgatgatgacagcggacttgtgcagtggaaggaggcacagatactcctggacaatataa

SEQ ID NO: 267916 - DNA, 75 bp, Artificial Sequence
  Synthetic
caacactccgggggcctgtggcaaccttctatggacctgagcaggacaagatgccagaggtggctggccacttcc

SEQ ID NO: 267917 - DNA, 75 bp, Artificial Sequence
  Synthetic
gtctcactgaggagagaagaaagcactttcgacacctgctgacccattgtgacttcacaccgtggctggcatggc

SEQ ID NO: 267918 - DNA, 75 bp, Artificial Sequence
  Synthetic
atgttgcggctaatgtgtccaacgtgacaagtcgaagctggacatgggaaggcccagaggaaaatgctgtggacg

SEQ ID NO: 267919 - DNA, 75 bp, Artificial Sequence
  Synthetic
aggctaatggagacctggtgacattcaagagcccgaacggagcggaaagaaccctgagaccagtctggagagacg

SEQ ID NO: 267920 - DNA, 75 bp, Artificial Sequence
  Synthetic
ctcgcatgttcaaagaaggacgtgacataagagagttcgtggcatatgcttcgggacggcggagtcttggggaca

SEQ ID NO: 267921 - DNA, 75 bp, Artificial Sequence
  Synthetic
tgctgacaggaatgtcaggggttcctgagctcctgcgccacagatgcatgagtgccatggatgtcttttacacac

SEQ ID NO: 267922 - DNA, 75 bp, Artificial Sequence
  Synthetic
tgctttatgaggagcctggcagcagagcaatgaagatggcagagagagatgctccagaagccttcttaacgatgg

SEQ ID NO: 267923 - DNA, 75 bp, Artificial Sequence
  Synthetic
ttgaaatggtggtgcttggcctggccactctgggagctgtctggtgtctggttttgcggacttcaattagtcgca

SEQ ID NO: 267924 - DNA, 75 bp, Artificial Sequence
  Synthetic
tgatgctaggcacgatggtgctgttggtctcgctggcattactttgggcgggcggagtcggctatggaagcatgg

SEQ ID NO: 267925 - DNA, 75 bp, Artificial Sequence
  Synthetic
ccggtgtggctcttgtgttctacaccttgttgacagtgctgcagcctgaagctggcaagcagaggagcagcgacg

SEQ ID NO: 267926 - DNA, 75 bp, Artificial Sequence
  Synthetic
acaacaagctggcttacttcctcctgacactctgcagcctagctggcctggtggctgccaacgagatgggattcc

SEQ ID NO: 267927 - DNA, 75 bp, Artificial Sequence
  Synthetic
tggaaaagaccaaggcagatttatctgctgtgctatggagtgaacgtgaagagcccagagtgtggagcgagtgga

SEQ ID NO: 267928 - DNA, 75 bp, Artificial Sequence
  Synthetic
caaacattgacatccagccagccaagtcttggggaacttacgtgctggtggtctcacttttcacaccatacatca

SEQ ID NO: 267929 - DNA, 75 bp, Artificial Sequence
  Synthetic
ttcaccaactacagacaagaattcagcagctagtcaacagtgctgttgcgtcgggtgcgcaggccatgcgagatc

SEQ ID NO: 267930 - DNA, 75 bp, Artificial Sequence
  Synthetic
ttggggggggaactcctttctttggagtggctggacacgtcctgactctcggagtggtatccctagtgggagcga

SEQ ID NO: 267931 - DNA, 75 bp, Artificial Sequence
  Synthetic
caccaacctccttggtggtgggcgtaggactagcagcttttcacctggccatcgtggtgtccggcctggaggctg

SEQ ID NO: 267932 - DNA, 75 bp, Artificial Sequence
  Synthetic
agctgacccagagagcccacaaagttttcttctcggcaatggtacgcaatcccatggtggacggagatgtcatca

SEQ ID NO: 267933 - DNA, 75 bp, Artificial Sequence
  Synthetic
acccatttggagatggggaagtgaaacctgccctgtatgaaaggaagatgagcttgatactggcgatggtcctgt

SEQ ID NO: 267934 - DNA, 75 bp, Artificial Sequence
  Synthetic
gtttcatgtctgtggttttgaaccgaacggtgcccgcagttacggaggcatcggctgtaggactggcagcagcag

SEQ ID NO: 267935 - DNA, 75 bp, Artificial Sequence
  Synthetic
ggcagcttatcaggcctgaggctgacacgctctggaccatgccggtggcttgtgggctgagtggtgtggtcaggg

SEQ ID NO: 267936 - DNA, 75 bp, Artificial Sequence
  Synthetic
gaagcctatgggggtttctgcctcttgggcacaggctatggctgagaacttccggaactagacgcggtggttctg

SEQ ID NO: 267937 - DNA, 75 bp, Artificial Sequence
  Synthetic
agggagacactcttggtgatctctggaagaggaggctgaacaactgcaccaaagaggagttcttcgcctaccggc

SEQ ID NO: 267938 - DNA, 75 bp, Artificial Sequence
  Synthetic
gcactggcattttggaaactgaacgtgacaaggctagagaattgctcaagaagggtgagaccaacatgggcctgg

SEQ ID NO: 267939 - DNA, 75 bp, Artificial Sequence
  Synthetic
cagtgtcgagaggtacagcaaaacttgcctggcttgaggagcgcggttacgtgaacctcaaaggcgaagtggtgg

SEQ ID NO: 267940 - DNA, 75 bp, Artificial Sequence
  Synthetic
acctcggctgtggaagaggaggctggtcctactacgcagcctcccggcctgcggtcatgggggtcaaggcataca

SEQ ID NO: 267941 - DNA, 75 bp, Artificial Sequence
  Synthetic
caattggagggaaaggacatgaggtcccgagaatggtgacaagcctgggttggaatttaatcaagtttagggctg

SEQ ID NO: 267942 - DNA, 75 bp, Artificial Sequence
  Synthetic
gaatgaatgtgtttaccatgcaaccacatcgcgctgatactgtgatgtgcgatattggagagagtagcccggacg

SEQ ID NO: 267943 - DNA, 75 bp, Artificial Sequence
  Synthetic
ccgccattgaaggtgagagaacccgcaaagtgatactgctcatggagcagtggaagaatcggaaccccactgcgg

SEQ ID NO: 267944 - DNA, 75 bp, Artificial Sequence
  Synthetic
cttgtgtctttaaagtgttggctccatatagaccggaggtaattgaagcactacacagattccaactgcagtggg

SEQ ID NO: 267945 - DNA, 75 bp, Artificial Sequence
  Synthetic
gtggaggcctagtgcgcactcccttctcaagaaattcaacccatgagatgtattactccacggccatttcaggaa

SEQ ID NO: 267946 - DNA, 75 bp, Artificial Sequence
  Synthetic
acatcgtcaactccgtcaatgtgcaatctaggaagttgctggcccgctttggagaccagagaggacccatcaggg

SEQ ID NO: 267947 - DNA, 75 bp, Artificial Sequence
  Synthetic
tgccagagatggacctaggagtgggaactcgctgtgtcgtcctggcagaagacaaggtgaaagaacacgacgttc

SEQ ID NO: 267948 - DNA, 75 bp, Artificial Sequence
  Synthetic
aggagagaatcaaagctctgcaggagcaatacagtgatacctggcatgtggatagggaacacccataccgaacgt

SEQ ID NO: 267949 - DNA, 75 bp, Artificial Sequence
  Synthetic
ggcagtactggggtagctatcgcacagcgcccactggctctgcagcttcactgattaatggagttgtgaagctcc

SEQ ID NO: 267950 - DNA, 75 bp, Artificial Sequence
  Synthetic
tcagctggccgtggaatgcacgggaagatgtggtgcggatggcaatgacagacaccacagcgtttgggcagcaga

SEQ ID NO: 267951 - DNA, 75 bp, Artificial Sequence
  Synthetic
gagtgttcaaggacaaagttgacaccaaggcacaggagccccagccaggtaccagggtcatcatgagggcggtca

SEQ ID NO: 267952 - DNA, 75 bp, Artificial Sequence
  Synthetic
atgactggatgttcgaacggcttgcacgcagaagcagacctcgtatgtgcagcagagaagaattcattgcaaagg

SEQ ID NO: 267953 - DNA, 75 bp, Artificial Sequence
  Synthetic
tgaaagctaacgcagcactgggagcctggtctgatgagcaaaacaaatgggcaagtgcgaaggaagcagtggaag

SEQ ID NO: 267954 - DNA, 75 bp, Artificial Sequence
  Synthetic
atcctgctttttggcatctggtggacgaagagagagaaaggcatctaaaaggaagatgtgctcactgcgtgtaca

SEQ ID NO: 267955 - DNA, 75 bp, Artificial Sequence
  Synthetic
ggaagatgtgctcactgcgtgtacaacatgatgggcaagagagagaaaaagctgggggagttcggcgtggcaaaa

SEQ ID NO: 267956 - DNA, 75 bp, Artificial Sequence
  Synthetic
ggaagccgagctatctggtacatgtggctggggagccgctttctggagtttgaggcccttggattcctgaatgaa

SEQ ID NO: 267957 - DNA, 75 bp, Artificial Sequence
  Synthetic
gaccactgggcatctagagagtccagtggagcaggggtggaggggataagtctcaactacctggggtggcatttg

SEQ ID NO: 267958 - DNA, 75 bp, Artificial Sequence
  Synthetic
aagaagctgtcgctgttggagggaggtcttttctatgcggacgacacagccggatgggacaccagggtcaccaat

SEQ ID NO: 267959 - DNA, 75 bp, Artificial Sequence
  Synthetic
gcggatctggaagatgaagagcagatcctgcgttacatggaaggtgaacacaaacagctggcagccactgttatg

SEQ ID NO: 267960 - DNA, 75 bp, Artificial Sequence
  Synthetic
caaaaggcatatcatgccaaggttgtgaaggtagccaggccctcccgagatggagggtgcatcatggacgtcatc

SEQ ID NO: 267961 - DNA, 75 bp, Artificial Sequence
  Synthetic
acaagacgggaccaacgaggatcaggccaagtggtcacatacgccctcaataccctcaccaacataaaggtgcag

SEQ ID NO: 267962 - DNA, 75 bp, Artificial Sequence
  Synthetic
ctaattcgcatgatggaaggagagggggttatcgaggctacagactcacacaaccccaggctgctacgagtggag

SEQ ID NO: 267963 - DNA, 75 bp, Artificial Sequence
  Synthetic
aggtggctgcgtgaccacggagaagaacgccttggaagaatgctgatcagtggagatgattgtgtggtgagaccc

SEQ ID NO: 267964 - DNA, 75 bp, Artificial Sequence
  Synthetic
atagatgacaggtttagcaaggccctctacttcttgaatgatatggccaagactagaaaggacatcggcgaatgg

SEQ ID NO: 267965 - DNA, 75 bp, Artificial Sequence
  Synthetic
gagcattcagctggcttctcaagctgggaggaggttcccttctgctcgcaccatttccatgagttggtgatgaag

SEQ ID NO: 267966 - DNA, 75 bp, Artificial Sequence
  Synthetic
gacggacgcaccctggtcgtgccatgccgagatcaggacgaactggtggggagggcacgcgtctcaccggggtgt

SEQ ID NO: 267967 - DNA, 75 bp, Artificial Sequence
  Synthetic
ggttggagtgtccgcgagacagcttgtttgtccaaggcttacggccaaatgtggctgctgagctacttccacagg

SEQ ID NO: 267968 - DNA, 75 bp, Artificial Sequence
  Synthetic
agggacctgaggacactggggtttgccatttgctcggcagtccctaaggactgggttcctactggtcggacaaca

SEQ ID NO: 267969 - DNA, 75 bp, Artificial Sequence
  Synthetic
tggagcgttcacgccagtggagcctggatgactacagagaacatgctagatgtgtggaatcgagtgtggatcctg

SEQ ID NO: 267970 - DNA, 75 bp, Artificial Sequence
  Synthetic
gacaaccccttcatggagaacaaagaaaaggttggtgaatggagagacattccataccttcccaagtcacaagac

SEQ ID NO: 267971 - DNA, 75 bp, Artificial Sequence
  Synthetic
atgatgtgctcgtcactggttggaagacgggaaagagcagagtgggcaaagaacatctggggagcagtggagaaa

SEQ ID NO: 267972 - DNA, 75 bp, Artificial Sequence
  Synthetic
gtgaggaaaatgctgggccctgagaggtatagtgactacctttcctgcatggaccggcatgaactgcactgggag

SEQ ID NO: 267973 - DNA, 75 bp, Artificial Sequence
  Synthetic
ctcaaagtggagagctcaataatctaaccacagacaaccatagagcaaaagcaccatttcgtgagacccccctgc

SEQ ID NO: 267974 - DNA, 75 bp, Artificial Sequence
  Synthetic
cagttgaagggggaagctggccggtggtagaaaaccccccaacagggtgccaaacggcaacacgccagtgagagt

SEQ ID NO: 267975 - DNA, 75 bp, Artificial Sequence
  Synthetic
ggcgacgggaacatggtcgctcccgacgtagggcactctatccaattttgtgagaccccccgcaccatggaaggc

SEQ ID NO: 267976 - DNA, 75 bp, Artificial Sequence
  Synthetic
acgtagggcactctatccaattttgtgagaccccccgcaccatggaaggccaaacatggtgcatgaagggaaagg

SEQ ID NO: 267977 - DNA, 75 bp, Artificial Sequence
  Synthetic
cccccggaagcttgcttccgggaggagggaagagagaaattggcagctctcttcaggaaatttcctcctcctata

SEQ ID NO: 267978 - DNA, 75 bp, Artificial Sequence
  Synthetic
cttcaggaaatttcctcctcctataccaaattccccctcatctgagggggggcggttcttgttctccctgagcca

SEQ ID NO: 267979 - DNA, 75 bp, Artificial Sequence
  Synthetic
tctccctgagccaccatcacccagacacaggcagtctaacaaggaggtgatgtgtgactcggaacaacacccgct

SEQ ID NO: 267980 - DNA, 75 bp, Artificial Sequence
  Synthetic
agattttcttgcacgtgcgtgcgattgcttcagacagcaatagcagcggtggagttggtagagaggcttactcac

SEQ ID NO: 267981 - DNA, 75 bp, Artificial Sequence
  Synthetic
atcaactagtcgtgaacgtgttgaggaaaagacagcttaggagaacaagagctgggaatggccgggaaggccatt

SEQ ID NO: 267982 - DNA, 75 bp, Artificial Sequence
  Synthetic
ctggaaggaaaggggggcggtccccctcgacgagtgtcgaaagagaccgcaaagaagacgcgtcaacgcatggtc

SEQ ID NO: 267983 - DNA, 75 bp, Artificial Sequence
  Synthetic
caaatgccaaatggactagtgttgaagcgcataatggagattctgtggcacgccatggttggaacagcccgaagt

SEQ ID NO: 267984 - DNA, 75 bp, Artificial Sequence
  Synthetic
cctctcttgaaatcgttctggaaagttgtcccccttaagcaggcgatggcagcacttcgaaagataaagaaaacg

SEQ ID NO: 267985 - DNA, 75 bp, Artificial Sequence
  Synthetic
gtcagcacgctaatgattggtttgcaaaaacgagggaaaaggaggtcaacaacagattggactggatggttgctg

SEQ ID NO: 267986 - DNA, 75 bp, Artificial Sequence
  Synthetic
gcggtgatgctatttagcatcacacttgccgcaaccgtgaggaaagagggagatggtaccaccgtcatcagagct

SEQ ID NO: 267987 - DNA, 75 bp, Artificial Sequence
  Synthetic
gaaggaaaagacgcagccacccaggtgcgcgtggagaacggcacctgtgtgattctagcgacagacatggggaca

SEQ ID NO: 267988 - DNA, 75 bp, Artificial Sequence
  Synthetic
tggtgtgaggactcattgtcatacgaatgcgtgaccatagatcagggagaagagcccgttgatgtggactgtttc

SEQ ID NO: 267989 - DNA, 75 bp, Artificial Sequence
  Synthetic
tgcaggaatgtggatcaggtctatcttgagtatgggagatgcgggaaacaggaaggaacacggtcaagacgctcc

SEQ ID NO: 267990 - DNA, 75 bp, Artificial Sequence
  Synthetic
ttgagtatgggagatgcgggaaacaggaaggaacacggtcaagacgctccgtcttaatcccttcccatgcccaga

SEQ ID NO: 267991 - DNA, 75 bp, Artificial Sequence
  Synthetic
aagacttgacggggagaggccagagatggttggagggagacacaataaggtcccatctcactcgagttgagggct

SEQ ID NO: 267992 - DNA, 75 bp, Artificial Sequence
  Synthetic
gggtgtggaagaacaaactattcacgctggcagtggtggccattgtttggatgaccgtggaaagcatggcaacca

SEQ ID NO: 267993 - DNA, 75 bp, Artificial Sequence
  Synthetic
ctgcctggccccggcatacgcctcacgatgcacgcatttggaaaacagggatttcgtgactggcatgcagggaac

SEQ ID NO: 267994 - DNA, 75 bp, Artificial Sequence
  Synthetic
cacacgcgtgacgctggtgctagagctgggtggatgcgtgactatcacagctgaggggaaaccatcaatggacgt

SEQ ID NO: 267995 - DNA, 75 bp, Artificial Sequence
  Synthetic
ctgggtggatgcgtgactatcacagctgaggggaaaccatcaatggacgtgtggctagactccatctaccaagaa

SEQ ID NO: 267996 - DNA, 75 bp, Artificial Sequence
  Synthetic
aatcccgccaagacacgtgagtattgcctacatgcaaaactctcagataccaaggttgcggcaagatgtccagca

SEQ ID NO: 267997 - DNA, 75 bp, Artificial Sequence
  Synthetic
atggggcctgcgaccttggatgaagaacacaagagtggcacagtttgcaagagagaccagagtgaccgaggctgg

SEQ ID NO: 267998 - DNA, 75 bp, Artificial Sequence
  Synthetic
gagagaccagagtgaccgaggctggggtaatcattgcggattgtttgggaaaggtagcattgtcacctgtgtcaa

SEQ ID NO: 267999 - DNA, 75 bp, Artificial Sequence
  Synthetic
ggcatcatgtgaggcaaaaaagaaagccacgggatatgtttatgatgcaaacaagatagtgtacacggtcaaggt

SEQ ID NO: 268000 - DNA, 75 bp, Artificial Sequence
  Synthetic
gccacgggatatgtttatgatgcaaacaagatagtgtacacggtcaaggttgagccacacacagggaactatgtc

SEQ ID NO: 268001 - DNA, 75 bp, Artificial Sequence
  Synthetic
gcagccaacgaaacccacagtgggaggaaaactgcgctgttcacggtctcctcggaaaaaaccatcctgaccatg

SEQ ID NO: 268002 - DNA, 75 bp, Artificial Sequence
  Synthetic
ggtgaatatggagacgtgtcattgatgtgtagagtcgctagtggcgttgacttggcacagaccgttgtcctcgag

SEQ ID NO: 268003 - DNA, 75 bp, Artificial Sequence
  Synthetic
cttgacaagacagcagaacaccttcccacagcatggcaggttcacagagattggtttaatgatctggctctgcca

SEQ ID NO: 268004 - DNA, 75 bp, Artificial Sequence
  Synthetic
ccacagcatggcaggttcacagagattggtttaatgatctggctctgccatggaaacatgagggaatggtgggct

SEQ ID NO: 268005 - DNA, 75 bp, Artificial Sequence
  Synthetic
ggaacaatgcagaacgcctggttgagtttggagtcccgcatgctgtgaagatggacgtttacaaccttggggatc

SEQ ID NO: 268006 - DNA, 75 bp, Artificial Sequence
  Synthetic
atggacgtttacaaccttggggatcaaactggggtgttattgaaatcactcgctggagcgccattagctcacatt

SEQ ID NO: 268007 - DNA, 75 bp, Artificial Sequence
  Synthetic
gagggaaccaaataccacctgaagagcggtcatgtcacttgtgaggtggggctggaaaaactcaaagtgaaaggt

SEQ ID NO: 268008 - DNA, 75 bp, Artificial Sequence
  Synthetic
cttacctacacaatgtgcgacaaaacaaagtttacatggaaaagagttcctacagatagtgggcacgacacagtc

SEQ ID NO: 268009 - DNA, 75 bp, Artificial Sequence
  Synthetic
gtcatggaagtcgcattctctgggacaaagccgtgtagaatacctgtcagggctgtggcacatgggaccccggat

SEQ ID NO: 268010 - DNA, 75 bp, Artificial Sequence
  Synthetic
gtggatgtggccatgctcataacaccaaatccaacaatggaaagtaatggaggtggttttatagagatgcagctc

SEQ ID NO: 268011 - DNA, 75 bp, Artificial Sequence
  Synthetic
cccccaggggacaacatcatttatgttggggaactaaaacatcaatggttccagaaagggagcagcattggcagg

SEQ ID NO: 268012 - DNA, 75 bp, Artificial Sequence
  Synthetic
gttttccagaagaccaggaaaggcatagagaggctgacagcactgggggaacatgcgtgggacttcggctccacg

SEQ ID NO: 268013 - DNA, 75 bp, Artificial Sequence
  Synthetic
ggtggattcctgagttcaatcggaaaggcggtgcacacggtccttggaggtgcatttagcagcatcttcggaggg

SEQ ID NO: 268014 - DNA, 75 bp, Artificial Sequence
  Synthetic
gttggatttctgccgaggatcctgctgggggtattccttgcgtggcttggcctaaacatgagaaaccctaccatg

SEQ ID NO: 268015 - DNA, 75 bp, Artificial Sequence
  Synthetic
tcaatgagctttctgctggcgggaggcctggttctatccatgacccttggagtgggagctgacgtcggatgtgct

SEQ ID NO: 268016 - DNA, 75 bp, Artificial Sequence
  Synthetic
gtggacactgagagaatggaactccgctgtggtgaagggttggttgtctggagagaggtgtcggaatggtatgat

SEQ ID NO: 268017 - DNA, 75 bp, Artificial Sequence
  Synthetic
aactatgccttttaccctgagacacctgcggctctcgcctcggctttgaaggagatggttgaagagggggactgt

SEQ ID NO: 268018 - DNA, 75 bp, Artificial Sequence
  Synthetic
ctgcggctctcgcctcggctttgaaggagatggttgaagagggggactgtggtatagttccccaaaacaggctcg

SEQ ID NO: 268019 - DNA, 75 bp, Artificial Sequence
  Synthetic
agatggccatgtggaggagctcggtatcagagttgaacctggcactgtcagagggagacgcaaacctcactgtgg

SEQ ID NO: 268020 - DNA, 75 bp, Artificial Sequence
  Synthetic
tggtggacagacatgatcccactgactatcgaggtggtgtccctgggttgttaaagaaggggaaggacatgaaaa

SEQ ID NO: 268021 - DNA, 75 bp, Artificial Sequence
  Synthetic
tctcctggaagagctggggtcaatcaatgatctggagtgtcccagaggccccccgacggttcctggtgggaacag

SEQ ID NO: 268022 - DNA, 75 bp, Artificial Sequence
  Synthetic
aaggaagcagcgagtgtccactggaaaagagaagaacgggtgtcttcacggtggctgagtttggaatgggcctga

SEQ ID NO: 268023 - DNA, 75 bp, Artificial Sequence
  Synthetic
gaacaaaggtcttcctggatttcaggcaagagataacacgtgagtgcgacacaggagtaatgggggctgctgtca

SEQ ID NO: 268024 - DNA, 75 bp, Artificial Sequence
  Synthetic
agaatgggatagcggttcacacagaccaaagcctatggatgaaatccattaaaaatgaaactggaacattcattg

SEQ ID NO: 268025 - DNA, 75 bp, Artificial Sequence
  Synthetic
aaactgctcatggccagcaagtcacactattgacaacgctgatattgtggattcggagctttttctgccagccag

SEQ ID NO: 268026 - DNA, 75 bp, Artificial Sequence
  Synthetic
cctagccggaccccggtcgtggtacaatagaatacccggctattcagaacaagtgaagggaccatggaaatacac

SEQ ID NO: 268027 - DNA, 75 bp, Artificial Sequence
  Synthetic
acccattaggatcagcagagaagagtgtcctgggaccagggtcaccatagatgccagctgcgacaagcgtggagc

SEQ ID NO: 268028 - DNA, 75 bp, Artificial Sequence
  Synthetic
gtctgtgagaagcacctcagagagcggcaaggtcatcccagaatggtgctgccggaagtgcactctaccgccggt

SEQ ID NO: 268029 - DNA, 75 bp, Artificial Sequence
  Synthetic
gacattcagaacagggactgactgctggtatgccatggagatacggccagtccatgatcagggtggcctagtacg

SEQ ID NO: 268030 - DNA, 75 bp, Artificial Sequence
  Synthetic
ctcgatggttgtggcagacaatggagagctgctcagtgaaggaggaatccctgggattgtggctgtgtttgtagt

SEQ ID NO: 268031 - DNA, 75 bp, Artificial Sequence
  Synthetic
ccttgaatacatcatccgcaaaaggccaagcacagggttaacggttgtgtggggaggagtcgtggtcttggcgct

SEQ ID NO: 268032 - DNA, 75 bp, Artificial Sequence
  Synthetic
gcttgtcactggcatggtaacgttgcagagcatgctgcgttatgtgatcgcggtgggagtgacatttcaccttga

SEQ ID NO: 268033 - DNA, 75 bp, Artificial Sequence
  Synthetic
cggtgggagtgacatttcaccttgagctggggccagaaatcgtggctttgatgttgctccaggcagtgtttgagc

SEQ ID NO: 268034 - DNA, 75 bp, Artificial Sequence
  Synthetic
tgagggtcggacttctcagtgcgtttgtgctgcgcagaagtctaacaacccgcgagatagtgaccatctactttc

SEQ ID NO: 268035 - DNA, 75 bp, Artificial Sequence
  Synthetic
cgcgagatagtgaccatctactttctcctcttggtcctggaactgggcttgccgggcgcggatttggaggcgttg

SEQ ID NO: 268036 - DNA, 75 bp, Artificial Sequence
  Synthetic
tggaagtgggctgatgcactggccatgggggcaatgatattcagagcctgtacggctgagggaaaaacggggctg

SEQ ID NO: 268037 - DNA, 75 bp, Artificial Sequence
  Synthetic
gggctcctgttggttgccctcatgacccaacagaatgtggcgattgtgcaccaagggcttgtgatctttctgagc

SEQ ID NO: 268038 - DNA, 75 bp, Artificial Sequence
  Synthetic
gtggcttcagtttgttcagtgtggaaactgcttaagggacagagggagcaaaaggggctatcttggatagttcca

SEQ ID NO: 268039 - DNA, 75 bp, Artificial Sequence
  Synthetic
cttgctggaaagcttggagggagtggctctgggattaggttgctagccttttgggaactggcttcacgcaggggg

SEQ ID NO: 268040 - DNA, 75 bp, Artificial Sequence
  Synthetic
agacggtccttcagtgaaccgctgaccgttgtgggggtcatgttgactttagcaagtggcatgatgcgacacaca

SEQ ID NO: 268041 - DNA, 75 bp, Artificial Sequence
  Synthetic
tcccaggaggtcctgtgcgccctggcagtagcctcatttctcttactgatgctggtcttgggaacaagaaaaatg

SEQ ID NO: 268042 - DNA, 75 bp, Artificial Sequence
  Synthetic
cagctggttgctgaatggagtggttgtgtggaatggcacccagatctagtagatgagggtggagagattagcttg

SEQ ID NO: 268043 - DNA, 75 bp, Artificial Sequence
  Synthetic
cgggtccgccaggacgctctggggaatttccacctaacagagttggaaaaggaggaaagaatgatggccttctgg

SEQ ID NO: 268044 - DNA, 75 bp, Artificial Sequence
  Synthetic
ctgttggcgggactgacggcttcagctttacattggacaggaattctcgtcgtgatggggctgtggaccatgtca

SEQ ID NO: 268045 - DNA, 75 bp, Artificial Sequence
  Synthetic
ctttacattggacaggaattctcgtcgtgatggggctgtggaccatgtcagaaatgatgaggacagcacgcagat

SEQ ID NO: 268046 - DNA, 75 bp, Artificial Sequence
  Synthetic
cgtgatggggctgtggaccatgtcagaaatgatgaggacagcacgcagatctgacctggttttttccggacagag

SEQ ID NO: 268047 - DNA, 75 bp, Artificial Sequence
  Synthetic
cggcccagagcgatgcagccagcctttcgaggtcagagatggtgtttacagaatcttgagtccaggcctgctctg

SEQ ID NO: 268048 - DNA, 75 bp, Artificial Sequence
  Synthetic
ttcgaggtcagagatggtgtttacagaatcttgagtccaggcctgctctggggataccgccaggtcggagttggc

SEQ ID NO: 268049 - DNA, 75 bp, Artificial Sequence
  Synthetic
tacggttccaaaggagtcctccacacaatgtggcatgtgactagaggagccgccatattcattgacagtgcggtg

SEQ ID NO: 268050 - DNA, 75 bp, Artificial Sequence
  Synthetic
gctggaccctactgggcagatgtcaaggaagatgttgtgtgctatgggggggcctggagtctggagggaaaatgg

SEQ ID NO: 268051 - DNA, 75 bp, Artificial Sequence
  Synthetic
aagggagagaaggtgcaagtccatgccttccctccgggaagagctcatgaagtgcaccagtgccagcccggagaa

SEQ ID NO: 268052 - DNA, 75 bp, Artificial Sequence
  Synthetic
ttggtgcaatacccattgatctagcgaaagggacatccggcagtcctatcctcaatgcccagggggctgtggttg

SEQ ID NO: 268053 - DNA, 75 bp, Artificial Sequence
  Synthetic
gactgtatgggaatggactgaagacaaatgagacctatgtcagcagcatcgcccaaggagaagtggaaaaaagcc

SEQ ID NO: 268054 - DNA, 75 bp, Artificial Sequence
  Synthetic
ggcccaacctgccacaggcagttgtgggcacgggctggacctcgaagggaacgattacagtgctggacatgcatc

SEQ ID NO: 268055 - DNA, 75 bp, Artificial Sequence
  Synthetic
ccggttcagggaagacccacagagtcctcccagagctcattcggcaatgcatagacaaacgcctgagaacactgg

SEQ ID NO: 268056 - DNA, 75 bp, Artificial Sequence
  Synthetic
tgctggctccgactcgcgtggtgctcaaggaaatggaacgagcgctgaatgggaaaagagttaggtttcattcac

SEQ ID NO: 268057 - DNA, 75 bp, Artificial Sequence
  Synthetic
ctgcagttggggaccagcagatgggaagcgctatcgttgatgtgatgtgtcatgcaacttacgtcaacagaaggc

SEQ ID NO: 268058 - DNA, 75 bp, Artificial Sequence
  Synthetic
tgctgcctcagggacgccaaaattgggaggtggcaattatggatgaggcccactggacggaccctcatagcatag

SEQ ID NO: 268059 - DNA, 75 bp, Artificial Sequence
  Synthetic
ggaggtggcaattatggatgaggcccactggacggaccctcatagcatagccgctagaggccacttatattcaat

SEQ ID NO: 268060 - DNA, 75 bp, Artificial Sequence
  Synthetic
ggccaaagaaaacagatgtgcactggttttgatgacagcaacaccgccgggaaagagcgaacccttcccagagtc

SEQ ID NO: 268061 - DNA, 75 bp, Artificial Sequence
  Synthetic
caatggagccatcaccagtgaggaaaggcaaatccctgaaggggaatggcgcgatggctttgattggatcactga

SEQ ID NO: 268062 - DNA, 75 bp, Artificial Sequence
  Synthetic
gtatgaggggcggacagcgtggttcgtcccttcagtatcaaaaggtggggtcattgcccgtgctttgagacaaaa

SEQ ID NO: 268063 - DNA, 75 bp, Artificial Sequence
  Synthetic
ggggaagagcgtgatttgcttaaacagcaagacctttgaaaaagattactccagagtcagagatgagaagccaga

SEQ ID NO: 268064 - DNA, 75 bp, Artificial Sequence
  Synthetic
agcaagacctttgaaaaagattactccagagtcagagatgagaagccagactttgtggtaacaacagacatctca

SEQ ID NO: 268065 - DNA, 75 bp, Artificial Sequence
  Synthetic
ccagagtcagagatgagaagccagactttgtggtaacaacagacatctcagaaatgggagccaaccttgacgtca

SEQ ID NO: 268066 - DNA, 75 bp, Artificial Sequence
  Synthetic
gccgtgtcatagatgggcgaacaaacatcaagccggaggaggtcgatgggaaggtggaactaactggaactagac

SEQ ID NO: 268067 - DNA, 75 bp, Artificial Sequence
  Synthetic
gggtgacaacggcctctgcagcccagcgccgagggagagtcggcaggcatgacggaagaaccgatgaatacatct

SEQ ID NO: 268068 - DNA, 75 bp, Artificial Sequence
  Synthetic
actccggacagtgtgatgatgatgacagcggactagtgcaatggaaggaggcacagatcctcctggacaacataa

SEQ ID NO: 268069 - DNA, 75 bp, Artificial Sequence
  Synthetic
caacactccgagggcctgtagcaactttctatgggcctgaacaagacaagatgccggaggtggctggtcactttc

SEQ ID NO: 268070 - DNA, 75 bp, Artificial Sequence
  Synthetic
gtttaaccgaagagaaaagaaagcactttcgacacctgctaacccattgtgatttcacaccatggctggcatggc

SEQ ID NO: 268071 - DNA, 75 bp, Artificial Sequence
  Synthetic
atgttgcagccaatgtgcccaacgtgacaagccgaagctggacatgggaaggtccagaggaaaacgctgtggatg

SEQ ID NO: 268072 - DNA, 75 bp, Artificial Sequence
  Synthetic
aggccaatggagacctggtcactttcaagagcccgaacggagctgagagaaccctgaggccagtctggagggacg

SEQ ID NO: 268073 - DNA, 75 bp, Artificial Sequence
  Synthetic
cccgcatgttcaaagaaggacgtgacataagagagttcgtggcatacgcttcgggacggcggagcctcggggaca

SEQ ID NO: 268074 - DNA, 75 bp, Artificial Sequence
  Synthetic
tgctgacgggaatgtcgggggtcccagaactcctgcgtcacagatgcgtaagtgccgtggacgtcttttacacac

SEQ ID NO: 268075 - DNA, 75 bp, Artificial Sequence
  Synthetic
tgctttatgaagagcctggcagtagagcaatgaaaatggcagagagggatgccccagaagcctttttaacgatgg

SEQ ID NO: 268076 - DNA, 75 bp, Artificial Sequence
  Synthetic
gccccagaagcctttttaacgatggttgaaatggtggtacttggcttggccaccctaggagctgtctggtgccta

SEQ ID NO: 268077 - DNA, 75 bp, Artificial Sequence
  Synthetic
gttttgcggacttcaatcagccgtatgatgttgggcactttggtgttgctggtctcactggctctgctatgggcg

SEQ ID NO: 268078 - DNA, 75 bp, Artificial Sequence
  Synthetic
ggcggtgttggctatggaagcatggctggggtggcccttgtgttctacaccttgctgacagtgttgcagcctgaa

SEQ ID NO: 268079 - DNA, 75 bp, Artificial Sequence
  Synthetic
cttgctgacagtgttgcagcctgaagctggcaggcagaggagtagcgatgacaacaagctggcctatttcctttt

SEQ ID NO: 268080 - DNA, 75 bp, Artificial Sequence
  Synthetic
acaacaagctggcctatttccttttgacactctgcagtctggccagcctggtcgctgctaatgagatgggttttt

SEQ ID NO: 268081 - DNA, 75 bp, Artificial Sequence
  Synthetic
tggaaaagaccaaatcagatctatcggctgtgctgtggagtgaacgtgaagagcccagagtgtggagtgaatgga

SEQ ID NO: 268082 - DNA, 75 bp, Artificial Sequence
  Synthetic
ggctgtgctgtggagtgaacgtgaagagcccagagtgtggagtgaatggacaaacatagacatccaacccgccaa

SEQ ID NO: 268083 - DNA, 75 bp, Artificial Sequence
  Synthetic
gtcttggggaacctatgtgctggtggtttcactcttcacaccatacatcatccatcaacttcagacaaggatcca

SEQ ID NO: 268084 - DNA, 75 bp, Artificial Sequence
  Synthetic
gcaactggtcaacagcgctgttgcatcgggcgcgcaggccatgcgagacctaggggggggaacccccttttttgg

SEQ ID NO: 268085 - DNA, 75 bp, Artificial Sequence
  Synthetic
agtggctggccacgtcttaactctcggagtggtgtcattggtgggagcgacgccaacttccttggtggtgggcgt

SEQ ID NO: 268086 - DNA, 75 bp, Artificial Sequence
  Synthetic
ggagtggtgtcattggtgggagcgacgccaacttccttggtggtgggcgtgggactagcggcattccacttggct

SEQ ID NO: 268087 - DNA, 75 bp, Artificial Sequence
  Synthetic
atcgtggtgtccggcctggaggccgagctgacccagagagctcacaaggtcttcttctctgcaatggtacgcaac

SEQ ID NO: 268088 - DNA, 75 bp, Artificial Sequence
  Synthetic
agctgacccagagagctcacaaggtcttcttctctgcaatggtacgcaaccctatggtggacggagatgtcatca

SEQ ID NO: 268089 - DNA, 75 bp, Artificial Sequence
  Synthetic
cttcttctctgcaatggtacgcaaccctatggtggacggagatgtcatcaatccgtttggagatggggaagtgaa

SEQ ID NO: 268090 - DNA, 75 bp, Artificial Sequence
  Synthetic
accagctttgtatgagaggaagatgagcttgatcctggcaatggttttgtgcctcatgtctgtggttctgaaccg

SEQ ID NO: 268091 - DNA, 75 bp, Artificial Sequence
  Synthetic
gacagtgcccgcagtcacagaggcttcggctgttggactggcggcagcagggcagctcatcagacccgaggctga

SEQ ID NO: 268092 - DNA, 75 bp, Artificial Sequence
  Synthetic
cacgctctggaccatgccggtggcctgtgggcttagtggcgtggtcaggggcagtctatggggattcttgcctct

SEQ ID NO: 268093 - DNA, 75 bp, Artificial Sequence
  Synthetic
gcagtctatggggattcttgcctcttggacacaggttgtggctgagaacctctggcaccagacgcggtggctctg

SEQ ID NO: 268094 - DNA, 75 bp, Artificial Sequence
  Synthetic
tggacacaggttgtggctgagaacctctggcaccagacgcggtggctctgaaggggacactcttggtgacctctg

SEQ ID NO: 268095 - DNA, 75 bp, Artificial Sequence
  Synthetic
gaagagaaggctgaacaactgtaccaaagaggaattttttgcctaccggcgcactggtatcctggaaactgaacg

SEQ ID NO: 268096 - DNA, 75 bp, Artificial Sequence
  Synthetic
tgacaaggccagagaattgctcaggaagggtgagaccaacatgggcctggcggtgtcgagaggcacagcaaaact

SEQ ID NO: 268097 - DNA, 75 bp, Artificial Sequence
  Synthetic
cggtgtcgagaggcacagcaaaactcgcctggcttgaggagcgcggctacgtgaatctcaaaggtgaagtagtgg

SEQ ID NO: 268098 - DNA, 75 bp, Artificial Sequence
  Synthetic
acctcgggtgtggaagaggaggctggtcctactatgcagcctcccggcctgcagtcatgggtgtcaaggcgtaca

SEQ ID NO: 268099 - DNA, 75 bp, Artificial Sequence
  Synthetic
cgattggagggaagggacatgaagccccgaaaatggtgacaagcctgggctggaatctaattaagttcagagctg

SEQ ID NO: 268100 - DNA, 75 bp, Artificial Sequence
  Synthetic
gaatggatgttttcaccatgcagccacatcgagctgacaccgtgatgtgcgacattggagagagtagcccggacg

SEQ ID NO: 268101 - DNA, 75 bp, Artificial Sequence
  Synthetic
ctgccattgagggtgaaaggacccggaaagtaatactactcatggagcagtggaagaatcggaacccttctgcgt

SEQ ID NO: 268102 - DNA, 75 bp, Artificial Sequence
  Synthetic
tggaagaatcggaacccttctgcgtcttgtgttttcaaagtgctagccccttacagaccggaagtgattgaagcg

SEQ ID NO: 268103 - DNA, 75 bp, Artificial Sequence
  Synthetic
ttacagaccggaagtgattgaagcgctgcacagattccaactgcaatggggtggaggtctggtgcgcactccatt

SEQ ID NO: 268104 - DNA, 75 bp, Artificial Sequence
  Synthetic
gtggaggtctggtgcgcactccattctcaagaaattcaactcatgagatgtattactccacggccatctcgggaa

SEQ ID NO: 268105 - DNA, 75 bp, Artificial Sequence
  Synthetic
acatagtcaactccgtcaatgtgcaatccaggaagctgctagctcggtttggagaccagagaggacctattaggg

SEQ ID NO: 268106 - DNA, 75 bp, Artificial Sequence
  Synthetic
tgccagagatggacctgggagtggggacccgttgtgttgttctggcagaggacaaggtgaaagagagtgacgttc

SEQ ID NO: 268107 - DNA, 75 bp, Artificial Sequence
  Synthetic
aggaaaggatcaaggctctgcaggagcaatacggcgacacctggcatgtggacagagaacacccgtaccgcacat

SEQ ID NO: 268108 - DNA, 75 bp, Artificial Sequence
  Synthetic
gcaatacggcgacacctggcatgtggacagagaacacccgtaccgcacatggcagtactggggcagctatcgcac

SEQ ID NO: 268109 - DNA, 75 bp, Artificial Sequence
  Synthetic
agcacccactggatctgcagcctcgcttatcaacggagttgtgaagctcctcagttggccgtggaacgcacgaga

SEQ ID NO: 268110 - DNA, 75 bp, Artificial Sequence
  Synthetic
agatgtggtgcggatggcaatgacagacactacagcctttgggcagcagagagtgttcaaggacaaagtcgacac

SEQ ID NO: 268111 - DNA, 75 bp, Artificial Sequence
  Synthetic
gacactacagcctttgggcagcagagagtgttcaaggacaaagtcgacaccaaggcacaggaacctcagccaggt

SEQ ID NO: 268112 - DNA, 75 bp, Artificial Sequence
  Synthetic
accagagtcatcatgagagcggttaatgactggatgttagaacggctcgcacgcaaaagcaaaccccgcatgtgc

SEQ ID NO: 268113 - DNA, 75 bp, Artificial Sequence
  Synthetic
agcagagaggaattcattgctaaggtgaaggctaacgcagcactgggagcatggtctgacgagcaaaacaagtgg

SEQ ID NO: 268114 - DNA, 75 bp, Artificial Sequence
  Synthetic
gcaagtgcgaaagaagcagtggaagatcccgctttttggcacctagtggatgaagagagagaaaggcacctaaaa

SEQ ID NO: 268115 - DNA, 75 bp, Artificial Sequence
  Synthetic
ggaagatgtgcccactgtgtgtataacatgatgggcaaaagagagaaaaaacttggggagttcggcgtggcaaag

SEQ ID NO: 268116 - DNA, 75 bp, Artificial Sequence
  Synthetic
gatcactgggcatccagagaatccagtggagcaggagtggaagggataggcctcaactatttgggttggcacctg

SEQ ID NO: 268117 - DNA, 75 bp, Artificial Sequence
  Synthetic
aaaaagttgtcgctgcttgagggtggcctcttctatgcggacgacacagccggatgggataccagggttacaaat

SEQ ID NO: 268118 - DNA, 75 bp, Artificial Sequence
  Synthetic
gcctcttctatgcggacgacacagccggatgggataccagggttacaaatgcagacttggaggatgaagagcaga

SEQ ID NO: 268119 - DNA, 75 bp, Artificial Sequence
  Synthetic
ttctgcgctacatggaaggtgaacacaagcagctggcagccactgtgatgcagaaagcataccatgccaaggtcg

SEQ ID NO: 268120 - DNA, 75 bp, Artificial Sequence
  Synthetic
tgaaggtagccaggccctcccgagacggagggtgcatcatggacatcatcacaagacgggaccagcgaggatcag

SEQ ID NO: 268121 - DNA, 75 bp, Artificial Sequence
  Synthetic
gccaagtggttacatatgccctcaacaccctcactaatataaaggtacaactgattcgcatgatggagggagagg

SEQ ID NO: 268122 - DNA, 75 bp, Artificial Sequence
  Synthetic
gggtcatagaggccacagactcacacaaccctaggttgctacgagtggagaggtggctgcacgaccacggagaag

SEQ ID NO: 268123 - DNA, 75 bp, Artificial Sequence
  Synthetic
tggagacgactgtgtggtgagacccatggatgatagatttggtaaagccttatatttcttgaatgacatggccaa

SEQ ID NO: 268124 - DNA, 75 bp, Artificial Sequence
  Synthetic
gatcagaaaggacatcggtgaatgggagcactcagttggcttctcgagctgggaggaggtccctttctgctcgca

SEQ ID NO: 268125 - DNA, 75 bp, Artificial Sequence
  Synthetic
tcatttccacgaactggtgatgaaagacggacgcacccttgtcgtgccatgccgggatcaggatgaactggtggg

SEQ ID NO: 268126 - DNA, 75 bp, Artificial Sequence
  Synthetic
gagagcgcgcgtctccccagggtgtggttggagtgtgcgtgaaacagcctgtttgtccaaggcctatggccagat

SEQ ID NO: 268127 - DNA, 75 bp, Artificial Sequence
  Synthetic
gtggctgctcagttacttccacaggagggatctgaggaccctggggcttgccatctgctcggcggtccctgtgga

SEQ ID NO: 268128 - DNA, 75 bp, Artificial Sequence
  Synthetic
ccatctgctcggcggtccctgtggactgggtccccactggtcgaacgacatggagcatccacgccagtggggcct

SEQ ID NO: 268129 - DNA, 75 bp, Artificial Sequence
  Synthetic
ggatgaccacagagaacatgttggatgtgtggaatagagtgtggatcttggacaatcccttcatggagaacaaag

SEQ ID NO: 268130 - DNA, 75 bp, Artificial Sequence
  Synthetic
gacaatcccttcatggagaacaaagaaagggttgccgagtggagagacatcccatatcttcccaaggcacacgat

SEQ ID NO: 268131 - DNA, 75 bp, Artificial Sequence
  Synthetic
atgatgtgctcatcactggttggaaggcgagaaagagcggagtgggcaagaaacatctggggagcagtggagaaa

SEQ ID NO: 268132 - DNA, 75 bp, Artificial Sequence
  Synthetic
aaacatctggggagcagtggagaaagtgaggagaatgttgggccctgaaaggtacagtgactacctttcctgcat

SEQ ID NO: 268133 - DNA, 75 bp, Artificial Sequence
  Synthetic
ggaccgacacgaattgcactgggagctcaaaatagagagctcaataatttaaatacagacagtcaaagagctaaa

SEQ ID NO: 268134 - DNA, 75 bp, Artificial Sequence
  Synthetic
aaatacagacagtcaaagagctaaacccggagggctctctaaatattgtccggaaagaccatggaaatggtgcgg

SEQ ID NO: 268135 - DNA, 75 bp, Artificial Sequence
  Synthetic
cagcgcacgagagtgacggggaccggtcgcacccgacgcaccatccatgaagcacaacttcgtgagaccccccgg

SEQ ID NO: 268136 - DNA, 75 bp, Artificial Sequence
  Synthetic
gtcgcacccgacgcaccatccatgaagcacaacttcgtgagaccccccggtcagcttaagggggaagctggctgg

SEQ ID NO: 268137 - DNA, 75 bp, Artificial Sequence
  Synthetic
tggtgaaaaaacccccaacagggtgcccagcggcaacacgccagtgagagtggcgacgggaacatggtcgctccc

SEQ ID NO: 268138 - DNA, 75 bp, Artificial Sequence
  Synthetic
gtgagaccccccgcaccgtgaaaggccaagcatggtgcatgaaagggaaggcccccggaagcttgcttccgggag

SEQ ID NO: 268139 - DNA, 75 bp, Artificial Sequence
  Synthetic
tctccctgagccaccatcacccagacaccgatagtctgacaaggaggtgatgtgtgactcggaacaacacccgct

SEQ ID NO: 268140 - DNA, 75 bp, Artificial Sequence
  Synthetic
agacatgagctgggaatggccgggaaggccattctgaaaggaaaggggggcggtccccctcgacgagtgtcgaaa

SEQ ID NO: 268141 - DNA, 75 bp, Artificial Sequence
  Synthetic
aggccattctgaaaggaaaggggggcggtccccctcgacgagtgtcgaaagagaccgcaaagaagacgcgtcaac

SEQ ID NO: 268142 - DNA, 75 bp, Artificial Sequence
  Synthetic
ggtctatcttgagtatgggagatgcgggaaacaggaaggaacacggtcaagacgctccgtcttaatcccttccca

SEQ ID NO: 268143 - DNA, 75 bp, Artificial Sequence
  Synthetic
gggaaacaggaaggaacacggtcaagacgctccgtcttaatcccttcccacgctcagaaagacttgacggggaga

SEQ ID NO: 268144 - DNA, 75 bp, Artificial Sequence
  Synthetic
ggcaaccagagttgtcattgtgtcagcactgctctgcctggccccggcatacgcctcacgatgcacgcatttgga

SEQ ID NO: 268145 - DNA, 75 bp, Artificial Sequence
  Synthetic
acgcctcacgatgcacgcatttggaaaatagggatttcgtaactggcacgcagggaaccacacgcgtgacgctgg

SEQ ID NO: 268146 - DNA, 75 bp, Artificial Sequence
  Synthetic
tatcacagctgaggggaaaccatcaatggacgtgtggttagattccatctaccaagaaaatcccgccaagacacg

SEQ ID NO: 268147 - DNA, 75 bp, Artificial Sequence
  Synthetic
cacagagattggttcaatgatctggctctgccatggaaacacgagggaatggtgggctggaacaatgcagaacgc

SEQ ID NO: 268148 - DNA, 75 bp, Artificial Sequence
  Synthetic
ctgtgaagatggacgtttacaaccttggggatcaaactggggtgttattgaaatcacttgctggagcgccattag

SEQ ID NO: 268149 - DNA, 75 bp, Artificial Sequence
  Synthetic
tggggatcaaactggggtgttattgaaatcacttgctggagcgccattagctcacatcgagggaaccaaatacca

SEQ ID NO: 268150 - DNA, 75 bp, Artificial Sequence
  Synthetic
acccttggagtgggagctgacgtcggatgtgctgtggacactgagagaatggagctccgctgtggtgaagggttg

SEQ ID NO: 268151 - DNA, 75 bp, Artificial Sequence
  Synthetic
ggagctccgctgtggtgaagggttggttgtgtggagagaggtgtcggaatggtatgacaactatgccttctaccc

SEQ ID NO: 268152 - DNA, 75 bp, Artificial Sequence
  Synthetic
attcattgtcgaactcttggtcacagatttgagaaactgctcatggccagcaagtcacaccattgacaacgctga

SEQ ID NO: 268153 - DNA, 75 bp, Artificial Sequence
  Synthetic
caagtcacaccattgacaacgctgacattgtggactcagagctttttctgccagccagcctagccggaccccggt

SEQ ID NO: 268154 - DNA, 75 bp, Artificial Sequence
  Synthetic
ggttgtgtggggaggagtcgtggtcttggcgctgcttgttactggcatggtaacgctgcagagcatgctgcgtta

SEQ ID NO: 268155 - DNA, 75 bp, Artificial Sequence
  Synthetic
tgtgatcgcggtaggagtgacatttcaccttgagctgggaccagaaatcgtggctttgatgttgcttcaggcagt

SEQ ID NO: 268156 - DNA, 75 bp, Artificial Sequence
  Synthetic
caccttgagctgggaccagaaatcgtggctttgatgttgcttcaggcagtgtttgagttgagggtcggactcctc

SEQ ID NO: 268157 - DNA, 75 bp, Artificial Sequence
  Synthetic
ctactttctccttttggtcctagaactgggcttgccgggggcggatctggaagcgttgtggaagtgggctgacgc

SEQ ID NO: 268158 - DNA, 75 bp, Artificial Sequence
  Synthetic
tagttccacttgctggaaagcttggagggagtggctctgggattaggttgctagccttttgggaactggcttcac

SEQ ID NO: 268159 - DNA, 75 bp, Artificial Sequence
  Synthetic
agggagtggctctgggattaggttgctagccttttgggaactggcttcacgcagagagagacggtccttcagtga

SEQ ID NO: 268160 - DNA, 75 bp, Artificial Sequence
  Synthetic
gacacacatcccaggaagtcctgtgcgccctggcagtggcctcatttctcttactgatgctggttttgggaacaa

SEQ ID NO: 268161 - DNA, 75 bp, Artificial Sequence
  Synthetic
cgccctggcagtggcctcatttctcttactgatgctggttttgggaacaaggaaaatgcagctggttgctgaatg

SEQ ID NO: 268162 - DNA, 75 bp, Artificial Sequence
  Synthetic
ccatgtcagaaatgatgaggacagcacgcaggtctgacctggttttctccggacagagcggctcagagcgatgca

SEQ ID NO: 268163 - DNA, 75 bp, Artificial Sequence
  Synthetic
gtgcggtggctggaccctactgggcagatgttaaggaagatgttgtttgctacgggggggcctggagtctagagg

SEQ ID NO: 268164 - DNA, 75 bp, Artificial Sequence
  Synthetic
agatgttaaggaagatgttgtttgctacgggggggcctggagtctagaggaaaaatggaagggagagaaggtgca

SEQ ID NO: 268165 - DNA, 75 bp, Artificial Sequence
  Synthetic
ccggagaattggtcctagatactggaaggaggattggtgcaatacccattgatctagcgaaagggacatccggca

SEQ ID NO: 268166 - DNA, 75 bp, Artificial Sequence
  Synthetic
aagccagattttgtggtaacaacagacatctcagaaatgggtgccaaccttgatgttagccgtgtcatagatggg

SEQ ID NO: 268167 - DNA, 75 bp, Artificial Sequence
  Synthetic
caacataacaacactccgagggcctgtagcaactttctatgggcctgaacaagataagatgccggaggtggctgg

SEQ ID NO: 268168 - DNA, 75 bp, Artificial Sequence
  Synthetic
gtagcaactttctatgggcctgaacaagataagatgccggaggtggctggccactttcgtttaaccgaagagaaa

SEQ ID NO: 268169 - DNA, 75 bp, Artificial Sequence
  Synthetic
ctgagagaactctgaggccagtctggagggacgcccgcatgttcaaagaaggacgtgacataagagagttcgtgg

SEQ ID NO: 268170 - DNA, 75 bp, Artificial Sequence
  Synthetic
ggacgtgacataagagagttcgtggcatacgcctcgggacggcggagtcttgggggcatgctgacgggaatgtcg

SEQ ID NO: 268171 - DNA, 75 bp, Artificial Sequence
  Synthetic
ggtgcctagttttgaggacctcaatcagccgcatgatgttgggcactttggtgctgctggtctcactagctctgc

SEQ ID NO: 268172 - DNA, 75 bp, Artificial Sequence
  Synthetic
cagccgcatgatgttgggcactttggtgctgctggtctcactagctctgctatgggcgggcggtgttggctatgg

SEQ ID NO: 268173 - DNA, 75 bp, Artificial Sequence
  Synthetic
tagcgatgacaacaagctggcctatttccttttgacactctgcagtctggccagcttggtcgctgctaatgagat

SEQ ID NO: 268174 - DNA, 75 bp, Artificial Sequence
  Synthetic
ttccttttgacactctgcagtctggccagcttggtcgctgctaatgagatgggtttcttggaaaagaccaaatca

SEQ ID NO: 268175 - DNA, 75 bp, Artificial Sequence
  Synthetic
aacgtgaagagcccagagtgtggagtgaatggacaaatatagacatccaacctgccaagtcttggggaacatatg

SEQ ID NO: 268176 - DNA, 75 bp, Artificial Sequence
  Synthetic
tacgcaaccctatggtagacggagatgtcatcaatccgtttggagacggggaagtgaaaccagctttgtatgaga

SEQ ID NO: 268177 - DNA, 75 bp, Artificial Sequence
  Synthetic
tgagaacctctggcaccagacgcggtggctctgaaggagacacacttggtgacctctggaagagaaggctgaaca

SEQ ID NO: 268178 - DNA, 75 bp, Artificial Sequence
  Synthetic
gggcctggcggtgtcgagaggcacagcaaaactcgcctggcttgaggagcgcggctacgtgaacctcaaaggtga

SEQ ID NO: 268179 - DNA, 75 bp, Artificial Sequence
  Synthetic
agtggtggacctcggttgtggaagaggaggctggtcctactatgcagcctctcggcctgcagtcctgggtgtcaa

SEQ ID NO: 268180 - DNA, 75 bp, Artificial Sequence
  Synthetic
ggaggctggtcctactatgcagcctctcggcctgcagtcctgggtgtcaaggcgtacacgattggagggaaggga

SEQ ID NO: 268181 - DNA, 75 bp, Artificial Sequence
  Synthetic
gcaatggggtggaggtctggtgcgcactccattctcaagaaattcaactcacgagatgtattactccacggccat

SEQ ID NO: 268182 - DNA, 75 bp, Artificial Sequence
  Synthetic
ttcgggaaacatagtcaactccgttaatgtgcaatccaggaagctgctagctcggtttggagatcaaagaggacc

SEQ ID NO: 268183 - DNA, 75 bp, Artificial Sequence
  Synthetic
aatgtgcaatccaggaagctgctagctcggtttggagatcaaagaggacctactagggtgccagagatggacctg

SEQ ID NO: 268184 - DNA, 75 bp, Artificial Sequence
  Synthetic
gcagcagagagtgttcaaggacaaagtcgacaccaaggcacaggagcctcagccaggcaccagagtcatcatgag

SEQ ID NO: 268185 - DNA, 75 bp, Artificial Sequence
  Synthetic
tgagggtggcctcttctatgcggatgacacagccggatgggataccagggttacaaatgcagacttggaggatga

SEQ ID NO: 268186 - DNA, 75 bp, Artificial Sequence
  Synthetic
gacacagccggatgggataccagggttacaaatgcagacttggaggatgaagagcagcttttgcgctacatggaa

SEQ ID NO: 268187 - DNA, 75 bp, Artificial Sequence
  Synthetic
cggagaagaacgccttagaagaatgctggtcagtggagacgactgtgtggtgagacccatggatgatagatttgg

SEQ ID NO: 268188 - DNA, 75 bp, Artificial Sequence
  Synthetic
cctgtggactgggtccccactggtcgaacaacatggagcatccacgccagtggagcctggatgaccacagagaac

SEQ ID NO: 268189 - DNA, 75 bp, Artificial Sequence
  Synthetic
tggagaaagtgaggagaatgttgggccctgaaaggtacagtgactacctctcctgcatggaccgacacgaactgc

SEQ ID NO: 268190 - DNA, 75 bp, Artificial Sequence
  Synthetic
actgggagctcaaaatggagagctcaataatttaaacacagacagccaaagagcaaaacccggagggctcactaa

SEQ ID NO: 268191 - DNA, 75 bp, Artificial Sequence
  Synthetic
gagcaaaacccggagggctcactaaatattgtccggaaatggaaaattacagaccatggaagtggtgcggcagcg

SEQ ID NO: 268192 - DNA, 75 bp, Artificial Sequence
  Synthetic
acccgacgcaccatccatgaagcacaacttcgtgagaccccccggtcagcctaaggggcaagctggctggtggtg

SEQ ID NO: 268193 - DNA, 75 bp, Artificial Sequence
  Synthetic
acgggaacatggtcgctcccgacgcagggcactctatacaattttgtgagaccccccgcaccgtgaaaggccaag

SEQ ID NO: 268194 - DNA, 75 bp, Artificial Sequence
  Synthetic
tatacaattttgtgagaccccccgcaccgtgaaaggccaagcatggtgcatagaacgttaaggcgcgggggacat

SEQ ID NO: 268195 - DNA, 75 bp, Artificial Sequence
  Synthetic
cggaattcagtagtgtactaccagcaacaaacagtgacaatggcgaatttaataattatttcgatggttctgagc

SEQ ID NO: 268196 - DNA, 75 bp, Artificial Sequence
  Synthetic
aacaaacagtgacaatggcgaatttaataattatttcgatggttctgagcattgcctatgggcatccgctctcaa

SEQ ID NO: 268197 - DNA, 75 bp, Artificial Sequence
  Synthetic
atgcattaagattggtgattttgaagaagaaaaaagagaaaaactaagaatgatacaaaagaaacttgcaaagga

SEQ ID NO: 268198 - DNA, 75 bp, Artificial Sequence
  Synthetic
caagtcaaattggtgaccgctgttttgctggtggtaacctcttcaaggagatgaacttgagtgtaggacttggcg

SEQ ID NO: 268199 - DNA, 75 bp, Artificial Sequence
  Synthetic
atgaacttgagtgtaggacttggcgaaatatgtgttaaagatgacatatctattgttaagagtactactgttttt

SEQ ID NO: 268200 - DNA, 75 bp, Artificial Sequence
  Synthetic
agcaagaataaactggctcttgaagcaactacaaaattttatagatcctttatcgtaaaagactggtctgagtgc

SEQ ID NO: 268201 - DNA, 75 bp, Artificial Sequence
  Synthetic
tatacatgtagagcagcatgtgatattagattaaacaaagataatgccgaaataatattatcgtcaacaaaactc

SEQ ID NO: 268202 - DNA, 75 bp, Artificial Sequence
  Synthetic
ggacaaaaaacagccaaagatagagaaatatttttaggtgaatttgaagcaaaaatgtgtctgtaccttgtcgaa

SEQ ID NO: 268203 - DNA, 75 bp, Artificial Sequence
  Synthetic
aaccactttgaaattgtcgggacaacttcgacatcaggctggtttaagaacacaataacaaacaacctagaacat

SEQ ID NO: 268204 - DNA, 75 bp, Artificial Sequence
  Synthetic
gtggtcagaaatcagtaaaattccatgcatgctttagacaacataggggttgtgtaagattttttaaagggacat

SEQ ID NO: 268205 - DNA, 75 bp, Artificial Sequence
  Synthetic
aggacttaagatagaaataaatgctgatatgtccaaatggagtgcccaagatgtactttttaaatatttttggtt

SEQ ID NO: 268206 - DNA, 75 bp, Artificial Sequence
  Synthetic
attctgacattatatatctttgctgcaattatatttgcactaattataacaaagagttatgtagcatacctgctc

SEQ ID NO: 268207 - DNA, 75 bp, Artificial Sequence
  Synthetic
aatacagtagaaataaagcgtaactggcttcaaggcaacttaaattatacaagcagttacttacacagctgtagt

SEQ ID NO: 268208 - DNA, 75 bp, Artificial Sequence
  Synthetic
agctagacagatgtgtaaatcgaaaagctggtccttcacagcagctatattaactggattaatattgatggaatt

SEQ ID NO: 268209 - DNA, 75 bp, Artificial Sequence
  Synthetic
agctggtccttcacagcagctatattaactggattaatattgatggaattcatctcaccaattgcaggagagaga

SEQ ID NO: 268210 - DNA, 75 bp, Artificial Sequence
  Synthetic
atgtataagcttgaggagttggccgatgagtttataaagctaacagagcaggtgaatattctagaaagagaaatg

SEQ ID NO: 268211 - DNA, 75 bp, Artificial Sequence
  Synthetic
gaagtcttgaagcagtcaataattgttatgtttgcaatcattttagtattgttactttttgaaaatatgatattc

SEQ ID NO: 268212 - DNA, 75 bp, Artificial Sequence
  Synthetic
ttatgtttgcaatcattttagtattgttactttttgaaaatatgatattcaaccggcttttccgcattttttatc

SEQ ID NO: 268213 - DNA, 75 bp, Artificial Sequence
  Synthetic
gttcttgctccatgtgcggcttgatacattatagaccaggactcaaaatcgatttaaccaaaactaacagatgtg

SEQ ID NO: 268214 - DNA, 75 bp, Artificial Sequence
  Synthetic
gcagttgcatctgtggattcgacgagcagcagtcgtctggttttgaatatgaaatatttttaacggatatgcatg

SEQ ID NO: 268215 - DNA, 75 bp, Artificial Sequence
  Synthetic
tccaaaaagaatcatgcaaattcagtccaagagtaaaccactttaggaatactaaagctttattatttgcacttg

SEQ ID NO: 268216 - DNA, 75 bp, Artificial Sequence
  Synthetic
aaagatattaaaataacatatcaagagttgcacaactgcataggtccaaagataatgggcgatacttgtgtatca

SEQ ID NO: 268217 - DNA, 75 bp, Artificial Sequence
  Synthetic
aagagtgaattgtattctgatttattctcaaaaaatctagtcacagaatatgataaaaaatattttgaacctgat

SEQ ID NO: 268218 - DNA, 75 bp, Artificial Sequence
  Synthetic
aatgatactattagaaagaatactttacaagacagaatgtgaaatgctaagcttaaaaaagaacagtggacctta

SEQ ID NO: 268219 - DNA, 75 bp, Artificial Sequence
  Synthetic
ctagtgaaatgagatctcgatcacttttaacacctcgtaaattcacaacaagtgggtcacttaataggttgaaat

SEQ ID NO: 268220 - DNA, 75 bp, Artificial Sequence
  Synthetic
aaaaatcataatatagacttatgcagtaggcacaactacaaaatgatatgtcagtgtattaatgcacactctatg

SEQ ID NO: 268221 - DNA, 75 bp, Artificial Sequence
  Synthetic
tcagtgtattaatgcacactctatgtgtaagaatacagacatagattataacaaagagatcgaaacatattacaa

SEQ ID NO: 268222 - DNA, 75 bp, Artificial Sequence
  Synthetic
acaaagagatcgaaacatattacaaaagcaatgctgcagcctatagagctggcctgaacaccataatggacacat

SEQ ID NO: 268223 - DNA, 75 bp, Artificial Sequence
  Synthetic
aacatttgaagaatttgttaatacgatattatttaggtacaattcaaagaaattcaaagaatctttgtcaataca

SEQ ID NO: 268224 - DNA, 75 bp, Artificial Sequence
  Synthetic
aattcaaagaatctttgtcaatacaaaacccagcacagctttttattgagcaaatattattttccaataaaccag

SEQ ID NO: 268225 - DNA, 75 bp, Artificial Sequence
  Synthetic
gaaaaagatgactctgatgctcttaaggccttatttagtaatattactgattctgtccaggacaactatcagatg

SEQ ID NO: 268226 - DNA, 75 bp, Artificial Sequence
  Synthetic
caagatttttggattacaagacatgccaggaattgaagaactagatacaattataggtcgcaaaacatttgttga

SEQ ID NO: 268227 - DNA, 75 bp, Artificial Sequence
  Synthetic
attggaatattgaaatttgctagtaagctattagatattaaccttggtagatccacccgctcagctcatcattct

SEQ ID NO: 268228 - DNA, 75 bp, Artificial Sequence
  Synthetic
ctaatccttttactgattacagttattctaatgttaatataaaggaatgcatgtcgccagagagcttgaaatgtt

SEQ ID NO: 268229 - DNA, 75 bp, Artificial Sequence
  Synthetic
ttaagaagagagacagtacaccgcatacaaaccacctgctttgcaagatagacaacaaatataaagcatttgact

SEQ ID NO: 268230 - DNA, 75 bp, Artificial Sequence
  Synthetic
tacaaaccacctgctttgcaagatagacaacaaatataaagcatttgactggccagagatagaaacaattcaaaa

SEQ ID NO: 268231 - DNA, 75 bp, Artificial Sequence
  Synthetic
aggtcaaaaattatgccttggtgacagtcattgcaacttggaatttacagccataactgcagacagaattatgtc

SEQ ID NO: 268232 - DNA, 75 bp, Artificial Sequence
  Synthetic
attaactaactgttataaagaatctttcactgcgcaaccagcagatatgcaggctggaattaaaaaatgctcggc

SEQ ID NO: 268233 - DNA, 75 bp, Artificial Sequence
  Synthetic
tgatgaaataggagaatgtacaacacttgaagacaagacatggccaattgtattctgtagcggcaaatattacta

SEQ ID NO: 268234 - DNA, 75 bp, Artificial Sequence
  Synthetic
cttgaagacaagacatggccaattgtattctgtagcggcaaatattactactctgatagcaaggagcatgccaaa

SEQ ID NO: 268235 - DNA, 75 bp, Artificial Sequence
  Synthetic
gacggttctatcaacaattattgtttaaccaacaaatgttctgaacaacgtttcccaatacatgaaaattggttc

SEQ ID NO: 268236 - DNA, 75 bp, Artificial Sequence
  Synthetic
taaccaacaaatgttctgaacaacgtttcccaatacatgaaaattggttcaaaaaatgtaattgggacaagaccc

SEQ ID NO: 268237 - DNA, 75 bp, Artificial Sequence
  Synthetic
aaaaaatgtaattgggacaagacccacaaagaatttaggccatatgagacaaataactataatgatataacttct

SEQ ID NO: 268238 - DNA, 75 bp, Artificial Sequence
  Synthetic
tatagaaaagcaatagaatctgagataggaacagatttgatgacacaccattataagcccacaaagaaccttcca

SEQ ID NO: 268239 - DNA, 75 bp, Artificial Sequence
  Synthetic
catgttgtaccaaggtatcatagtatagatgtacaaggtacagaatcaacagagggtattatcaatggtttcata

SEQ ID NO: 268240 - DNA, 75 bp, Artificial Sequence
  Synthetic
atacaatttctgaagaaaattattgaagaattcacatacaaagggatacctgtaaaacatttatactcaaaaata

SEQ ID NO: 268241 - DNA, 75 bp, Artificial Sequence
  Synthetic
atagttatttttgtaaaaaaagctgtatataaagcacagtaccagaaagcatacaccacaggtcctagcatatcc

SEQ ID NO: 268242 - DNA, 75 bp, Artificial Sequence
  Synthetic
ataaatattgaacataacgaaagatgcacaggccactgccccgaaaagattcctgcaaaagaaggttggttaaca

SEQ ID NO: 268243 - DNA, 75 bp, Artificial Sequence
  Synthetic
ttttctaaagagcatactagttcttggggatgtgaagaatatggctgtcttgctatagatacaggctgtttatat

SEQ ID NO: 268244 - DNA, 75 bp, Artificial Sequence
  Synthetic
ggctcttgtcaagatgtcatacgcccagaattagatgtttataagaagattggcagtgaggcatcactgatagaa

SEQ ID NO: 268245 - DNA, 75 bp, Artificial Sequence
  Synthetic
atatgtataactttgcctcatgaaacttattgcaatgatatggacatattagaaccgattataggagataaatta

SEQ ID NO: 268246 - DNA, 75 bp, Artificial Sequence
  Synthetic
agtgcatcctttcagaatacacagactaatcaacttccgacccttatagcttataaaaagggaaaaatatacaca

SEQ ID NO: 268247 - DNA, 75 bp, Artificial Sequence
  Synthetic
ggtcaaatcaatgatattggaaacacagcattgcagtgcggctcaatccaagtaatcaatggatcaactatcgga

SEQ ID NO: 268248 - DNA, 75 bp, Artificial Sequence
  Synthetic
cagcattgcagtgcggctcaatccaagtaatcaatggatcaactatcggaactggcagcccaaaatttgattata

SEQ ID NO: 268249 - DNA, 75 bp, Artificial Sequence
  Synthetic
actggcagcccaaaatttgattatatatgccatgctatgagaaggaaagatgttatcgtaaggaagtgtttcaat

SEQ ID NO: 268250 - DNA, 75 bp, Artificial Sequence
  Synthetic
tgttatcgtaaggaagtgtttcaatgacaactatcagtcgtgcactaggctagaaaagcgaaatgacttgattcc

SEQ ID NO: 268251 - DNA, 75 bp, Artificial Sequence
  Synthetic
ttatagaaaaggcgatgtcatcgaagtatcaaaaacaggatcgaacatgggccaaatgacatttaaaatagaact

SEQ ID NO: 268252 - DNA, 75 bp, Artificial Sequence
  Synthetic
ctggcatttgtgctgggtgcattgactgtgctgaaggtatttcatgctctataaatgctgaagtgccagccgaaa

SEQ ID NO: 268253 - DNA, 75 bp, Artificial Sequence
  Synthetic
cagtctgccattgcaaaacaaactgtgaagattttataaacaatatagtgttttcaccgcaaatcaagaattaca

SEQ ID NO: 268254 - DNA, 75 bp, Artificial Sequence
  Synthetic
ccttaatctcagaatgtgacaaatttgaagaagcatttgacttcctcgacatgggattttgctcgaatgaaaatc

SEQ ID NO: 268255 - DNA, 75 bp, Artificial Sequence
  Synthetic
atataaaagtccactgtaaatctaaggttgaaaaaataacagcacatatctgtgggagagacattgatttacagt

SEQ ID NO: 268256 - DNA, 75 bp, Artificial Sequence
  Synthetic
ggttgaaaaaataacagcacatatctgtgggagagacattgatttacagttgacagttaagccatacaatcagaa

SEQ ID NO: 268257 - DNA, 75 bp, Artificial Sequence
  Synthetic
gtattcacatgtgcatgtacaggaatggatatgatgcagaatatcataaatttgatataccctctaaattcctca

SEQ ID NO: 268258 - DNA, 75 bp, Artificial Sequence
  Synthetic
gatagacttgtcgcagttagatgaatcaaattacataagggaagaggacctccagtgtggaacatggttatgtaa

SEQ ID NO: 268259 - DNA, 75 bp, Artificial Sequence
  Synthetic
tcaaattacataagggaagaggacctccagtgtggaacatggttatgtaaggtgcaaaaagaggggattgatatt

SEQ ID NO: 268260 - DNA, 75 bp, Artificial Sequence
  Synthetic
atgtttaaaggattattttcaggcttagggagatattggaccatattaatttattcaattataggtgtggtaata

SEQ ID NO: 268261 - DNA, 75 bp, Artificial Sequence
  Synthetic
tagggagatattggaccatattaatttattcaattataggtgtggtaataattgtgatattggtttatatcctat

SEQ ID NO: 268262 - DNA, 75 bp, Artificial Sequence
  Synthetic
tgcccataggtcgccttttaaaagcattcctaatcagacatgaaatagaatatgccatggagcagaaaatcaagt

SEQ ID NO: 268263 - DNA, 75 bp, Artificial Sequence
  Synthetic
agttttggttaaaaagggtaggcaagtttaaaatcaggtataaataaaattcatataaataaagtcaaaaattgt

SEQ ID NO: 268264 - DNA, 75 bp, Artificial Sequence
  Synthetic
ttggttaaaaagggtaggcaagtttaaaatcaggtataaataaaattcatataaataaagtcaaaaattgttgtt

SEQ ID NO: 268265 - DNA, 75 bp, Artificial Sequence
  Synthetic
ttactcaaccaatatcgaaataggatattgcattgccgtgaacctgaaatagcaaaggatatatggcgtgatcta

SEQ ID NO: 268266 - DNA, 75 bp, Artificial Sequence
  Synthetic
agcaaaggatatatggcgtgatctattgaatgatcgacacaactacttttctcgagaattttgcagagctgcaaa

SEQ ID NO: 268267 - DNA, 75 bp, Artificial Sequence
  Synthetic
ttgaatgatcgacacaactacttttctcgagaattttgcagagctgcaaaccttgagtatagaaatgatgttcct

SEQ ID NO: 268268 - DNA, 75 bp, Artificial Sequence
  Synthetic
agactgctgagcaatggatgcgtgaagagatagttgctgtaagagcagcctttgaggctgtaggcactctggcct

SEQ ID NO: 268269 - DNA, 75 bp, Artificial Sequence
  Synthetic
tgggccaggactgggttctctccagcagcaagagacttcttgcgccaattcggaattgacatatagtggagtaca

SEQ ID NO: 268270 - DNA, 75 bp, Artificial Sequence
  Synthetic
gctgaggatatttgtgctgaagtcctcgatggttacaaagcaaggaaagtgcgtttttgtacacctgataattac

SEQ ID NO: 268271 - DNA, 75 bp, Artificial Sequence
  Synthetic
attcgaaacaaacaaaaacaatctcaaaatgtcgcaactgttgctcaaccaatatcgaaataggatattgcactg

SEQ ID NO: 268272 - DNA, 75 bp, Artificial Sequence
  Synthetic
ttactacatgacgggaaaatgtatataatagatttcaaagtgtctgtagatgatcggtcttccagaattacaagg

SEQ ID NO: 268273 - DNA, 75 bp, Artificial Sequence
  Synthetic
gacataattacttttcccgagaattttgcagagctgcaaatcttgagtatagaaatgatgttcctgctgaagata

SEQ ID NO: 268274 - DNA, 75 bp, Artificial Sequence
  Synthetic
gagaaatacaatgaaatttttggagaagtgttcaatccagaaggtgtagactttgaagtcgttattattaggttg

SEQ ID NO: 268275 - DNA, 75 bp, Artificial Sequence
  Synthetic
tttgcgcagaagttctcgatgggtataaagcaaggaaagttcgcttttgcacacctgataattacttactacacg

SEQ ID NO: 268276 - DNA, 75 bp, Artificial Sequence
  Synthetic
gatccttcaaatatggcaatacatgtagactctcgagatttcatggatacgatcgggccaatcacattaaacatt

SEQ ID NO: 268277 - DNA, 75 bp, Artificial Sequence
  Synthetic
atgggaaaatgtatataatagacttcaaagtgtctgtagacgatcggtcttctagaatcacaagggagaagtata

SEQ ID NO: 268278 - DNA, 75 bp, Artificial Sequence
  Synthetic
agtatgcaatggttttttgatatgaaagatttcttatttggtaaatttcgggacgatgataaattccatgctata

SEQ ID NO: 268279 - DNA, 75 bp, Artificial Sequence
  Synthetic
atgagatctttggagaagtattcaatccagaaggtatagatttcgaaatcgttattattagattggacccttcaa

SEQ ID NO: 268280 - DNA, 75 bp, Artificial Sequence
  Synthetic
ataagtcaaggagaattcacaatgacattgccatggattgaagaggatactccagaattacttactcatcctata

SEQ ID NO: 268281 - DNA, 75 bp, Artificial Sequence
  Synthetic
atatggctatacacgtggactctcgagatttcatgaatacaattggaccggttacattaaacattagtatgcaat

SEQ ID NO: 268282 - DNA, 75 bp, Artificial Sequence
  Synthetic
tacaatgaattcatgaattcgatgccagaggcagaacaggttctattcaaagaagcactagaattcaaatcattc

SEQ ID NO: 268283 - DNA, 75 bp, Artificial Sequence
  Synthetic
ggttttttgacatgaaagacttcttgtttgggaaattccgggatgatgataaattccatgctataataagtcaag

SEQ ID NO: 268284 - DNA, 75 bp, Artificial Sequence
  Synthetic
ggagcagaaaaatggaatattttcttaaagggagtgatgtctaaatatggtgaatattataaagaatttactaaa

SEQ ID NO: 268285 - DNA, 75 bp, Artificial Sequence
  Synthetic
gagaatttacaatgacactaccatggattgaagaagacacgccagaattgcttactcatcctatatacaatgaat

SEQ ID NO: 268286 - DNA, 75 bp, Artificial Sequence
  Synthetic
ggacatgctcaatctatattcttgacaacaggggattaccccaagccagataaggaccaaatttcagctggatgg

SEQ ID NO: 268287 - DNA, 75 bp, Artificial Sequence
  Synthetic
ttatgaattcaatgccagaggcagagcaggtcctatttaaggaagcactagaattcaagtcattcggggcagaaa

SEQ ID NO: 268288 - DNA, 75 bp, Artificial Sequence
  Synthetic
taaggaccaaatttcagctggatggcgagagatggtaagtagagttagttctgaacgcgacatgtcaaatgacat

SEQ ID NO: 268289 - DNA, 75 bp, Artificial Sequence
  Synthetic
gcaggtcctatttaaggaagcactagaattcaagtcattcggggcagaaaaatggaatatctttttgaaaggggt

SEQ ID NO: 268290 - DNA, 75 bp, Artificial Sequence
  Synthetic
aaatcaggaaaaaccaagcatacattttatatgggcacaaaatgattcaagtagcaacaataacatacagaaact

SEQ ID NO: 268291 - DNA, 75 bp, Artificial Sequence
  Synthetic
gatgtcaaagtatggtgaatattataaagaatttactaaaggacatgctcattctatattcctgacaacaggaga

SEQ ID NO: 268292 - DNA, 75 bp, Artificial Sequence
  Synthetic
gtagcaacaataacatacagaaactaattaaactatccaaatcactgcaagccatgagtgggacagggagctatg

SEQ ID NO: 268293 - DNA, 75 bp, Artificial Sequence
  Synthetic
ttaccccaaaccagacaaagaccaaatttcagcaggttggaaagaaatggtagatagagtaaattctgaacgtga

SEQ ID NO: 268294 - DNA, 75 bp, Artificial Sequence
  Synthetic
taaatgctttcaaatcattaggaagattaatggatatatcatcagacattaaaaaatatgaatcattttgcggaa

SEQ ID NO: 268295 - DNA, 75 bp, Artificial Sequence
  Synthetic
catgtcaaatgacataaaccaggagaagccaagcatgcattttatatgggcacaaaatgattcaagtagcaataa

SEQ ID NO: 268296 - DNA, 75 bp, Artificial Sequence
  Synthetic
aattaaaatctctggcaagatccagtgtaaagaaactcgataggaaaatagaaccaatacaaattggaacagcaa

SEQ ID NO: 268297 - DNA, 75 bp, Artificial Sequence
  Synthetic
taacatacagaaactaatcaaattatccaaatcactgcaaactctgagcgggccggggagctatgtaaatgcttt

SEQ ID NO: 268298 - DNA, 75 bp, Artificial Sequence
  Synthetic
ctgtcttatgggagcaacaatttaaattagatacggatgtcataaaaagagaagacagaatacatttaatgaaag

SEQ ID NO: 268299 - DNA, 75 bp, Artificial Sequence
  Synthetic
tagatcactagggagattgatggacatatcatcagatattagaaaatacgaatcattttgtggaaaattgaaatc

SEQ ID NO: 268300 - DNA, 75 bp, Artificial Sequence
  Synthetic
attatttcggaattggcaaacacaagtctttttcaaaaaagttaaacaatgacataaatactgataagcctaaaa

SEQ ID NO: 268301 - DNA, 75 bp, Artificial Sequence
  Synthetic
actagcaaggtccagtgtaaaaaaacttgacaggaaaatagaaccaatacagattgggactgcaactgttttatg

SEQ ID NO: 268302 - DNA, 75 bp, Artificial Sequence
  Synthetic
tattgaattttgacaatgacgatatagttaggaaatgcaaagataaatataaccaagtcacacataatttgtctc

SEQ ID NO: 268303 - DNA, 75 bp, Artificial Sequence
  Synthetic
agattgggactgcaactgttttatgggaacagcaattcaagctagatacagatgttataaaaagagaagacagaa

SEQ ID NO: 268304 - DNA, 75 bp, Artificial Sequence
  Synthetic
aagttaatgaattggacaagattggaaattacctagagcatttttcagctaaaattagtgcctgcagtgtagaaa

SEQ ID NO: 268305 - DNA, 75 bp, Artificial Sequence
  Synthetic
tgtgggactttatatataatacaactaaaaccaagtattggcaatgcatcaatgattactccaccctaatgaaaa

SEQ ID NO: 268306 - DNA, 75 bp, Artificial Sequence
  Synthetic
ctgataagcctaaaatattgaacttcgacaatgaggacatagttaggaaatgcaaggataaatataatcaagtca

SEQ ID NO: 268307 - DNA, 75 bp, Artificial Sequence
  Synthetic
acatgctagctgtttcccaatataataggcacaatacctttaggattgtctcatgtgcaaataacaatgtatttg

SEQ ID NO: 268308 - DNA, 75 bp, Artificial Sequence
  Synthetic
tacataacttatcccaaatcaatgagttggataagattggaaactacttagagcatttctcagctaagattaatg

SEQ ID NO: 268309 - DNA, 75 bp, Artificial Sequence
  Synthetic
gcttagtgatgccaagctcagacataaaaacaaaaaaagcaacattagtctatgcaataatagctctccataatg

SEQ ID NO: 268310 - DNA, 75 bp, Artificial Sequence
  Synthetic
cctgcagtgtagaaatgtgggattttatatataatacgactaaaactaagtactggcaatgcatcaatgactatt

SEQ ID NO: 268311 - DNA, 75 bp, Artificial Sequence
  Synthetic
tactggcaatgcatcaatgactattccaccctaatgaaaaacatgttagctgtctctcaatataatagacacaat

SEQ ID NO: 268312 - DNA, 75 bp, Artificial Sequence
  Synthetic
aggaggcagagatagcagaacttggttcactctattccacttttaagacaacaacgggctatatttcaatatcga

SEQ ID NO: 268313 - DNA, 75 bp, Artificial Sequence
  Synthetic
aggcttttaggctagataaggaaaggtgccagcgcatagtgtcctctccaggcttatttctcatgacaagctgtc

SEQ ID NO: 268314 - DNA, 75 bp, Artificial Sequence
  Synthetic
acattcagaattgtctcatgcgcaaataataatgtatttggtttggtaatgccaagctcagatataaagacaaaa

SEQ ID NO: 268315 - DNA, 75 bp, Artificial Sequence
  Synthetic
ttttattcaatggcaataagagtctagaatttgataaattactaggattttcattttttacatcaatatcgatta

SEQ ID NO: 268316 - DNA, 75 bp, Artificial Sequence
  Synthetic
aaagctaccttagtctatgcaataatagctcttcataatgaagaggcagaaatagcagaacttggctcactctac

SEQ ID NO: 268317 - DNA, 75 bp, Artificial Sequence
  Synthetic
caaaagctatgctctctcttactgaaccttcacgctatatgatcatgaattcactggcagtttctagccatgtaa

SEQ ID NO: 268318 - DNA, 75 bp, Artificial Sequence
  Synthetic
tcaacttttaagacagtaacaggatatatttcaatatcaaaagcttttaggctggataaagagagatgccagcgt

SEQ ID NO: 268319 - DNA, 75 bp, Artificial Sequence
  Synthetic
gagagtatatatctgaaaaattttctccttatacgaaaacatcattttctgtagtgatgacagatttgattaaaa

SEQ ID NO: 268320 - DNA, 75 bp, Artificial Sequence
  Synthetic
atagtatcctctccaggtttgttcctcatgacaagctgtctattattcaatggtaataaaagcttagaatttgat

SEQ ID NO: 268321 - DNA, 75 bp, Artificial Sequence
  Synthetic
agggttgctattcagcgtatgaacagaggaaaaaggtgcaaataagggatataaaattaacagactacgatataa

SEQ ID NO: 268322 - DNA, 75 bp, Artificial Sequence
  Synthetic
aagttgctaggattttcgttttttacatcaatatcaattacgaaagctatgctctctcttactgagccctcacgc

SEQ ID NO: 268323 - DNA, 75 bp, Artificial Sequence
  Synthetic
ctcagaaaggagtagattccaaaagagatcttaaatccatttggttcccaggaaaggtaaatttaaaagaatact

SEQ ID NO: 268324 - DNA, 75 bp, Artificial Sequence
  Synthetic
tatatgatcatgaattcgttagcagtttctagtcatgtaaaagagtatatatctgaaaaattctccccttataca

SEQ ID NO: 268325 - DNA, 75 bp, Artificial Sequence
  Synthetic
tgaaccagatttatctaccattttattttaattctaaaggattgcatgaaaagcatcatgttttaatagatttgg

SEQ ID NO: 268326 - DNA, 75 bp, Artificial Sequence
  Synthetic
aaaacatcattttctgtggtaatgacagacttgattaaaaggggttgctattcagcatatgaacagagaaaaaaa

SEQ ID NO: 268327 - DNA, 75 bp, Artificial Sequence
  Synthetic
aagcatcatgttttaatagatttggctaaaacagtgctagaaatcgaaaaagagcaaagggaatcactgcctgag

SEQ ID NO: 268328 - DNA, 75 bp, Artificial Sequence
  Synthetic
gtacaaataagagatataaaactaacagattatgatataacacaaaaaggagtggattccaaaagagatctcaaa

SEQ ID NO: 268329 - DNA, 75 bp, Artificial Sequence
  Synthetic
ccatggtcagagatacctgccaagcagactgtcaacttaaatgttttaatttactcaattgcaaggaacttgaac

SEQ ID NO: 268330 - DNA, 75 bp, Artificial Sequence
  Synthetic
tctatttggttcccagggaaggtgaacctgaaagaatatttaaatcaaatttatctgccattttattttaattcc

SEQ ID NO: 268331 - DNA, 75 bp, Artificial Sequence
  Synthetic
ttagatacttcaagacataattttgtgaggagccgagtagaaaatgcaaataactttaacagatctataacgaca

SEQ ID NO: 268332 - DNA, 75 bp, Artificial Sequence
  Synthetic
aaaggattacatgaaaaacatcatgtcttgatagatttggctaaaacagtgctagaaattgaaaaagaacaaagg

SEQ ID NO: 268333 - DNA, 75 bp, Artificial Sequence
  Synthetic
atatccacctttaccagctcgaaatcatgtattaagattggtgattttgaagaggagaaaaagaggaaaaccaaa

SEQ ID NO: 268334 - DNA, 75 bp, Artificial Sequence
  Synthetic
gaatcactacctgagccgtggtcagagatacctgctaagcagactgttaacttaaaagttttgatttactcaatt

SEQ ID NO: 268335 - DNA, 75 bp, Artificial Sequence
  Synthetic
aatgatgcaaagaaactagcaaaggatatttctaaattaactatagccaatccagcattcttagacgaaatcaca

SEQ ID NO: 268336 - DNA, 75 bp, Artificial Sequence
  Synthetic
gcaaggaatttgaatttagatacttcaagacataatttcgtaagaagccgagtagaaaatgcaaataatttcaac

SEQ ID NO: 268337 - DNA, 75 bp, Artificial Sequence
  Synthetic
aatgaacatgagataagacactcaacttatgaggatttaaaacaatccatcccggattatacagactatatgtct

SEQ ID NO: 268338 - DNA, 75 bp, Artificial Sequence
  Synthetic
aggtctataacaacaatatctacctttaccagttcgaaatcatgcatcaagattggtgattttgaagaagaaaaa

SEQ ID NO: 268339 - DNA, 75 bp, Artificial Sequence
  Synthetic
aagaaaaaaaccaaaaatgatgcaaaaaagcttgcaaaggatatttctaaattaactatagccaatccagcattc

SEQ ID NO: 268340 - DNA, 75 bp, Artificial Sequence
  Synthetic
agaagattactaccaatgaaataagtgataaagaaacagtcaagctaattctagagactatgaagaagcataaaa

SEQ ID NO: 268341 - DNA, 75 bp, Artificial Sequence
  Synthetic
ttagacgaaatcacaaacgagcatgagataagacactcaacttatgaagacttaaaacaatccatcccggattac

SEQ ID NO: 268342 - DNA, 75 bp, Artificial Sequence
  Synthetic
tatttcacttcggattcttcaacaaaggacaaaaaacagctaaagatagagaaatatttttaggtgaattcgagg

SEQ ID NO: 268343 - DNA, 75 bp, Artificial Sequence
  Synthetic
caaaaatgtgcctgtaccttgtcgaaagaatagctaaagagagatgcaaattaaacccagaagaaatgataagtg

SEQ ID NO: 268344 - DNA, 75 bp, Artificial Sequence
  Synthetic
acagactatatgtctgtgaaagtttttgacagattatacgagaagattactaccaatgagataagtgataaagaa

SEQ ID NO: 268345 - DNA, 75 bp, Artificial Sequence
  Synthetic
aaccaggcgattctaagttaagagtattagaaaagcaatcagaagatgaaatcaggtatatcagcaacacaataa

SEQ ID NO: 268346 - DNA, 75 bp, Artificial Sequence
  Synthetic
acggtcaaactgattctagagaccatgagaaagcataaaatatttcattttggatttttcaataaaggccaaaaa

SEQ ID NO: 268347 - DNA, 75 bp, Artificial Sequence
  Synthetic
agacattgggaagtgccatagaaagcctgcaatccggatctttaaattgggcagatatatgtgaaagcaaggcac

SEQ ID NO: 268348 - DNA, 75 bp, Artificial Sequence
  Synthetic
acagctaaagatagagaaatatttttaggtgaatttgaggcaaaaatgtgtctgtaccttgtcgaaagaatagct

SEQ ID NO: 268349 - DNA, 75 bp, Artificial Sequence
  Synthetic
gagggcttaaaatagaaataaatgctgatatgtctaaatggagtgcccaagatgtactttttaagtatttctggc

SEQ ID NO: 268350 - DNA, 75 bp, Artificial Sequence
  Synthetic
aaagagagatgcaaattaaaccctgaagaaatgataagcgagccaggtgactcaaagttaagggtattagaaaag

SEQ ID NO: 268351 - DNA, 75 bp, Artificial Sequence
  Synthetic
tgatagtgcttgatcctattttgtatcctgctgagaggaagaggataatttactttctctgtaattatatgcaaa

SEQ ID NO: 268352 - DNA, 75 bp, Artificial Sequence
  Synthetic
caatcagaagacgaaattaggtatatcagctacacgataaagacattagggaatgccatagaaagtttgcaatct

SEQ ID NO: 268353 - DNA, 75 bp, Artificial Sequence
  Synthetic
gaatgccatagaaagtttgcaatctgggtctttaaattgggcagatatatgcgaaaataaggcaagagggcttaa

SEQ ID NO: 268354 - DNA, 75 bp, Artificial Sequence
  Synthetic
aaaggcttataatgcctgatgaattgctcactacgatattggaccagagggttccttattcaaatgatataattg

SEQ ID NO: 268355 - DNA, 75 bp, Artificial Sequence
  Synthetic
gattgatgacaaacaattatagatccaatacagtagaaataaagcgcaactggcttcaaggcaatttaaattata

SEQ ID NO: 268356 - DNA, 75 bp, Artificial Sequence
  Synthetic
ttaaatatttttggttgatagtacttgaccccatattatatcctgctgagaggaaaagaataatttatttcctct

SEQ ID NO: 268357 - DNA, 75 bp, Artificial Sequence
  Synthetic
caatacagtagaaataaagcgcaactggcttcaaggcaatttaaattatacaagcagttacttgcatagttgtag

SEQ ID NO: 268358 - DNA, 75 bp, Artificial Sequence
  Synthetic
tatgtctgtatataaagatataataagggaagcagcaacattattagagggggaagcccttgtgaattcaatggt

SEQ ID NO: 268359 - DNA, 75 bp, Artificial Sequence
  Synthetic
atattggatcaaagagttccctattcaaatgatataattgggttaatgacaaacaattataggtccaatacggta

SEQ ID NO: 268360 - DNA, 75 bp, Artificial Sequence
  Synthetic
acattctgacgataatcaaacatccatatgtatggtgcaaaacaagctgccagatgacaatataattgaattttg

SEQ ID NO: 268361 - DNA, 75 bp, Artificial Sequence
  Synthetic
caaatgatataattgggttaatgacaaacaattataggtccaatacggtagaaataaagcgtaactggcttcaag

SEQ ID NO: 268362 - DNA, 75 bp, Artificial Sequence
  Synthetic
cattaagatattcgagaagatatgtttaacttttggaaatcaggcgaacatgaaaaagacatacctaaccaattt

SEQ ID NO: 268363 - DNA, 75 bp, Artificial Sequence
  Synthetic
gcaatttgaattatacaagcagttacttacacagctgtagtatgtctgtatacaaagatataataagggaagcat

SEQ ID NO: 268364 - DNA, 75 bp, Artificial Sequence
  Synthetic
catcaaggaatttgtttctttattcaatatacacggggagccattctctatatatgggagatttttgcttacggc

SEQ ID NO: 268365 - DNA, 75 bp, Artificial Sequence
  Synthetic
caacattattggaaggagaggcccttgtgaactcaatggtacattctgatgacaatcaaacatctatatgtatgg

SEQ ID NO: 268366 - DNA, 75 bp, Artificial Sequence
  Synthetic
agtaggggactgtgcctatctggggccttatgaagatttagcaagcaggctatctgcaacacaaaccgctataaa

SEQ ID NO: 268367 - DNA, 75 bp, Artificial Sequence
  Synthetic
tgcaaaataaattaccagatgataatataattgaattttgcatcaagatattcgaaaagatatgtttaacttttg

SEQ ID NO: 268368 - DNA, 75 bp, Artificial Sequence
  Synthetic
gcaatcaggcaaacatgaagaagacatatctgactaatttcatcaaagagtttgtttctttatttaatatacatg

SEQ ID NO: 268369 - DNA, 75 bp, Artificial Sequence
  Synthetic
gcatggttgcccaccatcactagcatgggtatccattgctttaaatcactggataactcacaccacgtataatat

SEQ ID NO: 268370 - DNA, 75 bp, Artificial Sequence
  Synthetic
gtgaaccattttctgtatatgggagatttttactcacagcagtaggagactgtgcctacctagggccctacgaag

SEQ ID NO: 268371 - DNA, 75 bp, Artificial Sequence
  Synthetic
atttttactcacagcagtaggagactgtgcctacctagggccctacgaagatttagcaagtaggctatctgcaac

SEQ ID NO: 268372 - DNA, 75 bp, Artificial Sequence
  Synthetic
gttgcctggccaaaataacgacccattaccattcttccctactaacaatagaaatgaaataccagtggagatgtg

SEQ ID NO: 268373 - DNA, 75 bp, Artificial Sequence
  Synthetic
cggaatactagaaagcgacttatcaacaattgcactaactggtttggaagcaggaaatgttacgtttttaacaaa

SEQ ID NO: 268374 - DNA, 75 bp, Artificial Sequence
  Synthetic
acaaactgctataaagcatggttgcccaccatcacttgcatgggtatctattgctctaaatcactggataaccca

SEQ ID NO: 268375 - DNA, 75 bp, Artificial Sequence
  Synthetic
tatagcaagaaaattgtcatctccgatcttgcaaagagaaagtatccaagatcaatataattctatagaaaaatg

SEQ ID NO: 268376 - DNA, 75 bp, Artificial Sequence
  Synthetic
caccacatataacatgttgcctggccaaaataatgacccgttaccatttttccctaccaacaatagaagcgaaat

SEQ ID NO: 268377 - DNA, 75 bp, Artificial Sequence
  Synthetic
atcaatataattctatagaaaaatgggacctaagtaggttatcgcagatcgacattctgaggcttaaaatgctta

SEQ ID NO: 268378 - DNA, 75 bp, Artificial Sequence
  Synthetic
accagtggagatgtgcgggatactagaaagtgacctatcaacaattgcgctaactggtttagaagcaggaaatgt

SEQ ID NO: 268379 - DNA, 75 bp, Artificial Sequence
  Synthetic
ggtacatatctcttgatagttcggtcacatctgatgatggtatgggagagactagtgaaatgagatcccgatcac

SEQ ID NO: 268380 - DNA, 75 bp, Artificial Sequence
  Synthetic
cacgtttctaacaaatatagcaaaaaaattatcatctccaatcttacaaagagaaagtattcaagatcagtataa

SEQ ID NO: 268381 - DNA, 75 bp, Artificial Sequence
  Synthetic
ttttaacacctcgcaaattcacaacaagtgggtcgcttaataggctgaaatcgtataaagattttcaaaatataa

SEQ ID NO: 268382 - DNA, 75 bp, Artificial Sequence
  Synthetic
ttctatagaaaagtgggatttgagtaagttatcacaaattgacattctaaggcttaaaatgcttaggtacatatc

SEQ ID NO: 268383 - DNA, 75 bp, Artificial Sequence
  Synthetic
tagcagatgaggacaagacaaacgagctattcgagaatttcattaggcatccagagctattggtcacaaaaggcg

SEQ ID NO: 268384 - DNA, 75 bp, Artificial Sequence
  Synthetic
tcttgatagttcagtaacatctgatgatggtatgggagagactagtgaaatgagatctcgatcacttttgacacc

SEQ ID NO: 268385 - DNA, 75 bp, Artificial Sequence
  Synthetic
aaacatttgaagaatttgttaacacaatattatttaggtacaattcaaagaaattcaaagaatctctgtcaatac

SEQ ID NO: 268386 - DNA, 75 bp, Artificial Sequence
  Synthetic
tcgtaaattcacaacaagtggatcgctgaataggctgaaatcatacaaagactttcaagatataatagcagatga

SEQ ID NO: 268387 - DNA, 75 bp, Artificial Sequence
  Synthetic
aaaatccagcacaactttttattgagcaaatattgttttccaacaaaccaataattgactacactagcatacatg

SEQ ID NO: 268388 - DNA, 75 bp, Artificial Sequence
  Synthetic
ctgaataggctgaaatcatacaaagactttcaagatataatagcagatgaggacaagacgaatgaactatttgag

SEQ ID NO: 268389 - DNA, 75 bp, Artificial Sequence
  Synthetic
ataagatttttggattacaagatatgccaggaattgaagaattagatacaattataggccgaaaaacatttgttg

SEQ ID NO: 268390 - DNA, 75 bp, Artificial Sequence
  Synthetic
aaagttatgtccagatcgtagatgatttaagcaacttaacattggatattaatgacgtcaagactatattcgcct

SEQ ID NO: 268391 - DNA, 75 bp, Artificial Sequence
  Synthetic
aatctttgtcaatacaaaacccagcacagctttttattgaacaaatattattttccaataaaccagtaattgatt

SEQ ID NO: 268392 - DNA, 75 bp, Artificial Sequence
  Synthetic
tctgtctcatgaatgatccgctactaattacatctgctaacaacataataatgtctgttaaagggcatagccaag

SEQ ID NO: 268393 - DNA, 75 bp, Artificial Sequence
  Synthetic
acactagcatacatgataagatttttggattacaggacatgccaggaattgaagaattagatacaatcataggtc

SEQ ID NO: 268394 - DNA, 75 bp, Artificial Sequence
  Synthetic
aaagaataggacagtcagcatgcaaaatgccagaagtccgaagtctaaagcttatacattattcaccagcagttg

SEQ ID NO: 268395 - DNA, 75 bp, Artificial Sequence
  Synthetic
gtaaaacatttgttgaaagttatgttcagatcgtagacgacttaagcaatttaacattggatataaacgatgtca

SEQ ID NO: 268396 - DNA, 75 bp, Artificial Sequence
  Synthetic
ttttgagagcctatgtgagagggccaacaaatgtgccaaatgtagatatagatgagcttgcgagggatttatctc

SEQ ID NO: 268397 - DNA, 75 bp, Artificial Sequence
  Synthetic
agactatatttgctttttgcctcatgaatgatccgctactgatcacatctgctaataatataataatgtctgtta

SEQ ID NO: 268398 - DNA, 75 bp, Artificial Sequence
  Synthetic
atctggaagactttatacaaagcacaaaactcagagagaatatgagagagaggatagaaataaatgaaaaacggc

SEQ ID NO: 268399 - DNA, 75 bp, Artificial Sequence
  Synthetic
agggacatagtcaggaaagaataggtcaatcagcatgcaaaatgccagaagtccgaagtctaaaacttatacatt

SEQ ID NO: 268400 - DNA, 75 bp, Artificial Sequence
  Synthetic
atttaggaagggatttcaagtttgagatcaaagaattgactagattttaccaagtgtgttatgattatataaaat

SEQ ID NO: 268401 - DNA, 75 bp, Artificial Sequence
  Synthetic
attcaccagcagttgttttgagagcttatgtgagagggccgacaaatgtgccgaatgtagatatagatgagctcg

SEQ ID NO: 268402 - DNA, 75 bp, Artificial Sequence
  Synthetic
ctacagaacataaaattaaggtattcatcttgccatacaaagttttcacatcaatagaattctgcggcgcactga

SEQ ID NO: 268403 - DNA, 75 bp, Artificial Sequence
  Synthetic
caagagatctatctcatttagaagacttcatacaaagtacaaaactcagagaaaatatgagagaaagaatagaag

SEQ ID NO: 268404 - DNA, 75 bp, Artificial Sequence
  Synthetic
caggcaacttaataaatgacaaattgtggtacataacgcattacttaaaaaatatagtgtctactacacataagg

SEQ ID NO: 268405 - DNA, 75 bp, Artificial Sequence
  Synthetic
taaatgagaagcggcacttaggaagggatttcaaatttgaaatcaaagaactgactagattctaccaggtgtgtt

SEQ ID NO: 268406 - DNA, 75 bp, Artificial Sequence
  Synthetic
cacaaatttcgtcctcacctgaattggaattgcaaatagctgatgaagcactgagactaatagcacattttgctg

SEQ ID NO: 268407 - DNA, 75 bp, Artificial Sequence
  Synthetic
atgattatataaaatctacagaacataaagtcaaagtattcatattgccatacaaagttttcacatcaatagaat

SEQ ID NO: 268408 - DNA, 75 bp, Artificial Sequence
  Synthetic
acactttcttggcatctgaatcaagaattcaatttctgaaaaaggttattgaagaattcacatacaaggggatac

SEQ ID NO: 268409 - DNA, 75 bp, Artificial Sequence
  Synthetic
ctgtaaaacatttatattccaaaataaagaattccaagttaagggtcaaatttttagggattcttctgtggttag

SEQ ID NO: 268410 - DNA, 75 bp, Artificial Sequence
  Synthetic
tgcagataaatcagatgaaaagatcatatggaacaactggcaagtttcaagagatatgaatactggaccgataga

SEQ ID NO: 268411 - DNA, 75 bp, Artificial Sequence
  Synthetic
cttaatgataagcggttattctaggcagctgcggattactggggaagatgacaaattgattgctgctgaattgca

SEQ ID NO: 268412 - DNA, 75 bp, Artificial Sequence
  Synthetic
atgatctaacgcaaagtgatttagataagtttgatgcagataaatcagatgaaaagattatatggaataactggc

SEQ ID NO: 268413 - DNA, 75 bp, Artificial Sequence
  Synthetic
aagtgtcaagagatatgaataccggaccaatagatttaatgataagtggttattccaggcagctgcggatcacag

SEQ ID NO: 268414 - DNA, 75 bp, Artificial Sequence
  Synthetic
agtcactagactgtctgaagatttaatttataggcacggtcaagcaatgttgaataagccacacggcttaaaact

SEQ ID NO: 268415 - DNA, 75 bp, Artificial Sequence
  Synthetic
gggaagatgataaattgattgctgctgaattacaagttactagattgtcagaagatttgatttatagacacggcc

SEQ ID NO: 268416 - DNA, 75 bp, Artificial Sequence
  Synthetic
tgaaaaaatgcaacctgtgactgaaatgtctaagcaattacattatattgtttttcagcagagatcacggaaacg

SEQ ID NO: 268417 - DNA, 75 bp, Artificial Sequence
  Synthetic
aggcgatgttaaataagccgcacggattaaagcttgaaaaaatgcagcctgtaactgagatgtctaaacaactac

SEQ ID NO: 268418 - DNA, 75 bp, Artificial Sequence
  Synthetic
atatttctattctatattgcctacccaagtaattgaagaccataattctagagttgaatcatctagactgagcag

SEQ ID NO: 268419 - DNA, 75 bp, Artificial Sequence
  Synthetic
attatatcgttttccagcagagatcaagaaagcggtatttctattctatattgcctacccaaataattgaagacc

SEQ ID NO: 268420 - DNA, 75 bp, Artificial Sequence
  Synthetic
agattcaaaatgggttcctgtatgtcctgtcgcaatatcaaaactataccagcaaggacgacctatactttctaa

SEQ ID NO: 268421 - DNA, 75 bp, Artificial Sequence
  Synthetic
acaattctagagtcgaatcatctagattaaacagagattcaaaatgggttcctgtatgtcctgttgcagtatcaa

SEQ ID NO: 268422 - DNA, 75 bp, Artificial Sequence
  Synthetic
agttaggaatctgaatatgcaaactcattcactttctagaatacaagttaatgtagacgaatatgccattactag

SEQ ID NO: 268423 - DNA, 75 bp, Artificial Sequence
  Synthetic
aactctatcaacaaggacgacctatactctccaaagttaagaatctgaatatgcaaactcattcactttctagaa

SEQ ID NO: 268424 - DNA, 75 bp, Artificial Sequence
  Synthetic
aagagcacatttccagaaaatgcctttctttgaaggaccatcaattccttctggcggtatggatttatcagagtt

SEQ ID NO: 268425 - DNA, 75 bp, Artificial Sequence
  Synthetic
aatgaaatccacatccttattaagcttgaattatgataacataaaaaatgcttctctattagatatgtctagggt

SEQ ID NO: 268426 - DNA, 75 bp, Artificial Sequence
  Synthetic
tacaggttaatgtagatgaatatgctattacaagaagagcgcatttccaaaaaatgcctttctttgaaggaccat

SEQ ID NO: 268427 - DNA, 75 bp, Artificial Sequence
  Synthetic
atttaagtgcaatggcagtgaagatgaccaaatggctttcgaattcctatcggacgaagttttagagcaagatgt

SEQ ID NO: 268428 - DNA, 75 bp, Artificial Sequence
  Synthetic
ccatcccttctggtggcatggatctatcagagttaatgaaatccacatccttattgagcttaaattatgataata

SEQ ID NO: 268429 - DNA, 75 bp, Artificial Sequence
  Synthetic
taaaaaatgcttctttattggatatgtctagagtattcaagtgcaatggcagtgagaatgaccaaatggcttttg

SEQ ID NO: 268430 - DNA, 75 bp, Artificial Sequence
  Synthetic
aattgaagaaatagaatgcaaccctatattttctatcagttatacaaaaagaggagaatccaacatgacttataa

SEQ ID NO: 268431 - DNA, 75 bp, Artificial Sequence
  Synthetic
gtctagagtattcaagtgcaatggcagtgagaatgaccaaatggcttttgaattcctttcagatgaaattctaga

SEQ ID NO: 268432 - DNA, 75 bp, Artificial Sequence
  Synthetic
aaatgcctttcacaaagccttaatctcagaatgtgataaatttgaagaagcatttgactttctcgacatgggatt

SEQ ID NO: 268433 - DNA, 75 bp, Artificial Sequence
  Synthetic
tcagaatgtgataaatttgaagaagcatttgactttctcgacatgggattttgctcgaacgaaaatcttagcatt

SEQ ID NO: 268434 - DNA, 75 bp, Artificial Sequence
  Synthetic
tggattatcagttatttaaaaacgaatcagtggtccacagaactagacaattgtattcacatgtgtatgtatagg

SEQ ID NO: 268435 - DNA, 75 bp, Artificial Sequence
  Synthetic
ctggaggaaatacattggataatcagttatttaaaaacaaatcaatggtctacggaactagataattgtattcac

SEQ ID NO: 268436 - DNA, 75 bp, Artificial Sequence
  Synthetic
aatgggtatgatgcagagtatcataaatttgatataccttctaaattcctcaaagacccaataaaccgaacaata

SEQ ID NO: 268437 - DNA, 75 bp, Artificial Sequence
  Synthetic
attcacatgtgtatgtacaggaacgggtatgatacagaatatcataaatttgacataccctctaaattcctcaaa

SEQ ID NO: 268438 - DNA, 75 bp, Artificial Sequence
  Synthetic
aattggacagaggttattgaattcatattattaattgaagatttccaaacaaaaattgaaccatggtcgagtatg

SEQ ID NO: 268439 - DNA, 75 bp, Artificial Sequence
  Synthetic
cacatcaatagaattctgtggcgcattgacaggcaacttgataaatgacaagttatggtacataacgcactactt

SEQ ID NO: 268440 - DNA, 75 bp, Artificial Sequence
  Synthetic
agattggtgaccgctgttttgctggtggtagcctttttaaagaaatgaacctgagtgtgggacttggcgaaatat

SEQ ID NO: 268441 - DNA, 75 bp, Artificial Sequence
  Synthetic
gagtatgaagtcacatttctgttcaaaagcacacagcgtagcattagagtgtatgaaaaatgagaaaagatcact

SEQ ID NO: 268442 - DNA, 75 bp, Artificial Sequence
  Synthetic
ttctagagcaagacgtagttgaagaaatagaatgcaaccctatattttctatcagttatacaaaaagaggagaat

SEQ ID NO: 268443 - DNA, 75 bp, Artificial Sequence
  Synthetic
gcgtcaaagacgacatatctattgttaagagtacaactgcctttagtaagaatacactagcactcgaagcaacta

SEQ ID NO: 268444 - DNA, 75 bp, Artificial Sequence
  Synthetic
agtagtgtgctccacaattcaaaacataaaaagaaattttaataatgtcagagttcattttcaatgatgtaccac

SEQ ID NO: 268445 - DNA, 75 bp, Artificial Sequence
  Synthetic
atggggttttgctcaaatgagaaccttagtattttagaggaaatacattggattatcagttatttaaaaacgaat

SEQ ID NO: 268446 - DNA, 75 bp, Artificial Sequence
  Synthetic
caaaattctataggtcttttatcgtcaaagactggtctgaatgcaatccagtattagataagcttgggaatttca

SEQ ID NO: 268447 - DNA, 75 bp, Artificial Sequence
  Synthetic
aacggactacatctacatttgatccggaggcagcatatgtggcatttgaagctagatacggacaagtgctcaatg

SEQ ID NO: 268448 - DNA, 75 bp, Artificial Sequence
  Synthetic
tgagggttaaatttctagggatccttttatggttagatgatctaacacagaatgatctggataaatttgatgcag

SEQ ID NO: 268449 - DNA, 75 bp, Artificial Sequence
  Synthetic
tggttctgaatgttgatgataacgggcatttagtccctaggatgtatacatgcagagcagcatgtgatattagat

SEQ ID NO: 268450 - DNA, 75 bp, Artificial Sequence
  Synthetic
ctggtgttgttagagtcttcttcctcaaccaaaagaaggccaaagatgtcttacgtaagacatcgaggcccatgg

SEQ ID NO: 268451 - DNA, 75 bp, Artificial Sequence
  Synthetic
ttacgtaagacatcgaggcccatggttgaccttacttttggtggggtccaatttgcaatggttaataaccatttc

SEQ ID NO: 268452 - DNA, 75 bp, Artificial Sequence
  Synthetic
tgaataaagacaatgcagaaataatattgtcatcgacaaagcttaaccactttgaaattgttgggacaacttcaa

SEQ ID NO: 268453 - DNA, 75 bp, Artificial Sequence
  Synthetic
catcaggttggtttaagaatacaataacaaataatctagaacatacatgcgaacatgtgactgttaattgcggtc

SEQ ID NO: 268454 - DNA, 75 bp, Artificial Sequence
  Synthetic
agaaatcagtaaaattccatgcatgctttcggcagcataggggttgtataagattctttaaagggacatacatgc

SEQ ID NO: 268455 - DNA, 75 bp, Artificial Sequence
  Synthetic
ttaaacaagctgagtttagggccactgtggtagtgcctttggcagaggtgaagggctgtacttggaatgatggtg

SEQ ID NO: 268456 - DNA, 75 bp, Artificial Sequence
  Synthetic
cgtattcaatgattgaagcaatgtgcattaatatagaattaataatcctaacattgtatatctttgctgcaatta

SEQ ID NO: 268457 - DNA, 75 bp, Artificial Sequence
  Synthetic
aagggctgtacttggaatgatggtgatgcaatgtatctgggatttgctgccggtgccgagatgtttttgcagaca

SEQ ID NO: 268458 - DNA, 75 bp, Artificial Sequence
  Synthetic
ttcactttcttccctttggtgattgagatgcacagggtcctcaaggacggcatggatgtcaactttatgaagaaa

SEQ ID NO: 268459 - DNA, 75 bp, Artificial Sequence
  Synthetic
tatttgcactaatcataacgaagagctatatagcatacttactcctaccattgttctatccggtaacctggcttt

SEQ ID NO: 268460 - DNA, 75 bp, Artificial Sequence
  Synthetic
agatgcacagggtcctcaaggacggcatggatgtcaactttatgaagaaagtccttcggcagaggtatggccaga

SEQ ID NO: 268461 - DNA, 75 bp, Artificial Sequence
  Synthetic
acggaaaagtttacaaaaggattaattcatgctctaattgcctacttgcatcacatccctttactagctgcccga

SEQ ID NO: 268462 - DNA, 75 bp, Artificial Sequence
  Synthetic
tttgaggctgtaggcactctggcctgggccagaactggattctccccagcagcaagagacttcttgcgccaattc

SEQ ID NO: 268463 - DNA, 75 bp, Artificial Sequence
  Synthetic
agatctgcatatgtggctctagatttagctgcacagaagccctcaaagtacacaggatgggtaaagactgtctag

SEQ ID NO: 268464 - DNA, 75 bp, Artificial Sequence
  Synthetic
tgggccagaactggattctccccagcagcaagagacttcttgcgccaattcggaattgacatatagtggagtaca

SEQ ID NO: 268465 - DNA, 75 bp, Artificial Sequence
  Synthetic
gttataaatccctaagcaaagctagacagatgtgcaaatctaaaagctggtcattcacagcagctatactaactg

SEQ ID NO: 268466 - DNA, 75 bp, Artificial Sequence
  Synthetic
gcttaatattgatggaatttgtttcaccaattgcaggtgaaaggatgtacaaacttgaagagctggccgacgatt

SEQ ID NO: 268467 - DNA, 75 bp, Artificial Sequence
  Synthetic
acatagaaatggcagagcgggtgggtatgttagaaaaagaaataaaagttttaaaacagttcacgattgtcatgc

SEQ ID NO: 268468 - DNA, 75 bp, Artificial Sequence
  Synthetic
atttgcaatggttaataaccatttcccacagttccagtcgaatccagtgccggacaacggtcttaccttgcaccg

SEQ ID NO: 268469 - DNA, 75 bp, Artificial Sequence
  Synthetic
cggacaacggtcttaccttgcaccgtctgtcgggatacctagctcgctgggcatttacccagatgcgatcaccaa

SEQ ID NO: 268470 - DNA, 75 bp, Artificial Sequence
  Synthetic
ttgtaattattctgatactgctgctttttgaaaacacaatcttcaattacctctttaacaccctttatcgttctt

SEQ ID NO: 268471 - DNA, 75 bp, Artificial Sequence
  Synthetic
ttaagcaagctgagttcagggccactgtggtagtgcctttggcagaggtgaagggctgtacttggaacgacggtg

SEQ ID NO: 268472 - DNA, 75 bp, Artificial Sequence
  Synthetic
gttctatgtgtgggttgatacactatagaccagggctcaaggttgatttgaccaagactaacaaatgcgggagtt

SEQ ID NO: 268473 - DNA, 75 bp, Artificial Sequence
  Synthetic
aagggctgtacttggaacgacggtgacgcaatgtatctgggatttgctgctggtgctgaaatgtttctgcagaca

SEQ ID NO: 268474 - DNA, 75 bp, Artificial Sequence
  Synthetic
gcatttgcggatttgacgagcaacaatcatctgggtttgaatacgaagtattcttaaaggacatgcatattcaaa

SEQ ID NO: 268475 - DNA, 75 bp, Artificial Sequence
  Synthetic
gggaatcttgcaaatttggacctagagtaaatcactttaggaacaccaagattttgttgtttacaattgctattt

SEQ ID NO: 268476 - DNA, 75 bp, Artificial Sequence
  Synthetic
agatgcacagggtcctcaaggacggtatggatgtcaactttatgaagaaagttctccggcagaggtacggtcaga

SEQ ID NO: 268477 - DNA, 75 bp, Artificial Sequence
  Synthetic
gcacttctttttatacagtttatgcagatgaagactgcttgtccaagaatattaagataacatatcaagaattac

SEQ ID NO: 268478 - DNA, 75 bp, Artificial Sequence
  Synthetic
tttgaggctgtaggcactctggcctgggccaggactgggttctctccagcagcaagagacttcttgcgccaattc

SEQ ID NO: 268479 - DNA, 75 bp, Artificial Sequence
  Synthetic
acaattgtataggaccatacataatgggcgacacctgtgtgtcaaaaagtgaattatattctgatctgctttcaa

SEQ ID NO: 268480 - DNA, 75 bp, Artificial Sequence
  Synthetic
caggactgggttctctccagcagcaagagacttcttgcgccaattcggaattggcatatagtggagcacactact

SEQ ID NO: 268481 - DNA, 75 bp, Artificial Sequence
  Synthetic
agtagtgtactcctatttcaaaacaaacaaaaacaatctcaaaatgtcgcagctgttactcaaccagtatcgaaa

SEQ ID NO: 268482 - DNA, 75 bp, Artificial Sequence
  Synthetic
agaatttaatcacagaatatgacaaaaaatattttgaaccagacactgtaaatgaccaattcaacaaaattgaat

SEQ ID NO: 268483 - DNA, 75 bp, Artificial Sequence
  Synthetic
agctgttactcaaccagtatcgaaataggatattgcactgccgtgaacctgaaatagcgaaggatatatggcgtg

SEQ ID NO: 268484 - DNA, 75 bp, Artificial Sequence
  Synthetic
tcgctcaggatgcacacagaatgatactgttggaaagaatactttataagaccgaatgcgagatgctgagcttaa

SEQ ID NO: 268485 - DNA, 75 bp, Artificial Sequence
  Synthetic
agaagaatagtggaccttacaatgttgcttggcgcacatacttgaaaaatcataacatagatttgtgcagcaggc

SEQ ID NO: 268486 - DNA, 75 bp, Artificial Sequence
  Synthetic
tccctgctgaggatatttgcgctgaagtccttgatggttacaaagcaaggaaagtgcgtttttgtacacctgata

SEQ ID NO: 268487 - DNA, 75 bp, Artificial Sequence
  Synthetic
ataattacaaaatgatatgccagtgtatcaatatgcattctatgtgtaaaaatacagatatagacttcaacaatg

SEQ ID NO: 268488 - DNA, 75 bp, Artificial Sequence
  Synthetic
attacttactgcatgacgggaaaatgtatataatagatttcaaagtatctgtagatgatcgatcttccaggatta

SEQ ID NO: 268489 - DNA, 75 bp, Artificial Sequence
  Synthetic
aaattgaaacatattataaggccaatgccgcagcttataggtctgacttctacacaataatagatacactgaaaa

SEQ ID NO: 268490 - DNA, 75 bp, Artificial Sequence
  Synthetic
caagggagaaatacaatgagatttttggagaggtgttcaatccagaaggtgtagactttgaaattgttattatta

SEQ ID NO: 268491 - DNA, 75 bp, Artificial Sequence
  Synthetic
cagcatttagaggacttacgaaagtactgatcgaaaattacatagaaaaagatgattctgatgctctaaaggctt

SEQ ID NO: 268492 - DNA, 75 bp, Artificial Sequence
  Synthetic
ggttggatccttcaaatatggctatacatgtggattctcgagatttcatgaatacgattggaccaatcacattaa

SEQ ID NO: 268493 - DNA, 75 bp, Artificial Sequence
  Synthetic
tgtttagcaatattactaattctgttcaggacaactatcagatggttggcgtactaaaatttgctagcaagttac

SEQ ID NO: 268494 - DNA, 75 bp, Artificial Sequence
  Synthetic
acattagtatgcaatggttttttgacatgaaagacttcttatttggcaaatttcgagatgatgataaattccatg

SEQ ID NO: 268495 - DNA, 75 bp, Artificial Sequence
  Synthetic
taaatattagtttaggtaggtctacccgctcggctcaacattcaataatgactaatgaaatccctaagtcaaacc

SEQ ID NO: 268496 - DNA, 75 bp, Artificial Sequence
  Synthetic
ccataataagtcaaggagaattcacaatgacattgccatggattgaagaagataccccagaattgcttactcatc

SEQ ID NO: 268497 - DNA, 75 bp, Artificial Sequence
  Synthetic
cttttactgattatagttattctagcgtcaacattaaagaatgtatgtcgccagagagcttaaaatgttttaaga

SEQ ID NO: 268498 - DNA, 75 bp, Artificial Sequence
  Synthetic
caatatacaatgaatttatgaattcaatgccagaagcagaacaggctttattcaaagaagcattggaattcaaat

SEQ ID NO: 268499 - DNA, 75 bp, Artificial Sequence
  Synthetic
aaagagacagtgtaccgcatacgaaccatttgctctgtaagatggataacaagtataaagcatttgactggccag

SEQ ID NO: 268500 - DNA, 75 bp, Artificial Sequence
  Synthetic
cattcggagcggagaaatggaatatttttttaaaaggggtaatgtccaggtatggtgaatattataaagagttta

SEQ ID NO: 268501 - DNA, 75 bp, Artificial Sequence
  Synthetic
aaatagagacagttcaaaaagggcaaaagttgtgtcttggtgatagccactgtaacttagaatttacagctataa

SEQ ID NO: 268502 - DNA, 75 bp, Artificial Sequence
  Synthetic
ctaaagggcatgcacaatctatattcttgacaacaggagattaccccaggccagataaggaccaaatttcggccg

SEQ ID NO: 268503 - DNA, 75 bp, Artificial Sequence
  Synthetic
ctgcagacaagattatgtcattaactaattgttacaaagagtctttcactgcacagcctgctgacatgcaaactg

SEQ ID NO: 268504 - DNA, 75 bp, Artificial Sequence
  Synthetic
gctggcgagaaatggtgagtagagtaagctctgaacgtgacatgtcaaatgatataaatcaggaaaaaccaagca

SEQ ID NO: 268505 - DNA, 75 bp, Artificial Sequence
  Synthetic
gtatcaaaaaatgttcagctgacgagatcggagaatgtataacccttgaggataaagcgtggccaattgttgtct

SEQ ID NO: 268506 - DNA, 75 bp, Artificial Sequence
  Synthetic
gcggagacaaatactattactctgatggtaaagaacatgcaaaagatgggtctattaacaattattgtcttgcaa

SEQ ID NO: 268507 - DNA, 75 bp, Artificial Sequence
  Synthetic
tgcaagctatgagtgggacagggagctatgtaagtgctttcaaatcattaggaagactaatggatatatcatcag

SEQ ID NO: 268508 - DNA, 75 bp, Artificial Sequence
  Synthetic
ataaatgctctgaacagcgatttccaatacataaaaattggttcaaaaaatgcaactgggacaaaactcacaaag

SEQ ID NO: 268509 - DNA, 75 bp, Artificial Sequence
  Synthetic
atattaagaaatatgaatcattttgtggaaagttaaaatctctagcaagatctagtgtgaagaaacttgacagga

SEQ ID NO: 268510 - DNA, 75 bp, Artificial Sequence
  Synthetic
agttcaccactatgaggcaaataaattacaatgacataacttcatacagaaaggcaattgaatcagaaataggaa

SEQ ID NO: 268511 - DNA, 75 bp, Artificial Sequence
  Synthetic
aaatagaaccaatacaaattggaacagcaactgtcttatgggagcaacaattcaaattagatacggatgttataa

SEQ ID NO: 268512 - DNA, 75 bp, Artificial Sequence
  Synthetic
cagacctaatgacacatcattacaaacccacaaagaatctcccacatgttgttccacgatatcacagtatagatg

SEQ ID NO: 268513 - DNA, 75 bp, Artificial Sequence
  Synthetic
aaagggaagatagaatacacttaatgaaagactattttggaattggtaaacacaagtctttttcaaaaaagctaa

SEQ ID NO: 268514 - DNA, 75 bp, Artificial Sequence
  Synthetic
ttcaaggtacagaatcaacagaaggcattattaatgggttcatacaaaatacaatacctgctatcagcggcttag

SEQ ID NO: 268515 - DNA, 75 bp, Artificial Sequence
  Synthetic
acagtgacataaatactgataagcctaagatattgaattttgataatgacgacatagttaggaaatgcaaagaca

SEQ ID NO: 268516 - DNA, 75 bp, Artificial Sequence
  Synthetic
gtgttggctatcacttaggtttcagaggaaatcaactatttgatatagttatttttgttaaaaaggctgtatata

SEQ ID NO: 268517 - DNA, 75 bp, Artificial Sequence
  Synthetic
aatataatcaagtcacacataacttatctcaagtcaatgaattggacaagattgggaactacctagagcactttt

SEQ ID NO: 268518 - DNA, 75 bp, Artificial Sequence
  Synthetic
aagcacaatatcagaaagtgtacacaactggacccagtatatctataaatattgaacacaatgaaaagtgtacag

SEQ ID NO: 268519 - DNA, 75 bp, Artificial Sequence
  Synthetic
cagctaagattagtgcctgtagtgtagaaatgtgggactttatatataatacgactaaaactaagtattggcagt

SEQ ID NO: 268520 - DNA, 75 bp, Artificial Sequence
  Synthetic
gccactgtcccgaaaaaatacctgcaaaagaaggttggttgacattttctaaggaacatacaagctcttgggggt

SEQ ID NO: 268521 - DNA, 75 bp, Artificial Sequence
  Synthetic
gtatcaatgactactctaccttgatgaaaaacatgttagctgtttcccaatataataggcacaatacttttagag

SEQ ID NO: 268522 - DNA, 75 bp, Artificial Sequence
  Synthetic
gtgaggagtatggttgccttgccatagacactggttgcctatatggttcttgccaagatgttatacgtccagaat

SEQ ID NO: 268523 - DNA, 75 bp, Artificial Sequence
  Synthetic
ttgtctcatgtgcaaataataatgtatttggtttagtaatgccaagctcagacataaaaacaaaaaaagcaacat

SEQ ID NO: 268524 - DNA, 75 bp, Artificial Sequence
  Synthetic
tagatatttataagaagattggcagcgaagcatcacttatagaaatatgtataactttgcctcatgagacttatt

SEQ ID NO: 268525 - DNA, 75 bp, Artificial Sequence
  Synthetic
tagtctacgcaataatagctctccacaatgaggaggcagagatagcagaacttggttcactctattctactttta

SEQ ID NO: 268526 - DNA, 75 bp, Artificial Sequence
  Synthetic
gcaatgatatggatatattagaacctattattggagataaattaagtgcatcctttcaaaatacacaaacaaacc

SEQ ID NO: 268527 - DNA, 75 bp, Artificial Sequence
  Synthetic
agacaacaacaggatatatttcaatatcaaaggcttttagactagataaggaaagatgccaacgtatagtgtcct

SEQ ID NO: 268528 - DNA, 75 bp, Artificial Sequence
  Synthetic
aactgccagtcctcatggcttataagaaggggaaagtctatactggacagataaatgatgttgggaacacagcgt

SEQ ID NO: 268529 - DNA, 75 bp, Artificial Sequence
  Synthetic
ctccgggcttatttctcatgacaagctgtctattattcaatggtaataagagtctagaatttgataagttactag

SEQ ID NO: 268530 - DNA, 75 bp, Artificial Sequence
  Synthetic
tacaatgtggttcaatacaagtagtcaatggttcaactattgggtctggcaatcctaaatttgactatatatgcc

SEQ ID NO: 268531 - DNA, 75 bp, Artificial Sequence
  Synthetic
gattttcattctttacatcaatatcgattacaaaagccatgctatctctcacggagccttcgcgctatatgatca

SEQ ID NO: 268532 - DNA, 75 bp, Artificial Sequence
  Synthetic
atgctatgaggcgaaaagacgtcattgtgagaaaatgcttcaatgataattatcagtcttgcactagactggatg

SEQ ID NO: 268533 - DNA, 75 bp, Artificial Sequence
  Synthetic
tgaattcgctggcagtctctagccatgtgagagagtatatatctgaaaaattttctccttacacaaaaacatcat

SEQ ID NO: 268534 - DNA, 75 bp, Artificial Sequence
  Synthetic
cgagaaatgatttaattccttataggaaaggcgatattattgagatatcaaaaacagggtcaaatatgggtcaaa

SEQ ID NO: 268535 - DNA, 75 bp, Artificial Sequence
  Synthetic
tttctgtggtaatgacagatttgattaaaaagggctgctattcagcatacgagcagaggaaaaaggtgcaaataa

SEQ ID NO: 268536 - DNA, 75 bp, Artificial Sequence
  Synthetic
tgacatttaaaatagagttaggcgatattaattataaaatatttactaagtcggtggatctccaaatgtctggta

SEQ ID NO: 268537 - DNA, 75 bp, Artificial Sequence
  Synthetic
gggatataaaattaacagactacgatataacacaaaagggagtagattccaaaagagatcttaaatccatctggt

SEQ ID NO: 268538 - DNA, 75 bp, Artificial Sequence
  Synthetic
tttgtgccggatgcattgattgtgccgaaggcatatcatgttctataaatgccgatgtatcagctgaaactgtct

SEQ ID NO: 268539 - DNA, 75 bp, Artificial Sequence
  Synthetic
tcccagggaaggtaaatttaaaggagtacttgagccagatttatctaccattttattttaattccaaaggactac

SEQ ID NO: 268540 - DNA, 75 bp, Artificial Sequence
  Synthetic
gccattgtaaaacaaactgcgaagactttataagcaatattgtaatctcacctcaaatcaaaacttataatataa

SEQ ID NO: 268541 - DNA, 75 bp, Artificial Sequence
  Synthetic
atgaaaagcatcatgttttaatagatttggctaaaacagtgctagaaattgaaaaagaacaaagggagtcactac

SEQ ID NO: 268542 - DNA, 75 bp, Artificial Sequence
  Synthetic
aagtacattgcaagtcaaaagttgaaaagataacagcaaatatctgtgggagaaatattgacttacaattgacag

SEQ ID NO: 268543 - DNA, 75 bp, Artificial Sequence
  Synthetic
ctgaaccatggtcagagatacctgccaagcagactgtcaacttaaatgttttaatttactcaattgcaagaaatt

SEQ ID NO: 268544 - DNA, 75 bp, Artificial Sequence
  Synthetic
ttaagccgtacaaccaaaagatagatctatcacagctggatgaatcgaattatataaaagaagaagacctccaat

SEQ ID NO: 268545 - DNA, 75 bp, Artificial Sequence
  Synthetic
tgaacttagatacttcgagacataattttgtgagaagtcgagtagaaaatgcaaataactttaacagatctataa

SEQ ID NO: 268546 - DNA, 75 bp, Artificial Sequence
  Synthetic
gtggaacatggctgtgtaaagtccagaaagaagggattgatattgtatttaaaggactattttcaggattaggga

SEQ ID NO: 268547 - DNA, 75 bp, Artificial Sequence
  Synthetic
caacaatatctactttcaccagctcaaaatcgtgtattaagattggtgatttcgaggaggagaaaaagagaaaaa

SEQ ID NO: 268548 - DNA, 75 bp, Artificial Sequence
  Synthetic
aaaatcgtgtattaagattggtgatttcgaggaggagaaaaagagaaaaaccaaaaatgatgcaaagaaactagc

SEQ ID NO: 268549 - DNA, 75 bp, Artificial Sequence
  Synthetic
gctgtgtaaagtccagaaagaagggattgatattgtatttaaaggactattttcaggattagggaaatattggac

SEQ ID NO: 268550 - DNA, 75 bp, Artificial Sequence
  Synthetic
tcacaaatgagcatgagataagacactcaacttacgaggatttaaaacaatccatctcagattacacagactata

SEQ ID NO: 268551 - DNA, 75 bp, Artificial Sequence
  Synthetic
tgtctgtaaaagtttttgacagactatatgagaagattactaccaatgaaataagtgataaagaaacagtcaagc

SEQ ID NO: 268552 - DNA, 75 bp, Artificial Sequence
  Synthetic
atatgagaagattactaccaatgaaataagtgataaagaaacagtcaagctgattttagagactatgaagaagca

SEQ ID NO: 268553 - DNA, 75 bp, Artificial Sequence
  Synthetic
taaaatatttcacttcggatttttcaacaaaggacaaaaaacagctaaagatagagaaatatttttaggtgaatt

SEQ ID NO: 268554 - DNA, 75 bp, Artificial Sequence
  Synthetic
aacaaaggacaaaaaacagctaaagatagagaaatatttttaggtgaatttgaagcaaaaatgtgcctgtacctt

SEQ ID NO: 268555 - DNA, 75 bp, Artificial Sequence
  Synthetic
gtcgaaagaatagctaaagagagatgcaaattaaacccagaagagatgataagtgaaccaggtgattctaagtta

SEQ ID NO: 268556 - DNA, 75 bp, Artificial Sequence
  Synthetic
agagtattagaaaaacagtcagaagacgaaatcaggtatatcagtaatacaataaagacattggggaatgccata

SEQ ID NO: 268557 - DNA, 75 bp, Artificial Sequence
  Synthetic
gaaaacttgcaatccgggtctttagattgggcagatatatgtgaaaataaggcaagagggctcaaaatagaaata

SEQ ID NO: 268558 - DNA, 75 bp, Artificial Sequence
  Synthetic
aatgctgatatgtctaaatggagtgctcaagatgtactttttaagtatttctggctgatagtactcgatcctatc

SEQ ID NO: 268559 - DNA, 75 bp, Artificial Sequence
  Synthetic
ttgtatcctgctgagagaaagagaataatttatttcctctgtaattacatgcaaaaaaggcttataatgcctgat

SEQ ID NO: 268560 - DNA, 75 bp, Artificial Sequence
  Synthetic
gaattgcttactactatattggaccagagggttccctattcaaatgatataattgggttaatgacaaacaattat

SEQ ID NO: 268561 - DNA, 75 bp, Artificial Sequence
  Synthetic
aggtctaatacagtagaaataaaacgcaactggcttcaaggcaatttaaactatacaagcagctacttgcacagt

SEQ ID NO: 268562 - DNA, 75 bp, Artificial Sequence
  Synthetic
tgtagtatgtctgtatataaagatataataagggaagcagcaacattattagagggggaagccctcgtgaattca

SEQ ID NO: 268563 - DNA, 75 bp, Artificial Sequence
  Synthetic
taataagggaagcagcaacattattagagggggaagccctcgtgaattcaatggtacactctgatgacaatcaaa

SEQ ID NO: 268564 - DNA, 75 bp, Artificial Sequence
  Synthetic
catccatatgtatggtacagaacaagttgccagacgacaatataattgaattttgcattaagatattcgagaaga

SEQ ID NO: 268565 - DNA, 75 bp, Artificial Sequence
  Synthetic
tatgtttaacttttgggaatcaagctaacatgaagaagacatacctaaccaatttcatcaaggagtttgtttctt

SEQ ID NO: 268566 - DNA, 75 bp, Artificial Sequence
  Synthetic
tattcaatatacatggagagccattctctatatatgggcgatttttgcttacggcagtgggagactgtgcctatc

SEQ ID NO: 268567 - DNA, 75 bp, Artificial Sequence
  Synthetic
tagggccttatgaagatttagcaagtaggctatctgcaacacaaactgctataaagcacggttgcccaccatcac

SEQ ID NO: 268568 - DNA, 75 bp, Artificial Sequence
  Synthetic
ataaagcacggttgcccaccatcactagcatgggtatccattgccttaaatcactggataacccacaccacgtat

SEQ ID NO: 268569 - DNA, 75 bp, Artificial Sequence
  Synthetic
aatatgttgcctggccaaaataacgacccactaccattcttccctactaacaatagaaatgaaataccagtggag

SEQ ID NO: 268570 - DNA, 75 bp, Artificial Sequence
  Synthetic
atgtgcggaatattagaaagcgacctatcgacaattgcactgactggtttagaagcaggaaatgtcacatttttg

SEQ ID NO: 268571 - DNA, 75 bp, Artificial Sequence
  Synthetic
acaaatatagcaagaaaattatcatctccgatcttgcagagagagagtattcaagaccaatataattctatagaa

SEQ ID NO: 268572 - DNA, 75 bp, Artificial Sequence
  Synthetic
tcaagaccaatataattctatagaaaaatgggatctaagtagattatcgcagattgacattctgaggcttaaaat

SEQ ID NO: 268573 - DNA, 75 bp, Artificial Sequence
  Synthetic
gcttaggtacatatctcttgatagttcggttacatctgatgatggtatgggagagactagtgaaatgagatcccg

SEQ ID NO: 268574 - DNA, 75 bp, Artificial Sequence
  Synthetic
atcacttttaacacctcgtaagtttacaacaagtggatcgctcaatagactgaaatcatataaggattttcaaaa

SEQ ID NO: 268575 - DNA, 75 bp, Artificial Sequence
  Synthetic
tataatagcagatgaagacaagacaaatgagctattcgagaatttcatcaggcacccagagttattggtcacaaa

SEQ ID NO: 268576 - DNA, 75 bp, Artificial Sequence
  Synthetic
aggcgaaacattcgaagagtttgttaatacaatattatttagatacaattcaaagaaattcaaagaatctttatc

SEQ ID NO: 268577 - DNA, 75 bp, Artificial Sequence
  Synthetic
aatacaaaatccagcacagctatttattgagcaaatattattttccaacaaaccaataattgactacactagcat

SEQ ID NO: 268578 - DNA, 75 bp, Artificial Sequence
  Synthetic
acatgataagatcttcggattgcaagatatgccagggattgaagaactagatacaatcataggtcgcaaaacatt

SEQ ID NO: 268579 - DNA, 75 bp, Artificial Sequence
  Synthetic
tgttgaaagttatgtccagattgtagacgatttaagcaatttaacattggatataaatgatgtcaagactatatt

SEQ ID NO: 268580 - DNA, 75 bp, Artificial Sequence
  Synthetic
tgccttctgcctcatgaatgacccactactaattacatctgctaacaatataataatgtctgttaaaggacatag

SEQ ID NO: 268581 - DNA, 75 bp, Artificial Sequence
  Synthetic
ccaagaaagaataggacaatcagcatgcaaaatgccagaagtccgaagtctgaagcttatacattattcgccagc

SEQ ID NO: 268582 - DNA, 75 bp, Artificial Sequence
  Synthetic
agttgttttgagagcctacgtgagagggccaacaaatgtgccaaatgtagatatagatgaacttgcgagggatct

SEQ ID NO: 268583 - DNA, 75 bp, Artificial Sequence
  Synthetic
atctcatctggaagactttatacaaagcacaaaactcagagagaatatgagagagagaatagaaataaatgagaa

SEQ ID NO: 268584 - DNA, 75 bp, Artificial Sequence
  Synthetic
acggcatctaggaagggatttcaagttcgaaatcaaagaattgactagattttaccaagtatgttatgattatat

SEQ ID NO: 268585 - DNA, 75 bp, Artificial Sequence
  Synthetic
aaaatccacagaacataaaattaaggtattcatattgccatacaaagttttcacatcaatagaattctgtggcgc

SEQ ID NO: 268586 - DNA, 75 bp, Artificial Sequence
  Synthetic
actgacaggtaatttaataaatgacaaattgtggtacataacacattacttaaaaaatatagtgtctactacaca

SEQ ID NO: 268587 - DNA, 75 bp, Artificial Sequence
  Synthetic
taaagcacaaatttcgtcttcacctgaattggaattgcaaatagctgatgaagcactgagactagtagcacattt

SEQ ID NO: 268588 - DNA, 75 bp, Artificial Sequence
  Synthetic
tgctgatacttttttagcgtccgaatcaagaattcaatttctgaagaaggttatcgaagagttcacatacaaggg

SEQ ID NO: 268589 - DNA, 75 bp, Artificial Sequence
  Synthetic
aatacctgtgaaacatttatattccaaaataaagaattccaagttgagagttaaattcttaggaattcttttatg

SEQ ID NO: 268590 - DNA, 75 bp, Artificial Sequence
  Synthetic
gttagatgatctaacgcaaaatgatctagataaatttgatgcggataaatcagatgaaaagattatatggaataa

SEQ ID NO: 268591 - DNA, 75 bp, Artificial Sequence
  Synthetic
ctggcaagtatcaagagatatgaatactgggccaatagatttaatgataagtggttattctaggcagttgcgaat

SEQ ID NO: 268592 - DNA, 75 bp, Artificial Sequence
  Synthetic
gtggttattctaggcagttgcgaattacaggggaagatgataaattgattgctgctgaattgcaagttactagat

SEQ ID NO: 268593 - DNA, 75 bp, Artificial Sequence
  Synthetic
tgtcagaagatttgatttatagacacggtcaggcgatgttaaataagcctcacggattgaagcttgaaaaaatgc

SEQ ID NO: 268594 - DNA, 75 bp, Artificial Sequence
  Synthetic
agcctgtgactgagatgtctaaacaattacattatattgttttccaacagagatcaagaaagcgatacttctatt

SEQ ID NO: 268595 - DNA, 75 bp, Artificial Sequence
  Synthetic
ctatactacccacccaaataattgaagaccacaattctagagtcgaatcatctaggttaaacagagattcaaaat

SEQ ID NO: 268596 - DNA, 75 bp, Artificial Sequence
  Synthetic
gggttcctgtatgtcccgttgcagtatcaaaactttatcaacaaggacgacctatactttccaaagttaagaatc

SEQ ID NO: 268597 - DNA, 75 bp, Artificial Sequence
  Synthetic
tgaatatgcagactcactcactttctagaatacaggttaatgtagacgaatatgccattacaaggagagcacact

SEQ ID NO: 268598 - DNA, 75 bp, Artificial Sequence
  Synthetic
tagaatacaggttaatgtagacgaatatgccattacaaggagagcacacttccaaaagatgcctttctttgaagg

SEQ ID NO: 268599 - DNA, 75 bp, Artificial Sequence
  Synthetic
accatccatcccttctggtggcatggatctgtcagagttaatgaaatccacatccttattgagcttaaattatga

SEQ ID NO: 268600 - DNA, 75 bp, Artificial Sequence
  Synthetic
caatataaaaaatgcttctttattggatatgtccagagtattcaagtgcaatggcagtgagaatgaccaaatggc

SEQ ID NO: 268601 - DNA, 75 bp, Artificial Sequence
  Synthetic
gatatgtccagagtattcaagtgcaatggcagtgagaatgaccaaatggctttcgaattcctatcagatgaaatt

SEQ ID NO: 268602 - DNA, 75 bp, Artificial Sequence
  Synthetic
ctagagcaggacgtagttgaagaaatagaatgcaaccctatattttctatcagttatacaaaaagaggagaatcc

SEQ ID NO: 268603 - DNA, 75 bp, Artificial Sequence
  Synthetic
aatatgacttataagaacgccttccataaagccttaatctcagagtgtgataaatttgaagaggtattcgacttt

SEQ ID NO: 268604 - DNA, 75 bp, Artificial Sequence
  Synthetic
cttgacatggggttttgctcaaatgaaaatcttagcattttagaagaaatacactggattatcagttatttaaaa

SEQ ID NO: 268605 - DNA, 75 bp, Artificial Sequence
  Synthetic
acgaatcagtggtccacagaactagacaattgtattcatatgtgtatgtataggaatgggtatgatgcagagtac

SEQ ID NO: 268606 - DNA, 75 bp, Artificial Sequence
  Synthetic
catagatttgatataccttctaaattcctcaaagacccaataaaccggacaataaattggacagaggttattgag

SEQ ID NO: 268607 - DNA, 75 bp, Artificial Sequence
  Synthetic
ttcatattattaattgaagatttccaaacaaagattgaaccatggtcaagtatgaagtcacatttctgttcaaaa

SEQ ID NO: 268608 - DNA, 75 bp, Artificial Sequence
  Synthetic
gcacacagtgtggcattagagtgtataaagaacgagaaaagatcactggcagagtttgtagatagaagcaagaaa

SEQ ID NO: 268609 - DNA, 75 bp, Artificial Sequence
  Synthetic
actggaaaatccaaatttgatttctaaggtatatgcatataaaagtagtgtttgtttctaaataggagcacacta

SEQ ID NO: 268610 - DNA, 75 bp, Artificial Sequence
  Synthetic
tggaaaatccaaatttgatttctaaggtatatgcatataaaagtagtgtttgtttctaaataggagcacactact

SEQ ID NO: 268611 - DNA, 75 bp, Artificial Sequence
  Synthetic
agtagtgtactaccagcaacaaacagtgacaatggcgaatttaataattatttcaatggttctgagcgttgccta

SEQ ID NO: 268612 - DNA, 75 bp, Artificial Sequence
  Synthetic
gtgacaatggcgaatttaataattatttcaatggttctgagcgttgcctacgggcatcctctttcaacaagtcaa

SEQ ID NO: 268613 - DNA, 75 bp, Artificial Sequence
  Synthetic
gttaaagatgacatatctattgttaaaagtactactgtttttagtaagaatagaccagctcttgaggcaaccaca

SEQ ID NO: 268614 - DNA, 75 bp, Artificial Sequence
  Synthetic
aaattttatagatcttttattgtgaaagattggtctgagtgcaatccagtgctagataaatttggaaattttatg

SEQ ID NO: 268615 - DNA, 75 bp, Artificial Sequence
  Synthetic
gttttaagtgttgatgataatggccatataatgcctaaaatgtacacatgtagagcagcatgtgatattagatta

SEQ ID NO: 268616 - DNA, 75 bp, Artificial Sequence
  Synthetic
aacaaagataatgctgaaataatattatcgtcaacaaagctcaaccacttcgaaattgtcggaacaacttcgaca

SEQ ID NO: 268617 - DNA, 75 bp, Artificial Sequence
  Synthetic
cgaaattgtcggaacaacttcgacatcaggctggttcaaaaacacaataacaaacaatttggaacacacatgcga

SEQ ID NO: 268618 - DNA, 75 bp, Artificial Sequence
  Synthetic
gcatgtgaccgtaaattgtggtcagaaatcagtaaaattccatgcatgctttagacaacataggggttgtataag

SEQ ID NO: 268619 - DNA, 75 bp, Artificial Sequence
  Synthetic
ttagacaacataggggttgtataagattctttaaaggaacatatatgccatactcaatgattgaagcaatgtgtg

SEQ ID NO: 268620 - DNA, 75 bp, Artificial Sequence
  Synthetic
ttaacatagagctaataattctgacattatatatctttgctgcaattatatttgcattaattataacaaagagtt

SEQ ID NO: 268621 - DNA, 75 bp, Artificial Sequence
  Synthetic
atgtggcatacctgctcctgccgttattttatccagtgacatggttttacggaaaggtttataaaaagattaatt

SEQ ID NO: 268622 - DNA, 75 bp, Artificial Sequence
  Synthetic
cctgcccaaattgtctacttgcatctcatcctttcaccagctgccctaaaatctgtatatgcggttctagattta

SEQ ID NO: 268623 - DNA, 75 bp, Artificial Sequence
  Synthetic
gttgcacagaagctcttaaggtgcatagaatgggtaaggactgcttaggttataaatctctaagcaaagctagac

SEQ ID NO: 268624 - DNA, 75 bp, Artificial Sequence
  Synthetic
agatgtgtaagtcgaaaagctggtcctttacagcagctatattaactggattaatattgatggaatttatctcac

SEQ ID NO: 268625 - DNA, 75 bp, Artificial Sequence
  Synthetic
ttaatattgatggaatttatctcaccaattgcaggagagagaatgtataagcttgaggagttagctgatgagttt

SEQ ID NO: 268626 - DNA, 75 bp, Artificial Sequence
  Synthetic
ataaagctaacagagcaggtaaatattttagaaagagaaatggaagtcttgaagcagtcaataattgttatgttt

SEQ ID NO: 268627 - DNA, 75 bp, Artificial Sequence
  Synthetic
gcaatcattttggtattgttgctttttgaaaatatgatattcaaccggcttttcagcattttttatcgttcttgc

SEQ ID NO: 268628 - DNA, 75 bp, Artificial Sequence
  Synthetic
tccatgtgtggtttgatacattatagaccaggactcaagattgatttaaccaaaactaataaatgcggtagttgc

SEQ ID NO: 268629 - DNA, 75 bp, Artificial Sequence
  Synthetic
gaccaggactcaagattgatttaaccaaaactaataaatgcggtagttgcatctgtggattcaatgagcagcaat

SEQ ID NO: 268630 - DNA, 75 bp, Artificial Sequence
  Synthetic
catctggttttgaatatgaaatatttctaaaggatatgcatatccagaaagaatcatgcaaatttagtccaagag

SEQ ID NO: 268631 - DNA, 75 bp, Artificial Sequence
  Synthetic
taaaccactttaggaatattaaagctttattatttgcacttgtaatctgtgctactatatatacagtttatgcag

SEQ ID NO: 268632 - DNA, 75 bp, Artificial Sequence
  Synthetic
atgaagattgcttgtctaaagacattaaaataacatatcaagagttgcataattgcataggcccaaagataatgg

SEQ ID NO: 268633 - DNA, 75 bp, Artificial Sequence
  Synthetic
taaaataacatatcaagagttgcataattgcataggcccaaagataatgggcaacacttgtgtatcaaagaatga

SEQ ID NO: 268634 - DNA, 75 bp, Artificial Sequence
  Synthetic
aatattttgaacctgatactgtaaatgatcaattcaacaaaatagagtttgcccaagatgcacatagaatgatac

SEQ ID NO: 268635 - DNA, 75 bp, Artificial Sequence
  Synthetic
ttaatacacactctatgtgtaagaacacagatatagattacaacaaagagatcgaaacatattataaaagcaatg

SEQ ID NO: 268636 - DNA, 75 bp, Artificial Sequence
  Synthetic
cacagatatagattacaacaaagagatcgaaacatattataaaagcaatgctgcagcctatagagctgacctgaa

SEQ ID NO: 268637 - DNA, 75 bp, Artificial Sequence
  Synthetic
caccataatggacacattaaaaacggcattcagagggcttacaaaggtcctaattgaaaattatatagaaaaaga

SEQ ID NO: 268638 - DNA, 75 bp, Artificial Sequence
  Synthetic
gcattcagagggcttacaaaggtcctaattgaaaattatatagaaaaagatgactctgatgctcttaaggcttta

SEQ ID NO: 268639 - DNA, 75 bp, Artificial Sequence
  Synthetic
tttagtaatattactgattctgtccaggacaattatcagatgattggaatattgaaatttgccagtaagctatta

SEQ ID NO: 268640 - DNA, 75 bp, Artificial Sequence
  Synthetic
caacttggaatttacagccataactgcagataagattatgtcattaactaactgttataaggaatctttcactgc

SEQ ID NO: 268641 - DNA, 75 bp, Artificial Sequence
  Synthetic
gcaaccagcagatatgcagactggaattaaaaaatgctcagctgatgaaattggagaatgtacaacacttgaaga

SEQ ID NO: 268642 - DNA, 75 bp, Artificial Sequence
  Synthetic
caagacatggccgatcgtattctgtggtggcaaatattactactctgatagcaaagagcatgccaaggacggttc

SEQ ID NO: 268643 - DNA, 75 bp, Artificial Sequence
  Synthetic
tatcaacaactattgtttaacaaacaaatgctctgaacaacgttttccaatacatgaaaattggtttaaaaaatg

SEQ ID NO: 268644 - DNA, 75 bp, Artificial Sequence
  Synthetic
taattgggacaagacccacaaagaatttagcactatgagacagataaactataatgatataacttcttatagaaa

SEQ ID NO: 268645 - DNA, 75 bp, Artificial Sequence
  Synthetic
gcaatcagttatttgacatagttatttttgtgaaaaaagctgtatataaagcacagtaccagaaagcatacacca

SEQ ID NO: 268646 - DNA, 75 bp, Artificial Sequence
  Synthetic
caggtcccagtatatccataaatattgaacacaatgaaagatgtacaggccactgccccgaaaagattcctgcaa

SEQ ID NO: 268647 - DNA, 75 bp, Artificial Sequence
  Synthetic
aagaaggttggctaacattttctaaagaacatactagttcttggggatgtgaagaatatggctgtcttgctatag

SEQ ID NO: 268648 - DNA, 75 bp, Artificial Sequence
  Synthetic
aagtatcactgatagaaatatgcataactttgcctcatgaaacttattgcaatgatatggatatattagaaccga

SEQ ID NO: 268649 - DNA, 75 bp, Artificial Sequence
  Synthetic
ttataggtgataaattaagtgcatcctttcagaatacgcagactaaccaacttccgacccttatagcttataaaa

SEQ ID NO: 268650 - DNA, 75 bp, Artificial Sequence
  Synthetic
aagggaaaatatacacaggtcaaatcaatgatattggaaatacagcattgcagtgcggctcaatccaagtaatta

SEQ ID NO: 268651 - DNA, 75 bp, Artificial Sequence
  Synthetic
caatgatattggaaatacagcattgcagtgcggctcaatccaagtaattaatgggtcaactatcgggactggcag

SEQ ID NO: 268652 - DNA, 75 bp, Artificial Sequence
  Synthetic
ccccaaattcgattatatatgccatgctatgagaaggaaagatgttattgtaaggaagtgtttcaatgacaatta

SEQ ID NO: 268653 - DNA, 75 bp, Artificial Sequence
  Synthetic
tcagtcatgcactaggttagaaaaacggaatgacttgatcccttatagaaaaggcgatgtcattgaagtatcaaa

SEQ ID NO: 268654 - DNA, 75 bp, Artificial Sequence
  Synthetic
aacaggatcaaacatgggccaaatgacattcaaaatagaactaggtgatgtcaactataaaatattcactaaatc

SEQ ID NO: 268655 - DNA, 75 bp, Artificial Sequence
  Synthetic
aatagatcttcaaatgtctggcatttgtgctgggtgcattgactgtgctgaaggtatttcatgctctataaatgc

SEQ ID NO: 268656 - DNA, 75 bp, Artificial Sequence
  Synthetic
tgtgctgggtgcattgactgtgctgaaggtatttcatgctctataaatgctgaagtgccggccgaaacagtctgc

SEQ ID NO: 268657 - DNA, 75 bp, Artificial Sequence
  Synthetic
cattgtaaaacaaactgtgaagattttataaataatatagtgttttcaccacaaatcaagaattacaatataaaa

SEQ ID NO: 268658 - DNA, 75 bp, Artificial Sequence
  Synthetic
gtccactgtaaatctaaagttgaaaagataatagcacatatctgtgggagagacatcgatttacaattaactgtt

SEQ ID NO: 268659 - DNA, 75 bp, Artificial Sequence
  Synthetic
aaaccatacaatcagaagatagatttgtcgcagttagatgaatcaaattacataagggaagaggatctccagtgc

SEQ ID NO: 268660 - DNA, 75 bp, Artificial Sequence
  Synthetic
cataagggaagaggatctccagtgcgggacatggttatgtaaagtgcaaaaagagggggttgatattatattcaa

SEQ ID NO: 268661 - DNA, 75 bp, Artificial Sequence
  Synthetic
aggattattttcaggcttagggagatattggaccatattgatttattcaattataggtgtggtaataattgtgat

SEQ ID NO: 268662 - DNA, 75 bp, Artificial Sequence
  Synthetic
attggtttatatcctgttgcccataggtcggcttttaaaagcattcctaatcagacatgaaatagaatatgccat

SEQ ID NO: 268663 - DNA, 75 bp, Artificial Sequence
  Synthetic
ggagcaaaaaatcaagtagatttagctaaaaagggtaggcaggcctaaaatcaggtataaataaaatccatataa

SEQ ID NO: 268664 - DNA, 75 bp, Artificial Sequence
  Synthetic
taggcaggcctaaaatcaggtataaataaaatccatataaataaagtcaaaaattgttgttggtagcacactact

SEQ ID NO: 268665 - DNA, 75 bp, Artificial Sequence
  Synthetic
agtagtgtgctccacaattcaaaacataaaaagaaattccaataatgtcagagttcattttcaacgatgtaccac

SEQ ID NO: 268666 - DNA, 75 bp, Artificial Sequence
  Synthetic
tctgtcaggatacctagcgcgctgggcctttacccagatgcgatcaccaattaagcaagctgagttcagagccac

SEQ ID NO: 268667 - DNA, 75 bp, Artificial Sequence
  Synthetic
tgtagtagtgcctttggctgaggtaaagggctgtacttggaatgatggtgacgcaatgtacctggggtttgctgc

SEQ ID NO: 268668 - DNA, 75 bp, Artificial Sequence
  Synthetic
aagggctgtacttggaatgatggtgacgcaatgtacctggggtttgctgctggtgctgagatgttcctgcaaaca

SEQ ID NO: 268669 - DNA, 75 bp, Artificial Sequence
  Synthetic
ttcactttcttccctttggtgattgagatgcatagggttctcaaggatggcatggatgtcaactttatgaagaaa

SEQ ID NO: 268670 - DNA, 75 bp, Artificial Sequence
  Synthetic
agatgcatagggttctcaaggatggcatggatgtcaactttatgaagaaagtcctccggcagaggtatggtcaaa

SEQ ID NO: 268671 - DNA, 75 bp, Artificial Sequence
  Synthetic
agactgccgagcaatggatgcgtgaagaaatagttgctgtaagagcagcttttgaagctgtaggcactctggcct

SEQ ID NO: 268672 - DNA, 75 bp, Artificial Sequence
  Synthetic
cagaactggattctccccagcagcaagagacttcttgcgccaattcggaattgacatatagtggagcacactact

SEQ ID NO: 268673 - DNA, 75 bp, Artificial Sequence
  Synthetic
aagaaggttggctaacattttctaaagaacatactagttcttggggatgtgaagaatatgtctgtctcgctatag

SEQ ID NO: 268674 - DNA, 75 bp, Artificial Sequence
  Synthetic
gtgacaatggcgaatttaataattatttcaatggttctgggcgttgcctatgggcatccgctttcaacaagtcaa

SEQ ID NO: 268675 - DNA, 75 bp, Artificial Sequence
  Synthetic
gttaaagatgacatatctattgttaagagtactactgtttttagcaagaataaaccagctcttgaggcaactaca

SEQ ID NO: 268676 - DNA, 75 bp, Artificial Sequence
  Synthetic
atataatacctaaaatgtatacatgtagagcagcatgtgatattagattaaacaaagataatgccgaaataatat

SEQ ID NO: 268677 - DNA, 75 bp, Artificial Sequence
  Synthetic
tatcgtcaacaaaactcaaccactttgaaattgtcgggacaacttcgacatcaggctggttcaagaacacaataa

SEQ ID NO: 268678 - DNA, 75 bp, Artificial Sequence
  Synthetic
tgaaattgtcgggacaacttcgacatcaggctggttcaagaacacaataacaaacaacttagaacatacatgcga

SEQ ID NO: 268679 - DNA, 75 bp, Artificial Sequence
  Synthetic
atgtggcatacttgctcctgccgttattttatccagtgacgtggttttacggaaaggtttataaaaagattaatt

SEQ ID NO: 268680 - DNA, 75 bp, Artificial Sequence
  Synthetic
cttgcccaaattgtctacttgcatctcaccctttcaccagctgccctaaaatctgtatatgcggttctaggttta

SEQ ID NO: 268681 - DNA, 75 bp, Artificial Sequence
  Synthetic
gttgcacagaagctcttaaggtacatagaatgggtaaggactgcttaggttataagtctctaagcaaagctagac

SEQ ID NO: 268682 - DNA, 75 bp, Artificial Sequence
  Synthetic
ttaatattgatggaattcatctcaccaattgcaggagagagaatgtataagcttgaggagctggctgatgagttt

SEQ ID NO: 268683 - DNA, 75 bp, Artificial Sequence
  Synthetic
gaccaggactcaagatcgatttaaccaaaactaacagatgtggtagttgcatctgtggattcgacgagcagcaat

SEQ ID NO: 268684 - DNA, 75 bp, Artificial Sequence
  Synthetic
tttattatttgcacttgtaatctgtgctactatatatacagtttatgcagatgaagattgcttatctaaagatat

SEQ ID NO: 268685 - DNA, 75 bp, Artificial Sequence
  Synthetic
aatattttgaacctgatactgtaaatgatcaattcaacaagatagagtttgcccaagatgcacatagaatgatac

SEQ ID NO: 268686 - DNA, 75 bp, Artificial Sequence
  Synthetic
ttaatacacactctatgtgtaagaatacagatatagattataacaaagagatcgaaacatattataaaagcaatg

SEQ ID NO: 268687 - DNA, 75 bp, Artificial Sequence
  Synthetic
atcgaaacatattataaaagcaatgctgcagcctatagagctgacctgaacaccataatggacacattaaaaaca

SEQ ID NO: 268688 - DNA, 75 bp, Artificial Sequence
  Synthetic
tgaatataaaggagtgcatgtcaccagagagcttgaaatgttttaagaagagagacagtacaccgcatacaaacc

SEQ ID NO: 268689 - DNA, 75 bp, Artificial Sequence
  Synthetic
atagaaacaattcaaaaaggtcaaaaattgtgccttggtgacagtcattgcaacttggaatttacagccataact

SEQ ID NO: 268690 - DNA, 75 bp, Artificial Sequence
  Synthetic
aattgtgccttggtgacagtcattgcaacttggaatttacagccataactgcagacaagattatgtcattaacta

SEQ ID NO: 268691 - DNA, 75 bp, Artificial Sequence
  Synthetic
caagacatggccaattatattctgtggtggcaaatattactactctgatagcaaggagcatgccaaggacggttc

SEQ ID NO: 268692 - DNA, 75 bp, Artificial Sequence
  Synthetic
atacaggctgtctatatggctcttgtcaagatgtcatacgcccagaattagatgtttataagaagattggcagtg

SEQ ID NO: 268693 - DNA, 75 bp, Artificial Sequence
  Synthetic
ttataggagataaattaagtgcatcctttcagaatacacagactaatcaacttccgacccttatagcttataaaa

SEQ ID NO: 268694 - DNA, 75 bp, Artificial Sequence
  Synthetic
ctttcagaatacacagactaatcaacttccgacccttatagcttataaaaaagggaagatatacacaggtcaaat

SEQ ID NO: 268695 - DNA, 75 bp, Artificial Sequence
  Synthetic
taaggaagtgtttcaatgacaattatcagtcgtgcactaggctagaaaaacgaaacgacttgatcccttatagaa

SEQ ID NO: 268696 - DNA, 75 bp, Artificial Sequence
  Synthetic
aacaggatcgaacatgggccaaatgacatttaaaatagaactaggtgatatcaactataaaatatttactaaatc

SEQ ID NO: 268697 - DNA, 75 bp, Artificial Sequence
  Synthetic
gtccactgtaaatctaaagttgaaaaaataacagcacatatctgtgggagagacattgatttacagttaacaatt

SEQ ID NO: 268698 - DNA, 75 bp, Artificial Sequence
  Synthetic
aagccatacaatcagaagatagacttgtcgcagttagatgaatcaaattacataagggaagaggacctccagtgt

SEQ ID NO: 268699 - DNA, 75 bp, Artificial Sequence
  Synthetic
ggtcggcttttaaaagcattcctaatcagacatgaaatagaatatgccatggagcagaaaatcaagtagatttgg

SEQ ID NO: 268700 - DNA, 75 bp, Artificial Sequence
  Synthetic
ctaaaaagggtaggcaggtctaaaatcaggtataaataaaattcatataaataaagtcaaaaattgttgttggta

SEQ ID NO: 268701 - DNA, 75 bp, Artificial Sequence
  Synthetic
taggcaggtctaaaatcaggtataaataaaattcatataaataaagtcaaaaattgttgttggtagcacactact

SEQ ID NO: 268702 - DNA, 75 bp, Artificial Sequence
  Synthetic
agtagtgtactcctatttcgaaacaaacaaaaacaatctcaaaatgtcacaactgttgctcaaccaatatcggaa

SEQ ID NO: 268703 - DNA, 75 bp, Artificial Sequence
  Synthetic
aactgttgctcaaccaatatcggaataggatattgcactgccgtgaacctgagatagcaaaggatatatggcgag

SEQ ID NO: 268704 - DNA, 75 bp, Artificial Sequence
  Synthetic
taggatattgcactgccgtgaacctgagatagcaaaggatatatggcgagatctattaaatgatcgacacaatta

SEQ ID NO: 268705 - DNA, 75 bp, Artificial Sequence
  Synthetic
atctattaaatgatcgacacaattacttttctcgggaattttgcagagctgcaaatcttgagtacagaaatgatg

SEQ ID NO: 268706 - DNA, 75 bp, Artificial Sequence
  Synthetic
ttcctgctgaggatatttgtgctgaagttcttgatggttataaagcaaggaaagttcgcttttgtacacctgata

SEQ ID NO: 268707 - DNA, 75 bp, Artificial Sequence
  Synthetic
attacttactacatgatggaaagatgtatataatagacttcaaagtgtctgtagacgaccgatcttctagaatca

SEQ ID NO: 268708 - DNA, 75 bp, Artificial Sequence
  Synthetic
caagggagaaatataatgagatttttggagaggtattcaatccagaaggtgtagattttgaaattgttattatta

SEQ ID NO: 268709 - DNA, 75 bp, Artificial Sequence
  Synthetic
gattagatccttcaaatatgactatacatgtggactctcgagatttcgtgaatacaattgggccgattacattaa

SEQ ID NO: 268710 - DNA, 75 bp, Artificial Sequence
  Synthetic
acattagtatgcaatggttttttgatatgaaagacttcttgttcgggaaatttcgggatgatgataaattccatg

SEQ ID NO: 268711 - DNA, 75 bp, Artificial Sequence
  Synthetic
ctataataagtcaaggagaattcacaatgacattgccatggattgaagaagacaccccagaattgcttactcatc

SEQ ID NO: 268712 - DNA, 75 bp, Artificial Sequence
  Synthetic
gacaccccagaattgcttactcatcctatatacaatgaattcatgagttcaatgccagaggcagaacaggcccta

SEQ ID NO: 268713 - DNA, 75 bp, Artificial Sequence
  Synthetic
aatgccagaggcagaacaggccctattcaaggaagcattggaattcaaatcatttggggcagaaaaatggaatat

SEQ ID NO: 268714 - DNA, 75 bp, Artificial Sequence
  Synthetic
ctttttgaagggggtgatgtcaaagtatggtgaatattataaagaatttactaaaggacatgctcattctatatt

SEQ ID NO: 268715 - DNA, 75 bp, Artificial Sequence
  Synthetic
tatggtgaatattataaagaatttactaaaggacatgctcattctatatttctgacaacaggggactaccccaag

SEQ ID NO: 268716 - DNA, 75 bp, Artificial Sequence
  Synthetic
tctgacaacaggggactaccccaagccagacaaagaccaaatttcagcaggttggagagaaatggtaaacagagt

SEQ ID NO: 268717 - DNA, 75 bp, Artificial Sequence
  Synthetic
aagctctgaacgtgacatgtcaaatgacataaatcaggaaaaaccaagcatgcattttatatgggcaaagaatga

SEQ ID NO: 268718 - DNA, 75 bp, Artificial Sequence
  Synthetic
gacataaatcaggaaaaaccaagcatgcattttatatgggcaaagaatgattcaaatagcaacaataatatacaa

SEQ ID NO: 268719 - DNA, 75 bp, Artificial Sequence
  Synthetic
aagctaatcaaactatctaaatcactgcaagctatgagcgggacagggagctatgtaaatgctttcaagtcatta

SEQ ID NO: 268720 - DNA, 75 bp, Artificial Sequence
  Synthetic
ctatgtaaatgctttcaagtcattagggagattaatggatatatcatcagatgttaaaaaatatgaatcattttg

SEQ ID NO: 268721 - DNA, 75 bp, Artificial Sequence
  Synthetic
gggagattaatggatatatcatcagatgttaaaaaatatgaatcattttgtgggaaattgaaatctctggcaagg

SEQ ID NO: 268722 - DNA, 75 bp, Artificial Sequence
  Synthetic
tctagtataaaaaaacttgacaggaaaatagagccaatacaaattgggactgcaactgtcttatgggaacagcaa

SEQ ID NO: 268723 - DNA, 75 bp, Artificial Sequence
  Synthetic
aaatagagccaatacaaattgggactgcaactgtcttatgggaacagcaatttaaactagatacagatgttataa

SEQ ID NO: 268724 - DNA, 75 bp, Artificial Sequence
  Synthetic
aaagagaagacagaatacatttaatgaaagattattttgggatcggtaagcacaaatcattttcaaagaaattaa

SEQ ID NO: 268725 - DNA, 75 bp, Artificial Sequence
  Synthetic
cacaaatcattttcaaagaaattaaacaacgacataaatactgataagcctaaaatattaaatttcaacaatgat

SEQ ID NO: 268726 - DNA, 75 bp, Artificial Sequence
  Synthetic
gatatagtcaggaaatgcaaagataaatataatcaagtcatacataacctatcccaaatcaatgaattagataag

SEQ ID NO: 268727 - DNA, 75 bp, Artificial Sequence
  Synthetic
attggaaactacctagagcacttttcagctaaaattagtgcctgcagtgtagaaatgtgggattttatatataat

SEQ ID NO: 268728 - DNA, 75 bp, Artificial Sequence
  Synthetic
cagctaaaattagtgcctgcagtgtagaaatgtgggattttatatataatacaaccaaaactaaatactggcaat

SEQ ID NO: 268729 - DNA, 75 bp, Artificial Sequence
  Synthetic
gcatcaatgactattccaccctaatgaaaaacatgttagctgtctctcaatataatagacacaatacgtttagaa

SEQ ID NO: 268730 - DNA, 75 bp, Artificial Sequence
  Synthetic
ttgtctcatgtgcaaacaataatgtatttggtctagtaatgccaagctcagatataaagacaaaaaaagcaactt

SEQ ID NO: 268731 - DNA, 75 bp, Artificial Sequence
  Synthetic
taatgaggaggcagagatagcagaacttggctcactctactcaacttttaagacagcaacaggatatatttcaat

SEQ ID NO: 268732 - DNA, 75 bp, Artificial Sequence
  Synthetic
atcaaaggcttttaggctggataaagaaagatgccaacgcatagtatcctctccaggcttgttcctcatgacaag

SEQ ID NO: 268733 - DNA, 75 bp, Artificial Sequence
  Synthetic
ctccaggcttgttcctcatgacaagctgcctattattcaacggtaacaagagtttagaatttgataaattactag

SEQ ID NO: 268734 - DNA, 75 bp, Artificial Sequence
  Synthetic
agtttagaatttgataaattactaggattttcattttttacgtcaatatcaattacgaaagctatgctctccctt

SEQ ID NO: 268735 - DNA, 75 bp, Artificial Sequence
  Synthetic
actgagccttcacgttatatgatcatgaactcgttagcagtttccagccatgtaagagagtatatatctgaaaaa

SEQ ID NO: 268736 - DNA, 75 bp, Artificial Sequence
  Synthetic
ttctccccttatacaaaaacatcattttctgtggtaatgacagacttaatcaagaagggttgctattcagcatat

SEQ ID NO: 268737 - DNA, 75 bp, Artificial Sequence
  Synthetic
gaacagagaaaaaaagtacaaataagagacataaaattaacagattatgatataacacaaaagggagtggattcc

SEQ ID NO: 268738 - DNA, 75 bp, Artificial Sequence
  Synthetic
tataacacaaaagggagtggattccaaaagagatcttaaatctatttggttcccaggaaaggtaaacctgaaaga

SEQ ID NO: 268739 - DNA, 75 bp, Artificial Sequence
  Synthetic
aaaagagatcttaaatctatttggttcccaggaaaggtaaacctgaaagaatatttaaaccaaatttatctacca

SEQ ID NO: 268740 - DNA, 75 bp, Artificial Sequence
  Synthetic
ttttattttaactctaaaggattacatgaaaaacatcatgtcttgatagatttggctaaaacagtactagaaatc

SEQ ID NO: 268741 - DNA, 75 bp, Artificial Sequence
  Synthetic
tttggctaaaacagtactagaaatcgaaaaagagcaaagggagtcattacctgagccatggtcagagatacctgc

SEQ ID NO: 268742 - DNA, 75 bp, Artificial Sequence
  Synthetic
ctgagccatggtcagagatacctgctaagcagactgtcaacttaaatgttttaatttactcaattgcaaggaact

SEQ ID NO: 268743 - DNA, 75 bp, Artificial Sequence
  Synthetic
tgaatttagatacttcaagacataattttgtaagaagccgggtggaaaacgcaaataatttcaacagatctataa

SEQ ID NO: 268744 - DNA, 75 bp, Artificial Sequence
  Synthetic
gcaaataatttcaacagatctataacgacaatatctacttttaccagctcaaaatcatgcattaagattggtgat

SEQ ID NO: 268745 - DNA, 75 bp, Artificial Sequence
  Synthetic
aaaatcatgcattaagattggtgattttgaagaagaaaaaaagagaaaaactaagaatgatacaaagaaacttgc

SEQ ID NO: 268746 - DNA, 75 bp, Artificial Sequence
  Synthetic
aaaggatatttctaaattaaccatagccaacccagcattcttagatgagatcacaaacgaacatgagataaggca

SEQ ID NO: 268747 - DNA, 75 bp, Artificial Sequence
  Synthetic
ttcaacttatgaggacttaaaacaatctatcccagattacacagattatatgtctgtgaaagtttttgacagatt

SEQ ID NO: 268748 - DNA, 75 bp, Artificial Sequence
  Synthetic
tgtctgtgaaagtttttgacagattgtacgagaagattactaccaatgaaataaatgataaggaaacagtcaagc

SEQ ID NO: 268749 - DNA, 75 bp, Artificial Sequence
  Synthetic
tgattctagagaccatgaaaaaacataaaatatttcattttggattcttcaataaaggacaaaaaacagccaaag

SEQ ID NO: 268750 - DNA, 75 bp, Artificial Sequence
  Synthetic
atagagaaatatttttaggtgaatttgaagcaaaaatgtgtctgtaccttgtcgaaagaatagctaaagagaggt

SEQ ID NO: 268751 - DNA, 75 bp, Artificial Sequence
  Synthetic
gcaaattaaaccctgaagaaatgataagtgaaccaggcgactcgaaactaagggtattagagaagcaatcagaag

SEQ ID NO: 268752 - DNA, 75 bp, Artificial Sequence
  Synthetic
acgaaatcaggtatattagcaatacaataaagacattagggaatgccatagaggacttgcaatctggatctttaa

SEQ ID NO: 268753 - DNA, 75 bp, Artificial Sequence
  Synthetic
gaggacttgcaatctggatctttaaattgggcagatatatgcgaaaacaaagcaagaggacttaagatagaaata

SEQ ID NO: 268754 - DNA, 75 bp, Artificial Sequence
  Synthetic
cccaagatgtactttttaaatatttttggttgatagtgcttgatcccatcttatatcctgctgagaggaaaagga

SEQ ID NO: 268755 - DNA, 75 bp, Artificial Sequence
  Synthetic
aaagagttccttattcaaatgacataattggattaatgacaaacaattataggtctaatacagtagaaataaagc

SEQ ID NO: 268756 - DNA, 75 bp, Artificial Sequence
  Synthetic
tgtagtatgtctgtgtacaaagatataataagagaagcagcaatattattagaaggagaagcccttgtgaactca

SEQ ID NO: 268757 - DNA, 75 bp, Artificial Sequence
  Synthetic
atggtacattctgatgataatcaaacatctatatgtatggtgcagaataaattaccagatgacaatataattgaa

SEQ ID NO: 268758 - DNA, 75 bp, Artificial Sequence
  Synthetic
ttttgcattaagatattcgagaagatatgcttaacttttggcaatcaggcaaatatgaagaagacatatctaact

SEQ ID NO: 268759 - DNA, 75 bp, Artificial Sequence
  Synthetic
aacttcatcaaagagtttgtttctttatttaatatacatggagaaccattttctatatatgggagatttctactc

SEQ ID NO: 268760 - DNA, 75 bp, Artificial Sequence
  Synthetic
acagcagtaggagactgtgcctatctagggccttatgaagatttagcaagtaggctatctgcaacacaaactgct

SEQ ID NO: 268761 - DNA, 75 bp, Artificial Sequence
  Synthetic
taggctatctgcaacacaaactgctataaagcatggttgcccaccatcacttgcatgggtatctatcgctctaaa

SEQ ID NO: 268762 - DNA, 75 bp, Artificial Sequence
  Synthetic
ttgcatgggtatctatcgctctaaatcactggataacccacactacatataatatgttgcctggccaaaataatg

SEQ ID NO: 268763 - DNA, 75 bp, Artificial Sequence
  Synthetic
acccgttaccattcttccctactaacaatagaagtgaaataccagtagagatgtgcggaatactagaaagtgatt

SEQ ID NO: 268764 - DNA, 75 bp, Artificial Sequence
  Synthetic
atgtgcggaatactagaaagtgatttatcaacaattgcactaactggtttagaagcagggaatgtcacgtttcta

SEQ ID NO: 268765 - DNA, 75 bp, Artificial Sequence
  Synthetic
acaaatatagcaaggaagttatcatccccaatcttacaaagagaaagtattcaagatcaatacaattctatagaa

SEQ ID NO: 268766 - DNA, 75 bp, Artificial Sequence
  Synthetic
aagtgggatctgagcaaattatcacagatcgacattctaaggcttaaaatgctcaggtatatatctcttgatagt

SEQ ID NO: 268767 - DNA, 75 bp, Artificial Sequence
  Synthetic
agatcgacattctaaggcttaaaatgctcaggtatatatctcttgatagttcagtcacatctgatgatggtatgg

SEQ ID NO: 268768 - DNA, 75 bp, Artificial Sequence
  Synthetic
gctcaggtatatatctcttgatagttcagtcacatctgatgatggtatgggggagactagtgaaatgagatctcg

SEQ ID NO: 268769 - DNA, 75 bp, Artificial Sequence
  Synthetic
atcacttttaacacctcgtaaattcacaacaagtgggtcacttaataggttgaaatcatataaagactttcaaga

SEQ ID NO: 268770 - DNA, 75 bp, Artificial Sequence
  Synthetic
tataatagcagatgaggacaagacaaacgaactatttgagaatttcattagacacccagagttactggttacaaa

SEQ ID NO: 268771 - DNA, 75 bp, Artificial Sequence
  Synthetic
aacgaactatttgagaatttcattagacacccagagttactggttacaaaaggcgaaacatttgaagaatttgtt

SEQ ID NO: 268772 - DNA, 75 bp, Artificial Sequence
  Synthetic
attgagcaaatattattttccaataaaccagtaattgactacactagcatacatgacaagatttttggattacaa

SEQ ID NO: 268773 - DNA, 75 bp, Artificial Sequence
  Synthetic
gacatgccaggaattgaagaactagatacaattataggtcgcaaaacatttgttgagagttatgttcaaatcgta

SEQ ID NO: 268774 - DNA, 75 bp, Artificial Sequence
  Synthetic
gatgacttaagcaatttaacattggatataaacgatgtcaagactatatttgccttttgtcttatgaatgaccca

SEQ ID NO: 268775 - DNA, 75 bp, Artificial Sequence
  Synthetic
ctactgatcacatctgctaacaatataataatgtctgttaagggacatagtcaagaaagaataggtcaatcagca

SEQ ID NO: 268776 - DNA, 75 bp, Artificial Sequence
  Synthetic
tgcaaaatgccagaggtccgaagtctaaaactcatacattattcaccagcagttgttttgagagcctatgtgaga

SEQ ID NO: 268777 - DNA, 75 bp, Artificial Sequence
  Synthetic
taaaactcatacattattcaccagcagttgttttgagagcctatgtgagagggccaacaaatgtaccgaatgtag

SEQ ID NO: 268778 - DNA, 75 bp, Artificial Sequence
  Synthetic
atatagatgaacttgcaagggatctatctcatttagaagacttcatacaaagtacaaaactcagagaaaatatga

SEQ ID NO: 268779 - DNA, 75 bp, Artificial Sequence
  Synthetic
gagagagaatagaaataaatgagaagcggcacttaggaagggatttcaaatttgaaatcaaagaactaactagat

SEQ ID NO: 268780 - DNA, 75 bp, Artificial Sequence
  Synthetic
tttaccaagtgtgttatgattacataaagtctacagaacataaagtcaaggtattcatattgccatacaaagttt

SEQ ID NO: 268781 - DNA, 75 bp, Artificial Sequence
  Synthetic
tcacatcaatagaattctgcggggcactgacaggtaacttgataaatgacaaattatggtacataacgcattatt

SEQ ID NO: 268782 - DNA, 75 bp, Artificial Sequence
  Synthetic
tgaaaaatatagtgtctactacacataaggcacaaatttcttcttcacctgaattggaattgcaaatagctgatg

SEQ ID NO: 268783 - DNA, 75 bp, Artificial Sequence
  Synthetic
aggcactaagactagtagcacattttgctgatactttcttggcatcagaatcaagaatacaatttctgaagaaaa

SEQ ID NO: 268784 - DNA, 75 bp, Artificial Sequence
  Synthetic
aaaataaagaactccaagttgagggttaaatttctagggattcttttatggttagatgatctaacacagaatgat

SEQ ID NO: 268785 - DNA, 75 bp, Artificial Sequence
  Synthetic
ttaaatttctagggattcttttatggttagatgatctaacacagaatgatctggataaatttgatgcagataaat

SEQ ID NO: 268786 - DNA, 75 bp, Artificial Sequence
  Synthetic
cagatgaaaagattatatggaataactggcaagtgtcaagagatatgaatactggaccaatagacttaatgataa

SEQ ID NO: 268787 - DNA, 75 bp, Artificial Sequence
  Synthetic
ctggcaagtgtcaagagatatgaatactggaccaatagacttaatgataagcggttactctagacagctgcggat

SEQ ID NO: 268788 - DNA, 75 bp, Artificial Sequence
  Synthetic
cactggggaagatgacaaattgattgctgctgaattgcaggttactagattgtcagaagatttaatttatagaca

SEQ ID NO: 268789 - DNA, 75 bp, Artificial Sequence
  Synthetic
cggtcaggcaatgttgaataagccacacggcttaaagcttgaaaaaatgcaacctgtgactgagatgtctaaacg

SEQ ID NO: 268790 - DNA, 75 bp, Artificial Sequence
  Synthetic
cacggcttaaagcttgaaaaaatgcaacctgtgactgagatgtctaaacgattacattatatcgttttccagcaa

SEQ ID NO: 268791 - DNA, 75 bp, Artificial Sequence
  Synthetic
agatcacggaaacgatacttctattctatattacccacccaagtaattgaggaccataattctagagttgaatca

SEQ ID NO: 268792 - DNA, 75 bp, Artificial Sequence
  Synthetic
tctaggctaagcagagattcaaaatgggttcctgtatgccctgttgcaatatcaaaactctaccaacaaggacgg

SEQ ID NO: 268793 - DNA, 75 bp, Artificial Sequence
  Synthetic
cctatactttccaaagttagaaatctgaatatgcagactcattcgctttccagaatacaagttaatgtagatgaa

SEQ ID NO: 268794 - DNA, 75 bp, Artificial Sequence
  Synthetic
cagaatacaagttaatgtagatgaatatgccatcacgagaagagcacattttcagaaaatgcctttcttcgaagg

SEQ ID NO: 268795 - DNA, 75 bp, Artificial Sequence
  Synthetic
accatcaatcccttctggtggtatggatttgtctgagttgatgaaatctacatccctattaagcttgaattatga

SEQ ID NO: 268796 - DNA, 75 bp, Artificial Sequence
  Synthetic
taacataaaaaatgcatccttattggacatgtctagggtatttaagtgcaatggcagtgaagatgaccaaatggc

SEQ ID NO: 268797 - DNA, 75 bp, Artificial Sequence
  Synthetic
tttcgaatttctatcggacgaaattttggagcaagatgtagttgaagaaatagaatgcaaccctatattttctat

SEQ ID NO: 268798 - DNA, 75 bp, Artificial Sequence
  Synthetic
tagttatacaaaaagaggagaatccaatatgacttataaaaatgctttccacaaagccttaatctcagaatgtga

SEQ ID NO: 268799 - DNA, 75 bp, Artificial Sequence
  Synthetic
aaaatcttagtattctggaggaaatacattggataatcagttatttaaaaacaaatcaatggtctacggaactag

SEQ ID NO: 268800 - DNA, 75 bp, Artificial Sequence
  Synthetic
caggaatggatatgatgcagaatatcataaatttgatataccctctaaattcctcaaagacccaataaaccgaac

SEQ ID NO: 268801 - DNA, 75 bp, Artificial Sequence
  Synthetic
cataaatttgatataccctctaaattcctcaaagacccaataaaccgaacaataaattggactgaagtcattgaa

SEQ ID NO: 268802 - DNA, 75 bp, Artificial Sequence
  Synthetic
tttatattattaattgaagatttccaaacaaaaattgagccatggtctagtatgaagtcacacttctgttcaaaa

SEQ ID NO: 268803 - DNA, 75 bp, Artificial Sequence
  Synthetic
gcacacagtgtagcactagagtgtatgaaaaatgagaaaagatcattggcagaatttgtagacaaaagtaagaaa

SEQ ID NO: 268804 - DNA, 75 bp, Artificial Sequence
  Synthetic
actggcaaatccaaatttgacttctaaggtatacacatgtaaaagtagtgtttgtttctaaataggagcacacta

SEQ ID NO: 268805 - DNA, 75 bp, Artificial Sequence
  Synthetic
tggcaaatccaaatttgacttctaaggtatacacatgtaaaagtagtgtttgtttctaaataggagcacactact

SEQ ID NO: 268806 - DNA, 75 bp, Artificial Sequence
  Synthetic
agtagtgtgctaccggcaacaaacagtgacaatggcgaatttaataattatttcaatggttctgggcgttgccta

SEQ ID NO: 268807 - DNA, 75 bp, Artificial Sequence
  Synthetic
aagaacagtggaccttataatgttgcctggcgcacatatttaaaaaatcataatatagacttatgcagtaggcac

SEQ ID NO: 268808 - DNA, 75 bp, Artificial Sequence
  Synthetic
cctggcgcacatatttaaaaaatcataatatagacttatgcagtaggcacaactataaaatgatatgtcagtgta

SEQ ID NO: 268809 - DNA, 75 bp, Artificial Sequence
  Synthetic
ttatcaatggtttcatacaaaatacaatacctgctattagtggtctaggtgtcggttatcatctgaattttcaaa

SEQ ID NO: 268810 - DNA, 75 bp, Artificial Sequence
  Synthetic
agtagtgtactccacaattcaaaacataaaaagaaattccaataatgtcagagttcattttcaacgatgtaccac

SEQ ID NO: 268811 - DNA, 75 bp, Artificial Sequence
  Synthetic
tctgtcaggatacctagcgcgctgggcctttactcagatgcgatcaccaattaagcaagctgagttcagagctac

SEQ ID NO: 268812 - DNA, 75 bp, Artificial Sequence
  Synthetic
tgtagtagtgcctttggctgaggtaaaaggctgtacttggaatgatggtgatgcaatgtacctggggtttgctgc

SEQ ID NO: 268813 - DNA, 75 bp, Artificial Sequence
  Synthetic
aaaggctgtacttggaatgatggtgatgcaatgtacctggggtttgctgctggtgctgagatgttcctgcagacg

SEQ ID NO: 268814 - DNA, 75 bp, Artificial Sequence
  Synthetic
agatgcatagggttctcaaggatggcatggatgtcaactttatgaagaaagtcctccggcaacggtatggccaaa

SEQ ID NO: 268815 - DNA, 75 bp, Artificial Sequence
  Synthetic
agcaacaaacagtgacaatggcgaatttaataattatttcgatggttctgagcattgcctatgggcatccgctct

SEQ ID NO: 268816 - DNA, 75 bp, Artificial Sequence
  Synthetic
tgcaatccagtgctagacaaatttggaaattttatggttttaagtgttgatgataacggccatataatacctaaa

SEQ ID NO: 268817 - DNA, 75 bp, Artificial Sequence
  Synthetic
catacatgcgagcatgtaactgtaaattgtggtcagaaatcagtaaaattccatgcatgctttagacaacatagg

SEQ ID NO: 268818 - DNA, 75 bp, Artificial Sequence
  Synthetic
ctcctgccgttattttatccagcaacgtggttttatggaaaggtttataaaaagattaattcttgcccaaactgt

SEQ ID NO: 268819 - DNA, 75 bp, Artificial Sequence
  Synthetic
ctacttgcatctcaccctttcaccagctgccccaaaatctgtatatgcggttctaggtttagttgcacagaagct

SEQ ID NO: 268820 - DNA, 75 bp, Artificial Sequence
  Synthetic
gtcattaactaactgttataaagaatctttcactgcgcaaccagcagatatgcaggctggaattaaaaaatgctc

SEQ ID NO: 268821 - DNA, 75 bp, Artificial Sequence
  Synthetic
atacaaaatacaatacctgctattagtggtctaggtgttggttatcatctgaatttcaaaggcaatcagttattt

SEQ ID NO: 268822 - DNA, 75 bp, Artificial Sequence
  Synthetic
gtggttattctaggcagttgcgaattacaggggaagatgataaattgattgctgctgagtcgcaagttactagat

SEQ ID NO: 268823 - DNA, 75 bp, Artificial Sequence
  Synthetic
caagggaaaaatataatgagatttttggagaagtattcaatccagaaggtgtagattttgaaattgttattatta

SEQ ID NO: 268824 - DNA, 75 bp, Artificial Sequence
  Synthetic
gattagatccctcaaatatggctatacatgtggactctcgagatttcatgaatacaattgggccgatcacattaa

SEQ ID NO: 268825 - DNA, 75 bp, Artificial Sequence
  Synthetic
acattagtatgcaatggttttttgacatgaaagacttcttgttcgggaaattccgggatgatgataaatttcatg

SEQ ID NO: 268826 - DNA, 75 bp, Artificial Sequence
  Synthetic
ttcaaggaagcattagaattcaaatcattcggggcagaaaaatggaatatcttcttgaagagtgtgatgtcaaag

SEQ ID NO: 268827 - DNA, 75 bp, Artificial Sequence
  Synthetic
ccagataaaaaccaaatttcagcaggttggagagaaatggtaaatagagtgagctccgaacgtgacatgtcaaat

SEQ ID NO: 268828 - DNA, 75 bp, Artificial Sequence
  Synthetic
gacataaatcaggaaaaaccaagcatgcattttatatgggcacaaaatgattcaagtagcaataataatatacaa

SEQ ID NO: 268829 - DNA, 75 bp, Artificial Sequence
  Synthetic
gggagattaatggatatatcatcagatattaaaaaatatgaatcattttgtgggaagttaaaatctctggcaagg

SEQ ID NO: 268830 - DNA, 75 bp, Artificial Sequence
  Synthetic
gaaagattattttgggatcggtaagcacaaatcattttcaaagaaattaaacaatgacataaatactgataagcc

SEQ ID NO: 268831 - DNA, 75 bp, Artificial Sequence
  Synthetic
cacaaatcattttcaaagaaattaaacaatgacataaatactgataagcctaaaatattgaattttgacaatgat

SEQ ID NO: 268832 - DNA, 75 bp, Artificial Sequence
  Synthetic
atcccaaatcaatgaattagataagattggaaactacctagagcatttttcaactaagattagtgcctgcagtgt

SEQ ID NO: 268833 - DNA, 75 bp, Artificial Sequence
  Synthetic
ttgtctcatgtgcaaacaataatgtattcggtttagtaatgccaagctcagacataaagacaaaaaaagcaactt

SEQ ID NO: 268834 - DNA, 75 bp, Artificial Sequence
  Synthetic
agtttagaatttgataaattactaggattttcattctttacatcaatatcaattacgaaaactatgctctctctt

SEQ ID NO: 268835 - DNA, 75 bp, Artificial Sequence
  Synthetic
aaaagagatcttaaatctatttggttcccaggaaaggtaaacctaaaagaatatttaaaccaaatctatctgcca

SEQ ID NO: 268836 - DNA, 75 bp, Artificial Sequence
  Synthetic
ttaatttactcaattgcaaggaatttgaatttagatacttcaagacataattttgtaagaagccgggtagaaaat

SEQ ID NO: 268837 - DNA, 75 bp, Artificial Sequence
  Synthetic
tgtctgtgaaagtttttgacagattgtacgagaagattactaccaatgaaataagcgataaggaaacagtcaaac

SEQ ID NO: 268838 - DNA, 75 bp, Artificial Sequence
  Synthetic
atagagaaatatttttaggtgaatttgaagcaaaaatgtgtctgtaccttgtcgaaaggctagccaaagagaggt

SEQ ID NO: 268839 - DNA, 75 bp, Artificial Sequence
  Synthetic
gcaaattaaaccctgaagaaatgataagtgaaccaggtgactcgaaattaagggtattagagaagcaatcagaag

SEQ ID NO: 268840 - DNA, 75 bp, Artificial Sequence
  Synthetic
acgaaatcaggtatattagcaatacgataaaaacactagggaatgccatagaaagtttgcaatctggatctttaa

SEQ ID NO: 268841 - DNA, 75 bp, Artificial Sequence
  Synthetic
attgggcagatatatgcgaaaataaagcaagagggcttaaaatagaaataaatgctgacatgtccaaatggagtg

SEQ ID NO: 268842 - DNA, 75 bp, Artificial Sequence
  Synthetic
cccaagatgtactttttaagtatttttggttgatagtacttgatcccatcttgtatcctgctgagaggaaaagga

SEQ ID NO: 268843 - DNA, 75 bp, Artificial Sequence
  Synthetic
taatttatttcctctgtaattatatgcagaaaaggcttataatgcctgatgaattgctcactactatattggatc

SEQ ID NO: 268844 - DNA, 75 bp, Artificial Sequence
  Synthetic
gtaactggcttcaaggcaacttgaattatacaagcagttacttacacagctgtagtatgtctgtatacaaagata

SEQ ID NO: 268845 - DNA, 75 bp, Artificial Sequence
  Synthetic
tgtagtatgtctgtatacaaagatataataagagaagcagcaacattattagagggagaagcccttgtgaactca

SEQ ID NO: 268846 - DNA, 75 bp, Artificial Sequence
  Synthetic
tagggccttatgaagatttagcaagtaggctatctgcaacacaaactgctataaagcatggttgtccaccgtcac

SEQ ID NO: 268847 - DNA, 75 bp, Artificial Sequence
  Synthetic
atgtgcggaatactagaaagtgatttatcaacaattgcactaactggtttagaagcaggaaatgtcacgttccta

SEQ ID NO: 268848 - DNA, 75 bp, Artificial Sequence
  Synthetic
gctcaggtatatatctcttgatagttcagtcacatctgatgacggtatgggagagactagtgaaatgagatctcg

SEQ ID NO: 268849 - DNA, 75 bp, Artificial Sequence
  Synthetic
atcacttttaacgcctcgtaaattcacaacaagtgggtcacttaataggttgaaatcatacaaagattttcaaga

SEQ ID NO: 268850 - DNA, 75 bp, Artificial Sequence
  Synthetic
aacgaactatttgagaatttcattagacacccagagctactggttacaaaaggcgaaacatttggagaatttgtt

SEQ ID NO: 268851 - DNA, 75 bp, Artificial Sequence
  Synthetic
gacatgccaggaattgaagaactagatacaattataggtcgcaaaacatttgttgagagttatgtccagatcgta

SEQ ID NO: 268852 - DNA, 75 bp, Artificial Sequence
  Synthetic
tgcaaaatgccagaggtccgaagtctaaaactcatacattactcgccagcagttgttttgagagcctatgtgaga

SEQ ID NO: 268853 - DNA, 75 bp, Artificial Sequence
  Synthetic
taaaactcatacattactcgccagcagttgttttgagagcctatgtgagagggccaacaaatgtgccaaatgtag

SEQ ID NO: 268854 - DNA, 75 bp, Artificial Sequence
  Synthetic
tcacatcaatagaattctgtggcgcactgacaggtaacttgataaatgacaaattatggtacataacacattact

SEQ ID NO: 268855 - DNA, 75 bp, Artificial Sequence
  Synthetic
accgtcaatcccttctggtggtatggatttatcagagctaatgaaatccacatccctattaagcttgaactatga

SEQ ID NO: 268856 - DNA, 75 bp, Artificial Sequence
  Synthetic
caaatttgaagaagcatttgacttccttgacatgggattttgctcgaatgaaaatcttagcattctggaggaaat

SEQ ID NO: 268857 - DNA, 75 bp, Artificial Sequence
  Synthetic
cataaatttgatataccctctaaattcctcaaagacccaataaaccgaacaataaattggacagaggtcattgaa

SEQ ID NO: 268858 - DNA, 75 bp, Artificial Sequence
  Synthetic
agtagtgtactaccagcaacaaacagtgacaatggcgaatttaataattatttcgatggttctgagcattgccta

SEQ ID NO: 268859 - DNA, 75 bp, Artificial Sequence
  Synthetic
attttttaaagggacatatatgccatactcaatgatcgaagcaatgtgcgttaacatagagctaataattctgac

SEQ ID NO: 268860 - DNA, 75 bp, Artificial Sequence
  Synthetic
taattgaaaattatatagaaaaagatgactctgatgctcttaaggccttatttagtaatattactgattctgtcc

SEQ ID NO: 268861 - DNA, 75 bp, Artificial Sequence
  Synthetic
gctcagctcatcattctataatgacaaacgaaattcccaaatctaatccttttactgattacagttattctaatg

SEQ ID NO: 268862 - DNA, 75 bp, Artificial Sequence
  Synthetic
taggcaagtttaaaatcaggtataaataaaattcatataaataaagtcaaaaattgttgttggtagcacactact

SEQ ID NO: 268863 - DNA, 75 bp, Artificial Sequence
  Synthetic
agtagtgtgctcctattccgaaacaaacaaaaacaatctcaaaatgtcacaactgttgctcaaccaatatcggaa

SEQ ID NO: 268864 - DNA, 75 bp, Artificial Sequence
  Synthetic
tagtctatgcaataatggctctccataatgaggaggcagaaatagcagaacttggctcactctactcaactttta

SEQ ID NO: 268865 - DNA, 75 bp, Artificial Sequence
  Synthetic
ctgagccatggtcagagatacctgctaagcgactgtcacttaatgttttaatttactcattgcaggaactgaatt

SEQ ID NO: 268866 - DNA, 75 bp, Artificial Sequence
  Synthetic
cgcaccgaggatcctaggcttattgatcttcgcgcatataggaaagtctacacacttgtctgtgtgaggcccatc

SEQ ID NO: 268867 - DNA, 75 bp, Artificial Sequence
  Synthetic
cacctatttgaccaacatggggttgaggtactccaaagcagtcaaagacaaatatggagatcgagaaattgaagg

SEQ ID NO: 268868 - DNA, 75 bp, Artificial Sequence
  Synthetic
cagagccaccatgacactcaatttgccacaaggtctctatggtaggttcaactgcaagcgttgttggtttgcaac

SEQ ID NO: 268869 - DNA, 75 bp, Artificial Sequence
  Synthetic
aaaaggattgatagcctgtagtgaccactatctttgtctaaactgcctgactataatgttgagtgatggcaactt

SEQ ID NO: 268870 - DNA, 75 bp, Artificial Sequence
  Synthetic
ttgcgaagtatgcggaaaaacacttccaaaaaagatagtctttgaagagagtccatctgctccaccctacgatgg

SEQ ID NO: 268871 - DNA, 75 bp, Artificial Sequence
  Synthetic
gtcccaatgcagaaagaccctgaacaacatcattttcatagtctcccccccttgttccgtcatacatgctattgt

SEQ ID NO: 268872 - DNA, 75 bp, Artificial Sequence
  Synthetic
ctaaagggaggccctcggcgcaccccccaaaggggggtgcgccgggggcccccccggcctggggccgggatgcgt

SEQ ID NO: 268873 - DNA, 75 bp, Artificial Sequence
  Synthetic
gagtgcaggcatcgatccaaactgatttatcattaatgagctgtctttgaacatcccacaccctcacaacaccat

SEQ ID NO: 268874 - DNA, 75 bp, Artificial Sequence
  Synthetic
tcactcgatttcctgaactgctggaatcactggtatcaacctcttgcaattaacacccttcaacctgaattcacc

SEQ ID NO: 268875 - DNA, 75 bp, Artificial Sequence
  Synthetic
tttttcatccccaatcatgatagtatccagactcttgctatacacaagctggaatgaaccaaaactcacccagtc

SEQ ID NO: 268876 - DNA, 75 bp, Artificial Sequence
  Synthetic
agcttcttccttgagtatgtctttaaagtggttgaaatatacttctgcaatgtctttaaggtctgatgacagaag

SEQ ID NO: 268877 - DNA, 75 bp, Artificial Sequence
  Synthetic
gctgatcaacgctgttcccttttttactgactttaaataataaaacaaggaccttaaaaatttcctgataagttc

SEQ ID NO: 268878 - DNA, 75 bp, Artificial Sequence
  Synthetic
atcatctgtcaacagttctagagccataaacaaagattttgctgtgacattcacatcaagtcttgaaactacttt

SEQ ID NO: 268879 - DNA, 75 bp, Artificial Sequence
  Synthetic
gtcaccctccataatgattcccttatcaatgtggagggggttcatacccacttgtggtccctgtattttgtagga

SEQ ID NO: 268880 - DNA, 75 bp, Artificial Sequence
  Synthetic
aaatttgttttttaattcttttatatgggaactaaaatcaagtttaacatttcccaggtgctttgaaacaccttt

SEQ ID NO: 268881 - DNA, 75 bp, Artificial Sequence
  Synthetic
acattatggtaagttccaggtcttcggttttcccctgattcagccagaagcgtaatccaattcagcctaggatca

SEQ ID NO: 268882 - DNA, 75 bp, Artificial Sequence
  Synthetic
taacatgtcatcttgcctaatggcaacttcatccaagcacagtgtttcggtacccgagataatgggcgttaatgg

SEQ ID NO: 268883 - DNA, 75 bp, Artificial Sequence
  Synthetic
gtaagttccaggtcttcggttttcccctgattcagccagaagcgtaatccaattcagcctaggatcacctgtgcg

SEQ ID NO: 268884 - DNA, 75 bp, Artificial Sequence
  Synthetic
tattaaggcagcaccatccagagatatatgatctcctccagattgtgaaacatagcactcaacctcttggacaat

SEQ ID NO: 268885 - DNA, 75 bp, Artificial Sequence
  Synthetic
taagcaaatctgatcatcttcatttaaggtgagctgctctatatccaatatgaccttagctattattgtataaac

SEQ ID NO: 268886 - DNA, 75 bp, Artificial Sequence
  Synthetic
agttgatctttcatacttgtacttaagacttcgtctaagatgagtaaaagtcaacccaatgctcaacactaattg

SEQ ID NO: 268887 - DNA, 75 bp, Artificial Sequence
  Synthetic
gctttccagagttgacttcagtagttcttcaagattattgtagtcttttctattctcccagtccacttttgttaa

SEQ ID NO: 268888 - DNA, 75 bp, Artificial Sequence
  Synthetic
gaatgttgagaaattcaaaaatacatcagataatttaatggttgaatgtacgaacccaacatcaagatcatctaa

SEQ ID NO: 268889 - DNA, 75 bp, Artificial Sequence
  Synthetic
attcatagctcgcgataagttcaatttcttacaatccattataaattgtgttaactgtcccagagggtgttcaca

SEQ ID NO: 268890 - DNA, 75 bp, Artificial Sequence
  Synthetic
atcatttggcaataactcaacttccccataccaaaagtattttttaaattggctgcttgttagaagaacaggtgt

SEQ ID NO: 268891 - DNA, 75 bp, Artificial Sequence
  Synthetic
aatcattgaatcaaataggatctgcaatagaaaattatggcatatttgttcattcgtcactctaaagcctccggc

SEQ ID NO: 268892 - DNA, 75 bp, Artificial Sequence
  Synthetic
aagttcttgagactctctagtgtgagacatagactgctcattctgtttcactatgtataattcttcccttttcct

SEQ ID NO: 268893 - DNA, 75 bp, Artificial Sequence
  Synthetic
cttgatcatgtggcttataatacccaagctttcactgaccatatctattgccacacagatatctaagaacttgac

SEQ ID NO: 268894 - DNA, 75 bp, Artificial Sequence
  Synthetic
cttttgcacccaagacaactttagtgtatttaaatctgtcaaataaggtgctaaatgttcctcgaagatgtcggg

SEQ ID NO: 268895 - DNA, 75 bp, Artificial Sequence
  Synthetic
gtagttcctctttattgaatatagtacatgattcataccaattttgtcctcaagttcagtatgtgatgcaggctt

SEQ ID NO: 268896 - DNA, 75 bp, Artificial Sequence
  Synthetic
tactggccagaagaagttgggattatccaatttgtaaaccacatcaggaatcttaggtttagaaaatacccagtt

SEQ ID NO: 268897 - DNA, 75 bp, Artificial Sequence
  Synthetic
tcctaattcacatgcattggtcaagacaagggcaaaatagtcccaaaacaaaggccttgaaaaatcactcacagc

SEQ ID NO: 268898 - DNA, 75 bp, Artificial Sequence
  Synthetic
tttaagggattccttacaatatattccactagacactttgcaaacatcacaattcttatgatactgaattttact

SEQ ID NO: 268899 - DNA, 75 bp, Artificial Sequence
  Synthetic
caaaatatccttaatgtacatgaaaccacccttaccatctcggacacatttagatcccatactcttgcaaattcc

SEQ ID NO: 268900 - DNA, 75 bp, Artificial Sequence
  Synthetic
gacgaaccctgctgcaatgcagctctgaaaagcagatttattcacagcatctgttatgatcttccttgcccctct

SEQ ID NO: 268901 - DNA, 75 bp, Artificial Sequence
  Synthetic
tacaaagttcttcgataattttgattgaacagacttaattaagctgggcacttcttctctctgtataaccctatt

SEQ ID NO: 268902 - DNA, 75 bp, Artificial Sequence
  Synthetic
agagcccattaactttgtcctcaagaccattctcaaatctccatgtgcccttaaattcagccatctaatgtcaag

SEQ ID NO: 268903 - DNA, 75 bp, Artificial Sequence
  Synthetic
cagccttgagatattctgctccggcaccccaaggatccctgcaagcagtgtgaaacactcatcaggatctgattg

SEQ ID NO: 268904 - DNA, 75 bp, Artificial Sequence
  Synthetic
catagatgatattaaatactcctcctgaacctgaccatttctgatcaaataaaacaaccttgcagccatatctct

SEQ ID NO: 268905 - DNA, 75 bp, Artificial Sequence
  Synthetic
gacatactcaggtatctcatcatcattgtatacattttccacagatctttggagcctatacccccttgacccatc

SEQ ID NO: 268906 - DNA, 75 bp, Artificial Sequence
  Synthetic
aacccaatctttcacatccatgtcattcaggcacaggaatggattacttgggtgacctgagtacttaattatgtt

SEQ ID NO: 268907 - DNA, 75 bp, Artificial Sequence
  Synthetic
atttgttctctttgaaattgctccaacaacttcaactgaaacaccattggcaacacactgatcttgtatggtgtc

SEQ ID NO: 268908 - DNA, 75 bp, Artificial Sequence
  Synthetic
aattgtctcacataactgattaggtgcctttgctttcacattatgcaaagcagctgctgtgaactttgtcaaaag

SEQ ID NO: 268909 - DNA, 75 bp, Artificial Sequence
  Synthetic
aggcacttcctgtgaccaaatataaaaccttgatttgaattcacatgcaaatgtaccagcaacagtctttggact

SEQ ID NO: 268910 - DNA, 75 bp, Artificial Sequence
  Synthetic
aatgaacttattgagagttgctgacaagtagttgtgaaattctaaaaactccaatgacttgtcaatgtctaagga

SEQ ID NO: 268911 - DNA, 75 bp, Artificial Sequence
  Synthetic
ttcatcctggttctttaaatcattagtaacacctagcagaatctcatcatcactagaggtgaatgccatactaag

SEQ ID NO: 268912 - DNA, 75 bp, Artificial Sequence
  Synthetic
aacaccaacacacgtctgaagtgcataagatataaattgttctgttatcaatccatagaaatcagagacattatg

SEQ ID NO: 268913 - DNA, 75 bp, Artificial Sequence
  Synthetic
cagaatcccttgtcccatgtctaatacagaagatatatgagacgggatcacttcatctgcgaaaaacttgtccat

SEQ ID NO: 268914 - DNA, 75 bp, Artificial Sequence
  Synthetic
gaaatcttcagttttactagtcctattatccattagcccacatagccgtttcaaataaccttttgtataagcatg

SEQ ID NO: 268915 - DNA, 75 bp, Artificial Sequence
  Synthetic
taccacattaaagggaacctcaaccactttatgtatatgccaactaaggagattcaaaataggttctttgtctat

SEQ ID NO: 268916 - DNA, 75 bp, Artificial Sequence
  Synthetic
ttgggatccatctggaagggaaaactgcaacgccttaaacaactgtgaaaagataactggactcatgtgtggccc

SEQ ID NO: 268917 - DNA, 75 bp, Artificial Sequence
  Synthetic
ccattttgaatggtccattgaaacagtaaaaccagaccttctaacaacagacttcatatctaagagagccctctc

SEQ ID NO: 268918 - DNA, 75 bp, Artificial Sequence
  Synthetic
aaactcagcttcattattcagacatgtgtacttcatcttctccattaggcattcaaaataatcctcaatcaatct

SEQ ID NO: 268919 - DNA, 75 bp, Artificial Sequence
  Synthetic
tgtcattaatttggtgtttaaatcccccacatataattccctatttccaccaacttgttccttataagacaatcc

SEQ ID NO: 268920 - DNA, 75 bp, Artificial Sequence
  Synthetic
aaacttcaaccttcccagatctgaagaaacactatcaaatgcagttggtgattcttcagagtagaaacaaagatt

SEQ ID NO: 268921 - DNA, 75 bp, Artificial Sequence
  Synthetic
tctaagagatgaattagtgaaaaagctcttgtccaacctctttaaaattgactcagagttgctctctctacaact

SEQ ID NO: 268922 - DNA, 75 bp, Artificial Sequence
  Synthetic
aattctagcatcctctctgattcttgtagcagattgcttaaaacctagtctacacatgtttttatgatcatacct

SEQ ID NO: 268923 - DNA, 75 bp, Artificial Sequence
  Synthetic
acccaccttattgtcaaacccagtagaaaccaggatgtatttaaaacattcaaagtaatcctcctcttcataata

SEQ ID NO: 268924 - DNA, 75 bp, Artificial Sequence
  Synthetic
tttcctacataggttcttcattaaatattcaagtgggcatggattcaatatcctatcagtgaaatattgattcct

SEQ ID NO: 268925 - DNA, 75 bp, Artificial Sequence
  Synthetic
agaattgctattaaaaaccagttcaaccaactccttatatgtttcatgatgaaacaaggtataatcaaagtcctt

SEQ ID NO: 268926 - DNA, 75 bp, Artificial Sequence
  Synthetic
aacctcatgtttggatgtctccgattcaataacacagagtatttcttttgcccacaatgactttagaggattctt

SEQ ID NO: 268927 - DNA, 75 bp, Artificial Sequence
  Synthetic
atcatctggtccagttccaattctaggttccacattggctgctttgcttaagcattcattgacctccatttctat

SEQ ID NO: 268928 - DNA, 75 bp, Artificial Sequence
  Synthetic
tttctcaatcatttctaactgttcatcagttatctcgtccaaaaactcatcctgagacatctcaagtttattttc

SEQ ID NO: 268929 - DNA, 75 bp, Artificial Sequence
  Synthetic
ttttggtgttttgtcactcacaagagaaaggaaccttttgtatattttatattttaaagtgtgtggatccaactt

SEQ ID NO: 268930 - DNA, 75 bp, Artificial Sequence
  Synthetic
gtacctcaatttatttttgaatccctcagacaaatcaacaatcactgatgaaactactgctgcataatcgtatgt

SEQ ID NO: 268931 - DNA, 75 bp, Artificial Sequence
  Synthetic
actaagtgggttgcccaactcatccagttttggcaccacaacactcttattgctactcatatccaatgcagtact

SEQ ID NO: 268932 - DNA, 75 bp, Artificial Sequence
  Synthetic
tgtaaatgaaggagactgtggatcccttttcaacttgccattcacatccagttctcctaaattgaacaatgaaca

SEQ ID NO: 268933 - DNA, 75 bp, Artificial Sequence
  Synthetic
acaaagactcataacagtagggttaactcctggtttactaatttgatctgatgtattcaattgcttacttaggag

SEQ ID NO: 268934 - DNA, 75 bp, Artificial Sequence
  Synthetic
tctatctatgtctaaaagaattttggactcctcttcttctgtcatattaccatttaaactagagtttacaatgac

SEQ ID NO: 268935 - DNA, 75 bp, Artificial Sequence
  Synthetic
tgatccaaaatctatttttggctccatgaacttttcaaaacatttaatttgatcagtcaatctatctggagtctc

SEQ ID NO: 268936 - DNA, 75 bp, Artificial Sequence
  Synthetic
ttttgtgatcagatggcacaagtaagacacattcaacaaaaacttaaatgttttagacatatttggttgatttga

SEQ ID NO: 268937 - DNA, 75 bp, Artificial Sequence
  Synthetic
catatttaacagtgcaactactaaatcatcagctaatgtcattgttgcccactctgacctacttttgacttcaac

SEQ ID NO: 268938 - DNA, 75 bp, Artificial Sequence
  Synthetic
ctctagtttggccaataactgaacatgatgaatttcattgacatatgccattaaaaagtatctcaatccttgcag

SEQ ID NO: 268939 - DNA, 75 bp, Artificial Sequence
  Synthetic
ataaagttgcacccttttggacggacatgctaaaactgataagatcaaccttcttagcatagatgatatcaggtt

SEQ ID NO: 268940 - DNA, 75 bp, Artificial Sequence
  Synthetic
caagtcatcacccttgatgaagtccaaccatgacaacatctcttgagtcattgacaacaaaacctgttgtgacat

SEQ ID NO: 268941 - DNA, 75 bp, Artificial Sequence
  Synthetic
tataggcaaaaagaatctcttagggtcacaataaaatgagactatatggccaaccttgccactgtttgagcataa

SEQ ID NO: 268942 - DNA, 75 bp, Artificial Sequence
  Synthetic
tgaataacatctgttcctttctcctgtcttctgataaagtaatgaaacaccatatgcatggtgtaaactttgaaa

SEQ ID NO: 268943 - DNA, 75 bp, Artificial Sequence
  Synthetic
aaaacattcttcacatttaacagtgccgtagtaatcatttggttgatttatatgaaatctggaagtccctgatgt

SEQ ID NO: 268944 - DNA, 75 bp, Artificial Sequence
  Synthetic
cttcatcgaattaaccaaacctagactaagtgtggacaaggaatcaagatactgtttaaatgttgattctttcat

SEQ ID NO: 268945 - DNA, 75 bp, Artificial Sequence
  Synthetic
ctccagccattcaataacttcaggatcagtcttttcatgaacctcttcttctgaaactgtgtactgtatttccag

SEQ ID NO: 268946 - DNA, 75 bp, Artificial Sequence
  Synthetic
tcttctttcaaatgtagttgagtacaattctaaataatttgaccataagtccaaatcaagctcaactaaatgagg

SEQ ID NO: 268947 - DNA, 75 bp, Artificial Sequence
  Synthetic
ccttacaaacaccttaaaatcttcctgaatgtacccaggaagcaaatttaattttaacatcactttggacaacca

SEQ ID NO: 268948 - DNA, 75 bp, Artificial Sequence
  Synthetic
ctgagggtttcttgtgcacttcttattataaagatcaatgataagtgacggggacaccagcctatcattaacaga

SEQ ID NO: 268949 - DNA, 75 bp, Artificial Sequence
  Synthetic
ttgaagacaaccacccaccattaaatcaaacacaatttctccgtaggttctcagtaaactcagaaatgcattaaa

SEQ ID NO: 268950 - DNA, 75 bp, Artificial Sequence
  Synthetic
catgaccacatccagtgataataatgtgtttctcctagtatttagaatcttttgcccttttatcttattacatgt

SEQ ID NO: 268951 - DNA, 75 bp, Artificial Sequence
  Synthetic
agagagtataagaccatattctctccttatcataccaattctaggagcttctttctcatctgtagtctgtctctt

SEQ ID NO: 268952 - DNA, 75 bp, Artificial Sequence
  Synthetic
cagcaagccaaggaccttgattaggtgatttgaacataagtggcagtcccctttactatcaaatttcgaaaccct

SEQ ID NO: 268953 - DNA, 75 bp, Artificial Sequence
  Synthetic
tgacacctttaaaagagaatgctcttttaacttattcaacagaaagtcttggttagtttgagtgtaggccctttc

SEQ ID NO: 268954 - DNA, 75 bp, Artificial Sequence
  Synthetic
cacagtgcctgactctaatctaagcctaaattcattaaatatctcaattagcttcagtctgcattctccaaggct

SEQ ID NO: 268955 - DNA, 75 bp, Artificial Sequence
  Synthetic
catgtttggtctaatgttctttgtgaaaagagcttgaagttttttcttgtacgtcaggccagtttgcttcaattg

SEQ ID NO: 268956 - DNA, 75 bp, Artificial Sequence
  Synthetic
gctaatggactctaatccaagattctggttttccatagtagacagactatgaatcagtctgctgtattctgtttc

SEQ ID NO: 268957 - DNA, 75 bp, Artificial Sequence
  Synthetic
ctcaatatcctcaccctcatctttaagactatccatgacttttagtaacaaccacctcaatctctcaatcaccca

SEQ ID NO: 268958 - DNA, 75 bp, Artificial Sequence
  Synthetic
atccggtattgcctcaacataatagttactcctcccatcaataacaggaaccaatgttatgccatatgatgttaa

SEQ ID NO: 268959 - DNA, 75 bp, Artificial Sequence
  Synthetic
atctttggcaagactcattaacttttcaaaatctgctgcatattttttctcaaaagcagattgattggacctcac

SEQ ID NO: 268960 - DNA, 75 bp, Artificial Sequence
  Synthetic
gaaaacctcgaggagtataaggacatccccacatagataataaccatcaggtgtgcattccgggagggttggacc

SEQ ID NO: 268961 - DNA, 75 bp, Artificial Sequence
  Synthetic
aaccaacttatgatctttgagtatcatgttgactgttttattcctattcggaatgcatttgtgctttagacaaga

SEQ ID NO: 268962 - DNA, 75 bp, Artificial Sequence
  Synthetic
gtcaacttccactatgagtgacagtaatttgagaccttctataacaacagccctggtgtgaacctgggataaggt

SEQ ID NO: 268963 - DNA, 75 bp, Artificial Sequence
  Synthetic
caaagatttttgttctatataatgttcttcatctgggacccattttcttatgagatcctttagttctgaaattat

SEQ ID NO: 268964 - DNA, 75 bp, Artificial Sequence
  Synthetic
cccattttcttatgagatcctttagttctgaaattatttccgtcatgatctaggaagcctaggatcctcggtgcg

SEQ ID NO: 268965 - DNA, 75 bp, Artificial Sequence
  Synthetic
cgcacagtggatcctaggctattgagaatctctgcgcattggaatctccaagatgggacaacttgtgaccctctt

SEQ ID NO: 268966 - DNA, 75 bp, Artificial Sequence
  Synthetic
agatgggacaacttgtgaccctcttccaatcgatcccagagatcatagaggaggcagtcaacattgctctcattg

SEQ ID NO: 268967 - DNA, 75 bp, Artificial Sequence
  Synthetic
ctgttgcaataatgtgcattgttaaaggcactgtcaacctatggaagtgtggtattgtccaactgtgcatctttc

SEQ ID NO: 268968 - DNA, 75 bp, Artificial Sequence
  Synthetic
tactgttggcagggaaaagatgtgatgggtttcaaattgataggaggcacaaactggagtcagttgagttcaacc

SEQ ID NO: 268969 - DNA, 75 bp, Artificial Sequence
  Synthetic
tcaccagaatgttcaacaacctcccaatgtcctgtagcaaaaacaacactcaccattactacaaggggccagagg

SEQ ID NO: 268970 - DNA, 75 bp, Artificial Sequence
  Synthetic
gaacaaactgggggattgagttgaccttgaccaatgaatctgttgctaattactctaatatgtcagccataagga

SEQ ID NO: 268971 - DNA, 75 bp, Artificial Sequence
  Synthetic
gccttgcatatggaaacataaccaactgtgataagactaatgaagcaggtcataccttaaaatggttgctaaatg

SEQ ID NO: 268972 - DNA, 75 bp, Artificial Sequence
  Synthetic
agctacactttaatgtactacatgtgacacggcacattggtgcaaggtgcctaactacagactcagcgggcatac

SEQ ID NO: 268973 - DNA, 75 bp, Artificial Sequence
  Synthetic
tcatacagtataacttgactgtaggagattatggaggtgaggttgggagacacttaattgcttcactagcacaaa

SEQ ID NO: 268974 - DNA, 75 bp, Artificial Sequence
  Synthetic
ttataggggatgacaaagcagcgtgggtgggcaaatgcttcaacaactgttccgcaaatggtacctgtcgactta

SEQ ID NO: 268975 - DNA, 75 bp, Artificial Sequence
  Synthetic
ccaactgtgaaggctacacacattacaattacctaataattcaaaatacaacatgggaaaatcactgtagttact

SEQ ID NO: 268976 - DNA, 75 bp, Artificial Sequence
  Synthetic
caccaatgtctactatcagaatggcactaaacaaagttgcttacagttctgtttcaagaaagctactgggctttt

SEQ ID NO: 268977 - DNA, 75 bp, Artificial Sequence
  Synthetic
tcacttgggacatatctgattcatcaggaaggcatgtgccaggtggctactgtcttgaacaatgggcacttgtct

SEQ ID NO: 268978 - DNA, 75 bp, Artificial Sequence
  Synthetic
gggcaggtataaaatgctttgacaactcagtgatggcaaaatgcaacaaagaccataatgaagagttttgtgata

SEQ ID NO: 268979 - DNA, 75 bp, Artificial Sequence
  Synthetic
ctatgagactctttgacttcaaccaaaatgctataaaaactttacaattgaacactgagaattccatcaatcttc

SEQ ID NO: 268980 - DNA, 75 bp, Artificial Sequence
  Synthetic
tgaaaaggagtattaacggtttgatatccgattctcttgttataagaaacagtctcaaacaattggctagaattc

SEQ ID NO: 268981 - DNA, 75 bp, Artificial Sequence
  Synthetic
cttattgtaattacacaaaattctggtatgttaatgacacaatcactaaaagacatagtcttcctcaatgctggc

SEQ ID NO: 268982 - DNA, 75 bp, Artificial Sequence
  Synthetic
tgacatacaacggaagttatctaaatgaaacccactttaggaatgattggctgctagaaagtcaacaactataca

SEQ ID NO: 268983 - DNA, 75 bp, Artificial Sequence
  Synthetic
atgacatgctagtcaaagaatatgaagagaggcagggaaaaaccccaattgcattgacagacatctgcttttgga

SEQ ID NO: 268984 - DNA, 75 bp, Artificial Sequence
  Synthetic
gcctagtttattttacagtctcagtcttcttacaacttgtagggattccatctcaccgacacattgtgggtcaag

SEQ ID NO: 268985 - DNA, 75 bp, Artificial Sequence
  Synthetic
gctgtccaaaaccccatagaatctctagaaatggattatgtagttgtggatattataacatcccaatgaaaccag

SEQ ID NO: 268986 - DNA, 75 bp, Artificial Sequence
  Synthetic
tgagatgggttaggaaaggcaaataaactaaattggcctctgccgccctgatgtctcaccccctttgggggtgag

SEQ ID NO: 268987 - DNA, 75 bp, Artificial Sequence
  Synthetic
acatcagggcccatgaatgtcttcataggttaatcagattcagatcatctttgaatagaaggtcaatggggatga

SEQ ID NO: 268988 - DNA, 75 bp, Artificial Sequence
  Synthetic
gctgtcgaggtttcacatcccgtatgtagccggtaacagtggcatcgaacataatgcaatccatcaatgcacagt

SEQ ID NO: 268989 - DNA, 75 bp, Artificial Sequence
  Synthetic
gtggattggtggaggatgggggagcacccttcttctttttcttgatcaccaaccctgtgtgtttctcacagagtg

SEQ ID NO: 268990 - DNA, 75 bp, Artificial Sequence
  Synthetic
gattgaacctatcccaaactggatcctcaaagaccctcgcatgttcagaggtcaatttgacatcaacaaccttaa

SEQ ID NO: 268991 - DNA, 75 bp, Artificial Sequence
  Synthetic
tatctctcctcccatgcattaaaatcagctgttctatatcatcactgccttgggcagtgagcaccatcccctttg

SEQ ID NO: 268992 - DNA, 75 bp, Artificial Sequence
  Synthetic
gtagtgcctttataattgcacttattaaaccaggtctggcagcctttagatcctttagaagcaagccatgtgaat

SEQ ID NO: 268993 - DNA, 75 bp, Artificial Sequence
  Synthetic
acctactttggtctttgaatgcactttcattatgaggtgctctataacagtgtaagtagttcccgctttcaggtt

SEQ ID NO: 268994 - DNA, 75 bp, Artificial Sequence
  Synthetic
ggtaaatggcaagttccacaggatctcctgctggcccctctatgtcaatccatgttgtttctttaggtgacaact

SEQ ID NO: 268995 - DNA, 75 bp, Artificial Sequence
  Synthetic
tttgaactgcttgattaatcaggtcttcttgtcccttactcagaggactcaagttgattggacctccatttttca

SEQ ID NO: 268996 - DNA, 75 bp, Artificial Sequence
  Synthetic
caggcggaggactcactgcaggcttcccttctaagtcgatcaatgtgttgtcccaggctctcccaacaatttgag

SEQ ID NO: 268997 - DNA, 75 bp, Artificial Sequence
  Synthetic
atctcgacccaatgtaaggccaaccctctccactcagacaaagtttgtaaagtagattttcatatggattccttt

SEQ ID NO: 268998 - DNA, 75 bp, Artificial Sequence
  Synthetic
gaacacccacagatcccacaaacatctgctccctgttctttacttgtagaacagcttttattatggagctaaaca

SEQ ID NO: 268999 - DNA, 75 bp, Artificial Sequence
  Synthetic
taggtggactcatctttatggtctccaacatgtttcccccatcaatcatacaagctcccgctttcacagctgcag

SEQ ID NO: 269000 - DNA, 75 bp, Artificial Sequence
  Synthetic
agagactcagattgtaaccagagatgtttatctgtgattgttcctgggtaattgatttaagacacgggtgttgtt

SEQ ID NO: 269001 - DNA, 75 bp, Artificial Sequence
  Synthetic
cactcagcttctccaagtcatcaagatttggaaatttcactgtgtaaaccagtcccaatgcagaaagaccctgaa

SEQ ID NO: 269002 - DNA, 75 bp, Artificial Sequence
  Synthetic
atttggaaatttcactgtgtaaaccagtcccaatgcagaaagaccctgaacaacatcattcatagtctccccccc

SEQ ID NO: 269003 - DNA, 75 bp, Artificial Sequence
  Synthetic
ttgttccgtcatacatgctattgtgagtgcaggcatcgatccaaactgatttatcattaatgagctgtctttgac

SEQ ID NO: 269004 - DNA, 75 bp, Artificial Sequence
  Synthetic
atcccacaccctcacaacaccatttccagatctaagtccagggcccattcctacaagtttcattagttcagctct

SEQ ID NO: 269005 - DNA, 75 bp, Artificial Sequence
  Synthetic
ctggtttagttgtgttgctgttaagttaccctggtaaacaccagggttacccccttcagctcttatcaccttctt

SEQ ID NO: 269006 - DNA, 75 bp, Artificial Sequence
  Synthetic
tctgagcttctccaaatctgctgaaagttccaaaagttcatcctttgagaggccaccagctctcaggacaacatt

SEQ ID NO: 269007 - DNA, 75 bp, Artificial Sequence
  Synthetic
gtgctgagtagatctcattgacatcaaggcgtccacctctttgttcatgtctctaagtcttgtgagatctgaatc

SEQ ID NO: 269008 - DNA, 75 bp, Artificial Sequence
  Synthetic
tgttctcttctcttttctcataatcctttggacttgtgcaacctgattgaaatcaagagcagatattattgccct

SEQ ID NO: 269009 - DNA, 75 bp, Artificial Sequence
  Synthetic
tgcatcctttatcacatctaccttaacaggctctgtccagttagacaggcccctcctgagggcttgagtccaccg

SEQ ID NO: 269010 - DNA, 75 bp, Artificial Sequence
  Synthetic
gaagctgggaacctgtttttcagacattatggtaagttccaggtcttcggttttcccctgattcagccagaagcg

SEQ ID NO: 269011 - DNA, 75 bp, Artificial Sequence
  Synthetic
gtaagttccaggtcttcggttttcccctgattcagccagaagcgtaatccaattcagcctaggatccactgtgcg

SEQ ID NO: 269012 - DNA, 75 bp, Artificial Sequence
  Synthetic
cgcacagtggatcctaggctattgagatctctgcgcattggaatctccaagatgggacaacttgtgaccctcttc

SEQ ID NO: 269013 - DNA, 75 bp, Artificial Sequence
  Synthetic
gggcagtgagcaccatcccctttggtagtgcctttataattgcacttattaaaccaggtctggcagcctttagat

SEQ ID NO: 269014 - DNA, 75 bp, Artificial Sequence
  Synthetic
tagtgcctttataattgcacttattaaaccaggtctggcagcctttagatcctttataagcaagccatgtgagta

SEQ ID NO: 269015 - DNA, 75 bp, Artificial Sequence
  Synthetic
ggccttataccccgacttgccgagtttctctaggagagtccctttcccagccttgaggcggctggtcaataaaag

SEQ ID NO: 269016 - DNA, 75 bp, Artificial Sequence
  Synthetic
caagaattttaccaaaaatatacagattgcctgtctaaattcaaaccaattatggccatatgttttaggagttgt

SEQ ID NO: 269017 - DNA, 75 bp, Artificial Sequence
  Synthetic
cacaatagtattagtaacacagtttatagactatttcaagaactggccagaataccgtcaagaattagtactcag

SEQ ID NO: 269018 - DNA, 75 bp, Artificial Sequence
  Synthetic
ccccaccagtcgaagacaacttgtaataagacgggtggaataaggatgcttaaagcatggtgtaaatattctttt

SEQ ID NO: 269019 - DNA, 75 bp, Artificial Sequence
  Synthetic
aatgacttaattagagttgaaccaattggggtttggatacagggggagccaggacaagggaaatccttcctaaca

SEQ ID NO: 269020 - DNA, 75 bp, Artificial Sequence
  Synthetic
aggacaagggaaatccttcctaacacatacactgtccagacagttacaaagatcttgcaagttaaatggagttta

SEQ ID NO: 269021 - DNA, 75 bp, Artificial Sequence
  Synthetic
gtttgtgagatgtctaatgacgtgtgggaacttattggaagcaacaatttgccatacggcatcctactgccagcg

SEQ ID NO: 269022 - DNA, 75 bp, Artificial Sequence
  Synthetic
caccaacccgactgccagtgagtttatggatgggtatgacaatcaggacattcatctcattgacgatctagggca

SEQ ID NO: 269023 - DNA, 75 bp, Artificial Sequence
  Synthetic
atggatgggtatgacaatcaggacattcatctcattgacgatctagggcaaactaggaaagaaaaagatattgaa

SEQ ID NO: 269024 - DNA, 75 bp, Artificial Sequence
  Synthetic
atgttatgtaattgcatatcatcagtcccttttattgtcccaatggcccatcttgaagaaaaaggtaaattttat

SEQ ID NO: 269025 - DNA, 75 bp, Artificial Sequence
  Synthetic
ctggggccgaaagccaaggtttaacagaccctttaggattggttaaaacctgaattgttgtggaagatactcagt

SEQ ID NO: 269026 - DNA, 75 bp, Artificial Sequence
  Synthetic
actagtaaattggtgatagcaactaccaataaatcagatttttcaagtactgtcctacaagactcgggtgctcta

SEQ ID NO: 269027 - DNA, 75 bp, Artificial Sequence
  Synthetic
acactagttgtaaggcccacgaaggatgcccagaaggtacccgtaggtaacaagtgacactatggatctgatctg

SEQ ID NO: 269028 - DNA, 75 bp, Artificial Sequence
  Synthetic
aagagaagatttccatacattatgcacatcagggccgcaaaggcttatagtaagtcaggcaaactcaatgttagc

SEQ ID NO: 269029 - DNA, 75 bp, Artificial Sequence
  Synthetic
gggccaactacttctatcatggtgagttggttaaaaaacgtctagtgggccaaacccaggggggatccctggttt

SEQ ID NO: 269030 - DNA, 75 bp, Artificial Sequence
  Synthetic
caagctatgtccacaatggccacaggtgaatgctgggaggtgtcaaaaaatggtagagattgggaaaccttgaaa

SEQ ID NO: 269031 - DNA, 75 bp, Artificial Sequence
  Synthetic
cctttttattttactacagccaatatggagacaatcaagagcattgcagacatggccactggtatcacaggaacc

SEQ ID NO: 269032 - DNA, 75 bp, Artificial Sequence
  Synthetic
ttacaagacttagtcaagaaaatcactgaagactatgaagagagacaaaggaattacaattgttggaaacaacaa

SEQ ID NO: 269033 - DNA, 75 bp, Artificial Sequence
  Synthetic
gttgactctacaattaactcagtaaatgagacaattggcaacacagacaatgcatcaggcggtgatattttgact

SEQ ID NO: 269034 - DNA, 75 bp, Artificial Sequence
  Synthetic
cttgagaatcaaactttagatgacctggatgatgctgtttcctacattaaacacaatttcccagatgcaattcct

SEQ ID NO: 269035 - DNA, 75 bp, Artificial Sequence
  Synthetic
agggttgcggatgatgcatccaacgtattagggcctaattgttatgccacaacatctgagccagaaaataaggat

SEQ ID NO: 269036 - DNA, 75 bp, Artificial Sequence
  Synthetic
tggatgatgctgtttcctacattaaacacaatttcccagatgcaattccttacattgatgaatatcttaatattg

SEQ ID NO: 269037 - DNA, 75 bp, Artificial Sequence
  Synthetic
aaatgtctactttgattgaacaaatggaagctttcattgaaccaagaccaagcgttttcaaatgctttgcaacca

SEQ ID NO: 269038 - DNA, 75 bp, Artificial Sequence
  Synthetic
atcagcaccaactatgccgtttaccccagactttgcaaatgtagacaatttccattctatggcttatgatattac

SEQ ID NO: 269039 - DNA, 75 bp, Artificial Sequence
  Synthetic
aggttgcaaacaaaacacggaaagctgccaaagaagttgtggactggttcagtagtaaaattaaatcaatgctga

SEQ ID NO: 269040 - DNA, 75 bp, Artificial Sequence
  Synthetic
cagcggggataaaaaccctagtaagttgataaggctggagacaggtgattggactttaactgcaaaaagatcaga

SEQ ID NO: 269041 - DNA, 75 bp, Artificial Sequence
  Synthetic
gttttgtggagagaaataaggcatggttgacggtagtctcagccgttaccagtgctatcagtatattacttttgg

SEQ ID NO: 269042 - DNA, 75 bp, Artificial Sequence
  Synthetic
ttgataaggctggagacaggtgattggactttaactgcaaaaagatcagacaaaattatgcatgtagagctaccc

SEQ ID NO: 269043 - DNA, 75 bp, Artificial Sequence
  Synthetic
taactaaaattttcaagaaggaagactcaaaggatgagagggcctataacccaacacttcctgccacaaaaccaa

SEQ ID NO: 269044 - DNA, 75 bp, Artificial Sequence
  Synthetic
aaggaactttcccagtcacgcagagagagttcaaaaatgaagcaccctacgatggacaattagaacacattatat

SEQ ID NO: 269045 - DNA, 75 bp, Artificial Sequence
  Synthetic
atcaaggtgctgcaggaagtgctctggtggtttatatgccaaaaccagttgtagaccatgaaacaaaaatggagt

SEQ ID NO: 269046 - DNA, 75 bp, Artificial Sequence
  Synthetic
ctcagatggcctacataactggatccactacagggcacctcactcactgcgcagggtaccagcatgatgaaatta

SEQ ID NO: 269047 - DNA, 75 bp, Artificial Sequence
  Synthetic
gcagggtaccagcatgatgaaattattttacatgggcattcaattaagtaccttgagcaagaagaggacctaacg

SEQ ID NO: 269048 - DNA, 75 bp, Artificial Sequence
  Synthetic
acacaagctgacttatgtattccctatgtatctgacacaaactatgttatgactgattcgtcggacttagggcac

SEQ ID NO: 269049 - DNA, 75 bp, Artificial Sequence
  Synthetic
ctacactataagaataaggtgttcccaattgaaaacccatctgtgacacaggtgacattaggtggcaagccaatg

SEQ ID NO: 269050 - DNA, 75 bp, Artificial Sequence
  Synthetic
gacctagccattctaaaatgcaaattaccattcagatttaagaaaaattccaagtattacaccaacaaaattgga

SEQ ID NO: 269051 - DNA, 75 bp, Artificial Sequence
  Synthetic
acaggtggatgtgactgttctgggtagccagttacaacttgatttccagaaccctagaccttacaataaacaagt

SEQ ID NO: 269052 - DNA, 75 bp, Artificial Sequence
  Synthetic
acagagagcatgttaatttggatgactgaacagggcatcattacaaaggaagttcaaagggttcaccattctggt

SEQ ID NO: 269053 - DNA, 75 bp, Artificial Sequence
  Synthetic
ggtattaaaactagggaaggtacagaaagtactaaaaccatcagttatactgtcaaatcatgcaaaggaatgtgt

SEQ ID NO: 269054 - DNA, 75 bp, Artificial Sequence
  Synthetic
caaatgtgttaagtacaactggagcccagtcggttgcccttgttggtgagcgagctttctatgacccaagatcag

SEQ ID NO: 269055 - DNA, 75 bp, Artificial Sequence
  Synthetic
ggtggactcctaatctctaaagttgaaggtaatttcaagatcttgggcatgcacatagctggtaatggtgagatg

SEQ ID NO: 269056 - DNA, 75 bp, Artificial Sequence
  Synthetic
ctggaagtaggtcacgattcgatgacttggtcaaaataacacaattattttcagtcatggctgattctgacacac

SEQ ID NO: 269057 - DNA, 75 bp, Artificial Sequence
  Synthetic
ggtgtggcagtaccatttaattttctcaagaatgatatgtctgatcaagggattgtcactgaggtgatacctata

SEQ ID NO: 269058 - DNA, 75 bp, Artificial Sequence
  Synthetic
tcagtcatggctgattctgacacaccatccaccacacatggacacgatgccaagggttatttcaaatggtctgct

SEQ ID NO: 269059 - DNA, 75 bp, Artificial Sequence
  Synthetic
catccaccacacatggacacgatgccaagggttatttcaaatggtctgctactactaaccccatgtatatcgtcc

SEQ ID NO: 269060 - DNA, 75 bp, Artificial Sequence
  Synthetic
caaccaatgtacataaatacaaagactcaaattaacaaaagcccagtttatggagctgttgaggtcaaaatgggt

SEQ ID NO: 269061 - DNA, 75 bp, Artificial Sequence
  Synthetic
atagaaatatagtgtatctgagactctttccaaacatcaacaattttgtaaatagtttctcatattttagagggt

SEQ ID NO: 269062 - DNA, 75 bp, Artificial Sequence
  Synthetic
ccagccgttctaagcaaatcagacactagattggtagagcctgtggattgcttaattaagaaatcagcatctaaa

SEQ ID NO: 269063 - DNA, 75 bp, Artificial Sequence
  Synthetic
aatagtttctcatattttagagggtcattagtgctgagattgaatgtgtatgctagcacattcaatagaggaaga

SEQ ID NO: 269064 - DNA, 75 bp, Artificial Sequence
  Synthetic
cattagtgctgagattgaatgtgtatgctagcacattcaatagaggaagacttaggatggggttctttcctaatg

SEQ ID NO: 269065 - DNA, 75 bp, Artificial Sequence
  Synthetic
tacagagtcaacaaatttcaagtgaataatgagctatggcaaggcgtcaaagcctgtgtcaagtctaaatttaga

SEQ ID NO: 269066 - DNA, 75 bp, Artificial Sequence
  Synthetic
tgctagcacattcaatagaggaagacttaggatggggttctttcctaatgccagtgaagatacagatgaggaatt

SEQ ID NO: 269067 - DNA, 75 bp, Artificial Sequence
  Synthetic
ccagtgaagatacagatgaggaattggacaatgccatctacactatttgtgatattggtagtgacaacagttttg

SEQ ID NO: 269068 - DNA, 75 bp, Artificial Sequence
  Synthetic
gaaatctttggagttaatggtattgttgatatgaaaactgcaatactaggaacttcacatgtcaactccatggac

SEQ ID NO: 269069 - DNA, 75 bp, Artificial Sequence
  Synthetic
tacttggatgcggaaaactgctggacaccccattgggttacttcaaattgaagtattgaatagattgacttataa

SEQ ID NO: 269070 - DNA, 75 bp, Artificial Sequence
  Synthetic
ctcagtacttcagctggatacagttttgtgaaatctgggtacaaaaaaaaagatttaatctgtttagatcccttt

SEQ ID NO: 269071 - DNA, 75 bp, Artificial Sequence
  Synthetic
tctgtttcgccaatgcttgaaaaactggtccaagataagtttcgtaatctcttgaaaggtaatcaaatcacaacc

SEQ ID NO: 269072 - DNA, 75 bp, Artificial Sequence
  Synthetic
tgtattttgcaaggtagaatgggagaagatgccaaatttttctgctctactggctctatagttacattccagaac

SEQ ID NO: 269073 - DNA, 75 bp, Artificial Sequence
  Synthetic
tggctctatagttacattccagaactcttggggctcacagatggacctcagcgacccattgtgtattgaagatga

SEQ ID NO: 269074 - DNA, 75 bp, Artificial Sequence
  Synthetic
atcttcaatacatgtctaaaggatgaacttaggaaattggacaaaattgctactggtaaaactaggtgcattgaa

SEQ ID NO: 269075 - DNA, 75 bp, Artificial Sequence
  Synthetic
tcttggggctcacagatggacctcagcgacccattgtgtattgaagatgatgctgaaaactgtaaacaaacaata

SEQ ID NO: 269076 - DNA, 75 bp, Artificial Sequence
  Synthetic
aacttaggaaattggacaaaattgctactggtaaaactaggtgcattgaagcctgcgaagtggactattgcatag

SEQ ID NO: 269077 - DNA, 75 bp, Artificial Sequence
  Synthetic
tccccaaatgaattaggtttaacatcagcacaggatgatggacctctaggtggggaaaaaccaaattactttcta

SEQ ID NO: 269078 - DNA, 75 bp, Artificial Sequence
  Synthetic
ttatgacaaaatttaccaaacaccatgttattattcaggccttgctgttggaatcaacccatataaagattggca

SEQ ID NO: 269079 - DNA, 75 bp, Artificial Sequence
  Synthetic
tgttattattcaggccttgctgttggaatcaacccatataaagattggcatttcatgatcaatgccttaaatgaa

SEQ ID NO: 269080 - DNA, 75 bp, Artificial Sequence
  Synthetic
tttcatgatcaatgccttaaatgaatataattatgaaatggactattctcagtatgatggctcacttagttcaat

SEQ ID NO: 269081 - DNA, 75 bp, Artificial Sequence
  Synthetic
ttttcacggtatctcatacaaaagtggacaatatatttggtcgcgcatggtttgtgataagccatgattttaaca

SEQ ID NO: 269082 - DNA, 75 bp, Artificial Sequence
  Synthetic
acgagggacaatggcccttagatttgacttttccatttgaaggtcatggttccttatcattattgtttgcatatt

SEQ ID NO: 269083 - DNA, 75 bp, Artificial Sequence
  Synthetic
gctactgtgggaagctgtggaagtgttggcatactgtcatgattctccagatcttgtgatgcaacttcacaagcc

SEQ ID NO: 269084 - DNA, 75 bp, Artificial Sequence
  Synthetic
agtgattgattctgatcacgtagtcttcaacgagagatggttgattcatggtggaatgccatctggctccccttg

SEQ ID NO: 269085 - DNA, 75 bp, Artificial Sequence
  Synthetic
tctattcttgtcagacaaaggcttcttgagggttgtacacacttatgatactgctgacaatagattagtcaactt

SEQ ID NO: 269086 - DNA, 75 bp, Artificial Sequence
  Synthetic
gtggaatgccatctggctccccttgcaccacagtgctcaattcattatgcaatctaatgatgtgcatatatacca

SEQ ID NO: 269087 - DNA, 75 bp, Artificial Sequence
  Synthetic
ggcctccaatggcgtgattaccataccagctggagaacaaatgtcattatcagccccattctattctcacaaacc

SEQ ID NO: 269088 - DNA, 75 bp, Artificial Sequence
  Synthetic
caaacttaatcagaccagggattgattgcttacccattgtgtatggtgatgatgtaatcttgtcattggacaaag

SEQ ID NO: 269089 - DNA, 75 bp, Artificial Sequence
  Synthetic
ccagctggagaacaaatgtcattatcagccccattctattctcacaaaccattgaggacggttagggacacccac

SEQ ID NO: 269090 - DNA, 75 bp, Artificial Sequence
  Synthetic
aaattgaaccagagaaactgcaaagtatcatggcagaatcatttggagctgaagtgactgggtcacgcaaggatg

SEQ ID NO: 269091 - DNA, 75 bp, Artificial Sequence
  Synthetic
caggatagaagtatatatgagtcttaggtgcccaaatttcttttttcctgttccagcaccaaaaaacacaccacg

SEQ ID NO: 269092 - DNA, 75 bp, Artificial Sequence
  Synthetic
gaagtgactgggtcacgcaaggatgaaccaccgtcactcaaacccaggatggaagtggaattccttaagcgcaaa

SEQ ID NO: 269093 - DNA, 75 bp, Artificial Sequence
  Synthetic
cctggttacttcccagagtctacttttatagtagggaaattagacactgaaaatatgatacaacatttaatgtgg

SEQ ID NO: 269094 - DNA, 75 bp, Artificial Sequence
  Synthetic
tacgcaaagtcgtgctttgcggggtgatatggctaatttggcaaatcggagtccgtatgaccagcaaccccgaag

SEQ ID NO: 269095 - DNA, 75 bp, Artificial Sequence
  Synthetic
gatatggctaatttggcaaatcggagtccgtatgaccagcaaccccgaagtcaaatgatgaaattggcttaccta

SEQ ID NO: 269096 - DNA, 75 bp, Artificial Sequence
  Synthetic
gatagaggtttctataagcactatggtattatagttggagagtatgtataccaattagattcagatgacatcttt

SEQ ID NO: 269097 - DNA, 75 bp, Artificial Sequence
  Synthetic
gttatgcctccatggaaaagacatttaccaacactacatcaaaattttggatccgtatcttaaagagtggaacat

SEQ ID NO: 269098 - DNA, 75 bp, Artificial Sequence
  Synthetic
taccaacactacatcaaaattttggatccgtatcttaaagagtggaacatcactgtggatgattatgatgtggta

SEQ ID NO: 269099 - DNA, 75 bp, Artificial Sequence
  Synthetic
aaaacagcactaacaggaagagctaaattcacaaagacaagactgacatcagaatggatagttgaagaagaatgt

SEQ ID NO: 269100 - DNA, 75 bp, Artificial Sequence
  Synthetic
cactgtggatgattatgatgtggtaattgctaaattgatgcccatggtgtttgattagaattaaagttttggttt

SEQ ID NO: 269101 - DNA, 75 bp, Artificial Sequence
  Synthetic
agaatggatagttgaagaagaatgtgaactggattatttcagaattaaatatcttgagtcagctgtaaattcaga

SEQ ID NO: 269102 - DNA, 75 bp, Artificial Sequence
  Synthetic
gcatatcttttcagtggataaaaactgtgaaaccattgccaaggatatttttggaacacataccctgagccaaca

SEQ ID NO: 269103 - DNA, 75 bp, Artificial Sequence
  Synthetic
ttaccaaaagtcttttgggacaaaaatagtaagccagcctatggccaatcgagatactttgcagcagtacggtgt

SEQ ID NO: 269104 - DNA, 75 bp, Artificial Sequence
  Synthetic
ctttacaattagacactaatttgattagaacactaattcggaatattggacatggcaaaaaaaaaaaaaaaaaaa

SEQ ID NO: 269105 - DNA, 75 bp, Artificial Sequence
  Synthetic
ttggaacacataccctgagccaacaccaagctattggcctaattggaactattcttttaactgctgggcttatgt

SEQ ID NO: 269106 - DNA, 75 bp, Artificial Sequence
  Synthetic
caactattaaaacaccagttaatgcaaccaccatcaaagagttctttaatcatgcgatagaaggtgatgaacagg

SEQ ID NO: 269107 - DNA, 75 bp, Artificial Sequence
  Synthetic
aaccaccatcaaagagttctttaatcatgcgatagaaggtgatgaacagggattatctctccttgtgcaaaaatg

SEQ ID NO: 269108 - DNA, 75 bp, Artificial Sequence
  Synthetic
acagaaatattagacaatgatttggttaaatttataattaagattttagttagaattttgtgttatatggttcta

SEQ ID NO: 269109 - DNA, 75 bp, Artificial Sequence
  Synthetic
tagaattttgtgttatatggttctatattgtcataaaccaaatattctcactacagcatgtttatcaacccttct

SEQ ID NO: 269110 - DNA, 75 bp, Artificial Sequence
  Synthetic
aattatggatgtgacctcttcctctgttctatcaccctcttgtaaagctcttatgcaatgtttaatggatggtga

SEQ ID NO: 269111 - DNA, 75 bp, Artificial Sequence
  Synthetic
gttctatcaccctcttgtaaagctcttatgcaatgtttaatggatggtgacgtgaagaaactagccgaggtggta

SEQ ID NO: 269112 - DNA, 75 bp, Artificial Sequence
  Synthetic
ggagaaagagcgttctatgacccaagaacagcaggaagtaagagtaggtttgatgacctggtaaaaatatctcaa

SEQ ID NO: 269113 - DNA, 75 bp, Artificial Sequence
  Synthetic
gaacagcaggaagtaagagtaggtttgatgacctggtaaaaatatctcaacttttttcagtgatgagtgactcca

SEQ ID NO: 269114 - DNA, 75 bp, Artificial Sequence
  Synthetic
gcagaatccatgtctaatacagatgatgatgaaattaaggaacaaatttgtgatacagttaaatatactaagact

SEQ ID NO: 269115 - DNA, 75 bp, Artificial Sequence
  Synthetic
atcttatcaaaccaggggccattcaaagggtttaatgaagtttctacagcttttagacatatagattggtggata

SEQ ID NO: 269116 - DNA, 75 bp, Artificial Sequence
  Synthetic
ttttagacatatagattggtggatacacacattactcaaaatcaaagatatggtccttagtgtattcaagccaag

SEQ ID NO: 269117 - DNA, 75 bp, Artificial Sequence
  Synthetic
tctagagagtaaagccatacaatggctagaaagaaataaggaacatgtgtgtggaattctagactatgcttctga

SEQ ID NO: 269118 - DNA, 75 bp, Artificial Sequence
  Synthetic
atttgtgatttgggcagtgataatagttttgaaatcactattccatattcattttccacctggatgcggaaaaca

SEQ ID NO: 269119 - DNA, 75 bp, Artificial Sequence
  Synthetic
gtggaattctagactatgcttctgatattattgtggagtcaaaggaccagtctaaagttaaaactcaagatttct

SEQ ID NO: 269120 - DNA, 75 bp, Artificial Sequence
  Synthetic
attttccacctggatgcggaaaacagatggtcacccgattggactgttccaaattgaggtacttaacaggttaac

SEQ ID NO: 269121 - DNA, 75 bp, Artificial Sequence
  Synthetic
gttttgaaatcactattccatattcattttccacctggatgcggaaaacagatggtcacccgattggactgttcc

SEQ ID NO: 269122 - DNA, 75 bp, Artificial Sequence
  Synthetic
atcagagatattctgattgtttatctaaatttaaaccaattatggccatttgttttagaagttgtcacaatagta

SEQ ID NO: 269123 - DNA, 75 bp, Artificial Sequence
  Synthetic
tcagtaatacagtttataggcttttccaggaattagctagaattcctaatagaatcagtaccaacaatgatctaa

SEQ ID NO: 269124 - DNA, 75 bp, Artificial Sequence
  Synthetic
tggggcaagatgccaggttcttttgtccaactggttctgtagtaactttccaaaattcatggggttcacaaatgg

SEQ ID NO: 269125 - DNA, 75 bp, Artificial Sequence
  Synthetic
atgttttggtttttttttgttatgaacaatataattaaaaaactaatttaataattacattattttgaaatattg

SEQ ID NO: 269126 - DNA, 75 bp, Artificial Sequence
  Synthetic
aaatctttcttaacccacaccctttccagacaattacaaaaatcatgcaagcttaatggagtttttacaaacccg

SEQ ID NO: 269127 - DNA, 75 bp, Artificial Sequence
  Synthetic
tatgaacaatataattaaaaaactaatttaataattacattattttgaaatattgaacttaccaaaaaaaaaaaa

SEQ ID NO: 269128 - DNA, 75 bp, Artificial Sequence
  Synthetic
tgagcttctccaggagagcccctttcccagccctgaggcggctggtcaataaaagcctcatctgtaacaaacatc

SEQ ID NO: 269129 - DNA, 75 bp, Artificial Sequence
  Synthetic
actgctagtgagtttatggacggttatgataaccaggatatacacttaattgatgacttgggccaaacaagaaag

SEQ ID NO: 269130 - DNA, 75 bp, Artificial Sequence
  Synthetic
atgataaccaggatatacacttaattgatgacttgggccaaacaagaaaggaaaaagacattgaaatgctatgta

SEQ ID NO: 269131 - DNA, 75 bp, Artificial Sequence
  Synthetic
ctggtctccactagttgaaggcaacttgcaataaaatgagtgggaacaagacgcttaaagcatggtgtaaatttg

SEQ ID NO: 269132 - DNA, 75 bp, Artificial Sequence
  Synthetic
attgtatttcttctgtcccatttattgtaccaatggcacatcttgaagaaaaaggaaagttctacaccagtaaat

SEQ ID NO: 269133 - DNA, 75 bp, Artificial Sequence
  Synthetic
cttttctaacccacactttgtgtggggtggcagatggcgtgccataattctattagtgagataccacgcttgtgg

SEQ ID NO: 269134 - DNA, 75 bp, Artificial Sequence
  Synthetic
gattctggggcactaaagaggagattcccttatatcatgcatatccgggctgcaaaggcttacagtaaggctggg

SEQ ID NO: 269135 - DNA, 75 bp, Artificial Sequence
  Synthetic
tgcaaaggcttacagtaaggctgggaagcttaatgtaagtcaggctatggcagcaatgtcaacaggtgagtgctg

SEQ ID NO: 269136 - DNA, 75 bp, Artificial Sequence
  Synthetic
ggaggtgtcaaagaatggaagagattgggaaacactgaagttaaaagaattagttgataaaattacaattgatta

SEQ ID NO: 269137 - DNA, 75 bp, Artificial Sequence
  Synthetic
taaaacctggaatgttgttgaagatacttagtacctgccgatctggtaatagcacaagcactagttgtaaggccc

SEQ ID NO: 269138 - DNA, 75 bp, Artificial Sequence
  Synthetic
tgggaaacactgaagttaaaagaattagttgataaaattacaattgattacactgagagggtaaagaattacaat

SEQ ID NO: 269139 - DNA, 75 bp, Artificial Sequence
  Synthetic
gcttggaaacaacagctagagaatcaaactttagatgatttagatgatgctgtatcatatatcaaacataatttc

SEQ ID NO: 269140 - DNA, 75 bp, Artificial Sequence
  Synthetic
ttggtgacctggttaaaaaacgtctagtgggccaaacccgggggggatccccggtttccttttaatttcatcaat

SEQ ID NO: 269141 - DNA, 75 bp, Artificial Sequence
  Synthetic
ccagatgcaataccatatattgatgagtatctcaatattgagatgtcaacactaatcgagcaaatggaagctttt

SEQ ID NO: 269142 - DNA, 75 bp, Artificial Sequence
  Synthetic
gccattatggagacaattaagagcattgcagatatggcgactggagtagtcagttcagttgattcaactatcaat

SEQ ID NO: 269143 - DNA, 75 bp, Artificial Sequence
  Synthetic
actaatcgagcaaatggaagcttttatagaaccaaagcctagtgtcttcaagtgttttgccaataagatcggcac

SEQ ID NO: 269144 - DNA, 75 bp, Artificial Sequence
  Synthetic
aaagatatctaaagcttctaaagaagtggtagattggttttcatgcaaaattaagtctatgctaagctttgttga

SEQ ID NO: 269145 - DNA, 75 bp, Artificial Sequence
  Synthetic
gcagttaatgagaaagcggaaaatgtaggtaatgaaattggaggtaatttattaactaaagtcgcagatgacgca

SEQ ID NO: 269146 - DNA, 75 bp, Artificial Sequence
  Synthetic
tctagtgtgcttgggccaaattgttatgccacaacagctgagcctgaaaacaaagatgtagtacaggcaaccaca

SEQ ID NO: 269147 - DNA, 75 bp, Artificial Sequence
  Synthetic
ttttaagaaggaagagtccaaagatgaaagagcatataatccaactttaccagtaactaaacccaagggtacttt

SEQ ID NO: 269148 - DNA, 75 bp, Artificial Sequence
  Synthetic
actgtcaacacaaccaatttgacacaacacccctccgcaccaacaatgcccttcactcctgatttctctaatgtt

SEQ ID NO: 269149 - DNA, 75 bp, Artificial Sequence
  Synthetic
cccagttactcaacgggaatttaagaatgaagccccttatgacggacaattagaacatatcatctcccaaatggc

SEQ ID NO: 269150 - DNA, 75 bp, Artificial Sequence
  Synthetic
gatacgttccactcaatggcatatgatattaccactggggagaaaaaccctagcaaattggttaggttggagact

SEQ ID NO: 269151 - DNA, 75 bp, Artificial Sequence
  Synthetic
catgagtggacaccaacctgggctagaggatatcagataacccatgtggaattgccaaaagtcttttgggacaaa

SEQ ID NO: 269152 - DNA, 75 bp, Artificial Sequence
  Synthetic
ctatatcactggttcaactactggccatttaacacattgtgctggttatcaacatgatgagataatacttcatgg

SEQ ID NO: 269153 - DNA, 75 bp, Artificial Sequence
  Synthetic
aacatgatgagataatacttcatggccattctattaagtacttagagcaagaagaggaactaacattacattaca

SEQ ID NO: 269154 - DNA, 75 bp, Artificial Sequence
  Synthetic
aacagtaaaccagcatatggtcaatcaagatattttgcagcagtacggtgtggtttccatttccaggtgcaagta

SEQ ID NO: 269155 - DNA, 75 bp, Artificial Sequence
  Synthetic
caagatattttgcagcagtacggtgtggtttccatttccaggtgcaagtaaacgttaatcaagggacagctggta

SEQ ID NO: 269156 - DNA, 75 bp, Artificial Sequence
  Synthetic
agaataaagttttcccaattgaacaaccctcagtcactcaagttacacttggtggaaaaccaatggatctggcta

SEQ ID NO: 269157 - DNA, 75 bp, Artificial Sequence
  Synthetic
ttctaaaatgtaagttaccatttaggtttaagaaaaactccaaatattacaccaataaaattggaacagaaagta

SEQ ID NO: 269158 - DNA, 75 bp, Artificial Sequence
  Synthetic
tgccacatgtgttgatgaatttagctgaaaccacacaggctgatttatgtatcccctatgttgctgacacaaact

SEQ ID NO: 269159 - DNA, 75 bp, Artificial Sequence
  Synthetic
tgttgatttggatgactgagcaaggcattataacaaaagaagttcaaagagtccaccattctggtggcatcaaaa

SEQ ID NO: 269160 - DNA, 75 bp, Artificial Sequence
  Synthetic
cattataacaaaagaagttcaaagagtccaccattctggtggcatcaaaacccgggaggggactgaaagcacaaa

SEQ ID NO: 269161 - DNA, 75 bp, Artificial Sequence
  Synthetic
ctgctacacaagttgatgtaactatactaggtagtttattgcaattggatttccaaaatcctagggtgtttggtc

SEQ ID NO: 269162 - DNA, 75 bp, Artificial Sequence
  Synthetic
aagacgttggtatttacgacaatgcaccaacgcggaagcaaaatatcaagaagattcttacaatgagtaccaagt

SEQ ID NO: 269163 - DNA, 75 bp, Artificial Sequence
  Synthetic
tccccttcaatttccttaagaatgatatgtctgaccaaggcattatcacagatgtgacacccatacaacctatgt

SEQ ID NO: 269164 - DNA, 75 bp, Artificial Sequence
  Synthetic
ggaaatggagaaatgggtgttgccatccccttcaatttccttaagaatgatatgtctgaccaaggcattatcaca

SEQ ID NO: 269165 - DNA, 75 bp, Artificial Sequence
  Synthetic
acaagtggactagacaaaaaattgacattgctgaaggaccaggttccatgaatatggcaaatgtactgagcacca

SEQ ID NO: 269166 - DNA, 75 bp, Artificial Sequence
  Synthetic
atatcaatactaaaacccaaatccacaagagtccagtctatggtgcagtggaagtcaaaatgggcccagcagttc

SEQ ID NO: 269167 - DNA, 75 bp, Artificial Sequence
  Synthetic
ctgcagcgcaatcaattgctttggttggggagagagcattttatgacccaagaacagcaggtagtaagagcagat

SEQ ID NO: 269168 - DNA, 75 bp, Artificial Sequence
  Synthetic
taagtaagtcagaccctagacttgaggagccagttgagtgtttaattaagaaatctgctgcaaagtacagagtca

SEQ ID NO: 269169 - DNA, 75 bp, Artificial Sequence
  Synthetic
ttgatgatttggtaaaaatatctcagcttttctctgtgatgagtgattccacaaccccttcagccaaccatggta

SEQ ID NO: 269170 - DNA, 75 bp, Artificial Sequence
  Synthetic
ataaattccaggttaacaatgaactatggcaaggcgttaaggcctgtgtcaagtcaaaatttagagaaatttttg

SEQ ID NO: 269171 - DNA, 75 bp, Artificial Sequence
  Synthetic
aagtcaaaatttagagaaatttttggagttaatggcattgttgacatgaaaactgcaatattaggaacttcacat

SEQ ID NO: 269172 - DNA, 75 bp, Artificial Sequence
  Synthetic
gtagtgcataggaacattgtttacttaaaactgttccccaacttgaatgtttttgtcaacagttactcatatttt

SEQ ID NO: 269173 - DNA, 75 bp, Artificial Sequence
  Synthetic
tgggtataaaaagaaagatttgatatgtttagagccattttctgtgtcaccaatgcttgagaaactggttcagga

SEQ ID NO: 269174 - DNA, 75 bp, Artificial Sequence
  Synthetic
caaattccacaaccttttgaagggtaatcaaattacaaccatcttcaacacatgtctaaaagatgaacttaggaa

SEQ ID NO: 269175 - DNA, 75 bp, Artificial Sequence
  Synthetic
attagacaagataacatctggtaaaaccagatgcattgaagcttgtgaagttgattactgcattgtctataggat

SEQ ID NO: 269176 - DNA, 75 bp, Artificial Sequence
  Synthetic
gataatgatggaaatatatgataaaatatatcagacaccctgttactactcagggcttgctgtgggtattaaccc

SEQ ID NO: 269177 - DNA, 75 bp, Artificial Sequence
  Synthetic
cttacaatagctccagccccaatgaagtttattgtattgtgcaaggcaaaatggggcaagatgccaggttcttct

SEQ ID NO: 269178 - DNA, 75 bp, Artificial Sequence
  Synthetic
atacaaagattggcactttatgattaatgcactaaatgactacaattatgaaatggattattcccagtatgatgg

SEQ ID NO: 269179 - DNA, 75 bp, Artificial Sequence
  Synthetic
atggggcaagatgccaggttcttctgtccaactggttctgtggtgactttccaaaactcatggggttcacaaatg

SEQ ID NO: 269180 - DNA, 75 bp, Artificial Sequence
  Synthetic
ccaaaactcatggggttcacaaatggatttgactgatccattatgtctagaagaatctgcagaggaatgtaaaca

SEQ ID NO: 269181 - DNA, 75 bp, Artificial Sequence
  Synthetic
ttcactcagctcaatgcttctgtgggaggcggtggaagtactggcatactgtcatgactccccagatcttgtgat

SEQ ID NO: 269182 - DNA, 75 bp, Artificial Sequence
  Synthetic
aagaatctgcagaggaatgtaaacaaaccatatcaccaaatgaattgggattaacatcagctcaggatgatggac

SEQ ID NO: 269183 - DNA, 75 bp, Artificial Sequence
  Synthetic
gcaacttcataaaccagtgattgactctgaccatgtagtctttaatgagaggtggttaatccacggtgggatgcc

SEQ ID NO: 269184 - DNA, 75 bp, Artificial Sequence
  Synthetic
cattgggtgacaacaagccaaattattttctaaatttcaagtctatgaatgtagacatcttcactgtttcccaca

SEQ ID NO: 269185 - DNA, 75 bp, Artificial Sequence
  Synthetic
atcaggttccccatgtaccacagtgctcaactcattatgtaatttgatgatgtgtatttacaccacaaatttgat

SEQ ID NO: 269186 - DNA, 75 bp, Artificial Sequence
  Synthetic
ccaaagtggacaatttatttggaagagcttggttctaccaggaatacacttttactggtgaaggacagtggagag

SEQ ID NO: 269187 - DNA, 75 bp, Artificial Sequence
  Synthetic
cagcccagggattgattgtttacccatagtttatggtgatgatgtcattctgtcattagacaaagaaattgaacc

SEQ ID NO: 269188 - DNA, 75 bp, Artificial Sequence
  Synthetic
ttaatttggagttcccaaaacaagggcatggttcactttccttactatttgcttatttcacaggtgaattaaaca

SEQ ID NO: 269189 - DNA, 75 bp, Artificial Sequence
  Synthetic
agagaaactgcagagtaccatggcagaatcatttggagccgaagtgactgggtcgcgcaaggatgaaccaccttc

SEQ ID NO: 269190 - DNA, 75 bp, Artificial Sequence
  Synthetic
tccatgttttgttcttggctggaagagggtttcttagggtagcccacacctacgacacatcacaaaacagggtta

SEQ ID NO: 269191 - DNA, 75 bp, Artificial Sequence
  Synthetic
acttcttgtcatctaatggtgttattacaattccagcaggagaacagatgacactatcggcaccttattactcaa

SEQ ID NO: 269192 - DNA, 75 bp, Artificial Sequence
  Synthetic
tcccagagtctacttttatagtagggaaattagacactgaaaacatgatacaacatttaatgtggatgaagaatt

SEQ ID NO: 269193 - DNA, 75 bp, Artificial Sequence
  Synthetic
acaaaccccttagaacagttagggatagtaatagtcttgggtatctgatgtgcaaaccattccttactggaacaa

SEQ ID NO: 269194 - DNA, 75 bp, Artificial Sequence
  Synthetic
caacagggaaaatagaggtctatcttagcctaagatgtccaaattttttctttcccctccccgcacctaaagtaa

SEQ ID NO: 269195 - DNA, 75 bp, Artificial Sequence
  Synthetic
catggaaaagacatttaccagcactacatcaaaattttggatccatacctcagagaatggaatattactgtggat

SEQ ID NO: 269196 - DNA, 75 bp, Artificial Sequence
  Synthetic
gattatgatgtggtaattgctgaattgatgcccatggtgtttgattaaaattgaagttttggttttcttttgcta

SEQ ID NO: 269197 - DNA, 75 bp, Artificial Sequence
  Synthetic
caactggccgtgctttgcggggtgacttagcaaatttttcagaccagagcccatatgatcagcaaccacagggcc

SEQ ID NO: 269198 - DNA, 75 bp, Artificial Sequence
  Synthetic
ttgaagttttggttttcttttgctatggactttataattagacactaatctgattagaacactaattcggaatat

SEQ ID NO: 269199 - DNA, 75 bp, Artificial Sequence
  Synthetic
aagtcatgaaattagcttatctggataggggtttttacaagcactatggcattatagtgggggatagtgtatatc

SEQ ID NO: 269200 - DNA, 75 bp, Artificial Sequence
  Synthetic
cgtcgggccttataccccgacttgctgagcttctctaggagagtccctttcccagccctgaggcggctggtcaat

SEQ ID NO: 269201 - DNA, 75 bp, Artificial Sequence
  Synthetic
tgagcttctctaggagagtccctttcccagccctgaggcggctggtcaataaaagcctcaattgtaacaaacatc

SEQ ID NO: 269202 - DNA, 75 bp, Artificial Sequence
  Synthetic
agttggattcagatgacattttcaaaactgctttaacagggaaagctaggttcaccaagacgaaattaaccccag

SEQ ID NO: 269203 - DNA, 75 bp, Artificial Sequence
  Synthetic
gttttcttttgctatggactttataattagacactaatctgattagaacactaattcggaatattggacataacc

SEQ ID NO: 269204 - DNA, 75 bp, Artificial Sequence
  Synthetic
actgggtcattgaggaagaatgcgaactggattatttcaggatgaagtaccttgaatcatctgttaactcagagc

SEQ ID NO: 269205 - DNA, 75 bp, Artificial Sequence
  Synthetic
ttgcaataaaatgagtggaaacaagacgcttaaagcatggtgtaaactaacttttctagcccacactttgtgtgg

SEQ ID NO: 269206 - DNA, 75 bp, Artificial Sequence
  Synthetic
ctggtctccactagttgaaggcaacttgcaataaaatgagtggaaacaagacgcttaaagcatggtgtaaactaa

SEQ ID NO: 269207 - DNA, 75 bp, Artificial Sequence
  Synthetic
atatcttttctgtggaccgcaactgtgaaactattgccaaggatatctttggtacccactctcttagtcaacacc

SEQ ID NO: 269208 - DNA, 75 bp, Artificial Sequence
  Synthetic
aagctatcggtttgataggtacaattcttttaaccgctggtttgatgtcaaccattaaaacaccagtcagtgcta

SEQ ID NO: 269209 - DNA, 75 bp, Artificial Sequence
  Synthetic
caaccattaaggaattctttaaccatgcaatggaaggtgatgagcagggactatccttgcttgtacaaaaatgca

SEQ ID NO: 269210 - DNA, 75 bp, Artificial Sequence
  Synthetic
gtgcctctggggccgaaagccgaggtttagcagaccctttaggattggtttgaaacctgaaatgttgtggaagat

SEQ ID NO: 269211 - DNA, 75 bp, Artificial Sequence
  Synthetic
ctactttcttttcttcagctgccaccgagattttagacaatgatttggttaagttcatagttaaaatacttgtta

SEQ ID NO: 269212 - DNA, 75 bp, Artificial Sequence
  Synthetic
gaattctttgctatatggcgttgtactgccacaaaccaaatattcttacaacagcttgtttatccacactgttaa

SEQ ID NO: 269213 - DNA, 75 bp, Artificial Sequence
  Synthetic
tgatctggggccaggtacctctatcttggtgacctggttaaaaaacgtctagtgggccaaacccgggggggatcc

SEQ ID NO: 269214 - DNA, 75 bp, Artificial Sequence
  Synthetic
ttatggatgtcacatcatcatcagtgttgtcaccttcttgtaaagcactcatgcagtgtctgatggacggtgacg

SEQ ID NO: 269215 - DNA, 75 bp, Artificial Sequence
  Synthetic
tcaaaaaattagctgaggtagtagctgagtccatgtctaatacggatgatgaagaaatcaaagaacaaatttgtg

SEQ ID NO: 269216 - DNA, 75 bp, Artificial Sequence
  Synthetic
tgcagatatggcgaccggtgtagtcagttcagttgattcaactatcaatgcagttaatgagaaggtggaaaatgt

SEQ ID NO: 269217 - DNA, 75 bp, Artificial Sequence
  Synthetic
acacagtgaaatacactaagagtattctctcaaatcaaggaccattcaagggtttcaatgaagtctcaactgctt

SEQ ID NO: 269218 - DNA, 75 bp, Artificial Sequence
  Synthetic
cagttaatgagaaggtggaaaatgtaggtaacgaaattggaggcaatttactaaccaaggttgcagatgacgcat

SEQ ID NO: 269219 - DNA, 75 bp, Artificial Sequence
  Synthetic
ttagacacattgactggtggatacataccctgttaaaaattaaagatatggtacttagtgtctttaagccaagta

SEQ ID NO: 269220 - DNA, 75 bp, Artificial Sequence
  Synthetic
ctaaccaaggttgcagatgacgcatctagtgtgctcggaccaaattgttatgctacaacagctgaaccagagaac

SEQ ID NO: 269221 - DNA, 75 bp, Artificial Sequence
  Synthetic
aaggatgtagtacaggcaactacaactgttaacacgactaatttaacacaacatccctcagcaccaacaatgccc

SEQ ID NO: 269222 - DNA, 75 bp, Artificial Sequence
  Synthetic
tggagagcaaggctatccagtggttagaaaggaataaggaacaagtttgtgcaattttggactatgcctctgata

SEQ ID NO: 269223 - DNA, 75 bp, Artificial Sequence
  Synthetic
acatccctcagcaccaacaatgcccttcacccctgatttttccaatgttgacacatttcactcaatggcatatga

SEQ ID NO: 269224 - DNA, 75 bp, Artificial Sequence
  Synthetic
ttattgtggaatcaaaggaccagacaaaaatgaaatcacaagaattttaccaaaagtatacagactgcttggcta

SEQ ID NO: 269225 - DNA, 75 bp, Artificial Sequence
  Synthetic
aattcaaaccaattatggctatttgttttaggagctgtcacaacagcattagtaatacagtttacagattatttc

SEQ ID NO: 269226 - DNA, 75 bp, Artificial Sequence
  Synthetic
atgagtggacaccaacctgggctagaggacatcaaataacccatgtggaattaccaaaagtcttttgggacaaaa

SEQ ID NO: 269227 - DNA, 75 bp, Artificial Sequence
  Synthetic
aagagctggctagaataccatcaagaatcagtacccagaatgatctaattagggttgaaccaattggggtttgga

SEQ ID NO: 269228 - DNA, 75 bp, Artificial Sequence
  Synthetic
ttaccaaaagtcttttgggacaaaagcagtaagccagcctatggccaatcaagatactttgcagcagtacggtgt

SEQ ID NO: 269229 - DNA, 75 bp, Artificial Sequence
  Synthetic
tacagggagaaccaggacaaggaaaatctttcctaacacacactctgtccagacaactacagaagtcctgtaaat

SEQ ID NO: 269230 - DNA, 75 bp, Artificial Sequence
  Synthetic
tgcattggtggtgtatgaacccaaacctgttgtaacatatgacacaaagttagaatttggagcatttaccaatct

SEQ ID NO: 269231 - DNA, 75 bp, Artificial Sequence
  Synthetic
tgaatggtgtttacactaatccaactgctagtgagtttatggatggttatgacaaccaagatatccatctcattg

SEQ ID NO: 269232 - DNA, 75 bp, Artificial Sequence
  Synthetic
atgatttgggacaaactaggaaagagaaagacattgaaatgttgtgcaactgcatatcatcagtaccctttatag

SEQ ID NO: 269233 - DNA, 75 bp, Artificial Sequence
  Synthetic
tcccctatgttgctgacacaaactatgttaaaacagattcgtcagacttagggcaactaaaagtctatgtttgga

SEQ ID NO: 269234 - DNA, 75 bp, Artificial Sequence
  Synthetic
gggcaactaaaagtctatgtttggacacctttatccataccttcaggttctgctacacaagttgatgtaaccata

SEQ ID NO: 269235 - DNA, 75 bp, Artificial Sequence
  Synthetic
tcccaatggcacaccttgaagaaaaaggtaagttttatactagtaaattggtgatagctaccacaaacaaatcag

SEQ ID NO: 269236 - DNA, 75 bp, Artificial Sequence
  Synthetic
tgctacacaagttgatgtaaccatactgggtagcttattgcaattggatttccaaaaccccagggtatttggcca

SEQ ID NO: 269237 - DNA, 75 bp, Artificial Sequence
  Synthetic
gtgatagctaccacaaacaaatcagatttttcaagcactgttctacaagattcaggtgctctgaagagaagattc

SEQ ID NO: 269238 - DNA, 75 bp, Artificial Sequence
  Synthetic
tccaaaaccccagggtatttggccaagatgttggtatttatgacaatgcaccaacacggaagcaaaacctaaaaa

SEQ ID NO: 269239 - DNA, 75 bp, Artificial Sequence
  Synthetic
ctgggtagcttattgcaattggatttccaaaaccccagggtatttggccaagatgttggtatttatgacaatgca

SEQ ID NO: 269240 - DNA, 75 bp, Artificial Sequence
  Synthetic
ccaacacggaagcaaaacctaaaaaagattcttacaatgagcactaaatataagtggactaggcaaaaaattgac

SEQ ID NO: 269241 - DNA, 75 bp, Artificial Sequence
  Synthetic
ccatacatcatgcacatcagggctgcaaaagcttacagtaagtcaggtaaactcaatgttagtcaagctatgtcc

SEQ ID NO: 269242 - DNA, 75 bp, Artificial Sequence
  Synthetic
acaatggctacaggtgagtgctgggaagtgtctaaaaatggtagggattgggaaaccctaaaattacaggaatta

SEQ ID NO: 269243 - DNA, 75 bp, Artificial Sequence
  Synthetic
attgcagaaggaccaggttctatgaacatggcaaatgtattaagcaccactgcagcgcaatcaattgctttggtt

SEQ ID NO: 269244 - DNA, 75 bp, Artificial Sequence
  Synthetic
gtcaagaagatcactgaagattatgaagagagacaaaagaattacaattgctggaaacaacagctcgagaatcag

SEQ ID NO: 269245 - DNA, 75 bp, Artificial Sequence
  Synthetic
ggagaaagagcattctatgacccgagaacagcaggaagtaagagtaggtttgatgacctagtaaaaatatctcaa

SEQ ID NO: 269246 - DNA, 75 bp, Artificial Sequence
  Synthetic
gaacagcaggaagtaagagtaggtttgatgacctagtaaaaatatctcaacttttttctgtgatgagtgactcta

SEQ ID NO: 269247 - DNA, 75 bp, Artificial Sequence
  Synthetic
actctagatgacctggatgatgctgtttcctacatcaaacataatttcccagatgcaatcccctacattgacgaa

SEQ ID NO: 269248 - DNA, 75 bp, Artificial Sequence
  Synthetic
tttcctacatcaaacataatttcccagatgcaatcccctacattgacgaatatcttaacattgaaatgtctactt

SEQ ID NO: 269249 - DNA, 75 bp, Artificial Sequence
  Synthetic
caactccttcagccaaccatggtatagatgcaaaaggttatttcaagtggtcatccacaactgcaccacaatctg

SEQ ID NO: 269250 - DNA, 75 bp, Artificial Sequence
  Synthetic
tgattgaacaaatggaagctttcattgaaccaagacctagtgttttcaaatgctttgcaaccaaggttgcaaatc

SEQ ID NO: 269251 - DNA, 75 bp, Artificial Sequence
  Synthetic
tggtacataggaatattgtttacctaaaactgttccctaacttgaatgtttttgtcaacagctactcatatttta

SEQ ID NO: 269252 - DNA, 75 bp, Artificial Sequence
  Synthetic
tttgtcaacagctactcatattttagaggttcaatagtattgaggctgagtgtatatgccagcactttcaataga

SEQ ID NO: 269253 - DNA, 75 bp, Artificial Sequence
  Synthetic
aaacacgcaaagctgccaaagaagttgtggactggtttagtaataaaattaagtcaatgttgagttttgtggaga

SEQ ID NO: 269254 - DNA, 75 bp, Artificial Sequence
  Synthetic
ggtcgtctacggatgggtttttttccaaatgctaccgaagacagtacttcagaaatagacaatgccatatacaca

SEQ ID NO: 269255 - DNA, 75 bp, Artificial Sequence
  Synthetic
gaaacaaggcatggctaacggtagtttcagctgttactagtgcaatcagtatactacttttggtaactaaaattt

SEQ ID NO: 269256 - DNA, 75 bp, Artificial Sequence
  Synthetic
atttgtgatttaggtagtgataatagttttgaaatcactattccctattcattttccacctggatgcggaaaaca

SEQ ID NO: 269257 - DNA, 75 bp, Artificial Sequence
  Synthetic
tcaagaaggaagactcaaaggatgagagggcttataacccaacacttcctgttacaaaaccaaaaggagctttct

SEQ ID NO: 269258 - DNA, 75 bp, Artificial Sequence
  Synthetic
attttccacctggatgcggaaaacagatggccacccgattggattattccaaattgaagtacttaacaggttgac

SEQ ID NO: 269259 - DNA, 75 bp, Artificial Sequence
  Synthetic
cagtcactcagagagagtttaaaaatgaagcaccctatgatggacagttggagcacattatatctcagatggcct

SEQ ID NO: 269260 - DNA, 75 bp, Artificial Sequence
  Synthetic
ctacaatagctccagccctaatgaagtttattgtattgtgcaaggtaaaatggggcaagacgccaggttcttctg

SEQ ID NO: 269261 - DNA, 75 bp, Artificial Sequence
  Synthetic
acataactggttccactacaggacacctcactcactgtgcagggtatcagcatgatgaaatcattttacatgggc

SEQ ID NO: 269262 - DNA, 75 bp, Artificial Sequence
  Synthetic
tccaactggttctgtagtgactttccaaaattcatggggttcacaaatggatttgactgatccattatgtttaga

SEQ ID NO: 269263 - DNA, 75 bp, Artificial Sequence
  Synthetic
caaaattcatggggttcacaaatggatttgactgatccattatgtttagaagaatctgcagaggaatgtaaacag

SEQ ID NO: 269264 - DNA, 75 bp, Artificial Sequence
  Synthetic
attcaatcaagtatcttgaacaagaagaagacctaacactacattataagaacaaggtattcccaattgaaaatc

SEQ ID NO: 269265 - DNA, 75 bp, Artificial Sequence
  Synthetic
catctgtaacacaggtgacattaggtggtaagccaatggatttggccatcctaaaatgcaagctaccattcaggt

SEQ ID NO: 269266 - DNA, 75 bp, Artificial Sequence
  Synthetic
taacgtcagctcaggatgatggaccattgggtgataacaagccaaattatttcctaaattttaagtccatgaatg

SEQ ID NO: 269267 - DNA, 75 bp, Artificial Sequence
  Synthetic
ttcctaaattttaagtccatgaatgtggacatcttcactgtttcgcacactaaagtagataacctatttggaaga

SEQ ID NO: 269268 - DNA, 75 bp, Artificial Sequence
  Synthetic
ttaagaaaaattccaagtattacactaataaagttggaacagaaagcatgttgatttggatgactgaacaaggca

SEQ ID NO: 269269 - DNA, 75 bp, Artificial Sequence
  Synthetic
ttattacgaaagaagttcagagagttcatcattctggcggcatcaaaacccgggaagggactgaaagcacaaaaa

SEQ ID NO: 269270 - DNA, 75 bp, Artificial Sequence
  Synthetic
tcaccaatgaagggcagtggagagttaatttagagttcccaaaacaaggccatggttcgctttccttgctattcg

SEQ ID NO: 269271 - DNA, 75 bp, Artificial Sequence
  Synthetic
cgggaagggactgaaagcacaaaaacaatcagctacacagtaaaatcctgcaaaggtatgtgtggtggtttactc

SEQ ID NO: 269272 - DNA, 75 bp, Artificial Sequence
  Synthetic
catggttcgctttccttgctattcgcttacttcacgggtgaattgaatatccatgttctgttcctagctgagaaa

SEQ ID NO: 269273 - DNA, 75 bp, Artificial Sequence
  Synthetic
atttctaaagtggaagggaatttcaaaattcttggaatgcacatagctggaaatggagaaatgggtgttgccatc

SEQ ID NO: 269274 - DNA, 75 bp, Artificial Sequence
  Synthetic
ggattccttagagtagctcacacctatgacacatcagaaaacagggttaatttcttgtcatccaatggtgttatc

SEQ ID NO: 269275 - DNA, 75 bp, Artificial Sequence
  Synthetic
aaatggagaaatgggtgttgccatccctttcaactttcttaagaatgatatgtctgaccaaggcattgtcactga

SEQ ID NO: 269276 - DNA, 75 bp, Artificial Sequence
  Synthetic
tttcttgtcatccaatggtgttatcacaatcccagcaggagaacaaatgacattatctgcaccttactattcgaa

SEQ ID NO: 269277 - DNA, 75 bp, Artificial Sequence
  Synthetic
aaattcttggaatgcacatagctggaaatggagaaatgggtgttgccatccctttcaactttcttaagaatgata

SEQ ID NO: 269278 - DNA, 75 bp, Artificial Sequence
  Synthetic
taaaccccttagaacagttagagacagcaatagtctcgggtatctaatgtgtaaaccattcctcactggaacaac

SEQ ID NO: 269279 - DNA, 75 bp, Artificial Sequence
  Synthetic
agcaatagtctcgggtatctaatgtgtaaaccattcctcactggaacaacaacagggaaaatagaggtctatctt

SEQ ID NO: 269280 - DNA, 75 bp, Artificial Sequence
  Synthetic
gtaaaccattcctcactggaacaacaacagggaaaatagaggtctatcttagtttgagatgtccaaattttttct

SEQ ID NO: 269281 - DNA, 75 bp, Artificial Sequence
  Synthetic
agagtccagtctatggtgcagtagaagtgaagatgggcccagcagtcttgagtaaatcagaccccaggctcgaag

SEQ ID NO: 269282 - DNA, 75 bp, Artificial Sequence
  Synthetic
aaccagttgagtgcctgattaagaagtcagcagccaagtatagagtcaacaagttccaagttaataatgaactat

SEQ ID NO: 269283 - DNA, 75 bp, Artificial Sequence
  Synthetic
ttcctcttcccgcacctaaagttacaactagtcgtgcattgcggggtgacttagcaaatttctcagaccagagtc

SEQ ID NO: 269284 - DNA, 75 bp, Artificial Sequence
  Synthetic
aactagtcgtgcattgcggggtgacttagcaaatttctcagaccagagtccatatgatcaacaactgcagaacca

SEQ ID NO: 269285 - DNA, 75 bp, Artificial Sequence
  Synthetic
ggcaaggagttaaagcctgtattaagtccaagtttagagaaacctttggaatcaatggtatcacagatatgaaaa

SEQ ID NO: 269286 - DNA, 75 bp, Artificial Sequence
  Synthetic
agtgatgaagctagcttatttagataggggtttctacaaacactatggcattatagtaggagagagtgtttatca

SEQ ID NO: 269287 - DNA, 75 bp, Artificial Sequence
  Synthetic
atcaatggtatcacagatatgaaaacagccattctaggaacctctcatgtaaactctatggatttaagcacatca

SEQ ID NO: 269288 - DNA, 75 bp, Artificial Sequence
  Synthetic
acagctttaacagggaaagctaagttcactaagacaaaattaactccagactgggtcattgaggaggaatgtgaa

SEQ ID NO: 269289 - DNA, 75 bp, Artificial Sequence
  Synthetic
tcactaagacaaaattaactccagactgggtcattgaggaggaatgtgaactggattatttcagggtaaagtatc

SEQ ID NO: 269290 - DNA, 75 bp, Artificial Sequence
  Synthetic
atgcttgaaaagcttgtacaagacaagtttcatgcactactcaagggcaagcagattactactatctttaacact

SEQ ID NO: 269291 - DNA, 75 bp, Artificial Sequence
  Synthetic
ttgaatcatctgtcaactcagagcatatcttctcagtagaccacaattgtgaaactattgctaaggatatttttg

SEQ ID NO: 269292 - DNA, 75 bp, Artificial Sequence
  Synthetic
tatcttctcagtagaccacaattgtgaaactattgctaaggatatttttggcacccacactcttagtcaacacca

SEQ ID NO: 269293 - DNA, 75 bp, Artificial Sequence
  Synthetic
tgcctcaaggatgaactgagaaaattagacaaaatctcagctggtaagactaggtgtattgaagcttgtgaagtg

SEQ ID NO: 269294 - DNA, 75 bp, Artificial Sequence
  Synthetic
gactattgcatagtttatagaatgattatgatggaaatttatgacaaaatttaccagacaccatgttattattca

SEQ ID NO: 269295 - DNA, 75 bp, Artificial Sequence
  Synthetic
ccattaaaacaccagtcaatgctacaaccatcaaagaattcttcaatcatgcagtggaaggtgatgaacagggat

SEQ ID NO: 269296 - DNA, 75 bp, Artificial Sequence
  Synthetic
ggtcttgctgttgggattaacccatataaggattggcacttcatgatcaatgccttaaatgactataattatgaa

SEQ ID NO: 269297 - DNA, 75 bp, Artificial Sequence
  Synthetic
atggattactctcagtatgatggttcccttagttcaatgttattgtgggaggctgtggaggttttggcttattgc

SEQ ID NO: 269298 - DNA, 75 bp, Artificial Sequence
  Synthetic
aatttatagtgaaaatccttgtcagaattctctgttatatggtgttatattgtcacaaaccaaatattttaacca

SEQ ID NO: 269299 - DNA, 75 bp, Artificial Sequence
  Synthetic
cacgattcacctgatcttgttatgcagttacacaagccagtaattgactcagaccacgtggtcttcaacgagaga

SEQ ID NO: 269300 - DNA, 75 bp, Artificial Sequence
  Synthetic
aattctctgttatatggtgttatattgtcacaaaccaaatattttaaccactgcttgtctatccacactactaat

SEQ ID NO: 269301 - DNA, 75 bp, Artificial Sequence
  Synthetic
aatggatgtcacatcttcatcagtgttatcgccttcttgtaaggcactcatgcagtgcctaatggatggtgatgt

SEQ ID NO: 269302 - DNA, 75 bp, Artificial Sequence
  Synthetic
tggttaattcatggtggtatgccatcagggtctccatgtactactgtactaaattcattgtgtaatttgatgatg

SEQ ID NO: 269303 - DNA, 75 bp, Artificial Sequence
  Synthetic
caagaaactggcagaggttgtggctgaatccatgtctaacacagatgatgaagaaatcaaagaacaaatttgtga

SEQ ID NO: 269304 - DNA, 75 bp, Artificial Sequence
  Synthetic
ctatcaaaccagggaccctttaagggtttcaatgaagtgtcaacagcattcaggcacattgattggtggatacac

SEQ ID NO: 269305 - DNA, 75 bp, Artificial Sequence
  Synthetic
ttcatttggtgctgaagtgaccggttcccgcaaagatgagcctccatcattgaaatccagactggaggtggaatt

SEQ ID NO: 269306 - DNA, 75 bp, Artificial Sequence
  Synthetic
tcccgcaaagatgagcctccatcattgaaatccagactggaggtggaatttttgaagcgcaaacctggttacttc

SEQ ID NO: 269307 - DNA, 75 bp, Artificial Sequence
  Synthetic
ggagagcaaagctattcagtggttagagagaaataaagagcatgtttgtgctatcttggattatgcctctgatat

SEQ ID NO: 269308 - DNA, 75 bp, Artificial Sequence
  Synthetic
ctatcttggattatgcctctgatattattgtggaatcaaaagaccagacaaaaatgaaatcacaagaattttatc

SEQ ID NO: 269309 - DNA, 75 bp, Artificial Sequence
  Synthetic
aaaatgaaatcacaagaattttatcagaaatatactgattgcttatctaaatttaaaccaattatggctatctgc

SEQ ID NO: 269310 - DNA, 75 bp, Artificial Sequence
  Synthetic
agaaatatactgattgcttatctaaatttaaaccaattatggctatctgctttagaagttgccacaacagtatca

SEQ ID NO: 269311 - DNA, 75 bp, Artificial Sequence
  Synthetic
cctacctaatggagttatgcctccatggaaaagacacttacatacactacatcaaaattttggatccttatttga

SEQ ID NO: 269312 - DNA, 75 bp, Artificial Sequence
  Synthetic
aagagtggaacattacagtggataattatgaagtggtcatagctaagttgatgcccatggtgtttgattaaaatt

SEQ ID NO: 269313 - DNA, 75 bp, Artificial Sequence
  Synthetic
gtaatacagtctatagactattccaagagttagctagaataccatctagaattagtactcagaatgatctgatta

SEQ ID NO: 269314 - DNA, 75 bp, Artificial Sequence
  Synthetic
ttatgaagtggtcatagctaagttgatgcccatggtgtttgattaaaattaaatgttttggttttctttgttatg

SEQ ID NO: 269315 - DNA, 75 bp, Artificial Sequence
  Synthetic
gagtggagccaattggcgtctggatccaaggtgaaccaggacaaggaaaatctttcttaacacacacactatcca

SEQ ID NO: 269316 - DNA, 75 bp, Artificial Sequence
  Synthetic
atattattagaatactaatttgattagaacactaatttggaatattggacataccaaaaaaaaaaaaaaaaaaaa

SEQ ID NO: 269317 - DNA, 75 bp, Artificial Sequence
  Synthetic
gacagttgcaaaaatcctgtaaattaaatggtgtgtacaccaacccaacagctagtgagtttatggatgggtatg

SEQ ID NO: 269318 - DNA, 75 bp, Artificial Sequence
  Synthetic
cttttttaatttaagtaatcactatggagtctatcaaggatttagttaatgttgctactggtgctatggatactc

SEQ ID NO: 269319 - DNA, 75 bp, Artificial Sequence
  Synthetic
aaatggtgtgtacaccaacccaacagctagtgagtttatggatgggtatgataatcaggatattcacctcattga

SEQ ID NO: 269320 - DNA, 75 bp, Artificial Sequence
  Synthetic
tgatttgggacaaactaggaaggagaaagacattgaaatgttgtgtaattgtatttcctcagttccatttattgt

SEQ ID NO: 269321 - DNA, 75 bp, Artificial Sequence
  Synthetic
ctctctatttatgctagcactttcaatagagggaggctgaggatgggatttttccccaactgtacccatgatact

SEQ ID NO: 269322 - DNA, 75 bp, Artificial Sequence
  Synthetic
tttccccaactgtacccatgatactcagttggagttggataatgctatatatacaatctgtgacattggttcaga

SEQ ID NO: 269323 - DNA, 75 bp, Artificial Sequence
  Synthetic
cccaatggcacatcttgaggagaaaggtaaattttacactagcaaactagtgatagcaacaaccaacaaatctga

SEQ ID NO: 269324 - DNA, 75 bp, Artificial Sequence
  Synthetic
tttttcaagtacagtcttgcaagattctggcgcactaaaaagaagattcccatacatcatgcatattagagcagc

SEQ ID NO: 269325 - DNA, 75 bp, Artificial Sequence
  Synthetic
catacatcatgcatattagagcagctaaagcatacagtaaggctggaaagctcaatgtcagtcaagctatgtcaa

SEQ ID NO: 269326 - DNA, 75 bp, Artificial Sequence
  Synthetic
tcatggccactggtgagtgctgggaagtatcaaagaatggtagggattgggaaactctaaaactaaaggacttag

SEQ ID NO: 269327 - DNA, 75 bp, Artificial Sequence
  Synthetic
ttgctgagtctctctaggagagtccctttcccagccttgaggcggctggacaataaaagcctcaactgtaacaaa

SEQ ID NO: 269328 - DNA, 75 bp, Artificial Sequence
  Synthetic
agtatcaaagaatggtagggattgggaaactctaaaactaaaggacttagtccataagattacggaagattacca

SEQ ID NO: 269329 - DNA, 75 bp, Artificial Sequence
  Synthetic
caacttgcaataaaatgagtggaaataagacgcttgaagcatggtgcaaatctacttttctaacccacactttgt

SEQ ID NO: 269330 - DNA, 75 bp, Artificial Sequence
  Synthetic
gatgcaattccatacatagatgagtatcttaacattgaaatgtcaacactaattgagcaaatggaagccttcatt

SEQ ID NO: 269331 - DNA, 75 bp, Artificial Sequence
  Synthetic
atcttaacattgaaatgtcaacactaattgagcaaatggaagccttcattgagcctagacctagtgttttcaaat

SEQ ID NO: 269332 - DNA, 75 bp, Artificial Sequence
  Synthetic
gttttgcaaccaaggttgctaaccagacaaggaaagcagccaaagaagttgtggaatggttcagtagcaaaatca

SEQ ID NO: 269333 - DNA, 75 bp, Artificial Sequence
  Synthetic
gacaaggaaagcagccaaagaagttgtggaatggttcagtagcaaaatcaagtcaatgttgagctttgtggaaag

SEQ ID NO: 269334 - DNA, 75 bp, Artificial Sequence
  Synthetic
gtggaatggttcagtagcaaaatcaagtcaatgttgagctttgtggaaagaaataaagcctggctgacagtggtt

SEQ ID NO: 269335 - DNA, 75 bp, Artificial Sequence
  Synthetic
agtcaatgttgagctttgtggaaagaaataaagcctggctgacagtggtttcagctgttaccagtgcaatcagca

SEQ ID NO: 269336 - DNA, 75 bp, Artificial Sequence
  Synthetic
acaggtgcctctggggccaaaagccaaggtttaacagaccctttaggattggtttaaaacctgaaatgttgtgga

SEQ ID NO: 269337 - DNA, 75 bp, Artificial Sequence
  Synthetic
aaggtttaacagaccctttaggattggtttaaaacctgaaatgttgtggaaaatacttagtacctaccgacctgg

SEQ ID NO: 269338 - DNA, 75 bp, Artificial Sequence
  Synthetic
tattgctcctggtaacaaaaattttcaagaaggaaggctcaaaggatgaaagggcatacaacccaacactccctg

SEQ ID NO: 269339 - DNA, 75 bp, Artificial Sequence
  Synthetic
caagaaggaaggctcaaaggatgaaagggcatacaacccaacactccctgtcacaaaaccaaagggcacattccc

SEQ ID NO: 269340 - DNA, 75 bp, Artificial Sequence
  Synthetic
tagtaatgcaaacactagttgtaaggcccacgaaggatgcccagaaggtacccgtaggtaacaagtgacactatg

SEQ ID NO: 269341 - DNA, 75 bp, Artificial Sequence
  Synthetic
agtgacacagagagaattcaaaaatgaagcaccctatgatggacaattagaacatattatctcccagatggctta

SEQ ID NO: 269342 - DNA, 75 bp, Artificial Sequence
  Synthetic
aacatattatctcccagatggcttacataactggctccacaacagggcatcttacacactgtgctgggtaccaac

SEQ ID NO: 269343 - DNA, 75 bp, Artificial Sequence
  Synthetic
tatcctagtgacctggttaaaaaacgtctagtgggccaaacccgggggggatccccggtttccttttattttact

SEQ ID NO: 269344 - DNA, 75 bp, Artificial Sequence
  Synthetic
atgatgagatcatattacatgggcactcaatcaagtaccttgaacaagaggaggaactaactctgcattacaaga

SEQ ID NO: 269345 - DNA, 75 bp, Artificial Sequence
  Synthetic
aatgctattatggagacaataaagaatattgcagatatggcaactggagtagtcagctcagtcgattcaactgtc

SEQ ID NO: 269346 - DNA, 75 bp, Artificial Sequence
  Synthetic
gaggaactaactctgcattacaagaataaagtgttcccaattgagtgcccttctgtgacgcaagtcacattgggt

SEQ ID NO: 269347 - DNA, 75 bp, Artificial Sequence
  Synthetic
aatgcggtcaatgagaaggtagagaatgtgggcaatgaaattggaggtaatttactaaccaaagttgcagatgat

SEQ ID NO: 269348 - DNA, 75 bp, Artificial Sequence
  Synthetic
ggtaaacctatggatttggccatccttaagtgcagattaccattcagattcaagaaaaattccaaatattatact

SEQ ID NO: 269349 - DNA, 75 bp, Artificial Sequence
  Synthetic
gcatcaaatatacttggaccaaattgttatgccacgacagctgaaccagagaacaaagatgtggtacaggcaacc

SEQ ID NO: 269350 - DNA, 75 bp, Artificial Sequence
  Synthetic
gttatgccacgacagctgaaccagagaacaaagatgtggtacaggcaaccacaactgtcaacacaactaatttga

SEQ ID NO: 269351 - DNA, 75 bp, Artificial Sequence
  Synthetic
tatcactaaagaagttcagagggttcaccactctggtggtattaaaaccagagagggaactgagagtacaaagac

SEQ ID NO: 269352 - DNA, 75 bp, Artificial Sequence
  Synthetic
cacaacatccctcggcaccaacaatgcccttcactcctgatttctccaatgttgacacattccactcaatggcat

SEQ ID NO: 269353 - DNA, 75 bp, Artificial Sequence
  Synthetic
caccactctggtggtattaaaaccagagagggaactgagagtacaaagacaattagttacacagtgaaatcttgc

SEQ ID NO: 269354 - DNA, 75 bp, Artificial Sequence
  Synthetic
aaaggtatgtgtgggggtttactcatctctaaagtggaaggtaattttaaaattctaggtatgcatatagctggg

SEQ ID NO: 269355 - DNA, 75 bp, Artificial Sequence
  Synthetic
tcccagtaaactggttagattagaaactcatgaatggacaccaacctgggctagaggacaccagataacccatgt

SEQ ID NO: 269356 - DNA, 75 bp, Artificial Sequence
  Synthetic
aattctaggtatgcatatagctgggaatggggaaatgggtgttgccattcctttcaattttcttaaaaacgacat

SEQ ID NO: 269357 - DNA, 75 bp, Artificial Sequence
  Synthetic
ggagttaccaaaagtcttttgggacaaaaacagtaagccagcctatggccaatcaagatattttgcagcagtacg

SEQ ID NO: 269358 - DNA, 75 bp, Artificial Sequence
  Synthetic
ctttcaattttcttaaaaacgacatgtctgatcaaggcatcgttacagaagtgacacccatacagcccatgtaca

SEQ ID NO: 269359 - DNA, 75 bp, Artificial Sequence
  Synthetic
gtgtggttttcactttcaagtacaagtgaatgttaatcagggcacagctggtagtgcattggtagtgtatgaacc

SEQ ID NO: 269360 - DNA, 75 bp, Artificial Sequence
  Synthetic
tcaatactaagactcaaatccataaaagcccagtctatggagcagtggaagttaagatgggtccagcagtcctga

SEQ ID NO: 269361 - DNA, 75 bp, Artificial Sequence
  Synthetic
gttaagatgggtccagcagtcctgagtaaatcagaccccagacttgaagaaccggttgaatgcttaatcaagaaa

SEQ ID NO: 269362 - DNA, 75 bp, Artificial Sequence
  Synthetic
caaacccgtggtgacatatgattcaaagttggaattcggagcattcaccaatttgccacatgtgctaatgaattt

SEQ ID NO: 269363 - DNA, 75 bp, Artificial Sequence
  Synthetic
accggttgaatgcttaatcaagaaatcagctgctaaatacagagtcaacaaatttcaagtcaataatgagttatg

SEQ ID NO: 269364 - DNA, 75 bp, Artificial Sequence
  Synthetic
ggctgagaccacacaggctgatttatgtatcccctatgttgctgacacaaactatgttaaaacagattcgtcaga

SEQ ID NO: 269365 - DNA, 75 bp, Artificial Sequence
  Synthetic
gcaaggagtcaaggcttgtgttaaatccaaattcagagaaatctttgggatcaatgggatagtggatatgcaaac

SEQ ID NO: 269366 - DNA, 75 bp, Artificial Sequence
  Synthetic
agctattctcggcacatctcatgtgaattccatggaccttagcacatcagctgggtatagttttgttaagtcagg

SEQ ID NO: 269367 - DNA, 75 bp, Artificial Sequence
  Synthetic
ttacaaaaagaaagatctaatttgtcttgaacccttccatattcatcctatgcttgagaaacttgtacaagaaaa

SEQ ID NO: 269368 - DNA, 75 bp, Artificial Sequence
  Synthetic
cttgaacccttccatattcatcctatgcttgagaaacttgtacaagaaaaatttcaaaacctacttaagggcaac

SEQ ID NO: 269369 - DNA, 75 bp, Artificial Sequence
  Synthetic
cagattaccacaatttttaacacttgtttaaaagatgaactgaggaaattggataaaatctcagctggtaaaacc

SEQ ID NO: 269370 - DNA, 75 bp, Artificial Sequence
  Synthetic
ggataaaatctcagctggtaaaaccaggtgcattgaggcatgtgaagtggattattgcatagtctataggatgat

SEQ ID NO: 269371 - DNA, 75 bp, Artificial Sequence
  Synthetic
aggtgcattgaggcatgtgaagtggattattgcatagtctataggatgatcatgatggaaatttatgacaaaatc

SEQ ID NO: 269372 - DNA, 75 bp, Artificial Sequence
  Synthetic
tatcagacaccatgttattattcaggtcttgctgttggaataaacccatataaagattggcacttcatgatcaat

SEQ ID NO: 269373 - DNA, 75 bp, Artificial Sequence
  Synthetic
gtcttgctgttggaataaacccatataaagattggcacttcatgatcaatgccttgaatgactacaattatgaaa

SEQ ID NO: 269374 - DNA, 75 bp, Artificial Sequence
  Synthetic
taaagattggcacttcatgatcaatgccttgaatgactacaattatgaaatggattactcccagtatgatggttc

SEQ ID NO: 269375 - DNA, 75 bp, Artificial Sequence
  Synthetic
gccttgaatgactacaattatgaaatggattactcccagtatgatggttcccttagttcaatgctactgtgggaa

SEQ ID NO: 269376 - DNA, 75 bp, Artificial Sequence
  Synthetic
gctgtggaagtcttggcctattgtcatgattcacctgatctcgttatgcagttacataaaccagtgattgactcg

SEQ ID NO: 269377 - DNA, 75 bp, Artificial Sequence
  Synthetic
gaccatgtagtctttaacgagagatggttgattcatggaggtatgccatcaggatccccgtgcactactgtgtta

SEQ ID NO: 269378 - DNA, 75 bp, Artificial Sequence
  Synthetic
ggttgattcatggaggtatgccatcaggatccccgtgcactactgtgttaaattcattgtgcaaccttatgatgt

SEQ ID NO: 269379 - DNA, 75 bp, Artificial Sequence
  Synthetic
gcatctatactgccaacctaatcagcccaggaattgactgtttgccaattgtttatggtgatgatgtcatcttgt

SEQ ID NO: 269380 - DNA, 75 bp, Artificial Sequence
  Synthetic
cccaggaattgactgtttgccaattgtttatggtgatgatgtcatcttgtcacttgacaaagaaatagaccctga

SEQ ID NO: 269381 - DNA, 75 bp, Artificial Sequence
  Synthetic
gaaactgcaaagtatcatggcagactcatttggtgcagaagtgactggttctcgcaaagatgaacctccatcatt

SEQ ID NO: 269382 - DNA, 75 bp, Artificial Sequence
  Synthetic
tcatttggtgcagaagtgactggttctcgcaaagatgaacctccatcattgaagcccagactggaagtagaattt

SEQ ID NO: 269383 - DNA, 75 bp, Artificial Sequence
  Synthetic
ttgaagcgtaaacctggttacttcccagagtccacatttatagtaggaaaattggacactgaaaatatgatacaa

SEQ ID NO: 269384 - DNA, 75 bp, Artificial Sequence
  Synthetic
atagatctgactgacccattatgtctagaggaatctgcagaggagtgtaaacaaaccatatcaccgaatgagttg

SEQ ID NO: 269385 - DNA, 75 bp, Artificial Sequence
  Synthetic
ctacttaatggagttatgcctccatggaaaagacacttacttgcactacatcaaaattttggatccctatctgaa

SEQ ID NO: 269386 - DNA, 75 bp, Artificial Sequence
  Synthetic
tcaaaattttggatccctatctgaaagaatggaacattacagtggatgattatgatgtggttatagttaagttga

SEQ ID NO: 269387 - DNA, 75 bp, Artificial Sequence
  Synthetic
tatggactatatcattagaacactaatttgattagaacactaatttggaatattggacataccaaaaaaaaaaaa

SEQ ID NO: 269388 - DNA, 75 bp, Artificial Sequence
  Synthetic
cgtcgggccttacaccccgacttgctggacttctctaggagagtccctttcccagccctgaggcggctggtcaat

SEQ ID NO: 269389 - DNA, 75 bp, Artificial Sequence
  Synthetic
atgacactatctgcaccttactactcaaataagcctctcagaacagtcagggacagcaatagtcttgggtaccta

SEQ ID NO: 269390 - DNA, 75 bp, Artificial Sequence
  Synthetic
atgtgtagaccattccttactggaacaacaacagggaaaatagaagtctatcttagtttgagatgcccaaacttc

SEQ ID NO: 269391 - DNA, 75 bp, Artificial Sequence
  Synthetic
cattttgctgtaaagcatcctattgccagcggaacaacgcctggtaacaggtgcctctggggccaaaagccaagg

SEQ ID NO: 269392 - DNA, 75 bp, Artificial Sequence
  Synthetic
ttctttcctctccccgcacccaaggttacaactagccgtgccttgcggggtgacctggcaaatttttcagaccag

SEQ ID NO: 269393 - DNA, 75 bp, Artificial Sequence
  Synthetic
agataggggcttttacaaacactatggcattatagtaggagattatgtgtaccagctggattcagatgacatttt

SEQ ID NO: 269394 - DNA, 75 bp, Artificial Sequence
  Synthetic
agtgggccaaacccgggggggatccccggtttccttttattttatcaatgccactatggagacaattaagagtat

SEQ ID NO: 269395 - DNA, 75 bp, Artificial Sequence
  Synthetic
caaaacagctttagcagggaaagctaggttcactaggacaaaattaacaccagactgggtcattgaggaagagtg

SEQ ID NO: 269396 - DNA, 75 bp, Artificial Sequence
  Synthetic
tgagctggattacttcagggtgaagtaccttgaatcatccgttaactcggagcatatcttctcagtagaccacaa

SEQ ID NO: 269397 - DNA, 75 bp, Artificial Sequence
  Synthetic
ctaatgtgcttggaccaaattgttatgccacgacagctgaaccagagaacaaggatgtagtacaggcgactacaa

SEQ ID NO: 269398 - DNA, 75 bp, Artificial Sequence
  Synthetic
tgccacgacagctgaaccagagaacaaggatgtagtacaggcgactacaaccgttaacacgacaaatttaacaca

SEQ ID NO: 269399 - DNA, 75 bp, Artificial Sequence
  Synthetic
tatcaccactggggagaaaaatcctagcaaattggttagattggagactcatgagtggacaccaacctgggctag

SEQ ID NO: 269400 - DNA, 75 bp, Artificial Sequence
  Synthetic
ggattatccttacttgtgcaaaaatgtactacttttttctcttcagcagccacagaaattttagataatgacttg

SEQ ID NO: 269401 - DNA, 75 bp, Artificial Sequence
  Synthetic
aaagtaagccagcctatggccaatcaagatactttgcagcagtacggtgtggttttcattttcaggtgcaagtga

SEQ ID NO: 269402 - DNA, 75 bp, Artificial Sequence
  Synthetic
agtgttatcgccttcttgtaaggcactcatgcagtgcttaatggatggtgatgtcaagaaattggcagaagtagt

SEQ ID NO: 269403 - DNA, 75 bp, Artificial Sequence
  Synthetic
cctgttgtgacatatgacacaaagttagaatttggagcgtttaccaatttgccacacgtgttgatgaatttggct

SEQ ID NO: 269404 - DNA, 75 bp, Artificial Sequence
  Synthetic
atttgactgatccattatgtttagaagaatctgcagaggaatgtaaacagaccatatcaccaaacgaattgggct

SEQ ID NO: 269405 - DNA, 75 bp, Artificial Sequence
  Synthetic
attagtaacacagtttacagactatttcaagaactggccagaataccgtcaagaattagtactcagaatgattta

SEQ ID NO: 269406 - DNA, 75 bp, Artificial Sequence
  Synthetic
attagagttgagccaattggggtttggatacaaggggaaccaggacaaggaaaatccttcctaacacatacactg

SEQ ID NO: 269407 - DNA, 75 bp, Artificial Sequence
  Synthetic
gcttggttttaccaggagcacactttcaccaatgaagggcagtggagagttaatttagagttcccaaaacaaggc

SEQ ID NO: 269408 - DNA, 75 bp, Artificial Sequence
  Synthetic
aaaatccttcctaacacatacactgtccagacagttacaaaaatcttgtaagttaaacggagtctacaccaaccc

SEQ ID NO: 269409 - DNA, 75 bp, Artificial Sequence
  Synthetic
cttacttcacaggtgaattaaatatccatgttctgttcctagctgagaagggattcctcagggtagctcacacct

SEQ ID NO: 269410 - DNA, 75 bp, Artificial Sequence
  Synthetic
ccatgttctgttcctagctgagaagggattcctcagggtagctcacacctacgacacatcagaaaacagggttgc

SEQ ID NO: 269411 - DNA, 75 bp, Artificial Sequence
  Synthetic
ttcctcttcccgcacctaaagttacaactggccgtgctttgcggggtgacttggcaaatttctcagaccaaagcc

SEQ ID NO: 269412 - DNA, 75 bp, Artificial Sequence
  Synthetic
aactggccgtgctttgcggggtgacttggcaaatttctcagaccaaagcccatatgatcaacaactacagagcca

SEQ ID NO: 269413 - DNA, 75 bp, Artificial Sequence
  Synthetic
acagctttaacagggaaagctaagttcactaagacaaaattaacgccagactgggtcattgaggaagaatgcgaa

SEQ ID NO: 269414 - DNA, 75 bp, Artificial Sequence
  Synthetic
gaaactattgctaaggatatttttggcacccatactattagtcaacaccaagctgttggtttaataggcacaatt

SEQ ID NO: 269415 - DNA, 75 bp, Artificial Sequence
  Synthetic
aaccatcaaagaattcttcaatcatgcggtggaaggtgatgaacagggattatctttacttgtgcaaaaatgtac

SEQ ID NO: 269416 - DNA, 75 bp, Artificial Sequence
  Synthetic
tatctttacttgtgcaaaaatgtaccactttcttctcttcagcagctacagaaattttagacaatgacttggtta

SEQ ID NO: 269417 - DNA, 75 bp, Artificial Sequence
  Synthetic
cacagtaaaatatactattagtattatatcaaaccagggaccctttaagggtttcaacaaagtgtcaacagcatt

SEQ ID NO: 269418 - DNA, 75 bp, Artificial Sequence
  Synthetic
caggcacattgattggtggatacacactctattgaaaataaaagacatggttatgagtgtattcaaacccagtat

SEQ ID NO: 269419 - DNA, 75 bp, Artificial Sequence
  Synthetic
atgttaatttggatgactgaacagggcatcattacaaaggaagttcaaagggttcaccattctggtggcatcaaa

SEQ ID NO: 269420 - DNA, 75 bp, Artificial Sequence
  Synthetic
actcgggaaggtactgagagcacaaaaacaatcagctacacagtgaaatcttgtaaaggtatgtgtggcggttta

SEQ ID NO: 269421 - DNA, 75 bp, Artificial Sequence
  Synthetic
ctcatttctaaagtggaagggaatttcaaaattcttggaatgcacatagctggaaatggagaaatgggtgttgcc

SEQ ID NO: 269422 - DNA, 75 bp, Artificial Sequence
  Synthetic
attagcactcagaatgatttgattagagtggagccaattggcgtctggatccaaggtgaaccagggcaaggaaaa

SEQ ID NO: 269423 - DNA, 75 bp, Artificial Sequence
  Synthetic
atatgtctgatcaaggcattgtcactgaagtgacacccatacagcctatgtatattaataccaagacccaaatcc

SEQ ID NO: 269424 - DNA, 75 bp, Artificial Sequence
  Synthetic
ataaaagcccagtctatggcgcagtggaagtgaagatgggcccagcagtcttgagtaaatcagaccccaggcttg

SEQ ID NO: 269425 - DNA, 75 bp, Artificial Sequence
  Synthetic
gagaaccagtcgagtgcctaatcaagaaatcagcaagcaaatatagagtcaacaagtttcaagtcaaaaatgaac

SEQ ID NO: 269426 - DNA, 75 bp, Artificial Sequence
  Synthetic
ggcaaattttacactagcaaattagtgatagcgacaaccaacaaatctgatttttctagcacagtcttgcaagat

SEQ ID NO: 269427 - DNA, 75 bp, Artificial Sequence
  Synthetic
tttggcaaggtgtcaaggcctgtgtcaaatctaagtttagagaaatatttggagtcaatggcattgtggacatga

SEQ ID NO: 269428 - DNA, 75 bp, Artificial Sequence
  Synthetic
aaacagccatcttaggaacttcccatgtcaattctatggacttaagcacatcagcaggatacagctttgttaaat

SEQ ID NO: 269429 - DNA, 75 bp, Artificial Sequence
  Synthetic
taaagcatacagtaaggctggaaaactcaatgtcagtcaagctatgtcgatcatggccactggtgagtgctggga

SEQ ID NO: 269430 - DNA, 75 bp, Artificial Sequence
  Synthetic
catatatcatgcatattagagcagctaaagcatacagtaaggctggaaaactcaatgtcagtcaagctatgtcga

SEQ ID NO: 269431 - DNA, 75 bp, Artificial Sequence
  Synthetic
caggttacaaaaagaaagatttgatttgtcttgaacctttctccatttcacctatgcttgaaaagctagtgcaag

SEQ ID NO: 269432 - DNA, 75 bp, Artificial Sequence
  Synthetic
agtatcaaagaatggtagggactgggaaactctaaaactgaaggacttagttaataagattacagaagattacca

SEQ ID NO: 269433 - DNA, 75 bp, Artificial Sequence
  Synthetic
ataagttccatacactacttaagggcaaccaaattactactatctttaacacttgccttaaagatgaactgagaa

SEQ ID NO: 269434 - DNA, 75 bp, Artificial Sequence
  Synthetic
ggagagacagaagaattatgattgctggaaacagcagttagagaaccaaactctagatgatctggatgatgcagt

SEQ ID NO: 269435 - DNA, 75 bp, Artificial Sequence
  Synthetic
aattagataaaatttcaactggcaagacaaggtgcattgaagcctgcgaagtggactattgcatagtttatagaa

SEQ ID NO: 269436 - DNA, 75 bp, Artificial Sequence
  Synthetic
ctctagatgatctggatgatgcagtctcttttatcaagcataattttccagatgcgatcccatacatagatgaat

SEQ ID NO: 269437 - DNA, 75 bp, Artificial Sequence
  Synthetic
aattgagcaaatggaagcctttattgagcctagacctagtgtttttaaatgttttgctaccaaagttgctaacca

SEQ ID NO: 269438 - DNA, 75 bp, Artificial Sequence
  Synthetic
agtcaatgttgagttttgtggaaagaaataaagcctggctgacagtagtttcagctgttactagtgcaattagta

SEQ ID NO: 269439 - DNA, 75 bp, Artificial Sequence
  Synthetic
tcacaaaaccaaagggcacattcccagtggcacaaagagaatttaaaaatgaagcaccttatgatggacaattag

SEQ ID NO: 269440 - DNA, 75 bp, Artificial Sequence
  Synthetic
aacacattatctctcagagtgcttatataactggctccacaacagggcatcttacacactgtgctgggtatcaac

SEQ ID NO: 269441 - DNA, 75 bp, Artificial Sequence
  Synthetic
atgatgaaattatattacatggacactctatcaagtaccttgaacaagaggaggaattgactctgcattacaaga

SEQ ID NO: 269442 - DNA, 75 bp, Artificial Sequence
  Synthetic
gaggaattgactctgcattacaagaacaaagtgtttccaattgattgcccttccgtgactcaagtcacattgggt

SEQ ID NO: 269443 - DNA, 75 bp, Artificial Sequence
  Synthetic
caagaaaaattccaaatattatactaacaagattggaacagagagcatgctaatttggatgactgaacaaggcat

SEQ ID NO: 269444 - DNA, 75 bp, Artificial Sequence
  Synthetic
attaaagttttggttttcttttgctatggactttataattagacactaatttgattagaacactaattcggaata

SEQ ID NO: 269445 - DNA, 75 bp, Artificial Sequence
  Synthetic
atggactttataattagacactaatttgattagaacactaattcggaatattggacataccaaaaaaaaaaaaaa

SEQ ID NO: 269446 - DNA, 75 bp, Artificial Sequence
  Synthetic
caacaaacatctaagacaattacatacaaccttgtacctggtccccaccagtcgaaggcatctagcaataagatg

SEQ ID NO: 269447 - DNA, 75 bp, Artificial Sequence
  Synthetic
ggtggaacaaggatgcttaaagcacaaagacaattaacttttctaacccacaatttattgtggggtggtagatgg

SEQ ID NO: 269448 - DNA, 75 bp, Artificial Sequence
  Synthetic
cgtaccataactctattagtgagataccatgcttgtggatcttatgctcacacagccatcctctagtaagtttgt

SEQ ID NO: 269449 - DNA, 75 bp, Artificial Sequence
  Synthetic
aaggtgtctgatgatgtgtgggaacttattggaaacaacattctaccgtaaggtatccattagccagcggaacaa

SEQ ID NO: 269450 - DNA, 75 bp, Artificial Sequence
  Synthetic
agctattcttggcacatctcatgtgaactccatggaccttagcacatcagctggatatagttttgttaagtcagg

SEQ ID NO: 269451 - DNA, 75 bp, Artificial Sequence
  Synthetic
cacctggtgacaggtgcctctggggccaaaagccaaggtttaacagaccctaatggattggttcaaacctgggat

SEQ ID NO: 269452 - DNA, 75 bp, Artificial Sequence
  Synthetic
ttacaaaaaaaaagatctaatttgtcttgaacccttctatattcatcctatgcttgagaaacttgtgcaagaaaa

SEQ ID NO: 269453 - DNA, 75 bp, Artificial Sequence
  Synthetic
ccaaaagccaaggtttaacagaccctaatggattggttcaaacctgggatgttgtggaaaatatttagtacctgc

SEQ ID NO: 269454 - DNA, 75 bp, Artificial Sequence
  Synthetic
attccataacttacttaagggcaaccagattaccacaattttcaacacttgtttaaaagatgaactgaggaaact

SEQ ID NO: 269455 - DNA, 75 bp, Artificial Sequence
  Synthetic
actacctctatcttggtgagttgattaaaaaacgtctagtgggccaaacccaggggggatccctggtttcctttt

SEQ ID NO: 269456 - DNA, 75 bp, Artificial Sequence
  Synthetic
acttatcaaaatgatcatggagacaattaagagtattgcagatatggccactggagttgttagctctgtagattc

SEQ ID NO: 269457 - DNA, 75 bp, Artificial Sequence
  Synthetic
caccatcaatgctgtcaatgagaaagtagaaaatgtcggtaatgaaattggaggtaacttattaactaaggtggc

SEQ ID NO: 269458 - DNA, 75 bp, Artificial Sequence
  Synthetic
cgatgacgcatctagtgtacttggtcccaactgttttgctaccacggctgaaccagagaataaaaatgttgtaca

SEQ ID NO: 269459 - DNA, 75 bp, Artificial Sequence
  Synthetic
ggctactaccacagttaacacaaccaatttgacacaacacccttctgccccaacaatgcccttttcaccagattt

SEQ ID NO: 269460 - DNA, 75 bp, Artificial Sequence
  Synthetic
ctcaaatgtcgataattttcattcaatggcttatgacattactactggtgacaagaatcctagcaagttagtcag

SEQ ID NO: 269461 - DNA, 75 bp, Artificial Sequence
  Synthetic
tcatttggtgcagaagtgactggttctcgcaaggatgagcctccatcattgaaacccagactggaggtagaattt

SEQ ID NO: 269462 - DNA, 75 bp, Artificial Sequence
  Synthetic
acttgagacacatgaatggacaccatcatgggctaggggacaccaaattacacatgtagaattaccaaaagtctt

SEQ ID NO: 269463 - DNA, 75 bp, Artificial Sequence
  Synthetic
ttgaagcgcaaacctggttacttcccagagtccacatttatagtaggaaaattggacactgaaaatatgatacaa

SEQ ID NO: 269464 - DNA, 75 bp, Artificial Sequence
  Synthetic
ctggaataatcaggataaaccagcatatggccaatctcgttattttgcagctgtgagatgtggatttcatttcca

SEQ ID NO: 269465 - DNA, 75 bp, Artificial Sequence
  Synthetic
agttcaagtgaatgttaaccaaggaactgctggtagtgctctagtcgtgtatgaacccaaacccgttgtcacata

SEQ ID NO: 269466 - DNA, 75 bp, Artificial Sequence
  Synthetic
tgactcaaaattggaatttggtgctttcaccaatttgccacatgttttaatgaacttggctgagaccacacaggc

SEQ ID NO: 269467 - DNA, 75 bp, Artificial Sequence
  Synthetic
agaatggaacattacagtggatgattatgatgtggttgtagctaagttgatgcccatggtgtttgactagaatta

SEQ ID NO: 269468 - DNA, 75 bp, Artificial Sequence
  Synthetic
cgatttgtgtattccctatgttgctgatacaaactatgtcaagactgattcgtcagacttagggcaactcaaggt

SEQ ID NO: 269469 - DNA, 75 bp, Artificial Sequence
  Synthetic
atgttttggttttttttgttatggacttttttattaaaacactaattttattaaaacacttatttggaatattgg

SEQ ID NO: 269470 - DNA, 75 bp, Artificial Sequence
  Synthetic
tatggacttttttattaaaacactaattttattaaaacacttatttggaatattggacctaccaaaaaaaaaaaa

SEQ ID NO: 269471 - DNA, 75 bp, Artificial Sequence
  Synthetic
ctatgtttggaccccattaacaattcccactggatccgcaaaccaagtggatgttaccattttaggtagtctctt

SEQ ID NO: 269472 - DNA, 75 bp, Artificial Sequence
  Synthetic
taccccgacttgctgagcttctctaggagagtccctttcccagccttgaggcggctggtcaataaaagcctcaat

SEQ ID NO: 269473 - DNA, 75 bp, Artificial Sequence
  Synthetic
tgtaacaaacatctaagattattacattaaccccatgcctggtctccactagttgaaggcaacttgcaataaaat

SEQ ID NO: 269474 - DNA, 75 bp, Artificial Sequence
  Synthetic
acaattagattttcaaaatccaagagtatttggccaagatgtaaatatatatgataatgcacccaatggtaagaa

SEQ ID NO: 269475 - DNA, 75 bp, Artificial Sequence
  Synthetic
gaaaaactggaaaaagattatgacaatgagcacaaagtataagtggactaggtctaaaattgacatagccgaggg

SEQ ID NO: 269476 - DNA, 75 bp, Artificial Sequence
  Synthetic
gagtggaaacaagacgcttaaagtatggtgtaaattaacatttctaactcacattttgtgtggggtggcagatgg

SEQ ID NO: 269477 - DNA, 75 bp, Artificial Sequence
  Synthetic
tccaggttctatgaacatggccaatgttcttagtacaacaggagcccaatctgtggctctggttggtgagagggc

SEQ ID NO: 269478 - DNA, 75 bp, Artificial Sequence
  Synthetic
tttctatgatcctagaacagctggcagtaaatcaagatttgatgatctcgctaaaatagcacaactattttctgt

SEQ ID NO: 269479 - DNA, 75 bp, Artificial Sequence
  Synthetic
gatggcagactcaaccaccccatcagaaaaccacggggccgatgccaaagggtatttcaaatggtcagctacaac

SEQ ID NO: 269480 - DNA, 75 bp, Artificial Sequence
  Synthetic
tgttgtggaagatacttagtacctaccgatctggtagtagtgcaaacactagttgtaaggcccacgaaggatgcc

SEQ ID NO: 269481 - DNA, 75 bp, Artificial Sequence
  Synthetic
tgcaccccaaagtatcgtccacagaaatattgtctacttaaaactatttccaaatctcaatgtctttgtcaatag

SEQ ID NO: 269482 - DNA, 75 bp, Artificial Sequence
  Synthetic
ttattcatattttaggggctcattagtcctaagattgagtgtttatgctagtactttcaacagaggtagattaag

SEQ ID NO: 269483 - DNA, 75 bp, Artificial Sequence
  Synthetic
aatgggattcttccctaacgccacagcagactcaacttccaccttagacaatgctatatacactatatgtgatat

SEQ ID NO: 269484 - DNA, 75 bp, Artificial Sequence
  Synthetic
ccgggggggaaccccggtttccttttattttgtcagtgccactatggagacaattaagagtattgcagatatggc

SEQ ID NO: 269485 - DNA, 75 bp, Artificial Sequence
  Synthetic
aggtagtgataatagttttgagatcactataccttactctttctccacttggatgaggaaaacaaatgatcaccc

SEQ ID NO: 269486 - DNA, 75 bp, Artificial Sequence
  Synthetic
gactggagtggtcagttcagttgattccactattaatgcagttaatgagagagtggaaaatgtaggtaatgaaat

SEQ ID NO: 269487 - DNA, 75 bp, Artificial Sequence
  Synthetic
aattggattattccaaattgaagttttgaacagacttacatacaacagttccagcccatcagaggtctactgcat

SEQ ID NO: 269488 - DNA, 75 bp, Artificial Sequence
  Synthetic
tggaggtaatttattaaccaaagttgcagatgatgcttctaatgtgctcggaccaaattgctatgccacaacagc

SEQ ID NO: 269489 - DNA, 75 bp, Artificial Sequence
  Synthetic
agtgcaaggaaagatgggacaagatgttaggtttttctgtccaactggttctgtcgttacatttcaaaattcatg

SEQ ID NO: 269490 - DNA, 75 bp, Artificial Sequence
  Synthetic
tgaaccagagaacaaagatgtagtacaggcaaccacaactgttaacacgaccaacctgacacaacatccctcagc

SEQ ID NO: 269491 - DNA, 75 bp, Artificial Sequence
  Synthetic
gggttcacaaatggatttgactgatcccctttgtatcgaagaagatacagagaattgcaagcaaacaatgtcgcc

SEQ ID NO: 269492 - DNA, 75 bp, Artificial Sequence
  Synthetic
accaacaatgcccttcactcctgatttctccaatgttgacacattccactcaatggcatatgatatcaccactgg

SEQ ID NO: 269493 - DNA, 75 bp, Artificial Sequence
  Synthetic
tgaggaacacacctttaccgatgaagggcaatggagagtctcattaaaatttccaaaacaaggtcatggttcttt

SEQ ID NO: 269494 - DNA, 75 bp, Artificial Sequence
  Synthetic
ttctccaatgttgacacattccactcaatggcatatgatatcaccactggggaaaaaaatcctagtaaattggtt

SEQ ID NO: 269495 - DNA, 75 bp, Artificial Sequence
  Synthetic
ggaaaaaaatcctagtaaattggttagattggagacacatgagtggacaccaacatgggctagaggacatcagat

SEQ ID NO: 269496 - DNA, 75 bp, Artificial Sequence
  Synthetic
atcactcttgtttgcttacttcactggtgaattaaacattcatgtactattcctaagtgaaagaggattcctgag

SEQ ID NO: 269497 - DNA, 75 bp, Artificial Sequence
  Synthetic
aacccatgtggaattaccaaaagttttttgggacaaaaacagtaagccagcctatggccaatcaagatactttgc

SEQ ID NO: 269498 - DNA, 75 bp, Artificial Sequence
  Synthetic
agttgcccacacttatgacaccagtggtgaccgggtcaacttcttatcatctaatggtgttataactataccagc

SEQ ID NO: 269499 - DNA, 75 bp, Artificial Sequence
  Synthetic
cctatggccaatcaagatactttgcggcagtacggtgtggttttcattttcaagtacaagtgaatgttaatcaag

SEQ ID NO: 269500 - DNA, 75 bp, Artificial Sequence
  Synthetic
tggggaacagatgacactttcagctccattttattcaaataaaccattgagaacggtgagggatgataacagtct

SEQ ID NO: 269501 - DNA, 75 bp, Artificial Sequence
  Synthetic
gaacagctggtagtgcattggtggtgtatgaacccaaacctgttgtgacatatgactcaaagttagaatttggag

SEQ ID NO: 269502 - DNA, 75 bp, Artificial Sequence
  Synthetic
tggatatttgatgtgtaaacctttccttacaggaaccactactggaaagattgaagtttacctcagtttaaggtg

SEQ ID NO: 269503 - DNA, 75 bp, Artificial Sequence
  Synthetic
taagcattatggtatcattgtgggggattatgtgtaccaactggattctgatgacatttttaagacagccctaac

SEQ ID NO: 269504 - DNA, 75 bp, Artificial Sequence
  Synthetic
gatgaatttggctgagaccacacaggctgatttatgtatcccctatgttgctgacacaaactatgttaaaacaga

SEQ ID NO: 269505 - DNA, 75 bp, Artificial Sequence
  Synthetic
cggtaaagccaagttcactaaaaccaagttgacaaacgattgggtggtggaggaagaatgtgagcttgattactt

SEQ ID NO: 269506 - DNA, 75 bp, Artificial Sequence
  Synthetic
ttcgtcagacttagggcaactaaaagtctatgtttggacacctttatccataccttcaggttctgctacacaagt

SEQ ID NO: 269507 - DNA, 75 bp, Artificial Sequence
  Synthetic
cagaattaaatatcttgaatcagcagttaattcggagcacatattttctgtggataaaaactgtgaaaccattgc

SEQ ID NO: 269508 - DNA, 75 bp, Artificial Sequence
  Synthetic
taaggatatttttggcacccatacattgagccaacaccaggctataggcctggttggtacaatcctcttaactgc

SEQ ID NO: 269509 - DNA, 75 bp, Artificial Sequence
  Synthetic
ttatgacaatgcaccaacgcggaaacaaaatctaaaaaagattcttacaatgagcactaaatacaagtggactag

SEQ ID NO: 269510 - DNA, 75 bp, Artificial Sequence
  Synthetic
caaaatctaaaaaagattcttacaatgagcactaaatacaagtggactaggggaaaaattgacattgcagaaggg

SEQ ID NO: 269511 - DNA, 75 bp, Artificial Sequence
  Synthetic
aggtctcatgtctaccattaaaacacctgtaaatgccactacaattaaggagttctttaatcataccattgaggg

SEQ ID NO: 269512 - DNA, 75 bp, Artificial Sequence
  Synthetic
tgatgagcaaggtttatcactacttgtgcaaaagtgtactactttcttttcatctgcagctactgaaattttaga

SEQ ID NO: 269513 - DNA, 75 bp, Artificial Sequence
  Synthetic
tattgagtaccactgcagcgcaatcaattgctttggttggggaaagggcattttatgacccaagaacagcaggaa

SEQ ID NO: 269514 - DNA, 75 bp, Artificial Sequence
  Synthetic
taatgatctggtcaaatttatagttaaaatcttggttagaattttgtgttatatggttctctattgccacaaacc

SEQ ID NO: 269515 - DNA, 75 bp, Artificial Sequence
  Synthetic
gcaagagtaggtttgatgatttagtaaaaatatctcaacttttttctgtgatgagtgactccacaaccccttcag

SEQ ID NO: 269516 - DNA, 75 bp, Artificial Sequence
  Synthetic
ccaatcatggaatagatgcaaaaggctattttacgtggtcatccacaacagcacctcagtctgtagtgcatagga

SEQ ID NO: 269517 - DNA, 75 bp, Artificial Sequence
  Synthetic
aaacattcttactactgcttgtctatcaacccttttgatcatggatgtgacttcatcttcagtcctatcaccatc

SEQ ID NO: 269518 - DNA, 75 bp, Artificial Sequence
  Synthetic
ctattttacgtggtcatccacaacagcacctcagtctgtagtgcataggaatattgtttacttaaaattatttcc

SEQ ID NO: 269519 - DNA, 75 bp, Artificial Sequence
  Synthetic
atgtaaagccctgatgcaatgtcttatggatggtgatgttaagaagttagctgaagtggttgcggagtcgatgtc

SEQ ID NO: 269520 - DNA, 75 bp, Artificial Sequence
  Synthetic
taacttgaatgtttttgttaacagctactcatattttagaggttcaatagtgctgaggttgagcgtatatgccag

SEQ ID NO: 269521 - DNA, 75 bp, Artificial Sequence
  Synthetic
aaacacagacgatgatgagatcaaagagcaaatctgtgacacagtaaaatataccaagaatatcttatcaaacca

SEQ ID NO: 269522 - DNA, 75 bp, Artificial Sequence
  Synthetic
cactttcaatagaggtcgtctacggatgggcttctttccaaatgctacagaggacagtacttcagaaatagataa

SEQ ID NO: 269523 - DNA, 75 bp, Artificial Sequence
  Synthetic
atgggcttctttccaaatgctacagaggacagtacttcagaaatagataatgctatatacacaatttgtgatttg

SEQ ID NO: 269524 - DNA, 75 bp, Artificial Sequence
  Synthetic
aggccctttcaagggttttaatgaggtttccactgcattcagacacattgattggtggatccacactcttcttaa

SEQ ID NO: 269525 - DNA, 75 bp, Artificial Sequence
  Synthetic
aggacagtacttcagaaatagataatgctatatacacaatttgtgatttgggcagtgataacagttttgaaatta

SEQ ID NO: 269526 - DNA, 75 bp, Artificial Sequence
  Synthetic
ctattccatattcattttccacttggatgcggaaaacagatggccacccaattggattattccaaattgaagtgc

SEQ ID NO: 269527 - DNA, 75 bp, Artificial Sequence
  Synthetic
aatcaaggacatggttcttagtgtatttaaacctagcatagaaagtaaggctatccaatggttagaaagaaataa

SEQ ID NO: 269528 - DNA, 75 bp, Artificial Sequence
  Synthetic
gatgcggaaaacagatggccacccaattggattattccaaattgaagtgctcaacaggttaacttacaacagttc

SEQ ID NO: 269529 - DNA, 75 bp, Artificial Sequence
  Synthetic
agaacatgtgtgcagcattcttgattatgcttcagatattattgtagagtcaaaggatcaatcaaaaatgaaaac

SEQ ID NO: 269530 - DNA, 75 bp, Artificial Sequence
  Synthetic
cagccctaatgaagtttattgtattgtgcaaggtaaaatggggcaagatgccaggttcttctgtccaaccggctc

SEQ ID NO: 269531 - DNA, 75 bp, Artificial Sequence
  Synthetic
tcaagaattttatcaaagatattctgattgtctagctaaattcaaaccaattatggccatttgcttcagaagttg

SEQ ID NO: 269532 - DNA, 75 bp, Artificial Sequence
  Synthetic
ccaggttcttctgtccaaccggctctgtggtaactttccaaaattcatggggttcacaaatggatttgactgatc

SEQ ID NO: 269533 - DNA, 75 bp, Artificial Sequence
  Synthetic
ggttcacaaatggatttgactgatccactatgtctggaagaatctgcagaggaatgcaaacagactatatcacca

SEQ ID NO: 269534 - DNA, 75 bp, Artificial Sequence
  Synthetic
ccacaatagcattagtaatacagtctacagactattccaggaattagctcgaatacctaacaggattagtactca

SEQ ID NO: 269535 - DNA, 75 bp, Artificial Sequence
  Synthetic
aatgaattgggcttaacatcagctcaggatgatggaccattgggcgataacaagccaaattattttctaaatttc

SEQ ID NO: 269536 - DNA, 75 bp, Artificial Sequence
  Synthetic
aaatgacttgattagagttgaaccgattggtgtttggatacagggtgaacctggccaaggcaaatcattcctgac

SEQ ID NO: 269537 - DNA, 75 bp, Artificial Sequence
  Synthetic
aagtccatgaatgtggatatcttcactgtttcccacactaaagtagacaacatatttggaagagcttggttttac

SEQ ID NO: 269538 - DNA, 75 bp, Artificial Sequence
  Synthetic
acatacattatctagacaactgcaaaaatcttgcaagctaaatggagtttacacaaatccaacagccagtgaatt

SEQ ID NO: 269539 - DNA, 75 bp, Artificial Sequence
  Synthetic
caggaacatactttcaccgatgaagggcagtggagagttaatttagagtttccgaaacaaggccatggttcgctt

SEQ ID NO: 269540 - DNA, 75 bp, Artificial Sequence
  Synthetic
catggacggctatgacaaccaagatatccacttgattgatgatttgggccagactagaaaagaaaaagacattga

SEQ ID NO: 269541 - DNA, 75 bp, Artificial Sequence
  Synthetic
tccttgttatttgcttacttcacaggtgaattaaatattcatgttttgttcctagctgaaaagggatttcttaga

SEQ ID NO: 269542 - DNA, 75 bp, Artificial Sequence
  Synthetic
aatgctttgcaactgtatatcttctgttccttttattgtaccaatggcacatcttgaagaaaaaggtaaatttta

SEQ ID NO: 269543 - DNA, 75 bp, Artificial Sequence
  Synthetic
gtagcccacacctatgacacatcagcaaacagagttaacttcctgtcatccaatggcgtcatcacaatcccagct

SEQ ID NO: 269544 - DNA, 75 bp, Artificial Sequence
  Synthetic
caccagtaaattggtcattgctactactaacaaatcagacttctctagcactgtgctgcaagattctggggcact

SEQ ID NO: 269545 - DNA, 75 bp, Artificial Sequence
  Synthetic
ggagaacaaatgacattatctgcaccctactactcaaataaaccccttagaacagtcagagacgacaatagtctt

SEQ ID NO: 269546 - DNA, 75 bp, Artificial Sequence
  Synthetic
aaagaggcggtttccatacatcatgcatattagggctgccaaagcctatagtaaggcaggtaagttgaatgttag

SEQ ID NO: 269547 - DNA, 75 bp, Artificial Sequence
  Synthetic
gggtacttaatgtgtaaaccattcctcactggaacgacaacagggaagatagaggtttatcttagtttgagatgt

SEQ ID NO: 269548 - DNA, 75 bp, Artificial Sequence
  Synthetic
ccaggctatgtcaactatgtccactggtgagtgctgggaagtatctaagaatggtagagattgggaaactctaaa

SEQ ID NO: 269549 - DNA, 75 bp, Artificial Sequence
  Synthetic
ccaaatttcttctttcctcttcccgcacctaaggtttcaactagccgtgctttgcggggtgacttggcaaatttc

SEQ ID NO: 269550 - DNA, 75 bp, Artificial Sequence
  Synthetic
gttacaagaattggttaataaaatcactgaagattatgaagagagacagaaaaattataattgttggaaacaaca

SEQ ID NO: 269551 - DNA, 75 bp, Artificial Sequence
  Synthetic
cacctaaggtttcaactagccgtgctttgcggggtgacttggcaaatttctcagaccagagcccatatgatcaac

SEQ ID NO: 269552 - DNA, 75 bp, Artificial Sequence
  Synthetic
tcagaccagagcccatatgatcaacaaccacagagccaaattatgaaattagcttatttagatagggggttttac

SEQ ID NO: 269553 - DNA, 75 bp, Artificial Sequence
  Synthetic
attggataatcagtcattggacgacttagatgatgctgtctcatacataaagcataattttccagatgctatacc

SEQ ID NO: 269554 - DNA, 75 bp, Artificial Sequence
  Synthetic
aaccacagagccaaattatgaaattagcttatttagatagggggttttacaaacactatggcattatagtgggag

SEQ ID NO: 269555 - DNA, 75 bp, Artificial Sequence
  Synthetic
atagtgtatatcagttagattcagatgacattttcaaaacagctctaacagggaaagccaggttcactaagacaa

SEQ ID NO: 269556 - DNA, 75 bp, Artificial Sequence
  Synthetic
ttacattgatgaatatttgaacattgagatgtcaacactaattgaacaaatggaagcattcatcgaaccaaagcc

SEQ ID NO: 269557 - DNA, 75 bp, Artificial Sequence
  Synthetic
aagtgtttttaaatgttttgcaaacagagtggtttcaaacacaaaaaaagctgcaagagaagtggttgaatggtt

SEQ ID NO: 269558 - DNA, 75 bp, Artificial Sequence
  Synthetic
aattaacttcagactgggtcattgaagaggaatgtgaactggattatttcagggtgaaataccttgaatcatctg

SEQ ID NO: 269559 - DNA, 75 bp, Artificial Sequence
  Synthetic
tcaactcagaacatatcttctcagtggaccacaattgtgaaactattgctaaggatatctttggcacccacactc

SEQ ID NO: 269560 - DNA, 75 bp, Artificial Sequence
  Synthetic
ttcggataagatcaaatccatgttaagttttgttgaaaggaataaagcttggttaactgtagtttctgcagttac

SEQ ID NO: 269561 - DNA, 75 bp, Artificial Sequence
  Synthetic
ttagtcaacaccaggctattggcttaataggcacaattctcttaactgctggattgatgtcaaccattaaaacac

SEQ ID NO: 269562 - DNA, 75 bp, Artificial Sequence
  Synthetic
cagtgccattagcatactactcctagtaaccaaaattttcaaaaaggaagaatcaaaagatgagagggcttataa

SEQ ID NO: 269563 - DNA, 75 bp, Artificial Sequence
  Synthetic
ggattgatgtcaaccattaaaacaccagtcactgccaccaccattaaagaattcttcaaccatgcaatagaaggt

SEQ ID NO: 269564 - DNA, 75 bp, Artificial Sequence
  Synthetic
ccctacactaccagtgtctaagccaaaaggaactttccctgtttcacaaagggaatttaagaatgaagccccata

SEQ ID NO: 269565 - DNA, 75 bp, Artificial Sequence
  Synthetic
attcttcaaccatgcaatagaaggtgatgaacaggggctatctttacttgtgcaaaagtgtactactttcttctc

SEQ ID NO: 269566 - DNA, 75 bp, Artificial Sequence
  Synthetic
tgatggtcaattggaacatattatatcccagatggcatacatcactggttcaaccacgggccacttaacccattg

SEQ ID NO: 269567 - DNA, 75 bp, Artificial Sequence
  Synthetic
ttcagcagccacagaaatcttagacaatgatctggttaaatttatagtgaaaatccttgtcagaattctctgtta

SEQ ID NO: 269568 - DNA, 75 bp, Artificial Sequence
  Synthetic
ttcagcagcctcagaaatcttagacaatgatctggttaaatttatagtgaaaatccttgtcagaattctctgtta

SEQ ID NO: 269569 - DNA, 75 bp, Artificial Sequence
  Synthetic
ttcagcagccccagaaatcttagacaatgatctggttaaatttatagtgaaaatccttgtcagaattctctgtta

SEQ ID NO: 269570 - DNA, 75 bp, Artificial Sequence
  Synthetic
ttcagcagccgcagaaatcttagacaatgatctggttaaatttatagtgaaaatccttgtcagaattctctgtta

SEQ ID NO: 269571 - DNA, 75 bp, Artificial Sequence
  Synthetic
tgctggttaccagcatgatgagatcatactacatgggcactcaatcaaatatttggaacaagaagaagagttaac

SEQ ID NO: 269572 - DNA, 75 bp, Artificial Sequence
  Synthetic
aacatcttaaccactgcttgtttatccactctattaataatggatgtcacatcctcatcagtgttgtcaccttct

SEQ ID NO: 269573 - DNA, 75 bp, Artificial Sequence
  Synthetic
cctacattacaaaaataaaatttttccaattgagcaaccatctgttactcaggtaacgcttggtggtaagcctat

SEQ ID NO: 269574 - DNA, 75 bp, Artificial Sequence
  Synthetic
atcctcatcagtgttgtcaccttcttgtaaggcactcatgcagtgcctaatggatggtgatgttaagaaattggc

SEQ ID NO: 269575 - DNA, 75 bp, Artificial Sequence
  Synthetic
ggatttggctatcttaaagtgcaaattgccattcagattcaagaagaactctaggtattatactaatagaattgg

SEQ ID NO: 269576 - DNA, 75 bp, Artificial Sequence
  Synthetic
ggaagttgtggctgaatccatgtcaaacacagatgatgaagaaaccaaggaacaaatctgtgacacagtgaagta

SEQ ID NO: 269577 - DNA, 75 bp, Artificial Sequence
  Synthetic
aactgagagtatgttgatctggatgactgagcaaggtattattacaaaggaggtccaaagagtgcaccattctgg

SEQ ID NO: 269578 - DNA, 75 bp, Artificial Sequence
  Synthetic
aacaaatctgtgacacagtgaagtatactaagagtattctgtcaaaccagggaccttttaagggtttcaatgaag

SEQ ID NO: 269579 - DNA, 75 bp, Artificial Sequence
  Synthetic
tggtattaaaactagagagggaactgaaagcaccaagaccattagttacactgtaaagtcttgcaaaggaatgtg

SEQ ID NO: 269580 - DNA, 75 bp, Artificial Sequence
  Synthetic
tgtcaacagcattcaggcatattgattggtgggtacacactctattgaaaataaaagatatggttttgagtgttt

SEQ ID NO: 269581 - DNA, 75 bp, Artificial Sequence
  Synthetic
tggtggtcttttgatctcaaaagtggaaggcaatttcaaaattcttggcatgcacattgctggaaatggtgaaat

SEQ ID NO: 269582 - DNA, 75 bp, Artificial Sequence
  Synthetic
gagcacgtttgtgctatcctggattatgcctctgatattattgtggagtcaaaagaccagacaaaaatgaaatcc

SEQ ID NO: 269583 - DNA, 75 bp, Artificial Sequence
  Synthetic
gggtgtggctatccccttcaatttccttaagaatgatatgtctgaccagggaatagtcactgagatcacgcccat

SEQ ID NO: 269584 - DNA, 75 bp, Artificial Sequence
  Synthetic
aaaagaccagacaaaaatgaaatcccaggaattttaccagaaatacactgattgtttgtctaaatttaaaccaat

SEQ ID NO: 269585 - DNA, 75 bp, Artificial Sequence
  Synthetic
acagcccatgtacataaacaccaaatcccaaatacacaagagcccagtttacggtgcagtggaagttaagatggg

SEQ ID NO: 269586 - DNA, 75 bp, Artificial Sequence
  Synthetic
attgtttgtctaaatttaaaccaattatggctatttgctttagaagttgccacaacagcatcagcaatacagtct

SEQ ID NO: 269587 - DNA, 75 bp, Artificial Sequence
  Synthetic
cccagccgtgttgagcaaatcagacactagattggaagaaccaattgattgtttggtcaaaaagtcagcttcaaa

SEQ ID NO: 269588 - DNA, 75 bp, Artificial Sequence
  Synthetic
atacagggtcaataaattccaagttaataatgaactgtggcaaggagttaaagcttgtgtcaaatcaaagttcag

SEQ ID NO: 269589 - DNA, 75 bp, Artificial Sequence
  Synthetic
cacacactatccagacagttgcaaaaatcctgtaaattaaatggtgtgtacaccaacccaacagctagtgagttt

SEQ ID NO: 269590 - DNA, 75 bp, Artificial Sequence
  Synthetic
agaaatatttggtattaatggcattgttgacatgaaaactgctattcagggaacttctcatgttaattccttgga

SEQ ID NO: 269591 - DNA, 75 bp, Artificial Sequence
  Synthetic
ccttagtacatcagctgggtactcatttattaggtctggttatagaaagaaggacttaatttgtttggaaccatt

SEQ ID NO: 269592 - DNA, 75 bp, Artificial Sequence
  Synthetic
atgttgtgtaattgtatttcctcagtcccatttatagttccaatggcacatctcgaagagaaaggcaaattttat

SEQ ID NO: 269593 - DNA, 75 bp, Artificial Sequence
  Synthetic
ctcagtacacccaatgctagaaaaattggtacaagaaaaatttcacaaccttctgaaaggtaatcaaatcaccac

SEQ ID NO: 269594 - DNA, 75 bp, Artificial Sequence
  Synthetic
accagtagactggtgatagcaacaaccaacaaatctgatttttcaagtacagtcctacaagattctggtgcacta

SEQ ID NO: 269595 - DNA, 75 bp, Artificial Sequence
  Synthetic
gattttcaatacatgcttaaaagatgagcttagaaaattggacaaaattgccgctggtaagactaggtgtataga

SEQ ID NO: 269596 - DNA, 75 bp, Artificial Sequence
  Synthetic
ccaacaaatctgatttttcaagtacagtcctacaagattctggtgcactaaagagaagattcccatacattatgc

SEQ ID NO: 269597 - DNA, 75 bp, Artificial Sequence
  Synthetic
atattagagcagctaaagcatacagtaaggctggtaaacttaatgttagtcaagctatgtccaccatggccactg

SEQ ID NO: 269598 - DNA, 75 bp, Artificial Sequence
  Synthetic
agcttgtgaagtggattactgtattgtgtacaggatgattatgatggaaatttatgataaaatttaccagactcc

SEQ ID NO: 269599 - DNA, 75 bp, Artificial Sequence
  Synthetic
caagctatgtccaccatggccactggtgagtgctgggaagtgtcaaagaatggtagagattgggaaactttaaaa

SEQ ID NO: 269600 - DNA, 75 bp, Artificial Sequence
  Synthetic
ttgctattattctggattggctgttggaatcaatccatacaaagattggcattttatgatcaatgcccttaatga

SEQ ID NO: 269601 - DNA, 75 bp, Artificial Sequence
  Synthetic
ctgaaggacctagtccataagattacagaagattaccaggagaggcagaaaaattatgattgctggaaacagcag

SEQ ID NO: 269602 - DNA, 75 bp, Artificial Sequence
  Synthetic
ttacaactatgaaatggattattcccaatatgatggctcacttagttcaatgctactgtgggaggctgtggaagt

SEQ ID NO: 269603 - DNA, 75 bp, Artificial Sequence
  Synthetic
ttagagaatcaaactctagatgatttggacgatgctgtctcttacatcaagcataattttccagatgcaattcca

SEQ ID NO: 269604 - DNA, 75 bp, Artificial Sequence
  Synthetic
tctggcttattgccatgactcaccaaatcttgtgatacaactgcacaaacctgtcattgattctgaccatgttgt

SEQ ID NO: 269605 - DNA, 75 bp, Artificial Sequence
  Synthetic
tatatagatgaataccttactattgaaatgtcaacacttattgagccaatggaagcattcaatgagcctagacct

SEQ ID NO: 269606 - DNA, 75 bp, Artificial Sequence
  Synthetic
tttcaacgagagatggttaattcatggtggtatgccatcaggatcaccatgcaccaccgtactaaattcactttg

SEQ ID NO: 269607 - DNA, 75 bp, Artificial Sequence
  Synthetic
aaatgtcaacacttattgagccaatggaagcattcaatgagcctagaccttatgttttcaaatgttttgcaacca

SEQ ID NO: 269608 - DNA, 75 bp, Artificial Sequence
  Synthetic
caatttaatgatgtgcatttacactacaaatcttattagtcctggaattgattgtttaccaattgtatatggaga

SEQ ID NO: 269609 - DNA, 75 bp, Artificial Sequence
  Synthetic
agtagcaaaattaagtcaatgttgagttttgtagaaagaaacaaagcctggttaacagtagtttcagctgttacc

SEQ ID NO: 269610 - DNA, 75 bp, Artificial Sequence
  Synthetic
tgatgtgattctctcattggacaaagaaattgaaccagaaaaactgcaaagtatcatggcagattcatttggagc

SEQ ID NO: 269611 - DNA, 75 bp, Artificial Sequence
  Synthetic
agtgcaattagtatattgcttttggtgacaaaaatttttaagaaagaagactcaaaagatgaaagggcatacaac

SEQ ID NO: 269612 - DNA, 75 bp, Artificial Sequence
  Synthetic
tgaagtgactgggtcgcgtaaggatgaacccccttcactcaaaccaagaatggaggttgaattcttaaagcgcaa

SEQ ID NO: 269613 - DNA, 75 bp, Artificial Sequence
  Synthetic
gaacccccttcactcaaaccaagaatggaggttgaattcttaaagcgcaaacctggctacttcccagagtctact

SEQ ID NO: 269614 - DNA, 75 bp, Artificial Sequence
  Synthetic
ccgacccttcccgtgacaaaaccaaagggtgcattcccagtgtcacaaagggaatttaaaaatgaagctccctat

SEQ ID NO: 269615 - DNA, 75 bp, Artificial Sequence
  Synthetic
ggaatttaaaaatgaagctccctatgatggccaattagagcacataatatcccaaatggcatatataactggctc

SEQ ID NO: 269616 - DNA, 75 bp, Artificial Sequence
  Synthetic
caccacaggacatttcacacactgtgcaggttaccagcatgatgaggtcattctacatggacactcaattaagta

SEQ ID NO: 269617 - DNA, 75 bp, Artificial Sequence
  Synthetic
cagcaacttcaatcctacttaatggagttatgcctccatggaaaagacacttaccaacactacatcaaaatcttg

SEQ ID NO: 269618 - DNA, 75 bp, Artificial Sequence
  Synthetic
ccttgaacaagaagaagatttaactttgcactataaaaataaggtgttcccaattgagaacccatctgtaacaca

SEQ ID NO: 269619 - DNA, 75 bp, Artificial Sequence
  Synthetic
gacccttatttgaaggaatggaatatttcagtagatgattatgaagtggttattactaagttgatgcccatggtg

SEQ ID NO: 269620 - DNA, 75 bp, Artificial Sequence
  Synthetic
tttcagtagatgattatgaagtggttattactaagttgatgcccatggtgtttgattaaatttaatgttttggct

SEQ ID NO: 269621 - DNA, 75 bp, Artificial Sequence
  Synthetic
agttacgttgggtggtaaacctatggatttggctattctcaagtgcaaactaccatttaggttcaaaaaaaattc

SEQ ID NO: 269622 - DNA, 75 bp, Artificial Sequence
  Synthetic
ttttggctttcttttgctatggactttataattaggatactagtttgattagaacactaattcggaatattggac

SEQ ID NO: 269623 - DNA, 75 bp, Artificial Sequence
  Synthetic
gactgatcccctttgtatcgaagaagatacagagaattgcaagcaaacaatgtcgccaaatgaattgggactcac

SEQ ID NO: 269624 - DNA, 75 bp, Artificial Sequence
  Synthetic
gggcttggttttttgaggaacacacctttaccgatgaagggcaatggagagtctcattaaaatttccaaaacaag

SEQ ID NO: 269625 - DNA, 75 bp, Artificial Sequence
  Synthetic
aaccactactggaaagattgaagtttacctcagtttaaggtgcccaaattttttcttccctttacctgcccccaa

SEQ ID NO: 269626 - DNA, 75 bp, Artificial Sequence
  Synthetic
ttggatagaggcttctataagcattatggtatcattgtgggggattatgtgtaccaactggattctgatgacatt

SEQ ID NO: 269627 - DNA, 75 bp, Artificial Sequence
  Synthetic
agttcagagagtccaccattctgggggcatcaaaacacgagagggaactgagagtacaaaaacaatcagttacac

SEQ ID NO: 269628 - DNA, 75 bp, Artificial Sequence
  Synthetic
ggcatcaaaacacgagagggaactgagagtacaaaaacaatcagttacactgtaaaatcatgcaaaggcatgtgt

SEQ ID NO: 269629 - DNA, 75 bp, Artificial Sequence
  Synthetic
ccgcattgctgagcttctctaggagagtccctttcccagccttgaggcggctggtcaataaaagcctcaattgta

SEQ ID NO: 269630 - DNA, 75 bp, Artificial Sequence
  Synthetic
ctggtcaataaaagcctcaattgtaacaaacacctaagcttatcatacaagccccatgcctggtctccactagtc

SEQ ID NO: 269631 - DNA, 75 bp, Artificial Sequence
  Synthetic
gggggtttacttatctctaaagtggaaggaaattttaaaattcttggaatgcatatagctggaaatggagaaatg

SEQ ID NO: 269632 - DNA, 75 bp, Artificial Sequence
  Synthetic
aaggaaattttaaaattcttggaatgcatatagctggaaatggagaaatgggtgttgccattcctttcaattttc

SEQ ID NO: 269633 - DNA, 75 bp, Artificial Sequence
  Synthetic
gaaggcaacttgcaataagatgagtggaaacaagacgcttaaagcatggtgtaaattagcttttctaacccacat

SEQ ID NO: 269634 - DNA, 75 bp, Artificial Sequence
  Synthetic
ttaaaaatgacatatctgaccaaggcattgtcacagagataacacccatacagcccatgtatattaatactaaaa

SEQ ID NO: 269635 - DNA, 75 bp, Artificial Sequence
  Synthetic
ctcaaatccacaagagtccagtttatggagcagtggaagtcaagatgggcccagcagtcttaagtaaatcagatc

SEQ ID NO: 269636 - DNA, 75 bp, Artificial Sequence
  Synthetic
cgtctggtgacgtgtgggaacttatcggaaacagtattttgctgcaaagcatcctattgccagcgggacaacacc

SEQ ID NO: 269637 - DNA, 75 bp, Artificial Sequence
  Synthetic
ctaggcttgaagaacctgtcgagtgcctaattaagaaatcagccgcaaagtatagagtcaataaatttcaggtaa

SEQ ID NO: 269638 - DNA, 75 bp, Artificial Sequence
  Synthetic
acaatgaattatggcagggtgtcaaagcctgtgtcaaatccaaattcagggagatttttgggatcaatgggatag

SEQ ID NO: 269639 - DNA, 75 bp, Artificial Sequence
  Synthetic
ggattggtttaaaacctgaaatattgtggaagatacttagtacctactaatctggtagtagtgcaaacactagtt

SEQ ID NO: 269640 - DNA, 75 bp, Artificial Sequence
  Synthetic
tggacatgaagactgccgtcctagggacttcccatgttaattctatggacttgaatacgtcagctggatatagct

SEQ ID NO: 269641 - DNA, 75 bp, Artificial Sequence
  Synthetic
ttgtcaaatcgggatataaaaagaaagatttaatttgccttgaacctttctcagtatcacccatgcttgagaagt

SEQ ID NO: 269642 - DNA, 75 bp, Artificial Sequence
  Synthetic
tggtacaagataagtttcatgcattgttaaagggcaatcaaatcaccacaatttttaacacctgtctaaaagatg

SEQ ID NO: 269643 - DNA, 75 bp, Artificial Sequence
  Synthetic
ttatcaatgccactatggagacaatcaagaatatcgcagatatggcgactggagtggtcagctcagttgattcaa

SEQ ID NO: 269644 - DNA, 75 bp, Artificial Sequence
  Synthetic
gttaaagggcaatcaaatcaccacaatttttaacacctgtctaaaagatgaactgagaaaattggataaaatctc

SEQ ID NO: 269645 - DNA, 75 bp, Artificial Sequence
  Synthetic
ctatcaatgtagtcaatgagaaagtggaaaatgtaggtaacgaaattggaggtaatttactaaccaaagttgcag

SEQ ID NO: 269646 - DNA, 75 bp, Artificial Sequence
  Synthetic
aactggcaaaactaggtgtatcgaggcatgtgaggtagactattgtatagtctataggatgatcatgatggaaat

SEQ ID NO: 269647 - DNA, 75 bp, Artificial Sequence
  Synthetic
ggtaatttactaaccaaagttgcagatgatgcatctaatgtgcttggaccaaattgttatgctacaacggctgaa

SEQ ID NO: 269648 - DNA, 75 bp, Artificial Sequence
  Synthetic
tctataggatgatcatgatggaaatttatgacaagatctatcagacaccatgttactactcaggcctcgcagttg

SEQ ID NO: 269649 - DNA, 75 bp, Artificial Sequence
  Synthetic
ttatgacaagatctatcagacaccatgttactactcaggcctcgcagttggaattaacccatacaaagactggca

SEQ ID NO: 269650 - DNA, 75 bp, Artificial Sequence
  Synthetic
ccagagaacaaagatgtagtacaggcaaccacaactgttaatacaaccaatttgacacaacatccttcggcacca

SEQ ID NO: 269651 - DNA, 75 bp, Artificial Sequence
  Synthetic
ctttatgataaatgctctaaatgattacaattatgaaatggactactcccaatatgatggttccctaagctctat

SEQ ID NO: 269652 - DNA, 75 bp, Artificial Sequence
  Synthetic
acaatgccttttactcctgatttctctaacgttgacacattccactcaatggcgtatgatattaccactggagaa

SEQ ID NO: 269653 - DNA, 75 bp, Artificial Sequence
  Synthetic
tacaattatgaaatggactactcccaatatgatggttccctaagctctatgctattgtgggaggctgtggaagtc

SEQ ID NO: 269654 - DNA, 75 bp, Artificial Sequence
  Synthetic
gctattgtgggaggctgtggaagtcttggcttattgtcatgattcacctgatcttgttatgcaattacacaaacc

SEQ ID NO: 269655 - DNA, 75 bp, Artificial Sequence
  Synthetic
aagaatcctagcaaattagtaagattggagactcatgaatggacaccaacctgggctagaggataccagataact

SEQ ID NO: 269656 - DNA, 75 bp, Artificial Sequence
  Synthetic
ttggcttattgtcatgattcacctgatcttgttatgcaattacacaaaccagtaattgactcagaccatgtggtc

SEQ ID NO: 269657 - DNA, 75 bp, Artificial Sequence
  Synthetic
agtaattgactcagaccatgtggtcttcaatgagagatggttgattcatggtggtatgccatcaggctccccatg

SEQ ID NO: 269658 - DNA, 75 bp, Artificial Sequence
  Synthetic
catgtggaattaccaaaagtcttctgggataaaaatagcaagccagcatatggccaatcaagatattttgcagca

SEQ ID NO: 269659 - DNA, 75 bp, Artificial Sequence
  Synthetic
gtggtatgccatcaggctccccatgtaccactgtactaaattcattgtgtaacctgatgatgtgcatctacacta

SEQ ID NO: 269660 - DNA, 75 bp, Artificial Sequence
  Synthetic
gtacggtgtggtttccattttcaggttcaagtgaatgtcaaccaaggaacagctggtagtgcactagtggtgtat

SEQ ID NO: 269661 - DNA, 75 bp, Artificial Sequence
  Synthetic
caaacttaattagcccaggaattgattgcttaccaattgtttatggcgacgatgtcatcttgtcacttgataatg

SEQ ID NO: 269662 - DNA, 75 bp, Artificial Sequence
  Synthetic
gaacctaaacctgttgtgacatatgactcaaagttagaatttggagcatttaccaacctaccacatgtgctaatg

SEQ ID NO: 269663 - DNA, 75 bp, Artificial Sequence
  Synthetic
aaatagacccagagaaactgcagagtgtcatggcagattcgtttggtgctgaagtgactggttcccgcaaggatg

SEQ ID NO: 269664 - DNA, 75 bp, Artificial Sequence
  Synthetic
tgtcatggcagattcgtttggtgctgaagtgactggttcccgcaaggatgaacctccatcattaaaacctagatt

SEQ ID NO: 269665 - DNA, 75 bp, Artificial Sequence
  Synthetic
actcaaagttagaatttggagcatttaccaacctaccacatgtgctaatgaatttggctgagaccacccaggctg

SEQ ID NO: 269666 - DNA, 75 bp, Artificial Sequence
  Synthetic
atgtttggacacctttgtctataccttcaggttctgctacacaagttgatgtaaccatactgggcagcttattac

SEQ ID NO: 269667 - DNA, 75 bp, Artificial Sequence
  Synthetic
aaacatgatacaacatttaatgtggatgaaaaatttcagcacatttaagcagcaactccaatcctacttaatgga

SEQ ID NO: 269668 - DNA, 75 bp, Artificial Sequence
  Synthetic
aattggatttccaaaatcctagagtatttggtcaagatgttggtatttatgacaattcaccaacacggaagcaaa

SEQ ID NO: 269669 - DNA, 75 bp, Artificial Sequence
  Synthetic
tatcaacattacatcaaaatattggatccttatttgaaagaatggaacatcactgtggatgattatgatgttgta

SEQ ID NO: 269670 - DNA, 75 bp, Artificial Sequence
  Synthetic
atctaaagaaaattcttacaatgagcaccaaatacaaatggactagacagaaaattgatattgcagaaggaccag

SEQ ID NO: 269671 - DNA, 75 bp, Artificial Sequence
  Synthetic
caccaaatacaaatggactagacagaaaattgatattgcagaaggaccaggttccatgaacatggcgaatgtatt

SEQ ID NO: 269672 - DNA, 75 bp, Artificial Sequence
  Synthetic
attgctaagttgatgcccatggtgtttgactaaaattaatgttttggtttttctttgttatggactatatcatta

SEQ ID NO: 269673 - DNA, 75 bp, Artificial Sequence
  Synthetic
gagcaccactgcagcacaatcagttgctttggttggagaaagagcattctatgacccaagaacagcagggagtaa

SEQ ID NO: 269674 - DNA, 75 bp, Artificial Sequence
  Synthetic
cgtcgggccttataccccgacttgctgagcttctctaggagagtccctttccccagccctgaggcggctggtcaa

SEQ ID NO: 269675 - DNA, 75 bp, Artificial Sequence
  Synthetic
gtttttctttgttatggactatatcattagattactaatataattaggacactaatttggaatattggacatacc

SEQ ID NO: 269676 - DNA, 75 bp, Artificial Sequence
  Synthetic
aagtaggtttgacgatctagttaaaatttctcaacttttctctgtgatgagtgactccacaaccccttcagccaa

SEQ ID NO: 269677 - DNA, 75 bp, Artificial Sequence
  Synthetic
taaaagcctcaaatgtaactaacacctaagattacgtagataaccccatgcctggtctccactagtcgaaagcat

SEQ ID NO: 269678 - DNA, 75 bp, Artificial Sequence
  Synthetic
gctttggttggagaaagagcattctatgacccaagaacagcagggagtaaaagtaggtttgacgatctagttaaa

SEQ ID NO: 269679 - DNA, 75 bp, Artificial Sequence
  Synthetic
ccatggtatagatgcaaagggttatttcaaatggtcatccacaactgcgccgcagtctgtggtgcataggaatat

SEQ ID NO: 269680 - DNA, 75 bp, Artificial Sequence
  Synthetic
ctagcaataagatgagtggatctaagacgcttaaagcatggtgctagtattcttttctagcctgcgggaacgcag

SEQ ID NO: 269681 - DNA, 75 bp, Artificial Sequence
  Synthetic
ctagcattaagatgagtggatctaagacgcttaaagcatggtgctagtattcttttctagcctgcgggaacgcag

SEQ ID NO: 269682 - DNA, 75 bp, Artificial Sequence
  Synthetic
ctagcactaagatgagtggatctaagacgcttaaagcatggtgctagtattcttttctagcctgcgggaacgcag

SEQ ID NO: 269683 - DNA, 75 bp, Artificial Sequence
  Synthetic
ctagcagtaagatgagtggatctaagacgcttaaagcatggtgctagtattcttttctagcctgcgggaacgcag

SEQ ID NO: 269684 - DNA, 75 bp, Artificial Sequence
  Synthetic
tgtttatttaaaattgtttcctaacttgaatgtttttgtcaacagctattcatattttagaggttcaatggtgtt

SEQ ID NO: 269685 - DNA, 75 bp, Artificial Sequence
  Synthetic
gaggttgagtgtatatgccagcactttcaatagaggccgcctacggatgggcttctttccaaatgcaaccgagga

SEQ ID NO: 269686 - DNA, 75 bp, Artificial Sequence
  Synthetic
acgtgtgggaacttattggaaacaacaatttgctgtaaagcatcctactgccagcgggctaacatctggtaacag

SEQ ID NO: 269687 - DNA, 75 bp, Artificial Sequence
  Synthetic
gcttctttccaaatgcaaccgaggacagcacctcagaaatagataatgccatatacacaatttgtgatttgggca

SEQ ID NO: 269688 - DNA, 75 bp, Artificial Sequence
  Synthetic
atgcctctggggccaaaagccaaggtttagcagaccctttaggattggttcaaacctgaattgttgtggaagata

SEQ ID NO: 269689 - DNA, 75 bp, Artificial Sequence
  Synthetic
gactattccaaattgaagtgcttaacagattaacttacaatagctccagtcccaatgaggtctactgtattgtgc

SEQ ID NO: 269690 - DNA, 75 bp, Artificial Sequence
  Synthetic
tttagtacctgccgatttggtagttgtgcaaacactagttgtaaggcccacgaaggatgcccagaaggtacccgt

SEQ ID NO: 269691 - DNA, 75 bp, Artificial Sequence
  Synthetic
cgaaggatgcccagaaggtacccgtaggtaacaagcgacactatggatctgatctggggtccatcacttctgtaa

SEQ ID NO: 269692 - DNA, 75 bp, Artificial Sequence
  Synthetic
aaggtaaaatggggcaagatgccagattcttttgtccaactggttctgtagtgactttccaaaactcatggggtt

SEQ ID NO: 269693 - DNA, 75 bp, Artificial Sequence
  Synthetic
aagtggatgggttaaaaaacgtctagtgggccaaacccaggggggatccctggtttcttttgtttattagtaatt

SEQ ID NO: 269694 - DNA, 75 bp, Artificial Sequence
  Synthetic
cacagatggatctgactgatccgttatgtctagaagaatccgcagaggaatgtaaacagaccatatcaccaaatg

SEQ ID NO: 269695 - DNA, 75 bp, Artificial Sequence
  Synthetic
accatggagacaatcaagagtattgcagatatggctactggtgtagttagcacagttgattctaccatcaacact

SEQ ID NO: 269696 - DNA, 75 bp, Artificial Sequence
  Synthetic
aattaggtttgacatcggctcaggatgatggaccattgggtgataacaaaccaaattatttcctaaattttaagt

SEQ ID NO: 269697 - DNA, 75 bp, Artificial Sequence
  Synthetic
gtaaatgaaaaggttgaaagtgttggtaatgagataggtggcaacttgttaactaaagttgcagatgatgcttcc

SEQ ID NO: 269698 - DNA, 75 bp, Artificial Sequence
  Synthetic
ccatgaatgtggacatatttactgtttctcacactaaagtggacaacttatttgggagagcttggtttttccaag

SEQ ID NO: 269699 - DNA, 75 bp, Artificial Sequence
  Synthetic
aatgtgttggggccaaactgttttgccacaacggctgaaccagaaaacaagaatgtagttcaagccaccactaca

SEQ ID NO: 269700 - DNA, 75 bp, Artificial Sequence
  Synthetic
aacacactttcaccaatgaaggacagtggagagttagcttagaattcccaaaacaaggccatggttcactttcct

SEQ ID NO: 269701 - DNA, 75 bp, Artificial Sequence
  Synthetic
gtgaatacaactaatttaacccaacacccttcagcacccacaatgcccttttcaccagacttttctaatgttgac

SEQ ID NO: 269702 - DNA, 75 bp, Artificial Sequence
  Synthetic
tgttatttgcttattttacaggtgaattaaacatccatgttttgtttctagctgagaagggattcctcagagtag

SEQ ID NO: 269703 - DNA, 75 bp, Artificial Sequence
  Synthetic
aactttcattctatggcttatgacatcacaactggggataagaaccctagtaaattggttcgacttgagactcat

SEQ ID NO: 269704 - DNA, 75 bp, Artificial Sequence
  Synthetic
cccacacttatgacacatcagaaaacagggtcaacttcctatcatccaacggtgttatcacaatcccggcaggag

SEQ ID NO: 269705 - DNA, 75 bp, Artificial Sequence
  Synthetic
gagtggacaccatcttgggcaagagggcaccagataacacatgtggaattgcctaaagtgttttggaacaatcaa

SEQ ID NO: 269706 - DNA, 75 bp, Artificial Sequence
  Synthetic
agcaaatgacattatctgcaccttactattcaaataaacccctcagaacagttagggacagcaatagtcttgggt

SEQ ID NO: 269707 - DNA, 75 bp, Artificial Sequence
  Synthetic
gacaagcctgcttatggtcaatcccgctattttgcagcagtgagatgtgggtttcattttcaagtacaagtcaac

SEQ ID NO: 269708 - DNA, 75 bp, Artificial Sequence
  Synthetic
atttaatgtgtaaaccattcctcactggaacaaccacagggaaaatagaagtatatcttagtttgagatgtccaa

SEQ ID NO: 269709 - DNA, 75 bp, Artificial Sequence
  Synthetic
gttaatcaaggaactgcaggtagtgctctggttgtctatgaacccaaaccagttgtcacttacgattcaaaacta

SEQ ID NO: 269710 - DNA, 75 bp, Artificial Sequence
  Synthetic
attttttctttcctcttcctgcacctaaagttacaactagccgtgccttgcggggtgacttggcaaatttctcag

SEQ ID NO: 269711 - DNA, 75 bp, Artificial Sequence
  Synthetic
gaattcggggctttcactaatctgccacatgttttgatgaacttagctgagaccacacaagctgacttatgcatc

SEQ ID NO: 269712 - DNA, 75 bp, Artificial Sequence
  Synthetic
accagagtccatatggtcaacaaccacagaaccaaataatgaagttggcatacttagataggggtttttataagc

SEQ ID NO: 269713 - DNA, 75 bp, Artificial Sequence
  Synthetic
ccctatgttgctgacacaaactatgttaaaactgattcgtcagacttagggcaactaaaagtctatgtctggact

SEQ ID NO: 269714 - DNA, 75 bp, Artificial Sequence
  Synthetic
actatggtatcatagttgatggctatgtctaccaactggattctgatgatatcttcaagactgctcttactggga

SEQ ID NO: 269715 - DNA, 75 bp, Artificial Sequence
  Synthetic
ccactgactatccccacaggatctgccaaccaagttgatgtcactatattgggtagtttactgcaattggacttt

SEQ ID NO: 269716 - DNA, 75 bp, Artificial Sequence
  Synthetic
aagcaagattcacaaagacaaagttaacctcagactggattgtagaggaggagtgtgaactggactactttaggg

SEQ ID NO: 269717 - DNA, 75 bp, Artificial Sequence
  Synthetic
caaaatcccagagtttttggccaagatgttaatatatatgacaatgcaccaaatggtaaaaagaaaaattggaaa

SEQ ID NO: 269718 - DNA, 75 bp, Artificial Sequence
  Synthetic
tcaagtatcttgagtcctcagttaattcagaacacatattttcagtggactccaattgtgaaaccattgccaagg

SEQ ID NO: 269719 - DNA, 75 bp, Artificial Sequence
  Synthetic
aagattatgaccatgagcacaaaatacaagtggaccaggaccaaagttgacatagcagaaggtccagggactatg

SEQ ID NO: 269720 - DNA, 75 bp, Artificial Sequence
  Synthetic
acatttttggcacccacacccttagccaacaccaagctataggtttagttggcacaattcttttgactgctggtt

SEQ ID NO: 269721 - DNA, 75 bp, Artificial Sequence
  Synthetic
aacatggccaatgtgcttagcacaactggtgcgcaatcagtagccctggtgggtgagagagctttttatgatcct

SEQ ID NO: 269722 - DNA, 75 bp, Artificial Sequence
  Synthetic
tgatgtcaactattaagacaccagtaaatgctacaactatcaaagaattcttcaatcatgctgtagatggggatg

SEQ ID NO: 269723 - DNA, 75 bp, Artificial Sequence
  Synthetic
aggactgcaggtagtaagtcaaggtttgatgatcttgttaaaattgcacaattattctctgtaatggcagattca

SEQ ID NO: 269724 - DNA, 75 bp, Artificial Sequence
  Synthetic
aacaagggctttcattgcttgtacaaaaatgcaccactttcttctcttcagcagccacagaaatcttggataatg

SEQ ID NO: 269725 - DNA, 75 bp, Artificial Sequence
  Synthetic
accaccccatctgagaatcatggtattgatgccaaaggttatttcaaatggtcagctacaacagcgccacagagt

SEQ ID NO: 269726 - DNA, 75 bp, Artificial Sequence
  Synthetic
atttggtcaaatttatagttaaaattcttgttaggattttgtgttatatggttctatattgtcacaaaccaaaca

SEQ ID NO: 269727 - DNA, 75 bp, Artificial Sequence
  Synthetic
attgtccatagaaatatagtttatttgaaattgttcccaaatttgaatgtatttgttaatagctattcttatttt

SEQ ID NO: 269728 - DNA, 75 bp, Artificial Sequence
  Synthetic
ttctcacaacagcatgtctttcaacccttttaatcatggatgtaacatcttcatctgttctttccccttcttgta

SEQ ID NO: 269729 - DNA, 75 bp, Artificial Sequence
  Synthetic
aggggttcattagtcctgagactaagtgtctatgctagtactttcaacagggggcgactgagaatgggtttcttc

SEQ ID NO: 269730 - DNA, 75 bp, Artificial Sequence
  Synthetic
aggctttaatgcagtgcttgatggatggggatgtaaagaagcttgctgaggtagtggctgaatcaatgtcaaaca

SEQ ID NO: 269731 - DNA, 75 bp, Artificial Sequence
  Synthetic
ccaaattctacagctgattcaacatccacattagacaatgccatatacactatatgtgacattggtagtgacaat

SEQ ID NO: 269732 - DNA, 75 bp, Artificial Sequence
  Synthetic
ctgatgatgatgaaattaaagagcagatttgtgatactgtgaaatatacaaagacgattctttccaaccagggcc

SEQ ID NO: 269733 - DNA, 75 bp, Artificial Sequence
  Synthetic
agttttgagatcaccatcccttactctttctctacgtggatgaggaaaaccaatgaccacccaattgggctattt

SEQ ID NO: 269734 - DNA, 75 bp, Artificial Sequence
  Synthetic
cattcaaaggtttcaatgaggtttctacggcctttagacacatagattggtggatccacactcttcttaaaatta

SEQ ID NO: 269735 - DNA, 75 bp, Artificial Sequence
  Synthetic
caaattgaagttttaaataggctcacctataacagttctagtccatcagaagtatattgtatagtccaagggaaa

SEQ ID NO: 269736 - DNA, 75 bp, Artificial Sequence
  Synthetic
aggacatggttctcagtgtattcaaaccaagtctggagagcaaagctattcagtggttagaaaggaataaagaac

SEQ ID NO: 269737 - DNA, 75 bp, Artificial Sequence
  Synthetic
atgggacaagacgccaggtttttctgtccaactggctctgttgtaacattccaaaactcatggggttcacaaatg

SEQ ID NO: 269738 - DNA, 75 bp, Artificial Sequence
  Synthetic
atgtttgtgggattctagattatgcttctgatatcattgtggagtcaaaagatcaatccaaagtgaaaactcaag

SEQ ID NO: 269739 - DNA, 75 bp, Artificial Sequence
  Synthetic
gatttaacggaccccctttgtatagaagatgacacagaaaactgcaaacagacgatgtctccaaatgagctagga

SEQ ID NO: 269740 - DNA, 75 bp, Artificial Sequence
  Synthetic
atttctaccaaagatattctgattgcttagccaagttcaaaccaatcatggctatttgttttagaagttgccaca

SEQ ID NO: 269741 - DNA, 75 bp, Artificial Sequence
  Synthetic
ttaacttcagcccaagatgacggcccattgggtcaagaaaaacccaactacttcctcaactttaggtctatgaac

SEQ ID NO: 269742 - DNA, 75 bp, Artificial Sequence
  Synthetic
atagtattagtaatacagtgtacagacttttccaagagttggctagaattccaaatcgaattagtaccaataatg

SEQ ID NO: 269743 - DNA, 75 bp, Artificial Sequence
  Synthetic
gtggacattttcacagtatcacacactaaggtagacaatctttttggtagagcatggttctttgaggaacacaca

SEQ ID NO: 269744 - DNA, 75 bp, Artificial Sequence
  Synthetic
acttgattagaatagaacctattggcatttggatccaaggtgaaccagggcaaggcaaatctttcttgacccaca

SEQ ID NO: 269745 - DNA, 75 bp, Artificial Sequence
  Synthetic
ttcaccaatgaagggcaatggagagtaccattaaaattccccaaacaagggcatggatctttgtcactcctattt

SEQ ID NO: 269746 - DNA, 75 bp, Artificial Sequence
  Synthetic
ctttatctaggcaactgcaaaaatcatgcaaacttaatggggtcttcaccaacccaactgctagtgaatttatgg

SEQ ID NO: 269747 - DNA, 75 bp, Artificial Sequence
  Synthetic
gcttattttactggtgaattgaacattcatgtattattcttaagtgaaagagggtttctaagggtagcacacact

SEQ ID NO: 269748 - DNA, 75 bp, Artificial Sequence
  Synthetic
atgggtatgacaaccaagatattcatcttattgatgatttgggccaaacaaggaaagaaaaggacattgagatgt

SEQ ID NO: 269749 - DNA, 75 bp, Artificial Sequence
  Synthetic
tatgacaccagtaatgaccgtgtcaactttttgtcatcaaacggtgtgattaccataccagccggtgagcagatg

SEQ ID NO: 269750 - DNA, 75 bp, Artificial Sequence
  Synthetic
tatgcaactgcatttcgtctgtccccttcattgttccaatggcacatcttgaagaaaaaggaaaattttacacta

SEQ ID NO: 269751 - DNA, 75 bp, Artificial Sequence
  Synthetic
acactatcagctccttattactcaaataagccattaaggaccgtcagggatgacaacagtcttgggtatttgatg

SEQ ID NO: 269752 - DNA, 75 bp, Artificial Sequence
  Synthetic
gtaaattagtaattgctacaaccaacaaatcagatttttccagtacagtcctccaggattctggagcactgaaaa

SEQ ID NO: 269753 - DNA, 75 bp, Artificial Sequence
  Synthetic
tgtaagccttttctcacaggaaccactggtgggaaaattgaggtttatttaagtctgaggtgtccaaacttcttc

SEQ ID NO: 269754 - DNA, 75 bp, Artificial Sequence
  Synthetic
ggaggttcccctacatcatgcacattcgagctgctaaagcttatagcaaggcaggaaaactcaatgtgagtcagg

SEQ ID NO: 269755 - DNA, 75 bp, Artificial Sequence
  Synthetic
ttccctcttccagcacctaaagtgacaactagccgggcactacgtggtgatatggcaaacttctccaatcagagc

SEQ ID NO: 269756 - DNA, 75 bp, Artificial Sequence
  Synthetic
ctatggcaaccatgtccactggagaatgttgggaggtgtccaaaaatgggagagattgggaaacactaaaattaa

SEQ ID NO: 269757 - DNA, 75 bp, Artificial Sequence
  Synthetic
ccatataatcaatcaccacaaaaccaagtcatgaagttggcatacctagacaggggtttctataagcactatggc

SEQ ID NO: 269758 - DNA, 75 bp, Artificial Sequence
  Synthetic
aggacttggttgacaaaattactgctgactatactgagagagttaagaactacaatgcttggaaacaacaattgg

SEQ ID NO: 269759 - DNA, 75 bp, Artificial Sequence
  Synthetic
ataattgttgatgattatgtttaccaattagattcagatgatatcttcaagacagcactgactgggaaagcaagg

SEQ ID NO: 269760 - DNA, 75 bp, Artificial Sequence
  Synthetic
aaaatcagactcttgatgacttagatgatgctgtctcttatatcaagcacaatttcccagatgctgtaccatata

SEQ ID NO: 269761 - DNA, 75 bp, Artificial Sequence
  Synthetic
tttactaagacaaaattaacacaagattggatcattgaagaagagtgtgaactggattattttagagtcaaatat

SEQ ID NO: 269762 - DNA, 75 bp, Artificial Sequence
  Synthetic
ttgatgaatacctcaacattgaaatgtcaacattaattgagcaaatggaggctttcattgaaccaaagcccagtg

SEQ ID NO: 269763 - DNA, 75 bp, Artificial Sequence
  Synthetic
cttgaatcatctgttgattcagagcacattttttcagtagattctaattgtgaaacaattgccaaggacattttt

SEQ ID NO: 269764 - DNA, 75 bp, Artificial Sequence
  Synthetic
tgtttaagtgttttgctaacaagattggctcaaaaatatctaaggcttctagggaagttgtggattggttctcag

SEQ ID NO: 269765 - DNA, 75 bp, Artificial Sequence
  Synthetic
ggcacccatactcttagtcaacatcaggctattggtttaataggcacaatccttttgactgctggcttaatgtca

SEQ ID NO: 269766 - DNA, 75 bp, Artificial Sequence
  Synthetic
ataagatcaaatcaatgttaagctttgttgaaaggaacaaggcttggctgacagtggtttctgcagtaaccagcg

SEQ ID NO: 269767 - DNA, 75 bp, Artificial Sequence
  Synthetic
accattaagacaccagtcaattctacaaccattaaggaattttttaatcatgcagtggaaggcgatgaacaagga

SEQ ID NO: 269768 - DNA, 75 bp, Artificial Sequence
  Synthetic
ccataagcattctacttttagttaccaagatctttaaaaaagaggactcaaaggatgaaagagcctacaatccaa

SEQ ID NO: 269769 - DNA, 75 bp, Artificial Sequence
  Synthetic
ttatctttacttgtgcaaaaatgtactacttttttttcctcagcagccacagaaattctagacaacgatctagtt

SEQ ID NO: 269770 - DNA, 75 bp, Artificial Sequence
  Synthetic
cactccccgtggcaaaatcgaagggcacattcccaatttcacaaagggaatttaaaaatgaggctccatatgatg

SEQ ID NO: 269771 - DNA, 75 bp, Artificial Sequence
  Synthetic
aagttcatagtgaaaattcttgtcagaattctctgttatatggttttgtactgccacaaaccgaacattttaacg

SEQ ID NO: 269772 - DNA, 75 bp, Artificial Sequence
  Synthetic
gccaactagagcatattatatctcagatggcatacataactggttccactacagggcatctaacccattgtgcag

SEQ ID NO: 269773 - DNA, 75 bp, Artificial Sequence
  Synthetic
actgcttgtttgtctacactgctaataatggatgtcacatcctcatcagtgttgtcaccttcttgtaaggcactc

SEQ ID NO: 269774 - DNA, 75 bp, Artificial Sequence
  Synthetic
gctaccagcatgatgaaatcattctacatgggcactcaattaaatatcttgaacaagaagaggaattaacattgc

SEQ ID NO: 269775 - DNA, 75 bp, Artificial Sequence
  Synthetic
atgcaatgcttaatggatggtgacgttaagaaattggcagaagttgtggctgaatccatgtccaatacagatgat

SEQ ID NO: 269776 - DNA, 75 bp, Artificial Sequence
  Synthetic
attacaagaacaaagtattcccagttgaaagtccatctgtgacacaggtgacattaggtggtaaaccaatggact

SEQ ID NO: 269777 - DNA, 75 bp, Artificial Sequence
  Synthetic
gaagaaattaaggaacaaatttgtgacacagtaaaatatactaagagtattctgtcaaaccagggacctttcaag

SEQ ID NO: 269778 - DNA, 75 bp, Artificial Sequence
  Synthetic
tggctattcttaaatgtaaactgccatttagattcaagaaaaattccaagtattacactaataaaattggaacag

SEQ ID NO: 269779 - DNA, 75 bp, Artificial Sequence
  Synthetic
ggctttaatgaggtgtcaacagcattcaggcacatcgattggtggatacacacactactcaaaattaaagacatg

SEQ ID NO: 269780 - DNA, 75 bp, Artificial Sequence
  Synthetic
agagcatgctgatctggatgacagaacaaggcattatcactaaagaagtccagagagttcaccattccggtggta

SEQ ID NO: 269781 - DNA, 75 bp, Artificial Sequence
  Synthetic
gtgcttagtgtttttaaacctagcatagaaagcaaagccattcagtggttggagaggaacaaggaacatgtgtgt

SEQ ID NO: 269782 - DNA, 75 bp, Artificial Sequence
  Synthetic
tcaaaacccgagaggggacagagagtactaagactattagttatactgtaaaatcttgtaaaggtatgtgtggag

SEQ ID NO: 269783 - DNA, 75 bp, Artificial Sequence
  Synthetic
tccatcctagactatgcctcggacatcattgtggaatcaaaagaccagacaaagatgaaatcccaagagttttac

SEQ ID NO: 269784 - DNA, 75 bp, Artificial Sequence
  Synthetic
gtttactcatctctaaagtagaaggcaacttcaaaatacttggcatgcatatcgcaggtaatggagagatgggtg

SEQ ID NO: 269785 - DNA, 75 bp, Artificial Sequence
  Synthetic
cagaaatacactgattgtctatcaaaattcaagcctattatggccatttgttttagaagttgtcataacagcatt

SEQ ID NO: 269786 - DNA, 75 bp, Artificial Sequence
  Synthetic
tggcaattccctttaatttcttaaagaatgatatgtcagaccagggaattgttactgaggttactccaatacaac

SEQ ID NO: 269787 - DNA, 75 bp, Artificial Sequence
  Synthetic
agcaatacagtttataggctctttcaagaactggctaggataccatccaggataagtacccaaaatgacttgatt

SEQ ID NO: 269788 - DNA, 75 bp, Artificial Sequence
  Synthetic
caatgtacatcaataccaaatcacaaattcacaagagcccagtttatggggctgttgaagtgaagatggggccag

SEQ ID NO: 269789 - DNA, 75 bp, Artificial Sequence
  Synthetic
agagttgagccaattggagtctggatacagggtgagccaggacaagggaaatcttttttaacacatactttgtct

SEQ ID NO: 269790 - DNA, 75 bp, Artificial Sequence
  Synthetic
ctgtactcagtaagtctgacaccagattggaagaacccattgattgcctaattaagaaatcagcctctaaataca

SEQ ID NO: 269791 - DNA, 75 bp, Artificial Sequence
  Synthetic
aggcaactgcaaaaatcctgtaaattgaatggagtttacactaaccccactgctagtgagttcatggatggttat

SEQ ID NO: 269792 - DNA, 75 bp, Artificial Sequence
  Synthetic
gagtgaacaaattccaagtcaacaatgaactttggcaaggagtgaaagcttgtgtcaaatccaaatttagagaaa

SEQ ID NO: 269793 - DNA, 75 bp, Artificial Sequence
  Synthetic
gacaatcaagacatccatcttatagatgatttgggccaaaccaggaaggaaaaagacattgaaatgttgtgcaac

SEQ ID NO: 269794 - DNA, 75 bp, Artificial Sequence
  Synthetic
tttttggggttaatggtattgttgatatgaagacagcaatccttggaactacacatgtcaattcaatggatctca

SEQ ID NO: 269795 - DNA, 75 bp, Artificial Sequence
  Synthetic
tgcatctcatcagttccattcatcgtaccaatggcacatcttgaagagaaaggcaagttttacaccagtaaatta

SEQ ID NO: 269796 - DNA, 75 bp, Artificial Sequence
  Synthetic
gtacttcagctggatattcttttgtcaagagtggttacaaaaagaaagatctcatctgccttgagcccttttctg

SEQ ID NO: 269797 - DNA, 75 bp, Artificial Sequence
  Synthetic
gttatagcaaccactaacaaatcagacttttcaagcactgtcttacaagattctggtgcactgaagagaaggttt

SEQ ID NO: 269798 - DNA, 75 bp, Artificial Sequence
  Synthetic
tatcaccaatgctagaaaaattggtgcaggaaaaattccacaatctacttaaaggcaatcagattactacaatat

SEQ ID NO: 269799 - DNA, 75 bp, Artificial Sequence
  Synthetic
ccctatattatgcacattagagccgctaaagcgtatagcaaattaggaaaattaaatgttagtcaagctatgcaa

SEQ ID NO: 269800 - DNA, 75 bp, Artificial Sequence
  Synthetic
tcaatacttgtctaaaagatgaacttaggaagttggataaaatagctgcagggaaaacaagatgcattgaagctt

SEQ ID NO: 269801 - DNA, 75 bp, Artificial Sequence
  Synthetic
actatggccactggtgaatgttgggaggtctcaaagaatggtagagattgggaaactctcaaattaaaggatttg

SEQ ID NO: 269802 - DNA, 75 bp, Artificial Sequence
  Synthetic
gtgaagtagactattgcatagtttacagaatgataatgatggaaatttatgacaaaatttaccaaacaccttgct

SEQ ID NO: 269803 - DNA, 75 bp, Artificial Sequence
  Synthetic
gtacagaaaataacagaagattatcaggagaggcagaagaactatgattgttggaaacagcagttggaaaaccag

SEQ ID NO: 269804 - DNA, 75 bp, Artificial Sequence
  Synthetic
attattctggtttagctgttgggataaatccttataaagattggcacttcatgatcaatgctctgaatgattaca

SEQ ID NO: 269805 - DNA, 75 bp, Artificial Sequence
  Synthetic
actctagatgatttaaatgatgcagtatcatacatcaagcacaattttccagatgcaatcccctatattgatgag

SEQ ID NO: 269806 - DNA, 75 bp, Artificial Sequence
  Synthetic
actatgaaatggactactcacagtatgatggttcactaagctcaatgcttttgtgggaagcagtagaagttctag

SEQ ID NO: 269807 - DNA, 75 bp, Artificial Sequence
  Synthetic
taccttaacattgagatgtctacactgattgaacaaatggaagccttcattgaaccacggcctagcgtgtttaaa

SEQ ID NO: 269808 - DNA, 75 bp, Artificial Sequence
  Synthetic
catattgccatgatacacctgatcttgtcatgcaactacacaaaccagtcattgattcagaccatattgttttca

SEQ ID NO: 269809 - DNA, 75 bp, Artificial Sequence
  Synthetic
tgctttgctaccaaagttgctaaccagaccagaaaagcaaccaaagaagttgtggactggtttagtagtaaaatc

SEQ ID NO: 269810 - DNA, 75 bp, Artificial Sequence
  Synthetic
atgaaagatggctaattcatggtggtatgccatccgggtcaccatgcactactgttctgaactcactatgtaatc

SEQ ID NO: 269811 - DNA, 75 bp, Artificial Sequence
  Synthetic
aaatcaatgttaagttttgttgaaagaaacaaagcctggctgactgtggtttcagctgtcactagtgctataagc

SEQ ID NO: 269812 - DNA, 75 bp, Artificial Sequence
  Synthetic
tgatgatgtgcatctacactgccaacttaattagtccaggcattgactgcctaccaattgtctatggagatgatg

SEQ ID NO: 269813 - DNA, 75 bp, Artificial Sequence
  Synthetic
attctactcttggttacaaaaattttcaagaaagagaattcaaaggatgaaagagcttacaacccaacactccca

SEQ ID NO: 269814 - DNA, 75 bp, Artificial Sequence
  Synthetic
ttatcttgtctctagacaaagaaattgaaccagagaaactgcaaagtatcatggcagaatcttttggtgttgaag

SEQ ID NO: 269815 - DNA, 75 bp, Artificial Sequence
  Synthetic
gtagcaaaaccaaaaggtacattcccagtgtcacaaagagaatttaagaatgaggctccatatgacggccaacta

SEQ ID NO: 269816 - DNA, 75 bp, Artificial Sequence
  Synthetic
taacaggttcccggaaagacgaaccccctacactcaaaccaataatggaggtagagtttctgaaacggaaacctg

SEQ ID NO: 269817 - DNA, 75 bp, Artificial Sequence
  Synthetic
ccctacactcaaaccaataatggaggtagagtttctgaaacggaaacctggatacttcccagagtcaacatttat

SEQ ID NO: 269818 - DNA, 75 bp, Artificial Sequence
  Synthetic
gaacatataatatcccagatggcatatataactggttctactacggggcatcttacgcattgtgcagggtaccaa

SEQ ID NO: 269819 - DNA, 75 bp, Artificial Sequence
  Synthetic
catgatgagatcatcctacacggacactctattaaataccttgaacaagaagaggagctgaccctacactacaaa

SEQ ID NO: 269820 - DNA, 75 bp, Artificial Sequence
  Synthetic
actccaatcctacttaatggagttatgcctccatggaaaagacacttaccttcactacatcaaaattttggatcc

SEQ ID NO: 269821 - DNA, 75 bp, Artificial Sequence
  Synthetic
aacaaggtattcccagttgaaaacccatcagtgacacaggtaacattgggcggtaagccaatggacttggccatc

SEQ ID NO: 269822 - DNA, 75 bp, Artificial Sequence
  Synthetic
gtatctgaaagaatggaatattacagtggatgattatgaagtggtgatagctaagttgatgcccatggtgtttga

SEQ ID NO: 269823 - DNA, 75 bp, Artificial Sequence
  Synthetic
cttaaatgcaaattgccattcagattcaaaaagaactccaaatattacaccaataaaattggcacagagagcatg

SEQ ID NO: 269824 - DNA, 75 bp, Artificial Sequence
  Synthetic
gtggatgattatgaagtggtgatagctaagttgatgcccatggtgtttgattagattataatgttttggttttct

SEQ ID NO: 269825 - DNA, 75 bp, Artificial Sequence
  Synthetic
ctaatttggatgactgagcaaggaatcatcacaaaagaagtacagagagtacaccactctgggggcattaaaaca

SEQ ID NO: 269826 - DNA, 75 bp, Artificial Sequence
  Synthetic
tatggactttataattagaacactaatacaattaggacactaattcggaatattggacataacaaaaaaaaaaaa

SEQ ID NO: 269827 - DNA, 75 bp, Artificial Sequence
  Synthetic
gaaaggggtctcctagagagcttggccgtcgggccttataccccgacttgctgagtttctctaggagagtccctt

SEQ ID NO: 269828 - DNA, 75 bp, Artificial Sequence
  Synthetic
cgggaaggaactgagagtacaaaaacaatcagttacaccgtaaagtcttgcaaaggtatgtgtggtggtttgctc

SEQ ID NO: 269829 - DNA, 75 bp, Artificial Sequence
  Synthetic
tcccagccctgaggcggctggataataaaggcctcacatgtaacaaacatctaagacaaaataatttgccttgca

SEQ ID NO: 269830 - DNA, 75 bp, Artificial Sequence
  Synthetic
atttccaaggtagaagggaactttaaaattcttgggatgcatatagctggaaatggtgaaatgggtgttgctatt

SEQ ID NO: 269831 - DNA, 75 bp, Artificial Sequence
  Synthetic
cctggtccccactagttgaaggcatctagcaataagatgagtggaacaaggacgcttaaagtgcaatgatagtta

SEQ ID NO: 269832 - DNA, 75 bp, Artificial Sequence
  Synthetic
ccttttaactttcttaaaaatgacatgtctgaccaaggcattgttactgaaataacaccaatacagcccatgtac

SEQ ID NO: 269833 - DNA, 75 bp, Artificial Sequence
  Synthetic
tcttttctaacccactatttatagtggggtggtggatggcgcaccataattctaatagtgagataccacgcttgt

SEQ ID NO: 269834 - DNA, 75 bp, Artificial Sequence
  Synthetic
attaacaccaagacccaaatccataaaagtccagtttatggtgcagtggaggtcaaaatgggtccagcagttctg

SEQ ID NO: 269835 - DNA, 75 bp, Artificial Sequence
  Synthetic
agcaaatcagaccctagacttgaggaaccagttgagtgcctaattaagaaatcagcttcaaaatatagagttaac

SEQ ID NO: 269836 - DNA, 75 bp, Artificial Sequence
  Synthetic
aatgctttgccgtaaggctttcattagccagcggaccaccacctggtaacaggtgcctctggggccaaaagccaa

SEQ ID NO: 269837 - DNA, 75 bp, Artificial Sequence
  Synthetic
aagtttcaggttaataatgaactatggcaaggcgttaaagcctgtgtcaaatccaaatttagagagatctttgga

SEQ ID NO: 269838 - DNA, 75 bp, Artificial Sequence
  Synthetic
ggtttaatagaccctaatggaatggttcaaacctggagcattgtggaaagtacttagtacctgctgatctggtag

SEQ ID NO: 269839 - DNA, 75 bp, Artificial Sequence
  Synthetic
attaatggtattgtggacatgaaaacagccattttgggaacatcccatgtgaattccatggacctaagtacatct

SEQ ID NO: 269840 - DNA, 75 bp, Artificial Sequence
  Synthetic
gctgggtatagctttgttaagtcaggttacaaaaagaaagacctaatttgtcttgagccattctctgtttcacct

SEQ ID NO: 269841 - DNA, 75 bp, Artificial Sequence
  Synthetic
ctgatctggggccaactacctctatcttggtgagttggttaaaaaacgtctagtgggccaaacccaggggggatc

SEQ ID NO: 269842 - DNA, 75 bp, Artificial Sequence
  Synthetic
atgcttgagaaacttgtgcaggacaaatttcatgcattgctcaagggcaatcagattactacaatattcaatacc

SEQ ID NO: 269843 - DNA, 75 bp, Artificial Sequence
  Synthetic
cttggtgagttggttaaaaaacgtctagtgggccaaacccaggggggatccctggtttccttttattttactttg

SEQ ID NO: 269844 - DNA, 75 bp, Artificial Sequence
  Synthetic
tgtctaaaggatgagctgaggaaattggataagatctcagctggcaaaactaggtgtattgaggcatgtgaggta

SEQ ID NO: 269845 - DNA, 75 bp, Artificial Sequence
  Synthetic
tcaatatggagactattaaaggtattgcagatatggcaacggcagctgctaatggcattgattccacactaaatc

SEQ ID NO: 269846 - DNA, 75 bp, Artificial Sequence
  Synthetic
gactattgtatagtctataggatggttatgatggaaatctatgacaaaatttatcagacaccatgttactactca

SEQ ID NO: 269847 - DNA, 75 bp, Artificial Sequence
  Synthetic
aaactagtgaggcaacggtcaactccaatgcaacaggaggtgatattataactagagtggcagatgacgcttcaa

SEQ ID NO: 269848 - DNA, 75 bp, Artificial Sequence
  Synthetic
ggccttgcagttggaatcaacccatacaaggattggcacttcatgataaatgctctaaatgaatacaattatgaa

SEQ ID NO: 269849 - DNA, 75 bp, Artificial Sequence
  Synthetic
atgtgctgggacccaattgttatgcaacaacatcggaaccagaaaataaaaatgttgtgcaggctacaaccacag

SEQ ID NO: 269850 - DNA, 75 bp, Artificial Sequence
  Synthetic
ttaataccaccaacctcacacaacatccttcagcacctacaataccctttgctcctgacttttcaaatgtagata

SEQ ID NO: 269851 - DNA, 75 bp, Artificial Sequence
  Synthetic
gtttccattccatggcttacgatgtgacaacaggtgataagaatccaagtaagttggtcaggttaaaaaccactg

SEQ ID NO: 269852 - DNA, 75 bp, Artificial Sequence
  Synthetic
agaccatgtggtctttaatgagagatggttaatccatggtggtatgccatcgggttccccatgtaccactgtgct

SEQ ID NO: 269853 - DNA, 75 bp, Artificial Sequence
  Synthetic
aatggatacaaacatgggaaagatctcaccagatcgattatgtggaactaccaaaggccttttgggcaagtgaaa

SEQ ID NO: 269854 - DNA, 75 bp, Artificial Sequence
  Synthetic
aaattcattgtgtaacctgatgatgtgcatctatactacaaatttgattagcccaggaattgattgcttaccaat

SEQ ID NO: 269855 - DNA, 75 bp, Artificial Sequence
  Synthetic
agatgccagcttttggtcagtctaaatattttgctgctgttagatgtgggtttcactttcaagtgcaaataaatg

SEQ ID NO: 269856 - DNA, 75 bp, Artificial Sequence
  Synthetic
tgtttatggtgacgatgttatcctgtcgcttgataaagaaatagacccagagaaactgcaaggtatcatggcaga

SEQ ID NO: 269857 - DNA, 75 bp, Artificial Sequence
  Synthetic
tcaaccagggaacggctggcagcgccctagttgtctacaaaccaaaaccagtagtagacaatgatagtaaactag

SEQ ID NO: 269858 - DNA, 75 bp, Artificial Sequence
  Synthetic
ttcatttggtgctgaagtaactggttcccgtaaggatgagcctccatcattgaaatctagactggaggttgagtt

SEQ ID NO: 269859 - DNA, 75 bp, Artificial Sequence
  Synthetic
aatttgggtcttatactaacttaccacatgtattgatgaatttggcagagacaacacaagcggacttatgtatcc

SEQ ID NO: 269860 - DNA, 75 bp, Artificial Sequence
  Synthetic
tcccgtaaggatgagcctccatcattgaaatctagactggaggttgagtttctcaagcgtaaacctggttacttc

SEQ ID NO: 269861 - DNA, 75 bp, Artificial Sequence
  Synthetic
cctatgtttcagacacaaactatgtcaagactgattcgtctgacttagggctattggaagtatatgtctggaccc

SEQ ID NO: 269862 - DNA, 75 bp, Artificial Sequence
  Synthetic
cactgtcaattcctcatggttctgcaacccaagttgatgttactattttaggaagtttgttgcaactggactttc

SEQ ID NO: 269863 - DNA, 75 bp, Artificial Sequence
  Synthetic
tggaaaagatacttatatacactacatcaaaattttggatccctacttgaaggaatggaatattactgtggatga

SEQ ID NO: 269864 - DNA, 75 bp, Artificial Sequence
  Synthetic
aaaatcccagggtttatgggcaggaagttaacatatatgacaacgctcctgcacctggtaagttgaggaaatatc

SEQ ID NO: 269865 - DNA, 75 bp, Artificial Sequence
  Synthetic
ttatgatgtagtaattgctaagttgatgcccatggtgtttgactaaaatttaatgttttggtttttctttgttat

SEQ ID NO: 269866 - DNA, 75 bp, Artificial Sequence
  Synthetic
tcacaatgagcactaaatacaagtggacccggtcaaaaattgacatagctgaaggccctggctccatgaatttag

SEQ ID NO: 269867 - DNA, 75 bp, Artificial Sequence
  Synthetic
ccaatgtcctcagtacaactggagcccaatctttggcattggttggtgaaagagctttttatgatcctagaacag

SEQ ID NO: 269868 - DNA, 75 bp, Artificial Sequence
  Synthetic
tccctttcccagccttgaggcggctggtcaataaaaacctcaatcgtaacaaacatctaagattattacattaac

SEQ ID NO: 269869 - DNA, 75 bp, Artificial Sequence
  Synthetic
cccatgcctggtctccactagttgaaggcaacttgcaataaaatgagtggaaacaagacgcttaaagcatggtgt

SEQ ID NO: 269870 - DNA, 75 bp, Artificial Sequence
  Synthetic
ctggtagcaaatctagatttgacgatttaatcaaaattgcacagatgttttcagtgatgggagatagtagtcaac

SEQ ID NO: 269871 - DNA, 75 bp, Artificial Sequence
  Synthetic
aaacaagacgcttaaagcatggtgtaaattaacttttctaacccgcattttgtgtggggtggcagatggcgtgcc

SEQ ID NO: 269872 - DNA, 75 bp, Artificial Sequence
  Synthetic
cttcaacatcagagggcatagatgctaggggttatttcaagtgggcagccagcaaagctcctcaacaagtcatac

SEQ ID NO: 269873 - DNA, 75 bp, Artificial Sequence
  Synthetic
ataggaacttgatatacttaaaattatttccaaatttgaacttgtttgcccagtcatactcatacttcagaggct

SEQ ID NO: 269874 - DNA, 75 bp, Artificial Sequence
  Synthetic
ctctagttcttcgattgtcagtgtactctagcacctttaacagaggtagactgagaatgggctttttcccaaatt

SEQ ID NO: 269875 - DNA, 75 bp, Artificial Sequence
  Synthetic
gtaacaggtgcctccggggccaaaagccaaggtttagcagacccattaggattggttttcaaacctgaaatgttg

SEQ ID NO: 269876 - DNA, 75 bp, Artificial Sequence
  Synthetic
gttctgatgacaaaacgcaagaactggagaatgcaatatacactatttgtgatattgggacagacaatagttttg

SEQ ID NO: 269877 - DNA, 75 bp, Artificial Sequence
  Synthetic
aaataacaatcccttactcattctcaacctggatgaggaagaccaaaggtcacacaattggcttattccaagttg

SEQ ID NO: 269878 - DNA, 75 bp, Artificial Sequence
  Synthetic
aagttctaaataggctgacctacaacagctctagtcctagtgaagtttactgcatagtccaaggcagactgggta

SEQ ID NO: 269879 - DNA, 75 bp, Artificial Sequence
  Synthetic
cctctatcttggtggcctggttaaaaaacgtctagtgggccaaacccgggggggatccccggtttccttttattt

SEQ ID NO: 269880 - DNA, 75 bp, Artificial Sequence
  Synthetic
gtgatgccaagttttattgcccgactggttcagtaacaacgttccagaattcctggggttcacagatggatttga

SEQ ID NO: 269881 - DNA, 75 bp, Artificial Sequence
  Synthetic
ggggatccccggtttccttttattttatcactgccactatggagacaattaagaatattgcagatatggcaactg

SEQ ID NO: 269882 - DNA, 75 bp, Artificial Sequence
  Synthetic
gagtagttagttcagttgattcaactatcaatgcagttaacgagagagtggaaaacgtaggtaatgaaattggag

SEQ ID NO: 269883 - DNA, 75 bp, Artificial Sequence
  Synthetic
gtgatccactctgcattgaggataaagtcgaagaatgcaaacagacattgtccccaaatgaactaggcttgacat

SEQ ID NO: 269884 - DNA, 75 bp, Artificial Sequence
  Synthetic
gtaatttactaaccaaagttgcagatgacgcatctaatgtgctaggaccaaactgttatgctacaacagctgaac

SEQ ID NO: 269885 - DNA, 75 bp, Artificial Sequence
  Synthetic
ccgctcaagatgatgggccacttggcaatgaaaaacctaattacttcctcaactttaaagcaataaatgtggata

SEQ ID NO: 269886 - DNA, 75 bp, Artificial Sequence
  Synthetic
ttttcacagtgagccatacaaaagtggataatatttttggaagggcatggtattctatggctcatgaatttagaa

SEQ ID NO: 269887 - DNA, 75 bp, Artificial Sequence
  Synthetic
cagagaataaagatgtagtgcaggcaaccacaactgttaacacgaccaatttgacacagcacccctcggcaccaa

SEQ ID NO: 269888 - DNA, 75 bp, Artificial Sequence
  Synthetic
atgaaggtttgtggaggactaaacttactttcccaaaacaaggccacggtgcactttcacaattttttgcttatt

SEQ ID NO: 269889 - DNA, 75 bp, Artificial Sequence
  Synthetic
caatgtcgacacattccactcaatggcatatgatatcaccactggggagaaaaatcctagcaaattggttagatt

SEQ ID NO: 269890 - DNA, 75 bp, Artificial Sequence
  Synthetic
atactggagagttaaatatccatgtactgtttttgtgtgaaaaaggttttctcagagtagctcacacatatgaca

SEQ ID NO: 269891 - DNA, 75 bp, Artificial Sequence
  Synthetic
aaaatcctagcaaattggttagattggagactcatgagtggacaccaacttgggccagaggataccagataaccc

SEQ ID NO: 269892 - DNA, 75 bp, Artificial Sequence
  Synthetic
atgtggagctaccaaaagtcttttgggataaaaccagtaagccagcctatggccaatcaagatattttgcagcag

SEQ ID NO: 269893 - DNA, 75 bp, Artificial Sequence
  Synthetic
gtgatgaggggcgagatgacttcttgtcatccaatggagtcattaccataccagctggagagcaaatgtctctat

SEQ ID NO: 269894 - DNA, 75 bp, Artificial Sequence
  Synthetic
tgcggtgtggattccattttcaggtacaagtaaatgtaaatcaaggaacagctggcagtgcgttggtggtgtatg

SEQ ID NO: 269895 - DNA, 75 bp, Artificial Sequence
  Synthetic
ctgctccattctactcacacaggccattgagaacaattcgcaatgaggatgcattaggatatttactatgtcaac

SEQ ID NO: 269896 - DNA, 75 bp, Artificial Sequence
  Synthetic
acaagtaaatgtaaatcaaggaacagctggcagtgcgttggtggtgtatgaaccaaagccagttgtgacatatga

SEQ ID NO: 269897 - DNA, 75 bp, Artificial Sequence
  Synthetic
ctatgcttacaggaacatcaagtggcaagattgaggtgtatctcagcttgaggtgtccaaatctgttttttccaa

SEQ ID NO: 269898 - DNA, 75 bp, Artificial Sequence
  Synthetic
accaatctaccacatgtgttgatgaatttggctgagaccacacaggctgatttatgtatcccctatgttgctgac

SEQ ID NO: 269899 - DNA, 75 bp, Artificial Sequence
  Synthetic
tcccagcacctaagcctgccaatgcattaaggtcactcaacccatttagtgatgaaagtccatatgaagcaccaa

SEQ ID NO: 269900 - DNA, 75 bp, Artificial Sequence
  Synthetic
ttaatagacaaattatgaaattggcctatatagacaggggattttacaaacactatggtattatagttggagatt

SEQ ID NO: 269901 - DNA, 75 bp, Artificial Sequence
  Synthetic
tgtttggacacctttatccataccttcaggttctgcaacacaagttgatgtgaccatattgggtagtttattgca

SEQ ID NO: 269902 - DNA, 75 bp, Artificial Sequence
  Synthetic
atgtctaccaattagattcagatgatatttttaaaactgctcttacagggaaagctaaattcacaaaaacaaggt

SEQ ID NO: 269903 - DNA, 75 bp, Artificial Sequence
  Synthetic
attggacttccaaaatcctagggtatttggtcaagatgtcggcatttatgacaatgctccgacacggaggcaaaa

SEQ ID NO: 269904 - DNA, 75 bp, Artificial Sequence
  Synthetic
taagtaatgattgggttgtagaggaggaatgtgaattagactatttcagagtcaaatatttggagtcttcagtca

SEQ ID NO: 269905 - DNA, 75 bp, Artificial Sequence
  Synthetic
tttcaaaaagattctcacaatgagtactaaatacaaatggactagacaaaaaattgacattgcagaagggccagg

SEQ ID NO: 269906 - DNA, 75 bp, Artificial Sequence
  Synthetic
attcagaacacatattctctgtggataaaaattgtgagacaattgccaaagatatatttggttcacatacactca

SEQ ID NO: 269907 - DNA, 75 bp, Artificial Sequence
  Synthetic
agtaccactgcagcgcaatcaattgctttggttggagaaagagcattctatgacccaagaacagcaggaagcaag

SEQ ID NO: 269908 - DNA, 75 bp, Artificial Sequence
  Synthetic
gtcagcaccaagccattggcttgatcgggacaatcctcttaacagctggactcatgtcaacaattaagacaccag

SEQ ID NO: 269909 - DNA, 75 bp, Artificial Sequence
  Synthetic
agcagatttgatgatttagtaaaaatatctcaacttttttctgtgatgagtgactccacaactccttcaaccaac

SEQ ID NO: 269910 - DNA, 75 bp, Artificial Sequence
  Synthetic
ttaacgccacaacaatcaaggaatttttcaaccatgcaattgaaggggatgaacagggtttatccctgttagtgc

SEQ ID NO: 269911 - DNA, 75 bp, Artificial Sequence
  Synthetic
catggtatagatgcaaaaggttacttcaagtggtcatctacaactgcgccacagtccgtagtgcataggaatatt

SEQ ID NO: 269912 - DNA, 75 bp, Artificial Sequence
  Synthetic
aaaaatgcactactttcttctcatctgcagcaactgaaatcttggacaatgatttggtgaaatttatagttaaaa

SEQ ID NO: 269913 - DNA, 75 bp, Artificial Sequence
  Synthetic
gtttacttaaaattatttcccaacttgaatgtttttgtcaacagctactcatattttagaggctcaatagtgctt

SEQ ID NO: 269914 - DNA, 75 bp, Artificial Sequence
  Synthetic
ttctagttaggattttgtgttatatggtcctgtattgccacaaacccaacattctgaccactgcttgtttgtcta

SEQ ID NO: 269915 - DNA, 75 bp, Artificial Sequence
  Synthetic
aggttgagtgtgtatgccagcactttcaataggggtcgtctacggatgggtttctttccaaatgctacagaagac

SEQ ID NO: 269916 - DNA, 75 bp, Artificial Sequence
  Synthetic
cattactaattatggatgtgacatcttcatctgttttatccccatcatgcaaagctttaatgcaatgcttgatgg

SEQ ID NO: 269917 - DNA, 75 bp, Artificial Sequence
  Synthetic
tcaataggggtcgtctacggatgggtttctttccaaatgctacagaagactcaacctcagaaatagataatgcta

SEQ ID NO: 269918 - DNA, 75 bp, Artificial Sequence
  Synthetic
tatacacaatttgtgatttgggtagtgataacagttttgaaatcactattccatactcattttccacctggatgc

SEQ ID NO: 269919 - DNA, 75 bp, Artificial Sequence
  Synthetic
acggtgatgtaaagaagcttgctgaagtggttgctgagtctatgtcaaacacggacgacgatgaaattaaagaac

SEQ ID NO: 269920 - DNA, 75 bp, Artificial Sequence
  Synthetic
tgataacagttttgaaatcactattccatactcattttccacctggatgcggaaaacgaatggccacccaattgg

SEQ ID NO: 269921 - DNA, 75 bp, Artificial Sequence
  Synthetic
ggaaaacgaatggccacccaattggactattccaaatagaagtgcttaacaggttgacttacaatagctccagcc

SEQ ID NO: 269922 - DNA, 75 bp, Artificial Sequence
  Synthetic
aaatctgtgatacagtaaagtacacaaaaacaatcctctcaaatcagggtccattcaaaggtttcaatgaagtct

SEQ ID NO: 269923 - DNA, 75 bp, Artificial Sequence
  Synthetic
aggttgacttacaatagctccagccctaatgaagtttattgtattgtgcaaggtaaaatggggcaagatgccagg

SEQ ID NO: 269924 - DNA, 75 bp, Artificial Sequence
  Synthetic
ccacagcatttagacacatagattggtgggttcataccctactaaaaatcaaggatatggttctcagtgtattta

SEQ ID NO: 269925 - DNA, 75 bp, Artificial Sequence
  Synthetic
agccaagcttggaaagcaaagccatacagtggttggaaagaaacaaagagcatgtatgtgggattctagattatg

SEQ ID NO: 269926 - DNA, 75 bp, Artificial Sequence
  Synthetic
cttctgacattattgtggaatcaaaagatcagactaaggttaagactcaagacttttaccaaaggtattctgatt

SEQ ID NO: 269927 - DNA, 75 bp, Artificial Sequence
  Synthetic
gtaaacagactatatcaccaaatgaattgggcttaacatcagcccaggatgatggaccattgggtgatagtaagc

SEQ ID NO: 269928 - DNA, 75 bp, Artificial Sequence
  Synthetic
caaattatttcctaaatttcaagtccatgaatgtggacattttcactgtttctcacactaaagtagacaacctat

SEQ ID NO: 269929 - DNA, 75 bp, Artificial Sequence
  Synthetic
gcttagccaagttcaaaccaattatggccatttgtttcagaagctgccataacagtatcagtaatacagtataca

SEQ ID NO: 269930 - DNA, 75 bp, Artificial Sequence
  Synthetic
gactctttcaagaactagctagaatccctaatcgaatcagtactaacaatgatttgattagaattgagcccattg

SEQ ID NO: 269931 - DNA, 75 bp, Artificial Sequence
  Synthetic
ttggaagagcttggttttaccaggaacacactttcaccgatgaagggcagtggagagtcagtttagagttcccga

SEQ ID NO: 269932 - DNA, 75 bp, Artificial Sequence
  Synthetic
aacaaggtcatggttcactttccttgctatttgcttatttcacaggtgagttaaatatccatgttttgttcctag

SEQ ID NO: 269933 - DNA, 75 bp, Artificial Sequence
  Synthetic
gcatatggattcagggtgaaccaggccaaggaaaatcttttttgactcatactctttccaggcagttgcaaaaat

SEQ ID NO: 269934 - DNA, 75 bp, Artificial Sequence
  Synthetic
ctgaaaagggattccttagagtagcacatacttatgacacatcagcagacagggtaaatttcttgtcatccaatg

SEQ ID NO: 269935 - DNA, 75 bp, Artificial Sequence
  Synthetic
catgtaagctcaatggagtttttaccaacccaactgccagtgagtttatggacggctatgataatcaggatattc

SEQ ID NO: 269936 - DNA, 75 bp, Artificial Sequence
  Synthetic
atttgattgatgacttgggccagacacgaaaagagaaagatatagaaatgttatgtaattgtatttcttctgtcc

SEQ ID NO: 269937 - DNA, 75 bp, Artificial Sequence
  Synthetic
gtgttattacaatcccagccggagaacaaatgacattatctgcaccttactactcaaataaaccccttagaacag

SEQ ID NO: 269938 - DNA, 75 bp, Artificial Sequence
  Synthetic
ctttcattgtcccaatggcacatcttgaagaaaaagggaagttttatactagcaaattagttattgccactacca

SEQ ID NO: 269939 - DNA, 75 bp, Artificial Sequence
  Synthetic
tctatcttagcttgagatgtccaaatttcttttttccacttcctgcacctaaggtttcaaccagccgtgctttgc

SEQ ID NO: 269940 - DNA, 75 bp, Artificial Sequence
  Synthetic
ataagtcagatttttccagtacagttctccaggactctggagcactgaaaagaagatttccctacatcatgcaca

SEQ ID NO: 269941 - DNA, 75 bp, Artificial Sequence
  Synthetic
gtggtgacttagcaaatttctcagaccagagcccatatgatcaactaccacagagtcaagtgatgaaattagctt

SEQ ID NO: 269942 - DNA, 75 bp, Artificial Sequence
  Synthetic
ttcgggcagcgaaagcctatagtaaagcaggaaaactcaatgtcagtcaggctatggcaacaatgtcaactggtg

SEQ ID NO: 269943 - DNA, 75 bp, Artificial Sequence
  Synthetic
agtgctgggaggtgtcaaagaatggtagagattgggaaacactgaaattaagagaattagttgataaaatcactg

SEQ ID NO: 269944 - DNA, 75 bp, Artificial Sequence
  Synthetic
atttagatagggggttttacaagcactatggcattatagtaggagacattgtgtatcaattggattcagatgaca

SEQ ID NO: 269945 - DNA, 75 bp, Artificial Sequence
  Synthetic
aagattacaatgagagaacaaagaattacaacgcttggaaacaacagttggagaatcagactcttgacgatctag

SEQ ID NO: 269946 - DNA, 75 bp, Artificial Sequence
  Synthetic
actccagactgggtcattgaggaagaatgtgaactggattatttcagggtaaagtaccttgaatcgtctgtcaac

SEQ ID NO: 269947 - DNA, 75 bp, Artificial Sequence
  Synthetic
atgatgctgtttcatatataaaacacaatttcccagatgctataccacatattgacgaatatctaaatattgaaa

SEQ ID NO: 269948 - DNA, 75 bp, Artificial Sequence
  Synthetic
tcagaacatattttctcagtggaccacaattgtgaaactattgctaaggatatctttggcacccacacccttagt

SEQ ID NO: 269949 - DNA, 75 bp, Artificial Sequence
  Synthetic
tgtcaactttgattgaacagatggaggcttttattgaacccaaacctagtgttttcaaatgttttactaataaga

SEQ ID NO: 269950 - DNA, 75 bp, Artificial Sequence
  Synthetic
caacaccaagctattggtttaataggcacaattctcctaactgctggattgatgtcaaccattaaaacaccagtt

SEQ ID NO: 269951 - DNA, 75 bp, Artificial Sequence
  Synthetic
ttggttcaaaaatatctaaagcatctaaggaggttgtagattggtttacagacaaaattaaatcaatgttgagct

SEQ ID NO: 269952 - DNA, 75 bp, Artificial Sequence
  Synthetic
aataccaagaccattaaagagtttttcaatcatgcagtggaaggtgatgaacaggggttatctttacttgtacaa

SEQ ID NO: 269953 - DNA, 75 bp, Artificial Sequence
  Synthetic
ttgttgaaagaaacaaagcgtggcttactgttgtgtctgctgtaactagtgcaattagtatcctcctattagtca

SEQ ID NO: 269954 - DNA, 75 bp, Artificial Sequence
  Synthetic
aaatgtactactttcttctcttcagcagccacagaaattttagacaatgatttggttaaattcatagtgaaaatt

SEQ ID NO: 269955 - DNA, 75 bp, Artificial Sequence
  Synthetic
ctaaaatcttcaagaaggaggaatccaaggatgaaagggcatataatccaacactgccagtcgccaaaccaaagg

SEQ ID NO: 269956 - DNA, 75 bp, Artificial Sequence
  Synthetic
cttgtcagaattctctgttatatggtgttgtattgtcataaaccaaatattttaaccactgcttgtttatccaca

SEQ ID NO: 269957 - DNA, 75 bp, Artificial Sequence
  Synthetic
gaactttccccgtgtcgcaaagagagtttaaaaatgaggcaccatatgatggccaattggaacacataatttcac

SEQ ID NO: 269958 - DNA, 75 bp, Artificial Sequence
  Synthetic
ctactaataatggatgtcacatcttcatcggtgttgtcaccctcttgtaaggcactcatgcagtgtctgatggat

SEQ ID NO: 269959 - DNA, 75 bp, Artificial Sequence
  Synthetic
agatggcttacataactgggtcaaccactgggcatctcacccattgtgctggttaccagcatgatgaaataatac

SEQ ID NO: 269960 - DNA, 75 bp, Artificial Sequence
  Synthetic
catcggtgttgtcaccctcttgtaaggcactcatgcagtgtctgatggatggtgatgtcaagagattggcagaag

SEQ ID NO: 269961 - DNA, 75 bp, Artificial Sequence
  Synthetic
ttgtggctgaatccatgtctaatacagatgatgaggaaatcaaagaacaaatttgtgacacagtaaagtatacca

SEQ ID NO: 269962 - DNA, 75 bp, Artificial Sequence
  Synthetic
tccatggacactcaataaaatatttggaacaagaagatggactgacactacactataaaaacaaagttttcccaa

SEQ ID NO: 269963 - DNA, 75 bp, Artificial Sequence
  Synthetic
ttgaacaaccatctgtgacgcaggttacattgggtggcaaacctatggacctagccatccttaaatgtaaattgc

SEQ ID NO: 269964 - DNA, 75 bp, Artificial Sequence
  Synthetic
agagtatcctatcaaaccagggaccttttaagggtttcaatgaagtgtcaacggcatttaggcacattgattggt

SEQ ID NO: 269965 - DNA, 75 bp, Artificial Sequence
  Synthetic
acggcatttaggcacattgattggtggatacacactctgttgaaaataaaagatatggttctgagtgtattcaag

SEQ ID NO: 269966 - DNA, 75 bp, Artificial Sequence
  Synthetic
ccttcagatttaagaaaaattcaaaatattataccaataaaattgggactgaaagtatgttaatatggatgaccg

SEQ ID NO: 269967 - DNA, 75 bp, Artificial Sequence
  Synthetic
cccagtatggagagtaaagcaatccagtggttagagagaaataaagagcatgtttgtgccatcttggattatgcc

SEQ ID NO: 269968 - DNA, 75 bp, Artificial Sequence
  Synthetic
aacaaggtataatcactaaggaagttcaaagagtgcatcattctggtgggattaaaactagagaaggcactgaaa

SEQ ID NO: 269969 - DNA, 75 bp, Artificial Sequence
  Synthetic
tgtttgtgccatcttggattatgcctccgatattattgtggagtcaaaagaccaaacaaaaatgaaatctcaaga

SEQ ID NO: 269970 - DNA, 75 bp, Artificial Sequence
  Synthetic
gtactaagactatcagttatactgtaaaatcatgcaaagggatgtgtggtggtctactcatatctaaagttgaag

SEQ ID NO: 269971 - DNA, 75 bp, Artificial Sequence
  Synthetic
attctaccagaaatacactgattgtttgtctaagtttaaaccaattatggctatctgctttaggagttgccacaa

SEQ ID NO: 269972 - DNA, 75 bp, Artificial Sequence
  Synthetic
gaaatttcaaaattcttggcatgcacattgctggcaatggggagatgggtgtagcaattccattcaacttcctta

SEQ ID NO: 269973 - DNA, 75 bp, Artificial Sequence
  Synthetic
tagcatcagcaatacagtttataggctattccaagagttggctagaataccatctagaattagtactcagaatga

SEQ ID NO: 269974 - DNA, 75 bp, Artificial Sequence
  Synthetic
agaatgacatgtctgatcaaggcgttgtcacagaggtgacccctatacaacccatgtacatcaacaccaaatcac

SEQ ID NO: 269975 - DNA, 75 bp, Artificial Sequence
  Synthetic
tttaattagagtggagccaatcggtgtttggatccagggtgaaccaggacagggaaagtctttcttaacacatac

SEQ ID NO: 269976 - DNA, 75 bp, Artificial Sequence
  Synthetic
agatccacaaaagccctgtttatggagcagttgaagtaaagatgggaccagctgtacttagtaaatcagatacta

SEQ ID NO: 269977 - DNA, 75 bp, Artificial Sequence
  Synthetic
actatccagacagttacaaaaatcctgtaaattaaatggtgtgtacactaatccaacagctagtgagtttatgga

SEQ ID NO: 269978 - DNA, 75 bp, Artificial Sequence
  Synthetic
ggctggaagagccagtagattgtttaattaagaagtctgcttccaagtatagggtaaataagtttcaagttaaca

SEQ ID NO: 269979 - DNA, 75 bp, Artificial Sequence
  Synthetic
atccaacagctagtgagtttatggatgggtacgataaccaagacattcaccttatagatgatttgggacaaacaa

SEQ ID NO: 269980 - DNA, 75 bp, Artificial Sequence
  Synthetic
atgaattatggcagggagttaaagcttgtgttaaatccaaatttagagaaatatttggtataaatggcatagttg

SEQ ID NO: 269981 - DNA, 75 bp, Artificial Sequence
  Synthetic
gtgtaattgtatttcctcagttccatttatagttccaatggcacatcttgaagagaaaggcaaattttataccag

SEQ ID NO: 269982 - DNA, 75 bp, Artificial Sequence
  Synthetic
ggaaggagaaagacattgaaatgctgtgtaattgtatttcctcagttccatttatagttccaatggcacatcttg

SEQ ID NO: 269983 - DNA, 75 bp, Artificial Sequence
  Synthetic
acatgaaaacagcaatactcggaacatcacatgttaactcaatggatcttagcacttcagctgggtattcatttg

SEQ ID NO: 269984 - DNA, 75 bp, Artificial Sequence
  Synthetic
taaactggtaatagcaacaactaataaatctgatttctcaagtacagttctgcaagactctggtgcattaaagag

SEQ ID NO: 269985 - DNA, 75 bp, Artificial Sequence
  Synthetic
ttaaaagtgggtacaagaagaaagatttaatctgtcttgaaccatactcggtaagccctatgctagaaaagttag

SEQ ID NO: 269986 - DNA, 75 bp, Artificial Sequence
  Synthetic
aagattcccttacatcatgcatattagagcagctaaagcgtacagtaaggctggaaaactcaatgtcagtcaagc

SEQ ID NO: 269987 - DNA, 75 bp, Artificial Sequence
  Synthetic
tgcaggacaagtttcacaatctgttaaagggtaaccagattacaaccattttcaacacctgtcttaaagatgaat

SEQ ID NO: 269988 - DNA, 75 bp, Artificial Sequence
  Synthetic
catgtccgccatggccactggtgagtgctgggaggtgtcgaagaatggtagagactgggatactctaaaactgaa

SEQ ID NO: 269989 - DNA, 75 bp, Artificial Sequence
  Synthetic
tgaggaaattggacaagattgctgcaggcaagacaagatgcattgaagcatgtgaagttgattactgtattgttt

SEQ ID NO: 269990 - DNA, 75 bp, Artificial Sequence
  Synthetic
gagactgggatactctaaaactgaaggacctggttcagaagattacagaggattaccaagagaggcaaaagaatt

SEQ ID NO: 269991 - DNA, 75 bp, Artificial Sequence
  Synthetic
atagaatgattatgatggaaatatatgacagaatttatcagaccccttgttattattcaggattagctgttggaa

SEQ ID NO: 269992 - DNA, 75 bp, Artificial Sequence
  Synthetic
atgattgctggaaacagcagttagagaaccaaactctagatgatctggatgatgctgtctcttatattaagcata

SEQ ID NO: 269993 - DNA, 75 bp, Artificial Sequence
  Synthetic
actttccagatgcaattccatatattgatgagtacctcaacattgaaatgtcaacactaattgaacaaatggaag

SEQ ID NO: 269994 - DNA, 75 bp, Artificial Sequence
  Synthetic
taaatccttacaaggactggcactttatgatcaatgctctcaatgaatacaactatgagatggactattctcaat

SEQ ID NO: 269995 - DNA, 75 bp, Artificial Sequence
  Synthetic
cattcattgagcctagacctagtgttttcaagtgttttgcaaccaaggttgcaaaccagacaagaaaagcagcca

SEQ ID NO: 269996 - DNA, 75 bp, Artificial Sequence
  Synthetic
atgatggttcacttagttcaatgttattgtgggaggccgtggaagtccttgcatactgccatgattcaccagatc

SEQ ID NO: 269997 - DNA, 75 bp, Artificial Sequence
  Synthetic
aagaggttgtggattggttcagtagtaaaatcaagtcaatgttgagttttgtagaaaggaacaaagcctggctaa

SEQ ID NO: 269998 - DNA, 75 bp, Artificial Sequence
  Synthetic
ttgttatgcaactccataaaccagtgattgactctgatcatgtagtgttcaatgagagatggttgattcatggtg

SEQ ID NO: 269999 - DNA, 75 bp, Artificial Sequence
  Synthetic
cagtagtctcagctgttaccagtgcaattagcatattgctccttgtgacaaaaattttcaagaaagaagactcaa

SEQ ID NO: 270000 - DNA, 75 bp, Artificial Sequence
  Synthetic
gtatgccatctggatcaccgtgtaccactgtgctaaattcactttgtaatttgatgatgtgcatttacactacta

SEQ ID NO: 270001 - DNA, 75 bp, Artificial Sequence
  Synthetic
aaaattttcaagaaagaagactcaaaagatgaaagagcgtacaacccaaccctccctgtgacaaagccaaagggt

SEQ ID NO: 270002 - DNA, 75 bp, Artificial Sequence
  Synthetic
atttgattagtccaggaattgactgtttaccaattgtctacggggatgatgtaattctgtcattggataaagaaa

SEQ ID NO: 270003 - DNA, 75 bp, Artificial Sequence
  Synthetic
gcattcccagtgtcacaaagggaattcaaaaatgaagctccttatgatggccaattagagcacataatatcccaa

SEQ ID NO: 270004 - DNA, 75 bp, Artificial Sequence
  Synthetic
ttgaaccagagaaactgcaaagtatcatggcagattcatttggagctgaagtgactggttctcggaaggatgaac

SEQ ID NO: 270005 - DNA, 75 bp, Artificial Sequence
  Synthetic
atggcatacataactggctccaccacaggacacctcacacactgtgcaggttatcagcatgatgagatcattcta

SEQ ID NO: 270006 - DNA, 75 bp, Artificial Sequence
  Synthetic
gtgactggttctcggaaggatgaacctccaacactcaaaccacgaatggaggtagaatttctgaagagaaaacct

SEQ ID NO: 270007 - DNA, 75 bp, Artificial Sequence
  Synthetic
catggacactcaatcaagtatcttgaacaggaagaggatttaaccctgcattacaaaaataaggtgttcccaatt

SEQ ID NO: 270008 - DNA, 75 bp, Artificial Sequence
  Synthetic
aacaggaagaggatttaaccctgcattacaaaaataaggtgttcccaattgataacccgtctgtgacacaagtta

SEQ ID NO: 270009 - DNA, 75 bp, Artificial Sequence
  Synthetic
aactccaatcctacttaatggagttatgcctccatggaaaagacacttacctacactacatcaaaattttggatc

SEQ ID NO: 270010 - DNA, 75 bp, Artificial Sequence
  Synthetic
cgttgggtggtaaacctatggatttggctattctcaagtgcaagctaccatttaggttcaagaaaaattccaaat

SEQ ID NO: 270011 - DNA, 75 bp, Artificial Sequence
  Synthetic
attatactaacaaaattggaacagaaagtatgttaatttggatgaccgaacaaggcattatcactaaagaggtcc

SEQ ID NO: 270012 - DNA, 75 bp, Artificial Sequence
  Synthetic
cttatttgaaagaatggaacatcgcagtggatgattatgaagtagtaatggctaagttgatgcccatggtgtttg

SEQ ID NO: 270013 - DNA, 75 bp, Artificial Sequence
  Synthetic
agagggtccatcattctggaggcatcaaaacacgagaggggaccgagagtacaaaaactattagttacactgtga

SEQ ID NO: 270014 - DNA, 75 bp, Artificial Sequence
  Synthetic
attaaattataatgttttggttttcttttgctatggactttatgattaggacactaattcaattagaacactaat

SEQ ID NO: 270015 - DNA, 75 bp, Artificial Sequence
  Synthetic
ctaattcaattagaacactaattcggaatattggacataacaaaaaaaaaaaaaaaaaaaaaaaaaaaaaaaaaa

SEQ ID NO: 270016 - DNA, 75 bp, Artificial Sequence
  Synthetic
aatcctgtaaaggcatgtgtggaggtttgcttatctccaaagtggaagggaactttaaaattcttggaatgcaca

SEQ ID NO: 270017 - DNA, 75 bp, Artificial Sequence
  Synthetic
tagctggaaatggagaaatgggcgttgctatccctttcaattttcttaagaatgacatgtctgaccaaggcattg

SEQ ID NO: 270018 - DNA, 75 bp, Artificial Sequence
  Synthetic
tcacagaaacaacgcctatacagcccatgtatataaataccaaaactcaaatccataagagtccagtttatggag

SEQ ID NO: 270019 - DNA, 75 bp, Artificial Sequence
  Synthetic
atgcctggtctccgttagttgaaggcaacttgcaataaaatgagcggaaacaagacgcttaaagcatggtgtaaa

SEQ ID NO: 270020 - DNA, 75 bp, Artificial Sequence
  Synthetic
cttgaagaacctgttgagtgtctaattaagaggtcagcctcaaagtatagaatcaataaatttcaggtaaacaat

SEQ ID NO: 270021 - DNA, 75 bp, Artificial Sequence
  Synthetic
gtggaccttatgctcacacagccatcctctagtaagtttgtgagacgtctggtgacgtgtgggaacttattggaa

SEQ ID NO: 270022 - DNA, 75 bp, Artificial Sequence
  Synthetic
gtgtcaaatccaaatttagggaaatttttgggatcaatggaatagtagatatgaagacagccatcctagggacat

SEQ ID NO: 270023 - DNA, 75 bp, Artificial Sequence
  Synthetic
ggtgacgtgtgggaacttattggaaacaacattttgctgtaaagcatcctattgccagcggaacaacacctggta

SEQ ID NO: 270024 - DNA, 75 bp, Artificial Sequence
  Synthetic
cacatgttaactctatggatttgagtacatcagctgggtatagctttgttaaatcagggtataaaaagaaagatt

SEQ ID NO: 270025 - DNA, 75 bp, Artificial Sequence
  Synthetic
tgatctgccttgaacctttctcagtatcacctatgcttgagaatttagtacaagacaagcttcatgcactgctga

SEQ ID NO: 270026 - DNA, 75 bp, Artificial Sequence
  Synthetic
agggcaatcaaatcaccacaatatttaacacttgtttgaaggatgagctgaggaaattggacaaaatttcatcag

SEQ ID NO: 270027 - DNA, 75 bp, Artificial Sequence
  Synthetic
gcaaaactaggtgcattgaggcatgtgaagtagactattgtatagtctatagaatgatcatgatggaaatttatg

SEQ ID NO: 270028 - DNA, 75 bp, Artificial Sequence
  Synthetic
agaatgatcatgatggaaatttatgacaagatttaccaaacaccatgctactactcaggcctcgctgttggaatt

SEQ ID NO: 270029 - DNA, 75 bp, Artificial Sequence
  Synthetic
ttatgaaatggattactcccagtatgatggttccctcagttcaatgttattgtgggaggcagtggaagttttggc

SEQ ID NO: 270030 - DNA, 75 bp, Artificial Sequence
  Synthetic
gttatgcagttacataaaccagtaattgattcagaccatgtggtctttaatgagagatggttgatacatggcggt

SEQ ID NO: 270031 - DNA, 75 bp, Artificial Sequence
  Synthetic
tcctagtaaattggttagattggagacacatgagtggacaccaacctgggctagaggacatcagataactcatgt

SEQ ID NO: 270032 - DNA, 75 bp, Artificial Sequence
  Synthetic
ttaattagcccaggaattgactgtttaccaattgtttatggtgatgacgtcatcttgtcacttgacagagaaata

SEQ ID NO: 270033 - DNA, 75 bp, Artificial Sequence
  Synthetic
ggaattaccaaaagtcttttgggataaaaacagcaagccagcctatggccaatcaagatacttcgcagcagtacg

SEQ ID NO: 270034 - DNA, 75 bp, Artificial Sequence
  Synthetic
gacccagagaaactgcagggtatcatggcagattcatttggtgccgaagtgactggttcgcgcaaggatgagcct

SEQ ID NO: 270035 - DNA, 75 bp, Artificial Sequence
  Synthetic
aatcaagatacttcgcagcagtacggtgtggttttcactttcaagtgcaggtgaatgttaatcaaggaacagctg

SEQ ID NO: 270036 - DNA, 75 bp, Artificial Sequence
  Synthetic
ccatcattaaaacccagattggaggtggaattcctgaagcgtaaacctggttatttcccagagtccacatttata

SEQ ID NO: 270037 - DNA, 75 bp, Artificial Sequence
  Synthetic
cttcaatcctacttaatggagttatgcctccatggaaaagacacttacttatattacatcaaaatcttggatcca

SEQ ID NO: 270038 - DNA, 75 bp, Artificial Sequence
  Synthetic
catattgggtagcttattgcaattggacttccaaaatcctagggtattcggccaggacgttggtatttatgacaa

SEQ ID NO: 270039 - DNA, 75 bp, Artificial Sequence
  Synthetic
ataattctatcagtgggataccacgcttgtggatcttatgcccacacagccatcctctagtaagtttgtaagacg

SEQ ID NO: 270040 - DNA, 75 bp, Artificial Sequence
  Synthetic
aatacaagtggactagggggaaaattgacattgcagaagggccaggttctatgaacatggcgaacgtgttaagta

SEQ ID NO: 270041 - DNA, 75 bp, Artificial Sequence
  Synthetic
tctgatgacgtgtgggaacttattggaagtgacattttgctgcaaagcatcctattgccagcggaataacacctg

SEQ ID NO: 270042 - DNA, 75 bp, Artificial Sequence
  Synthetic
ccaagaacagcaggaagcaagagtaggtttgatgatttagtaaaaatatctcaacttttttctgtgatgagtgac

SEQ ID NO: 270043 - DNA, 75 bp, Artificial Sequence
  Synthetic
gtaacaggtgcctctggggccaaaagccaaggtttaacagaccctttaggattggtgttaacctgaagtgttatg

SEQ ID NO: 270044 - DNA, 75 bp, Artificial Sequence
  Synthetic
tcaacaaccccttcagccaaccatggtatagatgcaaaaggctattttacgtggtcatccacaacagcaccacag

SEQ ID NO: 270045 - DNA, 75 bp, Artificial Sequence
  Synthetic
gaaaatatttagtacctgctgatttggtagtaatgcaaacactagttgtaaggcccacgaaggatgcccagaagg

SEQ ID NO: 270046 - DNA, 75 bp, Artificial Sequence
  Synthetic
gtggtcatccacaacagcaccacagtctgtagtgcataggaatattgtttatctaaaattgtttcccaacttgaa

SEQ ID NO: 270047 - DNA, 75 bp, Artificial Sequence
  Synthetic
tctattaaggtgagttggttaaaaaacgtctagtgggccaaacccaggggggatccctggtttccttttatttta

SEQ ID NO: 270048 - DNA, 75 bp, Artificial Sequence
  Synthetic
ctacattcaacatggagacaatcaagagcattgcaaacatggctactggtattacgaaaactgttgattcaacaa

SEQ ID NO: 270049 - DNA, 75 bp, Artificial Sequence
  Synthetic
tacaatttgtgatttgggcagtgacaacagttttgaaattactattccatactcgttttccacctggatgcggaa

SEQ ID NO: 270050 - DNA, 75 bp, Artificial Sequence
  Synthetic
ttaactcagtgaatgaaacaatcggcaacacagataatgcatcaggtggtgatattttgaccaaagttgcagatg

SEQ ID NO: 270051 - DNA, 75 bp, Artificial Sequence
  Synthetic
aacggatggccacccaattggattatttcaaattgaggtacttaacagattaacttacaacagctccagccctaa

SEQ ID NO: 270052 - DNA, 75 bp, Artificial Sequence
  Synthetic
atgcatccaatgtgttaggacctaactgctatgccacaacttctgaaccagaaaataaggatgtagtacaggcaa

SEQ ID NO: 270053 - DNA, 75 bp, Artificial Sequence
  Synthetic
caactactgttaatactacaaatttaactcaacacccatcagcaccgactatgccatttacaccagactttgcca

SEQ ID NO: 270054 - DNA, 75 bp, Artificial Sequence
  Synthetic
atgtggataatttccattctatggcttatgatattaccagtggagataaaaaccctagtaagttgataaggctag

SEQ ID NO: 270055 - DNA, 75 bp, Artificial Sequence
  Synthetic
tagaagaatctgcagaggaatgcaaacagaccatatcgccaaatgagttgggcttaacttcagctcaggatgatg

SEQ ID NO: 270056 - DNA, 75 bp, Artificial Sequence
  Synthetic
aaccctagtaagttgataaggctagaaacaggtgattggactttgaccgcaaagagatctgacaagattatgcat

SEQ ID NO: 270057 - DNA, 75 bp, Artificial Sequence
  Synthetic
gaccattgggtgataacaagccaaattatttcctaaatttcaagtccatgaatgtggatatcttcactgtttccc

SEQ ID NO: 270058 - DNA, 75 bp, Artificial Sequence
  Synthetic
acacaaaggtagataacctatttggaagagcttggttttacaaggaacacactttcaccaacgaagggcagtgga

SEQ ID NO: 270059 - DNA, 75 bp, Artificial Sequence
  Synthetic
agatgcggtttccatttccaagtacaaatcaatgtgaatcaaggcgctgcaggaagtgctttggtggtctacatg

SEQ ID NO: 270060 - DNA, 75 bp, Artificial Sequence
  Synthetic
gaattaatttagagttcccgaaacaaggccatggttcgctttcattgttattcgcttacttcacaggtgaactaa

SEQ ID NO: 270061 - DNA, 75 bp, Artificial Sequence
  Synthetic
ccaaaaccagtggtggaccatgaaacaaagatggagtttggcgcatttactaacttaccacatgtgttaatgaat

SEQ ID NO: 270062 - DNA, 75 bp, Artificial Sequence
  Synthetic
ttcgcttacttcacaggtgaactaaatatccatgttctgttcctagctgaaaggggatttctcagagtagcccac

SEQ ID NO: 270063 - DNA, 75 bp, Artificial Sequence
  Synthetic
caaagatggagtttggcgcatttactaacttaccacatgtgttaatgaatttagcagaaacaacacaagctgact

SEQ ID NO: 270064 - DNA, 75 bp, Artificial Sequence
  Synthetic
catcacaatcccagctggggaacaaatgacattatctgcaccctactactcaaataaacccctcagaacagtcag

SEQ ID NO: 270065 - DNA, 75 bp, Artificial Sequence
  Synthetic
atgacattatctgcaccctactactcaaataaacccctcagaacagtcagagataacaatagtcttgggtatcta

SEQ ID NO: 270066 - DNA, 75 bp, Artificial Sequence
  Synthetic
gacttagggcacttgagagtctatgtctggacacccctttccatgccaacgggaataacaacacaggtggatgtg

SEQ ID NO: 270067 - DNA, 75 bp, Artificial Sequence
  Synthetic
actgtcctgggtagcctattacaactggatttccagaaccctagaccctacaataaacaagtcaatatctatgat

SEQ ID NO: 270068 - DNA, 75 bp, Artificial Sequence
  Synthetic
aatgggcctaaaaagataatcagtaaaaagaaaatcttaacaatgagtacaaagtataaatggacacggaataaa

SEQ ID NO: 270069 - DNA, 75 bp, Artificial Sequence
  Synthetic
tttgatattgcagagggacctggctcaatgaatatggcaaatgtattaagtacaactggagctcagtcagtagcc

SEQ ID NO: 270070 - DNA, 75 bp, Artificial Sequence
  Synthetic
agcccatatgatcaacaaccacagagccagatcatgaaattagcttatttaaatagggggttttacaagcactat

SEQ ID NO: 270071 - DNA, 75 bp, Artificial Sequence
  Synthetic
cttgttggcgaacgagctttttatgacccaagatcagctggaagtagatcacgatttgatgatttggccaaaata

SEQ ID NO: 270072 - DNA, 75 bp, Artificial Sequence
  Synthetic
ggcattatagtgggagatagtgtgtatcagttagattcggatgacattttcaaaacagctctaacagggaaagcc

SEQ ID NO: 270073 - DNA, 75 bp, Artificial Sequence
  Synthetic
acgcaactattttcagttatggctgattctgacacaccatctaccacacatgggcatgatgccaagggttatttt

SEQ ID NO: 270074 - DNA, 75 bp, Artificial Sequence
  Synthetic
aagtggtctgcaactactaacccaatgtatattgtccatagaaatatagtgtatctgaggctctttccaaacatc

SEQ ID NO: 270075 - DNA, 75 bp, Artificial Sequence
  Synthetic
gtatctgaggctctttccaaacatcaataattttgtaaacagtttctcatattttagaggatcattggtgttgag

SEQ ID NO: 270076 - DNA, 75 bp, Artificial Sequence
  Synthetic
aacatatcttctcagtggaccacaattgtgaaactattgctaaggatatatttggtacccacacccttagtcaac

SEQ ID NO: 270077 - DNA, 75 bp, Artificial Sequence
  Synthetic
accaggctattggcttaataggcacaattctcttgactgctgggttgatgtcaaccattaaaacaccagtcactg

SEQ ID NO: 270078 - DNA, 75 bp, Artificial Sequence
  Synthetic
agatgaagaattggacaatgctatttacactatctgtgacattggtagtgacaatagttttgaaataacaatacc

SEQ ID NO: 270079 - DNA, 75 bp, Artificial Sequence
  Synthetic
ccaccaccatcaaagagttcttcaaccacgcagtggaaggcgatgaacaggggctatctttacttgtacaaaagt

SEQ ID NO: 270080 - DNA, 75 bp, Artificial Sequence
  Synthetic
ccacgcagtggaaggcgatgaacaggggctatctttacttgtacaaaagtgcactacttttttttcttcagcagc

SEQ ID NO: 270081 - DNA, 75 bp, Artificial Sequence
  Synthetic
ctattccttttctacttggatgcgaaagactgctggacaccctattgggttgcttcaaattgaagtattgaatag

SEQ ID NO: 270082 - DNA, 75 bp, Artificial Sequence
  Synthetic
tgcttcaaattgaagtattgaatagattgacatataatagttccagtcctagtgaggttttttgtattttacaag

SEQ ID NO: 270083 - DNA, 75 bp, Artificial Sequence
  Synthetic
gtagaatgggagaagatgccaaatttttctgccctactggctccctagttacattccagaattcttggggctcac

SEQ ID NO: 270084 - DNA, 75 bp, Artificial Sequence
  Synthetic
taataatggatgtcacatcctcatcagtgttgtcaccttcttgtaaggcacttatgcagtgcctaatggatggtg

SEQ ID NO: 270085 - DNA, 75 bp, Artificial Sequence
  Synthetic
acattccagaattcttggggctcacaaatggacctcagcgacccactgtgtattgaggatgatgctgaaaattgc

SEQ ID NO: 270086 - DNA, 75 bp, Artificial Sequence
  Synthetic
atgttaagaaattggcggaagttgtggctgaatccatgtctaatacagatgatgaagaaatcaaggaacaaattt

SEQ ID NO: 270087 - DNA, 75 bp, Artificial Sequence
  Synthetic
aagcaaacaatatccccaaatgaattaggtttaacatcagcacaagatgatggacctctaggtggggaaaaacca

SEQ ID NO: 270088 - DNA, 75 bp, Artificial Sequence
  Synthetic
aactattttctaaattttagaaccatgaatgtggacatttttacggtttctcatacaaaagtggacaatatattt

SEQ ID NO: 270089 - DNA, 75 bp, Artificial Sequence
  Synthetic
aagggtttcaatgaagtatcaacagcatttaggcacattgattggtgggtgcacactctattgaaaataaaagat

SEQ ID NO: 270090 - DNA, 75 bp, Artificial Sequence
  Synthetic
ggccgtgcatggtttgtaacaagtcatgattttaacaatgagggacaatggcccttagatttgacttttccattt

SEQ ID NO: 270091 - DNA, 75 bp, Artificial Sequence
  Synthetic
atggttttgagtgttttcaaacccagtatggagagtaaagctattcagtggttagagagaaataaagagcacgtt

SEQ ID NO: 270092 - DNA, 75 bp, Artificial Sequence
  Synthetic
gaaggccatggttctttatcattattgttcgcatacttcactggggaactaaatatacatgttctgtttttgtca

SEQ ID NO: 270093 - DNA, 75 bp, Artificial Sequence
  Synthetic
tgtgctatcttggattatgcctctgacattattgtggaatcaaaagaccagacaaaaatgaagtcacaggagttt

SEQ ID NO: 270094 - DNA, 75 bp, Artificial Sequence
  Synthetic
gacaaaggcttcttgagggttgttcatacgtatgacaatactaacaataggttaatcaacttggcctctaatggt

SEQ ID NO: 270095 - DNA, 75 bp, Artificial Sequence
  Synthetic
gtgattaccataccagctggaaaacaaatgtcactgtcagcccctttctattctcacaagccattgaggacagtc

SEQ ID NO: 270096 - DNA, 75 bp, Artificial Sequence
  Synthetic
atcagcaatacagtctataggctattccaagagttagctagaataccatctagaattagcacccagaatgatttg

SEQ ID NO: 270097 - DNA, 75 bp, Artificial Sequence
  Synthetic
agggacactcacagcctaggtaggctcatttgcaaaccattcttgactggaacaacatctggcaggatagaagta

SEQ ID NO: 270098 - DNA, 75 bp, Artificial Sequence
  Synthetic
attagagtggaaccaatcggcatttggatccaaggtgaaccgggacaaggaaagtcttttttaacgcacacacta

SEQ ID NO: 270099 - DNA, 75 bp, Artificial Sequence
  Synthetic
tacatgagccttaggtgtccaaattttttcttccctgttccagctccaaaaaccacaccacgctcggaaagtcgt

SEQ ID NO: 270100 - DNA, 75 bp, Artificial Sequence
  Synthetic
gctctacggggcgatatggccaatttgacaaatcaaagtccttatgaccatcagccacaaaaccaggtgatgaaa

SEQ ID NO: 270101 - DNA, 75 bp, Artificial Sequence
  Synthetic
tatgataaccaagacatccaccttattgatgatttgggccaaacaaggaaggagaaagacattgaaatgctgtgt

SEQ ID NO: 270102 - DNA, 75 bp, Artificial Sequence
  Synthetic
ttggcctatttagatagaggcttctataagcattatggtattatagttggggagtacatataccaattggactca

SEQ ID NO: 270103 - DNA, 75 bp, Artificial Sequence
  Synthetic
aattgtatatcctcagtcccgtttatagttccaatggcacatctcgaggagaaaggcaaattttataccagtaaa

SEQ ID NO: 270104 - DNA, 75 bp, Artificial Sequence
  Synthetic
gatgatatctttaaaacagcattaacaggaaaagccaaatttacaaaaacgagactgacatcagattggatagtt

SEQ ID NO: 270105 - DNA, 75 bp, Artificial Sequence
  Synthetic
ctggtgatagcaacaaccaataaatctgatttttcaagtacagtcctacaagattctggtgcattgaagagaaga

SEQ ID NO: 270106 - DNA, 75 bp, Artificial Sequence
  Synthetic
ctgatttttcaagtacagtcctacaagattctggtgcattgaagagaagattcccgtacattatgcatattagag

SEQ ID NO: 270107 - DNA, 75 bp, Artificial Sequence
  Synthetic
gaagaagagtgtgagctggattactttagaattaaatatcttgagtcagctgtgaactcagagcacatcttttca

SEQ ID NO: 270108 - DNA, 75 bp, Artificial Sequence
  Synthetic
gttgataaaaattgtgaaaccattgctaaggatatttttggaacacacaccctgagtcaacaccaggctattggc

SEQ ID NO: 270109 - DNA, 75 bp, Artificial Sequence
  Synthetic
ctaattggtactattctcttaaccgctgggctcatgtcaaccattaagacaccagttaatacaactaccatcaag

SEQ ID NO: 270110 - DNA, 75 bp, Artificial Sequence
  Synthetic
gaattcttcaatcatgcactagaaggtgatgaacaggggctgtctctccttgtgcaaaaatgcacaactttcttc

SEQ ID NO: 270111 - DNA, 75 bp, Artificial Sequence
  Synthetic
ctgtctcttacatcaagcataattttccagatgcaatcccatatatagatgaatatcttaatattgaaatgtcga

SEQ ID NO: 270112 - DNA, 75 bp, Artificial Sequence
  Synthetic
tcttctgctgccacagaaatattagacaatgatttggttaaatttatagttaagattttagtcaggattttatgt

SEQ ID NO: 270113 - DNA, 75 bp, Artificial Sequence
  Synthetic
cactaattgagcaaatggaagcattcattgagcctagacctagtgttttcaaatgttttgcaactaagattgcaa

SEQ ID NO: 270114 - DNA, 75 bp, Artificial Sequence
  Synthetic
tatatggttctttattgtcataaaccaaatattcttactacagcatgtttatcaactcttttaattatggatgtg

SEQ ID NO: 270115 - DNA, 75 bp, Artificial Sequence
  Synthetic
accagacaaagagagcagccaaagaagttgtggaatggttcagtgcaaaaattaagtcaatgttaagttttgtag

SEQ ID NO: 270116 - DNA, 75 bp, Artificial Sequence
  Synthetic
acctcttcttctgtcctatcaccctcttgtaaagctcttatgcaatgtttgatggatggtgacgtgaagaaactg

SEQ ID NO: 270117 - DNA, 75 bp, Artificial Sequence
  Synthetic
cttgtaaagctcttatgcaatgtttgatggatggtgacgtgaagaaactggctgaggtggtggcagaatccatgt

SEQ ID NO: 270118 - DNA, 75 bp, Artificial Sequence
  Synthetic
agtttcagctgttaccagtgcaattagtatattgcttctggtgacaaaaatttttaggaaagaagactcaaaaga

SEQ ID NO: 270119 - DNA, 75 bp, Artificial Sequence
  Synthetic
ctaacacagatgatgatgaaattaaggaacaaatttgtgatacagtgaaatatactaagactattctatcaaacc

SEQ ID NO: 270120 - DNA, 75 bp, Artificial Sequence
  Synthetic
agtatattgcttctggtgacaaaaatttttaggaaagaagactcaaaagatgaaagggcatataatccgaccctt

SEQ ID NO: 270121 - DNA, 75 bp, Artificial Sequence
  Synthetic
aggggccattcaaaggatttaatgaggtttctacagcttttagacacatagattggtggattcacacattgatta

SEQ ID NO: 270122 - DNA, 75 bp, Artificial Sequence
  Synthetic
cctgtgacaaaaccaaagggtgcattcccagtgtcgcaaagggaatttaaaaatgaagctccctatgatggccaa

SEQ ID NO: 270123 - DNA, 75 bp, Artificial Sequence
  Synthetic
aaatcaaggacatggtccttagtgtattcaaaccaagtttagagagtaaagccatacaatggctagaaaggaata

SEQ ID NO: 270124 - DNA, 75 bp, Artificial Sequence
  Synthetic
ctagaacatataatatcccaaatggcatatataactggctcaactacaggacatctcacacattgtgcaggctac

SEQ ID NO: 270125 - DNA, 75 bp, Artificial Sequence
  Synthetic
aagaacatgtttgtgccatcttagactatgcatctgacatcattgtggagtcaaaagatcaaacaatgatgaaat

SEQ ID NO: 270126 - DNA, 75 bp, Artificial Sequence
  Synthetic
cagcatgatgaggtcattctacatggacactcaattaagtatcttgagcaagaagaagatttaactctgcactat

SEQ ID NO: 270127 - DNA, 75 bp, Artificial Sequence
  Synthetic
gacactcaattaagtatcttgagcaagaagaagatttaactctgcactataagaataaggtgttcccaattgaga

SEQ ID NO: 270128 - DNA, 75 bp, Artificial Sequence
  Synthetic
cccaagaattctaccaaaaatatacagattgtctatctaaattcaaaccaattatggctatttgttttaggagtt

SEQ ID NO: 270129 - DNA, 75 bp, Artificial Sequence
  Synthetic
gggtggtaaacctatggatttggctatcctcaagtgtaaactaccatttaggtttaagaaaaattccaaatacta

SEQ ID NO: 270130 - DNA, 75 bp, Artificial Sequence
  Synthetic
gccataacagcattagtaatactgtatatagactctttcaagagttagctcgtataccatctagaattagtacac

SEQ ID NO: 270131 - DNA, 75 bp, Artificial Sequence
  Synthetic
aaaatgacttaattagagtggaaccaattggcgtgtggattcagggtgaacctggacaaggcaaatcatttttga

SEQ ID NO: 270132 - DNA, 75 bp, Artificial Sequence
  Synthetic
cacacacactttcaaggcaattgcagaagtcatgtaaatttaatggtgtttatacaaaccccactgcaagtgaat

SEQ ID NO: 270133 - DNA, 75 bp, Artificial Sequence
  Synthetic
acacgagagggaactgagagtacaaaaacaatcagttacactgtgaaatcatgcaaaggcatgtgtgggggtttg

SEQ ID NO: 270134 - DNA, 75 bp, Artificial Sequence
  Synthetic
ttatggatggttatgacaaccaggacatccacttgattgatgatttgggacaaaccaggaaggaaaaagatattg

SEQ ID NO: 270135 - DNA, 75 bp, Artificial Sequence
  Synthetic
ctcatttctaaagtggaggggaattttaaaattcttggaatgcatatagctggaaatggagaaatgggagttgct

SEQ ID NO: 270136 - DNA, 75 bp, Artificial Sequence
  Synthetic
aaatgctttgtaattgtatctcatcagtgccttttattgtgccaatggcacacttagaggagaaaggcaagtttt

SEQ ID NO: 270137 - DNA, 75 bp, Artificial Sequence
  Synthetic
attcctttcaatttccttaaaaatgacatatctgaccaaggcattgtcacagagataacacccatacagcctatg

SEQ ID NO: 270138 - DNA, 75 bp, Artificial Sequence
  Synthetic
agagataacacccatacagcctatgtacattaatactaaaacacagattcacaagagtccagtttatggagcagt

SEQ ID NO: 270139 - DNA, 75 bp, Artificial Sequence
  Synthetic
atacaagtaaattagttatagctaccacaaataagtctgatttctccagcactgtactccaggactccggagcac

SEQ ID NO: 270140 - DNA, 75 bp, Artificial Sequence
  Synthetic
agaagtcaagatgggcccagcagtcttgagtaaatcagatcctaggcttgaagaacctgtcgagtgcttaatcaa

SEQ ID NO: 270141 - DNA, 75 bp, Artificial Sequence
  Synthetic
tcaaaagaaggtttccttacatcatgcatattagggctgccaaagcttatagcaaagcaggtaagcttaatgtta

SEQ ID NO: 270142 - DNA, 75 bp, Artificial Sequence
  Synthetic
aaaatcagcttcaaagtatagagtcaataaatttcaggtgaacagtgaattatggcagggtgtcaaagcctgtgt

SEQ ID NO: 270143 - DNA, 75 bp, Artificial Sequence
  Synthetic
gccaagcaatgtcagtaatggcaaatggtgagtgctgggaggtgtcaaagaatggtagagattgggaaaccctca

SEQ ID NO: 270144 - DNA, 75 bp, Artificial Sequence
  Synthetic
caaatccaaattcagagaaatttttgggatcaatggaatagtggacatgaagactgccgtcctagggacttccca

SEQ ID NO: 270145 - DNA, 75 bp, Artificial Sequence
  Synthetic
aattaaaagatttggtgcaaaagatcacagaagattatcaagaaagacagaagaactataatgcttggaaacaac

SEQ ID NO: 270146 - DNA, 75 bp, Artificial Sequence
  Synthetic
gggatcaatggaatagtggacatgaagactgccgtcctagggacttcccatgttaactctatggacttgagcaca

SEQ ID NO: 270147 - DNA, 75 bp, Artificial Sequence
  Synthetic
aattggagaatcagtcactagatgatttagacgatgctgtgtcatacatcaaacataactttccagatgccattc

SEQ ID NO: 270148 - DNA, 75 bp, Artificial Sequence
  Synthetic
tcagctggatatagctttgtcaaatcaggatataaaaagaaagatttaatttgccttgaacctttctcagtttca

SEQ ID NO: 270149 - DNA, 75 bp, Artificial Sequence
  Synthetic
catatattgatgaatatttgaatatagaaatgtcaacactcattgaacaaatggaggcctttattgagccacgcc

SEQ ID NO: 270150 - DNA, 75 bp, Artificial Sequence
  Synthetic
cccatgctcgaaaagttggtacaagataagtttcatgcattgctaaagggcaatcaaatcactacaatttttaac

SEQ ID NO: 270151 - DNA, 75 bp, Artificial Sequence
  Synthetic
caatcaaatcactacaatttttaacacctgtttaaaggatgaactgaggaaattggacaaaatctcaactggtaa

SEQ ID NO: 270152 - DNA, 75 bp, Artificial Sequence
  Synthetic
ctagtgtcttcaagtgttttgccaacaaggtcgctacacgaactcagagggccgctaaggaggttgtggaatggt

SEQ ID NO: 270153 - DNA, 75 bp, Artificial Sequence
  Synthetic
ttagcagtaaaatcaaatcaatgttgagttttgtggaaagaaataaggcttggctcaccgttgtatcagctgtta

SEQ ID NO: 270154 - DNA, 75 bp, Artificial Sequence
  Synthetic
gatttatcagacaccatgttactactcaggccttgcagttggaattaacccatataaagactggcacttcatgat

SEQ ID NO: 270155 - DNA, 75 bp, Artificial Sequence
  Synthetic
ctagtgcagttagcattttacttctagttaccaaaatttttaagaaggaagagtcaaaagatgaaagggcctata

SEQ ID NO: 270156 - DNA, 75 bp, Artificial Sequence
  Synthetic
atccaactctaccagtggttaaacctaaggggactttcccagtatctcaaagagagttcaagaatgaagcacctt

SEQ ID NO: 270157 - DNA, 75 bp, Artificial Sequence
  Synthetic
atgatggccagttggaacatattatttcacaaatggcctatattacaggttcaaccactggccacttgacacatt

SEQ ID NO: 270158 - DNA, 75 bp, Artificial Sequence
  Synthetic
gtgctggttatcaacatgatgagattatcttgcatggtcattccattaaataccttgagcaagaggaagaactca

SEQ ID NO: 270159 - DNA, 75 bp, Artificial Sequence
  Synthetic
catcaggctccccatgcaccactgtgctaaattcaatatgtaacttgatgatgtgcatctacactacaaatttaa

SEQ ID NO: 270160 - DNA, 75 bp, Artificial Sequence
  Synthetic
cactgcattttaaaaacaaagttttcccaattgagcaaccatctgtaacacaggttacacttagtggaaaaccaa

SEQ ID NO: 270161 - DNA, 75 bp, Artificial Sequence
  Synthetic
ttagcccaggaattgattgcttaccaattgtttatggtgatgatgtcatcttgtcacttgataaagaaatagacc

SEQ ID NO: 270162 - DNA, 75 bp, Artificial Sequence
  Synthetic
tggacttggccattctaaaatgtaagttaccatttagatttaaaaagaattcaaaatactatactaataagatag

SEQ ID NO: 270163 - DNA, 75 bp, Artificial Sequence
  Synthetic
gtactgaaagtatgttaatttggatgactgagcaaggtataatcactaaggaggttcaaagagtacaccattctg

SEQ ID NO: 270164 - DNA, 75 bp, Artificial Sequence
  Synthetic
ggttcccgcaaggatgaacctccatcattaaaacctagattggaggttgagttccttaaacgtaaacccggttat

SEQ ID NO: 270165 - DNA, 75 bp, Artificial Sequence
  Synthetic
gtgggattaagactagagagggaaccgaaagcactaaaactattagttatactgtgaaatcttgcaaaggtatgt

SEQ ID NO: 270166 - DNA, 75 bp, Artificial Sequence
  Synthetic
gtggggggctcctcatttcaaaagtggaaggcaatttcaaaattttgggaatgcatattgctggaaatggggaga

SEQ ID NO: 270167 - DNA, 75 bp, Artificial Sequence
  Synthetic
tgggagtagctattccctttaattttcttaaaaatgacttatcagaccaagggataattaccgaaatcacaccaa

SEQ ID NO: 270168 - DNA, 75 bp, Artificial Sequence
  Synthetic
tacatcaaaattttggatccttacttgaaagaatggaatatcactgtggatgattatgatgttgtaattgctagg

SEQ ID NO: 270169 - DNA, 75 bp, Artificial Sequence
  Synthetic
ttgatgcccatggtgtttgactaaaattaatgttttggtttttctttgttatggactatattattagaacactaa

SEQ ID NO: 270170 - DNA, 75 bp, Artificial Sequence
  Synthetic
tacagccaatgtacataaacactaaaactcagatacataaaagtcctgtatatggagcagttgaagtaagaatgg

SEQ ID NO: 270171 - DNA, 75 bp, Artificial Sequence
  Synthetic
gcccagccgttctaagtaaatctgatactagactggaggaacctgtgaactgtctcattaaaaagtcagcttcaa

SEQ ID NO: 270172 - DNA, 75 bp, Artificial Sequence
  Synthetic
ctatattattagaacactaatataattagaacactaatttggaatatgggacataccaaaaaaaaaaaaaaaaaa

SEQ ID NO: 270173 - DNA, 75 bp, Artificial Sequence
  Synthetic
tttgaaaggggtctcctagaaagcttggccgtcgggccttataccccgacttgccgagtttctctaggagagtcc

SEQ ID NO: 270174 - DNA, 75 bp, Artificial Sequence
  Synthetic
ttgccgagtttctctaggagagtccctttcccagccctgaggcggctggtcaataaaagcctcaaacgtaactaa

SEQ ID NO: 270175 - DNA, 75 bp, Artificial Sequence
  Synthetic
agtatagggtcaacaaattccatgtaaataatgaactttggcaaggtgttaaagcatgtgttaaatctaagttca

SEQ ID NO: 270176 - DNA, 75 bp, Artificial Sequence
  Synthetic
gagaaatttttggagttaatggagttgtggacatgaaaacagcaattttgggaacatcacatgtcaattcaatgg

SEQ ID NO: 270177 - DNA, 75 bp, Artificial Sequence
  Synthetic
acttgagtacatcagctggatacagttttgtcaaatctgggtacaagaagaaagacctaatttgtttggaaccat

SEQ ID NO: 270178 - DNA, 75 bp, Artificial Sequence
  Synthetic
aaggatgcttaaagcatggcgtaaatattcttttctaacccatgatttcatggggtggcagatggcgtgccataa

SEQ ID NO: 270179 - DNA, 75 bp, Artificial Sequence
  Synthetic
tctcagttgctccaatgttagagaaacttgtgcaggataaattccataacttattaaaagggaatcagatcacca

SEQ ID NO: 270180 - DNA, 75 bp, Artificial Sequence
  Synthetic
caatttttaatacttgtcttaaagatgagttgagaaagcttgacaagatcgcttcagggaaaactaggtgcatag

SEQ ID NO: 270181 - DNA, 75 bp, Artificial Sequence
  Synthetic
ctgccagcggattcacacctggtaacaggtgcccctggggccaaaagccaaggtttaacagaccctttaggattg

SEQ ID NO: 270182 - DNA, 75 bp, Artificial Sequence
  Synthetic
aagcctgtgaagttgattactgcattgtatacagaatgattatgatggaaatttatgacaaaatctaccagaccc

SEQ ID NO: 270183 - DNA, 75 bp, Artificial Sequence
  Synthetic
cctgttattactctggccttgcggttggaattaatccttacagggattggcacttcatgatcaatgcacttaatg

SEQ ID NO: 270184 - DNA, 75 bp, Artificial Sequence
  Synthetic
attacaactatgaaatggactactcccaatatgatggctcacttagttcaatgttgttgtgggaagctgtagagg

SEQ ID NO: 270185 - DNA, 75 bp, Artificial Sequence
  Synthetic
tcatggtgagttggttaaaaaacgtctagtgggccagacccaggggggatccctggtttccttttttatttcact

SEQ ID NO: 270186 - DNA, 75 bp, Artificial Sequence
  Synthetic
tcttatcttactgtcatgattcacctgatctcgtgatgcaactacacaaaccagtcattgactctgaccatgtag

SEQ ID NO: 270187 - DNA, 75 bp, Artificial Sequence
  Synthetic
tttttaatgagagatggttaattcatggtggtatgccatcaggttccccatgcaccactgttttaaattcattgt

SEQ ID NO: 270188 - DNA, 75 bp, Artificial Sequence
  Synthetic
gcattgcagacatggccactggtatcacaaaaactgttgactccacaattaactcagtaaatgagacaattggca

SEQ ID NO: 270189 - DNA, 75 bp, Artificial Sequence
  Synthetic
gcaatttgatgatgtgcatttacaccacaaatttaattagtcctgggattgattgcttaccaattgtttatggag

SEQ ID NO: 270190 - DNA, 75 bp, Artificial Sequence
  Synthetic
acacagacaatgcatcaggcggcgatattttgaccagagtcgcagatgatgcatctaatgtattagggcctaatt

SEQ ID NO: 270191 - DNA, 75 bp, Artificial Sequence
  Synthetic
tattttgaccagagtcgcagatgatgcatctaatgtattagggcctaattgctatgccacgacatctgagccagc

SEQ ID NO: 270192 - DNA, 75 bp, Artificial Sequence
  Synthetic
atgatgttattctttcactggacaaagagattgaaccagagaaactgcaaagtatcatggcagattcatttggag

SEQ ID NO: 270193 - DNA, 75 bp, Artificial Sequence
  Synthetic
aaataaggatgtggtacaggcaacaactactgttaacactacaaatttaacccaacacccatcagcaccaactat

SEQ ID NO: 270194 - DNA, 75 bp, Artificial Sequence
  Synthetic
atggaggttgagttcttgaaaaggaaacctggttactttccagagtctacttttatagtaggtaagttagacact

SEQ ID NO: 270195 - DNA, 75 bp, Artificial Sequence
  Synthetic
gaaaatatgatacaacatttaatgtggatgaaaaatttcagcacgtttaagcagcagctccaatcctacttaatg

SEQ ID NO: 270196 - DNA, 75 bp, Artificial Sequence
  Synthetic
ggatgaaaaatttcagcacgtttaagcagcagctccaatcctacttaatggaactatgcctccatggaaaagaca

SEQ ID NO: 270197 - DNA, 75 bp, Artificial Sequence
  Synthetic
gaactatgcctccatggaaaagacacctaccagcactacattaaaatcttggaaccgtatctacaggagtggaat

SEQ ID NO: 270198 - DNA, 75 bp, Artificial Sequence
  Synthetic
atgcggtttccatttccaagtacaaattaatgtgaatcaaggtgctgcaggaagtgctctggtggtttatatgcc

SEQ ID NO: 270199 - DNA, 75 bp, Artificial Sequence
  Synthetic
attactgtggatgattatgatgtggttattactaggttgatgcccatggtgtttgactaaaatgaatgttttggt

SEQ ID NO: 270200 - DNA, 75 bp, Artificial Sequence
  Synthetic
attaatgtgaatcaaggtgctgcaggaagtgctctggtggtttatatgccaaagccagttgtggaccatgagaca

SEQ ID NO: 270201 - DNA, 75 bp, Artificial Sequence
  Synthetic
tttcttttgatatggactgtgtacttagaatactaattaattagaacactaatttggaacattggacataacaaa

SEQ ID NO: 270202 - DNA, 75 bp, Artificial Sequence
  Synthetic
acttagaatactaattaattagaacactaatttggaacattggacataacaaaaaaaaaaaaaaaaaaaaaaaaa

SEQ ID NO: 270203 - DNA, 75 bp, Artificial Sequence
  Synthetic
taccccgacttgctgagcttctctaggagagcccctttcccagccctgaggcggctggtcaataaaagcctcaca

SEQ ID NO: 270204 - DNA, 75 bp, Artificial Sequence
  Synthetic
cgtaactaacatctaagacaatcttatacaaccttgtgcctggtccccaccagtcgaaggcatctagcaataaga

SEQ ID NO: 270205 - DNA, 75 bp, Artificial Sequence
  Synthetic
tggacgcccctttctatgccaacgggaataacaacacaggtggatgtgactgttctgggtagcttgttacaactt

SEQ ID NO: 270206 - DNA, 75 bp, Artificial Sequence
  Synthetic
gaataacaacacaggtggatgtgactgttctgggtagcttgttacaacttgatttccagaaccctaggccttaca

SEQ ID NO: 270207 - DNA, 75 bp, Artificial Sequence
  Synthetic
taggtggaacaaggacgcttaaagcacaaagacaattaacttttctaactcacaatttgttgtggggtggtagat

SEQ ID NO: 270208 - DNA, 75 bp, Artificial Sequence
  Synthetic
ataaacaagtcaatatttatgataatgggcccacaaagatgattagtaaaaagaaaatcttaacaatgagcacaa

SEQ ID NO: 270209 - DNA, 75 bp, Artificial Sequence
  Synthetic
ggcgtaccataattctattagtgagataccacgcttgtggaccttatgctcatacagccatcctctagtaagttt

SEQ ID NO: 270210 - DNA, 75 bp, Artificial Sequence
  Synthetic
aagaaaatcttaacaatgagcacaaaatataaatggacgcggaacaaatttgatattgcagagggacctggttca

SEQ ID NO: 270211 - DNA, 75 bp, Artificial Sequence
  Synthetic
tgatattgcagagggacctggttcaatgaacatggcaaatgtattaagtacaactggagcccagtcggttgccct

SEQ ID NO: 270212 - DNA, 75 bp, Artificial Sequence
  Synthetic
gtaaggtgtctggtgatgtgtgggaacttattggaaacaacattttgccgcaaggcatccattagccagcggaat

SEQ ID NO: 270213 - DNA, 75 bp, Artificial Sequence
  Synthetic
aacacctggtaacaggtgcctctggggccaaaagccaaggtttaacagaccctaatggattgatttaaatctgga

SEQ ID NO: 270214 - DNA, 75 bp, Artificial Sequence
  Synthetic
ggccaaaagccaaggtttaacagaccctaatggattgatttaaatctggaatgttgtggaatatatttagtacct

SEQ ID NO: 270215 - DNA, 75 bp, Artificial Sequence
  Synthetic
ggcacgatgccaagggttatttcaaatggtctgctataactaatcccatgtatatcgtccacagaaatatagtgt

SEQ ID NO: 270216 - DNA, 75 bp, Artificial Sequence
  Synthetic
tggatacctctatcttggtgatccagttaaaaaacgtctagtgggccaaacccaggggggatccctggtttcctt

SEQ ID NO: 270217 - DNA, 75 bp, Artificial Sequence
  Synthetic
ttattttattactgccattatggagacaatcaagaatattgcagacatggccactggttttactaacacaattga

SEQ ID NO: 270218 - DNA, 75 bp, Artificial Sequence
  Synthetic
ttcaactgttaatgctgtgactgaaggagtgtccaaaattggaaatgattcaggtggtgagattcttacaaaggt

SEQ ID NO: 270219 - DNA, 75 bp, Artificial Sequence
  Synthetic
cactatttgtgatattggtagtgacaacagttttgaaataacaataccctattctttttctacttggatgcggaa

SEQ ID NO: 270220 - DNA, 75 bp, Artificial Sequence
  Synthetic
agctgacgatgcttcaaatcttctcggaccaaattgtgtggcatccacctcacaacctgaaaataaggatgtggt

SEQ ID NO: 270221 - DNA, 75 bp, Artificial Sequence
  Synthetic
tgacttataatagttccagtcctagtgaagttttctgcattttgcaaggtagaatgggagaagatgccaaatttt

SEQ ID NO: 270222 - DNA, 75 bp, Artificial Sequence
  Synthetic
ccaggcgactaccacagtaaacactacaaacttgacacaacacccttctgctcccactatgcctttcactcctga

SEQ ID NO: 270223 - DNA, 75 bp, Artificial Sequence
  Synthetic
agaatgggagaagatgccaaatttttctgccctactggctccatagttacattccagaactcttggggctcacag

SEQ ID NO: 270224 - DNA, 75 bp, Artificial Sequence
  Synthetic
cttttctaatgttaatgttttccactccatggcctatgatgtaaccactggtgataagaaccctagtaaactaat

SEQ ID NO: 270225 - DNA, 75 bp, Artificial Sequence
  Synthetic
atgggcctcagcgacccattgtgtatcgaggatgatgctgaaaactgtaaacaaacaatatccccaaatgaattg

SEQ ID NO: 270226 - DNA, 75 bp, Artificial Sequence
  Synthetic
caggctagatactacaacatggcaacacacatggcctagacaacacttgataaataatgtagaattacctaaggc

SEQ ID NO: 270227 - DNA, 75 bp, Artificial Sequence
  Synthetic
tttttgggacaaaaatagtaaaccagcatatggacaatccaggtactttgcagctgtgagatgtggatttcattt

SEQ ID NO: 270228 - DNA, 75 bp, Artificial Sequence
  Synthetic
ttactttctaaattttagaactatgaatgtggacattttcacggtatctcatacaaaagtggacaatatatttgg

SEQ ID NO: 270229 - DNA, 75 bp, Artificial Sequence
  Synthetic
ccaagtgcaaattaatgtcaatcaaggaacagccggttgtgcactagtagtatatgaacccaagccaatagtaac

SEQ ID NO: 270230 - DNA, 75 bp, Artificial Sequence
  Synthetic
tcgcgcctggtttgtgacaagccatgattttaacaatgagggacaatggcccttaaatttgacttttccatttga

SEQ ID NO: 270231 - DNA, 75 bp, Artificial Sequence
  Synthetic
ccatggtagtcatttagaatttggatcatacactaacttaccacatgtattgatgaatttagctgaaaccacaca

SEQ ID NO: 270232 - DNA, 75 bp, Artificial Sequence
  Synthetic
aggtcatggctctttatcattattgtttgcatatttcactggagaactaaatatacatgttctattcttgtcagg

SEQ ID NO: 270233 - DNA, 75 bp, Artificial Sequence
  Synthetic
ggctgacttatgcatcccctatgtttctgatacaaactatgtcaagactgattcatcagacttagggcgtttacg

SEQ ID NO: 270234 - DNA, 75 bp, Artificial Sequence
  Synthetic
atatacatgttctattcttgtcaggcaaaggctttttgagggttgtacacacttatgacactgctgataatagat

SEQ ID NO: 270235 - DNA, 75 bp, Artificial Sequence
  Synthetic
attcatcagacttagggcgtttacgggtttatgtttggactccactaacaattccatctagtgcaactaatgatg

SEQ ID NO: 270236 - DNA, 75 bp, Artificial Sequence
  Synthetic
taactaacttggcctctaatggcgtgatcaccataccagctggagaacaaatgtcattatcagcccctttctatt

SEQ ID NO: 270237 - DNA, 75 bp, Artificial Sequence
  Synthetic
gatcaccataccagctggagaacaaatgtcattatcagcccctttctattctcacaagccattgaggacggttag

SEQ ID NO: 270238 - DNA, 75 bp, Artificial Sequence
  Synthetic
atgtcattatcagcccctttctattctcacaagccattgaggacggttagggacactcacagcttgggtaggctt

SEQ ID NO: 270239 - DNA, 75 bp, Artificial Sequence
  Synthetic
tggatgtgacagttctaggtagtttattacaacttgatttccaaaatccaagaacttatgacacagatgtgaaca

SEQ ID NO: 270240 - DNA, 75 bp, Artificial Sequence
  Synthetic
tctatgacaataacccaccaagcacaaaagtaaaacttagtaaatcaaggttcactaagaaaattctgtccatgt

SEQ ID NO: 270241 - DNA, 75 bp, Artificial Sequence
  Synthetic
caactaaatacaaatggactaggaacaaaattgatattgctaagggtcctgggtcaatgaatatggcaaatgttt

SEQ ID NO: 270242 - DNA, 75 bp, Artificial Sequence
  Synthetic
acacaccacgctcgcaaagtcgtgctctacgaggtgatatggctaatttgacaaatcagagtccttatgaccagc

SEQ ID NO: 270243 - DNA, 75 bp, Artificial Sequence
  Synthetic
tctacgaggtgatatggctaatttgacaaatcagagtccttatgaccagcaaccccgaaatcaagtgatgaaatt

SEQ ID NO: 270244 - DNA, 75 bp, Artificial Sequence
  Synthetic
taagtacaacaggagcccagtcaatagccctagtaggtgaaagagctttttatgacccgcgaacagctggcagca

SEQ ID NO: 270245 - DNA, 75 bp, Artificial Sequence
  Synthetic
ggcttacctagatagaggcttctataagcactatggtattatagttggagagcatgtataccaattagattcaga

SEQ ID NO: 270246 - DNA, 75 bp, Artificial Sequence
  Synthetic
aatctagatttggagatatggttcacatagcccaattattctcagtgatgtcagatacaacaaccccttccacat

SEQ ID NO: 270247 - DNA, 75 bp, Artificial Sequence
  Synthetic
tgatatctttaaaacggcattaacaggaaaagccaaattcacaaagactagactgacatcagagtggatagttga

SEQ ID NO: 270248 - DNA, 75 bp, Artificial Sequence
  Synthetic
ctagtggaattgatgactttggctattttgattggtcagccacttacacaccacaacaagttatacatcgcaata

SEQ ID NO: 270249 - DNA, 75 bp, Artificial Sequence
  Synthetic
agaagaatgtgaactggattatttcagaatcaagtatcttgaatcagctgtaaattcagagcatatcttttcagt

SEQ ID NO: 270250 - DNA, 75 bp, Artificial Sequence
  Synthetic
ttgtgaagttgagtcagttttcaaatctaaaaccttttgtcaatgcatacacctactttaggggttcactggtgt

SEQ ID NO: 270251 - DNA, 75 bp, Artificial Sequence
  Synthetic
aaggatatttttggaacacataccctgagccaacaccaagctattggcctaattggtactattctcttaactgct

SEQ ID NO: 270252 - DNA, 75 bp, Artificial Sequence
  Synthetic
tgagaatgtcagtctatgccagcactttcaaccgaggccggctgcgcatggggttttttccaaattttacaacca

SEQ ID NO: 270253 - DNA, 75 bp, Artificial Sequence
  Synthetic
atacaacatctgaaatggataatgctatatacactatttgtgacattggatctgacaatagctttgaaataacca

SEQ ID NO: 270254 - DNA, 75 bp, Artificial Sequence
  Synthetic
gggctcatgtcaactattaaaaccccagtcaatacaaccaccattaaagagttcttcaatcatgcgatagaaggt

SEQ ID NO: 270255 - DNA, 75 bp, Artificial Sequence
  Synthetic
cagtcaatacaaccaccattaaagagttcttcaatcatgcgatagaaggtgatgaacagggactatctcttctag

SEQ ID NO: 270256 - DNA, 75 bp, Artificial Sequence
  Synthetic
taccctatactttctcaacttggatgaggaaaactaacgggagacctattggactttttcaagttgaagttttaa

SEQ ID NO: 270257 - DNA, 75 bp, Artificial Sequence
  Synthetic
tgcaaaaatgtactacttttttctcttctgctgctacagaaatattagacaatgatttggttaaatttataatta

SEQ ID NO: 270258 - DNA, 75 bp, Artificial Sequence
  Synthetic
ataggttaacttacaatagttcatgccccaacaaagtacattgtattgtgcaagggagacttgggaatgacgcaa

SEQ ID NO: 270259 - DNA, 75 bp, Artificial Sequence
  Synthetic
gattttattgccctacggggtccttagtggaatttcaaaactcgtggggttcccaaatggacttgtctgaccctc

SEQ ID NO: 270260 - DNA, 75 bp, Artificial Sequence
  Synthetic
tgcacatggagggtgatgaagctgaggattgtaaacaaactatatcccctgatgaactaggtctaacctcagcac

SEQ ID NO: 270261 - DNA, 75 bp, Artificial Sequence
  Synthetic
aagatgatgggccccttggggtagagaaaccaaattattttctaaactttagagcaatcaatgtagacatcttta

SEQ ID NO: 270262 - DNA, 75 bp, Artificial Sequence
  Synthetic
aatacagatgatgatgaaattaaggaacagatttgtgatacagtcaaatatactaagactatcttatcaaaccag

SEQ ID NO: 270263 - DNA, 75 bp, Artificial Sequence
  Synthetic
ctgttagtcatactaagatagataacatctttggccgtgcatggttggcccttgagcatacatttgcagatgatg

SEQ ID NO: 270264 - DNA, 75 bp, Artificial Sequence
  Synthetic
gggccgttcaaagggtttaatgaagtttctacagctttcagacatatagattggtggattcacacattactcaaa

SEQ ID NO: 270265 - DNA, 75 bp, Artificial Sequence
  Synthetic
ttggtggattcacacattactcaaaatcaaagacatggttcttagtgtgttcaagccaagtctagagagtaaggc

SEQ ID NO: 270266 - DNA, 75 bp, Artificial Sequence
  Synthetic
gaacatggagggcagacttgaattttcccactcaaggccatggcactctgacaagacttttcacatattactctg

SEQ ID NO: 270267 - DNA, 75 bp, Artificial Sequence
  Synthetic
gcgaattgaatgtgcatgtgctgtatcttagtgataatgggttcctccgggtgactcatgcctatgaccatgata

SEQ ID NO: 270268 - DNA, 75 bp, Artificial Sequence
  Synthetic
atgataggtccaacttcctgtcatctaatggggtaatcacagtgccagcaggggagcaaatgacactctctgttc

SEQ ID NO: 270269 - DNA, 75 bp, Artificial Sequence
  Synthetic
cattttattcttccaaaccacttaggactgtaagagaaaaaggtgcgctgggcaaattaatttgcaaaccactat

SEQ ID NO: 270270 - DNA, 75 bp, Artificial Sequence
  Synthetic
aatgatctaattagaattgagcccattggtatttggatccagggtgaaccaggacaagggaaatctttcttaacc

SEQ ID NO: 270271 - DNA, 75 bp, Artificial Sequence
  Synthetic
tatctggcacccactcggggaagattgaggtttatttgagtcttagatgccccaatttattcttcccttcccctg

SEQ ID NO: 270272 - DNA, 75 bp, Artificial Sequence
  Synthetic
cacaccctttctagacaattacaaaaatcatgtaaacttaatggggtttttacaaatccaactgctagtgagttt

SEQ ID NO: 270273 - DNA, 75 bp, Artificial Sequence
  Synthetic
cacctaaagagaaaacttctagaactctacggggtgacatggcaaatcttacaaatcagagtccatatagtcaac

SEQ ID NO: 270274 - DNA, 75 bp, Artificial Sequence
  Synthetic
atggacggttatgataaccaggatatacatttaattgatgacttgggccaaacaagaaaagagaaagatattgaa

SEQ ID NO: 270275 - DNA, 75 bp, Artificial Sequence
  Synthetic
aacagcaaacccaaatgatgaaattggcatacttagacagaggcttctacaaacactatggtatcatagttgggg

SEQ ID NO: 270276 - DNA, 75 bp, Artificial Sequence
  Synthetic
actatgtgtatcaactggactctgacgatattttcaaaaccgcactaacaggaaaagctaggtttaccaaaacaa

SEQ ID NO: 270277 - DNA, 75 bp, Artificial Sequence
  Synthetic
ggttaaccccagattggattgttgaagaagagtgtgagttagattactttagggttaagtaccttgagtcttcag

SEQ ID NO: 270278 - DNA, 75 bp, Artificial Sequence
  Synthetic
aagaggagattcccttacattatgcatatccgggctgcaaaggcttacagtaaggctgggaagcttaatgtaagt

SEQ ID NO: 270279 - DNA, 75 bp, Artificial Sequence
  Synthetic
tgaactctgaacacatattcacagtaaactcgaactgtgagacactcgctaaagacatttttggaacccatactc

SEQ ID NO: 270280 - DNA, 75 bp, Artificial Sequence
  Synthetic
atatccgggctgcaaaggcttacagtaaggctgggaagcttaatgtaagtcaagctatggcagtaatgtcaacag

SEQ ID NO: 270281 - DNA, 75 bp, Artificial Sequence
  Synthetic
tcagccagcatcaagccattgggttagttggtactattctcttaacagctggtttgatgtcaactattaagactc

SEQ ID NO: 270282 - DNA, 75 bp, Artificial Sequence
  Synthetic
taaggctgggaagcttaatgtaagtcaagctatggcagtaatgtcaacaggtgagtgttgggaggtatcaaagaa

SEQ ID NO: 270283 - DNA, 75 bp, Artificial Sequence
  Synthetic
tggaagagattgggaaacactgaagttaaaagaattagttgataaaattgcaattgattataatgagagagtaaa

SEQ ID NO: 270284 - DNA, 75 bp, Artificial Sequence
  Synthetic
cagtgaatgctacaaccatcaaagaattctttaatcatgcagtcgatggcgatgaacagggcctgtccttacttg

SEQ ID NO: 270285 - DNA, 75 bp, Artificial Sequence
  Synthetic
tacaaaaatgtactacattcttttcttcagccgccaccgaaatcctagacaatgatttagttaagtttatagtca

SEQ ID NO: 270286 - DNA, 75 bp, Artificial Sequence
  Synthetic
ctagagaatcaaactttagatgatttagatgatgctgtatcatatatcaaacataatttcccagatgcaatacca

SEQ ID NO: 270287 - DNA, 75 bp, Artificial Sequence
  Synthetic
aaattcttgttaggatcctctgttacatggtattgtattgtcacaagccaaacattttaacaactgcatgcttgt

SEQ ID NO: 270288 - DNA, 75 bp, Artificial Sequence
  Synthetic
ggaagctttcatagagccaaagcctagtgtcttcaagtgttttgctaataagattggctcaaagatatctaaagc

SEQ ID NO: 270289 - DNA, 75 bp, Artificial Sequence
  Synthetic
ccacgttgctaataatggatgtgacttcttcatcagtactatcaccctcctgtaaggcgctcatgcagtgcctaa

SEQ ID NO: 270290 - DNA, 75 bp, Artificial Sequence
  Synthetic
tggatggtgatgtcaagaagttggcagaggttgtagcagagtctatgtccaacacagatgatgacgaaattaagg

SEQ ID NO: 270291 - DNA, 75 bp, Artificial Sequence
  Synthetic
gctttgttgagaggaacaaggcttggcttacagtagtttcagctgtcaccagtgccattagcatacttttgttag

SEQ ID NO: 270292 - DNA, 75 bp, Artificial Sequence
  Synthetic
gcttacagtagtttcagctgtcaccagtgccattagcatacttttgttagtgactaaaatctttaagaaggaaga

SEQ ID NO: 270293 - DNA, 75 bp, Artificial Sequence
  Synthetic
aacaaatttgtgacacagtaaaatacacaaaaactattttgtcaaaccagggccccttcaaaggttttaatgagg

SEQ ID NO: 270294 - DNA, 75 bp, Artificial Sequence
  Synthetic
tttcaacagcattcagacacatcgactggtggattcacacactcttgaagattaaagatatggttcttagtgttt

SEQ ID NO: 270295 - DNA, 75 bp, Artificial Sequence
  Synthetic
ttaagcccagcattgagagtaaagcaattcagtggttggaaagaaataaggaacatgtatgttccatccttgatt

SEQ ID NO: 270296 - DNA, 75 bp, Artificial Sequence
  Synthetic
aactactggccatttaacacattgtgctggttaccaacatgatgagataatactccatggccattctattaagta

SEQ ID NO: 270297 - DNA, 75 bp, Artificial Sequence
  Synthetic
acgcatcagatataatagtggagtcaaaagatcaatcaaagatgaaaactcaagaattctaccagagatattctg

SEQ ID NO: 270298 - DNA, 75 bp, Artificial Sequence
  Synthetic
tttagagcaagaagaggaactgacactacactataagaataaagttttcccaattgaacaaccctcagttaccca

SEQ ID NO: 270299 - DNA, 75 bp, Artificial Sequence
  Synthetic
attgcttggccaaattcaaaccaattatggccatctgcttcagaagttgccataatagtgttagtaatactgtgt

SEQ ID NO: 270300 - DNA, 75 bp, Artificial Sequence
  Synthetic
caattgaacaaccctcagttacccaagtcacacttggtggaaaaccaatggatctggctattctaaaatgtaagt

SEQ ID NO: 270301 - DNA, 75 bp, Artificial Sequence
  Synthetic
atagactctttcaagaattggccagaattcccaatagaattagtactcaaaatgatttaattagagttgaaccaa

SEQ ID NO: 270302 - DNA, 75 bp, Artificial Sequence
  Synthetic
ttggtgtttggatacaaggagaacctggacaaggtaaatcatttttgacacacacattatctaggcaacttcaaa

SEQ ID NO: 270303 - DNA, 75 bp, Artificial Sequence
  Synthetic
ggcatcaaaacccgggaggggactgaaagcacaaaaacaattagctacacagtaaaatcctgtaaaggtatgtgt

SEQ ID NO: 270304 - DNA, 75 bp, Artificial Sequence
  Synthetic
aatcttgtgaattgaacggagtatatacaaatccaacagctagtgagtttatggatggctatgacaatcaggaca

SEQ ID NO: 270305 - DNA, 75 bp, Artificial Sequence
  Synthetic
tccatttaattgatgacttaggtcagactagaaaagaaaaagatattgaaatgctttgcaactgcatatcctcag

SEQ ID NO: 270306 - DNA, 75 bp, Artificial Sequence
  Synthetic
tccctttcattgtgccaatggcacatcttgaagaaaaaggcaaattttacactagcaagttggttattgccacca

SEQ ID NO: 270307 - DNA, 75 bp, Artificial Sequence
  Synthetic
ggtgttgccatccctttcaattttcttaagaatgatatgtctgaccaaggcattatcacagatgtgacacccata

SEQ ID NO: 270308 - DNA, 75 bp, Artificial Sequence
  Synthetic
cattatcacagatgtgacacccatacagcccatgtacatcaatactaaaacccaaattcacaagagtccagtcta

SEQ ID NO: 270309 - DNA, 75 bp, Artificial Sequence
  Synthetic
ctaataaatcagacttctcaagcacagtgctacaagattctggtgcgttgaagaggcgatttccatacatcatgc

SEQ ID NO: 270310 - DNA, 75 bp, Artificial Sequence
  Synthetic
tggtgcagtggaagtcaaaatgggcccagcagttctaagcaaatcagaccctagacttgaagagccagttgagtg

SEQ ID NO: 270311 - DNA, 75 bp, Artificial Sequence
  Synthetic
acattagagctgctaaggcctacagcaaggctggcaagttaaatgttagtcaggcaatgtcaactatgtcaactg

SEQ ID NO: 270312 - DNA, 75 bp, Artificial Sequence
  Synthetic
gcgagtgctgggaagtatctaagaatggtagagattgggaaactctaaaactcaatgatttagttaagaaaataa

SEQ ID NO: 270313 - DNA, 75 bp, Artificial Sequence
  Synthetic
ctgaagactatgaagagagacagaaaaattatagctgttggaaacaacaattagacaatcagtctctagatgatt

SEQ ID NO: 270314 - DNA, 75 bp, Artificial Sequence
  Synthetic
tggatgatgcagtttcatacataaagcacaacttcccagatgctgttccttacatagatgaatacttgaacattg

SEQ ID NO: 270315 - DNA, 75 bp, Artificial Sequence
  Synthetic
agatttgatatgtttagagccattttctgtgtcaccaatgcttgagaaactggtccaggacaaattccataatct

SEQ ID NO: 270316 - DNA, 75 bp, Artificial Sequence
  Synthetic
agatgtcaacattgattgagcaaatggaagctttcattgaaccaaagccaagtgtttttaaatgctttgcaaata

SEQ ID NO: 270317 - DNA, 75 bp, Artificial Sequence
  Synthetic
aagtagtctcaaacacaaggaaagctgcaaaagaggtagttgaatggttttcaaataaaattaaatctatgctga

SEQ ID NO: 270318 - DNA, 75 bp, Artificial Sequence
  Synthetic
gttttgttgagaggaacaaagcatggctgactgtagtttctgcagttacaagtgcaattagcatactgcttctgg

SEQ ID NO: 270319 - DNA, 75 bp, Artificial Sequence
  Synthetic
atatgacaaaatatatcaaacaccctgttactactcagggcttgctgtgggtattaacccatacaaagattggca

SEQ ID NO: 270320 - DNA, 75 bp, Artificial Sequence
  Synthetic
tgaccaaaattttcaagaaagaggagtcaaaagatgagagagcttacaaccctacattaccagtggccaagccga

SEQ ID NO: 270321 - DNA, 75 bp, Artificial Sequence
  Synthetic
aaggtgcctttcctgtcacacaaagagagttcaagaatgaggctccatatgacggccagttagaacacatcattt

SEQ ID NO: 270322 - DNA, 75 bp, Artificial Sequence
  Synthetic
ctcagatggcttacattactggctcaaccacaggtcacttgactcattgtgctggttaccagcatgatgagataa

SEQ ID NO: 270323 - DNA, 75 bp, Artificial Sequence
  Synthetic
agtgattgactctgaccatattgtttttaatgagaggtggttaatccatggtgggatgccatcaggttccccatg

SEQ ID NO: 270324 - DNA, 75 bp, Artificial Sequence
  Synthetic
tactacatggacattcaattaaatatttggagcaggaagatgagttgacattacactacaaaaataaggtcttcc

SEQ ID NO: 270325 - DNA, 75 bp, Artificial Sequence
  Synthetic
tactacagtgcttaactcattatgcaatttgatgatgtgtatttacactacaaatttgatcagcccaggaattga

SEQ ID NO: 270326 - DNA, 75 bp, Artificial Sequence
  Synthetic
caattgagcaaccatctgttactcaggtgacacttggtggtaaacctatggatttggctattttaaaatgtaaat

SEQ ID NO: 270327 - DNA, 75 bp, Artificial Sequence
  Synthetic
aatttgatgatgtgtatttacactacaaatttgatcagcccaggaattgattgcctacccatagtttatggtgat

SEQ ID NO: 270328 - DNA, 75 bp, Artificial Sequence
  Synthetic
tgccattcagatttaagaaaaattccaagtattacgcaaacaagattggaactgagagtatgttgatttggatga

SEQ ID NO: 270329 - DNA, 75 bp, Artificial Sequence
  Synthetic
ctgaacaaggtattatcacaaaagaggtccagagagtgcaccattctggtagcattaaaactagagaaggaactg

SEQ ID NO: 270330 - DNA, 75 bp, Artificial Sequence
  Synthetic
aaagcaccaggaccatcagctacacagtgaaatcttgcaaaggtatgtgtggcggacttttaatctcaaaagtgg

SEQ ID NO: 270331 - DNA, 75 bp, Artificial Sequence
  Synthetic
aaggcaatttcaaaattcttggcatgcacattgctggtaacggtgagatgggcgtagccatccccttcaactttc

SEQ ID NO: 270332 - DNA, 75 bp, Artificial Sequence
  Synthetic
ttaagaatgacatgtctgaccaggggatcgtaactgatattatacccatacagccaatgtacattaacaccaagt

SEQ ID NO: 270333 - DNA, 75 bp, Artificial Sequence
  Synthetic
atccatacctcaaagaatggaacattattgtggatgattatgatgtggtaattgctaaattgatgcccatggtgt

SEQ ID NO: 270334 - DNA, 75 bp, Artificial Sequence
  Synthetic
tattgtggatgattatgatgtggtaattgctaaattgatgcccatggtgtttgattaaaaattgaagttttggtt

SEQ ID NO: 270335 - DNA, 75 bp, Artificial Sequence
  Synthetic
cccaaattcacaagagtccagtttatggtgctgtggaagtccaaatgggtccagctgtgctaagtagatcggaca

SEQ ID NO: 270336 - DNA, 75 bp, Artificial Sequence
  Synthetic
ccagactagaggaaccagtggaatgcttaatcaagaagtctgctgcaaaatatagagtgaacaaatttcaagtca

SEQ ID NO: 270337 - DNA, 75 bp, Artificial Sequence
  Synthetic
acaatgaactatggcaaggagttaaggcctgtgtcaaatcaaaatttagagaaatatttggtgttaatggcattg

SEQ ID NO: 270338 - DNA, 75 bp, Artificial Sequence
  Synthetic
gggtgtggtggcctcactctatctaggtgagttggttaaaaaacgtctagtgggccaaacccaggggggatccct

SEQ ID NO: 270339 - DNA, 75 bp, Artificial Sequence
  Synthetic
ggtgagttggttaaaaaacgtctagtgggccaaacccaggggggatccctggcttcctttttttaatttgagtaa

SEQ ID NO: 270340 - DNA, 75 bp, Artificial Sequence
  Synthetic
ttgacatgaagacagctattttgggaacttcccatgtcaattctatggatcttagcacctcagctgggtattcat

SEQ ID NO: 270341 - DNA, 75 bp, Artificial Sequence
  Synthetic
ttgtcaaatctgggtataaaaagaaagacttgatttgtttagagccgttctcagtcagcccagttctagagaaat

SEQ ID NO: 270342 - DNA, 75 bp, Artificial Sequence
  Synthetic
tggtacaagaaaaattccacaatcttttaaaaggaaatgaaattactacaatctttaacacatgtcttaaggatg

SEQ ID NO: 270343 - DNA, 75 bp, Artificial Sequence
  Synthetic
aattgagaaaactagacaaaattgctgctggtaagaccagatgcattgaagcttgtgaagtggattactgcattg

SEQ ID NO: 270344 - DNA, 75 bp, Artificial Sequence
  Synthetic
tgtacaggatgatcatgatggaaatttatgacaaaatttataagactccctgttattattctggattggcagttg

SEQ ID NO: 270345 - DNA, 75 bp, Artificial Sequence
  Synthetic
agtaagcttattagactagatacagcttcatggcagactagttattctaggcagtacaaaataaccaccgtggaa

SEQ ID NO: 270346 - DNA, 75 bp, Artificial Sequence
  Synthetic
gaattaacccatacaaggattggcattttatgatcaacgctctcaatgattacaattatgaaatggactactcac

SEQ ID NO: 270347 - DNA, 75 bp, Artificial Sequence
  Synthetic
cttcatggcagactagttattctaggcagtacaaaataaccaccgtggaattgccaaaatctttttgggatgata

SEQ ID NO: 270348 - DNA, 75 bp, Artificial Sequence
  Synthetic
aatatgatggttcacttagttcaatgttgctatgggaggcagtggaggttttagcttactgtcatgattcacctg

SEQ ID NO: 270349 - DNA, 75 bp, Artificial Sequence
  Synthetic
atctcgtgattcaactacacaaaccagtcatagattctgaccatgttgtttttaacgagagatggttgattcatg

SEQ ID NO: 270350 - DNA, 75 bp, Artificial Sequence
  Synthetic
gtggtatgccatcagggtctccatgtacaactgtgctaaactcgctatgcaacttaatgatgtgcatctacacca

SEQ ID NO: 270351 - DNA, 75 bp, Artificial Sequence
  Synthetic
caaatttgatcagtcctggagttgattgtttaccaattgtttatggagatgatgtaatcctctcattagacaaag

SEQ ID NO: 270352 - DNA, 75 bp, Artificial Sequence
  Synthetic
aaattgaaccagagaaactgcagcgtatcatggcagattcacttggagctgaagtgactgggtcacgcaaggatg

SEQ ID NO: 270353 - DNA, 75 bp, Artificial Sequence
  Synthetic
aacctccctcacttaaaccaagaatggaggttgaattcctaaagcgaaaacccggttatttcccagagtctactt

SEQ ID NO: 270354 - DNA, 75 bp, Artificial Sequence
  Synthetic
ttcaactaaatacaagtggacacgaaccaaagtcgacatagcagaagggcctgggaccatgaacatggccaatgt

SEQ ID NO: 270355 - DNA, 75 bp, Artificial Sequence
  Synthetic
atccctatctcaaggaatggaacattccagtggatgattatgaagtggttattactaagctgatgcccatggtgt

SEQ ID NO: 270356 - DNA, 75 bp, Artificial Sequence
  Synthetic
ggttttcttttgctatggactattcattagaacactaatttgattagaactctaatttggaatattggacataac

SEQ ID NO: 270357 - DNA, 75 bp, Artificial Sequence
  Synthetic
gcttggccgtcgggccttataccccgatttgctgagcttctctaggagagtccttttcccagccagaggtggctg

SEQ ID NO: 270358 - DNA, 75 bp, Artificial Sequence
  Synthetic
ggtggcagatggcgtgccataactctaatagtgagataccacgcttgtggaccttatgctcacacagccatcctc

SEQ ID NO: 270359 - DNA, 75 bp, Artificial Sequence
  Synthetic
agaaataaacattcatattctatacatggcagagcaggggtttcttagagtggctcacacatatgacactgaaga

SEQ ID NO: 270360 - DNA, 75 bp, Artificial Sequence
  Synthetic
acccatcagctccaactatcccgttcacaccagactttagaaatgtggacaactttcattcaatggcttatgata

SEQ ID NO: 270361 - DNA, 75 bp, Artificial Sequence
  Synthetic
taagcttataagactggacacagcttcatggcagactagttacactaggcagtacaaaataaccgctgtggaatt

SEQ ID NO: 270362 - DNA, 75 bp, Artificial Sequence
  Synthetic
gcacgggactactcggactactgcagaagtttatattagtttgaggtgccccaatttctttttccctgtaccggc

SEQ ID NO: 270363 - DNA, 75 bp, Artificial Sequence
  Synthetic
ttttacaagcactatggtattattgtaggagataatgtatatcaattggattcagatgacattttcaaaacagct

SEQ ID NO: 270364 - DNA, 75 bp, Artificial Sequence
  Synthetic
ttcagatgacattttcaaaacagctttaacagggaaagctaggtttactaggacaaaattgactccagactgggt

SEQ ID NO: 270365 - DNA, 75 bp, Artificial Sequence
  Synthetic
aagtagaaatttatgataatggaccaaataaggccagtactaatagatttaataagagaaaatttttgactgctt

SEQ ID NO: 270366 - DNA, 75 bp, Artificial Sequence
  Synthetic
tgagcacaacaggagcccaatctgtggctctagtgggtgaaagagcattttatgatcctagaactgcagggagca

SEQ ID NO: 270367 - DNA, 75 bp, Artificial Sequence
  Synthetic
ggctctagtgggtgaaagagcattttatgatcctagaactgcagggagcaaatctagatttgatgatatgatcaa

SEQ ID NO: 270368 - DNA, 75 bp, Artificial Sequence
  Synthetic
aatctagatttgatgatatgatcaaaatagcccaattattttcagttatgtcagacaacaccacaccttcaagta

SEQ ID NO: 270369 - DNA, 75 bp, Artificial Sequence
  Synthetic
aatagcccaattattttcagttatgtcagacaacaccacaccttcaagtagtagtggtatagacaaatatgggta

SEQ ID NO: 270370 - DNA, 75 bp, Artificial Sequence
  Synthetic
ttagactctctatttatgctagcactttcaacagagggaggttgaggatgggatttttccccaactgtactcatg

SEQ ID NO: 270371 - DNA, 75 bp, Artificial Sequence
  Synthetic
gaggaagacacatggccaccaattgggtttatttcaagttgaagtcttgaaccgtttgacctacaacagttctag

SEQ ID NO: 270372 - DNA, 75 bp, Artificial Sequence
  Synthetic
aaccaattggtgtttggatacaaggggaaccaggacaaggaaaatctttcctaacacacacactatccaggcagt

SEQ ID NO: 270373 - DNA, 75 bp, Artificial Sequence
  Synthetic
atgatgggcctttgggtaatgagaaaccaaattactttttaaacttcagaactatgaatgttgacatttttacag

SEQ ID NO: 270374 - DNA, 75 bp, Artificial Sequence
  Synthetic
accaaattactttttaaacttcagaactatgaatgttgacatttttacagttagtcataccaaagttgacaacat

SEQ ID NO: 270375 - DNA, 75 bp, Artificial Sequence
  Synthetic
attgaaatgttgtgtaattgtatttcctcagttccatttatagttccaatggcacatcttgaagagaaaggcaaa

SEQ ID NO: 270376 - DNA, 75 bp, Artificial Sequence
  Synthetic
ttttatactagcaaattggtaatagcaacaactaacaagtctgacttttcaagcacagtcttgcaagattctggt

SEQ ID NO: 270377 - DNA, 75 bp, Artificial Sequence
  Synthetic
ggcagagcaggggtttcttagagtggctcacacatatgatactgaagataataggaaaacattcttgtcttcaaa

SEQ ID NO: 270378 - DNA, 75 bp, Artificial Sequence
  Synthetic
ataggaaaacattcttgtcttcaaatggggtaataactatccctgctggtgagcagatgacactctcagtacctt

SEQ ID NO: 270379 - DNA, 75 bp, Artificial Sequence
  Synthetic
tttattcaaacaagcctctgaggacagtgcgccatgattcagcattaggttttcttatgtgtagaccaatgatgc

SEQ ID NO: 270380 - DNA, 75 bp, Artificial Sequence
  Synthetic
ccactggtgagtgttgggaagtgtcaaagaatggaagggactgggagacactaaaacttaaggacttagtccaga

SEQ ID NO: 270381 - DNA, 75 bp, Artificial Sequence
  Synthetic
tttcttatgtgtagaccaatgatgcacgggactactcgaaccactgcagaagtttacattagtttaaggtgtccc

SEQ ID NO: 270382 - DNA, 75 bp, Artificial Sequence
  Synthetic
agattacagaagattaccaggagagacagaagaactataattgttggaaacaacaacttgagaatcagactttag

SEQ ID NO: 270383 - DNA, 75 bp, Artificial Sequence
  Synthetic
aatttctttttccctgtaccggctcctaaaccaactggttcaagggccgctgcactttatgatgaaagcccctac

SEQ ID NO: 270384 - DNA, 75 bp, Artificial Sequence
  Synthetic
ctaaaccaactggttcaagggccgctgcactttatgatgaaagcccctacgtaccaactgataatagtaaaatgc

SEQ ID NO: 270385 - DNA, 75 bp, Artificial Sequence
  Synthetic
ttacaagcactatggtattattgtaggagacagtgtatatcaattggattcggatgacattttcaaaacagcttt

SEQ ID NO: 270386 - DNA, 75 bp, Artificial Sequence
  Synthetic
acaccagtcaatgctacaaccatcaaagaattctttaatcatgcattggaaggtgatgaacaggggctttcttta

SEQ ID NO: 270387 - DNA, 75 bp, Artificial Sequence
  Synthetic
cttgtgcaaaaatgtactaccttcttctcttcagcagccacagaaattttggataatgatttggttaaatttata

SEQ ID NO: 270388 - DNA, 75 bp, Artificial Sequence
  Synthetic
tctcttcagcagccacagaaattttggataatgatttggttaaatttatagtgaaaattcttgtcagaattctct

SEQ ID NO: 270389 - DNA, 75 bp, Artificial Sequence
  Synthetic
accaaatattttaactaccgcttgtttatctacactattaataatggatgtaacatcttcttcagtgttgtcgcc

SEQ ID NO: 270390 - DNA, 75 bp, Artificial Sequence
  Synthetic
gacacaagttacattgggtggtaaacccatggatatggctattcttaagtgtaaactacctttcaggttcaagaa

SEQ ID NO: 270391 - DNA, 75 bp, Artificial Sequence
  Synthetic
attgggacagagagtatgttgatttggatgactgaacaaggcattatcaccaaagaagttcaaagagttcaccac

SEQ ID NO: 270392 - DNA, 75 bp, Artificial Sequence
  Synthetic
ttacactgtgaagtcttgcaaaggtatgtgtggtggtctgcttatttctaaagtggaaggaaactttaaaattct

SEQ ID NO: 270393 - DNA, 75 bp, Artificial Sequence
  Synthetic
ttgattggtggatacacactttattgaaaataaaagatatggttttaagtgtattcaaacccagcatggagagta

SEQ ID NO: 270394 - DNA, 75 bp, Artificial Sequence
  Synthetic
tggaatgcacatagctggaaatggagaaatgggtgtggctattcctttcaattttcttaaaaatgacatgtcaga

SEQ ID NO: 270395 - DNA, 75 bp, Artificial Sequence
  Synthetic
attttcttaaaaatgacatgtcagaccaaggcatagtcacgggaattacatctatacagcccatgtacatcaata

SEQ ID NO: 270396 - DNA, 75 bp, Artificial Sequence
  Synthetic
ctaaaacacaaatccacaagagcccagtctatggagcagtggaagtcaaaatgggcccagcagttttaagcaaat

SEQ ID NO: 270397 - DNA, 75 bp, Artificial Sequence
  Synthetic
cagaccctaggcttgaagaacctgtcgagtgcctaatcaagaaatcagccgcaaagtatagagtcaataaatttc

SEQ ID NO: 270398 - DNA, 75 bp, Artificial Sequence
  Synthetic
atggatctgagtacttctgctgggtatagttttgtgaaatcaggttataaaaagaaagatctaatttgccttgag

SEQ ID NO: 270399 - DNA, 75 bp, Artificial Sequence
  Synthetic
tgtacaccaacccaacagctagtgagtttatggacgggtatgataaccaggacattcacctcattgatgatttgg

SEQ ID NO: 270400 - DNA, 75 bp, Artificial Sequence
  Synthetic
tgaaatgttatgtaattgcatctcctcagttccatttatagtcccaatggcacatcttgaggagaaaggcaaatt

SEQ ID NO: 270401 - DNA, 75 bp, Artificial Sequence
  Synthetic
acagtaaggctggaaaactcaatgtcagtcaggctatgtcaaccatggccaccggtgagtgctgggaagtttcaa

SEQ ID NO: 270402 - DNA, 75 bp, Artificial Sequence
  Synthetic
agaatggcagggactgggaaactctaaaattgaaggacctagtccagaagattacagaagactaccaggaaaggc

SEQ ID NO: 270403 - DNA, 75 bp, Artificial Sequence
  Synthetic
attacagaagactaccaggaaaggcagaagaattataattgctggaaacagcagttagagaatcaaactctagat

SEQ ID NO: 270404 - DNA, 75 bp, Artificial Sequence
  Synthetic
gaagtcttggcttattgtcatgattcacctgatcttgtcatgcaattacataaaccagtaatagattcagaccat

SEQ ID NO: 270405 - DNA, 75 bp, Artificial Sequence
  Synthetic
attgaaatgtcaacactaattgagcaaatggaagccttcattgaacctagacctagtgtttttaaatgttttgca

SEQ ID NO: 270406 - DNA, 75 bp, Artificial Sequence
  Synthetic
gttcagtagtaagatcaagttaatgttgagttttgtagaaagaaataaagcctggctaacagtagcttcagctgt

SEQ ID NO: 270407 - DNA, 75 bp, Artificial Sequence
  Synthetic
cctggctaacagtagcttcagctgtcaccagtgcaattagtatattgctcctggtgacaaaaatttttaagaagg

SEQ ID NO: 270408 - DNA, 75 bp, Artificial Sequence
  Synthetic
aggatgagcctccatcattaaaacccagaatggaggtggaattcttgaagcgtaagcctggttacttcccagagt

SEQ ID NO: 270409 - DNA, 75 bp, Artificial Sequence
  Synthetic
aagagtctaaagatgaaagagcatataatccaaccttaccagcagccaaacccaagggtactttcccagttactc

SEQ ID NO: 270410 - DNA, 75 bp, Artificial Sequence
  Synthetic
tcaagcagcaacttcaatcctacttaatggagttatgcctccatggaaaagacacttacttacactacatcaaaa

SEQ ID NO: 270411 - DNA, 75 bp, Artificial Sequence
  Synthetic
aacgagaatttaagaatgaagccccttatgatggacaattagaacatatcatctctcagatggcctatatcactg

SEQ ID NO: 270412 - DNA, 75 bp, Artificial Sequence
  Synthetic
ttatgatggacaattagaacatatcatctctcagatggcctatatcactggtgcaactactggccatttaacaca

SEQ ID NO: 270413 - DNA, 75 bp, Artificial Sequence
  Synthetic
agtacttagagcaggaggaaggactgacactacactacaagaataaagttttcccaattgaacaaccctcagtca

SEQ ID NO: 270414 - DNA, 75 bp, Artificial Sequence
  Synthetic
tttgttatggactatatcattagaacactaattcagttagaacactaatttggaatatgaacaaacacaaaaaaa

SEQ ID NO: 270415 - DNA, 75 bp, Artificial Sequence
  Synthetic
aatggatttggctattttaaaatgcaagttgccatttaggtttaagaaaaattccaaatattataccaataaaat

SEQ ID NO: 270416 - DNA, 75 bp, Artificial Sequence
  Synthetic
aagttgccatttaggtttaagaaaaattccaaatattataccaataaaattggaacagaaagtatgttgatctgg

SEQ ID NO: 270417 - DNA, 75 bp, Artificial Sequence
  Synthetic
caataaatgccttaaatgtaactaacacctaagattgctttaacaaccctatgcctggtctccactagttgaagg

SEQ ID NO: 270418 - DNA, 75 bp, Artificial Sequence
  Synthetic
atgactgagcagggcattataacaaaagaagtccaaagagttcaccattctggtggcatcaaaactcgggagggg

SEQ ID NO: 270419 - DNA, 75 bp, Artificial Sequence
  Synthetic
catctagcaataaaatgagtggaatcaagacgcttaaagcatagtgccagcatgcatttctaacctgcagttttt

SEQ ID NO: 270420 - DNA, 75 bp, Artificial Sequence
  Synthetic
gcagggtggcagatggcgtgccataattctattagtgagatactacgcttgtagatcttatgctcacacagccat

SEQ ID NO: 270421 - DNA, 75 bp, Artificial Sequence
  Synthetic
gaatgcacatagctggaaatggagaaatgggtgttgctattcctttcaattttctcaagaatgatatgtctgatc

SEQ ID NO: 270422 - DNA, 75 bp, Artificial Sequence
  Synthetic
cctctagtaagtttgtaagatgtctgatgacgtgtgggaacttattggaaataacaccttgctgtaaagcatctt

SEQ ID NO: 270423 - DNA, 75 bp, Artificial Sequence
  Synthetic
attgccagcggaacaacacctggtaacaggtgcctctggggccaaaagccaaggtttaacagaccctttaagatt

SEQ ID NO: 270424 - DNA, 75 bp, Artificial Sequence
  Synthetic
catacagcctatgtacatcaatactaaaacccaaatccataagagtccagtctatggtgcagtggaagtcaaaat

SEQ ID NO: 270425 - DNA, 75 bp, Artificial Sequence
  Synthetic
aaggtttaacagaccctttaagattggttcaaacctgaggtgttatggaaaatattcagtacctgctgatttggt

SEQ ID NO: 270426 - DNA, 75 bp, Artificial Sequence
  Synthetic
ttaaagcctgtgtcaagtcaaaatttagagaaatttttggagtcaacggcatcgttgatatgaaaactgcaatat

SEQ ID NO: 270427 - DNA, 75 bp, Artificial Sequence
  Synthetic
atcttggtgagttggttaaaaaacgtctagtgggccacacccaggggggatccctggttttcttttattacacaa

SEQ ID NO: 270428 - DNA, 75 bp, Artificial Sequence
  Synthetic
taggaacttcacatgttaactcaatggacctcagtacttcagctggctacagttttgtgaaatctgggtataaaa

SEQ ID NO: 270429 - DNA, 75 bp, Artificial Sequence
  Synthetic
ttgtcattatggagacaatcaaaggcatcaccgatatggcggcaggaatcactaagactattgattctactgtca

SEQ ID NO: 270430 - DNA, 75 bp, Artificial Sequence
  Synthetic
agaaagacttaatatgtttggagccattttctgtgtcaccaatgcttgagaagttggttcaggacaaattttaca

SEQ ID NO: 270431 - DNA, 75 bp, Artificial Sequence
  Synthetic
acactgtcaatgaaatcattaccaaccctagcaatgcagctggaggtgacatgttgactaaagtggctgatgatg

SEQ ID NO: 270432 - DNA, 75 bp, Artificial Sequence
  Synthetic
atcttttgaagggtaatcaaattacaaccatcttcaatacatgcctaaaagatgaacttaggaaattagacaaga

SEQ ID NO: 270433 - DNA, 75 bp, Artificial Sequence
  Synthetic
cttcaaatgtactagggccaaattgttttgctacaacttcaacaccagagaataaggatgtggtccaagcaacta

SEQ ID NO: 270434 - DNA, 75 bp, Artificial Sequence
  Synthetic
tagcatctggtaaaaccagatgcattgaagcttgtgaggttgattactgtattgtctacaggatgataatgatgg

SEQ ID NO: 270435 - DNA, 75 bp, Artificial Sequence
  Synthetic
ctactgttaacactacaaacttgacacaacacccttctgcccctactatgccctttactccagatttccgcaacg

SEQ ID NO: 270436 - DNA, 75 bp, Artificial Sequence
  Synthetic
tgaagcttgtgaggttgattactgtattgtctacaggatgataatgatggaaatatatgacaaaatatatcaaac

SEQ ID NO: 270437 - DNA, 75 bp, Artificial Sequence
  Synthetic
tggacatatttcattcaatggcttatgatgtcaccacaggggacaagaatcccagcaaactaattaggttggaaa

SEQ ID NO: 270438 - DNA, 75 bp, Artificial Sequence
  Synthetic
tgactacaactatgaaatggattattcccaatatgatggctcacttagctcaatgcttctgtgggaggcagtgga

SEQ ID NO: 270439 - DNA, 75 bp, Artificial Sequence
  Synthetic
cagaatattgggagcggacatatgctagacaacatttaatagtggatgtggaacttcctcatgctttttgggaca

SEQ ID NO: 270440 - DNA, 75 bp, Artificial Sequence
  Synthetic
ataccaacaaacctgcatatggacagtctcggtactttgcagctgttagatgtggtttccacttccaagtccaag

SEQ ID NO: 270441 - DNA, 75 bp, Artificial Sequence
  Synthetic
aaccagtgattgactctgaccatattgtttttaatgagaggtggttgatccacggtgggatgccatcaggttccc

SEQ ID NO: 270442 - DNA, 75 bp, Artificial Sequence
  Synthetic
taaatgtgaaccaaggaacagctggtagtgcactagttgtctatgaaccaaaaccagcagtcacccacagtgata

SEQ ID NO: 270443 - DNA, 75 bp, Artificial Sequence
  Synthetic
catgtactacagtgctcaattcattatgcaatttgatgatgtgtgtttacaccacaaatttgatcagtccaggaa

SEQ ID NO: 270444 - DNA, 75 bp, Artificial Sequence
  Synthetic
aaatggagtttggtgctttcaccaatctgccacatgtacttatgaatttggctgaaacaacacaagcagatttat

SEQ ID NO: 270445 - DNA, 75 bp, Artificial Sequence
  Synthetic
accacaaatttgatcagtccaggaattgattgcctacctatagtttatggtgatgatgtcattctatcattagac

SEQ ID NO: 270446 - DNA, 75 bp, Artificial Sequence
  Synthetic
gtatcccctatgtatcagacacaaactatgttaaaacggattcgtctgacttagggcgtttaagagtgtatgtgt

SEQ ID NO: 270447 - DNA, 75 bp, Artificial Sequence
  Synthetic
aaagaaatagaaccagagagactacaaagtatcatggcagaatcatttggagccgaagtgactgggtcgcgtaag

SEQ ID NO: 270448 - DNA, 75 bp, Artificial Sequence
  Synthetic
gggctccattaacaataccatctggtgcaactagtacagttgatgtaactgtgttagggagtctgttacaattag

SEQ ID NO: 270449 - DNA, 75 bp, Artificial Sequence
  Synthetic
gatgaaccaccttcactcaaacccaggatggaagttgaattcctcaagcgcaagcctggttatttcccagagtct

SEQ ID NO: 270450 - DNA, 75 bp, Artificial Sequence
  Synthetic
attttcagaacccaagagtctacaacacccaagtggatatatatgataataacaatgaaactagagctaggcaaa

SEQ ID NO: 270451 - DNA, 75 bp, Artificial Sequence
  Synthetic
ttaggaagaagaaatggctaacaatgtcaactaaatacaaatggactaggagtaaaattgacattgccgagggcc

SEQ ID NO: 270452 - DNA, 75 bp, Artificial Sequence
  Synthetic
caggagctatgaacatggccaatgtacttagtactactggtgctcagtcagttgctctagtgggagaaagagctt

SEQ ID NO: 270453 - DNA, 75 bp, Artificial Sequence
  Synthetic
tttatgatcctagaacagcaggtagtaaatctagatttgatgatttggtaaaaatagcccaattattttcagtta

SEQ ID NO: 270454 - DNA, 75 bp, Artificial Sequence
  Synthetic
tttgactaaaattgaagttttggttttcttttgctatggactttataattagacactaatctgattagaacacta

SEQ ID NO: 270455 - DNA, 75 bp, Artificial Sequence
  Synthetic
tgagtgattcaacaaccccctccacaagttcaggcattgatgataaaggctattttgagtggaaagccacagcca

SEQ ID NO: 270456 - DNA, 75 bp, Artificial Sequence
  Synthetic
tcctagagagcttggccgtcgggccttatacccgacttgctgagtttctctaggagagtccctttcccagccctg

SEQ ID NO: 270457 - DNA, 75 bp, Artificial Sequence
  Synthetic
taggagagtccctttcccagccctgaggcggctggtcaataaaagcctcaaatgtaactaacatctaagacattt

SEQ ID NO: 270458 - DNA, 75 bp, Artificial Sequence
  Synthetic
caccacaaactgtaatccaccggaatgtggtgaaattaaaccaatttccaaacttgaacatgtttgtgaattcat

SEQ ID NO: 270459 - DNA, 75 bp, Artificial Sequence
  Synthetic
atgattcaaccccatgcctggtccccactagtcgaaagcatctagccataagatgagtggactaaggacgcttaa

SEQ ID NO: 270460 - DNA, 75 bp, Artificial Sequence
  Synthetic
attcatacttcagagggtcactaattattaggttatctgtttatgctagtacttttaatcgtggtagactcagaa

SEQ ID NO: 270461 - DNA, 75 bp, Artificial Sequence
  Synthetic
agatgagtggactaaggacgcttaaagcatggagccaacaaccatttctaacccatgttttgcatggggtggcag

SEQ ID NO: 270462 - DNA, 75 bp, Artificial Sequence
  Synthetic
tgggtttcttcccaaactttaccacgaataccacttcagaaatagacaattcaatctataccatttgtgatatag

SEQ ID NO: 270463 - DNA, 75 bp, Artificial Sequence
  Synthetic
atggcgtgccataactctactagtgggataccacgcttgtggaccttatgcccacacagccatcctctagtaagt

SEQ ID NO: 270464 - DNA, 75 bp, Artificial Sequence
  Synthetic
ggataccacgcttgtggaccttatgcccacacagccatcctctagtaagtttgtaagacgtctgatgacgtgtgg

SEQ ID NO: 270465 - DNA, 75 bp, Artificial Sequence
  Synthetic
ggtctgacaatagttttgaaattaccataccatataccttctcaacatggatgaggaagactaatgggcatgcct

SEQ ID NO: 270466 - DNA, 75 bp, Artificial Sequence
  Synthetic
gaaaacactagaaatattaacttgctgtaaagcatcctactgccagcggaatcacatctggtaacagatgcctct

SEQ ID NO: 270467 - DNA, 75 bp, Artificial Sequence
  Synthetic
taggactattccagattgaggtgctaaataggttgacatacaacagttcaagtcctagttctgtacattgtatag

SEQ ID NO: 270468 - DNA, 75 bp, Artificial Sequence
  Synthetic
ggggccaaaagccaaggtttagcagaccctttaggattggttcaatacctgagttaatatggaaagtgcttagta

SEQ ID NO: 270469 - DNA, 75 bp, Artificial Sequence
  Synthetic
ttcaagggagattgggcaatgatgccaaatttttttgtccagctggctcacttgtaactttccaaaattcttggg

SEQ ID NO: 270470 - DNA, 75 bp, Artificial Sequence
  Synthetic
accctttaggattggttcaatacctgagttaatatggaaagtgcttagtacctgctgacttggtagtagtgcaaa

SEQ ID NO: 270471 - DNA, 75 bp, Artificial Sequence
  Synthetic
gctcacaaatggatttgacagacccattgtgtatagaagatgattgcactgaggattgcaaacagacaatttctc

SEQ ID NO: 270472 - DNA, 75 bp, Artificial Sequence
  Synthetic
ggctggatacctctatcttggtgatccagttaaaaaacgtctagcgggccaagcccaggggggatccctggtttc

SEQ ID NO: 270473 - DNA, 75 bp, Artificial Sequence
  Synthetic
cagatgaattaggtttgacttctgcacaagatgatggacccttgggaggtgaaaagccaaattatttcctaaatt

SEQ ID NO: 270474 - DNA, 75 bp, Artificial Sequence
  Synthetic
cctatttttattattatcactatggagacaatcaagagcattgcagatatggccactggcttcactaacacaatt

SEQ ID NO: 270475 - DNA, 75 bp, Artificial Sequence
  Synthetic
tcagagcagtcaatgtagacatattcactgtgagccacaccaaagtagacaacatctttgggagggcatggtttg

SEQ ID NO: 270476 - DNA, 75 bp, Artificial Sequence
  Synthetic
gattcaactgtcaacgctgtaactgaaggtgtatctaagattggaaatgattcgggtggtgagattcttacaaag

SEQ ID NO: 270477 - DNA, 75 bp, Artificial Sequence
  Synthetic
catatgaccacacctatagagatgaagggacttggagacaagcccttgatttcccaaagaaaggccatggtgcac

SEQ ID NO: 270478 - DNA, 75 bp, Artificial Sequence
  Synthetic
gtagcagatgatgcttcaaaccttcttggaccaaattgtgttgcatccacctcacagcctgaaaataaggatgta

SEQ ID NO: 270479 - DNA, 75 bp, Artificial Sequence
  Synthetic
taactcaactatttgcatattattcgggtgagcttaatatacatgttttatttttgagtgaaacaggatttttga

SEQ ID NO: 270480 - DNA, 75 bp, Artificial Sequence
  Synthetic
gtacaagcaactaccacagtcaacacactcacaaatttgacacaacatccttctgctcccactatgcctttcact

SEQ ID NO: 270481 - DNA, 75 bp, Artificial Sequence
  Synthetic
gagtggcacatacctatgatagtgatacaaacagatctgacttcttttcttcaaatggtgtcatcacagtcccag

SEQ ID NO: 270482 - DNA, 75 bp, Artificial Sequence
  Synthetic
ccagatttttccaatgttgacgtttttcactccatggcttatgatataaccactggtgataagaaccctagtaaa

SEQ ID NO: 270483 - DNA, 75 bp, Artificial Sequence
  Synthetic
caggagaacaaatgactctgtcagtgccattctattcctctaagcctttgagaaccatcagggattcagctgcac

SEQ ID NO: 270484 - DNA, 75 bp, Artificial Sequence
  Synthetic
cttattaggctagacaccacaacctggcaacacacttggcctagacagcatttaataaatgacgtagaattacct

SEQ ID NO: 270485 - DNA, 75 bp, Artificial Sequence
  Synthetic
tagggtacgtgatgtgcaagccatttatgtctggaaccacaggtgggaaaatagaaatatacctgagtttgaggt

SEQ ID NO: 270486 - DNA, 75 bp, Artificial Sequence
  Synthetic
aaggcattctgggacaaaaatagtaaacctgcatacgggcagtccagatattttgctgctgtgaggtgtggattc

SEQ ID NO: 270487 - DNA, 75 bp, Artificial Sequence
  Synthetic
gtccaaatttgtttttccccctccctgcacctaagcccacatccggccgatcgctacggggtgatatggcacaac

SEQ ID NO: 270488 - DNA, 75 bp, Artificial Sequence
  Synthetic
catttccaagtacaaattaatgtcaatcaaggaacagctggttgtgcactggtagtttatgaacccaagcctata

SEQ ID NO: 270489 - DNA, 75 bp, Artificial Sequence
  Synthetic
ttgtaaaccaaagtccctacaacataacacctgtaaatcagactatgaaattagcatacttggataggggtttct

SEQ ID NO: 270490 - DNA, 75 bp, Artificial Sequence
  Synthetic
gtaacccatggtggccatctagaatttggatcgtatactaacttaccacatgtattgatgaatttggctgaaacc

SEQ ID NO: 270491 - DNA, 75 bp, Artificial Sequence
  Synthetic
ataagcattatggaattatagttggagataatgtgtaccaattggattcagatgatatctttaagacagctctaa

SEQ ID NO: 270492 - DNA, 75 bp, Artificial Sequence
  Synthetic
actcaagctgacctatgtatcccctatgtttctgacacaaactatgttaagactgattcgtcagacctagggcgt

SEQ ID NO: 270493 - DNA, 75 bp, Artificial Sequence
  Synthetic
ctgggaaagcaaagttcacaaaatctaaattgactgcagattgggttgttgaggaagaatgtgagctggattact

SEQ ID NO: 270494 - DNA, 75 bp, Artificial Sequence
  Synthetic
gactgattcgtcagacctagggcgtttgagggtttatgtttggacaccactgacaattccatccagtgcgactaa

SEQ ID NO: 270495 - DNA, 75 bp, Artificial Sequence
  Synthetic
ttagggttaaataccttgagtcatctgtgaattctgaacatatattttcggttgacaagaattgtgagaccattg

SEQ ID NO: 270496 - DNA, 75 bp, Artificial Sequence
  Synthetic
tgatgtggatgtgacagttttaggtagcttattacaacttgatttccaaaatccaagaacttatgacacagatgt

SEQ ID NO: 270497 - DNA, 75 bp, Artificial Sequence
  Synthetic
ccaaagacatatttggtacacatacattaagtcaacatcaagcaattggtctaattggtaccatattgttaactg

SEQ ID NO: 270498 - DNA, 75 bp, Artificial Sequence
  Synthetic
caatatctatgataacagtccactagacacaaaaacgaaatatggcaaattaagattctccaagaaaattttgtc

SEQ ID NO: 270499 - DNA, 75 bp, Artificial Sequence
  Synthetic
ctggcctcatgtccacaattcagacaccagtcaataccacaacaattaaggaattctttaatcatgccattgagg

SEQ ID NO: 270500 - DNA, 75 bp, Artificial Sequence
  Synthetic
tatgtcaactaaatacaaatggactaggaacaaaatagatattgcagagggtcctgggtcaatgaatatggcaaa

SEQ ID NO: 270501 - DNA, 75 bp, Artificial Sequence
  Synthetic
gcgatgagcagggtttgtcactacttgtgcagaaatgcactactttcttttcatcagctgcaactgaaatattag

SEQ ID NO: 270502 - DNA, 75 bp, Artificial Sequence
  Synthetic
cgtcttaagtactacaggagctcaatcaatcgccttagtaggtgagagagctttttatgacccacggacagctgg

SEQ ID NO: 270503 - DNA, 75 bp, Artificial Sequence
  Synthetic
acaatgacctagttaaatttatagttaaaattttagttagaattttgtgttatatggtcctatattgccacaaac

SEQ ID NO: 270504 - DNA, 75 bp, Artificial Sequence
  Synthetic
tagcaaatctagatttggtgatatgatccacatagcccaattattctcagtgatgtcagatacaacaaccccctc

SEQ ID NO: 270505 - DNA, 75 bp, Artificial Sequence
  Synthetic
caaatatacttactactgcatgcttatccactctgttaataatggatgttacttcttcatccgtgctatcccctt

SEQ ID NO: 270506 - DNA, 75 bp, Artificial Sequence
  Synthetic
tacatcaagtgggattgatgaccttggctatttggattggtcagccacttacgtaccacaacaagttatacatcg

SEQ ID NO: 270507 - DNA, 75 bp, Artificial Sequence
  Synthetic
cttgtaaggcgctcatgcagtgcctcatggatggagatgtcaagaagttggcagaggtggtagctgagtctatgt

SEQ ID NO: 270508 - DNA, 75 bp, Artificial Sequence
  Synthetic
caatgttgtgaagttaaatcagttttctaatttaaaaccctttgttaatgcatacacctattttaggggttcact

SEQ ID NO: 270509 - DNA, 75 bp, Artificial Sequence
  Synthetic
ctaacacagatgatgaggaaattaaggaacaaatttgtgacacagtgaaatataccaaaagtattctgtctaacc

SEQ ID NO: 270510 - DNA, 75 bp, Artificial Sequence
  Synthetic
ggtgttgaggatgtcagtctatgccagtactttcaacagaggccgattgcgcatgggtttctttccaaattttac

SEQ ID NO: 270511 - DNA, 75 bp, Artificial Sequence
  Synthetic
aaggcccatttaaaggctttaatgaagtctcaactgctttcagacacattgattggtggatacacaccttattga

SEQ ID NO: 270512 - DNA, 75 bp, Artificial Sequence
  Synthetic
aaccaacaccacatctgaaatggataatgccatatacactatttgtgacattggctctgataatagctttgaaat

SEQ ID NO: 270513 - DNA, 75 bp, Artificial Sequence
  Synthetic
agatcaaggacatggtattgagtgtattcaagcctagtatggagagtaaagctattcagtggctggagagaaaca

SEQ ID NO: 270514 - DNA, 75 bp, Artificial Sequence
  Synthetic
aaccataccttatactttctcaacatggatgaggaaaaccaacgggagacctattggacttttccaagttgaggt

SEQ ID NO: 270515 - DNA, 75 bp, Artificial Sequence
  Synthetic
aggaacacgtttgtgccattttggactatgcctcagacataattgtagaatcaaaagaccagacaaaaatgaagt

SEQ ID NO: 270516 - DNA, 75 bp, Artificial Sequence
  Synthetic
tttaaacaggttaacttacaatagctcatgtcccaataaagtacattgtattgtacaagggaggcttgggaatga

SEQ ID NO: 270517 - DNA, 75 bp, Artificial Sequence
  Synthetic
cacaggaattctatcagaagtatacagactgcctgacaaaatttaagccaattatggctatttgttttaggagtt

SEQ ID NO: 270518 - DNA, 75 bp, Artificial Sequence
  Synthetic
tgcaagattttattgccccacagggtctctagtggaattccaaaattcatggggttcccaaatggacttgactga

SEQ ID NO: 270519 - DNA, 75 bp, Artificial Sequence
  Synthetic
gccataatagtattagtaacacagtttatagacttttccaagaattggctaggatgccatctagaattagtactc

SEQ ID NO: 270520 - DNA, 75 bp, Artificial Sequence
  Synthetic
ccctttgtgcgtggaagatgatgaagctgaggattgtaaacaaactatatctcctgatgaactaggtcttacctc

SEQ ID NO: 270521 - DNA, 75 bp, Artificial Sequence
  Synthetic
aaaatgatttaattagggtggaaccaattggggtttggattcaaggtgagccaggccaagggaaatctttcttaa

SEQ ID NO: 270522 - DNA, 75 bp, Artificial Sequence
  Synthetic
agcacaagatgatgggccccttggagtagagaaaccaaattattttctaaattttagagcaattaatgtagatat

SEQ ID NO: 270523 - DNA, 75 bp, Artificial Sequence
  Synthetic
cacacactctatctaggcaattgcaaaaatcttgtaaactaaatggtgtttacactaacccaactgccagtgaat

SEQ ID NO: 270524 - DNA, 75 bp, Artificial Sequence
  Synthetic
ctttactgttagtcatactaaggtagataacatttttgggcgtgcatggttggcccttgaacacacatttgcaga

SEQ ID NO: 270525 - DNA, 75 bp, Artificial Sequence
  Synthetic
ttatggatggttatgacaatcaagacatccaccttatagatgacttgggacagaccaggaaagaaaaagatatag

SEQ ID NO: 270526 - DNA, 75 bp, Artificial Sequence
  Synthetic
tgatggaacatggagggcagatttgaattttcccacacagggtcatggtactctgacaagactcttcacatatta

SEQ ID NO: 270527 - DNA, 75 bp, Artificial Sequence
  Synthetic
agatgctctgcaattgtatatcatctgttcccttcattgttccaatggcgcacttggaagaaaagggcaagtttt

SEQ ID NO: 270528 - DNA, 75 bp, Artificial Sequence
  Synthetic
ctctggtgaattaaatgtgcatgtactgtatcttagtgacaatgggttcctccgagtaactcatgcctatgacca

SEQ ID NO: 270529 - DNA, 75 bp, Artificial Sequence
  Synthetic
acactagtaaattggtaatagcaacaaccaataagtctgacttctcaagcactgtattgcaggattctggtgctt

SEQ ID NO: 270530 - DNA, 75 bp, Artificial Sequence
  Synthetic
tgataatgacagatccaactttttgtcatccaatggagtaattacagtgccagcaggtgaacagatgacgctttc

SEQ ID NO: 270531 - DNA, 75 bp, Artificial Sequence
  Synthetic
taaaaagaagattcccatatattatgcacatcagagctgctaaagcttacagcaaatctggtaagttgaatatta

SEQ ID NO: 270532 - DNA, 75 bp, Artificial Sequence
  Synthetic
tgtgccattctattcttctaaaccacttagaacaataagagaaactggtgcattaggcaaattaatctgtaaacc

SEQ ID NO: 270533 - DNA, 75 bp, Artificial Sequence
  Synthetic
gccaggctatgtccactatggctacaggtgagtgctgggaagtatcaaaaaatggtagggactgggagaccttaa

SEQ ID NO: 270534 - DNA, 75 bp, Artificial Sequence
  Synthetic
attgttgtctggcacacattcagggaagatcgaagtttatttgagtctcagatgccctaatctattctttccttc

SEQ ID NO: 270535 - DNA, 75 bp, Artificial Sequence
  Synthetic
aacttaaagatttggtacagaagatcacagaagattatcaggaaaggcagaagaactacaactgttggaaacaac

SEQ ID NO: 270536 - DNA, 75 bp, Artificial Sequence
  Synthetic
tcctgcacctaaagagaaaacttccagagctttgcggggtgacttggcaaattttatagatcagagtccatatgg

SEQ ID NO: 270537 - DNA, 75 bp, Artificial Sequence
  Synthetic
agctggaaaaccagactctagatgatttagatgatgcagtatcatacatcaagtacaatttcccagacgcaattc

SEQ ID NO: 270538 - DNA, 75 bp, Artificial Sequence
  Synthetic
tcaacagcaacaaacccaaatgatgaaattagcatatttagacaggggtttctataaacactatggcattatagt

SEQ ID NO: 270539 - DNA, 75 bp, Artificial Sequence
  Synthetic
cttacatcgatgaatatcttaatattgaaatgtctactctaattgaacagatggaagcttttattgaaccacgac

SEQ ID NO: 270540 - DNA, 75 bp, Artificial Sequence
  Synthetic
tggaggttatgtgtatcaactggactctgacgatattttcaaaacagcattgacaggtaaagctaggttcaccaa

SEQ ID NO: 270541 - DNA, 75 bp, Artificial Sequence
  Synthetic
ctagtgtgtttaaatgctttgccaccaaagttgctaaccacaccaggaaagcagctaaggaggttgtggactggt

SEQ ID NO: 270542 - DNA, 75 bp, Artificial Sequence
  Synthetic
aacaaggttaaccccagattggattgttgaagaggagtgtgaattagattactttcgggtcaagtaccttgagtc

SEQ ID NO: 270543 - DNA, 75 bp, Artificial Sequence
  Synthetic
ttagtaataagattaaatcaatgttaagttttgttgaaaggaataaagcctggttaacagtagtttcagcagtaa

SEQ ID NO: 270544 - DNA, 75 bp, Artificial Sequence
  Synthetic
ttcagtaaactctgaacacatattctcagtagattcaaactgtgagacaattgccaaagatatttttggaaccca

SEQ ID NO: 270545 - DNA, 75 bp, Artificial Sequence
  Synthetic
ccagtgctataagcattctactattggttaccaaaatcttcaagaaggaggactcaaaagatgaaagagcataca

SEQ ID NO: 270546 - DNA, 75 bp, Artificial Sequence
  Synthetic
cactcttagtcagcatcaagccattgggttggttggtgccattctcttaacagctggtttgatgtcaaccattaa

SEQ ID NO: 270547 - DNA, 75 bp, Artificial Sequence
  Synthetic
accccactctccctgtgaccaaaccaaaaggggctttcccagtaacacaaagggaatttaaaaatgaagcccctt

SEQ ID NO: 270548 - DNA, 75 bp, Artificial Sequence
  Synthetic
gacaccagtgaatgccacaaccatcaaagaattcttcaaccatgcaatcgatggtgatgagcagggcttgtcttt

SEQ ID NO: 270549 - DNA, 75 bp, Artificial Sequence
  Synthetic
atgatggccaattagaacacataatcacccagatggcatatataactggttctactacggggcaccttactcatt

SEQ ID NO: 270550 - DNA, 75 bp, Artificial Sequence
  Synthetic
acttgtgcaaaaatgtactacattcttttcatcagctgccacagaaattctggataatgatttggtaaagtttat

SEQ ID NO: 270551 - DNA, 75 bp, Artificial Sequence
  Synthetic
gtgcggggtaccaacatgatgagatcatcttacatgggcattcgattaaataccttgaacaagaagaggatctaa

SEQ ID NO: 270552 - DNA, 75 bp, Artificial Sequence
  Synthetic
agttaaaattcttgttaggatcctctgttatatggttttgtactgccataagcctaatattttaacaactgcgtg

SEQ ID NO: 270553 - DNA, 75 bp, Artificial Sequence
  Synthetic
tactgcattataagaataaggtgttcccaattgaaaatccatcagtgacacaggtaacattgggtggtaaaccga

SEQ ID NO: 270554 - DNA, 75 bp, Artificial Sequence
  Synthetic
cccaattgaaaatccatcagtgacacaggtaacattgggtggtaaaccgatggatttggccattctaaaatgtaa

SEQ ID NO: 270555 - DNA, 75 bp, Artificial Sequence
  Synthetic
tctatccacgttgttgataatggatgtgacatcctcatcagtactgtcaccttcttgtaaggcactcatgcagtg

SEQ ID NO: 270556 - DNA, 75 bp, Artificial Sequence
  Synthetic
attaccattcagatttaagaaaaattccaaatattacactaacaaaattggaacagagagtatgttaatttggat

SEQ ID NO: 270557 - DNA, 75 bp, Artificial Sequence
  Synthetic
cctgatggatggtgatgttaagaagttagcagaggttgtagcagagtccatgtccaacacagatgatgatgaaat

SEQ ID NO: 270558 - DNA, 75 bp, Artificial Sequence
  Synthetic
gactgaacaaggcatcattactaaagaggttcaaagagtccaccattctggaggcattaaaacacgggagggaac

SEQ ID NO: 270559 - DNA, 75 bp, Artificial Sequence
  Synthetic
taaggaacaaatttgtgacacagtaaagtatacaaagaccattttgtcaaatcagggccccttcaagggtttcaa

SEQ ID NO: 270560 - DNA, 75 bp, Artificial Sequence
  Synthetic
tgagagtacaaaaacaatcagttataccgtaaagtcctgtaaaggtatgtgtggaggtctgctaatttccaaagt

SEQ ID NO: 270561 - DNA, 75 bp, Artificial Sequence
  Synthetic
tgaggtttcaacggcatttagacacgttgactggtggattcatacacttttgaaaatcaaagatatggttcttag

SEQ ID NO: 270562 - DNA, 75 bp, Artificial Sequence
  Synthetic
tgagggaaactttaagattcttggaatgcacatagctggaaatggagaaatgggcgttgccattcctttcaattt

SEQ ID NO: 270563 - DNA, 75 bp, Artificial Sequence
  Synthetic
tgttttcaagcctagtattgagagtaaagcaattcagtggttagaaagaaacaaagagcatgtttgctccattct

SEQ ID NO: 270564 - DNA, 75 bp, Artificial Sequence
  Synthetic
tcttaagaatgatatgtctgaccaaggcattgtcacagaagcgacacccatacagcctatgtacattaatactaa

SEQ ID NO: 270565 - DNA, 75 bp, Artificial Sequence
  Synthetic
tgactatgcatcagacataattgtggaatcaaaggatcagactaagatgaagacacaagaattttaccagaggta

SEQ ID NO: 270566 - DNA, 75 bp, Artificial Sequence
  Synthetic
aactcaaattcacaagagtccagtctatggtgcagtggaagttaagatgggtccagcagtcttaagtaaatcaga

SEQ ID NO: 270567 - DNA, 75 bp, Artificial Sequence
  Synthetic
ttctgattgcctagctaagtttaaaccaattatggccatttgctttagaagctgtcacaatagtattagtaacac

SEQ ID NO: 270568 - DNA, 75 bp, Artificial Sequence
  Synthetic
ccctagacttgaagaaccagtcgaatgtttgattaagaaatcagctgcgaagtatagggtcaacaaattccaggt

SEQ ID NO: 270569 - DNA, 75 bp, Artificial Sequence
  Synthetic
tgtatataggctatttcaagaattggctagaatacccaatagaatcagcacccaaaatgacttaattagagttga

SEQ ID NO: 270570 - DNA, 75 bp, Artificial Sequence
  Synthetic
caataatgaattatggcagggtgttaaagcttgtgtcaagtctaaatttagagagatctttgggattaatggcat

SEQ ID NO: 270571 - DNA, 75 bp, Artificial Sequence
  Synthetic
accaattggtgtttggatacagggtgaacctggtcaaggaaagtcatttttgacccatacattatctagacaact

SEQ ID NO: 270572 - DNA, 75 bp, Artificial Sequence
  Synthetic
cgtggacatgaagacagccattttgggaacatcccatgtgaactctatggatctgagtacatcagctggatatag

SEQ ID NO: 270573 - DNA, 75 bp, Artificial Sequence
  Synthetic
tcaaaaatcttgcaaattaaatggagtctacacaaatccaacagccagtgaatttatggatggctatgacaacca

SEQ ID NO: 270574 - DNA, 75 bp, Artificial Sequence
  Synthetic
ctttgtcaaatctggttataaaaagagagatctaatttgtcttgaacctttttttgtttcacctatgttagagaa

SEQ ID NO: 270575 - DNA, 75 bp, Artificial Sequence
  Synthetic
ggacattcacttgattgatgacttgggccagactaggaaggaaaaagacattgagatgctttgcaattgtatatc

SEQ ID NO: 270576 - DNA, 75 bp, Artificial Sequence
  Synthetic
acttgtacaagataagtttcatgcactactcaagggcaatcaaattactacaattttcaacacttgtctaaaaga

SEQ ID NO: 270577 - DNA, 75 bp, Artificial Sequence
  Synthetic
ctcagttccattcattgtacctatggctcaccttgaggaaaaagggaagttctacacaagtaaattagtcatagc

SEQ ID NO: 270578 - DNA, 75 bp, Artificial Sequence
  Synthetic
cgaattgaggaaattggacaagatctcagccggcaaaactaggtgcattgaggcatgtgaggtggactattgtat

SEQ ID NO: 270579 - DNA, 75 bp, Artificial Sequence
  Synthetic
taccacaaataagtctgatttttccagtactgtattacaagattctggtgcgctcaaaaggcgattcccttatat

SEQ ID NO: 270580 - DNA, 75 bp, Artificial Sequence
  Synthetic
agtctatagaatgatcatgatggaaatctatgataaaatttatcagacaccatgttattattcaggtcttgctgt

SEQ ID NO: 270581 - DNA, 75 bp, Artificial Sequence
  Synthetic
catgcacattagggcagctaaggcttatagcaaatcaggtaaacttaatgtcagccaagcaatgtcaaccatgtc

SEQ ID NO: 270582 - DNA, 75 bp, Artificial Sequence
  Synthetic
tggaattaacccatacaaagattggcactttatgattaatgccttgaatgattacaactatgaaatggattattc

SEQ ID NO: 270583 - DNA, 75 bp, Artificial Sequence
  Synthetic
cactggtgaatgctgggaagtttccaagaacggtagagattgggaaaccctaaaactgaaggacttggtgcaaaa

SEQ ID NO: 270584 - DNA, 75 bp, Artificial Sequence
  Synthetic
attacaactatgaaatggattattctcaatacgatggttcccttagttcaatgttattatgggaggctgtggaag

SEQ ID NO: 270585 - DNA, 75 bp, Artificial Sequence
  Synthetic
gattacagaagattatcaggaaagacaaaaaaattacaatgcctggaaacagcaattggagaatcagacattaga

SEQ ID NO: 270586 - DNA, 75 bp, Artificial Sequence
  Synthetic
tgacttggacgatgctgtgtcttacatcaagcataatttccctgatgccatcccatacattgatgagtaccttaa

SEQ ID NO: 270587 - DNA, 75 bp, Artificial Sequence
  Synthetic
tttttaacgagagatggttgattcatggtggtatgccgtcagggtccccatgcactactgtgttaaattcactgt

SEQ ID NO: 270588 - DNA, 75 bp, Artificial Sequence
  Synthetic
tattgaaatgtcaacactcattgagcaaatggaggctttcatcgaaccacgccctagtgtctttaagtgttttgc

SEQ ID NO: 270589 - DNA, 75 bp, Artificial Sequence
  Synthetic
tgcactactgtgttaaattcactgtgtaatctaatgatgtgcatttacactactaatttaatcagtccaggaatt

SEQ ID NO: 270590 - DNA, 75 bp, Artificial Sequence
  Synthetic
agtaaagttgccgcacaaaccaggaaagcagccaaggaagttgtgggctggttcagcaggtaaaatcaagtcaat

SEQ ID NO: 270591 - DNA, 75 bp, Artificial Sequence
  Synthetic
gttaagctttattgaaaggaataaggcctggcttactgttgtctcagccgttactagtgctattagtattctgct

SEQ ID NO: 270592 - DNA, 75 bp, Artificial Sequence
  Synthetic
ctgaagtgactggctcccgcaaggacgagcctccatcattaaagcctagaatggaggtagagttcttaaaacgca

SEQ ID NO: 270593 - DNA, 75 bp, Artificial Sequence
  Synthetic
cgagcctccatcattaaagcctagaatggaggtagagttcttaaaacgcaagcctggttatttcccagagtctac

SEQ ID NO: 270594 - DNA, 75 bp, Artificial Sequence
  Synthetic
actagttaccaagatcttcaagaaggaagagtcaaaagatgagagggcctacaatccaaccctgcctattactaa

SEQ ID NO: 270595 - DNA, 75 bp, Artificial Sequence
  Synthetic
accaaaaggaacattcccagtatcccaacgggaattcaagaatgaggccccctatgatggtcaactagaacacat

SEQ ID NO: 270596 - DNA, 75 bp, Artificial Sequence
  Synthetic
gcagcaacttcaatcctacttaatggagttatgcctccatggaaaagacacttacttacactgcatcaaaatctt

SEQ ID NO: 270597 - DNA, 75 bp, Artificial Sequence
  Synthetic
tatttcacaaatggcctatattacaggttctactactgggcacttaacacattgtgctggttatcagcacgatga

SEQ ID NO: 270598 - DNA, 75 bp, Artificial Sequence
  Synthetic
ggatccctatttgaaagagtggaacatcattgtggatgattatgatgtagtcattgctaagttaatgcccatggt

SEQ ID NO: 270599 - DNA, 75 bp, Artificial Sequence
  Synthetic
aatcatcttgcatggtcattcaatcaagtaccttgaacaagaggaagacctcaccttgcattataaaaacaaagt

SEQ ID NO: 270600 - DNA, 75 bp, Artificial Sequence
  Synthetic
gtttgactaaattcattgttttaggttttttttttgttatggattatatcattagaacactaattttattagaac

SEQ ID NO: 270601 - DNA, 75 bp, Artificial Sequence
  Synthetic
ttttccaatagaaaacccttcagtcactcaggttacacttggtggcaagccaatggacctcgccatcttaaagtg

SEQ ID NO: 270602 - DNA, 75 bp, Artificial Sequence
  Synthetic
cttctctaggagagcccttttcccagccagaggtggctggttaaataatacctattgtaacaaaacatctaagat

SEQ ID NO: 270603 - DNA, 75 bp, Artificial Sequence
  Synthetic
ttttttttttgttatggattatatcattagaacactaattttattagaacactaatttggaatattggacatacc

SEQ ID NO: 270604 - DNA, 75 bp, Artificial Sequence
  Synthetic
caagctaccatttaggtttaagaagaattctaagtattacaccaacaaaattgggactgaaagtatgttgatttg

SEQ ID NO: 270605 - DNA, 75 bp, Artificial Sequence
  Synthetic
gatgacagaacaaggaatcatcactaaagaggtacagagagttcaccactctggtggcattaagaccagagaagg

SEQ ID NO: 270606 - DNA, 75 bp, Artificial Sequence
  Synthetic
caccgagagtactaaaaccattagttacactgtcaaatcatgtaaaggaatgtgtggtggacttctgatttctaa

SEQ ID NO: 270607 - DNA, 75 bp, Artificial Sequence
  Synthetic
taccacgcttgtggaccttatgctcacacagccatcctctagtaagtttgtgagacgtctgatgacgtgtgggaa

SEQ ID NO: 270608 - DNA, 75 bp, Artificial Sequence
  Synthetic
ggttgagggcaacttcaagattctgggtatgcatatagctggtaatggtgaaatgggtgtggctataccattcaa

SEQ ID NO: 270609 - DNA, 75 bp, Artificial Sequence
  Synthetic
acatctggtaacagatgcctctggggccaaaagccaaggtttaacagaccctttgggattggttcaaacctgaac

SEQ ID NO: 270610 - DNA, 75 bp, Artificial Sequence
  Synthetic
ttttctcaagaatgatatgtctgaccaggggattatcactgaggtaacacctatacaaccaatgtacataaatac

SEQ ID NO: 270611 - DNA, 75 bp, Artificial Sequence
  Synthetic
tgttatggaagacatttagtacctgctgatttggtagtaatgcaaacactagttgtaaggcccacgaaggatgcc

SEQ ID NO: 270612 - DNA, 75 bp, Artificial Sequence
  Synthetic
aaagtctcaaatccataagagtccagtctatggggccgttgaggtcaaaatgggcccagcggtcttgagtaagtc

SEQ ID NO: 270613 - DNA, 75 bp, Artificial Sequence
  Synthetic
agttgtaaggcccacgaaggatgcccagaaggtacccgtaggtaacaagtgacactatggatctgatctggggcc

SEQ ID NO: 270614 - DNA, 75 bp, Artificial Sequence
  Synthetic
agataccagactagaggaacctgtggattgtctaatcaagaaatcagcatctaaatatagggttaataaatttca

SEQ ID NO: 270615 - DNA, 75 bp, Artificial Sequence
  Synthetic
agctacctctatctaggtgagttggttaaaaaacgtctagtgggccaaacccaggggggatccctggtttccttt

SEQ ID NO: 270616 - DNA, 75 bp, Artificial Sequence
  Synthetic
agttaacaatgaactatggcaaggcgtcaaagcttgtgtcaaatctaaatttagggagatctttggagttaatgg

SEQ ID NO: 270617 - DNA, 75 bp, Artificial Sequence
  Synthetic
ttaatttgagtaatcactatggagtctatcaaggatttagtcaatgttgctactggtgctatggatactctttcc

SEQ ID NO: 270618 - DNA, 75 bp, Artificial Sequence
  Synthetic
cattgttgatatgaaaactgcaatactaggaacttcacatgtcaactcaatggatcttagtacttcagctggtta

SEQ ID NO: 270619 - DNA, 75 bp, Artificial Sequence
  Synthetic
tagtttggtaaagtctggatacaagaaaaaggatctgatatgtctagagccattttcagtttcaccaatgcttga

SEQ ID NO: 270620 - DNA, 75 bp, Artificial Sequence
  Synthetic
aaagctagtccaagataagttccataatctcctgaaaggtaaccaaattacaactatcttcaatacatgcctaaa

SEQ ID NO: 270621 - DNA, 75 bp, Artificial Sequence
  Synthetic
ggatgaactgagaaaattagacaaaatagcagctgggaaaactagatgtattgaagcatgtgaagttgattattg

SEQ ID NO: 270622 - DNA, 75 bp, Artificial Sequence
  Synthetic
cattgtctacagaatgataatgatggaaatatatgacaaaatataccaaactccctgctattactcaggacttgc

SEQ ID NO: 270623 - DNA, 75 bp, Artificial Sequence
  Synthetic
tgtgggtatcaacccatacaaagattggcactttatgattaatgcactaaatgattacaattatgagatggacta

SEQ ID NO: 270624 - DNA, 75 bp, Artificial Sequence
  Synthetic
ttcccaatatgatggctcactcagttcaatgcttttgtgggaagctgtggaagtgctagcatactgtcatgattc

SEQ ID NO: 270625 - DNA, 75 bp, Artificial Sequence
  Synthetic
aatgctagtagatttaataagagaaaatttttgactgcttcaactaaatacaagtggacacggaataaagtcgac

SEQ ID NO: 270626 - DNA, 75 bp, Artificial Sequence
  Synthetic
tccagatcttgtgatgcagctccataaacctgtgattgattctgatcacgttgttttcaacgagagatggttgat

SEQ ID NO: 270627 - DNA, 75 bp, Artificial Sequence
  Synthetic
tcatggtgggatgccttctggctctccttgtaccacagtacttaattcattatgtaatctaatgatgtgcattta

SEQ ID NO: 270628 - DNA, 75 bp, Artificial Sequence
  Synthetic
caccacaaatttaatcagtccaggggttgattgcctaccaattgtgtatggtgacgatgtaattttatcactgga

SEQ ID NO: 270629 - DNA, 75 bp, Artificial Sequence
  Synthetic
cagagaaatagaaccagagagactgcaaagtatcatggcagattcatttggagctgaggtaactgggtcacgcaa

SEQ ID NO: 270630 - DNA, 75 bp, Artificial Sequence
  Synthetic
aagttgaagtcctgaaccgtttgacctacaacagttctagtccaaataaggtgcattgtatagtacagggaaggc

SEQ ID NO: 270631 - DNA, 75 bp, Artificial Sequence
  Synthetic
ggatgaaccaccttctcttaaacctaggatggaggttgagttcctcaagcgcaagcctggttacttcccagagtc

SEQ ID NO: 270632 - DNA, 75 bp, Artificial Sequence
  Synthetic
tacttttatagtaggaaaattagacactgaaaacatgatacaacacctaatgtggatgaaaaatttcagcacatt

SEQ ID NO: 270633 - DNA, 75 bp, Artificial Sequence
  Synthetic
caagcagcaacttcaatcctacttaatggagttatgcctccatggaaaagacatttaccaacgttacatcaaaat

SEQ ID NO: 270634 - DNA, 75 bp, Artificial Sequence
  Synthetic
tttggatccatatctcaaagaatggaatattgttgtggatgattatgatgtggtaattgctaaattgatgcccat

SEQ ID NO: 270635 - DNA, 75 bp, Artificial Sequence
  Synthetic
aatattgttgtggatgattatgatgtggtaattgctaaattgatgcccatggtgtttgattaataataaaagttt

SEQ ID NO: 270636 - DNA, 75 bp, Artificial Sequence
  Synthetic
tggttttcttttgctatggactttataattagaacactaatatgattaggacactaattcggaatattggacata

SEQ ID NO: 270637 - DNA, 75 bp, Artificial Sequence
  Synthetic
gttttcttttgctatggactttataattagaacactaatatgattaggacactaattcggaatattggacataac

SEQ ID NO: 270638 - DNA, 75 bp, Artificial Sequence
  Synthetic
tttgaaagggtctcctagagagcttggccgtcgggccttataccccgacttgctgagcttctctaggagagtccc

SEQ ID NO: 270639 - DNA, 75 bp, Artificial Sequence
  Synthetic
tttcccagccttgaggcggctggtcaataaaagcctcaattgtaacaaacatctaagattattatattaacccca

SEQ ID NO: 270640 - DNA, 75 bp, Artificial Sequence
  Synthetic
aataaaagcctcaattgtaacaaacatctaagattattatattaaccccatgcctggtctccactggttgaaggc

SEQ ID NO: 270641 - DNA, 75 bp, Artificial Sequence
  Synthetic
aacttgcaataaaatgagtgggaacaagacgcttaaagcatggtgtgaactaactttctaacccacattttgtgt

SEQ ID NO: 270642 - DNA, 75 bp, Artificial Sequence
  Synthetic
ggaccttatgctcacacagccatcctctagtaagtttgtgagacgtctggtgacgtgtgggaacttattggaagc

SEQ ID NO: 270643 - DNA, 75 bp, Artificial Sequence
  Synthetic
tctagtaagtttgtgagacgtctggtgacgtgtgggaacttattggaagcaacattttgctgcaaagcatcctat

SEQ ID NO: 270644 - DNA, 75 bp, Artificial Sequence
  Synthetic
cccaacagctagtgagtttatggatgggtatgacaaccaggacattcacctcattgatgatttgggccaaactag

SEQ ID NO: 270645 - DNA, 75 bp, Artificial Sequence
  Synthetic
ctagtgggccaaacccgggggggatccccggtttccttttattttatcaatgctacaatggagacaattaaaagt

SEQ ID NO: 270646 - DNA, 75 bp, Artificial Sequence
  Synthetic
attgcagatatggcgaccggagtggtcagttcagttgattccactatcaatgcagttaatgagagagtagaaaat

SEQ ID NO: 270647 - DNA, 75 bp, Artificial Sequence
  Synthetic
atgctgtctcttacatcaagcataattttccagatgcaattccatatatagatgagtatcttaatattgaaatgt

SEQ ID NO: 270648 - DNA, 75 bp, Artificial Sequence
  Synthetic
gtgggcaatgaaattggaggtaacctattaaccaaagtagcagatgatgcttctaatgtgcttggaccaaattgt

SEQ ID NO: 270649 - DNA, 75 bp, Artificial Sequence
  Synthetic
tatgctacaacagctgaaccagagaacaaagatgtggtacaggcaaccacaactgttaatacaaccaatttgaca

SEQ ID NO: 270650 - DNA, 75 bp, Artificial Sequence
  Synthetic
tgatacattccactcaatggcatatgacatcaccacaggggagaagaatcctagcaaattagttagattagagac

SEQ ID NO: 270651 - DNA, 75 bp, Artificial Sequence
  Synthetic
gacatcaccacaggggagaagaatcctagcaaattagttagattagagacacatgagtggacaccaacatgggct

SEQ ID NO: 270652 - DNA, 75 bp, Artificial Sequence
  Synthetic
tcaagatactttgcagcagtacggtgtggctttcattttcaggtgcaagtgaatgttaaccaaggaacagctggt

SEQ ID NO: 270653 - DNA, 75 bp, Artificial Sequence
  Synthetic
agtgcattggtggtgtatgaacccaaacctgttgtgacatatgactcaaagttagaatttggagcatttaccaat

SEQ ID NO: 270654 - DNA, 75 bp, Artificial Sequence
  Synthetic
gaatgatcatgatggaaatttatgacaaaatttatcaaacaccatgttattattcaggccttgctgttggaatca

SEQ ID NO: 270655 - DNA, 75 bp, Artificial Sequence
  Synthetic
tattgggtagtttattgcaattggacttccaaaatcctagggtgtttggccaagacgttggtatctatgataatg

SEQ ID NO: 270656 - DNA, 75 bp, Artificial Sequence
  Synthetic
cttccaaaatcctagggtgtttggccaagacgttggtatctatgataatgcaccaacgcggaaacaaaatcttaa

SEQ ID NO: 270657 - DNA, 75 bp, Artificial Sequence
  Synthetic
acattgcagaagggccaggttctatgaacatggcgaacgtattgagtaccactgcagcgcaatcaattgctttgg

SEQ ID NO: 270658 - DNA, 75 bp, Artificial Sequence
  Synthetic
ttcaatcctacttaatggagttatgcctccatggaaaagacacttacttgtattacatcaaaattttggatccat

SEQ ID NO: 270659 - DNA, 75 bp, Artificial Sequence
  Synthetic
tttgatgatttagtgaaaatatcccaacttttttctgtgatgagtgactccacaactccctcagccaaccatggt

SEQ ID NO: 270660 - DNA, 75 bp, Artificial Sequence
  Synthetic
ttttgaaaggggtctcctagagagcttggccatcgggccttacaccccgattcgctgagcttctctaggagagcc

SEQ ID NO: 270661 - DNA, 75 bp, Artificial Sequence
  Synthetic
atagatgcaaaaggttatttcacatggtcatccacaactgcaccacaatctgtagtacataggaatattgtttac

SEQ ID NO: 270662 - DNA, 75 bp, Artificial Sequence
  Synthetic
gcttaaagtgtgttgtacatattcttttctaacctgtgttctacacagggtggcagatggcgtgccataactcta

SEQ ID NO: 270663 - DNA, 75 bp, Artificial Sequence
  Synthetic
gaggccgtctaaggatgggcttcttcccaaatgctacagaggacagcacttcagaaatagataatgctatataca

SEQ ID NO: 270664 - DNA, 75 bp, Artificial Sequence
  Synthetic
cgaatggccacccaattggactattccaaattgaagtgcttaataggttaacttataatagctccagccccaatg

SEQ ID NO: 270665 - DNA, 75 bp, Artificial Sequence
  Synthetic
ccaaattgaagtgcttaataggttaacttataatagctccagccccaatgaagtttattgcattgtgcaaggtaa

SEQ ID NO: 270666 - DNA, 75 bp, Artificial Sequence
  Synthetic
aatggggcaagatgccagattcttctgtccaaccggctctgtagtaactttccaaaattcatggggttcacaaat

SEQ ID NO: 270667 - DNA, 75 bp, Artificial Sequence
  Synthetic
tagtacctgctgatttggtagtaatgcaaacactagttgtaaggcccacgaaggatgcccagaaggtacccgtag

SEQ ID NO: 270668 - DNA, 75 bp, Artificial Sequence
  Synthetic
ggatttaactgatccactatgtctagaagaatctgcagaggaatgtaaacagactatatcaccaaatgaattggg

SEQ ID NO: 270669 - DNA, 75 bp, Artificial Sequence
  Synthetic
tttaacatcagctcaggatgatggaccattgggtgacaacaagccaaattatttcttaaatttcaagtccatgaa

SEQ ID NO: 270670 - DNA, 75 bp, Artificial Sequence
  Synthetic
ccattgggtgacaacaagccaaattatttcttaaatttcaagtccatgaatgtggatatctttactgtttctcac

SEQ ID NO: 270671 - DNA, 75 bp, Artificial Sequence
  Synthetic
gtgagttggttaaaaaacgtctagtgggccaaacccaggggggatccctggcttccttttttttttaatttgagt

SEQ ID NO: 270672 - DNA, 75 bp, Artificial Sequence
  Synthetic
actaaagtagacaatctatttggaagagcttggttttaccaggaacacactttcaccgatgaggggcagtggaga

SEQ ID NO: 270673 - DNA, 75 bp, Artificial Sequence
  Synthetic
gttaatttggaattcccgaaacaaggccatggttcactttccttgctattcgcttacttcacaggtgaattaaat

SEQ ID NO: 270674 - DNA, 75 bp, Artificial Sequence
  Synthetic
attcatgttttgttcctggctgaaaagggattccttagagtggcccacacttatgacacatcagcagacagagtt

SEQ ID NO: 270675 - DNA, 75 bp, Artificial Sequence
  Synthetic
ataaagatgtagtgcaagctacaaccactgtaaataccacaaacttgacccaacacccgtcagctccaactatcc

SEQ ID NO: 270676 - DNA, 75 bp, Artificial Sequence
  Synthetic
aatttcctgtcatccaatggcgttattacaatcccagctggagaacaaatgacactatctgcaccctactactca

SEQ ID NO: 270677 - DNA, 75 bp, Artificial Sequence
  Synthetic
aataaacccctcaggacagtcagagacaacaatagtcttgggtatctaatgtgtaaaccattccttactggaacg

SEQ ID NO: 270678 - DNA, 75 bp, Artificial Sequence
  Synthetic
gtgtaaaccattccttactggaacgacaacagggaaaatagaggtttatattagcttgagatgtccaaatttctt

SEQ ID NO: 270679 - DNA, 75 bp, Artificial Sequence
  Synthetic
ctttcctcttcccgcacctaaggtttcaactggccgtgctttgcgaggtgacttggcaaatttctcagatcagag

SEQ ID NO: 270680 - DNA, 75 bp, Artificial Sequence
  Synthetic
tccatatggtcagcaaacacagagccaagtgatgaggttagcttacttagatagggggttttacaggcactatgg

SEQ ID NO: 270681 - DNA, 75 bp, Artificial Sequence
  Synthetic
caagtgatgaggttagcttacttagatagggggttttacaggcactatggcattatagtgggagacagtgtatat

SEQ ID NO: 270682 - DNA, 75 bp, Artificial Sequence
  Synthetic
gttcactaagacaaaattaactccagactggattattgaggaggaatgtgaactggattatttcagggtgaagta

SEQ ID NO: 270683 - DNA, 75 bp, Artificial Sequence
  Synthetic
ccttgaatcatctgtcaactcagaacatatcttctcagtggatcacaattgtgaaactattgctaaggatatctt

SEQ ID NO: 270684 - DNA, 75 bp, Artificial Sequence
  Synthetic
tggcacccaaactcttagccaacaccaggccattggcttggtaggcacaattctcttaactgctggattgatgtc

SEQ ID NO: 270685 - DNA, 75 bp, Artificial Sequence
  Synthetic
aaccattaaaacaccagtcaatgccaccaccattaaagaattctttaaccatgcaatagaaggtgatgagcaggg

SEQ ID NO: 270686 - DNA, 75 bp, Artificial Sequence
  Synthetic
gctttctttacttgtgcagaagtgtactactttcttttcctcagcagccacagaaatcttagacaatgatctggt

SEQ ID NO: 270687 - DNA, 75 bp, Artificial Sequence
  Synthetic
actactttcttttcctcagcagccacagaaatcttagacaatgatctggttaagtttatagtgaaaatccttgtc

SEQ ID NO: 270688 - DNA, 75 bp, Artificial Sequence
  Synthetic
cactgcttgtttatccacactgttgataatggatgtcacatcctcatcagtgttgtcaccttcttgcaaggcact

SEQ ID NO: 270689 - DNA, 75 bp, Artificial Sequence
  Synthetic
ataatggatgtcacatcctcatcagtgttgtcaccttcttgcaaggcactaatgcagtgcctaatggatggtgac

SEQ ID NO: 270690 - DNA, 75 bp, Artificial Sequence
  Synthetic
ggtactttgattgggcagccacagtagcaccacaaaatatggtgcacagaaatgttgttacattggaccaatttc

SEQ ID NO: 270691 - DNA, 75 bp, Artificial Sequence
  Synthetic
ttctatcaaaccagggaccctttaagggctttaatgaagtgtcaacagcattcaggcacattgactggtggatac

SEQ ID NO: 270692 - DNA, 75 bp, Artificial Sequence
  Synthetic
gggctttaatgaagtgtcaacagcattcaggcacattgactggtggatacacactctattaaaaataaaagatat

SEQ ID NO: 270693 - DNA, 75 bp, Artificial Sequence
  Synthetic
tggttcagacaatagttttgaattgactataccatattccttctccacttggatgaggaagacacatggccacca

SEQ ID NO: 270694 - DNA, 75 bp, Artificial Sequence
  Synthetic
tagagagaaataaagaacacgtttgtgctatcttggattatgcctctgacattattgtggagtcaaaagaccaga

SEQ ID NO: 270695 - DNA, 75 bp, Artificial Sequence
  Synthetic
aagtttaaaccaattatggctatttgctttagaagttgccacaatagcattagcaatacagtttatagactattt

SEQ ID NO: 270696 - DNA, 75 bp, Artificial Sequence
  Synthetic
caagaactggctagaataccatcaagaattagcactcagaatgatctaattagagttgaaccaattggtgtttgg

SEQ ID NO: 270697 - DNA, 75 bp, Artificial Sequence
  Synthetic
aatctttcctaacacacacactatccagacagttacaaaaatcctgtaaattgaatggtgtgtataccaacccaa

SEQ ID NO: 270698 - DNA, 75 bp, Artificial Sequence
  Synthetic
gatgatttgggacaaactaggaaggagaaagacattgaaatgttgtgtaattgtatttcctcagttccatttata

SEQ ID NO: 270699 - DNA, 75 bp, Artificial Sequence
  Synthetic
attctggtgcattaaagaggagattcccatacatcatgcacatcagagcagccaaagcatacagtaaggctggaa

SEQ ID NO: 270700 - DNA, 75 bp, Artificial Sequence
  Synthetic
caggagagacagaagaactataattgttggaaacaacaacttgagaatcagactttagatgacctagatgatgca

SEQ ID NO: 270701 - DNA, 75 bp, Artificial Sequence
  Synthetic
gctcctaaaccaactggttcaggggctgctgtactttatgatgaaagtccttatgtaccaactgataataggaaa

SEQ ID NO: 270702 - DNA, 75 bp, Artificial Sequence
  Synthetic
ttatgtaccaactgataataggaaaatgcagttagcctatttagataggggtttttacaagcactatggtattat

SEQ ID NO: 270703 - DNA, 75 bp, Artificial Sequence
  Synthetic
cagatgcaatcccctacattgatgaatatcttaatattgagatgtctactttaattgaacaaatggaagctttca

SEQ ID NO: 270704 - DNA, 75 bp, Artificial Sequence
  Synthetic
gtcattgaggaagagtgtgaattggattatttcagggtgaagtaccttgaatcatctgtcaactcagagcatatt

SEQ ID NO: 270705 - DNA, 75 bp, Artificial Sequence
  Synthetic
taaatcaatgttgagctttgtggagagaaacaaggcttggttaacagtggtctcagccgtcactagtgcaattag

SEQ ID NO: 270706 - DNA, 75 bp, Artificial Sequence
  Synthetic
tatactacttctggtgaccaaaatttttaaaaaggaagactcaaaggatgagagagcttataacccaacacttcc

SEQ ID NO: 270707 - DNA, 75 bp, Artificial Sequence
  Synthetic
agagagcttataacccaacacttcctgccgcaaagccaaaaggagctttcccagtcacgcagagagagtttaaaa

SEQ ID NO: 270708 - DNA, 75 bp, Artificial Sequence
  Synthetic
atgaggcaccatatgacggacagttagaacacattatctcccagatggcatacataaccggttccacaacgggac

SEQ ID NO: 270709 - DNA, 75 bp, Artificial Sequence
  Synthetic
tacataaccggttccacaacgggacatctcacacactgtgcaggttaccaacatgatgagattattttacatgga

SEQ ID NO: 270710 - DNA, 75 bp, Artificial Sequence
  Synthetic
ttcaccactctggtggcatcaaaacacgggagggcactgaaagtacaaaaacaatcagttatactgtgaagtctt

SEQ ID NO: 270711 - DNA, 75 bp, Artificial Sequence
  Synthetic
gtaaaggtatgtgtggaggtttgcttatctctaaagtggaaggaaactttaaaattcttggaatgcacatagctg

SEQ ID NO: 270712 - DNA, 75 bp, Artificial Sequence
  Synthetic
aatcagccgcaaagtatagagtcaataaatttcaggtaaataatgaactatggcagggtgtcaaagcctgtgtta

SEQ ID NO: 270713 - DNA, 75 bp, Artificial Sequence
  Synthetic
agtccaaatttagggaaatttttggagttaatggtattgtggacatgaaaacagctattttgggaacatcccatg

SEQ ID NO: 270714 - DNA, 75 bp, Artificial Sequence
  Synthetic
agttaatggtattgtggacatgaaaacagctattttgggaacatcccatgtgaactccatggatctgagtacttc

SEQ ID NO: 270715 - DNA, 75 bp, Artificial Sequence
  Synthetic
aaatttcatgcactgctaaagggcaaccagatcaccacaatttttaacacttgtctaaaagatgagctaagaaaa

SEQ ID NO: 270716 - DNA, 75 bp, Artificial Sequence
  Synthetic
ttgtctaaaagatgagctaagaaaattggataagatttcagcaggtaagacaagatgcattgaggcctgtgaagt

SEQ ID NO: 270717 - DNA, 75 bp, Artificial Sequence
  Synthetic
ggactattgcatagtctatagaatgatcatgatggaaatctatgataaaatttatcagacaccatgttattattc

SEQ ID NO: 270718 - DNA, 75 bp, Artificial Sequence
  Synthetic
aggtctcgctgttgggatcaacccatacaaagattggcacttcatgattaatgcactaaatgattataattatga

SEQ ID NO: 270719 - DNA, 75 bp, Artificial Sequence
  Synthetic
aatggattactcccagtatgatggttcccttagttcaatgctattgtgggaggctgtggaagtcttggcttattg

SEQ ID NO: 270720 - DNA, 75 bp, Artificial Sequence
  Synthetic
tcatgattcacctgatcttgtcatgcaattacataaaccagtagtagattcagaccacgtggtctttaacgagag

SEQ ID NO: 270721 - DNA, 75 bp, Artificial Sequence
  Synthetic
atggttaattcatggcggtatgccatcagggtcaccatgtactactgtattaaattcattatgcaatctgatgat

SEQ ID NO: 270722 - DNA, 75 bp, Artificial Sequence
  Synthetic
gtgcatttacaccaccaatttaatcagcccaggaattgattgtttaccaattgtttatggtgatgatgttatcct

SEQ ID NO: 270723 - DNA, 75 bp, Artificial Sequence
  Synthetic
agcccaggaattgattgtttaccaattgtttatggtgatgatgttatcctgtcacttgataaagaaatagaccca

SEQ ID NO: 270724 - DNA, 75 bp, Artificial Sequence
  Synthetic
ttgtttatggtgatgatgttatcctgtcacttgataaagaaatagacccagagaaactacagggtgtcatggcag

SEQ ID NO: 270725 - DNA, 75 bp, Artificial Sequence
  Synthetic
tcctacttaatggagttatgcctccatggaaaagacacttacttacactacatcaaaattttggatccatacttg

SEQ ID NO: 270726 - DNA, 75 bp, Artificial Sequence
  Synthetic
aaagagtggaatatcacagtggatgattatgatgttgttattgctaagttgatgcccatggtgtttgactaaaat

SEQ ID NO: 270727 - DNA, 75 bp, Artificial Sequence
  Synthetic
atggactatattattagagcactaattcaattagaacattaatttggaatattggacataccaaaaaaaaaaaaa

SEQ ID NO: 270728 - DNA, 75 bp, Artificial Sequence
  Synthetic
tttgaaaggggtctcctagagagcttgcctagggccttataacccgacttgctgagcttctataggaaaaaaccc

SEQ ID NO: 270729 - DNA, 75 bp, Artificial Sequence
  Synthetic
aaaaattccaaatattatactaacaaaattgggacagagagtatgttgatttggatgactgaacaaggcattatc

SEQ ID NO: 270730 - DNA, 75 bp, Artificial Sequence
  Synthetic
tttcccagccttggggtggctggtcaataaaaacccccatagtaaccaacacctaagacaatttgatcaacccta

SEQ ID NO: 270731 - DNA, 75 bp, Artificial Sequence
  Synthetic
tgcctggtccccactattcgaaggcaacttgcaataagaagagtggaacaaggatgcttaaagcatagtgtaaat

SEQ ID NO: 270732 - DNA, 75 bp, Artificial Sequence
  Synthetic
aggatgcttaaagcatagtgtaaatgatcttttctaacctgtattatgtacagggtggcagatggcgtgccataa

SEQ ID NO: 270733 - DNA, 75 bp, Artificial Sequence
  Synthetic
atctattagtgggataccacgcttgtggaccttatgcccacacagccatcctctagtaagtttgtaaaatgtctg

SEQ ID NO: 270734 - DNA, 75 bp, Artificial Sequence
  Synthetic
gtgagatgtgggaacttattggaaacaacaatttgcttaatagcatcctagtgccagcggaacaacatctggtaa

SEQ ID NO: 270735 - DNA, 75 bp, Artificial Sequence
  Synthetic
cagatgcctctggggccaaaagccaaggtttgacagacccattaggattggtttcaaaacctgaattgttgtgga

SEQ ID NO: 270736 - DNA, 75 bp, Artificial Sequence
  Synthetic
aggtttgacagacccattaggattggtttcaaaacctgaattgttgtggaagatattcagtacctatcaatctgg

SEQ ID NO: 270737 - DNA, 75 bp, Artificial Sequence
  Synthetic
gcccacgaaggatgcccagaaggtacccgcaggtaacaagagacactgtggatctgatctggggccaactacctc

SEQ ID NO: 270738 - DNA, 75 bp, Artificial Sequence
  Synthetic
tatcaggtgagttagttaaaaaacgtctagtgggccaaacccaggggggatccctggtttccttttattgttaat

SEQ ID NO: 270739 - DNA, 75 bp, Artificial Sequence
  Synthetic
attgacattatggagacaattaagagtattgcagatatggctactggtgttgtaagttctgttgattctaccatc

SEQ ID NO: 270740 - DNA, 75 bp, Artificial Sequence
  Synthetic
aatgcagtcaatgaaaaggtagaaagcgtcggtaatgaaattggaggtaatttgttaactaaagtagctgatgat

SEQ ID NO: 270741 - DNA, 75 bp, Artificial Sequence
  Synthetic
gcttccaatatcctaggaccaaattgttttgcaacgactgctgaaccagagaacaagaatgtagttcaagccact

SEQ ID NO: 270742 - DNA, 75 bp, Artificial Sequence
  Synthetic
actactgttaatactaccaacttgactcaacatccatcggcacctacgatgcccttttcaccagatttctccaat

SEQ ID NO: 270743 - DNA, 75 bp, Artificial Sequence
  Synthetic
gtcgacaattttcactctatggcttatgacatcacaactggggacaaaaatcccagtaaattggttcgtcttgaa

SEQ ID NO: 270744 - DNA, 75 bp, Artificial Sequence
  Synthetic
acccatgagtggacgccatcttgggcaagaggataccagattacacatgtagaattacctaaagttttttgggat

SEQ ID NO: 270745 - DNA, 75 bp, Artificial Sequence
  Synthetic
caccaagacaagcccgcatatggacaatcacgctactttgcggctgtaagatgtggctttcactttcaagtacaa

SEQ ID NO: 270746 - DNA, 75 bp, Artificial Sequence
  Synthetic
cataaaccagtaatagattcagaccatgtggtcttcaacgagagatggttaattcatggcggtatgccatcaggg

SEQ ID NO: 270747 - DNA, 75 bp, Artificial Sequence
  Synthetic
gttaatgtgaatcaaggtactgcaggcagtgccttggtagtatatgaacctaaaccagttgtcacttatgattca

SEQ ID NO: 270748 - DNA, 75 bp, Artificial Sequence
  Synthetic
tcaccatgtactactgtactaaattcattgtgtaatctgatgatgtgcatttacactaccaatttaatcagtcca

SEQ ID NO: 270749 - DNA, 75 bp, Artificial Sequence
  Synthetic
aaactggaatttggagcctttacaaatcttccacatgttttgatgaatttggctgaaaccacacaggctgactta

SEQ ID NO: 270750 - DNA, 75 bp, Artificial Sequence
  Synthetic
tgtatcccctatgttgctgacacaaactatgtcaagaccgattcgtcagacttagggcagttaaaagtctatgtc

SEQ ID NO: 270751 - DNA, 75 bp, Artificial Sequence
  Synthetic
ctgcagggtgtcatggcagattcatttggagctgaagtgactggttctcgcaaggatgagcctccatcattaaaa

SEQ ID NO: 270752 - DNA, 75 bp, Artificial Sequence
  Synthetic
tggactccattgtcaatccccactggatctgctaaccaagttgatgtcaccatactgggtagcttgttgcaatta

SEQ ID NO: 270753 - DNA, 75 bp, Artificial Sequence
  Synthetic
gacttccaaaatccaagggtatttgctcaagatgtcaacatatatgataatgcaccaaatggtaaaaagaaaaat

SEQ ID NO: 270754 - DNA, 75 bp, Artificial Sequence
  Synthetic
tggaagaaaattatgaccatgagcacaaaatacaaatggaccagaacaaaaatcgatatagcagaaggtcctggt

SEQ ID NO: 270755 - DNA, 75 bp, Artificial Sequence
  Synthetic
tcaatgaacatggcaaatgtcctttgtacaactggtgctcaatcagtggctttagtaggtgaaagagctttctat

SEQ ID NO: 270756 - DNA, 75 bp, Artificial Sequence
  Synthetic
gatcctagaactgcaggcagtaaatcaagatttgatgatcttgttaagatagcccagttattctcagtgatggca

SEQ ID NO: 270757 - DNA, 75 bp, Artificial Sequence
  Synthetic
atatcattagaacactaattcagttagaacactaatttggaatattggacataccaaaaaaaaaaaaaaaaaaaa

SEQ ID NO: 270758 - DNA, 75 bp, Artificial Sequence
  Synthetic
gattcaaccactccatcagaaaatcatggagttgatgcaaaaggatatttcaagtggtcagcaacaacagccccc

SEQ ID NO: 270759 - DNA, 75 bp, Artificial Sequence
  Synthetic
agtccctttcccagccctgaggcggctggtcaataaaagcctcaaatgtaactaacatctaagattgatttaata

SEQ ID NO: 270760 - DNA, 75 bp, Artificial Sequence
  Synthetic
actaacatctaagattgatttaataaccccatgcctgatccccaccagtcgaagacaactagtaataagacgggt

SEQ ID NO: 270761 - DNA, 75 bp, Artificial Sequence
  Synthetic
cagagtattgtccacagaaatattgtctacttaagactatttccaaatttgaatgtttttgttaacagttattca

SEQ ID NO: 270762 - DNA, 75 bp, Artificial Sequence
  Synthetic
tactttaggggttcattagttttaagattgagcgtctacgccagtactttcaatagaggtcgattgaggatgggc

SEQ ID NO: 270763 - DNA, 75 bp, Artificial Sequence
  Synthetic
ttcttccccaatgccacaacggactcaacttccaccttggacaatgctatatacacaatatgtgatataggtagt

SEQ ID NO: 270764 - DNA, 75 bp, Artificial Sequence
  Synthetic
gacaatagttttgaaattacaatcccttactctttttccacttggatgaggaaaacaaatggccacccaattgga

SEQ ID NO: 270765 - DNA, 75 bp, Artificial Sequence
  Synthetic
ggtaacaggtgcccctggggccaaaagccaaggtttaacagaccctttaggattggttaaaacctgaattgttgt

SEQ ID NO: 270766 - DNA, 75 bp, Artificial Sequence
  Synthetic
ttgtttcaaattgaagtcttaaacaggctcacatacaacagttctagtccatcggaggtttattgtatagtccaa

SEQ ID NO: 270767 - DNA, 75 bp, Artificial Sequence
  Synthetic
ggtaaaatgggacaagatgccaggttcttctgcccaactggttctgttgttacattccagaattcatggggttca

SEQ ID NO: 270768 - DNA, 75 bp, Artificial Sequence
  Synthetic
cagatggatttaaccgaccctctttgtattgaagatgacacagaaaattgcaaacaaacaatgtctccaaatgaa

SEQ ID NO: 270769 - DNA, 75 bp, Artificial Sequence
  Synthetic
ttctatcatggtgagttggtttaaaaacgtctagtgggccaaacccaggggggatccctggtttctttttatttc

SEQ ID NO: 270770 - DNA, 75 bp, Artificial Sequence
  Synthetic
ctaggactcacttcagcccaagatgatggcccacttggtcaagaaaagccaaattattttctcaattttaggtcg

SEQ ID NO: 270771 - DNA, 75 bp, Artificial Sequence
  Synthetic
actactgccaatatggagacaatcaagagcattgcagacatggccactggtatcacaaaaactgttgactctaca

SEQ ID NO: 270772 - DNA, 75 bp, Artificial Sequence
  Synthetic
atgaatgtggacatttttactgtatcacatactaaagtagataacctatttgggcgggcatggttttttatggag

SEQ ID NO: 270773 - DNA, 75 bp, Artificial Sequence
  Synthetic
catactttcaccaatgagggacaatggagagtgccattggaatttccaaaacaaggtcatgggtccttatcactg

SEQ ID NO: 270774 - DNA, 75 bp, Artificial Sequence
  Synthetic
ttgtttgcttattttactggtgaactgaatatccatgttctgttcctaagtgagagggggtttctgagggttgca

SEQ ID NO: 270775 - DNA, 75 bp, Artificial Sequence
  Synthetic
agaaaataaggatgtagtacaggcaacgactactgtcaacactacaaacttaacccaacacccatcagcgccaac

SEQ ID NO: 270776 - DNA, 75 bp, Artificial Sequence
  Synthetic
cacacatatgacactagtaatgatcgagtcaattttctgtcatcgaacggtgtaataactgtaccagccggagag

SEQ ID NO: 270777 - DNA, 75 bp, Artificial Sequence
  Synthetic
tatgccgttcaccccagattttgcaaatgtagacaatttccattccatggcttatgatatcactagcggggataa

SEQ ID NO: 270778 - DNA, 75 bp, Artificial Sequence
  Synthetic
cagatgacactttcagctccctactattcaaacaaaccattaagaactgtcagagataacaatagtcttggttat

SEQ ID NO: 270779 - DNA, 75 bp, Artificial Sequence
  Synthetic
tgtagagttacccaaagctttttggaatgaacaacggaaacccgcatatggccaggccaaatattttgctgctgt

SEQ ID NO: 270780 - DNA, 75 bp, Artificial Sequence
  Synthetic
ttgatgtgcaagcccttcttgactggaacctctactggtaaaattgaggtttatcttagcctgagatgtccaaat

SEQ ID NO: 270781 - DNA, 75 bp, Artificial Sequence
  Synthetic
aatgaacaacggaaacccgcatatggccaggccaaatattttgctgctgttagatgcggtttccatttccaagta

SEQ ID NO: 270782 - DNA, 75 bp, Artificial Sequence
  Synthetic
ttctttttccctcttcctgcccctaaggttacgagtagtcgtgcactacggggtgatatggcaaaccttacaaat

SEQ ID NO: 270783 - DNA, 75 bp, Artificial Sequence
  Synthetic
cagagtccatatggtcaacaaccacagaatcgtatgatgaaactagcatatttagatagaggtttctacaaacat

SEQ ID NO: 270784 - DNA, 75 bp, Artificial Sequence
  Synthetic
acaaaaatggagtttggtgcatttactaatttaccacatgtgttaatgaacttggcagagacaacacaagctgac

SEQ ID NO: 270785 - DNA, 75 bp, Artificial Sequence
  Synthetic
tatggcattatagttggagaccatgtgtaccaactagattcagatgacattttcaagacagcattgacaggaaaa

SEQ ID NO: 270786 - DNA, 75 bp, Artificial Sequence
  Synthetic
ggacttagggcacttgagagtttatgtctggacacccctttctatgccaacgggaataacaacacaggtggatgt

SEQ ID NO: 270787 - DNA, 75 bp, Artificial Sequence
  Synthetic
gccaaatttactaaaactaagttgacttcagattgggttattgaagaagagtgtgaattagactactttagaatc

SEQ ID NO: 270788 - DNA, 75 bp, Artificial Sequence
  Synthetic
aaatatcttgaatcagctgtggattcagagcacattttttcagtagacaaaaactgtgaaaccattgccaaggat

SEQ ID NO: 270789 - DNA, 75 bp, Artificial Sequence
  Synthetic
gactgtactgggtagcttgttacaacttgacttccagaaccctaggccctacaataaacaagtcaatatttatga

SEQ ID NO: 270790 - DNA, 75 bp, Artificial Sequence
  Synthetic
atttttggaacccatacactaagccaacatcaagcaatagggttagtgggaaccattttattgactgctggcctt

SEQ ID NO: 270791 - DNA, 75 bp, Artificial Sequence
  Synthetic
atgtcaactataaaaaccccagttaatgctgtgacaataaaagaattctttaatcatgccatagatggcgatgag

SEQ ID NO: 270792 - DNA, 75 bp, Artificial Sequence
  Synthetic
gtacaactggagcccagtcggttgcccttgttggtgagcgtgctttttatgacccaaggtcagctggaagtaggt

SEQ ID NO: 270793 - DNA, 75 bp, Artificial Sequence
  Synthetic
caaggtctttccttgcttgtacaaaaatgtactacattcttttcttctgctgcaactgagattttggataatgat

SEQ ID NO: 270794 - DNA, 75 bp, Artificial Sequence
  Synthetic
ttagtcaagttcatagtgaaaatcctggtgagaatactttgctacatggtactttattgccataaacctaacatt

SEQ ID NO: 270795 - DNA, 75 bp, Artificial Sequence
  Synthetic
gattctgacacaccatccaccacacatgggcacgatgccaagggttattttaaatggtctgctactaccaatcct

SEQ ID NO: 270796 - DNA, 75 bp, Artificial Sequence
  Synthetic
ttgactactgcttgcttatccactcttttaataatggatgttacttcctcttcagtgctgtcaccttcttgtaaa

SEQ ID NO: 270797 - DNA, 75 bp, Artificial Sequence
  Synthetic
atgtatattgtccacagaaatatagtgtatctgagactttttccaaacattaataattttgtaaatagtttctca

SEQ ID NO: 270798 - DNA, 75 bp, Artificial Sequence
  Synthetic
gccttgatgcagtgtctgatggatggtgatgttaagaaactggctgaaattgtggcagaatcaatgtccaacact

SEQ ID NO: 270799 - DNA, 75 bp, Artificial Sequence
  Synthetic
gatgatgatgaagttaaggagcaaatatgtgacacagtaaagtatactaagaccatcctatcaaatcaaggacct

SEQ ID NO: 270800 - DNA, 75 bp, Artificial Sequence
  Synthetic
tttaaaggattcaatgaagtttccacagcatttaggcatatagactggtggatacatacattactcaaaatcaaa

SEQ ID NO: 270801 - DNA, 75 bp, Artificial Sequence
  Synthetic
gatatggttcttagtgttttcaaacccagcatagaaagcaaggctattcagtggttggagagaaataaggaacat

SEQ ID NO: 270802 - DNA, 75 bp, Artificial Sequence
  Synthetic
gtttgtagtatccttgattatgcctcagacattattgttgagtcaaaagaccaatctaagatgaagactcaagat

SEQ ID NO: 270803 - DNA, 75 bp, Artificial Sequence
  Synthetic
ttctaccaaaggtattcagattgtttggccaagttcaagccaatcatggcaatttgctttagaagctgccacaac

SEQ ID NO: 270804 - DNA, 75 bp, Artificial Sequence
  Synthetic
cagatggacctcagcgacccattgtgcattgaagatgatgctgaaaactgcaaacaaacaatatccccaaatgaa

SEQ ID NO: 270805 - DNA, 75 bp, Artificial Sequence
  Synthetic
agtatcagcaacacagtttacagacttttccaggagctggccaggatccccaaccgaatcagtaccaataatgat

SEQ ID NO: 270806 - DNA, 75 bp, Artificial Sequence
  Synthetic
ttaattagaattgagcccattggcatttggatccaaggtgagccaggacaaggaaaatctttcttgacccacacc

SEQ ID NO: 270807 - DNA, 75 bp, Artificial Sequence
  Synthetic
cccatacaaaagtggacaatgtatttggccgcgcatggtttgttacaagccatgattttaataacgagggacaat

SEQ ID NO: 270808 - DNA, 75 bp, Artificial Sequence
  Synthetic
ctctccagacaattacaaaaatcatgtaagcttaatggtgtttttactaatccaactgctagtgagttcatggat

SEQ ID NO: 270809 - DNA, 75 bp, Artificial Sequence
  Synthetic
ggttatgataatcaggacattcatttgattgatgacttgggtcaaacaagaaaagagaaagatattgaaatgttg

SEQ ID NO: 270810 - DNA, 75 bp, Artificial Sequence
  Synthetic
ttgtttgcatattttactggggaattaaatatacatgttctattcttgtcagacaaaggcttcttgagggttgta

SEQ ID NO: 270811 - DNA, 75 bp, Artificial Sequence
  Synthetic
taaatatacatgttctattcttgtcagacaaaggcttcttgagggttgtacacacttatgacactgctgacaata

SEQ ID NO: 270812 - DNA, 75 bp, Artificial Sequence
  Synthetic
tgcaattgcatttcttctgttccctttattgtgccaatggcacatcttgaagaaaaagggaaattttatactagc

SEQ ID NO: 270813 - DNA, 75 bp, Artificial Sequence
  Synthetic
agacaaaggcttcttgagggttgtacacacttatgacactgctgacaatagattaattaacttggcctctaatgg

SEQ ID NO: 270814 - DNA, 75 bp, Artificial Sequence
  Synthetic
aagttagttgttgccaccactaacaagtcagatttttctagcacggtcctccaggattctggggcactgaagagg

SEQ ID NO: 270815 - DNA, 75 bp, Artificial Sequence
  Synthetic
caaatgtcattatcagcccctttctattcccacaagccattgaggacggttagggatactcatagcttaggtagg

SEQ ID NO: 270816 - DNA, 75 bp, Artificial Sequence
  Synthetic
agattcccttacattatgcacattcgagcagcaaaggcctacagcaaggctggaaagctcaatgtaagccaggcc

SEQ ID NO: 270817 - DNA, 75 bp, Artificial Sequence
  Synthetic
ctcatttgcaaaccattcctgactggaacaacatctggcaggatagaagtatatatgagtcttaggtgcccaaat

SEQ ID NO: 270818 - DNA, 75 bp, Artificial Sequence
  Synthetic
atggcaacaatgtcaactggtgagtgctgggaagtatcaaagaatggaagggattgggaaacactaaaattgaaa

SEQ ID NO: 270819 - DNA, 75 bp, Artificial Sequence
  Synthetic
gacctagttgacaaaattacaatcgattataatgagagggttaagaattataatgcttggaaacaacaattggaa

SEQ ID NO: 270820 - DNA, 75 bp, Artificial Sequence
  Synthetic
tgctttacgaggtgatatggctaatttgacaaatcagagtccttatgaccagcagccccgaaatcaaatgatgaa

SEQ ID NO: 270821 - DNA, 75 bp, Artificial Sequence
  Synthetic
aatcagactcttgatgatctagatgatgctgtatcatacattaagcacaatttcccagatgccataccatatgtt

SEQ ID NO: 270822 - DNA, 75 bp, Artificial Sequence
  Synthetic
attggcttacctaaatagaggtttctataaacattatggtattatagttggggagcatgtataccaattagattc

SEQ ID NO: 270823 - DNA, 75 bp, Artificial Sequence
  Synthetic
tataaacattatggtattatagttggggagcatgtataccaattagattcagacgacatctttaaaacagcatta

SEQ ID NO: 270824 - DNA, 75 bp, Artificial Sequence
  Synthetic
gatgagtatcttaatattgaaatgtcaacattaattgaacaaatggaggctttcatagaaccaaagcctagtgtc

SEQ ID NO: 270825 - DNA, 75 bp, Artificial Sequence
  Synthetic
ttcaaatgctttgctaacaaaattggttcaaaaatttctaaagcttctagggaagttgtggactggttttcagat

SEQ ID NO: 270826 - DNA, 75 bp, Artificial Sequence
  Synthetic
tttagaatcaagtatcttgaatcagctgtaaattcagagcatatcttttcagtggacaaaaactgtgaaaccatc

SEQ ID NO: 270827 - DNA, 75 bp, Artificial Sequence
  Synthetic
aaaattaaatccatgctcagttttgttgagaggaataaggcttggctcacagttgtatctgctgtcaccagtgct

SEQ ID NO: 270828 - DNA, 75 bp, Artificial Sequence
  Synthetic
gccaaggatatttttgggacacatactctgagccaacaccaagctattggcctaattggtactattcttttaact

SEQ ID NO: 270829 - DNA, 75 bp, Artificial Sequence
  Synthetic
attagtatacttttgttggtaacaaagatcttcaagaaagaggaatctaaagatgagagagcttataatcctact

SEQ ID NO: 270830 - DNA, 75 bp, Artificial Sequence
  Synthetic
gctgggcttatgtcaaccattaaaacaccagtcaatgcaaccaccatcaaagagtttttcaatcatgcgatagaa

SEQ ID NO: 270831 - DNA, 75 bp, Artificial Sequence
  Synthetic
ttaccggttgccaaacccaagggcactttcccagtttcccagcgggagttcaaaaatgaagctccttatgatgga

SEQ ID NO: 270832 - DNA, 75 bp, Artificial Sequence
  Synthetic
agagtttttcaatcatgcgatagaaggtgatgaacagggactatctctccttgtgcaaaagtgtactactttttt

SEQ ID NO: 270833 - DNA, 75 bp, Artificial Sequence
  Synthetic
caattggaacacatcatttctcaaatggcatatattactggttcaacaactggccatatgactcattgcgccggt

SEQ ID NO: 270834 - DNA, 75 bp, Artificial Sequence
  Synthetic
tatcaacatgatgaaattatactccatggtcattccattaagtatttagaacaagaagatgaattgacactacat

SEQ ID NO: 270835 - DNA, 75 bp, Artificial Sequence
  Synthetic
tacaagaataaagttttcccaattgaacaaccatctgttacccaagtgacacttggtggtaaaccaatggatttg

SEQ ID NO: 270836 - DNA, 75 bp, Artificial Sequence
  Synthetic
gctattctcaagtgtaagttgcctttcaggttcaagaaaaactctaaatattacaccaacaagattggaactgaa

SEQ ID NO: 270837 - DNA, 75 bp, Artificial Sequence
  Synthetic
agtatgctaatctggatgactgagcaaggcattattaccaaggaagtccaaagagtgcaccattcaggtggcatc

SEQ ID NO: 270838 - DNA, 75 bp, Artificial Sequence
  Synthetic
aagacaagggaaggaactgaaagcacaaagactatcagttatactgttaaatcttgcaaaggaatgtgtggtggc

SEQ ID NO: 270839 - DNA, 75 bp, Artificial Sequence
  Synthetic
agattggtggattcatacattacttaaaatcaaagacatggtccttagtgtattcaagccaagtctagaaagtaa

SEQ ID NO: 270840 - DNA, 75 bp, Artificial Sequence
  Synthetic
ctacttatttcaaaagtagaaggtaacttcaaaatcctgggtatgcatattgctggtaatggtgaaatgggagta

SEQ ID NO: 270841 - DNA, 75 bp, Artificial Sequence
  Synthetic
actatgcttctgatatcattgtggagtcaaaggatcagtccaaagttaaaactcaagatttttatcagagatact

SEQ ID NO: 270842 - DNA, 75 bp, Artificial Sequence
  Synthetic
gctataccctttaattttcttaaaaatgacatgtctgatcaaggcattgttactgagatcactccaatccagccc

SEQ ID NO: 270843 - DNA, 75 bp, Artificial Sequence
  Synthetic
atgtatataaacactaaaactcagatccacaagagccctgtctatggtgctgttgaggtgaaaatgggtccagct

SEQ ID NO: 270844 - DNA, 75 bp, Artificial Sequence
  Synthetic
gtcctaagtaagtcagacaccaggttggaggaacctgtagaatgtcttattaaaaaatcggcttccaagtacaga

SEQ ID NO: 270845 - DNA, 75 bp, Artificial Sequence
  Synthetic
gttaacaaattccaggtgaacaatgaactctggcaaggtgtcaaagcatgtgttaaatctaaattcagagaaatc

SEQ ID NO: 270846 - DNA, 75 bp, Artificial Sequence
  Synthetic
tttggaatgaatggtattgttgacatgaaaactgccattttaggaacttctcatgtaaattctatggatttgagc

SEQ ID NO: 270847 - DNA, 75 bp, Artificial Sequence
  Synthetic
acttcagctggttatagttttgttaaatctggctacaaaaagaaagatctaatttgcttggaaccattctcagta

SEQ ID NO: 270848 - DNA, 75 bp, Artificial Sequence
  Synthetic
gaaatgctatgcaattgtatttcttctgtcccatttattgtaccgatggcacatcttgaagaaaaaggaaagttc

SEQ ID NO: 270849 - DNA, 75 bp, Artificial Sequence
  Synthetic
gccccattgttagagaggcttgtacaggacaaattccacaacttactaaaagggaatcaaataactacaaccttc

SEQ ID NO: 270850 - DNA, 75 bp, Artificial Sequence
  Synthetic
tacaccagtaaattggtcattgccaccaccaacaaatcagacttttccagcacagttctccaggattctggggca

SEQ ID NO: 270851 - DNA, 75 bp, Artificial Sequence
  Synthetic
aacacttgccttaaagatgagttaagaaagctagataagattgcctcaggaaaaactaggtgtatagaggcttgt

SEQ ID NO: 270852 - DNA, 75 bp, Artificial Sequence
  Synthetic
ttaaagaggagattcccttatatcatgcatatccgggctgcaaaggcttatagtaaggctggaaagcttaatgta

SEQ ID NO: 270853 - DNA, 75 bp, Artificial Sequence
  Synthetic
gaagttgattattgcattgtttacagaatgatcatgatggaaatttatgacaagatttatcaaactccatgttac

SEQ ID NO: 270854 - DNA, 75 bp, Artificial Sequence
  Synthetic
tagtaaggctggaaagcttaatgtaagtcaagctatggcagcaatgtcaacaggtgagtgttgggaggtgtcaaa

SEQ ID NO: 270855 - DNA, 75 bp, Artificial Sequence
  Synthetic
tactcaggactagctgttggaatcaacccatacaaagattggcacttcatgattaatgctctcaatgattacaat

SEQ ID NO: 270856 - DNA, 75 bp, Artificial Sequence
  Synthetic
gaatggaagagactgggaaacactgaaattaaaagaattagttgataaaattacaattgattacaacgagagggt

SEQ ID NO: 270857 - DNA, 75 bp, Artificial Sequence
  Synthetic
tatgaaatggactattctcaatatgatggctcccttagttcaatgttgctatgggaggctgtggaagttctagct

SEQ ID NO: 270858 - DNA, 75 bp, Artificial Sequence
  Synthetic
aaaaaattacaatgcttggaaacagcagctagagaatcaaactttagatgatttagatgatgctgtatcatatat

SEQ ID NO: 270859 - DNA, 75 bp, Artificial Sequence
  Synthetic
tactgtcatgattcacctgatctcgtgatgcaactgcacaaaccagtcattgactctgaccatgttgttttcaac

SEQ ID NO: 270860 - DNA, 75 bp, Artificial Sequence
  Synthetic
ccatatatcgatgagtatctcaatattgagatgtcaacactaatcgagcaaatggaagctttcatagaaccaaaa

SEQ ID NO: 270861 - DNA, 75 bp, Artificial Sequence
  Synthetic
gagagatggttgattcatggtggtatgccatcaggatctccatgtactactgtgttaaattcactatgcaatttg

SEQ ID NO: 270862 - DNA, 75 bp, Artificial Sequence
  Synthetic
cccagtgtctttaaatgttttgccaataagattggctcaaagatatctaaagcctctaaagaagtggtagattgg

SEQ ID NO: 270863 - DNA, 75 bp, Artificial Sequence
  Synthetic
atgatgtgtatttacactacaaatttaatcagtcctggaattgattgtctaccaatcgtatatggcgatgatgtt

SEQ ID NO: 270864 - DNA, 75 bp, Artificial Sequence
  Synthetic
agcctctaaagaagtggtagattggttttcaagcaaaattaagtctatgttaagttttgttgagaggaacaaggc

SEQ ID NO: 270865 - DNA, 75 bp, Artificial Sequence
  Synthetic
ggcagattcatttggagccgaagtgactgggtcacgcaaagatgaacctccttcacttaaaccaagaatggaggt

SEQ ID NO: 270866 - DNA, 75 bp, Artificial Sequence
  Synthetic
actgggtcacgcaaagatgaacctccttcacttaaaccaagaatggaggttgaattcttaaagcggaaacctggt

SEQ ID NO: 270867 - DNA, 75 bp, Artificial Sequence
  Synthetic
tatttcccagagtctacttttatagtaggtaaattagacactgaaaatatgatacaacatttaatgtggatgaaa

SEQ ID NO: 270868 - DNA, 75 bp, Artificial Sequence
  Synthetic
aactttagcacatttaagcagcagctccaatcctatttaatggaactatgcctccatggaaaagacacttatcaa

SEQ ID NO: 270869 - DNA, 75 bp, Artificial Sequence
  Synthetic
cactacattaagatcttggaaccatatctacaggaatggaatatcactgtggatgattatgatgtggttataact

SEQ ID NO: 270870 - DNA, 75 bp, Artificial Sequence
  Synthetic
aagttgatgcccatggtgtttgattaagattaatgttttgtttttcttttgctatggactatgtggttagaacac

SEQ ID NO: 270871 - DNA, 75 bp, Artificial Sequence
  Synthetic
gtttttcttttgctatggactatgtggttagaacactaattaattaggacactaacttggaacattggacatgac

SEQ ID NO: 270872 - DNA, 75 bp, Artificial Sequence
  Synthetic
ggaacagaaagtatgttgatttggatgactgagcagggcattataacaaaagaagtccaaagagttcaccattct

SEQ ID NO: 270873 - DNA, 75 bp, Artificial Sequence
  Synthetic
ttttcccagccctgaggcggctggtcaataaaagcctcaaacgtaactaacacctaagaagatcatgtaaaccct

SEQ ID NO: 270874 - DNA, 75 bp, Artificial Sequence
  Synthetic
atgcctggtctccactattcgaaggcaacttgcaataagaagagtgggatcaagacgcttaaagcatagagacag

SEQ ID NO: 270875 - DNA, 75 bp, Artificial Sequence
  Synthetic
tgtggcggtctgctcatttctaaggtggaagggaatttcaaaatacttggaatgcacatagctggaaatggagaa

SEQ ID NO: 270876 - DNA, 75 bp, Artificial Sequence
  Synthetic
caagacgcttaaagcatagagacagttttcttttctaacccacatttgtgtggggtggcagatggcgtgccataa

SEQ ID NO: 270877 - DNA, 75 bp, Artificial Sequence
  Synthetic
ttctcaagaatgatatgtctgatcaaggcattatcacagatgtgacacccatacagcccatgtacatcaatacta

SEQ ID NO: 270878 - DNA, 75 bp, Artificial Sequence
  Synthetic
aggcattatcacagatgtgacacccatacagcccatgtacatcaatactaaaacccaaatccataagagtccagt

SEQ ID NO: 270879 - DNA, 75 bp, Artificial Sequence
  Synthetic
gtgacgtgtgggaacttattggaaacaacattttgctgcaaagcatcctactgccagcggaaaaacacctggtaa

SEQ ID NO: 270880 - DNA, 75 bp, Artificial Sequence
  Synthetic
accctagacttgaagagccagttgagtgcttaatcaagaaatccgctgcaaagtacagagtcaataaattccagg

SEQ ID NO: 270881 - DNA, 75 bp, Artificial Sequence
  Synthetic
caggtgcctctggggccaaaagccaaggtttaacagaccctttaggattggttctaaacctgagatgttgtggaa

SEQ ID NO: 270882 - DNA, 75 bp, Artificial Sequence
  Synthetic
aggtttaacagaccctttaggattggttctaaacctgagatgttgtggaagatatttagtacctgctgatctggt

SEQ ID NO: 270883 - DNA, 75 bp, Artificial Sequence
  Synthetic
cccatgaaggatgcccagaaggtacccgtaggtaacaagtgacactatggatctgatttggggccagatacctct

SEQ ID NO: 270884 - DNA, 75 bp, Artificial Sequence
  Synthetic
atcttggtgatctggttaaaaaacatctaatgggccaaacccgggggggatccccggtttcctcttattctatca

SEQ ID NO: 270885 - DNA, 75 bp, Artificial Sequence
  Synthetic
atgccactatggagacaattaagaatattgcagacatggcaactggagtagtcagttcagtcgattcaactatca

SEQ ID NO: 270886 - DNA, 75 bp, Artificial Sequence
  Synthetic
acgcagttaatgagaaggtggaaaatgtaggtaatgaaattggaggtaatttactaactaaggttgcagatgacg

SEQ ID NO: 270887 - DNA, 75 bp, Artificial Sequence
  Synthetic
catctaacgtgcttgggccaaattgttacgctacaacagctgaacctgagaacaaagatgtagttcaggcaacca

SEQ ID NO: 270888 - DNA, 75 bp, Artificial Sequence
  Synthetic
aacaaagatgtagttcaggcaaccacaactgtcaacacaactaatttgacacaacatccctcagcaccaacaatg

SEQ ID NO: 270889 - DNA, 75 bp, Artificial Sequence
  Synthetic
ccctgttactactcagggcttgctgtgggtattaacccatataaagattggcactttatgatcaatgcactaaat

SEQ ID NO: 270890 - DNA, 75 bp, Artificial Sequence
  Synthetic
tgacatcaccactggggagaaaaaccctagcaaattggttagattggaaactcatgagtggacaccaacctgggc

SEQ ID NO: 270891 - DNA, 75 bp, Artificial Sequence
  Synthetic
aatgcttctgtgggaggcagtggaagtactggcatactgtcatgactcaccagatcttgtgatgcaactccataa

SEQ ID NO: 270892 - DNA, 75 bp, Artificial Sequence
  Synthetic
tagaggatatcagataacccatgtggaattaccaaaagtcttttgggacaaaaacagtaagccagcctatggtca

SEQ ID NO: 270893 - DNA, 75 bp, Artificial Sequence
  Synthetic
atcaagatattttgcagcagtacggtgtggtttccattttcaagtacaagtgaatgttaatcaagggacagctgg

SEQ ID NO: 270894 - DNA, 75 bp, Artificial Sequence
  Synthetic
tgcaatttgatgatgtgtgtttacaccacaaatttgatcagcccaggaatcgattgcctacctatagtttatggt

SEQ ID NO: 270895 - DNA, 75 bp, Artificial Sequence
  Synthetic
tagtgcactggtggtgtacgagcccaaacctgttgtgacatatgactcaaaattggaattcggagcatttactaa

SEQ ID NO: 270896 - DNA, 75 bp, Artificial Sequence
  Synthetic
gatgatgtcattctgtcattagacaaagaaatagaaccagagagactgcaaagtatcatggcagaatcatttgga

SEQ ID NO: 270897 - DNA, 75 bp, Artificial Sequence
  Synthetic
tctgccacatgtgttgatgaatttagccgaaaccacacaggctgatttatgtatcccctatgttgctgacacaaa

SEQ ID NO: 270898 - DNA, 75 bp, Artificial Sequence
  Synthetic
ttccgccacacaagtagatgtgaccatactgggtagtttattgcaattggacttccaaaatcctagggtatttgg

SEQ ID NO: 270899 - DNA, 75 bp, Artificial Sequence
  Synthetic
tcaagacgttggcatttatgacaatgcaccaacacggaagcaaaatatcaaaaagattctcacaatgagtaccaa

SEQ ID NO: 270900 - DNA, 75 bp, Artificial Sequence
  Synthetic
ggagttatgcctccatggaaaagacatttatcagcactacatcaaaattttggatccatacctcaaagaatggaa

SEQ ID NO: 270901 - DNA, 75 bp, Artificial Sequence
  Synthetic
tgaacatggcaaatgtgttgagcaccactgcagcgcaatcaattgctttggttggggaaagagcattctatgacc

SEQ ID NO: 270902 - DNA, 75 bp, Artificial Sequence
  Synthetic
ggttttcttttgctatggactttataattagacactaatctgattggaacactaattcggaatattggacataac

SEQ ID NO: 270903 - DNA, 75 bp, Artificial Sequence
  Synthetic
caagaacagcaggcagtaagagtaggtttgatgacctggtaaaaatatctcaacttttttctgtgatgtgtgact

SEQ ID NO: 270904 - DNA, 75 bp, Artificial Sequence
  Synthetic
tctaggagagtccctttcccagccagaggtggctggttaaacaatacctaatgtaacaaaacatctaagactttg

SEQ ID NO: 270905 - DNA, 75 bp, Artificial Sequence
  Synthetic
ctacaaccccttcagccaaccatggaatagacgcaaaaggttatttcaagtggtcgtccacaactgcaccacagt

SEQ ID NO: 270906 - DNA, 75 bp, Artificial Sequence
  Synthetic
taacccatacctggtctccacccgttgaaggcaactagcaataaaataggtgggcttagacgcttaaagtatggt

SEQ ID NO: 270907 - DNA, 75 bp, Artificial Sequence
  Synthetic
tgggcttagacgcttaaagtatggtgtaaacaatcttttctagcctgtgcctagcatagggtggcagatggcgtg

SEQ ID NO: 270908 - DNA, 75 bp, Artificial Sequence
  Synthetic
ctgtagtgcataggaatattgtttacttaaaattgtttccaaacttgaatgtttttgtcaacagttactcatatt

SEQ ID NO: 270909 - DNA, 75 bp, Artificial Sequence
  Synthetic
agaggccgtctacggatgggcttctttccaaatgctactgaggacagcacttcagaaattgacaatgccatatac

SEQ ID NO: 270910 - DNA, 75 bp, Artificial Sequence
  Synthetic
cgtctgatgacgtgtgggaacttattggaaataacagtttgctgaaaagcatctcattgccagcggatcaacacc

SEQ ID NO: 270911 - DNA, 75 bp, Artificial Sequence
  Synthetic
acaatttgtgacttgggtagtgacaacagttttgaaatcactattccatattcattttccacttggatgcggaaa

SEQ ID NO: 270912 - DNA, 75 bp, Artificial Sequence
  Synthetic
tggtaacaggtgcctctggggccaaaagccaaggtttaacagaccctttgagattggttcaaacctgaattgtta

SEQ ID NO: 270913 - DNA, 75 bp, Artificial Sequence
  Synthetic
tggaaaatatttagtacctgctgatttggtagcaatacaaacactagttgtaaggcccacgaaggatgcccagaa

SEQ ID NO: 270914 - DNA, 75 bp, Artificial Sequence
  Synthetic
acggatggtcacccaatcggactatttcaaattgaagtgcttaacaggttaacctacaatagctccagccccaat

SEQ ID NO: 270915 - DNA, 75 bp, Artificial Sequence
  Synthetic
ttccaaaactcatggggttcacaaatggatttgaccgatccattatgtttaaaagaatctgcagaagaatgtaaa

SEQ ID NO: 270916 - DNA, 75 bp, Artificial Sequence
  Synthetic
tatcactatcactatggagacaatcaagagtattgcagatatggctactggtgttaccaaaacaattgacacaac

SEQ ID NO: 270917 - DNA, 75 bp, Artificial Sequence
  Synthetic
gattaacatcagctcaggatgatggaccattgggcgataacaagccaaattatttcctaaatttcaagtctatga

SEQ ID NO: 270918 - DNA, 75 bp, Artificial Sequence
  Synthetic
tgttgacaaagttaatgaagtagttactgacattggcaatgcttctggtggtgatattttgactaaggtagcaga

SEQ ID NO: 270919 - DNA, 75 bp, Artificial Sequence
  Synthetic
atgtggacatcttcactgtttcccatactaaggtggacaacttatttggaagagcatggttttatcaggaacaca

SEQ ID NO: 270920 - DNA, 75 bp, Artificial Sequence
  Synthetic
tgatgcttcaaacgtgttaggaccaaattgttacgcaaccacctctgaaccagaaaacaaagatgttgttcaagc

SEQ ID NO: 270921 - DNA, 75 bp, Artificial Sequence
  Synthetic
cttttacaaatgaaggacagtggagagttaatttggagttcccaaaacaaggtcatggttcactttctctgctat

SEQ ID NO: 270922 - DNA, 75 bp, Artificial Sequence
  Synthetic
gaccacaactgttaatacaaccaatttgacacaacatccatctgccccaactctaccattcactccagatttctc

SEQ ID NO: 270923 - DNA, 75 bp, Artificial Sequence
  Synthetic
ttgcttatttcacaggtgaattaaacatccatgttttgttcctagctggaaaaggatttcttaggatagctcata

SEQ ID NO: 270924 - DNA, 75 bp, Artificial Sequence
  Synthetic
taatgttgacactttccattctatggcatatgatataacaacaggaagtaagaacccaaataagttgattaggct

SEQ ID NO: 270925 - DNA, 75 bp, Artificial Sequence
  Synthetic
catacgacacatcaacaaatagagttaacttcttgtcatctaatggtgttatcacaatcccggcgggagaacaaa

SEQ ID NO: 270926 - DNA, 75 bp, Artificial Sequence
  Synthetic
taaaactcatgcatgggccagcacactccaaagaggacaccaaattgaacatgtcagtttgccagtagacttttg

SEQ ID NO: 270927 - DNA, 75 bp, Artificial Sequence
  Synthetic
tgaccttatctgcaccttactactcaaacaaaccccttaggacggttagggacagcaatagtcttgggtatctga

SEQ ID NO: 270928 - DNA, 75 bp, Artificial Sequence
  Synthetic
ggatgagcagagaaagccagcttatggccaggctaagtattttgcagctgttagatgtgggtttcatttccaggt

SEQ ID NO: 270929 - DNA, 75 bp, Artificial Sequence
  Synthetic
tgtgcaaaccattcctcactggaacaacaactgggaaaatagaggtctaccttagcctgagatgtccaaatttct

SEQ ID NO: 270930 - DNA, 75 bp, Artificial Sequence
  Synthetic
gcaggttaatgtcaatcaaggaactgctggtagtgctctggttgtctatgaaccaaagcctgttgttgattatga

SEQ ID NO: 270931 - DNA, 75 bp, Artificial Sequence
  Synthetic
tctttcctctccccgcgcctaaagtgacaactggtcgtgctttgcggggtgacttggcaaatttctcagaccaga

SEQ ID NO: 270932 - DNA, 75 bp, Artificial Sequence
  Synthetic
taaggacttagaatttggtgccttcactaacctaccacatgtacttatgaatttagccgaaactacccaggctga

SEQ ID NO: 270933 - DNA, 75 bp, Artificial Sequence
  Synthetic
gcccttatgaccaacaaccacagagccaagtgatgaaattagcttacttggatagaggcttttacaagcattatg

SEQ ID NO: 270934 - DNA, 75 bp, Artificial Sequence
  Synthetic
tttatgtatcccctatgttgcagatacaaactacgtgaagacagattcatctgacttagggcaattaaaagtgta

SEQ ID NO: 270935 - DNA, 75 bp, Artificial Sequence
  Synthetic
gtatcattgtggatgattatgtttatcaactggactcagatgatatcttcaaaacagctctaactggcaaggcca

SEQ ID NO: 270936 - DNA, 75 bp, Artificial Sequence
  Synthetic
tgtgtgggcacctcttagtatcccttcaggctcatccaaccaggttgatgtgacgatacttgggagtttattaca

SEQ ID NO: 270937 - DNA, 75 bp, Artificial Sequence
  Synthetic
aaaacagctctaactggcaaggccaagtttaccaaaacaaagttaacacaggattgggttatagaggaagaatgt

SEQ ID NO: 270938 - DNA, 75 bp, Artificial Sequence
  Synthetic
actagatttccaaaaccccagagtttatggtcaaaatgtggacatatatgacactgctccatctaggcctatacc

SEQ ID NO: 270939 - DNA, 75 bp, Artificial Sequence
  Synthetic
gaactagattatttcagagtcaagtaccttgaatcatctgtaaattcagaacacattttctcagttgactctaat

SEQ ID NO: 270940 - DNA, 75 bp, Artificial Sequence
  Synthetic
cttaaggaaaactaagtatctatctatgagcaccaaatataaatggacaagaaataagatagatatagcagaagg

SEQ ID NO: 270941 - DNA, 75 bp, Artificial Sequence
  Synthetic
tgtgaaactattgccaaagatatctttggaacccagacccttagtcaacatcaggctattggtttgattggtaca

SEQ ID NO: 270942 - DNA, 75 bp, Artificial Sequence
  Synthetic
tcctggttcaatgaatatggctaacgtgcttagcacaacagctgcccaatctgttgcactagtgggggaaagagc

SEQ ID NO: 270943 - DNA, 75 bp, Artificial Sequence
  Synthetic
attcttctgactgctggtctaatgtcaactattaagacaccagttaatgttactactatcaaagaattcttcaac

SEQ ID NO: 270944 - DNA, 75 bp, Artificial Sequence
  Synthetic
tttttatgatcctagaactgcaggcagcaaatcaagatttgatgatctagtaaaaattgcccaactattttctgt

SEQ ID NO: 270945 - DNA, 75 bp, Artificial Sequence
  Synthetic
catgcaatggatggagacgaacaggggctatccttacttgtgcagaagtgtaccacattcttctcctcagctgct

SEQ ID NO: 270946 - DNA, 75 bp, Artificial Sequence
  Synthetic
tatggcagattcaacaaccccatcagcaaatcatggtatagatcaaaaaggctactttaagtggtcagccaactc

SEQ ID NO: 270947 - DNA, 75 bp, Artificial Sequence
  Synthetic
acagaaattttggacaatgatctggtgaaatttatagtgaaaatccttgttaggattctctgttatatggtgtta

SEQ ID NO: 270948 - DNA, 75 bp, Artificial Sequence
  Synthetic
ggatccacaggccattgtacatagaaatttagtgtatttagatctttttcctaatcttaaggtgtttgagaatag

SEQ ID NO: 270949 - DNA, 75 bp, Artificial Sequence
  Synthetic
tactgtcacaaaccaaacattttaaccactgcttgtttgtccacattactaataatggatgtcacatcttcatca

SEQ ID NO: 270950 - DNA, 75 bp, Artificial Sequence
  Synthetic
ctattcatatttcaggggttccctgatcataaggctgagtgtatatgctagtacatttaataggggccgcttgag

SEQ ID NO: 270951 - DNA, 75 bp, Artificial Sequence
  Synthetic
gtgttgtcgccttcttgcaaagcacttatgcagtgcctaatggatggtgacgtcaagaaattggcagaagttgtg

SEQ ID NO: 270952 - DNA, 75 bp, Artificial Sequence
  Synthetic
aatgggattctttcccaacagtagtacagatgaaacctcagaaattgacaatgctatatacacaatttgtgacat

SEQ ID NO: 270953 - DNA, 75 bp, Artificial Sequence
  Synthetic
atgaagaaatcaaagaacaaatttgtgacacagtaaaatatactaagagcattttatcaaatcaaggacctttta

SEQ ID NO: 270954 - DNA, 75 bp, Artificial Sequence
  Synthetic
tgggtctgacaacagttttgaaatcacaatcccatactcgttctcaacatggatgaggaaaactcatggcaaacc

SEQ ID NO: 270955 - DNA, 75 bp, Artificial Sequence
  Synthetic
agggtttcaatgaagtgtcaacagctttcaggcatattgattggtggatacacactctattgaaaataaaagaca

SEQ ID NO: 270956 - DNA, 75 bp, Artificial Sequence
  Synthetic
aattgggttgtttcagatagaggtactaaacagactaacttacaattactcaagtccaaatgaggtttattgcat

SEQ ID NO: 270957 - DNA, 75 bp, Artificial Sequence
  Synthetic
tggttttgagtgtatttaaacccagtatggagagcaaggccattcagtggttagagagaaacaaagagcatgttt

SEQ ID NO: 270958 - DNA, 75 bp, Artificial Sequence
  Synthetic
tgttcaaggcaaaatggggcaagatgctaaattcttctgcccaactgggtcccttgttaccttccaaaattcgtg

SEQ ID NO: 270959 - DNA, 75 bp, Artificial Sequence
  Synthetic
gtgccattctagactatgcctctgatattattgtagaatcaaaggaccagacaaagatgaaaacacaagagtttt

SEQ ID NO: 270960 - DNA, 75 bp, Artificial Sequence
  Synthetic
gggttcacaaatggatctcacagaccccctttgtattgaggactctgcagaggattgtaaacagacaatcacacc

SEQ ID NO: 270961 - DNA, 75 bp, Artificial Sequence
  Synthetic
accaaaagtatacagactgcctagctaaatttaaaccaattatggcaatttgctttaggagttgtcataatagta

SEQ ID NO: 270962 - DNA, 75 bp, Artificial Sequence
  Synthetic
taccgaactgggattaacatcagcccaagatgatggaccccttggtaatgacaaaccaaattacttcttgaattt

SEQ ID NO: 270963 - DNA, 75 bp, Artificial Sequence
  Synthetic
ttagtaatactgtttacaggcttttccaggaattagcaagaataccatcaagaattagtactcagaatgatttaa

SEQ ID NO: 270964 - DNA, 75 bp, Artificial Sequence
  Synthetic
taagtcaatgaatgttgacatatttacagttagtcacactaaagtagacaatatttttggcagggcttggtttgc

SEQ ID NO: 270965 - DNA, 75 bp, Artificial Sequence
  Synthetic
ttagagttgagccaattggggtttggattcaaggtgagccaggtcaagggaagtcttttctaacgcacacattgt

SEQ ID NO: 270966 - DNA, 75 bp, Artificial Sequence
  Synthetic
ccatgttcatgatttcaccaatgatggcctatggaggcaagaactaaaattcccaaaagaggggcacggagccct

SEQ ID NO: 270967 - DNA, 75 bp, Artificial Sequence
  Synthetic
ctagacaactgcaaaaatcttgtaagttaaatggtgtgtacactaacccaaccgctagtgaatttatggatggtt

SEQ ID NO: 270968 - DNA, 75 bp, Artificial Sequence
  Synthetic
gtcactcctatttgcttacttcactggtgagctcaacattcatgttctatttcttagtgataagggtttccttag

SEQ ID NO: 270969 - DNA, 75 bp, Artificial Sequence
  Synthetic
acgacaaccaggacatccatctcatagatgatttagggcaaactagaaaggaaaaagacatagaaatgctttgca

SEQ ID NO: 270970 - DNA, 75 bp, Artificial Sequence
  Synthetic
agttggacatacatatgacacagagacaaatagaacaaattttctatcatccagtggaattataactgtcccagc

SEQ ID NO: 270971 - DNA, 75 bp, Artificial Sequence
  Synthetic
actgtatctcttctgttccatttattgttccaatggcacatctggaagaaaaaggtaagttttataccagcaagt

SEQ ID NO: 270972 - DNA, 75 bp, Artificial Sequence
  Synthetic
tggagaacaaatgactttgtctgtccctttctactctaataaacccctaagaaccataagatcatcaaatgcctt

SEQ ID NO: 270973 - DNA, 75 bp, Artificial Sequence
  Synthetic
tagtaatagctacgactaacaagtctgatttttcaagtacagtattacaagattctggtgctttaaagagaagat

SEQ ID NO: 270974 - DNA, 75 bp, Artificial Sequence
  Synthetic
aggctatctactctgcaaaccactcttaacaggtaccagttctggtaggattgagatattcctcagcttgagatg

SEQ ID NO: 270975 - DNA, 75 bp, Artificial Sequence
  Synthetic
ttccatacattatgcacattagagcagctaaagcttacagcaaagttggtaaattaaatgttagccaagctatgt

SEQ ID NO: 270976 - DNA, 75 bp, Artificial Sequence
  Synthetic
tccaaatttcttctttccattaccagcccccaaacctgccaccagcagacgccggggtgatttagccaccttgac

SEQ ID NO: 270977 - DNA, 75 bp, Artificial Sequence
  Synthetic
ccactatggctacaggtgagtgttgggaggtgtcaaaaaatggtagggactgggaaacgctaaaactgaaggact

SEQ ID NO: 270978 - DNA, 75 bp, Artificial Sequence
  Synthetic
tgatcaaagcccttatgaccaccaaccacagagacaaataatgaaattggcttataaagacagggggttttacaa

SEQ ID NO: 270979 - DNA, 75 bp, Artificial Sequence
  Synthetic
tagtgcagaaaatcacagaagattaccaggaaagacaaaataattataattgttggaaacaacagttggagaatc

SEQ ID NO: 270980 - DNA, 75 bp, Artificial Sequence
  Synthetic
acactatgggattgtggtgggcaacagtgtatatcaattagattctgatgacatttttagaactgctctaacagg

SEQ ID NO: 270981 - DNA, 75 bp, Artificial Sequence
  Synthetic
agactttagatgatctagatgatgctgtctcgtacatcaagcacaattttccagatgcaatcccctatattgatg

SEQ ID NO: 270982 - DNA, 75 bp, Artificial Sequence
  Synthetic
gaaagctaagttcactaaaactcagttgacatcagattggattgttgaagaagaatgtgagttagattatttcag

SEQ ID NO: 270983 - DNA, 75 bp, Artificial Sequence
  Synthetic
aatatcttaatattgaaatgtctacgttgattgagcaaatggaggcatttattgaaccacgccctagtgtgttta

SEQ ID NO: 270984 - DNA, 75 bp, Artificial Sequence
  Synthetic
gataaagtatctagaatcaactgttaatactgaacatatattctctgtagacaacaactgtgagactttagcaaa

SEQ ID NO: 270985 - DNA, 75 bp, Artificial Sequence
  Synthetic
agtgctttgccaccaaggtagctagccagactaggaaggcagccaaggatgtcgtagaatggttcagtagtaaaa

SEQ ID NO: 270986 - DNA, 75 bp, Artificial Sequence
  Synthetic
agatatatttggttctcattcactaagccagcaccaagcaataggtttgattggcactatccttctaactgctgg

SEQ ID NO: 270987 - DNA, 75 bp, Artificial Sequence
  Synthetic
tcaaatcaatgctaagttttgttgaaaggaacaaagcctggttgactgtggtctcagctgtcactagcgccataa

SEQ ID NO: 270988 - DNA, 75 bp, Artificial Sequence
  Synthetic
tctcatgtcaaccattaagacaccagtcaactccaccactatccgggaattcttcaaccatgctgtggatggcga

SEQ ID NO: 270989 - DNA, 75 bp, Artificial Sequence
  Synthetic
gcattctgcttttggtcactaaaattttcaagaaggaggactcaaaagatgagagagcttataatcccactctcc

SEQ ID NO: 270990 - DNA, 75 bp, Artificial Sequence
  Synthetic
tgagcagggtctgtccctacttgtgcagaaatgtacaacgtttttctcatcagcagccacagaaattctagacaa

SEQ ID NO: 270991 - DNA, 75 bp, Artificial Sequence
  Synthetic
ctgtggtaaagccaaaaggaacattcccagtgacacaaagggaatttaaaaatgaagctccttatgacggtcaat

SEQ ID NO: 270992 - DNA, 75 bp, Artificial Sequence
  Synthetic
tgatctggttaagttcatagtcaaaatccttgtccgaattctgtgttacatggttctctattgtcacaaaccaaa

SEQ ID NO: 270993 - DNA, 75 bp, Artificial Sequence
  Synthetic
tagagcacataatatctcagatggcatatataactggctctaccacaggacacctcacccattgtgcagggtacc

SEQ ID NO: 270994 - DNA, 75 bp, Artificial Sequence
  Synthetic
tattctgactactgcttgcttgtcaacattactgataatggatgttacttcctcctctgtgttatcaccctcatg

SEQ ID NO: 270995 - DNA, 75 bp, Artificial Sequence
  Synthetic
aacatgatgagatcattttacatgggcactcaattaaatatctagaacaagaagaagaattgactttgcattaca

SEQ ID NO: 270996 - DNA, 75 bp, Artificial Sequence
  Synthetic
taaagctctcatgcagtgtcttatggatggagatgttaagaaattggctgaagttgtagctgaatcaatgtccaa

SEQ ID NO: 270997 - DNA, 75 bp, Artificial Sequence
  Synthetic
aaaacaaagtattcccaattgaaaatccatcagtgactcaggtcacattgggtggaaaacccatggatttggctc

SEQ ID NO: 270998 - DNA, 75 bp, Artificial Sequence
  Synthetic
caccgatgatgaagaagttaaggaacaaatttgtgatacagttaagtataccaagcaaatcctttcaaatcaggg

SEQ ID NO: 270999 - DNA, 75 bp, Artificial Sequence
  Synthetic
tccttaagtgtaaactgccattcaggttcaaaaagaattccaaatattacactaataaaattggaacagaaagta

SEQ ID NO: 271000 - DNA, 75 bp, Artificial Sequence
  Synthetic
accattcaagggatttaatgaggtctccaccgctttcaggcacattgattggtggatacaaaccttgcttagaat

SEQ ID NO: 271001 - DNA, 75 bp, Artificial Sequence
  Synthetic
tgctgatctggatgactgaacaaggtattattacaaaagaagtccagagggttcaccactctggaggtattaaaa

SEQ ID NO: 271002 - DNA, 75 bp, Artificial Sequence
  Synthetic
aaaggacatggtgctgtctgtgtttaaacccagtatggagaggaaggcaattgattggttagaaagaaacaagga

SEQ ID NO: 271003 - DNA, 75 bp, Artificial Sequence
  Synthetic
caagggaagggactgagagcacaaaaacaatcagttataccgtgaagtcatgtaaaggtatgtgtgggggtttgc

SEQ ID NO: 271004 - DNA, 75 bp, Artificial Sequence
  Synthetic
acatgtttgtgcaattctggactatgcttctgacataattgttgagtcaaaggatcagacaaaaatgaagacaca

SEQ ID NO: 271005 - DNA, 75 bp, Artificial Sequence
  Synthetic
agagttctaccagaagtacaatgactgtttatccaaatttaaacccattatggccatctgttttagaagctgtca

SEQ ID NO: 271006 - DNA, 75 bp, Artificial Sequence
  Synthetic
taaaattcttggaatgcacatagctggaaatggagaaatgggtgttgccatcccttttgactttctcaggaatga

SEQ ID NO: 271007 - DNA, 75 bp, Artificial Sequence
  Synthetic
catgtctgatcaaggcattgtcacagaggtaacacccatacaacccatgtatatcaatactaagacacaaatcca

SEQ ID NO: 271008 - DNA, 75 bp, Artificial Sequence
  Synthetic
taatagtattagtaatacagtttacagattatttcaagagttagcgaggattccatctaggatggccacccagaa

SEQ ID NO: 271009 - DNA, 75 bp, Artificial Sequence
  Synthetic
taaaagtccagtgtatggtgcggtggaggttaagatgggcccagcagtcctaaataaatcagaccccagacttga

SEQ ID NO: 271010 - DNA, 75 bp, Artificial Sequence
  Synthetic
tgacctaatacgtgtagaacccattggtatttggattcagggtgaaccaggacaaggtaaatcatttctgacaca

SEQ ID NO: 271011 - DNA, 75 bp, Artificial Sequence
  Synthetic
agaaccagtcgagtgcttaatcaagaagtcagctgcaaaatatagagtcaatagattccaagtcgacaatgaact

SEQ ID NO: 271012 - DNA, 75 bp, Artificial Sequence
  Synthetic
tactctgtctaaacagctccaaaagtcctgcaaactacaaggtatctacaccaaccccactgctagtgagtttat

SEQ ID NO: 271013 - DNA, 75 bp, Artificial Sequence
  Synthetic
atggcaaggtgttaaagcctgtgtcaaatctaaatttagggaaatttttggaatcaacggaattgttgacatgaa

SEQ ID NO: 271014 - DNA, 75 bp, Artificial Sequence
  Synthetic
ggatggttatgacaatcaggatatacacttaatagatgatttaggtcagacaaggaaagagagggacattgaaat

SEQ ID NO: 271015 - DNA, 75 bp, Artificial Sequence
  Synthetic
aacagccattcttggaacatctcatgtaaactcaatggacttaagtacatcagcaggttatagctttgtcaaatc

SEQ ID NO: 271016 - DNA, 75 bp, Artificial Sequence
  Synthetic
gctctgtaactgcatatcctctgtgccttacatcgtgcctatggctcacttagaagaaaaaggtaaattttatac

SEQ ID NO: 271017 - DNA, 75 bp, Artificial Sequence
  Synthetic
tggatataaaaagaaagatctaatttgtcttgaacctttctctatatcacccatgcttgagaaacttgtgcaaga

SEQ ID NO: 271018 - DNA, 75 bp, Artificial Sequence
  Synthetic
aagtaaactggtaattgcaactactaacaaaccagacttttctagcacagtactattagactcaggagccctacg

SEQ ID NO: 271019 - DNA, 75 bp, Artificial Sequence
  Synthetic
aaaattccatgctttgcttaagggtagccaaattaccactattttcaacacttgttttaaagatgaactgagaaa

SEQ ID NO: 271020 - DNA, 75 bp, Artificial Sequence
  Synthetic
tagaagattcccatacatcatgcacattagggctgcaaagcactatagtagggcaggcaaattgagtgtagcaca

SEQ ID NO: 271021 - DNA, 75 bp, Artificial Sequence
  Synthetic
attggacaaaatctcagctgggaaaactagatgcattgaagcctgtgaagtagactattgtatagtctacagaat

SEQ ID NO: 271022 - DNA, 75 bp, Artificial Sequence
  Synthetic
ggccatgccagtgatgtctactggtgattgttgggaagtttcaaagaatggaagagattgggaaactttaaaact

SEQ ID NO: 271023 - DNA, 75 bp, Artificial Sequence
  Synthetic
gatcatgatggaaatttatgacaagatttaccagacaccttgctactactcaggtcttgctgttgggattaaccc

SEQ ID NO: 271024 - DNA, 75 bp, Artificial Sequence
  Synthetic
gaaggaattaattgacaaaatcactgaggattataatgatagagttaaaaattataatacatggaagaaacaatt

SEQ ID NO: 271025 - DNA, 75 bp, Artificial Sequence
  Synthetic
ggaagaccaaaccatggacgacctagatgacacagtttcttacattaaacataatttccctgaggcagtcccata

SEQ ID NO: 271026 - DNA, 75 bp, Artificial Sequence
  Synthetic
atacaaagattggcacttcatgatcaatgctataaatgactttaattatgaaatggattactctcagtacgatgg

SEQ ID NO: 271027 - DNA, 75 bp, Artificial Sequence
  Synthetic
cattgatgagtacttgaacatagagatgtccaccttaattgagcaaatggaggcatttattgaaccaaggccaag

SEQ ID NO: 271028 - DNA, 75 bp, Artificial Sequence
  Synthetic
ttcccttagttcaatgttattgtgggaggccgtggaggttttggcttattgccatgattcacgtaatcttgttat

SEQ ID NO: 271029 - DNA, 75 bp, Artificial Sequence
  Synthetic
tgtgttcaagtgctttgcaaacaaaattgggactaaattgaaatgtgcatctcaagatgttattaattggtttag

SEQ ID NO: 271030 - DNA, 75 bp, Artificial Sequence
  Synthetic
atcaggatccccatgtactactgttttgaattcattgtgcaatctgatgatgtgcatttacaccaccaatttaat

SEQ ID NO: 271031 - DNA, 75 bp, Artificial Sequence
  Synthetic
tgacaaaatcaaatccatgctaaattttgtggagagaaataaggcctggttgactgtagtctcagctgtcactag

SEQ ID NO: 271032 - DNA, 75 bp, Artificial Sequence
  Synthetic
tgtgcatttacaccaccaatttaatcagcccaggaattgactgtttaccaattgtttatggtgatgatgtcatct

SEQ ID NO: 271033 - DNA, 75 bp, Artificial Sequence
  Synthetic
cagcccaggaattgactgtttaccaattgtttatggtgatgatgtcatcttgtcacttgataaagaaatagaccc

SEQ ID NO: 271034 - DNA, 75 bp, Artificial Sequence
  Synthetic
tgccatcagtattctactcttggttacaaagatcttcaagaaagaagattcaaaagatgaaagagcatataatcc

SEQ ID NO: 271035 - DNA, 75 bp, Artificial Sequence
  Synthetic
aacacttcctgtgacaaaaccaaaaggggcattcccagtaacacagagagaattcaaaaatgaggccccttatga

SEQ ID NO: 271036 - DNA, 75 bp, Artificial Sequence
  Synthetic
agagaaactgcagagtatcatggcagattcatttggcgccgaagtgaccggttctcgtaaggatgagcctccatc

SEQ ID NO: 271037 - DNA, 75 bp, Artificial Sequence
  Synthetic
tggacaattagaacacattatctcccagatggcctacataactggctccactacaggacacctcactcattgtgc

SEQ ID NO: 271038 - DNA, 75 bp, Artificial Sequence
  Synthetic
tcccagagtccacatttatagtaggaaaattggacactgaaaatatgatacaacatttaatgtggatgaaaaatt

SEQ ID NO: 271039 - DNA, 75 bp, Artificial Sequence
  Synthetic
aggttatcagcacgatgaaataattttacatgggcattcaattaagtacctcgaacaggaggaagagttgaccct

SEQ ID NO: 271040 - DNA, 75 bp, Artificial Sequence
  Synthetic
acattacaagaataaggtgttcccaattgaaagtccatctgtaacacaggtgacactaggtggtaaaccaatgga

SEQ ID NO: 271041 - DNA, 75 bp, Artificial Sequence
  Synthetic
atcctacttaatggagttatgcctccatggaaaagacacttacttacactacatcaaaattttggatccatactt

SEQ ID NO: 271042 - DNA, 75 bp, Artificial Sequence
  Synthetic
tttggctattctcaaatgcaaattaccattcaggtttaagaagaattcaaaatactataccaataaaattgggac

SEQ ID NO: 271043 - DNA, 75 bp, Artificial Sequence
  Synthetic
gattatgatgttgtcattgccaagttgatgcccatggtgtttgactaaaattaatgtttttgttttcttttgtta

SEQ ID NO: 271044 - DNA, 75 bp, Artificial Sequence
  Synthetic
ccattcaggtttaagaagaattcaaaatactataccaataaaattgggacagaaagtatgttaatctggatgacc

SEQ ID NO: 271045 - DNA, 75 bp, Artificial Sequence
  Synthetic
tggactatattattagaacactaattcaattagaacactaatttggaatattggacataccaaaaaaaaaaaaaa

SEQ ID NO: 271046 - DNA, 75 bp, Artificial Sequence
  Synthetic
ttcaaagagtccaccactctggaggcatcaaaacacgggagggcaccgagagtacaaaaacaatcagttacaccg

SEQ ID NO: 271047 - DNA, 75 bp, Artificial Sequence
  Synthetic
tagaacactaatttggaatattggacataccaaaaaaaaaaaaaaaaaaaaaaaaaaaaaaaaaaaaaaaaaaaa

SEQ ID NO: 271048 - DNA, 75 bp, Artificial Sequence
  Synthetic
tttgaaaggggctctcctagagagcttggccgtcgggccttacaccccgacttgctgagcttctctaggagagcc

SEQ ID NO: 271049 - DNA, 75 bp, Artificial Sequence
  Synthetic
tgaagtcctgcaaaggtatgtgtggaggcctactcatttccaaagttgaaggaaacttcaaaattcttggaatgc

SEQ ID NO: 271050 - DNA, 75 bp, Artificial Sequence
  Synthetic
cctttcccagccttgaggcggctggtcaataaaagcctcacatataaataacatctaagaatagcttcataaccc

SEQ ID NO: 271051 - DNA, 75 bp, Artificial Sequence
  Synthetic
tacacctggtccccactagtcgaagacaacttgtaataagatgagtggaacaaggacgcttaaagtgtagtgaaa

SEQ ID NO: 271052 - DNA, 75 bp, Artificial Sequence
  Synthetic
aaaaatgacatgtcagaccaaggcattgtcacagaagtgacacctatacagcccatgtatattaacacaaagtct

SEQ ID NO: 271053 - DNA, 75 bp, Artificial Sequence
  Synthetic
caaggacgcttaaagtgtagtgaaaatattcctttctaacccatgcacctcatggggtggcagatggcgtgccat

SEQ ID NO: 271054 - DNA, 75 bp, Artificial Sequence
  Synthetic
caaattcacaagagcccggtttatggtgcagtagaggtcaaaatgggcccagcagtcctgagtaaatcagaccct

SEQ ID NO: 271055 - DNA, 75 bp, Artificial Sequence
  Synthetic
agacttggagaaccagttgagtgcttaattaagaaatctgctgcaaagtatagggttaacaagttcaatgtcaat

SEQ ID NO: 271056 - DNA, 75 bp, Artificial Sequence
  Synthetic
tcctctagtaagtttgtgagatgtccgatgacgtgtgggaacttattggaaacaacaatttgccgtaaggcatcc

SEQ ID NO: 271057 - DNA, 75 bp, Artificial Sequence
  Synthetic
cgatgacgtgtgggaacttattggaaacaacaatttgccgtaaggcatcctaatgccagcggattcacacctggt

SEQ ID NO: 271058 - DNA, 75 bp, Artificial Sequence
  Synthetic
aatgagttatggcagggtgttaaagcctgtgtcaagtccaaattcagagaaatctttggggtcaatggcatagta

SEQ ID NO: 271059 - DNA, 75 bp, Artificial Sequence
  Synthetic
gacatgaaaacagccattctgggtacatcccatgtgaattctatggatttgagcacatcagctggatacagcttt

SEQ ID NO: 271060 - DNA, 75 bp, Artificial Sequence
  Synthetic
caaggtttaacagacccgttaggattggtttaaacctgaattgttgtgaaagatactcagtacctgctgatttgg

SEQ ID NO: 271061 - DNA, 75 bp, Artificial Sequence
  Synthetic
gttaaatcaggttacaaaaagaaagatttgatctgtcttgaacctttctctgtttcacccatgcttgaaaaactt

SEQ ID NO: 271062 - DNA, 75 bp, Artificial Sequence
  Synthetic
gtacaagataaatttcatgcactattaaagggcaatcagattactactattttcaacacttgcttaaaagatgaa

SEQ ID NO: 271063 - DNA, 75 bp, Artificial Sequence
  Synthetic
taaagggcaatcagattactactattttcaacacttgcttaaaagatgaactgagaaaacttgacaagatttcaa

SEQ ID NO: 271064 - DNA, 75 bp, Artificial Sequence
  Synthetic
tatcttggtgagttggttaaaaaacgtctagtgggccaaacccgagggggatcctcggtttctatttattttata

SEQ ID NO: 271065 - DNA, 75 bp, Artificial Sequence
  Synthetic
ctggtaagaccaggtgcattgaagcctgtgaggtggactattgcatagtctatagaatgattatgatggaaattt

SEQ ID NO: 271066 - DNA, 75 bp, Artificial Sequence
  Synthetic
tttgctaacatggagacaataaaaggtattgcagatatggcgactggaattactaaaaccattgactcaactgtc

SEQ ID NO: 271067 - DNA, 75 bp, Artificial Sequence
  Synthetic
aacactgtcaatgaaaccatcaccaatcccagcaatgcggctggaggtgatatgctcactaaagttgccgatgat

SEQ ID NO: 271068 - DNA, 75 bp, Artificial Sequence
  Synthetic
atgacaaaatttatcaaacaccatgttattattcaggtctagcagttggaatcaatccatacaaagattggcact

SEQ ID NO: 271069 - DNA, 75 bp, Artificial Sequence
  Synthetic
gcttcaaatgtgttaggaccaaattgctacgcaacaacgtcaactccggagaataaggatgtagttcaggccacc

SEQ ID NO: 271070 - DNA, 75 bp, Artificial Sequence
  Synthetic
accactgtcaacaccacgaatttgacacaacacccttcagctcccactatgccctttacaccagatttccgtaat

SEQ ID NO: 271071 - DNA, 75 bp, Artificial Sequence
  Synthetic
gttgacatgtttcattcaatggcttatgatgtcacaactggagacaaaaatcctagtaaactaatcaggttgaaa

SEQ ID NO: 271072 - DNA, 75 bp, Artificial Sequence
  Synthetic
acagagtactgggaacgaacatacgctagacaacacttaatagttgatgtggaactcccccatgccttttgggat

SEQ ID NO: 271073 - DNA, 75 bp, Artificial Sequence
  Synthetic
ctactgtactaaattcattgtgtaatctgatgatgtgtatttacactactaatttaattagcccaggaattgatt

SEQ ID NO: 271074 - DNA, 75 bp, Artificial Sequence
  Synthetic
aatactaacaaacccgcatatggacaatcccgatactttgcagccgttaggtgtgggttccatttccaagtgcaa

SEQ ID NO: 271075 - DNA, 75 bp, Artificial Sequence
  Synthetic
tgtaatcttgtcacttgataaagaaatagacccagagaagctgcagagtatcatggcagattcatttggtgccga

SEQ ID NO: 271076 - DNA, 75 bp, Artificial Sequence
  Synthetic
gtgaatgtaaatcaaggaacagcaggcagtgctctagttgtttatgaaccaaaaccagtagtcactcacagtgac

SEQ ID NO: 271077 - DNA, 75 bp, Artificial Sequence
  Synthetic
agtgactggttctcgcaaggatgaacctccatcattgaaacccagattggaggtagaattcttaaagcgtaaacc

SEQ ID NO: 271078 - DNA, 75 bp, Artificial Sequence
  Synthetic
aagatggagtttggtgcatttaccaacttgccacatgtactcatgaacttggctgagacgacacaagccgacctg

SEQ ID NO: 271079 - DNA, 75 bp, Artificial Sequence
  Synthetic
tgtatcccctatgtatcagacacaaactatgttgtaacggattcgtctgatctagggcgtctaagggtttatgtt

SEQ ID NO: 271080 - DNA, 75 bp, Artificial Sequence
  Synthetic
tgggctccgttaacaataccatctggggccaccagtacagtcgatgtaactgtactagggagtttgttacaattg

SEQ ID NO: 271081 - DNA, 75 bp, Artificial Sequence
  Synthetic
gacttccaaaacccaagagtttacaacacccaagtgaacatatatgacaataataatgagactagggcaaagcag

SEQ ID NO: 271082 - DNA, 75 bp, Artificial Sequence
  Synthetic
attaggaaaaaaaaatggttaaccatgtcaaccaaatataaatggaccagaaataaagtagatattgctgaaggt

SEQ ID NO: 271083 - DNA, 75 bp, Artificial Sequence
  Synthetic
ccaggagctatgaatatggctaatgtgcttagtaccactggcgcccagtcagttgctttggtgggagagagggct

SEQ ID NO: 271084 - DNA, 75 bp, Artificial Sequence
  Synthetic
ttttatgaccccagaacagcaggaagtaaatctaggtttgatgatttggtgaaaatagctcaatcattttcagtt

SEQ ID NO: 271085 - DNA, 75 bp, Artificial Sequence
  Synthetic
ggtctccactggccgaaggcaactagcaataaggcaggtgggttcagacgcttaaagtgtgttgtacatattctt

SEQ ID NO: 271086 - DNA, 75 bp, Artificial Sequence
  Synthetic
atgagtgattcgacaaccccttctgcaagctcaggtattgatgacaaaggttattttgaatggaaagctacagcc

SEQ ID NO: 271087 - DNA, 75 bp, Artificial Sequence
  Synthetic
acaccactaactgtgatacatcgaaatgtagtcaaattgaatcaatttccaaacttgaacatgtttgtaaattca

SEQ ID NO: 271088 - DNA, 75 bp, Artificial Sequence
  Synthetic
tattcctatttcagagggtcactaattataaggttatctgtttatgctagcactttcaatcgtggtagacttaga

SEQ ID NO: 271089 - DNA, 75 bp, Artificial Sequence
  Synthetic
atgggcttcttcccaaatttcaccacaaataccacttcagagatagataattcaatttacactatttgtgatata

SEQ ID NO: 271090 - DNA, 75 bp, Artificial Sequence
  Synthetic
gggtcagacaatagctttgaaatcaccataccatacactttttcaacatggatgaggaagaccaatggacatgca

SEQ ID NO: 271091 - DNA, 75 bp, Artificial Sequence
  Synthetic
tgagttggttaaaaaacgtctagtgggccaaacccaggggggatcctggtttctttttaatttaagtaatcacta

SEQ ID NO: 271092 - DNA, 75 bp, Artificial Sequence
  Synthetic
ttggggttgttccaaattgaggtactgaacagattgacatataatagttcaagtcccagctctgtacactgcata

SEQ ID NO: 271093 - DNA, 75 bp, Artificial Sequence
  Synthetic
gttcaagggagattgggcaatgatgccaaattcttctgtccatctggttcccttgttacctttcaaaattcgtgg

SEQ ID NO: 271094 - DNA, 75 bp, Artificial Sequence
  Synthetic
ctctccctgtctaacgtggaaactgaagttaataatattatttctggtaatgaagttggtggggagataataact

SEQ ID NO: 271095 - DNA, 75 bp, Artificial Sequence
  Synthetic
ggttctcagatggacttgacagacccactgtgtatagaagatgattgcactgaagattgtaaacagacgatttct

SEQ ID NO: 271096 - DNA, 75 bp, Artificial Sequence
  Synthetic
ccagatgaattaggtttaacatctgcacaagatgatggtcccctaggaggtgaaaagccaaactacttcctaaat

SEQ ID NO: 271097 - DNA, 75 bp, Artificial Sequence
  Synthetic
ttcagagctgttaatgtagatatattcactgtgagccacactaaggtggacaatatttttggcagagcatggttc

SEQ ID NO: 271098 - DNA, 75 bp, Artificial Sequence
  Synthetic
gcttatgaccatacttacagagatgaaggaacttggagacaggctcttgatttcccaaagaaaggccatggcgca

SEQ ID NO: 271099 - DNA, 75 bp, Artificial Sequence
  Synthetic
tactggagacaagaaccccagtaagcttatacgactggacacagcttcatggcagaccagttattctaggcagta

SEQ ID NO: 271100 - DNA, 75 bp, Artificial Sequence
  Synthetic
ctgacccaattgtttgcatactattcaggcgaattaaacatacatgttttgtttttgagcgagacagggtttttg

SEQ ID NO: 271101 - DNA, 75 bp, Artificial Sequence
  Synthetic
aaatctttttgggatgataccagaaagcccgcctatggccaagccaaatattttgctgcagtaaggtgtggtttt

SEQ ID NO: 271102 - DNA, 75 bp, Artificial Sequence
  Synthetic
agagtggcacacacctatgacagtgacacaaacagatctgatttcttttcttcaaatggtgtcatcactgtccca

SEQ ID NO: 271103 - DNA, 75 bp, Artificial Sequence
  Synthetic
gcgggagagcaaatgactttgtcagtaccattctattcttctaaacctctaaggaccattagagattcagcagca

SEQ ID NO: 271104 - DNA, 75 bp, Artificial Sequence
  Synthetic
ctgggatatgtaatgtgtaaaccattcatgtctgggaccacaggtggaaaaatagaaatttatttaagtctgagg

SEQ ID NO: 271105 - DNA, 75 bp, Artificial Sequence
  Synthetic
tgtccaaatttgttttttcctctccctgcgcctaaacctacatctggtcgctcactgagaggtgatatggcacaa

SEQ ID NO: 271106 - DNA, 75 bp, Artificial Sequence
  Synthetic
ttttctgatcagagcccatacactcaccaaccacataaccagaagatgaaactggcatacttagacagagggttt

SEQ ID NO: 271107 - DNA, 75 bp, Artificial Sequence
  Synthetic
agagaaaatttttgactgcttcaactaaatacaagtggacacgaaccaaagtcgatatagcagaagggcctggga

SEQ ID NO: 271108 - DNA, 75 bp, Artificial Sequence
  Synthetic
tacaagcactatggtatcatagttggagaatatgtgtaccaattagactcagatgatatctttaaaaccgcctta

SEQ ID NO: 271109 - DNA, 75 bp, Artificial Sequence
  Synthetic
actgggaaagcaaggttcaccaaggctaagttgacctcagattgggtagttgaagaggaatgtgaactagattat

SEQ ID NO: 271110 - DNA, 75 bp, Artificial Sequence
  Synthetic
tttagagtcaaataccttgagtcatcggttaattcagaacacatcttttccgtgagctcaaactgtgaaactatt

SEQ ID NO: 271111 - DNA, 75 bp, Artificial Sequence
  Synthetic
taggtttgatgacatgatcaaaatagctcaattattctcagtcatgtcagacaacaccacaccttcaagtagtag

SEQ ID NO: 271112 - DNA, 75 bp, Artificial Sequence
  Synthetic
gctaaggatatttttggcactcacaccctaagccaacatcaagctattggattaatcggtacaattctcttaaca

SEQ ID NO: 271113 - DNA, 75 bp, Artificial Sequence
  Synthetic
gctggcttaatgtcaaccattaaaacacctgtaaccgctacaactataaaggaatttttcaaccatgccatagat

SEQ ID NO: 271114 - DNA, 75 bp, Artificial Sequence
  Synthetic
taatctagcccaatttccaaacttgaccctgttcatgaattcttattcctactttagggggttcttaataattag

SEQ ID NO: 271115 - DNA, 75 bp, Artificial Sequence
  Synthetic
ggagatgagcaaggcttgtcattgcttgtgcaaaaatgtaccatttttttttcttcagcagccactgaaatattg

SEQ ID NO: 271116 - DNA, 75 bp, Artificial Sequence
  Synthetic
gacaatgatctagtcaagtttatagttaagatcctagttaggattctgtgttacatggtcttgtattgccacaaa

SEQ ID NO: 271117 - DNA, 75 bp, Artificial Sequence
  Synthetic
ccaaatattcttactactgcctgcttgtcaacattattaataatggatgtgacatcttcctcagttttgtctcct

SEQ ID NO: 271118 - DNA, 75 bp, Artificial Sequence
  Synthetic
tcctgtaaagctttgatgcaatgccttatggatggggatgttaagaaactagcagaagttgtggctgaatctatg

SEQ ID NO: 271119 - DNA, 75 bp, Artificial Sequence
  Synthetic
tctaatacagatgatgaggagatcaaggagcaaatttgtgacacagttaaatataccaaaagtatattgtctaac

SEQ ID NO: 271120 - DNA, 75 bp, Artificial Sequence
  Synthetic
caaggcccatttaaaggtttcaatgaagtatcaactgcatttagacatatagattggtggatacatacactgttg

SEQ ID NO: 271121 - DNA, 75 bp, Artificial Sequence
  Synthetic
aaaatcaaggacatggttctcagtgttttcaaacctagtatggaaagtaaagcaatccagtggctagaaagaaat

SEQ ID NO: 271122 - DNA, 75 bp, Artificial Sequence
  Synthetic
aaggaacatgtctgtgccatcttggactatgcctcagatattattgtggagtctaaagatcagacaaaaatgaaa

SEQ ID NO: 271123 - DNA, 75 bp, Artificial Sequence
  Synthetic
gagggtcatggtatgttatcacagttttttgcttattttacaggagaaataaatattcatatcctatatatggca

SEQ ID NO: 271124 - DNA, 75 bp, Artificial Sequence
  Synthetic
tcacaggaattttaccaaaaatacactgattgtttgtctaaattcaagccaattatggctatctgttttaggagt

SEQ ID NO: 271125 - DNA, 75 bp, Artificial Sequence
  Synthetic
tgccacaatagtatcagtaacacagtttataggttgtttcaagaattggcgagaatcccatccaggattagtact

SEQ ID NO: 271126 - DNA, 75 bp, Artificial Sequence
  Synthetic
caaaatgatttaattagagtggaaccaattggtgtttggattcagggtgaaccaggacaagggaagtctttcttg

SEQ ID NO: 271127 - DNA, 75 bp, Artificial Sequence
  Synthetic
acacacacactatccagacaactacaaaaatcttgtaagttgaatggcgtgtacaccaatccaacagctagtgaa

SEQ ID NO: 271128 - DNA, 75 bp, Artificial Sequence
  Synthetic
gactacacgaactactgtagaagtttatgttagtttaaggtgccccaatttctttttccctgtaccagctcctaa

SEQ ID NO: 271129 - DNA, 75 bp, Artificial Sequence
  Synthetic
tttatggatggatatgacaaccaggatatccacctcattgacgatctagggcagacaaggaaagagaaagacatt

SEQ ID NO: 271130 - DNA, 75 bp, Artificial Sequence
  Synthetic
ctttctgatgagagcccctatgtattgactgacaatagaaaaatgcagctagcttatttagataggggtttctac

SEQ ID NO: 271131 - DNA, 75 bp, Artificial Sequence
  Synthetic
gagatgctgtgcaattgtatttcttcagtccctttcattgtaccaatggcacatctcgaagagaaaggtaaattt

SEQ ID NO: 271132 - DNA, 75 bp, Artificial Sequence
  Synthetic
tatactagtaaattggttatagcaactaccaacaaatcagacttctcaagtactgttttgcaagactctggggca

SEQ ID NO: 271133 - DNA, 75 bp, Artificial Sequence
  Synthetic
ctaaaaagaaggtttccatatattatgcacatcagagctgccaaagcatatagtaaatcaggtaaattaaatgtt

SEQ ID NO: 271134 - DNA, 75 bp, Artificial Sequence
  Synthetic
agtcaggctatgtcaactatggctactggtgaatgttgggaagtttcaaagaatggtagggactgggaaactctc

SEQ ID NO: 271135 - DNA, 75 bp, Artificial Sequence
  Synthetic
aaattgaaggatttggtccagaaaataactgaagattaccaggagagacagaagaattacaattgctggaaacaa

SEQ ID NO: 271136 - DNA, 75 bp, Artificial Sequence
  Synthetic
caacttgagaatcaaactctggacgacttagatgatgctgtttcatacattaagcataatttccctgatgcaatt

SEQ ID NO: 271137 - DNA, 75 bp, Artificial Sequence
  Synthetic
ccttatatagatgaatatctcaacattgaaatgtctaccttaattgaacaaatggaagcctttatagaaccacga

SEQ ID NO: 271138 - DNA, 75 bp, Artificial Sequence
  Synthetic
cctagtgtgtttaagtgttttaccaccaaaattgctaatcaaacaaggaaggcagctaaagaggttgtggattgg

SEQ ID NO: 271139 - DNA, 75 bp, Artificial Sequence
  Synthetic
tttagtagtaaaattaaatcaatgttgagttttgttgaaaggaacaaggcctggttgactgtagtctctgcagtg

SEQ ID NO: 271140 - DNA, 75 bp, Artificial Sequence
  Synthetic
actagtgctataagtattttattattggtcaccaaaatttttaagaaggaagattcaaaagatgaaagagcttat

SEQ ID NO: 271141 - DNA, 75 bp, Artificial Sequence
  Synthetic
aacccaacactccctgcggcaaaaccaaaaggtacgttcccagtgtcacaaagggaattcaaaaatgaagccccc

SEQ ID NO: 271142 - DNA, 75 bp, Artificial Sequence
  Synthetic
tatgatggccaattagaacatataatatcccagatggcatatataactggttccaccacaggacatctcacacac

SEQ ID NO: 271143 - DNA, 75 bp, Artificial Sequence
  Synthetic
tgtgcaggttaccagcatgatgagatcatcctacatgggcactcaataaaataccttgaacaagaagaggaattg

SEQ ID NO: 271144 - DNA, 75 bp, Artificial Sequence
  Synthetic
caagaattttaccagaaatacactgattgtttgtctaagtttaaaccaattatggctatctgctttagaagttgc

SEQ ID NO: 271145 - DNA, 75 bp, Artificial Sequence
  Synthetic
accctgcattacaagaacaaagtgtttccgattgagagcccatctgtgactcaagtcactttgggcggaaaacct

SEQ ID NO: 271146 - DNA, 75 bp, Artificial Sequence
  Synthetic
atggatttggctatccttaaatgtaaattgccattcagattcaagaaaaattccaaatattacactaataaaatc

SEQ ID NO: 271147 - DNA, 75 bp, Artificial Sequence
  Synthetic
ggaacagaaagcatgctcatttggatgactgaacaaggtatcattactaaagaagtacagagagtccaccactct

SEQ ID NO: 271148 - DNA, 75 bp, Artificial Sequence
  Synthetic
ggaggcattaaaacacgggaggggactgagagcacaaaaactatcagttacaccgtgaagtcttgtaaaggcatg

SEQ ID NO: 271149 - DNA, 75 bp, Artificial Sequence
  Synthetic
tgtggaggactactcatttccaaagtggaaggaaactttaaaattcttggaatgcatatagctggaaatggtgaa

SEQ ID NO: 271150 - DNA, 75 bp, Artificial Sequence
  Synthetic
atgggtgttgctattcctttcaatttcctcaagaatgacatatctgaccaaggcattgttacggaagtgacaccc

SEQ ID NO: 271151 - DNA, 75 bp, Artificial Sequence
  Synthetic
aagagaagatttccatatattatgcatattagagcagctaaagcatacagtaaggctggaaaactcaatgtcagt

SEQ ID NO: 271152 - DNA, 75 bp, Artificial Sequence
  Synthetic
atacaacccatgtatattaatactaaaacccaactccacaaaagtccagtctatggtgccgtggaagttaagatg

SEQ ID NO: 271153 - DNA, 75 bp, Artificial Sequence
  Synthetic
ggtccagcagttctaagtaaatcagaccctagactcgaagaaccagttgactgtctgattaagaaatctgctaca

SEQ ID NO: 271154 - DNA, 75 bp, Artificial Sequence
  Synthetic
tggtagggactgggaaactctaaaactgaaggacctagtccagaagattacagaagattaccaggagaggcagaa

SEQ ID NO: 271155 - DNA, 75 bp, Artificial Sequence
  Synthetic
aagtatcgagtcaacaaatttcaggtcaacaatgagttatggcagggtgtcaaggcttgtgttaagtctaagttt

SEQ ID NO: 271156 - DNA, 75 bp, Artificial Sequence
  Synthetic
cagaagattaccaggagaggcagaagaattatgattgctggaaacagcagttagagaaccaaactctagatgatc

SEQ ID NO: 271157 - DNA, 75 bp, Artificial Sequence
  Synthetic
gaattatgattgctggaaacagcagttagagaaccaaactctagatgatctggatgatgctgtctcttacatcaa

SEQ ID NO: 271158 - DNA, 75 bp, Artificial Sequence
  Synthetic
agagagatctttggggtcaatggtattgtggacatgaaaacagctatactaggaacatctcatgtgaattccatg

SEQ ID NO: 271159 - DNA, 75 bp, Artificial Sequence
  Synthetic
ttagagaaccaaactctagatgatctggatgatgctgtctcttacatcaagcataattttccagatgcaattcca

SEQ ID NO: 271160 - DNA, 75 bp, Artificial Sequence
  Synthetic
gatttgagtacatcagctgggtatagttttgttaaatcaggttacaaaaagaaagatctaattagtcttgaacct

SEQ ID NO: 271161 - DNA, 75 bp, Artificial Sequence
  Synthetic
ttctttgtttcacctatgcttgaaaaattggttcaagacaagtttcatgctttgcttaagggcaatcagattacc

SEQ ID NO: 271162 - DNA, 75 bp, Artificial Sequence
  Synthetic
agtgtttttaaatgttttgtaactagggtagcaaaccagacaaggaaagcagccagagaagtcgtggaatggttc

SEQ ID NO: 271163 - DNA, 75 bp, Artificial Sequence
  Synthetic
actatttttaacacttgcctaaaagatgaattgaggaaattggacaaaatctcagctggtaaaaccaggtgcatt

SEQ ID NO: 271164 - DNA, 75 bp, Artificial Sequence
  Synthetic
gaggcctgtgaggttgactattgcatagtttacaggatgattatgatggaaatatatgacaaaatttaccagaca

SEQ ID NO: 271165 - DNA, 75 bp, Artificial Sequence
  Synthetic
ccttgttattattcaggccttgctgttggaataaacccatacaaagactggcactttatgattaatgctttaaat

SEQ ID NO: 271166 - DNA, 75 bp, Artificial Sequence
  Synthetic
gactataattatgaaatggattattctcaatatgatggttccctcagttctatgttactgtgggaggcagtagag

SEQ ID NO: 271167 - DNA, 75 bp, Artificial Sequence
  Synthetic
gttttggcttattgccatgactcacctgatctcgttttacaactgcacaaaccagtaattgactcagaccacgtg

SEQ ID NO: 271168 - DNA, 75 bp, Artificial Sequence
  Synthetic
gtcttcaacgagagatggctgattcatggtggcatgccatcaggctccccatgtactactgtgttaaattcactg

SEQ ID NO: 271169 - DNA, 75 bp, Artificial Sequence
  Synthetic
atgtactactgtgttaaattcactgtgtaatttgatgatgtgcatttacaccactaacctaattagcccaggaat

SEQ ID NO: 271170 - DNA, 75 bp, Artificial Sequence
  Synthetic
gatttagctattctcaagtgtaagctaccatttagattcaagaagaattccaaatattatactagtaaaattgga

SEQ ID NO: 271171 - DNA, 75 bp, Artificial Sequence
  Synthetic
tgattgtttaccaattgtttatggtgatgatgtcatcttatcacttgataaagaaatagacccagagaggctgca

SEQ ID NO: 271172 - DNA, 75 bp, Artificial Sequence
  Synthetic
aagtgtcatggcagactcatttggtgcagaagtaactggatcacgcaaggatgaacctccatctttaaaacctag

SEQ ID NO: 271173 - DNA, 75 bp, Artificial Sequence
  Synthetic
atgaacctccatctttaaaacctagaatggaggttgagttcctaaagcgtaagcctggtttcttcccagagtcca

SEQ ID NO: 271174 - DNA, 75 bp, Artificial Sequence
  Synthetic
cattgtcacggaaataacacccatgcaacccatgtacattaatactaagactcaaattcacaagagtccagtcta

SEQ ID NO: 271175 - DNA, 75 bp, Artificial Sequence
  Synthetic
tggagcagtagaagttaagatgggcccagcagttctgagtaaatcagatcctaggcttgaagaacctgttgattg

SEQ ID NO: 271176 - DNA, 75 bp, Artificial Sequence
  Synthetic
agcagcaacttcaatcctacttaatggagttatgcctccatggaaaagacacttatttacactacatcaaaattc

SEQ ID NO: 271177 - DNA, 75 bp, Artificial Sequence
  Synthetic
tggatccctacttgaaggagtggaatatcactgtggatgattatgatgtggtcattgctaagttaatgcccatgg

SEQ ID NO: 271178 - DNA, 75 bp, Artificial Sequence
  Synthetic
tcttattaagaaatcagccgcaaaatatagagttaataaatttcaggtgaataatgaattatggcagggtgttaa

SEQ ID NO: 271179 - DNA, 75 bp, Artificial Sequence
  Synthetic
gtttttctttgttatggactatattattagaacactaatttgattagaacactaatttggaatattggacatacc

SEQ ID NO: 271180 - DNA, 75 bp, Artificial Sequence
  Synthetic
tggatatgaagacagccatcctggggacatctcatgttaactctatggacttaagcacatcagctggatatagct

SEQ ID NO: 271181 - DNA, 75 bp, Artificial Sequence
  Synthetic
cacacagccatcctctagtaagtttgtaagacgtctgatgacgtgtgggaacttgttggaaataacagtttgctg

SEQ ID NO: 271182 - DNA, 75 bp, Artificial Sequence
  Synthetic
agcaggcaaaaccaggtgcattgaggcatgtgaagtggactattgtatagtctatagaatgatcatgatggaaat

SEQ ID NO: 271183 - DNA, 75 bp, Artificial Sequence
  Synthetic
atcttgttatgcagttacataaaccagtgattgattcggaccacgtggtcttcaatgagagatggttgattcatg

SEQ ID NO: 271184 - DNA, 75 bp, Artificial Sequence
  Synthetic
tggtggggagataataaccaaagtagcagatgatgcttccaatttacttgggccaaacagttttgcaaccacagc

SEQ ID NO: 271185 - DNA, 75 bp, Artificial Sequence
  Synthetic
tttagaaatgtggacaactttcattcaatggcttatgacataactactggagacaaaaaccccagtaagcttatt

SEQ ID NO: 271186 - DNA, 75 bp, Artificial Sequence
  Synthetic
ctagttattctaggcagtacaaaataaccactgtggaattgcccaaatctttttgggatgataccagaaagcccg

SEQ ID NO: 271187 - DNA, 75 bp, Artificial Sequence
  Synthetic
cttatggccaagccaaatattttgctgcagtaaggtgtggatttcattttcaagtccaggttaatgtcaaccaag

SEQ ID NO: 271188 - DNA, 75 bp, Artificial Sequence
  Synthetic
atgcctggtctccactggttgaaggcaacttgcaataaaatgagtggaaattagacgcttaaagtgtgttgtaca

SEQ ID NO: 271189 - DNA, 75 bp, Artificial Sequence
  Synthetic
caagtccaggttaatgtcaaccaaggaactgcaggaagtgcattggtggtttatgaacctaagccagttatagat

SEQ ID NO: 271190 - DNA, 75 bp, Artificial Sequence
  Synthetic
tcaaggcaatatttggaatttggctctttaactaatctcccccatgtgttgatgaatctggctgaaaccacccag

SEQ ID NO: 271191 - DNA, 75 bp, Artificial Sequence
  Synthetic
gtggaccttatgctcacacagccatcctctagtaagtttgtaagacgtctgatgacgtgtgggaacttgttggaa

SEQ ID NO: 271192 - DNA, 75 bp, Artificial Sequence
  Synthetic
ataacagtttgctgcaaggcatcccactgccagcgggttcacatctggtaacagatgcctctggggccaaaagcc

SEQ ID NO: 271193 - DNA, 75 bp, Artificial Sequence
  Synthetic
caagtggacacgaaccaaagtagacatagcagaagggcctgggactatgaacatggccaatgtcttgagtacaac

SEQ ID NO: 271194 - DNA, 75 bp, Artificial Sequence
  Synthetic
ggaccaatttccgaacttgaacttgttcatgaatacttattcctattttaggggttctttaataattagactctc

SEQ ID NO: 271195 - DNA, 75 bp, Artificial Sequence
  Synthetic
ttcatgaatacttattcctattttaggggttctttaataattagactctccatttatgctagcactttcaataga

SEQ ID NO: 271196 - DNA, 75 bp, Artificial Sequence
  Synthetic
ctataacagttctagtccaaataaggtgcattgtatagtacagggaaggcttggggatgatgcaaaatttttctg

SEQ ID NO: 271197 - DNA, 75 bp, Artificial Sequence
  Synthetic
ggacaacatggaaaattgtaaacaatccatatcaccaaatgaattaggtttgacttcagctcaagatgatgggcc

SEQ ID NO: 271198 - DNA, 75 bp, Artificial Sequence
  Synthetic
gaccaaataaggccaatgctagtagatttaataaaaggaaatttttgactgcttcaactaaatacaagtggacac

SEQ ID NO: 271199 - DNA, 75 bp, Artificial Sequence
  Synthetic
gaaattaacgttcccaaaagagggccatggtatgttatcacagttttttgcatattttacaggagaaataaacat

SEQ ID NO: 271200 - DNA, 75 bp, Artificial Sequence
  Synthetic
actataccatattccttctccacttggatgaggaagacacatggccaccaattgggtttatttcaagttgaagtc

SEQ ID NO: 271201 - DNA, 75 bp, Artificial Sequence
  Synthetic
tttcaaaacagctttaacagggaaagctaggttcactaggacaaaattgactccagactgggtcattgaggagga

SEQ ID NO: 271202 - DNA, 75 bp, Artificial Sequence
  Synthetic
atgtgaactagattatttcagggtaaagtaccttgaatcttcagtcaactcagagcatattttttcagtagacca

SEQ ID NO: 271203 - DNA, 75 bp, Artificial Sequence
  Synthetic
aagtaccttgaatcttcagtcaactcagagcatattttttcagtagaccacaattgtgaaactattgctaaggat

SEQ ID NO: 271204 - DNA, 75 bp, Artificial Sequence
  Synthetic
atttttggtacccacactcttagtcaacatcaagccattggcttaataggcacaattcttttgacggctggttta

SEQ ID NO: 271205 - DNA, 75 bp, Artificial Sequence
  Synthetic
atgcaacaaccatcaaagagtttttcaaccatgctgtcgatggcgatgaacagggattgtccttacttgtgcaga

SEQ ID NO: 271206 - DNA, 75 bp, Artificial Sequence
  Synthetic
caaccatgctgtcgatggcgatgaacagggattgtccttacttgtgcagaagtgtaccacttttttctcttcagc

SEQ ID NO: 271207 - DNA, 75 bp, Artificial Sequence
  Synthetic
agtgtaccacttttttctcttcagcagctacagagattttggataatgatttagtcaaattcatagttaaaatcc

SEQ ID NO: 271208 - DNA, 75 bp, Artificial Sequence
  Synthetic
ttgttagaattctttgctatatggtgctatattgtcacaaaccaaacattttgaccacagcatgcctgtctactt

SEQ ID NO: 271209 - DNA, 75 bp, Artificial Sequence
  Synthetic
ttgaccacagcatgcctgtctactttattaataatggatgtcacatcttcatctgtgttatcaccttcttgtaag

SEQ ID NO: 271210 - DNA, 75 bp, Artificial Sequence
  Synthetic
aggttttcttatgtgtagaccaatgatgcacgggactactcgaactactgcagaagtttatattagtttaaggtg

SEQ ID NO: 271211 - DNA, 75 bp, Artificial Sequence
  Synthetic
atctgtgttatcaccttcttgtaaggctctaatgcaatgtcttatggatggtgatgttaagaaattggcagaagt

SEQ ID NO: 271212 - DNA, 75 bp, Artificial Sequence
  Synthetic
cagaagtttatattagtttaaggtgccccaatttctttttccctgtaccagctcctaaaccaactggttcaaggg

SEQ ID NO: 271213 - DNA, 75 bp, Artificial Sequence
  Synthetic
tgtggctgaatcaatgtccaacacagacgatgaggaaataaaagaacaaatttgtgacacagtgaaatatactaa

SEQ ID NO: 271214 - DNA, 75 bp, Artificial Sequence
  Synthetic
gacgatgaggaaataaaagaacaaatttgtgacacagtgaaatatactaagagcatcctatcaaatcaggggcct

SEQ ID NO: 271215 - DNA, 75 bp, Artificial Sequence
  Synthetic
tttaagggtttcaatgaagtgtcaacagcattcagacatattgattggtggatacacactctattgaaaataaaa

SEQ ID NO: 271216 - DNA, 75 bp, Artificial Sequence
  Synthetic
gatatggtcttgagtgtattcaaacctagtatggagagtaaagctatccagtggttggagagaaacaaagagcat

SEQ ID NO: 271217 - DNA, 75 bp, Artificial Sequence
  Synthetic
gtttgtgccatcctggactatgcctctgatattattgtggagtcaaaagaccaaacaaaaatgaaatcacaggaa

SEQ ID NO: 271218 - DNA, 75 bp, Artificial Sequence
  Synthetic
ccaaacaaaaatgaaatcacaggaattttaccaaaggtacacagattgtttagccaagtttaaaccaataatggc

SEQ ID NO: 271219 - DNA, 75 bp, Artificial Sequence
  Synthetic
ttatagttccaatggcacatcttgaagagaaaggtaaattttatactagcaaattggtaatagcaacaactaaca

SEQ ID NO: 271220 - DNA, 75 bp, Artificial Sequence
  Synthetic
aatctgatttttcaagtacagtcttgcaagattctggtgcattaaagagaagattcccatacattatgcacatta

SEQ ID NO: 271221 - DNA, 75 bp, Artificial Sequence
  Synthetic
gcaagattctggtgcattaaagagaagattcccatacattatgcacattagagctgccaaagcatatagtaaggc

SEQ ID NO: 271222 - DNA, 75 bp, Artificial Sequence
  Synthetic
gttgggaagtgtcaaagaatggaagagactgggagactctaaaacttaaggacttagtccagaagattacagaag

SEQ ID NO: 271223 - DNA, 75 bp, Artificial Sequence
  Synthetic
taattgttggaaacaacaacttgagaatcagactttagatgacctagatgatgcagtctcttacattaagcacaa

SEQ ID NO: 271224 - DNA, 75 bp, Artificial Sequence
  Synthetic
tttcccagatgcaatcccctacattgatgaatatcttaatattgagatgtctactttaattgaacaaatggaagc

SEQ ID NO: 271225 - DNA, 75 bp, Artificial Sequence
  Synthetic
cttcctgccgcaaagtcaaaaggaactttcccagtcacgcaaagagagttcaaaaatgaggcaccgtatgacgga

SEQ ID NO: 271226 - DNA, 75 bp, Artificial Sequence
  Synthetic
tggcatacataaccggttccacaacgggacatctcacacactgtgcgggttaccaacatgatgagatcattttgc

SEQ ID NO: 271227 - DNA, 75 bp, Artificial Sequence
  Synthetic
atgggcactcaattaagtacctagaacaagaagaggaattaaccctacattataaaaacaaggttttcccagttg

SEQ ID NO: 271228 - DNA, 75 bp, Artificial Sequence
  Synthetic
acaagaagaggaattaaccctacattataaaaacaaggttttcccagttgagaatccatctgtgacacaagttac

SEQ ID NO: 271229 - DNA, 75 bp, Artificial Sequence
  Synthetic
attgggtggtaaacccatggatttggctattcttaagtgtaaactaccttttaggttcaagaaaaattccaaata

SEQ ID NO: 271230 - DNA, 75 bp, Artificial Sequence
  Synthetic
aagagttcaccactctggtggcatcaaaacacgggagggcactgagagtacaaaaacaatcagttatactgtgaa

SEQ ID NO: 271231 - DNA, 75 bp, Artificial Sequence
  Synthetic
aaaacacgggagggcactgagagtacaaaaacaatcagttatactgtgaagtcttgcaaaggcatgtgtggtggt

SEQ ID NO: 271232 - DNA, 75 bp, Artificial Sequence
  Synthetic
atgacatgtcagaccaaggcatcgtcacggaaattacatccatacagcccatgtacatcaatactaaaacacaaa

SEQ ID NO: 271233 - DNA, 75 bp, Artificial Sequence
  Synthetic
ggtggaagtcaaaatgggcccagcagttttaagcaaatcagaccctaggcttgaagaacctgtcgagtgtttaat

SEQ ID NO: 271234 - DNA, 75 bp, Artificial Sequence
  Synthetic
caagaaatcagccgcaaagtatagggtcaataaatttcaggtaaataatgaattatggcagggtgtcaaagcctg

SEQ ID NO: 271235 - DNA, 75 bp, Artificial Sequence
  Synthetic
gtcaataaatttcaggtaaataatgaattatggcagggtgtcaaagcctgtgtcaagtccaaatttagggaaatt

SEQ ID NO: 271236 - DNA, 75 bp, Artificial Sequence
  Synthetic
actctggtggcatcaaaacacgggagggcactgagagtacaaaaacaattagttatactgtgaagtcatgtaaag

SEQ ID NO: 271237 - DNA, 75 bp, Artificial Sequence
  Synthetic
gcatgtgtggtggcctacttatctctaaggtagaaggaaacttcaaaattcttggaatgcacatagctggaaacg

SEQ ID NO: 271238 - DNA, 75 bp, Artificial Sequence
  Synthetic
aatttgccttgagccattttctgtctcacctatgcttgagaaatttgtgcaagacaaatttcatgcactgctaaa

SEQ ID NO: 271239 - DNA, 75 bp, Artificial Sequence
  Synthetic
tcatgcaattacataaaccagtaatagattcggaccatgtggtcttcaatgagagatggttaattcatggcggta

SEQ ID NO: 271240 - DNA, 75 bp, Artificial Sequence
  Synthetic
tgccatcagggtcaccatgtaccactgtattaaattcattgtgcaatttgatgatgtgcatttacactaccaatt

SEQ ID NO: 271241 - DNA, 75 bp, Artificial Sequence
  Synthetic
atccagggaaactgcaggatgtcatggcagattcatttggagctgaagtaactggttctcgcaaggatgagcctc

SEQ ID NO: 271242 - DNA, 75 bp, Artificial Sequence
  Synthetic
tacttcccagagtccacatttatagtaggaaaattggacactgaaaacatgatacaacatttaatgtggatgaaa

SEQ ID NO: 271243 - DNA, 75 bp, Artificial Sequence
  Synthetic
attaaagttttggtttttctttgttatggactatatcattagaacactaattcaattagaacactaatttggaat

SEQ ID NO: 271244 - DNA, 75 bp, Artificial Sequence
  Synthetic
tttgtaagacgtctgatgacgtgtgggaacttgttggagataacagtttgctgcaaagcatcccactgccagcgg

SEQ ID NO: 271245 - DNA, 75 bp, Artificial Sequence
  Synthetic
ttttcccagccagaggtggctggttaaataatacctattgtaacgaaacatctaagatacaataaccacacacct

SEQ ID NO: 271246 - DNA, 75 bp, Artificial Sequence
  Synthetic
ttggttaaaaaacgtctagtgggccaaacccgggggggatccctgatttccttttttagtttgagtaatcactat

SEQ ID NO: 271247 - DNA, 75 bp, Artificial Sequence
  Synthetic
tagtgcaagctacaaccactgtaaacaccacaaatttgacccaacacccatcagctccaactatcccattcacac

SEQ ID NO: 271248 - DNA, 75 bp, Artificial Sequence
  Synthetic
aaaataaccactgtggaattgcccaaatctttttgggatgatactagaaagcccgcctatggccaagccaaatat

SEQ ID NO: 271249 - DNA, 75 bp, Artificial Sequence
  Synthetic
atggagtctatcaaggatttagtcaatgttgctactggtgctatggatactctttccttgtctaatgtggaaact

SEQ ID NO: 271250 - DNA, 75 bp, Artificial Sequence
  Synthetic
gaagctaataatattatttctggtaatgaagttggtggggagataataaccaaagtagcagatgatgcttccaat

SEQ ID NO: 271251 - DNA, 75 bp, Artificial Sequence
  Synthetic
ccacagctcaaccagagaacaaagatgtagtgcaagctacaaccactgtaaacaccacgaatttgacccaacacc

SEQ ID NO: 271252 - DNA, 75 bp, Artificial Sequence
  Synthetic
aggtttgatgatatgatcaaaatagctcaattattttcagttatgtcagacaacaccacaccttcaagtagtagt

SEQ ID NO: 271253 - DNA, 75 bp, Artificial Sequence
  Synthetic
tatagattcaaggcaatatttggaatttggttctttaactaatctcccccatgtgttgatgaatctggctgagac

SEQ ID NO: 271254 - DNA, 75 bp, Artificial Sequence
  Synthetic
atgtgttgatgaatctggctgagaccacccaggctgacctatgcatcccctatgttgcagacacaaactatgtta

SEQ ID NO: 271255 - DNA, 75 bp, Artificial Sequence
  Synthetic
cataccaaagttgacaacatctttggtagagcttggtatgtgacgtctcatgattttaataatggagatacctgg

SEQ ID NO: 271256 - DNA, 75 bp, Artificial Sequence
  Synthetic
attgcgggtctatgtttggacacctctttcagtacctacaggggcttctaatgaggttgatgtcacagttatggg

SEQ ID NO: 271257 - DNA, 75 bp, Artificial Sequence
  Synthetic
ctttcagtacctacaggggcttctaatgaggttgatgtcacagttatgggtagcttattacaattggattttcaa

SEQ ID NO: 271258 - DNA, 75 bp, Artificial Sequence
  Synthetic
aggcagaaattaacatttccaaaagagggtcatggcatgttatcacagttttttgcttattttacaggagaaata

SEQ ID NO: 271259 - DNA, 75 bp, Artificial Sequence
  Synthetic
aatattcatatcctatatatggcagagcaggggtttcttagagtggctcatacatatgacactgaagataatagg

SEQ ID NO: 271260 - DNA, 75 bp, Artificial Sequence
  Synthetic
agtcgatatagcagaagggcctgggaccatgaacatggccaatgtcctgagcacaacaggagcccaatctgtggc

SEQ ID NO: 271261 - DNA, 75 bp, Artificial Sequence
  Synthetic
ctttttccctgtaccagctcctaaaccaactggttcaagggctacagcactttatgatgaaagcccctatgtacc

SEQ ID NO: 271262 - DNA, 75 bp, Artificial Sequence
  Synthetic
gtggtatagacaaatatgggtactttgattgggcagccacagtggcaccacaaaatatggtgcacagaaatgttg

SEQ ID NO: 271263 - DNA, 75 bp, Artificial Sequence
  Synthetic
gacattttcaaaacagctttaacagggaaagctaggttcactaagacaaaattaactccagactgggtcattgag

SEQ ID NO: 271264 - DNA, 75 bp, Artificial Sequence
  Synthetic
ttacactagaccaatttccaaacttgaacctgtttatgaatacttattcctactttaggggttctttaataatta

SEQ ID NO: 271265 - DNA, 75 bp, Artificial Sequence
  Synthetic
gaacctgtttatgaatacttattcctactttaggggttctttaataattagactctctatttatgctagcacttt

SEQ ID NO: 271266 - DNA, 75 bp, Artificial Sequence
  Synthetic
agtcaatgctacaaccatcaaagaattctttaatcatgcagtggaaggtgatgaacagggactatctttacttgt

SEQ ID NO: 271267 - DNA, 75 bp, Artificial Sequence
  Synthetic
tttttccccaactgtactcatgatactcagttggagttggacaatgctatatacacaatctgtgacattggttca

SEQ ID NO: 271268 - DNA, 75 bp, Artificial Sequence
  Synthetic
atggtgttatattgtcataaaccaaatattttaaccactgcttgtttatctacactactaataatggatgtaaca

SEQ ID NO: 271269 - DNA, 75 bp, Artificial Sequence
  Synthetic
gaagttgtggctgagtccatgtctaatacggatgatgaagaaatcaaagaacaaatttgtgacacagtaaaatat

SEQ ID NO: 271270 - DNA, 75 bp, Artificial Sequence
  Synthetic
aaataaggtgcattgtatagtacagggaaggctgggtgatgatgctaaatttttctgccccactggttctctggt

SEQ ID NO: 271271 - DNA, 75 bp, Artificial Sequence
  Synthetic
atggctatctgctttagaagttgccacaacagtattagtaatacagtctatagactattccaagagttagccaga

SEQ ID NO: 271272 - DNA, 75 bp, Artificial Sequence
  Synthetic
ttctttttccctgtaccagctcctaaaccaactggttcaagggctgcagcactttatgatgaaagcccctatgta

SEQ ID NO: 271273 - DNA, 75 bp, Artificial Sequence
  Synthetic
ccaactgataataggaaaatgcagttagcttatttagataggggtttttacaagcactatggtattattgtagga

SEQ ID NO: 271274 - DNA, 75 bp, Artificial Sequence
  Synthetic
aaattaactccagactgggtcattgaggaagaatgtgaattggattatttcagggtgaagtaccttgaatcatct

SEQ ID NO: 271275 - DNA, 75 bp, Artificial Sequence
  Synthetic
aggaagaatgtgaattggattatttcagggtgaagtaccttgaatcatctgtcaactcagagcatatcttctcag

SEQ ID NO: 271276 - DNA, 75 bp, Artificial Sequence
  Synthetic
gaattcaaaaatgaagccccttatgatggccaattagagcacataatatcccaaatggcatatataaccggctcc

SEQ ID NO: 271277 - DNA, 75 bp, Artificial Sequence
  Synthetic
aaaattcttgtcagaattctctgttacatggtgttatattgtcataaaccaaatattttaactactgcttgttta

SEQ ID NO: 271278 - DNA, 75 bp, Artificial Sequence
  Synthetic
catcttcttcagtgttgtcgccttcttgtaaggcactcatgcagtgtctaatggatggtgacgtcaagaaattgg

SEQ ID NO: 271279 - DNA, 75 bp, Artificial Sequence
  Synthetic
ttgtaaggcactcatgcagtgtctaatggatggtgacgtcaagaaattggcagaagttgtggctgagtccatgtc

SEQ ID NO: 271280 - DNA, 75 bp, Artificial Sequence
  Synthetic
aaatattatactaataaaattggaacagaaagtatgttaatctggatgactgaacaaggcattatcaccaaagaa

SEQ ID NO: 271281 - DNA, 75 bp, Artificial Sequence
  Synthetic
aataaaagatatggttttaagtgtattcaaacccagcatggagagtaaagccattcagtggttagaaagaaataa

SEQ ID NO: 271282 - DNA, 75 bp, Artificial Sequence
  Synthetic
agagcatgtttgtgctatcttggattatgcctctgatattattgtggaatcaaaagaccagacaaaaatgaaatc

SEQ ID NO: 271283 - DNA, 75 bp, Artificial Sequence
  Synthetic
tatgcctctgatattattgtggaatcaaaagaccagacaaaaatgaaatcgcaagaattttaccagaaatacact

SEQ ID NO: 271284 - DNA, 75 bp, Artificial Sequence
  Synthetic
ggagcagtagaagttaagatgggcccagcagtcttgagtaaatcagatcctaggcttgaagaacctgtcgagtgt

SEQ ID NO: 271285 - DNA, 75 bp, Artificial Sequence
  Synthetic
ccacaacagtattagtaatacagtctatagactattccaagagttagccagaataccttctagaattagcactca

SEQ ID NO: 271286 - DNA, 75 bp, Artificial Sequence
  Synthetic
gaataccttctagaattagcactcaaaatgatttaattagagtagagccaattggtatctggatccaaggtgaac

SEQ ID NO: 271287 - DNA, 75 bp, Artificial Sequence
  Synthetic
caccagtaaactggtaatagcaaccaccaacaaatctgatttttcaagtacagtcttgcaagattctggtgcatt

SEQ ID NO: 271288 - DNA, 75 bp, Artificial Sequence
  Synthetic
tggcttattgtcatgactcacctgatcttgttatgcagttacataaaccagtaattgattcagaccatgtggtct

SEQ ID NO: 271289 - DNA, 75 bp, Artificial Sequence
  Synthetic
tcttgttatgcagttacataaaccagtaattgattcagaccatgtggtcttcaatgagagatggttgattcatgg

SEQ ID NO: 271290 - DNA, 75 bp, Artificial Sequence
  Synthetic
gttagagaatcaaactctagatgatctggatgatgctgtctcttacatcaagcataattttccagatgcaattcc

SEQ ID NO: 271291 - DNA, 75 bp, Artificial Sequence
  Synthetic
ctggatttctctaggagagtccctttcccagccctgaggcggctggtaaataaaagcctcaattgtaacaaacat

SEQ ID NO: 271292 - DNA, 75 bp, Artificial Sequence
  Synthetic
tcccagccctgaggcggctggtaaataaaagcctcaattgtaacaaacatctaagaacactacattaaccccatg

SEQ ID NO: 271293 - DNA, 75 bp, Artificial Sequence
  Synthetic
cagtgcaattagtatattgctcctggtgacaaaaatttttaagaaggaagactcaaaggatgagagagcatacaa

SEQ ID NO: 271294 - DNA, 75 bp, Artificial Sequence
  Synthetic
cttgcaataagatgagtggaaacaagacgcttaaagcatggtgtaaatcaacttttctaacctgtacattgtatg

SEQ ID NO: 271295 - DNA, 75 bp, Artificial Sequence
  Synthetic
ggtgcctctggggccaaaagccaaggtttaacagaccctctaggattggtttaaaacctgagatgttgtggaaaa

SEQ ID NO: 271296 - DNA, 75 bp, Artificial Sequence
  Synthetic
ggatttagctatcctcaagtgtaagttaccatttaggttcaagaagaattccaaatattatactaataaaattgg

SEQ ID NO: 271297 - DNA, 75 bp, Artificial Sequence
  Synthetic
tattcagtacctaccaatctggtagtagtgcaaacactagttgtaaggcccacgaaggatgcccagaaggtaccc

SEQ ID NO: 271298 - DNA, 75 bp, Artificial Sequence
  Synthetic
cacgaaggatgcccagaaggtacccgtaggtaacaagtgacactacggatctgatctggggccaggtacctctat

SEQ ID NO: 271299 - DNA, 75 bp, Artificial Sequence
  Synthetic
ttaccatttaggttcaagaagaattccaaatattatactaataaaattggaacagaaagtatgttaatctggatg

SEQ ID NO: 271300 - DNA, 75 bp, Artificial Sequence
  Synthetic
ctaggtgacctggttaaaaaacgtctagtgggccaaacccgggggggaccccggtttccttttattttatcaatg

SEQ ID NO: 271301 - DNA, 75 bp, Artificial Sequence
  Synthetic
ccactatggagacaattaagagtattgcagatatggcgactggagtagtcagttcagttgattcaactatcaatg

SEQ ID NO: 271302 - DNA, 75 bp, Artificial Sequence
  Synthetic
cagtcaatgagaaggtggaaaatgtgggcaatgaaattggaggtaatttactaaccaaagttgcggatgatgctt

SEQ ID NO: 271303 - DNA, 75 bp, Artificial Sequence
  Synthetic
ctaatgtgcttgggccaaattgctacgctacaacagctgaaccggaaaacaaagatgtagtacaggcaaccacaa

SEQ ID NO: 271304 - DNA, 75 bp, Artificial Sequence
  Synthetic
gcaacctatgtacatcaatactagaactcaaatccacaagagtccagtctatggagcagtagaagttaagatggg

SEQ ID NO: 271305 - DNA, 75 bp, Artificial Sequence
  Synthetic
cgctacaacagctgaaccggaaaacaaagatgtagtacaggcaaccacaactgttaatacaactaatttgacaca

SEQ ID NO: 271306 - DNA, 75 bp, Artificial Sequence
  Synthetic
atatagagttaataaatttcaggtgaacaatgaattatggcagggtgtcaaagcctgtgttaaatccaaatttag

SEQ ID NO: 271307 - DNA, 75 bp, Artificial Sequence
  Synthetic
agcaaattagttagattggagactcatgagtggacaccaacatgggctagaggacaccagataacccacgtggaa

SEQ ID NO: 271308 - DNA, 75 bp, Artificial Sequence
  Synthetic
gtagatatgaagacagccatcctagggacatcccatgttaattctatggacttaagtacatcagctgggtatagt

SEQ ID NO: 271309 - DNA, 75 bp, Artificial Sequence
  Synthetic
ttgccaaaagttttttgggacaagaacagcaagccagcctatggtcaatcacgatattttgcagcagtacggtgt

SEQ ID NO: 271310 - DNA, 75 bp, Artificial Sequence
  Synthetic
tttgttaaatcagggtataaaaagaaagatttaatttgccttgaacctttctcagtttcgccaatgcttgagaag

SEQ ID NO: 271311 - DNA, 75 bp, Artificial Sequence
  Synthetic
ggttttcattttcaggtacaagtgaatgttaatcaaggaacagctggtagtgcactagtagtgtatgaacccaag

SEQ ID NO: 271312 - DNA, 75 bp, Artificial Sequence
  Synthetic
tgcactagtagtgtatgaacccaagcctgttgtgacatatgattcaaagttagaatttggagcatttaccaacct

SEQ ID NO: 271313 - DNA, 75 bp, Artificial Sequence
  Synthetic
ttggtgcaagacaagttccatgcactgctaaagggcaatcaaatcactacaattttcaacacttgtttaaaggat

SEQ ID NO: 271314 - DNA, 75 bp, Artificial Sequence
  Synthetic
aagatttaatttgccttgaacctttctcagtttcgccaatgcttgagaagttggtgcaagacaagttccatgcac

SEQ ID NO: 271315 - DNA, 75 bp, Artificial Sequence
  Synthetic
cacctttatctataccttcaggttctgctacacaagtagatgtgacaatactgggtagtttgttgcaattggact

SEQ ID NO: 271316 - DNA, 75 bp, Artificial Sequence
  Synthetic
ttcaaaatcctagggtatatggtcaagatgttggtatttatgacaatgcaccaacacggaagcaaaatctcaaaa

SEQ ID NO: 271317 - DNA, 75 bp, Artificial Sequence
  Synthetic
ggaatcaatccatataaagattggcactttatgattaatgccttgaacgactacaattatgagatggattactcc

SEQ ID NO: 271318 - DNA, 75 bp, Artificial Sequence
  Synthetic
cagtatgatggttctcttagttcaatgctattgtgggaggccgtggaggttttagcttattgtcatgactcacct

SEQ ID NO: 271319 - DNA, 75 bp, Artificial Sequence
  Synthetic
agattcttacaatgagcactaagtacaagtggactagacagaagattgatatcgcagaagggccaggttctatga

SEQ ID NO: 271320 - DNA, 75 bp, Artificial Sequence
  Synthetic
tgctattgtgggaggccgtggaggttttagcttattgtcatgactcacctgatctagttatacagttacataaac

SEQ ID NO: 271321 - DNA, 75 bp, Artificial Sequence
  Synthetic
acatggcgaatgtattgagcaccactgcagcacagtcacttgctttggttggagaaagagcattctatgacccaa

SEQ ID NO: 271322 - DNA, 75 bp, Artificial Sequence
  Synthetic
tgatgatctagtaaaaatatctcaacttttttctgtgatgagcgactccacaaccccttcagccaaccatggcat

SEQ ID NO: 271323 - DNA, 75 bp, Artificial Sequence
  Synthetic
agatgcaaagggttattttaagtggtcatctacaactgcaccacagtcagtagtacacagaaatattgtttactt

SEQ ID NO: 271324 - DNA, 75 bp, Artificial Sequence
  Synthetic
aaaattatttcccaacttaaatgtttttgtcaacagctactcatattttagaggttcagtagtgttgaggttaag

SEQ ID NO: 271325 - DNA, 75 bp, Artificial Sequence
  Synthetic
tgtgtatgccagcactttcaatagaggccgcctacggatgggcttctttccaaatgctactgaagacagtacttc

SEQ ID NO: 271326 - DNA, 75 bp, Artificial Sequence
  Synthetic
tttatagtaggaaaattggacactgaaaatatgatacaacatttaatgtggatgaaaaatttcagcacattcaag

SEQ ID NO: 271327 - DNA, 75 bp, Artificial Sequence
  Synthetic
agaaatagataatgccatatacacaatttgtgatttgggcagtgataacagctttgagattactattccatactc

SEQ ID NO: 271328 - DNA, 75 bp, Artificial Sequence
  Synthetic
attttccacctggatgcggaaaacggatggtcacccgattggactattccaaatcgaagtactcaataggctaac

SEQ ID NO: 271329 - DNA, 75 bp, Artificial Sequence
  Synthetic
ctataacagctccagtcctaatgaagtctactgtattgtgcaaggtaaaatgggacaagatgccaggttcttttg

SEQ ID NO: 271330 - DNA, 75 bp, Artificial Sequence
  Synthetic
tcatagtggatgattatgatgttgtcattgctaagttgatgcccatggtgtttgactaaggttaatgttttggtt

SEQ ID NO: 271331 - DNA, 75 bp, Artificial Sequence
  Synthetic
tgggacaagatgccaggttcttttgtccaactggctctgtggtgactttccagaattcatggggttcacagatgg

SEQ ID NO: 271332 - DNA, 75 bp, Artificial Sequence
  Synthetic
atttaactgatccattatgtctagaagagtctgcagaggaatgtaaacagactatatcaccaaacgaattgggct

SEQ ID NO: 271333 - DNA, 75 bp, Artificial Sequence
  Synthetic
actatatcaccaaacgaattgggcttaacatcagcacaagatgacgggccattgggtgatagcaagccaaattat

SEQ ID NO: 271334 - DNA, 75 bp, Artificial Sequence
  Synthetic
ttcctaaatttcaagtccatgaatgtggacatcttcactgtttctcacactaaagtagacaacttatttgggaga

SEQ ID NO: 271335 - DNA, 75 bp, Artificial Sequence
  Synthetic
gcctggttttatcaggaacacactttcaccaatgagggacagtggagagtcaatttagagtttccaaaacaaggc

SEQ ID NO: 271336 - DNA, 75 bp, Artificial Sequence
  Synthetic
ccagcggaacaacacctggtaacaggtgcctctggggccaaaagccaaggtttaacagaccctttaggattggtt

SEQ ID NO: 271337 - DNA, 75 bp, Artificial Sequence
  Synthetic
catggttcgctttccttactatttgcttatttcacaggtgaattaaatattcatgttttattcctagctgaaaaa

SEQ ID NO: 271338 - DNA, 75 bp, Artificial Sequence
  Synthetic
ggatttcttagagtagcccacacctacgacacatcagaaaacagggttaacttcctgtcgtccaatggtgttatt

SEQ ID NO: 271339 - DNA, 75 bp, Artificial Sequence
  Synthetic
acaattccagcaggagaacaaatgacattgtctgcaccttactattcaaataagcccctcagaacagttagagac

SEQ ID NO: 271340 - DNA, 75 bp, Artificial Sequence
  Synthetic
agtaatagccttgggtatctaatgtgcaaaccattcctcactggaacaactacagggaaaatagaagtctatctt

SEQ ID NO: 271341 - DNA, 75 bp, Artificial Sequence
  Synthetic
ccggtttccttttgttttactaatgctactatggagacaattaagaatattgcagatatggcaactggagtagtc

SEQ ID NO: 271342 - DNA, 75 bp, Artificial Sequence
  Synthetic
agtttgagatgtccaaatttcttctttcctcttcctgcacctaaagttacaactagtcgtgctttgcggggtgac

SEQ ID NO: 271343 - DNA, 75 bp, Artificial Sequence
  Synthetic
agttcagttgattcaaccatcaatgcagttaacgagaaggtggaaaatgtaggaaatgagattggaggtaattta

SEQ ID NO: 271344 - DNA, 75 bp, Artificial Sequence
  Synthetic
ctggcaaatttctcagatcagagcccatatggtcaacaatcacagagtcaagtaatgaaattagcttatttagat

SEQ ID NO: 271345 - DNA, 75 bp, Artificial Sequence
  Synthetic
ttgaccaaagttgcagatgatgcatctaatgtgcttggaccaaattgttatgctacaacagctgagccagagaat

SEQ ID NO: 271346 - DNA, 75 bp, Artificial Sequence
  Synthetic
agtaatgaaattagcttatttagatagaggtttttacaagcactatggcattgtggttggagatagtgtatatca

SEQ ID NO: 271347 - DNA, 75 bp, Artificial Sequence
  Synthetic
gttggattcagatgacattttcaagacagctttaacagggaaagctaggttcactaagacaaaattaactccaga

SEQ ID NO: 271348 - DNA, 75 bp, Artificial Sequence
  Synthetic
ctgggttgttgaagaagaatgtgaattggattacttcagagtgaaataccttgaatcatctgttaactcagagca

SEQ ID NO: 271349 - DNA, 75 bp, Artificial Sequence
  Synthetic
catcttctcagtagaccacaattgtgaaactattgctaaggatatctttggtacccacactcttagtcaacacca

SEQ ID NO: 271350 - DNA, 75 bp, Artificial Sequence
  Synthetic
agctattggtttggtgggtacaatcctcttaactgctggtttaatgtcaactattaaaacaccagtcaatgctac

SEQ ID NO: 271351 - DNA, 75 bp, Artificial Sequence
  Synthetic
ggtttccattttcaggtgcaagtgaatgttaatcaaggaacagctggtagtgcattggtggtgtatgaacccaaa

SEQ ID NO: 271352 - DNA, 75 bp, Artificial Sequence
  Synthetic
aaccattaaagaatttttcaaccacgccatggaaggcgatgaacagggtttgtctttacttgtacagaaatgtac

SEQ ID NO: 271353 - DNA, 75 bp, Artificial Sequence
  Synthetic
tactttcttctcttctgcagccacagaaattttggacaatgatttggttaaattcatagtgaaaattctcgtcag

SEQ ID NO: 271354 - DNA, 75 bp, Artificial Sequence
  Synthetic
aatcctctgttatatggtgttatattgtcataaaccaaatatcttaaccactgcttgtttgtcaacgctactaat

SEQ ID NO: 271355 - DNA, 75 bp, Artificial Sequence
  Synthetic
aatggatgttacatcctcgtcagtgctgtcgccttcctgcaaggcactcatgcagtgcctaatggatggtgatgt

SEQ ID NO: 271356 - DNA, 75 bp, Artificial Sequence
  Synthetic
gaatccatgtctaatacagatgatgaagaaatcaaagaacaaatttgtgacacagtaaaatatactaagagtatt

SEQ ID NO: 271357 - DNA, 75 bp, Artificial Sequence
  Synthetic
ctatcaaaccagggacccttcaagggttttaatgaagtatcaaccgcatttagacatatagattggtggatacac

SEQ ID NO: 271358 - DNA, 75 bp, Artificial Sequence
  Synthetic
actctattgaaaattaaagacatggttctgagtgtgtttaaacccagtatggagagcaaagctgtccagtggttg

SEQ ID NO: 271359 - DNA, 75 bp, Artificial Sequence
  Synthetic
gaacagcaggaagtaagagtaggtttgatgacttagtaaaaatatctcaacttttctctgtgatgagtgactcca

SEQ ID NO: 271360 - DNA, 75 bp, Artificial Sequence
  Synthetic
gagaggaacaaggaacatgtgtgtggaatcctagattatgcttctgatatcattgttgagtcaaaggatcaatcc

SEQ ID NO: 271361 - DNA, 75 bp, Artificial Sequence
  Synthetic
tggtacataggaatattgtttacctaaaacagtttcccaacttgaatgtttttgtcaacagctactcatatttta

SEQ ID NO: 271362 - DNA, 75 bp, Artificial Sequence
  Synthetic
aaagtgaaaacacaggaattttaccaaaggtattcagactgcttagccaaattcaaaccaatcatggccatttgt

SEQ ID NO: 271363 - DNA, 75 bp, Artificial Sequence
  Synthetic
gaggctcaatagtgctgaggctgagtgtatatgccagcactttcaatagaggtcgtctacggatgggcttcttcc

SEQ ID NO: 271364 - DNA, 75 bp, Artificial Sequence
  Synthetic
tttaggagctgccataacagtattagcaacacagtatatagacttttccaggagttggctagaatccccaatcgg

SEQ ID NO: 271365 - DNA, 75 bp, Artificial Sequence
  Synthetic
ggtcgtctacggatgggcttcttcccaaatgcaaccgaagacagtacttcagaaatagacaatgccatatacaca

SEQ ID NO: 271366 - DNA, 75 bp, Artificial Sequence
  Synthetic
attagtacgaataatgatttaattagaatagaacccattggtatttggatccagggcgagcctggacaaggcaaa

SEQ ID NO: 271367 - DNA, 75 bp, Artificial Sequence
  Synthetic
atttgtgatttgggcagtgataacagttttgaaatcactattccatactcattttccacctggatgcgtaaaaca

SEQ ID NO: 271368 - DNA, 75 bp, Artificial Sequence
  Synthetic
tccttcttaacccatactctttcaaggcaattacagaaatcatgtaaacttaatggtgtcttcactaacccaact

SEQ ID NO: 271369 - DNA, 75 bp, Artificial Sequence
  Synthetic
gatggccacccgattggattgttccaaattgaagtgcttaacaggttaacttacaatagctccagccctaatgaa

SEQ ID NO: 271370 - DNA, 75 bp, Artificial Sequence
  Synthetic
gctagtgagttcatggatggttatgataatcaggacattcacctaattgatgatttgggtcaaacaaggaaagag

SEQ ID NO: 271371 - DNA, 75 bp, Artificial Sequence
  Synthetic
ttacaatagctccagccctaatgaagtttattgtattgtgcagggtaaaatggggcaggacgccaggtttttctg

SEQ ID NO: 271372 - DNA, 75 bp, Artificial Sequence
  Synthetic
aaagacattgagatgttatgcaattgcatttcttcagttccttttattgtgccaatggcacatcttgaggaaaaa

SEQ ID NO: 271373 - DNA, 75 bp, Artificial Sequence
  Synthetic
ggaaaattctacactagtaagctggtaattgctaccaccaacaaatcagatttttctagcacagtccttcaggac

SEQ ID NO: 271374 - DNA, 75 bp, Artificial Sequence
  Synthetic
tctggagcactcaaaaggaggttcccttacattatgcatatccgggcagcaaaagcttacagcaaagctggtaag

SEQ ID NO: 271375 - DNA, 75 bp, Artificial Sequence
  Synthetic
cttaatgtaagtcaggccatggcaacgatggctactggtgaatgttgggaagtatcaaagaatggaagagattgg

SEQ ID NO: 271376 - DNA, 75 bp, Artificial Sequence
  Synthetic
catggttcgctttccttgctattcgcttatttcacaggtgaattaaatatccatgttttgttcctagctgagaag

SEQ ID NO: 271377 - DNA, 75 bp, Artificial Sequence
  Synthetic
gaaacgctgaaattaaaagaattggttgacaagattacaggtgactataatgaaagggtgaagaattatgatgct

SEQ ID NO: 271378 - DNA, 75 bp, Artificial Sequence
  Synthetic
tggaaacaacagttggaaaaccagacacttgatgacttggatgatgctgtgtcttacattaaacacaattttcct

SEQ ID NO: 271379 - DNA, 75 bp, Artificial Sequence
  Synthetic
acaatcccagctggagaacagatgacattatctgcaccttactactcgaataagccccttagaacagttagggat

SEQ ID NO: 271380 - DNA, 75 bp, Artificial Sequence
  Synthetic
gatgccataccatatattgatgagtacctcaacattgagatgtcaacattaattgaacaaatggaagcattcata

SEQ ID NO: 271381 - DNA, 75 bp, Artificial Sequence
  Synthetic
cattatctgcaccttactactcgaataagccccttagaacagttagggataacaatagtcttgggtatttaatgt

SEQ ID NO: 271382 - DNA, 75 bp, Artificial Sequence
  Synthetic
gaaccaaaacctagtgtcttcaaatgctttgctaataaaattggctcaaaaatttctaaagcctccagggaagtt

SEQ ID NO: 271383 - DNA, 75 bp, Artificial Sequence
  Synthetic
gttgactggttctctgacaaaattaagtccatgctcagttttgtcgagagaaataaagcttggctcacagttgtc

SEQ ID NO: 271384 - DNA, 75 bp, Artificial Sequence
  Synthetic
tccctcttcccgcacctaaagttacaactggccgcgctttgcggggtgacttggcaaatttctcagatcagagcc

SEQ ID NO: 271385 - DNA, 75 bp, Artificial Sequence
  Synthetic
tctgctgtcaccagtgctatcagtatactcttgctagtaaccaaaatttttaagggaaaagaatctaaagatgag

SEQ ID NO: 271386 - DNA, 75 bp, Artificial Sequence
  Synthetic
tatatgatcaacaatcacagagccaagtgatgaagctagcttacttagataggggtttctacaagcactatggca

SEQ ID NO: 271387 - DNA, 75 bp, Artificial Sequence
  Synthetic
agagcttataacccaactttaccagtcgccaaaaccaaaggtgcctttccaatctcccagcgggagttcaaaaat

SEQ ID NO: 271388 - DNA, 75 bp, Artificial Sequence
  Synthetic
gaagccccttatgatgggcaattggaacatatcatctcacagatggcatacattactggttctacaactgggcac

SEQ ID NO: 271389 - DNA, 75 bp, Artificial Sequence
  Synthetic
ttggattatttcagggtaaagtaccttgaatcatctgtcaactcagagcatatcttctcagtagaccacaattgt

SEQ ID NO: 271390 - DNA, 75 bp, Artificial Sequence
  Synthetic
ctcactcattgtgctggatatcaacatgatgaaatcatacttcatggtcactccattaagtacctggaacaggag

SEQ ID NO: 271391 - DNA, 75 bp, Artificial Sequence
  Synthetic
gcacccacactcttagtcagcaccaggctgttggtttgataggcacaattctcttaactgctggtctaatgtcga

SEQ ID NO: 271392 - DNA, 75 bp, Artificial Sequence
  Synthetic
gaagagcttacattacattacaagaataaggttttcccaattgaacaaccatccgtcactcaggtgactctaggt

SEQ ID NO: 271393 - DNA, 75 bp, Artificial Sequence
  Synthetic
ggtaaacccatggatttagcaattctcaaatgtaaattaccatttaggttcaaaaagaactcaaaatattacacc

SEQ ID NO: 271394 - DNA, 75 bp, Artificial Sequence
  Synthetic
tatctctacttgtacaaaaatgcaccactttcttctcttcagcagccacagaaattttagacaatgatttggtta

SEQ ID NO: 271395 - DNA, 75 bp, Artificial Sequence
  Synthetic
aataagataggtacagaaagtatgctaatttggatgactgaacaaggcattatcacaaaggaagttcagagagta

SEQ ID NO: 271396 - DNA, 75 bp, Artificial Sequence
  Synthetic
caccattcaggtggtattaaaactagggagggaactgagagcactaaaaccattagttacactgtaaaatcatgt

SEQ ID NO: 271397 - DNA, 75 bp, Artificial Sequence
  Synthetic
aatcctctgttacatggtgttatattgccacaaaccaaatattctaaccactgcttgtttatccacactactaat

SEQ ID NO: 271398 - DNA, 75 bp, Artificial Sequence
  Synthetic
aaaggtatgtgtggtggtctcctaatatccaaagtagaaggaaattttaaaattctagggatgcacattgcaggc

SEQ ID NO: 271399 - DNA, 75 bp, Artificial Sequence
  Synthetic
aatggtgaaatgggggttgctatacccttcaattttctcaagaatgatatgtcagaccagggaattgtaacagaa

SEQ ID NO: 271400 - DNA, 75 bp, Artificial Sequence
  Synthetic
gaatccatgtctaatacagatgatgaggaaatcaaagaacaaatttgtgacacagtaaaatataccaaaagtatt

SEQ ID NO: 271401 - DNA, 75 bp, Artificial Sequence
  Synthetic
atcacaccaattcaacctatgtacattaacactaagacacagattcataaaagtccagtctatggggcggttgaa

SEQ ID NO: 271402 - DNA, 75 bp, Artificial Sequence
  Synthetic
gtcaaaatgggccctgcagtactgagcaaatctgacaccaggctagaggaaccagttgagtgcttaatcaagaaa

SEQ ID NO: 271403 - DNA, 75 bp, Artificial Sequence
  Synthetic
tctgcatcaaagtacagggttaacaaatttcaggttaacaatgaattatggcagggtgtcaaagcctgtgttaag

SEQ ID NO: 271404 - DNA, 75 bp, Artificial Sequence
  Synthetic
gagagaaataaagagcatgtttgtgctgtcttggattatgcctctgatatcattgtggagtcaaaagaccagaca

SEQ ID NO: 271405 - DNA, 75 bp, Artificial Sequence
  Synthetic
tcaaaatttagagaaatatttggaatcaatggtatagtagacatgaaaacagccatcttaggtacctccaatgta

SEQ ID NO: 271406 - DNA, 75 bp, Artificial Sequence
  Synthetic
aactcaatggatctgagtacatcagcaggttatagttttgtaaagtctggctataaaaagaaggatttaatttgt

SEQ ID NO: 271407 - DNA, 75 bp, Artificial Sequence
  Synthetic
tttagaagttgccacaatagcattagcaatacagtctatagactattccaagagctagctagaataccatctagg

SEQ ID NO: 271408 - DNA, 75 bp, Artificial Sequence
  Synthetic
cttgagccattctctgtgtcaccaatgctagagaagctggtacaggaaaaatttcataacctactgaaaggtaat

SEQ ID NO: 271409 - DNA, 75 bp, Artificial Sequence
  Synthetic
cagatcactactatttttaatacttgcctaaaagatgaacttagaaaattagataaaattacagctgggaaaact

SEQ ID NO: 271410 - DNA, 75 bp, Artificial Sequence
  Synthetic
agatgcattgaggcatgtgaagtagattactgcattgtttataggatgataatgatggaaatttatgacaaaatt

SEQ ID NO: 271411 - DNA, 75 bp, Artificial Sequence
  Synthetic
cccaatggcacatcttgaagagaagggcaaattttacaccagcaaactagtgatagcaacaactaacaaatctga

SEQ ID NO: 271412 - DNA, 75 bp, Artificial Sequence
  Synthetic
taccaaaccccatgttactattcaggacttgctgtgggaataaacccctataaagattggcactttatgattaat

SEQ ID NO: 271413 - DNA, 75 bp, Artificial Sequence
  Synthetic
gcactcaatgactacaattatgaaatggattactcccagtacgatggctctctaagttccatgttactttgggag

SEQ ID NO: 271414 - DNA, 75 bp, Artificial Sequence
  Synthetic
gcagtagaagttttagcttattgccatgattcaccagatcttgtgatgcaactccataaaccagtgattgattca

SEQ ID NO: 271415 - DNA, 75 bp, Artificial Sequence
  Synthetic
agtgtcaaagaatggtagggactgggaaactctaagactaaaggacttagtccataagattactgaggattacca

SEQ ID NO: 271416 - DNA, 75 bp, Artificial Sequence
  Synthetic
gatcacgtagttttcaacgagagatggctgattcatggtggtatgccatcaggatctccttgcactacagtacta

SEQ ID NO: 271417 - DNA, 75 bp, Artificial Sequence
  Synthetic
aattcactatgtaatctaatgatgtgcatttacactacaaatttaattagcccaggcattgactgtctgccaata

SEQ ID NO: 271418 - DNA, 75 bp, Artificial Sequence
  Synthetic
tggaaacagcagttagagaaccaaactttagatgatttggatgatgcagtctcttacatcaagcacaatttccca

SEQ ID NO: 271419 - DNA, 75 bp, Artificial Sequence
  Synthetic
gtctatggtgatgatgttatcttgtccctggacaaagaaattgagccaaaaagactgcagagtgtcatggcagaa

SEQ ID NO: 271420 - DNA, 75 bp, Artificial Sequence
  Synthetic
gagcctaggcctagtgttttcaaatgttttgcaaccaaggttgctaaccagacaaagaaagcaaccaaagaagtt

SEQ ID NO: 271421 - DNA, 75 bp, Artificial Sequence
  Synthetic
tcttttggagctgaagtaactgggtcgcgaaaggatgagccaccgtctttaaaacctaggatggaggtcgaattt

SEQ ID NO: 271422 - DNA, 75 bp, Artificial Sequence
  Synthetic
gacaaagaaagcaaccaaagaagttgtggaatggtttagtagcaaaatcaagtcaatgctgagttttgtagaaaa

SEQ ID NO: 271423 - DNA, 75 bp, Artificial Sequence
  Synthetic
ctaaagcgcaaacctggttactttccagagtctacatttatagtaggaaaattagacactgaaaacatgatacaa

SEQ ID NO: 271424 - DNA, 75 bp, Artificial Sequence
  Synthetic
cacttaatgtggatgaaaaattttagcacttttaagcagcaactccaatcctacttgatggagctatgcctccat

SEQ ID NO: 271425 - DNA, 75 bp, Artificial Sequence
  Synthetic
caagaaagaagactcaaaagatgaaagagcatacaacccaacactccctgttacaaaaccaaagggcacattccc

SEQ ID NO: 271426 - DNA, 75 bp, Artificial Sequence
  Synthetic
ggaaaagacacttatcttcactacatcaaaattttggatccttatctgaaagaatggaacattacagtggatgat

SEQ ID NO: 271427 - DNA, 75 bp, Artificial Sequence
  Synthetic
tatgatgtggtgatagctaagttgatgcccatggtgtttgactaaattaatgttttggttttcttttgctatgga

SEQ ID NO: 271428 - DNA, 75 bp, Artificial Sequence
  Synthetic
tatggactttataattaggatactaatttgattagaacactaattcggaatattggacataacaaaaaaaaaaaa

SEQ ID NO: 271429 - DNA, 75 bp, Artificial Sequence
  Synthetic
atgatgagatcatattgcatggacactcaatcaagtaccttgaacaagaggaggaattgaccctgcattacaaga

SEQ ID NO: 271430 - DNA, 75 bp, Artificial Sequence
  Synthetic
cgtcgggccttataccccgatttgctgagcttctctaggagagtccctttccccagccagaggtggctggtcaaa

SEQ ID NO: 271431 - DNA, 75 bp, Artificial Sequence
  Synthetic
ataaagtgttcccagttgagtgcccttccgtgactcaagtcacattgggtggcaaacctatggatttggccatcc

SEQ ID NO: 271432 - DNA, 75 bp, Artificial Sequence
  Synthetic
taataccaattgtaacaaaacatctaagatacaacaaccacacacctggtctccaccagtcgaaggcaactagca

SEQ ID NO: 271433 - DNA, 75 bp, Artificial Sequence
  Synthetic
ttccgtgactcaagtcacattgggtggcaaacctatggatttggccatcctaaagtgtaaattaccattcagatt

SEQ ID NO: 271434 - DNA, 75 bp, Artificial Sequence
  Synthetic
ataagataggtgggttgagacgcttaaagtgtgtagtacatttacttttccaacctgtgctttgcacagggtggc

SEQ ID NO: 271435 - DNA, 75 bp, Artificial Sequence
  Synthetic
tattactaaggaagttcagagggtccaccactctggtggtatcaaaaccagagaaggaactgagagtacaaagac

SEQ ID NO: 271436 - DNA, 75 bp, Artificial Sequence
  Synthetic
caccactctggtggtatcaaaaccagagaaggaactgagagtacaaagacaattagctacacagtgaaatcttgt

SEQ ID NO: 271437 - DNA, 75 bp, Artificial Sequence
  Synthetic
gggaacttgttggaaataatagtttgctgtaaagcatcccattgccagcggaatcacatctggtaacaggtgcct

SEQ ID NO: 271438 - DNA, 75 bp, Artificial Sequence
  Synthetic
ctggggccaaaagccaaggtttaacagaccctttgggattggttcaaacctgaactattatggaaaatatttagt

SEQ ID NO: 271439 - DNA, 75 bp, Artificial Sequence
  Synthetic
cttttaattttcttaaaaatgacatgtctgatcaaggcattgtcacagaagttacacccatacagcccatgtaca

SEQ ID NO: 271440 - DNA, 75 bp, Artificial Sequence
  Synthetic
gggccaactacctctatcttggtgagttggttaaaaaacgtctagtgggccaaacccgggggggaccccggtttc

SEQ ID NO: 271441 - DNA, 75 bp, Artificial Sequence
  Synthetic
cttttatttaataatgccactatggagacaatcaagaatatcgcagatatggctactggagttgttagctctgtt

SEQ ID NO: 271442 - DNA, 75 bp, Artificial Sequence
  Synthetic
agctattcttggcacatctcatgtaaattccatggaccttagcacgtcagctggatatagttttgttaaggcagg

SEQ ID NO: 271443 - DNA, 75 bp, Artificial Sequence
  Synthetic
gactcaaccatcaatgctgtcaatgagaaagtggaaaatgttggtaatgaaattggagggaatctattaactaaa

SEQ ID NO: 271444 - DNA, 75 bp, Artificial Sequence
  Synthetic
ttacaaaaagaaagatctaatttgtcttgaacccttctctatttctcctatgcttgagaaacttgtacaagaaaa

SEQ ID NO: 271445 - DNA, 75 bp, Artificial Sequence
  Synthetic
gtggctgatgacgcatcaaatgtacttgggcctaattgttttgcgactaccgccgaaccagagaacaagaatgta

SEQ ID NO: 271446 - DNA, 75 bp, Artificial Sequence
  Synthetic
cttgaacccttctctatttctcctatgcttgagaaacttgtacaagaaaaatttcataacttacttaagggcaat

SEQ ID NO: 271447 - DNA, 75 bp, Artificial Sequence
  Synthetic
gttcaagcaactaccactgtgaataccacaaatctgacccaacatccatctgctccaactatgcctttttcacca

SEQ ID NO: 271448 - DNA, 75 bp, Artificial Sequence
  Synthetic
gatttttcaaatgttgacaactttcattctatggcatatgacatcactaccggagataaaaaccccagtaaattg

SEQ ID NO: 271449 - DNA, 75 bp, Artificial Sequence
  Synthetic
catgatggaaatttatgataaaatctatcagacaccgtgttactattcaggccttgctgttggaataaacccata

SEQ ID NO: 271450 - DNA, 75 bp, Artificial Sequence
  Synthetic
gttagacttgaaactcacgaatggacaccatcttgggctagaggacaccagataactcatgttgaattacctaaa

SEQ ID NO: 271451 - DNA, 75 bp, Artificial Sequence
  Synthetic
gttttttggaataaccaggataaaccagcttatggccaatctcgctatttcgccgctgtgagatgtggtttccac

SEQ ID NO: 271452 - DNA, 75 bp, Artificial Sequence
  Synthetic
gctgtggaagtcttggcatattgtcatgattcacctgatcttgttatacagttacatagaccagtgattgactcg

SEQ ID NO: 271453 - DNA, 75 bp, Artificial Sequence
  Synthetic
ttccaagttcaggtaaatgtcaatcaaggaaccgctggcagtgctttagtggtctatgaaccaaaaccagtagtc

SEQ ID NO: 271454 - DNA, 75 bp, Artificial Sequence
  Synthetic
gaccatgtggtcttcaacgagagatggttgattcatggaggtatgccatcagggtccccatgtactactgtgtta

SEQ ID NO: 271455 - DNA, 75 bp, Artificial Sequence
  Synthetic
acctatgactctaaattggagtttggtgcattcacaaacctgcctcatgttcttatgaatttagcagaaaccaca

SEQ ID NO: 271456 - DNA, 75 bp, Artificial Sequence
  Synthetic
agggtccccatgtactactgtgttaaattcattatgcaaccttatgatgtgcatctatactaccaacttaatcag

SEQ ID NO: 271457 - DNA, 75 bp, Artificial Sequence
  Synthetic
caggctgacttgtgcatcccctatgttgctgacacaaactatgtaaagacagattcgtcagatctagggcaatta

SEQ ID NO: 271458 - DNA, 75 bp, Artificial Sequence
  Synthetic
aaggtctatgtctggacaccactcacaattcctactggttctgctaatcaggtggacgtaacaatcttaggtagt

SEQ ID NO: 271459 - DNA, 75 bp, Artificial Sequence
  Synthetic
ttgctccaattagatttccaaaaccctagggtttttggccaagatgttaacatatatgataatgctcccaataac

SEQ ID NO: 271460 - DNA, 75 bp, Artificial Sequence
  Synthetic
ctcgcaaggatgaacctccatcattgaaacccagactggaggtagaatttttaaagcgtaaacctggttacttcc

SEQ ID NO: 271461 - DNA, 75 bp, Artificial Sequence
  Synthetic
aaaaagaaaaattggaaaaagatcatgacaatgagcactaaatataagtggactagaaccaaaattgatattgca

SEQ ID NO: 271462 - DNA, 75 bp, Artificial Sequence
  Synthetic
gaagggccaggatccatgaacatggccaatgtacttagcactactggcgcccagtcagtagctctagtgggtgaa

SEQ ID NO: 271463 - DNA, 75 bp, Artificial Sequence
  Synthetic
agagcattctatgacccaagaactgctggtagtaggtcaaggtttgatgatcttgtgaaaatatcacaattgttc

SEQ ID NO: 271464 - DNA, 75 bp, Artificial Sequence
  Synthetic
agagtggaatattatagtggatgattatgatgtggttataactaagttgatgcccatggtgtttgattagaatta

SEQ ID NO: 271465 - DNA, 75 bp, Artificial Sequence
  Synthetic
tccgttatggctgattcaactacaccgtctgagaaccatggtgctgatgcaaaagggtacttcaaatggtcagct

SEQ ID NO: 271466 - DNA, 75 bp, Artificial Sequence
  Synthetic
atgttttggtttttttttgttatggactttatcattaaaacactaatttgattattacactaatttgaaatattg

SEQ ID NO: 271467 - DNA, 75 bp, Artificial Sequence
  Synthetic
acaacagctccacaaagcatagttcataggaatatagtgtacctgaaattattcccaaatttgaatgtctttgtc

SEQ ID NO: 271468 - DNA, 75 bp, Artificial Sequence
  Synthetic
tttgaaaggggtctcctagagagcttggccgtcgggccttataccccgacttgctgagcttctctaggagagtcc

SEQ ID NO: 271469 - DNA, 75 bp, Artificial Sequence
  Synthetic
tatggactttatcattaaaacactaatttgattattacactaatttgaaatattggacataccaaaaaaaaaaaa

SEQ ID NO: 271470 - DNA, 75 bp, Artificial Sequence
  Synthetic
aacagctattcatattttagaggctctttgatccttaggttgagtgtgtatgccagcacctttaacagaggccgg

SEQ ID NO: 271471 - DNA, 75 bp, Artificial Sequence
  Synthetic
ctttcccagccctgaggcggctggttaataatagcctcaagcgtaactaatatctaagaagattgtgcaaaccct

SEQ ID NO: 271472 - DNA, 75 bp, Artificial Sequence
  Synthetic
ctgagaatgggattttttcccaatgccacagcagattccacttccacactggataacgcaatttacacaatttgt

SEQ ID NO: 271473 - DNA, 75 bp, Artificial Sequence
  Synthetic
gacattggaagtgacaatagttttgagatcaccatcccatattctttttccacttggatgaggaagacaaatgac

SEQ ID NO: 271474 - DNA, 75 bp, Artificial Sequence
  Synthetic
caagacgcttaaagcatagagacagtattcttttctaacccacattactgtggggtggcagatggcgtgccataa

SEQ ID NO: 271475 - DNA, 75 bp, Artificial Sequence
  Synthetic
cacccaattggattattccaaattgaagtcttgaataggctcacttataatagttccagtccttcagaagtgtac

SEQ ID NO: 271476 - DNA, 75 bp, Artificial Sequence
  Synthetic
tgtatagtgcaaggtaaaatggggcaagatgccagattcttttgtcctacaggttcagtggtgacttttcagaat

SEQ ID NO: 271477 - DNA, 75 bp, Artificial Sequence
  Synthetic
aggtttaatagaccctttaggattggttctaaacctgagatgttgtggaaaatatttagtacctgctgacctggt

SEQ ID NO: 271478 - DNA, 75 bp, Artificial Sequence
  Synthetic
tcgtgggggtcacagatggacctaactgacccactctgtattgaagatgatgcagaaaattgcaagcagacaatg

SEQ ID NO: 271479 - DNA, 75 bp, Artificial Sequence
  Synthetic
tcccctaatgaactaggactcacatcagcccaagatgatggtcctctgggccaggagaaaccaaactacttcctt

SEQ ID NO: 271480 - DNA, 75 bp, Artificial Sequence
  Synthetic
aattttagatctatgaatgtagacatcttcactgtttcccacacgaaagtagacaacctgtttggaagggcctgg

SEQ ID NO: 271481 - DNA, 75 bp, Artificial Sequence
  Synthetic
atcttggtgggttggttaaaaaacgtctagtgggccaaacccaggggggatccctggtttccttttattttatca

SEQ ID NO: 271482 - DNA, 75 bp, Artificial Sequence
  Synthetic
tatttaatatggagacaatcaagggtattgcagatatggcaactggtattaccaagactattgattctacagtta

SEQ ID NO: 271483 - DNA, 75 bp, Artificial Sequence
  Synthetic
ttttttgaggaacacacatttaccgatgaagggcagtggagagtaccactgaaattccccaaacaaggtcatggg

SEQ ID NO: 271484 - DNA, 75 bp, Artificial Sequence
  Synthetic
acactgttaatgagaccattaccaaccccaacaatgctgctggtggggatatgcttacaaaagtggctgatgatg

SEQ ID NO: 271485 - DNA, 75 bp, Artificial Sequence
  Synthetic
tccttatcacttttatttgcttatttcactggtgagcttaacatccatgttttatttctttgtgagaggggtttt

SEQ ID NO: 271486 - DNA, 75 bp, Artificial Sequence
  Synthetic
cttcaaatgtgttaggaccaaactgttttgcaacaacatcaacaccggagaacaaggacgttgtccaagcaacga

SEQ ID NO: 271487 - DNA, 75 bp, Artificial Sequence
  Synthetic
ttgagagttgcacatacctatgacaccagtggagacagggttaattttctatcatcaaatggtgtaataactata

SEQ ID NO: 271488 - DNA, 75 bp, Artificial Sequence
  Synthetic
ctactgttaatacaacaaatttgacacaacacccttctgccccaactatgccttttaccccagatttccgtaatg

SEQ ID NO: 271489 - DNA, 75 bp, Artificial Sequence
  Synthetic
cctgctggagagcagatgacactttcagctccatactactcaaataagccactgagaactgtcagggatgataat

SEQ ID NO: 271490 - DNA, 75 bp, Artificial Sequence
  Synthetic
tagacatgtttcactcaatggcttatgacgtcaccacaggagacaagaatcctagtaaattgattaggttaagga

SEQ ID NO: 271491 - DNA, 75 bp, Artificial Sequence
  Synthetic
agccttgggtacttaatgtgtaaacctttcctgactgggaccactactgggaaaattgaagtttatcttagcctg

SEQ ID NO: 271492 - DNA, 75 bp, Artificial Sequence
  Synthetic
cagaattctgggaacgcacatatgcaagacaacatttgatagtggatgtagaactccctcatgccttttgggaca

SEQ ID NO: 271493 - DNA, 75 bp, Artificial Sequence
  Synthetic
aggtgcccaaatttctttttccctctacctgcaccaaaagttacaaccagccgtgctttacggggtgatatggca

SEQ ID NO: 271494 - DNA, 75 bp, Artificial Sequence
  Synthetic
atactaacaaaccagcatatggacaatcccggtatttcgcagccgtcaggtgcggtttccattttcaagtacagg

SEQ ID NO: 271495 - DNA, 75 bp, Artificial Sequence
  Synthetic
aacttctctgaccagggcccatatgatcagcaatcacaaagccaggtgatgaagttggcttacttagacaggggc

SEQ ID NO: 271496 - DNA, 75 bp, Artificial Sequence
  Synthetic
tgaatgttaaccaaggaacagcaggaagtgctttagttgtgtatgaaccaaaaccagctgttacccacagtgata

SEQ ID NO: 271497 - DNA, 75 bp, Artificial Sequence
  Synthetic
ttttataaacactacggtattattgtaggagatagtgtgtatcaattggactcagatgatattttcaaaacagcc

SEQ ID NO: 271498 - DNA, 75 bp, Artificial Sequence
  Synthetic
agatggagtttggagcctttaccaatttaccacatgtactcatgaatttggctgaaacaacgcaagctgatttat

SEQ ID NO: 271499 - DNA, 75 bp, Artificial Sequence
  Synthetic
ctgactgggaaagctaggtttactaaaacaaaattgaccccagattgggtcgttgaagaagaatgtgagctagat

SEQ ID NO: 271500 - DNA, 75 bp, Artificial Sequence
  Synthetic
gtatcccctatgtgtcagacacaaactatgttaaaacagattcgtctgacctagggcgtttaagagtgtatgtgt

SEQ ID NO: 271501 - DNA, 75 bp, Artificial Sequence
  Synthetic
tattttagggtaaagtaccttgagtcatcagtcaatacagaacatatcttctcagtagatcacaattgtgaaacc

SEQ ID NO: 271502 - DNA, 75 bp, Artificial Sequence
  Synthetic
gggctccactaacaataccatctggagcaactagtactgttgatgtgactgtgttaggaagcttgttacaattag

SEQ ID NO: 271503 - DNA, 75 bp, Artificial Sequence
  Synthetic
attgctaaagatattttcggtacccataccctcagtcaacaccaggccataggtttaattggaacaatcctttta

SEQ ID NO: 271504 - DNA, 75 bp, Artificial Sequence
  Synthetic
atttccaaaaccccagagtctataacacccaagttgatatatacgacaacaacaatgacactagggcaaaacaga

SEQ ID NO: 271505 - DNA, 75 bp, Artificial Sequence
  Synthetic
actgctggtttaatgtcaaccataaaaacgccagttaacactacaactattagagagttcttcaaccatgcaatt

SEQ ID NO: 271506 - DNA, 75 bp, Artificial Sequence
  Synthetic
tcaggaaaaagaagtggttaactatgtcaactaaatataaatggacaaggaacaaaattgatatagcggaaggcc

SEQ ID NO: 271507 - DNA, 75 bp, Artificial Sequence
  Synthetic
gatggagacgagcagggattgtctctattggtgcagaagtgtactacatttttctcttcagctgccacagaaatc

SEQ ID NO: 271508 - DNA, 75 bp, Artificial Sequence
  Synthetic
caggtgctatgaatatggctaatgtgctcagcaccaccggtgcccagtcagtggccctagttggagagagagctt

SEQ ID NO: 271509 - DNA, 75 bp, Artificial Sequence
  Synthetic
ctggataatgatttggtgaaatttattgtgaaaattttagttagaatcctgtgttacatggtattatattgtcac

SEQ ID NO: 271510 - DNA, 75 bp, Artificial Sequence
  Synthetic
tttacgaccccagaacggcaggtagtaagtctagatttgatgatttagtgaaaatagcccaactattctcagtta

SEQ ID NO: 271511 - DNA, 75 bp, Artificial Sequence
  Synthetic
aaacctaacatcttaactactgcctgtctatccacactgttgataatggatgtgacctcttcatcagtattgtca

SEQ ID NO: 271512 - DNA, 75 bp, Artificial Sequence
  Synthetic
tgagtgattcaactactccctctgcaagctcaggaattgatgacaaaggttactttgagtggaaagccacagcca

SEQ ID NO: 271513 - DNA, 75 bp, Artificial Sequence
  Synthetic
ccctcttgtaaggctctcatgcagtgcctcatggatggagatgttaagaagttggctgaagttgtggctgagtcc

SEQ ID NO: 271514 - DNA, 75 bp, Artificial Sequence
  Synthetic
caccacagactgtgattcaccggaatgtagtgaaattgaaccaatttccaaatttgaacatgtttgtaaattcat

SEQ ID NO: 271515 - DNA, 75 bp, Artificial Sequence
  Synthetic
atgtctaatacagatgatgaggaaattaaagaacaaatttgtgacacagtaaaatatactaagagtattttgtca

SEQ ID NO: 271516 - DNA, 75 bp, Artificial Sequence
  Synthetic
attcatactttaggggatcactaattatcagattgtctgtctatgccagtactttcaatcgtggtaggttgagga

SEQ ID NO: 271517 - DNA, 75 bp, Artificial Sequence
  Synthetic
aaccagggaccttttaaaggcttcaatgaagtttcaactgcattcagacacattgattggtggatacatactcta

SEQ ID NO: 271518 - DNA, 75 bp, Artificial Sequence
  Synthetic
tgggcttcttcccgaattttactacaaatactacctcagaaatagacaattcaatctacacaatttgtgatatag

SEQ ID NO: 271519 - DNA, 75 bp, Artificial Sequence
  Synthetic
ctgaagattaaggatatggttttgagtgtgttcaaacctagtatggagagtaaggccattcaatggctggagaga

SEQ ID NO: 271520 - DNA, 75 bp, Artificial Sequence
  Synthetic
ggtctgacaatagctttgaaatcactataccttacactttttcaacatggatgaggaaaactaatgggcatgcac

SEQ ID NO: 271521 - DNA, 75 bp, Artificial Sequence
  Synthetic
aataaagagcatgtttgtgccatcctggactatgcctctgatattattgtggaatcaaaagaccagactaagatg

SEQ ID NO: 271522 - DNA, 75 bp, Artificial Sequence
  Synthetic
tgggactgttccaaattgaggttttaaacagactgacttataatagttcaagtcccagttctgtacattgtatag

SEQ ID NO: 271523 - DNA, 75 bp, Artificial Sequence
  Synthetic
aaatcacaagaattttaccaaaagtacacagactgcttatccaaattcaaaccaatcatggctatttgcttcaga

SEQ ID NO: 271524 - DNA, 75 bp, Artificial Sequence
  Synthetic
ttcaaggtagattgggtaatgatgccaaattcttttgcccagcaggctctcttgttacattccaaaattcatggg

SEQ ID NO: 271525 - DNA, 75 bp, Artificial Sequence
  Synthetic
agttgccataacagcattagtaacactgtctatagactgttccaggaattagctaggataccatcaaggattagt

SEQ ID NO: 271526 - DNA, 75 bp, Artificial Sequence
  Synthetic
gttcacaaatggatttgactgacccgttgtgtatagaggatgattgcactgaagattgcaaacagactatttccc

SEQ ID NO: 271527 - DNA, 75 bp, Artificial Sequence
  Synthetic
acacagaatgatctgattagagttgaaccaattggagtttggatacaaggggaacctggtcaaggaaaatccttc

SEQ ID NO: 271528 - DNA, 75 bp, Artificial Sequence
  Synthetic
cagatgaactgggtctaacttcagcccaagacgatggtcctctgggaggtgaaaagccaaattacttcttgaatt

SEQ ID NO: 271529 - DNA, 75 bp, Artificial Sequence
  Synthetic
ttgacacacacattatctagacaactacaaaaatcatgtaaattgaatggtgtttacaccaacccaactgcaagt

SEQ ID NO: 271530 - DNA, 75 bp, Artificial Sequence
  Synthetic
ttagagctgtcaatgttgacatatttactgtgagtcacactaaagtagacaacatctttggtagggcatggtttg

SEQ ID NO: 271531 - DNA, 75 bp, Artificial Sequence
  Synthetic
gaatttatggatggttatgataaccaggacattcatctcatagatgacttgggtcagaccaggaaagaaaaagat

SEQ ID NO: 271532 - DNA, 75 bp, Artificial Sequence
  Synthetic
catatgatcatacatatagagatgaaggaacctggaggcaggctttggatttcccaaagaaaggccatggtgcct

SEQ ID NO: 271533 - DNA, 75 bp, Artificial Sequence
  Synthetic
attgaaatgctgtgcaattgcatatcttcagtaccatttattgttccaatggcacacttagaggagaaaggcaag

SEQ ID NO: 271534 - DNA, 75 bp, Artificial Sequence
  Synthetic
taacccaattatttgcctattactcaggagaattaaatatacatgttttattcttgagtgaaacagggtttctga

SEQ ID NO: 271535 - DNA, 75 bp, Artificial Sequence
  Synthetic
ttttacactagcaaattagttatagcaaccaccaacaagtctgacttttccagcacagtactacaagattctggt

SEQ ID NO: 271536 - DNA, 75 bp, Artificial Sequence
  Synthetic
gagtggcacatacttatgacagtgatacaaacaggtctgacttcttctcttcaaacggcgtcatcactgtgcccg

SEQ ID NO: 271537 - DNA, 75 bp, Artificial Sequence
  Synthetic
gcactcaaaagaaggttcccatacattatgcacatcagagctgctaaggcatacagtaaggcaggtaaactgaat

SEQ ID NO: 271538 - DNA, 75 bp, Artificial Sequence
  Synthetic
caggggaacaaatgaccctgtcagtaccattctactcttcaaagcccttgaggacaatcagggattcagctgctc

SEQ ID NO: 271539 - DNA, 75 bp, Artificial Sequence
  Synthetic
gttagccaggccatgtccactatggccactggtgaatgttgggaagtttcaaagaatggcagagactgggaaact

SEQ ID NO: 271540 - DNA, 75 bp, Artificial Sequence
  Synthetic
tagggtatgtgatgtgtaaaccattcatgtctgggacaacaggtggaaagatagagatatatctgagtttaagat

SEQ ID NO: 271541 - DNA, 75 bp, Artificial Sequence
  Synthetic
ctaaaactaaaggacttggtccagaagattacagaagattatcaggagagacagaagaactatgattgctggaaa

SEQ ID NO: 271542 - DNA, 75 bp, Artificial Sequence
  Synthetic
agattacagaagattatcaggagagacagaagaactatgattgctggaaacaacagctagagaaccaaactctag

SEQ ID NO: 271543 - DNA, 75 bp, Artificial Sequence
  Synthetic
gtccaaacctattctttcccttaccagctccgaaacctgcaactagtcgtgctttgcggggtgacatggcaaact

SEQ ID NO: 271544 - DNA, 75 bp, Artificial Sequence
  Synthetic
tctcagaccagagcctatatgatcaacaaccacagggccaggtgatgaaattagcttacttggataggggttttt

SEQ ID NO: 271545 - DNA, 75 bp, Artificial Sequence
  Synthetic
attccatacatagatgagtatcttaacattgaaatgtcaacactaattgaacaaatggaagccttcattgaacca

SEQ ID NO: 271546 - DNA, 75 bp, Artificial Sequence
  Synthetic
acaagcactatggaatcattgtgggagagagtgtgtatcaattggactcagatgatattttcaaaacagctctaa

SEQ ID NO: 271547 - DNA, 75 bp, Artificial Sequence
  Synthetic
agaccaagtgttttcaaatgcttcgcaaccaaggttgcaaaccagacacggaaagcagccaaagaagttgtggac

SEQ ID NO: 271548 - DNA, 75 bp, Artificial Sequence
  Synthetic
cagggaaagccaagttcactaagacaaagttgactccagactggatcattgaggaagagtgtgaattagactatt

SEQ ID NO: 271549 - DNA, 75 bp, Artificial Sequence
  Synthetic
tggtttagtagtaagatcaaatcaatgttgagttttgtggagagaaacaaagcttggttgacagtagtctcagct

SEQ ID NO: 271550 - DNA, 75 bp, Artificial Sequence
  Synthetic
gaggaagagtgtgaattagactatttcagggtaaaataccttgaatcttcagtcaactcagagcatattttctca

SEQ ID NO: 271551 - DNA, 75 bp, Artificial Sequence
  Synthetic
gttaccagtgcaatcagtatactacttttggtgaccaaaattttcaagaaggaagactcagaggatgagagagct

SEQ ID NO: 271552 - DNA, 75 bp, Artificial Sequence
  Synthetic
tataacccaacacttcctgttgcaaagccaaaaggaactttcccagtcacacagagagagttcaaaaatgaagca

SEQ ID NO: 271553 - DNA, 75 bp, Artificial Sequence
  Synthetic
ctaaggatatttttggcacccacactcttagtcaacaccaagccattggcttaataggcacaattcttttgacag

SEQ ID NO: 271554 - DNA, 75 bp, Artificial Sequence
  Synthetic
ctggtttaatgtcaaccattaagacacctgtaaatgcaacaaccatcaaagagtttttcaaccatgctgtcgatg

SEQ ID NO: 271555 - DNA, 75 bp, Artificial Sequence
  Synthetic
ccttatgatgggcaattggaacacatcatatcccaaatggcttacataactggctccactacagggcaccttact

SEQ ID NO: 271556 - DNA, 75 bp, Artificial Sequence
  Synthetic
cactgtgcagggtaccagcatgatgaaatcattttgcatggacattcaattaagtaccttgagcaagaagaagat

SEQ ID NO: 271557 - DNA, 75 bp, Artificial Sequence
  Synthetic
tcttcagcagccacagagattctggataatgatctagttaaattcatagttaaaatccttgttagaattctttgt

SEQ ID NO: 271558 - DNA, 75 bp, Artificial Sequence
  Synthetic
ctgatcctgcactataagaataaggtatttccaattgaaagcccatctgtgactcaggtcacactgggtggaaaa

SEQ ID NO: 271559 - DNA, 75 bp, Artificial Sequence
  Synthetic
taaaatccttgttagaattctttgttacatggtgctgtattgccacaagccaaacatcttgaccacagcatgtct

SEQ ID NO: 271560 - DNA, 75 bp, Artificial Sequence
  Synthetic
gactcaggtcacactgggtggaaaacccatggatttggcaatacttaaatgtaaattaccattcagatttaagaa

SEQ ID NO: 271561 - DNA, 75 bp, Artificial Sequence
  Synthetic
aaattccaaatattacactaacaaaattggaactgagagtatgctaatttggatgaccgaacaaggtattattac

SEQ ID NO: 271562 - DNA, 75 bp, Artificial Sequence
  Synthetic
taaagaagttcaaagagttcaccattctggaggtatcaaaacacgtgaggggactgagagttcaaaaactattag

SEQ ID NO: 271563 - DNA, 75 bp, Artificial Sequence
  Synthetic
ttacactgtaaaatcttgcaaaggcatgtgtggaggtttactcatttccaaagtagaaggaaattttaaaattct

SEQ ID NO: 271564 - DNA, 75 bp, Artificial Sequence
  Synthetic
gattggtggatacatactctattgaaaataaaagatatggtcctgagtgtattcaaacctagtatggagagtaag

SEQ ID NO: 271565 - DNA, 75 bp, Artificial Sequence
  Synthetic
tggaatgcacatagctggaaatggagaaatgggtgttgccatcccatttaattttctcaagaatgacatgtctga

SEQ ID NO: 271566 - DNA, 75 bp, Artificial Sequence
  Synthetic
gctattcagtggctagagagaaacaaagagcatgtttgtgccatcctggactatgcctccgacatcattgtggaa

SEQ ID NO: 271567 - DNA, 75 bp, Artificial Sequence
  Synthetic
ccaaggcattgttacagaagtaacacctatacaacccatgtacattaacactaagtctcaaattcacaagagtcc

SEQ ID NO: 271568 - DNA, 75 bp, Artificial Sequence
  Synthetic
aagagcatgtttgtgccatcctggactatgcctccgacatcattgtggaatcaaaagaccaaacaaaaatgaaat

SEQ ID NO: 271569 - DNA, 75 bp, Artificial Sequence
  Synthetic
agtttatggtgcagttgaagttaaaatgggcccagcagtcttgagcaaatcagaccccagacttgaagaaccaat

SEQ ID NO: 271570 - DNA, 75 bp, Artificial Sequence
  Synthetic
ataatggccatttgctttaggagctgtcacaacagtattagtaacacagtttatagactatttcaagaactggct

SEQ ID NO: 271571 - DNA, 75 bp, Artificial Sequence
  Synthetic
tgagtgcctaattaagaaatctgcagcaaagtatagagttaataaatttcaagtcaataatgaactatggcaagg

SEQ ID NO: 271572 - DNA, 75 bp, Artificial Sequence
  Synthetic
ttatagactatttcaagaactggctagaataccatcaagaatcagcactcagaatgatttaattagagttgagcc

SEQ ID NO: 271573 - DNA, 75 bp, Artificial Sequence
  Synthetic
tgtcaaagcctgcgtcaagtccaaatttagagaaatctttggaattaatggcattgtggacatgaaaacagctat

SEQ ID NO: 271574 - DNA, 75 bp, Artificial Sequence
  Synthetic
aattggtgtttggatacagggagaaccaggacaaggaaaatctttcctaacacacacactatccagacagttgca

SEQ ID NO: 271575 - DNA, 75 bp, Artificial Sequence
  Synthetic
cttgggtacatcccatgtaaactctatggacctgagtacatctgctggatatagttttgtgaaatcaggttacaa

SEQ ID NO: 271576 - DNA, 75 bp, Artificial Sequence
  Synthetic
aaagtcatgtaagttaaatggtgtgtataccaacccaacagctagtgagtttatggatggatatgacaaccagga

SEQ ID NO: 271577 - DNA, 75 bp, Artificial Sequence
  Synthetic
gaagaaggacctgatttgtcttgaaccattttctgtttcacccatgcttgagaaacttgtacaagacaaattcca

SEQ ID NO: 271578 - DNA, 75 bp, Artificial Sequence
  Synthetic
tatccatctcattgatgatttggggcaaactaggaaggagaaagacattgaaatgctgtgcaactgtatttcctc

SEQ ID NO: 271579 - DNA, 75 bp, Artificial Sequence
  Synthetic
tgcattactcaagggtaaccagatcactacaattttcaacacttgtctaaaagatgaattaagaaaactggaaaa

SEQ ID NO: 271580 - DNA, 75 bp, Artificial Sequence
  Synthetic
gatttcagctggcaagactagatgcattgaggcttgtgaagtggactactgtatagtttatagaatgatcatgat

SEQ ID NO: 271581 - DNA, 75 bp, Artificial Sequence
  Synthetic
aactaataaatctgatttttcaagtacagtcttgcaagattctggtgcattaaagagaagattcccatacatcat

SEQ ID NO: 271582 - DNA, 75 bp, Artificial Sequence
  Synthetic
acagtcttgcaagattctggtgcattaaagagaagattcccatacatcatgcacattagagcagccaaagcatat

SEQ ID NO: 271583 - DNA, 75 bp, Artificial Sequence
  Synthetic
ggaaatttatgataaaatttaccagacaccgtgttactactcaggccttgctgttggaatcaatccatacaaaga

SEQ ID NO: 271584 - DNA, 75 bp, Artificial Sequence
  Synthetic
agtaaggctggaaaactcaatgtcagtcaagctatgtctaccatggccactggtgagtgttgggaagtgtcaaag

SEQ ID NO: 271585 - DNA, 75 bp, Artificial Sequence
  Synthetic
ttggcacttcatgattaatgcactaaatgattataattatgagatggactattctcagtatgatgggtctcttag

SEQ ID NO: 271586 - DNA, 75 bp, Artificial Sequence
  Synthetic
attctcagtatgatgggtctcttagttcaatgctattgtgggaggctgtggatgttttggcttattgccatgact

SEQ ID NO: 271587 - DNA, 75 bp, Artificial Sequence
  Synthetic
tggtgagtgttgggaagtgtcaaagaatggaagggactgggagactctaaaacttaaggacttagtccaaaagat

SEQ ID NO: 271588 - DNA, 75 bp, Artificial Sequence
  Synthetic
cacctgatctcgtcatgcaattacataaaccagtgattgactcagaccatgtggtctttaacgagagatggttga

SEQ ID NO: 271589 - DNA, 75 bp, Artificial Sequence
  Synthetic
tacagaagattaccaggagagacaaaagaactataattgttggaaacaacaacttgaaaatcagactttagatga

SEQ ID NO: 271590 - DNA, 75 bp, Artificial Sequence
  Synthetic
aacttgaaaatcagactttagatgacctggatgatgcagtttcttacattaagcacaacttcccagatgcagtcc

SEQ ID NO: 271591 - DNA, 75 bp, Artificial Sequence
  Synthetic
tacatggcggtatgccatcaggatctccatgcactactgtactaaactcattgtgtaatctgatgatgtgcattt

SEQ ID NO: 271592 - DNA, 75 bp, Artificial Sequence
  Synthetic
cctacattgatgaatatcttaatattgagatgtctactttaattgaacaaatggaagccttcattgaaccaagac

SEQ ID NO: 271593 - DNA, 75 bp, Artificial Sequence
  Synthetic
acaccaccaatttaattagcccaggaattgattgtttaccaattgtttatggtgacgatgtcatattgtcacttg

SEQ ID NO: 271594 - DNA, 75 bp, Artificial Sequence
  Synthetic
cgagtgttttcaaatgctttgcaaccaaagttgcaagccagacacgaaaagcagctaaagaagttgtagactggt

SEQ ID NO: 271595 - DNA, 75 bp, Artificial Sequence
  Synthetic
caaagttgcaagccagacacgaaaagcagctaaagaagttgtagactggttcagtagtaagattaaatcaatgtt

SEQ ID NO: 271596 - DNA, 75 bp, Artificial Sequence
  Synthetic
gagttttgtagagaaaaacaaggcttggttaacagtggtatcagccgtcactagtgcaatcagtatactactcct

SEQ ID NO: 271597 - DNA, 75 bp, Artificial Sequence
  Synthetic
aggatgaacctccgtcattaaaacccaggttggaggtggaatttctgaagcgtaaacctggttacttcccagagt

SEQ ID NO: 271598 - DNA, 75 bp, Artificial Sequence
  Synthetic
cgtaaacctggttacttcccagagtccacatttatagtaggaaaattggacactgaaaacatgatacaacactta

SEQ ID NO: 271599 - DNA, 75 bp, Artificial Sequence
  Synthetic
ggtgaccaaaatttttaagaaggaagactcaaaggacgaaagagcttacaacccaacacttcctgtcgcaaagcc

SEQ ID NO: 271600 - DNA, 75 bp, Artificial Sequence
  Synthetic
aaaaggaacgttcccggtgacccaaagggagttcaaaaatgaagcaccatatgatgggcaattagaacatataat

SEQ ID NO: 271601 - DNA, 75 bp, Artificial Sequence
  Synthetic
ctctcaaatggcatacataactgggtccactacaggacaccttactcactgcgcaggataccaacatgatgagat

SEQ ID NO: 271602 - DNA, 75 bp, Artificial Sequence
  Synthetic
cattttgcatggacattcaatcaaataccttgagcaagaagaaaacctgacactccactataagaacaaggtgtt

SEQ ID NO: 271603 - DNA, 75 bp, Artificial Sequence
  Synthetic
gtttttctttgttatggactatatcattggaacactaatttaattagaacaccaatttggaatattggacatacc

SEQ ID NO: 271604 - DNA, 75 bp, Artificial Sequence
  Synthetic
ccctatcgagaacccatccgtgacacaagttacgttgggtggtaaacctatggatttggctatactcaagtgtag

SEQ ID NO: 271605 - DNA, 75 bp, Artificial Sequence
  Synthetic
gttaccatttagattcaagaaaaactccaaatattatactaacaaaattggaacagagagtatgttgatttggat

SEQ ID NO: 271606 - DNA, 75 bp, Artificial Sequence
  Synthetic
gactgaacaaggtattattaccaaagaagttcaaagagttcaccactctggaggcatcaaaacacgggagggcac

SEQ ID NO: 271607 - DNA, 75 bp, Artificial Sequence
  Synthetic
gaagttcaaagagttcaccactctggaggcatcaaaacacgggagggcactgagagtacaaaaacaatcagttac

SEQ ID NO: 271608 - DNA, 75 bp, Artificial Sequence
  Synthetic
accgtgaagtcttgtaaaggcacgtgtggaggcctactcatttctaaagttgaaggaaacttcaagattcttgga

SEQ ID NO: 271609 - DNA, 75 bp, Artificial Sequence
  Synthetic
atgcacatagctggaaatggggaaatgggtgtcgctatccccttcaattttcttaaaaatgacatgtcagaccaa

SEQ ID NO: 271610 - DNA, 75 bp, Artificial Sequence
  Synthetic
tcttaaaaatgacatgtcagaccaaggcattgtcacagaagtgacacctatacagcccatgtatatcaacaccaa

SEQ ID NO: 271611 - DNA, 75 bp, Artificial Sequence
  Synthetic
gtcccaaattcacaagagtccagtctatggtgcagtggaagttaaaatgggcccagcagtcctgagtaaatcaga

SEQ ID NO: 271612 - DNA, 75 bp, Artificial Sequence
  Synthetic
ccctagactagaggaaccagtcgagtgcttaatcaagaaatcagctgctaagtacagagtcaacaagttccaagt

SEQ ID NO: 271613 - DNA, 75 bp, Artificial Sequence
  Synthetic
caataatgaactatggcagggtgttaaggcctgtgttaagtccaaatttagggagatctttgggatcaatggtat

SEQ ID NO: 271614 - DNA, 75 bp, Artificial Sequence
  Synthetic
tgtggatatgaaaacagccattctgggaacatctcatgtaaattctatggatctgagtacatcggctggatatag

SEQ ID NO: 271615 - DNA, 75 bp, Artificial Sequence
  Synthetic
ctttgtcaaatcaggctataaaaagaaggatttgatttgtctcgaacctttctctgtctcgcccatgcttgagaa

SEQ ID NO: 271616 - DNA, 75 bp, Artificial Sequence
  Synthetic
gcttgtacaagataagttccatgcactgcttaaaggcaaccagatttcaactatcttcaacacctgccttaaaga

SEQ ID NO: 271617 - DNA, 75 bp, Artificial Sequence
  Synthetic
tgaactgaggaaattggacaaaatctcggctggtaagactaggtgtattgaagcctgtgaggtggactattgcat

SEQ ID NO: 271618 - DNA, 75 bp, Artificial Sequence
  Synthetic
cacttcatgatcaatgccctgaatgactacaattatgaaatggattactctcagtatgatggttcccttagttca

SEQ ID NO: 271619 - DNA, 75 bp, Artificial Sequence
  Synthetic
actacaattatgaaatggattactctcagtatgatggttcccttagttcaatgttactgtgggaggctgtggagg

SEQ ID NO: 271620 - DNA, 75 bp, Artificial Sequence
  Synthetic
ttttggcctattgtcatgattcacctgatcttgttatgcaattacacaaaccagtaattgactcggaccatgtgg

SEQ ID NO: 271621 - DNA, 75 bp, Artificial Sequence
  Synthetic
tgatcttgttatgcaattacacaaaccagtaattgactcggaccatgtggtcttcaatgagagatggttaattca

SEQ ID NO: 271622 - DNA, 75 bp, Artificial Sequence
  Synthetic
tggcggtatgccatcaggatctccatgtaccactgtgttaaattcattgtgtaatttgatgatgtgcatatatac

SEQ ID NO: 271623 - DNA, 75 bp, Artificial Sequence
  Synthetic
aactaatttaattagcccagggattgactgtttaccaattgtttatggtgatgatgtcatcttgtcacttgataa

SEQ ID NO: 271624 - DNA, 75 bp, Artificial Sequence
  Synthetic
atgatgtcatcttgtcacttgataaagaaatagacccagagaaactgcagagtatcatggcagattcatttggtg

SEQ ID NO: 271625 - DNA, 75 bp, Artificial Sequence
  Synthetic
ctgaagtaactggttcccgcaaggatgagcctccctcactaaaacccagattggaggtggaattcctgaagcgta

SEQ ID NO: 271626 - DNA, 75 bp, Artificial Sequence
  Synthetic
ctatatcattagaacactaattaaattagaacactaatttggaatattggacatacgaaaaaaaaaaaaaaaaaa

SEQ ID NO: 271627 - DNA, 75 bp, Artificial Sequence
  Synthetic
ggttcagacgcttaaagtgtgttgtacatattcttttctaacctatgtttcacatagggtggcagatggcgtgcc

SEQ ID NO: 271628 - DNA, 75 bp, Artificial Sequence
  Synthetic
gccaaggtttaacagaccctttgggattggttcaaacctgaattgttatggaagacacttagtacctgctaactt

SEQ ID NO: 271629 - DNA, 75 bp, Artificial Sequence
  Synthetic
tctatcttggtgagttggttaaaaaacgtctagtgggccaaacccaggggggatccctggtttccttttatttta

SEQ ID NO: 271630 - DNA, 75 bp, Artificial Sequence
  Synthetic
aaatattcactatggagacaattaagaacattgcagacatggcaaccggtgtagttagctctattgattctactg

SEQ ID NO: 271631 - DNA, 75 bp, Artificial Sequence
  Synthetic
tcaatgctgtcaatagtactactgaaaatattggaaataatattggtgggaacctattaaccaaagttgcagatg

SEQ ID NO: 271632 - DNA, 75 bp, Artificial Sequence
  Synthetic
atgcctctaacgtcttgggaccaaattgctatgcaaccacttcacgacctgaaaatagagatgttgtgcaagcga

SEQ ID NO: 271633 - DNA, 75 bp, Artificial Sequence
  Synthetic
caacaaccgtcaataccactaaccttacacaacacccttctgcaccaaccataccattcacccctgactttaaaa

SEQ ID NO: 271634 - DNA, 75 bp, Artificial Sequence
  Synthetic
atatagacaattaccactccatggcatatgacattactactggagacaagaatccaagcaaactggttagattaa

SEQ ID NO: 271635 - DNA, 75 bp, Artificial Sequence
  Synthetic
agactgcttattggggtgttgctgacaaaagaaggcatgaaatagcgtatgtaggtttaccaaatggattttgga

SEQ ID NO: 271636 - DNA, 75 bp, Artificial Sequence
  Synthetic
ctgagacacgaatgcctgcacatggacaatcacggtattttggtgccgtcaggtgtggtttccatttccaagttc

SEQ ID NO: 271637 - DNA, 75 bp, Artificial Sequence
  Synthetic
aaataaacgtcaatcaaggaactgcaggcagcgctttggttgtctatgaaccaaagccagtggttagtgcaaaag

SEQ ID NO: 271638 - DNA, 75 bp, Artificial Sequence
  Synthetic
aacatttagaatttggtgcctacacaaatttaccacatgttttgatgaatttggcagaaactacacaggcagacc

SEQ ID NO: 271639 - DNA, 75 bp, Artificial Sequence
  Synthetic
tatgcatcccctatgtatcagatacaaactatgtaccaactgactcgtctgatttagggcaacttacagtgtatg

SEQ ID NO: 271640 - DNA, 75 bp, Artificial Sequence
  Synthetic
tctggactccactatctacaccaaataatgcttcaaacactgtggatgttaccattatgggtagtctactacaat

SEQ ID NO: 271641 - DNA, 75 bp, Artificial Sequence
  Synthetic
tggactttcagaatcccaggacatatggcgaagctgtggacatctatgatacagcacctgggaacaacaaaggat

SEQ ID NO: 271642 - DNA, 75 bp, Artificial Sequence
  Synthetic
ttaacaaaagaagatacttaactgcatccacaaagtataaatggactagaaacaaaatggacatagcagaaggtc

SEQ ID NO: 271643 - DNA, 75 bp, Artificial Sequence
  Synthetic
ctgggtcaatgaatttggccaatgttctaagtaccacaggggcccagtctgtagccttagttggagaaagagctt

SEQ ID NO: 271644 - DNA, 75 bp, Artificial Sequence
  Synthetic
tctatgatcctaggactgctggcagcaaaagtaggtttggggatttaattaagattgcacaaatgttctcagtta

SEQ ID NO: 271645 - DNA, 75 bp, Artificial Sequence
  Synthetic
tgtctgacaaggatactccatctgctagcagtggagttgacaaatatggatattttaattggtcctcaactactg

SEQ ID NO: 271646 - DNA, 75 bp, Artificial Sequence
  Synthetic
aaccacagaatatggtgcataggagtatggtttacattgatcaatttccaaatttgaatctgttcatgaattcat

SEQ ID NO: 271647 - DNA, 75 bp, Artificial Sequence
  Synthetic
attcatattttagaggctctctgatattaagactatcaatctacgctagtacattcaataggggcagactgagga

SEQ ID NO: 271648 - DNA, 75 bp, Artificial Sequence
  Synthetic
tgggttttttcccaaatgcaacaaacaacacccagaaagaattggacaatgcaatttatacaatatgtgatattg

SEQ ID NO: 271649 - DNA, 75 bp, Artificial Sequence
  Synthetic
gcactgacaacagctttgaattaaccataccatattctttttctacctggatgaggaagactcatgggaaaagcc

SEQ ID NO: 271650 - DNA, 75 bp, Artificial Sequence
  Synthetic
tagggctgtttcaagtggaagtgctcaatagattaacatacaatagttccagtccaaatactgtacactgcatcg

SEQ ID NO: 271651 - DNA, 75 bp, Artificial Sequence
  Synthetic
tgcaaggcagactaggggacgatgccaaattcttttgtcctgctggttcactagtggaatttcaaaattcatggg

SEQ ID NO: 271652 - DNA, 75 bp, Artificial Sequence
  Synthetic
ggtcacaaatggatctgacagacccattagagatggaggattgtactgaggattgcaaacaatctctatccccag

SEQ ID NO: 271653 - DNA, 75 bp, Artificial Sequence
  Synthetic
atgaattgggcctcacatcagcccaagatgatggacctctcgggtccgagaaaccaaattatttcttaaatttta

SEQ ID NO: 271654 - DNA, 75 bp, Artificial Sequence
  Synthetic
gggcaatggatgttgatattttcaccgcaagccacactaaagtagataacatttttgggcgtgcctggtacaact

SEQ ID NO: 271655 - DNA, 75 bp, Artificial Sequence
  Synthetic
cacggcatgaattcacaaatggtgatctgtggcgtagttcattgactttccctaagaaaggccatgggatgctat

SEQ ID NO: 271656 - DNA, 75 bp, Artificial Sequence
  Synthetic
cacaactttttgcatattttacgggtgaagtgaatatacatatcctttatatggctgaaagaggatttcttagag

SEQ ID NO: 271657 - DNA, 75 bp, Artificial Sequence
  Synthetic
tggcacactcatatgacactgagacacagagggatgactttctatcatcaaatggtgtgataacaataccagctg

SEQ ID NO: 271658 - DNA, 75 bp, Artificial Sequence
  Synthetic
gagaacaaatgactttatctgtaccatactactcaaataaaccattgaggactataagacatgaatcagcacttg

SEQ ID NO: 271659 - DNA, 75 bp, Artificial Sequence
  Synthetic
gtttcttgttgtgtcaaccacttttatcaggtacagacaggactattgcagaagtatatattagcttaaggtgtc

SEQ ID NO: 271660 - DNA, 75 bp, Artificial Sequence
  Synthetic
caaactttttctttccagcgccagcacctagaccaattaatactacaccaataggctacagtaacgaaagcccat

SEQ ID NO: 271661 - DNA, 75 bp, Artificial Sequence
  Synthetic
atggtcaagaacaagtgacaacaatgaaattagcttacttagacaggggtttctataaacactatggcatcattg

SEQ ID NO: 271662 - DNA, 75 bp, Artificial Sequence
  Synthetic
ttgatgatcatgtttatcaactagattcagatgacatcttcaaaacagccctaactggcaaggctagatttacta

SEQ ID NO: 271663 - DNA, 75 bp, Artificial Sequence
  Synthetic
ctaactggcaaggctagatttactaagacaaagttgacacaagattggatcattgaggaagagtgtgaactagat

SEQ ID NO: 271664 - DNA, 75 bp, Artificial Sequence
  Synthetic
tatttcagagtcaagtaccttgaatcatcagtaaattcagaacacattttctcagtagattctaattgtgagacc

SEQ ID NO: 271665 - DNA, 75 bp, Artificial Sequence
  Synthetic
attgccaaagacatctttggcacacacaccatcagtcaacatcaagtcattggtttgattggcacaattcttctg

SEQ ID NO: 271666 - DNA, 75 bp, Artificial Sequence
  Synthetic
actgctggcctgatgtcaaccattaagacaccggttaatgctaagactattaaagaattctttaaccatgctatt

SEQ ID NO: 271667 - DNA, 75 bp, Artificial Sequence
  Synthetic
gatggggatgaacaggggctgtccttacttgtgcaaaagtgtaccactttcttttcttcagctgctacagagatt

SEQ ID NO: 271668 - DNA, 75 bp, Artificial Sequence
  Synthetic
ttggataatgatttggttaaattcatagttaagatacttgttaggattctctgttatatggggttgtattgccac

SEQ ID NO: 271669 - DNA, 75 bp, Artificial Sequence
  Synthetic
aaaccaaacattctaactactgcttgtctatctacactgttaattatggatgtcacatcatcatcagtgctgtcg

SEQ ID NO: 271670 - DNA, 75 bp, Artificial Sequence
  Synthetic
ccttcttgtaaggcactcatgcagtgcctaatggatggtgacgttaaaaaattggctgaagtagtagctgagtcc

SEQ ID NO: 271671 - DNA, 75 bp, Artificial Sequence
  Synthetic
atgtctaacacggatgatgaagaaatcaaagaacaaatttgtgatacagtgaagtacaccaaaagtatcctctca

SEQ ID NO: 271672 - DNA, 75 bp, Artificial Sequence
  Synthetic
aatcaaggaccattcaagggtttcaatgaagtctcgactgcatttagacacattgattggtggatacataccctg

SEQ ID NO: 271673 - DNA, 75 bp, Artificial Sequence
  Synthetic
ttgaaaattaaagatatggtgcttagtgttttcaagccaagcatggagagtagggctgttcaggggttaaaaaga

SEQ ID NO: 271674 - DNA, 75 bp, Artificial Sequence
  Synthetic
aataaggagcatgtttgtgcaatcttggattatgcctctgatattattgtggaatcaaaggaccaaacaaaaatg

SEQ ID NO: 271675 - DNA, 75 bp, Artificial Sequence
  Synthetic
tggattatgcctctgatattattgtggaatcaaaggaccaaacaaaaatgaaatcacaagaattttaccaaaagt

SEQ ID NO: 271676 - DNA, 75 bp, Artificial Sequence
  Synthetic
ggaatcaaaggaccaaacaaaaatgaaatcacaagaattttaccaaaagtacacagattgtctagctaaattcaa

SEQ ID NO: 271677 - DNA, 75 bp, Artificial Sequence
  Synthetic
accaattatggctatttgttttaggagctgtcacaacagcattagtaatacagtttatagactattccaagaact

SEQ ID NO: 271678 - DNA, 75 bp, Artificial Sequence
  Synthetic
agctgtcacaacagcattagtaatacagtttatagactattccaagaactggccagaataccatcaagaatcagt

SEQ ID NO: 271679 - DNA, 75 bp, Artificial Sequence
  Synthetic
actcaaaatgacttaattagagttgagccaattggagtttggatacagggtgaaccaggacaagggaaatctttc

SEQ ID NO: 271680 - DNA, 75 bp, Artificial Sequence
  Synthetic
ttaacacacactctgtccgggcagttacaaaaatcttgcagattgaatggtgtttacaccaacccaaccgctagt

SEQ ID NO: 271681 - DNA, 75 bp, Artificial Sequence
  Synthetic
tacaaaaatcttgcagattgaatggtgtttacaccaacccaaccgctagtgagtttatggatggatatgacaacc

SEQ ID NO: 271682 - DNA, 75 bp, Artificial Sequence
  Synthetic
aggacatccatctcattgatgacttgggtcaaactaggaaagagaaagacattgaaatgttgtgcaactgcatat

SEQ ID NO: 271683 - DNA, 75 bp, Artificial Sequence
  Synthetic
cctcagtaccttttatagtcccaatggcacatcttgaggaaaaaggtaaattctatactagtaaattggtgattg

SEQ ID NO: 271684 - DNA, 75 bp, Artificial Sequence
  Synthetic
ttctatactagtaaattggtgattgcaactaccaacaaatcagacttttcaagtactgttctacaagactcaggt

SEQ ID NO: 271685 - DNA, 75 bp, Artificial Sequence
  Synthetic
gctttgaagaggagattcccatatatcatgcacatcagggctgcaaaggcttacagtaaatcaggtaaactcaat

SEQ ID NO: 271686 - DNA, 75 bp, Artificial Sequence
  Synthetic
gttagccaggctatgtccacgatggccacaggtgagtgttgggaagtgtcaaaaaatggtagagactgggaaact

SEQ ID NO: 271687 - DNA, 75 bp, Artificial Sequence
  Synthetic
ttgaagttacaggatttagtcaagaaaatcaccgaagactatgaagaaagacaaaagaattacaattgttggaaa

SEQ ID NO: 271688 - DNA, 75 bp, Artificial Sequence
  Synthetic
caacaacttgagaaccagactctggatgacctggatgatgcagtttcctacattaaacacaattttccagatgct

SEQ ID NO: 271689 - DNA, 75 bp, Artificial Sequence
  Synthetic
atgacctggatgatgcagtttcctacattaaacacaattttccagatgctatcccctacattgatgaatatctta

SEQ ID NO: 271690 - DNA, 75 bp, Artificial Sequence
  Synthetic
atattgagatgtctactttgattgaacaaatggaagcttttattgagccaagaccaagtgttttcaaatgctttg

SEQ ID NO: 271691 - DNA, 75 bp, Artificial Sequence
  Synthetic
ctactaaggttgcaaatcaaacacggaaggcagccaaagaagttttagactggtttagtagtaagatcaaatcaa

SEQ ID NO: 271692 - DNA, 75 bp, Artificial Sequence
  Synthetic
tgttaagttttgtggagagaaacaaggcatggctgacggtagtctcagctgtcactagtgcaattagtatactgc

SEQ ID NO: 271693 - DNA, 75 bp, Artificial Sequence
  Synthetic
ttttggtaaccaaaatctttaaaaaggaagactcaaaggatgagagagcttataacccaacacttcctgttacaa

SEQ ID NO: 271694 - DNA, 75 bp, Artificial Sequence
  Synthetic
agccaaaagggacattcccagtcacacagagagagttcaaaaatgaggcaccctatgatgggcaattggaacaca

SEQ ID NO: 271695 - DNA, 75 bp, Artificial Sequence
  Synthetic
tcatatctcagatggcttacataactggcaccaccacagggcatcttactcattgtgcaggttaccagcatgatg

SEQ ID NO: 271696 - DNA, 75 bp, Artificial Sequence
  Synthetic
aaatcattttacatggtcattcaatcaagtaccttgaacaggaggaggaactgacactacattataagaataagg

SEQ ID NO: 271697 - DNA, 75 bp, Artificial Sequence
  Synthetic
tgtttccaattgaaaacccatctgtgacccaagttacattgggaggcaaacccatggatttagccatccttaagt

SEQ ID NO: 271698 - DNA, 75 bp, Artificial Sequence
  Synthetic
gtaaattaccattcaggtttaagaaaaattccaaatattacactaacaaaattgggacagaaagtatgctaattt

SEQ ID NO: 271699 - DNA, 75 bp, Artificial Sequence
  Synthetic
ggatgacagaacaaggtatcattactaaagaagttcagagagtccatcattctggaggcatcaaaacacgggagg

SEQ ID NO: 271700 - DNA, 75 bp, Artificial Sequence
  Synthetic
gcacagagagcacaaagacaatcagttacaccgtgaagtcttgtaaaggcatgtgtggaggtctgctcatttcaa

SEQ ID NO: 271701 - DNA, 75 bp, Artificial Sequence
  Synthetic
aagttgaaggaaatttcaaaattcttggaatgcacatagcaggaaatggggaaatgggtgttgccatccctttta

SEQ ID NO: 271702 - DNA, 75 bp, Artificial Sequence
  Synthetic
actttcttaagaatgatatgtctgatcaaggcattgtcacagaggtgacgcccatacaacctatgtacattaaca

SEQ ID NO: 271703 - DNA, 75 bp, Artificial Sequence
  Synthetic
tcaaggcattgtcacagaggtgacgcccatacaacctatgtacattaacactaagactcaaatccacaagagccc

SEQ ID NO: 271704 - DNA, 75 bp, Artificial Sequence
  Synthetic
agtctatggtgcagtggatgtgaagatgggcccagcagtcttgagtaaatcagaccccagacttgaggaaccagt

SEQ ID NO: 271705 - DNA, 75 bp, Artificial Sequence
  Synthetic
tgattgtctaattaagaaatcagcatccaaatacagagtcaacaagtttcaagtcaacaatgagctatggcaggg

SEQ ID NO: 271706 - DNA, 75 bp, Artificial Sequence
  Synthetic
tgttaaggcatgtgttaaatctaaatttagagaaatttttggggtcaatggtgtcgtagacatgaaaacagccat

SEQ ID NO: 271707 - DNA, 75 bp, Artificial Sequence
  Synthetic
tttaggaacttctcatgtgaattctatggacttaagcacatcagctggatatagctttgtcaaattaggttacaa

SEQ ID NO: 271708 - DNA, 75 bp, Artificial Sequence
  Synthetic
gaagaaagatttgatttgtcttgaacctttttctgtttcacctatgcttgaaaagcttgtacaagataaattcca

SEQ ID NO: 271709 - DNA, 75 bp, Artificial Sequence
  Synthetic
taaattactcaagggcaaccagattactaccattttcaacacttgcttaaaagatgaactaagaaaacttgacaa

SEQ ID NO: 271710 - DNA, 75 bp, Artificial Sequence
  Synthetic
actaccattttcaacacttgcttaaaagatgaactaagaaaacttgacaaaatttcagctggtaagaccaggtgc

SEQ ID NO: 271711 - DNA, 75 bp, Artificial Sequence
  Synthetic
attgaagcctgtgaagtggactattgcatagtctatagaatgattatgatggaaatttatgataaaatttaccag

SEQ ID NO: 271712 - DNA, 75 bp, Artificial Sequence
  Synthetic
acaccatgctattattcaggccttgctgttggaatcaacccatacaaagattggcacttcatgatcaatgcctta

SEQ ID NO: 271713 - DNA, 75 bp, Artificial Sequence
  Synthetic
aatgattacaattatgaaatggattactcccaatatgacggttctctcagttcaatgttattgtgggaggctgtg

SEQ ID NO: 271714 - DNA, 75 bp, Artificial Sequence
  Synthetic
actcccaatatgacggttctctcagttcaatgttattgtgggaggctgtggaagttctggcttattgtcatgatt

SEQ ID NO: 271715 - DNA, 75 bp, Artificial Sequence
  Synthetic
caaaccagtaattgactcggaccatgtggtcttcaatgagagatggttgattcatggcggtatgccatcaggatc

SEQ ID NO: 271716 - DNA, 75 bp, Artificial Sequence
  Synthetic
atactactaatttgattagcccaggggttgactgcttaccaattgtttatggtgatgatgtcatcttgtcacttg

SEQ ID NO: 271717 - DNA, 75 bp, Artificial Sequence
  Synthetic
acaaagaaatagacccagagaaactgcaaagtgtcatggcagattcatttggtgctgaagtaactggttctcgca

SEQ ID NO: 271718 - DNA, 75 bp, Artificial Sequence
  Synthetic
aggatgagcctccgtcgttaaaacctagattggaggtggaattcctgaagcgcaaacctggctacttcccagagt

SEQ ID NO: 271719 - DNA, 75 bp, Artificial Sequence
  Synthetic
aatggagttatgcctccatggaaaagacacttacttaaaatacatcacgattttggatccatacctgaaagaatg

SEQ ID NO: 271720 - DNA, 75 bp, Artificial Sequence
  Synthetic
tatatcattagaacactaattcaattagtacactaatttggaatattggacataacaaaaaaaaaaaaaaaaaaa

SEQ ID NO: 271721 - DNA, 75 bp, Artificial Sequence
  Synthetic
gcttctctaggagagcccttttcccagccagaggtggctggttaaatactacctatagtaacaaaacatctaaga

SEQ ID NO: 271722 - DNA, 75 bp, Artificial Sequence
  Synthetic
actggccgaaggcaactagcaataaggcaggtgggttcagacgcttaaagtgtgttgtacatattcttttctaac

SEQ ID NO: 271723 - DNA, 75 bp, Artificial Sequence
  Synthetic
gttaaaaaacgtctagtgggccaaacccaggggggatccctggtttcctttttatttagataaccactatggagt

SEQ ID NO: 271724 - DNA, 75 bp, Artificial Sequence
  Synthetic
tccaactatcccgttcacaccagattttagaaatgtggacaactttcattcaatggcttatgatataactactgg

SEQ ID NO: 271725 - DNA, 75 bp, Artificial Sequence
  Synthetic
agactggacacagcttcatggcagactagttattctaggcagtacaaaataaccactgtggaattgcccaaatct

SEQ ID NO: 271726 - DNA, 75 bp, Artificial Sequence
  Synthetic
ttacaattggattttcaaaacccacgcccttatggtgaagatgtggaaatttatgataatggaccaaataaggcc

SEQ ID NO: 271727 - DNA, 75 bp, Artificial Sequence
  Synthetic
gcccttatggtgaagatgtggaaatttatgataatggaccaaataaggccaatgctagtagatttaataagagaa

SEQ ID NO: 271728 - DNA, 75 bp, Artificial Sequence
  Synthetic
ttatgataatggaccaaataaggccaatgctagtagatttaataagagaaaatttttgactgcttcaactaaata

SEQ ID NO: 271729 - DNA, 75 bp, Artificial Sequence
  Synthetic
gcagccacagtagcaccacaaaatatggtgcacagaaatgttgttacactagaccaatttccaaacttgaacctg

SEQ ID NO: 271730 - DNA, 75 bp, Artificial Sequence
  Synthetic
tatttatgctagtactttcaatagagggaggcttaggatgggatttttccccaactgtactcatgatactcagtt

SEQ ID NO: 271731 - DNA, 75 bp, Artificial Sequence
  Synthetic
ccccactggttctctggtctccttccaaaattcatggggttcacaaatggaccttacagatccattgtgtattga

SEQ ID NO: 271732 - DNA, 75 bp, Artificial Sequence
  Synthetic
caaagttgacaacatctttggtagagcttggtatgtgacttctcatgattttaacaatggagatacctggaggca

SEQ ID NO: 271733 - DNA, 75 bp, Artificial Sequence
  Synthetic
caagcctctgaggacagtgcgccatgattcagcattaggttttcttatgtgtagaccaatgatgcacgggactac

SEQ ID NO: 271734 - DNA, 75 bp, Artificial Sequence
  Synthetic
gattcagcattaggttttcttatgtgtagaccaatgatgcacgggactacccgaactactgcagaagtttatatt

SEQ ID NO: 271735 - DNA, 75 bp, Artificial Sequence
  Synthetic
agtttaaggtgccccaatttctttttccctgtaccagctcctaaaccaactggttcaagggctgcagcactttat

SEQ ID NO: 271736 - DNA, 75 bp, Artificial Sequence
  Synthetic
tatatcaattggattcggatgacattttcaaaacagctttaacagggaaagctaggttcactaggacaaaattaa

SEQ ID NO: 271737 - DNA, 75 bp, Artificial Sequence
  Synthetic
caattgtgaaaccattgctaaggatatttttggtacccacactcttaatcaacaccaggctattggtttagtagg

SEQ ID NO: 271738 - DNA, 75 bp, Artificial Sequence
  Synthetic
tacaattctcttaactgctggtttgatgtcaactattaaaacaccagtcaatgctacaaccatcaaagaattctt

SEQ ID NO: 271739 - DNA, 75 bp, Artificial Sequence
  Synthetic
tttgtgacacagtgaaatatactaagagtattttatcaaaccaggggccttttaagggtttcaatgaagtgtcaa

SEQ ID NO: 271740 - DNA, 75 bp, Artificial Sequence
  Synthetic
tttaagggtttcaatgaagtgtcaacggcatttaggcacattgattggtggatacacactttattgaaaataaaa

SEQ ID NO: 271741 - DNA, 75 bp, Artificial Sequence
  Synthetic
ttttaccagaaatacactgattgtttgtctaagtttaaaccaattatggctatttgctttagaagttgccacaac

SEQ ID NO: 271742 - DNA, 75 bp, Artificial Sequence
  Synthetic
agtattagtaatacagtctatagactattccaagagttagccagaataccttctagaattagcactcagaatgat

SEQ ID NO: 271743 - DNA, 75 bp, Artificial Sequence
  Synthetic
aatctgatttttcaagtacagtcttgcaagattctggtgcattaaagagaagatttccatatattatgcatatta

SEQ ID NO: 271744 - DNA, 75 bp, Artificial Sequence
  Synthetic
tggaaaactcaatgtcagtcaggctatgtcaaccatggccaccggtgagtgctgggaagtttcaaagaatggtag

SEQ ID NO: 271745 - DNA, 75 bp, Artificial Sequence
  Synthetic
tagaaagaaataaagcctggctaacagtagtttcagctgttaccagtgcaattagtatattgctcctggtgacaa

SEQ ID NO: 271746 - DNA, 75 bp, Artificial Sequence
  Synthetic
agatgagagagcatacaacccaaccctccctgtggcaaaacctaagggtacattcccagtgtcgcaaagggaatt

SEQ ID NO: 271747 - DNA, 75 bp, Artificial Sequence
  Synthetic
caaaaatgaagccccttatgatggccaattagaacacataatatcccaaatggcatatataactggctccaccac

SEQ ID NO: 271748 - DNA, 75 bp, Artificial Sequence
  Synthetic
tatcaacatgatgagatcattctacatggacactcaattaagtatcttgaacaagaagaagatttgaccctgcat

SEQ ID NO: 271749 - DNA, 75 bp, Artificial Sequence
  Synthetic
atggacactcaattaagtatcttgaacaagaagaagatttgaccctgcattataaaaataaagtgttcccaattg

SEQ ID NO: 271750 - DNA, 75 bp, Artificial Sequence
  Synthetic
agaacccatccgtgacacaagtcacattgggtggtaaacctatggatttagctatcctcaagtgtaagttaccat

SEQ ID NO: 271751 - DNA, 75 bp, Artificial Sequence
  Synthetic
ttatactaataaaattggaacagaaagtatgttaatctggatgactgaacaaggcattatcaccaaagaagttaa

SEQ ID NO: 271752 - DNA, 75 bp, Artificial Sequence
  Synthetic
gagagtccaccattctggaggcattaaaacacgggaggggactgagagtacaaaaacaatcagttacactgtgaa

SEQ ID NO: 271753 - DNA, 75 bp, Artificial Sequence
  Synthetic
aaaacacgggaggggactgagagtacaaaaacaatcagttacactgtgaaatcttgcaaaggcatgtgcggaggt

SEQ ID NO: 271754 - DNA, 75 bp, Artificial Sequence
  Synthetic
aagacaagttccatgcactgctaaagggcaatcaaatcactacaatttttaacacttgtttaaaggatgagctga

SEQ ID NO: 271755 - DNA, 75 bp, Artificial Sequence
  Synthetic
gggcaatcaaatcactacaatttttaacacttgtttaaaggatgagctgaggaaattagacaaaatctcagcagg

SEQ ID NO: 271756 - DNA, 75 bp, Artificial Sequence
  Synthetic
gagagatggttgattcatggcggtatgccatcaggatccccatgcactactgttttgaattcattatgcaacctg

SEQ ID NO: 271757 - DNA, 75 bp, Artificial Sequence
  Synthetic
ggatgattatgatgttgtcattgctaagttgatgcccatggtgtttgactaagattaatgttttggtttttcttt

SEQ ID NO: 271758 - DNA, 75 bp, Artificial Sequence
  Synthetic
tatggactatattattagaacactaattcaattagaacactaatttggaatattggacataccaaaaaaaaaaaa

SEQ ID NO: 271759 - DNA, 75 bp, Artificial Sequence
  Synthetic
atttgctgagtttctctaggagagtccctttcccagccttgaggtggctggttaataaaacctcaagcgtaacta

SEQ ID NO: 271760 - DNA, 75 bp, Artificial Sequence
  Synthetic
acatctaagacaaatttatcaaccccatgcctggtccccactagtcgaaagcaacttgcaataagatgagtggaa

SEQ ID NO: 271761 - DNA, 75 bp, Artificial Sequence
  Synthetic
gcaacttgcaataagatgagtggaacaaggatgcttaaagcatggtgcaaataaacttttctaacccatttactt

SEQ ID NO: 271762 - DNA, 75 bp, Artificial Sequence
  Synthetic
ggggtggcagatggcgtgccataactctattagtgagataccacgcttgtggaccttatgctcacacagccatcc

SEQ ID NO: 271763 - DNA, 75 bp, Artificial Sequence
  Synthetic
tgacgtgtgggaacttattggaatctacaatttgccgaaaggcatcctactgccagcggaacaacacctggtaac

SEQ ID NO: 271764 - DNA, 75 bp, Artificial Sequence
  Synthetic
aggtgcccctggggccaaaagccaaggtttaacagaccctttaggattggtgaaaacctgaattgtagtggaaaa

SEQ ID NO: 271765 - DNA, 75 bp, Artificial Sequence
  Synthetic
cacgaaggatgcccagaaggtacccgtaggtaacaagtgacactatggatctgatctggggctggctacctctat

SEQ ID NO: 271766 - DNA, 75 bp, Artificial Sequence
  Synthetic
cttggtgagtcggttaaaaaacgtctagtgggccaaacccaggggggatccctggtttccctttatatcattata

SEQ ID NO: 271767 - DNA, 75 bp, Artificial Sequence
  Synthetic
gctatggagacaatcaagaacattgcagacatggccacaggtatcaccaatactattgatgactcagtcaatacc

SEQ ID NO: 271768 - DNA, 75 bp, Artificial Sequence
  Synthetic
ctaagtgaaagcttttctaaaattggcaatgattctggtggtgagattttaactagagtagctgacgatgcctct

SEQ ID NO: 271769 - DNA, 75 bp, Artificial Sequence
  Synthetic
agtgtattgggtccaaactgtttagcctcaacgtcaatgccagagaacaaggatgttgtccaggctaccacgact

SEQ ID NO: 271770 - DNA, 75 bp, Artificial Sequence
  Synthetic
gttaataccaccaatctgacacaacacccgtcagctccaacgatgccattcacaccggattttactaacgttgac

SEQ ID NO: 271771 - DNA, 75 bp, Artificial Sequence
  Synthetic
aactttcattcaatggcctatgatgtgacaactggagataagaatccaagtaaattgatacgccttgataccaca

SEQ ID NO: 271772 - DNA, 75 bp, Artificial Sequence
  Synthetic
acttggcaacacacttggccacgccaacatttgattaatgatgtccaattgcctaaagcattttgggataaaaac

SEQ ID NO: 271773 - DNA, 75 bp, Artificial Sequence
  Synthetic
tcaaaaccagcatatggccaatctcgctattttgcagcagtaaggtgtgggttccatttccaagtgcaaattaat

SEQ ID NO: 271774 - DNA, 75 bp, Artificial Sequence
  Synthetic
gtcaaccaaggaactgcaggttgtgcactggtggtttatgaacccaagccaattgtaacccatggcagtcacctc

SEQ ID NO: 271775 - DNA, 75 bp, Artificial Sequence
  Synthetic
gagtttgggtcctttactaatttaccacatgtacttatgaatctggcagaaacaactcaggctgatttatgtatc

SEQ ID NO: 271776 - DNA, 75 bp, Artificial Sequence
  Synthetic
ccctatgtgtcagacacaaactacgttaagactgattcgtctgatctagggcgtctgagagtatatgtgtggact

SEQ ID NO: 271777 - DNA, 75 bp, Artificial Sequence
  Synthetic
ccactgacaattccttcgagtgctacaaatgatgtggatgtcactgtccttggtagcttgttacaattggacttt

SEQ ID NO: 271778 - DNA, 75 bp, Artificial Sequence
  Synthetic
cagaatccaaggacttatgacactgatgttgacatttatgacaataatcctgatgtcaaatctaaaaagaaactt

SEQ ID NO: 271779 - DNA, 75 bp, Artificial Sequence
  Synthetic
tatgtcagaaagaagaagttgatgacaatgtctactaagtacaagtggacaagaaccaaagtggacattgctgag

SEQ ID NO: 271780 - DNA, 75 bp, Artificial Sequence
  Synthetic
ggtcctggctcaatgaacatggcaaatgtgttgagcaccactggagcccagtctatagctctggtgggggagaga

SEQ ID NO: 271781 - DNA, 75 bp, Artificial Sequence
  Synthetic
gccttctatgaccccagaacagctgggagtaagtcccggttcagtgacatgattcatatagctcaactattctca

SEQ ID NO: 271782 - DNA, 75 bp, Artificial Sequence
  Synthetic
gtgatgtcagacacaactactccatctacatccagtggtattgatgactttggttactttgactggtcagcaaca

SEQ ID NO: 271783 - DNA, 75 bp, Artificial Sequence
  Synthetic
tacgtcccacagcaagttattcataggaatgtggtcaaattgagtcaattttcaaatttaaagccttttgtgaat

SEQ ID NO: 271784 - DNA, 75 bp, Artificial Sequence
  Synthetic
gcatacacttatttcaggggctccttagtcctaagaatgtcagtttatgctagtacttttaataggggcagactg

SEQ ID NO: 271785 - DNA, 75 bp, Artificial Sequence
  Synthetic
agaatgggtttctttccaaatttcaccactaataccacctcagaaatggataatgctatatacactatatgtgac

SEQ ID NO: 271786 - DNA, 75 bp, Artificial Sequence
  Synthetic
ataggttcagacaatagctttgaaatcactatcccctacaccttctctacttggatgaggaagaccgatgggagg

SEQ ID NO: 271787 - DNA, 75 bp, Artificial Sequence
  Synthetic
cccttagggcttttccaagtagaggtactaaataggttgacttacaacagttcctgccccaacaaggtacattgc

SEQ ID NO: 271788 - DNA, 75 bp, Artificial Sequence
  Synthetic
atagttcaaggaaggctgggtaatgatgcaaggttttattgtcccactggttcgcttgttgagtttcagaactca

SEQ ID NO: 271789 - DNA, 75 bp, Artificial Sequence
  Synthetic
tggggctcccagatggatttgagtgacccattatgcattgaagacaatgaaatggaagattgtaagcaaacaata

SEQ ID NO: 271790 - DNA, 75 bp, Artificial Sequence
  Synthetic
tcccctgatgaattgggtttgacatcagcccaagatgatgggccacttggtgttgaaaagccaaattactttcta

SEQ ID NO: 271791 - DNA, 75 bp, Artificial Sequence
  Synthetic
aactttagggctattaatgtagatattttcacagtaagccataccaaggttgataacatctttgggcgagcgtgg

SEQ ID NO: 271792 - DNA, 75 bp, Artificial Sequence
  Synthetic
cttgcgcatgagcacacatctgctgatgatggaacttggagagtcaacttagatttcccaactcagggacacggg

SEQ ID NO: 271793 - DNA, 75 bp, Artificial Sequence
  Synthetic
actttgacccggcttttcacttactattctggtgagcttaacgtgcatgtactgtatctcagtgacaatggtttc

SEQ ID NO: 271794 - DNA, 75 bp, Artificial Sequence
  Synthetic
ttaagagtcacacatgcttatgaccacaatgataatagatcaaactttttgtcttccaatggtgtgataacggtg

SEQ ID NO: 271795 - DNA, 75 bp, Artificial Sequence
  Synthetic
ccagcaggtgaacaaatgacactatcagtaccattttattcctccaagccacttagaaccattagggactctgga

SEQ ID NO: 271796 - DNA, 75 bp, Artificial Sequence
  Synthetic
gcattgggtagattaatatgcaaacctcttttatcaggaactcacaacgggaagattgaagtctatttgagtctc

SEQ ID NO: 271797 - DNA, 75 bp, Artificial Sequence
  Synthetic
aggtgccccaacctattcttcccatcaccagctcctaaacagaaaacaagcagagcaatcatgtctggaaatcca

SEQ ID NO: 271798 - DNA, 75 bp, Artificial Sequence
  Synthetic
tttgaagatgagagctcctataacacaacatctggaaaacagactatgaaattggcatatttagatagaggcttc

SEQ ID NO: 271799 - DNA, 75 bp, Artificial Sequence
  Synthetic
tataaacattatggcattattgtagatgactatgtgtaccaattagattcagatgatatatttaagactgcttta

SEQ ID NO: 271800 - DNA, 75 bp, Artificial Sequence
  Synthetic
acagggaaagccaaattcacaaaaacaaaactatcaccagattgggttgttgaagaagaatgtgaacttgactac

SEQ ID NO: 271801 - DNA, 75 bp, Artificial Sequence
  Synthetic
tttagagtcaaatatcttgagtcttcagttaattcagagcacattttctctgtggattctaactgtgaaactctt

SEQ ID NO: 271802 - DNA, 75 bp, Artificial Sequence
  Synthetic
gctaaagatatctttggctcgcacactcttagtcagcatcaagctattgggttaattggtacaattctattaact

SEQ ID NO: 271803 - DNA, 75 bp, Artificial Sequence
  Synthetic
gctggattgatgtccactatcaaaactccagtgaatacaaccactattaaggaatttttcaaccatgcaattgat

SEQ ID NO: 271804 - DNA, 75 bp, Artificial Sequence
  Synthetic
ggagatgaacaaggcctctccttgcttgtacaaaaatgcaccacttttttttcttcagcggccacagaaatttta

SEQ ID NO: 271805 - DNA, 75 bp, Artificial Sequence
  Synthetic
gacaatgacttggttaaatttatagtcaaaattttagtcaggattctttgctatatggtactgtattgccacaaa

SEQ ID NO: 271806 - DNA, 75 bp, Artificial Sequence
  Synthetic
ccaaatatattgactactgcatgtctttctacactgctaataatggatgtgacatcttcatcggtactttcacct

SEQ ID NO: 271807 - DNA, 75 bp, Artificial Sequence
  Synthetic
tcttgcaaggcactcatgcagtgtctcatagatggtgatgttaagaaattggccgaagtggtggctgaatccatg

SEQ ID NO: 271808 - DNA, 75 bp, Artificial Sequence
  Synthetic
tcaaacacagatgatgaggagattaaagaacaaatctgtgacacagtgaaatatactaaaaccatactatccaac

SEQ ID NO: 271809 - DNA, 75 bp, Artificial Sequence
  Synthetic
caaggtccatttaagggatttaacgaggtgtccaccgcatttaggcacatagattggtggatacacaccctgttg

SEQ ID NO: 271810 - DNA, 75 bp, Artificial Sequence
  Synthetic
aaaattaaggatatggtacttagtgtattcaagccaagcatggaaagcagggctattcaatggttagagaggaac

SEQ ID NO: 271811 - DNA, 75 bp, Artificial Sequence
  Synthetic
aaggagcatgtatgtgccattctagactatgcttctgacattattgtagagtcaaaagaccaaactaaaatgaaa

SEQ ID NO: 271812 - DNA, 75 bp, Artificial Sequence
  Synthetic
tctcaggaattttaccaaaaatacacagactgcctttctaaatttaaaccaattatggcaatctgcttcaggagt

SEQ ID NO: 271813 - DNA, 75 bp, Artificial Sequence
  Synthetic
tgtcataacagtattagcaacactgtttacaggcttttccaagagctggctcggataccatccagaattagcacg

SEQ ID NO: 271814 - DNA, 75 bp, Artificial Sequence
  Synthetic
caaaatgatttaattagagtagaaccaattggcgtgtggatccagggtgaacctggacaaggcaaatcatttttg

SEQ ID NO: 271815 - DNA, 75 bp, Artificial Sequence
  Synthetic
acacacacactttcgagacagttgcagaaatcatgtaaattgaatggtgtttatacgaaccccactgccagtgaa

SEQ ID NO: 271816 - DNA, 75 bp, Artificial Sequence
  Synthetic
tttatggatggttatgacaatcaagacattcacttgatcgatgatttggggcaaaccaggaaagaaaaagacatt

SEQ ID NO: 271817 - DNA, 75 bp, Artificial Sequence
  Synthetic
gaaatgttgtgtaattgtatctcatcagtcccatttattgtgcccatggcccaccttgaagaaaaaggaaagttt

SEQ ID NO: 271818 - DNA, 75 bp, Artificial Sequence
  Synthetic
tacacaagtaaattggttatagctactacaaacaaatcagatttttccagcactgtacttcaagattctggcaca

SEQ ID NO: 271819 - DNA, 75 bp, Artificial Sequence
  Synthetic
ctcaaaaggagattcccttacattatgcacataagggcagctaaggcctatagcaagtctggcaaacttaatgtt

SEQ ID NO: 271820 - DNA, 75 bp, Artificial Sequence
  Synthetic
agccaagctatgtcagttatgtccaccggtgagtgttgggaggtatccaagaatggtagagactgggaaacactc

SEQ ID NO: 271821 - DNA, 75 bp, Artificial Sequence
  Synthetic
aagttgaaagatttggtgcaaaagataacagaagactaccaagagaggcaaaagaattacaatgcttggaaacag

SEQ ID NO: 271822 - DNA, 75 bp, Artificial Sequence
  Synthetic
caattggagaatcagacactcgacgatttggacgacgcagtgtcttacattaaacacaattttccagatgccatc

SEQ ID NO: 271823 - DNA, 75 bp, Artificial Sequence
  Synthetic
ccatatattgatgagtatttaaatatagaaatgtcaaccctcattgaacaaatggaagcctttattgaaccacga

SEQ ID NO: 271824 - DNA, 75 bp, Artificial Sequence
  Synthetic
cctagtgttttcaagtgttttgccaataaagtggccacgcaaaccaggaaagccgctaaggaggtggtggattgg

SEQ ID NO: 271825 - DNA, 75 bp, Artificial Sequence
  Synthetic
ttcagttcaaagattaaatctatgttaagttttgtggaaaggaacaaggcttggttgacagtggtctcggctgta

SEQ ID NO: 271826 - DNA, 75 bp, Artificial Sequence
  Synthetic
acaagtgccattagcatcttattacttgttaccaagatcttcaagaaagaagaatccaaagatgaaagagcatat

SEQ ID NO: 271827 - DNA, 75 bp, Artificial Sequence
  Synthetic
aatccaaccctccctgttactaaaccaaagggtactttcccagtgtcccaacgggaatttaagaatgaagctcct

SEQ ID NO: 271828 - DNA, 75 bp, Artificial Sequence
  Synthetic
tatgatggccaactagagcacatcatttcacaaatggcatacatcactggatcaaccactggacacctcacgcac

SEQ ID NO: 271829 - DNA, 75 bp, Artificial Sequence
  Synthetic
tgtgctgggtaccaacatgatgagatcatcctgcatggacgctcaatcaagtaccttgagcaagaagagggtctc

SEQ ID NO: 271830 - DNA, 75 bp, Artificial Sequence
  Synthetic
acccttcactataagaataaggtttttccaatagaaaatccttctgttactcaggtcaccctaggtggcaagcca

SEQ ID NO: 271831 - DNA, 75 bp, Artificial Sequence
  Synthetic
atggacctcgccatcctaaagtgcaaactgccattcaggttcaagaagaactccaagtattacactaacaaaatt

SEQ ID NO: 271832 - DNA, 75 bp, Artificial Sequence
  Synthetic
gggactgagagtatgttggtttggatgacagaacaaggaatcatcaccaaggaggtccagagagttcaccactct

SEQ ID NO: 271833 - DNA, 75 bp, Artificial Sequence
  Synthetic
ggtggtattaaaactagggaaggtactgaaagtactaaaactatcagttacactgtcaaatcatgcaaaggaatg

SEQ ID NO: 271834 - DNA, 75 bp, Artificial Sequence
  Synthetic
tgtggtggactcctgatctctaaagttgagggtaatttcaagatcttgggtatgcatattgctggaaatggagaa

SEQ ID NO: 271835 - DNA, 75 bp, Artificial Sequence
  Synthetic
ttctcaagaatgatatgtctgatcaaggcattgtcactgaagtgacacccatacagcctatgtatatcaacacca

SEQ ID NO: 271836 - DNA, 75 bp, Artificial Sequence
  Synthetic
agactcaaatccataagagcccagtctatggtgcagtggaagtgaagatgggcccagcagtcttgagtaaatcag

SEQ ID NO: 271837 - DNA, 75 bp, Artificial Sequence
  Synthetic
accccagacttaaagaacccgttgagtgcctgatcaagaagtcagcatccaagtatagagttaataagttccaag

SEQ ID NO: 271838 - DNA, 75 bp, Artificial Sequence
  Synthetic
tcaataatgaactatggcaaggagttaaagcctgtgtcaagtccaaatttagagagatctttggggtcaatggca

SEQ ID NO: 271839 - DNA, 75 bp, Artificial Sequence
  Synthetic
agagagatctttggggtcaatggcattgtagacatgaaaacagccattctagggacctcccatgtcaactctatg

SEQ ID NO: 271840 - DNA, 75 bp, Artificial Sequence
  Synthetic
gatctaagcacatcagctggatatagctttgtcaaatcaggttataaaaagaaagatttaatttgtcttgaacct

SEQ ID NO: 271841 - DNA, 75 bp, Artificial Sequence
  Synthetic
gctttgtcaaatcaggttataaaaagaaagatttaatttgtcttgaacctttctctgtttcacctatgcttgaaa

SEQ ID NO: 271842 - DNA, 75 bp, Artificial Sequence
  Synthetic
ttctctgtttcacctatgcttgaaaagctcgtacaagacaagtttcatgcactactcaaaggtaaccaaattacc

SEQ ID NO: 271843 - DNA, 75 bp, Artificial Sequence
  Synthetic
acaattttcaatacttgcttaaaggatgaattaagaaaattggataaaatttcagctggtaagactagatgcata

SEQ ID NO: 271844 - DNA, 75 bp, Artificial Sequence
  Synthetic
gaggcctgtgaagtagactattgtatagtctatagaatgatcatgatggaaatctatgataagatttatcaaaca

SEQ ID NO: 271845 - DNA, 75 bp, Artificial Sequence
  Synthetic
ccatgttattactcaggccttgctgttggaatcaacccatacaaagattggcattttatggtcaatgcactaaat

SEQ ID NO: 271846 - DNA, 75 bp, Artificial Sequence
  Synthetic
gattacaattatgagatggattattcccagtatgatggctcccttagttcaatgttattgtgggaggctgtggaa

SEQ ID NO: 271847 - DNA, 75 bp, Artificial Sequence
  Synthetic
gtctttaacgagagatggttgattcatggtggtatgccatcagggtccccatgcactactgtattaaattcattg

SEQ ID NO: 271848 - DNA, 75 bp, Artificial Sequence
  Synthetic
tgcaatttgatgatgtgcatttatacaaccaatttaatcagcccaggaattgattgcttgccaattgtttacggt

SEQ ID NO: 271849 - DNA, 75 bp, Artificial Sequence
  Synthetic
caaccaatttaatcagcccaggaattgattgcttgccaattgtttacggtgatgatgtcatcttgtcacttgata

SEQ ID NO: 271850 - DNA, 75 bp, Artificial Sequence
  Synthetic
aagaaatagatccagagaaactgcaaagtatcatggcagattcatttggtgctgaagtaactggttcgcgcaaag

SEQ ID NO: 271851 - DNA, 75 bp, Artificial Sequence
  Synthetic
atgaacctccatcattaaaaactaggttggaggtggagttcttaaagcgtaaacctggctatttcccagaatcca

SEQ ID NO: 271852 - DNA, 75 bp, Artificial Sequence
  Synthetic
aaacctggctatttcccagaatccacatttatagtaggaaaattggatactgaaaacatgatacaacatttgatg

SEQ ID NO: 271853 - DNA, 75 bp, Artificial Sequence
  Synthetic
tggatccatacctcaaagagtggaatatcactgtggatgattatgatgttgtcattgctaagttgatgcccatgg

SEQ ID NO: 271854 - DNA, 75 bp, Artificial Sequence
  Synthetic
ggtttttctttgttatggactatattattagaacactaattaaattagaacactaattcggaatattggacataa

SEQ ID NO: 271855 - DNA, 75 bp, Artificial Sequence
  Synthetic
cgtcgggccttataccccgacttgctgagcttctctaggagagcccttttcccagccagaggtggctggttaaat

SEQ ID NO: 271856 - DNA, 75 bp, Artificial Sequence
  Synthetic
tgagcttctctaggagagcccttttcccagccagaggtggctggttaaataatacctactgtaacaaaacatcta

SEQ ID NO: 271857 - DNA, 75 bp, Artificial Sequence
  Synthetic
agatgcaacaaccacacacctggtttccactggccgaaggcaactagcaataaggcaggtgggttcagacgctta

SEQ ID NO: 271858 - DNA, 75 bp, Artificial Sequence
  Synthetic
gaactgctatggaagacacttagtacctgctgatttggtagtaatgcaaacactagttgtaaggcccacgaagga

SEQ ID NO: 271859 - DNA, 75 bp, Artificial Sequence
  Synthetic
ggccaactacctctatctaggtgagttggttaaaaaacgtctagtgggccaaacccaggggggatccctggtttc

SEQ ID NO: 271860 - DNA, 75 bp, Artificial Sequence
  Synthetic
ggagtctatcaaggatttagttaatgttgctactggtgctatggatactctctccttgtctaatgtggaagctga

SEQ ID NO: 271861 - DNA, 75 bp, Artificial Sequence
  Synthetic
tcattcaatggcttatgatataactactggagacaaaaaccccagtaagcttataagactggacacagcttcatg

SEQ ID NO: 271862 - DNA, 75 bp, Artificial Sequence
  Synthetic
cccaggctgacctatgcatcccctatgttgcagacacaaactatgttaaaactgactcgtctgatctagggcaat

SEQ ID NO: 271863 - DNA, 75 bp, Artificial Sequence
  Synthetic
gcttattgcaattggattttcaaaacccacgcccttatggtgaagatgtggaaatttatgataatggaccaaata

SEQ ID NO: 271864 - DNA, 75 bp, Artificial Sequence
  Synthetic
cccacgcccttatggtgaagatgtggaaatttatgataatggaccaaataaggtcaatgctagtaaatttaacaa

SEQ ID NO: 271865 - DNA, 75 bp, Artificial Sequence
  Synthetic
ggtatagacaaatatggatactttgattgggcagccacagtggcaccacaaaatatggtgcacagaaatgttgtt

SEQ ID NO: 271866 - DNA, 75 bp, Artificial Sequence
  Synthetic
tactccttctctacttggatgaggaagacacatggccaccaattaggtttatttcaagtcgaagtcttaaaccgt

SEQ ID NO: 271867 - DNA, 75 bp, Artificial Sequence
  Synthetic
ttgacttacaacagttctagtccaaataaagtgcattgtatagtacagggaaggctgggtgatgatgctaagttt

SEQ ID NO: 271868 - DNA, 75 bp, Artificial Sequence
  Synthetic
ataaagtgcattgtatagtacagggaaggctgggtgatgatgctaagtttttctgccccactggctctctggtct

SEQ ID NO: 271869 - DNA, 75 bp, Artificial Sequence
  Synthetic
gtagagcttggtatgtgacgtctcatgactttaataatggagacacctggagacagaaacttacatttccaaaag

SEQ ID NO: 271870 - DNA, 75 bp, Artificial Sequence
  Synthetic
aactgacaatagaaaaatgcagctagcttatttagataggggtttttacaagcactatggcattatagtaggaga

SEQ ID NO: 271871 - DNA, 75 bp, Artificial Sequence
  Synthetic
gcttatttagataggggtttttacaagcactatggcattatagtaggagagaatgtatatcaattggattcggat

SEQ ID NO: 271872 - DNA, 75 bp, Artificial Sequence
  Synthetic
atgatctggttaaatttatagtgaaaatccttgtcagaattctctgttacatggtgttatattgccacaaaccaa

SEQ ID NO: 271873 - DNA, 75 bp, Artificial Sequence
  Synthetic
acaaatttgtgacacagtaaagtatactaagagtattctgtcaaaccaggggccttttaagggtttcaatgaagt

SEQ ID NO: 271874 - DNA, 75 bp, Artificial Sequence
  Synthetic
tagactattccaagagttagccagaataccttctagaattagcactcagaatgatttgattagagtggagccaat

SEQ ID NO: 271875 - DNA, 75 bp, Artificial Sequence
  Synthetic
tcacctcattgatgatttggggcaaactaggaaggagaaggacattgaaatgttatgtaattgcatctcctcagt

SEQ ID NO: 271876 - DNA, 75 bp, Artificial Sequence
  Synthetic
gtcttgcaagattctggcgcattaaagagaagattcccatatatcatgcacattagagcagctaaagcatacagt

SEQ ID NO: 271877 - DNA, 75 bp, Artificial Sequence
  Synthetic
aatgtcaacactaattgagcaaatggaagccttcattgaacctagacctagtgtttttaaatgttttgcaactag

SEQ ID NO: 271878 - DNA, 75 bp, Artificial Sequence
  Synthetic
gaagccttcattgaacctagacctagtgtttttaaatgttttgcaactagggtagcaaaccagacaaggaaagca

SEQ ID NO: 271879 - DNA, 75 bp, Artificial Sequence
  Synthetic
gtgcaattagtatattgctcctggtaacaaaaattttcaagaaggaagactcaaaagatgagagagcatacaacc

SEQ ID NO: 271880 - DNA, 75 bp, Artificial Sequence
  Synthetic
gaattcaaaaatgaagccccttatgatggccaactagagcacataatatcccaaatggcatatataaccggttcc

SEQ ID NO: 271881 - DNA, 75 bp, Artificial Sequence
  Synthetic
atggccaactagagcacataatatcccaaatggcatatataaccggttccaccacaggacatctcacacactgcg

SEQ ID NO: 271882 - DNA, 75 bp, Artificial Sequence
  Synthetic
ccaaatggcatatataaccggttccaccacaggacatctcacacactgcgcaggctatcaacatgatgagatcat

SEQ ID NO: 271883 - DNA, 75 bp, Artificial Sequence
  Synthetic
accatttagattcaagaaaaattccaaatattacactaataaaattggaacagaaagtatgttaatctggatgac

SEQ ID NO: 271884 - DNA, 75 bp, Artificial Sequence
  Synthetic
gaggtctgcttatctctaaagtggaaggaaactttaagattcttggaatgcacatagctgggaatggagaaatgg

SEQ ID NO: 271885 - DNA, 75 bp, Artificial Sequence
  Synthetic
ctaatcaagaaatcagccgcaaaatatagagttaataaatttcaggtgaacaatgaattatggcagggtgtcaaa

SEQ ID NO: 271886 - DNA, 75 bp, Artificial Sequence
  Synthetic
caatgaattatggcagggtgtcaaagcctgtgtcaaatccaaatttagggaaatttttgggatcaatggaatagt

SEQ ID NO: 271887 - DNA, 75 bp, Artificial Sequence
  Synthetic
agatatgaagacagccatcctagggacatcccatgttaactctatggacttaagtacatcagctgggtataactt

SEQ ID NO: 271888 - DNA, 75 bp, Artificial Sequence
  Synthetic
tgaaaaatttcagcacatttaagcagcaacttcaatcctacttaatggagttatgcctccatggaaaagacactt

SEQ ID NO: 271889 - DNA, 75 bp, Artificial Sequence
  Synthetic
tgactaagattaatgttttggtttttctttgttatggactatatcattagaacactaattcaattagaacactaa

SEQ ID NO: 271890 - DNA, 75 bp, Artificial Sequence
  Synthetic
tggccgtcgggccttacaccccgacttgctgagtttctctaggagagtccctttcccagccagaggtggctggtc

SEQ ID NO: 271891 - DNA, 75 bp, Artificial Sequence
  Synthetic
aaacaataccaaacgtaactaaacatctaagataacatagccctatgcctggtctccaccagttgaaggcatctt

SEQ ID NO: 271892 - DNA, 75 bp, Artificial Sequence
  Synthetic
gcaataaaatgggtggattaagacgcttaaagcatggagtcaattatcttttctaactagtgatcttcactgggt

SEQ ID NO: 271893 - DNA, 75 bp, Artificial Sequence
  Synthetic
ggcagatggcgtgccataactctattagtgggataccacgctcgtggatcttatgcccacacagccatcctctag

SEQ ID NO: 271894 - DNA, 75 bp, Artificial Sequence
  Synthetic
taagtttgcaaggtgtctgatgaggcgtgggaacttattggaaataattacttgctgcgaagcatcctactgcca

SEQ ID NO: 271895 - DNA, 75 bp, Artificial Sequence
  Synthetic
gcggatcaacacctggtaacaggtgcccctggggccaaaagccacggtttaacagaccctttaggattggttaaa

SEQ ID NO: 271896 - DNA, 75 bp, Artificial Sequence
  Synthetic
acctgagtaattatggaagatacttagtacctaccaacttggtaacagtgcaaacactagttgtaaggcccacga

SEQ ID NO: 271897 - DNA, 75 bp, Artificial Sequence
  Synthetic
aggatgcccagaaggtacccgcaggtaacaagagacactgtggatctgatctggggccacctacctctatcctgg

SEQ ID NO: 271898 - DNA, 75 bp, Artificial Sequence
  Synthetic
tgaggtggttaaaaaacgtctagtgggccaaacccaggggggatccctggtttccttattttagtgtaaatgtca

SEQ ID NO: 271899 - DNA, 75 bp, Artificial Sequence
  Synthetic
ttatggagacaatcaagagcattgcagatatggcgaccggtgtaactaaaaccattgatgccacaatcaattctg

SEQ ID NO: 271900 - DNA, 75 bp, Artificial Sequence
  Synthetic
ttaatgagatcatcactaacacagataatgcttcaggtggagatatattgactaaagttgctgatgatgcttcaa

SEQ ID NO: 271901 - DNA, 75 bp, Artificial Sequence
  Synthetic
atattttagggcccaactgttatgcgacaacatctgagccagaaaacaaggatgtggtgcaagcaaccaccactg

SEQ ID NO: 271902 - DNA, 75 bp, Artificial Sequence
  Synthetic
tgaacaccactaatctgacacagcacccatcagcaccaacgttaccatttacaccagacttttcgaatgttgaca

SEQ ID NO: 271903 - DNA, 75 bp, Artificial Sequence
  Synthetic
cgtttcattcaatggcttatgatactacaactggtagtaagaaccctaataagttagttaggttaacgacacatg

SEQ ID NO: 271904 - DNA, 75 bp, Artificial Sequence
  Synthetic
cttgggctagtaccctacagaggggtcatcagattgatcatgttaatctaccagttgacttctgggatgaacaga

SEQ ID NO: 271905 - DNA, 75 bp, Artificial Sequence
  Synthetic
ggaaaccagcttatggccatgctaaatattttgcagctgttcggtgtggatttcattttcaagtacaggtcaatg

SEQ ID NO: 271906 - DNA, 75 bp, Artificial Sequence
  Synthetic
tgaatcagggaactgctgggagtgctttggtagtgtatgaaccaaagccagtagttgattatgataaggatttgg

SEQ ID NO: 271907 - DNA, 75 bp, Artificial Sequence
  Synthetic
aatttggagcatttaccaatttaccacatgtgttaatgaacttggccgagactacccaggccgacttatgtatcc

SEQ ID NO: 271908 - DNA, 75 bp, Artificial Sequence
  Synthetic
cctatgttgcagatacaaactatgtgaagactgattcatctgacttagggcaattgaaagtttatgtgtggactc

SEQ ID NO: 271909 - DNA, 75 bp, Artificial Sequence
  Synthetic
cccttagcattccatcaggctcatctaaccaagtggacgtgactatattgggtagcttattacaattggatttcc

SEQ ID NO: 271910 - DNA, 75 bp, Artificial Sequence
  Synthetic
aaaacccaagggtgtatgggcaaaatgttgacatttacgatacagcaccctctaaaccaattccattgaggaaga

SEQ ID NO: 271911 - DNA, 75 bp, Artificial Sequence
  Synthetic
ctaaatatttgactatgagcacaaaatacaaatggacaagaaataaagtagacatagctgaaggtccaggttcaa

SEQ ID NO: 271912 - DNA, 75 bp, Artificial Sequence
  Synthetic
tgaacatggcaaatgtacttagtacgacagcagcacaatcagtagcattggttggggagagggctttttatgatc

SEQ ID NO: 271913 - DNA, 75 bp, Artificial Sequence
  Synthetic
ccaggactgctggtagcaaatctagatttgatgacttagtaaaaatctcacagttgttttcagttatggcagatt

SEQ ID NO: 271914 - DNA, 75 bp, Artificial Sequence
  Synthetic
ccaccactccatctgccaatcatggaatagaccaaaagggttatttcaaatggtctgccaattctgatccacagg

SEQ ID NO: 271915 - DNA, 75 bp, Artificial Sequence
  Synthetic
caatagtgcatagaaacttagttcatttaaatctatttccaaatttgaaggtctttgaaaacagttattcatact

SEQ ID NO: 271916 - DNA, 75 bp, Artificial Sequence
  Synthetic
tcagaggttctcttataatcaggttaagtgtttatgctagtacattcaacagaggccgtttgaatgggttctttc

SEQ ID NO: 271917 - DNA, 75 bp, Artificial Sequence
  Synthetic
caaattccagtacagatgaaacttctgaaattgataatgccatctacaccatatgtgatattggatctgacaata

SEQ ID NO: 271918 - DNA, 75 bp, Artificial Sequence
  Synthetic
gttttgagattactatcccttattcattttccacttggatgaggaagacacatggtaaacctattggcctattcc

SEQ ID NO: 271919 - DNA, 75 bp, Artificial Sequence
  Synthetic
agattgaagtcctaaataggttaacatacaattactccagtccaaatgaggtatactgcatagtgcaaggtaaaa

SEQ ID NO: 271920 - DNA, 75 bp, Artificial Sequence
  Synthetic
tgggacaagacgccaaatttttctgccccactgggtctttagtaactttccagaattcatggggttcccaaatgg

SEQ ID NO: 271921 - DNA, 75 bp, Artificial Sequence
  Synthetic
acttgactgacccgctttgcatagaagattcagtagaagattgtaagcaaaccattacaccaacagaattgggac

SEQ ID NO: 271922 - DNA, 75 bp, Artificial Sequence
  Synthetic
taacctcagcacaagatgatggccctttaggaaatgacaaaccaaattattttcttaactttaagtctatgaatg

SEQ ID NO: 271923 - DNA, 75 bp, Artificial Sequence
  Synthetic
ttgatatctttactgtcagtcacaccaaagtagacaatatttttggacgtgcttggtttgcccatgttcatgact

SEQ ID NO: 271924 - DNA, 75 bp, Artificial Sequence
  Synthetic
tcactaatgatggcctatggagacagggattggaatttccaaaggaagggcacggtgccctatcacttctgtttg

SEQ ID NO: 271925 - DNA, 75 bp, Artificial Sequence
  Synthetic
cctactttactggtgaattaaacatccatgttctatttcttagtgataggggttttctcagagttggacatacat

SEQ ID NO: 271926 - DNA, 75 bp, Artificial Sequence
  Synthetic
atgacactgagacaaacagaaccaattttttatcatccagtggcataattacagtaccagcaggagaacagatga

SEQ ID NO: 271927 - DNA, 75 bp, Artificial Sequence
  Synthetic
cactatctgtcccctcttattccaacaagccattacggacagttagatcatccaatgctttaggttatttactgt

SEQ ID NO: 271928 - DNA, 75 bp, Artificial Sequence
  Synthetic
gtaaaccattgctaactggtaccagctctggtagaatagagatattccttagcttgagatgtccaaatttcttct

SEQ ID NO: 271929 - DNA, 75 bp, Artificial Sequence
  Synthetic
ttcccttaccagcaccaaaaccagcaacacgtaaatatagaggagatttggcaacatggtctgaccaaagtccct

SEQ ID NO: 271930 - DNA, 75 bp, Artificial Sequence
  Synthetic
atggtcgtcaggggaaaaaacagctgatgaaactggcttatttagatagaggtttttacaagcactatggaattg

SEQ ID NO: 271931 - DNA, 75 bp, Artificial Sequence
  Synthetic
ttgtaggtgatgatgtttaccagttggattcggatgacatttttaagacagctttaactggtaaggccaaattta

SEQ ID NO: 271932 - DNA, 75 bp, Artificial Sequence
  Synthetic
ctaaaacaagattaacaccagattgggttgtggaggaagagtgtgaattagactatttcagaattaagtatttgg

SEQ ID NO: 271933 - DNA, 75 bp, Artificial Sequence
  Synthetic
aatcttctgtcaattctgaacacatcttttctgtagacaacaattgtgagaccatagcgaaggacatatttggtt

SEQ ID NO: 271934 - DNA, 75 bp, Artificial Sequence
  Synthetic
cacattcattaagtcagcaccaacaaatagggttaatcggaacaatactcttaactgctggccttatgtcaacca

SEQ ID NO: 271935 - DNA, 75 bp, Artificial Sequence
  Synthetic
ttaaaacaccagtaaatcctaccacaatcaaagagttctttaatcatgctatagaaggtgatgaacaaggattgt

SEQ ID NO: 271936 - DNA, 75 bp, Artificial Sequence
  Synthetic
ccttgcttgtgcaaaaatgtactacatttttctcatctgcagcaactgagttattggacaatgacttagtcaagt

SEQ ID NO: 271937 - DNA, 75 bp, Artificial Sequence
  Synthetic
ttattataaaaatattggttagaatactctgttatatggtactttactgccataagccaaacattttaacaactg

SEQ ID NO: 271938 - DNA, 75 bp, Artificial Sequence
  Synthetic
cctgtctatccactctattagttatggatgttacatcatcttctgtgttatccccgtcatgtaaggccttgatgc

SEQ ID NO: 271939 - DNA, 75 bp, Artificial Sequence
  Synthetic
aatgcctgatggatggggatgtaaagaaattagctgaggtggttgcggagtcaatgtccaatacagacgatgatg

SEQ ID NO: 271940 - DNA, 75 bp, Artificial Sequence
  Synthetic
agatcaaggaacagatttgtgacacagtgaaatatactaaacaaattctttccaaccaaggaccattcaaaggct

SEQ ID NO: 271941 - DNA, 75 bp, Artificial Sequence
  Synthetic
tcaatgaaatatctactgctttcagacatattgattggtggatacaaactttgttgaaaattaaggatatggtac

SEQ ID NO: 271942 - DNA, 75 bp, Artificial Sequence
  Synthetic
tatcagtatttaagcccagtgtggagaagagagcagttgaatggttggaaagaaataaagagcatgtgtgcagta

SEQ ID NO: 271943 - DNA, 75 bp, Artificial Sequence
  Synthetic
tacttgattatgcttctgacattatagttaagtcaaaggaccagacaaaaatgaaaacacaagaattttatcagc

SEQ ID NO: 271944 - DNA, 75 bp, Artificial Sequence
  Synthetic
gttacaatgattgtttgtctaaatttaaacccattatggcaatgtgctttagaagctgtcacaatagtattagta

SEQ ID NO: 271945 - DNA, 75 bp, Artificial Sequence
  Synthetic
acacagtctacagattattccaggaattagctagaatacccaacagaatggccacacaaaatgacttaatccgag

SEQ ID NO: 271946 - DNA, 75 bp, Artificial Sequence
  Synthetic
tagaaccaattggaatttggatccaaggtgagcccggtcagggcaaatcattcctaacacacacactttctaaac

SEQ ID NO: 271947 - DNA, 75 bp, Artificial Sequence
  Synthetic
aactacaaaagacttgtggattacagggtatttataccaacccaactgcaagtgaattcatggatggatatgata

SEQ ID NO: 271948 - DNA, 75 bp, Artificial Sequence
  Synthetic
atcaggatatacatttgattgatgatttgggccaaacaaggaaggagagggacattgagatgttgtgtaattgta

SEQ ID NO: 271949 - DNA, 75 bp, Artificial Sequence
  Synthetic
tatcatcagatcccgatatagtccctatggcccaccttgaggaaaaaggcaaattctacacaagcaaattagtta

SEQ ID NO: 271950 - DNA, 75 bp, Artificial Sequence
  Synthetic
tagccaccacaaataaacctgatttttccagtacagtcttattagattcaggtgctctgaggagaaggtttccat

SEQ ID NO: 271951 - DNA, 75 bp, Artificial Sequence
  Synthetic
acattatgcatattagagctgctaaacattatagcaaatcaggcaaactaaatgtctcccaagctatgccacata

SEQ ID NO: 271952 - DNA, 75 bp, Artificial Sequence
  Synthetic
tgtcaaccggcgagtgttgggaagtctctaagaatggtagagactgggaaactttgaaactgaaagagctaatag

SEQ ID NO: 271953 - DNA, 75 bp, Artificial Sequence
  Synthetic
ataagatcacagttgactacaaagagagaattgcaaattacaacacttggaagaagcagttagaggaccagaccc

SEQ ID NO: 271954 - DNA, 75 bp, Artificial Sequence
  Synthetic
tcgatgatttggatgatgcagtttcatacatcaagcacaactacccagatgcaattccgtatattgatgaatatc

SEQ ID NO: 271955 - DNA, 75 bp, Artificial Sequence
  Synthetic
tgaatattgaaatgtcaacactaattgaacaaatggaagcttttattgaaccaaaacctagtgttttcaaatgtt

SEQ ID NO: 271956 - DNA, 75 bp, Artificial Sequence
  Synthetic
ttgccagcagagttggagataaaattaaagaagcttctagggaggttgttaaatggttctcagataaattaaaat

SEQ ID NO: 271957 - DNA, 75 bp, Artificial Sequence
  Synthetic
ctatgctaaattttgtagaaaggaacaaggcatggttaactgtggtttcagcagtaactagtgccattggtatcc

SEQ ID NO: 271958 - DNA, 75 bp, Artificial Sequence
  Synthetic
tcttactggtcaccaaaatttttaaaaaagaagaatctaaagatgagagggcttacaaccctacattaccagtgg

SEQ ID NO: 271959 - DNA, 75 bp, Artificial Sequence
  Synthetic
ccaaaccaaaaggcactttccctgtttcacagagggagttcaagaatgaagcgccatatgatggccaactggagc

SEQ ID NO: 271960 - DNA, 75 bp, Artificial Sequence
  Synthetic
atatcatctcccagatggcatacatcactggctcaaccacaggccacataacccattgtgcaggttaccagcatg

SEQ ID NO: 271961 - DNA, 75 bp, Artificial Sequence
  Synthetic
atgagatcatactgcatggacactcaatcaaatatttagaacaagaagaagaactgacattacattataagaata

SEQ ID NO: 271962 - DNA, 75 bp, Artificial Sequence
  Synthetic
aagttttcccaattgagcaaccatctgtcactcaggtaacgcttggtggtaaacctatggatttggccattgtaa

SEQ ID NO: 271963 - DNA, 75 bp, Artificial Sequence
  Synthetic
aatgtaaattgccattcagattcaagaaaaactctaaatattatactaataaaattgggactgagagcatgttga

SEQ ID NO: 271964 - DNA, 75 bp, Artificial Sequence
  Synthetic
tctggatgactgagcagggtatcatcacaaaagaagttcagagggtgcatcattctggtggcattaaaactagag

SEQ ID NO: 271965 - DNA, 75 bp, Artificial Sequence
  Synthetic
aggggactgaaagcactaagaccatcagctacacggtgaaatcttgcaaaggtatgtgtggtggacttttgatct

SEQ ID NO: 271966 - DNA, 75 bp, Artificial Sequence
  Synthetic
caaaagtggaaggcaattttaagattcttggtatgcacattgctgggaatggtgagatgggtgtagctatcccct

SEQ ID NO: 271967 - DNA, 75 bp, Artificial Sequence
  Synthetic
ttaattttcttaaaaatgacatgtctgatcagggaattgttactgaagtcacacccatacagcccatgtacatta

SEQ ID NO: 271968 - DNA, 75 bp, Artificial Sequence
  Synthetic
acaccaaatcccaaattcacaagagcccagtttatggtgctgtggaagttaaaatgggcccagctgtactgagta

SEQ ID NO: 271969 - DNA, 75 bp, Artificial Sequence
  Synthetic
aatcggacactagactagaagaaccagtggattgtttggtcaagaagtcagcatcaaaatatagggtcaataaat

SEQ ID NO: 271970 - DNA, 75 bp, Artificial Sequence
  Synthetic
ttcaggtcaacaatgagctatggcagggggttaaagcttgtgttaagtcaaagtttagagaaatatttggtgtta

SEQ ID NO: 271971 - DNA, 75 bp, Artificial Sequence
  Synthetic
atggtattgttgacatgaaaacagctatattaggaacttcccatgttaactcaatggatctcagtacttctgcag

SEQ ID NO: 271972 - DNA, 75 bp, Artificial Sequence
  Synthetic
gatattcatttgtcaaatctgggtacaaaaagaaagatctaatttgtttagaaccattctcggtgagcccaatgt

SEQ ID NO: 271973 - DNA, 75 bp, Artificial Sequence
  Synthetic
tagagaaattagtacaagagaaattccacaacctcctaaaaggaaatcagattacaaccatttttaatacatgtc

SEQ ID NO: 271974 - DNA, 75 bp, Artificial Sequence
  Synthetic
tcaaggatgagttgaggaagctggataaaatcgcaaccggtaaaactcgatgtattgaggcttgtgaaatagact

SEQ ID NO: 271975 - DNA, 75 bp, Artificial Sequence
  Synthetic
attgcattgtttacagaatgattatgatggagatatatgacaaaatttaccaaactccatgttactattcagggc

SEQ ID NO: 271976 - DNA, 75 bp, Artificial Sequence
  Synthetic
ttgctgttggtatcaatccgtacagagattggcacttcatgattaatgcactcaatgattacaattatgaaatgg

SEQ ID NO: 271977 - DNA, 75 bp, Artificial Sequence
  Synthetic
actactcccaatatgatggatcacttagttcaatgctattgtgggaggctgtgcaggtcctagcctattgccatg

SEQ ID NO: 271978 - DNA, 75 bp, Artificial Sequence
  Synthetic
attcacctgatctcgttatgcaactacacaaaccagtgattgactctgatcacgtggtctttaacgagaggtggc

SEQ ID NO: 271979 - DNA, 75 bp, Artificial Sequence
  Synthetic
tgatacatggtggtatgccttcaggatctccctgtaccacagttctgaattcactttgtaatctgatgatgtgca

SEQ ID NO: 271980 - DNA, 75 bp, Artificial Sequence
  Synthetic
tctacactacaaatctaattagccctgggattgattgcttaccaatagtttatggggatgatgtcatcttatccc

SEQ ID NO: 271981 - DNA, 75 bp, Artificial Sequence
  Synthetic
ttgacaaggaaatagaaccagagagactgcaaagtatcatggcagaatcatttggagctgaagtgaccggttcac

SEQ ID NO: 271982 - DNA, 75 bp, Artificial Sequence
  Synthetic
gcaaggacgaaccaccatcattgaaaccaaggatggaggttgaattccttaagcgcaagccaggttactttccag

SEQ ID NO: 271983 - DNA, 75 bp, Artificial Sequence
  Synthetic
aagcgcaagccaggttactttccagagtctacatttatagtaggtaaattggacactgaaaacatgatacaacat

SEQ ID NO: 271984 - DNA, 75 bp, Artificial Sequence
  Synthetic
ctaatgtggatgaaaaatttcagcacatttaagcagcaactccaatcctacttgatggagttatgcctccatgga

SEQ ID NO: 271985 - DNA, 75 bp, Artificial Sequence
  Synthetic
aaggacacttaccaacactacgtcaaaatcttgaatccttatctcaaggaatggaatattccagtggatgattat

SEQ ID NO: 271986 - DNA, 75 bp, Artificial Sequence
  Synthetic
aaatcttgaatccttatctcaaggaatggaatattccagtggatgattatgaagtggttattggtaagttggtgc

SEQ ID NO: 271987 - DNA, 75 bp, Artificial Sequence
  Synthetic
ccatggtgtttgattaaaattaatgttttggttttcttttgctatggactattcattaggatactaatttgatta

SEQ ID NO: 271988 - DNA, 75 bp, Artificial Sequence
  Synthetic
ctattcattaggatactaatttgattagaacactaatttggaatattggacataacaaaaaaaaaaaaaaaaaaa

SEQ ID NO: 271989 - DNA, 75 bp, Artificial Sequence
  Synthetic
ctctaggagagtccctttcccagccctgaggcggctggtcaataaaagcctcaatcgtaactaacatctaagaat

SEQ ID NO: 271990 - DNA, 75 bp, Artificial Sequence
  Synthetic
ctgaggcggctggtcaataaaagcctcaatcgtaactaacatctaagaatattatttcaaccccatgcctggtct

SEQ ID NO: 271991 - DNA, 75 bp, Artificial Sequence
  Synthetic
gatggcgtgccataattctattagtgagataccacgcttgtggaccttatgctcacacagccatcctctagtaag

SEQ ID NO: 271992 - DNA, 75 bp, Artificial Sequence
  Synthetic
gagataccacgcttgtggaccttatgctcacacagccatcctctagtaagtttgcaagatgtctggtgacgtgtg

SEQ ID NO: 271993 - DNA, 75 bp, Artificial Sequence
  Synthetic
tggggccaaaagccaaggtttaacagaccctttaggattggttttaaaacctgaaatgttgtggaagatacttag

SEQ ID NO: 271994 - DNA, 75 bp, Artificial Sequence
  Synthetic
ggggccaagtacctctatcttggtgacttggttaaaaaacgtctagtgggccaaacccgggggggatccctggtt

SEQ ID NO: 271995 - DNA, 75 bp, Artificial Sequence
  Synthetic
tccttttattttaccaatgccactatggagacaatcaagagtattgcagatatggcgactggagtagtcagctca

SEQ ID NO: 271996 - DNA, 75 bp, Artificial Sequence
  Synthetic
gttgattcaactattaatgcagttaatgagaaagtggaaaatgtaggtaatgaaattggaggtaatttgctaact

SEQ ID NO: 271997 - DNA, 75 bp, Artificial Sequence
  Synthetic
aaagttgcagatgacgcatctaatgtacttggaccaaattgttatgctacaacagccgaaccagaaaacaaagat

SEQ ID NO: 271998 - DNA, 75 bp, Artificial Sequence
  Synthetic
gtagtacaggcaaccacaactgttaacacgactaatttgacacagcatccttcagcaccaacaatgccctttact

SEQ ID NO: 271999 - DNA, 75 bp, Artificial Sequence
  Synthetic
cctgatttctccaatgtcgacacattccactcaatggcatatgatatcactactggagagaaaaaccccagcaaa

SEQ ID NO: 272000 - DNA, 75 bp, Artificial Sequence
  Synthetic
ttagttagattagagactcatcagtggacaccaacttgggctagaggttaccagataacccatgtggaattacca

SEQ ID NO: 272001 - DNA, 75 bp, Artificial Sequence
  Synthetic
aaagtcttttgggacaaaaatagtaagccagcctatggccaatcgagatattttgcagcagtacgatgtggtttc

SEQ ID NO: 272002 - DNA, 75 bp, Artificial Sequence
  Synthetic
catttccaggtacaagtgaatgttaatcaaggaacagctggtagtgcattggtagtgtatgaacccaagcctgtg

SEQ ID NO: 272003 - DNA, 75 bp, Artificial Sequence
  Synthetic
gtgacatatgattcaaaattagaatttggagcatttaccaatctaccacatgtattgatgaatttggctgagacc

SEQ ID NO: 272004 - DNA, 75 bp, Artificial Sequence
  Synthetic
ttggagcatttaccaatctaccacatgtattgatgaatttggctgagaccacgcaagctgatttgtgtatcccct

SEQ ID NO: 272005 - DNA, 75 bp, Artificial Sequence
  Synthetic
atgttgctgacacaaactatgttaaaacagattcgtcagacttagggcaactaaaagtttatgtttggactccct

SEQ ID NO: 272006 - DNA, 75 bp, Artificial Sequence
  Synthetic
tatccataccatcaggttctgctacacaagttgatgtaacaatattgggtagtttattacaactggatttccaaa

SEQ ID NO: 272007 - DNA, 75 bp, Artificial Sequence
  Synthetic
atcctagggtatttggccaagacgttggtatttatgataatgcaccaacgaggaaacaaaatctaaagaaaattc

SEQ ID NO: 272008 - DNA, 75 bp, Artificial Sequence
  Synthetic
tcacaatgagcactaaatacaagtggactagacaaaaaattgacattgcagaaggaccaggttctatgaacatgg

SEQ ID NO: 272009 - DNA, 75 bp, Artificial Sequence
  Synthetic
cgaatgtcttgagcaccactgcagcacaatcaattgctttggttggagaaagagctttctatgacccaaggacag

SEQ ID NO: 272010 - DNA, 75 bp, Artificial Sequence
  Synthetic
ccggaagtaaaagtaggtttgatgacctagtaaaaatatctcaacttttctctgtgatgagtgactctacaaccc

SEQ ID NO: 272011 - DNA, 75 bp, Artificial Sequence
  Synthetic
cctcagccaaccatggtatagatgcaaaaggttatttcaagtggtcatccacaactgcaccacaatctgtagtac

SEQ ID NO: 272012 - DNA, 75 bp, Artificial Sequence
  Synthetic
ataggaatattgtttatttgaaattgtttcctaatttgaatgtttttgttaacagctactcatatttcaggggtt

SEQ ID NO: 272013 - DNA, 75 bp, Artificial Sequence
  Synthetic
caatagtgctaaggttgagtgtatatgctagcactttcaatagaggccgtctacggatgggcttctttccaaatg

SEQ ID NO: 272014 - DNA, 75 bp, Artificial Sequence
  Synthetic
ctactgaagatagcacctcagaaattgacaatgccatatacacaatttgtgatttgggtagtgataacagttttg

SEQ ID NO: 272015 - DNA, 75 bp, Artificial Sequence
  Synthetic
tgacaatgccatatacacaatttgtgatttgggtagtgataacagttttgaaatcactattccgtattcattttc

SEQ ID NO: 272016 - DNA, 75 bp, Artificial Sequence
  Synthetic
cacttggatgcggaaaacagatggccacccaattggactattccaaattgaagtgcttaataggttgacctacaa

SEQ ID NO: 272017 - DNA, 75 bp, Artificial Sequence
  Synthetic
tagttctagtcctaatgaagtttattgcattgtgcaaggtaaaatgggacaagatgccaggttcttctgtccaac

SEQ ID NO: 272018 - DNA, 75 bp, Artificial Sequence
  Synthetic
tggttctgtggtgacttttcaaaattcatggggttcacaaatggatctgactgatcctttatgtctagaggaatc

SEQ ID NO: 272019 - DNA, 75 bp, Artificial Sequence
  Synthetic
tgcagaggagtgcaaacaaaccatatcacctaatgaactaggcttaacatcagcacaagatgatggaccattggg

SEQ ID NO: 272020 - DNA, 75 bp, Artificial Sequence
  Synthetic
cgacaataaaccaaattatttcctaaatttcaagtccatgaatgtggacatctttactgtttcccacactaaagt

SEQ ID NO: 272021 - DNA, 75 bp, Artificial Sequence
  Synthetic
agacaacttgtttggaagggcttggtttttcaaggagcacactttcaccgatgagggacagtggagagttagttt

SEQ ID NO: 272022 - DNA, 75 bp, Artificial Sequence
  Synthetic
agagttcccaaaacaaggccatggttcactttccttattatttgcatactttacaggtgaattaaatatccatgt

SEQ ID NO: 272023 - DNA, 75 bp, Artificial Sequence
  Synthetic
tttgttcttggctgaaaagggattcctcagggtggctcacacctatgacacatcggaaaacagggttaacttctt

SEQ ID NO: 272024 - DNA, 75 bp, Artificial Sequence
  Synthetic
atcatccaatggtgttatcacaatcccagctggagagcaaatgacattatctgcaccttactactcaaataaacc

SEQ ID NO: 272025 - DNA, 75 bp, Artificial Sequence
  Synthetic
ccttagaactgtcagggatagcaatagccttgggtatctaatgtgcaaaccattcctcacaggaacgacaagagg

SEQ ID NO: 272026 - DNA, 75 bp, Artificial Sequence
  Synthetic
gaaaatagaggtctatcttagtttgaggtgccccaatttcttctttcctctacctgcacctaaagttacaactgg

SEQ ID NO: 272027 - DNA, 75 bp, Artificial Sequence
  Synthetic
tcgcgccttgcggggcgacatggcaaacttctcgaatgagagcctatatgatcaacaatcacagagccaactgat

SEQ ID NO: 272028 - DNA, 75 bp, Artificial Sequence
  Synthetic
gaaattagcttatctagacaggggtttttacaaacactatggtattatagtaggagacagtgtgtatcagttaga

SEQ ID NO: 272029 - DNA, 75 bp, Artificial Sequence
  Synthetic
ttcagatgacatttttaagacagctttaacagggaaagctagattcactaagacaaagttaactccagattgggt

SEQ ID NO: 272030 - DNA, 75 bp, Artificial Sequence
  Synthetic
cattgaggaagagtgcgaactggattatttcagggtgaagtaccttgaatcgtctgtcaactcagagcatatttt

SEQ ID NO: 272031 - DNA, 75 bp, Artificial Sequence
  Synthetic
ctcagtagaccacaattgtgagactatcgctaaggatatctttggcacccacactcttagtcaacatcatgctat

SEQ ID NO: 272032 - DNA, 75 bp, Artificial Sequence
  Synthetic
acactcttagtcaacatcatgctattggcttggtaggtacaattctcctaactgctggtttgatgtcgaccatta

SEQ ID NO: 272033 - DNA, 75 bp, Artificial Sequence
  Synthetic
tacttgtacaaaaatgtaccactttcttctcttcagcagctacagaaattttagacaatgatttggttaagttta

SEQ ID NO: 272034 - DNA, 75 bp, Artificial Sequence
  Synthetic
tagtgaagatccttgtcagaattctatgttacatggtgttatattgtcacaaaccaaatattttaactactgctt

SEQ ID NO: 272035 - DNA, 75 bp, Artificial Sequence
  Synthetic
gtttatccacattgctaattatggatgtcacatcttcatcagtgctgtcgccttcttgtaaggcacttatgcagt

SEQ ID NO: 272036 - DNA, 75 bp, Artificial Sequence
  Synthetic
gcctaatggatggcgacgttaagaaattggcagaagttgtagctgagtcaatgtcaaacacagatgatgatgaaa

SEQ ID NO: 272037 - DNA, 75 bp, Artificial Sequence
  Synthetic
ttaaagaacaaatttgtgatacagttaagtatactaaaacaatcctttctaaccaaggtccattcaaaggtttta

SEQ ID NO: 272038 - DNA, 75 bp, Artificial Sequence
  Synthetic
atgaggtttctacagcatttagacatatagattggtggatacacactttacttaaaatcaaagacatggtcctca

SEQ ID NO: 272039 - DNA, 75 bp, Artificial Sequence
  Synthetic
gtgtcttcaagccaagtattgagagtaaggctatccagtggttagaaaggaataaagaacatgtgtgtggcattc

SEQ ID NO: 272040 - DNA, 75 bp, Artificial Sequence
  Synthetic
ttgactacgcctctgatatcattgtagaatcaaaagaccaatctaaagtcaaaacccaagatttctaccagagat

SEQ ID NO: 272041 - DNA, 75 bp, Artificial Sequence
  Synthetic
attcagattgtcttgctaaatttaaaccaataatggctatgtgctttaggagttgtcacaatagcataagtaata

SEQ ID NO: 272042 - DNA, 75 bp, Artificial Sequence
  Synthetic
cagtgtataggctttttcaggaattagccaggatacctagtaggattagtacccaaaatgacttgattagagttg

SEQ ID NO: 272043 - DNA, 75 bp, Artificial Sequence
  Synthetic
aacccattggtatttggattcaaggtgaacctggacagggtaaatcattcctaacacatactttgtctagacaac

SEQ ID NO: 272044 - DNA, 75 bp, Artificial Sequence
  Synthetic
tacaaaaatcttgtaaattgaatggaatatttaccaacccaacagccagcgaatttatggatggatatgataatc

SEQ ID NO: 272045 - DNA, 75 bp, Artificial Sequence
  Synthetic
aggatatccacttaattgatgatttgggacagactaggaaagaaaaagacatcgaaatgctgtgcaactgtatat

SEQ ID NO: 272046 - DNA, 75 bp, Artificial Sequence
  Synthetic
ctgcagtcccttttgtcgtgccgatggcacacttagaggagaaaggaaagttttataccagcaagttggtcatag

SEQ ID NO: 272047 - DNA, 75 bp, Artificial Sequence
  Synthetic
ctaccacaaacaagtcagatttctctagtacagtcctccaagactctggtgccctcaagaggcgcttcccctaca

SEQ ID NO: 272048 - DNA, 75 bp, Artificial Sequence
  Synthetic
taatgcatatcagagctgccaaggcatacagtaaagcaggcaaattaaatgtgagccaagctatggccacaatgt

SEQ ID NO: 272049 - DNA, 75 bp, Artificial Sequence
  Synthetic
ctactggtgaatgttgggaagtctcaaagaatgggagagattgggaaaccctaaaactcaaagacttagtggaca

SEQ ID NO: 272050 - DNA, 75 bp, Artificial Sequence
  Synthetic
aaataactgtagattacaatgaaaggattaaaaattataatgcatggaaaacacaattggaaaatcaaaccctag

SEQ ID NO: 272051 - DNA, 75 bp, Artificial Sequence
  Synthetic
atgatttggatgatgctgtatcatacattaaacacaattttccagatgccattccatacatagatgagtatttaa

SEQ ID NO: 272052 - DNA, 75 bp, Artificial Sequence
  Synthetic
atattgagatgtccactctgattgaacaaatggaagctttcattgaaccacgcccaagtgtcttcaaatgttttg

SEQ ID NO: 272053 - DNA, 75 bp, Artificial Sequence
  Synthetic
caaacaaagtgggtgctaaaatttctaaagcctctcgggaggtgattgattggttctcagacaaaattaaatcta

SEQ ID NO: 272054 - DNA, 75 bp, Artificial Sequence
  Synthetic
tgttgagcttcgtggagagaaacaaggcatggctcactgtggtctcagctgtcactagtgcaattagcatattac

SEQ ID NO: 272055 - DNA, 75 bp, Artificial Sequence
  Synthetic
tcttggtgacaaagattttcaagaaggaagattccaaagatgagagagcctacaatccaacattaccagtggcaa

SEQ ID NO: 272056 - DNA, 75 bp, Artificial Sequence
  Synthetic
aaccaaaaggaactttcccagtttctcagagagaatttaaaaatgaggccccatatgatggacaacttgaacata

SEQ ID NO: 272057 - DNA, 75 bp, Artificial Sequence
  Synthetic
ttatatcccaaatggcctatatcacaggctccaccacagggcatctaacacattgtgctggttaccaacatgatg

SEQ ID NO: 272058 - DNA, 75 bp, Artificial Sequence
  Synthetic
aaattattctgcatggtcattcaattaagtacctggagcaggaggaggaacttactttgcactacaagaacaaag

SEQ ID NO: 272059 - DNA, 75 bp, Artificial Sequence
  Synthetic
tctttccaattgaaagcccatcagtgacacaagtcacgcttggtgggaaacctatggacctcgccatattaaaat

SEQ ID NO: 272060 - DNA, 75 bp, Artificial Sequence
  Synthetic
gcaaactgccctttagattcaaaaagaactcaaaatactacactaataagattggtactgaaagtatgctgattt

SEQ ID NO: 272061 - DNA, 75 bp, Artificial Sequence
  Synthetic
ggatgactgagcagggaatcattacaaaggaggtgcagagagtccaccactctggtggtatcaaaactagagaag

SEQ ID NO: 272062 - DNA, 75 bp, Artificial Sequence
  Synthetic
gtactgaaagtaccaagaccattagttatactgtcaagtcatgtaaaggaatgtgtggaggtcttctgatctcca

SEQ ID NO: 272063 - DNA, 75 bp, Artificial Sequence
  Synthetic
aggttgaaggtaacttcaaaatattgggcatgcatattgcaggcaatggtgaaatgggagtggctatacctttta

SEQ ID NO: 272064 - DNA, 75 bp, Artificial Sequence
  Synthetic
acttcctgaaaaatgatatgtcagaccaaggcattgtcacagaaatcacgcctatccaacccatgtacatcaata

SEQ ID NO: 272065 - DNA, 75 bp, Artificial Sequence
  Synthetic
caaagtcacagatccacaagagcccagtctatggtgctgttgaggtcaagatgggacctgcggtactcagtaaat

SEQ ID NO: 272066 - DNA, 75 bp, Artificial Sequence
  Synthetic
ctgacactagactggaagaaccagtagattgtctgatcaagaagtctgcttctaagtatagagtcaacaaattcc

SEQ ID NO: 272067 - DNA, 75 bp, Artificial Sequence
  Synthetic
aggtcaataatgaattatggcaaggtgtaaaagcttgtgttaaatcaaaatttagagaaatctttgggatcaatg

SEQ ID NO: 272068 - DNA, 75 bp, Artificial Sequence
  Synthetic
gtattgtagacatgaagactgctattctaggaacctctcatgttaactcaatggacctgagtacttcagcagggt

SEQ ID NO: 272069 - DNA, 75 bp, Artificial Sequence
  Synthetic
atagctttgtaaaatctggctataaaaagaaagatttgatctgcctggaaccattttcagtgtccccgatgctag

SEQ ID NO: 272070 - DNA, 75 bp, Artificial Sequence
  Synthetic
aaaagctagtgcaagaaaagttccataacctcctaaagggcaaccaaatcactacaattttcaacacttgtctca

SEQ ID NO: 272071 - DNA, 75 bp, Artificial Sequence
  Synthetic
aagatgagcttaggaaattagacaagattgcatctggcaagaccaggtgtattgaagcttgtgaagtcgattatt

SEQ ID NO: 272072 - DNA, 75 bp, Artificial Sequence
  Synthetic
gtattgtttacagaatgataatgatggaaatatatgacaaaatataccaaaccccctgttattactctggattgg

SEQ ID NO: 272073 - DNA, 75 bp, Artificial Sequence
  Synthetic
ctgttggcatcaacccgtataaagattggcattttatgattaatgctttaaatgactataattatgaaatggatt

SEQ ID NO: 272074 - DNA, 75 bp, Artificial Sequence
  Synthetic
actctcaatatgatggttccctgagttcaatgcttctatgggaggcagtggaggttttagcttactgccatgatt

SEQ ID NO: 272075 - DNA, 75 bp, Artificial Sequence
  Synthetic
caccagatctagtgatgcaacttcacaaaccagtgattgattccgatcacgttgtattcaatgagagatggctga

SEQ ID NO: 272076 - DNA, 75 bp, Artificial Sequence
  Synthetic
ttcatggtggcatgccttctgggtcaccttgcaccactgtactaaattcactttgcaatcttatgatgtgcattt

SEQ ID NO: 272077 - DNA, 75 bp, Artificial Sequence
  Synthetic
acactacaaatttgatcagtccagggatagattgcttacctatagtttatggtgatgatgtgatcctatcattgg

SEQ ID NO: 272078 - DNA, 75 bp, Artificial Sequence
  Synthetic
acaaagaaattgaaccagagaaactgcaaagtatcatggcagattcatttggagctgaagtcactggatctcgta

SEQ ID NO: 272079 - DNA, 75 bp, Artificial Sequence
  Synthetic
aggatgaacctccatctttaaaaccacgtatggaggtggagttcctcaagagaaagccaggttacttcccagagt

SEQ ID NO: 272080 - DNA, 75 bp, Artificial Sequence
  Synthetic
gacacttatcaacactacatcaaaattttggatccctacctaaaagaatggaatatcacagtggatgattatgaa

SEQ ID NO: 272081 - DNA, 75 bp, Artificial Sequence
  Synthetic
gtggtaattgctaagttgatgcccatggtgtttgactaattttaaatgttttggttttcttttgctatggacttt

SEQ ID NO: 272082 - DNA, 75 bp, Artificial Sequence
  Synthetic
tatggactttataattggaatactaattcaaataggatactaatttggaatattggacataacaaaaaaaaaaaa

SEQ ID NO: 272083 - DNA, 75 bp, Artificial Sequence
  Synthetic
ctgcaaagcatcccattgccagcggatctacatctggtaacagatgcctctggggccaaaagccaaggtttaaca

SEQ ID NO: 272084 - DNA, 75 bp, Artificial Sequence
  Synthetic
agtagcagatgatgcttccaatttacttgggccaaacagttttgcaaccacagctcaaccagagaacaaagatgt

SEQ ID NO: 272085 - DNA, 75 bp, Artificial Sequence
  Synthetic
caaggaactgcaggaagtgcattggtggtttatgagcctaagccggttatagattcaaggcaatatttggaattt

SEQ ID NO: 272086 - DNA, 75 bp, Artificial Sequence
  Synthetic
ccaggctgacctatgcatcccctatgttgcagacacaaactatgttaaaactgactcgtctgatctagggcaatt

SEQ ID NO: 272087 - DNA, 75 bp, Artificial Sequence
  Synthetic
tctgtcccactggctctctggtctccttccaaaattcatggggttcacaaatggatcttacagatccattgtgta

SEQ ID NO: 272088 - DNA, 75 bp, Artificial Sequence
  Synthetic
tagagcttggtatgtgacgtctcatgactttaataatggagatacctggagacagaaattaacatttccaaaaga

SEQ ID NO: 272089 - DNA, 75 bp, Artificial Sequence
  Synthetic
cttatttagataggggtttttacaagcactatggcattatagtaggagagagtgtatatcagttggattcagatg

SEQ ID NO: 272090 - DNA, 75 bp, Artificial Sequence
  Synthetic
gcactatggcattatagtaggagagagtgtatatcagttggattcagatgacattttcaaaacagctttaacagg

SEQ ID NO: 272091 - DNA, 75 bp, Artificial Sequence
  Synthetic
agtgtatatcagttggattcagatgacattttcaaaacagctttaacagggaaagctaggttcactaagacaaaa

SEQ ID NO: 272092 - DNA, 75 bp, Artificial Sequence
  Synthetic
tgatttggttaaatttatagtgaaaatccttgtcagaattctctgttacatggtgttatattgtcacaaaccaaa

SEQ ID NO: 272093 - DNA, 75 bp, Artificial Sequence
  Synthetic
cttcttcagtgttgtcgccttcttgtaaggcacttatgcagtgcctaatggatggtgacgtcaagaaattggcgg

SEQ ID NO: 272094 - DNA, 75 bp, Artificial Sequence
  Synthetic
aagttgtggctgaatccatgtctaatacggatgatgaagagatcaaggaacaaatttgtgacacagtaaaatata

SEQ ID NO: 272095 - DNA, 75 bp, Artificial Sequence
  Synthetic
gcattataaaaataaagtgttcccaattgagaacccatctgtgacacaagtcacattgggtggtaaacctatgga

SEQ ID NO: 272096 - DNA, 75 bp, Artificial Sequence
  Synthetic
attgagaacccatctgtgacacaagtcacattgggtggtaaacctatggatttggctatcctcaagtgtaaacta

SEQ ID NO: 272097 - DNA, 75 bp, Artificial Sequence
  Synthetic
aaaaatgacatgtctgaccaaggcgttgtcacggaaataacacccatgcaacccatgtacattaatactaaaact

SEQ ID NO: 272098 - DNA, 75 bp, Artificial Sequence
  Synthetic
ttgtcacggaaataacacccatgcaacccatgtacattaatactaaaactcaaatccacaagagtccagtctacg

SEQ ID NO: 272099 - DNA, 75 bp, Artificial Sequence
  Synthetic
attaacccatataaagattggcactttatgattaatgccttgaatgactacaattatgaaatggattactcccag

SEQ ID NO: 272100 - DNA, 75 bp, Artificial Sequence
  Synthetic
tatgatggttctcttagttcaatgctattgtgggaggccgtggaagttttggcttattgtcatgactcacctgat

SEQ ID NO: 272101 - DNA, 75 bp, Artificial Sequence
  Synthetic
cctgatgatgtgcatctacaccaccaatttaattagcccaggaattgactgtttaccaattgtttatggtgatga

SEQ ID NO: 272102 - DNA, 75 bp, Artificial Sequence
  Synthetic
tggttatttcccagagtccacatttatagtaggaaaattggacactgaaaatatgatacaacatttaatgtggat

SEQ ID NO: 272103 - DNA, 75 bp, Artificial Sequence
  Synthetic
cgtcgggccttataccccgacttgctgagcttctctaggagagtccctttcccagccagaggtggctggtcaaat

SEQ ID NO: 272104 - DNA, 75 bp, Artificial Sequence
  Synthetic
aatacctactgtaactaaacatctaagaaataacaaccacacacctggtctccaccagccgaaagcaactagcaa

SEQ ID NO: 272105 - DNA, 75 bp, Artificial Sequence
  Synthetic
taaggtgggtggatatagacgcttaaagtgtgttgtgcattttcttttctagcctgtgttttacacagggtggca

SEQ ID NO: 272106 - DNA, 75 bp, Artificial Sequence
  Synthetic
ctctcaattttaaacagtcactatggagtctatcaaggatttagttaatgttgctaccggtgccatggatactct

SEQ ID NO: 272107 - DNA, 75 bp, Artificial Sequence
  Synthetic
ttccttgtctaatgtagaaactgaagctaataatattatttctggcaatgaagttggtggggaaataataactaa

SEQ ID NO: 272108 - DNA, 75 bp, Artificial Sequence
  Synthetic
agttgcagatgatgcttctaatctactaggaccaaatagttttgcaaccacagcccaaccggagaacaaggatgt

SEQ ID NO: 272109 - DNA, 75 bp, Artificial Sequence
  Synthetic
tgtgcaagctacaactactgtaaacactacaaatttgacacaacacccatcggctccaactatcccattcacacc

SEQ ID NO: 272110 - DNA, 75 bp, Artificial Sequence
  Synthetic
ggattttagaaatgtggacaatttccattcaatggcttatgatataactactggagacaaaaaccccagtaaact

SEQ ID NO: 272111 - DNA, 75 bp, Artificial Sequence
  Synthetic
tataagacttgatacagctcaatggcagactagttattctaggcaacatcagataaccactgtggaactacccaa

SEQ ID NO: 272112 - DNA, 75 bp, Artificial Sequence
  Synthetic
atcattttggaatgacacaagaaagcctgcttacggccaagccaagtactttgcagctgttagatgtggtttcca

SEQ ID NO: 272113 - DNA, 75 bp, Artificial Sequence
  Synthetic
ttgcagctgttagatgtggtttccatttccaggttcaagttaatgtcaaccaaggaactgcagggagtgcattgg

SEQ ID NO: 272114 - DNA, 75 bp, Artificial Sequence
  Synthetic
tggtttatgagcccaaaccggttatagattcaaggcaatatttggaatttggttctttaaccaatctcccccatg

SEQ ID NO: 272115 - DNA, 75 bp, Artificial Sequence
  Synthetic
agattcaaggcaatatttggaatttggttctttaaccaatctcccccatgtgttaatgaatttggctgagaccac

SEQ ID NO: 272116 - DNA, 75 bp, Artificial Sequence
  Synthetic
acgggtttatgtttggactcctctttcagtacctacaggggcttccaatgaggttgatgtcacagttatgggtag

SEQ ID NO: 272117 - DNA, 75 bp, Artificial Sequence
  Synthetic
cctattacagttggattttcaaaatccacgcccttatggtgaaaatgtagaaatttatgataatgggccaaacaa

SEQ ID NO: 272118 - DNA, 75 bp, Artificial Sequence
  Synthetic
agttaatgctagtaaatttaacaagagaaaattcttgactgcttcaactaagtataagtggacacgaacaaaagt

SEQ ID NO: 272119 - DNA, 75 bp, Artificial Sequence
  Synthetic
cgatatagctgagggacctgggaccatgaacatggcaaatgtcctaagtacaacaggagcccagtctgtagcact

SEQ ID NO: 272120 - DNA, 75 bp, Artificial Sequence
  Synthetic
agtgggagaaagagcattttatgatcctagaactgcagggagtaagtctagatttgatgatatgattaagatagc

SEQ ID NO: 272121 - DNA, 75 bp, Artificial Sequence
  Synthetic
tcaattgttctcagttatgtcagacaacacaacaccatctagtagtagtggtatagacaaatatggatattttga

SEQ ID NO: 272122 - DNA, 75 bp, Artificial Sequence
  Synthetic
ttgggcggccacagtggcaccacaaaatatggtacacagaaatgttgttacattagaccaatttccaaacctaaa

SEQ ID NO: 272123 - DNA, 75 bp, Artificial Sequence
  Synthetic
cttgttcatgaatacttattcctattttaggggttctttaatacttagactctctatttatgctagtactttcaa

SEQ ID NO: 272124 - DNA, 75 bp, Artificial Sequence
  Synthetic
tagaggaagactgagaatgggatttttcccaaattgtacccatgatacccaattggagttagataatgccatata

SEQ ID NO: 272125 - DNA, 75 bp, Artificial Sequence
  Synthetic
tacaatctgtgacatcggctcagacaatagttttgaattgactataccatactctttctcaacttggatgaggaa

SEQ ID NO: 272126 - DNA, 75 bp, Artificial Sequence
  Synthetic
aacgcatggccatcaattgggtctatttcaagtggaagtattgaaccggttgacctacaatagttctagcccaaa

SEQ ID NO: 272127 - DNA, 75 bp, Artificial Sequence
  Synthetic
taaagtacattgtattgtacagggaaggctgggtgatgatgctaaatttttctgccccactggttctcttgtctc

SEQ ID NO: 272128 - DNA, 75 bp, Artificial Sequence
  Synthetic
ctttcaaaattcctggggttcacaaatggaccttacagacccattgtgtattgaagataacatggaaaattgcaa

SEQ ID NO: 272129 - DNA, 75 bp, Artificial Sequence
  Synthetic
acagtcaatatcaccaaatgaactgggtttgacttcagcccaagatgatgggccactaggtaatgagaaaccaaa

SEQ ID NO: 272130 - DNA, 75 bp, Artificial Sequence
  Synthetic
ttacttcttaaactttagaactatgaatgttgacattttcacagttagtcacaccaaagtcgacaatatttttgg

SEQ ID NO: 272131 - DNA, 75 bp, Artificial Sequence
  Synthetic
cagggcttggtatgtgacctctcatgactttaacaatggggacacctggaggcagaaattgacattcccaaaaga

SEQ ID NO: 272132 - DNA, 75 bp, Artificial Sequence
  Synthetic
aggtcatggcatgttatcacagttttttgcatattttacaggtgaaataaacatacacatcctatatatggcaga

SEQ ID NO: 272133 - DNA, 75 bp, Artificial Sequence
  Synthetic
gcaaggatttttaagagtggcacatacatatgatactgaagagaataggaaaacattcttgtcttcaaatggtgt

SEQ ID NO: 272134 - DNA, 75 bp, Artificial Sequence
  Synthetic
gatcaccatccctgcaggagaacaaatgactctctcagtacccttctactcaaataaaccattgcggacagtacg

SEQ ID NO: 272135 - DNA, 75 bp, Artificial Sequence
  Synthetic
ccacgaatcagcactaggctttcttatgtgcagaccaatgatgcatggtaccaccagaactacagcagaagttta

SEQ ID NO: 272136 - DNA, 75 bp, Artificial Sequence
  Synthetic
cattagtctgaggtgccccaatttcttcttccctgtaccagcgcctaaacctactggtacgagagccatagcctt

SEQ ID NO: 272137 - DNA, 75 bp, Artificial Sequence
  Synthetic
ccatgatgaaagtccctatgtttcaccagagaagaaaaatatgaaattagcttatttagataggggtttctataa

SEQ ID NO: 272138 - DNA, 75 bp, Artificial Sequence
  Synthetic
acattatggcatcattgttgatgattacgtttaccaactagattcagatgacatcttcaaaacagccctaactgg

SEQ ID NO: 272139 - DNA, 75 bp, Artificial Sequence
  Synthetic
acatcttcaaaacagccctaactggtaaggctaagtttactaagacaaagttgacacaagattggattgtagagg

SEQ ID NO: 272140 - DNA, 75 bp, Artificial Sequence
  Synthetic
aagaatgtgaactagattatttcagagtcaagtaccttgaatcatcggtaaattcagaacacattttctcagtag

SEQ ID NO: 272141 - DNA, 75 bp, Artificial Sequence
  Synthetic
agtcaagtaccttgaatcatcggtaaattcagaacacattttctcagtagattctaattgtgagaccattgccaa

SEQ ID NO: 272142 - DNA, 75 bp, Artificial Sequence
  Synthetic
agatatctttggtacacacaccctcagtcaacatcaagccattggtttgattggcacaatccttctgacagctgg

SEQ ID NO: 272143 - DNA, 75 bp, Artificial Sequence
  Synthetic
tctgatgtcaactattaagacgccagttaatgccaagactattaaggaattcttcaaccatgctattgatgggga

SEQ ID NO: 272144 - DNA, 75 bp, Artificial Sequence
  Synthetic
tgaacaggggctatccttacttgtgcaaaagtgtactactttcttttcttcagctgccacagagatcttagacaa

SEQ ID NO: 272145 - DNA, 75 bp, Artificial Sequence
  Synthetic
tgatctggttaagttcatagtaaaaatacttgttaggattctttgctacatggtgttgtattgtcacaaaccaaa

SEQ ID NO: 272146 - DNA, 75 bp, Artificial Sequence
  Synthetic
cattctgaccactgcttgtttgtccacactgttaattatggatgttacatcatcatcagtgttgtcaccttcttg

SEQ ID NO: 272147 - DNA, 75 bp, Artificial Sequence
  Synthetic
taaggcactcatgcagtgcctgatggacggtgacgtcaagaagttggctgaggtagtagctgaatccatgtccaa

SEQ ID NO: 272148 - DNA, 75 bp, Artificial Sequence
  Synthetic
cacggatgatgaggaaatcaaagaacaaatttgtgacacagtgaagtacaccaaaagtatcctttcaaatcaagg

SEQ ID NO: 272149 - DNA, 75 bp, Artificial Sequence
  Synthetic
gccattcaagggtttcaatgaagtctcaactgcatttagacatattgactggtggatacataccttgctgaaaat

SEQ ID NO: 272150 - DNA, 75 bp, Artificial Sequence
  Synthetic
caaagatatggtacttagtgttttcaagccgagtatggagagcaaggctattcagtggttagaaaggaataagga

SEQ ID NO: 272151 - DNA, 75 bp, Artificial Sequence
  Synthetic
aggatcagacaaaaatgaaatcacaggaattttaccaaaagtacactgactgtctggctaaattcaaaccaatta

SEQ ID NO: 272152 - DNA, 75 bp, Artificial Sequence
  Synthetic
tgacttgattagagttgagccaattggagtttggatacagggtgaaccaggacaagggaaatctttcttgacaca

SEQ ID NO: 272153 - DNA, 75 bp, Artificial Sequence
  Synthetic
cactctatccaggcaattacaaaagtcttgcaaactgaatggagtttacactaacccaactgctagtgaatttat

SEQ ID NO: 272154 - DNA, 75 bp, Artificial Sequence
  Synthetic
ggatggttatgacaaccaggacatccatctcattgacgacttgggtcaaactaggaaagagaaagacattgaaat

SEQ ID NO: 272155 - DNA, 75 bp, Artificial Sequence
  Synthetic
catctcattgacgacttgggtcaaactaggaaagagaaagacattgaaatgttgtgtaactgcatatcctcggta

SEQ ID NO: 272156 - DNA, 75 bp, Artificial Sequence
  Synthetic
cccttcatagtcccaatggcacatcttgaggaaaaaggtaaattttacactagtaaattggtgattgcaactact

SEQ ID NO: 272157 - DNA, 75 bp, Artificial Sequence
  Synthetic
ttgaggaaaaaggtaaattttacactagtaaattggtgattgcaactactaacaaatcagacttttcaagcactg

SEQ ID NO: 272158 - DNA, 75 bp, Artificial Sequence
  Synthetic
ttctacaagactcaggtgctttgaagagaagattcccatacatcatgcacatcagggctgcaaaggcttacagta

SEQ ID NO: 272159 - DNA, 75 bp, Artificial Sequence
  Synthetic
gagaagattcccatacatcatgcacatcagggctgcaaaggcttacagtaagtcaggtaaactcaatgttagcca

SEQ ID NO: 272160 - DNA, 75 bp, Artificial Sequence
  Synthetic
agctatgtctacaatggctacaggtgaatgctgggaagtgtctaaaaatggtagagattgggaaaccctaaaatt

SEQ ID NO: 272161 - DNA, 75 bp, Artificial Sequence
  Synthetic
acaagatttggtaaagaaaattactgaagactatgaagagagacaaaagaattataattgttggaaacaacagct

SEQ ID NO: 272162 - DNA, 75 bp, Artificial Sequence
  Synthetic
tgagaatcagactctagatgatctggatgacgcagtttcttacattaaacataatttccctgatgcaattcctta

SEQ ID NO: 272163 - DNA, 75 bp, Artificial Sequence
  Synthetic
cattgatgaatatcttaatattgagatgtctactttaattgaacaaatggaagcctttattgagccaagaccaag

SEQ ID NO: 272164 - DNA, 75 bp, Artificial Sequence
  Synthetic
tgtcttcaaatgttttgcaaccaaagttgcaaaccaaacaagaaaagcagctaaggaagttgtggactggttcag

SEQ ID NO: 272165 - DNA, 75 bp, Artificial Sequence
  Synthetic
tgtcttcaaatgttttgcaaccaaagttgcaaaccatacaagaaaagcagctaaggaagttgtggactggttcag

SEQ ID NO: 272166 - DNA, 75 bp, Artificial Sequence
  Synthetic
tgtcttcaaatgttttgcaaccaaagttgcaaaccacacaagaaaagcagctaaggaagttgtggactggttcag

SEQ ID NO: 272167 - DNA, 75 bp, Artificial Sequence
  Synthetic
tgtcttcaaatgttttgcaaccaaagttgcaaaccagacaagaaaagcagctaaggaagttgtggactggttcag

SEQ ID NO: 272168 - DNA, 75 bp, Artificial Sequence
  Synthetic
tagtaagattaaatcaatgttgagttttgtggagagaaataaggcttggctaacagtagtttctgctgtcactag

SEQ ID NO: 272169 - DNA, 75 bp, Artificial Sequence
  Synthetic
tgcaataagcatactacttttggtgactaagattttcaagaaggaggactcaaaggatgagcgggcttacaatcc

SEQ ID NO: 272170 - DNA, 75 bp, Artificial Sequence
  Synthetic
aacactccctgttgccaaatcaaaaggaactttcccagtcacgcaaagagagtttaaaaatgaggcaccatatga

SEQ ID NO: 272171 - DNA, 75 bp, Artificial Sequence
  Synthetic
tggacagttagaacatattatttcccagatggcctacataactggttccacaacaggacatctcacacactgtgc

SEQ ID NO: 272172 - DNA, 75 bp, Artificial Sequence
  Synthetic
tggttaccaacatgatgagatcattttgcatggacactcaattaagtacttggaacaggaagaggaattaaccct

SEQ ID NO: 272173 - DNA, 75 bp, Artificial Sequence
  Synthetic
aatattatactaacaaaattggaactgagagtatgttgatttggatgactgagcaaggtattatcacaaaagaag

SEQ ID NO: 272174 - DNA, 75 bp, Artificial Sequence
  Synthetic
tgcagagagtccatcactctggtggtatcaaaacccgcgagggaactgaaagcacaaaaacaatcagctatactg

SEQ ID NO: 272175 - DNA, 75 bp, Artificial Sequence
  Synthetic
taaaatcctgtaaagggatgtgtggtggtttgctcatctctaaagtggaagggaacttcaaaattcttgggatgc

SEQ ID NO: 272176 - DNA, 75 bp, Artificial Sequence
  Synthetic
acatagctggaaatggagaaatgggtgttgctatcccctttaattttctcaagaatgacatgtctgatcaaggca

SEQ ID NO: 272177 - DNA, 75 bp, Artificial Sequence
  Synthetic
ttgtcacagaagtaacacccatacaacccatgtacatcaacactaggactcaaattcataaaagtccggtctatg

SEQ ID NO: 272178 - DNA, 75 bp, Artificial Sequence
  Synthetic
gtgctgtggaagttaagatgggtccagcagtcctgagtaaatcagaccctagactagaagaaccagttgaatgct

SEQ ID NO: 272179 - DNA, 75 bp, Artificial Sequence
  Synthetic
taattaagaaatctgcttcaaaatatagagttaacaaatttcaggtcaacaatgaactgtggcaaggtgttaaag

SEQ ID NO: 272180 - DNA, 75 bp, Artificial Sequence
  Synthetic
cctgtgttaagtccaaatttagagaaatctttggggtcaatggtatagtggacatgaaaacagctatcttgggaa

SEQ ID NO: 272181 - DNA, 75 bp, Artificial Sequence
  Synthetic
caacccatgtgaattctatggatttgagtacatctgctggatatagtttcgtaaaatcaggctataaaaagaaag

SEQ ID NO: 272182 - DNA, 75 bp, Artificial Sequence
  Synthetic
atctaatttgtcttgaacctttctctgtctcacctatgcttgaaaaactcgtgcaagataaattccacaacttac

SEQ ID NO: 272183 - DNA, 75 bp, Artificial Sequence
  Synthetic
ttaagggtaatcaaataactacaatttttaacacttgtctaaaagatgaactgagaaaattagacaaaatatctg

SEQ ID NO: 272184 - DNA, 75 bp, Artificial Sequence
  Synthetic
ctggcaaaaccagatgtattgaggcttgtgaagtagattattgcatagtttacagaatgattatgatggagattt

SEQ ID NO: 272185 - DNA, 75 bp, Artificial Sequence
  Synthetic
acgacaaaatttaccagacaccatgctattactcaggtcttgctgttgggatcaacccatacaaagattggcact

SEQ ID NO: 272186 - DNA, 75 bp, Artificial Sequence
  Synthetic
ctattactcaggtcttgctgttgggatcaacccatacaaagattggcacttcatgatcagcgctttgaatgaata

SEQ ID NO: 272187 - DNA, 75 bp, Artificial Sequence
  Synthetic
tatgatggttcccttagttcaatgttactgtgggaggctgtggaggttttggcttattgtcatgacacacctgag

SEQ ID NO: 272188 - DNA, 75 bp, Artificial Sequence
  Synthetic
ggtatgccatcagggtctccatgtaccactgtgctaaattcgttgtgtaatttaatgatgtgcatttatactact

SEQ ID NO: 272189 - DNA, 75 bp, Artificial Sequence
  Synthetic
tgtcatcttgtcacttgataaagaaatagacccagagaaactgcagagtatcatggcagaatcatttggcgctga

SEQ ID NO: 272190 - DNA, 75 bp, Artificial Sequence
  Synthetic
agtgactggttctcgcaaggatgaacctccatcattaaaacccagattggaggtagaattcctaaagcgcaaacc

SEQ ID NO: 272191 - DNA, 75 bp, Artificial Sequence
  Synthetic
tatgcctccatggaaaagacacttacctacactacatcaaaattttggatccttacttaaaagagtggaatatca

SEQ ID NO: 272192 - DNA, 75 bp, Artificial Sequence
  Synthetic
gtttttctttgttatggactatatcattagaacactaattcaattagaacactaatttggaatattggacatacc

SEQ ID NO: 272193 - DNA, 75 bp, Artificial Sequence
  Synthetic
tgctgagcttctctaggagagcccttttcccagccagaggtggctggttaaataatacctattgtaacaagacat

SEQ ID NO: 272194 - DNA, 75 bp, Artificial Sequence
  Synthetic
ttttgctgcagtaaggtgtggttttcatttccaagtccaggttaacgtcaaccaaggaactgcaggaagtgcatt

SEQ ID NO: 272195 - DNA, 75 bp, Artificial Sequence
  Synthetic
ggtggtttatgagcctaaaccggttatagattcaaggcaatatttggaatttggttccttaactaatctccctca

SEQ ID NO: 272196 - DNA, 75 bp, Artificial Sequence
  Synthetic
atgttgcagacacaaactatgttaaaaccgactcgtctgatctagggcaattgcgggtctatgtttggacacctc

SEQ ID NO: 272197 - DNA, 75 bp, Artificial Sequence
  Synthetic
actctctatttatgctagcactttcaatagagggaggctgaggatgggatttttccccaactgtacccatgatac

SEQ ID NO: 272198 - DNA, 75 bp, Artificial Sequence
  Synthetic
aatagagggaggctgaggatgggatttttccccaactgtacccatgatactcagttggagttggacaatgctata

SEQ ID NO: 272199 - DNA, 75 bp, Artificial Sequence
  Synthetic
tattgaggataacatggaaaattgtaaacagtccatatcaccaaatgaattgggtttgacttcagctcaagatga

SEQ ID NO: 272200 - DNA, 75 bp, Artificial Sequence
  Synthetic
tgacattttcaaaacagctttaacagggaaagctaggttcactaggacaaaattaactccagactgggtcattga

SEQ ID NO: 272201 - DNA, 75 bp, Artificial Sequence
  Synthetic
ttggtatctggatccaaggtgaaccagggcaaggaaaatctttcttgacacacacactatccagacaattgcaaa

SEQ ID NO: 272202 - DNA, 75 bp, Artificial Sequence
  Synthetic
tcttgaggagaaaggcaaattttacaccagtaaactggtaatagcaaccaccaacaaatctgatttttcaagtac

SEQ ID NO: 272203 - DNA, 75 bp, Artificial Sequence
  Synthetic
gggtagcaaaccagacaaggaaagcagccaaagaagttgtggaatggttcagtagtaagatcaagttaatgttga

SEQ ID NO: 272204 - DNA, 75 bp, Artificial Sequence
  Synthetic
caccacaggacatctcacgcactgtgcaggctatcaacatgatgagatcattctacatggacactcaattaagta

SEQ ID NO: 272205 - DNA, 75 bp, Artificial Sequence
  Synthetic
ggcgttgctattcctttcaatttccttaaaaatgacatgtctgaccaaggcattgtcacggaaataacacccttg

SEQ ID NO: 272206 - DNA, 75 bp, Artificial Sequence
  Synthetic
actaaagggcaaccaaatcactacaattttcaacacttgtttaaaggatgagctgaggaaattagacaaaatttc

SEQ ID NO: 272207 - DNA, 75 bp, Artificial Sequence
  Synthetic
gaatcaacccatataaagattggcactttatgattaatgccttaaatgaatataattatgaaatggattactccc

SEQ ID NO: 272208 - DNA, 75 bp, Artificial Sequence
  Synthetic
atccatacctgaaagaatggaatatcacagtggatgattatgatgttgtcattgctaagttgatgcccatggtgt

SEQ ID NO: 272209 - DNA, 75 bp, Artificial Sequence
  Synthetic
attgctaagttgatgcccatggtgtttgactaagataaatgttttggtttttctttgtcatggactctatcattc

SEQ ID NO: 272210 - DNA, 75 bp, Artificial Sequence
  Synthetic
catggactctatcattctaccactaattcaattataacactattttgtagtattgcccattccaaaaaaaaaaaa

SEQ ID NO: 272211 - DNA, 75 bp, Artificial Sequence
  Synthetic
ggccttataccccgacttgccgagtttctctaggagagtccctttcccagccgtgaggtggctggtcaataaaaa

SEQ ID NO: 272212 - DNA, 75 bp, Artificial Sequence
  Synthetic
cctcaaatgtaactaacatcaaagaaaaatcactcaaccccatgcctggcccccgctagtcgaaagcaacttgca

SEQ ID NO: 272213 - DNA, 75 bp, Artificial Sequence
  Synthetic
ataagatgagtggaccaagggcgcttaaagcatggtgtcagcaatcttttctaacccatgtttcacatggggtgg

SEQ ID NO: 272214 - DNA, 75 bp, Artificial Sequence
  Synthetic
taaagcatggtgtcagcaatcttttctaacccatgtttcacatggggtggcagatggcgtgccataactctatta

SEQ ID NO: 272215 - DNA, 75 bp, Artificial Sequence
  Synthetic
agtttgtatgacgtccgatgacgtgtgggaacttattggaagcaacaatttgccgaaaggcatcctattgccagc

SEQ ID NO: 272216 - DNA, 75 bp, Artificial Sequence
  Synthetic
gatgcccagaaggtacccgtaggtaacaagtgacactatggatctgatctggggctgactaccactatcctggtg

SEQ ID NO: 272217 - DNA, 75 bp, Artificial Sequence
  Synthetic
agtcagttaaaaaacgtctagtgggccaaacccaggggggatccctggtttctttttattttataactgtcaata

SEQ ID NO: 272218 - DNA, 75 bp, Artificial Sequence
  Synthetic
tggagacaattaagaatattgcagatatggcaactggcgttgttagctcagttgattcaactatcaatgctgtaa

SEQ ID NO: 272219 - DNA, 75 bp, Artificial Sequence
  Synthetic
atgagaaagttgaaaacgttggtaatgaaattggtggaaatttactgactaaagtagcagatgatgcgtctaatg

SEQ ID NO: 272220 - DNA, 75 bp, Artificial Sequence
  Synthetic
ttctaggaccaaattgttttgcaaccacggctgaacctgagaataaaaatgtagtgcaggccaccacaacagtca

SEQ ID NO: 272221 - DNA, 75 bp, Artificial Sequence
  Synthetic
acaccacaaatttaacccaacacccatcagcaccaaccatgcctttctcaccagatttctccaatgtagacaatt

SEQ ID NO: 272222 - DNA, 75 bp, Artificial Sequence
  Synthetic
tccattcaatggcgtatgacattacaacaggagacaaaaacccaagcaaactagttagacttgaaacacatgaat

SEQ ID NO: 272223 - DNA, 75 bp, Artificial Sequence
  Synthetic
ggacaccatcctgggcaaggggacaccaaattacacatgttgaattacctaaagtgttttggaataaccaggata

SEQ ID NO: 272224 - DNA, 75 bp, Artificial Sequence
  Synthetic
aacctgcttatggccagtctcgttattttgctgctgtcagatgtggatttcacttccaagtccaagttaatgtta

SEQ ID NO: 272225 - DNA, 75 bp, Artificial Sequence
  Synthetic
atcaaggtactgctggtagtgcattggttgtctatgaacctaaacctgttgttacatatgatagcagattggaat

SEQ ID NO: 272226 - DNA, 75 bp, Artificial Sequence
  Synthetic
ttggcgcttttacaaatctgcctcatgttttaatgaacttggctgaaacaacacaagcggacttatgtatcccct

SEQ ID NO: 272227 - DNA, 75 bp, Artificial Sequence
  Synthetic
acgttgctgacacaaactatgtgaagactgattcgtcggacttagggcagttaaaagtctatgtgtggacgccat

SEQ ID NO: 272228 - DNA, 75 bp, Artificial Sequence
  Synthetic
tgacaattccaacaggttcagcaaatcaagtagacgtcacaattttgggtagcttattacagttggactttcaaa

SEQ ID NO: 272229 - DNA, 75 bp, Artificial Sequence
  Synthetic
atcccagagtatttggtcaagatgtcagtatatacgacaatgggccaaataccaagaagaaaaattggaagaaga

SEQ ID NO: 272230 - DNA, 75 bp, Artificial Sequence
  Synthetic
ttatgaccatgagtaccaaatataaatggactagaacaaaagtagacattgctgaagggcctggatctatgaata

SEQ ID NO: 272231 - DNA, 75 bp, Artificial Sequence
  Synthetic
tggcaaatgttctcagcaccactggggcccagtcagtagccctagtgggagaaagagctttttatgaccccagga

SEQ ID NO: 272232 - DNA, 75 bp, Artificial Sequence
  Synthetic
ctgcaggcagtagatcaagatttgatgaccttgtcaaaatttcacagttattttctgtgatggctgattcaacca

SEQ ID NO: 272233 - DNA, 75 bp, Artificial Sequence
  Synthetic
cgccatctgaaaaccatggggttgatgctaaaggctactttaaatggtctgcaaccacagcaccccaaagcattg

SEQ ID NO: 272234 - DNA, 75 bp, Artificial Sequence
  Synthetic
tgcacagaaacatcgtgtaccttaaattgtttccaaacttgaatgtgtttgtgaatagttattcatattttaggg

SEQ ID NO: 272235 - DNA, 75 bp, Artificial Sequence
  Synthetic
gttccttaattttgaggctaagtgtctacgctagcactttcaataggggtcgcctgaggatgggtttctttccaa

SEQ ID NO: 272236 - DNA, 75 bp, Artificial Sequence
  Synthetic
atgccaccgaagaatccacgtcaacgttggacaatgccatctacactatatgtgatattgggagtgacaacagtt

SEQ ID NO: 272237 - DNA, 75 bp, Artificial Sequence
  Synthetic
ttgaaattacgatcccctattctttctccacgtggatgaggaagacagatggacatgctattggattatttcaaa

SEQ ID NO: 272238 - DNA, 75 bp, Artificial Sequence
  Synthetic
ttgaggttttgaataggctcacatacaatagttctagcccttctgaagtctattgcattgtccagggagaaatgg

SEQ ID NO: 272239 - DNA, 75 bp, Artificial Sequence
  Synthetic
ggcaggacgcaaggttcttctgcccaactggttcagtggtgacatttcaaaactcctggggttcccaaatggact

SEQ ID NO: 272240 - DNA, 75 bp, Artificial Sequence
  Synthetic
tgacagaccccctttgtttggaggacgatactgaaaattgcaagcaaaccatgtccccagatgaattgggcctaa

SEQ ID NO: 272241 - DNA, 75 bp, Artificial Sequence
  Synthetic
catctgctcaagatgatggtccactgggccaagaaaaaccgaactacttccttaattttaggtcaatgaatgtgg

SEQ ID NO: 272242 - DNA, 75 bp, Artificial Sequence
  Synthetic
acattttcacagtttcacatactaaggtagacaatctgtttggaagagcttggttcttccaggaacacacattta

SEQ ID NO: 272243 - DNA, 75 bp, Artificial Sequence
  Synthetic
ctaatgaagggcagtggagagtaccattggagtttcccaaacaaggccatggttctttgtcactactttttgctt

SEQ ID NO: 272244 - DNA, 75 bp, Artificial Sequence
  Synthetic
attttactggagaactgaatattcatgtactttttctgggtgagagaggttttctgagaatagcccatacttatg

SEQ ID NO: 272245 - DNA, 75 bp, Artificial Sequence
  Synthetic
acacaagtgagaacagggtcaactttctttcatccaatggtgtgattacagtaccagctggtgagcaaatgacat

SEQ ID NO: 272246 - DNA, 75 bp, Artificial Sequence
  Synthetic
tatcagctccatattactctaataagcccttaaggacagtgagggactccaatagtcttgggtatttgatgtgta

SEQ ID NO: 272247 - DNA, 75 bp, Artificial Sequence
  Synthetic
aacctttcctaactggaaccactactggtaagattgaagtttatcttagcctcaggtgtccaaactttttcttcc

SEQ ID NO: 272248 - DNA, 75 bp, Artificial Sequence
  Synthetic
cactccctgctcctaaggttacatctggtcgcacgctgcggggtgatatggcaaatctcagcaaccaaagcccat

SEQ ID NO: 272249 - DNA, 75 bp, Artificial Sequence
  Synthetic
atgctgaacaaacacagaaacaaactatgaagttggcctatttggacagaggcttttacaagcactatggcatca

SEQ ID NO: 272250 - DNA, 75 bp, Artificial Sequence
  Synthetic
tagttgatgaatatgtgtaccagctagattcagatgacatattcaagacagcattaactgggaaagcaaaattca

SEQ ID NO: 272251 - DNA, 75 bp, Artificial Sequence
  Synthetic
caaaaactaaactgacacctgattgggttattgaagaagagtgtgagctagattattttagggttaaatatttag

SEQ ID NO: 272252 - DNA, 75 bp, Artificial Sequence
  Synthetic
agtcttctgtcaactcagaacacatcttctcagtagattcaaattgtgaaactattgctaaggatatttttggca

SEQ ID NO: 272253 - DNA, 75 bp, Artificial Sequence
  Synthetic
cccacaccctcagtcaacatcaggccattggattaattggtacaatcctcttgacagctggtctgatgtctacca

SEQ ID NO: 272254 - DNA, 75 bp, Artificial Sequence
  Synthetic
ttaaaacacctgtgaaagcaacgacaattaaagagtttttcaaccatgctattgatggtgatgagcagggattat

SEQ ID NO: 272255 - DNA, 75 bp, Artificial Sequence
  Synthetic
ccctactcgtacaaaaatgtactactttctcttcttcagcagctacagagattttggacaatgatttggtcaaat

SEQ ID NO: 272256 - DNA, 75 bp, Artificial Sequence
  Synthetic
ttatagttaaaattcttgttagaattctgtgttacatggtgctatactgccataagccaaatattttgactactg

SEQ ID NO: 272257 - DNA, 75 bp, Artificial Sequence
  Synthetic
cctgcctatcaacactattgataatggatgttacatcatcatcagtgttgtcaccctcatgcaaagcacttatgc

SEQ ID NO: 272258 - DNA, 75 bp, Artificial Sequence
  Synthetic
agtgcttaatggatggtgatgtcaagaaattagcagaggttgtggcagagtcaatgtctaacacagatgatgaag

SEQ ID NO: 272259 - DNA, 75 bp, Artificial Sequence
  Synthetic
aaatcaaagaacaaatttgtgacacagtgaagtataccaagactatattgtctaatcagggacctttcaaaggat

SEQ ID NO: 272260 - DNA, 75 bp, Artificial Sequence
  Synthetic
tcaatgaggtgtcaacagcttttaggcatattgattggtggatacacacattactaaaaatcaaagacatggtta

SEQ ID NO: 272261 - DNA, 75 bp, Artificial Sequence
  Synthetic
tcagtgtttttaaacccagtatggagagcaaggccatccaatggttagaaaggaacaaggagcatgtatgtgcca

SEQ ID NO: 272262 - DNA, 75 bp, Artificial Sequence
  Synthetic
ttttagattatgcttcagacatcattgtggagtcaaaagaccagacaaagatgaagtcccaagaattttaccaaa

SEQ ID NO: 272263 - DNA, 75 bp, Artificial Sequence
  Synthetic
agtacacagattgtctatctaagttcaagccaattatggccatctgttttaggagttgccataacagtattagta

SEQ ID NO: 272264 - DNA, 75 bp, Artificial Sequence
  Synthetic
acactgtttacagacttttccaagaattggctcgaataccatctaggattagtacacaaaatgacttaattagag

SEQ ID NO: 272265 - DNA, 75 bp, Artificial Sequence
  Synthetic
tggaaccaattggcgtctggattcaaggtgaacctggacaaggtaaatcattcctaacacacacactttcaaggc

SEQ ID NO: 272266 - DNA, 75 bp, Artificial Sequence
  Synthetic
agttacagaagtcatgtaagttgaatggtgtctatacaaatcccactgccagtgaatttatggatggttacgaca

SEQ ID NO: 272267 - DNA, 75 bp, Artificial Sequence
  Synthetic
accaagatatccatctaattgatgatttggggcaaactaggaaagagaaagacatagaaatgctttgtaactgta

SEQ ID NO: 272268 - DNA, 75 bp, Artificial Sequence
  Synthetic
tatcctcagtaccttttattgtaccaatggcacatttggaggaaaaaggtaaattttacacaagcaaattagtca

SEQ ID NO: 272269 - DNA, 75 bp, Artificial Sequence
  Synthetic
tagctaccacaaacaagtctgacttctccagtactgtactccaagattctggtgctctaaagaggaggtttcctt

SEQ ID NO: 272270 - DNA, 75 bp, Artificial Sequence
  Synthetic
atattatgcatattagagcagctaaggcctatagcaagtcaggcaagctcaatattagtcaagctatgtccacaa

SEQ ID NO: 272271 - DNA, 75 bp, Artificial Sequence
  Synthetic
tggctactggtgagtgctgggaggtgtctaaaaatggtagagattgggaaactctaaaactacaagatttggtca

SEQ ID NO: 272272 - DNA, 75 bp, Artificial Sequence
  Synthetic
agaagattacagaagattatgaggaaagacagaagaactacaattgttggaaacaacagctggagaatcagacat

SEQ ID NO: 272273 - DNA, 75 bp, Artificial Sequence
  Synthetic
tggatgacttggatgatgctgtttcatacattaaacacaattttccagatgcaatcccctatatagatgaatacc

SEQ ID NO: 272274 - DNA, 75 bp, Artificial Sequence
  Synthetic
tcaacattgaaatgtcaacactaattgaacaaatggaagctttcattgaaccacggccaagtgtatttaaatgtt

SEQ ID NO: 272275 - DNA, 75 bp, Artificial Sequence
  Synthetic
ttgccaataaagttgctactcaaactaggaaagctgctaaggaggtggttgaatggttcagctcaaaaatcaaat

SEQ ID NO: 272276 - DNA, 75 bp, Artificial Sequence
  Synthetic
caatgctgagctttgtagaaaggaataaggcttggctaacagttgtttcagctgtaaccagtgccattagtatct

SEQ ID NO: 272277 - DNA, 75 bp, Artificial Sequence
  Synthetic
tactacttgttactaaaatttttaagaaagaagagtccaaagatgagagagcttacaatccaactctccctgcca

SEQ ID NO: 272278 - DNA, 75 bp, Artificial Sequence
  Synthetic
ctaaaccaaagggcactttcccagtatcccaacgagaattcaagaatgaagctccctatgatggtcaactagagc

SEQ ID NO: 272279 - DNA, 75 bp, Artificial Sequence
  Synthetic
atattatttcacaaatggcatatatcactggttcaactactggtcatttgacacattgtgcagggtatcaacatg

SEQ ID NO: 272280 - DNA, 75 bp, Artificial Sequence
  Synthetic
atgaagtcattttgcatggacattcaattaagtaccttgagcaagaggaggatctcactctccattataagaata

SEQ ID NO: 272281 - DNA, 75 bp, Artificial Sequence
  Synthetic
aggtttttccaatagaacacccttctgttactcaggtcaccttaggtggtaagccaatggacctcgccatcttaa

SEQ ID NO: 272282 - DNA, 75 bp, Artificial Sequence
  Synthetic
agtgcaaactgccattcaggttcaagaagaactcaaagtattacactaataaaattgggactgaaagcatgttga

SEQ ID NO: 272283 - DNA, 75 bp, Artificial Sequence
  Synthetic
tttggatgacagagcaaggaattatcaccaaagaggttcatagagtccaccattccggtggtatcaaaaccagag

SEQ ID NO: 272284 - DNA, 75 bp, Artificial Sequence
  Synthetic
aaggcactgaaagtactaaaaccattagttatactgtcaaatcatgcaaaggaatgtgtggtggactcctaatat

SEQ ID NO: 272285 - DNA, 75 bp, Artificial Sequence
  Synthetic
ccaaggtcgaagggaatttcaagatcctgggtatgcacatagctggaaatggtgaaatgggtgtggccataccat

SEQ ID NO: 272286 - DNA, 75 bp, Artificial Sequence
  Synthetic
tcaatttcctgaaaaatgatatgtctgatcaaggaattgtcactgaagtaacacccatacaaccaatgtatataa

SEQ ID NO: 272287 - DNA, 75 bp, Artificial Sequence
  Synthetic
atactaagtctcaaattcacaaaagtccagtttatggagctgttgaggtcaaaatgggcccagctgtcctaagca

SEQ ID NO: 272288 - DNA, 75 bp, Artificial Sequence
  Synthetic
aatcggacgctagattagaggagcctgtagactgtttgatcaagaaatcagcgtctaaatatagagtcaacaaat

SEQ ID NO: 272289 - DNA, 75 bp, Artificial Sequence
  Synthetic
tccaagtaaataatgagttatggcaaggtgttaaagcctgtgtcaaatcaaaatttagagaaatctttgggatta

SEQ ID NO: 272290 - DNA, 75 bp, Artificial Sequence
  Synthetic
atggcattgttgacataaaaactgcaattttaggaacttcacatgttaactcaatggaccttagtacttcagctg

SEQ ID NO: 272291 - DNA, 75 bp, Artificial Sequence
  Synthetic
ggtatagctttgtcaaatctggatacaaaaagaaggacttgatatgtttggaaccattttctgtatcaccaatgt

SEQ ID NO: 272292 - DNA, 75 bp, Artificial Sequence
  Synthetic
tagagaaattggtccaggacaagttccacaaccttttaaaaggtaatcaaattacaactattttcaacacgtgct

SEQ ID NO: 272293 - DNA, 75 bp, Artificial Sequence
  Synthetic
taaaagatgagcttagaaaattggataaaattgcatgtggaaaaactagatgcattgaagcatgtgaagttgatt

SEQ ID NO: 272294 - DNA, 75 bp, Artificial Sequence
  Synthetic
attgcattgtctacagaatgataatgatggaaatttacgacaaaatatatcaaaccccctgctactattcaggac

SEQ ID NO: 272295 - DNA, 75 bp, Artificial Sequence
  Synthetic
ttgctgtggggattaacccatacaaagattggcactttatgatcaatgcattaaatgactacaattatgaaatgg

SEQ ID NO: 272296 - DNA, 75 bp, Artificial Sequence
  Synthetic
actattctcaatatgatggttcacttagctcaatgcttctgtgggaagctgtggaagtgctagcatattgtcatg

SEQ ID NO: 272297 - DNA, 75 bp, Artificial Sequence
  Synthetic
actcacctgatcttgtgatgcaactccataaaccagtgattgattccgatcatgttgtcttcaacgagagatggc

SEQ ID NO: 272298 - DNA, 75 bp, Artificial Sequence
  Synthetic
tgattcatggtggaatgccatctggctctccatgtaccacagtactaaattcattgtgcaatttgatgatgtgca

SEQ ID NO: 272299 - DNA, 75 bp, Artificial Sequence
  Synthetic
tttatactacaaatctaattagtccagggattgactgtctacccattgtgtatggagatgatgtgattttatcat

SEQ ID NO: 272300 - DNA, 75 bp, Artificial Sequence
  Synthetic
tggacaaggaaatagaaccagagaagctgcaaagtatcatggcagattcattcggagctgaagtgactgggtcac

SEQ ID NO: 272301 - DNA, 75 bp, Artificial Sequence
  Synthetic
gcaaggacgaaccaccatcacttaaacctaggatggaagtagaattccttaagcggaagcctggttacttcccag

SEQ ID NO: 272302 - DNA, 75 bp, Artificial Sequence
  Synthetic
ttaatgtggatgaaaaatttcagcacattcaagcagcaactccaatcctacttaatggagttatgcctccatgga

SEQ ID NO: 272303 - DNA, 75 bp, Artificial Sequence
  Synthetic
aaagacatttaccaacactacatcaaaattttggatccatatctcaaagagtggaacattattgtggatgattat

SEQ ID NO: 272304 - DNA, 75 bp, Artificial Sequence
  Synthetic
taccccgacttgctgagctcctctaggagagcccctttcccagccttggggcggctggtcaataaaagcctcaaa

SEQ ID NO: 272305 - DNA, 75 bp, Artificial Sequence
  Synthetic
tgtaactaacatctaagatagattataaccaccctatgcctggtccccactagtcgaaagcacctggcaataaga

SEQ ID NO: 272306 - DNA, 75 bp, Artificial Sequence
  Synthetic
cgagtggaataaggacgcttaaagcatagtgttagcatacacttctaacttgtgattttcacaaggtggcagatg

SEQ ID NO: 272307 - DNA, 75 bp, Artificial Sequence
  Synthetic
cttattggaaacaacaatttgctgcaaagcatcctactgccagtggactaacacctggtaacaggtgcccctggg

SEQ ID NO: 272308 - DNA, 75 bp, Artificial Sequence
  Synthetic
gccaaaagccaaggtttaacagaccctttaggattggtatatacctgagttgttgtggaaaatacttagtaccta

SEQ ID NO: 272309 - DNA, 75 bp, Artificial Sequence
  Synthetic
ctttaggattggtatatacctgagttgttgtggaaaatacttagtacctactgatttggtagccggacaaacact

SEQ ID NO: 272310 - DNA, 75 bp, Artificial Sequence
  Synthetic
gaccacccctatccaggtgggtcgattaaaaaacgtctagtgggccaaacccaggggggatccctggtttccttt

SEQ ID NO: 272311 - DNA, 75 bp, Artificial Sequence
  Synthetic
tattttatcacagtcactatggagacaatcaagaatattgcagacatggcgactggtgttgtcagctctgttgac

SEQ ID NO: 272312 - DNA, 75 bp, Artificial Sequence
  Synthetic
tcaaccatcaatgctgttaatgagaaagttgaaaatattggcaatgaggttggtgggaatttgttgaccaaagtt

SEQ ID NO: 272313 - DNA, 75 bp, Artificial Sequence
  Synthetic
gcagatgatgcatccaacatattaggacccaattgttttgcaacaacagcagagcctgaaaacaaaaatgtagtg

SEQ ID NO: 272314 - DNA, 75 bp, Artificial Sequence
  Synthetic
caggccaccacaaccgttaacactacaaatttgactcaacacccatctgccccaacaatgcctttttcaccagat

SEQ ID NO: 272315 - DNA, 75 bp, Artificial Sequence
  Synthetic
ttttcgaacgtagacaatttccactcgatggcttatgacatcactacaggtgacaagaaccctagtaaattggta

SEQ ID NO: 272316 - DNA, 75 bp, Artificial Sequence
  Synthetic
cgacttgaaactcacgagtggacaccatcatgggcaagaggacatcaaatcacacatgtggaattacccagagtg

SEQ ID NO: 272317 - DNA, 75 bp, Artificial Sequence
  Synthetic
ttttgggacaatcaggaaaaacctgcatatggacaatcccgctatttcgcggctgtcagatgtggttttcatttc

SEQ ID NO: 272318 - DNA, 75 bp, Artificial Sequence
  Synthetic
caagtacaagttaatgtaaaccagggtacagctggtagtgctttagttgtatatgagcccaagccagttgtgacc

SEQ ID NO: 272319 - DNA, 75 bp, Artificial Sequence
  Synthetic
tatgattctaaattggaatttggggccttcaccaatctcccacatgttttgatgaacttggctgaaactacacag

SEQ ID NO: 272320 - DNA, 75 bp, Artificial Sequence
  Synthetic
ctgacacaaactatgttaaaacagattcgtcagacttagggcaactaaagggctatgtttggacacctttgtcca

SEQ ID NO: 272321 - DNA, 75 bp, Artificial Sequence
  Synthetic
taccctcaggttctgctacacaagttgatgtaactatactgggtagtttattgcaactggactttcaaaatccta

SEQ ID NO: 272322 - DNA, 75 bp, Artificial Sequence
  Synthetic
ttgcaactggactttcaaaatcctagggtatttggccaggatgttggtatttatgacaatgcaccaacgcggaag

SEQ ID NO: 272323 - DNA, 75 bp, Artificial Sequence
  Synthetic
ttatgacaatgcaccaacgcggaagcaaaatcttaaaaagattctcacaatgagcactaaatacaagtggactag

SEQ ID NO: 272324 - DNA, 75 bp, Artificial Sequence
  Synthetic
ccaggttctatgaacatggcaaatgtattaagtaccacagcagcacaatcaattgctttggttggagaaagagca

SEQ ID NO: 272325 - DNA, 75 bp, Artificial Sequence
  Synthetic
atgagtgactctaccaccccttcagccaatcatggtattgatgcaaagggttacttcaagtggtcagccacaact

SEQ ID NO: 272326 - DNA, 75 bp, Artificial Sequence
  Synthetic
gcaccacagtcagtggtgcataggaatattgtttacttgaaattgtttcctaatttgaatgtttttgtcaatagc

SEQ ID NO: 272327 - DNA, 75 bp, Artificial Sequence
  Synthetic
tactcatattttagaggctcaatagtgctgaggttgagtgtatatgccagtactttcaatagaggccgtctacgg

SEQ ID NO: 272328 - DNA, 75 bp, Artificial Sequence
  Synthetic
atgggtttctttccaaatgccaccgaagatagtacttcagaaatagataatgccatatacacaatttgtgactta

SEQ ID NO: 272329 - DNA, 75 bp, Artificial Sequence
  Synthetic
ggcagtgataacagttttgaaattactattccgtactcattttccacctggatgcggaaaacagatggccacgca

SEQ ID NO: 272330 - DNA, 75 bp, Artificial Sequence
  Synthetic
attggattatttcaaattgaagtgcttaacaggctaacctacaatagctccagtcctaatgaagtttattgtatt

SEQ ID NO: 272331 - DNA, 75 bp, Artificial Sequence
  Synthetic
gtgcaaggtaaaatgggacaagatgctaggttcttctgtccaactggttctgtagtgactttccaaaattcatgg

SEQ ID NO: 272332 - DNA, 75 bp, Artificial Sequence
  Synthetic
tgtagtgactttccaaaattcatggggttcacaaatggatctgactgacccattatgtctagaggaatccgcaga

SEQ ID NO: 272333 - DNA, 75 bp, Artificial Sequence
  Synthetic
ggttcacaaatggatctgactgacccattatgtctagaggaatccgcagaggagtgtaaacagaccatatcacca

SEQ ID NO: 272334 - DNA, 75 bp, Artificial Sequence
  Synthetic
aatgaattgggcttaacatcggctcaagacgacggaccattgggtgataataagccaaattatttcctaaatttc

SEQ ID NO: 272335 - DNA, 75 bp, Artificial Sequence
  Synthetic
aagtccatgaacgtggacatcttcactgtctcacacaccaaagtagacaacctatttggaagagcttggttttac

SEQ ID NO: 272336 - DNA, 75 bp, Artificial Sequence
  Synthetic
caggaacacaccttcactgatgaaggacagtggagggttaacttagagttcccaaaacaaggccatggttcactt

SEQ ID NO: 272337 - DNA, 75 bp, Artificial Sequence
  Synthetic
tccctgttatttgcttatttcacaggtgaattaaatatccatgttttgttcttggctgaaaagggattccttaga

SEQ ID NO: 272338 - DNA, 75 bp, Artificial Sequence
  Synthetic
gtagctcacacctatgacacatcagaaaacagggttaatttcctatcatcaaatggcgtcattacaatcccagca

SEQ ID NO: 272339 - DNA, 75 bp, Artificial Sequence
  Synthetic
ggagaacaaatgacactatctgcaccttactactcaaataagcctctcagaacagttagggacagcaatagtctt

SEQ ID NO: 272340 - DNA, 75 bp, Artificial Sequence
  Synthetic
cttactactcaaataagcctctcagaacagttagggacagcaatagtcttggatacctaatgtgtaaaccattcc

SEQ ID NO: 272341 - DNA, 75 bp, Artificial Sequence
  Synthetic
ccaaacttcttcttccctctccccgcacctaaggttacaactagccgtgccttgcggggtgatttggcaaatttt

SEQ ID NO: 272342 - DNA, 75 bp, Artificial Sequence
  Synthetic
tcagaccagagtccatatgaccaacaaccacagagtcaagtcatgaaactagcctatttagataggggcttttac

SEQ ID NO: 272343 - DNA, 75 bp, Artificial Sequence
  Synthetic
gggaaagctaggttcactaggacaaaattaacaccagactgggtcattgaggaggaatgtgaactggattacttc

SEQ ID NO: 272344 - DNA, 75 bp, Artificial Sequence
  Synthetic
agggtgaagtaccttgaaccatccgttaactcggagcatatcttctcagtagaccacaattgtgagactattgcc

SEQ ID NO: 272345 - DNA, 75 bp, Artificial Sequence
  Synthetic
aaggacatctttggcacccatacccttagtcaacaccaggctattggtctaataggcacaattcttctaactgct

SEQ ID NO: 272346 - DNA, 75 bp, Artificial Sequence
  Synthetic
ggtctgatgtcaaccattaaaacaccagtcaatgctacaaccattaaggagttcttcaaccatgcagtggaaggt

SEQ ID NO: 272347 - DNA, 75 bp, Artificial Sequence
  Synthetic
cagtcaatgctacaaccattaaggagttcttcaaccatgcagtggaaggtgatgaacagggattatccttacttg

SEQ ID NO: 272348 - DNA, 75 bp, Artificial Sequence
  Synthetic
ttcagcagccacagaaatattagataatgacttggttaaatttatagtgaaaatacttgtcagaattctctgtta

SEQ ID NO: 272349 - DNA, 75 bp, Artificial Sequence
  Synthetic
catggtgttatattgtcacaaaccaaatattctgaccactgcttgtctgtctacactgttaataatggatgtcac

SEQ ID NO: 272350 - DNA, 75 bp, Artificial Sequence
  Synthetic
aatattctgaccactgcttgtctgtctacactgttaataatggatgtcacatcctcatcagtgttgtcgccttct

SEQ ID NO: 272351 - DNA, 75 bp, Artificial Sequence
  Synthetic
agaagtagtggctgaatccatgtctaatacagatgatgaagaaattaaagaacagatttgtgacacagtgaaata

SEQ ID NO: 272352 - DNA, 75 bp, Artificial Sequence
  Synthetic
tactaaaagtattttatcaaaccagggaccttttaagggtttcaatgaagtgtcaacagcattcaggcacatcga

SEQ ID NO: 272353 - DNA, 75 bp, Artificial Sequence
  Synthetic
ggaccttttaagggtttcaatgaagtgtcaacagcattcaggcacatcgattggtggatacacactctactgaaa

SEQ ID NO: 272354 - DNA, 75 bp, Artificial Sequence
  Synthetic
ataaaagatatggttctgagtgtattcaaacccagtatggaaagcaaagctatccagtggttagagagaaataag

SEQ ID NO: 272355 - DNA, 75 bp, Artificial Sequence
  Synthetic
gagcatgtttgtgctattttggattacgcctctgatattattgtggaatcaaaagaccagacaaaaatgaaatca

SEQ ID NO: 272356 - DNA, 75 bp, Artificial Sequence
  Synthetic
ggtggggtgggtacactcctcgctcaatgagtgggggtgtggctcattgcccacacctggttggttcccaggttc

SEQ ID NO: 272357 - DNA, 75 bp, Artificial Sequence
  Synthetic
atacaataaccatcaataaacttctcaacatctaagctactactatcccacactaaactggacgaagccgcttgg

SEQ ID NO: 272358 - DNA, 75 bp, Artificial Sequence
  Synthetic
aataagtctagtttcattctgtgtgtgttttgcactgaaattatttctgtctctggggtgctttacacttcagta

SEQ ID NO: 272359 - DNA, 75 bp, Artificial Sequence
  Synthetic
ggggctgtacccgggcggtcccactcttcacaggaatctgcacaggtggctttcacctctggacagtgcattcca

SEQ ID NO: 272360 - DNA, 75 bp, Artificial Sequence
  Synthetic
cacccgctccacagtagaagatgatgtgtgtctttgcttgtgaaaagcttgtgaaaatcgtgtgtaggcgtagcg

SEQ ID NO: 272361 - DNA, 75 bp, Artificial Sequence
  Synthetic
gtgtgtctttgcttgtgaaaagcttgtgaaaatcgtgtgtaggcgtagcggctacttgagtgccagcggactacc

SEQ ID NO: 272362 - DNA, 75 bp, Artificial Sequence
  Synthetic
cctagtggtaacactagcctctgggcccaaaaggcatgtcaattgaccactcaggtacacaaccccagtgatgca

SEQ ID NO: 272363 - DNA, 75 bp, Artificial Sequence
  Synthetic
tcaggtacacaaccccagtgatgcacacgtctagtaacggcttagtaacgagcattgattgatcatttgaaaact

SEQ ID NO: 272364 - DNA, 75 bp, Artificial Sequence
  Synthetic
gctaggaggtttaggtatgacgggctgaaggatgccctgaaggtacccataggtaaccttaagcgactatggatc

SEQ ID NO: 272365 - DNA, 75 bp, Artificial Sequence
  Synthetic
tgaaggatgccctgaaggtacccataggtaaccttaagcgactatggatctgatcaggggcccaccatgtactac

SEQ ID NO: 272366 - DNA, 75 bp, Artificial Sequence
  Synthetic
atgggtagaagtcttcggaccttgggttaaaaaacgtctaggcccgccccccacagggatgtggggtttccctta

SEQ ID NO: 272367 - DNA, 75 bp, Artificial Sequence
  Synthetic
ccacagggatgtggggtttcccttataaccccaatattgtataatggctgcatccaaaatgaatcccgttggcaa

SEQ ID NO: 272368 - DNA, 75 bp, Artificial Sequence
  Synthetic
cctgctttccacagtctcctcaaccgttggatctcttctacaaaacccctctgttgaagaaaaggaaatggattc

SEQ ID NO: 272369 - DNA, 75 bp, Artificial Sequence
  Synthetic
tgaccgtgttgctgcctccaccacgaccaatgctggtaatttggtgcaagcttctgtggctccaaccatgcctgt

SEQ ID NO: 272370 - DNA, 75 bp, Artificial Sequence
  Synthetic
aaaaccagactttaagaacacagatgacttcttgtccatgagctaccgctcaacaacggccccaaccaacccgac

SEQ ID NO: 272371 - DNA, 75 bp, Artificial Sequence
  Synthetic
aaaaatggttcacttagcgcatggaacttggacaactaatcagcacagacaggcattggttgcatcaattaccct

SEQ ID NO: 272372 - DNA, 75 bp, Artificial Sequence
  Synthetic
accacaggcattctggcccaatcaagattttccagcatgggggcaatctcgctattttgcagcagtgcgctgtgg

SEQ ID NO: 272373 - DNA, 75 bp, Artificial Sequence
  Synthetic
ctttcatatacaagtgcagttgaatgttaacattggttctgccggctgcttgattgccgcatacatgccaaagac

SEQ ID NO: 272374 - DNA, 75 bp, Artificial Sequence
  Synthetic
ggcccatgatcatatgggtacctatacttttggctcctacaccaacctgccacatgttttgatgaatgcagcaac

SEQ ID NO: 272375 - DNA, 75 bp, Artificial Sequence
  Synthetic
gacatctcaggctgatctctatataccctatgtttttaatcacaattatgcacgaactgattcagatgacttagg

SEQ ID NO: 272376 - DNA, 75 bp, Artificial Sequence
  Synthetic
aggtatttacatttgggtatggtcagctctcacagttccatcaggttcacctactacagtggatgtcaccatttt

SEQ ID NO: 272377 - DNA, 75 bp, Artificial Sequence
  Synthetic
tggttcattactcgacttagattttcaatgtcctcgtccccctggagcagccacagtaatctacacacaagggaa

SEQ ID NO: 272378 - DNA, 75 bp, Artificial Sequence
  Synthetic
aagaactgttcgaaagaccaaaacatcaaagtttaaatgggtcaggaataaaattgacatagctgaaggcccagg

SEQ ID NO: 272379 - DNA, 75 bp, Artificial Sequence
  Synthetic
tcaaagtttaaatgggtcaggaataaaattgacatagctgaaggcccaggagcaatgaacattgctaatgttctc

SEQ ID NO: 272380 - DNA, 75 bp, Artificial Sequence
  Synthetic
tccacaactggcggtcaaactattgccttggttggtgaaagagcattctatgacccaagaacagctggtgctgca

SEQ ID NO: 272381 - DNA, 75 bp, Artificial Sequence
  Synthetic
gtaaggtgcaaagatctcatggagatcgccagaatgccgagtgtgttcttgggagagagcactgaaccagatggt

SEQ ID NO: 272382 - DNA, 75 bp, Artificial Sequence
  Synthetic
cgaagaggctattttacctggtcacatacaatctcacctgttaattgggtctttgatgatcatatttatttagaa

SEQ ID NO: 272383 - DNA, 75 bp, Artificial Sequence
  Synthetic
aatatgcccaatttgagattgttttcctcttgttataattattggagagggtcttttgttattaaattaacagtc

SEQ ID NO: 272384 - DNA, 75 bp, Artificial Sequence
  Synthetic
tatgcatcaactttcaacaaaggacgcttgaggatggcattcttcccaaacagagagggcgcctacacacaggat

SEQ ID NO: 272385 - DNA, 75 bp, Artificial Sequence
  Synthetic
gaagcccagaatgcaatctttgttgtctgtgatataggcctgaataacacttttgagatgaccatcccctacact

SEQ ID NO: 272386 - DNA, 75 bp, Artificial Sequence
  Synthetic
tggggcaattggatgaggccaacaagagggaattccttgggacatttgaggattgatgtgctgaatcgtctcaca

SEQ ID NO: 272387 - DNA, 75 bp, Artificial Sequence
  Synthetic
tacaacagttcctccccgaatgcagtcaactgcattcttcagatcaagatgggagatgatgcaatgtttatggtg

SEQ ID NO: 272388 - DNA, 75 bp, Artificial Sequence
  Synthetic
cccaccacatctaatctagtttggcaaggcctacattcctggggttcagaaatggacctggtggactcccttgac

SEQ ID NO: 272389 - DNA, 75 bp, Artificial Sequence
  Synthetic
aatccagaagagatacaggataatgaggaaatacaaactcagaatgtggaggcagcacaaggggaagaagctgca

SEQ ID NO: 272390 - DNA, 75 bp, Artificial Sequence
  Synthetic
acagaagttggacttagggctacagaaaatgatggtagtctttcagaacaactgaatatgagtcaacccatgttc

SEQ ID NO: 272391 - DNA, 75 bp, Artificial Sequence
  Synthetic
ttgaatttcaagaagcataaagttaacatctatgcagcatctcacactaaagttgatcatatttttggcagagct

SEQ ID NO: 272392 - DNA, 75 bp, Artificial Sequence
  Synthetic
tgggcagtaggagtttttaatacagaaacagctgccatacaaaaatttgatttgcattttccaacttctacccat

SEQ ID NO: 272393 - DNA, 75 bp, Artificial Sequence
  Synthetic
ggtgcattatctagatttttctgtttttggactggagaactgaacattcacatcttgaatgtgtcaaccacaaat

SEQ ID NO: 272394 - DNA, 75 bp, Artificial Sequence
  Synthetic
gcattcttgaaagttgctcacacatggtttggcactgattctggaattgctcggacagccactttggaatcaaat

SEQ ID NO: 272395 - DNA, 75 bp, Artificial Sequence
  Synthetic
ggaacaatgattataccaccaaatgagcaaatgacactctgtgtgccctattattctgaggtcccattaagatgt

SEQ ID NO: 272396 - DNA, 75 bp, Artificial Sequence
  Synthetic
gttaagggctcagacaggaattcagccggtcttggttctcttttcacacaagctgtaggcagaacaatttccaat

SEQ ID NO: 272397 - DNA, 75 bp, Artificial Sequence
  Synthetic
cgggttcaaatttttgtgagcttccgctgtcctaattttttcttcccactacccgcgcccagagaagccacgtcc

SEQ ID NO: 272398 - DNA, 75 bp, Artificial Sequence
  Synthetic
cgaagcatattggaacgagtggatgaagcgaatgcagaagaacttgaagctgttttggaagctagaacaccagat

SEQ ID NO: 272399 - DNA, 75 bp, Artificial Sequence
  Synthetic
gcgccgctccgcctcaaatttaatccagaagaccccttgaaacaattgcgggaagcggctaaggcctactttaat

SEQ ID NO: 272400 - DNA, 75 bp, Artificial Sequence
  Synthetic
ataatgcacagtgatgaaatggattttgccggggggaaatttttgaatcaatgtggtgatgtggaaactaaccca

SEQ ID NO: 272401 - DNA, 75 bp, Artificial Sequence
  Synthetic
ggccctgacattgagttggtctataaaaacagaggcttttataaacattatggggttagatttggtggctatatc

SEQ ID NO: 272402 - DNA, 75 bp, Artificial Sequence
  Synthetic
taccatttgaattcacaggatattctgtcaactgcaattacaggcaagtctgatttcattaaggaggaagatgat

SEQ ID NO: 272403 - DNA, 75 bp, Artificial Sequence
  Synthetic
ggcaaatgggttcatgctatgacggcaccactggattattttactgaaaagtacatcaattcaatggttggttcc

SEQ ID NO: 272404 - DNA, 75 bp, Artificial Sequence
  Synthetic
aaacatattttttccgccacctccaattgtgagaccattgccagagaccttttcccagggagaaaggaaataact

SEQ ID NO: 272405 - DNA, 75 bp, Artificial Sequence
  Synthetic
cagtccaaagccttgggaattattggggtcattttgttgtcagcctctcttctttccttgcttgctgtaccctgg

SEQ ID NO: 272406 - DNA, 75 bp, Artificial Sequence
  Synthetic
gattattcctcacttcaaactgtttataaccaatccattgaaggtgacgcttctggcctcacacttttaagtcaa

SEQ ID NO: 272407 - DNA, 75 bp, Artificial Sequence
  Synthetic
ttctggcctcacacttttaagtcaaagatgcatgacttttttttctaacacaatgtgtgaaacctttaataatga

SEQ ID NO: 272408 - DNA, 75 bp, Artificial Sequence
  Synthetic
tcttgttaagtttattattaagattttggtgcggcttttgtgctacatcgttctctattgccatgcaccaaatat

SEQ ID NO: 272409 - DNA, 75 bp, Artificial Sequence
  Synthetic
gctgacaactatgtgtctgggaactcttcttgttttggacattacaacttgtgaaatcttgtctgccaacaccaa

SEQ ID NO: 272410 - DNA, 75 bp, Artificial Sequence
  Synthetic
agcactctttcaggcattggtcgatggtgatgtgaagagtcttgtctggaaaattgctgaaaacatgcagtttgc

SEQ ID NO: 272411 - DNA, 75 bp, Artificial Sequence
  Synthetic
ccaatccaaagatgaacaagcagaggaaatggcggcaaccttcaactttgcttctgatatggttaattttgtgcc

SEQ ID NO: 272412 - DNA, 75 bp, Artificial Sequence
  Synthetic
aatggaacagatgagacaagaaggctggagagaatttaatgatgtttctatgtccttccggcatgtagaatggtg

SEQ ID NO: 272413 - DNA, 75 bp, Artificial Sequence
  Synthetic
gctgaccatgtttaaaaaagtgtataatggtctgaaaagtatttttgcacctagtattgaacagaaggctgttga

SEQ ID NO: 272414 - DNA, 75 bp, Artificial Sequence
  Synthetic
ttggatagatcgcaatcaagaatatattgccgatgttttggaccatgcttccaacatcattataaaaatgaagga

SEQ ID NO: 272415 - DNA, 75 bp, Artificial Sequence
  Synthetic
cccaaaagaacagcggaaagcattaaccattagtgaatactttgaagttttgaagcaattaaagccaattgtgtc

SEQ ID NO: 272416 - DNA, 75 bp, Artificial Sequence
  Synthetic
tctttgcatgaaggttgctccctccactaagttttcctctcaagtgtttagaatttattctgaaatgatgaaggt

SEQ ID NO: 272417 - DNA, 75 bp, Artificial Sequence
  Synthetic
taatgttagagtgcctgcaaatactgacttgaccagattggaacccattggcatttgggtttctagtgagccagg

SEQ ID NO: 272418 - DNA, 75 bp, Artificial Sequence
  Synthetic
acagggtaaatcattttttacacacatgttgagcacctgccttttaaaatcctgcaatttagagggaatttatac

SEQ ID NO: 272419 - DNA, 75 bp, Artificial Sequence
  Synthetic
caaccccactgggtcagaatttatggatggttatattggacaggacatccatattatagatgatgcagggcaaaa

SEQ ID NO: 272420 - DNA, 75 bp, Artificial Sequence
  Synthetic
cagggaggaaaaagatttagccttgttgtgccagtgtatttcctctgtgccttttaccgtcccaatggcagattt

SEQ ID NO: 272421 - DNA, 75 bp, Artificial Sequence
  Synthetic
gacagagaagggcactttttacacaagtaaaattgtgattgctaccaccaataaatttgattttacatcaatggt

SEQ ID NO: 272422 - DNA, 75 bp, Artificial Sequence
  Synthetic
tttgacagatccagcagctcttgaaaggaggttcccgtttcatttgcgcattagagctgtagccagctactcgcg

SEQ ID NO: 272423 - DNA, 75 bp, Artificial Sequence
  Synthetic
caataataaattagatgtggcccgctcaatggcagccatggctgatggctcttgctgggaatactctacagatgg

SEQ ID NO: 272424 - DNA, 75 bp, Artificial Sequence
  Synthetic
tggtagggcttggaagactctgtccatggatgaacttgtgaaacagattacggcagtctatacacagagatcaga

SEQ ID NO: 272425 - DNA, 75 bp, Artificial Sequence
  Synthetic
tgcccttatggtttggaaaaggaagttaaacaccattaggaatgaaatgagtcctggatcctccaccggtaggat

SEQ ID NO: 272426 - DNA, 75 bp, Artificial Sequence
  Synthetic
ctttgaacccttggaggaaacactttgtgctctggaacgccgctttggtcaacttgctgatagccttaaagacaa

SEQ ID NO: 272427 - DNA, 75 bp, Artificial Sequence
  Synthetic
ttaccacaaaacagctgatgagctgattgaggctatagaagatatgatggcaccatcacagagcccttttgcatg

SEQ ID NO: 272428 - DNA, 75 bp, Artificial Sequence
  Synthetic
ctttgcagaatcctatcggcccaccattaaatacactgccagtgataaagttaaatcctgggtcaaaaatcatat

SEQ ID NO: 272429 - DNA, 75 bp, Artificial Sequence
  Synthetic
gaatagatggaaagagtttgtaatgagaaataaaggctggtttacacttttttctgtgctttcatcttttctttc

SEQ ID NO: 272430 - DNA, 75 bp, Artificial Sequence
  Synthetic
aattcttactcttgtttacttgcattataaaaaggaaaagaaagaggaagagagacaagagcgagcttacaaccc

SEQ ID NO: 272431 - DNA, 75 bp, Artificial Sequence
  Synthetic
tcaaaccgcaacttttaagaaggggggtaagcccaagctctcattggtgaaaaatacaaattttgttaatgaagc

SEQ ID NO: 272432 - DNA, 75 bp, Artificial Sequence
  Synthetic
accctatatgcaagatcttgaacactgttttgcacaaacagcctacatctcatcttcagagacccaggatataat

SEQ ID NO: 272433 - DNA, 75 bp, Artificial Sequence
  Synthetic
acattgtgctgctttgagtgaagacaccatcttggtttatggacactcccagttttattttaaccgctatgaaga

SEQ ID NO: 272434 - DNA, 75 bp, Artificial Sequence
  Synthetic
tctgcggttgcattttaaaggggccatttttcctatagaaggggggaaaatctctcaagttactgtgaatgggca

SEQ ID NO: 272435 - DNA, 75 bp, Artificial Sequence
  Synthetic
gcccatggatttaattcttgtgaaaatagataaacttccaataacatttaaaaattatacaaagtactatacaac

SEQ ID NO: 272436 - DNA, 75 bp, Artificial Sequence
  Synthetic
tgaggttggtaaggaaacactcttaatttggaattcagagaaaggcagattggctatgcctgttcaatgtgtagc

SEQ ID NO: 272437 - DNA, 75 bp, Artificial Sequence
  Synthetic
cccggctggtccggtggaaacaatggaaggaacagtcacccacaagacctattcatacaaggtggcatcaaaaaa

SEQ ID NO: 272438 - DNA, 75 bp, Artificial Sequence
  Synthetic
aggaatgtgtgggggtctcttggttactagagtgcacggcacatttaaggttttaggaatgcacattgctggcaa

SEQ ID NO: 272439 - DNA, 75 bp, Artificial Sequence
  Synthetic
tggacaagttgcacgagccgcagcagtccactttatatccaatggggctgctggctttatggatcagggtgttgt

SEQ ID NO: 272440 - DNA, 75 bp, Artificial Sequence
  Synthetic
tgtggccaaggaaaaattgcagaagcccatttatttgccatccaagacagccttgaatcctagtcccttgaatgg

SEQ ID NO: 272441 - DNA, 75 bp, Artificial Sequence
  Synthetic
agtagttcctgtgaaaatggagccagctgtgcttagtcctcatgataccaggcttgaagttgccatgcccagtgt

SEQ ID NO: 272442 - DNA, 75 bp, Artificial Sequence
  Synthetic
tgtgaaaacagcagcagccaagtatagagttaacattttcaaccctgactttgagatttgggagagagttgtgga

SEQ ID NO: 272443 - DNA, 75 bp, Artificial Sequence
  Synthetic
tgagctaaagtcaaggtttagatttaaacttgggattcataaacatgtttctttccaaaaagcagttcagggttt

SEQ ID NO: 272444 - DNA, 75 bp, Artificial Sequence
  Synthetic
ttcttctctttcatctcttgatctttccacttctccaggacaaaagtatgttgaaaaaggcatgaagaagagaga

SEQ ID NO: 272445 - DNA, 75 bp, Artificial Sequence
  Synthetic
tcttttatccactgaaccattttggatacatcctcaattggaaaatgatgttaaagatatacttggggctgttta

SEQ ID NO: 272446 - DNA, 75 bp, Artificial Sequence
  Synthetic
ttctggcaaaaaaccccatacattttttgctgcccatttgaaagatgaattgcgcaaaaaagaaaagattgcaca

SEQ ID NO: 272447 - DNA, 75 bp, Artificial Sequence
  Synthetic
aggcaagacccgctgcattgaagcctgctcaattgactatgtgattgcctatagagttgtaatgtcctctctcta

SEQ ID NO: 272448 - DNA, 75 bp, Artificial Sequence
  Synthetic
tgaggcaatctatcaaaccccagctcaggaattaggcttggcagtggggatgaatccctggacagactgggatcc

SEQ ID NO: 272449 - DNA, 75 bp, Artificial Sequence
  Synthetic
aatgattaatgttttgcaaccatataattatggtttggattattcatcttatgatggcagtctttctgagcagct

SEQ ID NO: 272450 - DNA, 75 bp, Artificial Sequence
  Synthetic
gatgaggtatggtgtggaaatacttgcctattgtcatgaacaaccagaggctgtgatgattcttcatgaaccagt

SEQ ID NO: 272451 - DNA, 75 bp, Artificial Sequence
  Synthetic
tataaactcacaacaccttgtgatggatgaaatttggcatgtaaatggaggaatgccctcaggagccccatgtac

SEQ ID NO: 272452 - DNA, 75 bp, Artificial Sequence
  Synthetic
aactgtgctaaattctatatgcaatctgctggtttgtacatatttggcttatgagcaaagtttggatattgaggt

SEQ ID NO: 272453 - DNA, 75 bp, Artificial Sequence
  Synthetic
gttgcccattgtttatggagatgatgtgattttttccgtttcctcccctttggatgctgaatatctggttcagag

SEQ ID NO: 272454 - DNA, 75 bp, Artificial Sequence
  Synthetic
tgcagccagaaattttgggatggaagtgacctcatcagataaatctggtcccccaagacttttgaaaatggatga

SEQ ID NO: 272455 - DNA, 75 bp, Artificial Sequence
  Synthetic
gattgaatttttaaagaggacaacaaaattttttcctggctccacctataaggtgggggccttgagcctggatac

SEQ ID NO: 272456 - DNA, 75 bp, Artificial Sequence
  Synthetic
catggaacaacatattatgtggatgaagaatttggaaacctttccagaacaacttgttagctttgaaaatgagtt

SEQ ID NO: 272457 - DNA, 75 bp, Artificial Sequence
  Synthetic
ggtgttgcatgggaaagaaatttatgatgattataaaagtaggtttaatcctattttgaatcaatggcgagtgtg

SEQ ID NO: 272458 - DNA, 75 bp, Artificial Sequence
  Synthetic
catgcaggactatgaagtggccctgcatcgcatgctacgctatgtttttgattaaattgatttaatttgattttg

SEQ ID NO: 272459 - DNA, 75 bp, Artificial Sequence
  Synthetic
attttgttagttttagtttaagtaagttagaattagattattttaatttagctttaaagattttgatttgattga

SEQ ID NO: 272460 - DNA, 75 bp, Artificial Sequence
  Synthetic
tttaagtaagttagaattagattattttaatttagctttaaagattttgatttgattgaatttggcccaccaatc

SEQ ID NO: 272461 - DNA, 75 bp, Artificial Sequence
  Synthetic
ggtggggtgggtacgtctctcgctcattgagtgggggcgtggctcaccaaccacacctggttggtccccaggttc

SEQ ID NO: 272462 - DNA, 75 bp, Artificial Sequence
  Synthetic
atgcaataaccactttttgtaatctttacatctaagcttaattcacccactagaactggacgaaaccgcttggaa

SEQ ID NO: 272463 - DNA, 75 bp, Artificial Sequence
  Synthetic
taagtttggttctctcttgagtgtgttttgtgttagcataatttctgtctctagagtgctttacactctagtagg

SEQ ID NO: 272464 - DNA, 75 bp, Artificial Sequence
  Synthetic
ggctgtacccgggcggtcccactcttcacaggaatctgcacaggtggctttcacctctggacagtgcattccata

SEQ ID NO: 272465 - DNA, 75 bp, Artificial Sequence
  Synthetic
cccgctccacaatagaagatgatgtatatctttgtttgtgaaatgctcatgaaacgtgtgtgtaggcgtagcggc

SEQ ID NO: 272466 - DNA, 75 bp, Artificial Sequence
  Synthetic
tacttgaatgccagcggaacccccctagtggtaacactagcctctgggcccaaaaggcatgtctctgaccattca

SEQ ID NO: 272467 - DNA, 75 bp, Artificial Sequence
  Synthetic
agtacacaaccccagtgatacacacatttagtaatggctcagtaatggacattgattgatcatcagacaattgtt

SEQ ID NO: 272468 - DNA, 75 bp, Artificial Sequence
  Synthetic
aggaggcctaggtatgacgggctgaaggatgccctggaggtacccgcaggtaaccttaagagactgtggatctga

SEQ ID NO: 272469 - DNA, 75 bp, Artificial Sequence
  Synthetic
aggatgccctggaggtacccgcaggtaaccttaagagactgtggatctgaccaggggcccaccatggaaacatgg

SEQ ID NO: 272470 - DNA, 75 bp, Artificial Sequence
  Synthetic
gtagaagtcttcggaccttgggttaaaaaacgtctaggcccgccccccacagggatgtggggtttcccttataac

SEQ ID NO: 272471 - DNA, 75 bp, Artificial Sequence
  Synthetic
cccaatatcacattatggctgcaaccaagatgaatcccgttgagaatcttctttctactgtctcctccaccgttg

SEQ ID NO: 272472 - DNA, 75 bp, Artificial Sequence
  Synthetic
gctcactgctacaaaatcccaccatggaagaaaaggaaatggactcagatcgtgttgcggcatccaccactacta

SEQ ID NO: 272473 - DNA, 75 bp, Artificial Sequence
  Synthetic
acgctggaaatgtagttcaggcttcagttgcccccaccatgccaattaaaccagatttcaagaacacggataact

SEQ ID NO: 272474 - DNA, 75 bp, Artificial Sequence
  Synthetic
ttttgtcaatgagttatagcccaaatactgcacctacaaatccaacaaaaatggtacatttggctaatggaacat

SEQ ID NO: 272475 - DNA, 75 bp, Artificial Sequence
  Synthetic
ggactacatcgcagcatcgacagtctttggttgcatcgattcagctaccacaggcattttggcccaatgaacgct

SEQ ID NO: 272476 - DNA, 75 bp, Artificial Sequence
  Synthetic
atccggcttggggtcaatcacgctattttgctgcagtccgatgtggctttcatattcaggttcaattgaatgtta

SEQ ID NO: 272477 - DNA, 75 bp, Artificial Sequence
  Synthetic
acattggctcagcaggttgtttgatagctgcctatatgcccaaaagtgcacatgatcatatggatacatatacat

SEQ ID NO: 272478 - DNA, 75 bp, Artificial Sequence
  Synthetic
ttagttcctacaccaatttgcctcatgttctgatgaatgctgccaccacgtctcaggctgatttgtatataccct

SEQ ID NO: 272479 - DNA, 75 bp, Artificial Sequence
  Synthetic
atgtgcataatcataattatgcaaagacagattcagatgacttgggtggtatatacatttggtgttggtctgccc

SEQ ID NO: 272480 - DNA, 75 bp, Artificial Sequence
  Synthetic
tcacagttccatcaggttctccgacaactgttgatgtcacaatttttggctccttgcttgacttggacttccagt

SEQ ID NO: 272481 - DNA, 75 bp, Artificial Sequence
  Synthetic
gccctagaccaccaggtgctaatactgtcatatttacacaaggcaaaagaactgccaggaaaaccaaagcaacaa

SEQ ID NO: 272482 - DNA, 75 bp, Artificial Sequence
  Synthetic
aatttaaatggacaaggaataaaatagacattgctgaaggtcctggcgctcttaatattgccaatgtcttgtcta

SEQ ID NO: 272483 - DNA, 75 bp, Artificial Sequence
  Synthetic
ctacagggggccaaactgttgccctcgttggggaaagagctttctacgatcccagaactgcaggagccgctgtgc

SEQ ID NO: 272484 - DNA, 75 bp, Artificial Sequence
  Synthetic
ggtgtaaggatttgatggaaattgccagaatgccatcagtctataagggggagagaactgaacctggaggaacta

SEQ ID NO: 272485 - DNA, 75 bp, Artificial Sequence
  Synthetic
atggctattttcaatggtctcatacgcactcccctataaattgggtttttgacgggggaattcatttggaagaca

SEQ ID NO: 272486 - DNA, 75 bp, Artificial Sequence
  Synthetic
tgcccaatctaaatttgttttcctcatgctataactattggagaggctcaattgttttgaaactcactgtgtatg

SEQ ID NO: 272487 - DNA, 75 bp, Artificial Sequence
  Synthetic
catcaacctttaacaagggtagattgagaatggccttcttcccaaatcatgatgcaaggtacacagaggaagaag

SEQ ID NO: 272488 - DNA, 75 bp, Artificial Sequence
  Synthetic
cacaaaatgccatcttcatggtgtgtgatattgggctcaacaacacttttgaaatgaccatcccatacacctggg

SEQ ID NO: 272489 - DNA, 75 bp, Artificial Sequence
  Synthetic
gaaactggatgagaccaactaggggatctgtcattggatggcttaggattgatgttttgaatcgcctcacttata

SEQ ID NO: 272490 - DNA, 75 bp, Artificial Sequence
  Synthetic
acagttcctcacccaatgctgttaattgcattcttcaggttaaaatggggaatgatgccaaatttatggtaccca

SEQ ID NO: 272491 - DNA, 75 bp, Artificial Sequence
  Synthetic
ccacatctaacattgtgtgggaaggtctccactcatgggggtctgagatggacttactggacagtttggataatc

SEQ ID NO: 272492 - DNA, 75 bp, Artificial Sequence
  Synthetic
cagaagagattcaagatatggaggaaccagaatctgaaaatgtggaggccgcacaaggagaggaagccgccactg

SEQ ID NO: 272493 - DNA, 75 bp, Artificial Sequence
  Synthetic
ccgttggccttcgagccaccgaaaatgatggatccctatctgaacaacaaaacatggcacaaccaatgtttttga

SEQ ID NO: 272494 - DNA, 75 bp, Artificial Sequence
  Synthetic
attttaagcaacatagagtggacatttactctgcttcccacaccaaagttgaccatatttttggtagggcgtggg

SEQ ID NO: 272495 - DNA, 75 bp, Artificial Sequence
  Synthetic
cagtgggaatttttaatgtgactaatgctaatatatccaaatttgaccttaactttcccacaaccacacatggtg

SEQ ID NO: 272496 - DNA, 75 bp, Artificial Sequence
  Synthetic
cattgtgtcgcttcttctgtttctggacgggagagcttaacttgcatattttgaacatttcttcttccaatgctc

SEQ ID NO: 272497 - DNA, 75 bp, Artificial Sequence
  Synthetic
cagtcaaagttgctcacacatggtttggcacagattcaggcattgccaggactgcaactttggaatcaaacgggg

SEQ ID NO: 272498 - DNA, 75 bp, Artificial Sequence
  Synthetic
ttatcatcataccaccaaatgagcaaatgacactctgcataccctattattctgaggcaccattgcgctgtgtta

SEQ ID NO: 272499 - DNA, 75 bp, Artificial Sequence
  Synthetic
aggggccacattcagctggtgctggattgggctcaattttcacacagtgtattggcaacagcgttaataacagga

SEQ ID NO: 272500 - DNA, 75 bp, Artificial Sequence
  Synthetic
ttcaaatttttgttagttttcgctgcccaaacttcttttttccccttcctgcaccccatgaggcttcttcaaggt

SEQ ID NO: 272501 - DNA, 75 bp, Artificial Sequence
  Synthetic
caattttgcagagaatttccactgctagcgcagatgagttagaagctgtcttggacgcaaaaacacctgatgctc

SEQ ID NO: 272502 - DNA, 75 bp, Artificial Sequence
  Synthetic
ctgtgcgcttgtgctaccaaccagaggatcctttgagacaacttagggaggcagctaaggcatatttcaatatta

SEQ ID NO: 272503 - DNA, 75 bp, Artificial Sequence
  Synthetic
tgcacaatgatgagatggactattctggaggtaaattcttgaatcagtgtggtgatgtggagtccaatccaggtc

SEQ ID NO: 272504 - DNA, 75 bp, Artificial Sequence
  Synthetic
ctgatattgaattagtctataagaacagaggcttttataaacattatggggttaggtttggtggctttatttacc

SEQ ID NO: 272505 - DNA, 75 bp, Artificial Sequence
  Synthetic
atcttaattcacaagacattttgtcgacagccatcactggaaaatcagacttcataaaagaggaagatgatggta

SEQ ID NO: 272506 - DNA, 75 bp, Artificial Sequence
  Synthetic
aatggacacatgctatgactgcacccctggattattttactgagaagtatgtgaaatcaatggttggttcaaaac

SEQ ID NO: 272507 - DNA, 75 bp, Artificial Sequence
  Synthetic
acattttttccgccacatcaaattgtgaaaccattgccagggatttgtttccaggaaagaaggagattagtcaat

SEQ ID NO: 272508 - DNA, 75 bp, Artificial Sequence
  Synthetic
ctaaagctttgggtattattggtgtgatccttctttctgcatctcttttatccctacttgccgttccatgggatt

SEQ ID NO: 272509 - DNA, 75 bp, Artificial Sequence
  Synthetic
attcctcacttcagacagtttataatcaatcaattgaaggggatgcttcaggcttaacacttttgagccagagat

SEQ ID NO: 272510 - DNA, 75 bp, Artificial Sequence
  Synthetic
gcatgacttttttttccaataccatgtgtgaaacttttaataatgatcttgtgaagtttataattaagattttag

SEQ ID NO: 272511 - DNA, 75 bp, Artificial Sequence
  Synthetic
ttaggcttctttgctatattgttctttattgtcatgcccctaatatgcttacaacaatgtgtttaggcacccttt

SEQ ID NO: 272512 - DNA, 75 bp, Artificial Sequence
  Synthetic
tggttttggatattaccacatgtgagattttatcagccaatacaaaggccctgtttcaagctcttcttgatggag

SEQ ID NO: 272513 - DNA, 75 bp, Artificial Sequence
  Synthetic
acgtcaagaatttggtttggaagattgcagagaacatgcagtttgcccagtctacagatgagcaggcagaggaaa

SEQ ID NO: 272514 - DNA, 75 bp, Artificial Sequence
  Synthetic
tggctgccaccttttcatttgccaaagacatggttgacattcatccaattggggctgagccatttcaaaaccaag

SEQ ID NO: 272515 - DNA, 75 bp, Artificial Sequence
  Synthetic
gctttagggagtttaatgatgtgtcaatgtcctttcgccacattgaatggtggcttacaatgtttaagaaagttt

SEQ ID NO: 272516 - DNA, 75 bp, Artificial Sequence
  Synthetic
acaatgttcttaagggcattttctctccatccattgagcagaaagcggtggcgtggttggatcgcaaccaagaat

SEQ ID NO: 272517 - DNA, 75 bp, Artificial Sequence
  Synthetic
atgttgcatcaatcttagatcattgctctgacatgattatccgcatgaaagacccaaaacaacagcggaacccca

SEQ ID NO: 272518 - DNA, 75 bp, Artificial Sequence
  Synthetic
agaccattgaagaatattttgatgtgttaaagaaaatgaagcccttggtgtcactctgcattaaagttgccccgt

SEQ ID NO: 272519 - DNA, 75 bp, Artificial Sequence
  Synthetic
caacaaagttttcatcccaagtgtttaggttgtattcagagctaatgaaggttaatgttagagtgccggttaaca

SEQ ID NO: 272520 - DNA, 75 bp, Artificial Sequence
  Synthetic
cagatctcacacgcattgagccaattggtgtgtggatctccagtgagccaggtcagggaaaatctttctttactc

SEQ ID NO: 272521 - DNA, 75 bp, Artificial Sequence
  Synthetic
acatgcttagcacttcacttttgaaaagttgtaatttggatggggtgtataccaatgccacaggctctgagttta

SEQ ID NO: 272522 - DNA, 75 bp, Artificial Sequence
  Synthetic
tggatggatatgttggtcaagatatacacattattgatgatgcaggacaaaatcgggaagagaaggatttggctc

SEQ ID NO: 272523 - DNA, 75 bp, Artificial Sequence
  Synthetic
tgctgtgccagtgcatctcatctgtgccatttactgtacctatggctgatctaacagagaaagggacattttata

SEQ ID NO: 272524 - DNA, 75 bp, Artificial Sequence
  Synthetic
ccagcaagattgttattgccacaaccaacaagagtgatttcaattgcatggttttgacagatccagctgctctag

SEQ ID NO: 272525 - DNA, 75 bp, Artificial Sequence
  Synthetic
agaggcgtttcccatttaatttgagaattagggcagttaaaagttttatgaataaggacagaaagttggatgtgc

SEQ ID NO: 272526 - DNA, 75 bp, Artificial Sequence
  Synthetic
caagatcaatgggagccatggcagatggatcctgctgggagtgctctatggactatggcagaacctggaacaccg

SEQ ID NO: 272527 - DNA, 75 bp, Artificial Sequence
  Synthetic
tggtgatgagagatcttgtgaaacaaataacagaaatgtataaacaaagagatgatgccctgactgtttggaagt

SEQ ID NO: 272528 - DNA, 75 bp, Artificial Sequence
  Synthetic
ataagttaaatcagattaggaatgagatgtcccctggtgactcaattggccgcattctcgatccaatggaggaga

SEQ ID NO: 272529 - DNA, 75 bp, Artificial Sequence
  Synthetic
cgcattctcgatccaatggaggagacactctgttcattggagcgcaggtttggccagttggcagatagtcttaga

SEQ ID NO: 272530 - DNA, 75 bp, Artificial Sequence
  Synthetic
gaaaattaccataggacagctgatgaactaattgaagttatagaagacatgatggcaccagggaatagtcccttt

SEQ ID NO: 272531 - DNA, 75 bp, Artificial Sequence
  Synthetic
gcatgcttcgaaagtgtagcaccatcacttaaaccaagaacagcttgtcaaaaagttaaagattgggtaaaacaa

SEQ ID NO: 272532 - DNA, 75 bp, Artificial Sequence
  Synthetic
cacatgattagatggggcaactttgtgatgaggaataaaggctggtttacacttttttctgtactttcatctttt

SEQ ID NO: 272533 - DNA, 75 bp, Artificial Sequence
  Synthetic
ctttcaattcttactcttgtttatttacattataaaaaagagaaaaaagaggaagaaagacaagagcgggcttac

SEQ ID NO: 272534 - DNA, 75 bp, Artificial Sequence
  Synthetic
aaccctcaaactgcaactcccaagaaggggggtaagccaaagctctctttggtaaaaactacaaattttataaat

SEQ ID NO: 272535 - DNA, 75 bp, Artificial Sequence
  Synthetic
gaggcaccatatatgcaggatttggaacactgctttgcccaaacagcctacatttcatccccagagactcaggat

SEQ ID NO: 272536 - DNA, 75 bp, Artificial Sequence
  Synthetic
ataattcattgtgctgccttgtgtgaggataccattttggtttatggacattcacaattttattttaaccgctat

SEQ ID NO: 272537 - DNA, 75 bp, Artificial Sequence
  Synthetic
gaagatttgcggttacattttaaaggagccatttttcctattgagggtggaaaaatttcacaagttactgtgaat

SEQ ID NO: 272538 - DNA, 75 bp, Artificial Sequence
  Synthetic
gggcagccgatggatttgattcttgttaaaatagacaaacttcccataacctttaaaaattataccaaatattac

SEQ ID NO: 272539 - DNA, 75 bp, Artificial Sequence
  Synthetic
acaactgaaattgggaaggaaactcttttaatttggaattctgagaaagggagactggctatgccagtccaatgt

SEQ ID NO: 272540 - DNA, 75 bp, Artificial Sequence
  Synthetic
gttgccccggctggaccggtggaaacaatggaaggcaccatcactcataaaacctattcctacaaagtggcatca

SEQ ID NO: 272541 - DNA, 75 bp, Artificial Sequence
  Synthetic
aagaaaggcatgtgcggtggactcctagttactagagtgaatggaacatttaaggttttggggatgcacattgct

SEQ ID NO: 272542 - DNA, 75 bp, Artificial Sequence
  Synthetic
gggaacggacaggttgcgcgggccgcagcagttcacttcatttcaaatggggctagtggttttatggatcagggg

SEQ ID NO: 272543 - DNA, 75 bp, Artificial Sequence
  Synthetic
gttgtggttgcaaaagagaagatgcagaaaccaatttatttgccatctaaaacagcactaaatcctagccctttg

SEQ ID NO: 272544 - DNA, 75 bp, Artificial Sequence
  Synthetic
aatggtgttgtgcccgtgaagatggagcctgcagttcttagccctcatgatgttagacttgaagtgattatgcca

SEQ ID NO: 272545 - DNA, 75 bp, Artificial Sequence
  Synthetic
agcgtggttaaaaatgcagcagccaagtacagagttaacatcttcaacccagattttgaaatctgggagagggtg

SEQ ID NO: 272546 - DNA, 75 bp, Artificial Sequence
  Synthetic
gttgatgaattgaaagcaaggtttcgatctaagcttggcatacacaaacatgtttctcttcaaaaggctgtgcaa

SEQ ID NO: 272547 - DNA, 75 bp, Artificial Sequence
  Synthetic
ggtttttcctccctttcgtctcttgatctttctacctctccagggcaaaagtatgttgaaaaaggaatgaagaaa

SEQ ID NO: 272548 - DNA, 75 bp, Artificial Sequence
  Synthetic
agggatcttttgtccactgaaccattttggatgcatcctcaattggaaagtgatgttaaagatatacttggggca

SEQ ID NO: 272549 - DNA, 75 bp, Artificial Sequence
  Synthetic
gtttattctggtaagaaaccccacacattttttgctgcccacttgaaagatgagttgcgcaagaaggaaaagatt

SEQ ID NO: 272550 - DNA, 75 bp, Artificial Sequence
  Synthetic
gcgcaaggaaagacccgctgcattgaagcatgttcaattgattatgttattgcctatagagttgtgatgtcctct

SEQ ID NO: 272551 - DNA, 75 bp, Artificial Sequence
  Synthetic
ctctatgaggcaatttatcaaaccccagctcaagaattgggcttggcagtgggaatgaatccctggacagattgg

SEQ ID NO: 272552 - DNA, 75 bp, Artificial Sequence
  Synthetic
gatccaatgattaatgttttgcagccttataattatggtttagattattcatcctatgatggcagtctttctgaa

SEQ ID NO: 272553 - DNA, 75 bp, Artificial Sequence
  Synthetic
cagttaatgagatatggtgttgaaatacttgcttattgtcatgagcaaccagaagctgtgatgattctccatgag

SEQ ID NO: 272554 - DNA, 75 bp, Artificial Sequence
  Synthetic
ccagttataaattcgcaacaccttgtgatggatgaaatctggcatgtaaatggaggaatgccctcaggagcccca

SEQ ID NO: 272555 - DNA, 75 bp, Artificial Sequence
  Synthetic
tgtacaactgtgctaaactctatatgtaatttgctggtttgtacatatttggcttatgagcagagtttggacatt

SEQ ID NO: 272556 - DNA, 75 bp, Artificial Sequence
  Synthetic
gaggtgttgcctattgtttatggggatgatgtgattttttctgtttcttcaccattggatgctgaatatttggtt

SEQ ID NO: 272557 - DNA, 75 bp, Artificial Sequence
  Synthetic
cagagcgctgcccaaaattttggaatggaagtgacatcatcagataaatctggccccccaaaacttttgaaaatg

SEQ ID NO: 272558 - DNA, 75 bp, Artificial Sequence
  Synthetic
tggaagtgacatcatcagataaatctggccccccaaaacttttgaaaatggatgagattgaatttttaaagagga

SEQ ID NO: 272559 - DNA, 75 bp, Artificial Sequence
  Synthetic
gtgtgcatgcaggactatgaagtggctctgcatcgcatgctacgctatgtttttgattagattgatttagtttga

SEQ ID NO: 272560 - DNA, 75 bp, Artificial Sequence
  Synthetic
ttttgattttattagttttattttaggttagaattagattattttagtttagttttaaggattttgatttgattg

SEQ ID NO: 272561 - DNA, 75 bp, Artificial Sequence
  Synthetic
ttattttaggttagaattagattattttagtttagttttaaggattttgatttgattgaatttggcccaccaatc

SEQ ID NO: 272562 - DNA, 75 bp, Artificial Sequence
  Synthetic
ggtggggtgggtacacttctcgctcgatgagtgggggtgtggctcattgcccacacctggttggttcccaggttc

SEQ ID NO: 272563 - DNA, 75 bp, Artificial Sequence
  Synthetic
atacaataaccatcaataaacttttaacatctaagatagtattatcccatactagactggacgaagccgcttgga

SEQ ID NO: 272564 - DNA, 75 bp, Artificial Sequence
  Synthetic
ataagtctagtcttatcttgtatgtgtcctgcactgaacttgtttctgtctctggagtgctctacacttcagtag

SEQ ID NO: 272565 - DNA, 75 bp, Artificial Sequence
  Synthetic
caggtacacaaccccagtgatgcacacgcttagtaatggcttagtaacaaacattgattgatcatttgaaagctg

SEQ ID NO: 272566 - DNA, 75 bp, Artificial Sequence
  Synthetic
gaaggatgccctgaaggtacccataggtaaccttaagcgactatggatctgatcaggggcccaccatgtaacaca

SEQ ID NO: 272567 - DNA, 75 bp, Artificial Sequence
  Synthetic
ctgctctccacagtctcctcaaccgttggatctcttctacaaaacccctctgttgaagaaaaggaaatggattct

SEQ ID NO: 272568 - DNA, 75 bp, Artificial Sequence
  Synthetic
gaccgtgttgctgcctctactacaaccaatgctggtaatttggtacaagcttctgtggccccaactatgcctgtc

SEQ ID NO: 272569 - DNA, 75 bp, Artificial Sequence
  Synthetic
aagccagattttaaaaacacagatgatttcttgtccatgagctaccgttcaacaacagccccaaccaaccccaca

SEQ ID NO: 272570 - DNA, 75 bp, Artificial Sequence
  Synthetic
aaaatggttcacttggcacatggcacttggacaactaatcagcacagacaggcattggtcgcatcaattactcta

SEQ ID NO: 272571 - DNA, 75 bp, Artificial Sequence
  Synthetic
ccgcaggcattttggcccaatcaagattttccagcatgggggcagtctcgttattttgcagcagtgcgctgtggc

SEQ ID NO: 272572 - DNA, 75 bp, Artificial Sequence
  Synthetic
tttcatattcaagtacagttgaatgttaacatcggttctgctggttgcttgattgccgcgtacatgccaaagacg

SEQ ID NO: 272573 - DNA, 75 bp, Artificial Sequence
  Synthetic
gcccatgatcatatgaacacctatacttttggttcttacaccaacctgccacatgttttgatgaatgcggcaacg

SEQ ID NO: 272574 - DNA, 75 bp, Artificial Sequence
  Synthetic
acatcccaggctgatctctatataccctatgtttttaatcataactatgcaagaactgattcagatgatttagga

SEQ ID NO: 272575 - DNA, 75 bp, Artificial Sequence
  Synthetic
ggcatttacatttgggtttggtcagctctcacagttccatcaggttcacctacaacagtggatgtgaccattttt

SEQ ID NO: 272576 - DNA, 75 bp, Artificial Sequence
  Synthetic
ggttcattactcgacttggattttcagtgtcctcgtcctcctggtgcagacacagtaatttacacacaagggaaa

SEQ ID NO: 272577 - DNA, 75 bp, Artificial Sequence
  Synthetic
agaactgttcgaaagaccaagacatcaaagttcaaatgggtcaggaataaaattgacatagctgaaggtccagga

SEQ ID NO: 272578 - DNA, 75 bp, Artificial Sequence
  Synthetic
caaagttcaaatgggtcaggaataaaattgacatagctgaaggtccaggagcaatgaacatcgctaatgttctct

SEQ ID NO: 272579 - DNA, 75 bp, Artificial Sequence
  Synthetic
ccacaactggtggtcaaactattgccttggttggtgaaagagcattctatgacccaagaacagctggtgctgcag

SEQ ID NO: 272580 - DNA, 75 bp, Artificial Sequence
  Synthetic
tgaggtgcaaggacctcatggagatcgccagaatgccaagtgtgttcttaggagagagtactgaaccagatggtc

SEQ ID NO: 272581 - DNA, 75 bp, Artificial Sequence
  Synthetic
gaaggggctatttcacctggtcacatacaatctcacctgttaattgggtttttgatgaccacatttatttggaaa

SEQ ID NO: 272582 - DNA, 75 bp, Artificial Sequence
  Synthetic
acatgcccaatctgagattattctcctcctgttacaactattggaggggctcctttgttattaaactgacagttt

SEQ ID NO: 272583 - DNA, 75 bp, Artificial Sequence
  Synthetic
atgcgtcaactttcaacaaaggacgcttgaggatggcatttttcccaaacagagaaggcgcctacacacaggatg

SEQ ID NO: 272584 - DNA, 75 bp, Artificial Sequence
  Synthetic
aagctcagaacgcaatctttgttgtgtgtgatataggcttgaataatacctttgagatgaccatcccctacactt

SEQ ID NO: 272585 - DNA, 75 bp, Artificial Sequence
  Synthetic
ggggcaactggatgagaccaacaagaggaaactccttgggacatctgaggattgatgtgttgaaccgtcttacat

SEQ ID NO: 272586 - DNA, 75 bp, Artificial Sequence
  Synthetic
acaacagttcttccccaaatgcagtcaactgcattcttcagattaagatgggggatgatgcaatgttcatggtgc

SEQ ID NO: 272587 - DNA, 75 bp, Artificial Sequence
  Synthetic
caactgcattcttcagattaagatgggggatgatgcaatgttcatggtgcctaccacatctaatctagtttggca

SEQ ID NO: 272588 - DNA, 75 bp, Artificial Sequence
  Synthetic
ggggatgatgcaatgttcatggtgcctaccacatctaatctagtttggcaaggtctgcactcatggggttcagaa

SEQ ID NO: 272589 - DNA, 75 bp, Artificial Sequence
  Synthetic
atggacttggtggactctctcgacaatccagacgagatacaagacaatgaggaaatacaaacccaaaatgtggag

SEQ ID NO: 272590 - DNA, 75 bp, Artificial Sequence
  Synthetic
gctgcacaaggggaagaagctgcgactgaagttggtcttagggcaacagaaaatgatggcagtctttcagaacaa

SEQ ID NO: 272591 - DNA, 75 bp, Artificial Sequence
  Synthetic
ttgaatatgagtcaacccatgttcctgaattttaagaagcataaagtcaacatctatgcagcatcccataccaaa

SEQ ID NO: 272592 - DNA, 75 bp, Artificial Sequence
  Synthetic
gttgatcatatttttggaagagcttgggcagtgggggtttttaacacagaaacagctgccatacaaaaatttgat

SEQ ID NO: 272593 - DNA, 75 bp, Artificial Sequence
  Synthetic
ttgcactttccaacttctactcatggtgcattgtctagatttttctgcttctggactggagagttaaatattcac

SEQ ID NO: 272594 - DNA, 75 bp, Artificial Sequence
  Synthetic
attttgaatgtgtcaaccacaaatgcctttttgaaagttgctcacacatggtttggcactgattctggaattgcc

SEQ ID NO: 272595 - DNA, 75 bp, Artificial Sequence
  Synthetic
cggacagctactttggaatcaaatggaacaatgattataccaccaaacgagcaaatgacactttgtgtaccctat

SEQ ID NO: 272596 - DNA, 75 bp, Artificial Sequence
  Synthetic
tattctgaggttccattaagatgtgttaaaggttcagacaggaattcagccggacttggttctctcttcacacag

SEQ ID NO: 272597 - DNA, 75 bp, Artificial Sequence
  Synthetic
gctgtgggcagaacaatctctaatcgggtacaaatctttgtgagcttccgctgtcctaattttttcttcccacta

SEQ ID NO: 272598 - DNA, 75 bp, Artificial Sequence
  Synthetic
cctgcgcccagggaagccacgtctcgaagcatattggaacgagtggatgaagcaaatgcggaagaacttgaagct

SEQ ID NO: 272599 - DNA, 75 bp, Artificial Sequence
  Synthetic
gtcttggaagctagaacaccagatgcaccgctccgcctcaagtttaatccagaagatcctttgaaacaattgcgg

SEQ ID NO: 272600 - DNA, 75 bp, Artificial Sequence
  Synthetic
gaggcggccaaggcttactttaatataatgcacagtgatgaaatggattttgccggggggaaatttttgaaccaa

SEQ ID NO: 272601 - DNA, 75 bp, Artificial Sequence
  Synthetic
tgtggtgacgtggaaaccaacccaggccctgacattgagttggtctataaaaacagaggcttctataagcattat

SEQ ID NO: 272602 - DNA, 75 bp, Artificial Sequence
  Synthetic
ggagttagatttggtggtcatatctaccacttgaattcacaagacattctgtcaaccgcaattacaggcaagtct

SEQ ID NO: 272603 - DNA, 75 bp, Artificial Sequence
  Synthetic
gacttcattaaggaagaagatgatggcaaatgggttcatgctatgacagcaccattggactactttactgaaaag

SEQ ID NO: 272604 - DNA, 75 bp, Artificial Sequence
  Synthetic
accattggactactttactgaaaagtacatcaattcaatggttggctccaaacacatcttttccgccacctccaa

SEQ ID NO: 272605 - DNA, 75 bp, Artificial Sequence
  Synthetic
ttgtgagaccattgccagagatcttttcccagggagaaaggaaataactcagtccaaagccttggggattattgg

SEQ ID NO: 272606 - DNA, 75 bp, Artificial Sequence
  Synthetic
ggtcatcttgttgtcagcctctcttctttcattgcttgctgtaccctgggattattcctcacttcaaactgttta

SEQ ID NO: 272607 - DNA, 75 bp, Artificial Sequence
  Synthetic
taaccaatccattgaaggtgatgcttctggcctcacactcctaagtcaaagatgcatgacttttttttccaatac

SEQ ID NO: 272608 - DNA, 75 bp, Artificial Sequence
  Synthetic
aatgtgtgaaacttttaataatgatcttgttaagtttattattaagattttggtgcggcttttgtgctacatcgt

SEQ ID NO: 272609 - DNA, 75 bp, Artificial Sequence
  Synthetic
ctgacaaccatgtgtctgggaactcttcttgttttggacattacaacttgtgaaatcttgtctgctaacaccaaa

SEQ ID NO: 272610 - DNA, 75 bp, Artificial Sequence
  Synthetic
gcactctttcaggcattggttgatggtgatgtgaagagtcttgtctggaaaattgctgagaatatgcaatttgcc

SEQ ID NO: 272611 - DNA, 75 bp, Artificial Sequence
  Synthetic
caatccaaggatgaacaagctgaggacatggcagcaaccttcaactttgcctctgacatggttaattttgtgcca

SEQ ID NO: 272612 - DNA, 75 bp, Artificial Sequence
  Synthetic
atggaacagatgagacaagaaggctggagagaatttaatgatgtttctatgtcctttcggcatgttgaatggtgg

SEQ ID NO: 272613 - DNA, 75 bp, Artificial Sequence
  Synthetic
ctgactatgttcaaaaaggtgtacaatgttctgaaaagtatttttgctcctagtattgaacagaaggctgttgat

SEQ ID NO: 272614 - DNA, 75 bp, Artificial Sequence
  Synthetic
tagtattgaacagaaggctgttgattggatagatcgcaatcaagagtacattgccgatgttttggaccatgcttc

SEQ ID NO: 272615 - DNA, 75 bp, Artificial Sequence
  Synthetic
caacatcatcataaaaatgaaggatccaaaagaacagcggagagcatcaaccattagtgaatactttgaggtttt

SEQ ID NO: 272616 - DNA, 75 bp, Artificial Sequence
  Synthetic
ctttgcatgaaggttgccccctccactaagttttcctctcaagtgtttagaatctattctgaaatgatgagggtc

SEQ ID NO: 272617 - DNA, 75 bp, Artificial Sequence
  Synthetic
aatgttagagtgcctgcgaatactgacttgactagactggaacccattggcatttgggtttctagtgagccagga

SEQ ID NO: 272618 - DNA, 75 bp, Artificial Sequence
  Synthetic
cagggtaaatcattctttacacatatgttgagtacctgtcttctgaagtcctgcaatttagaaggaatttatacc

SEQ ID NO: 272619 - DNA, 75 bp, Artificial Sequence
  Synthetic
aaccccacaggttcagaatttatggatggctatattgggcaggacattcatatcatagatgatgcagggcaaaat

SEQ ID NO: 272620 - DNA, 75 bp, Artificial Sequence
  Synthetic
agagaggaaaaagatttggccttgttgtgtcagtgtatttcttctgtgccttttactgttccaatggcagatttg

SEQ ID NO: 272621 - DNA, 75 bp, Artificial Sequence
  Synthetic
acagagaagggcactttttatacaagcaaaattgtgattgccaccaccaataaatttgattttacctcaatggtt

SEQ ID NO: 272622 - DNA, 75 bp, Artificial Sequence
  Synthetic
ttgacagatccagcagcccttgaaaggagatttccgttccacttgcgcattagagctgtagccagctattcgcgc

SEQ ID NO: 272623 - DNA, 75 bp, Artificial Sequence
  Synthetic
aacaacaaactagatgtggcccgttcaatggcggccatggcagatggttcttgctgggaatattccacagatggt

SEQ ID NO: 272624 - DNA, 75 bp, Artificial Sequence
  Synthetic
ggtagggcttggaagaccctctccatggatgaacttgtgaaacaaatcacggcagtttacacacagaggtcagat

SEQ ID NO: 272625 - DNA, 75 bp, Artificial Sequence
  Synthetic
gcccttatggtttggaaaaggaagttgaataccatcaggaacgaaatgagccctggatcatccaccggcaggatt

SEQ ID NO: 272626 - DNA, 75 bp, Artificial Sequence
  Synthetic
tttgaacccttagaggaaacactctgtgctttggaacgtcgctttggtcaacttgctgatagtcttaaagacaac

SEQ ID NO: 272627 - DNA, 75 bp, Artificial Sequence
  Synthetic
tatcataaaacagctgatgagttgattgaagctatagaagatatgatggcaccgtcacagagtccttttgcatgc

SEQ ID NO: 272628 - DNA, 75 bp, Artificial Sequence
  Synthetic
tttgctgaatcctatcgacccaccattaaatatactgccagtgataaagttaaatcatgggttaaaaatcatatg

SEQ ID NO: 272629 - DNA, 75 bp, Artificial Sequence
  Synthetic
aatagatggaaagaatttgtaatgagaaataaaggctggtttacacttttttctgtgctctcatcatttctctcg

SEQ ID NO: 272630 - DNA, 75 bp, Artificial Sequence
  Synthetic
attcttactcttgtctatttacactataaaaaggagaagaaagaggaagagagacaggagcgggcttacaaccct

SEQ ID NO: 272631 - DNA, 75 bp, Artificial Sequence
  Synthetic
caaactgcaatttctaagaaggggggtaagcctaagctctcattagtgaaaaccacaaactttgttaatgaagca

SEQ ID NO: 272632 - DNA, 75 bp, Artificial Sequence
  Synthetic
ccctatatgcaagatcttgaacattgctttgcacaaacggcctacatttcttctccagaaacccaagatataata

SEQ ID NO: 272633 - DNA, 75 bp, Artificial Sequence
  Synthetic
cattgtgctgccttgagtgaagacaccattttggtttatggacattctcagttttattttaaccgctatgaggac

SEQ ID NO: 272634 - DNA, 75 bp, Artificial Sequence
  Synthetic
ctgcggttacattttaaaggggccatttttcccatagaagggggaaaaatttctcaagttaccgtgaatggacag

SEQ ID NO: 272635 - DNA, 75 bp, Artificial Sequence
  Synthetic
cctatggatttgatacttgtgaagatagataaacttccaataacatttaaaaattatacaaaatattatacaact

SEQ ID NO: 272636 - DNA, 75 bp, Artificial Sequence
  Synthetic
gaggttggcaaggaaactcttttaatttggaattcagaaaagggcaggttggccatgcctgttcaatgtgtggct

SEQ ID NO: 272637 - DNA, 75 bp, Artificial Sequence
  Synthetic
ccggctggtccggtggagacaatggaaggaacaattactcataagacctattcatataaagtggcatcaaaaaaa

SEQ ID NO: 272638 - DNA, 75 bp, Artificial Sequence
  Synthetic
ggaatgtgtgggggccttttggtcactagagtgcatggcacattcaaggttctgggaatgcacattgcaggcaat

SEQ ID NO: 272639 - DNA, 75 bp, Artificial Sequence
  Synthetic
gggcaagttgcacgagctgcagcagttcactttatatccaatggtgcagctggctttatggatcaaggtgttgtt

SEQ ID NO: 272640 - DNA, 75 bp, Artificial Sequence
  Synthetic
gtggccaaagaaaagttacaaaagcccatttatttgccatctaagacagctttgaatcccagtcccttgaatggt

SEQ ID NO: 272641 - DNA, 75 bp, Artificial Sequence
  Synthetic
gtagtccccgtgaaaatggaaccagctgtgcttagtcctcatgacaccaggcttgaagtcatcatgcccagcgtt

SEQ ID NO: 272642 - DNA, 75 bp, Artificial Sequence
  Synthetic
gtgaaaacagcggcagctaagtatagagttaatatttttaatcctgattttgagatttgggagagagtggtggat

SEQ ID NO: 272643 - DNA, 75 bp, Artificial Sequence
  Synthetic
gagttaaaatcaaagtttagaaccaaacttggaattcataaacatgtctcttttcagaaagcagttcagggtttc

SEQ ID NO: 272644 - DNA, 75 bp, Artificial Sequence
  Synthetic
tcctccctttcatctcttgatctttccacatccccaggacaaaagtatgttgaaaagggtatgaagaagagagat

SEQ ID NO: 272645 - DNA, 75 bp, Artificial Sequence
  Synthetic
cttttgtccactgagccattttggatgcatcctcaattggaaggtgatgttaaagatatacttggggccgtttac

SEQ ID NO: 272646 - DNA, 75 bp, Artificial Sequence
  Synthetic
tctggtaaaaagccccatacattttttgctgcacatttgaaagatgagttgcgcaaaaaagaaaagattgcgcaa

SEQ ID NO: 272647 - DNA, 75 bp, Artificial Sequence
  Synthetic
ggaaagacccgctgcattgaagcctgttcaattgactatgtgattgcctacagagttgtaatgtcctcactctat

SEQ ID NO: 272648 - DNA, 75 bp, Artificial Sequence
  Synthetic
gaggcaatctatcaaactccggctcaggagttgggcctggcagtgggaatgaatccctggacagattgggatcca

SEQ ID NO: 272649 - DNA, 75 bp, Artificial Sequence
  Synthetic
atgatcaatgttttgcagccatataactatggcctggattactcatcttatgatggcagcctttctgaacaactg

SEQ ID NO: 272650 - DNA, 75 bp, Artificial Sequence
  Synthetic
atgagatatggagtggaaatacttgcctactgtcatgaacaaccagaggctgtaatgattcttcatgaacctgtt

SEQ ID NO: 272651 - DNA, 75 bp, Artificial Sequence
  Synthetic
ataaactctcaacaccttgtgatggatgaaatctggcatgtgaatggtggaatgccctcaggggccccatgtaca

SEQ ID NO: 272652 - DNA, 75 bp, Artificial Sequence
  Synthetic
actgtgctaaattccatatgcaatctgctagtttgtacatatttggcctatgagcagagcttggatattgaggtg

SEQ ID NO: 272653 - DNA, 75 bp, Artificial Sequence
  Synthetic
ttacccattgtttatggagatgatgtaattttttctgtttcatcccctttggatgctgaatacttggttcagagt

SEQ ID NO: 272654 - DNA, 75 bp, Artificial Sequence
  Synthetic
gcagcccaaaattttggaatggaagtgacctcatcagataaatctggtccccctaaacttttgaaaatggatgag

SEQ ID NO: 272655 - DNA, 75 bp, Artificial Sequence
  Synthetic
atggaacaacatattatgtggatgaagaatttggaaacctttccagaacaacttgttagttttgagaatgaattg

SEQ ID NO: 272656 - DNA, 75 bp, Artificial Sequence
  Synthetic
tattttgaatcaatggcgagtgtgcatgcaggactatgaagtggccctgcatcgcatgctacgctatgtttttga

SEQ ID NO: 272657 - DNA, 75 bp, Artificial Sequence
  Synthetic
ttgaattgatttagtttgattttgattttattagctttagtttatgtaagttagaattagattattttagtttag

SEQ ID NO: 272658 - DNA, 75 bp, Artificial Sequence
  Synthetic
tttatgtaagttagaattagattattttagtttagttttaaagattttgatttgattgaatttggcccaccaatc

SEQ ID NO: 272659 - DNA, 75 bp, Artificial Sequence
  Synthetic
ttgaaaggggggccctgtggccaattttggccacagggttcccctggtggggtgggtacacttctcgctcgatga

SEQ ID NO: 272660 - DNA, 75 bp, Artificial Sequence
  Synthetic
gcattattcagattaagatgggggatgatgcaatgttcatggtgcctaccacatctaatctagtttggcaaggtt

SEQ ID NO: 272661 - DNA, 75 bp, Artificial Sequence
  Synthetic
tgtactcatggggttcagaaatggacttggtggactctctcgacaatccagacgagatacaagacaatgaggaaa

SEQ ID NO: 272662 - DNA, 75 bp, Artificial Sequence
  Synthetic
attgccatgcaccaaatatgctgacaaccatgtgtctgggaactcttcttgttttggacattacaacttgtgaaa

SEQ ID NO: 272663 - DNA, 75 bp, Artificial Sequence
  Synthetic
ctgaaaagtatttttgctcctagtattgaacagaaggctgttgattggatagatcgcaatcaagagtacattgcc

SEQ ID NO: 272664 - DNA, 75 bp, Artificial Sequence
  Synthetic
ttgaacagaaggctgttgattggatagatcgcaatcaagagtacattgccgacgtcttggaccatgcttccaaca

SEQ ID NO: 272665 - DNA, 75 bp, Artificial Sequence
  Synthetic
tcatcataaaaatgaaggatccaaaagaacagcggagagcatcaaccattagtgaatactttgaggttttggaac

SEQ ID NO: 272666 - DNA, 75 bp, Artificial Sequence
  Synthetic
aactaaagccaattgtgtctctttgcatgaaggttgccccctccactaagttttcctctcaagtgtttagaatct

SEQ ID NO: 272667 - DNA, 75 bp, Artificial Sequence
  Synthetic
ctgatagtcttaaagacaactatcataaaacaactgatgagttgattgaagctatagaagatatgatggcaccgt

SEQ ID NO: 272668 - DNA, 75 bp, Artificial Sequence
  Synthetic
taaaacaactgatgagttgattgaagctatagaagatatgatggcaccgtcacagagcccttttgcatgctttgc

SEQ ID NO: 272669 - DNA, 75 bp, Artificial Sequence
  Synthetic
gggccttgagcctggataccatggaacaacatattatgtggatgaagaatttggaaacctttccagaacaacttg

SEQ ID NO: 272670 - DNA, 75 bp, Artificial Sequence
  Synthetic
agaatagccaatctgtaacttcaacacctaagcgcatcttgcccgccgttatctggtcgaaggcacttgcaataa

SEQ ID NO: 272671 - DNA, 75 bp, Artificial Sequence
  Synthetic
gactggttaaccctccatgcgtgattcacaatcctatctgtctctcgagtgctttacgctcgggtaggggctcac

SEQ ID NO: 272672 - DNA, 75 bp, Artificial Sequence
  Synthetic
ccaggaggtcccactctttacagaggtctgcgcaggtggctttcacctctcgacagcgcccctcaatcctgcctt

SEQ ID NO: 272673 - DNA, 75 bp, Artificial Sequence
  Synthetic
aggtgtgaaggttgcacgtattccaatgtgaacagtgcttgaattttgttggtaggtgtagcgaccacacatgag

SEQ ID NO: 272674 - DNA, 75 bp, Artificial Sequence
  Synthetic
ccagcggatttcccctggtggtaacaccagcctctgggcccaaaaggcatgtctttgacctcatgtgtgcacaat

SEQ ID NO: 272675 - DNA, 75 bp, Artificial Sequence
  Synthetic
cccagtgatgccaatgattagtaaagcacttagtatatatatgggatataccaatctcaagcacctaagggtgta

SEQ ID NO: 272676 - DNA, 75 bp, Artificial Sequence
  Synthetic
ggtatggtaggctgaaggatgccctggaggtacccgcaggtaacgattggttcactgtggatctgaccaggggcc

SEQ ID NO: 272677 - DNA, 75 bp, Artificial Sequence
  Synthetic
caccggaacttcgttctgggtagaagctctcgagccttgggttaaaaaacgtctaggcctatcccccggggggac

SEQ ID NO: 272678 - DNA, 75 bp, Artificial Sequence
  Synthetic
ccggggtttcccttataaccccatattttgcatcatggctggccgtaacgaaactaacgtttctgagcttctctc

SEQ ID NO: 272679 - DNA, 75 bp, Artificial Sequence
  Synthetic
cactgtctcatcaactgtcggatctctgctccagaaccccactgttgaagagaaagaaatggattccgatagggt

SEQ ID NO: 272680 - DNA, 75 bp, Artificial Sequence
  Synthetic
agctgcgtcaaccacaacaaatgctggcaacttggttcaggcatcagttgctcctactatgccatttaagccaga

SEQ ID NO: 272681 - DNA, 75 bp, Artificial Sequence
  Synthetic
ttttaccaatgttgatcagtttttatgtatgagctatagccctgagactgcccctactaacccaaccaaaatggt

SEQ ID NO: 272682 - DNA, 75 bp, Artificial Sequence
  Synthetic
gcatttggctgctgcacaatggcaaaccacacataatcgcactcatgaagtcctacggattgaattgccacggtc

SEQ ID NO: 272683 - DNA, 75 bp, Artificial Sequence
  Synthetic
attctggccaaatgaaaattatcctgcatggggtcagtcaagatatttcggagctgtccgttgtggattccattt

SEQ ID NO: 272684 - DNA, 75 bp, Artificial Sequence
  Synthetic
tcaggttcaacttaatgttaacattgggtctgctggctgtttgatagcctgctatttgccagcaacagctttgga

SEQ ID NO: 272685 - DNA, 75 bp, Artificial Sequence
  Synthetic
aaattttaattcctatacttttggcacctttacaaattttccccatgtattaatgaatgcagccacaacctccca

SEQ ID NO: 272686 - DNA, 75 bp, Artificial Sequence
  Synthetic
agctgatttgtatattccctatgtttttaatcataattatgccagaacagattcagcagatttgggtgggatttt

SEQ ID NO: 272687 - DNA, 75 bp, Artificial Sequence
  Synthetic
tatttatgtttggtcagccctaacagttcccaccggcgccccaaccactattgatgtgacagtttttggatctct

SEQ ID NO: 272688 - DNA, 75 bp, Artificial Sequence
  Synthetic
tttggatttggattttcagaatcccagggtgccaggaacagccattgggatattttctcagggtagaagacaaat

SEQ ID NO: 272689 - DNA, 75 bp, Artificial Sequence
  Synthetic
gcggaagaccaagtcatctaaatttaaatggacccgaaataaagtggatattgctgaggggcctggtgcaatgaa

SEQ ID NO: 272690 - DNA, 75 bp, Artificial Sequence
  Synthetic
tattgcaaatgttttgtccacaactggtgggcaatcaactgctttggttggtgagagagcattctatgatccccg

SEQ ID NO: 272691 - DNA, 75 bp, Artificial Sequence
  Synthetic
tacagccggcgcctcgatccgctgtaaagacctaatggatttggcacgcatgccatcatgcttgcgtggtgaaag

SEQ ID NO: 272692 - DNA, 75 bp, Artificial Sequence
  Synthetic
agcagtaccacaagatactacaggctattttacctggtcatcaaatatcacaccattaaatttcatttttgagta

SEQ ID NO: 272693 - DNA, 75 bp, Artificial Sequence
  Synthetic
tggagtttattttgaggatattcccaatctgaatctgatggctgccaattttaattattggagaggatccattgt

SEQ ID NO: 272694 - DNA, 75 bp, Artificial Sequence
  Synthetic
gattaagttaactgtttttgcctcaacttttaataaaggccgtcttcgtatggcatttttcccaaaccaaggtga

SEQ ID NO: 272695 - DNA, 75 bp, Artificial Sequence
  Synthetic
aaattttggcgaaccagcagcccaaaattcaatttatgtggtttgtgatataggcttaaataatacatttgaact

SEQ ID NO: 272696 - DNA, 75 bp, Artificial Sequence
  Synthetic
cactataccctatacgtggggcaattggatgagaccgtcacgtggcggccccgtgggatggctgaggatagatgt

SEQ ID NO: 272697 - DNA, 75 bp, Artificial Sequence
  Synthetic
tttgaatagattaacttttaatagctcatcaccttcctctgttaattgcattttgcaagtgaaaatgggcaatga

SEQ ID NO: 272698 - DNA, 75 bp, Artificial Sequence
  Synthetic
tgctcagtttatggtgcccactacctccaatttggtttgggagtcacctactggaatgtcctcctggggctcaca

SEQ ID NO: 272699 - DNA, 75 bp, Artificial Sequence
  Synthetic
aatggacttgattgattcattggataacccagaggagatccaagatagtgaggaacctgaatcatcaaatgttga

SEQ ID NO: 272700 - DNA, 75 bp, Artificial Sequence
  Synthetic
agcagcacaggggcaggaggcagcaacagcagtgggtttgagagccactgaaaacgatggttctctaactgagca

SEQ ID NO: 272701 - DNA, 75 bp, Artificial Sequence
  Synthetic
agtcaacgtggctcagcctatgttcttgaattttaaacagcataaagttgatatttattcaacatcccataccaa

SEQ ID NO: 272702 - DNA, 75 bp, Artificial Sequence
  Synthetic
ggtggatcatatttttgggagggcttggcgctttcaaattaccaatttggataacagcagtattgggcgctttac

SEQ ID NO: 272703 - DNA, 75 bp, Artificial Sequence
  Synthetic
cattcccttccccaccaccactcatggatcccttgctagattctttgcctattggacaggcgagttaaatataca

SEQ ID NO: 272704 - DNA, 75 bp, Artificial Sequence
  Synthetic
tgttattaatatttccacaacaaatgcttttttgaaagttgcgcatacctggtttggcaccacatcagggatagc

SEQ ID NO: 272705 - DNA, 75 bp, Artificial Sequence
  Synthetic
aagaactggtagtttagagtccaatggtgtgatgataattccgccaaatgagcaaatgactttttgtgttccata

SEQ ID NO: 272706 - DNA, 75 bp, Artificial Sequence
  Synthetic
ttattctgaagctccactacggactgttaagggcactggactctcagccggtcttggcacttttttctatcaggc

SEQ ID NO: 272707 - DNA, 75 bp, Artificial Sequence
  Synthetic
agttgggcgaaccattcagaatcgcatggagatttttgtctccttgcggtgtccaaatttctttttcccagtacc

SEQ ID NO: 272708 - DNA, 75 bp, Artificial Sequence
  Synthetic
agccccacatgaagctagtgcaagatcaacactggctagaattgatacagcaactgaggaagagctcaatgctat

SEQ ID NO: 272709 - DNA, 75 bp, Artificial Sequence
  Synthetic
tatgagctctgctgagcccgacacacctctccgcattggtaagccacctgaagatcccttaaaacaattacgtga

SEQ ID NO: 272710 - DNA, 75 bp, Artificial Sequence
  Synthetic
ggcagcaaaaacctattttaaaatttaccatgataaggatatggattatgctggagggaagtttttaaatcaatg

SEQ ID NO: 272711 - DNA, 75 bp, Artificial Sequence
  Synthetic
tggtgatgttgagaccaaccctgggcccgatattgaattggtttataaaccccgtggcttttataagcattatgg

SEQ ID NO: 272712 - DNA, 75 bp, Artificial Sequence
  Synthetic
ggttagaataaatgggcatgtttatcatttaaattcacaagatattttaaccaccgcaataacgggaaaagcaga

SEQ ID NO: 272713 - DNA, 75 bp, Artificial Sequence
  Synthetic
gtttattaaacaacaagatgatggccattgggttcatgccatgtcagccccccttgattattttactgaaaaata

SEQ ID NO: 272714 - DNA, 75 bp, Artificial Sequence
  Synthetic
tgttaattctctggttggctctaagcatatattttcagcaactgagaattgtgaaaccatcgctagagatatttt

SEQ ID NO: 272715 - DNA, 75 bp, Artificial Sequence
  Synthetic
tccaggtcaaccagaaatttctcagtctaaagccttgggcatcataggcttaattcttttgtctgcagcactgtt

SEQ ID NO: 272716 - DNA, 75 bp, Artificial Sequence
  Synthetic
gtctcttttggctgtgccctgggattttagttccttgcaaattgtttataatcaaggcattgaaggggatgctag

SEQ ID NO: 272717 - DNA, 75 bp, Artificial Sequence
  Synthetic
tggtttaactcttttgagtcagcgctgcatgacttttttttccaatactatgtgtgaaacctttaataatgattt

SEQ ID NO: 272718 - DNA, 75 bp, Artificial Sequence
  Synthetic
agtgaaatttataattaaaattttggttaggcttttatgttatattgtgctttattgtcatgctcctaatatgct

SEQ ID NO: 272719 - DNA, 75 bp, Artificial Sequence
  Synthetic
tacaaccatgtgcctggggactttacttgtgctggatattacaacatgtgagatcttatcagccaacaccaaggc

SEQ ID NO: 272720 - DNA, 75 bp, Artificial Sequence
  Synthetic
attgtttcaggccctaatggatggagatgtgaagagtttggtctggaaaattgctgaaaatatgcaatttgctca

SEQ ID NO: 272721 - DNA, 75 bp, Artificial Sequence
  Synthetic
atcatctgatgaacaagcagaagagatgtctgccactttttcatttgctaaggatatggttgatatacattcacc

SEQ ID NO: 272722 - DNA, 75 bp, Artificial Sequence
  Synthetic
tgatcaaccaccctttcagaatcagagttggagggattttaatgaggttagtatgtcttttagacatgttgagtg

SEQ ID NO: 272723 - DNA, 75 bp, Artificial Sequence
  Synthetic
gtggttaacaatgtttaagaagatttataatgttttgaaaggcattttctcccctagcattgaacaaaaagctgt

SEQ ID NO: 272724 - DNA, 75 bp, Artificial Sequence
  Synthetic
ggcatggcttgaaaggaaccatgagtatgtggcaggtgtcttggaccagtgttctgatatgatcattaagatgaa

SEQ ID NO: 272725 - DNA, 75 bp, Artificial Sequence
  Synthetic
ggatcccaaacagcaaaggaatgctaaggtcattgaggaatattttgaagtcttgaaacgcatgaagcccttggt

SEQ ID NO: 272726 - DNA, 75 bp, Artificial Sequence
  Synthetic
gtctttgtgtattaaagtggctccctccaccaaattctcctcccaggtttttcgtctttattctgagcttatgaa

SEQ ID NO: 272727 - DNA, 75 bp, Artificial Sequence
  Synthetic
agtgaatgttagagttccagctaataccgatttaactcgtattgaaccaattggcatttggatttcaagtgaacc

SEQ ID NO: 272728 - DNA, 75 bp, Artificial Sequence
  Synthetic
aggacaagggaaatctttttttacgcatatgcttagtacctcccttttaaaggcatgtaacctggagggtattta

SEQ ID NO: 272729 - DNA, 75 bp, Artificial Sequence
  Synthetic
tactaaccccacaggatctgagtttatggatggttatgtgggtcaggacatccacattattgatgatgctgggca

SEQ ID NO: 272730 - DNA, 75 bp, Artificial Sequence
  Synthetic
aaatcgggatgaaaaggacctagccttgttgtgccaatgtatatcgtctgtgccattcacagttcccatggcaga

SEQ ID NO: 272731 - DNA, 75 bp, Artificial Sequence
  Synthetic
tttggctgagaaaggaactttctataccagcaaggtagttatagccacaaccaataagatggattttaactgcat

SEQ ID NO: 272732 - DNA, 75 bp, Artificial Sequence
  Synthetic
ggtgttaactgaccctggtgcattggaacgccgatttccatttaacttgagagtgcgggcagtggctagctttat

SEQ ID NO: 272733 - DNA, 75 bp, Artificial Sequence
  Synthetic
gacaaaggatagaaagcttgatgtcccacgctccatgggtgcaatggctgatggttcatgctgggaatgttctac

SEQ ID NO: 272734 - DNA, 75 bp, Artificial Sequence
  Synthetic
agattatggtcgatcctggtcccctgtgaatatgaaggagcttgttaagaaaattgcagatgtttataaagagag

SEQ ID NO: 272735 - DNA, 75 bp, Artificial Sequence
  Synthetic
agatgatgccttaactgtttggaaatataagttaaatcagattagaaatgaaatggttccgggagattcaattgg

SEQ ID NO: 272736 - DNA, 75 bp, Artificial Sequence
  Synthetic
caggattttggaacctatggaggagactctttgttctcttgagagacgctttggccaacttgcagatagcctgag

SEQ ID NO: 272737 - DNA, 75 bp, Artificial Sequence
  Synthetic
ggagaactatcataaaacagctgatgagttaattgaggctattgaggatttaatggcacctggccagagcccttt

SEQ ID NO: 272738 - DNA, 75 bp, Artificial Sequence
  Synthetic
ttcctgctttgaacccacaggacccactattaaatatacagcctgtgataaggttaaatcttgggttaaaaatca

SEQ ID NO: 272739 - DNA, 75 bp, Artificial Sequence
  Synthetic
tatgaaaagatggagtgattttgtgattaggaataaaggctggtttacattattttctgtactttcttcttttct

SEQ ID NO: 272740 - DNA, 75 bp, Artificial Sequence
  Synthetic
ttctattcttaccttggtttatcttcattataagaaagagaaaaaagaggataaacaggagcgggcctacaaccc

SEQ ID NO: 272741 - DNA, 75 bp, Artificial Sequence
  Synthetic
tcaaactgcaattcccaagaagggaggtaggccgaagctcacattaatgaagagtactaattttgttaatgaggc

SEQ ID NO: 272742 - DNA, 75 bp, Artificial Sequence
  Synthetic
accatatatgcaagatttagaacattgctttgcccaaacagcctatatatcatcaagtgaaacaacagatattat

SEQ ID NO: 272743 - DNA, 75 bp, Artificial Sequence
  Synthetic
acattgttccgctctttttgaggataccatattggtatatggccattcacagtttttttttaaccgctatgaaga

SEQ ID NO: 272744 - DNA, 75 bp, Artificial Sequence
  Synthetic
tttgcggttacattttaaaggagcaatttttcccattgagggtggccgcatttcccaggttacagtgaatgggca

SEQ ID NO: 272745 - DNA, 75 bp, Artificial Sequence
  Synthetic
accaatggatttaattatggttaaaattgataaattgcccataacttttaaaaattatacaaaatattataccag

SEQ ID NO: 272746 - DNA, 75 bp, Artificial Sequence
  Synthetic
agatgttggcaaggataatcttttaatttggaattctgataagggtagacttgctatgcctgtagattgtgtggt

SEQ ID NO: 272747 - DNA, 75 bp, Artificial Sequence
  Synthetic
gccagcaggaccaatagagacaatggaaggtaccataacacataaaacatattcctataaggttgcttccaaacg

SEQ ID NO: 272748 - DNA, 75 bp, Artificial Sequence
  Synthetic
aggcatgtgtggtggtctcttggtcacaagagtcaatggtacctttaagatcttggggatgcatatagcaggtaa

SEQ ID NO: 272749 - DNA, 75 bp, Artificial Sequence
  Synthetic
tggacagatggcgcgggccgctgctgttcattttattaccaatggcaatatgcaagatcaaggtatagtcgtgaa

SEQ ID NO: 272750 - DNA, 75 bp, Artificial Sequence
  Synthetic
aaaggaaaagttagaaaaacccatgttcttgccctccaagactgctttgagtcccagcccccttaatggaattgt

SEQ ID NO: 272751 - DNA, 75 bp, Artificial Sequence
  Synthetic
tcctgtgaaaatggaaccagctgttttgagcccccatgatgcccgtttggaagttgtaatgccaagtgtggtgaa

SEQ ID NO: 272752 - DNA, 75 bp, Artificial Sequence
  Synthetic
aagtgcagctgccaagtatcgtgttaatatttttaatcctgattacgatatttgggagcgggttgttgatgattt

SEQ ID NO: 272753 - DNA, 75 bp, Artificial Sequence
  Synthetic
gaaagttagatttagacagaaattgggcatacataaacataccaccattcagaaagcagtgcaggggttttcttc

SEQ ID NO: 272754 - DNA, 75 bp, Artificial Sequence
  Synthetic
attggcttccttagatttggctacctcaccgggcttgaagtatgtttcccaaggacttaagaaacgagatctttt

SEQ ID NO: 272755 - DNA, 75 bp, Artificial Sequence
  Synthetic
gagtgtcgagcctttttgggttagtccccaattggaaatggatgttaaacaaattcttgctgatgtttattctgg

SEQ ID NO: 272756 - DNA, 75 bp, Artificial Sequence
  Synthetic
taataaaccaaccacccaatttgcagcacatttgaaagatgaattgaggaagaaagaaaaagtggctcaaggcaa

SEQ ID NO: 272757 - DNA, 75 bp, Artificial Sequence
  Synthetic
aactcgctgtatcgaggcttgttcagtggattttgtggtggcttatagagttgttatgtcttctctttatgaagc

SEQ ID NO: 272758 - DNA, 75 bp, Artificial Sequence
  Synthetic
catctaccaaacaccagcacaggagttaggccttgcagtaggcatgaatccatggactgattgggatccaatgat

SEQ ID NO: 272759 - DNA, 75 bp, Artificial Sequence
  Synthetic
taatacccttcttccctataattatggcctggattattcctcctatgatggtagtctttcagagcagttaatggc

SEQ ID NO: 272760 - DNA, 75 bp, Artificial Sequence
  Synthetic
atatggtgttgatattttggcctattgccatgaagagcctgaggttgtgaaattgttgcatagccctataataaa

SEQ ID NO: 272761 - DNA, 75 bp, Artificial Sequence
  Synthetic
ttcccagcatgttgttatggatgagctatggcatgtgatggggggaatgccctcaggtgctccttgcacaactgt

SEQ ID NO: 272762 - DNA, 75 bp, Artificial Sequence
  Synthetic
tcttaattctatttgtaatcttcttgtttgttcctatttagcctatgaacaaagtttggatttggaggtaagacc

SEQ ID NO: 272763 - DNA, 75 bp, Artificial Sequence
  Synthetic
aattgtgtatggggatgatgtgatattttctgtttcctcaccattggatatggactattttgtgaagagtgctgc

SEQ ID NO: 272764 - DNA, 75 bp, Artificial Sequence
  Synthetic
agagacgtttggtatggaagtgacggcctctgataaaaatggtgcccccaaattgcttagaatggaggagataga

SEQ ID NO: 272765 - DNA, 75 bp, Artificial Sequence
  Synthetic
atttttaaaaagaactacgaaaatgtttcccggctctacctataaggtaggggccctgagcctggatactatgga

SEQ ID NO: 272766 - DNA, 75 bp, Artificial Sequence
  Synthetic
acagcatataatgtggatgaaaaatttatccacattcccagaacaattggtcagttttgaaaatgaattggcttt

SEQ ID NO: 272767 - DNA, 75 bp, Artificial Sequence
  Synthetic
gcatgggaaggatgtttatgatgattataaacaaaagtttaatgttgttttgaatcagtggcgagtgtgcatgca

SEQ ID NO: 272768 - DNA, 75 bp, Artificial Sequence
  Synthetic
ggattatgatgtggtgctgcatcgtatgcttcgctatgtttttgagtgattcttttctttttgctttgctttttg

SEQ ID NO: 272769 - DNA, 75 bp, Artificial Sequence
  Synthetic
ttttgctttgcttttagtttagttttgcttttgcttttaaaagattttgatttgattgaattaggcccaccaatc

SEQ ID NO: 272770 - DNA, 75 bp, Artificial Sequence
  Synthetic
ttgaaaggggggccctgcagccgatataggctgcagggttcccctggtggggtgggtacgtctctcgctcattga

SEQ ID NO: 272771 - DNA, 75 bp, Artificial Sequence
  Synthetic
catggaacaacacattatgtggatgaagaatctggaaacctttccagaacaacttgttagctttgaaaatgagtt

SEQ ID NO: 272772 - DNA, 75 bp, Artificial Sequence
  Synthetic
agtttttaaaagttaacccgtggttttaccctagtttcggtgaatttgccaattttacggaataactgtttgaaa

SEQ ID NO: 272773 - DNA, 75 bp, Artificial Sequence
  Synthetic
ggttcaaactctggtgtccaacgtttgtattaaaatgagtggattaggaggccttcttcccctccgagggaagaa

SEQ ID NO: 272774 - DNA, 75 bp, Artificial Sequence
  Synthetic
aaagaaagcccctgtgatacaatcacagggcagggtcttgccgaagagcgactggaagggagctccgaaacagga

SEQ ID NO: 272775 - DNA, 75 bp, Artificial Sequence
  Synthetic
tctaaataaaaagaaagcgaaaaaggacgagacgaaaggccagaattggccaagaagaattaacccccggactgg

SEQ ID NO: 272776 - DNA, 75 bp, Artificial Sequence
  Synthetic
acaatggtcggcaattgagggctctggtgctcggctgtggagaagcattttctctacagacttgatcggaggctt

SEQ ID NO: 272777 - DNA, 75 bp, Artificial Sequence
  Synthetic
gttgttgttgatcgctattttatcaaatctctacgaaaaggttagacgtgacataacggaattgaaacgcagagt

SEQ ID NO: 272778 - DNA, 75 bp, Artificial Sequence
  Synthetic
gactcgattggaaaaatctcgagctagtttgattttgaccccaatggtgttgctgtgtctggctatcctcgcggc

SEQ ID NO: 272779 - DNA, 75 bp, Artificial Sequence
  Synthetic
aggcgtgacaatccaagtggttgtcactactgatgcacgaatcgagctttggtctgaccggaagaactttacagc

SEQ ID NO: 272780 - DNA, 75 bp, Artificial Sequence
  Synthetic
tcacgctcacctcgtcaaggttcctaccgacgtttgcaatgatggggtgtttgtaacaaaacattgtcccaaagt

SEQ ID NO: 272781 - DNA, 75 bp, Artificial Sequence
  Synthetic
tgagaagttgagtgaccttggcgaaatcgattgcggttcatcatggtctgaatttaccttgacttacacacgatg

SEQ ID NO: 272782 - DNA, 75 bp, Artificial Sequence
  Synthetic
cgtaaccttggaaagagcctcacgtgcggaagagaagggaaagacaatgctggggcagttcaaggaggatctttc

SEQ ID NO: 272783 - DNA, 75 bp, Artificial Sequence
  Synthetic
caccctggaaactgaggcttttttgctgtttaaaaaacatgcgttctcgaccatcctggttttgctagtattggc

SEQ ID NO: 272784 - DNA, 75 bp, Artificial Sequence
  Synthetic
catcgttatgaagtggcccgtgtgggttgtggtaatactggggattctagcgtggaacgtcgtgaaaggtgagtt

SEQ ID NO: 272785 - DNA, 75 bp, Artificial Sequence
  Synthetic
tgttgagccattcttggttttaaaacatgaccacagtactatgctcatgaccagactgtacccaggagaaatcgc

SEQ ID NO: 272786 - DNA, 75 bp, Artificial Sequence
  Synthetic
tcacgttgcaactcctgccgggttggtggacattcgtgttagccatgcccaaatttttggaggtcaacgctttcg

SEQ ID NO: 272787 - DNA, 75 bp, Artificial Sequence
  Synthetic
tgagttactgagcgactgctctgtgaacgcttcgtattcgaccgacatatgccccggaggatcacaacttgactt

SEQ ID NO: 272788 - DNA, 75 bp, Artificial Sequence
  Synthetic
ggaatcgatcaaaggtcctggacgtgtctgcatgaccgctccgtacaatcgaggatggggaaccggatgtttcaa

SEQ ID NO: 272789 - DNA, 75 bp, Artificial Sequence
  Synthetic
atggggaattggagctgttgccacgtgcgttgagttgaactgcacacgggaaacaaaagttgatttgttgacaaa

SEQ ID NO: 272790 - DNA, 75 bp, Artificial Sequence
  Synthetic
ttctgctattgtggccaacgtgacagtcaatttccactcgaccaatgacactaaactccttgtgcctgacacccc

SEQ ID NO: 272791 - DNA, 75 bp, Artificial Sequence
  Synthetic
aattacgttgaagtttgggaagttaggaacgatgacaatgacgtgtcgtttgggaaatgaccgcattgctaacga

SEQ ID NO: 272792 - DNA, 75 bp, Artificial Sequence
  Synthetic
tttttaccatgtaactgacaatattgcatctggactgttccagaaagctttgattgatgcgtgggaaggaccctc

SEQ ID NO: 272793 - DNA, 75 bp, Artificial Sequence
  Synthetic
caagatggcgaaccacattagcggacatgaaaaagtcgtgaagtggggtcacattctcccaaatgagatcaaggt

SEQ ID NO: 272794 - DNA, 75 bp, Artificial Sequence
  Synthetic
cagcaagatcattgaaatggagttagattgggaaaaagcgatcaccacacatgatggattttcgaacacctattt

SEQ ID NO: 272795 - DNA, 75 bp, Artificial Sequence
  Synthetic
ttggtgtcaagtggccgtgaacaagttggtcgttgggtcatttgcctcatgcaagagcggagcgaaggctagctt

SEQ ID NO: 272796 - DNA, 75 bp, Artificial Sequence
  Synthetic
catccaatcctcgtggggttttgatggtgtggttgaagtgactttggatgaggccaccaaaaccatttgctccct

SEQ ID NO: 272797 - DNA, 75 bp, Artificial Sequence
  Synthetic
acccctgacatgtaccggatgtagcttgttggctacaaaagtggttttccttgagggaagccagcgggctgttgg

SEQ ID NO: 272798 - DNA, 75 bp, Artificial Sequence
  Synthetic
gcacgtggggtgtggaaatggaacatcaatgttgacagtaggaacgacaaaggttgggatccaatgtgtggtcac

SEQ ID NO: 272799 - DNA, 75 bp, Artificial Sequence
  Synthetic
accggtgtcacaaatttggaacttcgtgactcacgcttccggacgatatgcgaaacttggttttggaggagttgg

SEQ ID NO: 272800 - DNA, 75 bp, Artificial Sequence
  Synthetic
aggagctttccatgatctgctagtgaaggttggattgaccttcacctgggattcatggaagatcatcaccgtgtt

SEQ ID NO: 272801 - DNA, 75 bp, Artificial Sequence
  Synthetic
gtctggtctcgtagtggcttttgccatctttgatcggaagttggtgatcctgatcattatcctctgtggaatcgc

SEQ ID NO: 272802 - DNA, 75 bp, Artificial Sequence
  Synthetic
ttatacccgagctgacattggatgtggcattgattttgacaggaagacctacacgtgtggaagcggtctattcgt

SEQ ID NO: 272803 - DNA, 75 bp, Artificial Sequence
  Synthetic
gtggaagggtttgggaaaatacccaacggccgaccattctgttgagtttgcctcatatgattttctatcagcgta

SEQ ID NO: 272804 - DNA, 75 bp, Artificial Sequence
  Synthetic
cctccaggagcagtttaagtctgagaagaaggtttgtattatttgtgaagacattgtccagtgtgaggcagctag

SEQ ID NO: 272805 - DNA, 75 bp, Artificial Sequence
  Synthetic
aaaagcagccgctgcggtgtataaaaacctaggccacccgtttgtctacgtgaacacgtcggactcctatggaaa

SEQ ID NO: 272806 - DNA, 75 bp, Artificial Sequence
  Synthetic
agtatttgccgaaatcccgaaaagagtccacactgttagtgtgggagtcgacgttgtggaaatggccatgatgac

SEQ ID NO: 272807 - DNA, 75 bp, Artificial Sequence
  Synthetic
tagggagaacaaaccggttggaccgtttggtgacttaccgcgtagtatggtttcgtggaagagtatccctgaaac

SEQ ID NO: 272808 - DNA, 75 bp, Artificial Sequence
  Synthetic
agaagagcacccagtgttgagagtgttgacatcttcaagtgattaccagaaggtatgtggaaaagcgattggatt

SEQ ID NO: 272809 - DNA, 75 bp, Artificial Sequence
  Synthetic
ccagtatgattttgttggataccgtcggaccatgtatggatctaatgtccagttaaaaatatcaaagaaggtttc

SEQ ID NO: 272810 - DNA, 75 bp, Artificial Sequence
  Synthetic
gattgaatgtcccacatacttggcaggagtcgccgtgaaaaatgatagaacggttttcactgatggaatgttctg

SEQ ID NO: 272811 - DNA, 75 bp, Artificial Sequence
  Synthetic
gatgtcatcgaaacgtgagaatggaacatacgcgatcactgagttagagatggagcagtctcacaagtgcatctg

SEQ ID NO: 272812 - DNA, 75 bp, Artificial Sequence
  Synthetic
gccagaccaatacactcctgacgccactttgacgccacgtgacaatgaaatgtttgttccgcctgagtggggagg

SEQ ID NO: 272813 - DNA, 75 bp, Artificial Sequence
  Synthetic
gccaatgtcgaaagccaaccacattcctggttacaaaatgcagactggatttccatggaacaaagcccccattcg

SEQ ID NO: 272814 - DNA, 75 bp, Artificial Sequence
  Synthetic
gtttgttgagggaagtgttccaggaaccattgtcacacagattagtcactgtgatggtagagggattgcagccga

SEQ ID NO: 272815 - DNA, 75 bp, Artificial Sequence
  Synthetic
agtgaatccagcaacgcagcccaattggtgctgtaagtcctgtacaaggattttccactttgaagtcgatgggaa

SEQ ID NO: 272816 - DNA, 75 bp, Artificial Sequence
  Synthetic
actctattatccaatggagattcggcccgacccgaaaggaggggaacagcaaaaagttcctgtagtggagacacc

SEQ ID NO: 272817 - DNA, 75 bp, Artificial Sequence
  Synthetic
cattggagatgaagaaaccgagactgttggtggatggctgggtagaatgtataacattccaggagctgagggatc

SEQ ID NO: 272818 - DNA, 75 bp, Artificial Sequence
  Synthetic
atatgcggattttcgactccccaagttgccaaattcaagaccaagcgcaatggtggggagtttggtcaatctatt

SEQ ID NO: 272819 - DNA, 75 bp, Artificial Sequence
  Synthetic
atgcttgatgttttcaattcagatagttaccaagactatgcgggcaagaacgcttatgcgtttctatctttgttg

SEQ ID NO: 272820 - DNA, 75 bp, Artificial Sequence
  Synthetic
cttggtttttatgttctttggaatgccaactttgtttggattaagtgggtttttggcgtggatgatgattctacc

SEQ ID NO: 272821 - DNA, 75 bp, Artificial Sequence
  Synthetic
aatctcacacaactcggtaacaatgtgcaacctaaccgtgcatctgtgggctgtactgctaaaccagagctcggc

SEQ ID NO: 272822 - DNA, 75 bp, Artificial Sequence
  Synthetic
gatgtttctgtggggcctaacgctccgatcccagatacagaggtctaccgctggacagatgctactctttaccat

SEQ ID NO: 272823 - DNA, 75 bp, Artificial Sequence
  Synthetic
gcagatgttgcatcacgccatctacgcgcactcttgggtgttcgggtgggtcatcgaagtatgcttgtcagtcgg

SEQ ID NO: 272824 - DNA, 75 bp, Artificial Sequence
  Synthetic
gcttatgatgaacttgttaaccgtcatcgatacggttcacccgaaactgatcgcatacttgctcttcttcggatg

SEQ ID NO: 272825 - DNA, 75 bp, Artificial Sequence
  Synthetic
gaaaacgggcatgtgcgtagtgtgcgcttggttattgatatactcaatcaggagatggaactctatagtcgccgc

SEQ ID NO: 272826 - DNA, 75 bp, Artificial Sequence
  Synthetic
ggctccggccgcgggcgggtggaggtcagggtatcgaacaatgatgtcctccagtttgattgttatctttatcag

SEQ ID NO: 272827 - DNA, 75 bp, Artificial Sequence
  Synthetic
tgtaggaattgcaggagttatcgcttcggactatggaggttatccggctgcggctgcggtgactgcagcattgtt

SEQ ID NO: 272828 - DNA, 75 bp, Artificial Sequence
  Synthetic
gataatgggaatcaaaatgtttgactttctgacgacccgattgtctcttgagttcgtatctgcaggcatgttccc

SEQ ID NO: 272829 - DNA, 75 bp, Artificial Sequence
  Synthetic
cgaaggtgttgaaaaagcctttgaaccggactcggtcagtgacttgtttagggcatctttcactgtagatgggat

SEQ ID NO: 272830 - DNA, 75 bp, Artificial Sequence
  Synthetic
aaagttgcaggaccatgttgaaccgatccccattttgtttgccattttgtacatctttattggagctgtggcctg

SEQ ID NO: 272831 - DNA, 75 bp, Artificial Sequence
  Synthetic
taaggttaacccggccctcggaatagtgtatgctatcgccatgttcgcgactcctttaccggagttaatgcgttt

SEQ ID NO: 272832 - DNA, 75 bp, Artificial Sequence
  Synthetic
atacatgatgaccatctattcctctacatttcggacagacactctgcttgggatggctatcccagaaacggagcc

SEQ ID NO: 272833 - DNA, 75 bp, Artificial Sequence
  Synthetic
agaactgtctcaagactttgggccaatccctgatgggatttatcgggtgaacaatcatggattttcagtgaagag

SEQ ID NO: 272834 - DNA, 75 bp, Artificial Sequence
  Synthetic
tcatcggggagttggaatcgtaaagaatggggtttttcacactctcatgcatgtcacgctcaatgagccactcgc

SEQ ID NO: 272835 - DNA, 75 bp, Artificial Sequence
  Synthetic
gtggcaaaatcgcctagtaggaccttcaatgggccactctctcaaggactatgtcacatacggtggaaactggca

SEQ ID NO: 272836 - DNA, 75 bp, Artificial Sequence
  Synthetic
attgcctgactttgatattgttaatgaggtgggcataatggtttgtggacgggatcgttccattcagtacaaaag

SEQ ID NO: 272837 - DNA, 75 bp, Artificial Sequence
  Synthetic
acacgaggttgggacaatcatgatcgacgacaagcgagtgatgtacttcactcatgattacgggcacggatcatc

SEQ ID NO: 272838 - DNA, 75 bp, Artificial Sequence
  Synthetic
tggttcaccaatttttgtgaacggagaacctgtggccttatacggcttcgggttccatttgtacaataggtatcg

SEQ ID NO: 272839 - DNA, 75 bp, Artificial Sequence
  Synthetic
atcaatagttctgcctatcccacgtgaagaagtccttgatggggctagtaatgagggcataccagctgagcacgg

SEQ ID NO: 272840 - DNA, 75 bp, Artificial Sequence
  Synthetic
aaccatgcgcaacaagttttttgttgactggcatccaggaaaagggaaaacccgaaaagtgatcgttaaagaggt

SEQ ID NO: 272841 - DNA, 75 bp, Artificial Sequence
  Synthetic
gttaaatgctttgaatttagcacggcggattgttgttctggcccctacacgagttgtcctggctgaaataactaa

SEQ ID NO: 272842 - DNA, 75 bp, Artificial Sequence
  Synthetic
ggcaataggggaaaacacatcaaaaacgccctcaaaaaatcttgctttcaccggtcacaatattgtgacggtggc

SEQ ID NO: 272843 - DNA, 75 bp, Artificial Sequence
  Synthetic
ttgccacgcgacgttcactgattatgttttgcgtcatgggttatcaaaattcaaagctcacgaagtcataatgga

SEQ ID NO: 272844 - DNA, 75 bp, Artificial Sequence
  Synthetic
tgagtgccattttctggacccacgatctatagctgcgagaggaatcctggagcatctggcaactaaacgtggagt

SEQ ID NO: 272845 - DNA, 75 bp, Artificial Sequence
  Synthetic
taaagtcacgtttatgagtgcaacgatcccaggacgtgaaccttcactcgggtcgaattttgagatctctgaaca

SEQ ID NO: 272846 - DNA, 75 bp, Artificial Sequence
  Synthetic
ggccttgcagtttccccgtgacgtcaaccaaaggtggatagaaactgttgctaggggaaagaccgttgccttcgt

SEQ ID NO: 272847 - DNA, 75 bp, Artificial Sequence
  Synthetic
gccatctcacagggtaggtgacaagctagctcgcgggtgtccccaagccatttccctgcataggaacaattttga

SEQ ID NO: 272848 - DNA, 75 bp, Artificial Sequence
  Synthetic
caccaattacagcacagctatggatgagtccataaaatttatctacaccactgacatatcggaaatgggagccaa

SEQ ID NO: 272849 - DNA, 75 bp, Artificial Sequence
  Synthetic
tttcagtgctgacaccgtcatagatttccgggtggcgattaagccaaagatttctagtgaatttgccgtcactct

SEQ ID NO: 272850 - DNA, 75 bp, Artificial Sequence
  Synthetic
tgaaccaactccgatcacgcgatcatcgatgattcaacggcgtggtcgagttggaagacaacgacctggaaccta

SEQ ID NO: 272851 - DNA, 75 bp, Artificial Sequence
  Synthetic
tatttacccagttgacaaaggcgtcgaagatgcctccgatcagttggcttgttggacagaagctcagatgttgtt

SEQ ID NO: 272852 - DNA, 75 bp, Artificial Sequence
  Synthetic
ggatcaattggacttgacaatgatggcagaggaagttcggcagtcaaacattccaggggcttacaaattagttgg

SEQ ID NO: 272853 - DNA, 75 bp, Artificial Sequence
  Synthetic
gcgtagcctagacatatttcggaagttgctggagaaggatgacataccaatctggctgagctggaagtgggccga

SEQ ID NO: 272854 - DNA, 75 bp, Artificial Sequence
  Synthetic
cagtgttcaacaacaatactccatattgtttgaaggagaacgtcaagagaatgtcgctcgtgtcgtcaacactcg

SEQ ID NO: 272855 - DNA, 75 bp, Artificial Sequence
  Synthetic
agactatgcttctctagagtataagccgaagtttgttgatgcacgattcgagcgtcttggatgggatcaacgaaa

SEQ ID NO: 272856 - DNA, 75 bp, Artificial Sequence
  Synthetic
gctgtcaattcagttttacatgaacactcggagcttcataactttcgccactttgtcacacgtcatttctcaagt

SEQ ID NO: 272857 - DNA, 75 bp, Artificial Sequence
  Synthetic
gatcgaagctggagttgtcaattctgcttggaagcgaataggagacgttagcatcatctttactgaaggaggcga

SEQ ID NO: 272858 - DNA, 75 bp, Artificial Sequence
  Synthetic
cccacatgctaaagatgaaactatcatggcttggactattctggttggaggagtgttgggggctcttggattcct

SEQ ID NO: 272859 - DNA, 75 bp, Artificial Sequence
  Synthetic
catagttgcatggggaatgaaggctgtcttgcgagtaattttcggatcccgcgataagcatcttagcgtcccaac

SEQ ID NO: 272860 - DNA, 75 bp, Artificial Sequence
  Synthetic
cttagtggcggatttccaaccatacatagtgtgtatagttcccattgccctacatcttgctggggttcctatacc

SEQ ID NO: 272861 - DNA, 75 bp, Artificial Sequence
  Synthetic
aatgacaattgtgtttttcgcgatgcttttcttgacttatccactaatgtacaagagtgccggacaacggagtta

SEQ ID NO: 272862 - DNA, 75 bp, Artificial Sequence
  Synthetic
tgttgacattgacttggtgaaatggattctgttaggtggatgtattgtaactggagtcatttgctgggaaatgag

SEQ ID NO: 272863 - DNA, 75 bp, Artificial Sequence
  Synthetic
attgctcccaaacatctcatcagacatttcagctattttgaataggcaaagacaaagggaagacaccccaacttt

SEQ ID NO: 272864 - DNA, 75 bp, Artificial Sequence
  Synthetic
tgatgcttcaccaccttgggaatggttggatttagcacagccagtccctcacaatgttgaattgacgtcagtggt

SEQ ID NO: 272865 - DNA, 75 bp, Artificial Sequence
  Synthetic
gataactacattcacgacctgtctgttcttgcaccaaattgtcggatggtcatacgagtcagagtggctgaaatc

SEQ ID NO: 272866 - DNA, 75 bp, Artificial Sequence
  Synthetic
ctatttcgaccacaaaggagtgggtcagatcatgggtggttttcggttggacacaatttcatggggatcagctct

SEQ ID NO: 272867 - DNA, 75 bp, Artificial Sequence
  Synthetic
aagcggtcttctgggcacagctacttatgcctcatggggagccattttgactgggttaggaggagcggttgtgta

SEQ ID NO: 272868 - DNA, 75 bp, Artificial Sequence
  Synthetic
ttttttcctgatggtttcaatgctcaagtggaacttttcgggaggagccacaactggcttagaaaacaatgtcat

SEQ ID NO: 272869 - DNA, 75 bp, Artificial Sequence
  Synthetic
gcgaaacgaccgagaaactggactaggtaatcggccggcaaacgacaataggcgttccctcctgtacggtgtggt

SEQ ID NO: 272870 - DNA, 75 bp, Artificial Sequence
  Synthetic
ggcggctgaatgtcttgtgtggttgttctgtttcagaactgccacggatgccatagtggtggcttgtttagtgtc

SEQ ID NO: 272871 - DNA, 75 bp, Artificial Sequence
  Synthetic
ctattgtttatggatcatcaacaacccggctagccctcaccacaaaaacactgacttaggatcggcgtgtagttt

SEQ ID NO: 272872 - DNA, 75 bp, Artificial Sequence
  Synthetic
catcggtcttttgtactgtacatgtcctactcaaaaatgcatccaagtattgatgaggtttgctttggccaggtt

SEQ ID NO: 272873 - DNA, 75 bp, Artificial Sequence
  Synthetic
gaacatgaacacccgctctctggaaaaaagcgcgacgggaggccttggacaccgttggaagaagctattaaatgc

SEQ ID NO: 272874 - DNA, 75 bp, Artificial Sequence
  Synthetic
gatgacactattggaattcaacgcttaccgatcttgtggagttgacgagactgagaagggtgactatgtgtcacg

SEQ ID NO: 272875 - DNA, 75 bp, Artificial Sequence
  Synthetic
aggagggctgaagctgagagagataaccatgaagtatggttggaagccagaagggatatgtgttgatcttggatg

SEQ ID NO: 272876 - DNA, 75 bp, Artificial Sequence
  Synthetic
cggcagaggaggatggtcacagcacttggctatggatccccgcgtaactagagtggaatcattcacgttaggagg

SEQ ID NO: 272877 - DNA, 75 bp, Artificial Sequence
  Synthetic
aacagcacgagaaaatccccagccaatcaagacacttggtcataaccttatccggttcaagagtggagtcaatgt

SEQ ID NO: 272878 - DNA, 75 bp, Artificial Sequence
  Synthetic
gtataatatgacgccaacacatgctaacaccatagtgtgtgatatcggagaaagtgaccccaaaccagaggtgga

SEQ ID NO: 272879 - DNA, 75 bp, Artificial Sequence
  Synthetic
aacctctagaacattgcgggtcctcaaaacacttgaactatggttggccaggaatccaaacgctgaatttgtgtg

SEQ ID NO: 272880 - DNA, 75 bp, Artificial Sequence
  Synthetic
caaagtcctttgcccataccccgtggaagtcctcaaatgtctggaaacccttcaacataagtatggcggaagaat

SEQ ID NO: 272881 - DNA, 75 bp, Artificial Sequence
  Synthetic
tattaggtcgacgtatagccgaaattcaagtgctgaaatgtattacatttctggaggccgtaacaacatggtgaa

SEQ ID NO: 272882 - DNA, 75 bp, Artificial Sequence
  Synthetic
ggttatcttcaccaccctccactccttgatttcgaggatacgaactaggccggagaaaatcgtcaaagaaagtgt

SEQ ID NO: 272883 - DNA, 75 bp, Artificial Sequence
  Synthetic
ttctctaccagttgggactagaagcgatccagggcacaagatcaagagtatggatccaaagatgatagcaacgcg

SEQ ID NO: 272884 - DNA, 75 bp, Artificial Sequence
  Synthetic
ggtggaaaagataaaaaaggaacatgcggacacgtggttcgttgacaacaaccatccataccaatcatttcggta

SEQ ID NO: 272885 - DNA, 75 bp, Artificial Sequence
  Synthetic
tgtgggatcgtacgtcacagatgatgtgacaccaggaggtcagactgtcaacccattaatgagaaaaatgatgtg

SEQ ID NO: 272886 - DNA, 75 bp, Artificial Sequence
  Synthetic
gccgtgggagactgttggaggagttgtaaatttcatgatgacggacgtgtccacatatgcccaacagaaggtgtt

SEQ ID NO: 272887 - DNA, 75 bp, Artificial Sequence
  Synthetic
gcgagagaaggtcgacacactatcccctgaacctccaaacgacattcaaagggttaacagatggatcaccgagtt

SEQ ID NO: 272888 - DNA, 75 bp, Artificial Sequence
  Synthetic
cttgtgtgcttcattcatgcgtcgagggttgaaacctagaatcctgaccatggagcaatatatcaacaacgtaaa

SEQ ID NO: 272889 - DNA, 75 bp, Artificial Sequence
  Synthetic
gagctcagctgccattggatcgtggagcagtgatgtcccgtggagcagtgtccgagaagctttagctgataaaag

SEQ ID NO: 272890 - DNA, 75 bp, Artificial Sequence
  Synthetic
attccaccaaatggtcgaggaggaaaggaaactccacttagcaggagactgccgcatgtgcgtgtacaacaccat

SEQ ID NO: 272891 - DNA, 75 bp, Artificial Sequence
  Synthetic
gggcaagaaggagaagaaaccttcagccatgggcgtggccaagggctctcgaaccatttggtacatgtggttagg

SEQ ID NO: 272892 - DNA, 75 bp, Artificial Sequence
  Synthetic
ttcacggtttttggagtacgaagcccttggcttcttaaatgaagatcattgggtgtcacgagacaacttggcatg

SEQ ID NO: 272893 - DNA, 75 bp, Artificial Sequence
  Synthetic
tggtgttggtggagtgggagtgaattacttcggctactacctacaagaaattgcacggaaagggaagttttttat

SEQ ID NO: 272894 - DNA, 75 bp, Artificial Sequence
  Synthetic
cgccgatgacatagcgggatgggacacgcggatcaatgagagtgacttggccgatgaggaatttctcatcatgtc

SEQ ID NO: 272895 - DNA, 75 bp, Artificial Sequence
  Synthetic
cctcatttgtgacccataccatcgatcacttgcaaaagccgtgtttcggtttgcctaccagaacattgtggcctt

SEQ ID NO: 272896 - DNA, 75 bp, Artificial Sequence
  Synthetic
gtttccgcgaaatcatcctgggtttggaagtggaacggtgatggatgtcgtggccagaactgaccaacgaggttc

SEQ ID NO: 272897 - DNA, 75 bp, Artificial Sequence
  Synthetic
aggacaggtcgtgacttacgctctaaacacgataacgaacgccaagattcaattaggcagaatgctggaagccga

SEQ ID NO: 272898 - DNA, 75 bp, Artificial Sequence
  Synthetic
aggattactagacgctcatgaacatgtaatcaaaaaatggttaaacgacaatggtgaagaggctctctccgggat

SEQ ID NO: 272899 - DNA, 75 bp, Artificial Sequence
  Synthetic
ggtggtggccggggatgatgttgtagttgcgaccaacaacggaaatttttcaaggtccttacgatacctccattt

SEQ ID NO: 272900 - DNA, 75 bp, Artificial Sequence
  Synthetic
gaacgggaaaattcgtaaagacattgatccgtccctaccgtccaaagttgaaacgaactgggaggtggttgaatt

SEQ ID NO: 272901 - DNA, 75 bp, Artificial Sequence
  Synthetic
ttgttctcaccattaccacgtgatgaccttaaaggacggacgacgaataattgtcccatgccgagagcagaatga

SEQ ID NO: 272902 - DNA, 75 bp, Artificial Sequence
  Synthetic
aatcattggacgaggcaggattcaaaaaggagggttggtgacccttgccgaaagtgcctgcctagcgaaggctta

SEQ ID NO: 272903 - DNA, 75 bp, Artificial Sequence
  Synthetic
tgggcaaatgtgggctttgtatttctttcaccgaagagatctgcggatggcttttctagccataacttcgagtgt

SEQ ID NO: 272904 - DNA, 75 bp, Artificial Sequence
  Synthetic
tccaatagactggttcccagagggccggacctcgtggtcgattcaccaaaataaagagtggatgaccactgagga

SEQ ID NO: 272905 - DNA, 75 bp, Artificial Sequence
  Synthetic
catgttgcgggtctggaatacagtgtggatccaggacaatccctggatggaggacaaaatggaaatcgaaaattg

SEQ ID NO: 272906 - DNA, 75 bp, Artificial Sequence
  Synthetic
gagggacattccgtacctcccgaaatccatggacctaaagtgcggcagtctcattggaacaaaagaaagagccgc

SEQ ID NO: 272907 - DNA, 75 bp, Artificial Sequence
  Synthetic
ttggtcaaaggatctgccgtcaacggtcacggcagttcggaaaattatcgaccaagacacgaaaaccgagaatgt

SEQ ID NO: 272908 - DNA, 75 bp, Artificial Sequence
  Synthetic
ctaccaagactttcttggcggaatgggccggttccaaacgtacactgaccccatggcaacgtaagaaaccatctt

SEQ ID NO: 272909 - DNA, 75 bp, Artificial Sequence
  Synthetic
ttccaaattagtcgaaaaattttgcccctcttcgaggggctttggcggcagcaggagattttctccggggtttca

SEQ ID NO: 272910 - DNA, 75 bp, Artificial Sequence
  Synthetic
cgctccccccgatgccagtggtcacagcccaagtcagagacttggagttgtggcgggacagtgagctctgtcagt

SEQ ID NO: 272911 - DNA, 75 bp, Artificial Sequence
  Synthetic
ggtcaatagctcaataaatatggcagcagagcttgtctcggggattcacgctccccccattgtgagtgtgtcgaa

SEQ ID NO: 272912 - DNA, 75 bp, Artificial Sequence
  Synthetic
ctggtttcgaaggacgtctagaacgacgctaaagttcaaatccggcaacagagagtttatgtctcggggcctcac

SEQ ID NO: 272913 - DNA, 75 bp, Artificial Sequence
  Synthetic
gcaccccccgttgtgagtgaagtcctttctggccatttagtggtcaggaagggtaccgttttggaacgacggaaa

SEQ ID NO: 272914 - DNA, 75 bp, Artificial Sequence
  Synthetic
taagttccatggagcgacactagccccactgaggggcggttggaatgacacccaacccgctatagtgcgtcgaca

SEQ ID NO: 272915 - DNA, 75 bp, Artificial Sequence
  Synthetic
ggtcaattagctacctggaataagctaatgtgcagggcaacaaagttctaacgaactagggtgagtagcgtcacc

SEQ ID NO: 272916 - DNA, 75 bp, Artificial Sequence
  Synthetic
ccccggttgtgaaaacgattgcgactagaactaaagtcgagagtctccccaccgataggggagctcgtcagtttg

SEQ ID NO: 272917 - DNA, 75 bp, Artificial Sequence
  Synthetic
ttgcgactagaactaaagtcgagagtctccccaccgataggggagctcgtcagtttgttttagtccaattacgct

SEQ ID NO: 272918 - DNA, 75 bp, Artificial Sequence
  Synthetic
cgcaccggggatcctaggcataccttggacgcgcatatttcttgatcaaagatgggacaaattgtgactttgatc

SEQ ID NO: 272919 - DNA, 75 bp, Artificial Sequence
  Synthetic
cagtccattcctgaagtcctgcaagaggtcttcaatgttgctctgatcattgtctcagttctatgcattgtcaaa

SEQ ID NO: 272920 - DNA, 75 bp, Artificial Sequence
  Synthetic
ggatttgtcaatctgatgagatgtggccttttccagctcgtcaccttcctcattttgtctggcagaagttgtgac

SEQ ID NO: 272921 - DNA, 75 bp, Artificial Sequence
  Synthetic
agcatgatgattgatagaaggcacaatctcacccatgttgaattcaatctcacacgaatgtttgacaatctgcct

SEQ ID NO: 272922 - DNA, 75 bp, Artificial Sequence
  Synthetic
caatcatgcagcaagaacaacacacaccattactataaaggaccatccaacacgacatggggaattgaactcacc

SEQ ID NO: 272923 - DNA, 75 bp, Artificial Sequence
  Synthetic
ttgacaaacacatctattgctaatgaaactagtgggaacttctccaacatcgggagccttggatatggcagtatt

SEQ ID NO: 272924 - DNA, 75 bp, Artificial Sequence
  Synthetic
agcaattgtgacaggacaagggaagcaggacatacattgaaatggttactcaatgaactacacttcaatgtgctc

SEQ ID NO: 272925 - DNA, 75 bp, Artificial Sequence
  Synthetic
catgtgactcgtcatataggtgccagatgtaagacagttgaaggtgctggggtgttaatccaatacaacttgaca

SEQ ID NO: 272926 - DNA, 75 bp, Artificial Sequence
  Synthetic
gttggggacagaggaggtgaggttggcagacatcttattgcatcactcgctcaaatcatcggggatcctaaaatc

SEQ ID NO: 272927 - DNA, 75 bp, Artificial Sequence
  Synthetic
gcatgggttgggaagtgcttcaacaactgcagtggagatacttgcagactgacaaactgtgagggtggaacacat

SEQ ID NO: 272928 - DNA, 75 bp, Artificial Sequence
  Synthetic
tacaatttcttaatcatacagaacaccacatgggaaaatcattgcacatacacaccaatggcaacaataagaatg

SEQ ID NO: 272929 - DNA, 75 bp, Artificial Sequence
  Synthetic
gctcttcaaagaactgcttatagttctgttagcaggaaacttcttggcttcttcacttgggacttgagtgattcc

SEQ ID NO: 272930 - DNA, 75 bp, Artificial Sequence
  Synthetic
tctgggcaacatgtcccaggtggctactgtctagagcagtgggccattatctgggctggaataaaatgtttcgac

SEQ ID NO: 272931 - DNA, 75 bp, Artificial Sequence
  Synthetic
aacactgtaatggcaaaatgcaacaaagatcacaacgaggaattttgcgacacaatgaggttatttgatttcaat

SEQ ID NO: 272932 - DNA, 75 bp, Artificial Sequence
  Synthetic
caaaatgccatcaaaaccttgcaactcaatgttgagaattcactgaatcttttcaaaaagaccatcaacggactc

SEQ ID NO: 272933 - DNA, 75 bp, Artificial Sequence
  Synthetic
atttctgactcacttgtgattagaaacagtctcaaacaacttgctaaaattccttactgcaactacacaaaattt

SEQ ID NO: 272934 - DNA, 75 bp, Artificial Sequence
  Synthetic
tggtacatcaatgacactatcacaggaaggcattctttaccgcagtgttggctggttcacaatggctcgtacctc

SEQ ID NO: 272935 - DNA, 75 bp, Artificial Sequence
  Synthetic
aatgaaacgcatttcaagaatgattggttgtgggagagccaaaatctatacaatgagatgctgatgaaagagtat

SEQ ID NO: 272936 - DNA, 75 bp, Artificial Sequence
  Synthetic
gaggaaagacaaggaaaaacccctttggcactgacagatatatgcttctggtctttggttttttacaccattaca

SEQ ID NO: 272937 - DNA, 75 bp, Artificial Sequence
  Synthetic
gtatttctccacatagttggaatacctactcataggcacatcattggtgatggttgcccgaaaccacacaggatt

SEQ ID NO: 272938 - DNA, 75 bp, Artificial Sequence
  Synthetic
tggttgcccgaaaccacacaggattacaagaaactccctgtgtagctgcgggtattataaaataccaaagaaacc

SEQ ID NO: 272939 - DNA, 75 bp, Artificial Sequence
  Synthetic
ttacaaatgggtaaggttgggaaaataagctccgcttccgacatgggcctcgacgtcactccccaataggggagt

SEQ ID NO: 272940 - DNA, 75 bp, Artificial Sequence
  Synthetic
taagctccgcttccgacatgggcctcgacgtcactccccaataggggagtgacgtcaggcctccgaggattaagc

SEQ ID NO: 272941 - DNA, 75 bp, Artificial Sequence
  Synthetic
tcagaggttgatcaagtctgtgttgttcctgtacagtgtgtcaataggtaaacatctcatgggtttctgatctct

SEQ ID NO: 272942 - DNA, 75 bp, Artificial Sequence
  Synthetic
gacccagcctgtcactgttgcatcaaacatgatggtgtcaagcaatgcacagtgggggtttgcagtggtttgtac

SEQ ID NO: 272943 - DNA, 75 bp, Artificial Sequence
  Synthetic
agctcctttcttcttcttctttatgactaagcccttgtgcttggtgcagagttggttgtatctctcccagatctc

SEQ ID NO: 272944 - DNA, 75 bp, Artificial Sequence
  Synthetic
atcctcaaaggtgcgtgcctgctctgcactgagcttcacgtcaagtacttttagatctcttcttccatgcatttc

SEQ ID NO: 272945 - DNA, 75 bp, Artificial Sequence
  Synthetic
gaacagtctgattatatcatctgaaccttgagcagtgaaaaccatgttctggggcaaatgtctgatgattgagga

SEQ ID NO: 272946 - DNA, 75 bp, Artificial Sequence
  Synthetic
gatcagacccggttgagcatcagccaagtcctttaaaaggagaccatgtgaatacttgctctgctctttgaagga

SEQ ID NO: 272947 - DNA, 75 bp, Artificial Sequence
  Synthetic
tttttcatcatggggaaacctataacagtgtatgtagttgcctgtatcaggttggtaaatggccatttccaccgg

SEQ ID NO: 272948 - DNA, 75 bp, Artificial Sequence
  Synthetic
gtcatttggtgtcccctcaatatcaatccacgtagtggctcttggatcaagcatctgaattgaggacacaacagt

SEQ ID NO: 272949 - DNA, 75 bp, Artificial Sequence
  Synthetic
gtcttctttttccttagggatttgtttaagatctggtgatccaccgtttcttactggtggctggatagcacttgg

SEQ ID NO: 272950 - DNA, 75 bp, Artificial Sequence
  Synthetic
ctttgagtccaaatccacagtggtgttgtcccaagccctcccttgaacttgggatcttgagccaatgtagggcca

SEQ ID NO: 272951 - DNA, 75 bp, Artificial Sequence
  Synthetic
gccatcccctgagagacagattttatacagcaggttttcataagggttcctttgcccgggtgtagtactcacaaa

SEQ ID NO: 272952 - DNA, 75 bp, Artificial Sequence
  Synthetic
cataccctcacggttcttaatctgcagtagactttttgtgagggtgctaaacatagagggcttcacttggatggt

SEQ ID NO: 272953 - DNA, 75 bp, Artificial Sequence
  Synthetic
ctcaagcatgttgccaccatcaatcatacaagcagctgctttgactgctgcagacagactaaggttatacccaga

SEQ ID NO: 272954 - DNA, 75 bp, Artificial Sequence
  Synthetic
gatattcaaggctgatggctcatggctgatgatttttagggcgctgtgttgttgtgtgagcttttccagatctgt

SEQ ID NO: 272955 - DNA, 75 bp, Artificial Sequence
  Synthetic
catgttcgggaacttgacagtgtaaagcaaaccaagtgcactcagtgcttggacaacatcattaagctgctcacc

SEQ ID NO: 272956 - DNA, 75 bp, Artificial Sequence
  Synthetic
cccttgctctgtcatacaggcgatggtcaaggctggcattgatccaaattgattaatcaatagtgtgttatcctt

SEQ ID NO: 272957 - DNA, 75 bp, Artificial Sequence
  Synthetic
gatgtcccagaccttcacaacaccatctctgttacctgcgggtctggcattagcaaaccccatcgagcggagaat

SEQ ID NO: 272958 - DNA, 75 bp, Artificial Sequence
  Synthetic
ctctgccctttgctccagctgagtgtttgtaagattgccttcatagacaccaggctgagacaggccttcggttct

SEQ ID NO: 272959 - DNA, 75 bp, Artificial Sequence
  Synthetic
ggtgactttcttccttaacttgtccaaatcagatgcaagctccatgagctcctctttagctaagcctcccacttt

SEQ ID NO: 272960 - DNA, 75 bp, Artificial Sequence
  Synthetic
aagtacattatctctttggactgatctcatattcatcagagcatcaacctctttgttcatgtccctcagcttggt

SEQ ID NO: 272961 - DNA, 75 bp, Artificial Sequence
  Synthetic
cagatcagaatcagtcctcttatctttgcgcactattctttggacttgagcaactttgtgaaagtcaagagcaga

SEQ ID NO: 272962 - DNA, 75 bp, Artificial Sequence
  Synthetic
caacagtgctcttgtgtctgacagcacatcagccttcacaggatgggtccagttggacaagcccctcctaaggga

SEQ ID NO: 272963 - DNA, 75 bp, Artificial Sequence
  Synthetic
ttgcacccagcggaacgatgggatattgtcggacattttggagttgttcacacttcctctgagtcagtaaagaag

SEQ ID NO: 272964 - DNA, 75 bp, Artificial Sequence
  Synthetic
tgttcacacttcctctgagtcagtaaagaagtgaacgtacagcgtgatctagtgtcgcctaggatccactgtgcg

SEQ ID NO: 272965 - DNA, 75 bp, Artificial Sequence
  Synthetic
cgcaccggggatcctaggcataccttggacgcgcatattacttgatcaaagatgggacaagttgtgactttgatc

SEQ ID NO: 272966 - DNA, 75 bp, Artificial Sequence
  Synthetic
ggatttgtcaatctgatgagatgtggcctattccaactcatcaccttcctcattttggctggcagaagttgtgat

SEQ ID NO: 272967 - DNA, 75 bp, Artificial Sequence
  Synthetic
atctcacccacgttgagttcaacctcacaagaatgtttgacaacttgccacaatcatgtagcaagaacaacacac

SEQ ID NO: 272968 - DNA, 75 bp, Artificial Sequence
  Synthetic
atcattactacaaaggaccatctaacacaacatggggaattgaactcactttgacaaacacatccattgcaaatg

SEQ ID NO: 272969 - DNA, 75 bp, Artificial Sequence
  Synthetic
caggtcacacattaaaatggttgcttaatgagttacacttcaatgtgctccatgtcactcgtcatgtaggtgcca

SEQ ID NO: 272970 - DNA, 75 bp, Artificial Sequence
  Synthetic
gatgcaaaacagttgagggtgctggggtgttgatccagtacaacttgacagttggggatagaggaggtgaggttg

SEQ ID NO: 272971 - DNA, 75 bp, Artificial Sequence
  Synthetic
gcagacatcttattgcgtcgcttgctcaaatcattggggacccaaaaattgcgtgggttggaaaatgtttcaata

SEQ ID NO: 272972 - DNA, 75 bp, Artificial Sequence
  Synthetic
actgtagtggagggtcttgcagactaacaaactgtgaaggtgggacacattacaatttcctgatcatacagaaca

SEQ ID NO: 272973 - DNA, 75 bp, Artificial Sequence
  Synthetic
ccacatgggaaaatcactgtacatatactccaatggcaacaataaggatggctctccaaaaaactgcttatagtt

SEQ ID NO: 272974 - DNA, 75 bp, Artificial Sequence
  Synthetic
ctgtgagcaggaaactccttggctttttcacttgggacttgagtgactctactgggcaacatgtcccaggtggtt

SEQ ID NO: 272975 - DNA, 75 bp, Artificial Sequence
  Synthetic
actgtttggagcaatgggctattgtttgggctggaataaaatgttttgataacactgtgatggcaaaatgcaaca

SEQ ID NO: 272976 - DNA, 75 bp, Artificial Sequence
  Synthetic
ttgggctggaataaaatgttttgataacactgtgatggcaaaatgcaacaaagatcacaatgaagaattttgcga

SEQ ID NO: 272977 - DNA, 75 bp, Artificial Sequence
  Synthetic
tacgatgaggttatttgatttcaatcagaatgctatcaaaaccttacaacttaatgttgagaattcgttgaatct

SEQ ID NO: 272978 - DNA, 75 bp, Artificial Sequence
  Synthetic
ctttaaaaagactatcaacggacttatttctgactcacttgtgattagaaacagtctcaaacagcttgccaaaat

SEQ ID NO: 272979 - DNA, 75 bp, Artificial Sequence
  Synthetic
gaagacattctttaccgcagtgttggttagttcacaatggctcgtacctcaatgaaacgcattttaagaatgatt

SEQ ID NO: 272980 - DNA, 75 bp, Artificial Sequence
  Synthetic
aatgaaacgcattttaagaatgattggttgtgggagagccagaatctgtacaatgaaatggtgataaaagaatat

SEQ ID NO: 272981 - DNA, 75 bp, Artificial Sequence
  Synthetic
gaagaaagacaaggtaagactccactagcattgacagacatttgcttctggtctttggtgttttacaccatcaca

SEQ ID NO: 272982 - DNA, 75 bp, Artificial Sequence
  Synthetic
gtgtttctccacttagttggaatacccactcataggcacatcattggtgatggctgtccgaagccacataggatt

SEQ ID NO: 272983 - DNA, 75 bp, Artificial Sequence
  Synthetic
actaggaactctctttgcagctgtgggtattataaaatcccaaagaaaccctacaaatgggtgagactgggtaaa

SEQ ID NO: 272984 - DNA, 75 bp, Artificial Sequence
  Synthetic
taagccctagcctcgacatgggcctcgacgtcactccccaataggggagtgacgtcgaggcctctgaggacttga

SEQ ID NO: 272985 - DNA, 75 bp, Artificial Sequence
  Synthetic
gacgtcgaggcctctgaggacttgagctcagaggttgatcagatctgtgttgttcctgtacagcgtgtcaatagg

SEQ ID NO: 272986 - DNA, 75 bp, Artificial Sequence
  Synthetic
gctcagaggttgatcagatctgtgttgttcctgtacagcgtgtcaataggcaagcatctcattggcttctggtcc

SEQ ID NO: 272987 - DNA, 75 bp, Artificial Sequence
  Synthetic
ctaacccagcctgtcactgttgcatcaaacatgatggtatcaagcaatgcacagtgaggattcgcagtggtttgt

SEQ ID NO: 272988 - DNA, 75 bp, Artificial Sequence
  Synthetic
gcagcccccttcttcttcttctttatgaccaaacctttatgtttggtgcagagtagattatatctctcccagatc

SEQ ID NO: 272989 - DNA, 75 bp, Artificial Sequence
  Synthetic
tcatcctcaaaggtgcgtgcttgctcggcactgagtttcacgtcaagcacttttaagtctcttctcccatgcatt

SEQ ID NO: 272990 - DNA, 75 bp, Artificial Sequence
  Synthetic
tcgaacaaactgattatatcatctgaaccttgagcagtgaaaaccatgttttgaggtaaatgtctgatgattgag

SEQ ID NO: 272991 - DNA, 75 bp, Artificial Sequence
  Synthetic
gaaatcaggcctggttgggcatcagccaagtcctttaaaagaagaccatgtgagtacttgctttgctctttgaag

SEQ ID NO: 272992 - DNA, 75 bp, Artificial Sequence
  Synthetic
gacttctcatcgtggggaaatctgtaacaatgtatgtagttgcccgtgtcaggctggtagatggccatttccacc

SEQ ID NO: 272993 - DNA, 75 bp, Artificial Sequence
  Synthetic
ggatcatttggtgttccttcaatgtcaatccatgtggtagcttttgaatcaagcatctgaattgaggacacaaca

SEQ ID NO: 272994 - DNA, 75 bp, Artificial Sequence
  Synthetic
gtgtcttctttctccttagggatttgtttaaggtccggtgatcctccgtttcttactggtggctggatagcactc

SEQ ID NO: 272995 - DNA, 75 bp, Artificial Sequence
  Synthetic
gtttaaggtccggtgatcctccgtttcttactggtggctggatagcactcggcttcgaatctaaatctacagtgg

SEQ ID NO: 272996 - DNA, 75 bp, Artificial Sequence
  Synthetic
tgttatcccaagccctcccttgaacttgagaccttgagccaatgtaaggccaaccatcccctgaaagacaaatct

SEQ ID NO: 272997 - DNA, 75 bp, Artificial Sequence
  Synthetic
ttgagaccttgagccaatgtaaggccaaccatcccctgaaagacaaatcttgtatagtaaattttcataaggatt

SEQ ID NO: 272998 - DNA, 75 bp, Artificial Sequence
  Synthetic
tctctgtccgggtgtagtgctcacaaacataccttcacgattctttatttgcaatagactctttatgagagtact

SEQ ID NO: 272999 - DNA, 75 bp, Artificial Sequence
  Synthetic
aaacatagaaggcttcacctggatggtctcaagcatattgccaccatcaatcatgcaagcagctgctttgactgc

SEQ ID NO: 273000 - DNA, 75 bp, Artificial Sequence
  Synthetic
tgcagacaaactgagattgtaccctgagatgtttatggctgatggctcattactaatgatttttagggcactgtg

SEQ ID NO: 273001 - DNA, 75 bp, Artificial Sequence
  Synthetic
ttgctgtgtgagtttctctagatctgtcatgttcgggaacttgacagtgtagagcaaaccaagtgcactcagcgc

SEQ ID NO: 273002 - DNA, 75 bp, Artificial Sequence
  Synthetic
agagcaaaccaagtgcactcagcgcttggacaacatcattaagttgttcacccccttgctcagtcatacaagcga

SEQ ID NO: 273003 - DNA, 75 bp, Artificial Sequence
  Synthetic
ttggacaacatcattaagttgttcacccccttgctcagtcatacaagcgatggttaaggctggcattgatccaaa

SEQ ID NO: 273004 - DNA, 75 bp, Artificial Sequence
  Synthetic
ttgattgatcaacaatgtattatccttgatgtcccagatcttcacaaccccatctctgttgcctgtgggtctagc

SEQ ID NO: 273005 - DNA, 75 bp, Artificial Sequence
  Synthetic
catctctgttgcctgtgggtctagcattagcgaaccccattgagcgaaggatttcggctctttgttccaactgag

SEQ ID NO: 273006 - DNA, 75 bp, Artificial Sequence
  Synthetic
tgtttgtgagattgcccccataaacaccaggctgagacaaactctcagttctagtgactttctttcttaacttgt

SEQ ID NO: 273007 - DNA, 75 bp, Artificial Sequence
  Synthetic
ccaaatcagatgcaagctccattagctcctctttggctaagcctcccaccttaagcacattgtccctctggattg

SEQ ID NO: 273008 - DNA, 75 bp, Artificial Sequence
  Synthetic
atctcatattcatcagagcatcaacctctttgttcatgtctcttaacttggtcagatcagaatcagtccttttat

SEQ ID NO: 273009 - DNA, 75 bp, Artificial Sequence
  Synthetic
gataacagtgttcttgtgtccgacaacacatcagccttcacaggatgggtccagttggatagacccctcctaagg

SEQ ID NO: 273010 - DNA, 75 bp, Artificial Sequence
  Synthetic
gactgtacccagcggaatgatgggatgttgtcagacattttggggttgtttgcacttcctccgagtcagtgaaga

SEQ ID NO: 273011 - DNA, 75 bp, Artificial Sequence
  Synthetic
tgtttgcacttcctccgagtcagtgaagaagtgaacgtacggcgtgatctagaatcgcctaggatccactgtgcg

SEQ ID NO: 273012 - DNA, 75 bp, Artificial Sequence
  Synthetic
cgcaccggggatcctaggcatctttgggtcacgcttcaaatttgtccaatttgaacccagctcaagtcctggtca

SEQ ID NO: 273013 - DNA, 75 bp, Artificial Sequence
  Synthetic
aaacttgggatgggactcagatatagcaaagaggtcaggaagagacatggcgacgaagatgtggtgggaagggtc

SEQ ID NO: 273014 - DNA, 75 bp, Artificial Sequence
  Synthetic
cccatgaccctcaatctaccacagggcctgtatggcaggttcaactgcaaatcttgctggttcgtcaacaaaggt

SEQ ID NO: 273015 - DNA, 75 bp, Artificial Sequence
  Synthetic
ctcatcaggtgcaaagaccactatctgtgtcttgggtgcttaaccaaaatgcactccagaggcaatctctgcgag

SEQ ID NO: 273016 - DNA, 75 bp, Artificial Sequence
  Synthetic
atatgcggccactcactgccaaccaagatggagttcctagaaagcccctctgcaccaccctacgagccataaacc

SEQ ID NO: 273017 - DNA, 75 bp, Artificial Sequence
  Synthetic
agggcccctgggcgcacccccctccgggggtgcgcccgggggcccccggccccatggggccggttgtttactcga

SEQ ID NO: 273018 - DNA, 75 bp, Artificial Sequence
  Synthetic
tctccactgactcattgtcctcaaacaactttcgacacctgattcccttgatcttgaagggtcctgtctcgtctg

SEQ ID NO: 273019 - DNA, 75 bp, Artificial Sequence
  Synthetic
caatcataacagatcctagagtcttacttcttattatactaaagtgaccacaattcaaccaatctttggcatcat

SEQ ID NO: 273020 - DNA, 75 bp, Artificial Sequence
  Synthetic
gcaacatgtgttcaaacacttcggggaaattttcaatcatgagtcttaaatcctgctcgttcatacttattccct

SEQ ID NO: 273021 - DNA, 75 bp, Artificial Sequence
  Synthetic
tgttgtgagactgtgcacttgaaaggtactgaaaaaggttggcaataaatcttggccttttctcaggttctaatg

SEQ ID NO: 273022 - DNA, 75 bp, Artificial Sequence
  Synthetic
cttccagtgcaatgatgaccacctttgagtctaagttcacttccaatctagaaaccactctgttgccctctttga

SEQ ID NO: 273023 - DNA, 75 bp, Artificial Sequence
  Synthetic
tcaacccaccctctaaaatgaggggttgcatcccaacatcaggaccaatcaacttataggaaaatttgtttttca

SEQ ID NO: 273024 - DNA, 75 bp, Artificial Sequence
  Synthetic
aatccttgaaacgatttttcaaatctattctcaccttctggaacacagttgaccttgacttgaagtgaatgtctt

SEQ ID NO: 273025 - DNA, 75 bp, Artificial Sequence
  Synthetic
gaccttccaatagatcattgaagtctagaacatcttttccgttgatgagaggattcagaaccaaaagtgacacac

SEQ ID NO: 273026 - DNA, 75 bp, Artificial Sequence
  Synthetic
catccagacttatgtgattcccggaagattgagaaacataatactcaacagaatgggggttcaacaataggtaac

SEQ ID NO: 273027 - DNA, 75 bp, Artificial Sequence
  Synthetic
catcagagtccaatgagtccagcaatgactccctttcaataagaaatcttaattttaatatgtaattggtagacc

SEQ ID NO: 273028 - DNA, 75 bp, Artificial Sequence
  Synthetic
tctcatatctaaatttgtggctcactctcttatgagaaaatgttaggttgagctcaatgggaatgacctcagaag

SEQ ID NO: 273029 - DNA, 75 bp, Artificial Sequence
  Synthetic
gtgatgctaaaatgagttgttcaatgttctcatagttatctctattcacccagtcaagttcattaataaatacac

SEQ ID NO: 273030 - DNA, 75 bp, Artificial Sequence
  Synthetic
taatgttcaaattaacacaggacaaaatcagtttgctgcttacaaagccaacatccaagtcatccagattcattg

SEQ ID NO: 273031 - DNA, 75 bp, Artificial Sequence
  Synthetic
tcctagaagtgttattctttttgcagtcacaaatgaactgggttaattgtttcagatcatgttgtgcattgtttg

SEQ ID NO: 273032 - DNA, 75 bp, Artificial Sequence
  Synthetic
gtcacaaatgaactgggttaattgtttcagatcatgttgtgcattgtttggcaacaattcaagctcaccaaacca

SEQ ID NO: 273033 - DNA, 75 bp, Artificial Sequence
  Synthetic
aaaatatttcttgaactgagatgttgacataatcacaggcaccaacattgactcaaacaaaatctgtatcaagaa

SEQ ID NO: 273034 - DNA, 75 bp, Artificial Sequence
  Synthetic
atttgagcacacttcttctggttcaaggttgaatcctctctccagtggatgagactctctgctatgggacattgc

SEQ ID NO: 273035 - DNA, 75 bp, Artificial Sequence
  Synthetic
atttgtgcacacttcttctggttcaaggttgaatcctctctccagtggatgagactctctgctatgggacattgc

SEQ ID NO: 273036 - DNA, 75 bp, Artificial Sequence
  Synthetic
atttgcgcacacttcttctggttcaaggttgaatcctctctccagtggatgagactctctgctatgggacattgc

SEQ ID NO: 273037 - DNA, 75 bp, Artificial Sequence
  Synthetic
atttgggcacacttcttctggttcaaggttgaatcctctctccagtggatgagactctctgctatgggacattgc

SEQ ID NO: 273038 - DNA, 75 bp, Artificial Sequence
  Synthetic
aagctcattttgctttacaatatacaattcttctctgcgatgttttataatatgactaacaataccaagacattc

SEQ ID NO: 273039 - DNA, 75 bp, Artificial Sequence
  Synthetic
tgatgttatatcaattgccacacaaaggtctaagaactttatcctctgaacccatgatagcctcagcatattcaa

SEQ ID NO: 273040 - DNA, 75 bp, Artificial Sequence
  Synthetic
atcagacaggaaaggggatatgtgttcatcaaatagtgtagggaagttcctcctgattgagtaaagtatgtggtt

SEQ ID NO: 273041 - DNA, 75 bp, Artificial Sequence
  Synthetic
gatgcccaccttgtcctcaagctcagaatgtgtgcttggttttattggccagaagtgattgggattgtttaggtg

SEQ ID NO: 273042 - DNA, 75 bp, Artificial Sequence
  Synthetic
agtgactatcttgggtacttcagctttttgaaacacccagttacccaactcgcaagcattggttaacacaagagc

SEQ ID NO: 273043 - DNA, 75 bp, Artificial Sequence
  Synthetic
aaaataatcccaaattaagggtctggagtactcacttacttcaccaagtgctgctttacaataaacacctttgcg

SEQ ID NO: 273044 - DNA, 75 bp, Artificial Sequence
  Synthetic
ctgattacaaaagtgacaatcacggtgtaagataatcttgcttgtaatatccctgatatacttaaatcctccttt

SEQ ID NO: 273045 - DNA, 75 bp, Artificial Sequence
  Synthetic
cccgtctcttacacattttgagcccatacttttgcaaactcctatgaatcctgatgctatgctgctctgaaaagc

SEQ ID NO: 273046 - DNA, 75 bp, Artificial Sequence
  Synthetic
tgatttgttgatagcatcagccaaaatcttcttagcccctctgacatagttctttgataatttggactgtacgga

SEQ ID NO: 273047 - DNA, 75 bp, Artificial Sequence
  Synthetic
tttgacaagactgggtatttcttctcgctgcacagttcttgttgtgctcattaacttagtacgaagcaccaatct

SEQ ID NO: 273048 - DNA, 75 bp, Artificial Sequence
  Synthetic
gagatcaccatgaacccttaaatttaaccacctaatattaagagcatcctcaatagcctcagtctcgacatcaca

SEQ ID NO: 273049 - DNA, 75 bp, Artificial Sequence
  Synthetic
agtctctaataactgttttaagcagtcatccggtgattgctgaagagttgttacaatataactttcttccagggc

SEQ ID NO: 273050 - DNA, 75 bp, Artificial Sequence
  Synthetic
tccagactgtattttgtaaaatattttcctgcatgcctttctgattattgaaagtagcagatcatcaggaaatag

SEQ ID NO: 273051 - DNA, 75 bp, Artificial Sequence
  Synthetic
tgtctcaattgatcgctgaagtctgtaccctctcgacccattaacccaatcgagtacatccatttcttccaggca

SEQ ID NO: 273052 - DNA, 75 bp, Artificial Sequence
  Synthetic
caaaaatggatcatttggaaacccactatagattatcatgctatttgttcgttttgcaatggcccctacaacctc

SEQ ID NO: 273053 - DNA, 75 bp, Artificial Sequence
  Synthetic
tattgacaccccgttagcaacacattggtccagtattgtgtcaattgtatctgcttgctgattgggtgctttagc

SEQ ID NO: 273054 - DNA, 75 bp, Artificial Sequence
  Synthetic
ctttatgttgtgtagagctgcagcaacaaactttgtaaggagggggacttcttgtgaccaaatgaagaatctcga

SEQ ID NO: 273055 - DNA, 75 bp, Artificial Sequence
  Synthetic
tttgaactcacttgcaaaggtccccacaactgttttagggctcacaaacttgttgagtttgtctgatagaaagta

SEQ ID NO: 273056 - DNA, 75 bp, Artificial Sequence
  Synthetic
gtgaaactccatacagtccaataccaattcaacattcaactcatctctgtccttaaatttgaaaccctcattcaa

SEQ ID NO: 273057 - DNA, 75 bp, Artificial Sequence
  Synthetic
ggataacatgatctcatcatcactcgaagtatatgagatgaaccgtgctccataacaaagctccaatgcgtaatt

SEQ ID NO: 273058 - DNA, 75 bp, Artificial Sequence
  Synthetic
gatgaactgctcagtgattagaccatataagtcagaggtgttgtgtaggatgccctgacccatatctaagactga

SEQ ID NO: 273059 - DNA, 75 bp, Artificial Sequence
  Synthetic
agagatgtgtgatggtaccttgcccttctcaaagtacccaaacataaattcctctgcaattgtgcaccccccttt

SEQ ID NO: 273060 - DNA, 75 bp, Artificial Sequence
  Synthetic
atccatcatacccaacccccttttcaagaaacctttcatgtatgcctcaacgacattgaagggcacttccaccat

SEQ ID NO: 273061 - DNA, 75 bp, Artificial Sequence
  Synthetic
cttgtgaatgtgccatagcaatatgttgatgactgcagcattgggaacttctgacccatctttgagtttgaactc

SEQ ID NO: 273062 - DNA, 75 bp, Artificial Sequence
  Synthetic
aagaccttttaataatgcggcaaagataaccggcgacatgtgtggcccccattttgaatggtccattgacaccgc

SEQ ID NO: 273063 - DNA, 75 bp, Artificial Sequence
  Synthetic
aagaccactttgcctaacaactgacttcatgtctaataatgctctctcaaactctttctcgttgttcagacaagt

SEQ ID NO: 273064 - DNA, 75 bp, Artificial Sequence
  Synthetic
atacctcatgttttgcataagggattcagagtaatcctcaatgagtctggttgtgagtttagtatttaaatcacc

SEQ ID NO: 273065 - DNA, 75 bp, Artificial Sequence
  Synthetic
gacataaagctccctgttgccacccacctgttctttataagaaagaccaaatttcaatctccctacattggtgga

SEQ ID NO: 273066 - DNA, 75 bp, Artificial Sequence
  Synthetic
tacaccagacctctctgtgggagactcatctgaatagaaacagagatttcgtaaggatgagttggtaaaaaagct

SEQ ID NO: 273067 - DNA, 75 bp, Artificial Sequence
  Synthetic
ttgatccaatcttttagctatcgattcagaattgctctctcttgagcttatacgtgatgtctctctaatttgtag

SEQ ID NO: 273068 - DNA, 75 bp, Artificial Sequence
  Synthetic
tgctgcatctgtgaacccaagtctgcttctacttttgtgatcatatcttccgactcgattatcataatcgcttgc

SEQ ID NO: 273069 - DNA, 75 bp, Artificial Sequence
  Synthetic
aatgagaatgtatttaaagcactcaaaataatcagcttctttgtacgccttcaatgtgaggttctttattaaaaa

SEQ ID NO: 273070 - DNA, 75 bp, Artificial Sequence
  Synthetic
ctccagaggacacggattcattagtctgtctgcaaagtacactgatctagcagtgacatcctcatagatcaagtt

SEQ ID NO: 273071 - DNA, 75 bp, Artificial Sequence
  Synthetic
tacaagatcctcatacacttctgctgaaaacaggctgtaatcaaaatcctttacatcatgaagtgaagtctctct

SEQ ID NO: 273072 - DNA, 75 bp, Artificial Sequence
  Synthetic
tttgatgacaaccattgtcgatttgggccataatctctctagtggacatgaagtcttaaggttggttttgacatt

SEQ ID NO: 273073 - DNA, 75 bp, Artificial Sequence
  Synthetic
ggtgtcaaccttagacaatacttttgcaactctggtctcaatttctttaagacagtcaccctgatcttctgatag

SEQ ID NO: 273074 - DNA, 75 bp, Artificial Sequence
  Synthetic
taactcttcaactccatcaggctctattgactccttttttatttggatcaatgatgacaacctcttcagaatctt

SEQ ID NO: 273075 - DNA, 75 bp, Artificial Sequence
  Synthetic
gaaatttacctcctttggatccaacttgtatttacccttagttttgaaatgttcaatcatttccacaacaacagc

SEQ ID NO: 273076 - DNA, 75 bp, Artificial Sequence
  Synthetic
agacacaatggaagagtaatcatattcagtgatgacctcaccaacttcattgagttttggaaccaccacactttt

SEQ ID NO: 273077 - DNA, 75 bp, Artificial Sequence
  Synthetic
gttgctggacatatccaaggctgtacttgtgaaggagggagtcatagggtcacaaggaagcaggggtttcacttc

SEQ ID NO: 273078 - DNA, 75 bp, Artificial Sequence
  Synthetic
caatgagctactgttaaatagtgatagacaaacactaagtacatccttattcaaccccggccttccctcacattt

SEQ ID NO: 273079 - DNA, 75 bp, Artificial Sequence
  Synthetic
ggattccagctttttaccaagtagtctctctatatcatgcaccatcttctcttcttcctcagtaggaagttccat

SEQ ID NO: 273080 - DNA, 75 bp, Artificial Sequence
  Synthetic
actattagaagggttgaccaagactgaatcaaactttaactttggttccaagaacttctcaaaacatttgatttg

SEQ ID NO: 273081 - DNA, 75 bp, Artificial Sequence
  Synthetic
atcagttaatctatcaggggtttctttggttataaaatggcataaataggagacattcaaaacaaacttaaagat

SEQ ID NO: 273082 - DNA, 75 bp, Artificial Sequence
  Synthetic
cttagccatatcttcctctctggagttgctgagtaccagaagtatcaaatcatcaataagcattgctgtctgcca

SEQ ID NO: 273083 - DNA, 75 bp, Artificial Sequence
  Synthetic
ttctgaaggtgttagcataacgactttcaatttctcaaacaattctttaaaatgaacttcatttacaaaggccat

SEQ ID NO: 273084 - DNA, 75 bp, Artificial Sequence
  Synthetic
aatgtaatatctaaagccttgcaagtaaacttgaatacgcttggaaggggtgcacagtatgcagagaataagtcg

SEQ ID NO: 273085 - DNA, 75 bp, Artificial Sequence
  Synthetic
tctgagtaaatcagaaacagaatccaagaggggttgggacataaagtccaaccaggataacatctccacacaagt

SEQ ID NO: 273086 - DNA, 75 bp, Artificial Sequence
  Synthetic
cctttgaatcacatctgcactaaagatcggtaagaaaaatctcttgggatcacagtaaaaagacgcttttgtttc

SEQ ID NO: 273087 - DNA, 75 bp, Artificial Sequence
  Synthetic
atacaaacccccacttttggatctataagcaacagcataacacctggacctctcccctgtcttctggtacagtag

SEQ ID NO: 273088 - DNA, 75 bp, Artificial Sequence
  Synthetic
tgtgagagaacctccttctccaaatcgctggaagaaaacttcgtcacagtaaaccttcccataaaactcatcagc

SEQ ID NO: 273089 - DNA, 75 bp, Artificial Sequence
  Synthetic
attgttcaccttcatcttaggaactgctgctgtcttcatgctattaatgagtgacaaactcaaacttgacaatgt

SEQ ID NO: 273090 - DNA, 75 bp, Artificial Sequence
  Synthetic
tttcagcaattcctcaaactcactttcgcccatgatggtataatcaggctgccctcttcctggcctacccccaca

SEQ ID NO: 273091 - DNA, 75 bp, Artificial Sequence
  Synthetic
catacactgtgactttgtcttgtattgaagacagggtttagcaccccattcatctaacactgatgttttcagatt

SEQ ID NO: 273092 - DNA, 75 bp, Artificial Sequence
  Synthetic
gaagtaatattcaacatcaggttcccgtagaagagggagaatgtcatcaaggggaagttcaccacagaccgagct

SEQ ID NO: 273093 - DNA, 75 bp, Artificial Sequence
  Synthetic
cagtctcttcttagccttctctaaccagttggggtttttaatgaattttttagtgatttgttccatcaggaagtc

SEQ ID NO: 273094 - DNA, 75 bp, Artificial Sequence
  Synthetic
gacattaatcaacctgtcatttacagacggtaacccttgcattaggagcacctctctgaacacagcacctggaga

SEQ ID NO: 273095 - DNA, 75 bp, Artificial Sequence
  Synthetic
agacttgtccaagtcacacaaaatgttgtacatgataaggtccagaaccaacatggtgttcctccttgtgttaaa

SEQ ID NO: 273096 - DNA, 75 bp, Artificial Sequence
  Synthetic
aaccttttgagacttaattttgttgcatattgaaagtactctaaaatattctctgctttcagttgatgaatgctt

SEQ ID NO: 273097 - DNA, 75 bp, Artificial Sequence
  Synthetic
gacctcagattgcctgagttggcctattatgcccaaaatgtgtactgagcaaaactcacataatctgatttctga

SEQ ID NO: 273098 - DNA, 75 bp, Artificial Sequence
  Synthetic
tttaggtacatctttgacagaacattggataaattcatggttctgaagtctagaaatcatatcttccctatctgt

SEQ ID NO: 273099 - DNA, 75 bp, Artificial Sequence
  Synthetic
agcctgcagtttcctatcgagttgaccagcaagttgcaacattttaaattgctgaaagatttccatgatttttgt

SEQ ID NO: 273100 - DNA, 75 bp, Artificial Sequence
  Synthetic
tctacattgatctgttgtcagtttattattaatgccagacattaatgccttttccaacctcactttgtaaggaag

SEQ ID NO: 273101 - DNA, 75 bp, Artificial Sequence
  Synthetic
tcccctttcctttacagcaagtagtgactccagaccgagactctgattttctaaggatgagagggaacttataag

SEQ ID NO: 273102 - DNA, 75 bp, Artificial Sequence
  Synthetic
gcgttcgtactccaactcctcaacttcttcaccagatgtccttaatccatccatgagttttaaaagcaaccaccg

SEQ ID NO: 273103 - DNA, 75 bp, Artificial Sequence
  Synthetic
aagtctctctaccacccaatcaggaacaaattctacataataactggatctaccgtcaataacaggtactaaggt

SEQ ID NO: 273104 - DNA, 75 bp, Artificial Sequence
  Synthetic
tatgttctgtctcttgagatcagaactaagctgcaacagcttcaaaaagtcctggttgtatttcttctcaaatgc

SEQ ID NO: 273105 - DNA, 75 bp, Artificial Sequence
  Synthetic
ttcttgactggtcctcacaaacacttccaaaagaatgaggacatctccaaccatacagtaaccatctggtgtaac

SEQ ID NO: 273106 - DNA, 75 bp, Artificial Sequence
  Synthetic
atccggcaatgtaggacatgttactctcaactccctaaggatagcattgacagtcatctttgtgttgtgtttgca

SEQ ID NO: 273107 - DNA, 75 bp, Artificial Sequence
  Synthetic
ggagtgtttcttgcatgaatccacttccactagcatggacaaaagcttcaggccctctatcgtgatggccctatc

SEQ ID NO: 273108 - DNA, 75 bp, Artificial Sequence
  Synthetic
tttgacttgtgcaagaacgttgtttttctgttcagatagctcttcccattcgggaacccattttctgactatgtc

SEQ ID NO: 273109 - DNA, 75 bp, Artificial Sequence
  Synthetic
ccattttctgactatgtctttaagttcgaaaacgtattcctccatgatcaagaaatgcctaggatcctcggtgcg

SEQ ID NO: 273110 - DNA, 75 bp, Artificial Sequence
  Synthetic
cgcaccgaggatcctaggcatttcttgatcatggaggaatacgtttccgaatttaaagacatggtaagaaaatgg

SEQ ID NO: 273111 - DNA, 75 bp, Artificial Sequence
  Synthetic
gttccagaatgggaagagttatctgagcagaagaataacgtgcttgcacaggttaaagacagagccatcacaata

SEQ ID NO: 273112 - DNA, 75 bp, Artificial Sequence
  Synthetic
gaaggcctgaaactcttatccatgttggtagaggtggactcatgtaagaaacattcctgcagacacaacacaaga

SEQ ID NO: 273113 - DNA, 75 bp, Artificial Sequence
  Synthetic
atgactgtcaatgctatccttagagagttgaaagtcacatgtcctacactaccggatgtcacaccagatggctac

SEQ ID NO: 273114 - DNA, 75 bp, Artificial Sequence
  Synthetic
tgcatggttggagatgtcctcatccttttggaagtgtttgtgaggaccagtcaagaagcatttgaaaaaaagtac

SEQ ID NO: 273115 - DNA, 75 bp, Artificial Sequence
  Synthetic
aatcaggacttcttgaaattgatgcagcttagttctgatctcaagaggcagaatataactttagtacctgttatt

SEQ ID NO: 273116 - DNA, 75 bp, Artificial Sequence
  Synthetic
gatggtagatccagctattatgtggaatatattcctgattgggttgtagagaggcttcggtggttgctcttgaag

SEQ ID NO: 273117 - DNA, 75 bp, Artificial Sequence
  Synthetic
cttatggatggactgaggacatctggtgaagaagttgaggaattggagtacgaacgccttataagttccctgtca

SEQ ID NO: 273118 - DNA, 75 bp, Artificial Sequence
  Synthetic
tctttggaaaatcagagtcttggtttagaatcactacttgccgtgaaagaaagaggacttccttacaaggtgagg

SEQ ID NO: 273119 - DNA, 75 bp, Artificial Sequence
  Synthetic
ttagaaaaggcattggtgtcttgcattaataacaaattgacaacagatcaatgcagaacaaagatcatggaagtt

SEQ ID NO: 273120 - DNA, 75 bp, Artificial Sequence
  Synthetic
tttcagcaatttaaaatgttgcaactctctggccaacatgataggaaactgcaagctacagatagagaagatatg

SEQ ID NO: 273121 - DNA, 75 bp, Artificial Sequence
  Synthetic
atctccaaactccagaaccatgaattcatccaatgttctatcaaagatatgcctaaatcagaaatcagattatgt

SEQ ID NO: 273122 - DNA, 75 bp, Artificial Sequence
  Synthetic
gaattttgttcagtacatattttaggcataatagaccaacttaggcaatctgaaatcaggcacccatcaatcgaa

SEQ ID NO: 273123 - DNA, 75 bp, Artificial Sequence
  Synthetic
agcaaagagtacttcagagtgctttcaatatgtaacaaaattaagtcccagaaggtttttaacacaagaaggaac

SEQ ID NO: 273124 - DNA, 75 bp, Artificial Sequence
  Synthetic
actttattggttttggacctcatcatgtacaacatcttgtgtgacttagacaaatcttctccaggcactgtgttc

SEQ ID NO: 273125 - DNA, 75 bp, Artificial Sequence
  Synthetic
agagaggtgctcttaatgcaagggctgccgtctgtaaatgacaggttaattaatgttgatttcttaatagagcaa

SEQ ID NO: 273126 - DNA, 75 bp, Artificial Sequence
  Synthetic
atcaccaaaaaatttatcaaaaatcccagttggttggagaaagccaagaaaagactaagtctggtgtgtagtgaa

SEQ ID NO: 273127 - DNA, 75 bp, Artificial Sequence
  Synthetic
tttcctcttgatgacatcttgcctcttctaagggaaccagacattgaatactactttgatctaaaaacatcaata

SEQ ID NO: 273128 - DNA, 75 bp, Artificial Sequence
  Synthetic
ttagatgagtggggagccaagccttatcttcaatacaagactaagtcacggtgtatgtgtggaggtagaccaggg

SEQ ID NO: 273129 - DNA, 75 bp, Artificial Sequence
  Synthetic
agggggcaacctgattatgcaattatgggtgaaagtgagtttgaggagttgttgaaagcattgtcaagtctaagt

SEQ ID NO: 273130 - DNA, 75 bp, Artificial Sequence
  Synthetic
ttgtcactcattaacagcatgaagacagcagcagttcctaagatgaaagtgaacaatgctgatgagttttatgga

SEQ ID NO: 273131 - DNA, 75 bp, Artificial Sequence
  Synthetic
aaggtctactgtgatgaagttttctttcaacgatttggagaagggggctctctcacactattgtaccaaaagaca

SEQ ID NO: 273132 - DNA, 75 bp, Artificial Sequence
  Synthetic
ggagagagatccaggtgttatgctgttgctttcagatccaaaagtggaggtttatatgagacaaaagcatcattt

SEQ ID NO: 273133 - DNA, 75 bp, Artificial Sequence
  Synthetic
tactgtgatcctaagaggtttttcttgccgatctttagtgcagatgtgattcaaagaacttgtgaagaaatgttg

SEQ ID NO: 273134 - DNA, 75 bp, Artificial Sequence
  Synthetic
tcttggttagactttatgtcccaacccttgttggatttggtatctgatttgctcagacgtctcatcctttgcata

SEQ ID NO: 273135 - DNA, 75 bp, Artificial Sequence
  Synthetic
ctatgcactccttccaagcgtattcaaatttacttacaaggctttagatattatattatggcttttgtgaatgaa

SEQ ID NO: 273136 - DNA, 75 bp, Artificial Sequence
  Synthetic
gttcattttaaggaattgtttgagaaactgaaagttgttatgctaacaccttcagaatggcagacagcaatactt

SEQ ID NO: 273137 - DNA, 75 bp, Artificial Sequence
  Synthetic
attgacgatctcatactcctagtactcaacaattcaagagaggaagatatggctaaaatctttaaatttgttcta

SEQ ID NO: 273138 - DNA, 75 bp, Artificial Sequence
  Synthetic
aatgtatcctacttgtgtcatttcataaccaaggagacccctgatagattgactgatcaaatcaaatgttttgag

SEQ ID NO: 273139 - DNA, 75 bp, Artificial Sequence
  Synthetic
aagttcttagaaccaaagttaaagtttgactcagtcctggtcaacccctccaacagtatggagctccctattgag

SEQ ID NO: 273140 - DNA, 75 bp, Artificial Sequence
  Synthetic
gaggaagagaaaatggtgcatgacatggagagactactaagtaaaaagctggaatctaaatgcgaagggagacca

SEQ ID NO: 273141 - DNA, 75 bp, Artificial Sequence
  Synthetic
gggatcaacaaggatgtgcttagtgtttgtctatcattgttcaacaatggctcactcgaagtgaaaccctcatct

SEQ ID NO: 273142 - DNA, 75 bp, Artificial Sequence
  Synthetic
tcttgcgaccctatgaccccctccttcacaagcacagctctggacatgtccagcaataaaagtgtggtggttccc

SEQ ID NO: 273143 - DNA, 75 bp, Artificial Sequence
  Synthetic
aaacttgatgaagttggtgaagttatcactgagtatgactactcttctattgtctctgctgttgttgtggaaata

SEQ ID NO: 273144 - DNA, 75 bp, Artificial Sequence
  Synthetic
gttgaacatttcaaaaccaaaggtaagtacaagctggacccaaaagagataaacttcaaaattctaaagaggtta

SEQ ID NO: 273145 - DNA, 75 bp, Artificial Sequence
  Synthetic
tcatcattgattcaaataaagaaggagtcagtagagcctgatgagactgaggagctgttatcagaagatcagagt

SEQ ID NO: 273146 - DNA, 75 bp, Artificial Sequence
  Synthetic
gattgtcttaaagagattgagactagagtttcgaaagtgttatctaaggttgacaccaatgtcaaacccgacttg

SEQ ID NO: 273147 - DNA, 75 bp, Artificial Sequence
  Synthetic
aagactccgtgtccgttggagaggttgtgccctaaatccacaatggtaatcatcaaaagggaaacttcgcttcat

SEQ ID NO: 273148 - DNA, 75 bp, Artificial Sequence
  Synthetic
gatgtgaaagactttgactacaacttattttcagctgaagtgtatgaagatcttgtgaatttgatttatgaggat

SEQ ID NO: 273149 - DNA, 75 bp, Artificial Sequence
  Synthetic
gtcactgctagatcaatgtactttgcagacagactaatgaatccgtgtcctttggagtacttgataaagaacctc

SEQ ID NO: 273150 - DNA, 75 bp, Artificial Sequence
  Synthetic
acactgaaggcttataaagaggctgattattttgagtgcttcaagtacatccttattgcaagcgattttgataat

SEQ ID NO: 273151 - DNA, 75 bp, Artificial Sequence
  Synthetic
cgagttggaagatatgatcacaaaagtagaagcagacttggattcacagatgcagcactacaaataagggagaca

SEQ ID NO: 273152 - DNA, 75 bp, Artificial Sequence
  Synthetic
tcacgcattagttcaagagagagcaactctgaatcgatagctaaaagattagatcagagtttctttacaaactca

SEQ ID NO: 273153 - DNA, 75 bp, Artificial Sequence
  Synthetic
tctttacgaaacctttgtttctattcagatgaatccccaacagagaggtctagtgtgtctactaatgtggggaga

SEQ ID NO: 273154 - DNA, 75 bp, Artificial Sequence
  Synthetic
ttgaaattcggactttcttacaaggagcaagtaggtggtaacagagagctttatgtcggtgacttgaacaccaag

SEQ ID NO: 273155 - DNA, 75 bp, Artificial Sequence
  Synthetic
ctcacaactagacttattgaggattactctgaatccctcatgcagaacatgaggtacacctgcctgaacaatgaa

SEQ ID NO: 273156 - DNA, 75 bp, Artificial Sequence
  Synthetic
aaggagtttgagagagcattattagatatgaaatcagttgtcagacaaagcggccttgcagtgtcaatggaccac

SEQ ID NO: 273157 - DNA, 75 bp, Artificial Sequence
  Synthetic
tcaaaatgggggccacacatgtcaccagtcatctttgccgcattattgaagggccttgagttcaatctcaaagat

SEQ ID NO: 273158 - DNA, 75 bp, Artificial Sequence
  Synthetic
ggatcagaagttcctaatgctgcgattgtcaacatattactatggcatatccacaagatggtagaagtgcctttc

SEQ ID NO: 273159 - DNA, 75 bp, Artificial Sequence
  Synthetic
aatgttgtagaagcatacatgaagggcttcttgaaaagagggttgggtatgatggacaaaggagggtgcacaatt

SEQ ID NO: 273160 - DNA, 75 bp, Artificial Sequence
  Synthetic
gcagaagaatttatgtttggatattttgaaaagggtaaggtgccatcacacatttcttcagtcctggatatgggt

SEQ ID NO: 273161 - DNA, 75 bp, Artificial Sequence
  Synthetic
caaggcattttgcacaatacctctgatctgtatggcctaatcactgagcaattcattaactatgcattggagctc

SEQ ID NO: 273162 - DNA, 75 bp, Artificial Sequence
  Synthetic
tgctatggtgtgcggttcatctcatatacttcaagtgatgatgaaatcatgctgtccttaaatgaggctttcaaa

SEQ ID NO: 273163 - DNA, 75 bp, Artificial Sequence
  Synthetic
tttaaagatagagatgagctaaatgttgacctggtgttagattgtatggagtttcactactttttatcagacaaa

SEQ ID NO: 273164 - DNA, 75 bp, Artificial Sequence
  Synthetic
ctcaacaaatttgtgagtcctaaaacagttgtggggacctttgcaagtgaatttaaatcgagattctttatttgg

SEQ ID NO: 273165 - DNA, 75 bp, Artificial Sequence
  Synthetic
tctcaagaagtccccctccttacaaagtttgttgctgcggccttacacaatataaaggctaaagcacctaaccag

SEQ ID NO: 273166 - DNA, 75 bp, Artificial Sequence
  Synthetic
caagcagatacaattgacacaatattagaccaatgtgtcgccaatggggtgtcaatagaggttgtgggggccatt

SEQ ID NO: 273167 - DNA, 75 bp, Artificial Sequence
  Synthetic
gcaaagcgaactttcagcatgattatctacagtggatttccaaatgatccattcttgtgcctagaagagatggat

SEQ ID NO: 273168 - DNA, 75 bp, Artificial Sequence
  Synthetic
gtgctagattgggtcaacgggtcgagagggtacagactccaacgatcaattgaatcattgtttcctgatgatttg

SEQ ID NO: 273169 - DNA, 75 bp, Artificial Sequence
  Synthetic
ctactttcaataattaggaaggcatgcaggaagatattttacaaaatacaatctggagctctggaagaaagttat

SEQ ID NO: 273170 - DNA, 75 bp, Artificial Sequence
  Synthetic
attgtaacaactcttcagcagtcaccggatgactgtttgaaacagttgttggagacttgtgatgttgagactgag

SEQ ID NO: 273171 - DNA, 75 bp, Artificial Sequence
  Synthetic
gctattgaagatgctctagacatcagatggttgaatctaagggttcatggtgatctgaggttggtgcttcggacc

SEQ ID NO: 273172 - DNA, 75 bp, Artificial Sequence
  Synthetic
aagttgatgagcaccacaagaactgtgcaacgggaagaaatacctagtcttgttaaatccgtacaatctaaattg

SEQ ID NO: 273173 - DNA, 75 bp, Artificial Sequence
  Synthetic
tcaaaaaattacgttagaggagccaagaaaattttagctgatgctatcaataaatcagctttccaaagtagtgtg

SEQ ID NO: 273174 - DNA, 75 bp, Artificial Sequence
  Synthetic
gcatcaggattcataggagtctgtaaaagcatgggttcaagatgcgttagagcgaaaagggggattcaaatacat

SEQ ID NO: 273175 - DNA, 75 bp, Artificial Sequence
  Synthetic
caggatcacacaggtaagatcaccttacatcgtgattgtcaccactgtaatcagcgcaagggtgtttactgtaaa

SEQ ID NO: 273176 - DNA, 75 bp, Artificial Sequence
  Synthetic
gcagcacttagtgaagtgagtgagtactccagacctttaatctgggattattttgcacttgtgctgaccaatgct

SEQ ID NO: 273177 - DNA, 75 bp, Artificial Sequence
  Synthetic
tgtgagctaggcaattgggtgtttcaaaaggctgaagtgccaaagatagtcactcacttaaataaccctaatcac

SEQ ID NO: 273178 - DNA, 75 bp, Artificial Sequence
  Synthetic
ttctggccaataaaaccaagtacacattctgaactagaagacaaggtgggcatcaaccacatactgtactcaatc

SEQ ID NO: 273179 - DNA, 75 bp, Artificial Sequence
  Synthetic
aggagaaacttccccacactgtttgatgaacacatatcccccttcttgtctgacttaaacatgttgagactgtca

SEQ ID NO: 273180 - DNA, 75 bp, Artificial Sequence
  Synthetic
tgggttcagaagataaaatttttagacctttgtgttgcaattgacataacatcagagtgtcttggtattgttagt

SEQ ID NO: 273181 - DNA, 75 bp, Artificial Sequence
  Synthetic
cacattataaaacatcgtagagaagagttgtatattgtaaagcaaaatgagcttgcaatgtctcacagtagggag

SEQ ID NO: 273182 - DNA, 75 bp, Artificial Sequence
  Synthetic
tctcacccactagagagggattcaaccttgagccagagagtatgtgcaaactttttaatacaaatcttgttcgag

SEQ ID NO: 273183 - DNA, 75 bp, Artificial Sequence
  Synthetic
tctatgttggtgcctgtgatcatgtcaacgtctcaatttaaaaagtacttttggttcggcgaagttgagttatta

SEQ ID NO: 273184 - DNA, 75 bp, Artificial Sequence
  Synthetic
ccaaacaatgcacaacatgatttgaaacaattaacccaatttgtatgtgactgcaaaaagaacaacacctctaga

SEQ ID NO: 273185 - DNA, 75 bp, Artificial Sequence
  Synthetic
acaatgaatctagatgacttggacgttggctttgttagcagcaacctgattttgtcctgtgccaatttgaatatt

SEQ ID NO: 273186 - DNA, 75 bp, Artificial Sequence
  Synthetic
agtgtattcattaatgaacttgactggatgaatagagatgactatgagaatatggagcaacacatcttagcatca

SEQ ID NO: 273187 - DNA, 75 bp, Artificial Sequence
  Synthetic
ccctcggaaatcatccctattgagctcaacttgacattctcgcataaaagggtgagtcacaaatttagatatgag

SEQ ID NO: 273188 - DNA, 75 bp, Artificial Sequence
  Synthetic
aggtccaccaattacatattaaaactaagatttcttattgaaaggggttcattgctggattcattagactgtgat

SEQ ID NO: 273189 - DNA, 75 bp, Artificial Sequence
  Synthetic
ggctatctactgttgaagcctcattctgtcgagtactatgttctcaatcctctgaaatcacataagcttgatggt

SEQ ID NO: 273190 - DNA, 75 bp, Artificial Sequence
  Synthetic
gtgtcacttttagttttaaatcctctcatcaacgggaaagatgtgttagactttaatgatttgttagaagatcaa

SEQ ID NO: 273191 - DNA, 75 bp, Artificial Sequence
  Synthetic
gatgttcgtttcaagtcaaggtcagctgtattccagaaagtaaaactagatatgaaagactacttcaaggacctg

SEQ ID NO: 273192 - DNA, 75 bp, Artificial Sequence
  Synthetic
aagaacaagttttcttataagttgattggtcctgatgttgggatgcaacctctgattttggaaaacgggttgatc

SEQ ID NO: 273193 - DNA, 75 bp, Artificial Sequence
  Synthetic
aagaaggaacagagtgtttctagattggaagtgaatttggactcaaaggtggtcatcattcgactggaagcactg

SEQ ID NO: 273194 - DNA, 75 bp, Artificial Sequence
  Synthetic
gaacctgagaaaaggtcaaagttcattgctaacctcttccaatacctctcaagtgcacagtctcacaataagggg

SEQ ID NO: 273195 - DNA, 75 bp, Artificial Sequence
  Synthetic
ataatcatgactgagcaagacctaaggtacatgatcgagaactttcctgaagtcttcgaacatatgttgcatgat

SEQ ID NO: 273196 - DNA, 75 bp, Artificial Sequence
  Synthetic
gctaaagactggttgaactgtggtcactttagcatagtaaaaagcaaaacactagggaccgtcatgattgcagat

SEQ ID NO: 273197 - DNA, 75 bp, Artificial Sequence
  Synthetic
gaaaaaggacccttcaagatcaaaggaatcaggtgtcggaaattgttcgaagacaatgagtcagtggagatcgag

SEQ ID NO: 273198 - DNA, 75 bp, Artificial Sequence
  Synthetic
tgagcaagcacccatgggggcccccggaggggggcccccaggccccaggggccctggtttatggctcatagggag

SEQ ID NO: 273199 - DNA, 75 bp, Artificial Sequence
  Synthetic
gtgcagacggactctccagaaactccatcttggttggaagtgagtgtccgcatatctcacagagatggcctctgg

SEQ ID NO: 273200 - DNA, 75 bp, Artificial Sequence
  Synthetic
agtgcatcttggttaagcatccaagacacagatagtggtctttgcacctgataagacccttgttgacaaaccaac

SEQ ID NO: 273201 - DNA, 75 bp, Artificial Sequence
  Synthetic
aggacttgcaattaaatctgccatacagaccctgtggtaggttgagggtcatagggacccttcccaccacatcct

SEQ ID NO: 273202 - DNA, 75 bp, Artificial Sequence
  Synthetic
cgtcgccatgactctccctgacttctttgctgtatctaagtcccatcctaaatcccaaccaagatttgagctggg

SEQ ID NO: 273203 - DNA, 75 bp, Artificial Sequence
  Synthetic
ttctttgctgtatctaagtcccatcctaaatcccaaccaagatttgagctgggtttaaaattggacaaatttgaa

SEQ ID NO: 273204 - DNA, 75 bp, Artificial Sequence
  Synthetic
tggttgcccgaaaccacacaggattacaagaaactccctgtgtagctgcgggtattataaataccaaagaaacct

SEQ ID NO: 273205 - DNA, 75 bp, Artificial Sequence
  Synthetic
aagctccgcttccgacatgggcctcgacggcactccccaataggggagtgacgtcgaggcctccgaggattaagc

SEQ ID NO: 273206 - DNA, 75 bp, Artificial Sequence
  Synthetic
gctcagaggttgatcagatctgtgttgttcctgtacagcgtgtcaataggcaagcatctcatgggtttctggtcc

SEQ ID NO: 273207 - DNA, 75 bp, Artificial Sequence
  Synthetic
gtttaaggtccggtgatcctccgtttcttactggtggctggatagcactcggcttcgaatctaaatccacagtgg

SEQ ID NO: 273208 - DNA, 75 bp, Artificial Sequence
  Synthetic
aggtcttcaatgtcgccttaatcattgtctcaaccttatgcatcatcaaaggatttgtcaatctgatgagatgtg

SEQ ID NO: 273209 - DNA, 75 bp, Artificial Sequence
  Synthetic
ggcatgatgattgatagaaggcacaatctcacccacgttgagttcaacctcacaagaatgtttgacaacttgcca

SEQ ID NO: 273210 - DNA, 75 bp, Artificial Sequence
  Synthetic
ttgacaaacacatccattgcaaatgaaactagtggaaacttttccaacatcagaagccttgcatatggtaacatt

SEQ ID NO: 273211 - DNA, 75 bp, Artificial Sequence
  Synthetic
gctcagaggttgatcagatctgtgttgttcctgtacagcgtgtcaatgggcaggcatctcattggcttctggtcc

SEQ ID NO: 273212 - DNA, 75 bp, Artificial Sequence
  Synthetic
ttggacgacatcattaagttgttcacccccttgctcagtcatacaagcgatggtcaaggctggcattgatccaaa

SEQ ID NO: 273213 - DNA, 75 bp, Artificial Sequence
  Synthetic
catctctgttgcctgtgggtctagcattagcgaaccccattgagcgaaggatttcggctctttgttccagttgag

SEQ ID NO: 273214 - DNA, 75 bp, Artificial Sequence
  Synthetic
gtcagatcagaatcagtccttttatctttgcgcatcattctttgaacttgagcaactttgtggaagtcaagagca

SEQ ID NO: 273215 - DNA, 75 bp, Artificial Sequence
  Synthetic
tgtttgcacttcctccgagtcagtgaaaaagtgaacgtacagcgtgatctaaaatcgcctaggatccactgtgcg

SEQ ID NO: 273216 - DNA, 75 bp, Artificial Sequence
  Synthetic
tggacgcgcatattacttgatcaaagatgggacaagttgtgactttgatccagtctatacccgaagtcctgcaag

SEQ ID NO: 273217 - DNA, 75 bp, Artificial Sequence
  Synthetic
cagaagccttgcatatggtaacattagtaattgtgataagacaaaagaagcaggtcacacattaaaatggttgct

SEQ ID NO: 273218 - DNA, 75 bp, Artificial Sequence
  Synthetic
cccttattgcaactatacaaaattttggtacatcaatgataccatcacaggaagacattctttaccacagtgttg

SEQ ID NO: 273219 - DNA, 75 bp, Artificial Sequence
  Synthetic
cgcacagtggatcctaggcgacactagatcacgctgtacgttcacttctttactgactcagaggaagtgtgaaca

SEQ ID NO: 273220 - DNA, 75 bp, Artificial Sequence
  Synthetic
actccaaaatgtccgacaatatcccatcgttccgctgggtgcaatcccttaggaggggcttgtccaactggaccc

SEQ ID NO: 273221 - DNA, 75 bp, Artificial Sequence
  Synthetic
atcctgtgaaggctgatgtgctgtcagacacaagagcactgttgtctgctcttgactttcacaaagttgctcaag

SEQ ID NO: 273222 - DNA, 75 bp, Artificial Sequence
  Synthetic
tccaaagaatggtgcgcaaagataagaggactgattctgatctgaccaagctgagggacatgaacaaagaggttg

SEQ ID NO: 273223 - DNA, 75 bp, Artificial Sequence
  Synthetic
atgctctgatgaatatgagatcagtccaaagagataatgtacttaaagtgggaggcttagctaaagaggagctca

SEQ ID NO: 273224 - DNA, 75 bp, Artificial Sequence
  Synthetic
tggagcttgcatctgatttggacaagttaaggaagaaagtcaccagaaccgaaggcctgtctcagcctggtgtct

SEQ ID NO: 273225 - DNA, 75 bp, Artificial Sequence
  Synthetic
atgaaggcaatcttacaaacactcagctggagcaaagggcagagattctccgctcgatggggtttgctaatgcca

SEQ ID NO: 273226 - DNA, 75 bp, Artificial Sequence
  Synthetic
gacccgcaggtaacagagatggtgttgtgaaggtctgggacatcaaggataacacactattgattaatcaatttg

SEQ ID NO: 273227 - DNA, 75 bp, Artificial Sequence
  Synthetic
gatcaatgccagccttgaccatcgcctgtatgacagagcaagggggtgagcagcttaatgatgttgtccaagcac

SEQ ID NO: 273228 - DNA, 75 bp, Artificial Sequence
  Synthetic
tgagtgcacttggtttgctttacactgtcaagttcccgaacatgacagatctggaaaagctcacacaacaacaca

SEQ ID NO: 273229 - DNA, 75 bp, Artificial Sequence
  Synthetic
gcgccctaaaaatcatcagccatgagccatcagccttgaatatctctgggtataaccttagtctgtctgcagcag

SEQ ID NO: 273230 - DNA, 75 bp, Artificial Sequence
  Synthetic
tcaaagcagctgcttgtatgattgatggtggcaacatgcttgagaccatccaagtgaagccctctatgtttagca

SEQ ID NO: 273231 - DNA, 75 bp, Artificial Sequence
  Synthetic
ccctcataaaaagtctactgcagattaagaaccgtgagggtatgtttgtgagtactacacccgggcaaaggaacc

SEQ ID NO: 273232 - DNA, 75 bp, Artificial Sequence
  Synthetic
cttatgaaaacctgctgtataaaatctgtctctcaggggatggctggccctacattggctcaagatcccaagttc

SEQ ID NO: 273233 - DNA, 75 bp, Artificial Sequence
  Synthetic
aagggagggcttgggacaacaccactgtggatttggactcaaagccaagtgctatccagccaccagtaagaaacg

SEQ ID NO: 273234 - DNA, 75 bp, Artificial Sequence
  Synthetic
gtggatcaccagatctcaaacaaatccctaaggaaaaagaagacactgttgtgtcctcaattcagatgcttgatc

SEQ ID NO: 273235 - DNA, 75 bp, Artificial Sequence
  Synthetic
caagagccactacgtggattgatattgaggggacaccaaatgacccggtggaaatggccatctaccaacctgata

SEQ ID NO: 273236 - DNA, 75 bp, Artificial Sequence
  Synthetic
caggcaactacatacactgttataggtttccccatgatgaaaaatccttcaaagagcagagcaagtattcacatg

SEQ ID NO: 273237 - DNA, 75 bp, Artificial Sequence
  Synthetic
gtctccttttaaaggacttggctgatgctcaaccgggtctgatctcctcaatcatcagacatttgccccagaaca

SEQ ID NO: 273238 - DNA, 75 bp, Artificial Sequence
  Synthetic
tggttttcactgctcaaggttcagatgatataatcagactgttcgaaatgcatggaagaagagatctaaaagtac

SEQ ID NO: 273239 - DNA, 75 bp, Artificial Sequence
  Synthetic
ttgacgtgaagctcagtgcagagcaggcacgcacctttgaggatgagatctgggagagatacaaccaactctgca

SEQ ID NO: 273240 - DNA, 75 bp, Artificial Sequence
  Synthetic
ccaagcacaagggcttagtcataaagaagaagaagaaaggagctgtacaaaccactgcaaacccccactgtgcat

SEQ ID NO: 273241 - DNA, 75 bp, Artificial Sequence
  Synthetic
tgcttgacaccatcatgtttgatgcaacagtgacaggctgggtcagagatcagaaacccatgagatgtttaccta

SEQ ID NO: 273242 - DNA, 75 bp, Artificial Sequence
  Synthetic
ttgacacactgtacaggaacaacacagacttgatcaacctctgagcttaatcctcggaggcctcgacgtcactcc

SEQ ID NO: 273243 - DNA, 75 bp, Artificial Sequence
  Synthetic
cctattggggagtgccgtcgaggcccatgtcggaagcggagcttattttcccaaccttacccatttgtaaggttt

SEQ ID NO: 273244 - DNA, 75 bp, Artificial Sequence
  Synthetic
ctttggtatttataatacccgcagctacacagggagtttcttgtaatcctgtgtggtttcgggcaaccatcacca

SEQ ID NO: 273245 - DNA, 75 bp, Artificial Sequence
  Synthetic
atgatgtgcctatgagtaggtattccaactatgtggagaaatactgtaatggtgtaaaaaaccaaagaccagaag

SEQ ID NO: 273246 - DNA, 75 bp, Artificial Sequence
  Synthetic
catatatctgtcagtgccaaaggggtttttccttgtctttcctcatactctttcatcagcatctcattgtataga

SEQ ID NO: 273247 - DNA, 75 bp, Artificial Sequence
  Synthetic
ttttggctctcccacaaccaatcattcttgaaatgcgtttcattgaggtacgagccattgtgaaccagccaacac

SEQ ID NO: 273248 - DNA, 75 bp, Artificial Sequence
  Synthetic
tgcggtaaagaatgccttcctgtgatagtgtcattgatgtaccaaaattttgtgtagttgcagtaaggaatttta

SEQ ID NO: 273249 - DNA, 75 bp, Artificial Sequence
  Synthetic
gcaagttgtttgagactgtttctaatcacaagtgagtcagaaatgagtccgttgatggtctttttgaaaagattc

SEQ ID NO: 273250 - DNA, 75 bp, Artificial Sequence
  Synthetic
agtgaattctcaacattgagttgcaaggttttgatggcattttgattgaaatcaaataacctcattgtgtcgcaa

SEQ ID NO: 273251 - DNA, 75 bp, Artificial Sequence
  Synthetic
aattcctcgttgtgatctttgttgcattttgccattacagtgttgtcgaaacattttattccagcccagataatg

SEQ ID NO: 273252 - DNA, 75 bp, Artificial Sequence
  Synthetic
gcccactgctctagacagtagccacctgggacatgttgcccagaggaatcactcaagtcccaagtgaagaagcca

SEQ ID NO: 273253 - DNA, 75 bp, Artificial Sequence
  Synthetic
agaagtttcctgctaacagaactataagcagttctttgaagagccattcttattgttgccattggtgtgtatgtg

SEQ ID NO: 273254 - DNA, 75 bp, Artificial Sequence
  Synthetic
caatgattttcccatgtggtgttctgtatgattaagaaattgtaatgtgttccaccctcacagtttgtcagtctg

SEQ ID NO: 273255 - DNA, 75 bp, Artificial Sequence
  Synthetic
caagtatctccactgcagttgttgaagcacttcccaacccatgcgattttaggatccccgatgatttgagcgagt

SEQ ID NO: 273256 - DNA, 75 bp, Artificial Sequence
  Synthetic
gatgcaataagatgtctgccaacctcacctcctctgtccccaactgtcaagttgtattggattaacaccccagca

SEQ ID NO: 273257 - DNA, 75 bp, Artificial Sequence
  Synthetic
ccttcaactgtcttacatctggcacctatatgacgagtcacatggagcacattgaagtgtagttcattgagtaac

SEQ ID NO: 273258 - DNA, 75 bp, Artificial Sequence
  Synthetic
catttcaatgtatgtcctgcttcccttgtcctgtcacaattgctaatattgccatatccaaggctcccgatgttg

SEQ ID NO: 273259 - DNA, 75 bp, Artificial Sequence
  Synthetic
gagaagttcccactagtttcattagcaatagatgtgtttgtcaaggtcagttcaattccccatgtcgtgttggat

SEQ ID NO: 273260 - DNA, 75 bp, Artificial Sequence
  Synthetic
ggtcctttatagtaatggtgtgtgttgttcttgctgcatgattgaggcagattgtcaaacattcgtgtgagattg

SEQ ID NO: 273261 - DNA, 75 bp, Artificial Sequence
  Synthetic
aattcaacatgggtgagattgtgccttctatcaatcatcatgctgtcacaacttctgccagacaaaatgaggaag

SEQ ID NO: 273262 - DNA, 75 bp, Artificial Sequence
  Synthetic
gtgacgagctggaaaaggccacatctcatcagattgacaaatcctttgacaatgcatagaactgagacaatgatc

SEQ ID NO: 273263 - DNA, 75 bp, Artificial Sequence
  Synthetic
agagcaacattgaagacctcttgcaggacttcaggaatggactggatcaaagtcacaatttgtcccatctttgat

SEQ ID NO: 273264 - DNA, 75 bp, Artificial Sequence
  Synthetic
gatcaaagtcacaatttgtcccatctttgatcaagaaatatgcgcgtccaaggtatgcctaggatccccggtgcg

SEQ ID NO: 273265 - DNA, 75 bp, Artificial Sequence
  Synthetic
cgcacagtggatcctaggcatatacgtctacgcctattggagatcatggggcaattcataacacttatgcaatcc

SEQ ID NO: 273266 - DNA, 75 bp, Artificial Sequence
  Synthetic
attccagaagcattgaacatggccttcaatgtagcactgatgattgtgtcagtgttgtgcattgttaaagggtta

SEQ ID NO: 273267 - DNA, 75 bp, Artificial Sequence
  Synthetic
gtcaacttgtggaaatgcggcatggtccaactactgctgtttctcttccttgctggcaggtcctgcgatggagaa

SEQ ID NO: 273268 - DNA, 75 bp, Artificial Sequence
  Synthetic
taccggatcgaccggcgacatgtactgtcacatgtcgagttcaatttgaccagaatgtttgacaacctgcctcag

SEQ ID NO: 273269 - DNA, 75 bp, Artificial Sequence
  Synthetic
tcatgttcagttaacaacacccaccactattataaggggccagagaacaccacctggggaattgagctcactctc

SEQ ID NO: 273270 - DNA, 75 bp, Artificial Sequence
  Synthetic
accaacatttctgtcatgaaccgatcaactgagaatgtgactagcattagaagtcttgggtttggcaatataaca

SEQ ID NO: 273271 - DNA, 75 bp, Artificial Sequence
  Synthetic
aactgcgacaagacatcagaagctggacacactttgaaatggcttttgaatgaactacatttcactgtgcttcat

SEQ ID NO: 273272 - DNA, 75 bp, Artificial Sequence
  Synthetic
gtcacaagacacataggtgcattatgcaggacaacagcaggtgcaggtcttctaattcaatacaatctgactcaa

SEQ ID NO: 273273 - DNA, 75 bp, Artificial Sequence
  Synthetic
tcagacaaaggaggcgaggttgggagacacttgattgcatctcttgcccagataattggtgacaacaaagcagca

SEQ ID NO: 273274 - DNA, 75 bp, Artificial Sequence
  Synthetic
tgggttggaaaatgcttcaacaattgcacagcaactggaaagtgcacccttacaaattgtgaaggaggtacacac

SEQ ID NO: 273275 - DNA, 75 bp, Artificial Sequence
  Synthetic
tacaaattcttggttattcaaaacaccacttggccaaaccactgttcctactcaccaatgtcaactgtgagaatg

SEQ ID NO: 273276 - DNA, 75 bp, Artificial Sequence
  Synthetic
ataattcagaagactgcttatggctctgtgtctagaaagttactagggttttttacctgggacatttcagattca

SEQ ID NO: 273277 - DNA, 75 bp, Artificial Sequence
  Synthetic
acagggaaacatgttcctggaggctattgtctagaacaatgggctattgtttgggcaggaataaagtgttttgac

SEQ ID NO: 273278 - DNA, 75 bp, Artificial Sequence
  Synthetic
aattcagtcatggcaaaatgcaataaagatcacaatgaagagttttgtgacacaatgagactatttgattttaat

SEQ ID NO: 273279 - DNA, 75 bp, Artificial Sequence
  Synthetic
caaaatgcaataaaaaccttgcagctgaatgtcgaaaacagtctaaacttgatgaagaaaagtatcaatggtcta

SEQ ID NO: 273280 - DNA, 75 bp, Artificial Sequence
  Synthetic
atttctgactcactagtaattagaaatagtctcaagcagctggccaaaatcccgtattgtaattacactaagttc

SEQ ID NO: 273281 - DNA, 75 bp, Artificial Sequence
  Synthetic
tggtacgtcaacgacaccattacaggaaaacacagtctaccacaatgttggctagtatccaatggtagctatctc

SEQ ID NO: 273282 - DNA, 75 bp, Artificial Sequence
  Synthetic
aatgaaactcactttaaaaatgagtggttgtgggaaagtcagaggctttacaatgatatgttgttgaaagagtac

SEQ ID NO: 273283 - DNA, 75 bp, Artificial Sequence
  Synthetic
gaggaacgacaggggagcactcccttggcattagctgacctctgtttttggtcactagtttttttcacctcgaca

SEQ ID NO: 273284 - DNA, 75 bp, Artificial Sequence
  Synthetic
gtcttcctccaactcattggtattccaacccacagacatctaataggagaaggctgtcctaagccacacagactg

SEQ ID NO: 273285 - DNA, 75 bp, Artificial Sequence
  Synthetic
acctcaaattcattatgctcttgtggatactacaagatcccaaagaaaccctatagatgggtaagaaaaggaaaa

SEQ ID NO: 273286 - DNA, 75 bp, Artificial Sequence
  Synthetic
taagtgaccaggacactggcctcgatgtcacaccccgcaaggggtgtgacatcgaggctccaatttggagtttag

SEQ ID NO: 273287 - DNA, 75 bp, Artificial Sequence
  Synthetic
agctcgatcagtgcggcttgatctctgtagaggagatcaagaggaattagtctagtgggcttcttgtcatccaca

SEQ ID NO: 273288 - DNA, 75 bp, Artificial Sequence
  Synthetic
taccctccaactgtggagcagaacatgatgcaatcaagaagtgcacaatgcgggtttttactgccaggtggagat

SEQ ID NO: 273289 - DNA, 75 bp, Artificial Sequence
  Synthetic
cccttcttctttcttgctaacacaagacccttatgcttattacacaaaacaccatacttgtcccaaaccttgtct

SEQ ID NO: 273290 - DNA, 75 bp, Artificial Sequence
  Synthetic
tcaaactgcctagcctgttctgaagtcagcttcacatcaattattgagatgtccctcctagcatgcatctccaag

SEQ ID NO: 273291 - DNA, 75 bp, Artificial Sequence
  Synthetic
agtttttcaatgtcatcgcttccttgtgcagttagcacaatgcctgccggcaaattctttatgatgtatgagatc

SEQ ID NO: 273292 - DNA, 75 bp, Artificial Sequence
  Synthetic
aatccgggctgagcattggtgaggtcctttagaagcatcccatgagaatatttgctctgatctttgaagctctta

SEQ ID NO: 273293 - DNA, 75 bp, Artificial Sequence
  Synthetic
atgtcatgtggctctctgtagcagtgaatgtaatttccactttcaggctggaaaatggcgagttccacagggtca

SEQ ID NO: 273294 - DNA, 75 bp, Artificial Sequence
  Synthetic
ttgggtgtgccttcaatatcaatccatgttgttgctttgctgtccagctttttcaacccctcaaggagaatttcc

SEQ ID NO: 273295 - DNA, 75 bp, Artificial Sequence
  Synthetic
tccttagcatgactgagttgagaaagtctgggggctcctccattccgcacaggtgcgtgatttgggcttcccaca

SEQ ID NO: 273296 - DNA, 75 bp, Artificial Sequence
  Synthetic
tcagttaaatcaatagtggtgttatcccaagctctccctttaacttgtgatctagagcctatgtaaggccaacca

SEQ ID NO: 273297 - DNA, 75 bp, Artificial Sequence
  Synthetic
tcacctgacagacagagcttgtagagaagattctcatatgggtttctctgccctggaactccactgacgaacatt

SEQ ID NO: 273298 - DNA, 75 bp, Artificial Sequence
  Synthetic
ttctccttggatttcacttcaagaactgctttaatcatagagctgaacatggttggttttacttgaatggtctca

SEQ ID NO: 273299 - DNA, 75 bp, Artificial Sequence
  Synthetic
agcatgtttcctccgtcaagcatgcaggcaccagctttcactgcagctgaaagacttaggttgtaaccagaaaca

SEQ ID NO: 273300 - DNA, 75 bp, Artificial Sequence
  Synthetic
ttgatctgagactgctcttgtgttatatagctcaagcatgggtgctgatcagccaatttctctagatcagccatg

SEQ ID NO: 273301 - DNA, 75 bp, Artificial Sequence
  Synthetic
tttgggtactttactgtgtaaagcagccccagagctgtgagcccttgaaccacatcatttagactctcacctccc

SEQ ID NO: 273302 - DNA, 75 bp, Artificial Sequence
  Synthetic
tgttctgtcatacatgccagagtgacagcaggcattgatccaaattgattaatcaatagtgaactatccttgatg

SEQ ID NO: 273303 - DNA, 75 bp, Artificial Sequence
  Synthetic
tcccaaaccttgacaattccagaagggtttccacgtagtggtgcaaaacccatttctctcagtattctggttctc

SEQ ID NO: 273304 - DNA, 75 bp, Artificial Sequence
  Synthetic
tgttcaagctgtgtcgttgtcaagttgccggcatagacacctggctgtccattcccttcaaaccttgtcactttc

SEQ ID NO: 273305 - DNA, 75 bp, Artificial Sequence
  Synthetic
ttcctcaacttctgaaggtcagaagccagctccattagttcatctttggacaggccacccactctcaatacattg

SEQ ID NO: 273306 - DNA, 75 bp, Artificial Sequence
  Synthetic
tcccgttgagtggttctcatattcataagtgcatccacttctttgttaaggtcacgcaacttagtcaagtcaaca

SEQ ID NO: 273307 - DNA, 75 bp, Artificial Sequence
  Synthetic
tcagtcctcttgtccttcctcatgagcctctgcacttgggccactctgtcaaagtccaaagccgccagaagtgct

SEQ ID NO: 273308 - DNA, 75 bp, Artificial Sequence
  Synthetic
cttgtgtcagtgatgacatcggactttacaggattagtccaattagaaagaccacgtcttaaagcctgggtccat

SEQ ID NO: 273309 - DNA, 75 bp, Artificial Sequence
  Synthetic
ctaaaggatgccacattatcggaagtcatcctgagtttatgcaaagcgtttccgggtatgcctaggatccactgt

SEQ ID NO: 273310 - DNA, 75 bp, Artificial Sequence
  Synthetic
aaggatgccacattatcggaagtcatcctgagtttatgcaaagcgtttccgggtatgcctaggatccactgtgcg

SEQ ID NO: 273311 - DNA, 75 bp, Artificial Sequence
  Synthetic
attccagaggcattgaacatggctttcaatgttgccttagtgatcatttctgtgttgtgttttgtcaaagggctt

SEQ ID NO: 273312 - DNA, 75 bp, Artificial Sequence
  Synthetic
gtgaatctctggaagtgtggtcttgctcagttgatactattcctgttccttgcaggtagatcctgtgacggagaa

SEQ ID NO: 273313 - DNA, 75 bp, Artificial Sequence
  Synthetic
tataagatcgatcgacggcatgttctatcccatgttgagttcaacctgaccagaatgtttgacaacctgcctcag

SEQ ID NO: 273314 - DNA, 75 bp, Artificial Sequence
  Synthetic
tcttgctcagtgaacaacactcaccactactacaaggggccggagaacacaacttggggaatcgagctcactctc

SEQ ID NO: 273315 - DNA, 75 bp, Artificial Sequence
  Synthetic
accaatatatctgtgatgaatcggtcgtcagaaaatgtaacatcaatacgaagccttggttttggcaatatcaca

SEQ ID NO: 273316 - DNA, 75 bp, Artificial Sequence
  Synthetic
aactgcgacaaaacgtcggaagctggtcacaccctgaaatggcttttgaatgagctacacttcactgtgctccat

SEQ ID NO: 273317 - DNA, 75 bp, Artificial Sequence
  Synthetic
gtcacaaggcacattggtgcattatgcaggaccacttcaggtgcagggcttctaattcaatataatttgactcaa

SEQ ID NO: 273318 - DNA, 75 bp, Artificial Sequence
  Synthetic
tctgacaagggaggagaagttggaagacacttgattgcatctcttgctcagattatcgggaacaacaaagcagca

SEQ ID NO: 273319 - DNA, 75 bp, Artificial Sequence
  Synthetic
tgggttgggaaatgtttcaataattgcacagcaagtggtcaatgctctctaactaactgtgaagggggcacacac

SEQ ID NO: 273320 - DNA, 75 bp, Artificial Sequence
  Synthetic
tataagttcttgataattcaaaacaccacctggccaaatcattgttcttactcacccatgtcaacagtgaggatg

SEQ ID NO: 273321 - DNA, 75 bp, Artificial Sequence
  Synthetic
attatacagaagacagcttacagctcagtgtctcgaaaattactgggtttcttcacctgggacatttcagactca

SEQ ID NO: 273322 - DNA, 75 bp, Artificial Sequence
  Synthetic
acaggcaatcatgtccctggaggatattgtctagagcagtgggccattgtttgggcaggaataaaatgttttgac

SEQ ID NO: 273323 - DNA, 75 bp, Artificial Sequence
  Synthetic
aattcagtgatggccaaatgtaataaggatcataacgaagaattctgtgatactatgagactgtttgacttcaat

SEQ ID NO: 273324 - DNA, 75 bp, Artificial Sequence
  Synthetic
caaaatgcaatcaaaactctacaattgaatgttgagaacagtctaaatctcatgaagaaaagcatcaatggtctg

SEQ ID NO: 273325 - DNA, 75 bp, Artificial Sequence
  Synthetic
atttctgactcacttgtgatcaggaacagccttaaacaactggctaaaataccatactgcaactacactaaattt

SEQ ID NO: 273326 - DNA, 75 bp, Artificial Sequence
  Synthetic
tggtatgtcaatgatacaatcacaggaaaacatagtctgccacaatgctggttggtatcaaatgggagctacctt

SEQ ID NO: 273327 - DNA, 75 bp, Artificial Sequence
  Synthetic
aatgagtcccatttcaaaaatgaatggctttgggaatctcagaaactctataatgacatgctgttaaaagagtat

SEQ ID NO: 273328 - DNA, 75 bp, Artificial Sequence
  Synthetic
gaggaaagacaggggaacactcccttagcactggctgatttgtgcttctggtcactggttttctttacttcaacg

SEQ ID NO: 273329 - DNA, 75 bp, Artificial Sequence
  Synthetic
gtgttccttcagttagtgggtatcccaactcacagacatctgataggagagggctgtcccaaacctcacagactg

SEQ ID NO: 273330 - DNA, 75 bp, Artificial Sequence
  Synthetic
acaaagaactccttatgcttttgtgggttttataagataccaaaaaaaccttttagatgggttaggaaaggaaaa

SEQ ID NO: 273331 - DNA, 75 bp, Artificial Sequence
  Synthetic
tagacaaccagcaagccttccggcctcgatgtcacaccccgtaaggggtgtgacatcgaggcttcatctgaagac

SEQ ID NO: 273332 - DNA, 75 bp, Artificial Sequence
  Synthetic
ctagagctcgatcaatgcagcttgatccctgtaaaggagatcaagagggagcaatctagtcggctttttatcatc

SEQ ID NO: 273333 - DNA, 75 bp, Artificial Sequence
  Synthetic
cacatatcctccaattgtggagcaaaacatgatgcaatcaagaagagcacaatgtgggtttttactgcctggcgg

SEQ ID NO: 273334 - DNA, 75 bp, Artificial Sequence
  Synthetic
agagcctttcttcttccttgctaacacaagacctttgtgtttgttacacaagatgccaaatttatcccaaacttt

SEQ ID NO: 273335 - DNA, 75 bp, Artificial Sequence
  Synthetic
gtcctcaaattgtctggcctgctctgatgtgagcttcacatcaattattgaaatgtccctccttgcatgcatctc

SEQ ID NO: 273336 - DNA, 75 bp, Artificial Sequence
  Synthetic
aaggagcttctcaatgtcatcggcaccctgtgcagtgagcacaattcctgctggtaggttttttatgatgaatga

SEQ ID NO: 273337 - DNA, 75 bp, Artificial Sequence
  Synthetic
gatcaggccgggctgggcatttgtgaggtccttgagcaacatcccgtgggagtacttactctgatctttgaagct

SEQ ID NO: 273338 - DNA, 75 bp, Artificial Sequence
  Synthetic
agtacttactctgatctttgaagcttttgacatcatgaggctctctgtaacagtgaacatagttcccactgtcag

SEQ ID NO: 273339 - DNA, 75 bp, Artificial Sequence
  Synthetic
gttggaaaatggccagctccactggatcatttggcgttccctcaatgtcaatccatgtggttgctttactatcca

SEQ ID NO: 273340 - DNA, 75 bp, Artificial Sequence
  Synthetic
acttttttaggccttcaagaagaatttcttctttggcatgactcaattgagagagtctaggagcacctccatttc

SEQ ID NO: 273341 - DNA, 75 bp, Artificial Sequence
  Synthetic
gaacaggtgggtggttggggcctccaacatcagtcagatcaatagtggtgttgtcccatgccctccctttcactt

SEQ ID NO: 273342 - DNA, 75 bp, Artificial Sequence
  Synthetic
gtgaccgagacccgatgtagggccatccatcaccagaaaggcagagtttgtaaagcaagttttcgtatgggttcc

SEQ ID NO: 273343 - DNA, 75 bp, Artificial Sequence
  Synthetic
aaaactgcctttatcatggagctgaacattgttggctttacttgaatagtttcaagcatgtttcctccatcaagc

SEQ ID NO: 273344 - DNA, 75 bp, Artificial Sequence
  Synthetic
atacaagctccagctttcaccgcagcagacaagctcaaattgtagccagacacattgatttgagactgctcttga

SEQ ID NO: 273345 - DNA, 75 bp, Artificial Sequence
  Synthetic
gtaatataactaagacaaggatactgatctgaaagtttctccagatcagccatgttcgggtacttcactgtgtag

SEQ ID NO: 273346 - DNA, 75 bp, Artificial Sequence
  Synthetic
agcaatcccagagctgtgaggccctgcaccacgtcgttcagactctcacctccctgttcggccatacatgccaat

SEQ ID NO: 273347 - DNA, 75 bp, Artificial Sequence
  Synthetic
gtgacagcaggcatagacccaaattggttgattaggagtgaactatccttgatgtcccacactttcacaacacct

SEQ ID NO: 273348 - DNA, 75 bp, Artificial Sequence
  Synthetic
gaagggttgcctctcagctgagcaaaacccatatccctcaggattctggtcctttgctcaagttgtgttgtggtt

SEQ ID NO: 273349 - DNA, 75 bp, Artificial Sequence
  Synthetic
agattgccagcatagacacccggctgcccactcccttcagcccttagcactttcttcttcagcttctgaagatca

SEQ ID NO: 273350 - DNA, 75 bp, Artificial Sequence
  Synthetic
gaggccaattccataagttcatccttggacagtcctccaactctcagtacattgtctttctgagttgttctcatg

SEQ ID NO: 273351 - DNA, 75 bp, Artificial Sequence
  Synthetic
ttcatcagtgcatctacttctttgtttaaatcacgcaacttggtcaaatcggtgtctgtccttttgtccttcctc

SEQ ID NO: 273352 - DNA, 75 bp, Artificial Sequence
  Synthetic
atgagcctttggacttgagctactctatcaaagtccagggctgcaagaagagctcgtgtgtcagtgatgacatca

SEQ ID NO: 273353 - DNA, 75 bp, Artificial Sequence
  Synthetic
gacttcacagggttagtccagttggaaagaccccgcctgagagcctgagtccatctgaaggatgccacattgtca

SEQ ID NO: 273354 - DNA, 75 bp, Artificial Sequence
  Synthetic
cgcacagtggatcctaggcttttttggatcacgcttacccctgttcaggataacactgaaaacatgggtctacgc

SEQ ID NO: 273355 - DNA, 75 bp, Artificial Sequence
  Synthetic
tacagcaaagaggtgagagagagacacggagacaaagatctggaagggagagtccccatgacactcaatctccca

SEQ ID NO: 273356 - DNA, 75 bp, Artificial Sequence
  Synthetic
cagggtttatatggacgcttcaactgtaagtcttgctggtttgcaaacagaggtctcatagcctgctcagatcac

SEQ ID NO: 273357 - DNA, 75 bp, Artificial Sequence
  Synthetic
tatctgtgcctgaattgcttgactagactcaggtctcagtctcaattctgtggaatctgcggcaagcctctgcca

SEQ ID NO: 273358 - DNA, 75 bp, Artificial Sequence
  Synthetic
acaaaaatcagatttgaggagagcccatctgctccaccatacgaaccctaactgcccaccgggccccggcgcacc

SEQ ID NO: 273359 - DNA, 75 bp, Artificial Sequence
  Synthetic
ccccaaagggggtgcgcccggggccccccgggcccgggggcccgtatgaaactagtcaatctcgacagcttggga

SEQ ID NO: 273360 - DNA, 75 bp, Artificial Sequence
  Synthetic
gtccgggagcaatcttctgcagttcactccttttagtttaaaggggcccctctcatctgcaatcatgacacaacc

SEQ ID NO: 273361 - DNA, 75 bp, Artificial Sequence
  Synthetic
aagtgatttgcttttgcacaatgaaaatgatccacaattcaaccagtcatttgtggcatccaacatcgagtcaaa

SEQ ID NO: 273362 - DNA, 75 bp, Artificial Sequence
  Synthetic
cacttgaggatagttgtctattaattgaactaggttggattcagtcatggatatacgatgctcttctcctctaag

SEQ ID NO: 273363 - DNA, 75 bp, Artificial Sequence
  Synthetic
tgatcctatatacataaacagatttgatataaatgttgaccttgactcttcctccagacatcccaaggccacgaa

SEQ ID NO: 273364 - DNA, 75 bp, Artificial Sequence
  Synthetic
aactgctttaaagtccaatctcaatttcaattgagaaacaattcgtgacccttctttgatttgacctttatctag

SEQ ID NO: 273365 - DNA, 75 bp, Artificial Sequence
  Synthetic
aactagaggttccatgatgatatctggtccaattaatttgtaagagaatttgttctttaattccttcaagaaagg

SEQ ID NO: 273366 - DNA, 75 bp, Artificial Sequence
  Synthetic
tttgaaatcaaacctcatcttcgagaacagtggactttcagcagagaaatttacatcttcatgtctgagaacatc

SEQ ID NO: 273367 - DNA, 75 bp, Artificial Sequence
  Synthetic
atctatatttaaaacctcttttccactgataagtggatctagaggtaagagacccacaccatccaggctaatgtg

SEQ ID NO: 273368 - DNA, 75 bp, Artificial Sequence
  Synthetic
gttgccacctgattgtgaaacaaagtattcaacagagtgtggtgtaatcagaagtgactggtcctcaagcatatt

SEQ ID NO: 273369 - DNA, 75 bp, Artificial Sequence
  Synthetic
tgagttcagtactcgtttatcgaacactacatgtaccttgagaatgtaactagtgcacctctcatatctgaactt

SEQ ID NO: 273370 - DNA, 75 bp, Artificial Sequence
  Synthetic
gtgactggatctaatatgactaaaagtcatgctgaactcaaacttaaaaacatcgcatggtgacgatagaattag

SEQ ID NO: 273371 - DNA, 75 bp, Artificial Sequence
  Synthetic
ctcttggaatgatttatactcatgcctgttttcccaatctaatgatgtgatgaaagtagacaatgcgacaaaagt

SEQ ID NO: 273372 - DNA, 75 bp, Artificial Sequence
  Synthetic
agttgtcctcttaactctactggtcacgtaacctacatccaagtcatctaatgtcatagccctgcttgaattcaa

SEQ ID NO: 273373 - DNA, 75 bp, Artificial Sequence
  Synthetic
ctgcttacagtcaagaataaattgtgtaaactgagcaagatgatgagaagcatcattcgggagctgtaaaacttc

SEQ ID NO: 273374 - DNA, 75 bp, Artificial Sequence
  Synthetic
tccataccagaagtactttctaaactgactagtggtaagaagaactggatttaccatggaatcaaacaacacttg

SEQ ID NO: 273375 - DNA, 75 bp, Artificial Sequence
  Synthetic
taagaggaagttcttacacacttcttgaggttcaagacttaaaccactctctaagtttgtactttcccttgtatg

SEQ ID NO: 273376 - DNA, 75 bp, Artificial Sequence
  Synthetic
ggacatggatagctcttgctgcttgacaatataaagctcctctctcttcctcctcatgatatgagatataatacc

SEQ ID NO: 273377 - DNA, 75 bp, Artificial Sequence
  Synthetic
caaacattctgaagacatatctaatgccacacacaaatccaaaaactttatcttttgaacccaactcaatcttaa

SEQ ID NO: 273378 - DNA, 75 bp, Artificial Sequence
  Synthetic
catgtttaaatcagacatataaggactgatgtgctcatcaaagatactaggatagtttcttctgatcgaatatag

SEQ ID NO: 273379 - DNA, 75 bp, Artificial Sequence
  Synthetic
gacatgattcattccgactttatcttccaactctgtctgactggagggttttatcggccagaagtggtttggatt

SEQ ID NO: 273380 - DNA, 75 bp, Artificial Sequence
  Synthetic
gtccagatggaagactgtctttggtaaaattggtgcaccgaatacccaattccctaactcacaagcattggacaa

SEQ ID NO: 273381 - DNA, 75 bp, Artificial Sequence
  Synthetic
gactaatgaaaaataatcccagaagataggtcttgaatactctgaaacacttcgcagtgcatcctcacagtaaat

SEQ ID NO: 273382 - DNA, 75 bp, Artificial Sequence
  Synthetic
gttttttgagggtttgcagtatgggcaataagaggttgtgtgcggcattacatgctttgtaatttctttaatata

SEQ ID NO: 273383 - DNA, 75 bp, Artificial Sequence
  Synthetic
tacaaatcctccagtattatctctcacacactttgaccccatacttttgcaaacgccaataaacccagacgatat

SEQ ID NO: 273384 - DNA, 75 bp, Artificial Sequence
  Synthetic
gcaactttgaaatgccgacttattgatggcatctgtcagtattcttttggctcctcttacaaagttctttgataa

SEQ ID NO: 273385 - DNA, 75 bp, Artificial Sequence
  Synthetic
ttttgattgaactgatctcacgaggcttggtatctcctccctttgcagggttctggtcgatgacatcaattttgt

SEQ ID NO: 273386 - DNA, 75 bp, Artificial Sequence
  Synthetic
cctcaagaccagtctaagatcaccatatgccctgaggttgagccaccggtaaccagcaaggtcttttttaatgtc

SEQ ID NO: 273387 - DNA, 75 bp, Artificial Sequence
  Synthetic
ctcatcaacatctgctattgttaacattgaatttaaacattcatcaggggaaccttgtatggatgcaacaaggaa

SEQ ID NO: 273388 - DNA, 75 bp, Artificial Sequence
  Synthetic
ttcttcttcaatcttcccagactgaattctatgaaacacctttctacaggcatccctaataagattaggacacaa

SEQ ID NO: 273389 - DNA, 75 bp, Artificial Sequence
  Synthetic
gtcatcagggaagatattttcgattgacctttgtaatctataacctcttgaaccatcaacccagtctctcacatc

SEQ ID NO: 273390 - DNA, 75 bp, Artificial Sequence
  Synthetic
actctcctctagacacaagaatggattcaatgggtgcccagaataacagactagagaatttgtgcgcttggatat

SEQ ID NO: 273391 - DNA, 75 bp, Artificial Sequence
  Synthetic
tgcaccaacaatttctattgacaccccattcgccacacattgatccaaaattgtatccactgtctcagccagctg

SEQ ID NO: 273392 - DNA, 75 bp, Artificial Sequence
  Synthetic
gtttggtgctttggcttttatgttatgaagagcagcggcaacaaattttgttagtaagggaacttcctgtgacca

SEQ ID NO: 273393 - DNA, 75 bp, Artificial Sequence
  Synthetic
aataaagaaccttgacttgaattcactggcaaaagtaccagctactgttttaggactgacgaatttattcaactt

SEQ ID NO: 273394 - DNA, 75 bp, Artificial Sequence
  Synthetic
atctgaaagaaaattatggaattccaagatttccaatgccacatcaacattcaaagaaccatcttcatgattcaa

SEQ ID NO: 273395 - DNA, 75 bp, Artificial Sequence
  Synthetic
ggctgacgaggttgataacatgatctcatcatcactagaggtatatgatgtcattgagacattatagcagaaatc

SEQ ID NO: 273396 - DNA, 75 bp, Artificial Sequence
  Synthetic
tagtacatagtttatgaattgctctgtgataagaccgtataagtcagacatattgtgtagtattccttgtcccat

SEQ ID NO: 273397 - DNA, 75 bp, Artificial Sequence
  Synthetic
atcaaccacagatgaaaggtgtgaaggtacaactcccttttcaaaaaacccaaacataaattcctctgatagtgt

SEQ ID NO: 273398 - DNA, 75 bp, Artificial Sequence
  Synthetic
tgctccacctctatccatgagtcccaatcctctcttaacaaatccactcataaaagcctgtacaacattgaaagg

SEQ ID NO: 273399 - DNA, 75 bp, Artificial Sequence
  Synthetic
aacttccacaattttatgaagatgccaatataatatgtttagtactgctttcttatctatctctgagccatcttt

SEQ ID NO: 273400 - DNA, 75 bp, Artificial Sequence
  Synthetic
caatcgaaatttcaaacacctcaaaagttgtgcaaaaatggcaggactcatgtgaggcccccattttgaatgatc

SEQ ID NO: 273401 - DNA, 75 bp, Artificial Sequence
  Synthetic
catgctcaccgcgaatccaccctgcctgacaacagatttcatatcaaggagcgccctctcaaactcagattcact

SEQ ID NO: 273402 - DNA, 75 bp, Artificial Sequence
  Synthetic
attcagacatgtgtatttcatgttcgagcatattgattctgcataatcctctactaatctggtgatcaacttggt

SEQ ID NO: 273403 - DNA, 75 bp, Artificial Sequence
  Synthetic
gtttaagtcacccacatacaactccctgtttccccccacttgctctttataagacaacccaaatttaagttttcc

SEQ ID NO: 273404 - DNA, 75 bp, Artificial Sequence
  Synthetic
aacatcagttgccaccccagtcctcgttgtaggtgattcatcagagtagaagcaaagattccttagggatgaatt

SEQ ID NO: 273405 - DNA, 75 bp, Artificial Sequence
  Synthetic
tgtaaagaaacttttatccaaccttttggctatggattctgagttactttcccttgtactaatgcgggcttcttc

SEQ ID NO: 273406 - DNA, 75 bp, Artificial Sequence
  Synthetic
tctaatcttcaaagcaggatctttgagccctaatctggttcttattttatgatcatatctcccgattttgttgtc

SEQ ID NO: 273407 - DNA, 75 bp, Artificial Sequence
  Synthetic
aaattcacttgcaattagaatgtacttaaaacattcaaaaaagtcaccttcattaaaagccttaagtgtaaggtt

SEQ ID NO: 273408 - DNA, 75 bp, Artificial Sequence
  Synthetic
tttcattaacatgtctagcggacaagggtttaagtacttctctagaaagtagaagtcatgggcagacttatcatt

SEQ ID NO: 273409 - DNA, 75 bp, Artificial Sequence
  Synthetic
gaagacaattgtaactagttcctcataagtatcaaaagggaacaactgaacatcaaaatccttcacctcatgaag

SEQ ID NO: 273410 - DNA, 75 bp, Artificial Sequence
  Synthetic
tgaagtttctgatgaaatcttgtctctcacttccttgctccaaagcctcttcaaatgtgcttcagctcccttttc

SEQ ID NO: 273411 - DNA, 75 bp, Artificial Sequence
  Synthetic
tttactttgctttctattcagctcatccttggacatcccctcaaatgtctttgagacttttacctcaatctcact

SEQ ID NO: 273412 - DNA, 75 bp, Artificial Sequence
  Synthetic
caacatcaactgctgttcttctgtgagctcgtccataaaagattcatcaggggccacaacctcaccagactcgct

SEQ ID NO: 273413 - DNA, 75 bp, Artificial Sequence
  Synthetic
ctttctattgcttttctttgttgggttcacctctaccagtgagctcaacttcttaaaaattctaaatctaaggtc

SEQ ID NO: 273414 - DNA, 75 bp, Artificial Sequence
  Synthetic
tctaggatctaatttatattttcctttagtcttaaaatgctctgtcaagtccaccacaacacttgagacaatttt

SEQ ID NO: 273415 - DNA, 75 bp, Artificial Sequence
  Synthetic
cccaaagtcatattcagtaagggtttcaccaatctcattcaactttggcacaactacacttttgttgctggacaa

SEQ ID NO: 273416 - DNA, 75 bp, Artificial Sequence
  Synthetic
atctaatgcagtgctagtgaaagatggggttaatggatcatggttcagtaggggcttcacctcaagatttgaact

SEQ ID NO: 273417 - DNA, 75 bp, Artificial Sequence
  Synthetic
attaaagagagaggagcacaatgatactagttcttttgaaacacccggtatgttctcacattttgagaaaatctt

SEQ ID NO: 273418 - DNA, 75 bp, Artificial Sequence
  Synthetic
tttattaagtagtctatgtaaaccctcacaaacttggtcctcttgctcacttgtcaactctggtgtagagtcagg

SEQ ID NO: 273419 - DNA, 75 bp, Artificial Sequence
  Synthetic
gttaaccatcaagctgccaaatttaagcttgggctccagaaacttctcaaaacacttgatttggtctgtgagcct

SEQ ID NO: 273420 - DNA, 75 bp, Artificial Sequence
  Synthetic
atcaggggtttcttttgtaattagatgacataggtaagacaaattcaaaatgaatttgaatgactttgccatatc

SEQ ID NO: 273421 - DNA, 75 bp, Artificial Sequence
  Synthetic
agcttccttagacatctctaagacaatcctggttaagtcgtccatccaaatcatcacttgcctctctgaagccgt

SEQ ID NO: 273422 - DNA, 75 bp, Artificial Sequence
  Synthetic
caatgcatccacttccaactttgcaaagaggtcattacaatgaatctcatttacataagccattataagatatct

SEQ ID NO: 273423 - DNA, 75 bp, Artificial Sequence
  Synthetic
aaagccttggaggtatacttggaccctttttgatggagtgcataagacacacaaaatcaattttctgaggaggtc

SEQ ID NO: 273424 - DNA, 75 bp, Artificial Sequence
  Synthetic
tgcaacaaccttgatattgtcatcactcaaaaagtcaagccatgacaacatctcattgcacatcctatttagaac

SEQ ID NO: 273425 - DNA, 75 bp, Artificial Sequence
  Synthetic
atcttgggacatgattggtaaaaagaacctctttgggtcagcataaaatgaaatcttgctgccataatcaatctg

SEQ ID NO: 273426 - DNA, 75 bp, Artificial Sequence
  Synthetic
ttgctcattgtcagaaaatgctacactgtaacatcttgatttttctccagttttctgatataaaagtgtgcaagc

SEQ ID NO: 273427 - DNA, 75 bp, Artificial Sequence
  Synthetic
attgttatcgccaaatccctgaaagtaaacttcttcacagtggacaattccataaaaatcattggcttgatttat

SEQ ID NO: 273428 - DNA, 75 bp, Artificial Sequence
  Synthetic
ttttgatttaggtgcacttgaggtcttcatagagttcactaatgataagctaagacttgataaaatcttcaagta

SEQ ID NO: 273429 - DNA, 75 bp, Artificial Sequence
  Synthetic
tgacaagaagtcttcttcagtcatcatgcttaagttcttaagagtttctgcattacacacacaacccttactact

SEQ ID NO: 273430 - DNA, 75 bp, Artificial Sequence
  Synthetic
tctataacagatgcttggtttgaattgctgggtcattaaaagttcatcctttatactaaaccatgtgtcaaaatc

SEQ ID NO: 273431 - DNA, 75 bp, Artificial Sequence
  Synthetic
aatctcaaccaaataatcttccaatgctttaaacatacagtcctgaactactctcttcagtttcccatgaacctt

SEQ ID NO: 273432 - DNA, 75 bp, Artificial Sequence
  Synthetic
ttccagccatttgggacttttaatcattttcctctcatatatgctaatcagaaagtcaattgacaacagtctatc

SEQ ID NO: 273433 - DNA, 75 bp, Artificial Sequence
  Synthetic
attgacagcggggatacattgcattctcaggatagtcagtgcagctttgattccataaatcttaatcaaacttaa

SEQ ID NO: 273434 - DNA, 75 bp, Artificial Sequence
  Synthetic
gagtttatttaacattattaaatctaaaaccatcaaagtcccccttcttgtgttcagtaccttcaaactcttaac

SEQ ID NO: 273435 - DNA, 75 bp, Artificial Sequence
  Synthetic
cttattgcaaactgacaacaattggttgtattcttttaatatgaagctgctttctatgttcttgttgctcacaaa

SEQ ID NO: 273436 - DNA, 75 bp, Artificial Sequence
  Synthetic
agattgcttgattattgtcaaaactttgaacatgtgaatcatgcagtttttgcaagagtcttcttcactcatgat

SEQ ID NO: 273437 - DNA, 75 bp, Artificial Sequence
  Synthetic
tgcacatttgatcaaaccatgttctcttaatgtctttagtatgaactctctatccgttttcctatattttggttt

SEQ ID NO: 273438 - DNA, 75 bp, Artificial Sequence
  Synthetic
gaattgaccctgatcaaaaagttgtctaaaattctgatagatcctcaatatttcccctttgcactcatcaactga

SEQ ID NO: 273439 - DNA, 75 bp, Artificial Sequence
  Synthetic
catattattattcaaattcccatacattattttggtgagtctgtctatatactcaattcccctttccttaattga

SEQ ID NO: 273440 - DNA, 75 bp, Artificial Sequence
  Synthetic
taatagggattcaagtccgagactttgattttccaaggcagaaagactagatacaagcctctcatattctagctc

SEQ ID NO: 273441 - DNA, 75 bp, Artificial Sequence
  Synthetic
ttcaaccgattcaccatcttcttttagcaaatccattaattttattagatgccatctaattttttctaccaccca

SEQ ID NO: 273442 - DNA, 75 bp, Artificial Sequence
  Synthetic
gtctggcatgaactcaacataataggatgacctaccatcaatcataggaacaagtgtgatgccatgtgactgtaa

SEQ ID NO: 273443 - DNA, 75 bp, Artificial Sequence
  Synthetic
gtctttctttacttgcataagttttgtgtagtcttgttcatacttcttttcaaaagactcctggttagagcgcac

SEQ ID NO: 273444 - DNA, 75 bp, Artificial Sequence
  Synthetic
aaacacctctagtagtataagtacatctccaatcaacctataaccatctggaacaatttctggtaatgtcggaca

SEQ ID NO: 273445 - DNA, 75 bp, Artificial Sequence
  Synthetic
aactattttgttgtctctgagtattgagttcaatgttttctctctattatgaatgcatgagttcttttgacatga

SEQ ID NO: 273446 - DNA, 75 bp, Artificial Sequence
  Synthetic
gtcaacctctacaattgtggacaacaattttagtccttcaattgttatagccctcaattttgtctgggacagaaa

SEQ ID NO: 273447 - DNA, 75 bp, Artificial Sequence
  Synthetic
aattgctttctgctccgcaaagttttcatcatcagacacccatttcctgacaaggtcgtgcaattcgttaacgtg

SEQ ID NO: 273448 - DNA, 75 bp, Artificial Sequence
  Synthetic
ccatttcctgacaaggtcgtgcaattcgttaacgtgttcctccatgttcaaggaaagcgtaggatccactgtgcg

SEQ ID NO: 273449 - DNA, 75 bp, Artificial Sequence
  Synthetic
cgcaccgtggatcctaggcatatacgtctacgcctattggagatcatggggcagttcataacactgatgcagtcg

SEQ ID NO: 273450 - DNA, 75 bp, Artificial Sequence
  Synthetic
attccagaagcattgaacatggctttcaatgttgctttagtgatcatttctgtattgtgttttgtcaaagggctt

SEQ ID NO: 273451 - DNA, 75 bp, Artificial Sequence
  Synthetic
taaagcaagttttcgtatgggttcctctgtcccggagactcactgacaaacatcttttctttagacttcacttct

SEQ ID NO: 273452 - DNA, 75 bp, Artificial Sequence
  Synthetic
cgcacagtggatcctaggcatacaagtctacgccttactcttgatcatggggcaattcataactttgatgcaatc

SEQ ID NO: 273453 - DNA, 75 bp, Artificial Sequence
  Synthetic
gataccagaagcattgaacatggctttcaatgttgctctagtgattgtgtcactgttatgtgttaccaagggact

SEQ ID NO: 273454 - DNA, 75 bp, Artificial Sequence
  Synthetic
gatcaacctctggaaatgcgggatcattcaactcctaatgtttcttgcattagcaggaagatcctgtgatggtga

SEQ ID NO: 273455 - DNA, 75 bp, Artificial Sequence
  Synthetic
atacaagatcgataggagacatgtcctgtcacatgtagagtttaacctaactaggatgtttgacaatctgccaca

SEQ ID NO: 273456 - DNA, 75 bp, Artificial Sequence
  Synthetic
atcctgctctatcaacaatacccaccattactataagggaccagaaaacaccacttggggtgttgagctcacact

SEQ ID NO: 273457 - DNA, 75 bp, Artificial Sequence
  Synthetic
caccaatacttcagtgatgaatagatctgatgagaatgtcacatcaatcagaagtcttgggtttgggaacataac

SEQ ID NO: 273458 - DNA, 75 bp, Artificial Sequence
  Synthetic
caactgtgacaagacaggtgaggcaggccacactctgaaatggctcctgaacgagcttcacttcacagtgctcca

SEQ ID NO: 273459 - DNA, 75 bp, Artificial Sequence
  Synthetic
cgtcacgaggcatataggggctttttgcagaacaacagcaggtgctggcctgttgattcaatacaatctgacaac

SEQ ID NO: 273460 - DNA, 75 bp, Artificial Sequence
  Synthetic
ctctgacaaaggtggtgaagttggaagacatctaatagcatctcttgcccaaatcatcggagataataaagcagc

SEQ ID NO: 273461 - DNA, 75 bp, Artificial Sequence
  Synthetic
atgggttgggaaatgctacaacaactgcaccagctctggatgctctctaacaaactgtgagggtgggacccatta

SEQ ID NO: 273462 - DNA, 75 bp, Artificial Sequence
  Synthetic
caagtttcttgtgattcaaaaccccacatggccaaatcattgctcctattcaccaatgtctactgtaaggatgat

SEQ ID NO: 273463 - DNA, 75 bp, Artificial Sequence
  Synthetic
aattcaaaaaacagcatacagctcagtttccaggaaactcttgggattcttcacatgggacatttcagactcatc

SEQ ID NO: 273464 - DNA, 75 bp, Artificial Sequence
  Synthetic
aggccaacatgtgcctggaggatactgtttggaacagtgggcaattgtctgggcaggaatcaaatgttttgataa

SEQ ID NO: 273465 - DNA, 75 bp, Artificial Sequence
  Synthetic
gggcaggaatcaaatgttttgataactctgtaatggccaaatgcaacaaagatcccaatgaggaattctgtgacc

SEQ ID NO: 273466 - DNA, 75 bp, Artificial Sequence
  Synthetic
ccatgaggttgtttgacttcaatcaaaatgcgattaaaacattgcagttaaatgttgaaaacagtctaaatctga

SEQ ID NO: 273467 - DNA, 75 bp, Artificial Sequence
  Synthetic
tgaaaaaaagcataaatggtttgatttctgattcacttgtcatcagaaacagtctcaaacaactggccaaaatcc

SEQ ID NO: 273468 - DNA, 75 bp, Artificial Sequence
  Synthetic
ttctgattcacttgtcatcagaaacagtctcaaacaactggccaaaatccctatttgtaactacacgaaattctg

SEQ ID NO: 273469 - DNA, 75 bp, Artificial Sequence
  Synthetic
gtatgtgaatgacaccataactgggaaacatagtctgcctcaatgttggcttgtctcaaatggtagctacctaaa

SEQ ID NO: 273470 - DNA, 75 bp, Artificial Sequence
  Synthetic
tgaaacgcattttaaaaatgaatggttgtgggaaagccaaaaactttataatgacatgctcttgaaagaatatga

SEQ ID NO: 273471 - DNA, 75 bp, Artificial Sequence
  Synthetic
agaaagacaagggaatacccctttagctctagctgacctttgcttctggtccttggtgttcttcacaacaacagt

SEQ ID NO: 273472 - DNA, 75 bp, Artificial Sequence
  Synthetic
attctttcagttgattggcatccctactcacagacacctgattggtgaaggttgcccaaaacctcacagattgac

SEQ ID NO: 273473 - DNA, 75 bp, Artificial Sequence
  Synthetic
actcacagacacctgattggtgaaggttgcccaaaacctcacagattgacttcaaattcattgtgttcatgtggc

SEQ ID NO: 273474 - DNA, 75 bp, Artificial Sequence
  Synthetic
ttcaaattcattgtgttcatgtggcttttataagatacccccgaagccatttatatgggtggggaaaggtacgta

SEQ ID NO: 273475 - DNA, 75 bp, Artificial Sequence
  Synthetic
gacaaccagaaacaagaccagtaactggcctcaatgtcacaccccaattggggtgtgacatcgaggctccgtcaa

SEQ ID NO: 273476 - DNA, 75 bp, Artificial Sequence
  Synthetic
tggcctcaatgtcacaccccaattggggtgtgacatcgaggctccgtcaaggagttctagagctcaatcagtgag

SEQ ID NO: 273477 - DNA, 75 bp, Artificial Sequence
  Synthetic
gcttgctctctatagaggaggtccagcggtaaaagtctggtgggtttcttgtcatcaacgaacccaccaattgtg

SEQ ID NO: 273478 - DNA, 75 bp, Artificial Sequence
  Synthetic
gagcaaaacatgatgcagtccagaagagcacagtgtgggtttttactaccaggaggagagcctttcttctttctt

SEQ ID NO: 273479 - DNA, 75 bp, Artificial Sequence
  Synthetic
gcaagaacaatccccttatgcttgttgcacagaatgccaaacttgtcccagactttgtcctcgaactgccttgct

SEQ ID NO: 273480 - DNA, 75 bp, Artificial Sequence
  Synthetic
tgttctgaggttaatctcacatctatgattgatatgtctctccttgcatgcatctccaatagtttctcaatgtca

SEQ ID NO: 273481 - DNA, 75 bp, Artificial Sequence
  Synthetic
tcactcccctgtgcagtgagaacaattcctgcaggaagattcttgatgataaaggatatcaacccaggttgtgtg

SEQ ID NO: 273482 - DNA, 75 bp, Artificial Sequence
  Synthetic
tttgtaagatccttcaagagcattccatgtgagtatttactctgatctttgaagctctttacatcatggggctcc

SEQ ID NO: 273483 - DNA, 75 bp, Artificial Sequence
  Synthetic
ctgtagcagtggatgtagttgccgctctcaggctggaatattgctaattccactggatcattaggtgtcccttca

SEQ ID NO: 273484 - DNA, 75 bp, Artificial Sequence
  Synthetic
atgtcaatccaggtagttgccttgctgtccagtcttttgagaccctcgagaatctgttcttctttagcatgacta

SEQ ID NO: 273485 - DNA, 75 bp, Artificial Sequence
  Synthetic
agttgagagagtcttggtgagcctccattccgcactggtggatgattgggactaccagtgtctgttaagtccaca

SEQ ID NO: 273486 - DNA, 75 bp, Artificial Sequence
  Synthetic
gtggtgttgtcccaagctctccctttgacctgtgatctagacccgatgtaaggccacccatcaccagatagacac

SEQ ID NO: 273487 - DNA, 75 bp, Artificial Sequence
  Synthetic
aatttatacaacaagttctcataagggttcctttgccctggagcctcactgacaaacatccttttctttgacttc

SEQ ID NO: 273488 - DNA, 75 bp, Artificial Sequence
  Synthetic
actttcaggacagcctttatcattgagctgaacattgtaggttccacttgaattgttctcaaagcaatgttgcct

SEQ ID NO: 273489 - DNA, 75 bp, Artificial Sequence
  Synthetic
ccgtctagcatgcaggcccctgcttttacagcagcagaaagacttaggttgtaaccagagacattaatttgtgat

SEQ ID NO: 273490 - DNA, 75 bp, Artificial Sequence
  Synthetic
tgttcctgtgtaatgtaacccaaacaaggatattggtcagcaagtttttctaaatctgacatatttgggtactta

SEQ ID NO: 273491 - DNA, 75 bp, Artificial Sequence
  Synthetic
actgtgtacaagagcccaagtgctgacaaaccctgcacaacatcatttagtgattcaccaccctgctcagtcatg

SEQ ID NO: 273492 - DNA, 75 bp, Artificial Sequence
  Synthetic
catgccattgtcacagcaggcatcgatccaaactggtttattagaagagagctatctttgatgtcccacacctta

SEQ ID NO: 273493 - DNA, 75 bp, Artificial Sequence
  Synthetic
actactccagagggattccctcttagttgagcaaaacccatgtctctcaagatctttgacctttgctctagttgt

SEQ ID NO: 273494 - DNA, 75 bp, Artificial Sequence
  Synthetic
gtggtagttaaattaccagcatatacacccggttgtccactaccctctactctgagtaccttcttcttgagcttc

SEQ ID NO: 273495 - DNA, 75 bp, Artificial Sequence
  Synthetic
tgtaagtcagaagcaagttccatcagctcatctttagataaaccaccaaccctcaaaacattatccttctgtgtt

SEQ ID NO: 273496 - DNA, 75 bp, Artificial Sequence
  Synthetic
gttctcatattcattagtgcatcaacttctttattaagatccctcaattttgtgaggtcggtgtcagtcctctta

SEQ ID NO: 273497 - DNA, 75 bp, Artificial Sequence
  Synthetic
tcctttctcatcagcctctgtacctgtgcaactctgtcaaagtcaagagctgcaagcagagccctggtgtcagtg

SEQ ID NO: 273498 - DNA, 75 bp, Artificial Sequence
  Synthetic
atgacatcagacttcacaggattggtccaatttgagagacctctcctcagagcctgagtccacctgaaggatgcc

SEQ ID NO: 273499 - DNA, 75 bp, Artificial Sequence
  Synthetic
ggatgccacgttatcagaagccatatcagggttttgagcaaagcgtttccttgtttgcctaggatccactgtgcg

SEQ ID NO: 273500 - DNA, 75 bp, Artificial Sequence
  Synthetic
cgcacagtggatcctaggcatataagtctacgccaacttcaggatcatgggccaattcttgacactgatgcagtc

SEQ ID NO: 273501 - DNA, 75 bp, Artificial Sequence
  Synthetic
aatcccagaggcattgaacatggctttcaatgttgctctagtgatcatctcacttctgtgcattgtcaaggggtt

SEQ ID NO: 273502 - DNA, 75 bp, Artificial Sequence
  Synthetic
tgtgaacctatggaaatgtggcattattcaactcataatgtttcttgcgttagcaggtagatcttgtgatggtga

SEQ ID NO: 273503 - DNA, 75 bp, Artificial Sequence
  Synthetic
gttcaaaatagacagaagacatgtgctgtcccacgttgagttcaacctgaccagaatgtttgataacctaccgca

SEQ ID NO: 273504 - DNA, 75 bp, Artificial Sequence
  Synthetic
atcctgttcagtgaacaacacacaccattactacaaagggcctgagaacaccacctggggaattgagctaacatt

SEQ ID NO: 273505 - DNA, 75 bp, Artificial Sequence
  Synthetic
gacaaacacatcagtcatgaataggtcaactgagaatgtaacaagcatcaggagtcttggatttggcaatataac

SEQ ID NO: 273506 - DNA, 75 bp, Artificial Sequence
  Synthetic
caactgtgacaagacatctgaagcaggtcatacactgaaatggctactcaatgagctccacttcactgtcctcca

SEQ ID NO: 273507 - DNA, 75 bp, Artificial Sequence
  Synthetic
tgtcacaaggcacattggtgctctctgcaggacaacagctggtgcaggtctgctgatccagtacaacatgtcagc

SEQ ID NO: 273508 - DNA, 75 bp, Artificial Sequence
  Synthetic
ttcagacaaagggggtgaggtaggagcacatttggttgcatcccttgctcaaatcatcggagacaacaaagctgc

SEQ ID NO: 273509 - DNA, 75 bp, Artificial Sequence
  Synthetic
gtgggttgggaaatgcttcaataattgtactagtgctggtaaatgtgctctaaccaactgtgaaggaagcacgca

SEQ ID NO: 273510 - DNA, 75 bp, Artificial Sequence
  Synthetic
ttacaagtacttgataattcagaatacgacatggcctaatcactgctcttattcaccgatgtccactgtaaggat

SEQ ID NO: 273511 - DNA, 75 bp, Artificial Sequence
  Synthetic
gatcatacaaaagactgcatacagttcagtctctaggagacttttagggttttttacatgggatatctcagactc

SEQ ID NO: 273512 - DNA, 75 bp, Artificial Sequence
  Synthetic
aacaggacaacatgttcctgggggctactgtctggaacagtgggccattgtttgggcaggaatcaaatgctttga

SEQ ID NO: 273513 - DNA, 75 bp, Artificial Sequence
  Synthetic
caattctgttatggcaaagtgcaacaaagaccataatgaggagttttgtgacacaatgagattgtttgattttaa

SEQ ID NO: 273514 - DNA, 75 bp, Artificial Sequence
  Synthetic
tcagaatgcaataaaaactttacagttaaatgtggagaacaccttaaacttgatgaaaaagagtatcaatggtct

SEQ ID NO: 273515 - DNA, 75 bp, Artificial Sequence
  Synthetic
aatctctgactcacttgttataaggaatagtttaaaacaattggctaaaattccttactgcaattatactaaatt

SEQ ID NO: 273516 - DNA, 75 bp, Artificial Sequence
  Synthetic
ctggtatgtaaatgacacaataacaggcagacacagcctgcctcaatgctggctagtttccaacgggagttacct

SEQ ID NO: 273517 - DNA, 75 bp, Artificial Sequence
  Synthetic
taatgaatcccacttcaagaatgactggttgtgggaaagccagaaactctacaatgatatgctcttaaaagagta

SEQ ID NO: 273518 - DNA, 75 bp, Artificial Sequence
  Synthetic
tgaagagaggcaaggaaatacgcctttagctctggctgatctttgcttttggtccttagtatttttcacttcaac

SEQ ID NO: 273519 - DNA, 75 bp, Artificial Sequence
  Synthetic
agtcttcctacagctggttggtataccaactcatagacatttgattggagaaggctgccctaaacctcacagact

SEQ ID NO: 273520 - DNA, 75 bp, Artificial Sequence
  Synthetic
ttcttcaaactctttgtgttcatgtggattttataaaattccaaaaaaaccttttagatgggtaaggaaaggaaa

SEQ ID NO: 273521 - DNA, 75 bp, Artificial Sequence
  Synthetic
atgagccatcaccattgccaacaatggcctcgatgtcacacccccaaaagggggtgtgacatcgaggctcctcca

SEQ ID NO: 273522 - DNA, 75 bp, Artificial Sequence
  Synthetic
gggagtctagagctcaatcagtgaggcctgctctctgtatagaacgtcaagtggcaggagtcttgtgggtttttt

SEQ ID NO: 273523 - DNA, 75 bp, Artificial Sequence
  Synthetic
gtcgtcaacaaaaccacctattgtagaacaaaacatgatgcagtccagaagtgcacagtgaggatttttacttcc

SEQ ID NO: 273524 - DNA, 75 bp, Artificial Sequence
  Synthetic
tggtggagaacctttcttcttgcgtgcgagaacaatccctttgtgcttgttgcataagaccccatacttgtccca

SEQ ID NO: 273525 - DNA, 75 bp, Artificial Sequence
  Synthetic
cactttgtcctcaaattgcctagcttgttcagcagtaagtctcacatctatgattgaaatatccctcctggcatg

SEQ ID NO: 273526 - DNA, 75 bp, Artificial Sequence
  Synthetic
catttccaaaagtcgttcaatgtcatcacttccctgtgccgtgaggacaattccagcaggtaaattcttaattat

SEQ ID NO: 273527 - DNA, 75 bp, Artificial Sequence
  Synthetic
gaaagaaattagaccaggctgtgtgttagtgaggtctttcaaaagcatgccatgtgagtatttgctctgatcctt

SEQ ID NO: 273528 - DNA, 75 bp, Artificial Sequence
  Synthetic
gaagcttttcacatcgtgaggctctctgtagcaatgaatgtaactgccactttctggctggaatattgccaactc

SEQ ID NO: 273529 - DNA, 75 bp, Artificial Sequence
  Synthetic
tacaggatcatttggtgttccctcaatatcaatccaagttgtggctttgctatccagcctcttcaaaccttcaag

SEQ ID NO: 273530 - DNA, 75 bp, Artificial Sequence
  Synthetic
gatttgttcttctcttgcatggctgagttgagagagtctcggtggtcctccatttctcactggtggatgatttgg

SEQ ID NO: 273531 - DNA, 75 bp, Artificial Sequence
  Synthetic
gctgccagtgtcgctcaagtccactgtcgtgttatcccaagccctcccctttatttgtgacctagaaccgatgta

SEQ ID NO: 273532 - DNA, 75 bp, Artificial Sequence
  Synthetic
aggccatccatcaccagataagcacaatttgtatagcaaattctcatatgggttcctctgtcccgggatctcact

SEQ ID NO: 273533 - DNA, 75 bp, Artificial Sequence
  Synthetic
gacgaacattttctctctggatttgacctcgagaactgctttaatcacagagctgaacattgttggtttcacgtt

SEQ ID NO: 273534 - DNA, 75 bp, Artificial Sequence
  Synthetic
gattgtctcaagcatatttccaccatccagcatgcaggctccagccttcacagcagccgaaagactcaaattgta

SEQ ID NO: 273535 - DNA, 75 bp, Artificial Sequence
  Synthetic
gccggagacattgatctgtgattgctcctgtgttatgtaacttaggcaggggtactgatcactcagcttttccaa

SEQ ID NO: 273536 - DNA, 75 bp, Artificial Sequence
  Synthetic
gtctgacatatttgggtatttaactgtgtacagtaatccaagggcagttagaccctgaacaacatcattgagtgg

SEQ ID NO: 273537 - DNA, 75 bp, Artificial Sequence
  Synthetic
ttctcccccttgctcagtcatacaggccatggtgacagcaggcatggatccaaactgatttattaacagagagct

SEQ ID NO: 273538 - DNA, 75 bp, Artificial Sequence
  Synthetic
gtcctttatgtcccaaaccttcaccaccccagaggggttccctcttaattgagcaaagcccatgtctctcagaat

SEQ ID NO: 273539 - DNA, 75 bp, Artificial Sequence
  Synthetic
ccttgttctctgctccaattgagttgtagttagattgccagcatacacaccgggctgtccactcccttcagccct

SEQ ID NO: 273540 - DNA, 75 bp, Artificial Sequence
  Synthetic
gaggactttctttttcagcttttgtaaatcagaggcaagttccataagctcgtctttggacaaaccacccacttt

SEQ ID NO: 273541 - DNA, 75 bp, Artificial Sequence
  Synthetic
caagacattgtccttttgagtcgttctcatgttcatcaaagcgtctacttccttgttaaggtccctcagcttagt

SEQ ID NO: 273542 - DNA, 75 bp, Artificial Sequence
  Synthetic
caggtctgcatcagtcctcttgtcttttctcatgagcctttgaacctgtgcgactctatcaaagtcaagagctgc

SEQ ID NO: 273543 - DNA, 75 bp, Artificial Sequence
  Synthetic
aagcagagctttggtgtcagtgatgacgtcagacttaacagggttggtccaattggaaagacctctccttaaagc

SEQ ID NO: 273544 - DNA, 75 bp, Artificial Sequence
  Synthetic
ctgggtccatctaaaggatgcaacgttatcggatgccatcacaagttcttgagcaaagcgtttcctaatgtgcct

SEQ ID NO: 273545 - DNA, 75 bp, Artificial Sequence
  Synthetic
ggatgcaacgttatcggatgccatcacaagttcttgagcaaagcgtttcctaatgtgcctaggatccactgtgcg

SEQ ID NO: 273546 - DNA, 75 bp, Artificial Sequence
  Synthetic
cgcacagtggatcctcggcatataagtctacgccaatccttgatcatggggcaattcatcacactgatgcaatcg

SEQ ID NO: 273547 - DNA, 75 bp, Artificial Sequence
  Synthetic
ataccagaagcactgagcatggccttcaatgtggctcttgttcttgtttcagttctgtgcatcaccaaaggatta

SEQ ID NO: 273548 - DNA, 75 bp, Artificial Sequence
  Synthetic
attaatctctggaaatgtggcattgtgcaactagttttatttctcactttagcaggcaggtcatgtgatggattt

SEQ ID NO: 273549 - DNA, 75 bp, Artificial Sequence
  Synthetic
gctgatcttaagattgacagaaggcatgtgttatcatctgttgagttcaacttgaccaagatgttcgataatctc

SEQ ID NO: 273550 - DNA, 75 bp, Artificial Sequence
  Synthetic
cctcaatcatgctccgtcaataacacccaccattactacaaaggaccagcaaacacaacctggggcatagaattg

SEQ ID NO: 273551 - DNA, 75 bp, Artificial Sequence
  Synthetic
acattgaccaatatatcattaatgaacagaagtgacgagaatgtgacatccatacgcagtcttgggtttggaaac

SEQ ID NO: 273552 - DNA, 75 bp, Artificial Sequence
  Synthetic
attaccaactgtgacaaaacttcagaggcaggtcatactttaaagtggctgctaaatgagcctcactttactgta

SEQ ID NO: 273553 - DNA, 75 bp, Artificial Sequence
  Synthetic
ttgcatgttacaaggcacattggtgccctgtgcagaacaacctctggtgcaggcctcttaatccagtacaatcta

SEQ ID NO: 273554 - DNA, 75 bp, Artificial Sequence
  Synthetic
accagatcagacaagggcggagaagtaggagcacatttaattgcatctcttgctcaaataataggagacaataaa

SEQ ID NO: 273555 - DNA, 75 bp, Artificial Sequence
  Synthetic
gctgcatgggtaggtaaatgctttaacaactgcagcagggatggtgtatgcaggcttactaactgcgaggggagt

SEQ ID NO: 273556 - DNA, 75 bp, Artificial Sequence
  Synthetic
acacactataaatacttaatcatccagaacacgacatggcctaaccattgttcttattcaccaatgtcaacagtg

SEQ ID NO: 273557 - DNA, 75 bp, Artificial Sequence
  Synthetic
aggatgattatccagaagacagcctacagttcagtctcaaggaaactcttgggcttcttcacatgggacatctct

SEQ ID NO: 273558 - DNA, 75 bp, Artificial Sequence
  Synthetic
gattcaacaggtcagcatgttccagggggttattgcttagaacagtgggcaattgtctgggctggcatcaaatgt

SEQ ID NO: 273559 - DNA, 75 bp, Artificial Sequence
  Synthetic
tttgacaattctgttatggccaaatgtaataaagaccataatgaagagttctgtgacacaatgaggctgtttgac

SEQ ID NO: 273560 - DNA, 75 bp, Artificial Sequence
  Synthetic
ttcaatcagaatgcaataaaaacacttcaactcaatgttgaaaacagccttaacctaatgaagaagagcataaat

SEQ ID NO: 273561 - DNA, 75 bp, Artificial Sequence
  Synthetic
ggattaatctcagactctcttgtgattagaaacagtcttaaacagttggccagaattccatattgcaattatacc

SEQ ID NO: 273562 - DNA, 75 bp, Artificial Sequence
  Synthetic
aaattctggtatgttaatgacacaatcacaggaaaacacagcttgcctcaatgctggttaacctcaaacgggagc

SEQ ID NO: 273563 - DNA, 75 bp, Artificial Sequence
  Synthetic
tatttaaacgagactcactttagaaatgagtggttgtgggaaagtcaaaagctttataatgaaatgttaataaag

SEQ ID NO: 273564 - DNA, 75 bp, Artificial Sequence
  Synthetic
gagtatgaggaacgacagggaaacactcctctagctttaactgacctttgcttttggtcattggtcttcttcacg

SEQ ID NO: 273565 - DNA, 75 bp, Artificial Sequence
  Synthetic
acaacagttttcctgcaattgattggaataccaacccacagacacattgttggggaagggtgcccaaaacctcat

SEQ ID NO: 273566 - DNA, 75 bp, Artificial Sequence
  Synthetic
agactgtcatcaaattcactgtgctcatgtggatattacaagattccaaaaaagccttataggtgggttaggaaa

SEQ ID NO: 273567 - DNA, 75 bp, Artificial Sequence
  Synthetic
ggtaagtaaaccaggcactcctggcctcgacgtcacaccccataaggggtgtgacatcgaggctccggtcggagt

SEQ ID NO: 273568 - DNA, 75 bp, Artificial Sequence
  Synthetic
ttagagctcaattaatgcagcttgatctctgtagagaagatcaattggcagtagtctgattggctttttgtcatc

SEQ ID NO: 273569 - DNA, 75 bp, Artificial Sequence
  Synthetic
gacaaacccaccaattgttgaacagaacatgatgcaatccaaaagtgcgcagtgtgggtttttacttccaggtgg

SEQ ID NO: 273570 - DNA, 75 bp, Artificial Sequence
  Synthetic
tgaacctttcttctttcttgccaaaacaatccctttatgtttgttacaaagaattccatacttgtcccagacttt

SEQ ID NO: 273571 - DNA, 75 bp, Artificial Sequence
  Synthetic
atcctcgaattgtctcgcttgctctgttgtgagccttacatctataatagaaatgtcccttctagcatgcatttc

SEQ ID NO: 273572 - DNA, 75 bp, Artificial Sequence
  Synthetic
aagtagtttttcaatgtcatcactgccctgtgcagtgagcacaatccctgccgggagattctttatgatgaatga

SEQ ID NO: 273573 - DNA, 75 bp, Artificial Sequence
  Synthetic
aatgagccctggctgtgtgtttgtcagatctttgagcagcatcccatgtgaatatttactctgatccttgaagct

SEQ ID NO: 273574 - DNA, 75 bp, Artificial Sequence
  Synthetic
cttcacatcatgtggttctctgtaacagtggatgtagtttccactttctggttggaaaatggccagttccacagg

SEQ ID NO: 273575 - DNA, 75 bp, Artificial Sequence
  Synthetic
atcatttggtgtcccttcaatgtcaatccatgttgttgccttactatccaactttgagatgctttcaagtagttg

SEQ ID NO: 273576 - DNA, 75 bp, Artificial Sequence
  Synthetic
ttcttctttcgcatgactcaattgagatagccttggtgctcctccattcctcacaggaggatggtttgggctgcc

SEQ ID NO: 273577 - DNA, 75 bp, Artificial Sequence
  Synthetic
agtgtcagtgaagtcaactgtggtattatcccaagctctccccttgatctgtgatcttgatccaatatatggcca

SEQ ID NO: 273578 - DNA, 75 bp, Artificial Sequence
  Synthetic
tccatcaccggacaaacacagtttgtagagtagattctcataagggttcctctgtcctggggtctcactgacaaa

SEQ ID NO: 273579 - DNA, 75 bp, Artificial Sequence
  Synthetic
cattttctctctagatttgacttcaagcacagctttgataatagagctgaacatggctggctttaactggattgt

SEQ ID NO: 273580 - DNA, 75 bp, Artificial Sequence
  Synthetic
ctccaacatgttgcctccatcaagcatgcaggcacctgccttgactgcggcagaaagactcagattgtacccaga

SEQ ID NO: 273581 - DNA, 75 bp, Artificial Sequence
  Synthetic
cacattgatctgggattgctcctgtgtgatgtaacttaaacaaggaaattgatcagtgagcttttccaaatctgt

SEQ ID NO: 273582 - DNA, 75 bp, Artificial Sequence
  Synthetic
catgtttgggtactttactgtgtaaagtaaccccaaggcagttaagccctgaactacatcattgagactttcacc

SEQ ID NO: 273583 - DNA, 75 bp, Artificial Sequence
  Synthetic
gccttgttctgtcatacatgccatagttactgcaggcatagaaccaaattgatttatcaaaagtgaactgtcctt

SEQ ID NO: 273584 - DNA, 75 bp, Artificial Sequence
  Synthetic
tacatcccatactttgacaactccaggtgtaccacctctcaatggtgcaaagcccatgtctctcaggattctgga

SEQ ID NO: 273585 - DNA, 75 bp, Artificial Sequence
  Synthetic
tctctgctcaagctgtgtggtagtgagattcccagcataaattccaggctgacctgcaccttcaactctaagaac

SEQ ID NO: 273586 - DNA, 75 bp, Artificial Sequence
  Synthetic
cttctttttcaacttttgtaaatctgaggctaattccatgagctcatcttttgacagtccacccactctcaggac

SEQ ID NO: 273587 - DNA, 75 bp, Artificial Sequence
  Synthetic
attgtccttctgtgttgtcctcatattcatcagagcatcgacttccttgttcaaatctctcagtttggttaggtc

SEQ ID NO: 273588 - DNA, 75 bp, Artificial Sequence
  Synthetic
tgtatcagtcctcttgtccttcctcatgagtctttggacttgagccaccctgtcgaaatccagggctgctagtag

SEQ ID NO: 273589 - DNA, 75 bp, Artificial Sequence
  Synthetic
agctctagcatcagtgatgacttcagatttaattgaattcgtccagctggacaaccctctcctgagtgcttgagt

SEQ ID NO: 273590 - DNA, 75 bp, Artificial Sequence
  Synthetic
ccacctgaacgatgcaacgttctctgatgccatcttagtctttggggcaaagcgtttccttgtgtgcctaggatc

SEQ ID NO: 273591 - DNA, 75 bp, Artificial Sequence
  Synthetic
cgatgcaacgttctctgatgccatcttagtctttggggcaaagcgtttccttgtgtgcctaggatccactgtgcg

SEQ ID NO: 273592 - DNA, 75 bp, Artificial Sequence
  Synthetic
cgcacagtggatcctaggcatatacgtctacgcctattggagatcatggggcagttcataacactgatgcagtcg

SEQ ID NO: 273593 - DNA, 75 bp, Artificial Sequence
  Synthetic
aaggatgccacattgtcagaagtcatcctgggtttgtgcaaagcgtatccggatatgcctaggatccactgtgcg

SEQ ID NO: 273594 - DNA, 75 bp, Artificial Sequence
  Synthetic
atgggttgggaaatgctacaacaactgcaccagctctggcaagtgctctctaacaaactgtgagggtgggacaca

SEQ ID NO: 273595 - DNA, 75 bp, Artificial Sequence
  Synthetic
tgcaccagctctggcaagtgctctctaacaaactgtgagggtgggacacattacaagtttcttgtgattcaaaac

SEQ ID NO: 273596 - DNA, 75 bp, Artificial Sequence
  Synthetic
tctgggcaggaatcaaatgttttgataactctgtaatggccaaatgcaacaaagatcacaatgaggaattctgtg

SEQ ID NO: 273597 - DNA, 75 bp, Artificial Sequence
  Synthetic
taactctgtaatggccaaatgcaacaaagatcacaatgaggaattctgtgacaccatgaggctgtttgacttcaa

SEQ ID NO: 273598 - DNA, 75 bp, Artificial Sequence
  Synthetic
aacagtctcaaacaactggccaaaattccgtactgtaactacaccaagttttggtatgtgaatgacaccataact

SEQ ID NO: 273599 - DNA, 75 bp, Artificial Sequence
  Synthetic
ggtttttataagatacccaagaagccatttagatgggttaggaaaggtaaataggcaaccagaaacaagaccagt

SEQ ID NO: 273600 - DNA, 75 bp, Artificial Sequence
  Synthetic
aactggcctcgatgtcacaccccaattggggtgtgacatcgaggctcgcgtcaaggagtttagagctcaatcagt

SEQ ID NO: 273601 - DNA, 75 bp, Artificial Sequence
  Synthetic
ttggggtgtgacatcgaggctcgcgtcaaggagtttagagctcaatcagtgaggcttgctctctatagaggaggt

SEQ ID NO: 273602 - DNA, 75 bp, Artificial Sequence
  Synthetic
ttcacttccaggacagcctttatcattgagctgaacattgtaggtttcacttgaattgtctcaagcatgttgcct

SEQ ID NO: 273603 - DNA, 75 bp, Artificial Sequence
  Synthetic
cgcaccggggatcctaggctttccttgaacatggaggaacacgttaacgaattgcacgaccttgtcaggaaatgg

SEQ ID NO: 273604 - DNA, 75 bp, Artificial Sequence
  Synthetic
gtgtctgatgatgaaaactttgcggagcagaaagcaatttttctgtcccagacaaaattgagggctataacaatt

SEQ ID NO: 273605 - DNA, 75 bp, Artificial Sequence
  Synthetic
gaaggactaaaattgttgtccacaattgtagaggttgactcatgtcaaaagaactcatgcattcataatagagag

SEQ ID NO: 273606 - DNA, 75 bp, Artificial Sequence
  Synthetic
aaaacattgaactcaatactcagagacaacaaaatagtttgtccgacattaccagaaattgttccagatggttat

SEQ ID NO: 273607 - DNA, 75 bp, Artificial Sequence
  Synthetic
aggttgattggagatgtacttatactactagaggtgtttgtgcgctctaaccaggagtcttttgaaaagaagtat

SEQ ID NO: 273608 - DNA, 75 bp, Artificial Sequence
  Synthetic
gaacaagactacacaaaacttatgcaagtaaagaaagacttacagtcacatggcatcacacttgttcctatgatt

SEQ ID NO: 273609 - DNA, 75 bp, Artificial Sequence
  Synthetic
gatggtaggtcatcctattatgttgagttcatgccagactgggtggtagaaaaaattagatggcatctaataaaa

SEQ ID NO: 273610 - DNA, 75 bp, Artificial Sequence
  Synthetic
ttaatggatttgctaaaagaagatggtgaatcggttgaagagctagaatatgagaggctcgtatctagtctttct

SEQ ID NO: 273611 - DNA, 75 bp, Artificial Sequence
  Synthetic
gccttggaaaatcaaagtctcggacttgaatccctattatcaattaaggaaaggggaattgagtatacagacaga

SEQ ID NO: 273612 - DNA, 75 bp, Artificial Sequence
  Synthetic
ctcaccaaaataatgtatgggaatttgaataataatatgtcagttgatgagtgcaaaggggaaatattgaggatc

SEQ ID NO: 273613 - DNA, 75 bp, Artificial Sequence
  Synthetic
tatcagaattttagacaactttttgatcagggtcaattcaacccaaaatataggaaaacggatagagagttcata

SEQ ID NO: 273614 - DNA, 75 bp, Artificial Sequence
  Synthetic
ctaaagacattaagagaacatggtttgatcaaatgtgcaatcatgagtgaagaagactcttgcaaaaactgcatg

SEQ ID NO: 273615 - DNA, 75 bp, Artificial Sequence
  Synthetic
attcacatgttcaaagttttgacaataatcaagcaatcttttgtgagcaacaagaacatagaaagcagcttcata

SEQ ID NO: 273616 - DNA, 75 bp, Artificial Sequence
  Synthetic
ttaaaagaatacaaccaattgttgtccgtttgcaataaggttaagagtttgaaggtactgaacacaagaaggggg

SEQ ID NO: 273617 - DNA, 75 bp, Artificial Sequence
  Synthetic
actttgatggttttagatttaataatgttaaataaactcttaagtttgattaagatttatggaatcaaagctgca

SEQ ID NO: 273618 - DNA, 75 bp, Artificial Sequence
  Synthetic
ctgactatcctgagaatgcaatgtatccccgctgtcaatgatagactgttgtcaattgactttctgattagcata

SEQ ID NO: 273619 - DNA, 75 bp, Artificial Sequence
  Synthetic
tatgagaggaaaatgattaaaagtcccaaatggctggaaaaggttcatgggaaactgaagagagtagttcaggac

SEQ ID NO: 273620 - DNA, 75 bp, Artificial Sequence
  Synthetic
tgtatgtttaaagcattggaagattatttggttgagattgattttgacacatggtttagtataaaggatgaactt

SEQ ID NO: 273621 - DNA, 75 bp, Artificial Sequence
  Synthetic
ttaatgacccagcaattcaaaccaagcatctgttatagaagtagtaagggttgtgtgtgtaatgcagaaactctt

SEQ ID NO: 273622 - DNA, 75 bp, Artificial Sequence
  Synthetic
aagaacttaagcatgatgactgaagaagacttcttgtcatacttgaagattttatcaagtcttagcttatcatta

SEQ ID NO: 273623 - DNA, 75 bp, Artificial Sequence
  Synthetic
gtgaactctatgaagacctcaagtgcacctaaatcaaaaataaatcaagccaatgatttttatggaattgtccac

SEQ ID NO: 273624 - DNA, 75 bp, Artificial Sequence
  Synthetic
tgtgaagaagtttactttcagggatttggcgataacaatgcttgcacacttttatatcagaaaactggagaaaaa

SEQ ID NO: 273625 - DNA, 75 bp, Artificial Sequence
  Synthetic
tcaagatgttacagtgtagcattttctgacaatgagcaacagattgattatggcagcaagatttcattttatgct

SEQ ID NO: 273626 - DNA, 75 bp, Artificial Sequence
  Synthetic
gacccaaagaggttctttttaccaatcatgtcccaagatgttctaaataggatgtgcaatgagatgttgtcatgg

SEQ ID NO: 273627 - DNA, 75 bp, Artificial Sequence
  Synthetic
cttgactttttgagtgatgacaatatcaaggttgttgcagacctcctcagaaaattgattttgtgtgtcttatgc

SEQ ID NO: 273628 - DNA, 75 bp, Artificial Sequence
  Synthetic
actccatcaaaaagggtccaagtatacctccaaggctttagatatcttataatggcttatgtaaatgagattcat

SEQ ID NO: 273629 - DNA, 75 bp, Artificial Sequence
  Synthetic
tgtaatgacctctttgcaaagttggaagtggatgcattgacggcttcagagaggcaagtgatgatttggatggac

SEQ ID NO: 273630 - DNA, 75 bp, Artificial Sequence
  Synthetic
gacttaaccaggattgtcttagagatgtctaaggaagctgatatggcaaagtcattcaaattcattttgaatttg

SEQ ID NO: 273631 - DNA, 75 bp, Artificial Sequence
  Synthetic
tcttacctatgtcatctaattacaaaagaaacccctgataggctcacagaccaaatcaagtgttttgagaagttt

SEQ ID NO: 273632 - DNA, 75 bp, Artificial Sequence
  Synthetic
ctggagcccaagcttaaatttggcagcttgatggttaaccctgactctacaccagagttgacaagtgagcaagag

SEQ ID NO: 273633 - DNA, 75 bp, Artificial Sequence
  Synthetic
gaccaagtttgtgagggtttacatagactacttaataaaaagattttctcaaaatgtgagaacataccgggtgtt

SEQ ID NO: 273634 - DNA, 75 bp, Artificial Sequence
  Synthetic
tcaaaagaactagtatcattgtgctcctctctctttaatagttcaaatcttgaggtgaagcccctactgaaccat

SEQ ID NO: 273635 - DNA, 75 bp, Artificial Sequence
  Synthetic
gatccattaaccccatctttcactagcactgcattagatttgtccagcaacaaaagtgtagttgtgccaaagttg

SEQ ID NO: 273636 - DNA, 75 bp, Artificial Sequence
  Synthetic
aatgagattggtgaaacccttactgaatatgactttgggaaaattgtctcaagtgttgtggtggacttgacagag

SEQ ID NO: 273637 - DNA, 75 bp, Artificial Sequence
  Synthetic
cattttaagactaaaggaaaatataaattagatcctagagaccttagatttagaatttttaagaagttgagctca

SEQ ID NO: 273638 - DNA, 75 bp, Artificial Sequence
  Synthetic
ctggtagaggtgaacccaacaaagaaaagcaatagaaagagcgagtctggtgaggttgtggcccctgatgaatct

SEQ ID NO: 273639 - DNA, 75 bp, Artificial Sequence
  Synthetic
tttatggacgagctcacagaagaacagcagttgatgttgagtgagattgaggtaaaagtctcaaagacatttgag

SEQ ID NO: 273640 - DNA, 75 bp, Artificial Sequence
  Synthetic
gggatgtccaaggatgagctgaatagaaagcaaagtaaagaaaagggagctgaagcacatttgaagaggctttgg

SEQ ID NO: 273641 - DNA, 75 bp, Artificial Sequence
  Synthetic
agcaaggaagtgagagacaagatttcatcagaaacttcacttcatgaggtgaaggattttgatgttcagttgttc

SEQ ID NO: 273642 - DNA, 75 bp, Artificial Sequence
  Synthetic
ccttttgatacttatgaggaactagttacaattgtcttcaatgataagtctgcccatgacttctactttctagag

SEQ ID NO: 273643 - DNA, 75 bp, Artificial Sequence
  Synthetic
aagtacttaaacccttgtccgctagacatgttaatgaaaaaccttacacttaaggcttttaatgaaggtgacttt

SEQ ID NO: 273644 - DNA, 75 bp, Artificial Sequence
  Synthetic
tttgaatgttttaagtacattctaattgcaagtgaatttgacaacaaaatcgggagatatgatcataaaataaga

SEQ ID NO: 273645 - DNA, 75 bp, Artificial Sequence
  Synthetic
accagattagggctcaaagatcctgctttgaagattagagaagaagcccgcattagtacaagggaaagtaactca

SEQ ID NO: 273646 - DNA, 75 bp, Artificial Sequence
  Synthetic
gaatccatagccaaaaggttggataaaagtttctttacaaattcatccctaaggaatctttgcttctactctgat

SEQ ID NO: 273647 - DNA, 75 bp, Artificial Sequence
  Synthetic
gaatcacctacaacgaggactggggtggcaactgatgttggaaaacttaaatttgggttgtcttataaagagcaa

SEQ ID NO: 273648 - DNA, 75 bp, Artificial Sequence
  Synthetic
gtggggggaaacagggagttgtatgtgggtgacttaaacaccaagttgatcaccagattagtagaggattatgca

SEQ ID NO: 273649 - DNA, 75 bp, Artificial Sequence
  Synthetic
gaatcaatatgctcgaacatgaaatacacatgtctgaatagtgaatctgagtttgagagggcgctccttgatctg

SEQ ID NO: 273650 - DNA, 75 bp, Artificial Sequence
  Synthetic
aaatctgttgtcaggcagggtggattcgcggtgagcatggatcattcaaaatgggggcctcacatgagtcctgcc

SEQ ID NO: 273651 - DNA, 75 bp, Artificial Sequence
  Synthetic
atttttgcacaacttttgaggtgtttgaaatttcgattgaaagatggctcagagatagataagaaagcagtacta

SEQ ID NO: 273652 - DNA, 75 bp, Artificial Sequence
  Synthetic
aacatattatattggcatcttcataaaattgtggaagttcctttcaatgttgtacaggcttttatgagtggattt

SEQ ID NO: 273653 - DNA, 75 bp, Artificial Sequence
  Synthetic
gttaagagaggattgggactcatggatagaggtggagcaacactatcagaggaatttatgtttgggttttttgaa

SEQ ID NO: 273654 - DNA, 75 bp, Artificial Sequence
  Synthetic
aagggagttgtaccttcacacctttcatctgtggttgatatgggacaaggaatactacacaatatgtctgactta

SEQ ID NO: 273655 - DNA, 75 bp, Artificial Sequence
  Synthetic
tacggtcttatcacagagcaattcataaactatgtactagatttctgctataatgtctcaatgacatcatatacc

SEQ ID NO: 273656 - DNA, 75 bp, Artificial Sequence
  Synthetic
tctagtgatgatgagatcatgttatcaacctcgtcagccttgaatcatgaagatggttctttgaatgttgatgtg

SEQ ID NO: 273657 - DNA, 75 bp, Artificial Sequence
  Synthetic
gcattggaaatcttggaattccataattttctttcagataagttgaataaattcgtcagtcctaaaacagtagct

SEQ ID NO: 273658 - DNA, 75 bp, Artificial Sequence
  Synthetic
ggtacttttgccagtgaattcaagtcaaggttctttatttggtcacaggaagttcccttactaacaaaatttgtt

SEQ ID NO: 273659 - DNA, 75 bp, Artificial Sequence
  Synthetic
gccgctgctcttcataacataaaagccaaagcaccaaaccagctggctgagacagtggatacaattttggatcaa

SEQ ID NO: 273660 - DNA, 75 bp, Artificial Sequence
  Synthetic
tgtgtggcgaatggggtgtcaatagaaattgttggtgcaatatccaagcgcacaaattctctagtctgttattct

SEQ ID NO: 273661 - DNA, 75 bp, Artificial Sequence
  Synthetic
gggcacccattgaatccattcttgtgtctagaggagagtgatgtgagagactgggttgatggttcaagaggttat

SEQ ID NO: 273662 - DNA, 75 bp, Artificial Sequence
  Synthetic
agattacaaaggtcaatcgaaaatatcttccctgatgacttgtgtcctaatcttattagggatgcctgtagaaag

SEQ ID NO: 273663 - DNA, 75 bp, Artificial Sequence
  Synthetic
gtgtttcatagaattcagtctgggaagattgaagaagaattccttgttgcatccatacaaggttcccctgatgaa

SEQ ID NO: 273664 - DNA, 75 bp, Artificial Sequence
  Synthetic
tgtttaaattcaatgttaacaatagcagatgttgatgaggacattaaaaaagaccttgctggttaccggtggctc

SEQ ID NO: 273665 - DNA, 75 bp, Artificial Sequence
  Synthetic
aacctcagggcatatggtgatcttagactggtcttgaggacaaaattgatgtcatcgaccagaaccctgcaaagg

SEQ ID NO: 273666 - DNA, 75 bp, Artificial Sequence
  Synthetic
gaggagataccaagcctcgtgagatcagttcaatcaaaattatcaaagaactttgtaagaggagccaaaagaata

SEQ ID NO: 273667 - DNA, 75 bp, Artificial Sequence
  Synthetic
ctgacagatgccatcaataagtcggcatttcaaagttgcatatcgtctgggtttattggcgtttgcaaaagtatg

SEQ ID NO: 273668 - DNA, 75 bp, Artificial Sequence
  Synthetic
gggtcaaagtgtgtgagagataatactggaggatttgtatatattaaagaaattacaaagcatgtaatgccgcac

SEQ ID NO: 273669 - DNA, 75 bp, Artificial Sequence
  Synthetic
acaacctcttattgcccatactgcaaaccctcaaaaaacatttactgtgaggatgcactgcgaagtgtttcagag

SEQ ID NO: 273670 - DNA, 75 bp, Artificial Sequence
  Synthetic
tattcaagacctatcttctgggattatttttcattagtcttgtccaatgcttgtgagttagggaattgggtattc

SEQ ID NO: 273671 - DNA, 75 bp, Artificial Sequence
  Synthetic
ggtgcaccaattttaccaaagacagtcttccatctggacaatccaaaccacttctggccgataaaaccctccagt

SEQ ID NO: 273672 - DNA, 75 bp, Artificial Sequence
  Synthetic
cagacagagttggaagataaagtcggaatgaatcatgtcctatattcgatcagaagaaactatcctagtatcttt

SEQ ID NO: 273673 - DNA, 75 bp, Artificial Sequence
  Synthetic
gatgagcacatcagtccttatatgtctgatttaaacatgttaagattgagttgggttcaaaagataaagtttttg

SEQ ID NO: 273674 - DNA, 75 bp, Artificial Sequence
  Synthetic
gatttgtgtgtggcattagatatgtcttcagaatgtttgggtattatatctcatatcatgaggaggaagagagag

SEQ ID NO: 273675 - DNA, 75 bp, Artificial Sequence
  Synthetic
gagctttatattgtcaagcagcaagagctatccatgtcccatacaagggaaagtacaaacttagagagtggttta

SEQ ID NO: 273676 - DNA, 75 bp, Artificial Sequence
  Synthetic
agtcttgaacctcaagaagtgtgtaagaacttcctcttacaagtgttgtttgattccatggtaaatccagttctt

SEQ ID NO: 273677 - DNA, 75 bp, Artificial Sequence
  Synthetic
cttaccactagtcagtttagaaagtacttctggtatggagaagtcttacagctcccgaatgatgcttctcatcat

SEQ ID NO: 273678 - DNA, 75 bp, Artificial Sequence
  Synthetic
cttgctcagtttacacaatttattcttgactgtaagcagttgaattcaagcagggctatgacattagatgacttg

SEQ ID NO: 273679 - DNA, 75 bp, Artificial Sequence
  Synthetic
gatgtaggttacgtgaccagtagaattaagaggacaactacttttgtcgcattgtctactttcatcacatcacta

SEQ ID NO: 273680 - DNA, 75 bp, Artificial Sequence
  Synthetic
gattgggaaaacaggcatgagtataaatcattccaagagctaattctatcgtcaccatgcgatgtttttaagttt

SEQ ID NO: 273681 - DNA, 75 bp, Artificial Sequence
  Synthetic
gagttcagcatgacttttagtcatattagatccagtcacaagttcagatatgagaggtgcactagttacattctc

SEQ ID NO: 273682 - DNA, 75 bp, Artificial Sequence
  Synthetic
aaggtacatgtagtgttcgataaacgagtactgaactcaaatatgcttgaggaccagtcacttctgattacacca

SEQ ID NO: 273683 - DNA, 75 bp, Artificial Sequence
  Synthetic
cactctgttgaatactttgtttcacaatcaggtggcaaccacattagcctggatggtgtgggtctcttacctcta

SEQ ID NO: 273684 - DNA, 75 bp, Artificial Sequence
  Synthetic
gatccacttatcagtggaaaagaggttttaaatatagatgatgttctcagacatgaagatgtaaatttctctgct

SEQ ID NO: 273685 - DNA, 75 bp, Artificial Sequence
  Synthetic
gaaagtccactgttctcgcagatgaggtttgatttcaaacctttcttgaaggaattaaagaacggattctcttac

SEQ ID NO: 273686 - DNA, 75 bp, Artificial Sequence
  Synthetic
aaattaattggaccagatatcatcatggaacctctagttctagataaaggtcaaatcaaagaagggtcacgaatt

SEQ ID NO: 273687 - DNA, 75 bp, Artificial Sequence
  Synthetic
gtttctcaattgaaattgagattggactttaaagcagttttcgtggccttgggatgtctggaggaagagtcaagg

SEQ ID NO: 273688 - DNA, 75 bp, Artificial Sequence
  Synthetic
tcaacatttatatcaaatctgtttatgtatataggatcacttagaggagaagagcatcgtatatccatgactgaa

SEQ ID NO: 273689 - DNA, 75 bp, Artificial Sequence
  Synthetic
tccaacctagttcaattaatagacaactatcctcaagtgtttgactcgatgttggatgccacaaatgactggttg

SEQ ID NO: 273690 - DNA, 75 bp, Artificial Sequence
  Synthetic
aattgtggatcattttcattgtgcaaaagcaaatcacttggttgtgtcatgattgcagatgagaggggccccttt

SEQ ID NO: 273691 - DNA, 75 bp, Artificial Sequence
  Synthetic
aaactaaaaggagtgaactgcagaagattgctcccggactcccaagctgtcgagattgactagtttcatacgggc

SEQ ID NO: 273692 - DNA, 75 bp, Artificial Sequence
  Synthetic
ccccgggcccggggggccccgggcgcaccccctttggggggtgcgccggggcccggtgggcagttagggttcgta

SEQ ID NO: 273693 - DNA, 75 bp, Artificial Sequence
  Synthetic
tgatgaagcagatgggctctcctcaaatctgatttttgttggcagaggcttgccgcagattccacagaattgaga

SEQ ID NO: 273694 - DNA, 75 bp, Artificial Sequence
  Synthetic
ctgagacctgagtctagtcaagcaattcaggcacagatagtgatctgagcaggctatgagacctctgtttgcaaa

SEQ ID NO: 273695 - DNA, 75 bp, Artificial Sequence
  Synthetic
ccagcaagacttacagttgaagcgtccatataaaccctgtgggagattgagtgtcatggggactctcccttccag

SEQ ID NO: 273696 - DNA, 75 bp, Artificial Sequence
  Synthetic
atctttgtctccgtgtctctctctcacctctttgctgtagcgtagacccatgttttcagtgttatcctgaacagg

SEQ ID NO: 273697 - DNA, 75 bp, Artificial Sequence
  Synthetic
gcgtagacccatgttttcagtgttatcctgaacaggggtaagcgtgatccaaaaaagcctaggatccccggtgcg

SEQ ID NO: 273698 - DNA, 75 bp, Artificial Sequence
  Synthetic
tgagcgttagtaatttttcgttcagaggtttcaccgcctctattctgtaccctagacttcgtgtctcttaagtac

SEQ ID NO: 273699 - DNA, 75 bp, Artificial Sequence
  Synthetic
cgggccgtaaaaggattcgcccaccatggatcttgattgtttcgcacaccgcgaccacgacaaggtcaagctcgc

SEQ ID NO: 273700 - DNA, 75 bp, Artificial Sequence
  Synthetic
catctctgactgcatagagaaatcggctggagcttacgtgaatacatctcacgtcatcacagttgttcttacacc

SEQ ID NO: 273701 - DNA, 75 bp, Artificial Sequence
  Synthetic
tgaacaactagagcaagccaagaaggctttttcaccccaacccgtcacctaccaacctcgggtttgcctacccca

SEQ ID NO: 273702 - DNA, 75 bp, Artificial Sequence
  Synthetic
tgcactagcaaagcactacaccacagtcctcgaagggcaactcaaaaatgccataagagggcggccttacattga

SEQ ID NO: 273703 - DNA, 75 bp, Artificial Sequence
  Synthetic
agccggaccagctccacatcaaatcaattctagacctaaggacacccacttttgcctagttcgaggagatgctcg

SEQ ID NO: 273704 - DNA, 75 bp, Artificial Sequence
  Synthetic
caatcatgtaaggtttgccaccgccccaaacaacgggctcagccgtaaagtcaagagaatatatcaaggcatcca

SEQ ID NO: 273705 - DNA, 75 bp, Artificial Sequence
  Synthetic
aaaagaggacgccaccgcctgcttgaacggctatcaaggttgtcatcagcctagggcaacctccattgccataca

SEQ ID NO: 273706 - DNA, 75 bp, Artificial Sequence
  Synthetic
ctctacctatgacattcctcttaaagagttctgtcgaggtatgaacaaccacaaatcagacctagcccatgtcat

SEQ ID NO: 273707 - DNA, 75 bp, Artificial Sequence
  Synthetic
aatgcacatgccatctgaaatcacatttccccctggagtgtttgtcaatgacatgactggctacagactcgatac

SEQ ID NO: 273708 - DNA, 75 bp, Artificial Sequence
  Synthetic
cacaggtgagacagcaaagttcacctacttagaggacacatccaatggttatgatcactctaaagccgactggct

SEQ ID NO: 273709 - DNA, 75 bp, Artificial Sequence
  Synthetic
agagtggactacggtgacagcattgatagtggacggcttcacattccacgtcgaagtacagcgccggctcggctc

SEQ ID NO: 273710 - DNA, 75 bp, Artificial Sequence
  Synthetic
tgtcgtctatctcatcatttaccgctcgactcttccagtcaagatcacaagaccattagacccactctgctccac

SEQ ID NO: 273711 - DNA, 75 bp, Artificial Sequence
  Synthetic
cagctttgtcttcgacccgtatgggcccacctcaggtcacacagcacccaccagctatgttagatcactgcactc

SEQ ID NO: 273712 - DNA, 75 bp, Artificial Sequence
  Synthetic
ctatgcttgtggtttgcctgacgaaaccttctcttataccagacttgtcatttatgccaaaggtctggcattcag

SEQ ID NO: 273713 - DNA, 75 bp, Artificial Sequence
  Synthetic
agcaaagataggtgcagtcgctctcaatgaaggctggaacccagacacaacagccttcagtgcagtggttgccgg

SEQ ID NO: 273714 - DNA, 75 bp, Artificial Sequence
  Synthetic
ggtctttatggatgttgctgtaaagcgatacctaagatctaagggtattagcaactgcatgaaagagctcaagaa

SEQ ID NO: 273715 - DNA, 75 bp, Artificial Sequence
  Synthetic
agagcaaaatgctgggttctggtcactcttgtggcagcgtatttgcatctggttcggagatagcaatgaacaccg

SEQ ID NO: 273716 - DNA, 75 bp, Artificial Sequence
  Synthetic
acacatggatcacaacacactcaaaggatgggtcagttcaggcatgatccttgatcctgcttgcatggtcctcca

SEQ ID NO: 273717 - DNA, 75 bp, Artificial Sequence
  Synthetic
gggccaagccaacttaaatgtcctctcactcacaactacccagtcaggcgagttcgaaatcataggctggcttgc

SEQ ID NO: 273718 - DNA, 75 bp, Artificial Sequence
  Synthetic
cagctcttttgagaagatactggactacccaaaccaccaccacgactacctgaaggatctaatgccaggcttcac

SEQ ID NO: 273719 - DNA, 75 bp, Artificial Sequence
  Synthetic
accagaccgcgctgagcactacgagaacctgctacacaccgttttgcacactaaggagcgccaaggcgaaactga

SEQ ID NO: 273720 - DNA, 75 bp, Artificial Sequence
  Synthetic
tggtgagctcaccgaccgactcacagagtacattaatgtaccctatgaagaagtccatgcgcttgtgactaaccg

SEQ ID NO: 273721 - DNA, 75 bp, Artificial Sequence
  Synthetic
actcgacctccgaactcgtcatcacatccagccaaagagctgtttgacaaccccggctcccaccccaatcccaac

SEQ ID NO: 273722 - DNA, 75 bp, Artificial Sequence
  Synthetic
accacaaagttccagatccagtagtccatctagaacccgcagttcatcagtgtctagctctagctcagtaagtac

SEQ ID NO: 273723 - DNA, 75 bp, Artificial Sequence
  Synthetic
atcagtcatttcattccaaatggagagggagagtcagttcgaggctcgtaaccaaccccaaatcaacctcctcga

SEQ ID NO: 273724 - DNA, 75 bp, Artificial Sequence
  Synthetic
cacacctctagacgctaatcttgatctaacccaagcaacttttctacaaccgtcagcgcctcctgataccaatca

SEQ ID NO: 273725 - DNA, 75 bp, Artificial Sequence
  Synthetic
aaaccaaacagctctccaagaccaagctagggccatcacacccactcagaacccacctgacactgccacactacc

SEQ ID NO: 273726 - DNA, 75 bp, Artificial Sequence
  Synthetic
gagtactagagtgttaccagcagctacacccgtcgacataaacaccacactgcaacccagcccctccacaggagc

SEQ ID NO: 273727 - DNA, 75 bp, Artificial Sequence
  Synthetic
tatccgtaagacaagccctagagtcccacctaccgttgttcctccaccacagaacgcgcaagtcactccaatcca

SEQ ID NO: 273728 - DNA, 75 bp, Artificial Sequence
  Synthetic
actaccccagaccgggcagaaccccagatccaacatccgttaccacaacacctcgatctttgacactcactgctg

SEQ ID NO: 273729 - DNA, 75 bp, Artificial Sequence
  Synthetic
cattgcagtaaacccggcccaccccaccctaaaaccaggaggcggtctgagtgcgctattccacaggcaatttcc

SEQ ID NO: 273730 - DNA, 75 bp, Artificial Sequence
  Synthetic
agatctagcagcaaagacagcaccacacacaactagtttcgagcgtctcccaccctatgcagtgtccaccaaagt

SEQ ID NO: 273731 - DNA, 75 bp, Artificial Sequence
  Synthetic
gaatgcagtaggcaacatctcagaagtcgttcatgcaattggacctgacagaggaagaggtcagacctcatacaa

SEQ ID NO: 273732 - DNA, 75 bp, Artificial Sequence
  Synthetic
ccagctgctctgcacatatcaacttgccatgcaggtagcttcaggtcctgcggctttccccctgctaggagccaa

SEQ ID NO: 273733 - DNA, 75 bp, Artificial Sequence
  Synthetic
catttttggttggtctccagaagactctctcagggcatttatggaagctgatactcaagacatgcaccatctcta

SEQ ID NO: 273734 - DNA, 75 bp, Artificial Sequence
  Synthetic
catttatgacccctccgaccctggcagatttagaaggctaatcggtaaagacccaacagacggtgatcagagacc

SEQ ID NO: 273735 - DNA, 75 bp, Artificial Sequence
  Synthetic
gcccacaagggattctatggtcagggaaatcaacggtgtgatcgagccccccagacccacactggccgaaagtat

SEQ ID NO: 273736 - DNA, 75 bp, Artificial Sequence
  Synthetic
tggcagcacactcggactggcacccagctggtacaaaccaaccactcatcgctacgacgatatggcttgtaaagc

SEQ ID NO: 273737 - DNA, 75 bp, Artificial Sequence
  Synthetic
catcaacagcaacatgggcatggaaaaaggtaaaggtggtgattctaaggtatttgctgagctagttgcttctgc

SEQ ID NO: 273738 - DNA, 75 bp, Artificial Sequence
  Synthetic
tcctctcatcgaaccctttatattcaagtatcatctcacagaaggcgttcccggttcaggaaagtcccacgctgc

SEQ ID NO: 273739 - DNA, 75 bp, Artificial Sequence
  Synthetic
taagaagctcaacaaaagtacttgtgtggtggttccaaccggcgaactcaagagcgactggaagcaaagtgggtt

SEQ ID NO: 273740 - DNA, 75 bp, Artificial Sequence
  Synthetic
caaaaacactgttacaccccatgtagccatcaaatacggcatcaaatctaaatttctcgtcgtcgacgaagtctt

SEQ ID NO: 273741 - DNA, 75 bp, Artificial Sequence
  Synthetic
cagcatcccaccccacctgttggcaaccatcctctacaaacacagagacaacaacatcctacttggggattctaa

SEQ ID NO: 273742 - DNA, 75 bp, Artificial Sequence
  Synthetic
gcaaatagctgcctgtgattttgacaacttccgcaactttgatataattgctccaaaactcaccccgtccgtcta

SEQ ID NO: 273743 - DNA, 75 bp, Artificial Sequence
  Synthetic
cctcaatctcacctacaggctcccacaagacatcaccaggtacctgcagcgcgactacccgggcatccacactgc

SEQ ID NO: 273744 - DNA, 75 bp, Artificial Sequence
  Synthetic
tagtaaagtccccgtctcaatctctttctatccgcccccctcaggcaccccttgtcaagttatcggctaccgtca

SEQ ID NO: 273745 - DNA, 75 bp, Artificial Sequence
  Synthetic
attgatcaaagaacaaccaccgtggaagaaaactgccaacacatctcatgagctccagggtgctacccgtaaagc

SEQ ID NO: 273746 - DNA, 75 bp, Artificial Sequence
  Synthetic
cgtgcacttacacctgcttacaggcgatgtggagatgatacggtcatccagatctcatactattgtggcactctc

SEQ ID NO: 273747 - DNA, 75 bp, Artificial Sequence
  Synthetic
acgtcacactgaccaaattttcatcacaggagacgcagagtccattcaaacactccagctcactgataaaatgga

SEQ ID NO: 273748 - DNA, 75 bp, Artificial Sequence
  Synthetic
aaacatcatcatcaactacgctcctaccactttagttaatgatggtgcgaccttggagatcaccagcacacctga

SEQ ID NO: 273749 - DNA, 75 bp, Artificial Sequence
  Synthetic
cgatgacactcatgtcacagctcctgccgcagattcgacagccgtaggtgagatactccaggcttgcacaaatca

SEQ ID NO: 273750 - DNA, 75 bp, Artificial Sequence
  Synthetic
tctatatgcccccatttcagctgtcgtactagactgcgagaaaataaatcaaggttcactcaccgtcaagtgcgc

SEQ ID NO: 273751 - DNA, 75 bp, Artificial Sequence
  Synthetic
tgtaccagatgaacgcatcataccaaaaaccaacttcacagagatagaacactgtcgtcgtgcaaatgccagcag

SEQ ID NO: 273752 - DNA, 75 bp, Artificial Sequence
  Synthetic
cacctggacgacagtgcgcaccctcataggccgctacaccaaacttaccatcaacccagctcatgtacacgatac

SEQ ID NO: 273753 - DNA, 75 bp, Artificial Sequence
  Synthetic
catccaagcagttaacaaaacattctggaaatgcctcacagtcgacaccatgaattgcttacctacaacagcaga

SEQ ID NO: 273754 - DNA, 75 bp, Artificial Sequence
  Synthetic
gctcgccgagcttgtccgcagcatgaaggacaagggagcagaccccactctcatacacgatctggacttcaacga

SEQ ID NO: 273755 - DNA, 75 bp, Artificial Sequence
  Synthetic
catctctgttacgaagatgacgttcttccaaaaggagtgtgataagttcaccatggatgaaccagtccaacacaa

SEQ ID NO: 273756 - DNA, 75 bp, Artificial Sequence
  Synthetic
caagcctggacaagggatttcagcatggccaaagaccctatgttttatctacgggcttttcttcagaaaactaga

SEQ ID NO: 273757 - DNA, 75 bp, Artificial Sequence
  Synthetic
aaaggaactaagacaggctctgaaaccaagcatcatcttctcaaacccttacacagaggaacaacttgcaagagc

SEQ ID NO: 273758 - DNA, 75 bp, Artificial Sequence
  Synthetic
tgtctccaagtgcaccacaggaaccacagtcttctatgagaacgatttctcagcatttgacagcacacagaatct

SEQ ID NO: 273759 - DNA, 75 bp, Artificial Sequence
  Synthetic
agtttctcttggcaatgagtttctcatcttggtacaatgtggaatgccacctgcactcgctgaagtctacttcaa

SEQ ID NO: 273760 - DNA, 75 bp, Artificial Sequence
  Synthetic
cctccgcctgaagtggactcttgacgctagagttgccagtctccgtggtacatccaagaagcactctggggagcc

SEQ ID NO: 273761 - DNA, 75 bp, Artificial Sequence
  Synthetic
aggcaccatgctttttaacaccatttggaacatgaccgctgtcttccacaccactagtttcaccagaatgaccct

SEQ ID NO: 273762 - DNA, 75 bp, Artificial Sequence
  Synthetic
cgccctcttcaaaggagatgactcgcttgtgtgctgtgactccagcatactcaccccaactgccaaggagttcat

SEQ ID NO: 273763 - DNA, 75 bp, Artificial Sequence
  Synthetic
ttctcagaacgggctcgtcatgaaacagaagacgtcccacctcggctcctttacgtgcagtctcgtcacccgcac

SEQ ID NO: 273764 - DNA, 75 bp, Artificial Sequence
  Synthetic
aagctatgttccggatgtcatcaggttcgcttgcaggttgaacaacaaggacttcacagacaccaagcgcatcga

SEQ ID NO: 273765 - DNA, 75 bp, Artificial Sequence
  Synthetic
ggatctccagagggccacagacgatttcatcaagagagcgactgtcaccactaactacggttccacttgctcgat

SEQ ID NO: 273766 - DNA, 75 bp, Artificial Sequence
  Synthetic
caacggcagatactatggtgtcccttctgacaccattgagtgtgttgttggcttcctccaagattttgctctcac

SEQ ID NO: 273767 - DNA, 75 bp, Artificial Sequence
  Synthetic
cggaaaaatagacctccaaacatcatacaaaccaatcttaaaatattaaaataagagaagaaattaaataagttg

SEQ ID NO: 273768 - DNA, 75 bp, Artificial Sequence
  Synthetic
gacattagttgtgtgcgtttgagatagatacattcacaatggcagattctaatgcagtcgtcccttccgcacaat

SEQ ID NO: 273769 - DNA, 75 bp, Artificial Sequence
  Synthetic
ctaaaccacgtcgcactaggcgcccaaagatggacccctctcagatcccagatacagtcaaaaccttccgtctca

SEQ ID NO: 273770 - DNA, 75 bp, Artificial Sequence
  Synthetic
caaccgaccctatcatggcacccccacctggtgaaattgattcacttctctatacatcaggcctctcacctgcag

SEQ ID NO: 273771 - DNA, 75 bp, Artificial Sequence
  Synthetic
ttgtcctttccttctcctcattcacctcacctgcagttgtcttcgctgccaactatgagaaatacaagatcttgt

SEQ ID NO: 273772 - DNA, 75 bp, Artificial Sequence
  Synthetic
ctttcaaagctactgtcctctccctagcaccagaagctatttccagttacaacctctctgtcgtctggttcccag

SEQ ID NO: 273773 - DNA, 75 bp, Artificial Sequence
  Synthetic
atgcatcagaaggacccacctccctccaagctacaaacttgtccatggtccgccgctaccactcaatcttaccag

SEQ ID NO: 273774 - DNA, 75 bp, Artificial Sequence
  Synthetic
gacaatctggttctctctcccttaccgcatctgagctcctccacggtatagctgagaagtacgtcgaccccactc

SEQ ID NO: 273775 - DNA, 75 bp, Artificial Sequence
  Synthetic
actctgatgcattatccgctttctgcgggctcttcatggtagtgtgccacggagcccctttcaaccactaccgtg

SEQ ID NO: 273776 - DNA, 75 bp, Artificial Sequence
  Synthetic
acactcagtaccttggccctctgttcaagatccaattcgagttcaagctgtcagtcttcggttactctcccggca

SEQ ID NO: 273777 - DNA, 75 bp, Artificial Sequence
  Synthetic
acattccagttaaagttcagggcgcctcagctactgagattgtctcatttggaacagttgatgggaaagctacct

SEQ ID NO: 273778 - DNA, 75 bp, Artificial Sequence
  Synthetic
ttgacaccccttccgcaattgctctccatgcttcataccaaagtggcccaccaaattcacccgggccttctatcg

SEQ ID NO: 273779 - DNA, 75 bp, Artificial Sequence
  Synthetic
gccaagtactcctcacagtggctgacaccgtgtcagctgcgctccctttccctttcagtatacttgcaaaagttg

SEQ ID NO: 273780 - DNA, 75 bp, Artificial Sequence
  Synthetic
gtctcttctttatccgcaagattactggagccaatggaacttccttcatggtctacaaatcctatggagatgcaa

SEQ ID NO: 273781 - DNA, 75 bp, Artificial Sequence
  Synthetic
ttcgcaaccgcccactaccctcacgctcaagccatcaactgggcaatgcacttgtccgccagaccacattcggca

SEQ ID NO: 273782 - DNA, 75 bp, Artificial Sequence
  Synthetic
ctaacgatgactcagttctcccaccccagcccatcagccagttcaccttccacttcaagactggcgatgtccttg

SEQ ID NO: 273783 - DNA, 75 bp, Artificial Sequence
  Synthetic
tcatccagggttccttcaaggccccaaccagtcgacccaataattggaatgttcaggaattctccatttcgagaa

SEQ ID NO: 273784 - DNA, 75 bp, Artificial Sequence
  Synthetic
tccttaacatcactaatgggacctccactacaaacattcttgtgtttgaaaagtggactctggatggtaacctcc

SEQ ID NO: 273785 - DNA, 75 bp, Artificial Sequence
  Synthetic
cacagatcaagaacacctacggtctcatcggggtccactacttcccggcttccattagtcctgttggcaccagca

SEQ ID NO: 273786 - DNA, 75 bp, Artificial Sequence
  Synthetic
ccttcgacaacatcattggtgattgcaaagtctttgcaggcaccgcaactgacagcatgttaacgcctggtccag

SEQ ID NO: 273787 - DNA, 75 bp, Artificial Sequence
  Synthetic
gttctatcacagtaacattcctatcccaaacccgcggcttcctcagtcagactgagctcacacaaggtctcatag

SEQ ID NO: 273788 - DNA, 75 bp, Artificial Sequence
  Synthetic
ccgcttcaagcaccatggacaccacagactcatctctcacccgacaagcatcccaaccaatggaggtggatggct

SEQ ID NO: 273789 - DNA, 75 bp, Artificial Sequence
  Synthetic
tcctttccggtctaatcccctccacacccctctgcaacatggtgaacaacaccttctcctgcggcaacagcgaca

SEQ ID NO: 273790 - DNA, 75 bp, Artificial Sequence
  Synthetic
gtcaagccacttcccggtcagctgttcactctcttggccccaattgtgataaatgcggactagatctcaacctaa

SEQ ID NO: 273791 - DNA, 75 bp, Artificial Sequence
  Synthetic
gagtgacaccctgcattgccactcgcctccaacacacaccaaaagcatgccctcactgctccttcctcctcggtc

SEQ ID NO: 273792 - DNA, 75 bp, Artificial Sequence
  Synthetic
tcactgcctacacagtggactgtatgcgtccttccgacaccactgattctaccgtggacgctctccttaacccac

SEQ ID NO: 273793 - DNA, 75 bp, Artificial Sequence
  Synthetic
tcaactctctcgatcttgagtctgagtcagaaccttctgatgacgacctgatccaattcgatgactaaacatcat

SEQ ID NO: 273794 - DNA, 75 bp, Artificial Sequence
  Synthetic
ttggcctactatctcttctattaatcctctaacttttcttatatattcaccctattcagttatacacccaaaaaa

SEQ ID NO: 273795 - DNA, 75 bp, Artificial Sequence
  Synthetic
ttcttatatattcaccctattcagttatacacccaaaaaaaaaaaaaaaaaaaaaaaaaaaaaaaaaaaaaaaaa

SEQ ID NO: 273796 - DNA, 75 bp, Artificial Sequence
  Synthetic
accaaggggaaaacgaagtggtaacgcaaatcatcaaagaccctcgaggttacataggtccggaacctatggcct

SEQ ID NO: 273797 - DNA, 75 bp, Artificial Sequence
  Synthetic
tacataggtccggaacctatggccttcgtgaccgacctcgagtcagagtagttcaataaggacctatcaagtttg

SEQ ID NO: 273798 - DNA, 75 bp, Artificial Sequence
  Synthetic
tcgtgaccgacctcgagtcagagtagttcaataaggacctatcaagtttgggcaatttttcgtccccgacacaaa

SEQ ID NO: 273799 - DNA, 75 bp, Artificial Sequence
  Synthetic
gctagaacagaactgctcgtggggtgctgcactgattaatgataatagatacattaatggcatcaatcagttcta

SEQ ID NO: 273800 - DNA, 75 bp, Artificial Sequence
  Synthetic
aatgtcatccgtgcttaaagcatatgagcgattcacactcactcaagaactgcaagatcagagtgaggaaggtac

SEQ ID NO: 273801 - DNA, 75 bp, Artificial Sequence
  Synthetic
aatcccacctacaacactaaaaccggtaatcagggtatttatactaacctctaataacccagagctaagatcccg

SEQ ID NO: 273802 - DNA, 75 bp, Artificial Sequence
  Synthetic
ctaataacccagagctaagatcccggcttcttctattctgcctacggattgttctcagtaatggtgcaagggatt

SEQ ID NO: 273803 - DNA, 75 bp, Artificial Sequence
  Synthetic
cccatcgctttggagcattacttacaatgttttcgctaccatcagccacaatgctcaatcatgtcaaattagctg

SEQ ID NO: 273804 - DNA, 75 bp, Artificial Sequence
  Synthetic
atgctcaatcatgtcaaattagctgaccagtcaccagaagctgatatcgaaagggtagagatcgatggctttgag

SEQ ID NO: 273805 - DNA, 75 bp, Artificial Sequence
  Synthetic
agatgtatgggcaacactgaacccaggaacaggaagcggggtatattatttaggctgggtactcttcccaatata

SEQ ID NO: 273806 - DNA, 75 bp, Artificial Sequence
  Synthetic
gagggatcattccgcttaatccccaatgctcgttcaggtatgagccgtggagagatcaatgcctatgctgcactt

SEQ ID NO: 273807 - DNA, 75 bp, Artificial Sequence
  Synthetic
atgctcgttcaggtatgagccgtggagagatcaatgcctatgctgcacttgcagaagatctacctgacacactaa

SEQ ID NO: 273808 - DNA, 75 bp, Artificial Sequence
  Synthetic
actttatcccccagatggttgctgctctctgttcacaaaaccaggcaactcaagtccaaaatgctaagtcatcat

SEQ ID NO: 273809 - DNA, 75 bp, Artificial Sequence
  Synthetic
accatgcaacacctttcgttgattccgaagtcgagggaactgcatgggatgagattgagactttcttagatatgt

SEQ ID NO: 273810 - DNA, 75 bp, Artificial Sequence
  Synthetic
cgaagtcgagggaactgcatgggatgagattgagactttcttagatatgtgttacagtgtcctaatgcaggcatg

SEQ ID NO: 273811 - DNA, 75 bp, Artificial Sequence
  Synthetic
actatagcagctggtttggcaatcgaatgattcagtctggaatcctggcatgtcctcttcaacaggatctaacta

SEQ ID NO: 273812 - DNA, 75 bp, Artificial Sequence
  Synthetic
gatagtgacttgcaagtgcatgactgcgccagaccaacctgctgcttctattgagaaacgcctgcaaaaatatcg

SEQ ID NO: 273813 - DNA, 75 bp, Artificial Sequence
  Synthetic
gcgccagaccaacctgctgcttctattgagaaacgcctgcaaaaatatcgtcagcaaggcaggatcaacccgaga

SEQ ID NO: 273814 - DNA, 75 bp, Artificial Sequence
  Synthetic
tatctcctgcaaccggaggctcgacgaataatccagaatgtaatccggaagggaatggtggtcagacatttcctc

SEQ ID NO: 273815 - DNA, 75 bp, Artificial Sequence
  Synthetic
acctttgaactgcagcttgcccgagcacaaagccttgtatcaaataggtattatgctatggtaggggatgttgga

SEQ ID NO: 273816 - DNA, 75 bp, Artificial Sequence
  Synthetic
ctctcttaggacaatttcagattgtcccatttatccgtcaggtgacactatcctaaaggcaaaagtatccaggtc

SEQ ID NO: 273817 - DNA, 75 bp, Artificial Sequence
  Synthetic
aagtatatagagaattgtggaatgggaggcttctttttgacactaaaatatgcattaggaaccagatggcccaca

SEQ ID NO: 273818 - DNA, 75 bp, Artificial Sequence
  Synthetic
gaggcttctttttgacactaaaatatgcattaggaaccagatggcccacacttgctttagctgcattttcaggag

SEQ ID NO: 273819 - DNA, 75 bp, Artificial Sequence
  Synthetic
ccagaccatggaatgcataccaaacattattgacactaatgacacacaaaaatgtttttaagaaaaaccaagaga

SEQ ID NO: 273820 - DNA, 75 bp, Artificial Sequence
  Synthetic
agctaacaaagctaaagtccctcatggcattataccagacccttggtgagcaggcccgatatttggccctattgg

SEQ ID NO: 273821 - DNA, 75 bp, Artificial Sequence
  Synthetic
taagctatactattacattctacttggaaacctcccaaatgagatcgacattgacgatttcggtccattacataa

SEQ ID NO: 273822 - DNA, 75 bp, Artificial Sequence
  Synthetic
caggcccgatatttggccctattggagtcaccacatttgatggattttgctgcagcaaactacccactgctatat

SEQ ID NO: 273823 - DNA, 75 bp, Artificial Sequence
  Synthetic
agctatgctatgggaataggctatgtgttagatgtcaacatgaggaactacgctttctccagatcatacatgaat

SEQ ID NO: 273824 - DNA, 75 bp, Artificial Sequence
  Synthetic
aaactgcaagaaaacaacagggtgcagttgacatgaggatggcagaagatctcggtctaactcaagccgaacgca

SEQ ID NO: 273825 - DNA, 75 bp, Artificial Sequence
  Synthetic
taatactgtggccgcggattcttcccttgattccggattttaaaatcaatgaccaattgcctctactcaaaaatt

SEQ ID NO: 273826 - DNA, 75 bp, Artificial Sequence
  Synthetic
ccgagatggcaaatacacttgccaaattgaccacagcaaatcgaggggcagacaccaggggaggagtcaacccgt

SEQ ID NO: 273827 - DNA, 75 bp, Artificial Sequence
  Synthetic
attgaccacagcaaatcgaggggcagacaccaggggaggagtcaacccgttctcatctgtcactgggacaactca

SEQ ID NO: 273828 - DNA, 75 bp, Artificial Sequence
  Synthetic
ggtgcccgctgcagcaacaggtgacacattcgagagttacatggcagcggatcgactgaggcagagatatgctga

SEQ ID NO: 273829 - DNA, 75 bp, Artificial Sequence
  Synthetic
atcgactgaggcagagatatgctgatgcaggcacccatgatgatgagatgccaccattggaagaggaggaagagg

SEQ ID NO: 273830 - DNA, 75 bp, Artificial Sequence
  Synthetic
aatagtttcacccaggatgaatcaagaactgtgacaaccaatttgatatccccattccaagatctgaccccagat

SEQ ID NO: 273831 - DNA, 75 bp, Artificial Sequence
  Synthetic
gaatgccgcactgggtgatcttgacatctagacaattcagatcccaatctaaaatcgacacacctaattgaccag

SEQ ID NO: 273832 - DNA, 75 bp, Artificial Sequence
  Synthetic
ttaagaaaaaaataggcccggacgggttagcaacaatcgactgccgatgccaacagcacaatccacaatctacaa

SEQ ID NO: 273833 - DNA, 75 bp, Artificial Sequence
  Synthetic
tggatcccactgatctgagcttctccccagatgagatcaataagctcatagagacaggcctgaatactgtggagt

SEQ ID NO: 273834 - DNA, 75 bp, Artificial Sequence
  Synthetic
cccagatgagatcaataagctcatagagacaggcctgaatactgtggagtattttacttcccaacaagtcacagg

SEQ ID NO: 273835 - DNA, 75 bp, Artificial Sequence
  Synthetic
aacatcctctcttggaaagaatacaataccaccaggggtcacaggactactaaccaatgctgcagaggcaaagat

SEQ ID NO: 273836 - DNA, 75 bp, Artificial Sequence
  Synthetic
taaccaatgctgcagaggcaaagatccaagagtcaactaaccatcagaagggtttagttggtgggggtgcaaaac

SEQ ID NO: 273837 - DNA, 75 bp, Artificial Sequence
  Synthetic
caaagaaaccgcgaccaaaaattgccattgtgccagcagatgacaaaacagtgcctggaaagccgatcccaaacc

SEQ ID NO: 273838 - DNA, 75 bp, Artificial Sequence
  Synthetic
gtgcctggaaagccgatcccaaaccctctattaggtctggactccaccccgagcacccaaactgtgcttgatcta

SEQ ID NO: 273839 - DNA, 75 bp, Artificial Sequence
  Synthetic
gagcacccaaactgtgcttgatctaagtgggaaaacattaccatcaggatcctataagggggttaagcttgcgaa

SEQ ID NO: 273840 - DNA, 75 bp, Artificial Sequence
  Synthetic
gagatcagatcacattagaatacataaataatccacacctggtatcacgattagctcttttgccatctcagctag

SEQ ID NO: 273841 - DNA, 75 bp, Artificial Sequence
  Synthetic
cctataagggggttaagcttgcgaaatttggaaaagaaaatctgatgacacggttcatcgaggaacccagagaga

SEQ ID NO: 273842 - DNA, 75 bp, Artificial Sequence
  Synthetic
atcctatcgcacccagttcccccatcgattttaagaggggcagggataccggcgggttccatagaagggagtact

SEQ ID NO: 273843 - DNA, 75 bp, Artificial Sequence
  Synthetic
caatcggatgggtgggagatgaagtcaaggtcactgagtggtgcaatccatcctgttctccaatcaccgctgcag

SEQ ID NO: 273844 - DNA, 75 bp, Artificial Sequence
  Synthetic
caaggcgatttgaatgcacttgtcaccagtgtccagtcacttgctctgaatgtgaacgagatacttaatacagtg

SEQ ID NO: 273845 - DNA, 75 bp, Artificial Sequence
  Synthetic
agaaatttggactctcggatgaatcaactggagacaaaagtagatcgcattctctcatctcagtctctaatccag

SEQ ID NO: 273846 - DNA, 75 bp, Artificial Sequence
  Synthetic
accatcaagaatgacatagttggacttaaagcagggatggctactttagaaggaatgattacaactgtgaaaatc

SEQ ID NO: 273847 - DNA, 75 bp, Artificial Sequence
  Synthetic
atggacccgggagttcccagtaatgttactgtggaagatgtacgcaagaaattaagtaaccatgctgttgttgtg

SEQ ID NO: 273848 - DNA, 75 bp, Artificial Sequence
  Synthetic
ccaatctaacccatcggttggatgatggcacaactaccctaaagtttactcctgcgagctcttatactttttcaa

SEQ ID NO: 273849 - DNA, 75 bp, Artificial Sequence
  Synthetic
ccagaatcattcaatgatagtttcttgactcaatctgaagatgtaatttcacttgatgagttggctcgaccaact

SEQ ID NO: 273850 - DNA, 75 bp, Artificial Sequence
  Synthetic
gcaacaagtgttaagaagattgtcaggaaggttcctcctcagaaggatctgactggattgaagatcacactagag

SEQ ID NO: 273851 - DNA, 75 bp, Artificial Sequence
  Synthetic
caattggcaaaggattgcatcagcaaaccgaagatgagggaagagtatctcctcaaaatcaaccaggcttccagt

SEQ ID NO: 273852 - DNA, 75 bp, Artificial Sequence
  Synthetic
cctcaaaatcaaccaggcttccagtgaggctcagctaattgacctcaagaaagcaatcatccgcagtgcaatttg

SEQ ID NO: 273853 - DNA, 75 bp, Artificial Sequence
  Synthetic
gaggctcagctaattgacctcaagaaagcaatcatccgcagtgcaatttgatcaagaaacacccaattacactac

SEQ ID NO: 273854 - DNA, 75 bp, Artificial Sequence
  Synthetic
actggtatgacactgtactaaccctgagggttttagaaaaaacgattaacgataaataagcccgaacactacaca

SEQ ID NO: 273855 - DNA, 75 bp, Artificial Sequence
  Synthetic
tatctgagggtagttgggtggagtaatatagtggattattcttacatgatcttaagaaggatcccgggtgcagca

SEQ ID NO: 273856 - DNA, 75 bp, Artificial Sequence
  Synthetic
gataaataagcccgaacactacacactacctgaggcagccatgccatccatcagcatccccgcagaccccaccaa

SEQ ID NO: 273857 - DNA, 75 bp, Artificial Sequence
  Synthetic
tccacgtcaatcaataaaagcgttcccaattgtgatcaacagtgatgggggtgagaaaggccgcttggttaaaca

SEQ ID NO: 273858 - DNA, 75 bp, Artificial Sequence
  Synthetic
actacgcacaacctacttgaatgacctagatactcatgagccactggtgacattcgtaaatacctatggattcat

SEQ ID NO: 273859 - DNA, 75 bp, Artificial Sequence
  Synthetic
ctagatactcatgagccactggtgacattcgtaaatacctatggattcatctacgaacaggatcgggggaatact

SEQ ID NO: 273860 - DNA, 75 bp, Artificial Sequence
  Synthetic
attgtcggagaggatcaacttgggaagaaaagagaggctgtgactgctgcaatggttacccttggatgtgggcct

SEQ ID NO: 273861 - DNA, 75 bp, Artificial Sequence
  Synthetic
agaaaagagaggctgtgactgctgcaatggttacccttggatgtgggcctaatctaccatcattagggaatgtcc

SEQ ID NO: 273862 - DNA, 75 bp, Artificial Sequence
  Synthetic
aatggttacccttggatgtgggcctaatctaccatcattagggaatgtcctgggacaactgagtgaattccaggt

SEQ ID NO: 273863 - DNA, 75 bp, Artificial Sequence
  Synthetic
tgggacaactgagtgaattccaggtcattgttaggaagacatccagcaaagcggaagagatggtctttgaaattg

SEQ ID NO: 273864 - DNA, 75 bp, Artificial Sequence
  Synthetic
cattgttaggaagacatccagcaaagcggaagagatggtctttgaaattgttaagtatccgagaatatttcgggg

SEQ ID NO: 273865 - DNA, 75 bp, Artificial Sequence
  Synthetic
attaaagctaccacaaggtgatcatttatatattgcagaaggtagtggtgcaagtatgacaattatagaatactt

SEQ ID NO: 273866 - DNA, 75 bp, Artificial Sequence
  Synthetic
ttaagtatccgagaatatttcggggtcatacattaatccagaaaggactagtctgtgtctccgcagaaaaatttg

SEQ ID NO: 273867 - DNA, 75 bp, Artificial Sequence
  Synthetic
gtcccatacaagctctggcaagcacacacagatcaatatcccgagatttttgaggatttcattcctctatggaac

SEQ ID NO: 273868 - DNA, 75 bp, Artificial Sequence
  Synthetic
tggaatggactatctcttcattccgacatttctgtcagtgacttactgtccagctgcaatcaaatttcaggtacc

SEQ ID NO: 273869 - DNA, 75 bp, Artificial Sequence
  Synthetic
acatttctgtcagtgacttactgtccagctgcaatcaaatttcaggtacctggccccatgttgaaaatgagatca

SEQ ID NO: 273870 - DNA, 75 bp, Artificial Sequence
  Synthetic
tggccccatgttgaaaatgagatcaagatacactcagagcttacaacttgaactaatgataagaatcctgtgtaa

SEQ ID NO: 273871 - DNA, 75 bp, Artificial Sequence
  Synthetic
aactaatgataagaatcctgtgtaagcccgattcgccacttatgaaggtccatatccctgacaaggaaggaagag

SEQ ID NO: 273872 - DNA, 75 bp, Artificial Sequence
  Synthetic
gatgtcttgtatcagtatggctgcatgtatgcaacatcttcaaatcaggaaacaagaatggcagtgagtggcagg

SEQ ID NO: 273873 - DNA, 75 bp, Artificial Sequence
  Synthetic
tttgtatccttgccgacaactttgcattccagactgtctcgcaggcaacaggaacggcgatgactttaaccgatc

SEQ ID NO: 273874 - DNA, 75 bp, Artificial Sequence
  Synthetic
aagggtttaccttgatatcacctgaaagaataaatcagtattgggatggtcacttaaagcaagaacgtatcgtag

SEQ ID NO: 273875 - DNA, 75 bp, Artificial Sequence
  Synthetic
catgcaacttgaagtgtcgattgcagatatgtggggaccaactatcataattcatgccagaggtcacattcccaa

SEQ ID NO: 273876 - DNA, 75 bp, Artificial Sequence
  Synthetic
caattctgatcggttcctgaagctttctccaaataggaaatacttggttacacaattaactacaggctacattag

SEQ ID NO: 273877 - DNA, 75 bp, Artificial Sequence
  Synthetic
ggagactactgacatcataagtccaaaagtcaaaatttcatctaagcatcgccgctttgggaaatcaaattgggg

SEQ ID NO: 273878 - DNA, 75 bp, Artificial Sequence
  Synthetic
aaagtcaaaatttcatctaagcatcgccgctttgggaaatcaaattggggtctgttcaagaaaactaaatcactg

SEQ ID NO: 273879 - DNA, 75 bp, Artificial Sequence
  Synthetic
gccgctttgggaaatcaaattggggtctgttcaagaaaactaaatcactgcctaacctgacggagctggaatgac

SEQ ID NO: 273880 - DNA, 75 bp, Artificial Sequence
  Synthetic
atcgatctaaccagacctatccaaaagcaaatctggaaagcattaggttgtgtagtctattgtcacgatccagta

SEQ ID NO: 273881 - DNA, 75 bp, Artificial Sequence
  Synthetic
cctaacctgacggagctggaatgactgacctctaatcgagattacaccacctcaaactataggtgggtggtacct

SEQ ID NO: 273882 - DNA, 75 bp, Artificial Sequence
  Synthetic
tgacctctaatcgagattacaccacctcaaactataggtgggtggtacctcagtgattaatctcgtaagcactga

SEQ ID NO: 273883 - DNA, 75 bp, Artificial Sequence
  Synthetic
ggaaatctaaatatatcaaggatcagaattagtttaagaaaaattaagaggattaatcttggttttccccttggt

SEQ ID NO: 273884 - DNA, 75 bp, Artificial Sequence
  Synthetic
atccagattagagagcttaattagctctgtattaataataacactactattccaataactggaatcaccagcttg

SEQ ID NO: 273885 - DNA, 75 bp, Artificial Sequence
  Synthetic
atttatctccaaaatgattcaaagaaaacaaatcatattaagactatcctaagcacgaacccatatcgtccttca

SEQ ID NO: 273886 - DNA, 75 bp, Artificial Sequence
  Synthetic
aaacaaatcatattaagactatcctaagcacgaacccatatcgtccttcaaatcatgggtactataattcaattt

SEQ ID NO: 273887 - DNA, 75 bp, Artificial Sequence
  Synthetic
atcctatcgcaaccagtttccccatcgattttaagaggggcagggataccggcgggttccatagaagggagtact

SEQ ID NO: 273888 - DNA, 75 bp, Artificial Sequence
  Synthetic
ctggtggtctcctgtctattggcaggagcaggcagccttgatccagcagccctcatgcaaatcggtgtcattcca

SEQ ID NO: 273889 - DNA, 75 bp, Artificial Sequence
  Synthetic
cctcatgcaaatcggtgtcattccaacaaatgtccggcaacttatgtattatactgaggcctcatcagcattcat

SEQ ID NO: 273890 - DNA, 75 bp, Artificial Sequence
  Synthetic
tgttgtgaagttaatgcctacaattgactcgccgattagtggatgtaatataacatcaatttcaagctataatgc

SEQ ID NO: 273891 - DNA, 75 bp, Artificial Sequence
  Synthetic
gagacgccggtttgcaggggtggtgattggattagctgcattaggagtagctactgccgcacaggtcactgccgc

SEQ ID NO: 273892 - DNA, 75 bp, Artificial Sequence
  Synthetic
agtagcactagtaaaggcaaataaaaatgctgcggctatactcaatctcaaaaatgcaatccaaaaaacaaatac

SEQ ID NO: 273893 - DNA, 75 bp, Artificial Sequence
  Synthetic
aatgctgcggctatactcaatctcaaaaatgcaatccaaaaaacaaatacagcagttgcagatgtggtccaggcc

SEQ ID NO: 273894 - DNA, 75 bp, Artificial Sequence
  Synthetic
acacaatcactaggaacggcagttcaagcagttcaagatcacataaacagtgtggtaagtccagcaattacagca

SEQ ID NO: 273895 - DNA, 75 bp, Artificial Sequence
  Synthetic
gccaattgtaaggcccaagatgctatcattggctcaatcctcaatctctatttgaccgagttgacaactatcttc

SEQ ID NO: 273896 - DNA, 75 bp, Artificial Sequence
  Synthetic
cacaatcaaattacaaaccctgcattgagtcctattacaattcaagctttaaggatcctactggggagtaccttg

SEQ ID NO: 273897 - DNA, 75 bp, Artificial Sequence
  Synthetic
aaggatcctactggggagtaccttgccgactgtggtcgaaaaatctttcaatacccagataagtgcagctgagct

SEQ ID NO: 273898 - DNA, 75 bp, Artificial Sequence
  Synthetic
tctctcatcagggttattgacaggccagattgtgggattagatttgacctatatgcagatggtcataaaaattga

SEQ ID NO: 273899 - DNA, 75 bp, Artificial Sequence
  Synthetic
gcaacccagatcatagatctggccaccatttctgcattcattaacaatcaagaagtcatggcccaattaccaaca

SEQ ID NO: 273900 - DNA, 75 bp, Artificial Sequence
  Synthetic
cgtgttattgtgactggcagcttgatccaagcctatcccgcatcgcaatgcactattacacccaacactgtgtac

SEQ ID NO: 273901 - DNA, 75 bp, Artificial Sequence
  Synthetic
tccaagcctatcccgcatcgcaatgcactattacacccaacactgtgtactgtaggtataatgatgcccaagtac

SEQ ID NO: 273902 - DNA, 75 bp, Artificial Sequence
  Synthetic
tgtaggtataatgatgcccaagtactctcagatgatacgatggcttgcctccaaggtaacttgacaagatgcacc

SEQ ID NO: 273903 - DNA, 75 bp, Artificial Sequence
  Synthetic
ctgctgtgatcctacagccgagttcatcccctgtaactgtcattgacatgtacaaatgtgtgagtctgcagcttg

SEQ ID NO: 273904 - DNA, 75 bp, Artificial Sequence
  Synthetic
attggccaatgtaacctacaatagcaccatcaagcttgaaacatcccagatcttgcctattgatccgttggatat

SEQ ID NO: 273905 - DNA, 75 bp, Artificial Sequence
  Synthetic
tcttgcctattgatccgttggatatatcccagaatctagctgcggtgaataagagtctaagtgatgcactacaac

SEQ ID NO: 273906 - DNA, 75 bp, Artificial Sequence
  Synthetic
aagagtctaagtgatgcactacaacacttagcacaaagtgacacatacctttctgcaatcacatcagctacgact

SEQ ID NO: 273907 - DNA, 75 bp, Artificial Sequence
  Synthetic
gtgtggaagttattgaccattgtcactgctaatcgaaatagaatggagaattttgtttatcataattcagcattc

SEQ ID NO: 273908 - DNA, 75 bp, Artificial Sequence
  Synthetic
caccactcacgatctgatctcagtgagaaaaatcaacctgcaactcttggaacaagataagacagtcatccatta

SEQ ID NO: 273909 - DNA, 75 bp, Artificial Sequence
  Synthetic
ctgacaccgtctcggaaagcccaaatcacgctgcccgatccggaagatccggaaagcaaaaaagccacaaggaga

SEQ ID NO: 273910 - DNA, 75 bp, Artificial Sequence
  Synthetic
acaggaaacccaatcatccgcctcccattcatcccctctctgcctgcaaccttcaccgttccaactccaagacac

SEQ ID NO: 273911 - DNA, 75 bp, Artificial Sequence
  Synthetic
cattcatcccctctctgcctgcaaccttcaccgttccaactccaagacacctgctgtcccaacacccgctatagg

SEQ ID NO: 273912 - DNA, 75 bp, Artificial Sequence
  Synthetic
gaatgccgcactgggtgatctcgacatctagacaattcagatcccaatcttaaactgacatacccaattgatcag

SEQ ID NO: 273913 - DNA, 75 bp, Artificial Sequence
  Synthetic
ctatccactgcatcatctctcctgccatacttcctactcacatcatatctattttaaagaaaaaataggcccgaa

SEQ ID NO: 273914 - DNA, 75 bp, Artificial Sequence
  Synthetic
catacttcctactcacatcatatctattttaaagaaaaaataggcccgaacactaatcgtgccggcagtgccact

SEQ ID NO: 273915 - DNA, 75 bp, Artificial Sequence
  Synthetic
cactaatcgtgccggcagtgccactgcacacacaacactacacatacaatacactacaatggttgcagaagatgc

SEQ ID NO: 273916 - DNA, 75 bp, Artificial Sequence
  Synthetic
ccctgttaggggcacttgccgagtattatttcgaacaacaactttaatttttctatgcacactactagcattaag

SEQ ID NO: 273917 - DNA, 75 bp, Artificial Sequence
  Synthetic
ttctatgcacactactagcattaagcatctctatcctttatgagagtttaataacccaaaagcaaatcatgagcc

SEQ ID NO: 273918 - DNA, 75 bp, Artificial Sequence
  Synthetic
ataacccaaaagcaaatcatgagccacgcaggctcaactggatctaattctagattaggaagtatcactgatctt

SEQ ID NO: 273919 - DNA, 75 bp, Artificial Sequence
  Synthetic
tagattaggaagtatcactgatcttcttaataatattctctctgtcgcaaatcagattatatataactctgcagt

SEQ ID NO: 273920 - DNA, 75 bp, Artificial Sequence
  Synthetic
cttaataatattctctctgtcgcaaatcagattatatataactctgcagtcgctctacctctacaattggacact

SEQ ID NO: 273921 - DNA, 75 bp, Artificial Sequence
  Synthetic
cgctctacctctacaattggacactcttgaatcaacactccttacagccattaagtctcttcaaaccagtgacaa

SEQ ID NO: 273922 - DNA, 75 bp, Artificial Sequence
  Synthetic
gatttttgaggacttcatccctctatggaacggaaacgccgccatgactgacataggaatgacagcttgtgtaga

SEQ ID NO: 273923 - DNA, 75 bp, Artificial Sequence
  Synthetic
acattaatggcatcaatcagttctatttctcaattgctgagggtcgcaatctgacacttggcccacttcttaata

SEQ ID NO: 273924 - DNA, 75 bp, Artificial Sequence
  Synthetic
ctgacacttggcccacttcttaatatacctagtttcattccaactgccacgacaccagagggctgcaccaggatc

SEQ ID NO: 273925 - DNA, 75 bp, Artificial Sequence
  Synthetic
ccatcattctcgctcaccaagacacactggtgttatacacacaatgttatcctgaatggatgccaggatcatgta

SEQ ID NO: 273926 - DNA, 75 bp, Artificial Sequence
  Synthetic
tcctcaaatcaatttgtttccatgggaatcattgaacccacttctgccgggtttccatcctttcgaaccctaaag

SEQ ID NO: 273927 - DNA, 75 bp, Artificial Sequence
  Synthetic
actctatatctcagcgatggggtcaatcgtaagagctgctctatcagtacagttccggggggttgtatgatgtac

SEQ ID NO: 273928 - DNA, 75 bp, Artificial Sequence
  Synthetic
gaatgccgcactgggtgatcttgacatctagacaattcagatcccaatctaaaattgacatacctaattgattag

SEQ ID NO: 273929 - DNA, 75 bp, Artificial Sequence
  Synthetic
agttccggggggttgtatgatgtactgttttgtctctactcaaccagagagggatgactacttttctaccgctcc

SEQ ID NO: 273930 - DNA, 75 bp, Artificial Sequence
  Synthetic
tgttttgtctctactcaaccagagagggatgactacttttctaccgctcctccagaacaacgaattattataatg

SEQ ID NO: 273931 - DNA, 75 bp, Artificial Sequence
  Synthetic
tccagaacaacgaattattataatgtactataatgatacaatcgtggagcgcataattaatccacccggggtact

SEQ ID NO: 273932 - DNA, 75 bp, Artificial Sequence
  Synthetic
tggcggcgtgattaaagatacgagtttatggaataatcaagcaaataaatactttatcccccagatggttgctgc

SEQ ID NO: 273933 - DNA, 75 bp, Artificial Sequence
  Synthetic
ttatggaataatcaagcaaataaatactttatcccccagatggttgctgctctctgctcacaaaaccaggcaact

SEQ ID NO: 273934 - DNA, 75 bp, Artificial Sequence
  Synthetic
atggacccgggagttcccagtaatgttactgtggaagatgtacgcaagacactaagtaaccatgctgttgttgtg

SEQ ID NO: 273935 - DNA, 75 bp, Artificial Sequence
  Synthetic
tctctgctcacaaaaccaggcaactcaagtccaaaatgctaagtcatcatactatagcagctggtttggcaatcg

SEQ ID NO: 273936 - DNA, 75 bp, Artificial Sequence
  Synthetic
actatagcagctggtttggcaatcgaatgattcagtctgggatcctggcatgtcctcttcaacaggatctaacca

SEQ ID NO: 273937 - DNA, 75 bp, Artificial Sequence
  Synthetic
aatgattcagtctgggatcctggcatgtcctcttcaacaggatctaaccaatgagtgtttagttctgcccttttc

SEQ ID NO: 273938 - DNA, 75 bp, Artificial Sequence
  Synthetic
gataaataagcccgaacactacacactacctgaggcagccatgccatccatcagcattcccgcagaccccaccaa

SEQ ID NO: 273939 - DNA, 75 bp, Artificial Sequence
  Synthetic
atgagtgtttagttctgcccttttctaatgatcaggtgcttatgggtgctgaagggagattatacatgtatggtg

SEQ ID NO: 273940 - DNA, 75 bp, Artificial Sequence
  Synthetic
taatgatcaggtgcttatgggtgctgaagggagattatacatgtatggtgactcggtgtattactaccaaagaag

SEQ ID NO: 273941 - DNA, 75 bp, Artificial Sequence
  Synthetic
ctagatactcatgagccactggtgacattcataaatacctatggattcatctacgaacaggatcgggggaatacc

SEQ ID NO: 273942 - DNA, 75 bp, Artificial Sequence
  Synthetic
caatagttggtggcctatgaccatgctgtataaggtaaccataacattcactaatggtcagccatctgctatatc

SEQ ID NO: 273943 - DNA, 75 bp, Artificial Sequence
  Synthetic
gctctgcaacaaatagatgtcccggtttttgcttgaaaggagtgtatgctgatgcctggttactgaccaaccctt

SEQ ID NO: 273944 - DNA, 75 bp, Artificial Sequence
  Synthetic
gatgcctggttactgaccaacccttcgtctaccagtacatttggatcagaagcaaccttcactggttcttatctc

SEQ ID NO: 273945 - DNA, 75 bp, Artificial Sequence
  Synthetic
aacgcagcaactcagcgtatcaatccgacgatgtatatcgcgaacaacacacagatcataagctcacagcaattt

SEQ ID NO: 273946 - DNA, 75 bp, Artificial Sequence
  Synthetic
tgacctctaatcgagactacaccgccgcaaactataggtgggtggtacctcagtgattaatcttgtaagcactga

SEQ ID NO: 273947 - DNA, 75 bp, Artificial Sequence
  Synthetic
atctatattattgaattgtcctcatctctcttaggacaatttcagattgtcccatttatccgtcaggtgacacta

SEQ ID NO: 273948 - DNA, 75 bp, Artificial Sequence
  Synthetic
aacagtgacaaaactcctacagccgatcggtgagaatttggagacgattaggaaccagttgattccaactcggag

SEQ ID NO: 273949 - DNA, 75 bp, Artificial Sequence
  Synthetic
ctctcttaggacaatttcagattgtcccatttatccgtcaggtgacactatcctaaaggcagaagcctccaggtc

SEQ ID NO: 273950 - DNA, 75 bp, Artificial Sequence
  Synthetic
tgacccagccaatcaaagcattataccagaccatggaatgcataccaaacattattgacactaatgatacacaaa

SEQ ID NO: 273951 - DNA, 75 bp, Artificial Sequence
  Synthetic
acaataggccagaatggctgggtctcgggagatattactccctgaagtccatctcaattcaccaattgtaaagca

SEQ ID NO: 273952 - DNA, 75 bp, Artificial Sequence
  Synthetic
agaagtcatggcccaattaccaacacgtgttatggtgactggcagcttgatccaagcctatcccgcatcgcaatg

SEQ ID NO: 273953 - DNA, 75 bp, Artificial Sequence
  Synthetic
tcaaaattggaatcaaatagcacatgaagagtctaacttagctcaacgcttggtaaatgtaagaaattttctaat

SEQ ID NO: 273954 - DNA, 75 bp, Artificial Sequence
  Synthetic
tgtaggtataatgatgcccaagtactctcagatgatactatggcttgcctccaaggtaacttgacaagatgcacc

SEQ ID NO: 273955 - DNA, 75 bp, Artificial Sequence
  Synthetic
tggtaaatgtaagaaattttctaattacccacatccctgatcttagaaagggccattggcaagagtatgtcaatg

SEQ ID NO: 273956 - DNA, 75 bp, Artificial Sequence
  Synthetic
tacccacatccctgatcttagaaagggccattggcaagagtatgtcaatgtaatactgtggccgcgaattcttcc

SEQ ID NO: 273957 - DNA, 75 bp, Artificial Sequence
  Synthetic
cttgatcccggattttaaaatcaatgaccaattgcctctgctcaaaaattgggacaagttagttaaagaatcatg

SEQ ID NO: 273958 - DNA, 75 bp, Artificial Sequence
  Synthetic
acaatctcagattcaccatcactcaattggccaatgtaacctacaatagcaccatcaagcttgaatcatcccaga

SEQ ID NO: 273959 - DNA, 75 bp, Artificial Sequence
  Synthetic
gggacaagttagttaaagaatcatgttcagtaatcaatgcgggtacttcccagtgcattcagaatctcagctatg

SEQ ID NO: 273960 - DNA, 75 bp, Artificial Sequence
  Synthetic
accatcaagcttgaatcatcccagatcttgtctattgatccgttggatatatcccagaatctagctgcggtgaat

SEQ ID NO: 273961 - DNA, 75 bp, Artificial Sequence
  Synthetic
cagtgcattcagaatctcagctatggactgacaggtcgtgggaacctctttacacgatcacgtgaactctctggt

SEQ ID NO: 273962 - DNA, 75 bp, Artificial Sequence
  Synthetic
gaccgcagggatattgatcttaagacggttgtggcagcatggcatgactcagactggaaaagaataagtgatttt

SEQ ID NO: 273963 - DNA, 75 bp, Artificial Sequence
  Synthetic
gtgtggaagttattgaccattgtcgttgctaatcgaaatagaatggagaattttgtttatcataaataagcattc

SEQ ID NO: 273964 - DNA, 75 bp, Artificial Sequence
  Synthetic
agactggaaaagaataagtgatttttggattatgatcaaattccagatgagacaattaactgctaggcaaacaga

SEQ ID NO: 273965 - DNA, 75 bp, Artificial Sequence
  Synthetic
tcataatgatcctgatttaatcacgtatatcgaaaatagagaaggcataatcatcataacccctgaactggtagc

SEQ ID NO: 273966 - DNA, 75 bp, Artificial Sequence
  Synthetic
attatttaacactgagaatcatacactaacatacatgacctttgaaattgtactgatggtttcagatatgtacga

SEQ ID NO: 273967 - DNA, 75 bp, Artificial Sequence
  Synthetic
tgcacagttagcacttacctgaatcctctgaagaaaagaataacatatttattgagccttgtagataacttagct

SEQ ID NO: 273968 - DNA, 75 bp, Artificial Sequence
  Synthetic
acactacaatggttgcagaagatgcccctgttagggccacttgccgagtattatttcgaacaacaactttaatct

SEQ ID NO: 273969 - DNA, 75 bp, Artificial Sequence
  Synthetic
tttcagataggtgatgctgtatataacataattgctttgctagaatcctttgtatatgcacagttgcaaatgtca

SEQ ID NO: 273970 - DNA, 75 bp, Artificial Sequence
  Synthetic
aagcaggctcaactggatctaattctggattaggaagtatcactgatcttcttaataatattctctctgtcgcaa

SEQ ID NO: 273971 - DNA, 75 bp, Artificial Sequence
  Synthetic
cttacggctgaattgctctgtataatgaggctttggggacaccccatgctcactgccagtcaagctgcgggaaag

SEQ ID NO: 273972 - DNA, 75 bp, Artificial Sequence
  Synthetic
cactgccagtcaagctgcgggaaaggtacgcgagtctatgtgtgctggaaaagtattagactttcccaccattat

SEQ ID NO: 273973 - DNA, 75 bp, Artificial Sequence
  Synthetic
gaaaacactagcctttttccatactattctgatcaatggatacaggaggaagcatcatggagtatggccaccctt

SEQ ID NO: 273974 - DNA, 75 bp, Artificial Sequence
  Synthetic
aaacttaccgggtaatgcttcaaagggtctcacggaacttatgaatgacaatactgagataagctatgaattcac

SEQ ID NO: 273975 - DNA, 75 bp, Artificial Sequence
  Synthetic
acttaagcattggaaggaaatctctcttataaaattcaagaaatgttttgatgcagacgcaggtgaggaactcag

SEQ ID NO: 273976 - DNA, 75 bp, Artificial Sequence
  Synthetic
cccctaccaaatccattcaatcgacggctattgctaaactttctcggagatgacaaattcgacccgaatgtggag

SEQ ID NO: 273977 - DNA, 75 bp, Artificial Sequence
  Synthetic
ctacagtatgtaacatcaggtgagtatctacatgatgacacgttttgtgcatcatattcactaaaagagaaggaa

SEQ ID NO: 273978 - DNA, 75 bp, Artificial Sequence
  Synthetic
attaaacctgatggtcgaatttttgcaaagttgactaagagaatgagatcatgtcaagttatagcagaatctctt

SEQ ID NO: 273979 - DNA, 75 bp, Artificial Sequence
  Synthetic
ttagcgaaccatgctgggaagttaatgaaagagaatggtgttgtgatgaatcagctatcattaacaaaatcacta

SEQ ID NO: 273980 - DNA, 75 bp, Artificial Sequence
  Synthetic
ggatcaagcggtcaagaagcagcatatggccacacaacttgttttagggacacaggctctgttatggtatactgt

SEQ ID NO: 273981 - DNA, 75 bp, Artificial Sequence
  Synthetic
ttaacaatgagtcagattggaataatatccgagaaagctagaaagtcgactcgagataacataaatcaacctggt

SEQ ID NO: 273982 - DNA, 75 bp, Artificial Sequence
  Synthetic
ttccagaatatccagagaaataaatcacatcactccaagcaagtcaatcagcgagatccaagtgatgactttgaa

SEQ ID NO: 273983 - DNA, 75 bp, Artificial Sequence
  Synthetic
attattgacactaatgacacacaaaattggttttaagaaaaaccaagagaacaataggccagaatggctgggtct

SEQ ID NO: 273984 - DNA, 75 bp, Artificial Sequence
  Synthetic
atctcaattcaccaattgtaaagcataagctatactattacattctacttggaaacctcccaaatgagatcgacc

SEQ ID NO: 273985 - DNA, 75 bp, Artificial Sequence
  Synthetic
ttggcagcatcttttttaactactgatctcaaaaaatattgtttacaatggaggtaccagacaattatcccattt

SEQ ID NO: 273986 - DNA, 75 bp, Artificial Sequence
  Synthetic
gctcaatcattaaacagaatgtatggttatcctcatctctttgagtggattcacttacggctaatgcgtagtaca

SEQ ID NO: 273987 - DNA, 75 bp, Artificial Sequence
  Synthetic
ctttacgtgggggatcccttcaacccaccagcagataccagtcaatttgatctagataaagtaattaatggagat

SEQ ID NO: 273988 - DNA, 75 bp, Artificial Sequence
  Synthetic
atcttcattgtatcacccagaggtggaattgaagggctgtgtcaaaaggcttggacaatgatatctatctctgtg

SEQ ID NO: 273989 - DNA, 75 bp, Artificial Sequence
  Synthetic
gaattgaagggctgtgtcaaaaggcttggacaatgatatctatctctgtgataattctatctgccacagagtctg

SEQ ID NO: 273990 - DNA, 75 bp, Artificial Sequence
  Synthetic
gcacacgagtaatgagtatggtgcagggagataatcaagcaattgctgtcaccacacgagtaccaaggagcctgc

SEQ ID NO: 273991 - DNA, 75 bp, Artificial Sequence
  Synthetic
gatcccatcccagaactcagaggacaattccatgcattcgtatgttctgagattcttgatgcactaagaggaact

SEQ ID NO: 273992 - DNA, 75 bp, Artificial Sequence
  Synthetic
cgactcttgagaaaaagactattgcttttagatcttgtaatctattctttgagaggttaaaatgtaataattttg

SEQ ID NO: 273993 - DNA, 75 bp, Artificial Sequence
  Synthetic
aatagtttcacccaggatgaattaagaactgtgacaactaatttgatatccccattccaagatctgaccccagat

SEQ ID NO: 273994 - DNA, 75 bp, Artificial Sequence
  Synthetic
gattaggtcaccatttgaaagaacaagagactatcattagttctcacttctttgtttatagcaagagaatattct

SEQ ID NO: 273995 - DNA, 75 bp, Artificial Sequence
  Synthetic
atcaggggaggattctaacgcaagccttaaaaaatgctagtaagctctgcttgacagctgatgtcctaggagaat

SEQ ID NO: 273996 - DNA, 75 bp, Artificial Sequence
  Synthetic
gtttctacttgaatatctatatgaccatcaaacagctctcctatgatatcatcttccctcaagtgtcaattcctg

SEQ ID NO: 273997 - DNA, 75 bp, Artificial Sequence
  Synthetic
gagatcagatcacattagaatacataaataatccacacctggtatcacgattggctcttttgccatcccagctag

SEQ ID NO: 273998 - DNA, 75 bp, Artificial Sequence
  Synthetic
gaggtctaaactacctgtcatgcagtaggctgttcaatcgaaacataggcgacccggtggtttccgcagttgcag

SEQ ID NO: 273999 - DNA, 75 bp, Artificial Sequence
  Synthetic
atcttaagagattaattaaatcaggatgtatggattactggatcctttataacttattagggagaaaaccgggaa

SEQ ID NO: 274000 - DNA, 75 bp, Artificial Sequence
  Synthetic
acggctcatgggctactttagcagctgacccgtactcaatcaatatagagtatcaataccccccaactacagctc

SEQ ID NO: 274001 - DNA, 75 bp, Artificial Sequence
  Synthetic
aacagttaatgatcactggactcggaatcttagaaacatggaataatcccccaatcaatagaacattcgaagaat

SEQ ID NO: 274002 - DNA, 75 bp, Artificial Sequence
  Synthetic
ttaagaggcacacccaacaagctctgatggaactcagtacgaatccaatgttacgtggcatattctctgacaatg

SEQ ID NO: 274003 - DNA, 75 bp, Artificial Sequence
  Synthetic
cacaggcagaagaaaataatcttgctagatttctcctggatagggaggtgatctttccgcgtgtagctcacatca

SEQ ID NO: 274004 - DNA, 75 bp, Artificial Sequence
  Synthetic
cagtcaagccacatattacagtaccgtacagcaataaatttgtatttgatgaggacccgctatctgaatatgaaa

SEQ ID NO: 274005 - DNA, 75 bp, Artificial Sequence
  Synthetic
tcattgagcaaaccagtgtcgggaggagaaaacagattcaaggatatttggattcaactagatcgataatgagga

SEQ ID NO: 274006 - DNA, 75 bp, Artificial Sequence
  Synthetic
aatcactagaaattaagcccttgtccaataggaagcttaatgaaatactggattacaacatcaattacctagctt

SEQ ID NO: 274007 - DNA, 75 bp, Artificial Sequence
  Synthetic
cacttgaagcaagaacgtatcgtagcagaagcaattgataaggtggttctaggagaaaatgctctatttaattcg

SEQ ID NO: 274008 - DNA, 75 bp, Artificial Sequence
  Synthetic
acaatttggcattactcaagaatgctattgaacctccgacttatttgaaggcaatgactcttgaaacatgtagca

SEQ ID NO: 274009 - DNA, 75 bp, Artificial Sequence
  Synthetic
tcgacattgcaaggagcctccggaagctctcctgggccccactcttgggtgggagaaatcttgaaggattagaga

SEQ ID NO: 274010 - DNA, 75 bp, Artificial Sequence
  Synthetic
gctctcctgggccccactcttgggtgggagaaatcttgaaggattagagacgccagatcccattgaaattactgc

SEQ ID NO: 274011 - DNA, 75 bp, Artificial Sequence
  Synthetic
cgccagatcccattgaaattactgcaggagcattaattgttggatcgggctactgtgaacagtgtgctgcaggag

SEQ ID NO: 274012 - DNA, 75 bp, Artificial Sequence
  Synthetic
gatccccgtgataatcctcctatccgtgtaccgtacattggctccaggactgatgagaggagggtagcctcaatg

SEQ ID NO: 274013 - DNA, 75 bp, Artificial Sequence
  Synthetic
gcatacatcaggggtgcctcgagtagcctaaaagcagttcttagactggcgggagtgtacatctgggcattcgga

SEQ ID NO: 274014 - DNA, 75 bp, Artificial Sequence
  Synthetic
gggagtgtacatctgggcattcggagatactctggagaattggatagatgcactggatttgtctcacactagagt

SEQ ID NO: 274015 - DNA, 75 bp, Artificial Sequence
  Synthetic
gatactctggagaattggatagatgcactggatttgtctcacactagagttaacatcacacttgaacagctgcaa

SEQ ID NO: 274016 - DNA, 75 bp, Artificial Sequence
  Synthetic
taacatcacacttgaacagctgcaatccctcaccccacttccaacctctgccaatctaacccatcggttggatga

SEQ ID NO: 274017 - DNA, 75 bp, Artificial Sequence
  Synthetic
tccctcaccccacttccaacctctgccaatctaacccatcggttggatgatggcacaactaccctaaagtttact

SEQ ID NO: 274018 - DNA, 75 bp, Artificial Sequence
  Synthetic
ccaatctaacccatcggttggatgatggcacaactaccctaaagtttactcctgcgagctcttacaccttttcaa

SEQ ID NO: 274019 - DNA, 75 bp, Artificial Sequence
  Synthetic
cctgcgagctcttacaccttttcaagtttcactcatatatcaaatgatgagcaatacctgacaattaatgacaaa

SEQ ID NO: 274020 - DNA, 75 bp, Artificial Sequence
  Synthetic
gtttcactcatatatcaaatgatgagcaatacctgacaattaatgacaaaactgcagattcaaatataatctacc

SEQ ID NO: 274021 - DNA, 75 bp, Artificial Sequence
  Synthetic
gatcttagaaacatggaataatcccccaatcaatagaacattcgaagaatctaccctacatttgcacactggtgc

SEQ ID NO: 274022 - DNA, 75 bp, Artificial Sequence
  Synthetic
ctaccctacatttgcacactggtgcatcatgttgtgtccgacctgtggactcctgcatcatctcagaagcattaa

SEQ ID NO: 274023 - DNA, 75 bp, Artificial Sequence
  Synthetic
gtacagcaataaatttgtatttgatgaagacccgctatctgaatatgagactgcaaaactggaatcgttatcatt

SEQ ID NO: 274024 - DNA, 75 bp, Artificial Sequence
  Synthetic
ctgcaaaactggaatcgttatcattccaagcccaattatgcaacattgatgctgtagatatgacaggtaaattaa

SEQ ID NO: 274025 - DNA, 75 bp, Artificial Sequence
  Synthetic
gctgtagatatgacaggtaaattaacattattgtcccaattcactgcaaggcagattatcaatgcaatcactgga

SEQ ID NO: 274026 - DNA, 75 bp, Artificial Sequence
  Synthetic
ctcgatgagtctgtctctcttactaatgatgccattgttgcatcagactatgtctccaattggattagtgaatgc

SEQ ID NO: 274027 - DNA, 75 bp, Artificial Sequence
  Synthetic
atgtataccaaattagatgaattatttatgtattgtgggtgggaactactattggaactatcctatcaaatgtat

SEQ ID NO: 274028 - DNA, 75 bp, Artificial Sequence
  Synthetic
tatctgagggtagttgggtggagtaatatagtggattattcttacatgatcttgagaagaatcccgggtgcagca

SEQ ID NO: 274029 - DNA, 75 bp, Artificial Sequence
  Synthetic
ttaaacaatctggcatctacattaagtcatccaaaacttttccgacgagctatcaacctagatatagttgccccc

SEQ ID NO: 274030 - DNA, 75 bp, Artificial Sequence
  Synthetic
ttaaatgctcctcattttgcatctctggattacatcaagatgagtgtggatgcaatactctggggctgtaaaaga

SEQ ID NO: 274031 - DNA, 75 bp, Artificial Sequence
  Synthetic
gggacttagaattagttgtgacatctgaagatagccttattctcagtgaccgatccatgaatctcattgcaagga

SEQ ID NO: 274032 - DNA, 75 bp, Artificial Sequence
  Synthetic
aattaactttattatcactgattcaccataatggtttggaactaccaaagattaaggggttctctcctgatgaga

SEQ ID NO: 274033 - DNA, 75 bp, Artificial Sequence
  Synthetic
agtgtttcgctttgacagaatttttgaggaaagtggtgaactcagggttgagttcaatagagaacctatcaaatt

SEQ ID NO: 274034 - DNA, 75 bp, Artificial Sequence
  Synthetic
agttcaatagagaacctatcaaattttatgtacaatgtggagaacccacggcttgcagcattcgccagcaacaat

SEQ ID NO: 274035 - DNA, 75 bp, Artificial Sequence
  Synthetic
gaatcattagaatatattgatagtcttaagctaaccccacatgtgcctggcacctcatgcattgaggatgatagt

SEQ ID NO: 274036 - DNA, 75 bp, Artificial Sequence
  Synthetic
ttaagctaaccccacatgtgcctggcacctcatgcattgaggatgatagtctatgtacaaatgattacataatct

SEQ ID NO: 274037 - DNA, 75 bp, Artificial Sequence
  Synthetic
ggatcatagagtctaatgcaaacttggagaagtatccaattccaaatagccctgaggatgattccaatttccata

SEQ ID NO: 274038 - DNA, 75 bp, Artificial Sequence
  Synthetic
cctgaggatgattccaatttccataactttaagttgaatgctccatcgcaccataccttacgcccattagggttg

SEQ ID NO: 274039 - DNA, 75 bp, Artificial Sequence
  Synthetic
tcatcaactgcttggtataagggtataagctgttgcaggtaccttgagcgattaaagctaccacaaggtgatcat

SEQ ID NO: 274040 - DNA, 75 bp, Artificial Sequence
  Synthetic
attaaagctaccacaaggtgatcatttatatattgcagaaggtagtggtgccagtatgacaatcatagaatacct

SEQ ID NO: 274041 - DNA, 75 bp, Artificial Sequence
  Synthetic
attcccaggaagaaagatatattacaattctttatttagtagtggtgacaatcccccacaaagaaattatgcacc

SEQ ID NO: 274042 - DNA, 75 bp, Artificial Sequence
  Synthetic
aatgcctactcagttcattgagagtgtcccatacaagctctggcaagcacacacagatcaatatcccgagatttt

SEQ ID NO: 274043 - DNA, 75 bp, Artificial Sequence
  Synthetic
ggaaacgccgccatgactgacataggaatgacagcttgtgtagaattcatcatcaatcgagtcggcccaaggact

SEQ ID NO: 274044 - DNA, 75 bp, Artificial Sequence
  Synthetic
catcaatcgagtcggcccaaggacttgcagtttagtacatgtagatttggaatcacgtgcaagcttaaatcaaca

SEQ ID NO: 274045 - DNA, 75 bp, Artificial Sequence
  Synthetic
atgcctgtcaaagccgataattaatgctatcatcactgctacaactgttttgtgccctcatggggtgcttattct

SEQ ID NO: 274046 - DNA, 75 bp, Artificial Sequence
  Synthetic
gaaatatagttggttgccatttactagatttagtactttgatcactttcttatggtgctactttgagagaatcac

SEQ ID NO: 274047 - DNA, 75 bp, Artificial Sequence
  Synthetic
tatggtgctactttgagagaatcactgttcttaggagcacatattctggtccagctaatcatgaggtttatttaa

SEQ ID NO: 274048 - DNA, 75 bp, Artificial Sequence
  Synthetic
tttgtatccttgccaacaactttgcattccagactgtctcgcaggcaacaggaatggcgatgactttaaccgatc

SEQ ID NO: 274049 - DNA, 75 bp, Artificial Sequence
  Synthetic
aagggtttactttgatatcacctgaaagaataaatcagtattgggatggtcacttgaagcaagaacgtatcgtag

SEQ ID NO: 274050 - DNA, 75 bp, Artificial Sequence
  Synthetic
cagaagcaattgataaggtggttctaggagaaaatgctctattcaattcgagtgataatgaattaattctcaaat

SEQ ID NO: 274051 - DNA, 75 bp, Artificial Sequence
  Synthetic
agtgataatgaattaattctcaaatgtggagggacaccaaatgcacggaatcttatcgatatcgagccagtcgca

SEQ ID NO: 274052 - DNA, 75 bp, Artificial Sequence
  Synthetic
actttcatagaatttgaacaactgatctgcacaatgttgacaacccacttgaaggaaataattgatataacaagg

SEQ ID NO: 274053 - DNA, 75 bp, Artificial Sequence
  Synthetic
tcttcttggtaaaatcagtacgatagtgagattattaacagaaaggattctaaatcatactatcaggaattggtt

SEQ ID NO: 274054 - DNA, 75 bp, Artificial Sequence
  Synthetic
gatcctcccaccttcgctccggatgatcgtgaagcaggacttggaattcggcatattcaggattacttccatcct

SEQ ID NO: 274055 - DNA, 75 bp, Artificial Sequence
  Synthetic
caattctgatcggttcctgaggctttctccaaataggaaatacttgattacacaattaactgcaggctacattag

SEQ ID NO: 274056 - DNA, 75 bp, Artificial Sequence
  Synthetic
gaaattgattgagggggattgtaatatcgatctaaccagacctatccaaaagcaaatctggaaagcattaggttg

SEQ ID NO: 274057 - DNA, 75 bp, Artificial Sequence
  Synthetic
agcaaatctggaaagcattaggttgtgtagtctattgtcacgatccaatggatcaaagggagtcaacagagttta

SEQ ID NO: 274058 - DNA, 75 bp, Artificial Sequence
  Synthetic
gatcaaagggagtcaacagagtttattgatataaatattaatgaagaaatagaccgcgggatcgatggcgaggaa

SEQ ID NO: 274059 - DNA, 75 bp, Artificial Sequence
  Synthetic
ggaaatctaaatatatcaagaatcagaattagtttaagaaaaaagaataggattaatcttggttttccccttggt

SEQ ID NO: 274060 - DNA, 75 bp, Artificial Sequence
  Synthetic
accaaggggaaaatgaagtggtgactcaaatcatcgaagaccctcgagattacataggtccggaacctatggcct

SEQ ID NO: 274061 - DNA, 75 bp, Artificial Sequence
  Synthetic
gagggatcattccgcctaatccccaatgctcgttcaggtatgagccgtggagaaatcaatgcctatgctgcactt

SEQ ID NO: 274062 - DNA, 75 bp, Artificial Sequence
  Synthetic
atgctcgttcaggtatgagccgtggagaaatcaatgcctatgctgcacttgcagaagatctgcctgacacactaa

SEQ ID NO: 274063 - DNA, 75 bp, Artificial Sequence
  Synthetic
gaggcttctttttgacactaaaatatgcattgggaaccagatggcccacacttgccttagctgcattttcaggag

SEQ ID NO: 274064 - DNA, 75 bp, Artificial Sequence
  Synthetic
cgctttctccagatcatacatgaataagacatatttccaattgggaatggaaactgcaagaaaacaacagggtgc

SEQ ID NO: 274065 - DNA, 75 bp, Artificial Sequence
  Synthetic
tctcatctgtcactgggacaacccaggtgcccgcttcagcaacaggtgacacattcgagagttacatggcagcgg

SEQ ID NO: 274066 - DNA, 75 bp, Artificial Sequence
  Synthetic
acattcgagagttacatggcagcggatcgactgaggcagagatatgctgatgcaggcacttatgatgatgagatg

SEQ ID NO: 274067 - DNA, 75 bp, Artificial Sequence
  Synthetic
atcgactgaggcagagatatgctgatgcaggcacttatgatgatgagatgccaccattggaagaggaggaagagg

SEQ ID NO: 274068 - DNA, 75 bp, Artificial Sequence
  Synthetic
ccaccattggaagaggaggaagaggacgacacatctgcaggtccacgcactggaccaactcttgaacaagtggcc

SEQ ID NO: 274069 - DNA, 75 bp, Artificial Sequence
  Synthetic
acgacacatctgcaggtccacgcactggaccaactcttgaacaagtggccttggacatccagaacgcagcagttg

SEQ ID NO: 274070 - DNA, 75 bp, Artificial Sequence
  Synthetic
gagctcccatccatacagatgacctgaatgccgcactgggtgatctcgacatctagacaattcagatcccaatct

SEQ ID NO: 274071 - DNA, 75 bp, Artificial Sequence
  Synthetic
gaatgccgcactgggtgatctcgacatctagacaattcagatcccaatcttaaattgacatacctaattgattag

SEQ ID NO: 274072 - DNA, 75 bp, Artificial Sequence
  Synthetic
ttagatggaactacaatggattccataaggttcctgcctaccatcggcttttaagaaaaaaataggcccggacgg

SEQ ID NO: 274073 - DNA, 75 bp, Artificial Sequence
  Synthetic
gttagcaacaagcgactgccggtgccaacagcgcaatccacaatccacaatggatcccactgatctgagcttctc

SEQ ID NO: 274074 - DNA, 75 bp, Artificial Sequence
  Synthetic
taaccaatgctgcagaggcaaagatccaagagtcaactaaccatcagaagggctcagttggtgggggtgcaaaac

SEQ ID NO: 274075 - DNA, 75 bp, Artificial Sequence
  Synthetic
ctctattaggtctggattccaccccgagcacccaaactgtgcttgatctaagtgggaaaactttaccatcaggat

SEQ ID NO: 274076 - DNA, 75 bp, Artificial Sequence
  Synthetic
gaggctcagctaattgacctcaagaaagcaatcatccgcagtgcaatttgatcaaaaaacacccaagtacactac

SEQ ID NO: 274077 - DNA, 75 bp, Artificial Sequence
  Synthetic
cattcgtaaatacctatggattcatctacgaacaggatcggggaaataccattgtcggagaggatcaactgggga

SEQ ID NO: 274078 - DNA, 75 bp, Artificial Sequence
  Synthetic
tgggacaactgagtgaattccaggtcattgttaggaagacatccagcaaagcagaagagatggtctttgaaattg

SEQ ID NO: 274079 - DNA, 75 bp, Artificial Sequence
  Synthetic
ttaagtcaccagggaaaatacaatctggaatggactatctcttcattccgacatttctgtcagtgacttactgtc

SEQ ID NO: 274080 - DNA, 75 bp, Artificial Sequence
  Synthetic
aactaatgataagaatcctgtgtaagcccgattcgccacttatgaaggtccatacccctgacaaggagggaagag

SEQ ID NO: 274081 - DNA, 75 bp, Artificial Sequence
  Synthetic
aagtgctaagttgttttttggaaagggtggatggagctgccatccacttcacgaagttgttccaagtgtcaccaa

SEQ ID NO: 274082 - DNA, 75 bp, Artificial Sequence
  Synthetic
aacactatggtccgtgggctgtgagattacaaaggcgaaggcaataatacaagagagtagcatctctcttctcgt

SEQ ID NO: 274083 - DNA, 75 bp, Artificial Sequence
  Synthetic
aaagtcaaaatttcatctaagcatcgccgctttgggaaatcaaattggggtctgttcaagaaaaccaaatcactg

SEQ ID NO: 274084 - DNA, 75 bp, Artificial Sequence
  Synthetic
gccgctttgggaaatcaaattggggtctgttcaagaaaaccaaatcactgcctaacctgacggagctggaatgac

SEQ ID NO: 274085 - DNA, 75 bp, Artificial Sequence
  Synthetic
tgacctctgatcgagattacaccgcctcaaactataggtgggtggtacctcagtaattaatctcataagcactaa

SEQ ID NO: 274086 - DNA, 75 bp, Artificial Sequence
  Synthetic
tccaataactagaatcaccagcttgatttatctccaagatgattcaaagaaaacaaatcatattaagactatcct

SEQ ID NO: 274087 - DNA, 75 bp, Artificial Sequence
  Synthetic
aaacaaatcatattaagactatcctaagcacgaacccatattgtccttcaaatcatgggcatcataattcaattt

SEQ ID NO: 274088 - DNA, 75 bp, Artificial Sequence
  Synthetic
agtagcactagtaaaggcaaatgaaaatgctgcggctatactcaatctcaaaaatgcaatccaaaaaacaaatgc

SEQ ID NO: 274089 - DNA, 75 bp, Artificial Sequence
  Synthetic
aatgctgcggctatactcaatctcaaaaatgcaatccaaaaaacaaatgcggcagttgcagacgtggtccaggcc

SEQ ID NO: 274090 - DNA, 75 bp, Artificial Sequence
  Synthetic
cactatcacacccaacactgtgtactgtaggtataatgatgcccaagtactctcagatgatactatggcttgcct

SEQ ID NO: 274091 - DNA, 75 bp, Artificial Sequence
  Synthetic
tgtaggtataatgatgcccaagtactctcagatgatactatggcttgccttcaaggtaacttgacaagatgcacc

SEQ ID NO: 274092 - DNA, 75 bp, Artificial Sequence
  Synthetic
ttctctccagtggttgggagctttctcactcgattcgtgctgttcgatggaatagtttatgcaaattgcaggtcg

SEQ ID NO: 274093 - DNA, 75 bp, Artificial Sequence
  Synthetic
aatagtttatgcaaattgcaggtcgatgttgtgcaagtgcatgcagcctgctgctgtgatcctacagccgagttc

SEQ ID NO: 274094 - DNA, 75 bp, Artificial Sequence
  Synthetic
attaataatcttgctcagtgtagttgtgtggaagttattgaccattgtcgctgctaatcgaaatagaatggagaa

SEQ ID NO: 274095 - DNA, 75 bp, Artificial Sequence
  Synthetic
ttttgtttatcataatcaagcattccatcactcacaatctgatctcagtgagaaaaatcaacctgcaactcttgg

SEQ ID NO: 274096 - DNA, 75 bp, Artificial Sequence
  Synthetic
agaaaaatcaacctgcaactcttggaacaagataagacagttatccattagtaattttaaagaaaaaaacgatag

SEQ ID NO: 274097 - DNA, 75 bp, Artificial Sequence
  Synthetic
gaccgaacctagtattgaaagaaccgtctcggtcaatctaggtaatcgagctgataccgtctcggaaagctcaaa

SEQ ID NO: 274098 - DNA, 75 bp, Artificial Sequence
  Synthetic
gcaggaaacttaattatctgcttcctattcatcttctttctgtttgtaaccttcattgttccaactctaagacac

SEQ ID NO: 274099 - DNA, 75 bp, Artificial Sequence
  Synthetic
cttcattgttccaactctaagacacttgctgtcctaacacccgctataggctatccactgcatcatctctcctgc

SEQ ID NO: 274100 - DNA, 75 bp, Artificial Sequence
  Synthetic
cttgaatcaacactccttacagctattaagtctcttcagaccagtgacaagctagaacagaactgctcgtggggt

SEQ ID NO: 274101 - DNA, 75 bp, Artificial Sequence
  Synthetic
gctagaacagaactgctcgtggggtgctgcactgattaatgataatagatacatcaatggcatcaatcagttcta

SEQ ID NO: 274102 - DNA, 75 bp, Artificial Sequence
  Synthetic
tttttcaattgctgagggtcgcaatctgacacttggtccacttcttaatatacctagtttcattccaactgccac

SEQ ID NO: 274103 - DNA, 75 bp, Artificial Sequence
  Synthetic
ctgacacttggtccacttcttaatatacctagtttcattccaactgccacaacaccagagggctgcaccaggatc

SEQ ID NO: 274104 - DNA, 75 bp, Artificial Sequence
  Synthetic
agttccggggggttgtatgatgtactgttttgtctctactcaaccagagagggatgactacttttctgccgctcc

SEQ ID NO: 274105 - DNA, 75 bp, Artificial Sequence
  Synthetic
agatgtatgggcaacattgaacccaggaacaggaagcggggtatattatttaggttgggtgctctttccaatata

SEQ ID NO: 274106 - DNA, 75 bp, Artificial Sequence
  Synthetic
taatgatcaggtgcttatgggtgctgaagggagattgtacatgtatggtgactcggtgtattattatcaaagaag

SEQ ID NO: 274107 - DNA, 75 bp, Artificial Sequence
  Synthetic
ctaatggtcagccatctgctatatcagctcagaatgtgcccacacagcaggtccctagacctgggacaggagact

SEQ ID NO: 274108 - DNA, 75 bp, Artificial Sequence
  Synthetic
gctctgcaaccaatagatgtcccggtttttgcttgacaggagtgtatgctgatgcctggttactgaccaaccctt

SEQ ID NO: 274109 - DNA, 75 bp, Artificial Sequence
  Synthetic
gatgcctggttactgaccaacccttcgtctactagtacatttggatcagaagcaaccttcactggctcttatctc

SEQ ID NO: 274110 - DNA, 75 bp, Artificial Sequence
  Synthetic
tcctaaaggcagaagcctccaggcctgacccagccaatcaaagcattataccagaccatagaatgcataccaaac

SEQ ID NO: 274111 - DNA, 75 bp, Artificial Sequence
  Synthetic
ggccattggcaagagtatgtcaatgtaatactgtggccgcgaattcttcccttgattccggattttaaaatcaat

SEQ ID NO: 274112 - DNA, 75 bp, Artificial Sequence
  Synthetic
gaccaattgcctctgctcaaaaattgggacaagttagttaaagaatcatgctcagtgatcaatgcaggtacttcc

SEQ ID NO: 274113 - DNA, 75 bp, Artificial Sequence
  Synthetic
agactggaaaagaataagtgatttttggattatgatcaaattccagatgagacaattaattgttaggcaaacaga

SEQ ID NO: 274114 - DNA, 75 bp, Artificial Sequence
  Synthetic
cactgccagtcaagctgcgggaaaggtacgcgagtctatgtgtgctggaaaggtattagacttttccaccattat

SEQ ID NO: 274115 - DNA, 75 bp, Artificial Sequence
  Synthetic
tatatttatgaaagataaagcaattagtgccccaaaacaagactggatgagtgtgtttagaagaagcctaatcaa

SEQ ID NO: 274116 - DNA, 75 bp, Artificial Sequence
  Synthetic
cctctaccaaatccattcaatcgacggctgttgctaaactttctcgaagatgacaaattcgacccgaatgtagag

SEQ ID NO: 274117 - DNA, 75 bp, Artificial Sequence
  Synthetic
cacaggcagaagaaaataaccttgctaggtttctcctggatagggaggtggtctttccgcgtgtagctcacatca

SEQ ID NO: 274118 - DNA, 75 bp, Artificial Sequence
  Synthetic
tattgaacctccgacttatttgaaggcaatgacacttgaaacatgtagcatcgatattgcgaggagcctacggaa

SEQ ID NO: 274119 - DNA, 75 bp, Artificial Sequence
  Synthetic
gggagaaatcttgaaggattagagactccagatcccattgaaattactgcaggagcattaattgttggatcgagc

SEQ ID NO: 274120 - DNA, 75 bp, Artificial Sequence
  Synthetic
atcatgttgtgtccgacctgtggactcctgcattatctcagaagcattaacagtcaagccacatattacagtacc

SEQ ID NO: 274121 - DNA, 75 bp, Artificial Sequence
  Synthetic
gaagacccgctatctgaatatgagactgcaaaactggaatcgttatcgttccaagcccaactaggaaacattgat

SEQ ID NO: 274122 - DNA, 75 bp, Artificial Sequence
  Synthetic
tgcaatactctggggctgtaaaagagtcatcaatgtgctctccaatggaggggacttagaattagttgtgacatc

SEQ ID NO: 274123 - DNA, 75 bp, Artificial Sequence
  Synthetic
tgaggacttcatccctctatggaacggaaacgccgccatgactgacataggaatgacagcttgtgtagagttcat

SEQ ID NO: 274124 - DNA, 75 bp, Artificial Sequence
  Synthetic
tatggtgctactttgagagaatcactgttcttaggagcacatattctgatccagctaatcatgaagtgtatttaa

SEQ ID NO: 274125 - DNA, 75 bp, Artificial Sequence
  Synthetic
gaaggaaataattgatataacaaggtctggaacccaggattatgaaagtttattactcactccttacaatttagg

SEQ ID NO: 274126 - DNA, 75 bp, Artificial Sequence
  Synthetic
gatcctcccaccttcgctccggatgattgtgaagcaggacttggaattcggcatattcaggattacttccatctt

SEQ ID NO: 274127 - DNA, 75 bp, Artificial Sequence
  Synthetic
ggaaatctaaacatatcaagaatcagaattagtttaagaaaaaagaggaggattaatcttggttttccccttggt

SEQ ID NO: 274128 - DNA, 75 bp, Artificial Sequence
  Synthetic
accaaggggaaaacgaagtggtgactcaaatcatcgaagaccctcgagattacataggtccggaacctatggcct

SEQ ID NO: 274129 - DNA, 75 bp, Artificial Sequence
  Synthetic
catacttcctactcacattatatctattttaaagaaaaagaaaaaataggcccgaacactaatcgtgccggcagt

SEQ ID NO: 274130 - DNA, 75 bp, Artificial Sequence
  Synthetic
agatgcccctgttaggggcacttgccgagtattatttcgaacaacaactttactttttctatgcacactactagc

SEQ ID NO: 274131 - DNA, 75 bp, Artificial Sequence
  Synthetic
ttggttgatcctcccaccttcgctccggatgattgtgaagcaggacttggaattcggcatattcaggattacttc

SEQ ID NO: 274132 - DNA, 75 bp, Artificial Sequence
  Synthetic
tcgtgaccgacctcgagtcagagtagttcaataaggacctatcgagtttgggcaatttttcgtccccgacacaaa

SEQ ID NO: 274133 - DNA, 75 bp, Artificial Sequence
  Synthetic
caggcccgatatttggccctattggagtcaccacatttgatggactttgctgcggcaaactacccattgctatat

SEQ ID NO: 274134 - DNA, 75 bp, Artificial Sequence
  Synthetic
tgcaggcacacatgatgacgagatgccaccactggaagaggaggaagaggacgatacatctgcaggtccacgcac

SEQ ID NO: 274135 - DNA, 75 bp, Artificial Sequence
  Synthetic
tggaccaactcttgaacaagtggccttggatatccagaatgcagcagctggagctcccatccatacagatgatct

SEQ ID NO: 274136 - DNA, 75 bp, Artificial Sequence
  Synthetic
gaatgccgcactgggtgatcttgacatctagacaacccaaatctcaatcttaaatcaacacacccacctgaccag

SEQ ID NO: 274137 - DNA, 75 bp, Artificial Sequence
  Synthetic
ctagctggaactacagtggattccacaaggctcctgcctaccatcggcttttaagaaaaaaataggcccggacgg

SEQ ID NO: 274138 - DNA, 75 bp, Artificial Sequence
  Synthetic
gttagcaacaagcgactgccgatgccaacatcacaatccacaatctacaatggatcccactgatctgagcttctc

SEQ ID NO: 274139 - DNA, 75 bp, Artificial Sequence
  Synthetic
caacatcacaatccacaatctacaatggatcccactgatctgagcttctccccagatgagatcaataagctcata

SEQ ID NO: 274140 - DNA, 75 bp, Artificial Sequence
  Synthetic
gagacaggcctgaatactgtggagtattttacttcccaacaaatcataggaacatcctctcttggaaagaataca

SEQ ID NO: 274141 - DNA, 75 bp, Artificial Sequence
  Synthetic
ataccaccaggggtcacaggactactaaccaatgctgcagaggcaaagatccaagaatcaactaaccatcagaag

SEQ ID NO: 274142 - DNA, 75 bp, Artificial Sequence
  Synthetic
ggttcagttggtgggggtgcaaaaccaaagaaaccgcgaccaaaaattgccattgtgccagcagatgacaaaacg

SEQ ID NO: 274143 - DNA, 75 bp, Artificial Sequence
  Synthetic
gataaataagcccgaacactacacactacctgaggcaaccatgccatccatcagcatccctgcagaccccaccaa

SEQ ID NO: 274144 - DNA, 75 bp, Artificial Sequence
  Synthetic
ctagatactcatgagccactggtgacattcgtaaatacctatggattcatctacgaacagaatcgggggaatacc

SEQ ID NO: 274145 - DNA, 75 bp, Artificial Sequence
  Synthetic
aactaatgataagaatcctgtgtaagcccgattcgccactcatgaaggtccacattcctgacaaggaaggaagag

SEQ ID NO: 274146 - DNA, 75 bp, Artificial Sequence
  Synthetic
tgtatgcaacatcttcaaatcaggaaacaagaatggcagtgagtggcaggaatactggatgagaaagtgtgctaa

SEQ ID NO: 274147 - DNA, 75 bp, Artificial Sequence
  Synthetic
aagtgccaagttgttttttggaaagggtggatggagctgccatccacttcacgaagtcgttccaagtgtcactaa

SEQ ID NO: 274148 - DNA, 75 bp, Artificial Sequence
  Synthetic
tgacctctagtcgagattacaccacctcaaactataggtgggtggtacctcagtgatcaatctcgcaagcactga

SEQ ID NO: 274149 - DNA, 75 bp, Artificial Sequence
  Synthetic
tcgtaggctacaacacaccaacactatccagattagagagcttaattagctctgtattaataataacactactat

SEQ ID NO: 274150 - DNA, 75 bp, Artificial Sequence
  Synthetic
tctaacaactggaatcaccagcttgatttatctccaaaatgattcaaagaaaacaaatcatattaagactatcct

SEQ ID NO: 274151 - DNA, 75 bp, Artificial Sequence
  Synthetic
aaacaaatcatattaagactatcctaagcacgaacccatactgtccttaaaatcatgggtactataattcaattt

SEQ ID NO: 274152 - DNA, 75 bp, Artificial Sequence
  Synthetic
aatgctgcggctatactcaatctcaaaaatgcaatccaaaaaacaaatgcagcagttgcagatgtggtccaggcc

SEQ ID NO: 274153 - DNA, 75 bp, Artificial Sequence
  Synthetic
gctgccaactttaactgtacaacctgcaacccagatcatagatctggccaccatatctgcattcattaacaatca

SEQ ID NO: 274154 - DNA, 75 bp, Artificial Sequence
  Synthetic
gcaacccagatcatagatctggccaccatatctgcattcattaacaatcaagaggtcatggcccaattaccaaaa

SEQ ID NO: 274155 - DNA, 75 bp, Artificial Sequence
  Synthetic
atcccctgtgactgtcattgacatacacaaatgtgtgagtctgcagcttgacaatctcagactcaccatcactca

SEQ ID NO: 274156 - DNA, 75 bp, Artificial Sequence
  Synthetic
ttctgcaatcacatcagctacgactacaagtgtattatccataatagcaatctgtcttggatcgttaggtttaat

SEQ ID NO: 274157 - DNA, 75 bp, Artificial Sequence
  Synthetic
atcaataatcttgctcagtgtagctgtgtggaggttactgaccattgtcgctgctaatcgaaatagaatggagaa

SEQ ID NO: 274158 - DNA, 75 bp, Artificial Sequence
  Synthetic
gtgtggaggttactgaccattgtcgctgctaatcgaaatagaatggagaattttgtttatcataattcagcattt

SEQ ID NO: 274159 - DNA, 75 bp, Artificial Sequence
  Synthetic
ataattttaaaggaaaaaacgataggaccgaaactagtattgaaagaaccgtctcggtcaatccagacaattgag

SEQ ID NO: 274160 - DNA, 75 bp, Artificial Sequence
  Synthetic
ctgataccgtcccggaaagctcaaatcacgctgcccgatccggaggatccggaaagcaaaaaagctacaaagaga

SEQ ID NO: 274161 - DNA, 75 bp, Artificial Sequence
  Synthetic
acaagaaacccaactatctgattcctattcatcttctttctgtctgcaaacctcaccgttccaactccaagacac

SEQ ID NO: 274162 - DNA, 75 bp, Artificial Sequence
  Synthetic
ttgccgtcccagcacctgccacatgccatccactgcatcatctctcccgccatacttcctactcacatcatatct

SEQ ID NO: 274163 - DNA, 75 bp, Artificial Sequence
  Synthetic
catatctatcctttatgagagtttaataatccaaaagcaaatcatgagccaagcaggctcaactggatctaattt

SEQ ID NO: 274164 - DNA, 75 bp, Artificial Sequence
  Synthetic
ggaacaggaagcggggtatattatttaggttgggtgctctttccaacatatggtggcgtgattaaagatacaagt

SEQ ID NO: 274165 - DNA, 75 bp, Artificial Sequence
  Synthetic
aatgattcagtctgggatcctggcatgtcctcttcaacaggacctaaccaatgagtgtttaattctccccttttc

SEQ ID NO: 274166 - DNA, 75 bp, Artificial Sequence
  Synthetic
gtccctagacctgggacaggagactgctctgcgacaaatcgatgtcccggtttttgcttgaaaggagtgtatgct

SEQ ID NO: 274167 - DNA, 75 bp, Artificial Sequence
  Synthetic
tcctaaaggcagaagcatccaagtctgacccagccaatcaaagcattataccaggccatggaatacataccaaat

SEQ ID NO: 274168 - DNA, 75 bp, Artificial Sequence
  Synthetic
ccaggccatggaatacataccaaatattattgacactaaagacacacaaaattggttttaagaaaaaacaagaga

SEQ ID NO: 274169 - DNA, 75 bp, Artificial Sequence
  Synthetic
ttgacgatttaggtccattacataatcaaaattggaatcaaatagcacatgaagagtctaacttagctcaacgct

SEQ ID NO: 274170 - DNA, 75 bp, Artificial Sequence
  Synthetic
attatttaccactgagaatcatacactaacatacatgacctttgaaattgtactgatggtttcagatatgtacga

SEQ ID NO: 274171 - DNA, 75 bp, Artificial Sequence
  Synthetic
gtgtgtttagaagaagcctaatcaaacagcgccatcagcatcatcaggtccccctaccaaatccattcaatcgac

SEQ ID NO: 274172 - DNA, 75 bp, Artificial Sequence
  Synthetic
atcttaagagattaattaaatcaggatgtatggattactggatcctttataacttattgagtagaaaaccgggaa

SEQ ID NO: 274173 - DNA, 75 bp, Artificial Sequence
  Synthetic
tactgtgaacagtgtgctgcaggagacaatcgattcacatggtttttcttgccatctggtatcgagataggaggg

SEQ ID NO: 274174 - DNA, 75 bp, Artificial Sequence
  Synthetic
aacagttaatgatcactggactcgggatcttagaaacatggaataatcccccaatcaatagaacatttgaagaat

SEQ ID NO: 274175 - DNA, 75 bp, Artificial Sequence
  Synthetic
tactacctgaccagaaaattattgaattcaatacgagatactgagtcgggtcaagtagcagtcacctcatattat

SEQ ID NO: 274176 - DNA, 75 bp, Artificial Sequence
  Synthetic
cctgaggatgattccaatttccataactttaaattgaatgccccatcgcaccataccttacgcccattagggctg

SEQ ID NO: 274177 - DNA, 75 bp, Artificial Sequence
  Synthetic
aatgcctactcagttcattgagagcgtcccatacaagctctggcaagcacacacagatcaatatcccgcgatttt

SEQ ID NO: 274178 - DNA, 75 bp, Artificial Sequence
  Synthetic
gcatattcaggattacttccatcctcaattctgatcggttcctgaagctttctccaaataggaaatacttgatta

SEQ ID NO: 274179 - DNA, 75 bp, Artificial Sequence
  Synthetic
caattctgatcggttcctgaagctttctccaaataggaaatacttgattacacaattaactgcaggctacattag

SEQ ID NO: 274180 - DNA, 75 bp, Artificial Sequence
  Synthetic
ttgacataaacattaatgaagaaatagaccgcgggatcgatggcgaggaaatctaaacatatcaagaatcggaat

SEQ ID NO: 274181 - DNA, 75 bp, Artificial Sequence
  Synthetic
ggaaatctaaacatatcaagaatcggaattagtttaagaaaaaggaagaggattaatcctggttttccccttggt

SEQ ID NO: 274182 - DNA, 75 bp, Artificial Sequence
  Synthetic
accagggggaaaatgaagtggtgacgctaatcatctaagaccttcgagattacataggtccggaacttatggcct

SEQ ID NO: 274183 - DNA, 75 bp, Artificial Sequence
  Synthetic
tggaccaactcttgaacaagtggccttggacatccagaacgcagcagctggagctcccatccatacagacgacct

SEQ ID NO: 274184 - DNA, 75 bp, Artificial Sequence
  Synthetic
ttagatggaactacagtggattccataaggttcctgcctaccatcggcttttaagaaaaaaataggcccggacgg

SEQ ID NO: 274185 - DNA, 75 bp, Artificial Sequence
  Synthetic
cccagatgagatcaataagctcatagagacaggcctgaatactgtggagtatgtcacttcccaacaagtcacagg

SEQ ID NO: 274186 - DNA, 75 bp, Artificial Sequence
  Synthetic
tgacctctaatcgagattacaccacctcaaactataggtgggtggtacctcagtgaccaatctcgtaagcactga

SEQ ID NO: 274187 - DNA, 75 bp, Artificial Sequence
  Synthetic
aggtcgtcacaacattttatcactatgcacagttagcacttacctgaatcctctgaagaaaagaataacatattt

SEQ ID NO: 274188 - DNA, 75 bp, Artificial Sequence
  Synthetic
gcacccaatcatcatgttctaatcttgcaactactgtcatgaggttaactgagaatggtgttgaaaaagatatct

SEQ ID NO: 274189 - DNA, 75 bp, Artificial Sequence
  Synthetic
accaaggggaaaatgaagtagtgactcaaatcatcgaagaccctcgagattacataggtccggaacctatggccc

SEQ ID NO: 274190 - DNA, 75 bp, Artificial Sequence
  Synthetic
cgaagtcgagggaactgcatgggatgagattgagactttcttagatatgtgttacagtgttttaatgcaggcatg

SEQ ID NO: 274191 - DNA, 75 bp, Artificial Sequence
  Synthetic
gcgccagaccaacctgctgcgtctattgagaaacgcctgcaaaaatatcgtcagcaaggcagaatcaatccgaga

SEQ ID NO: 274192 - DNA, 75 bp, Artificial Sequence
  Synthetic
tctcatctgtcactgggacaactcaggcgcccgctgcagcaacaggcgacacattcgagggttacatggtagcgg

SEQ ID NO: 274193 - DNA, 75 bp, Artificial Sequence
  Synthetic
gagctcccatccatacagatgacctgaatgccgcactgggcgatctcgacatctagacaattcagatcccaatcc

SEQ ID NO: 274194 - DNA, 75 bp, Artificial Sequence
  Synthetic
aaaatcgacacacctaagtgaccagttagatggaactacagtgaattccataaggttcctgcctaccataggctt

SEQ ID NO: 274195 - DNA, 75 bp, Artificial Sequence
  Synthetic
ttaagaaaaaaataggcccggacgggttagcaacaagcgactgctgatgccaacaacacaatccacaatctacaa

SEQ ID NO: 274196 - DNA, 75 bp, Artificial Sequence
  Synthetic
ataccaccaggggtcacaggactattaaccaatgctgcagaggcaaagatccaagagtcaaccaaccatcagaag

SEQ ID NO: 274197 - DNA, 75 bp, Artificial Sequence
  Synthetic
gtgcccggaaagccgatcccaaaccctctattaggtctggactccaccccgagcacccaaactgtgcttgatcta

SEQ ID NO: 274198 - DNA, 75 bp, Artificial Sequence
  Synthetic
actacgaacaacctacttgaatgacctagatactcatgagccactggtgacattcgtaaatacttatggattcat

SEQ ID NO: 274199 - DNA, 75 bp, Artificial Sequence
  Synthetic
ctagatactcatgagccactggtgacattcgtaaatacttatggattcatctacgaacaagatcggggaaatacc

SEQ ID NO: 274200 - DNA, 75 bp, Artificial Sequence
  Synthetic
aacactatggtccgtgggttgtgagattacaaaggcgaaggcaataatacaggagagtagcatctctcttctcgt

SEQ ID NO: 274201 - DNA, 75 bp, Artificial Sequence
  Synthetic
attacaaaggcgaaggcaataatacaggagagtagcatctctcttctcgtggagaccactgacatcataagtcca

SEQ ID NO: 274202 - DNA, 75 bp, Artificial Sequence
  Synthetic
tctgttcaagaaaaccaaatcactgcccaacctgacggagctggaatgactgacctctaatcaagattacaccac

SEQ ID NO: 274203 - DNA, 75 bp, Artificial Sequence
  Synthetic
tgacctctaatcaagattacaccacctcaaactatagatgggtggtacctcagtgatcaatctcgtaagcactga

SEQ ID NO: 274204 - DNA, 75 bp, Artificial Sequence
  Synthetic
tcgtaggctacaacacactaatattatccagattagagagcttaattagctctgtattaataataacactactat

SEQ ID NO: 274205 - DNA, 75 bp, Artificial Sequence
  Synthetic
atccagattagagagcttaattagctctgtattaataataacactactattccaatagctagaatcaccagcttg

SEQ ID NO: 274206 - DNA, 75 bp, Artificial Sequence
  Synthetic
cctcatgcaaatcggtgtcattccaacaaatgtccggcaacttatgtattacactgaggcttcatcagcattcat

SEQ ID NO: 274207 - DNA, 75 bp, Artificial Sequence
  Synthetic
aacagtgacaaaactcctacagccgatcggtgagaatttagagacaattaggtaccagttgattccaactcggag

SEQ ID NO: 274208 - DNA, 75 bp, Artificial Sequence
  Synthetic
attggattagccgcattaggagtagctactgccgcacaggtcactgccgcagtagcactagtaaaggcaaacaaa

SEQ ID NO: 274209 - DNA, 75 bp, Artificial Sequence
  Synthetic
gccaattgtaaagcccaagatgctatcattggctcaatcctcaatctctatttgactgagttgacaactatcttc

SEQ ID NO: 274210 - DNA, 75 bp, Artificial Sequence
  Synthetic
cacaatcaaattacaaaccccgcattgagtcctattacaattcaagctttaaggatcctactagggagtaccttg

SEQ ID NO: 274211 - DNA, 75 bp, Artificial Sequence
  Synthetic
aaggatcctactagggagtaccttgccgactgtggtcgaaaaatcttttaatacccagataagcgcagctgagct

SEQ ID NO: 274212 - DNA, 75 bp, Artificial Sequence
  Synthetic
accatcaagcttgaaacatcccagatcttgcctattgatccattggatatatcccagaatctagctgcagtgaat

SEQ ID NO: 274213 - DNA, 75 bp, Artificial Sequence
  Synthetic
gtaatttttaagaaaaaaacgataggaccgaaactagtattgaaagaaccgtctcggtcaatctaggtaatcgag

SEQ ID NO: 274214 - DNA, 75 bp, Artificial Sequence
  Synthetic
ctgataccgtctcggaaagctcaaatcatgctgcctgatccggaagatccggaaagcaaaaaagctacaaggaga

SEQ ID NO: 274215 - DNA, 75 bp, Artificial Sequence
  Synthetic
acaggaaacctaatcatctgcttcctattcatcttctttctgttggtaaacttcattgtcccaactctaagacac

SEQ ID NO: 274216 - DNA, 75 bp, Artificial Sequence
  Synthetic
tattcatcttctttctgttggtaaacttcattgtcccaactctaagacacttgctgtcctaatacctgctatagg

SEQ ID NO: 274217 - DNA, 75 bp, Artificial Sequence
  Synthetic
accaaggggagaatagataggagtacggaacattataaataaaataaactacaataggcccggaaagttggctaa

SEQ ID NO: 274218 - DNA, 75 bp, Artificial Sequence
  Synthetic
gtctgcagcatggaatctgctcttagaactggcttaccagatgtactacctcagagtgaggggacgggatgcaat

SEQ ID NO: 274219 - DNA, 75 bp, Artificial Sequence
  Synthetic
tcgctagcgatctcgatatcgatatctgttcttttttaagttcagacctcctttccgggcaccaacaaacatgtc

SEQ ID NO: 274220 - DNA, 75 bp, Artificial Sequence
  Synthetic
cctggaatatatgcactccgtgttgcgacgcatccctggccttgtgttcggtggcatgtccgctacaataagtca

SEQ ID NO: 274221 - DNA, 75 bp, Artificial Sequence
  Synthetic
ctcggtcctcaccgcctttgagcgcttcactatcgagcaggagctccaggatagaggagccgagggtagcattcc

SEQ ID NO: 274222 - DNA, 75 bp, Artificial Sequence
  Synthetic
tccgaaaatcctccgacgtctcatcaatctcggcattattcggcctacaaactcaccatacttcgctacactcga

SEQ ID NO: 274223 - DNA, 75 bp, Artificial Sequence
  Synthetic
ccccgaaaccctcaaaacccgcattcaagtcttcgtattgaatgacgaggacccgcacctccggtggcggatgtt

SEQ ID NO: 274224 - DNA, 75 bp, Artificial Sequence
  Synthetic
ctacgtacgcttgtgtgtggatgcactgatgtgggggtccaggcgggtcctaactgatcttgcttcagggtactc

SEQ ID NO: 274225 - DNA, 75 bp, Artificial Sequence
  Synthetic
caacttctgcttgcgattaatccttagccctgctacacgtacggctagaaaaattggtgccatgatcacactatt

SEQ ID NO: 274226 - DNA, 75 bp, Artificial Sequence
  Synthetic
actcccgattctgattacctctgagctgagcttcatcctaaacgacagaatgatgaacttggtatcacggagcct

SEQ ID NO: 274227 - DNA, 75 bp, Artificial Sequence
  Synthetic
ctccttgcctgctgctgctatgcaaaaccatgtaaggcttgctgatagatcccccgatgcgattattgagcgcgt

SEQ ID NO: 274228 - DNA, 75 bp, Artificial Sequence
  Synthetic
ctctctaatctcttgtctactttcatctggacacgaacaaccaaaagttaaaggctgtgatcccaccgagaaatg

SEQ ID NO: 274229 - DNA, 75 bp, Artificial Sequence
  Synthetic
cgagattaatggctttgtcgatggaacttggagattgattccaaacgaccgcgccatcctaccggatgccaccat

SEQ ID NO: 274230 - DNA, 75 bp, Artificial Sequence
  Synthetic
tgcaatgctgacatacttcctcatgcaagggcccgtgatggctgtagaggagtacgaacagcgagagcggttgaa

SEQ ID NO: 274231 - DNA, 75 bp, Artificial Sequence
  Synthetic
caatgcactcaatgttgctgcagatgagctgccacccgacttggtcaacagaacaccttatgttgttcaaggtgg

SEQ ID NO: 274232 - DNA, 75 bp, Artificial Sequence
  Synthetic
aaaactcatccaggagcccaaaatcgacacttatccgaataatatttactatcttactaggaaactacttaatga

SEQ ID NO: 274233 - DNA, 75 bp, Artificial Sequence
  Synthetic
ggaggaccttccttgtgatgaagtagagatattcctccaaagagcatatagtgtgttgatccaggcatggatcat

SEQ ID NO: 274234 - DNA, 75 bp, Artificial Sequence
  Synthetic
gattagagggtcagaggagtcacggtttatgttgacattgtactatgagtcaatgacaattgatggaaatccgtt

SEQ ID NO: 274235 - DNA, 75 bp, Artificial Sequence
  Synthetic
ggtatgtaaatgcatgacagcatacgatcagcctgctccatctgaagaacgtaggatagccaaatataggcagca

SEQ ID NO: 274236 - DNA, 75 bp, Artificial Sequence
  Synthetic
agaggaagcagtacagtggcctgttaagacacaggaatctctcaccctcactttgactgacttccatgttcccat

SEQ ID NO: 274237 - DNA, 75 bp, Artificial Sequence
  Synthetic
aggtaggttggaagcccggttcattttgcagaatccagctcgaagggggatccaaaaggtcatcagagaaagcct

SEQ ID NO: 274238 - DNA, 75 bp, Artificial Sequence
  Synthetic
catcaatcctacgaccaggttagaaaagtatcaatatcctgattgggcaatccagacagaggagggtcaattcca

SEQ ID NO: 274239 - DNA, 75 bp, Artificial Sequence
  Synthetic
cgtagttcggcaataccttgcttatgaattgcaaatcgctcgcaaccaaagcttggtaactaacaaatactatgc

SEQ ID NO: 274240 - DNA, 75 bp, Artificial Sequence
  Synthetic
tgccgccaaccctccgacccatcatgtgctgcgaccactcggtttatcgtccacttcatggtataagtctctcag

SEQ ID NO: 274241 - DNA, 75 bp, Artificial Sequence
  Synthetic
tatagtaggagatattggaaagtacattgagaatgctggactaagtgcttttttcctaacagtcaagttcgcact

SEQ ID NO: 274242 - DNA, 75 bp, Artificial Sequence
  Synthetic
tgtagtggaatttctgagcaggcgacgattggtcactggaaaccatctataccttgctgagggtagcggcgcctc

SEQ ID NO: 274243 - DNA, 75 bp, Artificial Sequence
  Synthetic
gggtaccaagtggcaacctctggcattgtcggccttctctggagaattaacaaagctgaagtccctaatgctctt

SEQ ID NO: 274244 - DNA, 75 bp, Artificial Sequence
  Synthetic
aatgtcgctaattgaatcatatattccaggacccataatatactacaatagcctcttccatagtggagagaatcc

SEQ ID NO: 274245 - DNA, 75 bp, Artificial Sequence
  Synthetic
ataccgagacctgggtgaacaggcacgatacttggcactcttagaggctccccaggctatggattttgctcctgc

SEQ ID NO: 274246 - DNA, 75 bp, Artificial Sequence
  Synthetic
tccccaacgtaactttgcccctcaaccaactcaatttatggaaagcattccgtataagcagatcttagcagatat

SEQ ID NO: 274247 - DNA, 75 bp, Artificial Sequence
  Synthetic
aaactaccctctgatatacagctacgccatgggcgtgggaactgtactcgatccacagatgaggaattataactt

SEQ ID NO: 274248 - DNA, 75 bp, Artificial Sequence
  Synthetic
tcaaactccagcagggtttgtacaacaatttgttccattgtggactggccaatcagtacaaacagacttgaatcg

SEQ ID NO: 274249 - DNA, 75 bp, Artificial Sequence
  Synthetic
tgcacgcccgttcttaaatgcaatgtacttccaattcggtgtagaaacagctcgtcgccaacaaggtgccgttga

SEQ ID NO: 274250 - DNA, 75 bp, Artificial Sequence
  Synthetic
gaaagagtgtacggaatatattatcaataaagttggggttgagacatgtgggttggtacatgttgacttggaaga

SEQ ID NO: 274251 - DNA, 75 bp, Artificial Sequence
  Synthetic
tacaaagatggccgaggagcttggtctcaccgcccaagacaagcaggagatgacagaaacgctaaacaggcttgg

SEQ ID NO: 274252 - DNA, 75 bp, Artificial Sequence
  Synthetic
cttcgccattggaccatcagcagaacttaccgcaggaactattcactctatcattatagccaccactgtcctcaa

SEQ ID NO: 274253 - DNA, 75 bp, Artificial Sequence
  Synthetic
cgctgcaggtgcacgaggggccgctccggctgcacccaatccatttaatgcagcgcccccagcacctgctcccat

SEQ ID NO: 274254 - DNA, 75 bp, Artificial Sequence
  Synthetic
gcccggaggagctcttgttttcaagacgtattggaccccattttcccgattctccaggttaatttcagtcctctg

SEQ ID NO: 274255 - DNA, 75 bp, Artificial Sequence
  Synthetic
cccagttgcccaaccagcacaggatggcccacatgacaacgctgcagctgctccggcccccgcccccggtgccga

SEQ ID NO: 274256 - DNA, 75 bp, Artificial Sequence
  Synthetic
gatgttttttgaagaagtgactgcaatccggagctcttattctgacccacacaagacagaagtgtatctgtgtgc

SEQ ID NO: 274257 - DNA, 75 bp, Artificial Sequence
  Synthetic
cgcgcccggtcccgccggtcttcacatccctggaccaggagagccaggatttgaaccacaggagtactaccggca

SEQ ID NO: 274258 - DNA, 75 bp, Artificial Sequence
  Synthetic
attatttgcaggctctagcgcaagaggtagtatcagtcaagcaatccatggtgctacactgctccataccgaagg

SEQ ID NO: 274259 - DNA, 75 bp, Artificial Sequence
  Synthetic
acccggtatgatggacatggtcaagaacagactaaggatcgctagcgggggtgcaccgggagtcctaccgcatga

SEQ ID NO: 274260 - DNA, 75 bp, Artificial Sequence
  Synthetic
attcactatggtcgctcctgcagtagtagagacttttttagttgctcacaagaatcaatccaatgtagtgtgtca

SEQ ID NO: 274261 - DNA, 75 bp, Artificial Sequence
  Synthetic
actcgacgcggctgcacaaatatatgttgatgaagtcgtcactgggctaagacgccccaatgactttgcaggtat

SEQ ID NO: 274262 - DNA, 75 bp, Artificial Sequence
  Synthetic
agagattgatcgaatagtcctgacaggcgataattccatgcaggatcaagataatcaattgataattgctgcagg

SEQ ID NO: 274263 - DNA, 75 bp, Artificial Sequence
  Synthetic
cctcgaagccatgtttcagcagcttgcagaggagcaaaaaggtgacctagaggattagaacagacgcccaaccgt

SEQ ID NO: 274264 - DNA, 75 bp, Artificial Sequence
  Synthetic
tggggcacttgcagcacaattgtggcatgacaaccctgtctttcaagattggcctgcattagtaaaatacttagt

SEQ ID NO: 274265 - DNA, 75 bp, Artificial Sequence
  Synthetic
gcagctgcgcctccccagtctgcccccctttaagaaaaaataggcccgaaaggtgccaaacaacgagagcaaccg

SEQ ID NO: 274266 - DNA, 75 bp, Artificial Sequence
  Synthetic
cactgttattaccacccatcttaaagagatcattgagacctcaaaggtagacacattggaatatgaaagcctctt

SEQ ID NO: 274267 - DNA, 75 bp, Artificial Sequence
  Synthetic
cccacacactcggctcaccaacctgctctgcctttctaacccactgctgagatggctagtagttcgctaagcttc

SEQ ID NO: 274268 - DNA, 75 bp, Artificial Sequence
  Synthetic
gatgacagcgtataatacagggtcattcggccgaattaacaccatcactaatggattggtcgagacggttctaat

SEQ ID NO: 274269 - DNA, 75 bp, Artificial Sequence
  Synthetic
tctgatggagagattactgaactactggaaacaggactgggcactattgagagtatcgagaggatggtggcggca

SEQ ID NO: 274270 - DNA, 75 bp, Artificial Sequence
  Synthetic
ctctgtggcccgcaactggttgacacttactgagcaatacagactccggctgaagcatgacttggagctaggggt

SEQ ID NO: 274271 - DNA, 75 bp, Artificial Sequence
  Synthetic
aagggtgggcctgacgggggaattgacccagagtcccaacctggacagaggggacttccgactcccaccccccgg

SEQ ID NO: 274272 - DNA, 75 bp, Artificial Sequence
  Synthetic
cttccgagtcagaagccttctcaatgccgagcagtttctcggtcttactgagaacccgaaatatcttctcagtgc

SEQ ID NO: 274273 - DNA, 75 bp, Artificial Sequence
  Synthetic
acaacatcaacacccaccgctgcaggaagtgcctctgctactcttgagcttagtccggaaggaggagcaatcaaa

SEQ ID NO: 274274 - DNA, 75 bp, Artificial Sequence
  Synthetic
gcttggcaaaaggaagataagtgaattctttgatgagcgagctgtcgcatttctgagtcgcccaatgcaaaaaag

SEQ ID NO: 274275 - DNA, 75 bp, Artificial Sequence
  Synthetic
aaggcacctagggcgcaccctacactccccaacccccttgggcaagaagaacgccctggaaaccccttatccaca

SEQ ID NO: 274276 - DNA, 75 bp, Artificial Sequence
  Synthetic
agtgtggaagacaattgggtgtgcattgatggagggggatcctgtggctccactaagctctcactatctccaaga

SEQ ID NO: 274277 - DNA, 75 bp, Artificial Sequence
  Synthetic
tttaccccagtccgaggttcatcatccactcatgatcccctccctggaagtcgtcctggatcagaagtttatgag

SEQ ID NO: 274278 - DNA, 75 bp, Artificial Sequence
  Synthetic
agaagatgtcgaacgcgacatcgctggcgatattctgtgaataagaataatttaagaaaaaacttaactgtaaag

SEQ ID NO: 274279 - DNA, 75 bp, Artificial Sequence
  Synthetic
ggcgatctgatggcgagagctcgctccgaacttgtgactagatggtcggatgaagaaggtgatcctgtccccact

SEQ ID NO: 274280 - DNA, 75 bp, Artificial Sequence
  Synthetic
tattctgtgaataagaataatttaagaaaaaacttaactgtaaagttaagtaagcttatctattctccctctggt

SEQ ID NO: 274281 - DNA, 75 bp, Artificial Sequence
  Synthetic
agagtgttgcagagcacttttaagaggggggccgaccggaaaggagctaatcccggcgaaccaggccaccgtaga

SEQ ID NO: 274282 - DNA, 75 bp, Artificial Sequence
  Synthetic
gaatatagcatcgggtgggtctgtgggaccgtcagggtcctcgaatggtgcaacccagcatgttccccaatatcc

SEQ ID NO: 274283 - DNA, 75 bp, Artificial Sequence
  Synthetic
atggaaccaagatactaccaatgcacctgtggcacctgccccgcaaagtgccctcaatgtgccggagataatgga

SEQ ID NO: 274284 - DNA, 75 bp, Artificial Sequence
  Synthetic
attgttgaaagcaatcgagggccgcatgatggcgctggaaatgaaagttgatagagttctagcacagggatcagt

SEQ ID NO: 274285 - DNA, 75 bp, Artificial Sequence
  Synthetic
gctgacacagatcaagaatgaggtaacaaccctcaaagctaccactgccacaattgagggactgattaccacagt

SEQ ID NO: 274286 - DNA, 75 bp, Artificial Sequence
  Synthetic
ccgcattatggatccaggtgtccccagtaacatgactgcgcagattgctcgcaaccagatcgctgaagtaccgct

SEQ ID NO: 274287 - DNA, 75 bp, Artificial Sequence
  Synthetic
tatagtcactgggcctggaccggtgcctcaatacaagcgtgacacagatttaatagtgcttgatgagctggctcg

SEQ ID NO: 274288 - DNA, 75 bp, Artificial Sequence
  Synthetic
ccccagcatcgcgccactgcctgccgcacagacccagaagcccgctccagcaaagcaagccaccgacggggctcg

SEQ ID NO: 274289 - DNA, 75 bp, Artificial Sequence
  Synthetic
cctcatggtttcgcgtatgatcagcagctgtgttactaatgactcagctcgaaaacggttcgaagccaggttggg

SEQ ID NO: 274290 - DNA, 75 bp, Artificial Sequence
  Synthetic
atcgtgcacaaccatggaccaaatccaggcgctaaaaaatgatgtcattcgctatgcctcttaagtagttaggtg

SEQ ID NO: 274291 - DNA, 75 bp, Artificial Sequence
  Synthetic
ccttgcattgggcagcctgtgcattgcttgctacattggcttcatgcagcatttaagaaaaaattcacaaagtct

SEQ ID NO: 274292 - DNA, 75 bp, Artificial Sequence
  Synthetic
cgagcacaaagccgcaggcccgaacagaggtcacgcatgaagccagggtcgcaatggcgatgcatgccaagatcc

SEQ ID NO: 274293 - DNA, 75 bp, Artificial Sequence
  Synthetic
cactcaatcaaccccagaatcaggacactgcacaacttcaaccatttccccttgtgatgagcgagccagagaatg

SEQ ID NO: 274294 - DNA, 75 bp, Artificial Sequence
  Synthetic
ggaagcgcagactactcaaacagcttcgcatcaagcgcatcccgccattgagtataggcgatcagcagatcacat

SEQ ID NO: 274295 - DNA, 75 bp, Artificial Sequence
  Synthetic
ttataaatacatatggatttatccgtgcgaatcgcaccttcactgagttcatctctgaattgcaccgcccaggat

SEQ ID NO: 274296 - DNA, 75 bp, Artificial Sequence
  Synthetic
tgcagcccatagttactgcctgcatgttgccattcggtgccggaccattgctggacagcccagagaaaatcctgg

SEQ ID NO: 274297 - DNA, 75 bp, Artificial Sequence
  Synthetic
aagggttagatctgtgtgaaatcaaagtacggaaaagtgccgcagttaaggaagagattttattcgaagttacgg

SEQ ID NO: 274298 - DNA, 75 bp, Artificial Sequence
  Synthetic
cactgccaaaaatattccaagggttccagattagtgcacagccactgattaaggtctcctcagagaagtatgtta

SEQ ID NO: 274299 - DNA, 75 bp, Artificial Sequence
  Synthetic
aagcaccaggaaagatcaatgcaggtgttgaatacaagttctatccaaccttcgtatcacttacctactgtccta

SEQ ID NO: 274300 - DNA, 75 bp, Artificial Sequence
  Synthetic
ccacactcaaaattcaaggtcgccagactctggccactgtgcgggcaaagttcatgaggagtatccacctagaga

SEQ ID NO: 274301 - DNA, 75 bp, Artificial Sequence
  Synthetic
tcttgctcatcttcgaatgcaaggatgatgcgcccatggccaaagcgctgatcaagagagacgagagggatgggt

SEQ ID NO: 274302 - DNA, 75 bp, Artificial Sequence
  Synthetic
accaggcctctgtttgggtgcatatgtgcaacataaccaaaagtacacagaaattcaagacatatgatgattcct

SEQ ID NO: 274303 - DNA, 75 bp, Artificial Sequence
  Synthetic
attttggtcaaaaggtattagccatgaagcctgtaattgggctcgtagatatgtggggaccgactatcaccgtac

SEQ ID NO: 274304 - DNA, 75 bp, Artificial Sequence
  Synthetic
acatctcagggaagatgccgaagactgctgcaccctacttcaatagtagagggaggtcttgccatcctctctcag

SEQ ID NO: 274305 - DNA, 75 bp, Artificial Sequence
  Synthetic
aggtagcacccagcatagccaagatggcatggtctaacggatgccgaatccatcaagttaatgcgatcctccagg

SEQ ID NO: 274306 - DNA, 75 bp, Artificial Sequence
  Synthetic
aatctgacttatccctcattccgggtagtgatgacatcctatttaggaaagtccctgtggaccctgagaatatta

SEQ ID NO: 274307 - DNA, 75 bp, Artificial Sequence
  Synthetic
actttaaatcaacctactggaaccctttccgtaagtaggtcatgcaactcacctctttctgtacgcagtccgcga

SEQ ID NO: 274308 - DNA, 75 bp, Artificial Sequence
  Synthetic
atgtcaatttcactcctacctatatgttggctatgctcaatctttgcactgtgcttccatctcagccgtgcatca

SEQ ID NO: 274309 - DNA, 75 bp, Artificial Sequence
  Synthetic
ttctagctgtctcggctgatttattctcattgctcttgtcaaagctctatataggatccgaggtagaattttaga

SEQ ID NO: 274310 - DNA, 75 bp, Artificial Sequence
  Synthetic
aaaaatttcgatataaaaaatcaagacaggcccgaacaggtgccacccaaccaggacacacacgcccatccacct

SEQ ID NO: 274311 - DNA, 75 bp, Artificial Sequence
  Synthetic
ccgccccaggtcggagcaactccaccatgccacaacaacaagttgcccatacatgcgtgatgttgtggggtatca

SEQ ID NO: 274312 - DNA, 75 bp, Artificial Sequence
  Synthetic
tatctacagtgagcggtatcaacactgaagcgctcagtcagtatggtgtcgtagtaaccaacgttagacaactca

SEQ ID NO: 274313 - DNA, 75 bp, Artificial Sequence
  Synthetic
cctactacacacaggcaggcagtacataccttgcagtccgcctccttccatcacttgcttctccagaccagtctt

SEQ ID NO: 274314 - DNA, 75 bp, Artificial Sequence
  Synthetic
gtgccctgcatagtataatcaactataatgcaaccttacaggctatcttaagtcccattgctgaaaatctgaatc

SEQ ID NO: 274315 - DNA, 75 bp, Artificial Sequence
  Synthetic
taatcagcacagctctaagagagcaacaccgcaaaaaacgttttgcaggtgttgcgattggtttaactgcactag

SEQ ID NO: 274316 - DNA, 75 bp, Artificial Sequence
  Synthetic
gggttgccacggctgcacaggccaccgccgctgtggcacttgttcgggccaacaaaaacgcagagaaagtcgaac

SEQ ID NO: 274317 - DNA, 75 bp, Artificial Sequence
  Synthetic
aactaagccaggcacttggtgaaactaatgccgctatttccgatctcatcgatgcaactaagaatcttggctttg

SEQ ID NO: 274318 - DNA, 75 bp, Artificial Sequence
  Synthetic
ccgttcaagcaatccaaaatcagatcaatacagcaatattaccacaaatccacaatttatcatgtcaggtgatag

SEQ ID NO: 274319 - DNA, 75 bp, Artificial Sequence
  Synthetic
atgcacaacttggtaacattctgtccttgtatctcacagaattgaccacagtattccagccccaattaactaatc

SEQ ID NO: 274320 - DNA, 75 bp, Artificial Sequence
  Synthetic
ctgctctatctcccctcacgattcaggcgctcagggctgtgttaggtacaacattacctgctctgttgtcagaga

SEQ ID NO: 274321 - DNA, 75 bp, Artificial Sequence
  Synthetic
agcttaaatctaatatcccgctgggtgaccttatgagctcgggattgctcaaaggtcaattagtaggattaaacc

SEQ ID NO: 274322 - DNA, 75 bp, Artificial Sequence
  Synthetic
tccagaatatgctcatgattattgaattatacatccctaccctgtccactcatagcacagccaaagtattggatc

SEQ ID NO: 274323 - DNA, 75 bp, Artificial Sequence
  Synthetic
ttgtcacgatatcctcacatgtcaatggcagagaggtggaaattcaggtaccgaatcgagtcctagaattaggca

SEQ ID NO: 274324 - DNA, 75 bp, Artificial Sequence
  Synthetic
gcgaggtactcggatatgggggttcagagtgtgccctcactatgagtcacatcctatgtccttttaatgacgcca

SEQ ID NO: 274325 - DNA, 75 bp, Artificial Sequence
  Synthetic
gggtactatcaactgatatgaagtattgtttacaaggcaatatcacacattgcatattctcacctgtagtaggca

SEQ ID NO: 274326 - DNA, 75 bp, Artificial Sequence
  Synthetic
gcttcttaagaagatttgccctagtcaatggtgttgtcattgccaactgtgcagacatgtcttgcgtgtgctttg

SEQ ID NO: 274327 - DNA, 75 bp, Artificial Sequence
  Synthetic
atccacaagagattatttatcagaactttcaagagcccaccacagtcatcgatattaagaaatgtggcaaagtgc

SEQ ID NO: 274328 - DNA, 75 bp, Artificial Sequence
  Synthetic
agctggacaccctcaccttcacaatcagcacatttgcaaatcgcacatatggaccccctgcttatgttcctccag

SEQ ID NO: 274329 - DNA, 75 bp, Artificial Sequence
  Synthetic
acaatataatacaatctgaaccattagatatctctggaaatttaattgcagtaaacaactctctgagttctgctt

SEQ ID NO: 274330 - DNA, 75 bp, Artificial Sequence
  Synthetic
taaatcacctggctaccagtgagattctgcggaacgagcagatttggacaagtagtctaggaatctccactattg

SEQ ID NO: 274331 - DNA, 75 bp, Artificial Sequence
  Synthetic
ttgcattggtaattattggcatcctgatcatctgcttagttgtaacatgggctgctctatgggcactcttgaaag

SEQ ID NO: 274332 - DNA, 75 bp, Artificial Sequence
  Synthetic
aagtgcgaggactgaactctgctgttaacagccaattgtcatcatatgttatgggagataaattcattagatact

SEQ ID NO: 274333 - DNA, 75 bp, Artificial Sequence
  Synthetic
gatgcaaatcaagtcattgcaagaatctcagcaccactctagcgctcacgatcactatagcgttccatcaattat

SEQ ID NO: 274334 - DNA, 75 bp, Artificial Sequence
  Synthetic
acactactagtgccatcctgctttacttgccgtttcaatatggattacatatgattaagaaaaaaccattatagt

SEQ ID NO: 274335 - DNA, 75 bp, Artificial Sequence
  Synthetic
aagaaaatagtagaccgccacctaacaaggagaactaggcccgaagggcaccacacccgtccacacaagcagtcc

SEQ ID NO: 274336 - DNA, 75 bp, Artificial Sequence
  Synthetic
cttagttattcaggtgcctagggcgtgtagggcaatgtctcaattagggactgatcaaatcatgcaccttgctca

SEQ ID NO: 274337 - DNA, 75 bp, Artificial Sequence
  Synthetic
gccagccattgcaaggcgcacatggaggctctgcttccggatctttgctttatttatcctcattgctatagtgat

SEQ ID NO: 274338 - DNA, 75 bp, Artificial Sequence
  Synthetic
tacacaaattttcatgcttacttttgatcatacactactgacaacgacccagttcttaactagtattggtaacct

SEQ ID NO: 274339 - DNA, 75 bp, Artificial Sequence
  Synthetic
gcagagtacaataacctcgtggaccccggatgtacaggctatgttgagcatttctaatcaactcatatataccac

SEQ ID NO: 274340 - DNA, 75 bp, Artificial Sequence
  Synthetic
gtcaattactcttccattaaaaatctcaactacagaaatgtctattctcaccgccattcgagatcactgtcactg

SEQ ID NO: 274341 - DNA, 75 bp, Artificial Sequence
  Synthetic
ccctgattgttcatctgcctgccccaccagacaaatgctactcaatgatccacgatatatgagtggtgtcaatca

SEQ ID NO: 274342 - DNA, 75 bp, Artificial Sequence
  Synthetic
gtttattggggccccaacagagagcataaatatcacatttggacctttgttcggtattccaagctttatccctac

SEQ ID NO: 274343 - DNA, 75 bp, Artificial Sequence
  Synthetic
atcaacaactacacaaggatgtactcggataccatcatttgctctaggaccaagccactggtgttacacacataa

SEQ ID NO: 274344 - DNA, 75 bp, Artificial Sequence
  Synthetic
ttttatcaccgcagggtgtgcagacggagggcactcaaatcagtatttggccatgggaacaatacagagtgcgtc

SEQ ID NO: 274345 - DNA, 75 bp, Artificial Sequence
  Synthetic
agacggctcaccattattgattacagctagatcttattatcttagtgacggggtgaataggaaaagttgctcgat

SEQ ID NO: 274346 - DNA, 75 bp, Artificial Sequence
  Synthetic
tgctgtagtaccgggtggatgcgcgatgtactgctacgtcgcgacacgttctgaaaccgattactacgctggtaa

SEQ ID NO: 274347 - DNA, 75 bp, Artificial Sequence
  Synthetic
tagccccccacaacaactcttgactcttgtattctctaatgacaccatcatcgagcgcaccatccaccccaccgg

SEQ ID NO: 274348 - DNA, 75 bp, Artificial Sequence
  Synthetic
actggccaacggatgggtaatgctggttcctggagtagggagcgggacactatacaatgagtatctgttattccc

SEQ ID NO: 274349 - DNA, 75 bp, Artificial Sequence
  Synthetic
cgcctatgggggcatgcagcaaatcttggcaaaccagagtggtgagataaaccagttcttcacaccatacaatgc

SEQ ID NO: 274350 - DNA, 75 bp, Artificial Sequence
  Synthetic
cactgtgaggtgtgcaatggctcagcctcaattttcccaacgagcagctgcctcctattacccccgttacttttc

SEQ ID NO: 274351 - DNA, 75 bp, Artificial Sequence
  Synthetic
aaacagatggattcgctctgcaattgttgcctgcccttaccgagctatttatcagactcaatgcaccctgattcc

SEQ ID NO: 274352 - DNA, 75 bp, Artificial Sequence
  Synthetic
cctcccgaatagaatggtaatgatgggaagtgaagggcgaatcttcacacttggtgaccgcttgttttattatca

SEQ ID NO: 274353 - DNA, 75 bp, Artificial Sequence
  Synthetic
acgcagtagttcttggtggccatacccactactgtaccaggttggattaaactttctcacgactcctcccagtgt

SEQ ID NO: 274354 - DNA, 75 bp, Artificial Sequence
  Synthetic
ttcctcgatgactcaagtccctttggagcatcttgcgagaccggggaaagggggttgtccaggaaacagtcactg

SEQ ID NO: 274355 - DNA, 75 bp, Artificial Sequence
  Synthetic
tccagcaacatgcgttacaggagtatacgctgatgtatggccgctcaccgaccctaggagtggagtgggcgggac

SEQ ID NO: 274356 - DNA, 75 bp, Artificial Sequence
  Synthetic
ctcacttgttgcggcaggagggctagatagcacctccgaaagaatggcacctgtcaactatctcgcgattgggga

SEQ ID NO: 274357 - DNA, 75 bp, Artificial Sequence
  Synthetic
atccttattgtcaaagacatatcttctctccaaaacacaacctgctgcatataccactaccacctgcttccgtga

SEQ ID NO: 274358 - DNA, 75 bp, Artificial Sequence
  Synthetic
tacggatacagggaaaatctattgcattacaatagctgaattagggaaagtgctacttggtgaatttcagattgt

SEQ ID NO: 274359 - DNA, 75 bp, Artificial Sequence
  Synthetic
acccttcttacgagagattaagattcaatcacgctattaagttgttaaattactatctacgattcagacactaca

SEQ ID NO: 274360 - DNA, 75 bp, Artificial Sequence
  Synthetic
aaatcccttactttaagaaaaaacgtaggccggaatggctggccaacaggacgtcattctgcccgaggtacacct

SEQ ID NO: 274361 - DNA, 75 bp, Artificial Sequence
  Synthetic
cgattccccgatcgtgaagcacaaactgttgtatctattaaagctaggtggattcccaatcggcacagcattcga

SEQ ID NO: 274362 - DNA, 75 bp, Artificial Sequence
  Synthetic
tggagatggaccacatcagaggatccagcgttgggatcggatccgtggtgaggagaatcaactattctctcgact

SEQ ID NO: 274363 - DNA, 75 bp, Artificial Sequence
  Synthetic
agacctaatgagacaacgactggaacgttataccagcctgcggaccatatcagtagtccccaatcatttttctat

SEQ ID NO: 274364 - DNA, 75 bp, Artificial Sequence
  Synthetic
cttgatatggccgagatgcatacagctctgccaaactgttgacctacgagtctatatggagctggagagggaatg

SEQ ID NO: 274365 - DNA, 75 bp, Artificial Sequence
  Synthetic
gaaacacgtcaccaccaaagcatgtgagcttcttgataaacccttggtcagatgtcttagagatatcagccacaa

SEQ ID NO: 274366 - DNA, 75 bp, Artificial Sequence
  Synthetic
gttaactaaccgagctgacctgtttagccgtgcccgggacgaagcatatcaaggtggcgaacagcatccgaccct

SEQ ID NO: 274367 - DNA, 75 bp, Artificial Sequence
  Synthetic
ccaatcgattgaacgcacttgggaacataatccttgggctcaagctacgtccacctggctgatgatcaagcatcg

SEQ ID NO: 274368 - DNA, 75 bp, Artificial Sequence
  Synthetic
aatgcgccaactgataactcagatgaagtccgatcctacatctacttatcctacagtcctagaaacacgtcatca

SEQ ID NO: 274369 - DNA, 75 bp, Artificial Sequence
  Synthetic
cttagtcatgatcagccctgaattggtggcaattgttttccaggctgaaaaggtgatcacttactttaccttcga

SEQ ID NO: 274370 - DNA, 75 bp, Artificial Sequence
  Synthetic
gatggtcttgatggtatctgacgtatttgagggccgtctaaatgtcttgtcactttgccaggtgagcaattactt

SEQ ID NO: 274371 - DNA, 75 bp, Artificial Sequence
  Synthetic
aagcccactcgcacctagaatcacaaaaattcttgcccttgttgatcagttgggtaccatactcggagatggaat

SEQ ID NO: 274372 - DNA, 75 bp, Artificial Sequence
  Synthetic
ctatgacatcatcgcgtccctggaaagtttttgttatgctcaactccagttagaggacccagtgattgaaattgc

SEQ ID NO: 274373 - DNA, 75 bp, Artificial Sequence
  Synthetic
cggaacattctatgcatttatggcagatgagatgttaacttgtctattggatagcaaccaattctcgagggatga

SEQ ID NO: 274374 - DNA, 75 bp, Artificial Sequence
  Synthetic
agcatatgttatagttgagaaactcacatcgctatatggggggttatcaccagatttgacagccgaattgctatg

SEQ ID NO: 274375 - DNA, 75 bp, Artificial Sequence
  Synthetic
tctcatgaggctatgggggcacccaagtcttgtagctgctcaagcggcgggaaaagtcagggaatctatgtgtgc

SEQ ID NO: 274376 - DNA, 75 bp, Artificial Sequence
  Synthetic
tgcgaaggtcattcaacttggggtaacactaaagacattggcattctttcacaccatcttaattaatggataccg

SEQ ID NO: 274377 - DNA, 75 bp, Artificial Sequence
  Synthetic
gcggagacacaatgggatttggccacctgtccatttaccagagtatgccccacttgcccttgttgagctatgcaa

SEQ ID NO: 274378 - DNA, 75 bp, Artificial Sequence
  Synthetic
agataatcatgagataacatatgactttaccttgagacattggaaggcaatttctgcaattcagttcgagcgatg

SEQ ID NO: 274379 - DNA, 75 bp, Artificial Sequence
  Synthetic
ctttgacgcggaccctggtgaggatctaagtatattcatgaaggacaaagccataagttgcccaaagcaggattg

SEQ ID NO: 274380 - DNA, 75 bp, Artificial Sequence
  Synthetic
gatgagcgtattccggaagagcctcatcaaagacagattcacggctgcaaagcgcgatttacctcaacctgtcaa

SEQ ID NO: 274381 - DNA, 75 bp, Artificial Sequence
  Synthetic
ccggcgactactccttaactttcttgaagatgccaacttcgaccctgttgaagaactaaaatatgtgacaacacg

SEQ ID NO: 274382 - DNA, 75 bp, Artificial Sequence
  Synthetic
tgcatacctaactgatgatgaattctgtgcctcatactcactcaaagagaaagaaataaagaccaccggccgtat

SEQ ID NO: 274383 - DNA, 75 bp, Artificial Sequence
  Synthetic
ctttgcaaaattaactaggagaatgagatcctgtcaagttatcgcggaggctatgctcgcaaaccatgcagggaa

SEQ ID NO: 274384 - DNA, 75 bp, Artificial Sequence
  Synthetic
actgatgcgagagaatggtgtagtgatggatcagttaaaacttacaaaatcattattgacaatgaatcaaatcgg

SEQ ID NO: 274385 - DNA, 75 bp, Artificial Sequence
  Synthetic
aatagtatcccaaaagtctagaaaatttactagtgataaccagacaatttttaaacgaccaaatcgtagcaatca

SEQ ID NO: 274386 - DNA, 75 bp, Artificial Sequence
  Synthetic
aggtaagactgcgaatcgagacacccagagagatagcgatgaacatgaaatagcagcatgtttcctaacaactga

SEQ ID NO: 274387 - DNA, 75 bp, Artificial Sequence
  Synthetic
cttaaagaaatactgcttacagtggcgctatcagtccataggtatgtttgctagatcgcttaatcagatgtatgg

SEQ ID NO: 274388 - DNA, 75 bp, Artificial Sequence
  Synthetic
atatgatcatttgtttgagtggatccatctccgcttgatgcgtagcacattgtatgtaggagatccattcaatcc

SEQ ID NO: 274389 - DNA, 75 bp, Artificial Sequence
  Synthetic
ccctgaggccggaactgatttcgaccttgatagtgttaatggagatatattcatagtctcaccgcgagggggaat

SEQ ID NO: 274390 - DNA, 75 bp, Artificial Sequence
  Synthetic
agagggtctctgtcagaaattctggacaatgatatcgatctctgttattttactatcagcagcagaatccgggca

SEQ ID NO: 274391 - DNA, 75 bp, Artificial Sequence
  Synthetic
cagggttatgagcatggttcagggagacaatcaggtagttgcagtaaccacccgtgtaccaaggaccttgagcca

SEQ ID NO: 274392 - DNA, 75 bp, Artificial Sequence
  Synthetic
gagagataagaaggaaatagcccatcgagcttgtctatcattctttaaccgattaaaagagaataatttcggtct

SEQ ID NO: 274393 - DNA, 75 bp, Artificial Sequence
  Synthetic
tggacaccacttaaaggcgcaagagaccatcattagttcggacttctttgtttatagcaagagggtcttttttag

SEQ ID NO: 274394 - DNA, 75 bp, Artificial Sequence
  Synthetic
aggaaggattctcaaccaagctttgaagaatgcaagcaaactatgtcttatagccgatgttctaggggattgttc

SEQ ID NO: 274395 - DNA, 75 bp, Artificial Sequence
  Synthetic
acaagcctcctgttccaatctagctacaactgtgatgcgcttggctgagaatggtgttgaaaaggacctctgcta

SEQ ID NO: 274396 - DNA, 75 bp, Artificial Sequence
  Synthetic
ttatttaaatgtctacctgaccatcagacaggtcacctacgacattaagttccctcaagtacaaacatactctag

SEQ ID NO: 274397 - DNA, 75 bp, Artificial Sequence
  Synthetic
tgacattcgccatttctatgctaatcatcctcatttaattgcacgcctagctgtccttccttcacaattgggcgg

SEQ ID NO: 274398 - DNA, 75 bp, Artificial Sequence
  Synthetic
gctgaattatctttcctgcagtcgcctattcaaccggaatattggagatcctgcggtttctgcattggctgactt

SEQ ID NO: 274399 - DNA, 75 bp, Artificial Sequence
  Synthetic
aaaacgattgatacggtgtggggcaattgaacactgggtcctgtcaaatatcttgatgcgaaagccagggagtgg

SEQ ID NO: 274400 - DNA, 75 bp, Artificial Sequence
  Synthetic
taactggagcacattagcagcagatccatatgccctcaatgttgattacttgaatcctcctacaatgtttctcaa

SEQ ID NO: 274401 - DNA, 75 bp, Artificial Sequence
  Synthetic
aaagcatactcaacaagttttgatgggacagagccgcaatccgctgctgtcagggatattccatgagaatgcacg

SEQ ID NO: 274402 - DNA, 75 bp, Artificial Sequence
  Synthetic
acaggaggaaaatgatcttgctcagtttctcctagatcgagaggtggttatgccacgagtggcatatgtgatttt

SEQ ID NO: 274403 - DNA, 75 bp, Artificial Sequence
  Synthetic
ggctcagacgagctgtggaaggcgaaagcagatacaagggtttctagattctactcgaacaatgataagacatgc

SEQ ID NO: 274404 - DNA, 75 bp, Artificial Sequence
  Synthetic
attacagttacaacccttgtcatttagaaagttgaatcaggttttagagtataattgtctctacctggcttatag

SEQ ID NO: 274405 - DNA, 75 bp, Artificial Sequence
  Synthetic
tctggagatcatagaatacccaaaagaagttgctagccaccttatggctctcacatatgaaacttgtagtataga

SEQ ID NO: 274406 - DNA, 75 bp, Artificial Sequence
  Synthetic
cctagcaagaacactacgaaagttatcctgggcatcattacttgcaggtcgtccaatagagggcctagagacacc

SEQ ID NO: 274407 - DNA, 75 bp, Artificial Sequence
  Synthetic
agacccaattgaattgctggacggtgcacttgtcgtaggatctgggacctgtctgcagtgtgagcaaggagatac

SEQ ID NO: 274408 - DNA, 75 bp, Artificial Sequence
  Synthetic
taaattttcttggttttaccttcctgatggcatacaattggaccgagatccaatggagaatcctccaattagagt

SEQ ID NO: 274409 - DNA, 75 bp, Artificial Sequence
  Synthetic
tccatacattggttcaaaaacagatgagcgccgtgttgcgtctatgacttacgtaaagggtgcctcatcagcact

SEQ ID NO: 274410 - DNA, 75 bp, Artificial Sequence
  Synthetic
tagatcagcactccgattggctggagtctatatatgggcatttggtgaggatgaagtgagttgggttgaagcaca

SEQ ID NO: 274411 - DNA, 75 bp, Artificial Sequence
  Synthetic
tgcccttgctcagactcgagtcacaataactatggaccagctcagagcactcactccgctcccaacatcggccaa

SEQ ID NO: 274412 - DNA, 75 bp, Artificial Sequence
  Synthetic
catcacacatcgattagacgatggaactactcagctcaagtttacacctgcaagttcttatgcattctccagcta

SEQ ID NO: 274413 - DNA, 75 bp, Artificial Sequence
  Synthetic
tgttcatatctcaaatgatgaccaggtactagaattggacgacaaggtcttggactcaaatttgatataccaaca

SEQ ID NO: 274414 - DNA, 75 bp, Artificial Sequence
  Synthetic
agtaatgataacaggtcttggtgtcatcgaatcatggaacaacccacccatttcgactaatgaattcgaagtcac

SEQ ID NO: 274415 - DNA, 75 bp, Artificial Sequence
  Synthetic
actgcacttgcatactgggtcatcatgttgtattcgccccattgagcagtgtgttcagaatcctgcacttcttgc

SEQ ID NO: 274416 - DNA, 75 bp, Artificial Sequence
  Synthetic
tcttcctgacatctctacaccttaccacaacaagttcgtgtttgatcaggaccccttaacagacaccgtgcaaga

SEQ ID NO: 274417 - DNA, 75 bp, Artificial Sequence
  Synthetic
gagaattgatactaccatctatgctaacaagatcaatagtatcgatttcgtgccgctggttgacaggatccctct

SEQ ID NO: 274418 - DNA, 75 bp, Artificial Sequence
  Synthetic
cctatctcaactagttggtcggtcaacggtgaattcaatcattgggttagatgaatccacatcaatcatgaacga

SEQ ID NO: 274419 - DNA, 75 bp, Artificial Sequence
  Synthetic
tgcagtagttgagtcagactacgccaacaattggattagtgaatgtctgtattcatacattgaccaagtgatttt

SEQ ID NO: 274420 - DNA, 75 bp, Artificial Sequence
  Synthetic
agattttcttgcacgtgtgtgcgggtgctttagtcagtgtccgcagcgttctgttgaacgtgagtgtgttgagaa

SEQ ID NO: 274421 - DNA, 75 bp, Artificial Sequence
  Synthetic
tgggagtggttatgatgaccacttctaaaggaaaggggggcggtccccctaggcgcaagcttaaagtgaccgcaa

SEQ ID NO: 274422 - DNA, 75 bp, Artificial Sequence
  Synthetic
ataagtcgcgaccagcaacgagcccaatgccaaagggcttcgtgctgtcgcgcatgctggggattctttggcacg

SEQ ID NO: 274423 - DNA, 75 bp, Artificial Sequence
  Synthetic
ccgtgacaggcacggccagacccccagtgctgaaaatgttctggaaaacggtaccactgcgccaggcggaggctg

SEQ ID NO: 274424 - DNA, 75 bp, Artificial Sequence
  Synthetic
ttctgaagaagataaagagagttatcgggaacttgatgcagagccttcacatgagagggcgtcgcaggtcaggtg

SEQ ID NO: 274425 - DNA, 75 bp, Artificial Sequence
  Synthetic
cgggaacttgatgcagagccttcacatgagagggcgtcgcaggtcaggtgtggactggacttggatttttttgac

SEQ ID NO: 274426 - DNA, 75 bp, Artificial Sequence
  Synthetic
gatggcgttgatgaccatggccatggcaaccaccatccaccgggacagggaaggatacatggttatgcgggccag

SEQ ID NO: 274427 - DNA, 75 bp, Artificial Sequence
  Synthetic
tggaagggacgctgcaagccaggtcagggtacaaaacggaacgtgcgtcatcctggcaacagacatgggagagtg

SEQ ID NO: 274428 - DNA, 75 bp, Artificial Sequence
  Synthetic
gtgtgaagattcaatcacctactcttgcgtcacgattgaccaggaggaagaacccgttgacgtggactgcttctg

SEQ ID NO: 274429 - DNA, 75 bp, Artificial Sequence
  Synthetic
ccgaggtgttgatagggttaagttagagtatggacgctgtggaaggcaagctggatctagggggaaaaggtctgt

SEQ ID NO: 274430 - DNA, 75 bp, Artificial Sequence
  Synthetic
ggtcattccaacacatgcacaaaaagacatggtcgggcgaggtcatgcatggcttaaaggtgacaatattcgaga

SEQ ID NO: 274431 - DNA, 75 bp, Artificial Sequence
  Synthetic
tcatgtcacccgagtcgagggctggatgtggaagaacaagcttctaactgccgccattgtggccttggcttggct

SEQ ID NO: 274432 - DNA, 75 bp, Artificial Sequence
  Synthetic
catggttgatagttggatggccagagtgactgttatcctcttggcgttgagtctagggccagtgtacgccacgag

SEQ ID NO: 274433 - DNA, 75 bp, Artificial Sequence
  Synthetic
gtgcacgcatcttgagaacagagattttgtgacaggaactcaagggaccaccagagtgtccctagttttggaact

SEQ ID NO: 274434 - DNA, 75 bp, Artificial Sequence
  Synthetic
gccctcagtggggttcacagattgggaagaagtgcccttttgctcacaccattttcatgagctcgtgatgaaaga

SEQ ID NO: 274435 - DNA, 75 bp, Artificial Sequence
  Synthetic
tggaggctgcgtgaccatcacagctgagggcaagccatccattgatgtatggctcgaagacatttttcaggaaag

SEQ ID NO: 274436 - DNA, 75 bp, Artificial Sequence
  Synthetic
cccggctgaaaccagagaatactgcctgcacgccaaattgaccaacacaaaagtggaggctcgctgtccaaccac

SEQ ID NO: 274437 - DNA, 75 bp, Artificial Sequence
  Synthetic
gagcacgagtgtcgccaggatgtggatggagcgtgagagagacggcctgcctgtccaaggcgtacgggcagatgt

SEQ ID NO: 274438 - DNA, 75 bp, Artificial Sequence
  Synthetic
tggaccggcgacacttccggaggagcatcaggctaatatggtgtgcaagagagaccaaagcgaccgtggatgggg

SEQ ID NO: 274439 - DNA, 75 bp, Artificial Sequence
  Synthetic
aaaccactgcgggttttttgggaagggcagtatagtggcttgtgcaaagtttgaatgcgaggaagcaaaaaaagc

SEQ ID NO: 274440 - DNA, 75 bp, Artificial Sequence
  Synthetic
tatgggccacgtctatgactccacaaagatcacgtatgttgtcaaggttgagccccacacaggggattacttggc

SEQ ID NO: 274441 - DNA, 75 bp, Artificial Sequence
  Synthetic
agccccacacaggggattacttggctgcaaatgagaccaattcaaacaggaaatcagcacagtttacggtggcat

SEQ ID NO: 274442 - DNA, 75 bp, Artificial Sequence
  Synthetic
cctacctaccaaagacacaggatctggtgtgctcctcacttgtagggaggaaggaaagggcggaatgggccaaga

SEQ ID NO: 274443 - DNA, 75 bp, Artificial Sequence
  Synthetic
ccgagaaagtgatcctgcggctcggcgactatggagatgtgtcgctgacgtgtaaagtggcaagtgggattgatg

SEQ ID NO: 274444 - DNA, 75 bp, Artificial Sequence
  Synthetic
tcgcccaaactgtggtgatgtcactcgacagcagcaaggaccacctgccttctgcatggcaagtgcaccgtgact

SEQ ID NO: 274445 - DNA, 75 bp, Artificial Sequence
  Synthetic
tctgcatggcaagtgcaccgtgactggtttgaggacttggcgctgccctggaaacacaaggacaaccaagattgg

SEQ ID NO: 274446 - DNA, 75 bp, Artificial Sequence
  Synthetic
aacagtgtggagaaacttgtggaatttggaccaccacatgctgtgaaaatggatgttttcaatctgggggaccag

SEQ ID NO: 274447 - DNA, 75 bp, Artificial Sequence
  Synthetic
acggcagtgctgctcaaatcactggcaggagttccgctggccagtgtggagggccagaaataccacctgaaaagc

SEQ ID NO: 274448 - DNA, 75 bp, Artificial Sequence
  Synthetic
ggccatgttacttgtgatgtgggactggaaaagctgaaactgaaaggcacaacctactccatgtgtgacaaagca

SEQ ID NO: 274449 - DNA, 75 bp, Artificial Sequence
  Synthetic
aagttcaaatggaagagagttcctgtggacagcggccatgacacagtagtcatggaggtatcatacacaggaagc

SEQ ID NO: 274450 - DNA, 75 bp, Artificial Sequence
  Synthetic
acaagtggaggaggatttatagagatgcagttgccaccgggggacaacattatttatgtgggggacctaagtcag

SEQ ID NO: 274451 - DNA, 75 bp, Artificial Sequence
  Synthetic
gacaagccatgtcggatcccggtgcgggctgtagcacatggtgtcccagcggttaatgtagccatgctcataacc

SEQ ID NO: 274452 - DNA, 75 bp, Artificial Sequence
  Synthetic
cccaatccaaccattgaaacaaatggtggcggattcatagaaatgcagctgccaccaggggataacatcatctat

SEQ ID NO: 274453 - DNA, 75 bp, Artificial Sequence
  Synthetic
taggtagaatgttcgaaaagacccgtaagggtttggaaagattttcagtggttggagaacatgcatgggactttg

SEQ ID NO: 274454 - DNA, 75 bp, Artificial Sequence
  Synthetic
gccaccaggggataacatcatctatgtgggagaccttagccagcagtggtttcagaaaggcagtaccattggtag

SEQ ID NO: 274455 - DNA, 75 bp, Artificial Sequence
  Synthetic
agattttcctgcacgtgtgtgcgggtactttagtcagtatccgcggcgttctgttgaacgtgagtgtgttgagaa

SEQ ID NO: 274456 - DNA, 75 bp, Artificial Sequence
  Synthetic
aatgtttgaaaaaacccgcaggggattggaaaggctctctgtggttggagaacatgcatgggactttggctcagt

SEQ ID NO: 274457 - DNA, 75 bp, Artificial Sequence
  Synthetic
aggcggggtactgtcttctgtggggaaggcaatccacacggtgctggggggagctttcaacaccctttttggggg

SEQ ID NO: 274458 - DNA, 75 bp, Artificial Sequence
  Synthetic
ggttggattcatccctaagatgctgctgggggttgctctggtctggttgggactaaatgccaggaatccaacgat

SEQ ID NO: 274459 - DNA, 75 bp, Artificial Sequence
  Synthetic
ctttgaagaagatcaagagagtcattgggaacttgatgcagaatcttcacatgagagggcgtcgtaggtcaggtg

SEQ ID NO: 274460 - DNA, 75 bp, Artificial Sequence
  Synthetic
gactaaatgccaggaatccaacgatgtccatgacgtttcttgctgtgggggctttaacactgatgatgacaatgg

SEQ ID NO: 274461 - DNA, 75 bp, Artificial Sequence
  Synthetic
tgggaacttgatgcagaatcttcacatgagagggcgtcgtaggtcaggtgtggactggacttggacttttttgac

SEQ ID NO: 274462 - DNA, 75 bp, Artificial Sequence
  Synthetic
gagttggggcagattgtggatgtgccattgacccagaaaggatggaaatccgctgtggagaagggcttgttgtgt

SEQ ID NO: 274463 - DNA, 75 bp, Artificial Sequence
  Synthetic
ggaaagaggtgtcggaatggtatgacggctacgcctatcacccagaatcacctgacacgcttgcacaggctctca

SEQ ID NO: 274464 - DNA, 75 bp, Artificial Sequence
  Synthetic
cggaagggacgcagcaagccaggtcagagtacaaaacggaacgtgtgtcattctggcaacagacatgggagagtg

SEQ ID NO: 274465 - DNA, 75 bp, Artificial Sequence
  Synthetic
gagaggcctttgagagaggcgtttgtggggtcgtgccccaaaacagacttgaaatggccatgtggagaagcactg

SEQ ID NO: 274466 - DNA, 75 bp, Artificial Sequence
  Synthetic
gtgtgaagattcaatcacctactcttgtgtcacgattgaccaggaggaagaacctgttgatgtggattgcttctg

SEQ ID NO: 274467 - DNA, 75 bp, Artificial Sequence
  Synthetic
ctccggaactcaacttgatgctgagtgagggagaagcaaacttgaccatcgtggtagacaaaacagatccggcag

SEQ ID NO: 274468 - DNA, 75 bp, Artificial Sequence
  Synthetic
ccgaggtgttgatagggttaagttagagtatgggcgttgtggaaggcaagctggatttaggggaaagaggtccgt

SEQ ID NO: 274469 - DNA, 75 bp, Artificial Sequence
  Synthetic
actataggggaggcactcccatggttctaaagaagactggaaaagagagcaaggtgtcctggaagagctggggca

SEQ ID NO: 274470 - DNA, 75 bp, Artificial Sequence
  Synthetic
ggttattccaacacatgcacaaaaggacatggttgggcgaggtcatgcatggcttaaaggtgacaacatccgaga

SEQ ID NO: 274471 - DNA, 75 bp, Artificial Sequence
  Synthetic
gagtgttcacagtggcagaatttggggtttgcctacgcacaaaggtgattttagacttgcgtggagaggcttcaa

SEQ ID NO: 274472 - DNA, 75 bp, Artificial Sequence
  Synthetic
agtcaatcttgtggagtgttcctgatagccccaggcgcatgatgatgggggttgacggagttggggagtgcccct

SEQ ID NO: 274473 - DNA, 75 bp, Artificial Sequence
  Synthetic
tgtataggagagcaacaggagtgttcacagtggcagagtttggagtgggcctacgcacgaaagtgttcttggatc

SEQ ID NO: 274474 - DNA, 75 bp, Artificial Sequence
  Synthetic
tatggttgatagttggatggccagagtgacagtcatcctcttggcgttgagtctgggaccagtgtacgccacgag

SEQ ID NO: 274475 - DNA, 75 bp, Artificial Sequence
  Synthetic
tgcgtggtgaagcttcaaaagagtgtgacacaggagtgatgggagcagccgtgaagaatggaaaagccatccaca

SEQ ID NO: 274476 - DNA, 75 bp, Artificial Sequence
  Synthetic
gtgcacgcatcttgagaacagagatttcgtgacaggaactcaagggaccactagagtgtccctagtcttggaact

SEQ ID NO: 274477 - DNA, 75 bp, Artificial Sequence
  Synthetic
cggaccaaagtatgtggatgagctcctttcggaatgacacgggcacgtacatccatgagcttattctcactgatc

SEQ ID NO: 274478 - DNA, 75 bp, Artificial Sequence
  Synthetic
tggaggttgcgtgaccatcacagctgagggcaagccatccattgacgtatggcttgaggacatctttcaggaaag

SEQ ID NO: 274479 - DNA, 75 bp, Artificial Sequence
  Synthetic
tcaggaactgcacatggccagcaagtcacactattgataatgatggagttttagactcccatcttttcttgccag

SEQ ID NO: 274480 - DNA, 75 bp, Artificial Sequence
  Synthetic
cccggctgaaaccagagaatattgcctgcacgccaaattgaccaacacaaaagtggaggctcgttgtcctaccac

SEQ ID NO: 274481 - DNA, 75 bp, Artificial Sequence
  Synthetic
tcacccttgctgggcccaggtcaaagtacaacaggatacctgggtacagtgaacaagtaagaggaccatgggacc

SEQ ID NO: 274482 - DNA, 75 bp, Artificial Sequence
  Synthetic
cggaccggcgacacttccggaggagcatcaggctaacatggtgtgtaagagagaccaaagtgaccgcggatgggg

SEQ ID NO: 274483 - DNA, 75 bp, Artificial Sequence
  Synthetic
agactcctctgagggtggtccgggaccattgccctggaacaagtgtgaggattgacagccattgtgacaagagag

SEQ ID NO: 274484 - DNA, 75 bp, Artificial Sequence
  Synthetic
gaaccactgcgggttttttgggaaaggcagcatagtggcttgtgcaaagttcgaatgtgaggaagcaaaaaaggc

SEQ ID NO: 274485 - DNA, 75 bp, Artificial Sequence
  Synthetic
agagtggtgctgtcgggcttgtgaattaccaccggtgacattccgcaacggcacaaattgttggtatgccatgga

SEQ ID NO: 274486 - DNA, 75 bp, Artificial Sequence
  Synthetic
gagcttcagttagaagcaccacagaaagtggaaagatcattccagagtggtgctgccgggcctgtgagctaccac

SEQ ID NO: 274487 - DNA, 75 bp, Artificial Sequence
  Synthetic
tgtaggccatgtttatgactccacaaagatcacatatgttgtcaaggttgagcctcacacaggggattacctggc

SEQ ID NO: 274488 - DNA, 75 bp, Artificial Sequence
  Synthetic
agcctcacacaggggattacctggctgcaaatgagaccaactcaaacaggaagtcagcacagttcacggtggcat

SEQ ID NO: 274489 - DNA, 75 bp, Artificial Sequence
  Synthetic
cggtgacattccgtagtggcacggattgttggtacgctatggaaatcaggccagtccattcgcagggcggcttgg

SEQ ID NO: 274490 - DNA, 75 bp, Artificial Sequence
  Synthetic
tgcgttccatggtagttgctgacaatggtgccttgcttagtgagggaggagttcctggtctagtggcagtgtttg

SEQ ID NO: 274491 - DNA, 75 bp, Artificial Sequence
  Synthetic
tcgcccaaactgtggtgatgtcactcggcagcagcaaggaccacctgccttctgcatggcaggtgcatcgtgact

SEQ ID NO: 274492 - DNA, 75 bp, Artificial Sequence
  Synthetic
tattgatggaattccttttgagaaggcgtccgggatctgtcacgtccattttgtggggaggcatactaatgctgg

SEQ ID NO: 274493 - DNA, 75 bp, Artificial Sequence
  Synthetic
tctgcatggcaggtgcatcgtgactggtttgaggacttggctttgccctggaaacacaaggacaaccaagactgg

SEQ ID NO: 274494 - DNA, 75 bp, Artificial Sequence
  Synthetic
gcttgctggtcacgggtctcgtgagagtggaggagatcgtgcgctatgtcatagcagttggggtcactttccact

SEQ ID NO: 274495 - DNA, 75 bp, Artificial Sequence
  Synthetic
tggaattgggaccagagaccatggttcttgtgatgctgcaggcggtcttcaacatgcgcacatgttatctcatgg

SEQ ID NO: 274496 - DNA, 75 bp, Artificial Sequence
  Synthetic
actgccgtgctgctcaaatcgctggcaggagttccgctggccagtgtggaaggccagaaataccacctgaaaagt

SEQ ID NO: 274497 - DNA, 75 bp, Artificial Sequence
  Synthetic
ggtttcttgtcaagagggtgatcaccacacgtgaggtggtgactgtttacttcttgctattggtccttgagatgg

SEQ ID NO: 274498 - DNA, 75 bp, Artificial Sequence
  Synthetic
ggccatgtcacctgtgatgtaggattggaaaagctgaaactgaagggcacaacctactccatgtgtgacaaagca

SEQ ID NO: 274499 - DNA, 75 bp, Artificial Sequence
  Synthetic
ggataccggagatgaacttcggacacctctgggaatgggctgatgcactggccatggggttgctcataatcaagg

SEQ ID NO: 274500 - DNA, 75 bp, Artificial Sequence
  Synthetic
aagttcaaatggaagagggttcctgtggacagcggtcatgacacagtggttatggaggtgtcatacacgggaagc

SEQ ID NO: 274501 - DNA, 75 bp, Artificial Sequence
  Synthetic
ccagtgcgatggaagatcgcagaggtttgggattcttgctggctgggctcatgacacaaagacacctagtcgctg

SEQ ID NO: 274502 - DNA, 75 bp, Artificial Sequence
  Synthetic
gacaagccatgtcggatcccggtgcgggctgtggcacatggtgtcccagcggtcaatgtggccatgctcataacc

SEQ ID NO: 274503 - DNA, 75 bp, Artificial Sequence
  Synthetic
tccatcatggtttgatggtatttctcactgtggccttggcggtagtgggacggaatatctacaatggacaaaaag

SEQ ID NO: 274504 - DNA, 75 bp, Artificial Sequence
  Synthetic
cccaacccgaccattgaaacaagtggtggcggattcatagagatgcagttgccaccaggggacaacatcatctat

SEQ ID NO: 274505 - DNA, 75 bp, Artificial Sequence
  Synthetic
gccaccaggggacaacatcatctatgtgggagacctgagccagcagtggtttcagaaaggtagcactattggtag

SEQ ID NO: 274506 - DNA, 75 bp, Artificial Sequence
  Synthetic
agaggaaaggactgtgtttcacagtccccctggcctcactacttggtggctccggctccggattgcgcatgctgg

SEQ ID NO: 274507 - DNA, 75 bp, Artificial Sequence
  Synthetic
ccttgtgggaatgtcttgggggtcgtggcagacggagcctcagtgagccccttactgtggtgggggtcatgctgg

SEQ ID NO: 274508 - DNA, 75 bp, Artificial Sequence
  Synthetic
aggcgggatattgtcttctgtggggaaggcaatccacacagtgttgggaggagctttcaacaccctttttggggg

SEQ ID NO: 274509 - DNA, 75 bp, Artificial Sequence
  Synthetic
ccatggccagtggactactacgacattcatcccaagaggctcttttggccctttctgcaggatcctttctcattt

SEQ ID NO: 274510 - DNA, 75 bp, Artificial Sequence
  Synthetic
ggttggattcatccctaagatgctgctgggggtcgctctggtctggctggggctcaatgccagaaatccaacaat

SEQ ID NO: 274511 - DNA, 75 bp, Artificial Sequence
  Synthetic
tgatgctgatcctggggacccgtagactccagctaacggcggaatgggccggagtggtggagtggaaccctgagt

SEQ ID NO: 274512 - DNA, 75 bp, Artificial Sequence
  Synthetic
gtctatgacgttccttgctgtgggggctttgacattgatgatgacaatgggagttggggcagattatggatgtgc

SEQ ID NO: 274513 - DNA, 75 bp, Artificial Sequence
  Synthetic
tggtcaatgagggaggtgaggtaagcttgaaggtcagacaggatgccatggggaacttgcacttgacagaggtgg

SEQ ID NO: 274514 - DNA, 75 bp, Artificial Sequence
  Synthetic
aattgacccagaaaggatggaaatccgttgtggagaggggcttgttgtgtggaaagaggtgtcagaatggtatga

SEQ ID NO: 274515 - DNA, 75 bp, Artificial Sequence
  Synthetic
aacgggaggagcgtcgtttggccttatggcttgtgttcggcctactggcatcggcttatcattggtccggaatat

SEQ ID NO: 274516 - DNA, 75 bp, Artificial Sequence
  Synthetic
agcacgcagaactgaccttgtattctcagggcaattgtctgaccatggggagaaacggccttttgacatcaaaga

SEQ ID NO: 274517 - DNA, 75 bp, Artificial Sequence
  Synthetic
cggttacgcttatcatccagaatcacctgacacgcttgcacaggcccttagagaggcatttgaaagaggtgtctg

SEQ ID NO: 274518 - DNA, 75 bp, Artificial Sequence
  Synthetic
tggtcacaatgggggcttggacagtttatgagctcttctcatccacgcggagaactgacctggttttttcagggc

SEQ ID NO: 274519 - DNA, 75 bp, Artificial Sequence
  Synthetic
ttggagtggggtatggagcaaaaggagtcctacacaccatgtggcatgtgacaagaggagcggctcttagtgtgg

SEQ ID NO: 274520 - DNA, 75 bp, Artificial Sequence
  Synthetic
agttgcctgaccaaggggaaaaacgttcctttgacatcaaggaaggcgtataccgcatatacgcccctgggctct

SEQ ID NO: 274521 - DNA, 75 bp, Artificial Sequence
  Synthetic
tggggtcgtgccccaaaacagacttgaaatggccatgtggagaagtactgccccagaactcaatttggtgttgag

SEQ ID NO: 274522 - DNA, 75 bp, Artificial Sequence
  Synthetic
tgagggagaagcaaacctgaccattgtggtggacaaaacagatccggcagactacagaggaggcacccccatggt

SEQ ID NO: 274523 - DNA, 75 bp, Artificial Sequence
  Synthetic
tctggggttaccgccagataggcgtgggatatggaacgaaaggagtcttacacaccatgtggcatgtgacaagag

SEQ ID NO: 274524 - DNA, 75 bp, Artificial Sequence
  Synthetic
agtcctacacaccatgtggcatgtgacaagaggagcggctcttagtgtggaaggggccgtctcgggaccatattg

SEQ ID NO: 274525 - DNA, 75 bp, Artificial Sequence
  Synthetic
tctaaagaaaactggaaaagagagcaaggtgtcttggaagagctggggcaagtcaatcttgtggagtgttcccga

SEQ ID NO: 274526 - DNA, 75 bp, Artificial Sequence
  Synthetic
gagccgccctcagcgtggagggggccacatcaggaccatactgggcggatgtgcgtgaagacgtggtctgctatg

SEQ ID NO: 274527 - DNA, 75 bp, Artificial Sequence
  Synthetic
cagccccaggcgtatgatgatgggggttgacggagtcggggagtgtcccctgtataagagagctacaggagtgtt

SEQ ID NO: 274528 - DNA, 75 bp, Artificial Sequence
  Synthetic
ggggggcctggggcttggacaaaaaatggggaggcgaagtcgttcaggtacacgcattccctccggacagtggac

SEQ ID NO: 274529 - DNA, 75 bp, Artificial Sequence
  Synthetic
cacagtggcagaatttggtgtgggcctacgcacgaaagttttcttggacctgcgtggtgacgcctcaaaagagtg

SEQ ID NO: 274530 - DNA, 75 bp, Artificial Sequence
  Synthetic
acaaaatccatcaatgccagccaggaaagctgaaccttgagggggggagagttctgggggccatcccgatagacc

SEQ ID NO: 274531 - DNA, 75 bp, Artificial Sequence
  Synthetic
tgacacaggagtgatgggagcagccgtgaagaatggcaaagccatccacacggaccaaagcatgtggatgagctc

SEQ ID NO: 274532 - DNA, 75 bp, Artificial Sequence
  Synthetic
tcccacgtggtacttcaggtagcccaatcatcaatgcacagggagatgtgctgggtctgtacggcaatggtctga

SEQ ID NO: 274533 - DNA, 75 bp, Artificial Sequence
  Synthetic
ctttcggaatgacacgggcacgtacatccatgagctcattctcaccgacctcaggaattgtacatggccagcaag

SEQ ID NO: 274534 - DNA, 75 bp, Artificial Sequence
  Synthetic
aatcaaatgatgtttacatcagtagcattgctcagggcagtgttgaaaagagtcgccctgagatgccattggcag

SEQ ID NO: 274535 - DNA, 75 bp, Artificial Sequence
  Synthetic
agtcgccctgagatgccattggcagtccagggtggcaaatggacatctaagggcagcatcacacttttggatatg

SEQ ID NO: 274536 - DNA, 75 bp, Artificial Sequence
  Synthetic
tcacactatcgacaatgatggagttgtggactcccatcttttcctgccagttacccttgctgggcctaggtcaaa

SEQ ID NO: 274537 - DNA, 75 bp, Artificial Sequence
  Synthetic
catcccgggtcgggaaagacacacagagtccttcccgaactgattcgtgagtgcattgacaaaaggttgaggact

SEQ ID NO: 274538 - DNA, 75 bp, Artificial Sequence
  Synthetic
gtataacaggatacctgggtacagtgaacaaacaaaaggaccatgggaccagactcctctcagagtggtccggga

SEQ ID NO: 274539 - DNA, 75 bp, Artificial Sequence
  Synthetic
gttgtattggcgccaacacgggtggtcctgaaggaaatggaaagggccttgcaggggaaacgtgtcaagtttcat

SEQ ID NO: 274540 - DNA, 75 bp, Artificial Sequence
  Synthetic
ccattgccccggaacaagtgtgaggattgacagtcattgtgacaagagaggagcctcagttagaagcaccacaga

SEQ ID NO: 274541 - DNA, 75 bp, Artificial Sequence
  Synthetic
ttgatgtcatgtgccacgccacttatgtcaatcgccgactcttgccacaggggaaacaaaattgggaggtggcca

SEQ ID NO: 274542 - DNA, 75 bp, Artificial Sequence
  Synthetic
tcggcagcagttgacaatgcttcttcatcatcgggagctattgttgatgtcatgtgtcatgccacctacgtcaac

SEQ ID NO: 274543 - DNA, 75 bp, Artificial Sequence
  Synthetic
aagtggaaagatcattccagagtggtgctgtcgggcctgtgagctaccaccagtgacgttccgcagtggtacgga

SEQ ID NO: 274544 - DNA, 75 bp, Artificial Sequence
  Synthetic
cgccggctcttgccacaagggagacagaactgggaggtggccataatggatgaggcacattggaccgacccacac

SEQ ID NO: 274545 - DNA, 75 bp, Artificial Sequence
  Synthetic
ttgctggtatgccatggagatcaggccagtccactcgcagggtggcctggtgcgatccatggtcgtggctgacaa

SEQ ID NO: 274546 - DNA, 75 bp, Artificial Sequence
  Synthetic
agcatagctgcccgaggccatctttactccttggccaaggagaacagatgtgcactcgtgctgatgactgctacc

SEQ ID NO: 274547 - DNA, 75 bp, Artificial Sequence
  Synthetic
cggcgccttgcttagtgagggaggaatccctggtttggtggcagtgttcgtattgatggaattccttttgagaag

SEQ ID NO: 274548 - DNA, 75 bp, Artificial Sequence
  Synthetic
ccacctggcaagagcgaggcgttccctgaatccaaaggagccatagtgagtgaggaaaaacccattcccgaagga

SEQ ID NO: 274549 - DNA, 75 bp, Artificial Sequence
  Synthetic
gcgtccgggatccgtcatgtccatcttgtggggaggcatattaatgctgggcttgttggtcacaggtctcgtgag

SEQ ID NO: 274550 - DNA, 75 bp, Artificial Sequence
  Synthetic
gagtggagagatggctttgattggataacagaatttgagggtcgaacagcctggtttgtgccatcgatagccaag

SEQ ID NO: 274551 - DNA, 75 bp, Artificial Sequence
  Synthetic
agtggaggagatcgtgcgctacatcatagcagttgggatcactttccacttggaattaggaccagagactatggt

SEQ ID NO: 274552 - DNA, 75 bp, Artificial Sequence
  Synthetic
ggaggcgccatagcacggacactgagacagaaagggaaaagcgtgatctgtctgaacagtaagacctttgacaag

SEQ ID NO: 274553 - DNA, 75 bp, Artificial Sequence
  Synthetic
tcttgtgatgctgcaggcggttttcaacatgcgtacatgttatctcatggggtttcttgtcaagaaggtgatcac

SEQ ID NO: 274554 - DNA, 75 bp, Artificial Sequence
  Synthetic
ggtttcttgtcaagaaggtgatcaccacacgcgaggtggtgactgtttacttcttgctcctggtccttgagatgg

SEQ ID NO: 274555 - DNA, 75 bp, Artificial Sequence
  Synthetic
gattatggcagagtccatgaggaaaaacctgacttcgtcgtgacaactgacatctcagaaatgggggccaatcta

SEQ ID NO: 274556 - DNA, 75 bp, Artificial Sequence
  Synthetic
gatgttaatcgggtcatagatggtagaactaacatcaaacccgaggagatagatggaaaggtggaattgattggc

SEQ ID NO: 274557 - DNA, 75 bp, Artificial Sequence
  Synthetic
agatggaaaggtggaattgattggcacgagacgagtgacgacagcatcagctgcgcaacgcagagggcgagttgg

SEQ ID NO: 274558 - DNA, 75 bp, Artificial Sequence
  Synthetic
ccagtgcgatggaagatcgtagaggcctgggatttttgctggctgggctcatgacacaaagacatctggtcgctg

SEQ ID NO: 274559 - DNA, 75 bp, Artificial Sequence
  Synthetic
aaggcatgaaggacgcacggacctctatgtgtattctgggcagtgtgatgatgatgacagctccttagtgcagtg

SEQ ID NO: 274560 - DNA, 75 bp, Artificial Sequence
  Synthetic
tccatcatggcttgatagtatttctcactgtggctctggcggtggtgggacgaaatatttacaatggacaaaaag

SEQ ID NO: 274561 - DNA, 75 bp, Artificial Sequence
  Synthetic
gaaagaagcgcagattctgcttgacaacattactacagtgagaggaccagttgccactttttatggtccagagca

SEQ ID NO: 274562 - DNA, 75 bp, Artificial Sequence
  Synthetic
agaggaaaggactgtgtttcacaatccccctggcctcactgcttggtggctccggctccggattgcgcatgctgg

SEQ ID NO: 274563 - DNA, 75 bp, Artificial Sequence
  Synthetic
agggaaaatgctcgaggtggcggggcacttccgcttgacggaggaaaaaagaaagcacttccggcaccttctgac

SEQ ID NO: 274564 - DNA, 75 bp, Artificial Sequence
  Synthetic
ccttatggaaatgtcttgggggtcgtggcagacggagtctcagtgagccccttactgtagtgggggttatgttgg

SEQ ID NO: 274565 - DNA, 75 bp, Artificial Sequence
  Synthetic
aaactgtgacttcacgccctggctcgcatggcacgtggctgcaaacactgcctgtgtgacggaccggaaatggac

SEQ ID NO: 274566 - DNA, 75 bp, Artificial Sequence
  Synthetic
atggggctgagcggaatttgaaaccagtctggaaagacagtagaatgttccgggaaggaagggatctggcaaact

SEQ ID NO: 274567 - DNA, 75 bp, Artificial Sequence
  Synthetic
ctgggaaggtcccgacgagaatgccattgatggtccaggcggcgaactggtcacgttcagaagccccaatggagc

SEQ ID NO: 274568 - DNA, 75 bp, Artificial Sequence
  Synthetic
tgatgttgatcctggggacccgtagactccagctgacggcggaatgggccggagtggtggagtgggaccctgagc

SEQ ID NO: 274569 - DNA, 75 bp, Artificial Sequence
  Synthetic
ttctccaatacgcttctggccgcaggagtgccatggacatcttcactggacttggtggagtaccggacttgttgc

SEQ ID NO: 274570 - DNA, 75 bp, Artificial Sequence
  Synthetic
ggaacggaagctgaagccaatctggaaggacagtagaatgttccgggaggggagagatgtggcagacttcatcca

SEQ ID NO: 274571 - DNA, 75 bp, Artificial Sequence
  Synthetic
tggtcaatgaaggaggtgaggtgagcttgaaggtcagacaggatgccatggggaacttgcacctgacagaggtag

SEQ ID NO: 274572 - DNA, 75 bp, Artificial Sequence
  Synthetic
gtacgcttccggtcgtaggagtgccgtggacatcctgactggacttggtggagtcccagacctgctgcggttgcg

SEQ ID NO: 274573 - DNA, 75 bp, Artificial Sequence
  Synthetic
aacgggaggaacgccgtttggccttatggcttgtgttcggcctactggcatcggcctatcactggtccggaatac

SEQ ID NO: 274574 - DNA, 75 bp, Artificial Sequence
  Synthetic
ctgcacagcggcgtgggatgttgtctacacacttctcaatgagaccccagggagtcgagccatgaaaatggcgga

SEQ ID NO: 274575 - DNA, 75 bp, Artificial Sequence
  Synthetic
tggtcacaatgggggcttggacagcttacgaacttttctcatccacgcggagaactgatttggtcttctcagggc

SEQ ID NO: 274576 - DNA, 75 bp, Artificial Sequence
  Synthetic
gagagatgctcctgaggcgatgctgacatttttggaggtagcggttctgggcatcgccacactgggggtggtttg

SEQ ID NO: 274577 - DNA, 75 bp, Artificial Sequence
  Synthetic
agttgcctgatcaaggggaaaaacgttcttttgacatcaaggaaggtgtgtaccgtatatatgcccccgggctct

SEQ ID NO: 274578 - DNA, 75 bp, Artificial Sequence
  Synthetic
gtgtttcattgtccggacgtcagtcagcagaatggttctgggcaccctggtgttggcagtggctctcatcctgtt

SEQ ID NO: 274579 - DNA, 75 bp, Artificial Sequence
  Synthetic
tctggggttatcgccagataggtgtgggatatggaacaaaaggagtcttgcacaccatgtggcatgtaacaagag

SEQ ID NO: 274580 - DNA, 75 bp, Artificial Sequence
  Synthetic
gtggttgggaggaatggactatggaaccatggcaggagtggctctcatcttctatttgctcctcacggtactgca

SEQ ID NO: 274581 - DNA, 75 bp, Artificial Sequence
  Synthetic
gagccgccctcagtgtggagggggccatatcaggaccatactgggcggatgtacgtgaagatgtggtctgttatg

SEQ ID NO: 274582 - DNA, 75 bp, Artificial Sequence
  Synthetic
accagaaccgggaaagcagcgtagtggagaggataaccgactggccttcctgttgattggactggggagcgtggt

SEQ ID NO: 274583 - DNA, 75 bp, Artificial Sequence
  Synthetic
ggggggcctggggcttggacaaaaaatggggaggtgaagtcgttcaggtacatgcattccctccggacagtggac

SEQ ID NO: 274584 - DNA, 75 bp, Artificial Sequence
  Synthetic
gggccttgtggcagccaatgagctgggctatctggaacaaacgaaaactgacatttcaggactctttagacgtga

SEQ ID NO: 274585 - DNA, 75 bp, Artificial Sequence
  Synthetic
ataaaatccatcaatgccagccagggaagttaaaccttgagggagggagagttctgggggccatcccgatagatc

SEQ ID NO: 274586 - DNA, 75 bp, Artificial Sequence
  Synthetic
ggaccagggagggatggtttgggacgcatggacgaacatcgacatacagcctgcccgatcctggggaacttatgt

SEQ ID NO: 274587 - DNA, 75 bp, Artificial Sequence
  Synthetic
ttccacgcggcacttcaggcagcccgatcattaatgcacagggagatgtgctgggtctgtacggcaatggtctga

SEQ ID NO: 274588 - DNA, 75 bp, Artificial Sequence
  Synthetic
gctcattgtctccctctttactccatatatgctccatcagctacaaacaaaaatccagaggctggtgaacagctc

SEQ ID NO: 274589 - DNA, 75 bp, Artificial Sequence
  Synthetic
aatcaaatgatgtctacatcagtagtatcgctcagggcaatgtcgaaaagagtcgccctgagatgccactggcag

SEQ ID NO: 274590 - DNA, 75 bp, Artificial Sequence
  Synthetic
agtcgccctgagatgccactggcagttcagggtggcagatggacatcaaaaggcagcatcacagttttggatatg

SEQ ID NO: 274591 - DNA, 75 bp, Artificial Sequence
  Synthetic
agttgcagcgggaacacaggccatgagagaccttgggggaggcaccccattctttggtgtagctggacatgtcgt

SEQ ID NO: 274592 - DNA, 75 bp, Artificial Sequence
  Synthetic
ggcactcggtgtgacctctttggtaggagcgacgcccacctcccttgcattgggtgttgccttggctgccctcca

SEQ ID NO: 274593 - DNA, 75 bp, Artificial Sequence
  Synthetic
gttgtattggctccaacaagggtcgtccttaaggaaatggaaaaggccttgcaggggaaacgtgtcaagtttcat

SEQ ID NO: 274594 - DNA, 75 bp, Artificial Sequence
  Synthetic
tttggccgtggtcacatctgggctggaggctgaactgacccagagggcgcaccgggcatttttctcagccatggt

SEQ ID NO: 274595 - DNA, 75 bp, Artificial Sequence
  Synthetic
tcggcggcagttgacagtgcttcttcatcctcgggagccattgtagatgttatgtgccacgctacctacgtcaac

SEQ ID NO: 274596 - DNA, 75 bp, Artificial Sequence
  Synthetic
aaagaatccaatggtggatggagagatcatcaaccccattccggatggagacccaaaaccagctttgtatgagag

SEQ ID NO: 274597 - DNA, 75 bp, Artificial Sequence
  Synthetic
gaagatgagtttgtttctcgccatcggcctgtgcatagcggccgtagccttgaacaggactgccgcggcgatgac

SEQ ID NO: 274598 - DNA, 75 bp, Artificial Sequence
  Synthetic
agcatagctgcccgaggccatctttattccttggctaaggagaacagatgtgcactcgtgctgatgacagccacc

SEQ ID NO: 274599 - DNA, 75 bp, Artificial Sequence
  Synthetic
tgaacaggactgccgcggcgatgacagaagctggcgcagtggctgtggcggctttgggacagttgctgaggcccg

SEQ ID NO: 274600 - DNA, 75 bp, Artificial Sequence
  Synthetic
aagaggagagctggtggaccatgcccatggcttgcggaatggctggactggtgcggggaagcctatggggcttac

SEQ ID NO: 274601 - DNA, 75 bp, Artificial Sequence
  Synthetic
gagtggagagatggctttgattggataacggaatttgagggccgaacagcctggttcgtaccatcgatagccaag

SEQ ID NO: 274602 - DNA, 75 bp, Artificial Sequence
  Synthetic
tgccagttcttcaccgcatctggctcagaacccagggagctagaaggggtggagcagagggaagcacccttggtg

SEQ ID NO: 274603 - DNA, 75 bp, Artificial Sequence
  Synthetic
ggaggcgctatagcgcggacattaagacagaaagggaaaagcgtgatctgtctaaacagcaagacttttgacaag

SEQ ID NO: 274604 - DNA, 75 bp, Artificial Sequence
  Synthetic
acatttggaagcagcggctgaactcatgcaccaaagaagaattttttgcctacaggcgcacaggggtcatggaga

SEQ ID NO: 274605 - DNA, 75 bp, Artificial Sequence
  Synthetic
gattatggcagagtccatgaggaaaaacctgacttcgttgtgacaactgacatttcagaaatgggggccaatctg

SEQ ID NO: 274606 - DNA, 75 bp, Artificial Sequence
  Synthetic
caaaccgagaccaagctcgtgaattgcttcgccgaggtgagactaacatggggttggcagtatcgcgaggctgtg

SEQ ID NO: 274607 - DNA, 75 bp, Artificial Sequence
  Synthetic
gatgttaatcgggtcatagatggtagaaccaacatcaagcccgaggagatagatggaaaggtggaattgactggc

SEQ ID NO: 274608 - DNA, 75 bp, Artificial Sequence
  Synthetic
ccaaactagcttggctagaggaaagggggtacgcgacactcaaaggagaggttgtggaccttggttgtggaaggg

SEQ ID NO: 274609 - DNA, 75 bp, Artificial Sequence
  Synthetic
agatggaaaggtggaattgactggcacaagacgagtgacaacagcatcagcagcacaacgtagagggcgagttgg

SEQ ID NO: 274610 - DNA, 75 bp, Artificial Sequence
  Synthetic
ggggctggtcatattatgccgcctcaagaccatccgtcatggctgtgagagcttacaccattggagggaagggcc

SEQ ID NO: 274611 - DNA, 75 bp, Artificial Sequence
  Synthetic
atgaagcaccacgccttgtgacgagtcttggatggaatctcataaagttcaggagtgggatggatgtgttctcaa

SEQ ID NO: 274612 - DNA, 75 bp, Artificial Sequence
  Synthetic
gaaagaagcgcagattctacttgataacatcactacagtgagaggaccagttgccactttttatggtccagagca

SEQ ID NO: 274613 - DNA, 75 bp, Artificial Sequence
  Synthetic
tggcgaccacaagagcagacacaatcttgtgtgacattggggagagcagtccagatccggagaaggaaggggctc

SEQ ID NO: 274614 - DNA, 75 bp, Artificial Sequence
  Synthetic
ggggaaaatgctcgaggtggcggggcacttccgcttgacggaggagaaaagaaaacacttccggcaccttctgac

SEQ ID NO: 274615 - DNA, 75 bp, Artificial Sequence
  Synthetic
aaactgcgactttacaccttggctcgcatggcatgtggctgcaaacaccgcctgtgtgacggatcggaaatggac

SEQ ID NO: 274616 - DNA, 75 bp, Artificial Sequence
  Synthetic
tggccccgtataggccagaggtgctcgaggctttgcacagatttcagctacaatgggggggggggcttgtgagag

SEQ ID NO: 274617 - DNA, 75 bp, Artificial Sequence
  Synthetic
ctgggaaggtcccgatgagaatgccatcgatggtccaggcggcgaattgattactttcagaagccccaatggggc

SEQ ID NO: 274618 - DNA, 75 bp, Artificial Sequence
  Synthetic
tccctttctcacggaattccacccatgaaatgtactattccacggccgtcacaggaaatcttgttaattcagtca

SEQ ID NO: 274619 - DNA, 75 bp, Artificial Sequence
  Synthetic
acaggaaatcttgttaattcagtcaatgtgctctcgcggaagctcctggctagatttggggagacgagaggaccc

SEQ ID NO: 274620 - DNA, 75 bp, Artificial Sequence
  Synthetic
gtatgcatctggtcgtaggagcgccatggacatcctgactggacttggtggagtcccagatctgctgcggttgcg

SEQ ID NO: 274621 - DNA, 75 bp, Artificial Sequence
  Synthetic
atccaggtgcctgagatcgacctgggaactggaaccaggtgtgtgacgctagctgaggacaaagtgaagcccagg

SEQ ID NO: 274622 - DNA, 75 bp, Artificial Sequence
  Synthetic
ctgcacggcggcatgggatgttgtctacacactgctcaatgagaccccagggagtcgcgccatgaaaatggcgga

SEQ ID NO: 274623 - DNA, 75 bp, Artificial Sequence
  Synthetic
gacgtggcggagcgcattggagccttgagggaacagtactcagagtcgtggcacgaagacaaagaacatccctac

SEQ ID NO: 274624 - DNA, 75 bp, Artificial Sequence
  Synthetic
aagagatgctcctgaggcgatgctgacacttctggaagtggcggttttgggcatcgccacactaggggtggtctg

SEQ ID NO: 274625 - DNA, 75 bp, Artificial Sequence
  Synthetic
cggacatggcaatactggggcagctatcgcactccggctaccggatcagcggcatccctgatcaacggagtggtg

SEQ ID NO: 274626 - DNA, 75 bp, Artificial Sequence
  Synthetic
gtgtttcattgttcggacgtcagtcagcagaatggtcttaggtaccctggtgctggtggtggctctcatcctgtt

SEQ ID NO: 274627 - DNA, 75 bp, Artificial Sequence
  Synthetic
aagctgctaagctggccttggaatgcacgggaggatgttatcagaatggccatgacagacacaacggcctttggg

SEQ ID NO: 274628 - DNA, 75 bp, Artificial Sequence
  Synthetic
gtggttggggggaatggactacggaaccatggcaggagtggctctcatcttctatctgctcctcacagtactgca

SEQ ID NO: 274629 - DNA, 75 bp, Artificial Sequence
  Synthetic
cagcagcgagttttcaaagaaaaggttgacacaaaggcccaagagccgcagccaggcaccagagtgatcatgaga

SEQ ID NO: 274630 - DNA, 75 bp, Artificial Sequence
  Synthetic
accagaaccggggaagcagcgtagtggagaggacaaccgactggctttcctgttgattgggctagggagtgtggt

SEQ ID NO: 274631 - DNA, 75 bp, Artificial Sequence
  Synthetic
gctgtgagtgactggctgttggagcatctaagccgccgagccaaagtgaggatgtgtaccaaagatgagttcata

SEQ ID NO: 274632 - DNA, 75 bp, Artificial Sequence
  Synthetic
gggccttgtggcggccaatgagctgggctatttggaacaaacgaaagctgacatctcaggactcttcagacgtga

SEQ ID NO: 274633 - DNA, 75 bp, Artificial Sequence
  Synthetic
gcgaaggtgaggtccaacgctgctctaggtgcatggtcggatgaacagaataagtggagctcggcaaaagaggca

SEQ ID NO: 274634 - DNA, 75 bp, Artificial Sequence
  Synthetic
ggaccagggagggatggtttgggatgcatggacgaacattgacatacagcccgcccgatcctggggaacctatgt

SEQ ID NO: 274635 - DNA, 75 bp, Artificial Sequence
  Synthetic
gtggaagatccagaattttggaaattggtggatgaagagcgctccagacacttgaaaggtcagtgccgacattgt

SEQ ID NO: 274636 - DNA, 75 bp, Artificial Sequence
  Synthetic
gctcatcgtctcccttttcactccatacatgctccatcagctgcaaacaaaaatccagaggctggtgaacagctc

SEQ ID NO: 274637 - DNA, 75 bp, Artificial Sequence
  Synthetic
gtgtacaacatgatgggaaagagagagaagaagctaggtgagtttggagttgcaaaaggtagcagggccatctgg

SEQ ID NO: 274638 - DNA, 75 bp, Artificial Sequence
  Synthetic
agttgcagcaggaacacaggctatgagggatcttggtggaggcaccccattttttggtgtagctggacatgtcgt

SEQ ID NO: 274639 - DNA, 75 bp, Artificial Sequence
  Synthetic
tacatgtggcttggaagccgcttccttgagtttgaggtccttgggtttcttaatgaggagcattgggcttccaga

SEQ ID NO: 274640 - DNA, 75 bp, Artificial Sequence
  Synthetic
ggcactcggtgtgacctctttggtaggagcgacgcccacttctctcgcattgggagttgctctggccgccctcca

SEQ ID NO: 274641 - DNA, 75 bp, Artificial Sequence
  Synthetic
gaggtgagtggagctggggtggaaggaactagtctcaactatctgggctggctgctaagagaacttggaatgaaa

SEQ ID NO: 274642 - DNA, 75 bp, Artificial Sequence
  Synthetic
cttggccgttgttacatctgggctggaggctgagttgacccaaagggcgcaccgagcttttttctcagccatggt

SEQ ID NO: 274643 - DNA, 75 bp, Artificial Sequence
  Synthetic
gacggtggcaaactgtacgccgacgataccgctggctgggacactcgggtcaccaatgcagatttggaagatgaa

SEQ ID NO: 274644 - DNA, 75 bp, Artificial Sequence
  Synthetic
gagcagatccttcggtacatggaaggagaacaccatgtgctggcaaaaacaatacttgaaaaggcttaccatgcc

SEQ ID NO: 274645 - DNA, 75 bp, Artificial Sequence
  Synthetic
gaagatgagtttgtttctcgccatcggcttgtgcatggctgccgttgccttgaacaggactgccgcggcgatgac

SEQ ID NO: 274646 - DNA, 75 bp, Artificial Sequence
  Synthetic
aatacttgaaaaggcttaccatgccaaagtggtcaaggttgccaggccctcaccccaagggggatgtgtgatgga

SEQ ID NO: 274647 - DNA, 75 bp, Artificial Sequence
  Synthetic
tgaacaggactgccgcggcgatgacagaagctggcgcagtggccgtggctgctttgggacagttgctgaggcctg

SEQ ID NO: 274648 - DNA, 75 bp, Artificial Sequence
  Synthetic
cgtgatcacaaggagagaccagaggggatcaggacaggtcgtcacatacgccctcaacaccatcacaaacatgaa

SEQ ID NO: 274649 - DNA, 75 bp, Artificial Sequence
  Synthetic
agtccaactcatccgcatgatggaaggagaaggagtcataggaccagctgactcacaggaccctcgtctgaaaag

SEQ ID NO: 274650 - DNA, 75 bp, Artificial Sequence
  Synthetic
tgccagtccttcaccgcatctggctcagaacccagggagctagaaggggtggggcagagggaagtacccttggtg

SEQ ID NO: 274651 - DNA, 75 bp, Artificial Sequence
  Synthetic
ggtagaaacctggttgaaggagcacggagttgaaagactagggaggatgcttgtgagtggagatgattgtgtcgt

SEQ ID NO: 274652 - DNA, 75 bp, Artificial Sequence
  Synthetic
acatctggaagcagcggctgaacgcatgcaccaaagaagaattttttgcctatagacgcacaggggtcatggaga

SEQ ID NO: 274653 - DNA, 75 bp, Artificial Sequence
  Synthetic
caagcccatcgatgacaggttcggaaaggcgctgtacttcctgaatgacatggccaaggttcgtaaggatgtggg

SEQ ID NO: 274654 - DNA, 75 bp, Artificial Sequence
  Synthetic
caaatcgagaccaagctcgtgaattgcttcgccgaggtgagaccaacatggggttggcagtatcacgaggctgtg

SEQ ID NO: 274655 - DNA, 75 bp, Artificial Sequence
  Synthetic
ccttatagtgccctgcagagatcaagacgagctggtcggcagagcacgagtgtcgccaggatgtggatggagcgt

SEQ ID NO: 274656 - DNA, 75 bp, Artificial Sequence
  Synthetic
agagtgggagccctcgatgggcttcacagagtgggaggaggtccctttctgttcacatcacttccatgaacttgt

SEQ ID NO: 274657 - DNA, 75 bp, Artificial Sequence
  Synthetic
ctaaacttgcctggctagaaggaagggggtacgcgacactcaaaggagaggttgtggaccttggctgcggaaggg

SEQ ID NO: 274658 - DNA, 75 bp, Artificial Sequence
  Synthetic
gatgaaggatggacgctctctcatagtgccatgcagagaccaagatgagctggttggcagggcaagggtgtcacc

SEQ ID NO: 274659 - DNA, 75 bp, Artificial Sequence
  Synthetic
ggggctggtcatactatgccgcctcaagaccatccgtcatggctgtgagagcttacactattggagggaagggcc

SEQ ID NO: 274660 - DNA, 75 bp, Artificial Sequence
  Synthetic
aggatgtggatggagtgtgcgagagacggcctgcctgtccaaggcgtacgggcagatgtggcttctcaactactt

SEQ ID NO: 274661 - DNA, 75 bp, Artificial Sequence
  Synthetic
atgaggcgccacgccttgtgacgagccttggatggaatctcataaagtttaggagtgggatggatgtgttctcaa

SEQ ID NO: 274662 - DNA, 75 bp, Artificial Sequence
  Synthetic
tcatcgcagagaccttcgcacccttggtttcgccatatgttctgctgttcccgtgagttgggttcccatgggacg

SEQ ID NO: 274663 - DNA, 75 bp, Artificial Sequence
  Synthetic
tggcgactacaagagcagacacgatcttgtgtgacattggggagagcagtccggatccagagaaggaaggggctc

SEQ ID NO: 274664 - DNA, 75 bp, Artificial Sequence
  Synthetic
caccacttggagcatccacgcgagtggtgaatggatgacaacagaagacatgctgcgcatctggaacaaagtctg

SEQ ID NO: 274665 - DNA, 75 bp, Artificial Sequence
  Synthetic
ggtgaatggatgacaacagaagacatgctgcgcatctggaacaaagtctggattttggacaaccctcacatggaa

SEQ ID NO: 274666 - DNA, 75 bp, Artificial Sequence
  Synthetic
ggagccgaagagtgattcttctgatggaacaatggaaagccagaaacccagacgccgctgccgtcttcaaagtgc

SEQ ID NO: 274667 - DNA, 75 bp, Artificial Sequence
  Synthetic
gataagcagacagtggatgagtggagagacatcccctatctgccaaaaacacaggacctggtatgttcctcactt

SEQ ID NO: 274668 - DNA, 75 bp, Artificial Sequence
  Synthetic
tggccccgtatagaccagaggtgctcgaggccctgcaccgatttcagctacaatggggaggggggcttgtgagag

SEQ ID NO: 274669 - DNA, 75 bp, Artificial Sequence
  Synthetic
gttgggagaaaggagagggcagaatgggctaagaacatctggggctcagtggagaaggtcaggaagctcattgga

SEQ ID NO: 274670 - DNA, 75 bp, Artificial Sequence
  Synthetic
tccctttctcacggaattccacacatgaaatgtattactccacggccgtcacgggaaacctcgttaattcggtca

SEQ ID NO: 274671 - DNA, 75 bp, Artificial Sequence
  Synthetic
acgggaaacctcgttaattcggtcaatgtgctctcacggaaactcttggccagatttggggagacgagaggaccc

SEQ ID NO: 274672 - DNA, 75 bp, Artificial Sequence
  Synthetic
ccagaagactacagagactacttatcaagcatggacagacatgacctgcactgggagctcaagctagagagctcg

SEQ ID NO: 274673 - DNA, 75 bp, Artificial Sequence
  Synthetic
attcaggtgcctgagatcgacctgggaactggaaccaggtgtgtgacgctagctgaggacaaggtgaaacccagg

SEQ ID NO: 274674 - DNA, 75 bp, Artificial Sequence
  Synthetic
agagagctcgataatctaaactagcatgactgaacagtcaaaagaaccctaacacaggggatggtgtggcagcgc

SEQ ID NO: 274675 - DNA, 75 bp, Artificial Sequence
  Synthetic
ggtgctttagtcagtgtccgcagcgttctgttgaacgtgagtgtgttgagaaaaagacagcttaggagaacaaga

SEQ ID NO: 274676 - DNA, 75 bp, Artificial Sequence
  Synthetic
gatgtggcggagcgcattggagccttgagggaacagtactcagagtcatggcacgaggacacagaacatccttac

SEQ ID NO: 274677 - DNA, 75 bp, Artificial Sequence
  Synthetic
ttctgttgaacgtgagtgtgttgagaaaaagacagcttaggagaacaagagctgggagtggttatgatgaccact

SEQ ID NO: 274678 - DNA, 75 bp, Artificial Sequence
  Synthetic
gctcccgacgcagttaggtcagagaaaattttgtgagaccaaaaggcctcctggaaggctcaccaggagttaggc

SEQ ID NO: 274679 - DNA, 75 bp, Artificial Sequence
  Synthetic
cgaacatggcaatactggggcagttatcgcactccggccaccggatcagcggcatccctgatcaatggagtggtg

SEQ ID NO: 274680 - DNA, 75 bp, Artificial Sequence
  Synthetic
aagctgctaagctggccttggaatgcacgggaggatgtcaccagaatggccatgacagacacaacggcttttgga

SEQ ID NO: 274681 - DNA, 75 bp, Artificial Sequence
  Synthetic
cagcaacgagttttcaaggagaaagttgacacaaaagcccaagagccacagccaggcaccagagtgattatgaga

SEQ ID NO: 274682 - DNA, 75 bp, Artificial Sequence
  Synthetic
actgggggggcggttcttgttctccctgagccaccgccatccaggcacagatagcctgacaaggagatggtgagt

SEQ ID NO: 274683 - DNA, 75 bp, Artificial Sequence
  Synthetic
gctgtgagtgactggctattggagtaccttagccgccgagccaaagtgaggatgtgtaccaaagaggagttcata

SEQ ID NO: 274684 - DNA, 75 bp, Artificial Sequence
  Synthetic
gcgaaggtgaggtccaacgctgctctaggcgcttggtcggatgaacagaacaagtggagctcggcaaaagaggca

SEQ ID NO: 274685 - DNA, 75 bp, Artificial Sequence
  Synthetic
gtggaagacccagagttttggaaattggtggaagaagaacgctccagacacttgaaaggccaatgccgacattgt

SEQ ID NO: 274686 - DNA, 75 bp, Artificial Sequence
  Synthetic
gtgtataacatgatgggaaagagagagaagaagctaggtgagtttggagtggcaaagggcagcagggctatttgg

SEQ ID NO: 274687 - DNA, 75 bp, Artificial Sequence
  Synthetic
tacatgtggcttggaagccgcttccttgagtttgaggtccttgggtttcttaatgaggagcattgggcctctaga

SEQ ID NO: 274688 - DNA, 75 bp, Artificial Sequence
  Synthetic
gaggtgagcggcgctggggttgaagggactagtctcaactatctgggctggctgctaagggaacttggaatgaaa

SEQ ID NO: 274689 - DNA, 75 bp, Artificial Sequence
  Synthetic
gacggaggcaagctgtacgctgatgacaccgctggctgggacacccggatcactaatgctgatttggaggatgaa

SEQ ID NO: 274690 - DNA, 75 bp, Artificial Sequence
  Synthetic
gagcagatcctccggtacatggaaggagaacaccatgtgctggcaaaaacaatacttgaaaaagcctaccatgcc

SEQ ID NO: 274691 - DNA, 75 bp, Artificial Sequence
  Synthetic
aatacttgaaaaagcctaccatgccaaagtggttaaggttgccaggccctcaccccaagggggatgtgtaatgga

SEQ ID NO: 274692 - DNA, 75 bp, Artificial Sequence
  Synthetic
agtccagctcatccgcatgatggaaggagagggagtcataggaccagctgactcacaggaccctcgcctgaaaag

SEQ ID NO: 274693 - DNA, 75 bp, Artificial Sequence
  Synthetic
ggtggaaacctggctgaaggaacacggagttgaaaggctagggaggatgcttgtgagtggagatgattgtgtcgt

SEQ ID NO: 274694 - DNA, 75 bp, Artificial Sequence
  Synthetic
caaacccattgatgacaggttcggaaaggcactgtacttcctgaatgatatggccaaagtccgcaaggatgtggg

SEQ ID NO: 274695 - DNA, 75 bp, Artificial Sequence
  Synthetic
ggaatgggagccctcaacgggctttgcggagtgggaggaagtccctttctgttcacatcactttcatgaactcgt

SEQ ID NO: 274696 - DNA, 75 bp, Artificial Sequence
  Synthetic
gatgaaggacggacgctctctcatagtgccatgcagagaccaagatgagctggttggcagggcaagggtgtcccc

SEQ ID NO: 274697 - DNA, 75 bp, Artificial Sequence
  Synthetic
ggggtgcggatggagtgtgcgagagacggcctgcctgtccaaggcgtacgggcaaatgtggcttcttaactactt

SEQ ID NO: 274698 - DNA, 75 bp, Artificial Sequence
  Synthetic
ccaccgaagagacctccgcacccttggattcgccatatgctctgctgttcccgtgagttgggttcccatgggtcg

SEQ ID NO: 274699 - DNA, 75 bp, Artificial Sequence
  Synthetic
taccacgtggagcatccatgcgagtggcgaatggatgacgacagaagacatgctgcgcatctggaacaaggtctg

SEQ ID NO: 274700 - DNA, 75 bp, Artificial Sequence
  Synthetic
ggcgaatggatgacgacagaagacatgctgcgcatctggaacaaggtctggattctggacaatcctcacatgaga

SEQ ID NO: 274701 - DNA, 75 bp, Artificial Sequence
  Synthetic
ccagaaaactacagagactacttggcaagcatggatagacatgacctgcattgggagctcaagctagagagctcg

SEQ ID NO: 274702 - DNA, 75 bp, Artificial Sequence
  Synthetic
ataatctaaactagcatggctaaatagtcaaaagaaccctaatatagggggtggtgtggcagcgcacaatgacat

SEQ ID NO: 274703 - DNA, 75 bp, Artificial Sequence
  Synthetic
cgtgacgggagtgggtcgcccccgacgcaccatcctcttgggaaaacttcgtgagaccctcatggctgggaaagg

SEQ ID NO: 274704 - DNA, 75 bp, Artificial Sequence
  Synthetic
gcaccagccgtgtagtaagaaggccctgacccagagcggcagcacacttagtgacgggaaagtggtcgctcccga

SEQ ID NO: 274705 - DNA, 75 bp, Artificial Sequence
  Synthetic
ctgacccagagcggcagcacacttagtgacgggaaagtggtcgctcccgacgcaactgggtcaaaaggaactttg

SEQ ID NO: 274706 - DNA, 75 bp, Artificial Sequence
  Synthetic
ctcaccaggagttaggccgtttaggagcccccgggcataactcgggaggagggaggaagaagattggcaatcttc

SEQ ID NO: 274707 - DNA, 75 bp, Artificial Sequence
  Synthetic
tctccctgagccaccaccatccaggcacagacagcctgacaaggagatggtgtgtgactcggaaaaacacccgct

SEQ ID NO: 274708 - DNA, 75 bp, Artificial Sequence
  Synthetic
ttagtcagtgtccgcagcgttctgttgaacgtgagtgtgttgagaaaaagacagcttaggagaacaagagctggg

SEQ ID NO: 274709 - DNA, 75 bp, Artificial Sequence
  Synthetic
ggcaacagacatgggagagtggtgtgaagattcaatcacctactcttgcgtcacgattgaccaggaggaagaacc

SEQ ID NO: 274710 - DNA, 75 bp, Artificial Sequence
  Synthetic
cgataatctaaactagcatgactgaacagtcaaaagaaccctaacacaggggatggtgtggcagcgcacaacgac

SEQ ID NO: 274711 - DNA, 75 bp, Artificial Sequence
  Synthetic
atcgtgacgggagtgggtcgcccccgacgcaccatcctcttgggaaaaattttcgtgagaccctcacggctggca

SEQ ID NO: 274712 - DNA, 75 bp, Artificial Sequence
  Synthetic
atccggagaaggaaggggctcggagccgaagagtgattcttttgatggaacaatggaaagccagaaacccagatg

SEQ ID NO: 274713 - DNA, 75 bp, Artificial Sequence
  Synthetic
aagggcaccagtcgtgtagtaagaaggccctggcccagtgcggcagcacactcagtgacgggaaagtggtcgctc

SEQ ID NO: 274714 - DNA, 75 bp, Artificial Sequence
  Synthetic
ggccctggcccagtgcggcagcacactcagtgacgggaaagtggtcgctcccgacgtaactgggtaaaaacgaac

SEQ ID NO: 274715 - DNA, 75 bp, Artificial Sequence
  Synthetic
ctgcggcagtcttcaaggtgttggccccgtataggccagaggtgctcgaggctctgcacagatttcagctacaat

SEQ ID NO: 274716 - DNA, 75 bp, Artificial Sequence
  Synthetic
tttgtgagaccaaaaggcctcctggaaggctcaccaggagttaggccgtttaggagcccccgagcataactcggg

SEQ ID NO: 274717 - DNA, 75 bp, Artificial Sequence
  Synthetic
aggagggaggaagaaaattggcaatcttcctcgggatttttccgcctcctatactaaatttcccccaggaaactg

SEQ ID NO: 274718 - DNA, 75 bp, Artificial Sequence
  Synthetic
tttggggagacgagaggacccatccaggtgcctgagatcgacctgggaactggaaccaggtgtgtgacgctagct

SEQ ID NO: 274719 - DNA, 75 bp, Artificial Sequence
  Synthetic
caatcttcctcgggatttttccgcctcctatactaaatttcccccaggaaactgggggggcggttcttgttctcc

SEQ ID NO: 274720 - DNA, 75 bp, Artificial Sequence
  Synthetic
agattttctgcacgtgtgtgcgggcactttagtcagtgtccgcggcgttcttttgaacgtgagtgtgttgagaaa

SEQ ID NO: 274721 - DNA, 75 bp, Artificial Sequence
  Synthetic
aagacagcttaggagaacaagagctgggagtggtcatggtgactacttctaaaggaaaggggggcggtcccccta

SEQ ID NO: 274722 - DNA, 75 bp, Artificial Sequence
  Synthetic
gggagtggtcatggtgactacttctaaaggaaaggggggcggtccccctaagcgaaagctgaaagtgaccgcaaa

SEQ ID NO: 274723 - DNA, 75 bp, Artificial Sequence
  Synthetic
agcgaaagctgaaagtgaccgcaaacaagtcgcgactagcaacaggcccaatgccaaagggttttgtgctgtcgc

SEQ ID NO: 274724 - DNA, 75 bp, Artificial Sequence
  Synthetic
gcatgctggggatcctatggcatgccgtgacaggcacggccaggaccccggtgttgaaaatgttctggaaaacgg

SEQ ID NO: 274725 - DNA, 75 bp, Artificial Sequence
  Synthetic
taccactacgccaagcggaatccgctctgaagaagatcaagaaagtgatcggaaacttgatgcagagtctccaca

SEQ ID NO: 274726 - DNA, 75 bp, Artificial Sequence
  Synthetic
tgagaggacgtcgcagatcaggcgttgactggacatggaccttcttagttatggctttgatgactatggccatgg

SEQ ID NO: 274727 - DNA, 75 bp, Artificial Sequence
  Synthetic
caacttccatccatcgggatagagagggatacatggtcatgcgagctagcggaagagatgcagcaagtcaagtta

SEQ ID NO: 274728 - DNA, 75 bp, Artificial Sequence
  Synthetic
gtgttacgattgaccaggaagaagaacctgttgatgtggactgtttttgccgaggtgttgacagagtcaagttgg

SEQ ID NO: 274729 - DNA, 75 bp, Artificial Sequence
  Synthetic
gctcaagggtgacaacattcgagatcatgttacccgtgtcgagggctggatgtggaaaaacaagctcttgacagt

SEQ ID NO: 274730 - DNA, 75 bp, Artificial Sequence
  Synthetic
catgttacccgtgtcgagggctggatgtggaaaaacaagctcttgacagttgccgtagtggctttggcttggctc

SEQ ID NO: 274731 - DNA, 75 bp, Artificial Sequence
  Synthetic
atgctggatagttggatggctagggtgactgtgatccttctggcgctgagccttgggcctgtatatgccacgaga

SEQ ID NO: 274732 - DNA, 75 bp, Artificial Sequence
  Synthetic
tgcacgcaccttgagaacagggactttgtaacaggagtacagggaaccactagggtgtccctggttctggagctt

SEQ ID NO: 274733 - DNA, 75 bp, Artificial Sequence
  Synthetic
gggggatgtgtgaccatcactgctgagggcaagccgtccattgacgtatggctggaggacattttccaagaaagt

SEQ ID NO: 274734 - DNA, 75 bp, Artificial Sequence
  Synthetic
cccgctgaaaccagagaatactgtctacacgccaagctttccaatacaaaagtagaggctcgctgccctaccact

SEQ ID NO: 274735 - DNA, 75 bp, Artificial Sequence
  Synthetic
gggccagctacgcttccagaggagcaccaggccaacatggtgtgtaagagagaccagagcgaccgcggatgggga

SEQ ID NO: 274736 - DNA, 75 bp, Artificial Sequence
  Synthetic
aaccactgtggatttttcgggaaaggaagcatcgtggcctgtgccaagtttgaatgtgaggaagcaaaaaaggct

SEQ ID NO: 274737 - DNA, 75 bp, Artificial Sequence
  Synthetic
gtaggtcatgtttatgactcaacaaaaatcacatatgttgtcaaggtcgagccccatacgggggattaccaagct

SEQ ID NO: 274738 - DNA, 75 bp, Artificial Sequence
  Synthetic
gcaaatgagaccaatgagaacaggaaaacggcacagttcacagtggcatccgagaaggtgatcttggacctagga

SEQ ID NO: 274739 - DNA, 75 bp, Artificial Sequence
  Synthetic
gactatggagatgtgtcattgacatgcaaggtggcaagtggaattgatgtcgcccagactgtggtgatgtcgctt

SEQ ID NO: 274740 - DNA, 75 bp, Artificial Sequence
  Synthetic
ggcagtagcaaagatcatctgccttcggcatggcaggtgcatcgtgactggttcgaggacctagccctgccttgg

SEQ ID NO: 274741 - DNA, 75 bp, Artificial Sequence
  Synthetic
aaacataaagataatcaagattggaacagtgtggagaaacttgtggagttcgggccacctcatgctgtaaaaatg

SEQ ID NO: 274742 - DNA, 75 bp, Artificial Sequence
  Synthetic
gacatctttaatctgggggatcagactgctgttctgctcaaatcactggctggagtcccactggcaagtgtggac

SEQ ID NO: 274743 - DNA, 75 bp, Artificial Sequence
  Synthetic
aaccagaaatatcacttgaaaagtggtcatgtcacctgtgatgtggggcttgaaaagttgaagctgaaaggcaca

SEQ ID NO: 274744 - DNA, 75 bp, Artificial Sequence
  Synthetic
acttactctatgtgtgacaaaacaaagttcaaatggaaaagagttcctgtggacagtggtcatgatacagtggtc

SEQ ID NO: 274745 - DNA, 75 bp, Artificial Sequence
  Synthetic
atggaggtgtcttacacagggagtgacaagccctgccgaattccagtgcgagcagtggcgcacggtgtcccgaca

SEQ ID NO: 274746 - DNA, 75 bp, Artificial Sequence
  Synthetic
aggaggattcatagagatgcagttgccacctggggacaacattatctatgtaggggatcttagtcagcagtggtt

SEQ ID NO: 274747 - DNA, 75 bp, Artificial Sequence
  Synthetic
ccagaaaggcagcaccataggtagaatgttcgaaaagactcgcaagggtttggaaagactctcagtggttggaga

SEQ ID NO: 274748 - DNA, 75 bp, Artificial Sequence
  Synthetic
acacgcatgggactttggttcagtgggtggaatcctgtcgtcagttggaaaggccatccatacggtgttgggggg

SEQ ID NO: 274749 - DNA, 75 bp, Artificial Sequence
  Synthetic
cgggatttttccgcctcctatactaaatttcccccaggaaactgggggggcggttcttgttctccctgagccacc

SEQ ID NO: 274750 - DNA, 75 bp, Artificial Sequence
  Synthetic
gcttaacgctaggaatccaacaatgtctatgacttttcttgccgtgggggctctgaccttgatgatgacaatggg

SEQ ID NO: 274751 - DNA, 75 bp, Artificial Sequence
  Synthetic
gattttcttgcacgtgtgtgcgggcactttagtcagtgtctgcggcgttcttttgaacgtgagtgtgttgagaaa

SEQ ID NO: 274752 - DNA, 75 bp, Artificial Sequence
  Synthetic
agtcggagcagactatggatgcgcagttgatccagaaaggatggaaattcgctgcggagaagggcttgttgtgtg

SEQ ID NO: 274753 - DNA, 75 bp, Artificial Sequence
  Synthetic
gaaagaggtatcggagtggtatgacggctatgcttaccatccggaatcaccagacacacttgcgcaggccctcag

SEQ ID NO: 274754 - DNA, 75 bp, Artificial Sequence
  Synthetic
agaggcctttgagagaggcatctgtggagttgtgccccaaaacagacttgagatggccatgtggaggagcaccgc

SEQ ID NO: 274755 - DNA, 75 bp, Artificial Sequence
  Synthetic
tccggagctcaatttagtgttgagcgaaggagaggcaaacctgactatcgtggtggacaagacagatccagcaga

SEQ ID NO: 274756 - DNA, 75 bp, Artificial Sequence
  Synthetic
agtacggacgctgtggtagacaggctggattcagggggagaaggtctgtggtcatcccgacacatgcacaaaagg

SEQ ID NO: 274757 - DNA, 75 bp, Artificial Sequence
  Synthetic
ttacagaggaggcactccaatggctctgaagaaaactggaaaggagagtaaggtgtcatggaagagttggggcaa

SEQ ID NO: 274758 - DNA, 75 bp, Artificial Sequence
  Synthetic
agtcctaggcgcatgatgatgggggttgatggagctggggagtgccccctgcacaagagagcaacaggagtgttc

SEQ ID NO: 274759 - DNA, 75 bp, Artificial Sequence
  Synthetic
acagtggcagaatttgggtttggcttacgtacaaaggtgtttttagacctgcgtggggaagcttcaaaagagtgt

SEQ ID NO: 274760 - DNA, 75 bp, Artificial Sequence
  Synthetic
gacacaggagtgatgggggcagccgtgaagaatggcaaggccattcacacggaccagagcatgtggatgagctcc

SEQ ID NO: 274761 - DNA, 75 bp, Artificial Sequence
  Synthetic
ttccggaatgataccggcacgtacattcaggagctcattctcactgatcttcgaaattgtacatggccggcaagc

SEQ ID NO: 274762 - DNA, 75 bp, Artificial Sequence
  Synthetic
cacaccatcgataatgatggagtcttggactctcgtcttttcctgccggttactctcgccgggccccgttcaaaa

SEQ ID NO: 274763 - DNA, 75 bp, Artificial Sequence
  Synthetic
tacaacagaatacctggatatagtgagcaaacgaaagggccgtgggatcagacccctctgagagtggtccgggat

SEQ ID NO: 274764 - DNA, 75 bp, Artificial Sequence
  Synthetic
cattgccctggaacaagcgtgaagattgacagtcagtgtgacaagagaggagcctcagtcagaagcaccacagaa

SEQ ID NO: 274765 - DNA, 75 bp, Artificial Sequence
  Synthetic
agaggcctttgagagaggcatctgtggagttgtgccccaaaacagacttgagatggccatgtggaggagtgccgc

SEQ ID NO: 274766 - DNA, 75 bp, Artificial Sequence
  Synthetic
gctgccgagcttgtgagctgccaccggtgacgttccgcagcggcacagactgttggtatgccatggagatcagac

SEQ ID NO: 274767 - DNA, 75 bp, Artificial Sequence
  Synthetic
cggttcactcgcagggtggcctggttagatctatggtaatggctgacaacggcgcgatgctcagcgaggggggag

SEQ ID NO: 274768 - DNA, 75 bp, Artificial Sequence
  Synthetic
tccctggactggtggcggtgtttgtcctgatggagttcttgttgagaaggcgtccgggttctgtcacatctattt

SEQ ID NO: 274769 - DNA, 75 bp, Artificial Sequence
  Synthetic
tatggggaggtatactcatgctgggtttgcttgttacagggcttgtaggagtggaggagattgtacgctacttca

SEQ ID NO: 274770 - DNA, 75 bp, Artificial Sequence
  Synthetic
tagcagttgggatcaccttccacctggagttgggaccagagatcatggcccttgtgatgctgcaggcggtcttta

SEQ ID NO: 274771 - DNA, 75 bp, Artificial Sequence
  Synthetic
gcatgcgcacatgctatctcactgggtttctcactaagaaggtgatcaccacacgtgaggtggtgactgtttact

SEQ ID NO: 274772 - DNA, 75 bp, Artificial Sequence
  Synthetic
tcctacttttggtcctggagatggggataccagaaatgaaccttggacatttatgggagtgggctgattcgttgg

SEQ ID NO: 274773 - DNA, 75 bp, Artificial Sequence
  Synthetic
ccatgggactactcataatcaaggcaagctcgatggaagaccgaaaaggcttgggattcctattggctgggctca

SEQ ID NO: 274774 - DNA, 75 bp, Artificial Sequence
  Synthetic
ttgggattcctattggctgggctcatgacacagcgacacctgactgctgttcaccatggattgatagtatttctc

SEQ ID NO: 274775 - DNA, 75 bp, Artificial Sequence
  Synthetic
actgtggctttggccgtggtgggacgaaacatctacaacggacaaaaagagaggaaaggattaagcttcaccatc

SEQ ID NO: 274776 - DNA, 75 bp, Artificial Sequence
  Synthetic
cctttggcctcgctactgggggggcctggatctggcttacgcatgttagccttgtgggaatgcctgaggggccat

SEQ ID NO: 274777 - DNA, 75 bp, Artificial Sequence
  Synthetic
ggcagacgaagtctgagtgaacccctaactgtggtgggggtcatgttggcaatggctagtggactgctgcgtcat

SEQ ID NO: 274778 - DNA, 75 bp, Artificial Sequence
  Synthetic
tctctgctggttcctttctcattctgatgttgattttggggactcgcagactccagttgacggcggaatgggcgg

SEQ ID NO: 274779 - DNA, 75 bp, Artificial Sequence
  Synthetic
gattggctgagtggaaccctgaattggtcaacgaggggggtgaggttagcctaaaggtcaggcaggatgccatgg

SEQ ID NO: 274780 - DNA, 75 bp, Artificial Sequence
  Synthetic
ggtcaacgaggggggtgaggttagcctaaaggtcaggcaggatgccatggggaacttgcacttgacggaagtgga

SEQ ID NO: 274781 - DNA, 75 bp, Artificial Sequence
  Synthetic
acgggaagagcgcaggctggcactgtggctagtgtttggtttgctggcttcggccttccattggtctggaatatt

SEQ ID NO: 274782 - DNA, 75 bp, Artificial Sequence
  Synthetic
ggtgacaatgggagcatggacactctatgagctcctctcgtcaacacgcagaactgaccttgtattctcagggca

SEQ ID NO: 274783 - DNA, 75 bp, Artificial Sequence
  Synthetic
actgtccgaccacggggagagcaggccttttgacatcaaagatggcgtctatcgcatatacgcccctggactctt

SEQ ID NO: 274784 - DNA, 75 bp, Artificial Sequence
  Synthetic
atggggtcaccgccagattggagtggggtatggaacaaaaggagtcctacacaccatgtggcatgtgacaagagg

SEQ ID NO: 274785 - DNA, 75 bp, Artificial Sequence
  Synthetic
agcggctctcagtgtggaaggagccgtttcaggaccatattgggccgacgtgcgtgaggacgtggtctgttacgg

SEQ ID NO: 274786 - DNA, 75 bp, Artificial Sequence
  Synthetic
aggtgcctggagcctggaaggaaaatggggaggcgaagttgttcaggtccatgcttttcccccagacagtggaca

SEQ ID NO: 274787 - DNA, 75 bp, Artificial Sequence
  Synthetic
caaagtccatcaatgccaaccagggaaactgaatcttgagggagggcgagtcatgggggccatcccaatagacct

SEQ ID NO: 274788 - DNA, 75 bp, Artificial Sequence
  Synthetic
accccgtggtacctcaggcagcccaatcatcaacgcacaagggattgtgctgggtctttacggtaacggtctgaa

SEQ ID NO: 274789 - DNA, 75 bp, Artificial Sequence
  Synthetic
atcaaatgatgtttacatcagcagcattgcccaaggcagcgttgaaaagagccgtccagatatgccattggcagt

SEQ ID NO: 274790 - DNA, 75 bp, Artificial Sequence
  Synthetic
ccaggggggcagatggacatcaaaaggcagcatcacagtcttggatatgcatcctggatcgggaaagacacatag

SEQ ID NO: 274791 - DNA, 75 bp, Artificial Sequence
  Synthetic
agtccttcccgagctgattcgtgaatgcattgacaaaaggttaaggactgttgtgctggccccaacgcgggttgt

SEQ ID NO: 274792 - DNA, 75 bp, Artificial Sequence
  Synthetic
gttgaaagaaatggaaagggccctgcagggaaaacgtgtcaagtttcattcagctgccgttgacaacacctcttc

SEQ ID NO: 274793 - DNA, 75 bp, Artificial Sequence
  Synthetic
atgtgcaccagagatgaattcatagcgaaggttagatccaacgcagccctgggcgcatggtcggatgaacagaac

SEQ ID NO: 274794 - DNA, 75 bp, Artificial Sequence
  Synthetic
cagggaaaacgtgtcaagtttcattcagctgccgttgacaacacctcttcatcatcaggggccattgttgatgtc

SEQ ID NO: 274795 - DNA, 75 bp, Artificial Sequence
  Synthetic
gaagcacactggaccgaccctcatagcatagcagcacgtggtcatttgtactctttggccaaagagaacagatgc

SEQ ID NO: 274796 - DNA, 75 bp, Artificial Sequence
  Synthetic
gcgtttgttttgatgacggccactccgccaggcaagagtgaggcattccctgaatccaaaggagccatagtgagt

SEQ ID NO: 274797 - DNA, 75 bp, Artificial Sequence
  Synthetic
gaagagcgacccattcccgatggggagtggagagatggctttgattgggtaacggaattcgagggccggacggct

SEQ ID NO: 274798 - DNA, 75 bp, Artificial Sequence
  Synthetic
ggatgtggatggagcgtgagagagacggcctgcctgtccaaggcgtacgggcagatgtggctcctcaactacttc

SEQ ID NO: 274799 - DNA, 75 bp, Artificial Sequence
  Synthetic
tggttcgtgtcatcaatagccaagggaggtgctattgcacgaacactgaggcagaaagggaaaagtgtgatatgt

SEQ ID NO: 274800 - DNA, 75 bp, Artificial Sequence
  Synthetic
ttgaacagcaagacctttgacaaagattatggcagagtccgtgaggaaaaacctgactttgttgtgacgaccgac

SEQ ID NO: 274801 - DNA, 75 bp, Artificial Sequence
  Synthetic
atctcagaaatgggggccaatctggacgtccatagagtcatagatggcaggactaacatcaaacctgaagaaata

SEQ ID NO: 274802 - DNA, 75 bp, Artificial Sequence
  Synthetic
gatggaagagtggagttggctggcacaaggcgagtgactacagcatcagcggcgcaacgcagggggcgggtcgga

SEQ ID NO: 274803 - DNA, 75 bp, Artificial Sequence
  Synthetic
caaggcgagtgactacagcatcagcggcgcaacgcagggggcgggtcggaaggcatgaaggacgcactgacactt

SEQ ID NO: 274804 - DNA, 75 bp, Artificial Sequence
  Synthetic
atgtgtattctgggcaatgtgacgatgatgacagctctctggtgcagtggaaggaagcgcagatcttgctcgaca

SEQ ID NO: 274805 - DNA, 75 bp, Artificial Sequence
  Synthetic
atatcacaacagtgcggggaccagttgccaccttctatgggccagaacaaggaaaaatgcttgaggtggccgggc

SEQ ID NO: 274806 - DNA, 75 bp, Artificial Sequence
  Synthetic
acttccgcttgacggaggagaaaaggaaacactttagacaccttttgacaaattgtgacttcacgccctggcttg

SEQ ID NO: 274807 - DNA, 75 bp, Artificial Sequence
  Synthetic
catggcatgtggctgaaaatactacttgcgtgacagaccggaaatggacctgggagggtcccgaagagaatgcca

SEQ ID NO: 274808 - DNA, 75 bp, Artificial Sequence
  Synthetic
ttgcgtgacagaccggaaatggacctgggagggtcccgaagagaatgccattgatggtcctgatggtgaactggt

SEQ ID NO: 274809 - DNA, 75 bp, Artificial Sequence
  Synthetic
cacttttagaagccccaatggggctgagcggaagttgaaaccagtttggaaagacagtagaatgtttcgggaagg

SEQ ID NO: 274810 - DNA, 75 bp, Artificial Sequence
  Synthetic
aagggatgtggcagactttctccaatatgcttctggccgcaggagtgccatggacatcttcactggacttggtgg

SEQ ID NO: 274811 - DNA, 75 bp, Artificial Sequence
  Synthetic
agtcccagacctgttacgcttgcgttgcacggcagcatgggatgtcgtttacacattgctcaatgagaccccagg

SEQ ID NO: 274812 - DNA, 75 bp, Artificial Sequence
  Synthetic
acacattgctcaatgagaccccagggtcccgggctatgaagatggcagagagggacgctcccgaggccatgttga

SEQ ID NO: 274813 - DNA, 75 bp, Artificial Sequence
  Synthetic
cactcctggaggtggcggtgctaggcatcgccacactaggggtaatctggtgcttcattgttcgcacgtcggtta

SEQ ID NO: 274814 - DNA, 75 bp, Artificial Sequence
  Synthetic
gcaggatggtcttaggcactgtggtgctggttgtggctctcattctattgtggatgggaggaatggactatggga

SEQ ID NO: 274815 - DNA, 75 bp, Artificial Sequence
  Synthetic
ccatggcaggagtggctcttattttctatttgctccttacggttttgcaaccagaaccgggaaagcaacgcagcg

SEQ ID NO: 274816 - DNA, 75 bp, Artificial Sequence
  Synthetic
gggaagacaaccggctggcctttctgctgattggactggggagtgttataggtctggtggcggccaatgaactgg

SEQ ID NO: 274817 - DNA, 75 bp, Artificial Sequence
  Synthetic
gctatttggagcgaacaaaagccgacattgcaggacttttcagatacgacactcagggtgatagagtgtgggaca

SEQ ID NO: 274818 - DNA, 75 bp, Artificial Sequence
  Synthetic
catggacaaacatagacatacagcctgcccgatcttgggggacctacgtgtttatcgtgtcccttttcactccat

SEQ ID NO: 274819 - DNA, 75 bp, Artificial Sequence
  Synthetic
acatgctccatcagctgcagaccaagatccagaggctggtgaacagctcagtggcagctggaacgcaggctatga

SEQ ID NO: 274820 - DNA, 75 bp, Artificial Sequence
  Synthetic
gagacctgggaggaggcaccccattctttggcgtggctggacacgttgtggcacttggcgtgacttcgttggtgg

SEQ ID NO: 274821 - DNA, 75 bp, Artificial Sequence
  Synthetic
gagcgacgccctcttctctggcattgggggtggctttggccatcctccatctggctgtggttacatctgggctag

SEQ ID NO: 274822 - DNA, 75 bp, Artificial Sequence
  Synthetic
agattttcttgcacgtgtgtgcgggcactttagtcagtgtccgcggcgttcttttgaacgtgagtgtgttgagaa

SEQ ID NO: 274823 - DNA, 75 bp, Artificial Sequence
  Synthetic
aggctgaattgactcagagagcgcatagagcattcttttcggccatggtgaagaatccaatggtggatggagaga

SEQ ID NO: 274824 - DNA, 75 bp, Artificial Sequence
  Synthetic
tcatcaaccccattcccgatggagagccaaagccggccttgtatgaaagaaagatgagtctgctcttggccattg

SEQ ID NO: 274825 - DNA, 75 bp, Artificial Sequence
  Synthetic
gcctgtgtatagccgctgtggccctgaataggaccgcagctgcgatgactgaggccggcgcagtggccatagctg

SEQ ID NO: 274826 - DNA, 75 bp, Artificial Sequence
  Synthetic
gaataggaccgcagctgcgatgactgaggccggcgcagtggccatagctgctctgggacagctgttgaggcctga

SEQ ID NO: 274827 - DNA, 75 bp, Artificial Sequence
  Synthetic
ggcggaaagctggtggaccatgccaatggcttgcgggatggctgggctggtgcggggaagtctgtggggcttact

SEQ ID NO: 274828 - DNA, 75 bp, Artificial Sequence
  Synthetic
gccagttctccaccgcatctggctcagaactcagggggctagaaggggtggagcagagggaagcacccttggcga

SEQ ID NO: 274829 - DNA, 75 bp, Artificial Sequence
  Synthetic
tatctggaagcaacggttgaattcatgttccaaggaggaattctttgcttacagacgcacaggagtcatggagac

SEQ ID NO: 274830 - DNA, 75 bp, Artificial Sequence
  Synthetic
caaccgagaccaggcccgcgagctgctccgtagaggggagaccaatattggtttagccgtgtcacgaggttgtgc

SEQ ID NO: 274831 - DNA, 75 bp, Artificial Sequence
  Synthetic
caaacttgcgtggttagaagagagaggttacgcgacactcaaaggagaggtcgtggaccttggctgtggaagggg

SEQ ID NO: 274832 - DNA, 75 bp, Artificial Sequence
  Synthetic
gggctggtcatactatgccgcctcgcgaccatctgtcatggccgtgagagcttacaccattggagggaaaggcca

SEQ ID NO: 274833 - DNA, 75 bp, Artificial Sequence
  Synthetic
tgaggcgccgcgtttggtgacgagccttggatggaatctcataaagttcaggagtgggatggacgtcttttcaat

SEQ ID NO: 274834 - DNA, 75 bp, Artificial Sequence
  Synthetic
gccggccacaagagcagacacaatcctgtgtgacatcggggagagcaatccggatccagagaaggaagggactcg

SEQ ID NO: 274835 - DNA, 75 bp, Artificial Sequence
  Synthetic
gagtcggagggtgatcctcctaatggagcaatggaaggccaggaatccagacgctgctgctgttttcaaggtgtt

SEQ ID NO: 274836 - DNA, 75 bp, Artificial Sequence
  Synthetic
ggccccgtacagaccagaagtgcttgaggccctacaccggttccagctgcagtggggtggaggacttgtgagggt

SEQ ID NO: 274837 - DNA, 75 bp, Artificial Sequence
  Synthetic
ccctttctctcggaattccacgcacgagatgtattactccacagccgtcacgggaaatcttgtcaattcagtcaa

SEQ ID NO: 274838 - DNA, 75 bp, Artificial Sequence
  Synthetic
cgggaaatcttgtcaattcagtcaatgtgctctcacggaagcttctggccagatttggagagacaaggggaccca

SEQ ID NO: 274839 - DNA, 75 bp, Artificial Sequence
  Synthetic
tccaggtgcccgagattgatctaggaaccgggactaggtgtgtgacactggcagaagacaaggtgaaacctagtg

SEQ ID NO: 274840 - DNA, 75 bp, Artificial Sequence
  Synthetic
atgtgatggaacgcattggggccctgaaggaacaatactcagaatcatggcatgaagataaggaacacccctaca

SEQ ID NO: 274841 - DNA, 75 bp, Artificial Sequence
  Synthetic
gaacatggcagtactggggcagctaccgcacccctgccactggatcagcggcttcgctcatcaatggagtggtga

SEQ ID NO: 274842 - DNA, 75 bp, Artificial Sequence
  Synthetic
agttgctgagctggccctggaatgcccgggaggatgtcactagaatggccatgacagacacaacagcgtttgggc

SEQ ID NO: 274843 - DNA, 75 bp, Artificial Sequence
  Synthetic
aacagcgtgttttcaaggaaaaagtggacacaaaggcccaggaaccacagccaggcaccagggtgatcatgagag

SEQ ID NO: 274844 - DNA, 75 bp, Artificial Sequence
  Synthetic
cagtgagtgactggctatttgagcaccttcacagccgagccaaggtgaggatgtgcaccagagatgaattcatag

SEQ ID NO: 274845 - DNA, 75 bp, Artificial Sequence
  Synthetic
gggcgcatggtcggatgaacagaacaagtggagttcagcaaaagaggcagtggaagacccagaattttggaacct

SEQ ID NO: 274846 - DNA, 75 bp, Artificial Sequence
  Synthetic
ggtggatgaagagcgctccagacacctgaaaggccaatgtcgacactgcgtgtataatatgatgggaaagagaga

SEQ ID NO: 274847 - DNA, 75 bp, Artificial Sequence
  Synthetic
gaagaaattgggtgaatttggagttgccaaaggcagcagggccatctggtacatgtggcttgggagtcgtttcct

SEQ ID NO: 274848 - DNA, 75 bp, Artificial Sequence
  Synthetic
tgagtttgaggttctgggtttccttaatgaagaacactgggcttctagggtggtcagtggagccggagtggaagg

SEQ ID NO: 274849 - DNA, 75 bp, Artificial Sequence
  Synthetic
aaccagtctcaactacctgggttggttgctcagggagcttggagcaaaagatggcggcaggttgtacgctgacga

SEQ ID NO: 274850 - DNA, 75 bp, Artificial Sequence
  Synthetic
aatcaatgtggccatgctcattacccccaacccaaccattgaaacaagtggaggaggattcatagagatgcagtt

SEQ ID NO: 274851 - DNA, 75 bp, Artificial Sequence
  Synthetic
agcagatccttcggtacatggaaggagaacaccatgtgttagcaaaaacaatactggaaaaagcctatcacgcaa

SEQ ID NO: 274852 - DNA, 75 bp, Artificial Sequence
  Synthetic
aagtggtcaaggttgccagaccttcccctcaaggaggatgtgtgatggatgtgatcacgagaagagatcagagag

SEQ ID NO: 274853 - DNA, 75 bp, Artificial Sequence
  Synthetic
gatcaggacaggttgtcacatatgccctcaacaccatcacaaacatgaaagtccaactaatccgcatgatggaag

SEQ ID NO: 274854 - DNA, 75 bp, Artificial Sequence
  Synthetic
gtgagggagtcataggaccagcagactcacaggatccccgtctaaaaagggtagaagcttggctgagggagcacg

SEQ ID NO: 274855 - DNA, 75 bp, Artificial Sequence
  Synthetic
gagctgaacggttggggaggatgctggtgagtggagatgactgtgttgtcaaacccatcgacgacaggtttggaa

SEQ ID NO: 274856 - DNA, 75 bp, Artificial Sequence
  Synthetic
aggccctgtacttcttgaatgacatggcaaagacccgtaaggatgtgggagagtgggagccctcagtggggttca

SEQ ID NO: 274857 - DNA, 75 bp, Artificial Sequence
  Synthetic
atgaaagatgggcgttccctcatagtgccctgcagagatcaagacgagctggtcggcagagcacgagtgtcgcca

SEQ ID NO: 274858 - DNA, 75 bp, Artificial Sequence
  Synthetic
ggatgtggatggagcgtgagagagacggcctgcctgtccaaggcgtacgggcagatgtggcttctcaattacttc

SEQ ID NO: 274859 - DNA, 75 bp, Artificial Sequence
  Synthetic
catcgcagagatctccgcacccttggtttcgccatatgctctgcggttcccgtgaactgggttccgataggccgc

SEQ ID NO: 274860 - DNA, 75 bp, Artificial Sequence
  Synthetic
accacctggagcatccatgcgagtggtgaatggatgacgacagaagacatgctacgcatctggaacaaggtttgg

SEQ ID NO: 274861 - DNA, 75 bp, Artificial Sequence
  Synthetic
atcttggacaaccctcacatggaagacaaacaaacagtggatgaatggagagacattccctacctaccaaagaca

SEQ ID NO: 274862 - DNA, 75 bp, Artificial Sequence
  Synthetic
agacattccctacctaccaaagacacaggatctggtgtgctcctcacttgttggaaggaaggaaagggcggaatg

SEQ ID NO: 274863 - DNA, 75 bp, Artificial Sequence
  Synthetic
ggccaagaacatttggggttcagtggaaaaggtgaggaaactcattggagcagaggactacagagactacttggc

SEQ ID NO: 274864 - DNA, 75 bp, Artificial Sequence
  Synthetic
aaacatggacagacatgacttgcactgggagctcaagctagagagctcaataatctaaactagcacaaccataat

SEQ ID NO: 274865 - DNA, 75 bp, Artificial Sequence
  Synthetic
caagagaaacccgctatagggggtgatgtggcagcgcaccacgacatcgtgacgggaaaaggtcgtccccgacgc

SEQ ID NO: 274866 - DNA, 75 bp, Artificial Sequence
  Synthetic
atcatccctctagggcattttcgtgagaccctcacggctgtgaaagggcatcagtcgtgtagtaagaaggccctg

SEQ ID NO: 274867 - DNA, 75 bp, Artificial Sequence
  Synthetic
gcctactgcggcagcacacacagtgacgggaaattggtcgctcccgacgcagttaggtcaaagagaaatttgtga

SEQ ID NO: 274868 - DNA, 75 bp, Artificial Sequence
  Synthetic
gaccaaaaggcctcctggaaggctcaccaggagttaggccattttagagcccccgggcataactcgggaggaggg

SEQ ID NO: 274869 - DNA, 75 bp, Artificial Sequence
  Synthetic
accaggagttaggccattttagagcccccgggcataactcgggaggaggggggaagacaattggcaatcttcccc

SEQ ID NO: 274870 - DNA, 75 bp, Artificial Sequence
  Synthetic
gggaagacaattggcaatcttccccgggatttttccgcctcctataccaaatttcccccaggaaactgggggggc

SEQ ID NO: 274871 - DNA, 75 bp, Artificial Sequence
  Synthetic
tccctgagccaccgccatccaggcacagacagcctgacaaggagatggtgtgtgactcggaaaaacacccgctta

SEQ ID NO: 274872 - DNA, 75 bp, Artificial Sequence
  Synthetic
tttcttgcacgtgtgtgtggacactttagtcagtgtccgcggcgttcctttgaacgtgagtgtgttgaggaaaag

SEQ ID NO: 274873 - DNA, 75 bp, Artificial Sequence
  Synthetic
gaaagctgaaagtgaccgcaaacaagtcgcgaccagcaacaagcccaatgccaaagggttttgtgctgtcgcgca

SEQ ID NO: 274874 - DNA, 75 bp, Artificial Sequence
  Synthetic
tgctggggatcctttggcatgccatgacaggcacggccaggaccccagtgttgaaaatgttctggaaaacggtac

SEQ ID NO: 274875 - DNA, 75 bp, Artificial Sequence
  Synthetic
cattacgccaagcggaatctgcgttgaagaagatcaagagagtcattggaaacttgatgcagagcctccatatga

SEQ ID NO: 274876 - DNA, 75 bp, Artificial Sequence
  Synthetic
ggggacgtcgcagatcaggcgtcgactggacatggactttcttggtaatggctttgatggctatggccatggcga

SEQ ID NO: 274877 - DNA, 75 bp, Artificial Sequence
  Synthetic
cctccatccatcgggataaagagggatatatggtcatgcgagctagcggaagagatgccgcaagccaagtcagag

SEQ ID NO: 274878 - DNA, 75 bp, Artificial Sequence
  Synthetic
ttaccattgaccaggaagaagaacctgttgatgtggattgtttttgccgaggtgttgacagagtcaagttagagt

SEQ ID NO: 274879 - DNA, 75 bp, Artificial Sequence
  Synthetic
ttcttcccaggaggctctactggtcctctctgctggttcctttctcattctgatgttgattttggggactcgcag

SEQ ID NO: 274880 - DNA, 75 bp, Artificial Sequence
  Synthetic
caagggtgataacatccgagatcatgttacccgcgtcgagggctggatgtggaaaaacaagctcttgacagttgc

SEQ ID NO: 274881 - DNA, 75 bp, Artificial Sequence
  Synthetic
gttacccgcgtcgagggctggatgtggaaaaacaagctcttgacagttgctgtcgtggctttggcttggctcatg

SEQ ID NO: 274882 - DNA, 75 bp, Artificial Sequence
  Synthetic
ctggatagttggatggctagggtgactgtgatccttctggcgctgagccttgggcctgtatacgccacgagatgc

SEQ ID NO: 274883 - DNA, 75 bp, Artificial Sequence
  Synthetic
acacaccttgaaaacagggactttgtgacaggagtacagggaaccactagagtatccctggttctggagcttgga

SEQ ID NO: 274884 - DNA, 75 bp, Artificial Sequence
  Synthetic
ggatgtgtgaccattactgctgaaggcaagccatctattgatgtatggctggaggacatttttcaagaaagtcct

SEQ ID NO: 274885 - DNA, 75 bp, Artificial Sequence
  Synthetic
gctgaaaccagagaatactgtttacacgccaagctctccaacacgaaagtagaggctcgttgccccaccaccggg

SEQ ID NO: 274886 - DNA, 75 bp, Artificial Sequence
  Synthetic
ccagctacgcttccagaggaacaccaggccaacatggtgtgcaagagagaccagagtgaccgtggatggggaaac

SEQ ID NO: 274887 - DNA, 75 bp, Artificial Sequence
  Synthetic
aggccaacatggtgtgcaagagagaccagagtgaccgtggatggggaaaccactgcggattctttgggaaaggaa

SEQ ID NO: 274888 - DNA, 75 bp, Artificial Sequence
  Synthetic
gcatagtggcctgtgccaagtttgaatgcgaggaagcaaaaaaggcggtaggtcatgtttatgactcaacaaaaa

SEQ ID NO: 274889 - DNA, 75 bp, Artificial Sequence
  Synthetic
tcacgtacgttgtcaaggttgagccccacacgggggactaccaagctgcaaatgaaaccaacgagaacaggaaaa

SEQ ID NO: 274890 - DNA, 75 bp, Artificial Sequence
  Synthetic
aatgaaaccaacgagaacaggaaaacggcccagttcacggtggcatctgagaaggtgatcttaaatctaggagac

SEQ ID NO: 274891 - DNA, 75 bp, Artificial Sequence
  Synthetic
tatggagatgtatcattgacatgtaaggtggcaagtggaattgatgtcgcccagactgtggtgatgtcgcttggc

SEQ ID NO: 274892 - DNA, 75 bp, Artificial Sequence
  Synthetic
agcagcaaagatcacctgccttcggcatggcaggtgcatcgtgactggttcgaagacctagccctgccttggaaa

SEQ ID NO: 274893 - DNA, 75 bp, Artificial Sequence
  Synthetic
cacaaagacaatcaggactggaacagtgtggagaaacttgtggagtttgggccgcctcatgcagtgaaaatggat

SEQ ID NO: 274894 - DNA, 75 bp, Artificial Sequence
  Synthetic
atcttcaatctgggggatcagactgctgttttgctcaaatcactggctggagtcccactggcaagcgtggacaac

SEQ ID NO: 274895 - DNA, 75 bp, Artificial Sequence
  Synthetic
cagaaatatcacctgaaaagtggtcatgtcacctgtgatgtgggacttgaaaagctgaagctgaaaggcacaact

SEQ ID NO: 274896 - DNA, 75 bp, Artificial Sequence
  Synthetic
tactccatgtgtgacaaaacaaagttcaagtggaaaagagttcctgtggacagtggtcatgacacagtggtcatg

SEQ ID NO: 274897 - DNA, 75 bp, Artificial Sequence
  Synthetic
agccctgccggattccggtacgagcagtggcacatggtgtcccgacaatcaatgtggccatgctcattaccccca

SEQ ID NO: 274898 - DNA, 75 bp, Artificial Sequence
  Synthetic
aatgtggccatgctcattacccccaacccaaccattgaaacaagtggaggaggatttatagagatgcagttgcca

SEQ ID NO: 274899 - DNA, 75 bp, Artificial Sequence
  Synthetic
acccaaccattgaaacaagtggaggaggatttatagagatgcagttgccaccgggggacaacatcatctatgtgg

SEQ ID NO: 274900 - DNA, 75 bp, Artificial Sequence
  Synthetic
gggacctaagtcagcagtggttccagaaaggcagtaccataggtagaatgctcgaaaagacccgtaagggtttgg

SEQ ID NO: 274901 - DNA, 75 bp, Artificial Sequence
  Synthetic
gaaaggcagtaccataggtagaatgctcgaaaagacccgtaagggtttggaaagactctcagtggttggagaaca

SEQ ID NO: 274902 - DNA, 75 bp, Artificial Sequence
  Synthetic
caacgctaggaatccaacaatgtccatgacttttcttgccgtgggggttttgaccctgatgatgacaatgggagt

SEQ ID NO: 274903 - DNA, 75 bp, Artificial Sequence
  Synthetic
atgacttttcttgccgtgggggttttgaccctgatgatgacaatgggagtcggagcagactatggatgtgcggtt

SEQ ID NO: 274904 - DNA, 75 bp, Artificial Sequence
  Synthetic
gatccagagaggatggaaatccgatgtggagaaggcctagttgtgtggagagaggtatcggagtggtatgacggc

SEQ ID NO: 274905 - DNA, 75 bp, Artificial Sequence
  Synthetic
tatgcttaccatccggaatcaccagacacgctggcgcaggccctccgagaggcctttgagagaggcatctgtgga

SEQ ID NO: 274906 - DNA, 75 bp, Artificial Sequence
  Synthetic
gttgtgccccagaatagacttgaaatggccatgtggaggagcaccgctccggagctcaatttggtgttgagtgaa

SEQ ID NO: 274907 - DNA, 75 bp, Artificial Sequence
  Synthetic
ggagaggcgaatctgaccatcgtggtagacaagacagatccagcagattacagaggaggcactccaatggccctg

SEQ ID NO: 274908 - DNA, 75 bp, Artificial Sequence
  Synthetic
tagacaagacagatccagcagattacagaggaggcactccaatggccctgaagaaaactggaaaggagagtaagg

SEQ ID NO: 274909 - DNA, 75 bp, Artificial Sequence
  Synthetic
caagagagcaacaggagtgttcacagtggcagaatttggggttggcctacgcacaaaggtgtttttagacctgcg

SEQ ID NO: 274910 - DNA, 75 bp, Artificial Sequence
  Synthetic
tggagaggcttcaaaagagtgtgacacaggagtgatgggggcagctgtgaagaacggcaaggccattcacacgga

SEQ ID NO: 274911 - DNA, 75 bp, Artificial Sequence
  Synthetic
ccagagcatgtggatgagttccttccggaatgatactggtacgtacattcaggagctcattcttactgaccttcg

SEQ ID NO: 274912 - DNA, 75 bp, Artificial Sequence
  Synthetic
aaactgtacatggccagcaagtcacaccattgacaacgacggagtcttggactcccgtctttttctgcctgtcac

SEQ ID NO: 274913 - DNA, 75 bp, Artificial Sequence
  Synthetic
tctcgctgggccccgttcaaaatacaacagaatacctggatacagcgagcaaacgaaagggccatgggaccagac

SEQ ID NO: 274914 - DNA, 75 bp, Artificial Sequence
  Synthetic
aacagaatacctggatacagcgagcaaacgaaagggccatgggaccagacccctatgagggtggtccgggatcat

SEQ ID NO: 274915 - DNA, 75 bp, Artificial Sequence
  Synthetic
ctcagttagaagcaccacagaaagcggaaagatcatcccagagtggtgctgtcgggcttgtgaattaccaccggt

SEQ ID NO: 274916 - DNA, 75 bp, Artificial Sequence
  Synthetic
ggaaagatcatcccagagtggtgctgtcgggcttgtgaattaccaccggtgacgttccgcagcggcacagattgt

SEQ ID NO: 274917 - DNA, 75 bp, Artificial Sequence
  Synthetic
tggtatgccatggagattagaccggttcactcacagggtggcttggttcgatccatggtaatggctgacaacggt

SEQ ID NO: 274918 - DNA, 75 bp, Artificial Sequence
  Synthetic
gcgatgctcagcgaggggggaacccctggactggtggcggtatttgtcctgatggagttcttgttgagaaggcgt

SEQ ID NO: 274919 - DNA, 75 bp, Artificial Sequence
  Synthetic
ccgggttctgtcacatccattctgtggggaggcatactcatgctgggcttgcttgttacagggcttgttagagtg

SEQ ID NO: 274920 - DNA, 75 bp, Artificial Sequence
  Synthetic
gaggagatcgtgcgctacatcatagcggttgggatcactttccacttggagctgggaccagagatcatggccctt

SEQ ID NO: 274921 - DNA, 75 bp, Artificial Sequence
  Synthetic
gtgatgctgcaggcagtttttagcatgcgcacatgctatctcattgggtttctcgccaagagggtgatcaccaca

SEQ ID NO: 274922 - DNA, 75 bp, Artificial Sequence
  Synthetic
cgtgaggtggtgactgtttacttcctactcttggtcctagagatggggataccagaaatgaactttggacattta

SEQ ID NO: 274923 - DNA, 75 bp, Artificial Sequence
  Synthetic
tgggagtgggctgactcattggccatgggactactcataattaaggcaagctcgatggaagaccgaaaaggtcta

SEQ ID NO: 274924 - DNA, 75 bp, Artificial Sequence
  Synthetic
ggattcttattggctgggctcatgacacaacgacatctgactgctgttcaccatggattgatagtattcctcact

SEQ ID NO: 274925 - DNA, 75 bp, Artificial Sequence
  Synthetic
gtggctctggcggtggtgggacgaagcatctacaacgggcaaaaagagaggaaaggattaagctttaccatcccc

SEQ ID NO: 274926 - DNA, 75 bp, Artificial Sequence
  Synthetic
ttggcctcgctattgggggggcctggatctggcttgcgcatgctggccttgtgggaatgcctgggtggtcgtggc

SEQ ID NO: 274927 - DNA, 75 bp, Artificial Sequence
  Synthetic
agacgaagtctgagtgagcccctaactgtggtgggggtcatgttagcaatggctagtgggctgctgcgtcattct

SEQ ID NO: 274928 - DNA, 75 bp, Artificial Sequence
  Synthetic
tcccaggaggctctactggtcctctcggctggttcctttctcatcctgatgttgattttagggactcgcagactc

SEQ ID NO: 274929 - DNA, 75 bp, Artificial Sequence
  Synthetic
gttgattttagggactcgcagactccagttgacggcggaatgggcgggactggctgaatggaaccctgagttggt

SEQ ID NO: 274930 - DNA, 75 bp, Artificial Sequence
  Synthetic
tggctgaatggaaccctgagttggtcaacgaggggggtgaggttagcctaaaggtcaggcaggacgccatgggga

SEQ ID NO: 274931 - DNA, 75 bp, Artificial Sequence
  Synthetic
acttgcacttgacggaggtggaacgggaggagcgcaggctggcactgtggctggcatttggcttgctagcttcgg

SEQ ID NO: 274932 - DNA, 75 bp, Artificial Sequence
  Synthetic
ctttccattggtccggaatactggtgacaatgggggcatggacactgtatgagctcttctcatcagcacgcagaa

SEQ ID NO: 274933 - DNA, 75 bp, Artificial Sequence
  Synthetic
ctgaccttgtattctcagggcaattgtctgaccatggggagaaacggccttttgacattaaagacggcgtctatc

SEQ ID NO: 274934 - DNA, 75 bp, Artificial Sequence
  Synthetic
tatggaacaaaaggagtcctacacaccatgtggcatgtgacaagaggagcggctcttagtgtggagggggccgtt

SEQ ID NO: 274935 - DNA, 75 bp, Artificial Sequence
  Synthetic
tcgggaccatattgggcggatgtgcgtgaggacgtggtctgttatggaggtgcctggagcttggaaggaaaatgg

SEQ ID NO: 274936 - DNA, 75 bp, Artificial Sequence
  Synthetic
ggaggtgaagttgttcaggtccatgcttttccaccagacagtggacataaagttcatcaatgccaaccagggaaa

SEQ ID NO: 274937 - DNA, 75 bp, Artificial Sequence
  Synthetic
ctgaatcttgagggagggcgagtcatgggggccatcccaatagacttacctcgtggaacctcaggcagcccaatc

SEQ ID NO: 274938 - DNA, 75 bp, Artificial Sequence
  Synthetic
atcaacgcacaaggggttgtgttgggtctctacggcaacggtctgaaatccaatgatgtttacatcagcagcatc

SEQ ID NO: 274939 - DNA, 75 bp, Artificial Sequence
  Synthetic
gctcaaggcagcgttgagaaaagccgaccagaaatgccgttggcaatccaggggggcagatggacatcaaaaggc

SEQ ID NO: 274940 - DNA, 75 bp, Artificial Sequence
  Synthetic
agcatcacagtcctggacatgcatcctggatcgggaaagacacatagagtccttcccgagctgattcgtgaatgc

SEQ ID NO: 274941 - DNA, 75 bp, Artificial Sequence
  Synthetic
attgacaaaagattgaggactgttgtgttggccccaacgcgggttgttctgaaagagatggaaagagccctgcaa

SEQ ID NO: 274942 - DNA, 75 bp, Artificial Sequence
  Synthetic
gggaaacgcgtcaagttccactcggctgccgttgacaacacctcttcatcattgggggccattgttgatgtcatg

SEQ ID NO: 274943 - DNA, 75 bp, Artificial Sequence
  Synthetic
ttgggaggtggccataatggatgaagcacattggactgatcctcacagtatagcagcacgtggtcacctgtactc

SEQ ID NO: 274944 - DNA, 75 bp, Artificial Sequence
  Synthetic
gcacattggactgatcctcacagtatagcagcacgtggtcacctgtactctttggctaaagagaacagatgcgcg

SEQ ID NO: 274945 - DNA, 75 bp, Artificial Sequence
  Synthetic
tttgttctgatgacagctactccaccgggcaagagtgaggcattccccgagtccaaaggagccatagtgagtgaa

SEQ ID NO: 274946 - DNA, 75 bp, Artificial Sequence
  Synthetic
gaaagacccattcccgatggggagtggagagatggctttgattggataacggaatttgaaggccggacggcttgg

SEQ ID NO: 274947 - DNA, 75 bp, Artificial Sequence
  Synthetic
ttcgtgtcatcaatagccaaaggaggcgctatagcacgaacactgaggcagaaagggaaaagtgtgatttgtttg

SEQ ID NO: 274948 - DNA, 75 bp, Artificial Sequence
  Synthetic
acactgctggatgggacacccgaattaccaacgctgacttggaggatgaagagcagatccttcggtacatggaag

SEQ ID NO: 274949 - DNA, 75 bp, Artificial Sequence
  Synthetic
aacagcaagacttttgacaaagactatggcagagtccgtgaagaaaaacctgactttgttgtgacgaccgacatc

SEQ ID NO: 274950 - DNA, 75 bp, Artificial Sequence
  Synthetic
tcagaaatgggggccaacttggacgtcaacagggtcattgatggcaggaccaatatcaagcctgaagaaatagac

SEQ ID NO: 274951 - DNA, 75 bp, Artificial Sequence
  Synthetic
ggaagagtggaactggccggcacaaggcgagtaacaacagcatcagcggcacaacgcagggggcgggtcggaagg

SEQ ID NO: 274952 - DNA, 75 bp, Artificial Sequence
  Synthetic
catgaaggacgcacagacacttatgtgtattctggacaatgtgatgatgatgacagctctctggtgcagtggaaa

SEQ ID NO: 274953 - DNA, 75 bp, Artificial Sequence
  Synthetic
gaagcccagatcttactcgacaatattacaacagtgcggggaccagttgccaccttctatgggccagaacaaggg

SEQ ID NO: 274954 - DNA, 75 bp, Artificial Sequence
  Synthetic
aaaatgcttgaggtggccggacactttcgtttgacggaggagaaaaggaaacatttcagacatctcttaacaaac

SEQ ID NO: 274955 - DNA, 75 bp, Artificial Sequence
  Synthetic
acatttcagacatctcttaacaaactgtgacttcacaccctggcttgcatggcatgtggctgcaaacaccacctg

SEQ ID NO: 274956 - DNA, 75 bp, Artificial Sequence
  Synthetic
cgtgacagaccggaaatggacctgggagggtcccgaggagaatgccattgatggtcctgatggtgaactggtcac

SEQ ID NO: 274957 - DNA, 75 bp, Artificial Sequence
  Synthetic
tttcagaagccccaatggggctgagcggaaattgaaaccagtctggaaagacagtagaatgttccgggaaggaag

SEQ ID NO: 274958 - DNA, 75 bp, Artificial Sequence
  Synthetic
accggacttgttgcgcttgcgctgcacggcggcatgggatgtcgtctacacattgctcaatgagaccccaggttc

SEQ ID NO: 274959 - DNA, 75 bp, Artificial Sequence
  Synthetic
tcgggccatgaagatggcagagagggacgctcccgaggccatgttgacgcttctggaggtggcggtgctaggcat

SEQ ID NO: 274960 - DNA, 75 bp, Artificial Sequence
  Synthetic
cgccacactaggggtggtctggtgcttcattgtccgcacgtcggttagcaggatggttctgggcactgtggtgct

SEQ ID NO: 274961 - DNA, 75 bp, Artificial Sequence
  Synthetic
ggtggtggccctcattctactgtggctgggaggaatggactatgggaccatggcaggagtggcccttattttcta

SEQ ID NO: 274962 - DNA, 75 bp, Artificial Sequence
  Synthetic
tttgctccttacggttttacaaccagaaccaggaaaacaacgcagtggggaagacaaccgactggcttttctgct

SEQ ID NO: 274963 - DNA, 75 bp, Artificial Sequence
  Synthetic
gattggactggggagtgtcataggtctattggcggctaatgaattgggctatttggagagaacaaaagccgacat

SEQ ID NO: 274964 - DNA, 75 bp, Artificial Sequence
  Synthetic
tgcaggccttttcagatatgacacccagggtgacagagtgtgggacacatggacaaacattgacatacagcccgc

SEQ ID NO: 274965 - DNA, 75 bp, Artificial Sequence
  Synthetic
ccgatcctgggggacctatgtgtttatcgtgtcccttttcactccgtacatgctccatcagctgcagaccaaaat

SEQ ID NO: 274966 - DNA, 75 bp, Artificial Sequence
  Synthetic
ccagaggctggtgaacagctcggtagcagcaggaacgcaggctatgaaagacttgggaggaggcaccccattttt

SEQ ID NO: 274967 - DNA, 75 bp, Artificial Sequence
  Synthetic
cggtgtggctggacacgttgtggcacttggtgtgacttctttggtaggagcgacgcccacttctctggcattggg

SEQ ID NO: 274968 - DNA, 75 bp, Artificial Sequence
  Synthetic
cctataccaaatttcccccaggaaactgggggggcggttcttgttctccctgagccaccgccatccaggcacaga

SEQ ID NO: 274969 - DNA, 75 bp, Artificial Sequence
  Synthetic
agtggctttggccatcctccatttggctgtggtcacatctgggctagaggctgaattgactcagagagcgcacag

SEQ ID NO: 274970 - DNA, 75 bp, Artificial Sequence
  Synthetic
agcgttcttttcggccatggtgaagaatccaatggtggatggagaggtcatcaatcccattcccgatggagagcc

SEQ ID NO: 274971 - DNA, 75 bp, Artificial Sequence
  Synthetic
aaagccagccttgtatgaaagaaagatgagcctgctccttgccgttggcttgtgcatagctgctgtggccctgaa

SEQ ID NO: 274972 - DNA, 75 bp, Artificial Sequence
  Synthetic
gccggtgcagtggccgtggccgctctgggacagttgttgaggccagaggaggaaagctggtggaccatgccaatg

SEQ ID NO: 274973 - DNA, 75 bp, Artificial Sequence
  Synthetic
ctgcacagcggcgtgggatgttgtctacacactgcttaatgagaccccagggagtcgcgccatgaaaatggcgga

SEQ ID NO: 274974 - DNA, 75 bp, Artificial Sequence
  Synthetic
ggttctccaccgcatctggctcagaactcagggggctagaaggggtggagcagagggaagcacccttggcgacgt

SEQ ID NO: 274975 - DNA, 75 bp, Artificial Sequence
  Synthetic
ctggaagcaacggttgaactcatgcaccaaagaggaattttttgcttacagacgcacaggagtcatggagaccaa

SEQ ID NO: 274976 - DNA, 75 bp, Artificial Sequence
  Synthetic
ccgagaccaggcccgcgagctgctccgcagaggggagaccaacatgggtttggccgtatcacggggttgcgccaa

SEQ ID NO: 274977 - DNA, 75 bp, Artificial Sequence
  Synthetic
cgcagaggggagaccaacatgggtttggccgtatcacggggttgcgccaaacttgcatggttagaagaaagaggc

SEQ ID NO: 274978 - DNA, 75 bp, Artificial Sequence
  Synthetic
tacgcgacactcaagggagaagtcgtggaccttggctgtggaagggggggctggtcatattacgccgcctcgcga

SEQ ID NO: 274979 - DNA, 75 bp, Artificial Sequence
  Synthetic
ccatctgttatggccgtgaaagcttacaccattggagggaaaggccatgaggcgccgcgattggtgacgagcctt

SEQ ID NO: 274980 - DNA, 75 bp, Artificial Sequence
  Synthetic
ggatggaacctcataaagttcaggagtgggatggacgtcttttcaatgccagccacaagagtagatacaatcctg

SEQ ID NO: 274981 - DNA, 75 bp, Artificial Sequence
  Synthetic
tgtgacatcggggagagcaatccggatccagagaaggaggggactcggagccggagggtgatccttttgatggag

SEQ ID NO: 274982 - DNA, 75 bp, Artificial Sequence
  Synthetic
caatggaaagccaggaatccagacgctgctgctgttttcaaggtgttggccccgtacagaccagaagtgctagag

SEQ ID NO: 274983 - DNA, 75 bp, Artificial Sequence
  Synthetic
gccctacaccgttttcagctacagtggggtggaggacttgtgagagtccctttctcacggaattccacacatgag

SEQ ID NO: 274984 - DNA, 75 bp, Artificial Sequence
  Synthetic
atgtattattccacagccgtcacgggaaatcttgtcaattcggtcaatgtgctctcacgaaagcttcttgcgaga

SEQ ID NO: 274985 - DNA, 75 bp, Artificial Sequence
  Synthetic
gaaatcttgtcaattcggtcaatgtgctctcacgaaagcttcttgcgagatttggggagacaaggggacccatcc

SEQ ID NO: 274986 - DNA, 75 bp, Artificial Sequence
  Synthetic
tgatggagcgcattggggccctgaaggaacaatactcagaatcatggcatgaagataaggaacacccctacagaa

SEQ ID NO: 274987 - DNA, 75 bp, Artificial Sequence
  Synthetic
agattttcttgcacgtgtgtgcggacactttagtcagtgtccgcggcgttcctttgaacgtgagtgtgttgagga

SEQ ID NO: 274988 - DNA, 75 bp, Artificial Sequence
  Synthetic
catggcagtattggggtagctaccgcactcctgccactggatcagcggcttcacttatcaatggagtggtgaagt

SEQ ID NO: 274989 - DNA, 75 bp, Artificial Sequence
  Synthetic
tgttgagctggccttggaatgcccgagaggatgttactagaatggccatgacagacacaacagcgtttgggcaac

SEQ ID NO: 274990 - DNA, 75 bp, Artificial Sequence
  Synthetic
agcgcgttttcaaagaaaaagtggacacaaaggcccaggaaccacagccaggcaccagagtgatcatgagagcgg

SEQ ID NO: 274991 - DNA, 75 bp, Artificial Sequence
  Synthetic
tgagtgactggctacttgagcaccttcacagccgagccagggtgaggatgtgcaccagagatgaattcatagcaa

SEQ ID NO: 274992 - DNA, 75 bp, Artificial Sequence
  Synthetic
tcacagccgagccagggtgaggatgtgcaccagagatgaattcatagcaaaggtgagatccaacgcagctctggg

SEQ ID NO: 274993 - DNA, 75 bp, Artificial Sequence
  Synthetic
cgcatggtcggatgaacagaataaatggagctcagcgaaagaagcagtggaagacccagagttttggaacctggt

SEQ ID NO: 274994 - DNA, 75 bp, Artificial Sequence
  Synthetic
ggatgaagagcgctctagacacctgaaaggccaatgtcgacattgtgtgtacaacatgatgggaaagagagagaa

SEQ ID NO: 274995 - DNA, 75 bp, Artificial Sequence
  Synthetic
agagttcaaaacggaacatgcgtcattttggcaacggacatgggagaatggtgtgaagattcaataacctactcc

SEQ ID NO: 274996 - DNA, 75 bp, Artificial Sequence
  Synthetic
ttttggcaacggacatgggagaatggtgtgaagattcaataacctactcctgtgttaccattgaccaggaagaag

SEQ ID NO: 274997 - DNA, 75 bp, Artificial Sequence
  Synthetic
gaagctgggtgagtttggagtcgctaagggcagcagggccatctggtacatgtggcttgggagccgtttccttga

SEQ ID NO: 274998 - DNA, 75 bp, Artificial Sequence
  Synthetic
gtttgaagtcctaggtttcctcaacgaagaacactgggcttccagggtggtcagtggagccggagtggaaggaac

SEQ ID NO: 274999 - DNA, 75 bp, Artificial Sequence
  Synthetic
cagcctcaactatcttggttggttgctcagggagcttggagcaaaagatggcggcaggttatacgccgatgacac

SEQ ID NO: 275000 - DNA, 75 bp, Artificial Sequence
  Synthetic
gcggcaggttatacgccgatgacactgctggatgggacacccgaatcaccaacgcagacttggaggatgaagagc

SEQ ID NO: 275001 - DNA, 75 bp, Artificial Sequence
  Synthetic
agatccttcggtacatggaaggagaacaccatgtgctagcaaaaacaatactggaaaaagcctatcacgcaaaag

SEQ ID NO: 275002 - DNA, 75 bp, Artificial Sequence
  Synthetic
tggttaaggttgccaggccctcccctcaaggaggatgtgtgatggatgtgatcacgagaagagaccaaaggggat

SEQ ID NO: 275003 - DNA, 75 bp, Artificial Sequence
  Synthetic
cgggacaggttgtcacgtatgccctcaataccataacaaacatgaaagtccaactaatccgcatgatggaaggag

SEQ ID NO: 275004 - DNA, 75 bp, Artificial Sequence
  Synthetic
agggagtcatcggaccagcagactcacaggatccccgtctgaaaagggtagaagcttggctgagggagcatggag

SEQ ID NO: 275005 - DNA, 75 bp, Artificial Sequence
  Synthetic
ctgaacggttggggaggatgctggtgagtggagacgactgcgtcgtcaaacccatcgacgacaggtttggaaagg

SEQ ID NO: 275006 - DNA, 75 bp, Artificial Sequence
  Synthetic
cccatcgacgacaggtttggaaaggccctgtacttcctgaatgacatggcaaaaacccgtaaggatgtgggcgag

SEQ ID NO: 275007 - DNA, 75 bp, Artificial Sequence
  Synthetic
ccctgtacttcctgaatgacatggcaaaaacccgtaaggatgtgggcgagtgggagctcagtggggtttacagct

SEQ ID NO: 275008 - DNA, 75 bp, Artificial Sequence
  Synthetic
gggaagaagtgcccttctgctcacaccatttccatgagctcgtgatgaaggatgggcgttcccttatagtgccct

SEQ ID NO: 275009 - DNA, 75 bp, Artificial Sequence
  Synthetic
gcagagatcaagacgagctggtcggcagagcacgagtgtcgccaggatgtggatggagcgtgcgggagacagcct

SEQ ID NO: 275010 - DNA, 75 bp, Artificial Sequence
  Synthetic
gcctgtccaaagcgtatgggcagatgtggctcctcaactacttccatcgcagagatctccgtacccttggacttg

SEQ ID NO: 275011 - DNA, 75 bp, Artificial Sequence
  Synthetic
agactatggagatgtgtcattgacatgtaaggtggcaagtggaattgatgtcgcccagactgtggtgatgtcgct

SEQ ID NO: 275012 - DNA, 75 bp, Artificial Sequence
  Synthetic
ccatatgctctgcggttcccgtgaactgggttccgatgggccgcaccacctggagcatccatgcgagtggtgagt

SEQ ID NO: 275013 - DNA, 75 bp, Artificial Sequence
  Synthetic
ggatgacgacagaagacatgctacgcatctggaacaaggtctggattttggacaaccctcacatggaaaacaaac

SEQ ID NO: 275014 - DNA, 75 bp, Artificial Sequence
  Synthetic
aaatggtggatgaatggagagatattccctacctaccaaagacacaggatctggtatgttcctcacttgttggaa

SEQ ID NO: 275015 - DNA, 75 bp, Artificial Sequence
  Synthetic
ggaaggaaagggctgaatgggccaagaacatctggggctcagtggaaaaggtgaggaaacttattggagcagagg

SEQ ID NO: 275016 - DNA, 75 bp, Artificial Sequence
  Synthetic
aatacagagactatttggcaaacatggacagacatgatctgcactgggagctcaagctagagagctcaataatct

SEQ ID NO: 275017 - DNA, 75 bp, Artificial Sequence
  Synthetic
aaactagcacaaccaaataatcagaagaaacccactacagggggtgatgtggcagcgcaccacgacatcgtgacg

SEQ ID NO: 275018 - DNA, 75 bp, Artificial Sequence
  Synthetic
catggaggtgtcttacacgggaagcgacaagccctgccggattccggtacgagcagtggcacatggtgtcccgac

SEQ ID NO: 275019 - DNA, 75 bp, Artificial Sequence
  Synthetic
ggaagaggtcgtccccgacgcatcatctctctagggcattttcgtgagaccctcatggctgctaaaggggcatca

SEQ ID NO: 275020 - DNA, 75 bp, Artificial Sequence
  Synthetic
gccgtgtagtaagaaggccccgacctactgcggcagcacacacagtgacgggaagttggtcgctcccgacgcagt

SEQ ID NO: 275021 - DNA, 75 bp, Artificial Sequence
  Synthetic
cgcagttaggtcagagaaaattttgtgagaccaaaaggcctcctggaaggctcaccaggggttaggccattctag

SEQ ID NO: 275022 - DNA, 75 bp, Artificial Sequence
  Synthetic
tgcacgtgtgtgcgggcactttagtcagtgtccgcggcgttcttttgaacgtgagtgtgttgagaaaaagacagc

SEQ ID NO: 275023 - DNA, 75 bp, Artificial Sequence
  Synthetic
aacatgcatgggactttggttcagtgggcggaatcctgtcgtcagtggggaaagccgttcacacagtgttgggag

SEQ ID NO: 275024 - DNA, 75 bp, Artificial Sequence
  Synthetic
gggcgttcaacaccctttttgggggagttgggttcatccctaagatgctgttgggagtcgccttggtgtggttgg

SEQ ID NO: 275025 - DNA, 75 bp, Artificial Sequence
  Synthetic
agttgggttcatccctaagatgctgttgggagtcgccttggtgtggttggggctcaacgctaggaatccaacaat

SEQ ID NO: 275026 - DNA, 75 bp, Artificial Sequence
  Synthetic
aaggtgtcatggaagagttggggcaagtcaatcttgtggagtgtgcctgaaagtcctaggcgcatgatgatgggg

SEQ ID NO: 275027 - DNA, 75 bp, Artificial Sequence
  Synthetic
cgctgtggtagacaggctggattcagggggagaaggtctgtggtcatcccgacacatgcacaaaaggacatggtt

SEQ ID NO: 275028 - DNA, 75 bp, Artificial Sequence
  Synthetic
gggggagaaggtctgtggtcatcccgacacatgcacaaaaggacatggttgggcgaggacacgcatggctcaagg

SEQ ID NO: 275029 - DNA, 75 bp, Artificial Sequence
  Synthetic
tggctttggcttggctcatgctggatagttggatggctagggtgactgtgatccttctggcgctgagccttgggc

SEQ ID NO: 275030 - DNA, 75 bp, Artificial Sequence
  Synthetic
agaactgaccttgtattctcagggcaatcgtctgaccatggggagaaacggccttttgacatcaaagatggcgtc

SEQ ID NO: 275031 - DNA, 75 bp, Artificial Sequence
  Synthetic
tatcgcatatacgcccctggactcgtatggggtcaccgtcagattggagtggggtatggaacaaaaggagtccta

SEQ ID NO: 275032 - DNA, 75 bp, Artificial Sequence
  Synthetic
cttgcgcaggccctcagagaggcctttgagagaggcatctgtggagttgtgccccaaaacagacttgagatggcc

SEQ ID NO: 275033 - DNA, 75 bp, Artificial Sequence
  Synthetic
cagtgtgacaagagaggagcctcagtcagaagcaccacagaaagcgggaaaatcatcccagagtggtgctgccga

SEQ ID NO: 275034 - DNA, 75 bp, Artificial Sequence
  Synthetic
tgaacaggaccgcagcggcgatgactgaagccggtgcagtggccgtggccgctctgggacagttgttgaggccag

SEQ ID NO: 275035 - DNA, 75 bp, Artificial Sequence
  Synthetic
gggccattgttgatgtcatgtgtcacgccacttatgtcaatcgccgactcttgccacaggggagacagaattggg

SEQ ID NO: 275036 - DNA, 75 bp, Artificial Sequence
  Synthetic
cgccacttatgtcaatcgccgactcttgccacaggggagacagaattgggaggtggctataatggatgaagcaca

SEQ ID NO: 275037 - DNA, 75 bp, Artificial Sequence
  Synthetic
ggtttggccgtatcacggggttgcgctaaacttgcatggttagaagagagaggctacgcgacactcaagggggaa

SEQ ID NO: 275038 - DNA, 75 bp, Artificial Sequence
  Synthetic
gatgtgatggagcgcattggggccctgaaggaacaatactcagaatcatggcatgaagacaaggaacacccctac

SEQ ID NO: 275039 - DNA, 75 bp, Artificial Sequence
  Synthetic
tgaaggaacaatactcagaatcatggcatgaagacaaggaacacccctacagaacatggcagtattggggtagct

SEQ ID NO: 275040 - DNA, 75 bp, Artificial Sequence
  Synthetic
tggcaaaaacccgtaaggatgtgggcgagtgggagccctcagtggggttcacagcctgggaagaagtgcccttct

SEQ ID NO: 275041 - DNA, 75 bp, Artificial Sequence
  Synthetic
ttctccctgagccaccgccatccaggcacagatagcctgacaaggagatggtgtgtgactcggaaaaacacccgc

SEQ ID NO: 275042 - DNA, 75 bp, Artificial Sequence
  Synthetic
gtgtggacactttagtcagtgtccgcggcgttcctttgaacgtgagtgtgttgaggaaaagacagcttaggagaa

SEQ ID NO: 275043 - DNA, 75 bp, Artificial Sequence
  Synthetic
accaaacaagagaaaagacttgtctgtaatagttatctaatcatttaaaatatttagggttaaagtattaacctc

SEQ ID NO: 275044 - DNA, 75 bp, Artificial Sequence
  Synthetic
aaaaggacagatcaggaactttgatttctaagcatagtgccaaaatggcagggttattaagtgtctttgacacat

SEQ ID NO: 275045 - DNA, 75 bp, Artificial Sequence
  Synthetic
ttagttctaaaaggagtgagagcataaatagaggaggtggtggtgcggttatacctggacaaaagaacaccgtct

SEQ ID NO: 275046 - DNA, 75 bp, Artificial Sequence
  Synthetic
aaatagaggaggtggtggtgcggttatacctggacaaaagaacaccgtctcagtatttgttctaggctcaagtat

SEQ ID NO: 275047 - DNA, 75 bp, Artificial Sequence
  Synthetic
tgtagacgatagcgataagttagctatagcactcatgtttttaacacatgctcttgatactgacaagcaacattc

SEQ ID NO: 275048 - DNA, 75 bp, Artificial Sequence
  Synthetic
acaaagaagcggtttcctggtttcattaatggcaatggcatatagtagccctgaattatatctaacaactaatgg

SEQ ID NO: 275049 - DNA, 75 bp, Artificial Sequence
  Synthetic
agttaatgcagatgttaagtatgttatctacacaattgagcatgatcctcagaggacaacccataatgggttcat

SEQ ID NO: 275050 - DNA, 75 bp, Artificial Sequence
  Synthetic
atctacacaattgagcatgatcctcagaggacaacccataatgggttcattgttagaacaagagatatggactat

SEQ ID NO: 275051 - DNA, 75 bp, Artificial Sequence
  Synthetic
gaaaagacaacagagtggctattcagccgtataactaataaatacccattacttcagggacaaaaagacactcat

SEQ ID NO: 275052 - DNA, 75 bp, Artificial Sequence
  Synthetic
gatccagaatcgctactccagacttatggatatccctcatgtttaggagcattgatagtccaggtctggattgtc

SEQ ID NO: 275053 - DNA, 75 bp, Artificial Sequence
  Synthetic
ttggtcaaagcaattacaagtagtgctggattgaagaaaggattcttcaataggcttgaagccttcaggcaggat

SEQ ID NO: 275054 - DNA, 75 bp, Artificial Sequence
  Synthetic
ggaacagttagaagctcactagtcttcagtggagagacagttgaggggattgggtcagtgatgaggtctcagcag

SEQ ID NO: 275055 - DNA, 75 bp, Artificial Sequence
  Synthetic
tcagtggagagacagttgaggggattgggtcagtgatgaggtctcagcagagcctggtgtccttaatggtagaaa

SEQ ID NO: 275056 - DNA, 75 bp, Artificial Sequence
  Synthetic
cactagttaccatgaacacagctagatctgacttgaccactctagagaagaatattcagattgttgggaattaca

SEQ ID NO: 275057 - DNA, 75 bp, Artificial Sequence
  Synthetic
tcagagatgcaggtcttgcttcatttatgaacacgattagatatggtgtggagactaagatggcagcacttacat

SEQ ID NO: 275058 - DNA, 75 bp, Artificial Sequence
  Synthetic
tatctaatcttagacctgatattaataaactaaagagtttaattgacatctacttatctaaaggtgcaagagccc

SEQ ID NO: 275059 - DNA, 75 bp, Artificial Sequence
  Synthetic
cctttatatgtatattacgtgatccagtacacggagaatttgctcctggaaattatccagcattgtggagttatg

SEQ ID NO: 275060 - DNA, 75 bp, Artificial Sequence
  Synthetic
agtacacggagaatttgctcctggaaattatccagcattgtggagttatgctatgggggtcgcagtagtccagaa

SEQ ID NO: 275061 - DNA, 75 bp, Artificial Sequence
  Synthetic
caaagccatgcagcagtatgttacagggagaacatatctggatatggaaatgttccttcttggtcaagcagtagc

SEQ ID NO: 275062 - DNA, 75 bp, Artificial Sequence
  Synthetic
gggagaacatatctggatatggaaatgttccttcttggtcaagcagtagctaaagacgcagagtctaagattagt

SEQ ID NO: 275063 - DNA, 75 bp, Artificial Sequence
  Synthetic
tgttccttcttggtcaagcagtagctaaagacgcagagtctaagattagtaatgcattagagagtgaattaggta

SEQ ID NO: 275064 - DNA, 75 bp, Artificial Sequence
  Synthetic
taactgaaaatgccaaagacaggctcaaacatcatcttgctaacctttctggaggtgatggagcttatcataaac

SEQ ID NO: 275065 - DNA, 75 bp, Artificial Sequence
  Synthetic
ggaggtgatggagcttatcataaacctactggtggaggagcaatagaagttataattgacaatgcagacatagat

SEQ ID NO: 275066 - DNA, 75 bp, Artificial Sequence
  Synthetic
ctcaggacagaggaaatcacagaggaatattcaaccaggctttccaatattggagacaacaaagggagaatagca

SEQ ID NO: 275067 - DNA, 75 bp, Artificial Sequence
  Synthetic
gatgagcagaggagatgggaaacaaccagatccattagtgatgaccttaatccagataacaacactgacgatgaa

SEQ ID NO: 275068 - DNA, 75 bp, Artificial Sequence
  Synthetic
gtatccgctgcagaaaagaggattgcagaaagactggcaaaaaaggaggggaagaacaccagatcggatatactc

SEQ ID NO: 275069 - DNA, 75 bp, Artificial Sequence
  Synthetic
accaccggtggtatgaccgaagatacagacaatgatgatgatataatgagaatgaatgcactaggagggatatga

SEQ ID NO: 275070 - DNA, 75 bp, Artificial Sequence
  Synthetic
taaatccaaacaaaaggttttatatattagttaataagaaaaacttagggtgaaagaacagctcctagacactag

SEQ ID NO: 275071 - DNA, 75 bp, Artificial Sequence
  Synthetic
gaacttcatcaccccaaaagataggatcccaaactggccacccacaaaagaaccccccaaaaaccagagactaaa

SEQ ID NO: 275072 - DNA, 75 bp, Artificial Sequence
  Synthetic
tggatcaggatgccttcttttctgaagaatctatggaggaacagaaggagggacgctcaacaaccagcacactca

SEQ ID NO: 275073 - DNA, 75 bp, Artificial Sequence
  Synthetic
ccagtgcagtcggactcatcgacatcatccttgccagtgaacccacagacatcagaaaagatagaaaataccttt

SEQ ID NO: 275074 - DNA, 75 bp, Artificial Sequence
  Synthetic
gtgagcccatcacagcttggggaaaatcagaagcaagcaagatttctaaggatgcagtctgtgaagaaaacccaa

SEQ ID NO: 275075 - DNA, 75 bp, Artificial Sequence
  Synthetic
gaacagaaagggaagattatggacaaagtgaagagagtggaattcttagggagtcaaacaagtttgaagcaaaag

SEQ ID NO: 275076 - DNA, 75 bp, Artificial Sequence
  Synthetic
aagtgaagagagtggaattcttagggagtcaaacaagtttgaagcaaaagtttcttttagagaaactcatagctc

SEQ ID NO: 275077 - DNA, 75 bp, Artificial Sequence
  Synthetic
agatacatcatggagggcttggagaagaagtagtgcagactctatacttgagaatatgggcaatggatccgactc

SEQ ID NO: 275078 - DNA, 75 bp, Artificial Sequence
  Synthetic
ctatggcaatgaaattactggaaatggaagaggaaatcagagacaaagtcttgaagctaaagttggagagatgga

SEQ ID NO: 275079 - DNA, 75 bp, Artificial Sequence
  Synthetic
tccgagttctaatacgaggagaaaagacaaaactgagagacttccagaagagatacgaggaggttcacccatacc

SEQ ID NO: 275080 - DNA, 75 bp, Artificial Sequence
  Synthetic
taatgacagagaaagtagaagaaataataatggaggaagcctggagtctgtcagcacatataatccaagagtaga

SEQ ID NO: 275081 - DNA, 75 bp, Artificial Sequence
  Synthetic
aaataatattatggatccaactcaccaccttgaagaagaggtacttaagaggaacaagccacgagagatgaatgc

SEQ ID NO: 275082 - DNA, 75 bp, Artificial Sequence
  Synthetic
tacaagtcaatggccaggcggacacaagactgatcaacaagatggtaggcatgaatcgacaaccaatctaatatc

SEQ ID NO: 275083 - DNA, 75 bp, Artificial Sequence
  Synthetic
ctcaaatcaaaacaggccacaaggcacaaaaaagggaaaagggaaagaatcagctgtaaagcccaagattagaaa

SEQ ID NO: 275084 - DNA, 75 bp, Artificial Sequence
  Synthetic
atctaaaatgtcttttgaagacacaagaaacacagatcacatctatgaagactctcaagatcatataaggagaaa

SEQ ID NO: 275085 - DNA, 75 bp, Artificial Sequence
  Synthetic
agaaacacagatcacatctatgaagactctcaagatcatataaggagaaagcaaacagataacgagccatcacaa

SEQ ID NO: 275086 - DNA, 75 bp, Artificial Sequence
  Synthetic
aagattggtaaaaaaggcacagaagagaataccttatatacagaagaggtgatcaaattgttagtgagtcttggt

SEQ ID NO: 275087 - DNA, 75 bp, Artificial Sequence
  Synthetic
gatcaaattgttagtgagtcttggtgtaatcccatctgcagccgcattcaaccaatcccgaaacgtatgccatgt

SEQ ID NO: 275088 - DNA, 75 bp, Artificial Sequence
  Synthetic
atttgcgaaacgtgtcctcaattctgtgaactttgcagaaatgacagctaatatgtgcggattattgctatctgt

SEQ ID NO: 275089 - DNA, 75 bp, Artificial Sequence
  Synthetic
tgagaaatcagtatcagaccggattgaagaaaataagacactaataaatcagattataagtgatttaagtacagg

SEQ ID NO: 275090 - DNA, 75 bp, Artificial Sequence
  Synthetic
tagggaagtgcagaaacgtttcactgagtatcaaaaggaacagaactcattgattatgtcaaatctggcgacact

SEQ ID NO: 275091 - DNA, 75 bp, Artificial Sequence
  Synthetic
ccatatcataacagatagaggaggaaagaacaacagcgtggatacaggagagagaaaaccatcaatcaggaccaa

SEQ ID NO: 275092 - DNA, 75 bp, Artificial Sequence
  Synthetic
gggcaaggagctaacacagaaaacacaaaggtttgatccatctatggaattcaccgaagagatgaagtacaaacc

SEQ ID NO: 275093 - DNA, 75 bp, Artificial Sequence
  Synthetic
cgatctatacagggaagacacattgagacaaagaataacaaatcctgtccttgatgagagcgcagacaaaatcga

SEQ ID NO: 275094 - DNA, 75 bp, Artificial Sequence
  Synthetic
caattcgaatgccgcgagactgataccttgcaaagaaaaatcaacactgcgttcacttaaattgattattgagaa

SEQ ID NO: 275095 - DNA, 75 bp, Artificial Sequence
  Synthetic
gttcacttaaattgattattgagaacagcaatttaagtaaagcagacaaaattgcctatatcaggtcattatcaa

SEQ ID NO: 275096 - DNA, 75 bp, Artificial Sequence
  Synthetic
aatgcaaagatgacaaagaggtagaatcagtaatgaaactatttgaggaagatatagaatcaagtaatgaataat

SEQ ID NO: 275097 - DNA, 75 bp, Artificial Sequence
  Synthetic
tactgaccagcatatccagaaaacatcaagacaagagtgtactgtgacaagcaatgactctccaaatacctaata

SEQ ID NO: 275098 - DNA, 75 bp, Artificial Sequence
  Synthetic
agaaaaacttagggtgcaagactcaccaaccaaatcaaacaaatggccgagatctacaagttccccaagctatcg

SEQ ID NO: 275099 - DNA, 75 bp, Artificial Sequence
  Synthetic
gatctacaagttccccaagctatcgtatgaggaacatggatatatggaacctctaccactaaagaccggcccaga

SEQ ID NO: 275100 - DNA, 75 bp, Artificial Sequence
  Synthetic
caagaaggcagtcccacacataaggataatcaagataggggacccaccgaagcatggaaatcgataccttgatat

SEQ ID NO: 275101 - DNA, 75 bp, Artificial Sequence
  Synthetic
tctcttacttgggttttatgagatacccaaagaagttggaacatatggtagtgtatcagatttgacgagacccac

SEQ ID NO: 275102 - DNA, 75 bp, Artificial Sequence
  Synthetic
gtgtatcagatttgacgagacccacgggatacacaatctgcggttcaggatcattacctattggaatcgctaggt

SEQ ID NO: 275103 - DNA, 75 bp, Artificial Sequence
  Synthetic
acttaggtacagatcaggaactactcaaagcatcagtagagctaaaggtgacagtaagaaggacagtaaggtcaa

SEQ ID NO: 275104 - DNA, 75 bp, Artificial Sequence
  Synthetic
acagtaagaaggacagtaaggtcaagtgagatgattgtgtatatggtagattccataccaccagcaatgatggct

SEQ ID NO: 275105 - DNA, 75 bp, Artificial Sequence
  Synthetic
gtgagatgattgtgtatatggtagattccataccaccagcaatgatggcttgggcttctagactgaaacgaggca

SEQ ID NO: 275106 - DNA, 75 bp, Artificial Sequence
  Synthetic
tgggcttctagactgaaacgaggcatgatattcaatgcaaacaaagtagccctagctcctcaatgtctgcctata

SEQ ID NO: 275107 - DNA, 75 bp, Artificial Sequence
  Synthetic
cctagctcctcaatgtctgcctatagacaaagatataagattcagagttgtctttgtaaatggcacttctctagg

SEQ ID NO: 275108 - DNA, 75 bp, Artificial Sequence
  Synthetic
ttctattacaatagcaaaagttcccaagacattagccgatcttgccttaccgaattccatatccgtcaatttaat

SEQ ID NO: 275109 - DNA, 75 bp, Artificial Sequence
  Synthetic
ggtctcactcaagactggtgcgtcaactgagtccaagggcattattcctacgctaaacgaaaagggcgacaaggt

SEQ ID NO: 275110 - DNA, 75 bp, Artificial Sequence
  Synthetic
cgctaaacgaaaagggcgacaaggtactaaactttatggtacacctcggattaatacataggaaagtcggaagag

SEQ ID NO: 275111 - DNA, 75 bp, Artificial Sequence
  Synthetic
tgtattcaatggagtattgcaaaggtaaaatagagaagatgcggctgatcttctcattaggactggttggaggaa

SEQ ID NO: 275112 - DNA, 75 bp, Artificial Sequence
  Synthetic
tcagtttccatgttcagcttacaggtgtggtatctaaatcctttgttggtcagcttggagggaaaaaggaaatat

SEQ ID NO: 275113 - DNA, 75 bp, Artificial Sequence
  Synthetic
cagcttggagggaaaaaggaaatatgttaccctttgatggatgttaatccacacatgaatttagttatctgggct

SEQ ID NO: 275114 - DNA, 75 bp, Artificial Sequence
  Synthetic
gcttccgttgaaatcaccggcgtagatgctgtcttccaaccctccattccaagagatttcaaatactacccgaat

SEQ ID NO: 275115 - DNA, 75 bp, Artificial Sequence
  Synthetic
gtggtggcaaaaaacattggaaaaataaaagtctagagatccacaactacagtaaccccagacatttcaatatta

SEQ ID NO: 275116 - DNA, 75 bp, Artificial Sequence
  Synthetic
gactggtaagtgtcatcatatgatcagcatcattcatcaaaaataagaaaaacttagggtacaagttatccaaaa

SEQ ID NO: 275117 - DNA, 75 bp, Artificial Sequence
  Synthetic
aagacaaaacagaacaaacatatcaagacaaaaaatcataagatgcaagtcaccacccttagaccagccataata

SEQ ID NO: 275118 - DNA, 75 bp, Artificial Sequence
  Synthetic
caccacccttagaccagccataatactaagcatagcactattagtaaccggtcaagtccctagagataaactagc

SEQ ID NO: 275119 - DNA, 75 bp, Artificial Sequence
  Synthetic
caatttagggatcatcattaaggacagcaaagcactcaaaattgcaggatcttatgaaaacagatacatagtctt

SEQ ID NO: 275120 - DNA, 75 bp, Artificial Sequence
  Synthetic
cttatgaaaacagatacatagtcttaagccttgtaccaacaatagacaatgtgaatgggtgtggttctatccaaa

SEQ ID NO: 275121 - DNA, 75 bp, Artificial Sequence
  Synthetic
aagccttgtaccaacaatagacaatgtgaatgggtgtggttctatccaaatagcaaaatataaagagatgcttga

SEQ ID NO: 275122 - DNA, 75 bp, Artificial Sequence
  Synthetic
aagattgttaataccgataaaagatgcactagatttacaagagtctttgatagtgattgataatgaaaccgtcaa

SEQ ID NO: 275123 - DNA, 75 bp, Artificial Sequence
  Synthetic
gcactagatttacaagagtctttgatagtgattgataatgaaaccgtcaacaacaattatagtcctcagtataga

SEQ ID NO: 275124 - DNA, 75 bp, Artificial Sequence
  Synthetic
tttgttggtgcaattatcgggactatagcccttggggtagcaactgcggcccaagttacagcaggagtggccttg

SEQ ID NO: 275125 - DNA, 75 bp, Artificial Sequence
  Synthetic
atggaggcaagagaagccaaaagagatatatcaatgttaaaagaagcaattgagaagactcaaaactcaattgaa

SEQ ID NO: 275126 - DNA, 75 bp, Artificial Sequence
  Synthetic
aaattacagaattctgcaggtgaacagatactggctctcaaaatgctccaggattatgtcaatggagagatcaaa

SEQ ID NO: 275127 - DNA, 75 bp, Artificial Sequence
  Synthetic
ccagccattgaagaacttggatgtgagacggctgcacttaaattaggaattgcacttacacaacattatacagag

SEQ ID NO: 275128 - DNA, 75 bp, Artificial Sequence
  Synthetic
agacggctgcacttaaattaggaattgcacttacacaacattatacagagctcacaaatgcctttggttcgaatc

SEQ ID NO: 275129 - DNA, 75 bp, Artificial Sequence
  Synthetic
taggttccataggagagaagagcttaacattacaggccctatcatcattatacaagactaatataactaatatac

SEQ ID NO: 275130 - DNA, 75 bp, Artificial Sequence
  Synthetic
tgacagcaaccaatctcgggaagacagatatttatgacattatatatgctgagcaagttaaaggaagagtaatag

SEQ ID NO: 275131 - DNA, 75 bp, Artificial Sequence
  Synthetic
agatatttatgacattatatatgctgagcaagttaaaggaagagtaatagatgtcgatcttaaacgatatatggt

SEQ ID NO: 275132 - DNA, 75 bp, Artificial Sequence
  Synthetic
tacaatatctgtaaagataccaatattatcagaaataccaggagtattgatctatgaagtctcctctatatctta

SEQ ID NO: 275133 - DNA, 75 bp, Artificial Sequence
  Synthetic
caatatagatggagcagagtggtatgccgctgtacctgaccacatattaagcaaatccgcatatataggaggtgc

SEQ ID NO: 275134 - DNA, 75 bp, Artificial Sequence
  Synthetic
agatataagtgattgtatagaatccagattgacatatatttgcccgcaagatcctgctcagattatagcagataa

SEQ ID NO: 275135 - DNA, 75 bp, Artificial Sequence
  Synthetic
agattgacatatatttgcccgcaagatcctgctcagattatagcagataatcaacagcaatgtttttttggtcat

SEQ ID NO: 275136 - DNA, 75 bp, Artificial Sequence
  Synthetic
cttgacaagtgccctattactaaagtcattgataatcttgtgcctaaatttgcattcataaatggtggagtagtt

SEQ ID NO: 275137 - DNA, 75 bp, Artificial Sequence
  Synthetic
gcgaactgtatagcctctacatgtacctgtggagaagagaggatccaggtctctcaagatagaaataaaggagta

SEQ ID NO: 275138 - DNA, 75 bp, Artificial Sequence
  Synthetic
acctttttaactcataataattgtggattaatagggataaacgggatagaatttcatgctaacaagaaagggagt

SEQ ID NO: 275139 - DNA, 75 bp, Artificial Sequence
  Synthetic
atttcatgctaacaagaaagggagtgatgctacttggaatgtctcccctataggagtagggccagcagtatcgtt

SEQ ID NO: 275140 - DNA, 75 bp, Artificial Sequence
  Synthetic
aaggccagtagatatatctttacaaatagttgctgctactaattttctaaactcatcacgaaaagatcttatgaa

SEQ ID NO: 275141 - DNA, 75 bp, Artificial Sequence
  Synthetic
atagttgctgctactaattttctaaactcatcacgaaaagatcttatgaaggcaaaagaaatcttaaaccaggta

SEQ ID NO: 275142 - DNA, 75 bp, Artificial Sequence
  Synthetic
ggaaatcttaaagatttaaccaccataacgataattaatatagtaattataattatattacttatatgtgtaatt

SEQ ID NO: 275143 - DNA, 75 bp, Artificial Sequence
  Synthetic
taacgataattaatatagtaattataattatattacttatatgtgtaattggattaggcatactgtatcaccaat

SEQ ID NO: 275144 - DNA, 75 bp, Artificial Sequence
  Synthetic
tgagaagtgcactagggatgagagacaagatgtcagtattaaacaatagttcttactctttagaaccaagaaccg

SEQ ID NO: 275145 - DNA, 75 bp, Artificial Sequence
  Synthetic
tcttactctttagaaccaagaaccgcccaggtacaagtaattaaacctaccagtttcatgggataaactataaaa

SEQ ID NO: 275146 - DNA, 75 bp, Artificial Sequence
  Synthetic
atatattttaatccatcctcactaatcaaagtaaagaaaacttagggtgcacgacagtaactcaccaccaaagga

SEQ ID NO: 275147 - DNA, 75 bp, Artificial Sequence
  Synthetic
gaaacagttaggagaccaacacaccaagggatggaagagaccaaagttaagacatcagagtactgggccaggagt

SEQ ID NO: 275148 - DNA, 75 bp, Artificial Sequence
  Synthetic
cctcaaattcacgcaacaaatcatcctaacgtacagaacagagagaagatcaaagaaatattaacaattttaata

SEQ ID NO: 275149 - DNA, 75 bp, Artificial Sequence
  Synthetic
tcatttatttcttccctatctcttgtactggttatagctgtattgataatgcaatctttacataacggcacaata

SEQ ID NO: 275150 - DNA, 75 bp, Artificial Sequence
  Synthetic
ctaagatgtaaagatgtaggcctagaatctatcaataaatcaacttactctatatctaatgcaattctggacgtc

SEQ ID NO: 275151 - DNA, 75 bp, Artificial Sequence
  Synthetic
aatctatcaataaatcaacttactctatatctaatgcaattctggacgtcatcaaacaagagctgataactcgta

SEQ ID NO: 275152 - DNA, 75 bp, Artificial Sequence
  Synthetic
taataaatactcaaagttctgtgcaggtagctctcccaatcttgattaacaagaaaatccaggatctctcactaa

SEQ ID NO: 275153 - DNA, 75 bp, Artificial Sequence
  Synthetic
taattgagaaaagttcaaaagtgcatcaaaattctcctacttgtagtggtgtggctgccctgacacatgtggaag

SEQ ID NO: 275154 - DNA, 75 bp, Artificial Sequence
  Synthetic
tcaaaattctcctacttgtagtggtgtggctgccctgacacatgtggaagggataaaacctttagatccagacga

SEQ ID NO: 275155 - DNA, 75 bp, Artificial Sequence
  Synthetic
ttactggaggtgtccaagtggggaaccatatctggaggatgaattgacattaagccttatccctggacctagtat

SEQ ID NO: 275156 - DNA, 75 bp, Artificial Sequence
  Synthetic
gttggctggaacctctaccattgatggctgtgtaagattaccatcccttgcaataggaaaatcgctatatgccta

SEQ ID NO: 275157 - DNA, 75 bp, Artificial Sequence
  Synthetic
ggctgtgtaagattaccatcccttgcaataggaaaatcgctatatgcctatagttccaacctgataactaagggt

SEQ ID NO: 275158 - DNA, 75 bp, Artificial Sequence
  Synthetic
tgtcaagacatagggaaatcctatcaagtgctacagttaggtattataactctaaactcagacctacatcctgat

SEQ ID NO: 275159 - DNA, 75 bp, Artificial Sequence
  Synthetic
tctaaactcagacctacatcctgatttaaatcctataatatcacatacttatgatataaatgataatagaaagtc

SEQ ID NO: 275160 - DNA, 75 bp, Artificial Sequence
  Synthetic
ttgttctgttgctgtatcagaaactaaaggataccaattatgctcgatgccacgtgtcaacgaaaaaacagatta

SEQ ID NO: 275161 - DNA, 75 bp, Artificial Sequence
  Synthetic
cactagtgatggtatagaagatatagtttttgatgtacttgatctcaaaggatcctctagaagtttcaaattttc

SEQ ID NO: 275162 - DNA, 75 bp, Artificial Sequence
  Synthetic
aaacaatgatataaactttgatcatcctttctcagcgttataccctagtgtaggaagtggtattatatggaaaaa

SEQ ID NO: 275163 - DNA, 75 bp, Artificial Sequence
  Synthetic
taggaagtggtattatatggaaaaatgaactatatttcttaggttatggggctcttacaactgcacttcaaggga

SEQ ID NO: 275164 - DNA, 75 bp, Artificial Sequence
  Synthetic
atacaaaatgtaatttaatgggatgtccgggagcaacacaagacaactgcaacaagttcatctctagttcatggt

SEQ ID NO: 275165 - DNA, 75 bp, Artificial Sequence
  Synthetic
tatacagcaaacagatggttaatgtactgatacaggttaaggggtatttatctagcaagccaagtattatagtta

SEQ ID NO: 275166 - DNA, 75 bp, Artificial Sequence
  Synthetic
gaacaatcccaataacggaaaattatgtaggagcagaagggaaactagtgggaacacgtgagagaatatatatat

SEQ ID NO: 275167 - DNA, 75 bp, Artificial Sequence
  Synthetic
atacaagatcaacgggttggcataccaatttacaaataggagtacttaatataaatcatccaataaccataactt

SEQ ID NO: 275168 - DNA, 75 bp, Artificial Sequence
  Synthetic
caatttacaaataggagtacttaatataaatcatccaataaccataacttggacagatcacagagtgctatcaag

SEQ ID NO: 275169 - DNA, 75 bp, Artificial Sequence
  Synthetic
ataaatcatccaataaccataacttggacagatcacagagtgctatcaagaccaggaagaagtccttgtgcctgg

SEQ ID NO: 275170 - DNA, 75 bp, Artificial Sequence
  Synthetic
aataacaaatgccctagaaattgtactactggtgtatacacagatgcttatcctatatcgcctgatgctaattat

SEQ ID NO: 275171 - DNA, 75 bp, Artificial Sequence
  Synthetic
gttgctacagttactctattatctaattcaacacgaaataatcctactattatgtattcatcttctgatagagta

SEQ ID NO: 275172 - DNA, 75 bp, Artificial Sequence
  Synthetic
tatgtattcatcttctgatagagtatataatatgttaagattaagaaatactgaattagaagctgcatacacaac

SEQ ID NO: 275173 - DNA, 75 bp, Artificial Sequence
  Synthetic
cacgtcgtgtattgtacactttgatagaggttattgttttcatattatagaaattaatcaaaaagaactgaatac

SEQ ID NO: 275174 - DNA, 75 bp, Artificial Sequence
  Synthetic
actacagcctatgctctttaagactgcaatacctaaagcctgcagaataagcaatttataagacacctattgaaa

SEQ ID NO: 275175 - DNA, 75 bp, Artificial Sequence
  Synthetic
gcaatttataagacacctattgaaataataatctatatctaattacttaaaaagatgaccatgcatgacttagag

SEQ ID NO: 275176 - DNA, 75 bp, Artificial Sequence
  Synthetic
acaggtgatctgtggacacaaatcatacaggtcattaactagcatataatacatctaataagaaaaacttaggtt

SEQ ID NO: 275177 - DNA, 75 bp, Artificial Sequence
  Synthetic
gaatgcaaaagcattcagccagaatggatcattttaatatgtctcaaaatccaagtgatatactataccctgaat

SEQ ID NO: 275178 - DNA, 75 bp, Artificial Sequence
  Synthetic
gccatttgaactctccaattgtgaaagggaagatcgctcagctacatgtcttgttggacattaatcagccatatg

SEQ ID NO: 275179 - DNA, 75 bp, Artificial Sequence
  Synthetic
aaatgagggaccctagtataatagaaatcacgaaagttaaaattaaatctggagggttaaatcaaaggttaatca

SEQ ID NO: 275180 - DNA, 75 bp, Artificial Sequence
  Synthetic
gaatcagatctttagggaaagagatgaggagaattatacctgattttgataagtatacattcgaaccttacccaa

SEQ ID NO: 275181 - DNA, 75 bp, Artificial Sequence
  Synthetic
tattttctaaagaattatttagattagagataccagagatttgtgataaaattcgatcagtttttgcagtgtctg

SEQ ID NO: 275182 - DNA, 75 bp, Artificial Sequence
  Synthetic
attcgatcagtttttgcagtgtctgacaagttaagtaaagatatatctcagccattacaatacttatggagagat

SEQ ID NO: 275183 - DNA, 75 bp, Artificial Sequence
  Synthetic
gtgcgtaggcaattgggaggggattgttccaaggatctttctaacaatgagattgatatacataaaattcctgaa

SEQ ID NO: 275184 - DNA, 75 bp, Artificial Sequence
  Synthetic
gattgatatacataaaattcctgaaatccatactaaattcaccagaaataactggtataaatcattcatgacatg

SEQ ID NO: 275185 - DNA, 75 bp, Artificial Sequence
  Synthetic
gttcagtattaaatatgatatgagaagatgtcaaaagaatagggaaaacataaacttagacagtaggaaatcata

SEQ ID NO: 275186 - DNA, 75 bp, Artificial Sequence
  Synthetic
taactatcttaactgtaaatactattctataattatccatccggatctcttaatgatattggacaaggtcaaata

SEQ ID NO: 275187 - DNA, 75 bp, Artificial Sequence
  Synthetic
taatgatattggacaaggtcaaatacacgggatacttactaacaccagaattagtgctaatgtactgtgatgtgg

SEQ ID NO: 275188 - DNA, 75 bp, Artificial Sequence
  Synthetic
cacgggatacttactaacaccagaattagtgctaatgtactgtgatgtggtcgaaggtagatggaatatgtctgc

SEQ ID NO: 275189 - DNA, 75 bp, Artificial Sequence
  Synthetic
tgctggacaattagatgacaaatcacataaaataacactgaaaggagaagaattgtgggacaggatagatgaatt

SEQ ID NO: 275190 - DNA, 75 bp, Artificial Sequence
  Synthetic
aattgtgggacaggatagatgaattattcaagataatcggagaagagacatttaatattatatcactattggagc

SEQ ID NO: 275191 - DNA, 75 bp, Artificial Sequence
  Synthetic
cattatctttggcattgatacaattaacagatcctgttatgtctttaaaaggtgcatttatgagacatgtcatct

SEQ ID NO: 275192 - DNA, 75 bp, Artificial Sequence
  Synthetic
cagaaatgaatgaaacattgagtaaatgtggaaacctaactgaacttgaagtggatcacataatggattcaatcc

SEQ ID NO: 275193 - DNA, 75 bp, Artificial Sequence
  Synthetic
gtggatcacataatggattcaatcctgaacatttttatggatacaacagtagatgagaaagcagagatattctcc

SEQ ID NO: 275194 - DNA, 75 bp, Artificial Sequence
  Synthetic
ttctttaggacatttggtcatcctagccttgaggcctccatagctgctgaaaaagttaggcaacatatgtatgcg

SEQ ID NO: 275195 - DNA, 75 bp, Artificial Sequence
  Synthetic
aaaagttaggcaacatatgtatgcgcagaaaagtataaaatataagaccttatgtgagtgtcacgctatattttg

SEQ ID NO: 275196 - DNA, 75 bp, Artificial Sequence
  Synthetic
tacaattataataaacggatatagagataggcacggaggacaatggcccccatgtcagttcccagatcatgtgtg

SEQ ID NO: 275197 - DNA, 75 bp, Artificial Sequence
  Synthetic
tcaagaactcaggaattctcaaggatctaattcagctatatcttatgaaacagcagttgacaatttcgagagttt

SEQ ID NO: 275198 - DNA, 75 bp, Artificial Sequence
  Synthetic
tctaattcagctatatcttatgaaacagcagttgacaatttcgagagttttataggtttcagattcgagaaattc

SEQ ID NO: 275199 - DNA, 75 bp, Artificial Sequence
  Synthetic
cagcagttgacaatttcgagagttttataggtttcagattcgagaaattcatagaccctcaattagatgaagatc

SEQ ID NO: 275200 - DNA, 75 bp, Artificial Sequence
  Synthetic
tcactatttatatgagagataaagccttgtctccaagaagagaagcctgggattctgtgtatccagatggcaatc

SEQ ID NO: 275201 - DNA, 75 bp, Artificial Sequence
  Synthetic
tgctgtataaagtgccgttctctgaagaaacaaggagattgatagaagtctttatcagtgattctaatttcaatc

SEQ ID NO: 275202 - DNA, 75 bp, Artificial Sequence
  Synthetic
cagaagacattatacaatatgtagagacaggagagtggttgaacgatgagactttcaacatatcttatagcctaa

SEQ ID NO: 275203 - DNA, 75 bp, Artificial Sequence
  Synthetic
aagaaaaggagatcaaacaggagggtcgattatttgccaagatgacatacaaaatgagagcagtccaagtattgg

SEQ ID NO: 275204 - DNA, 75 bp, Artificial Sequence
  Synthetic
tcgattatttgccaagatgacatacaaaatgagagcagtccaagtattggcagaaactttgctagcaaaaggaat

SEQ ID NO: 275205 - DNA, 75 bp, Artificial Sequence
  Synthetic
aggaggtctatttaatgaaaatggtatggttaaaggtgaaattgatttactaaagagtctaactactttatctat

SEQ ID NO: 275206 - DNA, 75 bp, Artificial Sequence
  Synthetic
atggttaaaggtgaaattgatttactaaagagtctaactactttatctatatcaggggttccgaggactagcgag

SEQ ID NO: 275207 - DNA, 75 bp, Artificial Sequence
  Synthetic
atttataatgaatcagttagggaagaagaggataggaaaagatgggaaagggaaaattcctcatactattgggat

SEQ ID NO: 275208 - DNA, 75 bp, Artificial Sequence
  Synthetic
aaaaggaaaaaatcaaaacatgagttcaaggccacagactcatctactaacggctatgagactctaagctgtttt

SEQ ID NO: 275209 - DNA, 75 bp, Artificial Sequence
  Synthetic
cttactacggacttgaagaaatattgtctaaattggaggtttgagagtacatctctattcggacagagatgtaac

SEQ ID NO: 275210 - DNA, 75 bp, Artificial Sequence
  Synthetic
gaaatttttgggttcaagagattcttcaactggatgcatcctgtattggaagaatgtacaatatatgtgggtgat

SEQ ID NO: 275211 - DNA, 75 bp, Artificial Sequence
  Synthetic
tcaactggatgcatcctgtattggaagaatgtacaatatatgtgggtgatccttactgtcctgtgcccgataaaa

SEQ ID NO: 275212 - DNA, 75 bp, Artificial Sequence
  Synthetic
ttcacatgaatttagaagatcatgaagattcaggcatctttatacatagaccaaaaggtgggatagaaggttatt

SEQ ID NO: 275213 - DNA, 75 bp, Artificial Sequence
  Synthetic
gtcaaaaactttggactctcatatccataagcgcaattcatctagctgctgtcaaggtcggagttagggtatcag

SEQ ID NO: 275214 - DNA, 75 bp, Artificial Sequence
  Synthetic
ctatggtacaaggtgataaccaagcaattgctgtgacatccagggtaccagtgacggccacgtataagtccaaaa

SEQ ID NO: 275215 - DNA, 75 bp, Artificial Sequence
  Synthetic
aagagcaggtgtatacagagatcactaagtattttaagtctttaagagatgtgatgtctgatttaggacatgaac

SEQ ID NO: 275216 - DNA, 75 bp, Artificial Sequence
  Synthetic
tcaaacttaacgagacaattataagtagcaagatgtttgtgtatagtaagcgaatatattatgatggtaaaatac

SEQ ID NO: 275217 - DNA, 75 bp, Artificial Sequence
  Synthetic
tagcaagatgtttgtgtatagtaagcgaatatattatgatggtaaaatactaccccaatgtttaaaagcacttac

SEQ ID NO: 275218 - DNA, 75 bp, Artificial Sequence
  Synthetic
aaggtgtgttttttggtccgagaccttggtggatgaaaacaggtctgcgtgctccaatcttgcaactgctatagc

SEQ ID NO: 275219 - DNA, 75 bp, Artificial Sequence
  Synthetic
ttggtggatgaaaacaggtctgcgtgctccaatcttgcaactgctatagccaaagccatagaaaatggttactca

SEQ ID NO: 275220 - DNA, 75 bp, Artificial Sequence
  Synthetic
ccaatattaggttactcaatagctctgtataagacttgtcagcaagtatgtatttcattagggatgactatcaat

SEQ ID NO: 275221 - DNA, 75 bp, Artificial Sequence
  Synthetic
cctacaataacacctagtataagagaccaatattatttagggaagaattggcttagatgtgcagttttgatacct

SEQ ID NO: 275222 - DNA, 75 bp, Artificial Sequence
  Synthetic
gctaatgtagggggatttaactacatggcaatgtctagatgcttcgtcagaaatataggcgaccctgcagtagct

SEQ ID NO: 275223 - DNA, 75 bp, Artificial Sequence
  Synthetic
gctctagcagacctcaaaaggtttattcgagcaggactattggacagacagattttgtaccgtgtaatgaatcaa

SEQ ID NO: 275224 - DNA, 75 bp, Artificial Sequence
  Synthetic
ttcgagcaggactattggacagacagattttgtaccgtgtaatgaatcaagagtctggggagtctaatttcttag

SEQ ID NO: 275225 - DNA, 75 bp, Artificial Sequence
  Synthetic
actgggcatctgatccatactcatgtaatttaccgcattcgcagagtatcacaacaattataaagaatattacag

SEQ ID NO: 275226 - DNA, 75 bp, Artificial Sequence
  Synthetic
acaacaattataaagaatattacagctcgctcagttctccaagagtcaccaaatcccctactttcgggtctattt

SEQ ID NO: 275227 - DNA, 75 bp, Artificial Sequence
  Synthetic
ctcgctcagttctccaagagtcaccaaatcccctactttcgggtctatttacatatgacagtaaagaagaagact

SEQ ID NO: 275228 - DNA, 75 bp, Artificial Sequence
  Synthetic
tgaatttagcgacatttctgatggacagaaaggtcatattgccaagagttgcacatgagatactagataactctt

SEQ ID NO: 275229 - DNA, 75 bp, Artificial Sequence
  Synthetic
tgacaggaatcagagaatctatcgcaggaatgctggacactacaaaatcattagtacgggttagtattagaaaag

SEQ ID NO: 275230 - DNA, 75 bp, Artificial Sequence
  Synthetic
ggggtttatcatacaatatcttaagaaagctgataaattatgatttattacaatatgaaacattaaccaggactt

SEQ ID NO: 275231 - DNA, 75 bp, Artificial Sequence
  Synthetic
taaggaaagtcgtcacaaataacattgaatatgaatatatgtgttctgtggaattagcaattggattaaggcaaa

SEQ ID NO: 275232 - DNA, 75 bp, Artificial Sequence
  Synthetic
aaatgtggtcacatctaacatatgggagacctatacatggattagaaacacctgatcctctagaactccttaaag

SEQ ID NO: 275233 - DNA, 75 bp, Artificial Sequence
  Synthetic
gaacattcatcaaaggatctgaggtttgcaaaatatgcaggtctgaaggtgataatcctatatatacttggtttt

SEQ ID NO: 275234 - DNA, 75 bp, Artificial Sequence
  Synthetic
ttgcaaaatatgcaggtctgaaggtgataatcctatatatacttggttttatttacctgaggaaatagatttaga

SEQ ID NO: 275235 - DNA, 75 bp, Artificial Sequence
  Synthetic
taacctagaacaagggaatccatctataagaataccatattttgggtctactactgacgaaagatcagaagcaca

SEQ ID NO: 275236 - DNA, 75 bp, Artificial Sequence
  Synthetic
actaggttatgttaagacactgagtaaacctgcgaaagcagcgattaggattgctatgatatatacttgggctta

SEQ ID NO: 275237 - DNA, 75 bp, Artificial Sequence
  Synthetic
cggtactgatgagatatcatggatggaagcggctcagattgcacaaacaagagcaaatttaagtcttgataattt

SEQ ID NO: 275238 - DNA, 75 bp, Artificial Sequence
  Synthetic
gaagcggctcagattgcacaaacaagagcaaatttaagtcttgataatttgaaacttctgactccggtatcaaca

SEQ ID NO: 275239 - DNA, 75 bp, Artificial Sequence
  Synthetic
gagcaaatttaagtcttgataatttgaaacttctgactccggtatcaacatccacaaatctgtcccatagattaa

SEQ ID NO: 275240 - DNA, 75 bp, Artificial Sequence
  Synthetic
aagacactgctacccagatgaaattctcaagtgcaaccctagttagagctagtagatttattactatatcaaatg

SEQ ID NO: 275241 - DNA, 75 bp, Artificial Sequence
  Synthetic
ataagatggctctgaaagaggcaggtgagacaaaggatactaatttaatatatcagcagataatgttgacaggac

SEQ ID NO: 275242 - DNA, 75 bp, Artificial Sequence
  Synthetic
tgagacaaaggatactaatttaatatatcagcagataatgttgacaggacttagtgtctttgaattcaatactag

SEQ ID NO: 275243 - DNA, 75 bp, Artificial Sequence
  Synthetic
atacattaaaggtaagactaaacaaccaatgatcctacacttacatttaaacaatggctgctgcataatggaatc

SEQ ID NO: 275244 - DNA, 75 bp, Artificial Sequence
  Synthetic
ccaatgatcctacacttacatttaaacaatggctgctgcataatggaatcaccacaagagacttgtatccctcct

SEQ ID NO: 275245 - DNA, 75 bp, Artificial Sequence
  Synthetic
accacaagagacttgtatccctcctaaatctactctagatttagaagtaactaatgaagaaaataaattaatata

SEQ ID NO: 275246 - DNA, 75 bp, Artificial Sequence
  Synthetic
aaatctactctagatttagaagtaactaatgaagaaaataaattaatatatgataataatccattagaaagtgtt

SEQ ID NO: 275247 - DNA, 75 bp, Artificial Sequence
  Synthetic
gatctcagcattttccaaaaaattagagatatcgtgcatactgtagatatgactttctggtctgatttggaaata

SEQ ID NO: 275248 - DNA, 75 bp, Artificial Sequence
  Synthetic
gagatatcgtgcatactgtagatatgactttctggtctgatttggaaataatgagagcagtgactatctgtacgt

SEQ ID NO: 275249 - DNA, 75 bp, Artificial Sequence
  Synthetic
ctatgacaatagcagacaccatgtctcaattggatagagataaccttaaagaagtaattgttcttacgaatgatg

SEQ ID NO: 275250 - DNA, 75 bp, Artificial Sequence
  Synthetic
tcaattggatagagataaccttaaagaagtaattgttcttacgaatgatgatgacattaatagcttaataacaga

SEQ ID NO: 275251 - DNA, 75 bp, Artificial Sequence
  Synthetic
gtttatgataatagatatcccgctcttttgctcgacattcggaggaatcttagtaaatcagtttgcgtatgcatt

SEQ ID NO: 275252 - DNA, 75 bp, Artificial Sequence
  Synthetic
atacggtctaaatataagaggtagagaagaaatatggggttacgttacacggactttgaaagatacttctcatgc

SEQ ID NO: 275253 - DNA, 75 bp, Artificial Sequence
  Synthetic
ggactttgaaagatacttctcatgccgtgttaaaggtacttgctaatgcattgtcacatccaaaggtgttcaaga

SEQ ID NO: 275254 - DNA, 75 bp, Artificial Sequence
  Synthetic
gattctgggatttcggtgttttagagcctgtatatggacctaatttatccaaccaagataagataatgttagcat

SEQ ID NO: 275255 - DNA, 75 bp, Artificial Sequence
  Synthetic
aaccaagataagataatgttagcattatctgtttgtgagtactcaatagacttattcatgagggattggcaaagc

SEQ ID NO: 275256 - DNA, 75 bp, Artificial Sequence
  Synthetic
tatctgtttgtgagtactcaatagacttattcatgagggattggcaaagcggaataccactagaaacctttatat

SEQ ID NO: 275257 - DNA, 75 bp, Artificial Sequence
  Synthetic
gtgacaacgatccagaagtagttgaattgagaaaaggtgcctacttggcaagacatttagcatatttatgcagct

SEQ ID NO: 275258 - DNA, 75 bp, Artificial Sequence
  Synthetic
taggagagatttcttcatatggccctagattagaaactctaacatcgttagaaaggttagaggttcttaaaagct

SEQ ID NO: 275259 - DNA, 75 bp, Artificial Sequence
  Synthetic
tagattagaaactctaacatcgttagaaaggttagaggttcttaaaagctacctagagatatcttgtttagagga

SEQ ID NO: 275260 - DNA, 75 bp, Artificial Sequence
  Synthetic
tccaacattgagatacagtcaggttacagggttggtattaaaagtgttcccatcaacagtagtatatatcaggaa

SEQ ID NO: 275261 - DNA, 75 bp, Artificial Sequence
  Synthetic
gttagctataaagatgttgaggattaggggcataggggtgccagaggtgttggaagactgggatcccagtcatga

SEQ ID NO: 275262 - DNA, 75 bp, Artificial Sequence
  Synthetic
acaagctctactagataatatagctcaagagatccaacataatatcccaataaaccaatctatcaagacaccttt

SEQ ID NO: 275263 - DNA, 75 bp, Artificial Sequence
  Synthetic
ctgggggctcaaagtcaataattctcaagtcttacgtctaagaggatataaggaggttaaggataggaaatcagg

SEQ ID NO: 275264 - DNA, 75 bp, Artificial Sequence
  Synthetic
gcgatcaggagtaggtttaacacttccgtgtgataataggtacttatctcatcagataagacttttcgggattaa

SEQ ID NO: 275265 - DNA, 75 bp, Artificial Sequence
  Synthetic
ccgtgtgataataggtacttatctcatcagataagacttttcgggattaatagtactagctgcttgaaggccttg

SEQ ID NO: 275266 - DNA, 75 bp, Artificial Sequence
  Synthetic
gagttaacatatttaataggaccattgatagataaaagtaaagatagattattcttaggggaaggtgcaggtgct

SEQ ID NO: 275267 - DNA, 75 bp, Artificial Sequence
  Synthetic
atgttgtcatgttatgatgcaacgttaggaccttcgatgaactattacaactcaggtgtctcatcatgtgatata

SEQ ID NO: 275268 - DNA, 75 bp, Artificial Sequence
  Synthetic
aatggtcagagagaattagggatctatccatctgaggctgcattagtggcaaagaaactgaacaatgtaactaat

SEQ ID NO: 275269 - DNA, 75 bp, Artificial Sequence
  Synthetic
ttggatcagagaattaaggtgctgtttaacggaaaccctgggtctacatgggttggcaaccaggaatgcgaaaca

SEQ ID NO: 275270 - DNA, 75 bp, Artificial Sequence
  Synthetic
ttaatttggagtgaattacaggacaaatcaatcggcttgatacattgtgatctagaaggtggagaactcaaagat

SEQ ID NO: 275271 - DNA, 75 bp, Artificial Sequence
  Synthetic
acaccaacagtgctgcatgaacattatagcataattcggatagcatatttagtaggagataacgatgttttatta

SEQ ID NO: 275272 - DNA, 75 bp, Artificial Sequence
  Synthetic
gtgactaaaattgcaccaaaattgggtacagattggactcagcaactatgcttgtatctaagatattggaatgag

SEQ ID NO: 275273 - DNA, 75 bp, Artificial Sequence
  Synthetic
gtcaatttggttgttcttaaaacatctaatccttcttctactgagatgtatttgttatcaaggaatccaagtaaa

SEQ ID NO: 275274 - DNA, 75 bp, Artificial Sequence
  Synthetic
ctaatccttcttctactgagatgtatttgttatcaaggaatccaagtaaagatgtgattgaggatagtctaacag

SEQ ID NO: 275275 - DNA, 75 bp, Artificial Sequence
  Synthetic
tactctcagatctaaagccattgtctaaaaaagatagtatacaattagaaaagtggattttgattgagaaagaca

SEQ ID NO: 275276 - DNA, 75 bp, Artificial Sequence
  Synthetic
aagtggattttgattgagaaagacaaagttaaggaatggctaattaaagaattaagagagggagaactgatgtca

SEQ ID NO: 275277 - DNA, 75 bp, Artificial Sequence
  Synthetic
ggttcactcaggccttatcaccaggcacttcagatttttggatttgaggccaacttgcacaaattgtgtagagac

SEQ ID NO: 275278 - DNA, 75 bp, Artificial Sequence
  Synthetic
cacttcagatttttggatttgaggccaacttgcacaaattgtgtagagacttcttatcaactatgagtatctcag

SEQ ID NO: 275279 - DNA, 75 bp, Artificial Sequence
  Synthetic
atcacaagacatgtaaactcacagggaaatatgagttatatcctataagagacagtgggaagttgaaagtgatat

SEQ ID NO: 275280 - DNA, 75 bp, Artificial Sequence
  Synthetic
gaaatatgagttatatcctataagagacagtgggaagttgaaagtgatatcaagaaggcttataatatcctggat

SEQ ID NO: 275281 - DNA, 75 bp, Artificial Sequence
  Synthetic
gacagtgggaagttgaaagtgatatcaagaaggcttataatatcctggattgctttgtctatgtctactagactg

SEQ ID NO: 275282 - DNA, 75 bp, Artificial Sequence
  Synthetic
ttaacaggtgctttccccgatgttaagtttgagtccagattgaatataggtctagtctccttatctacgaatgag

SEQ ID NO: 275283 - DNA, 75 bp, Artificial Sequence
  Synthetic
tctagtctccttatctacgaatgagatcaaatcacttaaacttatatccaaggctacggtggataggttccaaga

SEQ ID NO: 275284 - DNA, 75 bp, Artificial Sequence
  Synthetic
atcaaatcacttaaacttatatccaaggctacggtggataggttccaagaagtgatccacagtgtatcctacaga

SEQ ID NO: 275285 - DNA, 75 bp, Artificial Sequence
  Synthetic
ttcttgactaaagaaattaaaatactcatgaagatacttggagctgttaaattatttggtgcaagacagacttac

SEQ ID NO: 275286 - DNA, 75 bp, Artificial Sequence
  Synthetic
aaccattcagctttaacacaagaatccttatccgatatagaaggatacctagatgattagctccaatatcaacaa

SEQ ID NO: 275287 - DNA, 75 bp, Artificial Sequence
  Synthetic
agatgattagctccaatatcaacaataaacaactaagagtcgttaagaagactatctagatccagacctaaatga

SEQ ID NO: 275288 - DNA, 75 bp, Artificial Sequence
  Synthetic
atgaaagaataagaaaaacttaatcaaacaatcaaagatctaagcaaaatgatatgtcttaaactcttgtctggt

SEQ ID NO: 275289 - DNA, 75 bp, Artificial Sequence
  Synthetic
accaaacaagagaaaagacttgtctgtaatagttatctaatcattaaaaatatttagggttaaagtattaacccc

SEQ ID NO: 275290 - DNA, 75 bp, Artificial Sequence
  Synthetic
aaagggacagatcaggaactttgatttttaaacatagtactaaaatggcagggttgttaagtgtctttgacacat

SEQ ID NO: 275291 - DNA, 75 bp, Artificial Sequence
  Synthetic
ttagttcaaaaaggagtgaaagtataaatagaggaggtggtggtgcagttatacctggacaaaagaacaccgtct

SEQ ID NO: 275292 - DNA, 75 bp, Artificial Sequence
  Synthetic
cagtatttgtcctggggtcaagcattgtggacgatagcgataagttagccatagcactcatgtttttaacacatg

SEQ ID NO: 275293 - DNA, 75 bp, Artificial Sequence
  Synthetic
ctcttgacactgacaagcaacactcacaaagaagcggtttcttggtctcattaatggcaatggcatatagtagtc

SEQ ID NO: 275294 - DNA, 75 bp, Artificial Sequence
  Synthetic
ctgagttatatctaacaaccaatggagttaatgcagatgttaagtatgttatctacacaatcgagcatgaccccc

SEQ ID NO: 275295 - DNA, 75 bp, Artificial Sequence
  Synthetic
agaggacaacccataatgggtttattgttaagacaagagatatggactatgaaaagaccacagaatggttattca

SEQ ID NO: 275296 - DNA, 75 bp, Artificial Sequence
  Synthetic
gccgtataactaataaacacccattacttcagggacaaaaagacactcatgatccggaatcattactccagactt

SEQ ID NO: 275297 - DNA, 75 bp, Artificial Sequence
  Synthetic
atggatacccttcgtgtttaggagcattgatagtccaggtttggattgtcttggtcaaagcgattacaagtagtg

SEQ ID NO: 275298 - DNA, 75 bp, Artificial Sequence
  Synthetic
ctggactaaagaaaggattttttaataggcttgaggcttttaggcaagacggaacagtcagaagctcactagtct

SEQ ID NO: 275299 - DNA, 75 bp, Artificial Sequence
  Synthetic
tcagtggggaaacagttgaaggaattggatcagtgatgaggtctcagcagagcctggtatctttaatggtagaaa

SEQ ID NO: 275300 - DNA, 75 bp, Artificial Sequence
  Synthetic
ctttagttactatgaatacagctagatctgatttaactactctagagaagaatattcagattgttgggaattata

SEQ ID NO: 275301 - DNA, 75 bp, Artificial Sequence
  Synthetic
tcagggatgcaggtcttgcttcattcatgaacacgattaaatatggtgtggaaaccaagatggcagcactcacat

SEQ ID NO: 275302 - DNA, 75 bp, Artificial Sequence
  Synthetic
tatctaatcttagacctgatatcaataaattaaagagtttaattgacatctatttatccaaaggtgcgagagccc

SEQ ID NO: 275303 - DNA, 75 bp, Artificial Sequence
  Synthetic
taaattaaagagtttaattgacatctatttatccaaaggtgcgagagccccttttatatgtatattacgtgatcc

SEQ ID NO: 275304 - DNA, 75 bp, Artificial Sequence
  Synthetic
caaagccatgcaacagtatgtgacagggagaacatatctggatatggaaatgttccttcttggtcaggcagtagc

SEQ ID NO: 275305 - DNA, 75 bp, Artificial Sequence
  Synthetic
taaagacgcagagtctaaaattagtaatgccttagaaggtgaattaggtataactgaaagtgccaaagacaggct

SEQ ID NO: 275306 - DNA, 75 bp, Artificial Sequence
  Synthetic
caaacatcatcttgctaatctttctggaggtgatggagcttatcataaacccactggtggaggggcaatagaggt

SEQ ID NO: 275307 - DNA, 75 bp, Artificial Sequence
  Synthetic
tgtaattgacaatgcagatatagatctcaggacagaggaaaacacagaagaatctttgatcagattttctaatat

SEQ ID NO: 275308 - DNA, 75 bp, Artificial Sequence
  Synthetic
tagagataataaagggagaggcactgacgggcagaggagatgggaagcgaccagatccaccagtgatgaccttaa

SEQ ID NO: 275309 - DNA, 75 bp, Artificial Sequence
  Synthetic
cccagacaacagcaccgatgatgaaatatctgctgcagagaggaggattgcagaaagactggccaaaaaagagga

SEQ ID NO: 275310 - DNA, 75 bp, Artificial Sequence
  Synthetic
aaagaataccaggttggatatactcattactgatggtgtaaccgaagacacagataacgatgatgatataatgag

SEQ ID NO: 275311 - DNA, 75 bp, Artificial Sequence
  Synthetic
aatgaatgcactaggaggaatataataaatctaagcgggaggttttttatattactcagtaagaaaaacttaggg

SEQ ID NO: 275312 - DNA, 75 bp, Artificial Sequence
  Synthetic
tgaaagaacggctcctagacactaggatcttcatcactcttaaagataagattttaaactggctacccacaagag

SEQ ID NO: 275313 - DNA, 75 bp, Artificial Sequence
  Synthetic
aatctcccaaaattcagagactaaatggatcaggatgccttcttttttgaagaatctatggaggaccagaagaag

SEQ ID NO: 275314 - DNA, 75 bp, Artificial Sequence
  Synthetic
gaacacccaacaaccagcacactcactagtgcagtcggactcatcgacattatccttgccagtgagcctacagac

SEQ ID NO: 275315 - DNA, 75 bp, Artificial Sequence
  Synthetic
atcagaaaagataggaaatacctatgtgagccaatcacagcttgggaaagatcagaaacaagcaagggttcaaaa

SEQ ID NO: 275316 - DNA, 75 bp, Artificial Sequence
  Synthetic
ggtacagttcgcgaagaaaactcaagaacagaaggggaagatcatggacaaagtgaaaagagtggaactcctagg

SEQ ID NO: 275317 - DNA, 75 bp, Artificial Sequence
  Synthetic
gagtcaaacaagtttgaaacagaagttccttttagagaaactcatagctcaggtacatcatggagggcttggaga

SEQ ID NO: 275318 - DNA, 75 bp, Artificial Sequence
  Synthetic
agaagtagtacagactctgtatttgagaatatgggcgatggatccgactcctatggcaaagaaattactggaaat

SEQ ID NO: 275319 - DNA, 75 bp, Artificial Sequence
  Synthetic
ggaggaggaaaccagagacaaagtcctgaagttaaagttagagaggtggatccgagttctgatacgaggagaaaa

SEQ ID NO: 275320 - DNA, 75 bp, Artificial Sequence
  Synthetic
gacaaaactgagggacttccagaagagatacgaggaggttcacccatacttaatgacagagaaggtagaagaaat

SEQ ID NO: 275321 - DNA, 75 bp, Artificial Sequence
  Synthetic
aataatggaggaggcctggagcttatcagcacacataatccaagaatagaaaacaatattatagatccaactcac

SEQ ID NO: 275322 - DNA, 75 bp, Artificial Sequence
  Synthetic
taccttgaagaagaggtacttaagagaaacaagccacgagagatgaatgtcatgagtcaatggtcaggtggatgc

SEQ ID NO: 275323 - DNA, 75 bp, Artificial Sequence
  Synthetic
aagactggtcagcaagacggtcaacatgaactgacaaccaatccaatatcttcaaatcaaaataggtcacaaggc

SEQ ID NO: 275324 - DNA, 75 bp, Artificial Sequence
  Synthetic
acaaaaaagggaaaggggaaagaattagctgtgaagcccagaaccaggaaatccaaaatgtcttctgaagacaca

SEQ ID NO: 275325 - DNA, 75 bp, Artificial Sequence
  Synthetic
agaaacactggtaatatctacgaaggccttcaagaatccataagagagaagaatacagacaacgagtcatcacaa

SEQ ID NO: 275326 - DNA, 75 bp, Artificial Sequence
  Synthetic
caaataggtaaaaaaggcacagaagagagtaccttatatacagaagaggtaatcaaattgttagtgagtcttggt

SEQ ID NO: 275327 - DNA, 75 bp, Artificial Sequence
  Synthetic
gtaatcccatctgtacccgcattcaatcaatcccgaaacatatgccatgtatttgcaaaacgtgtcctcaattct

SEQ ID NO: 275328 - DNA, 75 bp, Artificial Sequence
  Synthetic
gtgaactctgcagaaatgactgctaatatgtgcggattattgctatctgttgagaaatcagtatcagaccggatt

SEQ ID NO: 275329 - DNA, 75 bp, Artificial Sequence
  Synthetic
gaagagaataagatgctgataaatcaggttttaagtgatttaactacaggtagagaagtacagaaacgtttcact

SEQ ID NO: 275330 - DNA, 75 bp, Artificial Sequence
  Synthetic
gaatatcaaaaggagcaaaattcattgattatgtcaaacctggcgacactccatatcataacagatagaggggga

SEQ ID NO: 275331 - DNA, 75 bp, Artificial Sequence
  Synthetic
aagaacaacaacctagattcaggggagaggaaaccatcgatcaggactaaaggcaaagagccaatacagaaaaca

SEQ ID NO: 275332 - DNA, 75 bp, Artificial Sequence
  Synthetic
caaagatttgatccatctatggaattcacagaggagattaaatacaaacccgatctatacagggaagacacatta

SEQ ID NO: 275333 - DNA, 75 bp, Artificial Sequence
  Synthetic
agacaaagaataacaaatcctgtccttgatgagagcacagacagaatcgacaactcgaacgccgcgaggctaata

SEQ ID NO: 275334 - DNA, 75 bp, Artificial Sequence
  Synthetic
ccttgcagagaaaaatcgacattgcgttcactcaaattgattattgagagtagtaatttaagtaaagcagacaaa

SEQ ID NO: 275335 - DNA, 75 bp, Artificial Sequence
  Synthetic
attgcttatattaggtcgttatcaaaatgcaaagatgataaagaggtagaatcagtgatgaaactattcgaagaa

SEQ ID NO: 275336 - DNA, 75 bp, Artificial Sequence
  Synthetic
gatatagaatcaagtaatgaataatcactgaccagcatatccagaaaacattaagacgaaagtgcaccacaataa

SEQ ID NO: 275337 - DNA, 75 bp, Artificial Sequence
  Synthetic
tcagtagctctccaaatacctaataagaaaaacttagggtgcaagactcaccagccaaaccaagcaaatggccga

SEQ ID NO: 275338 - DNA, 75 bp, Artificial Sequence
  Synthetic
gatctacaagttccccaaactatcatacgaagaacatggctatatggaacctctaccactaaagactggcccaga

SEQ ID NO: 275339 - DNA, 75 bp, Artificial Sequence
  Synthetic
caagaaggcagtcccacacatcagggtaatcaagataggggacccaccgaagcatggaaatcgatatcttgatgt

SEQ ID NO: 275340 - DNA, 75 bp, Artificial Sequence
  Synthetic
tcttttacttgggttctatgaggtacccaaagagattggaacatacggtagtgtatcagatttgacaagacctac

SEQ ID NO: 275341 - DNA, 75 bp, Artificial Sequence
  Synthetic
aggatacacaatctgcggttcaggatcattacctattggaatcgctaggtactcaggtacagatcaagaactact

SEQ ID NO: 275342 - DNA, 75 bp, Artificial Sequence
  Synthetic
tcattacctattggaatcgctaggtactcaggtacagatcaagaactactcaaagcatcagtagacctaaaggta

SEQ ID NO: 275343 - DNA, 75 bp, Artificial Sequence
  Synthetic
gtgagatgattgtgtatatggtagattccataccaccagcaatgatggcttgggcccctaggttgaaacgaggta

SEQ ID NO: 275344 - DNA, 75 bp, Artificial Sequence
  Synthetic
tgatattcaatgctaacaaagtagccctagctcctcaatgtctacctatagacaaagatataagattcagagttg

SEQ ID NO: 275345 - DNA, 75 bp, Artificial Sequence
  Synthetic
cctagctcctcaatgtctacctatagacaaagatataagattcagagttgtctttgttaatggcacttctctagg

SEQ ID NO: 275346 - DNA, 75 bp, Artificial Sequence
  Synthetic
tctttgttaatggcacttctctaggttccatcacaatagcaaaagttcctaagacattagctgatcttgccttac

SEQ ID NO: 275347 - DNA, 75 bp, Artificial Sequence
  Synthetic
caaactctatatccgttaatctaatggtttcacttaagactggtgcgtcaactgaatctaaaggcattatcccta

SEQ ID NO: 275348 - DNA, 75 bp, Artificial Sequence
  Synthetic
cactaaatgaaaagggggacaagatgctgaactttatggtacacctcggattaatacataggaaggtcggaaggg

SEQ ID NO: 275349 - DNA, 75 bp, Artificial Sequence
  Synthetic
tgtactcaatggagtattgcaagggtaaaatagagaagatgcggctgatcttctcattaggactggttggaggaa

SEQ ID NO: 275350 - DNA, 75 bp, Artificial Sequence
  Synthetic
tcagcttccatgttcagctcacaggtgtggcatctaaatcttttattggtcagcttggagggaaaaaggaaatat

SEQ ID NO: 275351 - DNA, 75 bp, Artificial Sequence
  Synthetic
gttaccctctgatggatgtaaatccacatatgaatttagttatctgggctgcttccgttgaaataattggagtag

SEQ ID NO: 275352 - DNA, 75 bp, Artificial Sequence
  Synthetic
atgccgtttttcaaccttccattccaaaagatttcaagtactatccgaatgtggtggcaaaaaacattgggagaa

SEQ ID NO: 275353 - DNA, 75 bp, Artificial Sequence
  Synthetic
taaaggcctagagatccactgcaatggtaacctcagacatctaaatattagattagcaagtatcattatatgatt

SEQ ID NO: 275354 - DNA, 75 bp, Artificial Sequence
  Synthetic
agcatcattcattaggagtacaaaaaacttagggtacaagttatccaaaaaaagccaaacaggccaaacggacca

SEQ ID NO: 275355 - DNA, 75 bp, Artificial Sequence
  Synthetic
aaacaaaacaccacaagatgcaggtcaccaccctcagactagctataacactaagtatagcgtcatcagtcacca

SEQ ID NO: 275356 - DNA, 75 bp, Artificial Sequence
  Synthetic
gtcaagttcctagggataaactagccaatctagggatcatcatcaaggacagcaaggcactcaagattgcaggat

SEQ ID NO: 275357 - DNA, 75 bp, Artificial Sequence
  Synthetic
cttatgaaaaccgatatatagtcttaagccttgtaccaacaatagataacgtgagtgggtgtggttctattcaaa

SEQ ID NO: 275358 - DNA, 75 bp, Artificial Sequence
  Synthetic
tagcaaagtataaagagatgcttgaaagattgttgataccaataaaagatgcactagatctacaggagtctctga

SEQ ID NO: 275359 - DNA, 75 bp, Artificial Sequence
  Synthetic
taatgattgataatgaaaccaccgataatattcatcgtcctcagtatagatttgttggtgcaattatcgggacta

SEQ ID NO: 275360 - DNA, 75 bp, Artificial Sequence
  Synthetic
tagcactcggagtagcgaccgcggcccaggtcacagcaggagtggccttgatggaggcgagagaggctaagaaag

SEQ ID NO: 275361 - DNA, 75 bp, Artificial Sequence
  Synthetic
acatatcaatgttaaaagaagcaatggaaaagacccaaaactcaattgaaaaattacagaattccgcaggtgaac

SEQ ID NO: 275362 - DNA, 75 bp, Artificial Sequence
  Synthetic
agatattggctctcaaaatgctccaggattatgtcaatggagaaatcaaaccagccattgaagaactcggatgtg

SEQ ID NO: 275363 - DNA, 75 bp, Artificial Sequence
  Synthetic
agactgctgcacttaaattaggaattgcacttacacaacattatacagagctcacaaacgccttcgggtcaaatc

SEQ ID NO: 275364 - DNA, 75 bp, Artificial Sequence
  Synthetic
tgggttccataggagagaaaagcttaacattacaggctctatcatcattatacaaaactaacataactgatatat

SEQ ID NO: 275365 - DNA, 75 bp, Artificial Sequence
  Synthetic
tgacagcaactaatctcgggaaaacagatatttatgacattatatatgctgagcaagtcaaaggaagagtaatag

SEQ ID NO: 275366 - DNA, 75 bp, Artificial Sequence
  Synthetic
atgttgatcttagacgatatatggttacgatatctattaaaataccaatattatcagaaataccaggagtattga

SEQ ID NO: 275367 - DNA, 75 bp, Artificial Sequence
  Synthetic
tctatgaagtctcctccatttcttacaatatagatggagtagaatggtatgctgctgtacctgaccacatactaa

SEQ ID NO: 275368 - DNA, 75 bp, Artificial Sequence
  Synthetic
gtaaatcctcatatataggaggtgcagatgtaagtgattgtatagaatctggattgacatatatttgcccgcggg

SEQ ID NO: 275369 - DNA, 75 bp, Artificial Sequence
  Synthetic
atcctactcaaattatagcagataaccaacagaaatgttttttaggtcatctagataagtgtcctgttactaaag

SEQ ID NO: 275370 - DNA, 75 bp, Artificial Sequence
  Synthetic
tcattgataatcttgtgcctaaatttgcattcataaacggtggagtagttgcgaactgtatagcatctacatgta

SEQ ID NO: 275371 - DNA, 75 bp, Artificial Sequence
  Synthetic
cctgtggagaagagagaatccaagtctcccaagatagaaacaaaggagtgacctttttgactcataacaattgtg

SEQ ID NO: 275372 - DNA, 75 bp, Artificial Sequence
  Synthetic
gattaataggagtaaacggagtagaactttacgctaataagaaagggagcgatgccacttggaatgtctcaccta

SEQ ID NO: 275373 - DNA, 75 bp, Artificial Sequence
  Synthetic
actttacgctaataagaaagggagcgatgccacttggaatgtctcacctataggagtagggcctgcagtgtcatt

SEQ ID NO: 275374 - DNA, 75 bp, Artificial Sequence
  Synthetic
ggaaatcttaaagacttaactgtcataacgataattaacatagtaattataattgtcttacttatatgtgtaatt

SEQ ID NO: 275375 - DNA, 75 bp, Artificial Sequence
  Synthetic
ggattaggtatattgtatcaccaattgagaagtgcattagagatgagagacaagatgtcagcattaaacaatagt

SEQ ID NO: 275376 - DNA, 75 bp, Artificial Sequence
  Synthetic
tcttattccttggaaccaaagaccgcctaggtacaggtaatgaagcctataagtttcaaaagataaactataagg

SEQ ID NO: 275377 - DNA, 75 bp, Artificial Sequence
  Synthetic
atatatttcaaccaactctcaataatcaaaataaagaaaacttagggtgcatgatagtaactcaccaccaaaaga

SEQ ID NO: 275378 - DNA, 75 bp, Artificial Sequence
  Synthetic
gagacagatcaaaggtcaacgcatcaagagatggaagagaccaaagtaaagacatcagagtactgggccaaaagt

SEQ ID NO: 275379 - DNA, 75 bp, Artificial Sequence
  Synthetic
cctcaaactcacacggcaagtcatcttagcatacagaacagagagaggactaaagagatattaacaattttgata

SEQ ID NO: 275380 - DNA, 75 bp, Artificial Sequence
  Synthetic
tcatttattactttcttatctcttgtattggttgtaaccgtgttaataatgcaatctctacataatagcacaata

SEQ ID NO: 275381 - DNA, 75 bp, Artificial Sequence
  Synthetic
ctaagatgcaaagatgtagacctagaatctatcaataaatccactcactctatatccaatacaattctggacgtc

SEQ ID NO: 275382 - DNA, 75 bp, Artificial Sequence
  Synthetic
atcaagcaagaactgataactcgcatcataaacactcaaagttctgtacaggtggctctcccagtcttaataaac

SEQ ID NO: 275383 - DNA, 75 bp, Artificial Sequence
  Synthetic
aagaaaatccaggatctctcgctaaccattgagaaaagtttaaaagtgcatcaaaattcccctacttgtagtggt

SEQ ID NO: 275384 - DNA, 75 bp, Artificial Sequence
  Synthetic
gtagctgccctgacacatgtagagggaataaaacctttggatccagacgattattggagatgtccaagtggagaa

SEQ ID NO: 275385 - DNA, 75 bp, Artificial Sequence
  Synthetic
ccatatctagaggacgaactgacactaaatcttatccctggacctagtatgctggtcggaacctctaccattgat

SEQ ID NO: 275386 - DNA, 75 bp, Artificial Sequence
  Synthetic
ggctgtgtaagactaccatctcttgcaataggcaaatcgctatatgcctatagttctaacctaataactaagggc

SEQ ID NO: 275387 - DNA, 75 bp, Artificial Sequence
  Synthetic
tgtcaagacataggaaagtcctatcaagtactacagttaggtattataactctaaattcagatctacaccctgat

SEQ ID NO: 275388 - DNA, 75 bp, Artificial Sequence
  Synthetic
ttgaatcctataatatcacatacttatgatataaatgataatagaaagtcttgttctgttgctgtatcagagact

SEQ ID NO: 275389 - DNA, 75 bp, Artificial Sequence
  Synthetic
aaggggtatcaattatgttcaatgccacgtgtcaatgaaaaaacagattacacaagtgatggtattgaagatata

SEQ ID NO: 275390 - DNA, 75 bp, Artificial Sequence
  Synthetic
gtgtttgatgtacttgatctcaaggggttctctagaagtttcaaattttcgaacaatgatattaactttgatcac

SEQ ID NO: 275391 - DNA, 75 bp, Artificial Sequence
  Synthetic
cctttctcagcgttataccctagtgtaggaggtggcattatatgggaaaatgaactgtattttctaggttatggg

SEQ ID NO: 275392 - DNA, 75 bp, Artificial Sequence
  Synthetic
gctctgacaactgcacttcaaggtaacacaaaatgtaatttagtgggatgtccaggagcaacacaagacaactgc

SEQ ID NO: 275393 - DNA, 75 bp, Artificial Sequence
  Synthetic
aacaagttcatctccagttcatggttatacagtaaacaaatggttaatgtactaatacagattaaagggtactta

SEQ ID NO: 275394 - DNA, 75 bp, Artificial Sequence
  Synthetic
tccaacaagccaagtattagggtcagaacaatcccaataacagaaaattatgtaggagcagaagggagactagta

SEQ ID NO: 275395 - DNA, 75 bp, Artificial Sequence
  Synthetic
agaacacgtgaaagaatatatatatatacaagatcaacgggttggcacaccaacctacaaataggggtgctcaat

SEQ ID NO: 275396 - DNA, 75 bp, Artificial Sequence
  Synthetic
ataaatcatccaataaccataacctggacggatcatagagcattatcgagaccaggaagaagtccttgtgcctgg

SEQ ID NO: 275397 - DNA, 75 bp, Artificial Sequence
  Synthetic
aataacagatgtcctagaaattgtaccactggtgtgtacacagatgcttatcctatatcgcctgatgctaattat

SEQ ID NO: 275398 - DNA, 75 bp, Artificial Sequence
  Synthetic
gttgccacagttactctactgtctaactcgacacgcactaatcctactattatgtattcatcttctgataaagta

SEQ ID NO: 275399 - DNA, 75 bp, Artificial Sequence
  Synthetic
tataatatgttaagattaagaaatactgagttagaagctgcatacacaaccacatcatgtattgtccactttgac

SEQ ID NO: 275400 - DNA, 75 bp, Artificial Sequence
  Synthetic
agaggttattgttttcatattatagaaatcaatcaaaaagaacttaatacactacagcctatgctctttaagact

SEQ ID NO: 275401 - DNA, 75 bp, Artificial Sequence
  Synthetic
gcaatacccaaggcctgtaggataagcaatttataagagaaccactgaaataataacctatactcaattacttaa

SEQ ID NO: 275402 - DNA, 75 bp, Artificial Sequence
  Synthetic
gatagttatcatgcatgaactagaagcaaatgatttatggatatcaatcatacaggttattaactagtgtataat

SEQ ID NO: 275403 - DNA, 75 bp, Artificial Sequence
  Synthetic
acatccaataagaaaaacttaggttgaatgccaaagcattcatccagaatggatcactttagtacatcccaaagt

SEQ ID NO: 275404 - DNA, 75 bp, Artificial Sequence
  Synthetic
ccaagtgatatactataccctgaatgccatttgaactccccagtagtgaaaggaaagattgctcagctacacgtc

SEQ ID NO: 275405 - DNA, 75 bp, Artificial Sequence
  Synthetic
ttgatggacattaatcaaccgtatgaaatgaaggaccccagtataatagaaatcacaaaagttaaaattaaatct

SEQ ID NO: 275406 - DNA, 75 bp, Artificial Sequence
  Synthetic
ggagggttaaatcaaaggtcaatcagaatcagatctttagggaaagagatgagaagaattatacttgattttgat

SEQ ID NO: 275407 - DNA, 75 bp, Artificial Sequence
  Synthetic
aagtatacattcgaaccttacccaatattttctaaggaattgtttagattagatataccagaaatttgtgataag

SEQ ID NO: 275408 - DNA, 75 bp, Artificial Sequence
  Synthetic
attcgatcagtctttgcagtgtctgacaagttaagcaaagatatatcccaaccattacaatgtttatggagagat

SEQ ID NO: 275409 - DNA, 75 bp, Artificial Sequence
  Synthetic
gtgcataggcagttaggaggggattgttccaaggatccttctaacactgagattgacatacataaaatccctgaa

SEQ ID NO: 275410 - DNA, 75 bp, Artificial Sequence
  Synthetic
atccatactaaattcaccagaaataactggtataaaccattcatgacatggtttagtattaaatatgatatgaga

SEQ ID NO: 275411 - DNA, 75 bp, Artificial Sequence
  Synthetic
gtttagtattaaatatgatatgagaagatgtcaaaagagtagagagaacataaacctggacagtcggaaatcata

SEQ ID NO: 275412 - DNA, 75 bp, Artificial Sequence
  Synthetic
ttgaaggtagatggaatatgtctgctgctggacaattagataacaaatcacacaaaataacactgaagggagaag

SEQ ID NO: 275413 - DNA, 75 bp, Artificial Sequence
  Synthetic
aattgtgggacaggatagatgagttatttaagataatcggagaagagacatttaatattatatcactattggaac

SEQ ID NO: 275414 - DNA, 75 bp, Artificial Sequence
  Synthetic
cgttatctttagcattgatacaattaacagatcccgtcatgtctttaaaaggtgcatttatgagacatgttatct

SEQ ID NO: 275415 - DNA, 75 bp, Artificial Sequence
  Synthetic
cagaaatgaatgaaacattgagtaaatgtgaaaacctaactgagtctgaagtggatcacataatggattcaattc

SEQ ID NO: 275416 - DNA, 75 bp, Artificial Sequence
  Synthetic
gtggatcacataatggattcaattctgaacatctttatggatacaacagtagatgaaaaagcagagatattctcc

SEQ ID NO: 275417 - DNA, 75 bp, Artificial Sequence
  Synthetic
tacaattataataaatggatatagagataggcatgggggacaatggcctccatgtcagttcccagatcatgtgtg

SEQ ID NO: 275418 - DNA, 75 bp, Artificial Sequence
  Synthetic
tcaagagctaaggaattctcaaggatctaattcagctatatcttatgaaacagcagttgataactttgagagctt

SEQ ID NO: 275419 - DNA, 75 bp, Artificial Sequence
  Synthetic
tataggtttcaaattcgagaaattcatagaccctcaattagatgaagatctcaccatttatatgagagataaagc

SEQ ID NO: 275420 - DNA, 75 bp, Artificial Sequence
  Synthetic
attgtctccgaggagagaagcctgggattctgtgtatccagatggtaatttgctgtataaagtgccattctccga

SEQ ID NO: 275421 - DNA, 75 bp, Artificial Sequence
  Synthetic
ggaaacaaggagattgatagaagtctttattagtgattctagtttcaatccagatgacattatacaatatgtaga

SEQ ID NO: 275422 - DNA, 75 bp, Artificial Sequence
  Synthetic
gacaggagaatggttgaacgacgagactttcaacatatcctatagcttaaaggagaaggagattaaacaagaggg

SEQ ID NO: 275423 - DNA, 75 bp, Artificial Sequence
  Synthetic
tcgattgtttgccaagatgacatacaaaatgagagcagtccaagtattagcagaaactttgctagcaaaagggat

SEQ ID NO: 275424 - DNA, 75 bp, Artificial Sequence
  Synthetic
aggagctctatttaatgaaaatggtatggttaaaggtgaaatcgatttactaaagagtctaactaccttatctgt

SEQ ID NO: 275425 - DNA, 75 bp, Artificial Sequence
  Synthetic
atcaggagttccaagaactagcgagatttataatgaatcagttagtgaagaagaggataggaaaaaatgggaaag

SEQ ID NO: 275426 - DNA, 75 bp, Artificial Sequence
  Synthetic
ggaaaattcctcatattactgggataaaagaagaaattcaaggcatgagttcaaagctacagattcttctaccaa

SEQ ID NO: 275427 - DNA, 75 bp, Artificial Sequence
  Synthetic
cggctatgagactctaagctgttttcttactacggacttgaagaagtattgtctaaattggagatttgagagtac

SEQ ID NO: 275428 - DNA, 75 bp, Artificial Sequence
  Synthetic
gtctctattcggacaaagatgtaacgagatttttgggttcaagagattcttcaactggatgcatcctgtactgga

SEQ ID NO: 275429 - DNA, 75 bp, Artificial Sequence
  Synthetic
ggagtgtacaatatatgtgggtgatccttactgtcctgtacctgataaaattcataagaatttagaagatcatga

SEQ ID NO: 275430 - DNA, 75 bp, Artificial Sequence
  Synthetic
agattcaggcgtctttatacatagaccgagaggtgggatagagggttattgtcagaaactttggactctcatatc

SEQ ID NO: 275431 - DNA, 75 bp, Artificial Sequence
  Synthetic
cataagcgcaattcatctagctgctgtcaaggtcggggttagagtatcagctatggtgcaaggtgataaccaagc

SEQ ID NO: 275432 - DNA, 75 bp, Artificial Sequence
  Synthetic
aattgccgtgacatccagagtaccagtgacggccacatataagatcaaaaaggagcaggtatatacggagatcac

SEQ ID NO: 275433 - DNA, 75 bp, Artificial Sequence
  Synthetic
taagtatttcaaatctttaagagatgtgatgtcagacttaggacatgaactcaaactcaacgaaacaattataag

SEQ ID NO: 275434 - DNA, 75 bp, Artificial Sequence
  Synthetic
tagcaaaatgtttgtgtatagtaagcgaatatattatgacggcaaaatactaccccaatgtttaaaagcacttac

SEQ ID NO: 275435 - DNA, 75 bp, Artificial Sequence
  Synthetic
aaggtgtgttttttggtctgagaccttggtagatgaaaacaggtctgcgtgctccaatcttgcaactgctgtagc

SEQ ID NO: 275436 - DNA, 75 bp, Artificial Sequence
  Synthetic
caaggctatagaaaatggctactcaccaatattaggttactcaatagctttatataaaacttgtcagcaagtctg

SEQ ID NO: 275437 - DNA, 75 bp, Artificial Sequence
  Synthetic
tatttcattagggatgaccattaatcctacaataacgcctagtataagagaccaatattatttaggtaagaattg

SEQ ID NO: 275438 - DNA, 75 bp, Artificial Sequence
  Synthetic
gcttaggtgtgcagttttgacacctgctaatgtaggaggatttaactacatggcaatgtctagatgctttgttag

SEQ ID NO: 275439 - DNA, 75 bp, Artificial Sequence
  Synthetic
gaatataggtgaccctgcggtagctgctctagcagacctcaaaaggttcattcgagcaggacttttggacaaaca

SEQ ID NO: 275440 - DNA, 75 bp, Artificial Sequence
  Synthetic
gattttgtaccgtgtaatgaatcaagaatctggagagtcaaattttttagattgggcatctgatccgtactcatg

SEQ ID NO: 275441 - DNA, 75 bp, Artificial Sequence
  Synthetic
taatttaccgcattcgcaaagtattacaacaatcattaaaaatattacagctcgttcagtcctccaagagtcacc

SEQ ID NO: 275442 - DNA, 75 bp, Artificial Sequence
  Synthetic
aaatcctttactttcaggcctatttacagatgacagtaaagaagaagacttgaatttagcgacattcctgatgga

SEQ ID NO: 275443 - DNA, 75 bp, Artificial Sequence
  Synthetic
tagaaaagttatattgccaagagttgcacacgagatactagacaattctttgacgggaatcagagaatctattgc

SEQ ID NO: 275444 - DNA, 75 bp, Artificial Sequence
  Synthetic
aggaatgctggacactacaaaatcattagtgcgggttagtattagaaaggggggtctatcatacaatcttttaag

SEQ ID NO: 275445 - DNA, 75 bp, Artificial Sequence
  Synthetic
aaagctgataaattatgatttattacaatatgaaacattaaccagaactttaagaaaagtcgttactaataacat

SEQ ID NO: 275446 - DNA, 75 bp, Artificial Sequence
  Synthetic
tgaatatgaatatatgtgctctgtggaattggcaatcggattgagacaaaagatgtggtcacatctaacatatgg

SEQ ID NO: 275447 - DNA, 75 bp, Artificial Sequence
  Synthetic
gagacctattcatgggttagaaacacctgatcctctagaactccttagaggaacgtttatcgaaggatctgaggt

SEQ ID NO: 275448 - DNA, 75 bp, Artificial Sequence
  Synthetic
ttgcaaaatatgcaggtctgaaggtgacaatcctatatatacttggttttatttacctgaggaaatagatctgga

SEQ ID NO: 275449 - DNA, 75 bp, Artificial Sequence
  Synthetic
taacctagaacaagggaatccatctataagaataccatatttcgggtctactactgatgaaaggtcagaagcaca

SEQ ID NO: 275450 - DNA, 75 bp, Artificial Sequence
  Synthetic
gctaggttatgttaaaacactgagtaaacctgctaaagcagcaatcagaattgctatgatatatacttgggctta

SEQ ID NO: 275451 - DNA, 75 bp, Artificial Sequence
  Synthetic
tggtactgatgagatatcatggatggaagcagctcagattgcacaaactagagcaaatttgagtcttgataactt

SEQ ID NO: 275452 - DNA, 75 bp, Artificial Sequence
  Synthetic
aaaacttctgactccagtatcaacatctacaaatctgtctcatagactaaaagacactgctacccagatgaaatt

SEQ ID NO: 275453 - DNA, 75 bp, Artificial Sequence
  Synthetic
ctcaagtgcaactctagtgagagctagtagatttatcactatatcaaatgataagatggctctgagggaggcagg

SEQ ID NO: 275454 - DNA, 75 bp, Artificial Sequence
  Synthetic
tgagacaaaggatactaacttaatatatcaacaaataatgttgacaggacttagtatttttgaattcaataccag

SEQ ID NO: 275455 - DNA, 75 bp, Artificial Sequence
  Synthetic
atatattaagggtaagactaaacaaccgatgatcctacatttacatttaaacaatggctgctgcataatggaatc

SEQ ID NO: 275456 - DNA, 75 bp, Artificial Sequence
  Synthetic
ccgatgatcctacatttacatttaaacaatggctgctgcataatggaatcaccacaagaaacttgtattcctcct

SEQ ID NO: 275457 - DNA, 75 bp, Artificial Sequence
  Synthetic
aaatctactctagacttagaagtaactaatgaagaaaataaattaatatatgataataatccattaaaaaatgtt

SEQ ID NO: 275458 - DNA, 75 bp, Artificial Sequence
  Synthetic
ctaatgaagaaaataaattaatatatgataataatccattaaaaaatgttgatctcagtattttccaaagaatta

SEQ ID NO: 275459 - DNA, 75 bp, Artificial Sequence
  Synthetic
gagatatcgtgcatactgtagatatgactttctggtctgatctggaaataatgagagcagttactatctgtacat

SEQ ID NO: 275460 - DNA, 75 bp, Artificial Sequence
  Synthetic
ctatgacaatagcagacaccatgtctcaattggatagggataatcttaaagaagtaattgttctcacaaacgatg

SEQ ID NO: 275461 - DNA, 75 bp, Artificial Sequence
  Synthetic
acgacattaacagcttaataacagagtttatgataatagatattccactcttttgctcaacatttggaggaatct

SEQ ID NO: 275462 - DNA, 75 bp, Artificial Sequence
  Synthetic
tagtaaatcaatttgcatatgcattatacggtctaaatataagaggcagagaggagatatggagttacattacac

SEQ ID NO: 275463 - DNA, 75 bp, Artificial Sequence
  Synthetic
ggactttgaaagatacttctcatgccgtgttgaaagtacttgctaatgcattatcgcatccgaaggtattcaaga

SEQ ID NO: 275464 - DNA, 75 bp, Artificial Sequence
  Synthetic
gattctgggatttcggtattttagaacctgtatatggaccaaatttatccaatcaaaataagataatgttagcgt

SEQ ID NO: 275465 - DNA, 75 bp, Artificial Sequence
  Synthetic
tatctgtttgtgaatactcaatagatctattcatgagggactggcaaagcggaatgcctctagagacctttatat

SEQ ID NO: 275466 - DNA, 75 bp, Artificial Sequence
  Synthetic
gtgacaatgacccagaagtagttgaattgagaaaaggtgcatttttggcaagacatttagcgtatttatgcagct

SEQ ID NO: 275467 - DNA, 75 bp, Artificial Sequence
  Synthetic
taggagagatttcctcatatggccctcgattagaaactctaacatcattggaaaggttagaagttcttaaaagct

SEQ ID NO: 275468 - DNA, 75 bp, Artificial Sequence
  Synthetic
acctagagatatcttgtttagaggatccaacgttgagatacagtcaagttacagggctggtgttaaaagtattcc

SEQ ID NO: 275469 - DNA, 75 bp, Artificial Sequence
  Synthetic
cgtcaacagtggtatatatcagaaagttagccgtaaagatgttgagaattaggggcataggagtgccagaggtgc

SEQ ID NO: 275470 - DNA, 75 bp, Artificial Sequence
  Synthetic
tggaagattgggatcctagtcatgaacaagctctactagataatatagctcaagagatccaacataatattccaa

SEQ ID NO: 275471 - DNA, 75 bp, Artificial Sequence
  Synthetic
taaaccgatctatcaaaacatctttctgggggcttaaagtcaataattcccaggtcttacgtctgagagggtaca

SEQ ID NO: 275472 - DNA, 75 bp, Artificial Sequence
  Synthetic
aagaggttaagaaccggaaatcaggacgatcaggagtaggtctaacgcttccatgtgataataggtacctatccc

SEQ ID NO: 275473 - DNA, 75 bp, Artificial Sequence
  Synthetic
atcaaataagacttttcgggattaatagtactagctgcttgaaggccttagagttaacatatttaataggaccat

SEQ ID NO: 275474 - DNA, 75 bp, Artificial Sequence
  Synthetic
taatagataaaagtaaagatagattatttttaggagaaggtgcaggtgctatgttgtcatgttatgatgcaacat

SEQ ID NO: 275475 - DNA, 75 bp, Artificial Sequence
  Synthetic
taggaccttcgatgaattattataactcaggtgtctcatcatatgagataaacggtcagagagaattagggatct

SEQ ID NO: 275476 - DNA, 75 bp, Artificial Sequence
  Synthetic
atccatctgaagctgcattagtggcaaagaaattgaataatgtaactaatttgggtcagagaattaaagtgctat

SEQ ID NO: 275477 - DNA, 75 bp, Artificial Sequence
  Synthetic
ttaacgggaatcctgggtctacatgggttggcaatcaagaatgcgaaacattaatttggagtgaattacaggaga

SEQ ID NO: 275478 - DNA, 75 bp, Artificial Sequence
  Synthetic
aatcaatcggcttgatacattgtgatttagaaggtggagagctcaaagatacatcgacagtactgcatgaacatt

SEQ ID NO: 275479 - DNA, 75 bp, Artificial Sequence
  Synthetic
acatcgacagtactgcatgaacattatagcataattaggatagcatatttggtaggggataacgatgttttatta

SEQ ID NO: 275480 - DNA, 75 bp, Artificial Sequence
  Synthetic
gtgactaaaattgcacctaaattgggtacagattggactcaacaactatgcttgtatctaagatattggaatgag

SEQ ID NO: 275481 - DNA, 75 bp, Artificial Sequence
  Synthetic
gtcaatttagttgttcttaagacatctaatccttcctctactgaaatgtatttgttatcaaggaatccaagtaga

SEQ ID NO: 275482 - DNA, 75 bp, Artificial Sequence
  Synthetic
gatgtgattgaagatagtctaacagtaatctcagatctgaaaccattgtctaaaaaagatagtatacaattagaa

SEQ ID NO: 275483 - DNA, 75 bp, Artificial Sequence
  Synthetic
aagtggatattgattgagaaagacaaggttaaggaatggctaatgaaagaattaaaagagggagaactgacatca

SEQ ID NO: 275484 - DNA, 75 bp, Artificial Sequence
  Synthetic
ggttcactcagaccttatcaccaagcacttcagatttttggattcgaggccaacttgcacaaattgtgtagagac

SEQ ID NO: 275485 - DNA, 75 bp, Artificial Sequence
  Synthetic
cacttcagatttttggattcgaggccaacttgcacaaattgtgtagagactttttatcaactatgaatatttcag

SEQ ID NO: 275486 - DNA, 75 bp, Artificial Sequence
  Synthetic
atcataagacatgtaaactcacagggaaatatgagttataccctataagagacagtgggaaattgaaagtaatat

SEQ ID NO: 275487 - DNA, 75 bp, Artificial Sequence
  Synthetic
caagaaggcttataatatcctggattgctttatccatgtctactagactgttgacaggcgcttttcctgatgtca

SEQ ID NO: 275488 - DNA, 75 bp, Artificial Sequence
  Synthetic
tgctttatccatgtctactagactgttgacaggcgcttttcctgatgtcaaatttgagtccagattaaatatagg

SEQ ID NO: 275489 - DNA, 75 bp, Artificial Sequence
  Synthetic
ggtgattcatagtgtgtcctacagattcttgactaaagaaatcaaagtactcatgaagatacttggagctgttaa

SEQ ID NO: 275490 - DNA, 75 bp, Artificial Sequence
  Synthetic
attatttggtgcgagacagacttataatcattcagctttaaaaccagaactcctatctgatatagatggatattt

SEQ ID NO: 275491 - DNA, 75 bp, Artificial Sequence
  Synthetic
agatgattagcctgaatacccacaataaagaactaagagtcattaagaagactatctgggcccaaatctaattga

SEQ ID NO: 275492 - DNA, 75 bp, Artificial Sequence
  Synthetic
ttgaaagaataagaaaaaacttaatcaaacagtcaagatctaaacaaaatgatatgtcttaaactcttgtctggt

SEQ ID NO: 275493 - DNA, 75 bp, Artificial Sequence
  Synthetic
aaatagaggaggtggtggtgcggttatacctggacaaaagaacaccgtctcagtatttgtcctagggtcaagtat

SEQ ID NO: 275494 - DNA, 75 bp, Artificial Sequence
  Synthetic
agttaatgcagatgtcaaatatgttatctacacaattgagcatgatccccagaggacaacccataatgggttcat

SEQ ID NO: 275495 - DNA, 75 bp, Artificial Sequence
  Synthetic
atctacacaattgagcatgatccccagaggacaacccataatgggttcattgttaggacaagagatatagactat

SEQ ID NO: 275496 - DNA, 75 bp, Artificial Sequence
  Synthetic
gatccagaatcactactccaaacttatggatatccctcatgcttaggagcattgatagtccaggtttggattgtc

SEQ ID NO: 275497 - DNA, 75 bp, Artificial Sequence
  Synthetic
tcagtggagagacagttgaggggattgggtcagtgatgaggtctcagcagagcctggtatctttaatggtagaaa

SEQ ID NO: 275498 - DNA, 75 bp, Artificial Sequence
  Synthetic
tatctaatcttagacctgatataaataaacttaagagtttaattgacatctacttatccaaaggtgcaagagccc

SEQ ID NO: 275499 - DNA, 75 bp, Artificial Sequence
  Synthetic
tgttccttcttggtcaagcagtagctaaagacgcagagtccaagattagtaatgcattagaggatgaattaggta

SEQ ID NO: 275500 - DNA, 75 bp, Artificial Sequence
  Synthetic
ctcaggacagaggaaaccacagaagaatccccaatcaggctttccaatattagagacaacaaagggagagtagca

SEQ ID NO: 275501 - DNA, 75 bp, Artificial Sequence
  Synthetic
gacggacagaggagatggggaacaaccagatccattagtgatgactttaatccagataacaacactgacgatgaa

SEQ ID NO: 275502 - DNA, 75 bp, Artificial Sequence
  Synthetic
gtatccgctgcagaaaggaggattgcagaaagactggcaaaaagagaggggaagaacaccagatcggacatactc

SEQ ID NO: 275503 - DNA, 75 bp, Artificial Sequence
  Synthetic
accaccgagggtatgactgaagatacagataacgatgatgatataatgaaaatgaatgcactaggaggaatataa

SEQ ID NO: 275504 - DNA, 75 bp, Artificial Sequence
  Synthetic
taaatccaaataaagggttttttatattggttaataagaaaaacttagggtgaaagaatagctcctagatactag

SEQ ID NO: 275505 - DNA, 75 bp, Artificial Sequence
  Synthetic
gaactttatcactctcaaagataggatctcaaactggccacctacaaaagaaccccccaaaatccagagattaaa

SEQ ID NO: 275506 - DNA, 75 bp, Artificial Sequence
  Synthetic
tggatcaggatgccttcttttctgaagaatctatggaggaacaaaaggagggacactcaacaacccgcacactca

SEQ ID NO: 275507 - DNA, 75 bp, Artificial Sequence
  Synthetic
ccagtgcagtcggactcatcgacatcatccttgccagtgagcccacagacattagaaaagatagaaaatacctat

SEQ ID NO: 275508 - DNA, 75 bp, Artificial Sequence
  Synthetic
gtgagcccatcacagcttggggaaaatcagatgcaagcaagatttctaagggtacagtctgtgaagaaaacccag

SEQ ID NO: 275509 - DNA, 75 bp, Artificial Sequence
  Synthetic
aagtgaagagagtggaattcttagggagtcaaacaagtttaaagcaaaagtttcttttggagagactaatagctc

SEQ ID NO: 275510 - DNA, 75 bp, Artificial Sequence
  Synthetic
ctatggcgacgaaattactagaaatggaggaggaaatcagagacaaagtcttgaagctgaagttggagagatgga

SEQ ID NO: 275511 - DNA, 75 bp, Artificial Sequence
  Synthetic
tccgagttctaatacgaggagaaaagacaaaactgagggacttccagaagagatacgaggaggttcatccatacc

SEQ ID NO: 275512 - DNA, 75 bp, Artificial Sequence
  Synthetic
taatgacagagaaggtagaagaaataataatggaggaagcctggagtctgtcagcacacataatccaagagtaga

SEQ ID NO: 275513 - DNA, 75 bp, Artificial Sequence
  Synthetic
aaacaatatcacagatccaaatcatcaccttgaagaagaggtactcaggaggaacaagccacgagaggtgaatgc

SEQ ID NO: 275514 - DNA, 75 bp, Artificial Sequence
  Synthetic
tacaagtcaatggtcaggtggatacaagactgatcaacaagacggtaggcatgaaatgataactaatccaatatt

SEQ ID NO: 275515 - DNA, 75 bp, Artificial Sequence
  Synthetic
ttcaaatcaaaataagtcacaaggcacaaaaaaggaaaaagggaaagaatcaactgtaaagcccaagaccagaaa

SEQ ID NO: 275516 - DNA, 75 bp, Artificial Sequence
  Synthetic
atctaaaatgtcttttgaagatacaaaaagcacagatcacatctatgaagactctcaagaacatataaggagaaa

SEQ ID NO: 275517 - DNA, 75 bp, Artificial Sequence
  Synthetic
aaaagcacagatcacatctatgaagactctcaagaacatataaggagaaagaaaacagataacgagccatcacaa

SEQ ID NO: 275518 - DNA, 75 bp, Artificial Sequence
  Synthetic
atttgcaaaacgtgtcctcaattctgtgaactctgcagaaatgacagctaatatgtgcggattattgttatctgt

SEQ ID NO: 275519 - DNA, 75 bp, Artificial Sequence
  Synthetic
tgagaaatcagtatcagatcggattgaagaaaataagacactaataaatcagattataagtgatttaagtacaag

SEQ ID NO: 275520 - DNA, 75 bp, Artificial Sequence
  Synthetic
ccacatcataacagacagaggaggaaagaacaacagcatggacacaggggagaggaaaccatcaatcaggaccaa

SEQ ID NO: 275521 - DNA, 75 bp, Artificial Sequence
  Synthetic
gggcaaggagccaacacagagaacacaaagatttgatccatctatggaattcaccgaggagattaagtacaaacc

SEQ ID NO: 275522 - DNA, 75 bp, Artificial Sequence
  Synthetic
cgatctatacagggaagacacattgagacaaagaataacaaatcctgtccttgatgagagcgtagacagaatcga

SEQ ID NO: 275523 - DNA, 75 bp, Artificial Sequence
  Synthetic
caattcgaatgccgcgagactgataccttgcaaagagaaatcaacactgcgttcactcaaattgattattgagaa

SEQ ID NO: 275524 - DNA, 75 bp, Artificial Sequence
  Synthetic
gttcactcaaattgattattgagaacagcaatttaagtaaagcagacaaaattgcttatatcaggtcactatcaa

SEQ ID NO: 275525 - DNA, 75 bp, Artificial Sequence
  Synthetic
cactgatcagcatatccagaaaacatcaagacaagagtgtactgtggtgagtaatgactctccaaatacctaata

SEQ ID NO: 275526 - DNA, 75 bp, Artificial Sequence
  Synthetic
caagaaggcaatcccacacataaggataatcaagataggggacccaccgaaacatggaaatcgatatcttgatat

SEQ ID NO: 275527 - DNA, 75 bp, Artificial Sequence
  Synthetic
tctcttacttggattttatgagatacccaaagaagttggaacttacggtagtgtatcagacctgacgagacccac

SEQ ID NO: 275528 - DNA, 75 bp, Artificial Sequence
  Synthetic
gtgtatcagacctgacgagacccacaggatacacaatctgcggttcaggatcattacctataggaattgctaggt

SEQ ID NO: 275529 - DNA, 75 bp, Artificial Sequence
  Synthetic
tgtattcaatggagtattgcaagggtaaagtagaaaagatgcggctgatcttctcgttaggactgattggaggaa

SEQ ID NO: 275530 - DNA, 75 bp, Artificial Sequence
  Synthetic
gcttctgttgaaatcactggcgtagatgctgttttccaaccctccattccaagagattttaaatactacccgaat

SEQ ID NO: 275531 - DNA, 75 bp, Artificial Sequence
  Synthetic
gtggtggcaaaaaacattgggaaaatcaaagcctagagatctacagccacagcaaccccagacattccaatatta

SEQ ID NO: 275532 - DNA, 75 bp, Artificial Sequence
  Synthetic
gactggtaagtgtcattatatgatcagcatcattcatcagaaataagaaaaacttagggtacaagttatccaaaa

SEQ ID NO: 275533 - DNA, 75 bp, Artificial Sequence
  Synthetic
aagacaaaacagaacaaacagatcaagacaaaacatcacaagatgcaagtcaccaccctcagaacagccataata

SEQ ID NO: 275534 - DNA, 75 bp, Artificial Sequence
  Synthetic
caccaccctcagaacagccataatactaagcatagcactattagtgaccagtcaagttcccagagataaactagc

SEQ ID NO: 275535 - DNA, 75 bp, Artificial Sequence
  Synthetic
aagccttgtaccaacaatagacaatgtgaatgggtgtggttccatccaaatagcaaaatataaggagatgcttga

SEQ ID NO: 275536 - DNA, 75 bp, Artificial Sequence
  Synthetic
gcactagatttacaagaatctttgatagtgattgataatgaaaccgtcaacaacaattatcgtccacagtataga

SEQ ID NO: 275537 - DNA, 75 bp, Artificial Sequence
  Synthetic
atggaagcaagagaggcaaaaagagatatatcaatgttaaaagaagcaattggaaagactcagaactcaattgag

SEQ ID NO: 275538 - DNA, 75 bp, Artificial Sequence
  Synthetic
aaattacagaattctgcaggtgaacagatactggctctcaaaatgctccaagattatgtcaatggagagatcaag

SEQ ID NO: 275539 - DNA, 75 bp, Artificial Sequence
  Synthetic
ccagctattgaagaacttggatgtgagactgctgcacttaaattaggaattgcacttacacaacattatacagag

SEQ ID NO: 275540 - DNA, 75 bp, Artificial Sequence
  Synthetic
agactgctgcacttaaattaggaattgcacttacacaacattatacagagctcacaaatgcctttggatctaatc

SEQ ID NO: 275541 - DNA, 75 bp, Artificial Sequence
  Synthetic
taacagcaactaatctcgggaaaacagatatttatgacattatatatgctgagcaagttaaaggaagagtaatag

SEQ ID NO: 275542 - DNA, 75 bp, Artificial Sequence
  Synthetic
agatatttatgacattatatatgctgagcaagttaaaggaagagtaatagatgtcgaccttagacgatatatggt

SEQ ID NO: 275543 - DNA, 75 bp, Artificial Sequence
  Synthetic
caatatagatggagcagagtggtatgttgctgtacctgaccacatattaagtaaatccgcatatataggaggtgc

SEQ ID NO: 275544 - DNA, 75 bp, Artificial Sequence
  Synthetic
agattgacatatatttgcccgcaagatcctgctcagattatagcagataaccaacagcaatgttttttaggtcat

SEQ ID NO: 275545 - DNA, 75 bp, Artificial Sequence
  Synthetic
gcgaactgtatagcctccacatgtacctgtggagaagagagggtccaggtctctcaggatagaaataaaggagta

SEQ ID NO: 275546 - DNA, 75 bp, Artificial Sequence
  Synthetic
acctttttgactcacaataattgtggattaatagggataaacgggatagaatttcatgccaacaagaaaggaagt

SEQ ID NO: 275547 - DNA, 75 bp, Artificial Sequence
  Synthetic
atttcatgccaacaagaaaggaagtgatgctacttggaatgtctcccctataggagtaggaccagcaatatcgtt

SEQ ID NO: 275548 - DNA, 75 bp, Artificial Sequence
  Synthetic
ggaaatcttaaagatttaaccgtcataacgataattaatatagtaattatagctgtattacttatatgtgtaatt

SEQ ID NO: 275549 - DNA, 75 bp, Artificial Sequence
  Synthetic
taacgataattaatatagtaattatagctgtattacttatatgtgtaattagattaggcgtactgtattaccaat

SEQ ID NO: 275550 - DNA, 75 bp, Artificial Sequence
  Synthetic
tcttattctttagaaccaagaaccgcccagatacaagtaatgaagcctaccagtttcatgggataaactatgaag

SEQ ID NO: 275551 - DNA, 75 bp, Artificial Sequence
  Synthetic
gaaaaagaccagagatcaacacaccaagggatggaagagaccaaagttaagacatcagagtactggggcaagagt

SEQ ID NO: 275552 - DNA, 75 bp, Artificial Sequence
  Synthetic
tcatttatttcttccttatctcttgtactggttatagctgtattgataatgcaatccttacacaacggcacaata

SEQ ID NO: 275553 - DNA, 75 bp, Artificial Sequence
  Synthetic
ctgagatgtaaagatgtgggcctagaatccatcaatcaatccacttactccatatctaatgcaattctggacgtc

SEQ ID NO: 275554 - DNA, 75 bp, Artificial Sequence
  Synthetic
aatccatcaatcaatccacttactccatatctaatgcaattctggacgtcatcaaacaagaactgataactcgta

SEQ ID NO: 275555 - DNA, 75 bp, Artificial Sequence
  Synthetic
ccattgagaaaagttcaaaagtgcatcaaaattctcctacttgtagtggtgtggctgccctaacacatgtggaag

SEQ ID NO: 275556 - DNA, 75 bp, Artificial Sequence
  Synthetic
tcaaaattctcctacttgtagtggtgtggctgccctaacacatgtggaaggaataaaacctttggatccagacga

SEQ ID NO: 275557 - DNA, 75 bp, Artificial Sequence
  Synthetic
gctggctggaacatctaccattgatggctgtgtaagattaccatctcttgcaataggaaaatcgctatatgccta

SEQ ID NO: 275558 - DNA, 75 bp, Artificial Sequence
  Synthetic
ggctgtgtaagattaccatctcttgcaataggaaaatcgctatatgcctatagttccaacttaataactaagggt

SEQ ID NO: 275559 - DNA, 75 bp, Artificial Sequence
  Synthetic
ttgttctgttgctgtgtctgaaactaaaggataccaattatgctcgatgccacgtgtcaatgaaaaaacggacta

SEQ ID NO: 275560 - DNA, 75 bp, Artificial Sequence
  Synthetic
taggaagtggtattatatggaaaaatgaactgtatttcctaggttatggggctctgacaactgcacttcaaggga

SEQ ID NO: 275561 - DNA, 75 bp, Artificial Sequence
  Synthetic
tgtacagcagacagatggttaatgtcctgatacaggttaaggggtatctatctaacaagccaagtattatagtta

SEQ ID NO: 275562 - DNA, 75 bp, Artificial Sequence
  Synthetic
ataaatcatccaataaccataacttggacagatcacagagttctatcaagacctggaagaagtccttgtgcctgg

SEQ ID NO: 275563 - DNA, 75 bp, Artificial Sequence
  Synthetic
cacgtcatgtattgtccattttgatagaggttattgttttcatattatagaaattaatcaaaaagaactgaatac

SEQ ID NO: 275564 - DNA, 75 bp, Artificial Sequence
  Synthetic
actacaacctatgctttttaagactgcaatacctaaagcctgcaggataagcaatttataagacacctattgaaa

SEQ ID NO: 275565 - DNA, 75 bp, Artificial Sequence
  Synthetic
gcaatttataagacacctattgaaataataatctatatctaattacttacaagggtgaccatgcatgacttagag

SEQ ID NO: 275566 - DNA, 75 bp, Artificial Sequence
  Synthetic
gaatgccagagcattcagccagaatggatcaatttaatatgtctcaaaatccaagtgatatactataccctgaat

SEQ ID NO: 275567 - DNA, 75 bp, Artificial Sequence
  Synthetic
gccatctgaactctccagttgtgaaagggaagatcgctcagctacatgtcttgttagatattaatcagccgtatg

SEQ ID NO: 275568 - DNA, 75 bp, Artificial Sequence
  Synthetic
aaatgaaggaccctagtataatagaaatcacgaaagttaaaattaaatccggagggttaaatcaaaggttaatca

SEQ ID NO: 275569 - DNA, 75 bp, Artificial Sequence
  Synthetic
gaatcaggtctctagggaaagagatgaggagaattatacttgattttgataagtatacatttgaaccctacccaa

SEQ ID NO: 275570 - DNA, 75 bp, Artificial Sequence
  Synthetic
attcgatcagtttttgcagtgtctgacaagttaagcaaagatatatcccaaccattacaatacttatggagagat

SEQ ID NO: 275571 - DNA, 75 bp, Artificial Sequence
  Synthetic
cacaggatacttactaacaccagaattagtgctaatgtactgtgatgtagttgaaggtagatggaatatgtctgc

SEQ ID NO: 275572 - DNA, 75 bp, Artificial Sequence
  Synthetic
aattgtgggacaggatagatgaattatttaagataatcggggaagagacatttaatattatatcactactggagc

SEQ ID NO: 275573 - DNA, 75 bp, Artificial Sequence
  Synthetic
cagcagttgacaatttcgagagttttataggtttcagattcgagaaatttatagaccctcaattagatgaagacc

SEQ ID NO: 275574 - DNA, 75 bp, Artificial Sequence
  Synthetic
cagaagacattatacaatatgtagagacaggagagtggttaaacgatgagactttcaacatatcttatagcctta

SEQ ID NO: 275575 - DNA, 75 bp, Artificial Sequence
  Synthetic
aagaaaaggagatcaaacaggagggtcgattgtttgccaagatgacatacaagatgagagcagtccaagtattgg

SEQ ID NO: 275576 - DNA, 75 bp, Artificial Sequence
  Synthetic
tcgattgtttgccaagatgacatacaagatgagagcagtccaagtattggcagaaactttactagcgaaaggaat

SEQ ID NO: 275577 - DNA, 75 bp, Artificial Sequence
  Synthetic
atggttaaaggtgaaatcgatttactaaagagtctaactactttatctatatcaggggttccaaggactagcgag

SEQ ID NO: 275578 - DNA, 75 bp, Artificial Sequence
  Synthetic
tcaactggatgcatcctgtattggaagaatgtacaatatatgtgggtgatcctcactgtcccgtgcccgataaaa

SEQ ID NO: 275579 - DNA, 75 bp, Artificial Sequence
  Synthetic
gtcaaaaactttggactctcatatccataagtgcaattcatctagctgctgtcaaggtcggggttagagtatcag

SEQ ID NO: 275580 - DNA, 75 bp, Artificial Sequence
  Synthetic
ctatggtacaaggtgataaccaagcaattgccgtgacatccagggtaccagtgacggccacgtataggttcaaaa

SEQ ID NO: 275581 - DNA, 75 bp, Artificial Sequence
  Synthetic
aggagcaggtatatacggagatcactaagtattttaagtccttaagagatgtgatgtctgatttaggacatgaac

SEQ ID NO: 275582 - DNA, 75 bp, Artificial Sequence
  Synthetic
tcaaactcaacgagacaattataagtagcaagatgttcgtgtatagtaagcgaatatattatgatggtaaaatac

SEQ ID NO: 275583 - DNA, 75 bp, Artificial Sequence
  Synthetic
tagcaagatgttcgtgtatagtaagcgaatatattatgatggtaaaatactaccccagtgtttaaaagcacttac

SEQ ID NO: 275584 - DNA, 75 bp, Artificial Sequence
  Synthetic
ttggtggatgaaaacaggtctgcgtgctccaatcttgcaactgctatagctaaagccatagaaaatggttattca

SEQ ID NO: 275585 - DNA, 75 bp, Artificial Sequence
  Synthetic
ttcgagcaggactattggacaaacagattttgtaccgtgtaatgaatcaagagtctggagattctaatttcttag

SEQ ID NO: 275586 - DNA, 75 bp, Artificial Sequence
  Synthetic
ctcgttcagttctccaagagtcaccaaatcccctactttcgggtctatttacatgtgacagtaaagaagaagact

SEQ ID NO: 275587 - DNA, 75 bp, Artificial Sequence
  Synthetic
gaacatttatcaaaggatctgaggtctgcaaaatatgcaggtctgaaggtgataatcctatatatacttggtttt

SEQ ID NO: 275588 - DNA, 75 bp, Artificial Sequence
  Synthetic
ctgcaaaatatgcaggtctgaaggtgataatcctatatatacttggttttatttacccgaggaaatagatctgga

SEQ ID NO: 275589 - DNA, 75 bp, Artificial Sequence
  Synthetic
actgggttatgttaaaacactgagtaaacctgctaaagcagcgattaggattgctatgatatatacttgggcata

SEQ ID NO: 275590 - DNA, 75 bp, Artificial Sequence
  Synthetic
gagcaaatttaagtcttgataatttgaaacttctgactccggtatcaacatctacaaatctgtctcatagattaa

SEQ ID NO: 275591 - DNA, 75 bp, Artificial Sequence
  Synthetic
tgagacaaaggatactaatttaatatatcagcagataatgttgacaggacttagtgtttttgaattcaataccag

SEQ ID NO: 275592 - DNA, 75 bp, Artificial Sequence
  Synthetic
atacggtctaaatataagaggcagagaagaaatatggggttacattacacgaactttgaaagatacttcccatgc

SEQ ID NO: 275593 - DNA, 75 bp, Artificial Sequence
  Synthetic
gaactttgaaagatacttcccatgctgtgttaaaggtacttgctaatgcattgtcacatccaaaggtgtttaaga

SEQ ID NO: 275594 - DNA, 75 bp, Artificial Sequence
  Synthetic
tatctgtttgtgagtactcaatagacttattcatgagggactggcaaagcggaatacctctggaaacctttatat

SEQ ID NO: 275595 - DNA, 75 bp, Artificial Sequence
  Synthetic
taggagagatttcctcatatggccctagattagaaactctaacatcattagaaagattagaggttcttaaaagct

SEQ ID NO: 275596 - DNA, 75 bp, Artificial Sequence
  Synthetic
tagattagaaactctaacatcattagaaagattagaggttcttaaaagctatctagagatatcttgtttagagga

SEQ ID NO: 275597 - DNA, 75 bp, Artificial Sequence
  Synthetic
gttagccataaagatgttaaggattaggggcataggggtgccagaggtgttggaagactgggatcctagtcatga

SEQ ID NO: 275598 - DNA, 75 bp, Artificial Sequence
  Synthetic
ctgggggctcaaagtcaataattcccaagtattacgtctaaggggatataaggaggttaaggataggaaatcagg

SEQ ID NO: 275599 - DNA, 75 bp, Artificial Sequence
  Synthetic
gcgatcaggggtaggtctaacacttccatgtgataataggtacttatcccatcagataagactttttgggattaa

SEQ ID NO: 275600 - DNA, 75 bp, Artificial Sequence
  Synthetic
ccatgtgataataggtacttatcccatcagataagactttttgggattaatagtactagctgcttgaaggctttg

SEQ ID NO: 275601 - DNA, 75 bp, Artificial Sequence
  Synthetic
atgttgtcatgttatgatgcaacgttaggaccttcaatgaactattataactcaggtgtctcatcatatgatata

SEQ ID NO: 275602 - DNA, 75 bp, Artificial Sequence
  Synthetic
aatggtcagagggaattagggatctatccatctgaggctgcattagtggcaaagaaattgaataatgtaactaat

SEQ ID NO: 275603 - DNA, 75 bp, Artificial Sequence
  Synthetic
ttaatttggagtgagttacaagacaaatcaatcggcttgatacattgtgacctagaaggtggagaactcaaagat

SEQ ID NO: 275604 - DNA, 75 bp, Artificial Sequence
  Synthetic
gtcaatttagttgttcttaaaacatctaatccttcttctactgagatgtatttgttatcaaggagtcctagtaaa

SEQ ID NO: 275605 - DNA, 75 bp, Artificial Sequence
  Synthetic
ctaatccttcttctactgagatgtatttgttatcaaggagtcctagtaaagatgtgattgaggatagtttaacag

SEQ ID NO: 275606 - DNA, 75 bp, Artificial Sequence
  Synthetic
cacttcagatttttggatttgaggccaacttgcacaaattgtgtagagacttcttatctactatgagtatttcag

SEQ ID NO: 275607 - DNA, 75 bp, Artificial Sequence
  Synthetic
atatccagatgtgtataaattcattctacagagttttaaaagatacaatatttgagtggagtcggataacaaatg

SEQ ID NO: 275608 - DNA, 75 bp, Artificial Sequence
  Synthetic
gacagtgggaagttgaaagtgatatcaagaaggcttataatatcctggattgctttatccatgtctactagactg

SEQ ID NO: 275609 - DNA, 75 bp, Artificial Sequence
  Synthetic
atcaaatcacttaaacttatatccaaggctacggtggataggttccaagaagtgattcatagtgtatcctacaga

SEQ ID NO: 275610 - DNA, 75 bp, Artificial Sequence
  Synthetic
aaccatccaactttaacaccagaacccctatctgatatagaaggatatttagatgattagctcgaatatcaacaa

SEQ ID NO: 275611 - DNA, 75 bp, Artificial Sequence
  Synthetic
agatgattagctcgaatatcaacaataaacaactaagagtcattaagaagactatctggatccagacctaaatga

SEQ ID NO: 275612 - DNA, 75 bp, Artificial Sequence
  Synthetic
gatcagttttgtgagtacaaagctgcggttaagtcaattgaacatatatttgagtcaccactcaacaagtcaaaa

SEQ ID NO: 275613 - DNA, 75 bp, Artificial Sequence
  Synthetic
atcttataataactatggactggcaaacttaggagtaaagatcctactgtcggggggaggaggaggagcaagatc

SEQ ID NO: 275614 - DNA, 75 bp, Artificial Sequence
  Synthetic
caaactgttattacaacagtggggtaacagcagagggtagagccggacagagggaaatctctccctatccctcag

SEQ ID NO: 275615 - DNA, 75 bp, Artificial Sequence
  Synthetic
ttcaggaggggccatccgggggattaagaatgttatcatagtcccgattcccggagactcgtccatcattacccg

SEQ ID NO: 275616 - DNA, 75 bp, Artificial Sequence
  Synthetic
aagaatgttatcatagtcccgattcccggagactcgtccatcattacccgttcaagactgctcgacaggcttgtc

SEQ ID NO: 275617 - DNA, 75 bp, Artificial Sequence
  Synthetic
tttttaagagtcttcgagattggactggtaagagatctcgggctgggtccccctgttttccatatgaccaactat

SEQ ID NO: 275618 - DNA, 75 bp, Artificial Sequence
  Synthetic
acgggtcaaagctgaccggcgtgatgatcagcatgttatctttgttcgtagagtcacccgggcaattgatacagc

SEQ ID NO: 275619 - DNA, 75 bp, Artificial Sequence
  Synthetic
ctcacagtgaacatgagtgatgactatcggagatgtcttttagcggtaggggagttgaagttgacagccctatgc

SEQ ID NO: 275620 - DNA, 75 bp, Artificial Sequence
  Synthetic
agtaagaatcgcctctctagtgcaaggtgacaatcaaacaattgcagtgacaaaaagagtcccgagttcttggcc

SEQ ID NO: 275621 - DNA, 75 bp, Artificial Sequence
  Synthetic
gcctcttgtggttgtgatacttaacctggctgggcccactctagggggcgaactatacagtgtcttgcctacctc

SEQ ID NO: 275622 - DNA, 75 bp, Artificial Sequence
  Synthetic
tccagagcagctcaaaattacttcgtggttttaaggcagagattgcacgatgtaggtcatcacttaaaggccaat

SEQ ID NO: 275623 - DNA, 75 bp, Artificial Sequence
  Synthetic
ttatcttcacatagagggattatcaaagatgacgaggccaattgggtagtgccgtctaccgatgttcgtgatctt

SEQ ID NO: 275624 - DNA, 75 bp, Artificial Sequence
  Synthetic
aagatgacgaggccaattgggtagtgccgtctaccgatgttcgtgatcttcaaaacaaaggtgaatgtctggtgg

SEQ ID NO: 275625 - DNA, 75 bp, Artificial Sequence
  Synthetic
tggttttaaggcagagattgcacgatgtaggtcatcacttaaaggccaatgaaaccattgtatcttcccactttt

SEQ ID NO: 275626 - DNA, 75 bp, Artificial Sequence
  Synthetic
gtgcaggatccagaagagttcaatatgttgttagcctccatactagcacaagtctggatccttctggccaaggct

SEQ ID NO: 275627 - DNA, 75 bp, Artificial Sequence
  Synthetic
tgttgttagcctccatactagcacaagtctggatccttctggccaaggctgttacggcaccggatacggcagctg

SEQ ID NO: 275628 - DNA, 75 bp, Artificial Sequence
  Synthetic
aatctattgatcaccagactaaggatgtcttaactcccctttttaaaatcattggcgatgaagtcggcatcagaa

SEQ ID NO: 275629 - DNA, 75 bp, Artificial Sequence
  Synthetic
gttatcacttcagtgtttggcccactgatacctcacctatccggcatggatctttacaacaacccgttttcaaga

SEQ ID NO: 275630 - DNA, 75 bp, Artificial Sequence
  Synthetic
tgacttagctagtgacccgggtgtagttatcacttcagtgtttggcccactgatacctcacctatccggcatgga

SEQ ID NO: 275631 - DNA, 75 bp, Artificial Sequence
  Synthetic
atgagcagtcatttctaggaatgataaatacaattggattccctaacagagcagaggttatgccgcacattttga

SEQ ID NO: 275632 - DNA, 75 bp, Artificial Sequence
  Synthetic
tgcagaagatctatcacttcggcggttcatggtatctctcatacttgacatcaagaggacccccggcaacaagcc

SEQ ID NO: 275633 - DNA, 75 bp, Artificial Sequence
  Synthetic
caagtttggtatcgaaaccatgtatcctgcattagggctccacgagtttgccggggaattgtccactattgagtc

SEQ ID NO: 275634 - DNA, 75 bp, Artificial Sequence
  Synthetic
acagccacttatgatgtttccaggagcgagcatgcaatcgtgtactatatctatgacacaggtcgctcatcatct

SEQ ID NO: 275635 - DNA, 75 bp, Artificial Sequence
  Synthetic
cctgcattagggctccacgagtttgccggggaattgtccactattgagtccttgatgaacttgtatcaacagcta

SEQ ID NO: 275636 - DNA, 75 bp, Artificial Sequence
  Synthetic
ggtatagaggtaacatgtaatccagtctgagcagagctacgaccgtcactcaggcagtcccttgagtcgccaccg

SEQ ID NO: 275637 - DNA, 75 bp, Artificial Sequence
  Synthetic
gggcttgaactttggcaggtcatattttgaccctgcctattttcgtctcggacaggagatggtcagaagatctgc

SEQ ID NO: 275638 - DNA, 75 bp, Artificial Sequence
  Synthetic
cgcaggtctccttcctccagcacaaagcaggagagggagattcgcccgcaccagcgaccagagaaggggtcaaag

SEQ ID NO: 275639 - DNA, 75 bp, Artificial Sequence
  Synthetic
agtttcttgatggatcggcatataattgttcccagagctgcacatgaaatcttagaccatagcataactggagca

SEQ ID NO: 275640 - DNA, 75 bp, Artificial Sequence
  Synthetic
gctagagggactgggcctcgacaggcgcaggtctccttcctccagcacaaaacaggagagggagagtcgtacgca

SEQ ID NO: 275641 - DNA, 75 bp, Artificial Sequence
  Synthetic
ccagcaaccagagagggggtcaaagctgcgatcccaaacggatccgacgaaagggacaggaagcaaacacgctca

SEQ ID NO: 275642 - DNA, 75 bp, Artificial Sequence
  Synthetic
attatgattatgaacaattcagatccggtataacattattgacgaagaagggacagtgttatctcattgacaaag

SEQ ID NO: 275643 - DNA, 75 bp, Artificial Sequence
  Synthetic
aagggacaggaagcaaacacgctcaggaaggcccagaggagagacccccagccaacttctcctggaaatcatgcc

SEQ ID NO: 275644 - DNA, 75 bp, Artificial Sequence
  Synthetic
ctgcgatcccaaacggatccgacgaaagggacaggaagcaaacacgctcaggaaggcccagaggagagaccccca

SEQ ID NO: 275645 - DNA, 75 bp, Artificial Sequence
  Synthetic
gatcttcagaacaaaggtgaatgtctggtggaagcatgcaagactcgacctccttcattttgcaatggcacagga

SEQ ID NO: 275646 - DNA, 75 bp, Artificial Sequence
  Synthetic
ggtcagaaccctcgtgaggctcaaagatcggccgaggcactcttcaggctgcaggccatggccaagattctggag

SEQ ID NO: 275647 - DNA, 75 bp, Artificial Sequence
  Synthetic
gatcggccgaggcactcttcaggctgcaggccatggccaagattctggaggaccaggaggagggagaagacaaca

SEQ ID NO: 275648 - DNA, 75 bp, Artificial Sequence
  Synthetic
ttgctctgcttgaaccattatcgttggcttatcttcaacttcaggatgtcactctggagttaagaggtgcttttt

SEQ ID NO: 275649 - DNA, 75 bp, Artificial Sequence
  Synthetic
tggtggaagcatgcaagactcgacctccttcattttgcaatggcacaggatcaggcccgtggtcagaagggagaa

SEQ ID NO: 275650 - DNA, 75 bp, Artificial Sequence
  Synthetic
gacacagaaggcacctacaattccatcactgaaggattggattacgtattcatcacccacgatatacatctaact

SEQ ID NO: 275651 - DNA, 75 bp, Artificial Sequence
  Synthetic
cctcggctaagcagacgcaccctctgtcgaaatcagtgacaagacatctcctaccagtattataaaaaacttagg

SEQ ID NO: 275652 - DNA, 75 bp, Artificial Sequence
  Synthetic
tgggcctacggggatgatgaaaaatcatggagtgaagcctggatgctggctaggcagagagccgatatcaccctc

SEQ ID NO: 275653 - DNA, 75 bp, Artificial Sequence
  Synthetic
atatgaccggggatctgttgccggcaatgatgtcgctaggtccacagatgtcgaaaaactagaaggtgctgatat

SEQ ID NO: 275654 - DNA, 75 bp, Artificial Sequence
  Synthetic
tatcaagtccctcaaagcctctcccccggatctatccaccatcagagacaccattgagagctggagagaggggct

SEQ ID NO: 275655 - DNA, 75 bp, Artificial Sequence
  Synthetic
cctcaaagacaaggcattggctgcactgaagaatgagtgggattcagtttacccgaaagaatacctccgttataa

SEQ ID NO: 275656 - DNA, 75 bp, Artificial Sequence
  Synthetic
atcagagtatcaaccaatcatgctcaccagcaatcggaccaaacaaagtctacttgtctcctgaagataatctcg

SEQ ID NO: 275657 - DNA, 75 bp, Artificial Sequence
  Synthetic
accagcaatcggaccaaacaaagtctacttgtctcctgaagataatctcggatttagagagatcactggcaacga

SEQ ID NO: 275658 - DNA, 75 bp, Artificial Sequence
  Synthetic
tacttgtctcctgaagataatctcggatttagagagatcactggcaacgactgtgaggctgggctcggaggagtc

SEQ ID NO: 275659 - DNA, 75 bp, Artificial Sequence
  Synthetic
acgagcatgacctaacaaaagcccttcacactctggcagtctcaggtgttcccaagaacaacaaagataaccacc

SEQ ID NO: 275660 - DNA, 75 bp, Artificial Sequence
  Synthetic
gggtatccaacacagtgctacatctgcacgtggagacagaatgctgcgttgtacctatggttgaccacccaagga

SEQ ID NO: 275661 - DNA, 75 bp, Artificial Sequence
  Synthetic
aagccgagaggtgagatcaagccaagacaccaaaacacaaaatagagacaaggtccaaggggggcctatgtacaa

SEQ ID NO: 275662 - DNA, 75 bp, Artificial Sequence
  Synthetic
acgcagatcctccagttgctaacgtcttcaatggaggagaggatggatccgacgacagcgatgtggactctagct

SEQ ID NO: 275663 - DNA, 75 bp, Artificial Sequence
  Synthetic
atccagtctgagcagagctacgaccgtcactcaggcagtcccttgagtcgccaccgagtccaagcagcacagcct

SEQ ID NO: 275664 - DNA, 75 bp, Artificial Sequence
  Synthetic
ctatttgcgatgccaaccaatcagccctgatcagggtgagtcatacgagactgttagtgcattcatcaccgctga

SEQ ID NO: 275665 - DNA, 75 bp, Artificial Sequence
  Synthetic
gacaccaaaacacaaaatagagacaaggtccaaggggggcctatgtacaactatttgcgatgccaaccaatcagc

SEQ ID NO: 275666 - DNA, 75 bp, Artificial Sequence
  Synthetic
tcgaaaaactagaagttgctgatattcaagaggttcgtaactcccagaaaggcaaaggaggaagattccaaggcg

SEQ ID NO: 275667 - DNA, 75 bp, Artificial Sequence
  Synthetic
acccgatgtcaagcactccagaccatcagcccaatcaattaaaaagggcacagacgggaactcagtctcatctgg

SEQ ID NO: 275668 - DNA, 75 bp, Artificial Sequence
  Synthetic
tcagcccaatcaattaaaaagggcacagacgggaactcagtctcatctggaacggtgacagagtgtttatcgata

SEQ ID NO: 275669 - DNA, 75 bp, Artificial Sequence
  Synthetic
ctaaagagcatcgccagatgtgtcttctggtccgagactatagtggatgaaaccagagcggcctgcagcaatatt

SEQ ID NO: 275670 - DNA, 75 bp, Artificial Sequence
  Synthetic
tcctctcaatcaggctattacaaaaaacttaggagcaagggcaactgagcttcgcagacaagatgaccgagatct

SEQ ID NO: 275671 - DNA, 75 bp, Artificial Sequence
  Synthetic
tcaggatgtcgtggcaccgatcatcgagaacggtgatttgctgataaggatggcactcttgccagcacccatcgg

SEQ ID NO: 275672 - DNA, 75 bp, Artificial Sequence
  Synthetic
gagaacggtgatttgctgataaggatggcactcttgccagcacccatcgggggtctcaattatcttaacatgagc

SEQ ID NO: 275673 - DNA, 75 bp, Artificial Sequence
  Synthetic
aagtgatgacccagaccccgggagaatcatcctacctcgattgggcaagtgacccttattctgccaacctaccct

SEQ ID NO: 275674 - DNA, 75 bp, Artificial Sequence
  Synthetic
tctctactctttgctctctaggatgagcaaaggagtatacaagatctttaccaatgctttgagccaccccaaggt

SEQ ID NO: 275675 - DNA, 75 bp, Artificial Sequence
  Synthetic
tccaggggttgacacaagaatctggtaccatagcatcactgactcagcctaaagagaatgactccgagtatgagt

SEQ ID NO: 275676 - DNA, 75 bp, Artificial Sequence
  Synthetic
ccccctgtctcccccagtcggaagaacctttggttctttacctctaggggtcggtaggtcaactgctaagccaga

SEQ ID NO: 275677 - DNA, 75 bp, Artificial Sequence
  Synthetic
tacgtatctgctctgcgagagtgatgaggacgtggtcacagacaggttcgataacattcaagccaaacatctctg

SEQ ID NO: 275678 - DNA, 75 bp, Artificial Sequence
  Synthetic
aagtatgaaacggggtggcctcacccctcgagtcttagcccgcctttccaattatgattatgaacaattccgatc

SEQ ID NO: 275679 - DNA, 75 bp, Artificial Sequence
  Synthetic
actcgtgctcggtgcagctcgctatagctctgaggagccacatgtgggctaggttggctcgcgggagaccaatct

SEQ ID NO: 275680 - DNA, 75 bp, Artificial Sequence
  Synthetic
aacaaatcaggttgagagtagatcctggatttgtattcgaggcactgacagacatcgacaccaaactgcctcgaa

SEQ ID NO: 275681 - DNA, 75 bp, Artificial Sequence
  Synthetic
cggaggtcctcaagaaacccgcggtggataggtttcagaaaattggaaccaaagccaactccagctcaaagggtc

SEQ ID NO: 275682 - DNA, 75 bp, Artificial Sequence
  Synthetic
acctatcgacaagcaggcaagctctgcaatcgggtttgtcccatccgaccatgaatcatccagaaatgtcatccg

SEQ ID NO: 275683 - DNA, 75 bp, Artificial Sequence
  Synthetic
ctccaagtcgatccctcaagtcagcagtcagaattgcaacagtttactcatgggcctacggggatgatgagaaat

SEQ ID NO: 275684 - DNA, 75 bp, Artificial Sequence
  Synthetic
tctaactatgaggtccacgcttatcgtaggattggtttgaattcatcagcatgttataaagctgtagaaatctcc

SEQ ID NO: 275685 - DNA, 75 bp, Artificial Sequence
  Synthetic
gagtatccaacacagtgctacacctgcacgtggaaacagaatgttgtgttgtacctatggtggatcacccaagga

SEQ ID NO: 275686 - DNA, 75 bp, Artificial Sequence
  Synthetic
gcgtataaggaagttcttaaattagccaactgttattacaacagcggagtaatagctgaggggagagccggacag

SEQ ID NO: 275687 - DNA, 75 bp, Artificial Sequence
  Synthetic
ttcgcagacaagatgaccgagatctacgacttcgataaatcagcatgggatgtcaaagggtcaattgctcgcata

SEQ ID NO: 275688 - DNA, 75 bp, Artificial Sequence
  Synthetic
ggggttagaaaggagtgttaaagtgctgttcaacggcaaacctgaagtaacttgggtcgggaccaccgattgcta

SEQ ID NO: 275689 - DNA, 75 bp, Artificial Sequence
  Synthetic
gactgataccccaggtaagggtcatcgatcctggtctgggagacagaaaagatgagtgcttcatgtacctgtttc

SEQ ID NO: 275690 - DNA, 75 bp, Artificial Sequence
  Synthetic
cgatcctggtctgggagacagaaaagatgagtgcttcatgtacctgtttctcctaggagtgattgaggataacga

SEQ ID NO: 275691 - DNA, 75 bp, Artificial Sequence
  Synthetic
cagatattgagacactcccaaccaaagatgctgttgagaaattagaagaatttgcctctatcttatccttatccc

SEQ ID NO: 275692 - DNA, 75 bp, Artificial Sequence
  Synthetic
tttgcctctatcttatccttatccctaattttgggaaaaattggctctattaccgttatcaaagttatgcctatt

SEQ ID NO: 275693 - DNA, 75 bp, Artificial Sequence
  Synthetic
ccaggtttgcaatgcagtcaacctagtcccgcttgatactccccagagattcagggttgtgtacatgagcataac

SEQ ID NO: 275694 - DNA, 75 bp, Artificial Sequence
  Synthetic
ccctggatacacagaatttacatgtcactgtctgtgacatgatatatgggtcctatgtcacctatttggatcttt

SEQ ID NO: 275695 - DNA, 75 bp, Artificial Sequence
  Synthetic
agtttgcccagaagaatgctggagttccgctcagccaatgcagtagccttcaacttcttggtgacactaagaatt

SEQ ID NO: 275696 - DNA, 75 bp, Artificial Sequence
  Synthetic
gaacaagtctccatattagtagcaccgggaaaatgagcaaaaccctccatgcacagctggggttcaagaaaatct

SEQ ID NO: 275697 - DNA, 75 bp, Artificial Sequence
  Synthetic
gttatgtcttgctatattctgatgatccggcactgatcaggcaaacaattaagaacttgaagagaaaccacctaa

SEQ ID NO: 275698 - DNA, 75 bp, Artificial Sequence
  Synthetic
atgttataaagccgtagagatctccacgttaatcaagccatccttagaagtcggagagcatggattgttcttagg

SEQ ID NO: 275699 - DNA, 75 bp, Artificial Sequence
  Synthetic
tacatgtacgacacaagcagtcagaggacgcaggaagcccggtctccgatcaccgacctgaccctactccaagct

SEQ ID NO: 275700 - DNA, 75 bp, Artificial Sequence
  Synthetic
ttcaaattggtgggttacagtgctctcgtcagaggttaattagctatacatctgcccccttctcctccaccatga

SEQ ID NO: 275701 - DNA, 75 bp, Artificial Sequence
  Synthetic
ggaaggggccccaccctcccccgccagaaaacacactccaaggctccccgacacagcaccaacgcagccactctc

SEQ ID NO: 275702 - DNA, 75 bp, Artificial Sequence
  Synthetic
cctcaaaggaatgaacccacccccaggaaggggccccaccctcccccgccagaaaacacactccaaggctccccg

SEQ ID NO: 275703 - DNA, 75 bp, Artificial Sequence
  Synthetic
acacagcaccaacgcagccactctcccgatgggacgaggccggccccccaacaaacccggtccaggcggggggcc

SEQ ID NO: 275704 - DNA, 75 bp, Artificial Sequence
  Synthetic
gccattaagcaaagcataatcagagcgggggtcaggactgcaccaggacttgtgagccatatattatcagagaaa

SEQ ID NO: 275705 - DNA, 75 bp, Artificial Sequence
  Synthetic
aacttaggagtaaagatcctactgtcggggggaggaggaggagcaagatctttgaccatggcgactctccttaaa

SEQ ID NO: 275706 - DNA, 75 bp, Artificial Sequence
  Synthetic
aacacgcccgaggccaggcgccgggcacccccagacccgccaccggcgagacagaaccccaaggggggacccccc

SEQ ID NO: 275707 - DNA, 75 bp, Artificial Sequence
  Synthetic
catctccgataagattaaattcctcaaccctgacagagagtatgatttcagggatctccggtggtgtatgaatcc

SEQ ID NO: 275708 - DNA, 75 bp, Artificial Sequence
  Synthetic
gcacgatgtaggtcatcacttaaaggctaatgagaccatagtatcttctcacttttttgtatattccaaagggat

SEQ ID NO: 275709 - DNA, 75 bp, Artificial Sequence
  Synthetic
acacccaaccaccgaaacacccagccccagggaaggagtccccccccacacggcgaaggaacgggtgagagaccc

SEQ ID NO: 275710 - DNA, 75 bp, Artificial Sequence
  Synthetic
accaaacaaagttgggtaaggatagatcttataataactatggatcaggaaacttaggagtaaagatcctactgt

SEQ ID NO: 275711 - DNA, 75 bp, Artificial Sequence
  Synthetic
ggggaggttgcaccctacatggtaattctagagaactcaattcagaacaagtttagtgcaggagcttatcccctc

SEQ ID NO: 275712 - DNA, 75 bp, Artificial Sequence
  Synthetic
atcttataataactatggatcaggaaacttaggagtaaagatcctactgtcggggggaggaggaggagcaagatc

SEQ ID NO: 275713 - DNA, 75 bp, Artificial Sequence
  Synthetic
aacttaggagtaaagatcctactgtcggggggaggaggaggagcaagatctatcgatatggcgactctccttaaa

SEQ ID NO: 275714 - DNA, 75 bp, Artificial Sequence
  Synthetic
gggcctgaactttggcaggtcatattttgacccggcctattttcgtcttggacaggagatggtcagaagatctgc

SEQ ID NO: 275715 - DNA, 75 bp, Artificial Sequence
  Synthetic
ttcaggaggggccatccgggggattaagaatgttatcatagtcccaattcccggagattcatctatcattacccg

SEQ ID NO: 275716 - DNA, 75 bp, Artificial Sequence
  Synthetic
acaggggctccgccaccacagacctgatccaccgagagccagccagaggtcccctccagtcccgtccagtgcccc

SEQ ID NO: 275717 - DNA, 75 bp, Artificial Sequence
  Synthetic
agattggctggagatcctgacatcaatgggtcaaagctgaccggcgtgctgatcagcatgttatctttgttcgta

SEQ ID NO: 275718 - DNA, 75 bp, Artificial Sequence
  Synthetic
atgggtcaaagctgaccggcgtgctgatcagcatgttatctttgttcgtagagtcacccgggcaattgatccagc

SEQ ID NO: 275719 - DNA, 75 bp, Artificial Sequence
  Synthetic
ccagcccgacgacccctgcacgcaccggaagagggacccgcccgagaacgtccggcacatccatgtgtaaacatc

SEQ ID NO: 275720 - DNA, 75 bp, Artificial Sequence
  Synthetic
aagggacaaaaggcgaacccgctcaggaagacccagaggagagaccccgggccaaccgctcttggaaatcatgcc

SEQ ID NO: 275721 - DNA, 75 bp, Artificial Sequence
  Synthetic
agtactaggtcccagtccgggttgacctttgcatcacgtggtgctgatttggacaatgaggcagacatgtatttt

SEQ ID NO: 275722 - DNA, 75 bp, Artificial Sequence
  Synthetic
cctttgcatcacgtggtgctgatttggacaatgaggcagacatgtatttttcaactgaaggaccctcgagtggaa

SEQ ID NO: 275723 - DNA, 75 bp, Artificial Sequence
  Synthetic
ggtcggccgaggcactcttcaggctgcaagctatggccaagattctagagggccaggaggagggagaagataaca

SEQ ID NO: 275724 - DNA, 75 bp, Artificial Sequence
  Synthetic
gaacagagaaataatagacatagaggtccaggacgcagaagagttcaatatgttattagcatccatactagcaca

SEQ ID NO: 275725 - DNA, 75 bp, Artificial Sequence
  Synthetic
gttataaagttaatgccaaatataacagccatcgacaattgtacaaagtcagagattgcagagtacaagagattg

SEQ ID NO: 275726 - DNA, 75 bp, Artificial Sequence
  Synthetic
cctcagttgagcagaagctccctctgtcaacatcagcagcaaaatatcgcccatcagtgttataaaaaacttagg

SEQ ID NO: 275727 - DNA, 75 bp, Artificial Sequence
  Synthetic
aagaaagggcagtgttatctcattgacaaggactcgtgctcggtgcagctcgctatagctctgaggggccacatg

SEQ ID NO: 275728 - DNA, 75 bp, Artificial Sequence
  Synthetic
ttgctggagctgttctggccggagtagcacttggagttgcgacagccgctcagataactgcaggagtcgcccttc

SEQ ID NO: 275729 - DNA, 75 bp, Artificial Sequence
  Synthetic
cccttgagagctggagagaggggcttggcccctcggatcgtgcaacaccgaaccctgatgcgtccgagggagacc

SEQ ID NO: 275730 - DNA, 75 bp, Artificial Sequence
  Synthetic
gagaagtcgaatcaggcaatagaggaaatcagacttgcaaataaggagaccatactagcagtacagggcgtccag

SEQ ID NO: 275731 - DNA, 75 bp, Artificial Sequence
  Synthetic
gacgtgtctcctgaaggtaatctcggatttagagagatcacttacgatgacagtgaggcagggctcagagggatt

SEQ ID NO: 275732 - DNA, 75 bp, Artificial Sequence
  Synthetic
cttctgtccatagaatgtcatgcgagctggtaggtcacaagctcggcctcaagctccttaggtactacaccgaga

SEQ ID NO: 275733 - DNA, 75 bp, Artificial Sequence
  Synthetic
cgggggtgaagagattgaaggactcgaggatgctgactctctcgtggttcaagcagatcctccagttgctaacac

SEQ ID NO: 275734 - DNA, 75 bp, Artificial Sequence
  Synthetic
ttctagagaactcaattcagaacaagtttagtgcaggtgcttatcccctcctgtggagctatgccatgggtgttg

SEQ ID NO: 275735 - DNA, 75 bp, Artificial Sequence
  Synthetic
agggaaggtcagctctgtaatcgcggctgagcttggcatcacagcagaggaagctaaactagtctcggaaatcgc

SEQ ID NO: 275736 - DNA, 75 bp, Artificial Sequence
  Synthetic
attcttagcatcgcctacccaaccttatctgagatcaagggagtgatagttcacaagatagaagctataacatac

SEQ ID NO: 275737 - DNA, 75 bp, Artificial Sequence
  Synthetic
gttagggggactgggccacgacaggcgcaggtttctttcctccagcacaaaacaggagagggagagtcatctgca

SEQ ID NO: 275738 - DNA, 75 bp, Artificial Sequence
  Synthetic
ccagtgaccagagaagaagtcaaggctgcgattccgaatgggtccgaagaaagggacaaaaggcgaacccgccca

SEQ ID NO: 275739 - DNA, 75 bp, Artificial Sequence
  Synthetic
aagggacaaaaggcgaacccgcccaggaaggtccagaggagaaatcccgagccaaccgctcctggaaatcatgcc

SEQ ID NO: 275740 - DNA, 75 bp, Artificial Sequence
  Synthetic
tgcgttgtacccaatgagcccattgctccaggaatgtttccaggggtcaacaaagtcgtgcgccagaaccctagt

SEQ ID NO: 275741 - DNA, 75 bp, Artificial Sequence
  Synthetic
acaggacattcgtgcaagcattgccaagatccatgaagacaataaaactatcctctcaaagcttgaatctatact

SEQ ID NO: 275742 - DNA, 75 bp, Artificial Sequence
  Synthetic
ggccaaacccctcgtgaggctcagaggtcggctgaggcactcttcaggctgcaagctatggccaagattctagag

SEQ ID NO: 275743 - DNA, 75 bp, Artificial Sequence
  Synthetic
atcctatcaaaagcgaacctcattgcaaattgtgcgtcagttctgtggaaatgctacacaacagagacagtcatt

SEQ ID NO: 275744 - DNA, 75 bp, Artificial Sequence
  Synthetic
caaattgtgcgtcagttctgtggaaatgctacacaacagagacagtcattagccaagatcccgacaaactactaa

SEQ ID NO: 275745 - DNA, 75 bp, Artificial Sequence
  Synthetic
ggtcggctgaggcactcttcaggctgcaagctatggccaagattctagagggccaggaggggggagaagacaaca

SEQ ID NO: 275746 - DNA, 75 bp, Artificial Sequence
  Synthetic
cctcagttgagcagatgctccctcaatcaacatcattaattaaatatcgcccatcagtgttataaaaaacttagg

SEQ ID NO: 275747 - DNA, 75 bp, Artificial Sequence
  Synthetic
gaaactctagccaaccgagcagagaccaccgatggcagaggaacaagcataccatgtcaacaagggactggaatg

SEQ ID NO: 275748 - DNA, 75 bp, Artificial Sequence
  Synthetic
tatcaagtccctcaaaacctctcccccagatctatccatcatcagagatacccttgagagctggagagaggggct

SEQ ID NO: 275749 - DNA, 75 bp, Artificial Sequence
  Synthetic
cccttgagagctggagagaggggcttggcccctcggattgtgcaacgccgagccctggtgcgtccgagggagtcc

SEQ ID NO: 275750 - DNA, 75 bp, Artificial Sequence
  Synthetic
taatatgctgctgcacggggaggtgtaagaacaaggaagttcccatctccaaaatcaacccagggctcaaacgcg

SEQ ID NO: 275751 - DNA, 75 bp, Artificial Sequence
  Synthetic
atcagcagtcggatcaggcaaaattgacgtgtctcctgaaggtaatctcggatttagagagatcacttacgatga

SEQ ID NO: 275752 - DNA, 75 bp, Artificial Sequence
  Synthetic
aatagaaggttattgccaaaaactatggacaatcagtactataccatacttgtatctagcagcctatgagagcgg

SEQ ID NO: 275753 - DNA, 75 bp, Artificial Sequence
  Synthetic
taagaacaaggaagttcccatctccaaaatcaacccagggctcaaacgcgacctgaccgcgacctcagagtcgta

SEQ ID NO: 275754 - DNA, 75 bp, Artificial Sequence
  Synthetic
gacgtgtctcctgaaggtaatctcggatttagagagatcacttacgatgacagtgaggcagggccccgggggatt

SEQ ID NO: 275755 - DNA, 75 bp, Artificial Sequence
  Synthetic
cctgaatcattcggcataacacacatacatgtacgactcaagcagtcagaggacgcacgaaacccagcctccgat

SEQ ID NO: 275756 - DNA, 75 bp, Artificial Sequence
  Synthetic
tacatgtacgactcaagcagtcagaggacgcacgaaacccagcctccgatcacccacctgaccccaccccacact

SEQ ID NO: 275757 - DNA, 75 bp, Artificial Sequence
  Synthetic
taatcgggatgtctcctatagaaaaatgtaccattctcacacattacatcaagggagaatcagtacaatccccgt

SEQ ID NO: 275758 - DNA, 75 bp, Artificial Sequence
  Synthetic
gaggatgctgactctctcgtggttcaagcagatcctccagttgctaacaccttcagtggaggagaagatggatct

SEQ ID NO: 275759 - DNA, 75 bp, Artificial Sequence
  Synthetic
cagatgatcccagcagagatcctctatatgactggggatctgttaccggccatgatgtcgctaggtccacagatg

SEQ ID NO: 275760 - DNA, 75 bp, Artificial Sequence
  Synthetic
catgatgtcgctaggtccacagatgtcgaaaaattagaaggtgatgacattcaagcagttcttaactcccagaag

SEQ ID NO: 275761 - DNA, 75 bp, Artificial Sequence
  Synthetic
caaccggaagtgtgttcagcgctaaccaggtttgcaatgcagtcaatctggtcccacttgatagtccccagagat

SEQ ID NO: 275762 - DNA, 75 bp, Artificial Sequence
  Synthetic
agagaagctatagccgggatgttggacaccaccaagggtctgattagaacaagtatgagacggggtggcctcacc

SEQ ID NO: 275763 - DNA, 75 bp, Artificial Sequence
  Synthetic
tcagcccaatcaattaaaaagggcacagacgggaactcagtctcatctggaacggcgacagagtgtttattgata

SEQ ID NO: 275764 - DNA, 75 bp, Artificial Sequence
  Synthetic
agaaattcagtgatcttgtcaagttcatctccgataagattaaattcctcaaccctgatagagagtatgatttca

SEQ ID NO: 275765 - DNA, 75 bp, Artificial Sequence
  Synthetic
ccccgagagagtcacaattaattttgatcagttttgtgagtacaaggctgcggttaagtcaattgaacatatatt

SEQ ID NO: 275766 - DNA, 75 bp, Artificial Sequence
  Synthetic
aaagagaatgactccgagtatgagtatgaggatggtctatttacagagatacaggacattcgtgcaagcattgcc

SEQ ID NO: 275767 - DNA, 75 bp, Artificial Sequence
  Synthetic
acaggacattcgtgcaagcattgccaaaatccatgaagacaacaaaaccatcctctcaaagcttgaatccatact

SEQ ID NO: 275768 - DNA, 75 bp, Artificial Sequence
  Synthetic
gatgtcatcatcaacgatgaccaaggcttgttcaagatcttgtaattcactcgccggacaatggacccacctcca

SEQ ID NO: 275769 - DNA, 75 bp, Artificial Sequence
  Synthetic
ccggaacaggctgtctaggcaggacagtaacaagagctcatttctcagaacttacactgaccttaatggacctgg

SEQ ID NO: 275770 - DNA, 75 bp, Artificial Sequence
  Synthetic
caaaagacacactccaaggctccccaaaacagctccaacatggccatcctcccaacgggacggggccaacctccc

SEQ ID NO: 275771 - DNA, 75 bp, Artificial Sequence
  Synthetic
aaaacagctccaacatggccatcctcccaacgggacggggccaacctcccccatgaacccagtccgggggggggc

SEQ ID NO: 275772 - DNA, 75 bp, Artificial Sequence
  Synthetic
aggatccaacatccgaggttgagttgaacccagatttaagacctataatcagccgtgactccggcagagctctcg

SEQ ID NO: 275773 - DNA, 75 bp, Artificial Sequence
  Synthetic
accgcgtgggccggcaggacgcccccaggaggccccgaccaggaccgggcatcctcccccccccaaacgctcccc

SEQ ID NO: 275774 - DNA, 75 bp, Artificial Sequence
  Synthetic
cggaggtactcaagaaacctgctgttgataggtctcagaaaaatggaatcaaatccaactcaagttcaaagggtc

SEQ ID NO: 275775 - DNA, 75 bp, Artificial Sequence
  Synthetic
aaatccaactcaagttcaaagggtcagctccttaaggacctccagctaaaacctgttgacaaacaagcaagctct

SEQ ID NO: 275776 - DNA, 75 bp, Artificial Sequence
  Synthetic
gcactcccaaccccgccaccggggggacaggcagccaagacggggcccccccacccaaacggaccgccagaggag

SEQ ID NO: 275777 - DNA, 75 bp, Artificial Sequence
  Synthetic
gacaggcagccaagacggggcccccccacccaaacggaccgccagaggaggccccgccgactcagcacagacccg

SEQ ID NO: 275778 - DNA, 75 bp, Artificial Sequence
  Synthetic
atgagtcatccagaagtgtcatccgctctataattaagtcgagcaagctcaacattgatcacaaagactaccttc

SEQ ID NO: 275779 - DNA, 75 bp, Artificial Sequence
  Synthetic
gcgagagaggagttccaaagagggagcctcttgtagttgtgatactcaacctagctgggccgactctagcgggcg

SEQ ID NO: 275780 - DNA, 75 bp, Artificial Sequence
  Synthetic
atcatcaaacaaaacttaggggccaagtccagacgacagaccccagcccgcaacccagcaggccacagaaaggaa

SEQ ID NO: 275781 - DNA, 75 bp, Artificial Sequence
  Synthetic
ctccaaggatcttaaggaattccacaaaatgctaacaaccattcttgccaagcaaccgtaacacaacctccaacc

SEQ ID NO: 275782 - DNA, 75 bp, Artificial Sequence
  Synthetic
tgatctcatggtggagaaactctatttatcttcacatagagggattatcaaagatgacgaggccaattgggtagt

SEQ ID NO: 275783 - DNA, 75 bp, Artificial Sequence
  Synthetic
aaaatgctaacaaccattcttgccaagcaaccgtaacacaacctccaaccaacatcccatactcggctgaacaca

SEQ ID NO: 275784 - DNA, 75 bp, Artificial Sequence
  Synthetic
gacacccacccacagaagcacccaggccccggggagaagcctcccctccacacagcgagggagcgggcgagaaac

SEQ ID NO: 275785 - DNA, 75 bp, Artificial Sequence
  Synthetic
gccccggggagaagcctcccctccacacagcgagggagcgggcgagaaacaccagggggaattcgatcgggagtc

SEQ ID NO: 275786 - DNA, 75 bp, Artificial Sequence
  Synthetic
attttgcaatggcacaggatcaggcccgtggtcagaggggagaatccctgcttacggggtgatcagggtcagtct

SEQ ID NO: 275787 - DNA, 75 bp, Artificial Sequence
  Synthetic
ttcacagacaagatgaccgagatctacgacttcgataaatcagcatgggatgtcaaagggtcaattgctcccatc

SEQ ID NO: 275788 - DNA, 75 bp, Artificial Sequence
  Synthetic
cagaccgggcacacacccgacaccaccagcagagcagaggagagcccagacccgtgcggactcgacggcagggga

SEQ ID NO: 275789 - DNA, 75 bp, Artificial Sequence
  Synthetic
ccgtggtcagaggggagaatccctgcttacggggtgatcagggtcagtcttgacttagctagtgacccgggtgta

SEQ ID NO: 275790 - DNA, 75 bp, Artificial Sequence
  Synthetic
gactgataccccaggtgagagtcatcgaccctgggctaggagatagaaaagatgagtgcttcatgtacctgtttc

SEQ ID NO: 275791 - DNA, 75 bp, Artificial Sequence
  Synthetic
tgatacctcacctatctggcgtggatcattacaacaacccgttttctagagctgtatggttggctgtacgacctt

SEQ ID NO: 275792 - DNA, 75 bp, Artificial Sequence
  Synthetic
gatgagtgcttcatgtacctgtttcttttaggagtgattgaggataacgaccccctatccccccctgtcggaaga

SEQ ID NO: 275793 - DNA, 75 bp, Artificial Sequence
  Synthetic
cccgtgcggactcgacggcaggggagccaaccccgccacaaagagagacgaggggctccccccaagcacacaacc

SEQ ID NO: 275794 - DNA, 75 bp, Artificial Sequence
  Synthetic
tcattacaacaacccgttttctagagctgtatggttggctgtacgaccttatgagcagtcatttccaggaatgat

SEQ ID NO: 275795 - DNA, 75 bp, Artificial Sequence
  Synthetic
gcagaggttatgccgcacattttgaccacagagatcagaggccctcgaggtcgttgccatgttcccatagaattg

SEQ ID NO: 275796 - DNA, 75 bp, Artificial Sequence
  Synthetic
tcggtaggtcaactgctaagccagaggaactactaagggaagccacggaactagacatagtggtgaggcgcacgg

SEQ ID NO: 275797 - DNA, 75 bp, Artificial Sequence
  Synthetic
caggattaaacgagaagctggtattttataacaacactccactgtccttgctaacaccctggaggaaagtcttga

SEQ ID NO: 275798 - DNA, 75 bp, Artificial Sequence
  Synthetic
gagccaccgagagccaaccagaggccccccccagtcccgcctggggcccccccgaagaagccccagcagggtccc

SEQ ID NO: 275799 - DNA, 75 bp, Artificial Sequence
  Synthetic
agatttggtccaacgtggtcatattgccgacgatagaccttagatatagtacagccacttatgatgtttctagga

SEQ ID NO: 275800 - DNA, 75 bp, Artificial Sequence
  Synthetic
caaccggaagtgtgtttagcgccaaccaggtttgcaatgcaatcaatctggtcccacttgatattccccagagat

SEQ ID NO: 275801 - DNA, 75 bp, Artificial Sequence
  Synthetic
gccgacgatagaccttagatatagtacagccacttatgatgtttctaggagcgagcatgctatcgtggactatat

SEQ ID NO: 275802 - DNA, 75 bp, Artificial Sequence
  Synthetic
accagcacatccatgtataaacatcatgacacgggtcgcaaccttgacatttctgtttcttttcccaaataccat

SEQ ID NO: 275803 - DNA, 75 bp, Artificial Sequence
  Synthetic
cccccccagtcccgcctggggcccccccgaagaagccccagcagggtcccctggctcgacgacccctgcattcgc

SEQ ID NO: 275804 - DNA, 75 bp, Artificial Sequence
  Synthetic
gatagagtgtttcccttggcgtcataaggtgtggtgctaccatgattgtcttatatacaacaccataacagatga

SEQ ID NO: 275805 - DNA, 75 bp, Artificial Sequence
  Synthetic
aacaggagggggagagtcgtccgcaccagcgaccagagaaggggtcaaagctgcgatcccaaacggatccgaaga

SEQ ID NO: 275806 - DNA, 75 bp, Artificial Sequence
  Synthetic
cagccatcgacaattgtacgaaatcagagatttcagagtacaaaagattgctgatcacagtgttaaagcctgtag

SEQ ID NO: 275807 - DNA, 75 bp, Artificial Sequence
  Synthetic
agaggtcacatttatggtacacgtgggcaactttagacgaaagaagaatgaagtatattctgctgattactgcaa

SEQ ID NO: 275808 - DNA, 75 bp, Artificial Sequence
  Synthetic
gtttttgccctgggaggaataggaggaacaagtctccatattagaagcaccgggaaaatgagcaagactcttcat

SEQ ID NO: 275809 - DNA, 75 bp, Artificial Sequence
  Synthetic
gaacaagtctccatattagaagcaccgggaaaatgagcaagactcttcatgcacagctagggttcaaaaaaatct

SEQ ID NO: 275810 - DNA, 75 bp, Artificial Sequence
  Synthetic
accccaagaattccgtgtctacgatgatgtcatcatcaacgatgaccaaggcttgttcaagatcctgtaaaccgg

SEQ ID NO: 275811 - DNA, 75 bp, Artificial Sequence
  Synthetic
agaagtggctcccccttcccccgtccaaaagacacaccccaagaccccccaaaacagctccaacatggccatcct

SEQ ID NO: 275812 - DNA, 75 bp, Artificial Sequence
  Synthetic
caaaagacacaccccaagaccccccaaaacagctccaacatggccatcctcccaacgggacggggccgacctccc

SEQ ID NO: 275813 - DNA, 75 bp, Artificial Sequence
  Synthetic
aaaccaaaggaaccaccggggaaggctccgccgaaccagcacagacccgacccaagcaaggcggacccccaacac

SEQ ID NO: 275814 - DNA, 75 bp, Artificial Sequence
  Synthetic
gccccccccgcaacccaccgggcgccgaccgcgtgggccagcaggacgcccccaagagggcccgaccgggaccgg

SEQ ID NO: 275815 - DNA, 75 bp, Artificial Sequence
  Synthetic
ctcgcaggctggggacgaaagaaccgccagagggactgggcctcgacaggcgcaggtctccttcctccagcacaa

SEQ ID NO: 275816 - DNA, 75 bp, Artificial Sequence
  Synthetic
cgaccgcgtgggccagcaggacgcccccaagagggcccgaccgggaccgggcaccctccccccaaaaaaaccccc

SEQ ID NO: 275817 - DNA, 75 bp, Artificial Sequence
  Synthetic
cacagatcttacctatggtctgaaggagggtatccttgacctagggttgcacatgcatagctctcaatggttcga

SEQ ID NO: 275818 - DNA, 75 bp, Artificial Sequence
  Synthetic
gcactcccaatcccgccaccggggggacaagcagccaagacagggcccccccacccaaacggaccgccaggggag

SEQ ID NO: 275819 - DNA, 75 bp, Artificial Sequence
  Synthetic
gactttcctgttctggttcactatcaagacagagatgagatcaatgatcaaagaacagtcccatatatgccacaa

SEQ ID NO: 275820 - DNA, 75 bp, Artificial Sequence
  Synthetic
ctgcgatcccaaacggatctgaagagagggacagaaagcaaacacgcccaggaaggcccaaaggagagacccccg

SEQ ID NO: 275821 - DNA, 75 bp, Artificial Sequence
  Synthetic
gacaagcagccaagacagggcccccccacccaaacggaccgccaggggaggccccaccgacccagcacagacccg

SEQ ID NO: 275822 - DNA, 75 bp, Artificial Sequence
  Synthetic
cgaaaccgcccagcgcaccctactcatcatcaaacaaaacttaggggtcaagtccagacgacagaccccagcccg

SEQ ID NO: 275823 - DNA, 75 bp, Artificial Sequence
  Synthetic
atcatcaaacaaaacttaggggtcaagtccagacgacagaccccagcccgcgacccagcaggccacagaagggaa

SEQ ID NO: 275824 - DNA, 75 bp, Artificial Sequence
  Synthetic
ggacacccacccacagaagcacccaggccccggggagaagcccctccctccacacagcgagggagcgggcgagaa

SEQ ID NO: 275825 - DNA, 75 bp, Artificial Sequence
  Synthetic
atagatcagagatattcagaacttcttagccgagtcagatacttgtgggatcttattgatgggttcttcccaaca

SEQ ID NO: 275826 - DNA, 75 bp, Artificial Sequence
  Synthetic
ggccccggggagaagcccctccctccacacagcgagggagcgggcgagaaaaaccaggaggaacccgaccgggag

SEQ ID NO: 275827 - DNA, 75 bp, Artificial Sequence
  Synthetic
gccagaccgggcacacactcgacaccaccagcagagcagaggagagcccagacccccgcggactcgacggtaggg

SEQ ID NO: 275828 - DNA, 75 bp, Artificial Sequence
  Synthetic
ggcttatcttcaacttcaggatgtcactctggagttaagaggtgcttttttagaccattgcttcaaagaactcta

SEQ ID NO: 275829 - DNA, 75 bp, Artificial Sequence
  Synthetic
tacatgtgtgatacaagcggtcagaggacgcagaagattcaacttccgatcaccaacctggccccgctctatgct

SEQ ID NO: 275830 - DNA, 75 bp, Artificial Sequence
  Synthetic
tgttataaaaaacttaggagccagggttgtaggggccatggactccctatcagtcaatcaggtcttgtaccctga

SEQ ID NO: 275831 - DNA, 75 bp, Artificial Sequence
  Synthetic
gacccccgcggactcgacggtaggggagccaaccccgtcacaaggagagacgaggggatccccccaagcacacaa
